United States Patent 10,706,955 (BIOINFORMATIC PROCESSES FOR DETERMINATION OF PEPTIDE BINDING) - sequence listing, part 23

SEQ ID NO: 879306 - protein, 18 aa, Mycobacterium
YQIVMGERRWRAAQEAGL

SEQ ID NO: 879307 - protein, 19 aa, Mycobacterium
YQLDAFAAAVLRGAPIKTT

SEQ ID NO: 879308 - protein, 26 aa, Mycobacterium
YQLERVPMLLPICSHHYLPAGRGSFG

SEQ ID NO: 879309 - protein, 23 aa, Mycobacterium
YQLIRNRSALMVLPAGITKGTGL

SEQ ID NO: 879310 - protein, 17 aa, Mycobacterium
YQLLDSTRGRPFGLWLH

SEQ ID NO: 879311 - protein, 24 aa, Mycobacterium
YQLPAGAWALPGIGLVHASAALYP

SEQ ID NO: 879312 - protein, 18 aa, Mycobacterium
YQLSFHEGSRYPLDRGAA

SEQ ID NO: 879313 - protein, 18 aa, Mycobacterium
YQLTIFISRFPTETTLMI

SEQ ID NO: 879314 - protein, 17 aa, Mycobacterium
YQLVMGERRWRATQEAG

SEQ ID NO: 879315 - protein, 22 aa, Mycobacterium
YQNRIFTVPVISLPIVEKAIDE

SEQ ID NO: 879316 - protein, 23 aa, Mycobacterium
YQPKWDYAGMPLPIDGMPIILRP

SEQ ID NO: 879317 - protein, 18 aa, Mycobacterium
YQQALAAAHTRWVHAEDT

SEQ ID NO: 879318 - protein, 20 aa, Mycobacterium
YQQEIFGPVVTILPFDDEDE

SEQ ID NO: 879319 - protein, 22 aa, Mycobacterium
YQQFLVVDDFATRMPWPGVADQ

SEQ ID NO: 879320 - protein, 17 aa, Mycobacterium
YQQLVLIRQLVADLNVD

SEQ ID NO: 879321 - protein, 17 aa, Mycobacterium
YQQLVLIRQMVADLNID

SEQ ID NO: 879322 - protein, 23 aa, Mycobacterium
YQQSRWWSPRGWAHRQSAGLSAP

SEQ ID NO: 879323 - protein, 23 aa, Mycobacterium
YQRALDEWRLLSAAALVGLVEAT

SEQ ID NO: 879324 - protein, 17 aa, Mycobacterium
YQRALVELIPQVTVING

SEQ ID NO: 879325 - protein, 17 aa, Mycobacterium
YQRFRGGEIAGRTAGLV

SEQ ID NO: 879326 - protein, 23 aa, Mycobacterium
YQRFRGWEVAGLTAGLVGLGAVG

SEQ ID NO: 879327 - protein, 23 aa, Mycobacterium
YQRIRDILGRRPTDAELAMYSVM

SEQ ID NO: 879328 - protein, 22 aa, Mycobacterium
YQRIRDILGRRPTDTELAMYSV

SEQ ID NO: 879329 - protein, 24 aa, Mycobacterium
YQRTAPWILPKWDSRYGRLHQQLI

SEQ ID NO: 879330 - protein, 34 aa, Mycobacterium
YQRTMQLNYLGAVQLILKFIPGMRERGYGHIVNV

SEQ ID NO: 879331 - protein, 20 aa, Mycobacterium
YQRVWNYPTLSVMDGAAVSA

SEQ ID NO: 879332 - protein, 17 aa, Mycobacterium
YQRYMRYLTGCADAFRA

SEQ ID NO: 879333 - protein, 20 aa, Mycobacterium
YQRYSMFVVPGDTPGINVLR

SEQ ID NO: 879334 - protein, 18 aa, Mycobacterium
YQSAKWAVTGFSGVLAVE

SEQ ID NO: 879335 - protein, 25 aa, Mycobacterium
YQSQALIDLALRLRQRIADLDQVAA

SEQ ID NO: 879336 - protein, 30 aa, Mycobacterium
YQTVAMPGFPNFFMMLGPHSPVGNYPLTGI

SEQ ID NO: 879337 - protein, 19 aa, Mycobacterium
YQVALPLHPEFRTVPMVWY

SEQ ID NO: 879338 - protein, 18 aa, Mycobacterium
YQVCDWLVPMAADPLVSR

SEQ ID NO: 879339 - protein, 25 aa, Mycobacterium
YQVGIADVLHRWFGDSERSIRAVFD

SEQ ID NO: 879340 - protein, 17 aa, Mycobacterium
YQVGIADVLSRWLGESE

SEQ ID NO: 879341 - protein, 21 aa, Mycobacterium
YQVPLWPERLLTRDNAEEIER

SEQ ID NO: 879342 - protein, 20 aa, Mycobacterium
YQVSWPRHCVADTPGAEFHP

SEQ ID NO: 879343 - protein, 17 aa, Mycobacterium
YQWITRGHAQDGTLFEW

SEQ ID NO: 879344 - protein, 26 aa, Mycobacterium
YQYDGGFAEYMIVPRQVLKVDGLNRI

SEQ ID NO: 879345 - protein, 21 aa, Mycobacterium
YRADMNPLLYCRRQFTAFPTQ

SEQ ID NO: 879346 - protein, 18 aa, Mycobacterium
YRADTLDRWWSDVCGTLG

SEQ ID NO: 879347 - protein, 20 aa, Mycobacterium
YRAERWSDVVKLLTPVVNDA

SEQ ID NO: 879348 - protein, 18 aa, Mycobacterium
YRAGAWSAVPNLRARAFE

SEQ ID NO: 879349 - protein, 20 aa, Mycobacterium
YRAHWLVARTAEHIGGWAAR

SEQ ID NO: 879350 - protein, 24 aa, Mycobacterium
YRALRDRIFDAIWSELDPLEERIE

SEQ ID NO: 879351 - protein, 23 aa, Mycobacterium
YRANLRHVLLCTQRTARRLVAAG

SEQ ID NO: 879352 - protein, 17 aa, Mycobacterium
YRAPMAYPYRWPSGPEN

SEQ ID NO: 879353 - protein, 21 aa, Mycobacterium
YRAQWSPEYREYFGLCLEFPT

SEQ ID NO: 879354 - protein, 24 aa, Mycobacterium
YRARLRAGPPQWFEAPLQFADFAV

SEQ ID NO: 879355 - protein, 24 aa, Mycobacterium
YRASKLACMLFGSELARKAAAAGS

SEQ ID NO: 879356 - protein, 18 aa, Mycobacterium
YRAVLGVGVPAGSTSYLL

SEQ ID NO: 879357 - protein, 23 aa, Mycobacterium
YRAYYEPQQLPPGLSASLEATAR

SEQ ID NO: 879358 - protein, 26 aa, Mycobacterium
YRCDYPTLSALLPVALARTASAAPDL

SEQ ID NO: 879359 - protein, 19 aa, Mycobacterium
YRCTPMVYNWRPDGAVLDA

SEQ ID NO: 879360 - protein, 26 aa, Mycobacterium
YRDADGWIYLAGRTPDWMRINGENLA

SEQ ID NO: 879361 - protein, 26 aa, Mycobacterium
YRDAEGWIYLAGRTADWMRVDGENLA

SEQ ID NO: 879362 - protein, 29 aa, Mycobacterium
YRDAQPVAAPRRPIIRPIPVDESGFTISS

SEQ ID NO: 879363 - protein, 25 aa, Mycobacterium
YRDELESWYTPLNAFLSIGPPAQRI

SEQ ID NO: 879364 - protein, 18 aa, Mycobacterium
YRDETAPLLEFYDTEVKT

SEQ ID NO: 879365 - protein, 24 aa, Mycobacterium
YRDETAPLLEYYRDELKTVDAIGT

SEQ ID NO: 879366 - protein, 21 aa, Mycobacterium
YRDIDVLLVDDIQFIEGKDGI

SEQ ID NO: 879367 - protein, 24 aa, Mycobacterium
YRDKPVILNIFPSIDTPVCQASVR

SEQ ID NO: 879368 - protein, 18 aa, Mycobacterium
YRDLLRLVDDLAGALKGR

SEQ ID NO: 879369 - protein, 29 aa, Mycobacterium
YRDNARFGAKLWVLPANMASYNDIDALVD

SEQ ID NO: 879370 - protein, 24 aa, Mycobacterium
YRDPGLLLGQRIGAAGFTTLYSPV

SEQ ID NO: 879371 - protein, 22 aa, Mycobacterium
YRDPTALGGYRTYTPALKASDA

SEQ ID NO: 879372 - protein, 26 aa, Mycobacterium
YRDQLRAHCPQLRFLHLSGSADVIGR

SEQ ID NO: 879373 - protein, 23 aa, Mycobacterium
YRDTLVPAGDTWLINHRKVSTDW

SEQ ID NO: 879374 - protein, 17 aa, Mycobacterium
YRDVLTGLFATWFADHT

SEQ ID NO: 879375 - protein, 25 aa, Mycobacterium
YRDVPVQFPPIPSFSPEHFAVARGT

SEQ ID NO: 879376 - protein, 19 aa, Mycobacterium
YRDVRLLRLYEGTSEIQQL

SEQ ID NO: 879377 - protein, 21 aa, Mycobacterium
YREAALRLDRHFTISVIDCGS

SEQ ID NO: 879378 - protein, 26 aa, Mycobacterium
YREAERLWRPPKLPPVGDVTSPGKRR

SEQ ID NO: 879379 - protein, 22 aa, Mycobacterium
YREAYGMFAVNGILFNHESPRR

SEQ ID NO: 879380 - protein, 23 aa, Mycobacterium
YREAYGMFTVNGILFNHESPRRG

SEQ ID NO: 879381 - protein, 25 aa, Mycobacterium
YREGDWVYIPKACTWRQIPDSETTL

SEQ ID NO: 879382 - protein, 25 aa, Mycobacterium
YREGVLRLRIPVAERAKPRKITVEH

SEQ ID NO: 879383 - protein, 18 aa, Mycobacterium
YREHGVFGGPPPWNIGEP

SEQ ID NO: 879384 - protein, 27 aa, Mycobacterium
YREIADRLAYVVRLILTGAKETSQETT

SEQ ID NO: 879385 - protein, 29 aa, Mycobacterium
YRELRAGHDVWWTVLLDGGVRISIGCQSR

SEQ ID NO: 879386 - protein, 18 aa, Mycobacterium
YREQYVLVAPADNPLMGL

SEQ ID NO: 879387 - protein, 29 aa, Mycobacterium
YRESIRWGKWHMPALFTPETYVSAVDRAG

SEQ ID NO: 879388 - protein, 24 aa, Mycobacterium
YRESLGFEVLPLTGGERPPFEVLA

SEQ ID NO: 879389 - protein, 29 aa, Mycobacterium
YRESTSLLAPLPGARALLRRVAELGLQVV

SEQ ID NO: 879390 - protein, 32 aa, Mycobacterium
YRETAMSIPLRWFHTSTTILACCVLGLAGCAN

SEQ ID NO: 879391 - protein, 22 aa, Mycobacterium
YRETGKFVLFEAPAIVLATGGI

SEQ ID NO: 879392 - protein, 24 aa, Mycobacterium
YRETLGFEVLPLSGGAEPPFEVLC

SEQ ID NO: 879393 - protein, 33 aa, Mycobacterium
YRETVYRIMGRWLKGVFPVSTGLVVEALARPEW

SEQ ID NO: 879394 - protein, 20 aa, Mycobacterium
YREWDYAWIPNGEPGTGQHV

SEQ ID NO: 879395 - protein, 18 aa, Mycobacterium
YREWMALLEASFERMRDR

SEQ ID NO: 879396 - protein, 18 aa, Mycobacterium
YRFDLDALAPIAAELGPT

SEQ ID NO: 879397 - protein, 17 aa, Mycobacterium
YRFSVPNAGTYWAHPHV

SEQ ID NO: 879398 - protein, 18 aa, Mycobacterium
YRFVRRAAALAIPIAIVN

SEQ ID NO: 879399 - protein, 31 aa, Mycobacterium
YRGADLLGMRYLPPFAYFMDSPNAFAVLAGE

SEQ ID NO: 879400 - protein, 21 aa, Mycobacterium
YRGAEYSVDFVPKVRIEVVVD

SEQ ID NO: 879401 - protein, 20 aa, Mycobacterium
YRGAEYSVDFVPKVRVEVVV

SEQ ID NO: 879402 - protein, 32 aa, Mycobacterium
YRGATFRVESAVKARWQTPASAVFSGEFDGLE

SEQ ID NO: 879403 - protein, 21 aa, Mycobacterium
YRGAYLEQLLAGLLADLGVHT

SEQ ID NO: 879404 - protein, 21 aa, Mycobacterium
YRGAYLEQLLAGLLGDLGVRT

SEQ ID NO: 879405 - protein, 27 aa, Mycobacterium
YRGCMRGRTMWVVPFCMGPLGADDPKL

SEQ ID NO: 879406 - protein, 23 aa, Mycobacterium
YRGGLVPGFPNLFISSAPNYSPG

SEQ ID NO: 879407 - protein, 19 aa, Mycobacterium
YRGHPFIVVPDCVPELCTS

SEQ ID NO: 879408 - protein, 19 aa, Mycobacterium
YRGKAILATEPVASHLVSR

SEQ ID NO: 879409 - protein, 18 aa, Mycobacterium
YRGLLDWLEELRQQGFVR

SEQ ID NO: 879410 - protein, 35 aa, Mycobacterium
YRGPRRKGVRYFGPYSHAWAIRETLDLLTRVFPAR

SEQ ID NO: 879411 - protein, 27 aa, Mycobacterium
YRGPRRKGVRYFGPYSHAWAIRETVDL

SEQ ID NO: 879412 - protein, 29 aa, Mycobacterium
YRGQLVARAVDLVQLFPAAAYGKNGADIR

SEQ ID NO: 879413 - protein, 25 aa, Mycobacterium
YRGRYGLSVGALARWHRPRLETLAD

SEQ ID NO: 879414 - protein, 18 aa, Mycobacterium
YRGVQYPTDIAPKVRFEV

SEQ ID NO: 879415 - protein, 21 aa, Mycobacterium
YRHAFGRRLLELPAGLRDAAG

SEQ ID NO: 879416 - protein, 18 aa, Mycobacterium
YRHFPNKESLLVELLVGI

SEQ ID NO: 879417 - protein, 30 aa, Mycobacterium
YRHFPNKESLLVELLVGISARLLAGARDVR

SEQ ID NO: 879418 - protein, 19 aa, Mycobacterium
YRHIDETIVLPPLVTLMDT

SEQ ID NO: 879419 - protein, 20 aa, Mycobacterium
YRHRRDLVLLLTELSTLIDL

SEQ ID NO: 879420 - protein, 25 aa, Mycobacterium
YRHSRAIEPFNYRLSWLGRNVARWE

SEQ ID NO: 879421 - protein, 19 aa, Mycobacterium
YRIFIVDEAHMVTTAGFNA

SEQ ID NO: 879422 - protein, 17 aa, Mycobacterium
YRIHPAMLDAALQSLAA

SEQ ID NO: 879423 - protein, 24 aa, Mycobacterium
YRIIRLIELVAPKPARRGSRMPVR

SEQ ID NO: 879424 - protein, 26 aa, Mycobacterium
YRIQRRRAAPLRPIDTGAIALLDAAA

SEQ ID NO: 879425 - protein, 17 aa, Mycobacterium
YRKLINQGYIQAFAYTD

SEQ ID NO: 879426 - protein, 20 aa, Mycobacterium
YRKLRDTWLSARRDLSDRRN

SEQ ID NO: 879427 - protein, 18 aa, Mycobacterium
YRKSFADGLYLTGDLAKK

SEQ ID NO: 879428 - protein, 26 aa, Mycobacterium
YRLAGELGMPPWRVQKAQKQSRRWSR

SEQ ID NO: 879429 - protein, 25 aa, Mycobacterium
YRLANPPLLVPVLRAGLGMVDQAHA

SEQ ID NO: 879430 - protein, 19 aa, Mycobacterium
YRLARRFPRSMRKALIAWA

SEQ ID NO: 879431 - protein, 17 aa, Mycobacterium
YRLGARTLYHQFGAPLF

SEQ ID NO: 879432 - protein, 17 aa, Mycobacterium
YRLGARTLYHQFGAPLY

SEQ ID NO: 879433 - protein, 20 aa, Mycobacterium
YRLGLTYPAVFSQAVVLAGS

SEQ ID NO: 879434 - protein, 18 aa, Mycobacterium
YRLGTFGFLAPPGAPDGF

SEQ ID NO: 879435 - protein, 19 aa, Mycobacterium
YRLLWSRASVIVRDFGVTV

SEQ ID NO: 879436 - protein, 18 aa, Mycobacterium
YRLQTFGTVTRLAAGGEL

SEQ ID NO: 879437 - protein, 24 aa, Mycobacterium
YRLSKEAIILYGMSKAVELGARGI

SEQ ID NO: 879438 - protein, 18 aa, Mycobacterium
YRLSVFYDLAKTAVNRLA

SEQ ID NO: 879439 - protein, 24 aa, Mycobacterium
YRMKGTIAVRYRASTRRYTVNVVG

SEQ ID NO: 879440 - protein, 18 aa, Mycobacterium
YRMMQGFGVHTFRLVNDA

SEQ ID NO: 879441 - protein, 20 aa, Mycobacterium
YRMRMAPSIFRHVWSVLRIA

SEQ ID NO: 879442 - protein, 25 aa, Mycobacterium
YRMRPAQLRGPRPAPRLGAHTEHYR

SEQ ID NO: 879443 - protein, 18 aa, Mycobacterium
YRMSGPIRWASNLYPDST

SEQ ID NO: 879444 - protein, 18 aa, Mycobacterium
YRMYADGAGLRYIAQQLT

SEQ ID NO: 879445 - protein, 17 aa, Mycobacterium
YRMYADGAGLRYIAQRL

SEQ ID NO: 879446 - protein, 22 aa, Mycobacterium
YRNVLNPYLSPAAVKRWVPFVD

SEQ ID NO: 879447 - protein, 23 aa, Mycobacterium
YRPGQFLTLRIPSERTGSVARCY

SEQ ID NO: 879448 - protein, 17 aa, Mycobacterium
YRPLALEMAAQLGRVDV

SEQ ID NO: 879449 - protein, 27 aa, Mycobacterium
YRPMPTAELLSWFDGARRALVAAFAAI

SEQ ID NO: 879450 - protein, 20 aa, Mycobacterium
YRPMVERTIAWLTRDNRQVR

SEQ ID NO: 879451 - protein, 20 aa, Mycobacterium
YRPPPRPDVIATLDSAGLLP

SEQ ID NO: 879452 - protein, 23 aa, Mycobacterium
YRPSEDRLDWARRVLAAARSERG

SEQ ID NO: 879453 - protein, 30 aa, Mycobacterium
YRPTPPDDPAYRYSYPYFSSGAYVAEVDVD

SEQ ID NO: 879454 - protein, 26 aa, Mycobacterium
YRQDVRPPWSIGAPQPELAALIEGGK

SEQ ID NO: 879455 - protein, 17 aa, Mycobacterium
YRQETARMFGLPESGLA

SEQ ID NO: 879456 - protein, 24 aa, Mycobacterium
YRQETIRMFGLPESGLAETLRSAE

SEQ ID NO: 879457 - protein, 18 aa, Mycobacterium
YRQLLQHILQHVADGNLP

SEQ ID NO: 879458 - protein, 20 aa, Mycobacterium
YRQMFYDELPECLSALTTDP

SEQ ID NO: 879459 - protein, 18 aa, Mycobacterium
YRQPGFVAAMRDIMALQD

SEQ ID NO: 879460 - protein, 20 aa, Mycobacterium
YRQQVRHWIDTSLSHEPGQI

SEQ ID NO: 879461 - protein, 20 aa, Mycobacterium
YRQTVDGLPLFGPFWDRDAQ

SEQ ID NO: 879462 - protein, 25 aa, Mycobacterium
YRQYDPLMSPLVWDLAHIGQQEEFW

SEQ ID NO: 879463 - protein, 35 aa, Mycobacterium
YRRCRRINAAHGRTFFLATRLLAPDQRPPVHALYG

SEQ ID NO: 879464 - protein, 23 aa, Mycobacterium
YRRDRYLGIIDKVRAAIPHAAIT

SEQ ID NO: 879465 - protein, 17 aa, Mycobacterium
YRRFEGVGQLALEKLRE

SEQ ID NO: 879466 - protein, 19 aa, Mycobacterium
YRRFGVERSWRSLASLRAW

SEQ ID NO: 879467 - protein, 22 aa, Mycobacterium
YRRHQPILIALNEMAGYDPQTA

SEQ ID NO: 879468 - protein, 20 aa, Mycobacterium
YRRHVEVAFWGQIAKGLLAE

SEQ ID NO: 879469 - protein, 24 aa, Mycobacterium
YRRIDDAFLDPLQFRADSVLGVAG

SEQ ID NO: 879470 - protein, 26 aa, Mycobacterium
YRRLAAHFFLTFPALDDVRFTHRWAG

SEQ ID NO: 879471 - protein, 17 aa, Mycobacterium
YRRLLQHVRPMELLGLT

SEQ ID NO: 879472 - protein, 19 aa, Mycobacterium
YRRLPAAVRDRIRDLRARH

SEQ ID NO: 879473 - protein, 25 aa, Mycobacterium
YRRLRTWLTRLYRTEFDGFIGANFD

SEQ ID NO: 879474 - protein, 17 aa, Mycobacterium
YRRMPSLGEIEHIQSLL

SEQ ID NO: 879475 - protein, 24 aa, Mycobacterium
YRRPAPHEFIPFSGGLHRCIGAVM

SEQ ID NO: 879476 - protein, 27 aa, Mycobacterium
YRRQWDWFSYFYNALAARAFMAVDMAA

SEQ ID NO: 879477 - protein, 32 aa, Mycobacterium
YRRRFRRSFDRRKLGPTLWHRDFHDATIVECP

SEQ ID NO: 879478 - protein, 28 aa, Mycobacterium
YRRVTPRIFAVWLAARFLQLRSTTIADE

SEQ ID NO: 879479 - protein, 19 aa, Mycobacterium
YRRWGTVPALVADLLTDMA

SEQ ID NO: 879480 - protein, 26 aa, Mycobacterium
YRSDAGFDVLPLLLAYGGDVDRRTLA

SEQ ID NO: 879481 - protein, 25 aa, Mycobacterium
YRSGDRIVIAFPYRLVDFWRDHRAP

SEQ ID NO: 879482 - protein, 25 aa, Mycobacterium
YRSGGSLHLDWWYDTRRIPAATVEQ

SEQ ID NO: 879483 - protein, 28 aa, Mycobacterium
YRSGSSLHVDWWYDTRRITAETATALAR

SEQ ID NO: 879484 - protein, 26 aa, Mycobacterium
YRSGVRTLPQLLGEQGWYSALFGMQH

SEQ ID NO: 879485 - protein, 19 aa, Mycobacterium
YRSLADSFRPVVFRLDPPA

SEQ ID NO: 879486 - protein, 18 aa, Mycobacterium
YRSLRQLATLPGDPTVFP

SEQ ID NO: 879487 - protein, 24 aa, Mycobacterium
YRSNLRHVLLCTQRVARRLVAAEQ

SEQ ID NO: 879488 - protein, 30 aa, Mycobacterium
YRSVISSLTAMYWWGPASVSMLATAGPFVE

SEQ ID NO: 879489 - protein, 23 aa, Mycobacterium
YRTGDLACWGPDGQLQYLGRADD

SEQ ID NO: 879490 - protein, 27 aa, Mycobacterium
YRTGGPLPKFDFIPSALLPAWISDETI

SEQ ID NO: 879491 - protein, 18 aa, Mycobacterium
YRTPVPGLYLSGGGTHPG

SEQ ID NO: 879492 - protein, 20 aa, Mycobacterium
YRTSDGYLAALIYNDKHWAA

SEQ ID NO: 879493 - protein, 20 aa, Mycobacterium
YRTTLRYYKQAPDLITAFAI

SEQ ID NO: 879494 - protein, 21 aa, Mycobacterium
YRVETRMTLDVLVRIGDEVAE

SEQ ID NO: 879495 - protein, 18 aa, Mycobacterium
YRVHPALLDACFQSVAAH

SEQ ID NO: 879496 - protein, 24 aa, Mycobacterium
YRVNAGLGDIAFFGPGLGSSLDPS

SEQ ID NO: 879497 - protein, 19 aa, Mycobacterium
YRVPAWSEFVEVHWSPWGE

SEQ ID NO: 879498 - protein, 18 aa, Mycobacterium
YRVPGIVISPFSRGGLMV

SEQ ID NO: 879499 - protein, 18 aa, Mycobacterium
YRVPRLKVAVIEAGSKWL

SEQ ID NO: 879500 - protein, 20 aa, Mycobacterium
YRVRHLLDRYGSLINEVLEL

SEQ ID NO: 879501 - protein, 19 aa, Mycobacterium
YRWVAQVLNYVIFADPAND

SEQ ID NO: 879502 - protein, 18 aa, Mycobacterium
YRYDGDPLIFDADPDRLG

SEQ ID NO: 879503 - protein, 27 aa, Mycobacterium
YRYQGTVPWTLSPWASLNLGAAMFELT

SEQ ID NO: 879504 - protein, 18 aa, Mycobacterium
YRYRLTSRYEIPCTVAGT

SEQ ID NO: 879505 - protein, 17 aa, Mycobacterium
YSAALQRIHSRLIGLVE

SEQ ID NO: 879506 - protein, 31 aa, Mycobacterium
YSADLPFAPPRLAAPLWVSLLETEPIDPERL

SEQ ID NO: 879507 - protein, 17 aa, Mycobacterium
YSAFGNKEALFLRALDR

SEQ ID NO: 879508 - protein, 17 aa, Mycobacterium
YSAFHRSALLERMHAAG

SEQ ID NO: 879509 - protein, 20 aa, Mycobacterium
YSAFNEVHWVAPAEAVWACR

SEQ ID NO: 879510 - protein, 25 aa, Mycobacterium
YSAGILAYELLTGHTPFTGDSALSI

SEQ ID NO: 879511 - protein, 22 aa, Mycobacterium
YSAKYRIQLLRVFDQVIEHGRT

SEQ ID NO: 879512 - protein, 30 aa, Mycobacterium
YSAQSAGPPPWYLYRFVARGAVGVATAEPH

SEQ ID NO: 879513 - protein, 17 aa, Mycobacterium
YSARELIARIRAVLRRG

SEQ ID NO: 879514 - protein, 24 aa, Mycobacterium
YSATALLNLFDHLGIEKAALVGNS

SEQ ID NO: 879515 - protein, 17 aa, Mycobacterium
YSAVPFAQDASVLVIGE

SEQ ID NO: 879516 - protein, 22 aa, Mycobacterium
YSCVITQLTSLPWSGPAAAAML

SEQ ID NO: 879517 - protein, 24 aa, Mycobacterium
YSDAATTRDLLLSRLSRLVEYADR

SEQ ID NO: 879518 - protein, 17 aa, Mycobacterium
YSDALLSAVPIPDPRRN

SEQ ID NO: 879519 - protein, 35 aa, Mycobacterium
YSDDITLLAAQRRTPPPPLQMTLDATIHAARAVRV

SEQ ID NO: 879520 - protein, 33 aa, Mycobacterium
YSDDKLGSLLIRRGWVPVHIHFEDLSDMWVWPP

SEQ ID NO: 879521 - protein, 19 aa, Mycobacterium
YSDGFIAPAGFDFGRWRFE

SEQ ID NO: 879522 - protein, 17 aa, Mycobacterium
YSDHLWVYGATAYGRFC

SEQ ID NO: 879523 - protein, 19 aa, Mycobacterium
YSDIYLPLHGEHQAHNAVV

SEQ ID NO: 879524 - protein, 22 aa, Mycobacterium
YSDLGLNVVLPVLPLHGPRARG

SEQ ID NO: 879525 - protein, 27 aa, Mycobacterium
YSDWFGPQQIEWLSRLTAETPNLREAL

SEQ ID NO: 879526 - protein, 25 aa, Mycobacterium
YSEAAVEHLFAVASGLDSMVVGEQQ

SEQ ID NO: 879527 - protein, 24 aa, Mycobacterium
YSEAIALSRLGWAALTVGTSHAVL

SEQ ID NO: 879528 - protein, 36 aa, Mycobacterium
YSEARGFPPYHPRLMLKLLLYGYTSGVRSSRKIEAR

SEQ ID NO: 879529 - protein, 31 aa, Mycobacterium
YSENFYNNDPLWYAWPNHMKLFFNNKGVVAK

SEQ ID NO: 879530 - protein, 26 aa, Mycobacterium
YSERMLLSEPLLIEVPDHVPTEVAAL

SEQ ID NO: 879531 - protein, 20 aa, Mycobacterium
YSFDAGPATAPLFADLTFSA

SEQ ID NO: 879532 - protein, 20 aa, Mycobacterium
YSFGMRNAITLSWADNTGAT

SEQ ID NO: 879533 - protein, 17 aa, Mycobacterium
YSFLLSALAVTVASWRK

SEQ ID NO: 879534 - protein, 18 aa, Mycobacterium
YSGAPRPLQTLWGEVGFE

SEQ ID NO: 879535 - protein, 35 aa, Mycobacterium
YSGAVGLNWYLTDPTLRFTMAYYLQPEELAVVEPH

SEQ ID NO: 879536 - protein, 26 aa, Mycobacterium
YSGGLTYLFATYPTTVDFGNGIVTST

SEQ ID NO: 879537 - protein, 20 aa, Mycobacterium
YSGIGFGLHNDIVAPYLLAL

SEQ ID NO: 879538 - protein, 26 aa, Mycobacterium
YSGKSPSIPYSWNPKYPARIGVMPRE

SEQ ID NO: 879539 - protein, 19 aa, Mycobacterium
YSGPTAALTDVWRALRASM

SEQ ID NO: 879540 - protein, 20 aa, Mycobacterium
YSGPTAALTDVWRALRASMR

SEQ ID NO: 879541 - protein, 18 aa, Mycobacterium
YSGPTASLTDVWRALRAS

SEQ ID NO: 879542 - protein, 20 aa, Mycobacterium
YSGPTTALTDVWRALRASMR

SEQ ID NO: 879543 - protein, 27 aa, Mycobacterium
YSGTKARVLARRRLIIYSWGANELDAY

SEQ ID NO: 879544 - protein, 25 aa, Mycobacterium
YSGVMWACVFLRTGARRIHFGEIDR

SEQ ID NO: 879545 - protein, 25 aa, Mycobacterium
YSGVMWACVFMRTGARRVHFGEVEK

SEQ ID NO: 879546 - protein, 30 aa, Mycobacterium
YSGVTSYYILPTENLPLLEPLRAIPVIGNP

SEQ ID NO: 879547 - protein, 19 aa, Mycobacterium
YSGWTYLETDAPLVITMIW

SEQ ID NO: 879548 - protein, 31 aa, Mycobacterium
YSGYAPIMGTPWLTSFAQRSRFAEAFGSVGQ

SEQ ID NO: 879549 - protein, 19 aa, Mycobacterium
YSHKYGFRFSVLTRPPWAG

SEQ ID NO: 879550 - protein, 24 aa, Mycobacterium
YSHQLTIYIFRYGEGTVMAIMHPD

SEQ ID NO: 879551 - protein, 20 aa, Mycobacterium
YSHRGSYLHAMAMAAAINLR

SEQ ID NO: 879552 - protein, 18 aa, Mycobacterium
YSHSGYPGGLRKRAIGDL

SEQ ID NO: 879553 - protein, 24 aa, Mycobacterium
YSIQRSPTWILPKPDRPYSRWERW

SEQ ID NO: 879554 - protein, 26 aa, Mycobacterium
YSKEYEIERLMRDAPFLLIGEGTSEI

SEQ ID NO: 879555 - protein, 29 aa, Mycobacterium
YSKGMQMRLTFARALLNDPELLFLDEPTS

SEQ ID NO: 879556 - protein, 17 aa, Mycobacterium
YSKYKALMAQRVPLYRR

SEQ ID NO: 879557 - protein, 19 aa, Mycobacterium
YSLDEACLHAFPRRELTDA

SEQ ID NO: 879558 - protein, 19 aa, Mycobacterium
YSLDTACLVGFPRRDLSAE

SEQ ID NO: 879559 - protein, 18 aa, Mycobacterium
YSLESWIDTYDEGSFRRM

SEQ ID NO: 879560 - protein, 24 aa, Mycobacterium
YSLGAFAVWLRDLLDELGVSQATL

SEQ ID NO: 879561 - protein, 20 aa, Mycobacterium
YSLGGRIGLTLAATAPERLT

SEQ ID NO: 879562 - protein, 21 aa, Mycobacterium
YSLGPGLLKFGMNAHLRLLAG

SEQ ID NO: 879563 - protein, 21 aa, Mycobacterium
YSLQGLAAIPGGPFLSFGQVY

SEQ ID NO: 879564 - protein, 25 aa, Mycobacterium
YSLRGHKWFTSAPMCDIFLVLAQAP

SEQ ID NO: 879565 - protein, 17 aa, Mycobacterium
YSLSYKPNPRWSRRYAE

SEQ ID NO: 879566 - protein, 25 aa, Mycobacterium
YSLYDDARLLVYAITEAWQLTDYRM

SEQ ID NO: 879567 - protein, 25 aa, Mycobacterium
YSMAEVLAPTLIDYAPKGLAADMVP

SEQ ID NO: 879568 - protein, 32 aa, Mycobacterium
YSMCGRAYSPRFMWMWPNARISVMGGEQAASV

SEQ ID NO: 879569 - protein, 18 aa, Mycobacterium
YSMERWLRYVHANASTRN

SEQ ID NO: 879570 - protein, 22 aa, Mycobacterium
YSMSSRYNLIGRPAVVAVRDGR

SEQ ID NO: 879571 - protein, 33 aa, Mycobacterium
YSNGFFARGDYQNLIGWSYSITVSEFPAYGTLD

SEQ ID NO: 879572 - protein, 25 aa, Mycobacterium
YSNQLRWFDDPDLMSWLSTARLDLF

SEQ ID NO: 879573 - protein, 23 aa, Mycobacterium
YSNRAYLIQIRRAGAGTVLIDPV

SEQ ID NO: 879574 - protein, 24 aa, Mycobacterium
YSNRAYLIQIRRAGSGTVLIDPVS

SEQ ID NO: 879575 - protein, 21 aa, Mycobacterium
YSNRAYLVQIRRAGAGTALID

SEQ ID NO: 879576 - protein, 23 aa, Mycobacterium
YSNRAYLVQIRRVGAGTVLIDPV

SEQ ID NO: 879577 - protein, 32 aa, Mycobacterium
YSPAFAALEVERMWPRVWQLACMVDHIAAPGD

SEQ ID NO: 879578 - protein, 18 aa, Mycobacterium
YSPGQFLTLRVPSERTGS

SEQ ID NO: 879579 - protein, 18 aa, Mycobacterium
YSPGSYLVLLESTVAHAV

SEQ ID NO: 879580 - protein, 32 aa, Mycobacterium
YSPLPATHIGGLWWILTCLMRGGLCITGGENT

SEQ ID NO: 879581 - protein, 29 aa, Mycobacterium
YSPQSWSTIPGGPFLSFGQAYAWGQNGQS

SEQ ID NO: 879582 - protein, 29 aa, Mycobacterium
YSPQSWTTIPGGPFLSFGQAYAWGQNGQG

SEQ ID NO: 879583 - protein, 19 aa, Mycobacterium
YSPRFDGGVERLLARAEAG

SEQ ID NO: 879584 - protein, 20 aa, Mycobacterium
YSPRLRPGLPVSFPVDWSEL

SEQ ID NO: 879585 - protein, 22 aa, Mycobacterium
YSPRLRPGTPVSFPVAWDALDR

SEQ ID NO: 879586 - protein, 29 aa, Mycobacterium
YSQFDSLEELFFLLYDQWAARTAEQVRAA

SEQ ID NO: 879587 - protein, 23 aa, Mycobacterium
YSQGGLFPIAYTKGTDFRPAKRL

SEQ ID NO: 879588 - protein, 17 aa, Mycobacterium
YSQSKLANLLFTSELQR

SEQ ID NO: 879589 - protein, 26 aa, Mycobacterium
YSQTVLRCWFAEPPGWLEHRIKEHQN

SEQ ID NO: 879590 - protein, 18 aa, Mycobacterium
YSRLALGIGVHDITAGYR

SEQ ID NO: 879591 - protein, 23 aa, Mycobacterium
YSRLQWAVLNWNVNAIALYDAVG

SEQ ID NO: 879592 - protein, 19 aa, Mycobacterium
YSRPHAQSLFFGTSPGPMH

SEQ ID NO: 879593 - protein, 20 aa, Mycobacterium
YSRRLRRVMYMSALTAIRCD

SEQ ID NO: 879594 - protein, 19 aa, Mycobacterium
YSRRPYPPFMTSTLQQEAG

SEQ ID NO: 879595 - protein, 17 aa, Mycobacterium
YSSFLRHAERAANEFDI

SEQ ID NO: 879596 - protein, 24 aa, Mycobacterium
YSSFVLIPLLNFAVRRRCLLVGGP

SEQ ID NO: 879597 - protein, 26 aa, Mycobacterium
YSSISGLIGIVPQLTYAAANSVLDGL

SEQ ID NO: 879598 - protein, 24 aa, Mycobacterium
YSSTSWMMWNLQLSGLLVGTTIVL

SEQ ID NO: 879599 - protein, 27 aa, Mycobacterium
YSTAAPLDRRLLLTVLADLAPGSGVSA

SEQ ID NO: 879600 - protein, 25 aa, Mycobacterium
YSTEYDVERYFRDAPLMIVGEGTNE

SEQ ID NO: 879601 - protein, 18 aa, Mycobacterium
YSTGPHLHFEVLTNGTNR

SEQ ID NO: 879602 - protein, 31 aa, Mycobacterium
YSTHDEPMIPIYIFYSMFGFQRTGDGLWAAA

SEQ ID NO: 879603 - protein, 31 aa, Mycobacterium
YSTHDEPMIPLYIFYSMFGFQRTGDGLWAAA

SEQ ID NO: 879604 - protein, 17 aa, Mycobacterium
YSTYFLAHWARDRKSGR

SEQ ID NO: 879605 - protein, 26 aa, Mycobacterium
YSVIAGLPRRPTVPVPLLTPRLSAPW

SEQ ID NO: 879606 - protein, 17 aa, Mycobacterium
YSVTIPAIPININETYS

SEQ ID NO: 879607 - protein, 25 aa, Mycobacterium
YSWDVRRLETLERLGWIVIRVVAGD

SEQ ID NO: 879608 - protein, 23 aa, Mycobacterium
YSWQGVGTVWYEALTSPKARPNM

SEQ ID NO: 879609 - protein, 24 aa, Mycobacterium
YSYAPTRLRYPYARGVLIEMYREA

SEQ ID NO: 879610 - protein, 29 aa, Mycobacterium
YSYMRKVLQALTFLRGPRTWVLKSPQHCE

SEQ ID NO: 879611 - protein, 19 aa, Mycobacterium
YSYWVTRNYREAYGLFAVN

SEQ ID NO: 879612 - protein, 33 aa, Mycobacterium
YTADWKLRHLIKKYSDFIAWPIRMEVEKRVPAP

SEQ ID NO: 879613 - protein, 17 aa, Mycobacterium
YTAGDVHNYFWKARLDG

SEQ ID NO: 879614 - protein, 21 aa, Mycobacterium
YTAGQLPMRAGKLAGTGKLGA

SEQ ID NO: 879615 - protein, 22 aa, Mycobacterium
YTAHLGGSMRRLNFAVAGAPFC

SEQ ID NO: 879616 - protein, 18 aa, Mycobacterium
YTALAFRERLGAGGLRDL

SEQ ID NO: 879617 - protein, 17 aa, Mycobacterium
YTALFDAVVDRLRPLDP

SEQ ID NO: 879618 - protein, 18 aa, Mycobacterium
YTALIDANRGCFAAFRAV

SEQ ID NO: 879619 - protein, 28 aa, Mycobacterium
YTALQAPNCKLITWPIARCSARGIRTAE

SEQ ID NO: 879620 - protein, 21 aa, Mycobacterium
YTAVPTIHQILLERAKTEPSG

SEQ ID NO: 879621 - protein, 17 aa, Mycobacterium
YTAWRDGVLSKDEAALA

SEQ ID NO: 879622 - protein, 19 aa, Mycobacterium
YTCHWVRPEWILDPEADPE

SEQ ID NO: 879623 - protein, 20 aa, Mycobacterium
YTCSFLFCCSGYYDYDQGYS

SEQ ID NO: 879624 - protein, 20 aa, Mycobacterium
YTDFFAMAYRVLPADGMMLL

SEQ ID NO: 879625 - protein, 27 aa, Mycobacterium
YTDGKPAHPLIINGWVRTGHSDEQTTA

SEQ ID NO: 879626 - protein, 20 aa, Mycobacterium
YTDIGYWVDLARLLDDGGFD

SEQ ID NO: 879627 - protein, 29 aa, Mycobacterium
YTDPQGALALWSGWLGTDLSRFDLDDPVE

SEQ ID NO: 879628 - protein, 30 aa, Mycobacterium
YTDRLIPALSDAFDAMFGYPGPTVAAINGA

SEQ ID NO: 879629 - protein, 21 aa, Mycobacterium
YTDRRKLLEALAEGGGLIVPP

SEQ ID NO: 879630 - protein, 22 aa, Mycobacterium
YTDSPLFLAAKLIRSGSAAAYG

SEQ ID NO: 879631 - protein, 22 aa, Mycobacterium
YTDVDGIFTADPRIVPNARHLD

SEQ ID NO: 879632 - protein, 26 aa, Mycobacterium
YTDVDGVFTADPRIVPNAARLDKVSF

SEQ ID NO: 879633 - protein, 19 aa, Mycobacterium
YTDVDGVFTADPRIVPNAR

SEQ ID NO: 879634 - protein, 25 aa, Mycobacterium
YTDVVILAYAAKFASAFYGPFREAV

SEQ ID NO: 879635 - protein, 27 aa, Mycobacterium
YTEALPVFRQRWLLCEQPTGQIPEAAF

SEQ ID NO: 879636 - protein, 18 aa, Mycobacterium
YTEDRIFRALQDAGFDDW

SEQ ID NO: 879637 - protein, 23 aa, Mycobacterium
YTEEHEWVRRTGDTTVRIGITDY

SEQ ID NO: 879638 - protein, 26 aa, Mycobacterium
YTEEMPIKVPWSLPAARPAHTGDPAE

SEQ ID NO: 879639 - protein, 20 aa, Mycobacterium
YTELPIARHLQGMWVSWLHE

SEQ ID NO: 879640 - protein, 20 aa, Mycobacterium
YTELRPFVMHINHTGPQLSA

SEQ ID NO: 879641 - protein, 25 aa, Mycobacterium
YTENRYAPPPPYPSPDPFEPFAVAA

SEQ ID NO: 879642 - protein, 31 aa, Mycobacterium
YTENRYAPPPPYPSPDPFEPFAVAAVELADE

SEQ ID NO: 879643 - protein, 18 aa, Mycobacterium
YTEPILHRRRREVKARAA

SEQ ID NO: 879644 - protein, 18 aa, Mycobacterium
YTESWDRKLLALPGNDYA

SEQ ID NO: 879645 - protein, 22 aa, Mycobacterium
YTEVLGYFRRIENVTAAWHFVS

SEQ ID NO: 879646 - protein, 20 aa, Mycobacterium
YTFDKLVQVYPHVVRLRPAP

SEQ ID NO: 879647 - protein, 19 aa, Mycobacterium
YTFLADRYPATWQAPLRWA

SEQ ID NO: 879648 - protein, 25 aa, Mycobacterium
YTFMQDLVAGTYRLPWEDEVRHVDG

SEQ ID NO: 879649 - protein, 24 aa, Mycobacterium
YTGEAWIFVQLAPSVDRNALTEVE

SEQ ID NO: 879650 - protein, 25 aa, Mycobacterium
YTGELFEQGLPWRPGAQEMLDALVA

SEQ ID NO: 879651 - protein, 25 aa, Mycobacterium
YTGGACRLAFWKDDGYLVCEARDTG

SEQ ID NO: 879652 - protein, 24 aa, Mycobacterium
YTGGRWKILMIATEERYMLMQNDT

SEQ ID NO: 879653 - protein, 26 aa, Mycobacterium
YTGIDPYFDDLFLMAADRRHLSVERI

SEQ ID NO: 879654 - protein, 27 aa, Mycobacterium
YTGIDPYFDDLFLMAAERRFLSVERVV

SEQ ID NO: 879655 - protein, 26 aa, Mycobacterium
YTGIDPYFDDLFLMAAQKRFLSVERV

SEQ ID NO: 879656 - protein, 20 aa, Mycobacterium
YTGIDPYFDDLLLMSAQKRL

SEQ ID NO: 879657 - protein, 18 aa, Mycobacterium
YTGKPARLLKTKWTQAWD

SEQ ID NO: 879658 - protein, 19 aa, Mycobacterium
YTGLIYRALGFPTRMFTVL

SEQ ID NO: 879659 - protein, 20 aa, Mycobacterium
YTGLLRWLDELQDKGYVAAP

SEQ ID NO: 879660 - protein, 26 aa, Mycobacterium
YTGMAGHLAALLYDVPHVLTAHSLEP

SEQ ID NO: 879661 - protein, 31 aa, Mycobacterium
YTGMAGHLAALLYGVPHVLTAHSLEPLRPWK

SEQ ID NO: 879662 - protein, 32 aa, Mycobacterium
YTGNTDYYMYLTQDLPLVQPIRDIPYAGPPLA

SEQ ID NO: 879663 - protein, 44 aa, Mycobacterium
YTGNTHYYMFLTQDLPLLQPLRDIPFIGPPLANLIQPDLRVLVD

SEQ ID NO: 879664 - protein, 26 aa, Mycobacterium
YTGNTQYYMLLTQNLPLVQPIRDIPY

SEQ ID NO: 879665 - protein, 23 aa, Mycobacterium
YTGPALPIVAVPTTAGSGSEATQ

SEQ ID NO: 879666 - protein, 22 aa, Mycobacterium
YTGSALGQHWMYQGKHVLIVFD

SEQ ID NO: 879667 - protein, 40 aa, Mycobacterium
YTGVVRITLPARLIPFTGGYRAVMPGPVKALLAALRPDAL

SEQ ID NO: 879668 - protein, 29 aa, Mycobacterium
YTGYAPIIGAPWVTAFAERSKFAEAFKAL

SEQ ID NO: 879669 - protein, 25 aa, Mycobacterium
YTHTAILAYSAKFASGFYGPFREAV

SEQ ID NO: 879670 - protein, 17 aa, Mycobacterium
YTHTCFLNVPYEPYIEV

SEQ ID NO: 879671 - protein, 20 aa, Mycobacterium
YTIDHLFGTIWTRPELSMRD

SEQ ID NO: 879672 - protein, 24 aa, Mycobacterium
YTIKRLPHELIRFMKTGTGRRKVM

SEQ ID NO: 879673 - protein, 18 aa, Mycobacterium
YTILGACNPPLAHRAVTA

SEQ ID NO: 879674 - protein, 19 aa, Mycobacterium
YTITLSRLPEGVYIGLASV

SEQ ID NO: 879675 - protein, 27 aa, Mycobacterium
YTKGFKFSTYATWWIRQAITRGMADQS

SEQ ID NO: 879676 - protein, 17 aa, Mycobacterium
YTKHWMQWGQEGTLPVV

SEQ ID NO: 879677 - protein, 26 aa, Mycobacterium
YTKKANLPLSPLNPPVPPTAYSPPAP

SEQ ID NO: 879678 - protein, 19 aa, Mycobacterium
YTLLAVTAARWPDRAAIVD

SEQ ID NO: 879679 - protein, 34 aa, Mycobacterium
YTLNCEEPVWLQWFLILAKKMRFMGLAKLNPVLH

SEQ ID NO: 879680 - protein, 17 aa, Mycobacterium
YTLNRFPVLVDAAPKGL

SEQ ID NO: 879681 - protein, 33 aa, Mycobacterium
YTLQYDGFASFPRYPLNLLSDLNAFLGIQTIHG

SEQ ID NO: 879682 - protein, 19 aa, Mycobacterium
YTLWHHQLLGDPHDPTSLL

SEQ ID NO: 879683 - protein, 17 aa, Mycobacterium
YTLWRLQERVVGRGPNS

SEQ ID NO: 879684 - protein, 20 aa, Mycobacterium
YTMVFGYVAARHAAGRRLAG

SEQ ID NO: 879685 - protein, 21 aa, Mycobacterium
YTNAWTVMYDIPGVAAMLQQR

SEQ ID NO: 879686 - protein, 25 aa, Mycobacterium
YTNTRWLGFLNTMLVGRDAAGNWGQ

SEQ ID NO: 879687 - protein, 27 aa, Mycobacterium
YTPAPVARFLARWVGRAGTKILEPSCG

SEQ ID NO: 879688 - protein, 37 aa, Mycobacterium
YTPAVLPSFKIDFEDYWAFLAFAVAKGGPRLFEGFDP

SEQ ID NO: 879689 - protein, 19 aa, Mycobacterium
YTPDWVRTVPIWAEASRRE

SEQ ID NO: 879690 - protein, 21 aa, Mycobacterium
YTPQEISARVLMKLKRDAESY

SEQ ID NO: 879691 - protein, 18 aa, Mycobacterium
YTQALLDAVLEPDPRRTR

SEQ ID NO: 879692 - protein, 24 aa, Mycobacterium
YTQNWVVRTLTASAPPISGIVEEL

SEQ ID NO: 879693 - protein, 28 aa, Mycobacterium
YTQRSIFLPRGIPGRAYWFFARTAHHAG

SEQ ID NO: 879694 - protein, 30 aa, Mycobacterium
YTQVMKWMQRWPIRSYAARKWFTTADAIQL

SEQ ID NO: 879695 - protein, 20 aa, Mycobacterium
YTRALVAAVPVPDPVKQRAR

SEQ ID NO: 879696 - protein, 24 aa, Mycobacterium
YTRAMLARMKPVYRPGLIHVYHGV

SEQ ID NO: 879697 - protein, 25 aa, Mycobacterium
YTRDQLELLIQRRGTRKPLTDMPID

SEQ ID NO: 879698 - protein, 17 aa, Mycobacterium
YTRKWLQRMTVGQIDRS

SEQ ID NO: 879699 - protein, 20 aa, Mycobacterium
YTRLAALDLCPRIRVNAIAP

SEQ ID NO: 879700 - protein, 25 aa, Mycobacterium
YTRRDLPIHYLLADTFTVCDAYYCS

SEQ ID NO: 879701 - protein, 32 aa, Mycobacterium
YTRRERWAFTHLPWAKKLYRTRLWLRSEANIS

SEQ ID NO: 879702 - protein, 25 aa, Mycobacterium
YTRTLARVLHRPAVLPVPAAGPRLL

SEQ ID NO: 879703 - protein, 30 aa, Mycobacterium
YTRVLDVLERFYGLVLTDCGPGLLHSVMSS

SEQ ID NO: 879704 - protein, 20 aa, Mycobacterium
YTRWGAFLDDAAGFDAGFFG

SEQ ID NO: 879705 - protein, 38 aa, Mycobacterium
YTRYQPLGVVLAVMPWNFPLWQAVRFAAPALMAGNVGL

SEQ ID NO: 879706 - protein, 27 aa, Mycobacterium
YTTRPGSWIFFPAWNTTTGDLPPTPTP

SEQ ID NO: 879707 - protein, 44 aa, Mycobacterium
YTTTDLTAASLLKSMPAAVNAPAQALFGRPLIGNGSNGAPGTGA

SEQ ID NO: 879708 - protein, 18 aa, Mycobacterium
YTTVMTVLQRLAKKDLVV

SEQ ID NO: 879709 - protein, 20 aa, Mycobacterium
YTVAPLWPDSISMAGLQARI

SEQ ID NO: 879710 - protein, 22 aa, Mycobacterium
YTVDKALLELRNGRLRLDHRNI

SEQ ID NO: 879711 - protein, 28 aa, Mycobacterium
YTVGENIAIVPRLLKWEKQRIAARVDEL

SEQ ID NO: 879712 - protein, 24 aa, Mycobacterium
YTVPPRWLFLRIETDEGLVGWGEP

SEQ ID NO: 879713 - protein, 24 aa, Mycobacterium
YTWEHDLHLYWRKATSVAASAGPA

SEQ ID NO: 879714 - protein, 25 aa, Mycobacterium
YTWEHDMHLYWRRAISLAASLGPTT

SEQ ID NO: 879715 - protein, 21 aa, Mycobacterium
YTYHSKTLGWCDIAYNALVDK

SEQ ID NO: 879716 - protein, 25 aa, Mycobacterium
YTYQLEFFARHVLHGAPLPLDTTDA

SEQ ID NO: 879717 - protein, 24 aa, Mycobacterium
YTYSSAWFDLINPPPKLGRAAVSR

SEQ ID NO: 879718 - protein, 25 aa, Mycobacterium
YTYVPTMIEYYLREKPLLANVDTYR

SEQ ID NO: 879719 - protein, 25 aa, Mycobacterium
YVAAHAPYLAWLTKSSADSAAAATQ

SEQ ID NO: 879720 - protein, 26 aa, Mycobacterium
YVADNLPPQLITRMVDFGLAAGSRIT

SEQ ID NO: 879721 - protein, 18 aa, Mycobacterium
YVAELMELKPDESRWRMA

SEQ ID NO: 879722 - protein, 17 aa, Mycobacterium
YVAHQLDVIVRRTTYRL

SEQ ID NO: 879723 - protein, 19 aa, Mycobacterium
YVAKFLGLSDGVIGETEQR

SEQ ID NO: 879724 - protein, 32 aa, Mycobacterium
YVALRTEIDNWRWAGVPIFLRAGKALPEKVTE

SEQ ID NO: 879725 - protein, 33 aa, Mycobacterium
YVALRTEIDNWRWAGVPIFLRAGKALPERVTEV

SEQ ID NO: 879726 - protein, 32 aa, Mycobacterium
YVALRTEIDNWRWAGVPVFLRAGKALPERVTE

SEQ ID NO: 879727 - protein, 20 aa, Mycobacterium
YVALSDAVTWLAAAGRLSDP

SEQ ID NO: 879728 - protein, 17 aa, Mycobacterium
YVAMVPQWDLLNLLAEA

SEQ ID NO: 879729 - protein, 17 aa, Mycobacterium
YVAPWWEMSEHTATILK

SEQ ID NO: 879730 - protein, 19 aa, Mycobacterium
YVARLRAKLTTAEAANGIG

SEQ ID NO: 879731 - protein, 28 aa, Mycobacterium
YVARVQALLARVLTFPMPTAAAVTGHAF

SEQ ID NO: 879732 - protein, 24 aa, Mycobacterium
YVASKWAVRGLAKSAALELAPHNI

SEQ ID NO: 879733 - protein, 19 aa, Mycobacterium
YVASKWAVRGLTKSAALEL

SEQ ID NO: 879734 - protein, 20 aa, Mycobacterium
YVASKWAVRGLTKSAALELG

SEQ ID NO: 879735 - protein, 25 aa, Mycobacterium
YVAVGALEPAFFAELLRLLEIDPDT

SEQ ID NO: 879736 - protein, 24 aa, Mycobacterium
YVAVPVNLPALRLTGLQAAVAAAV

SEQ ID NO: 879737 - protein, 29 aa, Mycobacterium
YVAVSWLPPHHDMGLISMILGTVSFGGSC

SEQ ID NO: 879738 - protein, 17 aa, Mycobacterium
YVCDVNFMGFFPGLNDV

SEQ ID NO: 879739 - protein, 23 aa, Mycobacterium
YVDAFITGFVSYAKFLVRQGADA

SEQ ID NO: 879740 - protein, 30 aa, Mycobacterium
YVDDVALPGMLHLAILRSPYAHARIASIDT

SEQ ID NO: 879741 - protein, 30 aa, Mycobacterium
YVDDVALPGMLHLAILRSPYAHARIVSIDV

SEQ ID NO: 879742 - protein, 22 aa, Mycobacterium
YVDDVLALPAVRRNWSSVSPLR

SEQ ID NO: 879743 - protein, 30 aa, Mycobacterium
YVDDVTLPGMLHLAILRSPYAHARIVSIDT

SEQ ID NO: 879744 - protein, 26 aa, Mycobacterium
YVDFDPIYCWPKPVTKPYPPLYIGGG

SEQ ID NO: 879745 - protein, 20 aa, Mycobacterium
YVDFLPAALAAKRRGRRMRF

SEQ ID NO: 879746 - protein, 23 aa, Mycobacterium
YVDGELYLTGRIKDLIVIDGRNH

SEQ ID NO: 879747 - protein, 17 aa, Mycobacterium
YVDHQLDVIVRRTRYRL

SEQ ID NO: 879748 - protein, 22 aa, Mycobacterium
YVDLYSCFPSAVQVAAHELGLP

SEQ ID NO: 879749 - protein, 19 aa, Mycobacterium
YVDPLTAAGIIVEFTDRAR

SEQ ID NO: 879750 - protein, 18 aa, Mycobacterium
YVDPVAPDRARLASVAVQ

SEQ ID NO: 879751 - protein, 25 aa, Mycobacterium
YVDRDGFLYFAGRRGDWIRVDGENT

SEQ ID NO: 879752 - protein, 19 aa, Mycobacterium
YVDSFAGMFPRLGSAASTE

SEQ ID NO: 879753 - protein, 30 aa, Mycobacterium
YVDSKLAEFEDFLNGTLRSVGRGRHQLRTS

SEQ ID NO: 879754 - protein, 26 aa, Mycobacterium
YVDSLKKAMAAFGPIFVQLYGQGEAP

SEQ ID NO: 879755 - protein, 23 aa, Mycobacterium
YVDSMILATGWLGSLAVAGGPRP

SEQ ID NO: 879756 - protein, 21 aa, Mycobacterium
YVDTSYWRDMGTPEDFVRGSA

SEQ ID NO: 879757 - protein, 18 aa, Mycobacterium
YVDVLRLPVDIVVADKFA

SEQ ID NO: 879758 - protein, 21 aa, Mycobacterium
YVEAVAPDLMPRLTKYEPAGP

SEQ ID NO: 879759 - protein, 17 aa, Mycobacterium
YVEEELLYLLTDSNARA

SEQ ID NO: 879760 - protein, 27 aa, Mycobacterium
YVEEMGGMNIFFVLGKGGSARLVTPEL

SEQ ID NO: 879761 - protein, 35 aa, Mycobacterium
YVEFPSIGQLPYLLTLPGHGFYWFQLREPDPEPGA

SEQ ID NO: 879762 - protein, 21 aa, Mycobacterium
YVEGMWRMLQASEPEDFVLAT

SEQ ID NO: 879763 - protein, 22 aa, Mycobacterium
YVELFYGRPRTQSSWELVTDAL

SEQ ID NO: 879764 - protein, 17 aa, Mycobacterium
YVELGIDPENLRLFEHP

SEQ ID NO: 879765 - protein, 24 aa, Mycobacterium
YVELHDWFGRNNPLMRRLRVMRSN

SEQ ID NO: 879766 - protein, 19 aa, Mycobacterium
YVELPPERMTKASPAPFAI

SEQ ID NO: 879767 - protein, 17 aa, Mycobacterium
YVEPTVVGGLRQDDRLI

SEQ ID NO: 879768 - protein, 19 aa, Mycobacterium
YVEQLYAPIIDFLQDPVGN

SEQ ID NO: 879769 - protein, 25 aa, Mycobacterium
YVEVVRRLWDSWEDDAVIRDVATGR

SEQ ID NO: 879770 - protein, 18 aa, Mycobacterium
YVFGNGQPGGSGGAGGDA

SEQ ID NO: 879771 - protein, 20 aa, Mycobacterium
YVGALDLFRVKPGALTATQL

SEQ ID NO: 879772 - protein, 22 aa, Mycobacterium
YVGAYFLDDRAAVTALLNAARL

SEQ ID NO: 879773 - protein, 24 aa, Mycobacterium
YVGDRFPVLPMPDWMYNPIDPISI

SEQ ID NO: 879774 - protein, 18 aa, Mycobacterium
YVGDWAGALAREWAAETP

SEQ ID NO: 879775 - protein, 23 aa, Mycobacterium
YVGEAWIHVQLLPSVDGKGLSEV

SEQ ID NO: 879776 - protein, 24 aa, Mycobacterium
YVGGRLIGLVGALYADAVRALLRE

SEQ ID NO: 879777 - protein, 23 aa, Mycobacterium
YVGNIDLSFPYLDTAATRTIGVT

SEQ ID NO: 879778 - protein, 18 aa, Mycobacterium
YVGSKHWIRYDPKKPNRK

SEQ ID NO: 879779 - protein, 39 aa, Mycobacterium
YVGTGGALLPLLLFASARAAIPFTPLNYRLSAEGLRELV

SEQ ID NO: 879780 - protein, 28 aa, Mycobacterium
YVGTGGALLPLLLFASARAAVPVTPLNY

SEQ ID NO: 879781 - protein, 27 aa, Mycobacterium
YVGTGGALLPLLLFSSARANTAFTPLN

SEQ ID NO: 879782 - protein, 30 aa, Mycobacterium
YVGTGGAMLPLLIFASARAGLPFTSINYRL

SEQ ID NO: 879783 - protein, 27 aa, Mycobacterium
YVGTGGAMLPVLIFAAARAGVAFTPIN

SEQ ID NO: 879784 - protein, 22 aa, Mycobacterium
YVGVWELPVLGAIAAPAAALIR

SEQ ID NO: 879785 - protein, 18 aa, Mycobacterium
YVGYLRRKIDIPFGTNTI

SEQ ID NO: 879786 - protein, 30 aa, Mycobacterium
YVHNRLLTLLLFDIGSFAGLAPLLSSAVST

SEQ ID NO: 879787 - protein, 36 aa, Mycobacterium
YVHNRLLTLLLFDVGSFAGLAPLLSSAISAARRAGP

SEQ ID NO: 879788 - protein, 19 aa, Mycobacterium
YVHNTPIVPVFTRHDFDGP

SEQ ID NO: 879789 - protein, 19 aa, Mycobacterium
YVHPALVPLQAIELLDVDL

SEQ ID NO: 879790 - protein, 25 aa, Mycobacterium
YVHRDSPPFFVLHGDKDPLAPCAQA

SEQ ID NO: 879791 - protein, 30 aa, Mycobacterium
YVIGDGERPWWDAILIVEYPTPQAFIDMVS

SEQ ID NO: 879792 - protein, 24 aa, Mycobacterium
YVILNDFPLFWDPTLLEHDVHLPR

SEQ ID NO: 879793 - protein, 25 aa, Mycobacterium
YVILNTIRGFLPELGLKRENIVFIS

SEQ ID NO: 879794 - protein, 22 aa, Mycobacterium
YVILNTIRNFLPDLGLRRENIV

SEQ ID NO: 879795 - protein, 18 aa, Mycobacterium
YVILNTIRNFLPELGLRR

SEQ ID NO: 879796 - protein, 22 aa, Mycobacterium
YVINGRKWWTSGAADPRCKILI

SEQ ID NO: 879797 - protein, 21 aa, Mycobacterium
YVINGRKWWTSGASDPRCKIL

SEQ ID NO: 879798 - protein, 20 aa, Mycobacterium
YVKASRRRWLREEQYRRMYL

SEQ ID NO: 879799 - protein, 26 aa, Mycobacterium
YVKAVTYLPLRALLGSGLLTSEGNVW

SEQ ID NO: 879800 - protein, 24 aa, Mycobacterium
YVKDIRVWPKLRELGWDVIRVIKE

SEQ ID NO: 879801 - protein, 20 aa, Mycobacterium
YVKEDVAIRRLLATGLERAG

SEQ ID NO: 879802 - protein, 19 aa, Mycobacterium
YVKEDVAIRRLLSTGLERA

SEQ ID NO: 879803 - protein, 19 aa, Mycobacterium
YVLAELGFRVRRLAGRVVW

SEQ ID NO: 879804 - protein, 19 aa, Mycobacterium
YVLAHPCPMCLGSLYYCSP

SEQ ID NO: 879805 - protein, 25 aa, Mycobacterium
YVLAHPCPMCLGSLYYCSPREVVFL

SEQ ID NO: 879806 - protein, 17 aa, Mycobacterium
YVLASTATALPADIELP

SEQ ID NO: 879807 - protein, 18 aa, Mycobacterium
YVLHDVFAVPFQEIAETL

SEQ ID NO: 879808 - protein, 17 aa, Mycobacterium
YVLLPALSLRRWRRTLL

SEQ ID NO: 879809 - protein, 19 aa, Mycobacterium
YVLLVRVPSPRALEELLQL

SEQ ID NO: 879810 - protein, 17 aa, Mycobacterium
YVLQTALQLARRGVAVD

SEQ ID NO: 879811 - protein, 21 aa, Mycobacterium
YVLRTSSQVPFLVRDELCHVF

SEQ ID NO: 879812 - protein, 37 aa, Mycobacterium
YVLSQPGLRKLLPQEWLRFGWFFLVTRHDPKGLREWI

SEQ ID NO: 879813 - protein, 38 aa, Mycobacterium
YVLSQPGLRKLLPQEWLRFGWFFLVTRRDPGGLLEWIR

SEQ ID NO: 879814 - protein, 22 aa, Mycobacterium
YVLSVALSLLLGLIPGTDDPEQ

SEQ ID NO: 879815 - protein, 26 aa, Mycobacterium
YVNLGIGLPTLIPDHLPAGSQVTLHS

SEQ ID NO: 879816 - protein, 23 aa, Mycobacterium
YVNLGIGLPTLIPDHLPEGSDVT

SEQ ID NO: 879817 - protein, 17 aa, Mycobacterium
YVNLLSKSALMQGFNTL

SEQ ID NO: 879818 - protein, 27 aa, Mycobacterium
YVNYRQIIRLALELGYTGPFCCEHYGS

SEQ ID NO: 879819 - protein, 20 aa, Mycobacterium
YVPALEQVAAWYWSMTHPEE

SEQ ID NO: 879820 - protein, 20 aa, Mycobacterium
YVPAPLLSDIARHADPHAAL

SEQ ID NO: 879821 - protein, 19 aa, Mycobacterium
YVPDKGRFMAFAVPTIRGE

SEQ ID NO: 879822 - protein, 24 aa, Mycobacterium
YVPDLDLIAERLALAESTLSGAAA

SEQ ID NO: 879823 - protein, 23 aa, Mycobacterium
YVPDLDRRFTLAAGLLELADREF

SEQ ID NO: 879824 - protein, 20 aa, Mycobacterium
YVPELLMKAPEVIQLYADGP

SEQ ID NO: 879825 - protein, 17 aa, Mycobacterium
YVPGGRYPLVASAHMTV

SEQ ID NO: 879826 - protein, 29 aa, Mycobacterium
YVPGGTVRNWPWRRLALSKTANTYSRLAL

SEQ ID NO: 879827 - protein, 21 aa, Mycobacterium
YVPPDPFFNDPQWKGITDWRA

SEQ ID NO: 879828 - protein, 20 aa, Mycobacterium
YVPVTVPWAKIRDQVVPAMV

SEQ ID NO: 879829 - protein, 27 aa, Mycobacterium
YVQADACDGFILVPHLTPHGLDEFVDR

SEQ ID NO: 879830 - protein, 24 aa, Mycobacterium
YVQDYGAPIGWRLALRDPSAITAI

SEQ ID NO: 879831 - protein, 25 aa, Mycobacterium
YVQDYGAPIGWRLALRHPEAISAIV

SEQ ID NO: 879832 - protein, 24 aa, Mycobacterium
YVQDYGAPVGWRLALRDPAAITAI

SEQ ID NO: 879833 - protein, 29 aa, Mycobacterium
YVQQCVRSCRWLTLDLRHLEFIGTAGFSA

SEQ ID NO: 879834 - protein, 30 aa, Mycobacterium
YVRAVGPGIYSWLPLGLRVLRKIENVVRSE

SEQ ID NO: 879835 - protein, 20 aa, Mycobacterium
YVRDIRRLELLAELGWIVIR

SEQ ID NO: 879836 - protein, 19 aa, Mycobacterium
YVRGLWGELKNPGERPKQM

SEQ ID NO: 879837 - protein, 18 aa, Mycobacterium
YVRGMVYRQLHDDEKARI

SEQ ID NO: 879838 - protein, 18 aa, Mycobacterium
YVRKPPYFEGMSADPEPV

SEQ ID NO: 879839 - protein, 18 aa, Mycobacterium
YVRKPPYFEGMSAEPEPV

SEQ ID NO: 879840 - protein, 18 aa, Mycobacterium
YVRLYPAQVLKQADLVLA

SEQ ID NO: 879841 - protein, 24 aa, Mycobacterium
YVRMPHHRVVLRQQIFGYTYEELN

SEQ ID NO: 879842 - protein, 30 aa, Mycobacterium
YVRPVAPGVYSWLPLGLRVLRKIENIVREE

SEQ ID NO: 879843 - protein, 27 aa, Mycobacterium
YVRQLPSRRYALGPRLIRLGESATQQF

SEQ ID NO: 879844 - protein, 18 aa, Mycobacterium
YVRRAWQGAALLGDSRAL

SEQ ID NO: 879845 - protein, 27 aa, Mycobacterium
YVRRQRSWFRRDHRITWLDGAAPGNVD

SEQ ID NO: 879846 - protein, 17 aa, Mycobacterium
YVRRQRSWFRRDHRVHW

SEQ ID NO: 879847 - protein, 24 aa, Mycobacterium
YVRRQRSWFRRDHRVQWLNADDRA

SEQ ID NO: 879848 - protein, 19 aa, Mycobacterium
YVRSELTHFLGAEVGNPLA

SEQ ID NO: 879849 - protein, 17 aa, Mycobacterium
YVRSFAVSPRKGGPRAP

SEQ ID NO: 879850 - protein, 17 aa, Mycobacterium
YVRVPITAQPWSDGAVR

SEQ ID NO: 879851 - protein, 20 aa, Mycobacterium
YVRVPYRARVPMTRAALMHR

SEQ ID NO: 879852 - protein, 24 aa, Mycobacterium
YVSMPLFHSNAVLAGWAVAVAAGA

SEQ ID NO: 879853 - protein, 24 aa, Mycobacterium
YVSMPLFHSNAVLVGWAVAAACAG

SEQ ID NO: 879854 - protein, 24 aa, Mycobacterium
YVSMPLFHSNAVLVGWAVAAACRG

SEQ ID NO: 879855 - protein, 24 aa, Mycobacterium
YVSMPLFHSNAVLVGWAVALACQG

SEQ ID NO: 879856 - protein, 25 aa, Mycobacterium
YVSMPLFHSNAVLVGWAVAVACQGS

SEQ ID NO: 879857 - protein, 17 aa, Mycobacterium
YVSPEGALALFGGWTGV

SEQ ID NO: 879858 - protein, 31 aa, Mycobacterium
YVSRIDQLFIAPFHPGYLAQGLYTPEQYWPL

SEQ ID NO: 879859 - protein, 24 aa, Mycobacterium
YVSSKWGVIGLTKCAAHDLVGYGI

SEQ ID NO: 879860 - protein, 25 aa, Mycobacterium
YVTETDLYLWSERARFGSTWGGGAD

SEQ ID NO: 879861 - protein, 25 aa, Mycobacterium
YVTFANLVAPHWWSGPDWPEMVTAF

SEQ ID NO: 879862 - protein, 29 aa, Mycobacterium
YVTTINGAYIQFLFPGANAAGLTYPAQFW

SEQ ID NO: 879863 - protein, 24 aa, Mycobacterium
YVTTPGSALLFPSLCAPTGEAPRQ

SEQ ID NO: 879864 - protein, 29 aa, Mycobacterium
YVTTPGSALLFPSLCHSTGGLPAAEADPP

SEQ ID NO: 879865 - protein, 28 aa, Mycobacterium
YVTTPGSAWLFPSLCAPTGRVPARSAAQ

SEQ ID NO: 879866 - protein, 31 aa, Mycobacterium
YVTTPGSAWLLPGLFAPSPELPPPARKPQDH

SEQ ID NO: 879867 - protein, 27 aa, Mycobacterium
YVVEEHLYQQIYLPVPIETRGLVVEWL

SEQ ID NO: 879868 - protein, 17 aa, Mycobacterium
YVVEWPGAAPDLGNAAR

SEQ ID NO: 879869 - protein, 19 aa, Mycobacterium
YVVGLATYCASKHAVIAFT

SEQ ID NO: 879870 - protein, 18 aa, Mycobacterium
YVVGLMAEQWILANYSVL

SEQ ID NO: 879871 - protein, 17 aa, Mycobacterium
YVVQFDITLSGALDPRR

SEQ ID NO: 879872 - protein, 32 aa, Mycobacterium
YVVTGGLGGLGLFLARKLAAAGVGRIILNGRS

SEQ ID NO: 879873 - protein, 19 aa, Mycobacterium
YVVVLFDYRHFGASSGQPR

SEQ ID NO: 879874 - protein, 17 aa, Mycobacterium
YVYLARPDSTLVGRSVH

SEQ ID NO: 879875 - protein, 18 aa, Mycobacterium
YVYNFLGERQQLLSSVGP

SEQ ID NO: 879876 - protein, 19 aa, Mycobacterium
YWAALRSGLYITSVNHHLA

SEQ ID NO: 879877 - protein, 18 aa, Mycobacterium
YWAGLNKGKRSVAADMRS

SEQ ID NO: 879878 - protein, 37 aa, Mycobacterium
YWARQADWHRALYRAGFFGLSWPREYGGQELPPVYDV

SEQ ID NO: 879879 - protein, 36 aa, Mycobacterium
YWARQAHWHQALYREGFFGLSWPREYGGRELAPVYD

SEQ ID NO: 879880 - protein, 36 aa, Mycobacterium
YWARQAQWHQALYREGFFGLSFPREYGGQELPPVYD

SEQ ID NO: 879881 - protein, 19 aa, Mycobacterium
YWEKALDGVKLLNLPGDRP

SEQ ID NO: 879882 - protein, 18 aa, Mycobacterium
YWEPRASLLLNRSILERR

SEQ ID NO: 879883 - protein, 26 aa, Mycobacterium
YWFGEGVLPLLERRGLWARPNGQSPP

SEQ ID NO: 879884 - protein, 19 aa, Mycobacterium
YWGSPIPVWKSDDPAYPRI

SEQ ID NO: 879885 - protein, 19 aa, Mycobacterium
YWGTPIPVWKSDDPDYPRI

SEQ ID NO: 879886 - protein, 20 aa, Mycobacterium
YWIWTTMNRPGRYLVSSGML

SEQ ID NO: 879887 - protein, 18 aa, Mycobacterium
YWMPLFVTLADGAELDDA

SEQ ID NO: 879888 - protein, 26 aa, Mycobacterium
YWMSAKMPNDQFLLYAFDGRPAEPEC

SEQ ID NO: 879889 - protein, 21 aa, Mycobacterium
YWNHNSAYHPWLVGLAARRHG

SEQ ID NO: 879890 - protein, 19 aa, Mycobacterium
YWPKLDAMYPDFANYRSYT

SEQ ID NO: 879891 - protein, 17 aa, Mycobacterium
YWQRHPSLSYLFAGRFV

SEQ ID NO: 879892 - protein, 28 aa, Mycobacterium
YWRRGGFSAARFVACPFGAAGSRMYRTG

SEQ ID NO: 879893 - protein, 21 aa, Mycobacterium
YWSANLRNPVRFHQAIRVAAA

SEQ ID NO: 879894 - protein, 25 aa, Mycobacterium
YWTDDLVAFLIGCSFSFEAALLDSG

SEQ ID NO: 879895 - protein, 28 aa, Mycobacterium
YWTPEDLVYYQVLGGWKLATLLEVSYQR

SEQ ID NO: 879896 - protein, 19 aa, Mycobacterium
YWVDLARLLDDGGFDLLFI

SEQ ID NO: 879897 - protein, 22 aa, Mycobacterium
YWVEQLISPVHLKKAIRRARSK

SEQ ID NO: 879898 - protein, 27 aa, Mycobacterium
YWVSKAAAERLYLGLAADLKPDNIAVN

SEQ ID NO: 879899 - protein, 32 aa, Mycobacterium
YYAAQPDGPSILSPSLLSPRDNDFLSHNDTDF

SEQ ID NO: 879900 - protein, 25 aa, Mycobacterium
YYADEDAIAPLWKGSRFPIGSCISG

SEQ ID NO: 879901 - protein, 17 aa, Mycobacterium
YYADFEGVLAFLQRKMS

SEQ ID NO: 879902 - protein, 22 aa, Mycobacterium
YYADPCALFDLCKRRYSKNVAL

SEQ ID NO: 879903 - protein, 26 aa, Mycobacterium
YYADYRRYRWDLALRRDYQRAAFEAG

SEQ ID NO: 879904 - protein, 18 aa, Mycobacterium
YYAITVKPTVFINLVPDH

SEQ ID NO: 879905 - protein, 17 aa, Mycobacterium
YYAQWAQPWEVQALLRA

SEQ ID NO: 879906 - protein, 26 aa, Mycobacterium
YYCVVDTRGWLRDPAPLFRTNVEGTR

SEQ ID NO: 879907 - protein, 26 aa, Mycobacterium
YYCVVDTRGWLRHPAPLFRTNVEGTR

SEQ ID NO: 879908 - protein, 19 aa, Mycobacterium
YYDAAALMLSGKPFKKAAS

SEQ ID NO: 879909 - protein, 31 aa, Mycobacterium
YYDDAHVAQLRLIASLLNKGFSSAHIAEFFS

SEQ ID NO: 879910 - protein, 25 aa, Mycobacterium
YYDELFIGGQWRKPASPQQLAVISP

SEQ ID NO: 879911 - protein, 32 aa, Mycobacterium
YYDIVHSHYWLSGQVGWLARDRWAVPLVHTAH

SEQ ID NO: 879912 - protein, 23 aa, Mycobacterium
YYDKVDVTVIPPFTDLRSVQTLV

SEQ ID NO: 879913 - protein, 29 aa, Mycobacterium
YYDQYGYQRPLFALGFDTLFAGPAAEFFN

SEQ ID NO: 879914 - protein, 17 aa, Mycobacterium
YYEFANPGDVVEVRNTG

SEQ ID NO: 879915 - protein, 19 aa, Mycobacterium
YYEHAYLMRMATKSKPYTL

SEQ ID NO: 879916 - protein, 19 aa, Mycobacterium
YYEIDAEQYKLFLANTSAA

SEQ ID NO: 879917 - protein, 28 aa, Mycobacterium
YYEKAGLTPYLDKLGFNLVGYGCTTCIG

SEQ ID NO: 879918 - protein, 17 aa, Mycobacterium
YYEVDPYTPAAPRHPIS

SEQ ID NO: 879919 - protein, 18 aa, Mycobacterium
YYFANAYPAPTRGVPVPG

SEQ ID NO: 879920 - protein, 18 aa, Mycobacterium
YYFNDHGAQIDRFANSLI

SEQ ID NO: 879921 - protein, 18 aa, Mycobacterium
YYFNDHGAQIDRFASSLI

SEQ ID NO: 879922 - protein, 17 aa, Mycobacterium
YYFRTRAALLRGVGDRV

SEQ ID NO: 879923 - protein, 19 aa, Mycobacterium
YYGAFQAVADVSLSILPRS

SEQ ID NO: 879924 - protein, 29 aa, Mycobacterium
YYGFVSLDSLPFYDPWFAKARTSGAIEAR

SEQ ID NO: 879925 - protein, 20 aa, Mycobacterium
YYGGLQFNLGTWRSHGGAGM

SEQ ID NO: 879926 - protein, 30 aa, Mycobacterium
YYGHQLPAPAPYRNFVTWLAGQDRVAAQSV

SEQ ID NO: 879927 - protein, 28 aa, Mycobacterium
YYIDYSDFTLWVLRVSRVRWVGGYGRMD

SEQ ID NO: 879928 - protein, 21 aa, Mycobacterium
YYIRPLDLYLNGQDMALFDIA

SEQ ID NO: 879929 - protein, 17 aa, Mycobacterium
YYITVDAAWRPDTVWRY

SEQ ID NO: 879930 - protein, 25 aa, Mycobacterium
YYKAELIYGPVRTRPWKTVEDVELA

SEQ ID NO: 879931 - protein, 21 aa, Mycobacterium
YYKENSSLLAPLPGARDLLRR

SEQ ID NO: 879932 - protein, 21 aa, Mycobacterium
YYKFRNWDISGSWTGFSEQPQ

SEQ ID NO: 879933 - protein, 28 aa, Mycobacterium
YYLASAFREIWMQPAGSVGLIGFATNAT

SEQ ID NO: 879934 - protein, 21 aa, Mycobacterium
YYLGGRALIARFLTAIGQYPN

SEQ ID NO: 879935 - protein, 17 aa, Mycobacterium
YYLPRLVGMRRAQELML

SEQ ID NO: 879936 - protein, 25 aa, Mycobacterium
YYNADATIWLSRRSEPMPFYRRNVD

SEQ ID NO: 879937 - protein, 18 aa, Mycobacterium
YYNAIVWQDTRTDRIAAA

SEQ ID NO: 879938 - protein, 18 aa, Mycobacterium
YYNAIVWQDTRTDRIASG

SEQ ID NO: 879939 - protein, 25 aa, Mycobacterium
YYNERHNFWGISRYADVDAALKDTT

SEQ ID NO: 879940 - protein, 19 aa, Mycobacterium
YYQLPLPAERGTGLGKSLH

SEQ ID NO: 879941 - protein, 20 aa, Mycobacterium
YYRAMFSGRVTSWNLRDQHM

SEQ ID NO: 879942 - protein, 20 aa, Mycobacterium
YYRRLRDEAPLYHNQELGFW

SEQ ID NO: 879943 - protein, 20 aa, Mycobacterium
YYRSMFGGRVTSWNLRDRHM

SEQ ID NO: 879944 - protein, 19 aa, Mycobacterium
YYRTAEFFLRDDPGNDPRV

SEQ ID NO: 879945 - protein, 23 aa, Mycobacterium
YYSDFLMGACRRAGFEPDYVVSR

SEQ ID NO: 879946 - protein, 17 aa, Mycobacterium
YYSTIKDLTRLLGGPSH

SEQ ID NO: 879947 - protein, 18 aa, Mycobacterium
YYSVIYQAIDDIEKALRG

SEQ ID NO: 879948 - protein, 24 aa, Mycobacterium
YYVEHQLDVIIRRTTYRLRKANER

SEQ ID NO: 879949 - protein, 17 aa, Mycobacterium
YYVQYAHARLCALARNA

SEQ ID NO: 879950 - protein, 17 aa, Mycobacterium
YYWAARSLGGEFTAGNE

SEQ ID NO: 879951 - protein, 19 aa, Mycobacterium
YYWADAEVDAARRTLLANL

SEQ ID NO: 879952 - protein, 17 aa, Mycobacterium
YYWPKLVELYADFDKYQ

SEQ ID NO: 879953 - protein, 18 aa, Mycobacterium
YYYHAELDWWTSSFVLAE

SEQ ID NO: 879954 - protein, 22 aa, Mycobacterium
HAILTILAILKTGAAYLPIDPH

SEQ ID NO: 879955 - protein, 23 aa, Mycobacterium
ATVKRRLPIYAQPQWRQSLAAAS

SEQ ID NO: 879956 - protein, 19 aa, Mycobacterium
GYTLGNSLRRTLLSSIPGA

SEQ ID NO: 879957 - protein, 19 aa, Mycobacterium
ICFDGFHIMRWINRALDAV

SEQ ID NO: 879958 - protein, 20 aa, Mycobacterium
ATWRWATAIATAWRRIRAAF

SEQ ID NO: 879959 - protein, 17 aa, Mycobacterium
DKRSLVFPVKRLADLGF

SEQ ID NO: 879960 - protein, 19 aa, Mycobacterium
EALARVFDYTLAIGKTPIV

SEQ ID NO: 879961 - protein, 24 aa, Mycobacterium
EGPLPQTRFVLRKALAAHLPVILV

SEQ ID NO: 879962 - protein, 28 aa, Mycobacterium
ELAAPVTHIWYFKGVPSRLGYLLDLAPK

SEQ ID NO: 879963 - protein, 18 aa, Mycobacterium
GRIARVLGPRGLMPNPKT

SEQ ID NO: 879964 - protein, 19 aa, Mycobacterium
HIDKWKFTVPFVCGATNLG

SEQ ID NO: 879965 - protein, 17 aa, Mycobacterium
HPRLMPDFWEFPTVSMG

SEQ ID NO: 879966 - protein, 24 aa, Mycobacterium
IAEEYYISFLLDRANRTYLAMCSV

SEQ ID NO: 879967 - protein, 21 aa, Mycobacterium
TLLESFLFYSGFYLPMYWSSR

SEQ ID NO: 879968 - protein, 18 aa, Mycobacterium
WTTLGQYADWIFCLVRTD

SEQ ID NO: 879969 - protein, 20 aa, Mycobacterium
AIHAVFLFHAIKAGLDMGIV

SEQ ID NO: 879970 - protein, 19 aa, Mycobacterium
AQLVGWLEGLFHGIQTALF

SEQ ID NO: 879971 - protein, 18 aa, Mycobacterium
AQPWSLRYPLVDGQGNFG

SEQ ID NO: 879972 - protein, 26 aa, Mycobacterium
AYAKKFRFPTFLGAFKYYTSYTLKTF

SEQ ID NO: 879973 - protein, 23 aa, Mycobacterium
DGSDAMRWFLMASPILRGGNLIV

SEQ ID NO: 879974 - protein, 19 aa, Mycobacterium
DVLLPFLVTRQLICGAGKV

SEQ ID NO: 879975 - protein, 25 aa, Mycobacterium
EYASRGTWIWPPEPSLRLIADTIEF

SEQ ID NO: 879976 - protein, 18 aa, Mycobacterium
FYSGFYLPMYWSSRAKLT

SEQ ID NO: 879977 - protein, 21 aa, Mycobacterium
HAILAILAILKTGAAYLPIDP

SEQ ID NO: 879978 - protein, 17 aa, Mycobacterium
IHRLFDDLEFRVLRDRL

SEQ ID NO: 879979 - protein, 26 aa, Mycobacterium
ITPFNFPAMIPLWKAGPALACGNAFV

SEQ ID NO: 879980 - protein, 23 aa, Mycobacterium
KDLLPLLEKVIQAGKPLLIIAED

SEQ ID NO: 879981 - protein, 18 aa, Mycobacterium
LLMVQRYRAGWFKARIAE

SEQ ID NO: 879982 - protein, 22 aa, Mycobacterium
MAHFFYIHFGLPTYFKNVFEGH

SEQ ID NO: 879983 - protein, 22 aa, Mycobacterium
PTDTRAYFRGECLRRFGADIAA

SEQ ID NO: 879984 - protein, 19 aa, Mycobacterium
PVIDKDVRRWWRSDSLWQA

SEQ ID NO: 879985 - protein, 19 aa, Mycobacterium
RSLVFPVKRLADLGFRVLA

SEQ ID NO: 879986 - protein, 18 aa, Mycobacterium
SMFQAILPLRGKIINVEK

SEQ ID NO: 879987 - protein, 17 aa, Mycobacterium
VHAGVLLRYVPLTAKRV

SEQ ID NO: 879988 - protein, 24 aa, Mycobacterium
VPAFSGLFAPYWRSDARGAIVGLS

SEQ ID NO: 879989 - protein, 19 aa, Mycobacterium
YDILFFWVARMMMFGTFVG

SEQ ID NO: 879990 - protein, 19 aa, Mycobacterium
AGWVRMDFIVPSRGLIGFR

SEQ ID NO: 879991 - protein, 24 aa, Mycobacterium
ARLLYWGCDVWLNNPLRPLEACGT

SEQ ID NO: 879992 - protein, 24 aa, Mycobacterium
ASPPVKWPCFYGIDFPSPAELIAN

SEQ ID NO: 879993 - protein, 18 aa, Mycobacterium
CEEAPFYTLGPLATDIAP

SEQ ID NO: 879994 - protein, 24 aa, Mycobacterium
DPHKVAMLGLTFDDVLLLPAASDV

SEQ ID NO: 879995 - protein, 19 aa, Mycobacterium
DVLDTWFSSALWPFSTLGW

SEQ ID NO: 879996 - protein, 18 aa, Mycobacterium
DVLLFIDNIFRFTQAGSE

SEQ ID NO: 879997 - protein, 24 aa, Mycobacterium
EDGAGWLTFWRSLTARGLSGVKLV

SEQ ID NO: 879998 - protein, 24 aa, Mycobacterium
EVMPEDLIKFGLIPEFIGRLPVVA

SEQ ID NO: 879999 - protein, 23 aa, Mycobacterium
FMVRNTYIYPPKPSMRIISDIFA

SEQ ID NO: 880000 - protein, 24 aa, Mycobacterium
GGQEILFPALLPRAPYETTNRWTE

SEQ ID NO: 880001 - protein, 31 aa, Mycobacterium; identical to SEQ ID NO: 227175

SEQ ID NO: 880002 - protein, 17 aa, Mycobacterium
GQMPIHMRLPKLKGFRN

SEQ ID NO: 880003 - protein, 23 aa, Mycobacterium
GRENVFFLHVSLVPYLAPSGELK

SEQ ID NO: 880004 - protein, 20 aa, Mycobacterium
GTGTGGIQGAGGQGGTGGTG

SEQ ID NO: 880005 - protein, 18 aa, Mycobacterium
GWLTLNWPKEYGGQDRSP

SEQ ID NO: 880006 - protein, 20 aa, Mycobacterium
GYPVLVRPSYVLGGRGMEIV

SEQ ID NO: 880007 - protein, 19 aa, Mycobacterium
KAQIYAWRKGIKTLYYIRL

SEQ ID NO: 880008 - protein, 20 aa, Mycobacterium
LGIDCIWLPPFYDSPLRDGG

SEQ ID NO: 880009 - protein, 19 aa, Mycobacterium
LIVIPNDRLLQMGDAAVSL

SEQ ID NO: 880010 - protein, 20 aa, Mycobacterium
MPIHMRLPKLKGFRNRFRTE

SEQ ID NO: 880011 - protein, 23 aa, Mycobacterium
NCEIVPWCRFARKNYFYPDMPKN

SEQ ID NO: 880012 - protein, 28 aa, Mycobacterium
PKRLGSFMDSRLWRLLLAPGRGIGRLVT

SEQ ID NO: 880013 - protein, 20 aa, Mycobacterium
PPTFVLFTTGFLEAGYRRFL

SEQ ID NO: 880014 - protein, 24 aa, Mycobacterium
PTEFTLLRYFVINAGTVLSKPKIL

SEQ ID NO: 880015 - protein, 24 aa, Mycobacterium
QEDFIGIHFFSPVDKMPLVEIIKG

SEQ ID NO: 880016 - protein, 19 aa, Mycobacterium
QMLLKIGWPAEDLAGYVDG

SEQ ID NO: 880017 - protein, 23 aa, Mycobacterium
RAGKLPVTLFTAGGIATPADAAM

SEQ ID NO: 880018 - protein, 25 aa, Mycobacterium
RAYSPRFLWMWPNARISVMGGEQAA

SEQ ID NO: 880019 - protein, 19 aa, Mycobacterium
RGYTLRLPLDVLVVASANP

SEQ ID NO: 880020 - protein, 25 aa, Mycobacterium
RIEFKLRDWLFARQRYWGEPFPIVY

SEQ ID NO: 880021 - protein, 21 aa, Mycobacterium
RLTLPAKFRDALAGGLMVTKS

SEQ ID NO: 880022 - protein, 19 aa, Mycobacterium
RPILRWRKRKWLCPSTVCT

SEQ ID NO: 880023 - protein, 25 aa, Mycobacterium
SALVVFEVMVRPLIRLSLGKRQPMR

SEQ ID NO: 880024 - protein, 23 aa, Mycobacterium
SQDRGWVILLARYQRPKAIRQSG

SEQ ID NO: 880025 - protein, 26 aa, Mycobacterium
VDDPLAMYLFDLCTLPLNLAGHCGMS

SEQ ID NO: 880026 - protein, 24 aa, Mycobacterium
VNVDGFWMLQALLDIRHVAPELRC

SEQ ID NO: 880027 - protein, 27 aa, Mycobacterium
VVLAVMPWNFPLWQAVRFAAPALMAGN

SEQ ID NO: 880028 - protein, 25 aa, Mycobacterium
WKDGEALFLRCNIWREAAENVAESL

SEQ ID NO: 880029 - protein, 21 aa, Mycobacterium
YGDKSNWWAAYALWVFTLFGH

SEQ ID NO: 880030 - protein, 18 aa, Mycobacterium
YNYPNQLALAKLAPALAA

SEQ ID NO: 880031 - protein, 28 aa, Mycobacterium
YYDKAGLWPYLEKLGFYLVGYGCTTCIG

SEQ ID NO: 880032 - protein, 18 aa, Mycobacterium
AEESAFVLLALQAPVAGD

SEQ ID NO: 880033 - protein, 18 aa, Mycobacterium
AGPDALVVVLLPDGGRGY

SEQ ID NO: 880034 - protein, 20 aa, Mycobacterium
AHWPAFRRVDFLRALRDYSQ

SEQ ID NO: 880035 - protein, 17 aa, Mycobacterium
ALCKLLLSKPDLLLLDE

SEQ ID NO: 880036 - protein, 23 aa, Mycobacterium
ANELLLYEALGLCGPGEAPKLID

SEQ ID NO: 880037 - protein, 23 aa, Mycobacterium
APAIISLTLLPKLSPRAAARYYL

SEQ ID NO: 880038 - protein, 25 aa, Mycobacterium
AQISKPMLYLYYGSKEDLFGACLNR

SEQ ID NO: 880039 - protein, 17 aa, Mycobacterium
CNPYLTFAVLLAAGLRG

SEQ ID NO: 880040 - protein, 18 aa, Mycobacterium
DEFGFFVILLAVAGNETT

SEQ ID NO: 880041 - protein, 23 aa, Mycobacterium
DFTNIYFYTVLYHALRASNRIAI

SEQ ID NO: 880042 - protein, 19 aa, Mycobacterium
DLTIGFFLHIPFPPVELFM

SEQ ID NO: 880043 - protein, 23 aa, Mycobacterium
DPANNVEFFFLRPKDIAIYVGSG

SEQ ID NO: 880044 - protein, 18 aa, Mycobacterium
EALRWAMMRGEPLVVLAD

SEQ ID NO: 880045 - protein, 17 aa, Mycobacterium
ENLFFKEKRYDLARVGR

SEQ ID NO: 880046 - protein, 28 aa, Mycobacterium
EPWVRDYLLLRGLLGTSILWFELDRDGN

SEQ ID NO: 880047 - protein, 17 aa, Mycobacterium
FPYYLETYGFHSIHGRA

SEQ ID NO: 880048 - protein, 25 aa, Mycobacterium
FVPAFSGLFAPYWRSDARGAIVGLS

SEQ ID NO: 880049 - protein, 17 aa, Mycobacterium
FYGPQFALTFPVLTHYG

SEQ ID NO: 880050 - protein, 18 aa, Mycobacterium
GCSSRFPYYLETYGFHSI

SEQ ID NO: 880051 - protein, 19 aa, Mycobacterium
GDKSNWWAAYALWVFTLFG

SEQ ID NO: 880052 - protein, 22 aa, Mycobacterium
GFYGLSYWYPFQVTALGLGPIW

SEQ ID NO: 880053 - protein, 22 aa, Mycobacterium
GHLGFFVLDGWLRPVPVGVVGE

SEQ ID NO: 880054 - protein, 27 aa, Mycobacterium
GQHISTLLLTLLFRFMKPLVENGHIFL

SEQ ID NO: 880055 - protein, 18 aa, Mycobacterium
GQPRLRPPFPAVAGLYGC

SEQ ID NO: 880056 - protein, 23 aa, Mycobacterium
GVNLTFLPFIARAVIDALKIHPN

SEQ ID NO: 880057 - protein, 17 aa, Mycobacterium
GYRLLQRLGADVAEYGF

SEQ ID NO: 880058 - protein, 18 aa, Mycobacterium
GYVLRRLLRRVIRSAKLL

SEQ ID NO: 880059 - protein, 23 aa, Mycobacterium
IELDGLRLITWRGAARAEQGLPF

SEQ ID NO: 880060 - protein, 22 aa, Mycobacterium
ILRDYLTDLFPILELGTSAKML

SEQ ID NO: 880061 - protein, 21 aa, Mycobacterium
INNVLAFPGVFRGALDAGARR

SEQ ID NO: 880062 - protein, 17 aa, Mycobacterium
IYLAGRTADWMRVDGEN

SEQ ID NO: 880063 - protein, 20 aa, Mycobacterium
KAQIYAWRKGIKTLYYIRLR

SEQ ID NO: 880064 - protein, 24 aa, Mycobacterium
KDGEALFLRCNIWREAAENVAESL

SEQ ID NO: 880065 - protein, 17 aa, Mycobacterium
KFQFITLAGFHALNYSM

SEQ ID NO: 880066 - protein, 21 aa, Mycobacterium
KRYMHHYNFPPFSTGETGRVG

SEQ ID NO: 880067 - protein, 18 aa, Mycobacterium
LADLSFADYLMWVRRDDG

SEQ ID NO: 880068 - protein, 21 aa, Mycobacterium
LADRGFFSYALWRNASDTGAD

SEQ ID NO: 880069 - protein, 20 aa, Mycobacterium
LASILPSFPALLRKQLKGAP

SEQ ID NO: 880070 - protein, 20 aa, Mycobacterium
LDVLAVAMRLLAPGGALFIG

SEQ ID NO: 880071 - protein, 18 aa, Mycobacterium
LIVIPNDRLLQMGDAAVS

SEQ ID NO: 880072 - protein, 21 aa, Mycobacterium
LPTPAVAYLTGAYDADFGVMI

SEQ ID NO: 880073 - protein, 21 aa, Mycobacterium
LRAIPWVLAWSQSRVMLPGWY

SEQ ID NO: 880074 - protein, 26 aa, Mycobacterium
LTDEAIIAFLRLLLPAGLETTYRSSG

SEQ ID NO: 880075 - protein, 17 aa, Mycobacterium
MFQAILPLRGKIINVEK

SEQ ID NO: 880076 - protein, 26 aa, Mycobacterium
NAMWALSIPIPFIKPVGAGAGGYFAP

SEQ ID NO: 880077 - protein, 17 aa, Mycobacterium
NKLFAVLGARKTWIVLR

SEQ ID NO: 880078 - protein, 25 aa, Mycobacterium
NVVNAPTQALLGRPLIGDGADGTAP

SEQ ID NO: 880079 - protein, 26 aa, Mycobacterium
PEYRTMPMVWYIPPLSPVVDAVSRDG

SEQ ID NO: 880080 - protein, 18 aa, Mycobacterium
PITTPFGLYDCDVPCDGA

SEQ ID NO: 880081 - protein, 17 aa, Mycobacterium
PYPVTVGYMYIMKLHHL

SEQ ID NO: 880082 - protein, 18 aa, Mycobacterium
QPHLTAMWYAVVDGEIWL

SEQ ID NO: 880083 - protein, 20 aa, Mycobacterium
QVRLPGFRPGKAPAKLLEAR

SEQ ID NO: 880084 - protein, 17 aa, Mycobacterium
RADVVEIFPNPAAFLRL

SEQ ID NO: 880085 - protein, 23 aa, Mycobacterium
RARRCGWFDAVIARYATRVNGIT

SEQ ID NO: 880086 - protein, 24 aa, Mycobacterium
RDAPLLHWVVFEEEYFRAGAPGRA

SEQ ID NO: 880087 - protein, 17 aa, Mycobacterium
RIVFVEHAFTWILPLMW

SEQ ID NO: 880088 - protein, 17 aa, Mycobacterium
RLLEHRLQLQRLKRTHL

SEQ ID NO: 880089 - protein, 23 aa, Mycobacterium
RRRRCGWFDAVIARYATRVNGIT

SEQ ID NO: 880090 - protein, 17 aa, Mycobacterium
RVALCKLLLSKPDLLLL

SEQ ID NO: 880091 - protein, 23 aa, Mycobacterium
SFASLVFYSSWFKLHHPAAFCAA

SEQ ID NO: 880092 - protein, 21 aa, Mycobacterium
SGCVLLPGLPYLGLEHRAAWV

SEQ ID NO: 880093 - protein, 22 aa, Mycobacterium
SGNGIPDIFGRPLIGDGADGAP

SEQ ID NO: 880094 - protein, 25 aa, Mycobacterium
SLSHPYLDTVLFLLGVTRGEIEAAD

SEQ ID NO: 880095 - protein, 20 aa, Mycobacterium
SPIVGIWHSGGARLAEGVKA

SEQ ID NO: 880096 - protein, 22 aa, Mycobacterium
SVFAFLAAYRRQLFPEEMFADL

SEQ ID NO: 880097 - protein, 18 aa, Mycobacterium
SWFKLHHPAAFCAALLRA

SEQ ID NO: 880098 - protein, 24 aa, Mycobacterium
TNLKAWLYRILTNTYINSYRKKQR

SEQ ID NO: 880099 - protein, 21 aa, Mycobacterium
TRMFTVLFALGRLPGWIAHWR

SEQ ID NO: 880100 - protein, 23 aa, Mycobacterium
VALFTGFGWWRGLTDTDVWAWCH

SEQ ID NO: 880101 - protein, 29 aa, Mycobacterium
VGQIIPWNFPILMAVWKLAPALAAGNAVV

SEQ ID NO: 880102 - protein, 26 aa, Mycobacterium
VLIIGAWNYPFYLTLGPAVGAIAAGN

SEQ ID NO: 880103 - protein, 19 aa, Mycobacterium
VREQLLILPIIGVLDSQRA

SEQ ID NO: 880104 - protein, 17 aa, Mycobacterium
VTGNYRAWRHFIAMRAS

SEQ ID NO: 880105 - protein, 18 aa, Mycobacterium
VTGNYRAWRHFIAMRASE

SEQ ID NO: 880106 - protein, 23 aa, Mycobacterium
VVSIPTMILFKDGQPVKRIVGAK

SEQ ID NO: 880107 - protein, 19 aa, Mycobacterium
WAGVPFYLRTGKRLGRRVT

SEQ ID NO: 880108 - protein, 21 aa, Mycobacterium
WGPTVPLVGAPWFALSERNSP

SEQ ID NO: 880109 - protein, 17 aa, Mycobacterium
YADWIFCLVRTDPQAPK

SEQ ID NO: 880110 - protein, 17 aa, Mycobacterium
YDMSMARLLYWGCDVWL

SEQ ID NO: 880111 - protein, 20 aa, Mycobacterium
YGDMGLALPILAPGGVASAL

SEQ ID NO: 880112 - protein, 19 aa, Mycobacterium
YPVLVRPSYVLGGRGMEIV

SEQ ID NO: 880113 - protein, 21 aa, Mycobacterium
YTFMDLWFYHCNPRHHSIALT

SEQ ID NO: 880114 - protein, 17 aa, Mycobacterium
AADLARMYIRYAERHGW

SEQ ID NO: 880115 - protein, 21 aa, Mycobacterium
AAGDGFARYWLHNGWVTMGGE

SEQ ID NO: 880116 - protein, 24 aa, Mycobacterium
AAHHRLFSHVPWLSSQLLGAVEAY

SEQ ID NO: 880117 - protein, 25 aa, Mycobacterium
AANPKLFFQLYWLGDRDAIAARVER

SEQ ID NO: 880118 - protein, 17 aa, Mycobacterium
AAVLHRTAERRAATFST

SEQ ID NO: 880119 - protein, 19 aa, Mycobacterium
ADECRVFLSMLGIGPAKLD

SEQ ID NO: 880120 - protein, 17 aa, Mycobacterium
ADNDEWLKWLLVRRGSG

SEQ ID NO: 880121 - protein, 27 aa, Mycobacterium
ADSWIQIEQFRLLVLRTAWLIDKHHDY

SEQ ID NO: 880122 - protein, 23 aa, Mycobacterium
AEIYVPFSWFEPMWLENLGFAPE

SEQ ID NO: 880123 - protein, 21 aa, Mycobacterium
AELRLPLVLVIDTAGPALSAD

SEQ ID NO: 880124 - protein, 17 aa, Mycobacterium
AFHDQFVAALTAGGGLY

SEQ ID NO: 880125 - protein, 19 aa, Mycobacterium
AFNFPVAVWAWNTAVALVC

SEQ ID NO: 880126 - protein, 17 aa, Mycobacterium
AGHWLLARLGKRVLRPG

SEQ ID NO: 880127 - protein, 23 aa, Mycobacterium
AGVDTFFVATAPRYSFVSSSLAK

SEQ ID NO: 880128 - protein, 27 aa, Mycobacterium
AITPWNFPVVLAFMKLAPALVAGNTVV

SEQ ID NO: 880129 - protein, 24 aa, Mycobacterium
AKAAPLWRVLVALSIRHVGPTAAR

SEQ ID NO: 880130 - protein, 24 aa, Mycobacterium
AKRITAILPFYPYARQDKKHRGRE

SEQ ID NO: 880131 - protein, 21 aa, Mycobacterium
ALKPWYGYFCKRPCFHDEYLQ

SEQ ID NO: 880132 - protein, 20 aa, Mycobacterium
ALPTCPPLVIWDLTTPQPPQ

SEQ ID NO: 880133 - protein, 17 aa, Mycobacterium
ALSTYRFPTGWFIVAFG

SEQ ID NO: 880134 - protein, 17 aa, Mycobacterium
ALVVVLLPDGGRGYMSK

SEQ ID NO: 880135 - protein, 21 aa, Mycobacterium
AMTPWIWPTMHLNPPQWIQPI

SEQ ID NO: 880136 - protein, 21 aa, Mycobacterium
ANLAFFVLDGWLRPVPVGVAG

SEQ ID NO: 880137 - protein, 20 aa, Mycobacterium
AQCTFGMWVNLLDAGGYAGR

SEQ ID NO: 880138 - protein, 19 aa, Mycobacterium
AQPWSLRYPLVDGQGNFGS

SEQ ID NO: 880139 - protein, 26 aa, Mycobacterium
ARFRDALFPVWRYHPFFTNTDLPTAE

SEQ ID NO: 880140 - protein, 21 aa, Mycobacterium
ARKLAMEFARFLGLPPVRRMN

SEQ ID NO: 880141 - protein, 18 aa, Mycobacterium
ARLHTPLPLLAFTAWPEV

SEQ ID NO: 880142 - protein, 22 aa, Mycobacterium
ARNSGMPVLFWLDPYRPHENEL

SEQ ID NO: 880143 - protein, 26 aa, Mycobacterium
ARTRIRPHFFPFTEPSAEVDVWFVGK

SEQ ID NO: 880144 - protein, 22 aa, Mycobacterium
ASCKFMKMITPAALLRCLVEGA

SEQ ID NO: 880145 - protein, 22 aa, Mycobacterium
ASTPLFFAQAIGRFVRSRRPGE

SEQ ID NO: 880146 - protein, 27 aa, Mycobacterium
ATHNEPMIPIYIFYSMFGFQRTGDGLW

SEQ ID NO: 880147 - protein, 21 aa, Mycobacterium
ATHRFLAHLPGYQGWQWAVVV

SEQ ID NO: 880148 - protein, 17 aa, Mycobacterium
ATLLDYFPEDFLLVIDE

SEQ ID NO: 880149 - protein, 17 aa, Mycobacterium
ATNLLLMRGMIGKPGAG

SEQ ID NO: 880150 - protein, 22 aa, Mycobacterium
AVAMLVAIFRARPSPFYIMDEV

SEQ ID NO: 880151 - protein, 21 aa, Mycobacterium
AVEVALYRLLESWGMRPGLVM

SEQ ID NO: 880152 - protein, 21 aa, Mycobacterium
AVKALWDTILPFAGYAFNKSH

SEQ ID NO: 880153 - protein, 25 aa, Mycobacterium
AVPHPKWWFDLLTTEPLAFASLDRW

SEQ ID NO: 880154 - protein, 18 aa, Mycobacterium
AVPPAPPYYPVRTAAAQI

SEQ ID NO: 880155 - protein, 27 aa, Mycobacterium
AYAKKFRFPTFLGAFKYYTSYTLKTFD

SEQ ID NO: 880156 - protein, 20 aa, Mycobacterium
AYNYPNQLALAKLAPALAAG

SEQ ID NO: 880157 - protein, 17 aa, Mycobacterium
DADFFGFPPLAAQVLDP

SEQ ID NO: 880158 - protein, 17 aa, Mycobacterium
DAFIFGPPPLGPGAPPL

SEQ ID NO: 880159 - protein, 20 aa, Mycobacterium
DAQTPTLLFPFAAPRVVGDL

SEQ ID NO: 880160 - protein, 17 aa, Mycobacterium
DAQYWRRHSRQPVQFAE

SEQ ID NO: 880161 - protein, 17 aa, Mycobacterium
DATWRWAAMIATAWQAI

SEQ ID NO: 880162 - protein, 29 aa, Mycobacterium
DAYDAYLRLHLLSHRLVAPHGLNAGGLFG

SEQ ID NO: 880163 - protein, 23 aa, Mycobacterium
DDALNLPWLAMGATGFISVISHV

SEQ ID NO: 880164 - protein, 25 aa, Mycobacterium
DDARWDAVLAVNLLAPLRLTEGLVG

SEQ ID NO: 880165 - protein, 22 aa, Mycobacterium
DELYRRWTGLLSYRYIGRKHSS

SEQ ID NO: 880166 - protein, 24 aa, Mycobacterium
DFTNIYFYTVLFHALRASNKIAIE

SEQ ID NO: 880167 - protein, 25 aa, Mycobacterium
DHAGKWRVVFFWPKDFTFVCPTEIA

SEQ ID NO: 880168 - protein, 23 aa, Mycobacterium
DKVAKWWIPERWSFVSDIPRTSV

SEQ ID NO: 880169 - protein, 18 aa, Mycobacterium
DLINVRYLSGFSGSNGAL

SEQ ID NO: 880170 - protein, 22 aa, Mycobacterium
DLRAIPWVLAWSQSRVMLPGWY

SEQ ID NO: 880171 - protein, 21 aa, Mycobacterium
DLVSMFAPITRWAAGVPTARA

SEQ ID NO: 880172 - protein, 17 aa, Mycobacterium
DMLLLIVAALDQSALVS

SEQ ID NO: 880173 - protein, 19 aa, Mycobacterium
DNEAKWFWFEGNFGAYEEN

SEQ ID NO: 880174 - protein, 22 aa, Mycobacterium
DPLLDLGWLLATWRQPDGSSVF

SEQ ID NO: 880175 - protein, 17 aa, Mycobacterium
DRHLTLDGLRLVFERNR

SEQ ID NO: 880176 - protein, 23 aa, Mycobacterium
DTKMGLFPFRRNLSFYGVDLGML

SEQ ID NO: 880177 - protein, 23 aa, Mycobacterium
EDFIGIHFFSPVDKMPLVEIIKG

SEQ ID NO: 880178 - protein, 17 aa, Mycobacterium
EEFLRYFTPAPGDGRTF

SEQ ID NO: 880179 - protein, 23 aa, Mycobacterium
EEIYSFLRLLLPAGVETTYRSLG

SEQ ID NO: 880180 - protein, 25 aa, Mycobacterium
EERDIRFVRLWFTDVLGFLKSVAIA

SEQ ID NO: 880181 - protein, 26 aa, Mycobacterium
EEVKFGIEPWFRYFQKVAAFPQMTMP

SEQ ID NO: 880182 - protein, 17 aa, Mycobacterium
EFDADFFGFPPLAAQVL

SEQ ID NO: 880183 - protein, 23 aa, Mycobacterium
EFERRFFPIYPASTKVQSWDIFK

SEQ ID NO: 880184 - protein, 26 aa, Mycobacterium
EFYKWTQWIFLQIYNAWFDTAANKAR

SEQ ID NO: 880185 - protein, 28 aa, Mycobacterium
EGDRGLSWLPFFHDMGLITALLSPVLGH

SEQ ID NO: 880186 - protein, 24 aa, Mycobacterium
EGDVGWIPYFLWRAEHVYNRHSGW

SEQ ID NO: 880187 - protein, 23 aa, Mycobacterium
EGPRWFEGLLWFSDMLGEAVHTS

SEQ ID NO: 880188 - protein, 17 aa, Mycobacterium
EGRGFYHLMTNLPSERL

SEQ ID NO: 880189 - protein, 18 aa, Mycobacterium
EHAFSWILPLMWRMDAIY

SEQ ID NO: 880190 - protein, 24 aa, Mycobacterium
EHAVLHLLYARFWHKVLYDLGHVS

SEQ ID NO: 880191 - protein, 23 aa, Mycobacterium
EHAVLHLLYSRFWHKVLYDLGHV

SEQ ID NO: 880192 - protein, 22 aa, Mycobacterium
EIHAMWRINELLNWQVAAAGED

SEQ ID NO: 880193 - protein, 20 aa, Mycobacterium
EINSLRMFTGAGSAPMLQAA

SEQ ID NO: 880194 - protein, 19 aa, Mycobacterium
ELDGLRLITWRGASRAEQG

SEQ ID NO: 880195 - protein, 17 aa, Mycobacterium
ELLSPKWQKMWKPVVCA

SEQ ID NO: 880196 - protein, 28 aa, Mycobacterium
ELSDGTLRFLLWAAALLSPSPPSLMVLN

SEQ ID NO: 880197 - protein, 24 aa, Mycobacterium
ERDIRFVRLWFTDVLGFLKSVAIA

SEQ ID NO: 880198 - protein, 21 aa, Mycobacterium
ERFAVWLIFELLAVTLVDAKP

SEQ ID NO: 880199 - protein, 17 aa, Mycobacterium
ERRWGQLMLALYRAGRQ

SEQ ID NO: 880200 - protein, 24 aa, Mycobacterium
ESAELPLFRYIGGPNAHILPVPMM

SEQ ID NO: 880201 - protein, 25 aa, Mycobacterium
EVGKLADLVLWEPAFFGVRPHAVIK

SEQ ID NO: 880202 - protein, 25 aa, Mycobacterium
EVGKLADLVLWEPAFFGVRPHAVVK

SEQ ID NO: 880203 - protein, 25 aa, Mycobacterium
EVMPEDLIKFGLIPEFIGRLPVVAS

SEQ ID NO: 880204 - protein, 20 aa, Mycobacterium
EVYKLRQPVLLIWGREDRVN

SEQ ID NO: 880205 - protein, 17 aa, Mycobacterium
FDRLLGLRFGAAAVRAL

SEQ ID NO: 880206 - protein, 18 aa, Mycobacterium
FGELRWAVSGAAPIPKET

SEQ ID NO: 880207 - protein, 21 aa, Mycobacterium
FGPSTGLWLLLLAKGGGDTEV

SEQ ID NO: 880208 - protein, 23 aa, Mycobacterium
FMVRNTYIYPPKPSMRIISDIFG

SEQ ID NO: 880209 - protein, 17 aa, Mycobacterium
FPALLRKQLKGAPMPAP

SEQ ID NO: 880210 - protein, 18 aa, Mycobacterium
FPSWPLAHPFRRVAHNGE

SEQ ID NO: 880211 - protein, 21 aa, Mycobacterium
FPYPVTVGYMYILKLHHLVDD

SEQ ID NO: 880212 - protein, 17 aa, Mycobacterium
FQRAYKELAKQVRLPGF

SEQ ID NO: 880213 - protein, 17 aa, Mycobacterium
FRDYGYRRLRAKARLKF

SEQ ID NO: 880214 - protein, 21 aa, Mycobacterium
FTNDPLLQFRNFSYLDTQLIR

SEQ ID NO: 880215 - protein, 25 aa, Mycobacterium
FWFDPLCPWCWITSRWILEVEKVRD

SEQ ID NO: 880216 - protein, 21 aa, Mycobacterium
GAFWANDLLWLMDTRYLREHS

SEQ ID NO: 880217 - protein, 24 aa, Mycobacterium
GAMAYLVKPFTISDLIPAIELAVS

SEQ ID NO: 880218 - protein, 18 aa, Mycobacterium
GAMGFKFQFITLAGFHAL

SEQ ID NO: 880219 - protein, 22 aa, Mycobacterium
GAMGFKFQFITLAGFHALNYSM

SEQ ID NO: 880220 - protein, 24 aa, Mycobacterium
GDLRGRFRWWGLYTQRKPGYDGTW

SEQ ID NO: 880221 - protein, 20 aa, Mycobacterium
GELLDPLVNAPFESLTGREL

SEQ ID NO: 880222 - protein, 17 aa, Mycobacterium
GLQIEAPIPLSAKLELL

SEQ ID NO: 880223 - protein, 19 aa, Mycobacterium
GLRVVPWLWNAPPTDRRYY

SEQ ID NO: 880224 - protein, 25 aa, Mycobacterium
GLTMRFLLVELPNERWRFIITAHHI

SEQ ID NO: 880225 - protein, 17 aa, Mycobacterium
GMVFQRPNPFPAMSIRD

SEQ ID NO: 880226 - protein, 23 aa, Mycobacterium
GNAGIFDYFAPLVGFDGADLSSA

SEQ ID NO: 880227 - protein, 17 aa, Mycobacterium
GPDGKDLAILLLRLGRG

SEQ ID NO: 880228 - protein, 26 aa, Mycobacterium
GRAYSPRFLWMWPNARISVMGGEQAA

SEQ ID NO: 880229 - protein, 22 aa, Mycobacterium
GSDAMRWFLMASPILRGGNLIV

SEQ ID NO: 880230 - protein, 17 aa, Mycobacterium
GSSVLWLDAGRPAVFVG

SEQ ID NO: 880231 - protein, 22 aa, Mycobacterium
GSTPWMLRPLLDLLAHGAPVTI

SEQ ID NO: 880232 - protein, 21 aa, Mycobacterium
GTGTGGIQGAGGQGGTGGAGG

SEQ ID NO: 880233 - protein, 24 aa, Mycobacterium
GVARSGFYFYFDSKYAVLAVILAE

SEQ ID NO: 880234 - protein, 21 aa, Mycobacterium
GVVRPDLVIGWWAAPTILEHG

SEQ ID NO: 880235 - protein, 18 aa, Mycobacterium
HGWIHNELRRRCGGPPIA

SEQ ID NO: 880236 - protein, 18 aa, Mycobacterium
HGWIHNELRRRCGGPPVA

SEQ ID NO: 880237 - protein, 19 aa, Mycobacterium
HHCAWPLHRRFGIAATARA

SEQ ID NO: 880238 - protein, 24 aa, Mycobacterium
HHSRRGLLLLVGRRRRLLKYVAQI

SEQ ID NO: 880239 - protein, 19 aa, Mycobacterium
HLPELWRRFTITLRRTLRR

SEQ ID NO: 880240 - protein, 22 aa, Mycobacterium
HMALWRKRFQREWGEPARYIWK

SEQ ID NO: 880241 - protein, 30 aa, Mycobacterium
HMWFGDLVTMRWWDDLWLNESFATFASVLC

SEQ ID NO: 880242 - protein, 30 aa, Mycobacterium; identical to SEQ ID NO: 227588

SEQ ID NO: 880243 - protein, 23 aa, Mycobacterium
HSRRGLLLLVGRRRRLIKYISQI

SEQ ID NO: 880244 - protein, 17 aa, Mycobacterium
HVFLRIATDWDFVEVRR

SEQ ID NO: 880245 - protein, 20 aa, Mycobacterium
HVLFTWHLPELWRRFTITLR

SEQ ID NO: 880246 - protein, 18 aa, Mycobacterium
IADQLARRRLGYGRGARM

SEQ ID NO: 880247 - protein, 18 aa, Mycobacterium
IAGPFHFYHCSIPCEGGG

SEQ ID NO: 880248 - protein, 22 aa, Mycobacterium
IDALLLVRLPYHLSVLTQAAAR

SEQ ID NO: 880249 - protein, 20 aa, Mycobacterium
IDIALLYDAFASNPAMILEE

SEQ ID NO: 880250 - protein, 23 aa, Mycobacterium
IDPRTRWLLRELVYALLVKKDHA

SEQ ID NO: 880251 - protein, 19 aa, Mycobacterium
IENGSYFVYRLIKRLKKSA

SEQ ID NO: 880252 - protein, 17 aa, Mycobacterium
IGWTCRDVWWAATQDPR

SEQ ID NO: 880253 - protein, 19 aa, Mycobacterium
IHLTGLDKTFPLYPTLDDA

SEQ ID NO: 880254 - protein, 17 aa, Mycobacterium
IIDMWLPLSWSLNMVNR

SEQ ID NO: 880255 - protein, 19 aa, Mycobacterium
IKNLLPMFAVFKPTVVVSV

SEQ ID NO: 880256 - protein, 17 aa, Mycobacterium
ILRDYLTDLFPILELGT

SEQ ID NO: 880257 - protein, 23 aa, Mycobacterium
IRALYTFKRVAWWPYSVAMRQVN

SEQ ID NO: 880258 - protein, 22 aa, Mycobacterium
ITPWNFPHQINLAKLGPALAAG

SEQ ID NO: 880259 - protein, 19 aa, Mycobacterium
IVIGGGMCFTFLAAQGYSV

SEQ ID NO: 880260 - protein, 26 aa, Mycobacterium
IVPWNVPQFLIMPKLIPALIAGCTVI

SEQ ID NO: 880261 - protein, 21 aa, Mycobacterium
KAGFDLAMLRAVRAAVTVPVI

SEQ ID NO: 880262 - protein, 24 aa, Mycobacterium
KAVAAFRLALPRTMLRFAGGREIT

SEQ ID NO: 880263 - protein, 24 aa, Mycobacterium
KAVGAFRLALPRTMLRFAGGREIT

SEQ ID NO: 880264 - protein, 19 aa, Mycobacterium
KETLRLHPPLIILMRVAKG

SEQ ID NO: 880265 - protein, 22 aa, Mycobacterium
KEWHQYWIDTRLQWYVELGIDP

SEQ ID NO: 880266 - protein, 19 aa, Mycobacterium
KFLRPLFTGEQIYCQLFSE

SEQ ID NO: 880267 - protein, 20 aa, Mycobacterium
KGLWVLARYDDGRPSQLRLD

SEQ ID NO: 880268 - protein, 23 aa, Mycobacterium
KIDPYLRPLYDALYDMMDPELIP

SEQ ID NO: 880269 - protein, 17 aa, Mycobacterium
KLAAWLRGQGHTPLLVA

SEQ ID NO: 880270 - protein, 20 aa, Mycobacterium
KLAIVYLTYKLADGRVVLHG

SEQ ID NO: 880271 - protein, 18 aa, Mycobacterium
KLFYQPLLESIGPAGLEI

SEQ ID NO: 880272 - protein, 20 aa, Mycobacterium
KLRIVKYLAYGWSSLRSRPA

SEQ ID NO: 880273 - protein, 19 aa, Mycobacterium
KLWVDMAHFAGLVAAGLHP

SEQ ID NO: 880274 - protein, 19 aa, Mycobacterium
KMLYDNALLLRAYAHWARR

SEQ ID NO: 880275 - protein, 22 aa, Mycobacterium
KRHEILQLSLLKPKIAILDETD

SEQ ID NO: 880276 - protein, 20 aa, Mycobacterium
KRKIPLLFLQNIAGFMVGRD

SEQ ID NO: 880277 - protein, 17 aa, Mycobacterium
KRPEDFRFLIRLARQQG

SEQ ID NO: 880278 - protein, 23 aa, Mycobacterium
KVKHRTFHYPGGLVDFVKHINRT

SEQ ID NO: 880279 - protein, 24 aa, Mycobacterium
LCRRWYPRIYFGQPPKGLAHRALA

SEQ ID NO: 880280 - protein, 27 aa, Mycobacterium
LCSCFPWPVLGLPPYWYKDPVFRARAA

SEQ ID NO: 880281 - protein, 20 aa, Mycobacterium
LCYAGPFFRYERPQAGRYRQ

SEQ ID NO: 880282 - protein, 17 aa, Mycobacterium
LDRLLMPNYLLSALQAI

SEQ ID NO: 880283 - protein, 18 aa, Mycobacterium
LEAPLKQIAFNGGLEPGV

SEQ ID NO: 880284 - protein, 30 aa, Mycobacterium; identical to SEQ ID NO: 135986

SEQ ID NO: 880285 - protein, 23 aa, Mycobacterium
LGQIKAIWRINELLNWQVAASGE

SEQ ID NO: 880286 - protein, 19 aa, Mycobacterium
LGTMGLILRGSDELKKQVL

SEQ ID NO: 880287 - protein, 18 aa, Mycobacterium
LHLPWQWGAEWFLDQLVD

SEQ ID NO: 880288 - protein, 23 aa, Mycobacterium
LIDRPMEFLGNLVLLIVGGNDTT

SEQ ID NO: 880289 - protein, 19 aa, Mycobacterium
LIRAGYIRPVAPGLYSWLP

SEQ ID NO: 880290 - protein, 26 aa, Mycobacterium
LKCLCRFHHLLKTFWTGPRGWTDRQH

SEQ ID NO: 880291 - protein, 20 aa, Mycobacterium
LKHRLARSLFLYALCNGWIG

SEQ ID NO: 880292 - protein, 21 aa, Mycobacterium
LLAQKFVAPLLDRYLGRTGYD

SEQ ID NO: 880293 - protein, 23 aa, Mycobacterium
LLARLFGLPYFPVTPLFPLAGPA

SEQ ID NO: 880294 - protein, 19 aa, Mycobacterium
LLKLPIPVQRRVAAGVLSA

SEQ ID NO: 880295 - protein, 25 aa, Mycobacterium
LLSDGPVVLFFYPAAMTPGCTKEAC

SEQ ID NO: 880296 - protein, 17 aa, Mycobacterium
LLTVAWPGAHLGPMGLE

SEQ ID NO: 880297 - protein, 23 aa, Mycobacterium
LLVTPALLWLFIRGVRFMYSVDP

SEQ ID NO: 880298 - protein, 18 aa, Mycobacterium
LPCHGFWANAAWLEIVLA

SEQ ID NO: 880299 - protein, 20 aa, Mycobacterium
LPEQGAWLQPFRPLSSLLTS

SEQ ID NO: 880300 - protein, 20 aa, Mycobacterium
LPTPAVAYLTSAYDADFGVM

SEQ ID NO: 880301 - protein, 20 aa, Mycobacterium
LQIVLPTLLRRVPTLRLAVP

SEQ ID NO: 880302 - protein, 22 aa, Mycobacterium
LRDLLKFDFYFADSAAFRANIA

SEQ ID NO: 880303 - protein, 18 aa, Mycobacterium
LRNRALLELLYSTGARIS

SEQ ID NO: 880304 - protein, 26 aa, Mycobacterium
LRTEKSVMFIIPWGSHWIIGTTDTDW

SEQ ID NO: 880305 - protein, 21 aa, Mycobacterium
LSDAWVWDMYRPARFVKQVRV

SEQ ID NO: 880306 - protein, 24 aa, Mycobacterium
LSGAIRLIYPRETLWRPPVLTMSA

SEQ ID NO: 880307 - protein, 20 aa, Mycobacterium
LTLTELWRSYGIQPDLVIGH

SEQ ID NO: 880308 - protein, 18 aa, Mycobacterium
LTREVLGAGIPLFGICFG

SEQ ID NO: 880309 - protein, 18 aa, Mycobacterium
LWDTILPFAGYAFNKSHA

SEQ ID NO: 880310 - protein, 18 aa, Mycobacterium
LYIQLYLGGFGLELSDIE

SEQ ID NO: 880311 - protein, 19 aa, Mycobacterium
MGDCDQLMPEYLRFVKGVV

SEQ ID NO: 880312 - protein, 18 aa, Mycobacterium
MGIDRLLMALTGLSIRET

SEQ ID NO: 880313 - protein, 25 aa, Mycobacterium
MTGWQRLHFRFGIPAPLLEPLAVER

SEQ ID NO: 880314 - protein, 18 aa, Mycobacterium
MWALSIPVPFTKPVGAGA

SEQ ID NO: 880315 - protein, 21 aa, Mycobacterium
NAPALLGLIGLWYSNFFGAQS

SEQ ID NO: 880316 - protein, 19 aa, Mycobacterium
NFPDVLFIAGKYQVKIPPP

SEQ ID NO: 880317 - protein, 18 aa, Mycobacterium
NGERYQFLRWGQGAFRDF

SEQ ID NO: 880318 - protein, 23 aa, Mycobacterium
NLKAWLYRILTNTYINSYRKKQR

SEQ ID NO: 880319 - protein, 17 aa, Mycobacterium
NLLLMRGMIGKPGAGVC

SEQ ID NO: 880320 - protein, 23 aa, Mycobacterium
NLLVGPLQFNSKWQSPVLASPFT

SEQ ID NO: 880321 - protein, 26 aa, Mycobacterium
NLPITLWPGMKIGQLCILRLTSPAEH

SEQ ID NO: 880322 - protein, 28 aa, Mycobacterium
NRAFTPWYLVRYWRLLKFKLANPHIITR

SEQ ID NO: 880323 - protein, 27 aa, Mycobacterium
NRAYTPWYLVRYWRLLKFKLANPHIIT

SEQ ID NO: 880324 - protein, 28 aa, Mycobacterium
NRAYTPWYLVRYWRLLKFKLANPHIITR

SEQ ID NO: 880325 - protein, 26 aa, Mycobacterium
PADPPFEGMWWLYVPMAFDDFAIVLI

SEQ ID NO: 880326 - protein, 22 aa, Mycobacterium
PAHWHDFFASWPLLYVSHLMSL

SEQ ID NO: 880327 - protein, 26 aa, Mycobacterium
PDAFDCSGLIKWAFLQNGKSLPRSSQ

SEQ ID NO: 880328 - protein, 24 aa, Mycobacterium
PDDLNFLWLPLAHAFGKVMLALPL

SEQ ID NO: 880329 - protein, 23 aa, Mycobacterium
PDGTPFPTLYYLTHPALTAAASR

SEQ ID NO: 880330 - protein, 19 aa, Mycobacterium
PEPALRLVAVARLRLLCRA

SEQ ID NO: 880331 - protein, 18 aa, Mycobacterium
PGENIPAWLIFDQQYRDR

SEQ ID NO: 880332 - protein, 24 aa, Mycobacterium
PHGRDELWRFTPLKRLRGLHDGSA

SEQ ID NO: 880333 - protein, 26 aa, Mycobacterium
PIGVCGLITPWNWPINQVAVKVYPAL

SEQ ID NO: 880334 - protein, 23 aa, Mycobacterium
PILPQQALLYRLCGDRNPLHSDP

SEQ ID NO: 880335 - protein, 23 aa, Mycobacterium
PKASVMTHLRWLKALAAFGGIGL

SEQ ID NO: 880336 - protein, 18 aa, Mycobacterium
PKFTGFSPVLWALISGES

SEQ ID NO: 880337 - protein, 20 aa, Mycobacterium
PLADYLFPAAKILDPFGLEN

SEQ ID NO: 880338 - protein, 18 aa, Mycobacterium
PLVVLIWEDGGYGLIEWK

SEQ ID NO: 880339 - protein, 19 aa, Mycobacterium
PMFLLYDYSFLPEGATSKA

SEQ ID NO: 880340 - protein, 20 aa, Mycobacterium
PPTRVWGVPAAGLWAHRLGD

SEQ ID NO: 880341 - protein, 20 aa, Mycobacterium
PPVLLIMGLGAQLLLWRTAF

SEQ ID NO: 880342 - protein, 25 aa, Mycobacterium
PSFRYYGWGPRMWWWAQTMGIRKFQ

SEQ ID NO: 880343 - protein, 26 aa, Mycobacterium
PSFRYYGWGPRMWWWAQTMGIRKFQE

SEQ ID NO: 880344 - protein, 22 aa, Mycobacterium
PSQLALAWLLKRSPVMLPIPGT

SEQ ID NO: 880345 - protein, 24 aa, Mycobacterium
PTEFTLLRYFIINAGTVLSKPKIL

SEQ ID NO: 880346 - protein, 18 aa, Mycobacterium
PTPQPVLPRPMFGAAPAA

SEQ ID NO: 880347 - protein, 22 aa, Mycobacterium
PTRMFTVLFALGRLPGWIAHWR

SEQ ID NO: 880348 - protein, 21 aa, Mycobacterium
PTSVPAFRPGAQFKAVVSGAQ

SEQ ID NO: 880349 - protein, 17 aa, Mycobacterium
PVFIASDPVWAKKFADA

SEQ ID NO: 880350 - protein, 27 aa, Mycobacterium
PVLTTAAIGMFFPGPYRVPKASFNYKT

SEQ ID NO: 880351 - protein, 18 aa, Mycobacterium
PVYFALLARRRMDLYGAT

SEQ ID NO: 880352 - protein, 19 aa, Mycobacterium
QAVAPLRYFNDRAGSIYAG

SEQ ID NO: 880353 - protein, 19 aa, Mycobacterium
QDVLLFIDNIFRFTQAGSE

SEQ ID NO: 880354 - protein, 22 aa, Mycobacterium
QEVAALLRWLGNGNFLLLGYQP

SEQ ID NO: 880355 - protein, 17 aa, Mycobacterium
QFLRWGQGAFRDFKVVP

SEQ ID NO: 880356 - protein, 24 aa, Mycobacterium
QFNALFLDPYLWKLQVGGKRLVQK

SEQ ID NO: 880357 - protein, 17 aa, Mycobacterium
QGQWWYYARTFEGKQYR

SEQ ID NO: 880358 - protein, 23 aa, Mycobacterium
QHQMWAAQFIKYEKPRTWLNSGG

SEQ ID NO: 880359 - protein, 19 aa, Mycobacterium
QHYALFPHMTVWDNVAYGP

SEQ ID NO: 880360 - protein, 20 aa, Mycobacterium
QIGYSLLFRLASGSLLGPDR

SEQ ID NO: 880361 - protein, 17 aa, Mycobacterium
QLELGGKAPFVVFDDAD

SEQ ID NO: 880362 - protein, 17 aa, Mycobacterium
QLPLIWKRLVDAGMESG

SEQ ID NO: 880363 - protein, 24 aa, Mycobacterium
QRSDGRWIWRWDPAFISSNFDVLQ

SEQ ID NO: 880364 - protein, 21 aa, Mycobacterium
QSPIVGIWHSGGARLAEGVKA

SEQ ID NO: 880365 - protein, 19 aa, Mycobacterium
QTIIDMWLPLSWSLNMVNR

SEQ ID NO: 880366 - protein, 19 aa, Mycobacterium
QVWAMRYTLERAMRGQDTI

SEQ ID NO: 880367 - protein, 25 aa, Mycobacterium
RAGIPTLILWIWIEQPIWLAQIKRL

SEQ ID NO: 880368 - protein, 25 aa, Mycobacterium
RAKNMFALGLLSWMYGRPIETSEKF

SEQ ID NO: 880369 - protein, 29 aa, Mycobacterium
RASQTWRYPPFFHALLDAGVYPPCSAFEA

SEQ ID NO: 880370 - protein, 27 aa, Mycobacterium
RAWRLPMGFTAWPPWRPGVLFTGDSLG

SEQ ID NO: 880371 - protein, 23 aa, Mycobacterium
RDIRFVRLWFTDVLGYLKSVAIA

SEQ ID NO: 880372 - protein, 24 aa, Mycobacterium
RERGYAYFLYPPQAPLTETAYDRL

SEQ ID NO: 880373 - protein, 18 aa, Mycobacterium
RFGRIIFIGSVSGMWGIG

SEQ ID NO: 880374 - protein, 19 aa, Mycobacterium
RFHAVYWPAFLMSAGIELP

SEQ ID NO: 880375 - protein, 21 aa, Mycobacterium
RGFYHLMTNLPSERLSIAISA

SEQ ID NO: 880376 - protein, 24 aa, Mycobacterium
RGSPWATPLSWLVPPRVAMQILLT

SEQ ID NO: 880377 - protein, 24 aa, Mycobacterium
RIDPRTRWLLRELVYALLVKKDHA

SEQ ID NO: 880378 - protein, 17 aa, Mycobacterium
RIFAGAGSAPMLEAAVA

SEQ ID NO: 880379 - protein, 18 aa, Mycobacterium
RIVLFRKPIERRAKDTIE

SEQ ID NO: 880380 - protein, 22 aa, Mycobacterium
RLADAWVWDMYRPARFVKQVRV

SEQ ID NO: 880381 - protein, 24 aa, Mycobacterium
RLALSLILILPFYETVRLAEDMAV

SEQ ID NO: 880382 - protein, 17 aa, Mycobacterium
RLHPPLIILMRVAKGEF

SEQ ID NO: 880383 - protein, 17 aa, Mycobacterium
RLRPPFPAVAGLYGCPT

SEQ ID NO: 880384 - protein, 22 aa, Mycobacterium
RLTLPAKFRDALAGGLMVTKSQ

SEQ ID NO: 880385 - protein, 17 aa, Mycobacterium
RMEIALTYIFGVGRTRS

SEQ ID NO: 880386 - protein, 17 aa, Mycobacterium
RMFTGAGSAPMLQAAAA

SEQ ID NO: 880387 - protein, 17 aa, Mycobacterium
RMLYDYFQQLFAQVTNP

SEQ ID NO: 880388 - protein, 21 aa, Mycobacterium
RNAKLLDVLLAKGLDAPFSCR

SEQ ID NO: 880389 - protein, 28 aa, Mycobacterium
RQKRLMTLIHLWLVHRFKADAVYYVTPT

SEQ ID NO: 880390 - protein, 25 aa, Mycobacterium
RQRDDGRWIWRWDPAFITSNFQFLQ

SEQ ID NO: 880391 - protein, 20 aa, Mycobacterium
RREIGVPTVFNLLGPLTNPA

SEQ ID NO: 880392 - protein, 18 aa, Mycobacterium
RRPDLLVSLLTYWQRHPS

SEQ ID NO: 880393 - protein, 21 aa, Mycobacterium
RRRVALCKLLLSKPDLLLLDE

SEQ ID NO: 880394 - protein, 17 aa, Mycobacterium
RRVFATCRRLGLGTVAV

SEQ ID NO: 880395 - protein, 17 aa, Mycobacterium
RRYPLWEMYFVEGLANH

SEQ ID NO: 880396 - protein, 18 aa, Mycobacterium
RRYRTWIRWNAAIMVHRA

SEQ ID NO: 880397 - protein, 19 aa, Mycobacterium
RSRTHHYPFRLLAPKTMRT

SEQ ID NO: 880398 - protein, 26 aa, Mycobacterium
RSRTHHYPFRLLPPKTMRALIGRICE

SEQ ID NO: 880399 - protein, 26 aa, Mycobacterium
RSRTHHYPFRLLPPRTMRGLIGRICE

SEQ ID NO: 880400 - protein, 25 aa, Mycobacterium
RTEKSVLFVIPWGTHWIIGTTDTDW

SEQ ID NO: 880401 - protein, 17 aa, Mycobacterium
RVEDIYLPYKPKRRTKA

SEQ ID NO: 880402 - protein, 17 aa, Mycobacterium
RVGLLPTWGLSVRLPQK

SEQ ID NO: 880403 - protein, 20 aa, Mycobacterium
RVLAALHGWLAPLPPEGASA

SEQ ID NO: 880404 - protein, 22 aa, Mycobacterium
RVNGHLHLPALRAALEREVAEH

SEQ ID NO: 880405 - protein, 20 aa, Mycobacterium
RVPVWFMRQAGRSLPEYRAL

SEQ ID NO: 880406 - protein, 25 aa, Mycobacterium
RVSARVYPALVPLSHPLATVNGAFN

SEQ ID NO: 880407 - protein, 20 aa, Mycobacterium
RWAGVPFYLRTGKRLGRRVT

SEQ ID NO: 880408 - protein, 28 aa, Mycobacterium
RYALDLFATLGLQLLIVTPLQKVHVIEP

SEQ ID NO: 880409 - protein, 20 aa, Mycobacterium
RYMHHYNFPPFSTGETGRVG

SEQ ID NO: 880410 - protein, 19 aa, Mycobacterium
SAFVLLALQAPVAGDLRSI

SEQ ID NO: 880411 - protein, 22 aa, Mycobacterium
SAIRIGLALNCEIAPWGRFARK

SEQ ID NO: 880412 - protein, 26 aa, Mycobacterium
SDEAIYSFLRLLLPAGLETTYRSSGN

SEQ ID NO: 880413 - protein, 25 aa, Mycobacterium
SDLELYLFFSLLFSAGAETTRNAVA

SEQ ID NO: 880414 - protein, 18 aa, Mycobacterium
SDVCEPLFRVWPVSGRTA

SEQ ID NO: 880415 - protein, 26 aa, Mycobacterium
SFQLFPNFVMLFWGQGWYLTYHYWPT

SEQ ID NO: 880416 - protein, 24 aa, Mycobacterium
SGPRKDGVPLWWKSAARNKSSVAV

SEQ ID NO: 880417 - protein, 20 aa, Mycobacterium
SHLMYGLWWNFPVPDIERTD

SEQ ID NO: 880418 - protein, 18 aa, Mycobacterium
SILPITWAYIRMMGADGL

SEQ ID NO: 880419 - protein, 23 aa, Mycobacterium
SLADPLAFLLRKEGFEATVVTDG

SEQ ID NO: 880420 - protein, 18 aa, Mycobacterium
SLLLLIFPHLALAPYMRG

SEQ ID NO: 880421 - protein, 19 aa, Mycobacterium
SRELPWRRPIASLNYLLSS

SEQ ID NO: 880422 - protein, 18 aa, Mycobacterium
SRLMLDIASWRRRRREEL

SEQ ID NO: 880423 - protein, 24 aa, Mycobacterium
SRPLITNMIRLLKLPIPVQRRVAA

SEQ ID NO: 880424 - protein, 28 aa, Mycobacterium
SSTPPPPPPLPPTPFPKACPAPGVMQGC

SEQ ID NO: 880425 - protein, 26 aa, Mycobacterium
SSYLLNGLFFSLPWYYRSGYDVLLYT

SEQ ID NO: 880426 - protein, 27 aa, Mycobacterium
SVPHYGIGYGLLRYLYAPTGRVLGAQR

SEQ ID NO: 880427 - protein, 19 aa, Mycobacterium
SWMEIEAFRLLTLQTAWKI

SEQ ID NO: 880428 - protein, 20 aa, Mycobacterium
TAFLELCPFAAWGSKFPVGG

SEQ ID NO: 880429 - protein, 24 aa, Mycobacterium
TAVAMLVAIFRARPSPFYVMDEVE

SEQ ID NO: 880430 - protein, 24 aa, Mycobacterium
TDEAPLLATYAFLPIVRAFAEPAG

SEQ ID NO: 880431 - protein, 25 aa, Mycobacterium
TERGLLLTTLWYIREVDPTTLLLTG

SEQ ID NO: 880432 - protein, 19 aa, Mycobacterium
TEWFTVDWHRAIVDKWRAA

SEQ ID NO: 880433 - protein, 21 aa, Mycobacterium
TFEYQALLFIPSHAPFDLFNR

SEQ ID NO: 880434 - protein, 19 aa, Mycobacterium
TFPSWPLAHPFRRIAHNGE

SEQ ID NO: 880435 - protein, 24 aa, Mycobacterium
TGALLYIPLLTRMLMNLNAMGLSE

SEQ ID NO: 880436 - protein, 20 aa, Mycobacterium
TGRGPTPFRWSLTAGPAEPA

SEQ ID NO: 880437 - protein, 19 aa, Mycobacterium
TGRQWPLADVRLLAPILAS

SEQ ID NO: 880438 - protein, 19 aa, Mycobacterium
TGRSWPLADVRLLAPILAS

SEQ ID NO: 880439 - protein, 20 aa, Mycobacterium
TGRSWPLADVRLLAPILASK

SEQ ID NO: 880440 - protein, 22 aa, Mycobacterium
TKWEKLFRFLALDRLQTRLHRW

SEQ ID NO: 880441 - protein, 17 aa, Mycobacterium
TLLFPFAAPRVVGDLSE

SEQ ID NO: 880442 - protein, 18 aa, Mycobacterium
TPMDFLRDTLLWAKLIDK

SEQ ID NO: 880443 - protein, 27 aa, Mycobacterium
TPYSRMWGAYLTGMWLYRLSLAKVKWH

SEQ ID NO: 880444 - protein, 18 aa, Mycobacterium
TRKRVLALALRLLDRGYF

SEQ ID NO: 880445 - protein, 21 aa, Mycobacterium
TTDPVLAWLYVLDAWEGGLPS

SEQ ID NO: 880446 - protein, 26 aa, Mycobacterium
TVYAAQLPIPVWWPAEARAAFIEEYA

SEQ ID NO: 880447 - protein, 17 aa, Mycobacterium
TWDAFLARFAAIAGPVT

SEQ ID NO: 880448 - protein, 19 aa, Mycobacterium
TWPALPAETFPATGVLPPW

SEQ ID NO: 880449 - protein, 25 aa, Mycobacterium
VAWNVPLFLAINKLGPALLAGCTVV

SEQ ID NO: 880450 - protein, 19 aa, Mycobacterium
VFIGYLRRKLEANGGPRLL

SEQ ID NO: 880451 - protein, 24 aa, Mycobacterium
VFSEEFLLQRPLLTAIRRTEPTVL

SEQ ID NO: 880452 - protein, 18 aa, Mycobacterium
VGIVLLLRDVLARSLFEK

SEQ ID NO: 880453 - protein, 18 aa, Mycobacterium
VGLIFPWNGPIFNASAKL

SEQ ID NO: 880454 - protein, 17 aa, Mycobacterium
VGLLRQQLAPGQLVHGI

SEQ ID NO: 880455 - protein, 29 aa, Mycobacterium
VGQIIPWNFPILMGAWKLAPALAAGNAVV

SEQ ID NO: 880456 - protein, 18 aa, Mycobacterium
VIPLLRQGGGGSIVNVAS

SEQ ID NO: 880457 - protein, 17 aa, Mycobacterium
VLGPIGSITLLPLYFEL

SEQ ID NO: 880458 - protein, 18 aa, Mycobacterium
VLLESFLDGPEVSLFCVV

SEQ ID NO: 880459 - protein, 17 aa, Mycobacterium
VLLPFLVTRQLICGAGK

SEQ ID NO: 880460 - protein, 17 aa, Mycobacterium
VMWAFQQAGISLPHSSQ

SEQ ID NO: 880461 - protein, 20 aa, Mycobacterium
VPVIDKDVRRWWRSDSLWQA

SEQ ID NO: 880462 - protein, 21 aa, Mycobacterium
VQWQLVRRLVTIVEFSFAARC

SEQ ID NO: 880463 - protein, 20 aa, Mycobacterium
VRDLDLLRPIYAPTAAYGHF

SEQ ID NO: 880464 - protein, 20 aa, Mycobacterium
VRRYIIGCALRWMRDFHADG

SEQ ID NO: 880465 - protein, 24 aa, Mycobacterium
VTMTPLWGLPPYWAPGQPSPYLVD

SEQ ID NO: 880466 - protein, 19 aa, Mycobacterium
VTPMDFLRDTLLWAKLIDK

SEQ ID NO: 880467 - protein, 17 aa, Mycobacterium
WFVLTHLLGKPGVRNYD

SEQ ID NO: 880468 - protein, 19 aa, Mycobacterium
WPLGWGFDHFWGFPSGAAG

SEQ ID NO: 880469 - protein, 18 aa, Mycobacterium
WQRLLFDNGWLLPAQPPE

SEQ ID NO: 880470 - protein, 25 aa, Mycobacterium
WWAAYALWVFTLFGHPDVRLLDGGR

SEQ ID NO: 880471 - protein, 18 aa, Mycobacterium
WWEWAATYERAFTAAYDA

SEQ ID NO: 880472 - protein, 22 aa, Mycobacterium
YAQLLQFRLMVLYTAWEIDKYN

SEQ ID NO: 880473 - protein, 22 aa, Mycobacterium
YDHFTPYTLLQLEELGFCGKGE

SEQ ID NO: 880474 - protein, 21 aa, Mycobacterium
YDSIDPLWWGWRNHMKIFFNN

SEQ ID NO: 880475 - protein, 24 aa, Mycobacterium
YGGTYNLFHYSLAKLGIEVSFVDD

SEQ ID NO: 880476 - protein, 23 aa, Mycobacterium
YYAMTGWRLGWLLVPTELRRAVD

SEQ ID NO: 880477 - protein, 28 aa, Mycobacterium
YYNKAGLWPYLEKLGYYLGGYGCTTCIG

SEQ ID NO: 880478 - protein, 22 aa, Mycobacterium
AAAAAPYMGWLTAAAVQAGGAA

SEQ ID NO: 880479 - protein, 20 aa, Mycobacterium
AAAALPTTGLLAAGADEVSA

SEQ ID NO: 880480 - protein, 20 aa, Mycobacterium
AAAAPYLGWLQTAAAQAEQA

SEQ ID NO: 880481 - protein, 23 aa, Mycobacterium
AAAAPYVSWLNAAAVRAGEAALQ

SEQ ID NO: 880482 - protein, 31 aa, Mycobacterium
AAAAQLAPWQQWLQSLPGLPGQLAGSATAAA

SEQ ID NO: 880483 - protein, 23 aa, Mycobacterium
AAADQLILMRLIIGRAARRHGLR

SEQ ID NO: 880484 - protein, 20 aa, Mycobacterium
AAAFWATSFLGAVTVPIVHF

SEQ ID NO: 880485 - protein, 24 aa, Mycobacterium
AAAGLAPWQQLLQNIPGLSALSAV

SEQ ID NO: 880486 - protein, 22 aa, Mycobacterium
AAAGLIDLLLAAGGELITVLTG

SEQ ID NO: 880487 - protein, 23 aa, Mycobacterium
AAAIGLLDLLLASGGDLVTVLLG

SEQ ID NO: 880488 - protein, 17 aa, Mycobacterium
AAAKIWRGALKLGIEMR

SEQ ID NO: 880489 - protein, 20 aa, Mycobacterium
AAALAPITGLLPAGTDEVSA

SEQ ID NO: 880490 - protein, 26 aa, Mycobacterium
AAALHTQLERVLSAGAVAYAAAETTG

SEQ ID NO: 880491 - protein, 18 aa, Mycobacterium
AAALLAQTPVRGAMGFRL

SEQ ID NO: 880492 - protein, 24 aa, Mycobacterium
AAALTPLSWPTQTLAGLAAPAAAL

SEQ ID NO: 880493 - protein, 21 aa, Mycobacterium
AAALVPFSLPPVDLAGLASQI

SEQ ID NO: 880494 - protein, 19 aa, Mycobacterium
AAAMERAITLLLRQTPMDA

SEQ ID NO: 880495 - protein, 26 aa, Mycobacterium
AAANSWLDAFAFWRRTQGLPGCAIAW

SEQ ID NO: 880496 - protein, 18 aa, Mycobacterium
AAAPLVTAVLPPAADAVS

SEQ ID NO: 880497 - protein, 19 aa, Mycobacterium
AAAPYAGWLNVAAARAAGA

SEQ ID NO: 880498 - protein, 18 aa, Mycobacterium
AAARWRGPIPGRDRVRII

SEQ ID NO: 880499 - protein, 24 aa, Mycobacterium
AAAVGPFTFLRPGTVLGTGGKLGA

SEQ ID NO: 880500 - protein, 18 aa, Mycobacterium
AAAWLALGPAIVVVTFGA

SEQ ID NO: 880501 - protein, 32 aa, Mycobacterium
AADALLGVINTPTQALLGRPLIGNGANGTTVN

SEQ ID NO: 880502 - protein, 25 aa, Mycobacterium
AADIDEDLLLRLKAWRLDVAKEQKV

SEQ ID NO: 880503 - protein, 17 aa, Mycobacterium
AADLARMYIRYAERRGW

SEQ ID NO: 880504 - protein, 19 aa, Mycobacterium
AADLFAWLGPAPDAVVGAA

SEQ ID NO: 880505 - protein, 23 aa, Mycobacterium
AADNPYLWQLLAGRYPGVTVPWL

SEQ ID NO: 880506 - protein, 22 aa, Mycobacterium
AADPDVLFLSEAFTRPARLYGL

SEQ ID NO: 880507 - protein, 18 aa, Mycobacterium
AADRPWWEWAATYERAFS

SEQ ID NO: 880508 - protein, 25 aa, Mycobacterium
AADTAFFLLAFANIGLMPDGGSSAL

SEQ ID NO: 880509 - protein, 23 aa, Mycobacterium
AADWAEMLMRMYIRWAEQHDYPV

SEQ ID NO: 880510 - protein, 23 aa, Mycobacterium
AADWAEMLMRMYIRWAEQHKYPV

SEQ ID NO: 880511 - protein, 24 aa, Mycobacterium
AADWAEMLMRMYIRWAEQHKYPVE

SEQ ID NO: 880512 - protein, 28 aa, Mycobacterium
AAEGFTVVLLPRPLPTPVLAFAVRQVDA

SEQ ID NO: 880513 - protein, 19 aa, Mycobacterium
AAEHPWLLGAYLTHTFGVE

SEQ ID NO: 880514 - protein, 17 aa, Mycobacterium
AAELEKFQWFVRAHLEN

SEQ ID NO: 880515 - protein, 23 aa, Mycobacterium
AAEQLTPFHRMLAGLSGRSVSSA

SEQ ID NO: 880516 - protein, 24 aa, Mycobacterium
AAERPHYMPLFVAPQPLDSDDDSD

SEQ ID NO: 880517 - protein, 23 aa, Mycobacterium
AAEVPPWIGPLDVLIVAGDDPGD

SEQ ID NO: 880518 - protein, 24 aa, Mycobacterium
AAEYGLRPLVRLVSWGLAGVAPDI

SEQ ID NO: 880519 - protein, 20 aa, Mycobacterium
AAFHDDFVRILASGSNLYAT

SEQ ID NO: 880520 - protein, 22 aa, Mycobacterium
AAFHERFLQTLSGGAGAYAAAE

SEQ ID NO: 880521 - protein, 25 aa, Mycobacterium
AAFHERLVQTLRSGASAYLGTELAN

SEQ ID NO: 880522 - protein, 19 aa, Mycobacterium
AAFLEYLDMFYNLGIAGRA

SEQ ID NO: 880523 - protein, 21 aa, Mycobacterium
AAFLEYLDMFYNLGIAGRAMR

SEQ ID NO: 880524 - protein, 21 aa, Mycobacterium
AAFMVATAWEWELADRLRLAS

SEQ ID NO: 880525 - protein, 20 aa, Mycobacterium
AAFSRGLWWSALRATDWAAA

SEQ ID NO: 880526 - protein, 19 aa, Mycobacterium
AAFVRRPLRWIQALSDGSR

SEQ ID NO: 880527 - protein, 18 aa, Mycobacterium
AAFYGHVLGWVFDPETQR

SEQ ID NO: 880528 - protein, 18 aa, Mycobacterium
AAFYRRCRLVTERLWPTL

SEQ ID NO: 880529 - protein, 17 aa, Mycobacterium
AAGAPGGWLLGDGGAGG

SEQ ID NO: 880530 - protein, 20 aa, Mycobacterium
AAGDGFARYWLHNGWVTMGG

SEQ ID NO: 880531 - protein, 24 aa, Mycobacterium
AAGDPWASFVTYGLLGGAPVLCVS

SEQ ID NO: 880532 - protein, 17 aa, Mycobacterium
AAGLLWGTAGAGGAGGS

SEQ ID NO: 880533 - protein, 26 aa, Mycobacterium
AAGLRPLRPWRAALVAALAASAGARP

SEQ ID NO: 880534 - protein, 26 aa, Mycobacterium
AAGLRPLRPWRPALVAALAAADRPLP

SEQ ID NO: 880535 - protein, 25 aa, Mycobacterium
AAGLTPLRPWRSALAAALAAACGAA

SEQ ID NO: 880536 - protein, 21 aa, Mycobacterium
AAGLWSVWKPAKGAVPLLSCT

SEQ ID NO: 880537 - protein, 20 aa, Mycobacterium
AAGMRFPLFVKAVAGGGGRG

SEQ ID NO: 880538 - protein, 26 aa, Mycobacterium
AAGSKLAELVFPAPPAPIAATGGDPV

SEQ ID NO: 880539 - protein, 18 aa, Mycobacterium
AAGYWPDRAVLRSNWRRA

SEQ ID NO: 880540 - protein, 19 aa, Mycobacterium
AAHAPYLAWLAQASADSAT

SEQ ID NO: 880541 - protein, 22 aa, Mycobacterium
AAHEFYIRDVLLDWGRDDPNHL

SEQ ID NO: 880542 - protein, 20 aa, Mycobacterium
AAHFLEHLLFKSTPTRTAVD

SEQ ID NO: 880543 - protein, 21 aa, Mycobacterium
AAHHRLFGHVPWLAGQLLGAV

SEQ ID NO: 880544 - protein, 24 aa, Mycobacterium
AAHHRLFSHVPWLSSQLLGAVEAF

SEQ ID NO: 880545 - protein, 24 aa, Mycobacterium
AAHHRLFSHVPWLSSQLLNAVEAF

SEQ ID NO: 880546 - protein, 19 aa, Mycobacterium
AAHILPRGLRWFVRATAWA

SEQ ID NO: 880547 - protein, 18 aa, Mycobacterium
AAHLPYLAWLQQASADSA

SEQ ID NO: 880548 - protein, 24 aa, Mycobacterium
AAHLVPLDQPLWTCGLIQGLMRDG

SEQ ID NO: 880549 - protein, 19 aa, Mycobacterium
AAHRPTLLGSATPFFVAFM

SEQ ID NO: 880550 - protein, 17 aa, Mycobacterium
AAHSPMDVLWFRLNWRP

SEQ ID NO: 880551 - protein, 23 aa, Mycobacterium
AAHVPYLAWLLQNSANATAAALE

SEQ ID NO: 880552 - protein, 20 aa, Mycobacterium
AAHVPYLAWLLRASADSAGV

SEQ ID NO: 880553 - protein, 18 aa, Mycobacterium
AAIAALFGSHAREYQAIS

SEQ ID NO: 880554 - protein, 18 aa, Mycobacterium
AAIAPWNFPLMLETWKVA

SEQ ID NO: 880555 - protein, 24 aa, Mycobacterium
AAIDAALLAAALWRGVELVITSMG

SEQ ID NO: 880556 - protein, 20 aa, Mycobacterium
AAILGLLPPGGRMTGGRIVF

SEQ ID NO: 880557 - protein, 19 aa, Mycobacterium
AAIPLLPPMMDDLMRLELR

SEQ ID NO: 880558 - protein, 18 aa, Mycobacterium
AAIRMLRLLVLETAWKID

SEQ ID NO: 880559 - protein, 25 aa, Mycobacterium
AAISRLPLVPPLLEWLHAVRQPVVM

SEQ ID NO: 880560 - protein, 27 aa, Mycobacterium
AAITPFNFPFFLNIVKVLPALAAGCTV

SEQ ID NO: 880561 - protein, 27 aa, Mycobacterium
AAIVPWNIPLLTTVWKIGPALVAGNSV

SEQ ID NO: 880562 - protein, 25 aa, Mycobacterium
AAIVRPLLRFFFRSWFRVEVSGVEN

SEQ ID NO: 880563 - protein, 19 aa, Mycobacterium
AAKAFWPSPLPFPVMHIDT

SEQ ID NO: 880564 - protein, 17 aa, Mycobacterium
AAKLPPGWPMLVASWLA

SEQ ID NO: 880565 - protein, 18 aa, Mycobacterium
AAKRSGLYYTLLNTHLSP

SEQ ID NO: 880566 - protein, 24 aa, Mycobacterium
AAKTMGLPILYPWANRLGANSYTA

SEQ ID NO: 880567 - protein, 19 aa, Mycobacterium
AALANFFRIKPAYFTDDEY

SEQ ID NO: 880568 - protein, 17 aa, Mycobacterium
AALAYMLEIFAFRYKII

SEQ ID NO: 880569 - protein, 19 aa, Mycobacterium
AALFRLMRSPLMPITPHAI

SEQ ID NO: 880570 - protein, 21 aa, Mycobacterium
AALFRLMRSRLMPITPHAITS

SEQ ID NO: 880571 - protein, 17 aa, Mycobacterium
AALFSFHGQSYQTLGAQ

SEQ ID NO: 880572 - protein, 26 aa, Mycobacterium
AALFSGHGQAYRAISAQAAAFHDQFL

SEQ ID NO: 880573 - protein, 17 aa, Mycobacterium
AALFVLDRWLRPVPPGV

SEQ ID NO: 880574 - protein, 19 aa, Mycobacterium
AALGLLRRNKIEKLPIVDG

SEQ ID NO: 880575 - protein, 19 aa, Mycobacterium
AALGLLRRNKIEKLPVVDG

SEQ ID NO: 880576 - protein, 17 aa, Mycobacterium
AALIRMLWCVDPHLDLL

SEQ ID NO: 880577 - protein, 17 aa, Mycobacterium
AALNRLLFPGPTAEFEA

SEQ ID NO: 880578 - protein, 17 aa, Mycobacterium
AALNYELTLFLLRSPEA

SEQ ID NO: 880579 - protein, 17 aa, Mycobacterium
AALPPLLSQLAARPARR

SEQ ID NO: 880580 - protein, 18 aa, Mycobacterium
AALPWFWSDQYDVKLQIA

SEQ ID NO: 880581 - protein, 17 aa, Mycobacterium
AALRERLPFELTAGQRE

SEQ ID NO: 880582 - protein, 24 aa, Mycobacterium
AALRRYWIAALERIPDLRFTVEGV

SEQ ID NO: 880583 - protein, 17 aa, Mycobacterium
AALRYFWPRLTPGAFVL

SEQ ID NO: 880584 - protein, 23 aa, Mycobacterium
AALRYITRLLLRLGADDDAAFLH

SEQ ID NO: 880585 - protein, 28 aa, Mycobacterium
AALSPWEQLLQNVPALSPLAAIGNLGAG

SEQ ID NO: 880586 - protein, 23 aa, Mycobacterium
AALTPFSIPPLDLAGLAAGINAQ

SEQ ID NO: 880587 - protein, 24 aa, Mycobacterium
AALTPFSIPPLDLAGLAAGINAQV

SEQ ID NO: 880588 - protein, 21 aa, Mycobacterium
AALWDLPLVFVCQNNLYAEMT

SEQ ID NO: 880589 - protein, 18 aa, Mycobacterium
AALWPLLVGNIIAARGVL

SEQ ID NO: 880590 - protein, 21 aa, Mycobacterium
AAMLIAKPYLPWGDTHEFADR

SEQ ID NO: 880591 - protein, 19 aa, Mycobacterium
AAMMGLGEPAAQLGGQLAE

SEQ ID NO: 880592 - protein, 19 aa, Mycobacterium
AAMQGLIALPLLAGYDIHA

SEQ ID NO: 880593 - protein, 18 aa, Mycobacterium
AAMQGLVALPLLAGYDIG

SEQ ID NO: 880594 - protein, 20 aa, Mycobacterium
AAMQGLVALPLLVGYDIDAP

SEQ ID NO: 880595 - protein, 19 aa, Mycobacterium
AAMQGLVAVPLLVGYDLDD

SEQ ID NO: 880596 - protein, 20 aa, Mycobacterium
AAMTVLTGLIPAGAEEVSAQ

SEQ ID NO: 880597 - protein, 23 aa, Mycobacterium
AANAAPFQGLLGAVNAPVQTLTG

SEQ ID NO: 880598 - protein, 19 aa, Mycobacterium
AANCFLALKLSYANAMAEL

SEQ ID NO: 880599 - protein, 23 aa, Mycobacterium
AANDRFYFRQLLSGRDFAGADPI

SEQ ID NO: 880600 - protein, 18 aa, Mycobacterium
AANGFILDGFPRSLQQAK

SEQ ID NO: 880601 - protein, 24 aa, Mycobacterium
AANPKIFFQIYWLGGRDAIAERVE

SEQ ID NO: 880602 - protein, 23 aa, Mycobacterium
AANPKIFFQVYWLGGRDAIAERV

SEQ ID NO: 880603 - protein, 17 aa, Mycobacterium
AANPPMIRYPIPPMIHG

SEQ ID NO: 880604 - protein, 23 aa, Mycobacterium
AANRARLAMLLATNFFGINAPAI

SEQ ID NO: 880605 - protein, 25 aa, Mycobacterium
AANRARLAMLLATNFFGVNYPAIAE

SEQ ID NO: 880606 - protein, 24 aa, Mycobacterium
AANSWLDAFTRWRRARGLPATAIA

SEQ ID NO: 880607 - protein, 20 aa, Mycobacterium
AAPEEIAQAVLFLASPRASF

SEQ ID NO: 880608 - protein, 22 aa, Mycobacterium
AAPGLFLFCAVLAFSRWRFVAF

SEQ ID NO: 880609 - protein, 24 aa, Mycobacterium
AAPPPWIDIFIARNFHYLTELHCP

SEQ ID NO: 880610 - protein, 20 aa, Mycobacterium
AAPPRILWLQSAIPGQLLLE

SEQ ID NO: 880611 - protein, 17 aa, Mycobacterium
AAPPRVPPTPATWGWML

SEQ ID NO: 880612 - protein, 27 aa, Mycobacterium
AAPVYLYRFDYSTPLLRLLTVGAAHAT

SEQ ID NO: 880613 - protein, 17 aa, Mycobacterium
AAPYAGWLGLAAARATT

SEQ ID NO: 880614 - protein, 17 aa, Mycobacterium
AAPYVVWLRATAELCEQ

SEQ ID NO: 880615 - protein, 21 aa, Mycobacterium
AAPYVWWLHSTAEQTQQTATQ

SEQ ID NO: 880616 - protein, 22 aa, Mycobacterium
AAQFHQGFMQLLNSAGGAYAGA

SEQ ID NO: 880617 - protein, 22 aa, Mycobacterium
AAQGFAWPWSICRWVTGENPKF

SEQ ID NO: 880618 - protein, 22 aa, Mycobacterium
AAQRMWRLTRGNVLYLRNIVEQ

SEQ ID NO: 880619 - protein, 18 aa, Mycobacterium
AARGFDPIYGARPLRRLV

SEQ ID NO: 880620 - protein, 23 aa, Mycobacterium
AARLDLAAVFLYAGSILPGVAKL

SEQ ID NO: 880621 - protein, 17 aa, Mycobacterium
AARLWYRRFFADSGAAE

SEQ ID NO: 880622 - protein, 18 aa, Mycobacterium
AARPPAFREALMGVLNEL

SEQ ID NO: 880623 - protein, 26 aa, Mycobacterium
AARVGWRWRLVWFKAVSEMLSADYDS

SEQ ID NO: 880624 - protein, 18 aa, Mycobacterium
AARYLPWHPGRCAEVLVG

SEQ ID NO: 880625 - protein, 19 aa, Mycobacterium
AARYRRWLAALRGQARLVI

SEQ ID NO: 880626 - protein, 25 aa, Mycobacterium
AASASPLAGLLAAINAPVQSLTGRP

SEQ ID NO: 880627 - protein, 24 aa, Mycobacterium
AASPRFDPAIWPLTAHPDEEGRLC

SEQ ID NO: 880628 - protein, 18 aa, Mycobacterium
AASPYAGWLSAAAARAAG

SEQ ID NO: 880629 - protein, 23 aa, Mycobacterium
AATAAFDAFPAHVPVHEPTGAAG

SEQ ID NO: 880630 - protein, 23 aa, Mycobacterium
AATLLYDRWFRLLAPHLDPARNV

SEQ ID NO: 880631 - protein, 19 aa, Mycobacterium
AATPIMRWLHSVDGPVEEF

SEQ ID NO: 880632 - protein, 22 aa, Mycobacterium
AATVHPLMVAINRNRFVQLVAS

SEQ ID NO: 880633 - protein, 23 aa, Mycobacterium
AATVVFPLLPFTPKIRTGYNLPI

SEQ ID NO: 880634 - protein, 23 aa, Mycobacterium
AATWPDPWPMYRALRDQDPVHHV

SEQ ID NO: 880635 - protein, 23 aa, Mycobacterium
AATWSNPWPMYRALRDHDPVHHV

SEQ ID NO: 880636 - protein, 24 aa, Mycobacterium
AATYLTFDLIYRQWLDAGLDVHYV

SEQ ID NO: 880637 - protein, 17 aa, Mycobacterium
AAVALLRYEGRDAGWVP

SEQ ID NO: 880638 - protein, 18 aa, Mycobacterium
AAVAPYLRWLTGTAAQAE

SEQ ID NO: 880639 - protein, 23 aa, Mycobacterium
AAVDALLVRLFIRLSMALWGRRD

SEQ ID NO: 880640 - protein, 24 aa, Mycobacterium
AAVETWFHLLERYGTWRLSDVLGY

SEQ ID NO: 880641 - protein, 20 aa, Mycobacterium
AAVFLPRTPAPPGGWPVLAW

SEQ ID NO: 880642 - protein, 24 aa, Mycobacterium
AAVFLRAADLLSGPWRAILNAATM

SEQ ID NO: 880643 - protein, 24 aa, Mycobacterium
AAVGPDFPIIYRFSQWKANAYDAR

SEQ ID NO: 880644 - protein, 24 aa, Mycobacterium
AAVGPDFPILYRFSQWKQADYTAT

SEQ ID NO: 880645 - protein, 20 aa, Mycobacterium
AAVGVRWVPLPFGRQAIDEF

SEQ ID NO: 880646 - protein, 17 aa, Mycobacterium
AAVLHRTAERRAGVLGR

SEQ ID NO: 880647 - protein, 25 aa, Mycobacterium
AAVNAPAQALFGRPLIGNGSNGAPG

SEQ ID NO: 880648 - protein, 22 aa, Mycobacterium
AAVPPATPFALALRMLVIALKN

SEQ ID NO: 880649 - protein, 19 aa, Mycobacterium
AAVTPYVAWLQAGAAQAAQ

SEQ ID NO: 880650 - protein, 24 aa, Mycobacterium
AAWCAAGWYYRALGRPAAPRGANA

SEQ ID NO: 880651 - protein, 20 aa, Mycobacterium
AAWPATLDRLLALGGPEAIY

SEQ ID NO: 880652 - protein, 25 aa, Mycobacterium
AAWPDGLPLFFRVSATDWLGGDTDD

SEQ ID NO: 880653 - protein, 22 aa, Mycobacterium
AAYNLLHAWLQTPLTFAKWDAK

SEQ ID NO: 880654 - protein, 23 aa, Mycobacterium
ACADGFVYLYMTSRAHWLGLKAL

SEQ ID NO: 880655 - protein, 21 aa, Mycobacterium
ACADGFVYLYMTSRAHWLGVK

SEQ ID NO: 880656 - protein, 17 aa, Mycobacterium
ACFIWRVEQGLITHARD

SEQ ID NO: 880657 - protein, 17 aa, Mycobacterium
ACILHSRLLLPDSLHDD

SEQ ID NO: 880658 - protein, 19 aa, Mycobacterium
ACLLMFPRRDLTAGEAEAT

SEQ ID NO: 880659 - protein, 26 aa, Mycobacterium
ACPLTWAWNLLGWPSINVPAGFTSDG

SEQ ID NO: 880660 - protein, 25 aa, Mycobacterium
ACPVTWPWNLLGWPSINVPAGFTSD

SEQ ID NO: 880661 - protein, 17 aa, Mycobacterium
ACQPGRPVASITAAAPG

SEQ ID NO: 880662 - protein, 17 aa, Mycobacterium
ACRYDFLIPNRGVGVLL

SEQ ID NO: 880663 - protein, 17 aa, Mycobacterium
ACVFMRTGARRVHFGET

SEQ ID NO: 880664 - protein, 18 aa, Mycobacterium
ACYSAIYYTLRRENLVDV

SEQ ID NO: 880665 - protein, 22 aa, Mycobacterium
ADAALGLLRRNKIEKLPIVDGE

SEQ ID NO: 880666 - protein, 26 aa, Mycobacterium
ADADFSLSIFGLQLVKTGTANATTTF

SEQ ID NO: 880667 - protein, 24 aa, Mycobacterium
ADADVIRYLRWFTFLVAEELTELE

SEQ ID NO: 880668 - protein, 25 aa, Mycobacterium
ADAKEPWFLDAYRRAWQWADTTGWR

SEQ ID NO: 880669 - protein, 21 aa, Mycobacterium
ADALWFVPLLAQDALDKLELG

SEQ ID NO: 880670 - protein, 19 aa, Mycobacterium
ADAVPQIWPGRAIYRIWPD

SEQ ID NO: 880671 - protein, 22 aa, Mycobacterium
ADDLPDFPLLSPPSAVRRMPLM

SEQ ID NO: 880672 - protein, 21 aa, Mycobacterium
ADDPDWLRWNYATVVWGLATA

SEQ ID NO: 880673 - protein, 24 aa, Mycobacterium
ADDPLRALWLLNSDARLSVLNTEF

SEQ ID NO: 880674 - protein, 25 aa, Mycobacterium
ADDRLWDILLAIGADRRPAWASTLV

SEQ ID NO: 880675 - protein, 22 aa, Mycobacterium
ADDVLLFKYIIKNTAWANGKTV

SEQ ID NO: 880676 - protein, 18 aa, Mycobacterium
ADDYLRFVRLLLGDGTID

SEQ ID NO: 880677 - protein, 25 aa, Mycobacterium
ADELINFSLLPWPDYFGAAPKARAD

SEQ ID NO: 880678 - protein, 24 aa, Mycobacterium
ADEYGLRPLVRLVSWGLAGVAPDV

SEQ ID NO: 880679 - protein, 17 aa, Mycobacterium
ADFLTLCESFRLPVISL

SEQ ID NO: 880680 - protein, 17 aa, Mycobacterium
ADFRPLVFDGLFLQLPI

SEQ ID NO: 880681 - protein, 27 aa, Mycobacterium
ADFWFDPLCPWCWITSRWILEVEKVRD

SEQ ID NO: 880682 - protein, 22 aa, Mycobacterium
ADGPLRVFALLRDGRPVLLNFG

SEQ ID NO: 880683 - protein, 20 aa, Mycobacterium
ADGTLFSSLAGTGGTGGNGG

SEQ ID NO: 880684 - protein, 18 aa, Mycobacterium
ADGTYFYVLLADGTLRVG

SEQ ID NO: 880685 - protein, 22 aa, Mycobacterium
ADGWLALFRTWLADAQRAGLVE

SEQ ID NO: 880686 - protein, 23 aa, Mycobacterium
ADHEWRGWWGDEPPFHTPVFVLT

SEQ ID NO: 880687 - protein, 23 aa, Mycobacterium
ADIARKWGFWRLGPFTTVYRETY

SEQ ID NO: 880688 - protein, 17 aa, Mycobacterium
ADIVPLIQTWLPALTSS

SEQ ID NO: 880689 - protein, 19 aa, Mycobacterium
ADLLAVVARLNRLATQRIQ

SEQ ID NO: 880690 - protein, 18 aa, Mycobacterium
ADLLQAAGKYPPPPGASE

SEQ ID NO: 880691 - protein, 25 aa, Mycobacterium
ADLRGRFRWWGLYTQRKQGYDGTWT

SEQ ID NO: 880692 - protein, 24 aa, Mycobacterium
ADLRPRLRWEMLRLAADHADAGWI

SEQ ID NO: 880693 - protein, 22 aa, Mycobacterium
ADLTWLLSRWTCVFGTPACHGT

SEQ ID NO: 880694 - protein, 22 aa, Mycobacterium
ADLTWLLSRWTCVFGTPACQGT

SEQ ID NO: 880695 - protein, 17 aa, Mycobacterium
ADLVVLIRFARSDLSST

SEQ ID NO: 880696 - protein, 19 aa, Mycobacterium
ADMTWLLSHWTCVFGTPAC

SEQ ID NO: 880697 - protein, 21 aa, Mycobacterium
ADMTWLLSRWTCVFGTPACKG

SEQ ID NO: 880698 - protein, 21 aa, Mycobacterium
ADMTWLLSRWTCVFGTPACQG

SEQ ID NO: 880699 - protein, 24 aa, Mycobacterium
ADNRWLVLAMLQPGRYWPEFCRHI

SEQ ID NO: 880700 - protein, 22 aa, Mycobacterium
ADPLWLAWPNHMKIFWNNKGVV

SEQ ID NO: 880701 - protein, 23 aa, Mycobacterium
ADPSLKGPFAGVPFLLKDLGQEY

SEQ ID NO: 880702 - protein, 20 aa, Mycobacterium
ADPVFMLTGPIPATRYALDK

SEQ ID NO: 880703 - protein, 26 aa, Mycobacterium
ADRHAGWWRAPLRWTLRGSLAVRSRL

SEQ ID NO: 880704 - protein, 26 aa, Mycobacterium
ADRHGGWWRAPLRWTLRGSLAVRSRL

SEQ ID NO: 880705 - protein, 19 aa, Mycobacterium
ADRLAYVVRLILTGAKDTS

SEQ ID NO: 880706 - protein, 19 aa, Mycobacterium
ADRLAYVVRLILTGAKETS

SEQ ID NO: 880707 - protein, 23 aa, Mycobacterium
ADRPLRVTLLRLGAEDFVVLLVV

SEQ ID NO: 880708 - protein, 18 aa, Mycobacterium
ADRSGFVVNFLLVPYLLA

SEQ ID NO: 880709 - protein, 25 aa, Mycobacterium
ADRTLTTVAFERLGRAWPALGWAAV

SEQ ID NO: 880710 - protein, 25 aa, Mycobacterium
ADTGMWAQWLTLPAAAGPIVLAFNA

SEQ ID NO: 880711 - protein, 23 aa, Mycobacterium
ADTLADLVFAWKVGRAVKSNAIV

SEQ ID NO: 880712 - protein, 24 aa, Mycobacterium
ADVCHEAFRAEWLLSFLAADVRRD

SEQ ID NO: 880713 - protein, 21 aa, Mycobacterium
ADVIRYLRWFTFLSADELGEL

SEQ ID NO: 880714 - protein, 21 aa, Mycobacterium
ADVIRYLRWFTFLTADELGEL

SEQ ID NO: 880715 - protein, 28 aa, Mycobacterium
ADVKFGIEPWFRYFQKIAAFPQMTMSGD

SEQ ID NO: 880716 - protein, 26 aa, Mycobacterium
ADVKFGIEPWFRYFQKVAAFPQMTMP

SEQ ID NO: 880717 - protein, 25 aa, Mycobacterium
ADVLGYLRWFTFLTPDELAELADAT

SEQ ID NO: 880718 - protein, 22 aa, Mycobacterium
ADVLMLLYLLSADELRELLDRL

SEQ ID NO: 880719 - protein, 23 aa, Mycobacterium
ADWAEMLMRMYIRWAEAHKYPVE

SEQ ID NO: 880720 - protein, 17 aa, Mycobacterium
ADWAEMLMRMYIRWAEK

SEQ ID NO: 880721 - protein, 23 aa, Mycobacterium
ADWAEMLMRMYLRWAEQHKYPVE

SEQ ID NO: 880722 - protein, 22 aa, Mycobacterium
ADWAEMLMRMYVRWAEQHKYPV

SEQ ID NO: 880723 - protein, 23 aa, Mycobacterium
ADWPADLLMLQQLGFRLLAMTPH

SEQ ID NO: 880724 - protein, 26 aa, Mycobacterium
ADYAGFIWYPQLPALDHWLKLYQRAA

SEQ ID NO: 880725 - protein, 24 aa, Mycobacterium
ADYAGFIWYPQLPALELWRELYQR

SEQ ID NO: 880726 - protein, 25 aa, Mycobacterium
ADYGGFIWYPRLPALDLWLRLYDGA

SEQ ID NO: 880727 - protein, 24 aa, Mycobacterium
ADYLPDLDPPLPPLPAPISNNIPK

SEQ ID NO: 880728 - protein, 24 aa, Mycobacterium
ADYQPPLGPLLTTYRGRELVVKCA

SEQ ID NO: 880729 - protein, 27 aa, Mycobacterium
AEAGFIDLFIAYPLWVTAQKARRLRQV

SEQ ID NO: 880730 - protein, 23 aa, Mycobacterium
AEAGFLAPHWPAPYGLGAGAAQQ

SEQ ID NO: 880731 - protein, 22 aa, Mycobacterium
AEAIGYMLEILPALGYLHSIGL

SEQ ID NO: 880732 - protein, 19 aa, Mycobacterium
AEALRWAMMRGEPLVVLAD

SEQ ID NO: 880733 - protein, 25 aa, Mycobacterium
AEAYGLGVLLYAPLAGGLLTGKYRR

SEQ ID NO: 880734 - protein, 23 aa, Mycobacterium
AECRVWPSPLLPALPTMFDGLGD

SEQ ID NO: 880735 - protein, 25 aa, Mycobacterium
AEEIAWWVWWCWDQQLRKIEPSLLA

SEQ ID NO: 880736 - protein, 23 aa, Mycobacterium
AEEPFIMFPRHLGPGLYDIIHSA

SEQ ID NO: 880737 - protein, 24 aa, Mycobacterium
AEERYRFRFPRQQRGRFLCIADFV

SEQ ID NO: 880738 - protein, 18 aa, Mycobacterium
AEFAFPVAPWMFGAAGRE

SEQ ID NO: 880739 - protein, 22 aa, Mycobacterium
AEFHDRFVAALTAGADAYSSAE

SEQ ID NO: 880740 - protein, 23 aa, Mycobacterium
AEFKAMFQMKFYAVALLRSRGSL

SEQ ID NO: 880741 - protein, 23 aa, Mycobacterium
AEFKAMFQMKFYAVALLRSRGVP

SEQ ID NO: 880742 - protein, 22 aa, Mycobacterium
AEFKAMFQMKFYAVALLRTRGV

SEQ ID NO: 880743 - protein, 21 aa, Mycobacterium
AEFRAFYSRVLFWTYEPGRVD

SEQ ID NO: 880744 - protein, 20 aa, Mycobacterium
AEFVRLLLAASIRGLVGMIP

SEQ ID NO: 880745 - protein, 27 aa, Mycobacterium
AEFWFDPLCPWCWITSRWILEVQKVRD

SEQ ID NO: 880746 - protein, 25 aa, Mycobacterium
AEGAIGAQFVPASSLPTPSGGAGGD

SEQ ID NO: 880747 - protein, 23 aa, Mycobacterium
AEGGWVLPYLPKPWGRASSPVEQ

SEQ ID NO: 880748 - protein, 24 aa, Mycobacterium
AEGIAWVPYFPLGSSFPGFPKVAD

SEQ ID NO: 880749 - protein, 32 aa, Mycobacterium
AEGLEHTFALYYLSRFVLSHRLVGLLDAAEAP

SEQ ID NO: 880750 - protein, 18 aa, Mycobacterium
AEGLLIYLPADAQELLFA

SEQ ID NO: 880751 - protein, 18 aa, Mycobacterium
AEGLLMYLPAEAQDKLFT

SEQ ID NO: 880752 - protein, 18 aa, Mycobacterium
AEGLLYERRLFHSTFATD

SEQ ID NO: 880753 - protein, 17 aa, Mycobacterium
AEGLRALYLYTATFQDA

SEQ ID NO: 880754 - protein, 19 aa, Mycobacterium
AEGLRALYLYTATFQDAAV

SEQ ID NO: 880755 - protein, 18 aa, Mycobacterium
AEGYWRWITLLEDGFHRM

SEQ ID NO: 880756 - protein, 21 aa, Mycobacterium
AEHDLLACWLLEASGMPTDDA

SEQ ID NO: 880757 - protein, 22 aa, Mycobacterium
AEHPVPLLFVHGGWHGAWCWEH

SEQ ID NO: 880758 - protein, 24 aa, Mycobacterium
AEKLSFFPLWSYATPPAIELAERV

SEQ ID NO: 880759 - protein, 19 aa, Mycobacterium
AELDAFWALLRPAGIDFML

SEQ ID NO: 880760 - protein, 20 aa, Mycobacterium
AELGTFFLTGLFALLSTGAH

SEQ ID NO: 880761 - protein, 24 aa, Mycobacterium
AELHFLGAALWRTGIHRVLREFVL

SEQ ID NO: 880762 - protein, 22 aa, Mycobacterium
AELLGLRYLPPFPYFQQDASPN

SEQ ID NO: 880763 - protein, 20 aa, Mycobacterium
AELLLGMRRFLPSSPTSLYV

SEQ ID NO: 880764 - protein, 27 aa, Mycobacterium
AELLVIQFPLWWYGPPAILKGWFDRVL

SEQ ID NO: 880765 - protein, 26 aa, Mycobacterium
AENYPLCKTYLWPALLDLADRRAGNG

SEQ ID NO: 880766 - protein, 24 aa, Mycobacterium
AEPAAWFTYYYWLDDDRAPEFAPC

SEQ ID NO: 880767 - protein, 27 aa, Mycobacterium
AEPLFSLFQAMPIPYIEPEDMANLGVF

SEQ ID NO: 880768 - protein, 23 aa, Mycobacterium
AEQLAFFPLWSYATPTAVELAER

SEQ ID NO: 880769 - protein, 17 aa, Mycobacterium
AEQQAVLTGWWLRRMVA

SEQ ID NO: 880770 - protein, 24 aa, Mycobacterium
AERFTVLRPLLFTIAYEMLGSATE

SEQ ID NO: 880771 - protein, 24 aa, Mycobacterium
AERGKFDFMFLAEGLRLREQGGAI

SEQ ID NO: 880772 - protein, 23 aa, Mycobacterium
AERIARWFLPITGDLRAGGHYSL

SEQ ID NO: 880773 - protein, 24 aa, Mycobacterium
AERLGFRRGWLSERFDLKDSGAIL

SEQ ID NO: 880774 - protein, 27 aa, Mycobacterium
AERLGVLGLPFLFFIDAAQGRAGVLYH

SEQ ID NO: 880775 - protein, 25 aa, Mycobacterium
AESAGLPLFRYIGGPNAHILPVPMM

SEQ ID NO: 880776 - protein, 25 aa, Mycobacterium
AESGFPMLPPLMPPPISAGSGWRKR

SEQ ID NO: 880777 - protein, 24 aa, Mycobacterium
AESGFPMMPMMVPPPTASAGTGWR

SEQ ID NO: 880778 - protein, 27 aa, Mycobacterium
AETELPITPFVLTLRLLTVALRRHVVL

SEQ ID NO: 880779 - protein, 24 aa, Mycobacterium
AETLAFFPLWSYATPTAIELAERV

SEQ ID NO: 880780 - protein, 20 aa, Mycobacterium
AETRYWYYALQTCRLNEHRA

SEQ ID NO: 880781 - protein, 21 aa, Mycobacterium
AETVLPFSWQGVCLHAAGASR

SEQ ID NO: 880782 - protein, 18 aa, Mycobacterium
AETYLDIHRIIAAASLTG

SEQ ID NO: 880783 - protein, 19 aa, Mycobacterium
AEVDIWFPDKKGGPGWVEW

SEQ ID NO: 880784 - protein, 22 aa, Mycobacterium
AEVPLLGQIPLDPALVAAGDSG

SEQ ID NO: 880785 - protein, 22 aa, Mycobacterium
AEVPLLGRIPLDPALVAAGDSG

SEQ ID NO: 880786 - protein, 18 aa, Mycobacterium
AEWLLPRSPAIRKVLWRL

SEQ ID NO: 880787 - protein, 20 aa, Mycobacterium
AEWMGPFLERMGLTVGWITE

SEQ ID NO: 880788 - protein, 22 aa, Mycobacterium
AEWMGPLLKALGLTVGWITADS

SEQ ID NO: 880789 - protein, 24 aa, Mycobacterium
AEYDLSLWILKVRALTSAWGTSEW

SEQ ID NO: 880790 - protein, 17 aa, Mycobacterium
AEYLRLLRRHNVAATLS

SEQ ID NO: 880791 - protein, 25 aa, Mycobacterium
AEYSIDLFALLPLAELWVAATRIRQ

SEQ ID NO: 880792 - protein, 24 aa, Mycobacterium
AEYSIDLYSLLPLGELWVAAARMR

SEQ ID NO: 880793 - protein, 18 aa, Mycobacterium
AEYWHWVTLVQQAIVVIT

SEQ ID NO: 880794 - protein, 18 aa, Mycobacterium
AFAAKLAERVGCRRADDG

SEQ ID NO: 880795 - protein, 17 aa, Mycobacterium
AFAHLEPGQRRPSAELT

SEQ ID NO: 880796 - protein, 18 aa, Mycobacterium
AFAIAFYGIMYRGAVAVP

SEQ ID NO: 880797 - protein, 18 aa, Mycobacterium
AFAPVPLAWIAETGADPA

SEQ ID NO: 880798 - protein, 19 aa, Mycobacterium
AFAPVPLAWLADTGADEAK

SEQ ID NO: 880799 - protein, 21 aa, Mycobacterium
AFAPVPLAWLAETGADPARMN

SEQ ID NO: 880800 - protein, 18 aa, Mycobacterium
AFAPVPLAWLAETGADPG

SEQ ID NO: 880801 - protein, 17 aa, Mycobacterium
AFAWCWAKGGYWRSHIR

SEQ ID NO: 880802 - protein, 21 aa, Mycobacterium
AFDCSGLVMWSFQQAGISLPH

SEQ ID NO: 880803 - protein, 19 aa, Mycobacterium
AFDLAARRRLPVVLFAEGG

SEQ ID NO: 880804 - protein, 18 aa, Mycobacterium
AFDLIYRQWLDLGHDVHY

SEQ ID NO: 880805 - protein, 20 aa, Mycobacterium
AFDLYSCFPFPVFNICDGTG

SEQ ID NO: 880806 - protein, 18 aa, Mycobacterium
AFFAPYVDMGAWPVPNLL

SEQ ID NO: 880807 - protein, 18 aa, Mycobacterium
AFFFTKRKLARMAGLATA

SEQ ID NO: 880808 - protein, 17 aa, Mycobacterium
AFFGVRPHAVIKGGGIV

SEQ ID NO: 880809 - protein, 17 aa, Mycobacterium
AFFGVRPHAVIKGGMIA

SEQ ID NO: 880810 - protein, 18 aa, Mycobacterium
AFFRQYYNLRALLARIDP

SEQ ID NO: 880811 - protein, 25 aa, Mycobacterium
AFGDKVLPLYLPTGLPSCRGLIGLL

SEQ ID NO: 880812 - protein, 26 aa, Mycobacterium
AFGTPSYFAQLAFAVFHVVALPITVP

SEQ ID NO: 880813 - protein, 18 aa, Mycobacterium
AFHDQLVTALDAAAGKYA

SEQ ID NO: 880814 - protein, 19 aa, Mycobacterium
AFHQQFWRSLSGAAASYSG

SEQ ID NO: 880815 - protein, 24 aa, Mycobacterium
AFIARLLEMAPFRKILYSSDGFGP

SEQ ID NO: 880816 - protein, 19 aa, Mycobacterium
AFIMMLRYPAKVTGFFGMN

SEQ ID NO: 880817 - protein, 17 aa, Mycobacterium
AFKIPLVFVVDTPGFLP

SEQ ID NO: 880818 - protein, 19 aa, Mycobacterium
AFLGRLLELAPFSKILYSS

SEQ ID NO: 880819 - protein, 24 aa, Mycobacterium
AFLNVLSAAIWIPVPTAYAASKAA

SEQ ID NO: 880820 - protein, 17 aa, Mycobacterium
AFLRMYYLNKACEIQIA

SEQ ID NO: 880821 - protein, 18 aa, Mycobacterium
AFMQWRRAQGLPATSIAW

SEQ ID NO: 880822 - protein, 19 aa, Mycobacterium
AFMTGLLDALWSLDLLGAD

SEQ ID NO: 880823 - protein, 19 aa, Mycobacterium
AFNFPVAVWSWNTAIALVC

SEQ ID NO: 880824 - protein, 17 aa, Mycobacterium
AFPHYFILPTYSSASSY

SEQ ID NO: 880825 - protein, 18 aa, Mycobacterium
AFPHYFLLPQYSSASSYR

SEQ ID NO: 880826 - protein, 20 aa, Mycobacterium
AFPRSLLERLPRLKLITIVG

SEQ ID NO: 880827 - protein, 20 aa, Mycobacterium
AFQQAMGLVWYYANSNPAMS

SEQ ID NO: 880828 - protein, 18 aa, Mycobacterium
AFQYVPMLSMYAAMKATL

SEQ ID NO: 880829 - protein, 19 aa, Mycobacterium
AFRNELWQQRFPGLDWKVT

SEQ ID NO: 880830 - protein, 17 aa, Mycobacterium
AFRPLHYPMTSAIGLGI

SEQ ID NO: 880831 - protein, 17 aa, Mycobacterium
AFSRPAIWWSKLGGPVV

SEQ ID NO: 880832 - protein, 24 aa, Mycobacterium
AFTINPILLLEETGLVAAAKGGHF

SEQ ID NO: 880833 - protein, 18 aa, Mycobacterium
AFVAPLYAYLVSDLARDV

SEQ ID NO: 880834 - protein, 17 aa, Mycobacterium
AFVLPLHRRADGLGWAS

SEQ ID NO: 880835 - protein, 17 aa, Mycobacterium
AFVLQPLSAALAAGRRP

SEQ ID NO: 880836 - protein, 20 aa, Mycobacterium
AFVRLAYPSGNYKPLHSLLD

SEQ ID NO: 880837 - protein, 17 aa, Mycobacterium
AFVRMVLTNWFGQNCLA

SEQ ID NO: 880838 - protein, 21 aa, Mycobacterium
AFVVWLRLPTALRQGGIAVLP

SEQ ID NO: 880839 - protein, 17 aa, Mycobacterium
AFWLRTAATLDFDPLTA

SEQ ID NO: 880840 - protein, 17 aa, Mycobacterium
AFYEEQYWRARLAETPV

SEQ ID NO: 880841 - protein, 19 aa, Mycobacterium
AFYGPQFALTFPILTHYGV

SEQ ID NO: 880842 - protein, 19 aa, Mycobacterium
AFYQLLHQGTWLVPADFIG

SEQ ID NO: 880843 - protein, 20 aa, Mycobacterium
AGAAGGILWGNGGSGGSGAA

SEQ ID NO: 880844 - protein, 24 aa, Mycobacterium
AGAAGPLTNAGLAGGFGTGGTGGT

SEQ ID NO: 880845 - protein, 19 aa, Mycobacterium
AGAAPYTSWLTLAAAHAQR

SEQ ID NO: 880846 - protein, 22 aa, Mycobacterium
AGAAYLAITAYPSNSSGTAGAT

SEQ ID NO: 880847 - protein, 17 aa, Mycobacterium
AGAAYWWQNTRATVLFE

SEQ ID NO: 880848 - protein, 25 aa, Mycobacterium
AGADVLPWWPVLGVVLLLERETHRN

SEQ ID NO: 880849 - protein, 21 aa, Mycobacterium
AGAFFGLWQPLGHRGFEIIGE

SEQ ID NO: 880850 - protein, 25 aa, Mycobacterium
AGAGRSPWSLLRRRRGVLPSIEEAL

SEQ ID NO: 880851 - protein, 18 aa, Mycobacterium
AGAPLLRHRIELGSGALG

SEQ ID NO: 880852 - protein, 17 aa, Mycobacterium
AGATPFLVGLLAAAQRA

SEQ ID NO: 880853 - protein, 23 aa, Mycobacterium
AGAVTVPVNFLAHAGSDGGIGTG

SEQ ID NO: 880854 - protein, 17 aa, Mycobacterium
AGDGFARYWLHNGWVTM

SEQ ID NO: 880855 - protein, 20 aa, Mycobacterium
AGDRWILHCGDAFYHVGTLD

SEQ ID NO: 880856 - protein, 18 aa, Mycobacterium
AGELEKFQWFVRAHLESA

SEQ ID NO: 880857 - protein, 20 aa, Mycobacterium
AGELLFLYNGVRPRNVMPVH

SEQ ID NO: 880858 - protein, 24 aa, Mycobacterium
AGETGTWGNAGLPGKAGDAGGAGA

SEQ ID NO: 880859 - protein, 17 aa, Mycobacterium
AGFFTGLPDRPTGVPVL

SEQ ID NO: 880860 - protein, 17 aa, Mycobacterium
AGFGYAVLLPDVYYRTA

SEQ ID NO: 880861 - protein, 17 aa, Mycobacterium
AGFGYVVLVPDVYYRIP

SEQ ID NO: 880862 - protein, 17 aa, Mycobacterium
AGFTINRRFSLPGLPAP

SEQ ID NO: 880863 - protein, 23 aa, Mycobacterium
AGGAAVGLFGNGGIGGAGGGAEG

SEQ ID NO: 880864 - protein, 21 aa, Mycobacterium
AGGAGGLLWGQGGIGGTGGSG

SEQ ID NO: 880865 - protein, 24 aa, Mycobacterium
AGGAIFRFGLPPFKWWQGLQGRKL

SEQ ID NO: 880866 - protein, 27 aa, Mycobacterium
AGGANSQLLSLWGSAGAGGAGGIGGAG

SEQ ID NO: 880867 - protein, 23 aa, Mycobacterium
AGGFFFLVELLDATSFWQSARAG

SEQ ID NO: 880868 - protein, 28 aa, Mycobacterium
AGGGIFWTRLGLLLQFNPWGDTEWTTNT

SEQ ID NO: 880869 - protein, 19 aa, Mycobacterium
AGGGLLFGLGGSGGAGGVA

SEQ ID NO: 880870 - protein, 24 aa, Mycobacterium
AGGISGLLLGLDGFNAPASTSALH

SEQ ID NO: 880871 - protein, 17 aa, Mycobacterium
AGGNALGLFGHGGAGGA

SEQ ID NO: 880872 - protein, 24 aa, Mycobacterium
AGGNGFLGAPAFSSNPGGNGGNGG

SEQ ID NO: 880873 - protein, 17 aa, Mycobacterium
AGGPRPGWPTYFTKRPS

SEQ ID NO: 880874 - protein, 22 aa, Mycobacterium
AGGSAGLWGAGGAGGAGGAGAT

SEQ ID NO: 880875 - protein, 21 aa, Mycobacterium
AGGSAPLLGWGGNGGAGGDST

SEQ ID NO: 880876 - protein, 23 aa, Mycobacterium
AGGTGGWWFGNGGVGGAGGAGTA

SEQ ID NO: 880877 - protein, 28 aa, Mycobacterium
AGGVGGVDRALIGWSGGAGGVGGSGGAG

SEQ ID NO: 880878 - protein, 22 aa, Mycobacterium
AGGVGGWLFGAGGGGGAGGAGG

SEQ ID NO: 880879 - protein, 18 aa, Mycobacterium
AGGWLFGDGGIGGTGGAG

SEQ ID NO: 880880 - protein, 22 aa, Mycobacterium
AGGWLVRVVLSLILWPAEDAEI

SEQ ID NO: 880881 - protein, 19 aa, Mycobacterium
AGGWWQDAFLYSRALTIAG

SEQ ID NO: 880882 - protein, 23 aa, Mycobacterium
AGHDALLPLYDLLTRLFGFTRVY

SEQ ID NO: 880883 - protein, 17 aa, Mycobacterium
AGHLWWIRSQLRSLLVA

SEQ ID NO: 880884 - protein, 26 aa, Mycobacterium
AGIDRKALRVILGNPLIAITMLRHDV

SEQ ID NO: 880885 - protein, 24 aa, Mycobacterium
AGIHQLCLPLLPRLGHLPVPQRDA

SEQ ID NO: 880886 - protein, 18 aa, Mycobacterium
AGILPWHPDPVYSLGKHG

SEQ ID NO: 880887 - protein, 25 aa, Mycobacterium
AGINAPSQMLTGRPLIGNGANGVDG

SEQ ID NO: 880888 - protein, 20 aa, Mycobacterium
AGIPTLILWTAGDQPFWGSH

SEQ ID NO: 880889 - protein, 19 aa, Mycobacterium
AGIQSFFDLPLITARAAPE

SEQ ID NO: 880890 - protein, 23 aa, Mycobacterium
AGIRALAGLWRSLTRKEVFPTQP

SEQ ID NO: 880891 - protein, 29 aa, Mycobacterium
AGIVPWNFPLLLAVWKLGPALAAGNTIVL

SEQ ID NO: 880892 - protein, 17 aa, Mycobacterium
AGIVYLAAQPLPVSDHR

SEQ ID NO: 880893 - protein, 23 aa, Mycobacterium
AGKGRAILNYRPLHHIRRPQRDI

SEQ ID NO: 880894 - protein, 17 aa, Mycobacterium
AGKLIVVVLPDFGERYL

SEQ ID NO: 880895 - protein, 20 aa, Mycobacterium
AGKSTLLRILARDLEPLEGT

SEQ ID NO: 880896 - protein, 18 aa, Mycobacterium
AGKTPWPGGAPYAALPTG

SEQ ID NO: 880897 - protein, 22 aa, Mycobacterium
AGLDLLILRVAALFHENLKVLH

SEQ ID NO: 880898 - protein, 25 aa, Mycobacterium
AGLDLMLFHAWYLYRNLDLNVVLPV

SEQ ID NO: 880899 - protein, 23 aa, Mycobacterium
AGLDPFEVAALWNALRKGGVPTA

SEQ ID NO: 880900 - protein, 20 aa, Mycobacterium
AGLDVRAHRLPWPAGTKVFE

SEQ ID NO: 880901 - protein, 20 aa, Mycobacterium
AGLERIMRLLSQPGLDPDAH

SEQ ID NO: 880902 - protein, 17 aa, Mycobacterium
AGLLRIWKSLIVLYPDG

SEQ ID NO: 880903 - protein, 27 aa, Mycobacterium
AGLMRLPLPTLLLPTALRPALFPLWLA

SEQ ID NO: 880904 - protein, 23 aa, Mycobacterium
AGLQSMLPAITPLANIFAKLTVE

SEQ ID NO: 880905 - protein, 25 aa, Mycobacterium
AGLRRRVMVVLPFLTPTIASWWVGL

SEQ ID NO: 880906 - protein, 17 aa, Mycobacterium
AGLTLLQKSLRGSLFGG

SEQ ID NO: 880907 - protein, 21 aa, Mycobacterium
AGLTPLRPWRAALAEALATMG

SEQ ID NO: 880908 - protein, 19 aa, Mycobacterium
AGLWSVWKPDKSAAPLLSC

SEQ ID NO: 880909 - protein, 19 aa, Mycobacterium
AGMDLLPRLLFRAGELDTS

SEQ ID NO: 880910 - protein, 18 aa, Mycobacterium
AGMMLAAILGGSVGAPIV

SEQ ID NO: 880911 - protein, 19 aa, Mycobacterium
AGMTAWFDWLRRFAQGLPP

SEQ ID NO: 880912 - protein, 30 aa, Mycobacterium; identical to SEQ ID NO: 134255

SEQ ID NO: 880913 - protein, 31 aa, Mycobacterium
AGMTEPLYLMPWSTMFPLGISSATIGIAEGA

SEQ ID NO: 880914 - protein, 17 aa, Mycobacterium
AGNAMDWVYRDSGYRQF

SEQ ID NO: 880915 - protein, 28 aa, Mycobacterium
AGNWACIVPHTWLWTSPLGPEVRAVEMV

SEQ ID NO: 880916 - protein, 17 aa, Mycobacterium
AGPFFRYERPQAGRYRQ

SEQ ID NO: 880917 - protein, 24 aa, Mycobacterium
AGPNLAFQLLWYPSTMWDQSLPSF

SEQ ID NO: 880918 - protein, 20 aa, Mycobacterium
AGPPWFAVSPLMHAAGLWTA

SEQ ID NO: 880919 - protein, 19 aa, Mycobacterium
AGPVRLLRSDGHRGRHLPV

SEQ ID NO: 880920 - protein, 23 aa, Mycobacterium
AGPVTIPVFHLSPTPGFGNSGGA

SEQ ID NO: 880921 - protein, 24 aa, Mycobacterium
AGQPFGRALPQYGFRPTFVARPPA

SEQ ID NO: 880922 - protein, 22 aa, Mycobacterium
AGRFGIHPALLDAALHAGLYGA

SEQ ID NO: 880923 - protein, 25 aa, Mycobacterium
AGRFGVPMVWVPPLRERVSDIGVLW

SEQ ID NO: 880924 - protein, 22 aa, Mycobacterium
AGRGLFYGLGGAGGMGGSATAV

SEQ ID NO: 880925 - protein, 26 aa, Mycobacterium
AGRGRPFPDLILASLLRLKVNDVREV

SEQ ID NO: 880926 - protein, 18 aa, Mycobacterium
AGRRLIRFPELAAYPFVV

SEQ ID NO: 880927 - protein, 22 aa, Mycobacterium
AGRVDAFLLPTLSLRGMAQVNK

SEQ ID NO: 880928 - protein, 21 aa, Mycobacterium
AGRVIVLPWDKHIAAGTEIQL

SEQ ID NO: 880929 - protein, 23 aa, Mycobacterium
AGRWLVGAIHYKAQRWPEVISSL

SEQ ID NO: 880930 - protein, 20 aa, Mycobacterium
AGSFPWVLAITPPYTDSAQR

SEQ ID NO: 880931 - protein, 26 aa, Mycobacterium
AGSKLADLVFPTLPAPIAATGSDPVS

SEQ ID NO: 880932 - protein, 19 aa, Mycobacterium
AGSPLLFPGSWSPSGIATP

SEQ ID NO: 880933 - protein, 25 aa, Mycobacterium
AGTLAFFPLWGYATPTAIELAERLA

SEQ ID NO: 880934 - protein, 21 aa, Mycobacterium
AGTPVLAVFELRLTGSARTTG

SEQ ID NO: 880935 - protein, 25 aa, Mycobacterium
AGTRKPVWFFAYPGKPSELAPEDAQ

SEQ ID NO: 880936 - protein, 25 aa, Mycobacterium
AGTRLRGLVFPTPPAPIVAAGTDAL

SEQ ID NO: 880937 - protein, 21 aa, Mycobacterium
AGTSMLCCLPRPARLRESVIA

SEQ ID NO: 880938 - protein, 21 aa, Mycobacterium
AGTVLRFVPPLAALSAAVVTF

SEQ ID NO: 880939 - protein, 24 aa, Mycobacterium
AGVAFPDALLTRGLYQYKPDLPFS

SEQ ID NO: 880940 - protein, 19 aa, Mycobacterium
AGVDTFFVATAPRYSFVSS

SEQ ID NO: 880941 - protein, 17 aa, Mycobacterium
AGVHRLIAVLWGEPVEE

SEQ ID NO: 880942 - protein, 23 aa, Mycobacterium
AGVLDLWALWRRAGNESAVITSR

SEQ ID NO: 880943 - protein, 27 aa, Mycobacterium
AGVSKALFYFYFPRKEDVLFEVGVMST

SEQ ID NO: 880944 - protein, 25 aa, Mycobacterium
AGVVSGLSAFPGGIGGAGGAGGQGG

SEQ ID NO: 880945 - protein, 20 aa, Mycobacterium
AGWLTFLRSLTARGLSGVKL

SEQ ID NO: 880946 - protein, 22 aa, Mycobacterium
AGYVHSFPPMPLQPKGFMTPDE

SEQ ID NO: 880947 - protein, 25 aa, Mycobacterium
AGYVQFWAKWMPTLRKPLIDTLNTV

SEQ ID NO: 880948 - protein, 18 aa, Mycobacterium
AHAQLAMYQLAVAAGLIA

SEQ ID NO: 880949 - protein, 24 aa, Mycobacterium
AHCPAYFQLLIKSLLQPGLLELAQ

SEQ ID NO: 880950 - protein, 17 aa, Mycobacterium
AHDYLTFARALLGGGQA

SEQ ID NO: 880951 - protein, 18 aa, Mycobacterium
AHFLWLNWGPIPPRQDMA

SEQ ID NO: 880952 - protein, 24 aa, Mycobacterium
AHGLLTLSLLPHFTHQLYRVDNIT

SEQ ID NO: 880953 - protein, 23 aa, Mycobacterium
AHGVPTYRWPMVPALALTASMPV

SEQ ID NO: 880954 - protein, 22 aa, Mycobacterium
AHHRLFSHVPWLSSQVLGAVEA

SEQ ID NO: 880955 - protein, 21 aa, Mycobacterium
AHLGPYCWPAAIKMIESGALP

SEQ ID NO: 880956 - protein, 18 aa, Mycobacterium
AHLLLAMFNALQPGVFAL

SEQ ID NO: 880957 - protein, 18 aa, Mycobacterium
AHLRRARFWWRYCRGPVG

SEQ ID NO: 880958 - protein, 23 aa, Mycobacterium
AHMAAFHDQFVQTLKTGALAYTG

SEQ ID NO: 880959 - protein, 32 aa, Mycobacterium; identical to SEQ ID NO: 134259

SEQ ID NO: 880960 - protein, 23 aa, Mycobacterium
AHPDRVWAWYLWRHHMMSAVGPN

SEQ ID NO: 880961 - protein, 17 aa, Mycobacterium
AHPFPYISGLSLNLAIT

SEQ ID NO: 880962 - protein, 18 aa, Mycobacterium
AHPGLLRFTLGLGQTLAL

SEQ ID NO: 880963 - protein, 17 aa, Mycobacterium
AHQPAAIMLSFGDLRPF

SEQ ID NO: 880964 - protein, 22 aa, Mycobacterium
AHSLALQRLRLDPVLDLQMRLG

SEQ ID NO: 880965 - protein, 24 aa, Mycobacterium
AHVQTLLLPALQPEIRLAAPLLAK

SEQ ID NO: 880966 - protein, 20 aa, Mycobacterium
AHVYLRRALTSTELWPVGLE

SEQ ID NO: 880967 - protein, 19 aa, Mycobacterium
AHWPAFRRVDFLRALRDYS

SEQ ID NO: 880968 - protein, 23 aa, Mycobacterium
AHYAPFGLLTPAAWVALHAQRYM

SEQ ID NO: 880969 - protein, 18 aa, Mycobacterium
AHYAPFGLLTPAAWVAMH

SEQ ID NO: 880970 - protein, 17 aa, Mycobacterium
AIAALFSFHGQSYQTLG

SEQ ID NO: 880971 - protein, 18 aa, Mycobacterium
AIADWLYWQHVAGLLGSA

SEQ ID NO: 880972 - protein, 19 aa, Mycobacterium
AIAPQRWLTAIAGISRTLC

SEQ ID NO: 880973 - protein, 18 aa, Mycobacterium
AIAWHLLETLKPKVPVRR

SEQ ID NO: 880974 - protein, 18 aa, Mycobacterium
AIAWLLRVSPVMLPIPGT

SEQ ID NO: 880975 - protein, 17 aa, Mycobacterium
AICPGFIETPLFDSVMG

SEQ ID NO: 880976 - protein, 21 aa, Mycobacterium
AIDGGWWVLGVHSPAAAECLR

SEQ ID NO: 880977 - protein, 18 aa, Mycobacterium
AIDILRWAPQAASEPVAK

SEQ ID NO: 880978 - protein, 20 aa, Mycobacterium
AIDLLLSSWPGKRTLACLPG

SEQ ID NO: 880979 - protein, 18 aa, Mycobacterium
AIDPVLLDLLRLGAYQLL

SEQ ID NO: 880980 - protein, 23 aa, Mycobacterium
AIDPVLLDLLRLGTYQLLRTRVG

SEQ ID NO: 880981 - protein, 25 aa, Mycobacterium
AIDRILAYVAPILLGGPVTAVDDVG

SEQ ID NO: 880982 - protein, 17 aa, Mycobacterium
AIEELIDAVKFTPALTG

SEQ ID NO: 880983 - protein, 18 aa, Mycobacterium
AIEGLLLGAYRFTEFRSA

SEQ ID NO: 880984 - protein, 22 aa, Mycobacterium
AIERIGLLGQPFLFFVDTGRDR

SEQ ID NO: 880985 - protein, 19 aa, Mycobacterium
AIGLVDLLLAPGGDLVTVL

SEQ ID NO: 880986 - protein, 19 aa, Mycobacterium
AIGMSPWLVNPLSAPAGAG

SEQ ID NO: 880987 - protein, 18 aa, Mycobacterium
AIGTLYRYFPTKRHLFVS

SEQ ID NO: 880988 - protein, 18 aa, Mycobacterium
AIGTPGGWLLGDGGAGGS

SEQ ID NO: 880989 - protein, 18 aa, Mycobacterium
AIHAILLTGAGPAFCSGG

SEQ ID NO: 880990 - protein, 18 aa, Mycobacterium
AIHFDTFGLLPQSNGTFG

SEQ ID NO: 880991 - protein, 20 aa, Mycobacterium
AIIRYLPMEELIAAFLPVLF

SEQ ID NO: 880992 - protein, 18 aa, Mycobacterium
AIKLTFVNPLITADLATG

SEQ ID NO: 880993 - protein, 18 aa, Mycobacterium
AILPLYYLRRADIAETDL

SEQ ID NO: 880994 - protein, 17 aa, Mycobacterium
AIMPMRVISALLGIPEE

SEQ ID NO: 880995 - protein, 18 aa, Mycobacterium
AINALFRSVALTFGPRAI

SEQ ID NO: 880996 - protein, 23 aa, Mycobacterium
AINAPTEFLLARPLIGNGADGTA

SEQ ID NO: 880997 - protein, 17 aa, Mycobacterium
AINAPTQALLGRPLIGD

SEQ ID NO: 880998 - protein, 24 aa, Mycobacterium
AINAPTQTLLGRPLIGNGADGAAG

SEQ ID NO: 880999 - protein, 23 aa, Mycobacterium
AINAPTQTLLGRPLIGNGADGAP

SEQ ID NO: 881000 - protein, 20 aa, Mycobacterium
AINLLGPMRLTASLLPALLR

SEQ ID NO: 881001 - protein, 17 aa, Mycobacterium
AIPFIYPPVTLTSSDGL

SEQ ID NO: 881002 - protein, 18 aa, Mycobacterium
AIPFTPLNYRLSAEGLRE

SEQ ID NO: 881003 - protein, 19 aa, Mycobacterium
AIPWLVIRALSDLAGAGSG

SEQ ID NO: 881004 - protein, 18 aa, Mycobacterium
AIRIGLALNCEITPWGRF

SEQ ID NO: 881005 - protein, 17 aa, Mycobacterium
AIRLGERLGVPESTLLS

SEQ ID NO: 881006 - protein, 28 aa, Mycobacterium
AISAQAAAFHDQFLRALTGAGGAYAAAE

SEQ ID NO: 881007 - protein, 18 aa, Mycobacterium
AISRVPLMPAMLEWLHTA

SEQ ID NO: 881008 - protein, 18 aa, Mycobacterium
AITELLIEALKRLNMSWP

SEQ ID NO: 881009 - protein, 19 aa, Mycobacterium
AITKILPIPAEAATPFGIM

SEQ ID NO: 881010 - protein, 23 aa, Mycobacterium
AITRTLMRDLLPPPLHGLHGIEF

SEQ ID NO: 881011 - protein, 25 aa, Mycobacterium
AITSLQYVGLLRLWYSVKISRDPAG

SEQ ID NO: 881012 - protein, 25 aa, Mycobacterium
AIVDPFGHRWMLTGPITGAPVPIRH

SEQ ID NO: 881013 - protein, 18 aa, Mycobacterium
AIVLFLDIGLERCQQMFA

SEQ ID NO: 881014 - protein, 28 aa, Mycobacterium
AIVPWNSPLLMLAWKLSPALAGGNTIIL

SEQ ID NO: 881015 - protein, 21 aa, Mycobacterium
AIVRALVRHPRLARRYLAVEG

SEQ ID NO: 881016 - protein, 22 aa, Mycobacterium
AIVRPRWLWKFGKTLRPPDLRV

SEQ ID NO: 881017 - protein, 19 aa, Mycobacterium
AIWINPWYPSPMADAGYDV

SEQ ID NO: 881018 - protein, 18 aa, Mycobacterium
AIWRIRRAAPLLPTVLLG

SEQ ID NO: 881019 - protein, 25 aa, Mycobacterium
AIWSPNTWHWVVASLAIHHAGGVLV

SEQ ID NO: 881020 - protein, 21 aa, Mycobacterium
AIYDKWLTLGPLVDKFGLTTK

SEQ ID NO: 881021 - protein, 18 aa, Mycobacterium
AIYDKWLTLGPLVEKFGL

SEQ ID NO: 881022 - protein, 19 aa, Mycobacterium
AIYRWTWNAPTATAFVGVP

SEQ ID NO: 881023 - protein, 20 aa, Mycobacterium
AKALVPQLLAFGASRVYAAD

SEQ ID NO: 881024 - protein, 24 aa, Mycobacterium
AKAQPLWRVLVALSIRHVGPTAAR

SEQ ID NO: 881025 - protein, 24 aa, Mycobacterium
AKASFLAGLIFRTALRKKYEDKAA

SEQ ID NO: 881026 - protein, 24 aa, Mycobacterium
AKEATYKVWFPLTNRWLGFEDAHI

SEQ ID NO: 881027 - protein, 20 aa, Mycobacterium
AKELFLGRFPLELIHPFPTP

SEQ ID NO: 881028 - protein, 24 aa, Mycobacterium
AKESGSPIFLYLGGDFPQGLDKAA

SEQ ID NO: 881029 - protein, 25 aa, Mycobacterium
AKETTYKAWFPLTARWLGFEDAHIT

SEQ ID NO: 881030 - protein, 20 aa, Mycobacterium
AKEVFGAVTGRDDMKREGQA

SEQ ID NO: 881031 - protein, 18 aa, Mycobacterium
AKFHSRFAQTLAAAAASY

SEQ ID NO: 881032 - protein, 25 aa, Mycobacterium
AKGRRTVWIPWALGPAAAVMRVLPQ

SEQ ID NO: 881033 - protein, 24 aa, Mycobacterium
AKHGLVGLMRLYANLLAPHNIRVN

SEQ ID NO: 881034 - protein, 21 aa, Mycobacterium
AKIDAFFFTDVLGIQGEFNRS

SEQ ID NO: 881035 - protein, 25 aa, Mycobacterium
AKISKPMLYLYYGSKEDLFVACLRR

SEQ ID NO: 881036 - protein, 18 aa, Mycobacterium
AKIWRGALKLGIEMRVGP

SEQ ID NO: 881037 - protein, 18 aa, Mycobacterium
AKKWLAARGFDPIYGARP

SEQ ID NO: 881038 - protein, 22 aa, Mycobacterium
AKNMFALGLLSWMYGRELEASE

SEQ ID NO: 881039 - protein, 23 aa, Mycobacterium
AKNMFALGLLSWMYGRELEHSEA

SEQ ID NO: 881040 - protein, 25 aa, Mycobacterium
AKNMFALGLLSWMYGRPIRTSENFI

SEQ ID NO: 881041 - protein, 20 aa, Mycobacterium
AKQRMLIGRQLAWRVRELES

SEQ ID NO: 881042 - protein, 19 aa, Mycobacterium
AKRLRILALLDPPVESLML

SEQ ID NO: 881043 - protein, 24 aa, Mycobacterium
AKRQYGYYVWPLLMDGRLVARVDL

SEQ ID NO: 881044 - protein, 17 aa, Mycobacterium
AKRTPDLIPLCHQLALT

SEQ ID NO: 881045 - protein, 18 aa, Mycobacterium
AKRTPKLARTRSWPTLEV

SEQ ID NO: 881046 - protein, 23 aa, Mycobacterium
AKRTSDLIPLCHQLALTGVDVEF

SEQ ID NO: 881047 - protein, 27 aa, Mycobacterium
AKTDLLDEAWWLPSVFIANGGAVAASL

SEQ ID NO: 881048 - protein, 28 aa, Mycobacterium
AKTDLLDEAWWLPSVFIPNGGAAAASLG

SEQ ID NO: 881049 - protein, 18 aa, Mycobacterium
AKVPWILMHWRSVDADHP

SEQ ID NO: 881050 - protein, 27 aa, Mycobacterium
AKVTLWLDPVCPFSWNTARWLRAVAEK

SEQ ID NO: 881051 - protein, 22 aa, Mycobacterium
AKWMARGIDLLLLDEPTRGLDI

SEQ ID NO: 881052 - protein, 21 aa, Mycobacterium
AKYLNRLSDLLFILARAANPE

SEQ ID NO: 881053 - protein, 18 aa, Mycobacterium
AKYPFLVRGYIGPKALLA

SEQ ID NO: 881054 - protein, 23 aa, Mycobacterium
ALAAAFPRYHPRWAWGLTRVPGV

SEQ ID NO: 881055 - protein, 17 aa, Mycobacterium
ALAAFRRGTRGLAAMIA

SEQ ID NO: 881056 - protein, 19 aa, Mycobacterium
ALAARTLLPVPWVEAVDIS

SEQ ID NO: 881057 - protein, 17 aa, Mycobacterium
ALAERILLNSKTRRPSV

SEQ ID NO: 881058 - protein, 23 aa, Mycobacterium
ALAESPWLVQPLAAPAGAGKTHS

SEQ ID NO: 881059 - protein, 19 aa, Mycobacterium
ALAFQYLVQLILFDWPTHI

SEQ ID NO: 881060 - protein, 18 aa, Mycobacterium
ALAGAMRPPGAPGAPGAP

SEQ ID NO: 881061 - protein, 17 aa, Mycobacterium
ALAHDERFGIWGGLSER

SEQ ID NO: 881062 - protein, 24 aa, Mycobacterium
ALAHGVWLRPFGKLIYAMPPFICT

SEQ ID NO: 881063 - protein, 23 aa, Mycobacterium
ALAIRPRVLLLDEPLAALDAQLR

SEQ ID NO: 881064 - protein, 23 aa, Mycobacterium
ALAIRPRVLLLDEPLSALDAKVR

SEQ ID NO: 881065 - protein, 18 aa, Mycobacterium
ALAPWQTVLQNLPGLSGV

SEQ ID NO: 881066 - protein, 25 aa, Mycobacterium
ALARDFLTIWFAQLYRHVADIKARI

SEQ ID NO: 881067 - protein, 20 aa, Mycobacterium
ALAREFLLSWFVYTAWELEE

SEQ ID NO: 881068 - protein, 19 aa, Mycobacterium
ALARRPRVLLLDEPLAALD

SEQ ID NO: 881069 - protein, 18 aa, Mycobacterium
ALATLRRSLGASATYAVA

SEQ ID NO: 881070 - protein, 17 aa, Mycobacterium
ALAWGVPFYGVNHLGGH

SEQ ID NO: 881071 - protein, 19 aa, Mycobacterium
ALAYARRVMGLPATVVDWG

SEQ ID NO: 881072 - protein, 23 aa, Mycobacterium
ALAYGDMGLALPLLAPGGVASAL

SEQ ID NO: 881073 - protein, 19 aa, Mycobacterium
ALDGWPVNVALLGKGNTVS

SEQ ID NO: 881074 - protein, 27 aa, Mycobacterium
ALDIDLVFSPFFNALPIRRLGIHERAE

SEQ ID NO: 881075 - protein, 23 aa, Mycobacterium
ALDIDLYLRIAPELFLKKALVGG

SEQ ID NO: 881076 - protein, 21 aa, Mycobacterium
ALDIDLYLRIAPELFLKRCIV

SEQ ID NO: 881077 - protein, 22 aa, Mycobacterium
ALDLARLMRLPVMFAQLDDQLI

SEQ ID NO: 881078 - protein, 17 aa, Mycobacterium
ALDLLHRAGIEWDPALP

SEQ ID NO: 881079 - protein, 19 aa, Mycobacterium
ALDLLTRWGDALAAPPVQP

SEQ ID NO: 881080 - protein, 18 aa, Mycobacterium
ALDLRPTAQLPPKSLRRL

SEQ ID NO: 881081 - protein, 23 aa, Mycobacterium
ALDPALLIYVLPGSALHTTAVET

SEQ ID NO: 881082 - protein, 17 aa, Mycobacterium
ALDPILLKVLDAVPFRL

SEQ ID NO: 881083 - protein, 23 aa, Mycobacterium
ALDRALIDLATYFRDALLAAANG

SEQ ID NO: 881084 - protein, 23 aa, Mycobacterium
ALDRALIDLATYFRDALLVSAGA

SEQ ID NO: 881085 - protein, 23 aa, Mycobacterium
ALDRALIDLATYFRDALLVSSGA

SEQ ID NO: 881086 - protein, 19 aa, Mycobacterium
ALDSWPVNIALLGKGNTVN

SEQ ID NO: 881087 - protein, 19 aa, Mycobacterium
ALDTLALLAARWLEVARPL

SEQ ID NO: 881088 - protein, 23 aa, Mycobacterium
ALDTLLRLLHPVIPFITEALWQA

SEQ ID NO: 881089 - protein, 20 aa, Mycobacterium
ALDVLTLFSYPLHPPGKPER

SEQ ID NO: 881090 - protein, 18 aa, Mycobacterium
ALDWLIEQMGLASGATLL

SEQ ID NO: 881091 - protein, 29 aa, Mycobacterium
ALEFDYVDLFLIHWPLPTLYDGDFVSTWK

SEQ ID NO: 881092 - protein, 21 aa, Mycobacterium
ALEIFLTPQLPAPLIRVYGTT

SEQ ID NO: 881093 - protein, 19 aa, Mycobacterium
ALEPLFAKTLKWASTTPLD

SEQ ID NO: 881094 - protein, 23 aa, Mycobacterium
ALETLSLPLLRAWLASASGAGVA

SEQ ID NO: 881095 - protein, 27 aa, Mycobacterium
ALFASDIPPLSWFLGNSPPPFLNLLLG

SEQ ID NO: 881096 - protein, 19 aa, Mycobacterium
ALFFDKFFADAIAAGLRQV

SEQ ID NO: 881097 - protein, 21 aa, Mycobacterium
ALFFGHGLNIHFGLIKPPANV

SEQ ID NO: 881098 - protein, 19 aa, Mycobacterium
ALFLRHLWATDGSVRWDAK

SEQ ID NO: 881099 - protein, 22 aa, Mycobacterium
ALGFFTGWLFTEFPPHVVTGHA

SEQ ID NO: 881100 - protein, 21 aa, Mycobacterium
ALGHLFPFCAVLQELARRGHD

SEQ ID NO: 881101 - protein, 28 aa, Mycobacterium
ALGLPTHALPWYPLLRLPVNVTRSVAAL

SEQ ID NO: 881102 - protein, 25 aa, Mycobacterium
ALGWVNLHFSVLPAWRGAAPVQAAL

SEQ ID NO: 881103 - protein, 19 aa, Mycobacterium
ALHDQIVRALTAGAGGYSA

SEQ ID NO: 881104 - protein, 29 aa, Mycobacterium
ALHRATRPGARWYIWCFAQGAVHGVPTPF

SEQ ID NO: 881105 - protein, 21 aa, Mycobacterium
ALHRFGLPLVVIDPLNQPTTR

SEQ ID NO: 881106 - protein, 24 aa, Mycobacterium
ALHTTVMPFILRGIALLGMDSCRC

SEQ ID NO: 881107 - protein, 23 aa, Mycobacterium
ALHTTVMPFILRGIALLGMDSVL

SEQ ID NO: 881108 - protein, 19 aa, Mycobacterium
ALIAPLRIGLREAGVPVLL

SEQ ID NO: 881109 - protein, 18 aa, Mycobacterium
ALICVPPYHIAGVGAALS

SEQ ID NO: 881110 - protein, 19 aa, Mycobacterium
ALICVPPYHIAGVGAALSN

SEQ ID NO: 881111 - protein, 19 aa, Mycobacterium
ALICVPPYHIAGVSAALSN

SEQ ID NO: 881112 - protein, 17 aa, Mycobacterium
ALIGYRIPTPIPRISYA

SEQ ID NO: 881113 - protein, 19 aa, Mycobacterium
ALILLLNGYVGYATGASWP

SEQ ID NO: 881114 - protein, 18 aa, Mycobacterium
ALKPIFFGAVALGGSTGV

SEQ ID NO: 881115 - protein, 31 aa, Mycobacterium
ALLAIPPYGWVNLHFSLLPAWRGAAPVQAAI

SEQ ID NO: 881116 - protein, 19 aa, Mycobacterium
ALLASWWTETWNAGGGDFV

SEQ ID NO: 881117 - protein, 23 aa, Mycobacterium
ALLDLFLRIIVELFQRHWSSTEH

SEQ ID NO: 881118 - protein, 19 aa, Mycobacterium
ALLEPFKGPWGTDTLLDLM

SEQ ID NO: 881119 - protein, 17 aa, Mycobacterium
ALLGAAFPLKQAWHVNV

SEQ ID NO: 881120 - protein, 20 aa, Mycobacterium
ALLGIWRRGAIHVPLFTAFA

SEQ ID NO: 881121 - protein, 24 aa, Mycobacterium
ALLGLMKRLPWLSAVPAYFVGVGV

SEQ ID NO: 881122 - protein, 22 aa, Mycobacterium
ALLKGLTAHYLLKSVYPVADGD

SEQ ID NO: 881123 - protein, 19 aa, Mycobacterium
ALLKILALQFIMSDPRHQE

SEQ ID NO: 881124 - protein, 18 aa, Mycobacterium
ALLLELIERYAPTLSLIV

SEQ ID NO: 881125 - protein, 19 aa, Mycobacterium
ALLLHYLPEIDMRTGDILA

SEQ ID NO: 881126 - protein, 17 aa, Mycobacterium
ALLLMPLPNRLDLYEKL

SEQ ID NO: 881127 - protein, 17 aa, Mycobacterium
ALLLPRRTPGRRSPLWQ

SEQ ID NO: 881128 - protein, 19 aa, Mycobacterium
ALLLRFYGHLARRTGDALA

SEQ ID NO: 881129 - protein, 19 aa, Mycobacterium
ALLLRWYCRYGGELRRYRV

SEQ ID NO: 881130 - protein, 19 aa, Mycobacterium
ALLMAILLRGMDRGETARW

SEQ ID NO: 881131 - protein, 21 aa, Mycobacterium
ALLMGWLIPPPWQPGGRVPAA

SEQ ID NO: 881132 - protein, 24 aa, Mycobacterium
ALLMGWLITPPWQPGGRRSGSLIA

SEQ ID NO: 881133 - protein, 17 aa, Mycobacterium
ALLQLPVAHWPALGGMG

SEQ ID NO: 881134 - protein, 19 aa, Mycobacterium
ALLVPFARASSWPTDLELL

SEQ ID NO: 881135 - protein, 24 aa, Mycobacterium
ALLVRSLVAWFWDEPLRAPLIRHG

SEQ ID NO: 881136 - protein, 18 aa, Mycobacterium
ALLVVALSERPDLLMPAT

SEQ ID NO: 881137 - protein, 24 aa, Mycobacterium
ALLYAQVWIAQVGRIPLLLLDSDI

SEQ ID NO: 881138 - protein, 24 aa, Mycobacterium
ALMQRFYTTSWRFAPFLWQEIEDG

SEQ ID NO: 881139 - protein, 20 aa, Mycobacterium
ALNLLFAAKLLRANPYTINI

SEQ ID NO: 881140 - protein, 26 aa, Mycobacterium
ALPAIDAVLLAAALWRGVELVIASMG

SEQ ID NO: 881141 - protein, 22 aa, Mycobacterium
ALPDGALMRRAAYGLAAVIADE

SEQ ID NO: 881142 - protein, 25 aa, Mycobacterium
ALPHPHWWFDLLTTEPLAFASLDRW

SEQ ID NO: 881143 - protein, 17 aa, Mycobacterium
ALPIPSLVICELLGVPY

SEQ ID NO: 881144 - protein, 18 aa, Mycobacterium
ALPKPLDHFLLQADLTVV

SEQ ID NO: 881145 - protein, 17 aa, Mycobacterium
ALPLFHVNALVVTILAP

SEQ ID NO: 881146 - protein, 17 aa, Mycobacterium
ALPPALSRYVVEKGSIT

SEQ ID NO: 881147 - protein, 25 aa, Mycobacterium
ALPRTALFVLDPWLRPVPTGVAGEL

SEQ ID NO: 881148 - protein, 19 aa, Mycobacterium
ALPSWLRLDARFGSVYRHR

SEQ ID NO: 881149 - protein, 22 aa, Mycobacterium
ALPVKLSYAGPFFRYERPQAGR

SEQ ID NO: 881150 - protein, 20 aa, Mycobacterium
ALQDFSLFQVLRFGFRPSKV

SEQ ID NO: 881151 - protein, 25 aa, Mycobacterium
ALQFYGELFLFDYPVHIPQLLTWLS

SEQ ID NO: 881152 - protein, 19 aa, Mycobacterium
ALQGFVALPLLAGYDLDDP

SEQ ID NO: 881153 - protein, 17 aa, Mycobacterium
ALQGFVALPLLVGYDLD

SEQ ID NO: 881154 - protein, 26 aa, Mycobacterium
ALQSPKPLWALWRLGSDPAFARISME

SEQ ID NO: 881155 - protein, 18 aa, Mycobacterium
ALQYWRSLGLPAKHRLMT

SEQ ID NO: 881156 - protein, 23 aa, Mycobacterium
ALRAPLDVFLVRKLGVPRWSELA

SEQ ID NO: 881157 - protein, 18 aa, Mycobacterium
ALRDGVIPPTRNLRNLDP

SEQ ID NO: 881158 - protein, 20 aa, Mycobacterium
ALRDRLIVELLYATGIRVSE

SEQ ID NO: 881159 - protein, 21 aa, Mycobacterium
ALRDRLIVELLYATGIRVSEL

SEQ ID NO: 881160 - protein, 22 aa, Mycobacterium
ALRDRLIVELLYATGIRVSELC

SEQ ID NO: 881161 - protein, 24 aa, Mycobacterium
ALRGCTWLPFFHDMGLITVMVPSM

SEQ ID NO: 881162 - protein, 18 aa, Mycobacterium
ALRLAIARALIIVEPEDR

SEQ ID NO: 881163 - protein, 18 aa, Mycobacterium
ALRLMKPLRILIKPKVYG

SEQ ID NO: 881164 - protein, 19 aa, Mycobacterium
ALRLRRAWWGIGEAGNLMV

SEQ ID NO: 881165 - protein, 17 aa, Mycobacterium
ALRRRVFGLPKPGSLAI

SEQ ID NO: 881166 - protein, 28 aa, Mycobacterium
ALRTEIDNWRWAGVPIFLRAGKALPEKV

SEQ ID NO: 881167 - protein, 29 aa, Mycobacterium
ALRTEIDNWRWAGVPIFLRAGKALPEKVT

SEQ ID NO: 881168 - protein, 19 aa, Mycobacterium
ALRVLTGPRWRLGAHDLVV

SEQ ID NO: 881169 - protein, 24 aa, Mycobacterium
ALRVPLIAVILRRGYGLGAQAMAG

SEQ ID NO: 881170 - protein, 19 aa, Mycobacterium
ALRWRLTGLGLRVIAHDPY

SEQ ID NO: 881171 - protein, 23 aa, Mycobacterium
ALSDLFTPVPWWINTIANHFNRR

SEQ ID NO: 881172 - protein, 17 aa, Mycobacterium
ALSLFLAKTFLAEEPDA

SEQ ID NO: 881173 - protein, 18 aa, Mycobacterium
ALSTLIRHHRSLPVLLVL

SEQ ID NO: 881174 - protein, 21 aa, Mycobacterium
ALTAKLRSHWARRLPATIVGR

SEQ ID NO: 881175 - protein, 17 aa, Mycobacterium
ALTAYFMGSLRTAIHHQ

SEQ ID NO: 881176 - protein, 22 aa, Mycobacterium
ALTELINALPFLIGKRAGAPQG

SEQ ID NO: 881177 - protein, 22 aa, Mycobacterium
ALTGHLLPLLRAAGNARVVSLS

SEQ ID NO: 881178 - protein, 18 aa, Mycobacterium
ALTGPALRWNPWATPIPR

SEQ ID NO: 881179 - protein, 18 aa, Mycobacterium
ALTLLHPQQVIMLGRPTL

SEQ ID NO: 881180 - protein, 19 aa, Mycobacterium
ALTQYRFDPADLGLLRGFL

SEQ ID NO: 881181 - protein, 19 aa, Mycobacterium
ALTREVLGAGIPLFGICFG

SEQ ID NO: 881182 - protein, 27 aa, Mycobacterium
ALTSRFPIVLWVGRDLFLIYNDAYAQI

SEQ ID NO: 881183 - protein, 17 aa, Mycobacterium
ALTVIRPLSRSAGEEVA

SEQ ID NO: 881184 - protein, 24 aa, Mycobacterium
ALVGRPRVLLLDEPLGALDLKLRE

SEQ ID NO: 881185 - protein, 23 aa, Mycobacterium
ALVLRPRVLLLDEPLGALDAKLR

SEQ ID NO: 881186 - protein, 17 aa, Mycobacterium
ALVRLVIYWGQEALAFG

SEQ ID NO: 881187 - protein, 18 aa, Mycobacterium
ALVYWKPALLIDDIPDTG

SEQ ID NO: 881188 - protein, 18 aa, Mycobacterium
ALWDLPLVFVCQNNRYAE

SEQ ID NO: 881189 - protein, 23 aa, Mycobacterium
ALWDLPMVFLCQNNLYAEMTPTS

SEQ ID NO: 881190 - protein, 19 aa, Mycobacterium
ALWDTILPFAGYAFNKSHA

SEQ ID NO: 881191 - protein, 17 aa, Mycobacterium
ALYFYFASKNDVLAALV

SEQ ID NO: 881192 - protein, 23 aa, Mycobacterium
AMAAAVAPYTSWLSAAAAQAVGA

SEQ ID NO: 881193 - protein, 19 aa, Mycobacterium
AMDRLGLLALLTSALERAD

SEQ ID NO: 881194 - protein, 17 aa, Mycobacterium
AMDWYSRCVTGLRLTPV

SEQ ID NO: 881195 - protein, 25 aa, Mycobacterium
AMFGTWHYWWQAHLLDCLVDAQLRD

SEQ ID NO: 881196 - protein, 17 aa, Mycobacterium
AMISLETCPPMGHPHHH

SEQ ID NO: 881197 - protein, 19 aa, Mycobacterium
AMKWFHYIFDPTDTEQLAA

SEQ ID NO: 881198 - protein, 20 aa, Mycobacterium
AMLAPLRNILGAIATFEGLD

SEQ ID NO: 881199 - protein, 18 aa, Mycobacterium
AMLMLPFFNYADGNHDAI

SEQ ID NO: 881200 - protein, 18 aa, Mycobacterium
AMLPPRWVAVGIGPADGV

SEQ ID NO: 881201 - protein, 26 aa, Mycobacterium
AMLPSFVFLRRLLLLAWMGSHTHSRE

SEQ ID NO: 881202 - protein, 17 aa, Mycobacterium
AMLTLLQKNLQGTIFGG

SEQ ID NO: 881203 - protein, 19 aa, Mycobacterium
AMLVAIFRARPSPFYIMDE

SEQ ID NO: 881204 - protein, 18 aa, Mycobacterium
AMMLSAAMLLRWLGERAG

SEQ ID NO: 881205 - protein, 18 aa, Mycobacterium
AMNTLFDGIAPLLADLRA

SEQ ID NO: 881206 - protein, 25 aa, Mycobacterium
AMPAQWSLMVLLAAWLAMRFGELTE

SEQ ID NO: 881207 - protein, 26 aa, Mycobacterium
AMPAQWSLMVLLAAWLAMRFGELTEL

SEQ ID NO: 881208 - protein, 18 aa, Mycobacterium
AMPFLFRGPMLWIAALVG

SEQ ID NO: 881209 - protein, 20 aa, Mycobacterium
AMQMALLPERLPAAEALSWG

SEQ ID NO: 881210 - protein, 17 aa, Mycobacterium
AMQYLIPGWTFDPKRPA

SEQ ID NO: 881211 - protein, 17 aa, Mycobacterium
AMRDGHATVFMAMGGNF

SEQ ID NO: 881212 - protein, 17 aa, Mycobacterium
AMRHGVLPKTLHVNAPT

SEQ ID NO: 881213 - protein, 19 aa, Mycobacterium
AMRMALLPERLPATEALSY

SEQ ID NO: 881214 - protein, 22 aa, Mycobacterium
AMRSKRYFRLLDALDAIAAAYP

SEQ ID NO: 881215 - protein, 25 aa, Mycobacterium
AMSAVAAPYASWLSAAAAQAAGTAG

SEQ ID NO: 881216 - protein, 21 aa, Mycobacterium
AMSIPLRWFHTSTTILACCVL

SEQ ID NO: 881217 - protein, 20 aa, Mycobacterium
AMTPWIWPTMHLNPPNWIEP

SEQ ID NO: 881218 - protein, 29 aa, Mycobacterium
AMTRSIRYPLRKVHLALVLWFPDDATDGN

SEQ ID NO: 881219 - protein, 23 aa, Mycobacterium
AMVASVLPFVSWLSTTAALAEQA

SEQ ID NO: 881220 - protein, 18 aa, Mycobacterium
AMYRMVTLAVLRAGIDPG

SEQ ID NO: 881221 - protein, 17 aa, Mycobacterium
ANAFVMSFLGAVSSLNG

SEQ ID NO: 881222 - protein, 18 aa, Mycobacterium
ANALFWLDQFHIDGLRVD

SEQ ID NO: 881223 - protein, 23 aa, Mycobacterium
ANASPLEFLLDAVNAPTQTLFGR

SEQ ID NO: 881224 - protein, 23 aa, Mycobacterium
ANELLLYEALGLCGPGEAPRLID

SEQ ID NO: 881225 - protein, 21 aa, Mycobacterium
ANELLLYEALGLCGQGEAPKL

SEQ ID NO: 881226 - protein, 18 aa, Mycobacterium
ANFLLIGAAYQAGALRIP

SEQ ID NO: 881227 - protein, 21 aa, Mycobacterium
ANGETMAMLGRPLIGNGADGA

SEQ ID NO: 881228 - protein, 18 aa, Mycobacterium
ANGRILPIDLATSPLRAL

SEQ ID NO: 881229 - protein, 19 aa, Mycobacterium
ANLLFEMYAFDAVLPSRYA

SEQ ID NO: 881230 - protein, 18 aa, Mycobacterium
ANLLRLKAFFARQWRQMP

SEQ ID NO: 881231 - protein, 17 aa, Mycobacterium
ANLPKPLRWIADKTNPG

SEQ ID NO: 881232 - protein, 24 aa, Mycobacterium
ANLVAMPLFHVGGIGYALFGIRAG

SEQ ID NO: 881233 - protein, 23 aa, Mycobacterium
ANLVAMPLFHVGGIGYALFGIRS

SEQ ID NO: 881234 - protein, 17 aa, Mycobacterium
ANPPLLLATRRLIGDDG

SEQ ID NO: 881235 - protein, 17 aa, Mycobacterium
ANRKIFLYPENWIEPAL

SEQ ID NO: 881236 - protein, 24 aa, Mycobacterium
ANRNVFVQLIRTNLFGLNAPAIMA

SEQ ID NO: 881237 - protein, 21 aa, Mycobacterium
ANSIAWLLWHSARVQDLQLAD

SEQ ID NO: 881238 - protein, 17 aa, Mycobacterium
ANSILVVLSLACAKCLA

SEQ ID NO: 881239 - protein, 21 aa, Mycobacterium
ANTVQWLRYLHDGPLTVVAVN

SEQ ID NO: 881240 - protein, 35 aa, Mycobacterium
ANVEQNLLGLINAPTQALFGRPLIGNGADGAAGTG

SEQ ID NO: 881241 - protein, 20 aa, Mycobacterium
ANYHTMYFAYARRGQLRAGE

SEQ ID NO: 881242 - protein, 20 aa, Mycobacterium
ANYLFDQFIELMAAPNRGKG

SEQ ID NO: 881243 - protein, 22 aa, Mycobacterium
APAHPVPWRLDGLPLLLDPADW

SEQ ID NO: 881244 - protein, 19 aa, Mycobacterium
APAKLLEARFGREALLDQV

SEQ ID NO: 881245 - protein, 20 aa, Mycobacterium
APAQTLLGRPLIGNGANGAP

SEQ ID NO: 881246 - protein, 20 aa, Mycobacterium
APASYFQLAFTRVGLMPDGG

SEQ ID NO: 881247 - protein, 24 aa, Mycobacterium
APCFAALAGLAPLVGYPGGPPLGT

SEQ ID NO: 881248 - protein, 17 aa, Mycobacterium
APCRLLDDWIAPGAARA

SEQ ID NO: 881249 - protein, 23 aa, Mycobacterium
APDKPFFVYFAPGATHSPHHVWP

SEQ ID NO: 881250 - protein, 23 aa, Mycobacterium
APDKPFFVYLAPGATHSPHHVWP

SEQ ID NO: 881251 - protein, 23 aa, Mycobacterium
APEAPWVRPPLRSLRWMETFLET

SEQ ID NO: 881252 - protein, 25 aa, Mycobacterium
APGDTRFIVLLPLQPPAADVAPELD

SEQ ID NO: 881253 - protein, 22 aa, Mycobacterium
APGEILCLPYFLGEKSPVHDPD

SEQ ID NO: 881254 - protein, 18 aa, Mycobacterium
APGLWRYWAEHLDPNRAR

SEQ ID NO: 881255 - protein, 19 aa, Mycobacterium
APGLYSWLPLGLRVLRNIE

SEQ ID NO: 881256 - protein, 18 aa, Mycobacterium
APGMPMPAPGLVAPPTMP

SEQ ID NO: 881257 - protein, 23 aa, Mycobacterium
APGVPMLFPPWLERLQLKYVNPV

SEQ ID NO: 881258 - protein, 25 aa, Mycobacterium
APHLVKPLPFLFPLTNRVWERPYIA

SEQ ID NO: 881259 - protein, 25 aa, Mycobacterium
APHLVKPLPFLFPLTNRWWERPYVA

SEQ ID NO: 881260 - protein, 17 aa, Mycobacterium
APHPLLVYPAEQTARSL

SEQ ID NO: 881261 - protein, 18 aa, Mycobacterium
APIWWNEQPDGIGGFGDG

SEQ ID NO: 881262 - protein, 25 aa, Mycobacterium
APKPKRLTLFLIPMDRPGFTVRPIG

SEQ ID NO: 881263 - protein, 25 aa, Mycobacterium
APKPKRLTLFLLPMDRPGFTVRPIP

SEQ ID NO: 881264 - protein, 22 aa, Mycobacterium
APKPLRGMPPFSGPQGPFAGIA

SEQ ID NO: 881265 - protein, 23 aa, Mycobacterium
APKPMLPIAGFPFLTHVLSRVAA

SEQ ID NO: 881266 - protein, 26 aa, Mycobacterium
APKRLGSFMDSRLWRMLLAPGRGIGK

SEQ ID NO: 881267 - protein, 26 aa, Mycobacterium
APKRLGSFMDSRLWRMLLAPGRGIGR

SEQ ID NO: 881268 - protein, 20 aa, Mycobacterium
APLGFLAQTPPAVTPAGLIV

SEQ ID NO: 881269 - protein, 20 aa, Mycobacterium
APLLYPHMWSWDAAFVAIGL

SEQ ID NO: 881270 - protein, 24 aa, Mycobacterium
APLSLMPWVLTMPNPIFTRAARQM

SEQ ID NO: 881271 - protein, 19 aa, Mycobacterium
APLVILYAATLPIGAWPVV

SEQ ID NO: 881272 - protein, 24 aa, Mycobacterium
APMIGHYFTFMTPAAFVRRPERWI

SEQ ID NO: 881273 - protein, 26 aa, Mycobacterium
APNPLHPLTLPLLRPQQVIMLGRPTL

SEQ ID NO: 881274 - protein, 17 aa, Mycobacterium
APNRTGWLYPFASELVT

SEQ ID NO: 881275 - protein, 26 aa, Mycobacterium
APPCAPRWRWWRSSWWRVFSPAASCG

SEQ ID NO: 881276 - protein, 20 aa, Mycobacterium
APPPGIPQTPPLPGPEGPPP

SEQ ID NO: 881277 - protein, 21 aa, Mycobacterium
APPVLLIMGLGAQLLLWRTGF

SEQ ID NO: 881278 - protein, 23 aa, Mycobacterium
APQERIFMGFPPLGELFGATHDE

SEQ ID NO: 881279 - protein, 23 aa, Mycobacterium
APQGLLHKVVLARALQLTAETAL

SEQ ID NO: 881280 - protein, 18 aa, Mycobacterium
APQLWRYWAEHLDPDRAR

SEQ ID NO: 881281 - protein, 18 aa, Mycobacterium
APRQSLTGTPLPPALPAT

SEQ ID NO: 881282 - protein, 18 aa, Mycobacterium
APRTPLARVFWPRTRIVV

SEQ ID NO: 881283 - protein, 26 aa, Mycobacterium
APSPEAYLALVRYLLELDLIDRVVFA

SEQ ID NO: 881284 - protein, 24 aa, Mycobacterium
APTFDIFMWEIFGPLVAGARLVFN

SEQ ID NO: 881285 - protein, 19 aa, Mycobacterium
APTIRLIRRRLIPAGTWSG

SEQ ID NO: 881286 - protein, 23 aa, Mycobacterium
APTLSGFWHWAVANLPAEVTELP

SEQ ID NO: 881287 - protein, 21 aa, Mycobacterium
APTNALLGRPLIGNGANGAPG

SEQ ID NO: 881288 - protein, 20 aa, Mycobacterium
APTQALLGRPLIGNGTNGLP

SEQ ID NO: 881289 - protein, 20 aa, Mycobacterium
APTQTLFNRPLIGNGANGAP

SEQ ID NO: 881290 - protein, 19 aa, Mycobacterium
APVPYRSFITWLSEQDRAA

SEQ ID NO: 881291 - protein, 17 aa, Mycobacterium
APVTAIPLALRRSGLTV

SEQ ID NO: 881292 - protein, 24 aa, Mycobacterium
APVVLQFPWKLMPGKYIAGIEEAA

SEQ ID NO: 881293 - protein, 18 aa, Mycobacterium
APVYLYRFDFATPMLRLL

SEQ ID NO: 881294 - protein, 21 aa, Mycobacterium
APWASLVTYGLLGGAPVLCVS

SEQ ID NO: 881295 - protein, 19 aa, Mycobacterium
APYARWLSAAAGHASGAAA

SEQ ID NO: 881296 - protein, 19 aa, Mycobacterium
APYVGWLYRTAEQTQQAAI

SEQ ID NO: 881297 - protein, 17 aa, Mycobacterium
APYVSWLYTTATQTKQT

SEQ ID NO: 881298 - protein, 19 aa, Mycobacterium
AQAIAYMLEILPALGFLHS

SEQ ID NO: 881299 - protein, 23 aa, Mycobacterium
AQAITFHEQFVRALSSAGGAYAA

SEQ ID NO: 881300 - protein, 23 aa, Mycobacterium
AQALKPWYGYFCKRPCFHDEYLQ

SEQ ID NO: 881301 - protein, 23 aa, Mycobacterium
AQALVFHDQFVQMLNAGASSYAA

SEQ ID NO: 881302 - protein, 17 aa, Mycobacterium
AQALVKTGLRLVAAGIN

SEQ ID NO: 881303 - protein, 19 aa, Mycobacterium
AQAWNYMFPLTDPPNYEPS

SEQ ID NO: 881304 - protein, 17 aa, Mycobacterium
AQDFFFRKIIRDKGVAL

SEQ ID NO: 881305 - protein, 20 aa, Mycobacterium
AQFWALIHGFVMLELAGFFG

SEQ ID NO: 881306 - protein, 23 aa, Mycobacterium
AQGAFLPPLLLRAEDPTAAAVHE

SEQ ID NO: 881307 - protein, 19 aa, Mycobacterium
AQHLLGGRYLLAMTGSAPI

SEQ ID NO: 881308 - protein, 21 aa, Mycobacterium
AQHQPFQHFIARLYGVLVDDA

SEQ ID NO: 881309 - protein, 18 aa, Mycobacterium
AQIDGRFWLHLDRGWRFF

SEQ ID NO: 881310 - protein, 25 aa, Mycobacterium
AQISKPMLYLYYGSKEDLFGACLHR

SEQ ID NO: 881311 - protein, 22 aa, Mycobacterium
AQKLVQSGQWTGAAAAAYSEAH

SEQ ID NO: 881312 - protein, 18 aa, Mycobacterium
AQLDWPLAEALRYPAGLI

SEQ ID NO: 881313 - protein, 21 aa, Mycobacterium
AQLEIERMWPKVWQLACMLDH

SEQ ID NO: 881314 - protein, 17 aa, Mycobacterium
AQLLPRPIGLIIGLQLS

SEQ ID NO: 881315 - protein, 19 aa, Mycobacterium
AQLMFFLGHGYRVVAHDRR

SEQ ID NO: 881316 - protein, 23 aa, Mycobacterium
AQLPLLQFLIYPAVDFTVRRPSR

SEQ ID NO: 881317 - protein, 19 aa, Mycobacterium
AQLPLPVLIAGWLRSRAEA

SEQ ID NO: 881318 - protein, 18 aa, Mycobacterium
AQMLFFSLFPDGGGFDST

SEQ ID NO: 881319 - protein, 23 aa, Mycobacterium
AQMMFTGWWVNPAHLLVLGPYFN

SEQ ID NO: 881320 - protein, 24 aa, Mycobacterium
AQNGVPWWYFHELQGPYRGRRIEA

SEQ ID NO: 881321 - protein, 22 aa, Mycobacterium
AQNRLWFIQQLQGPSPVYNMAA

SEQ ID NO: 881322 - protein, 25 aa, Mycobacterium
AQPAGWFRFYFTDQRWEWSEQVQRL

SEQ ID NO: 881323 - protein, 17 aa, Mycobacterium
AQPGMFTFGWGPVLHQL

SEQ ID NO: 881324 - protein, 21 aa, Mycobacterium
AQPLWALWRFGTEPGFAKMTM

SEQ ID NO: 881325 - protein, 21 aa, Mycobacterium
AQPLWALWRFSTAPEATRLTM

SEQ ID NO: 881326 - protein, 20 aa, Mycobacterium
AQQALQAFRKFGFQLVIVAT

SEQ ID NO: 881327 - protein, 24 aa, Mycobacterium
AQQRALVVLLLQHFDRRAGLVAVR

SEQ ID NO: 881328 - protein, 27 aa, Mycobacterium
AQQYDVVLREFLDGLQGGFGRTLDTAA

SEQ ID NO: 881329 - protein, 23 aa, Mycobacterium
AQRALQLIYRVWPDLRVKPHLDK

SEQ ID NO: 881330 - protein, 23 aa, Mycobacterium
AQRDRWHFLPFAGGARSCIGEHF

SEQ ID NO: 881331 - protein, 20 aa, Mycobacterium
AQRFTLLRPMLFTIAYEILG

SEQ ID NO: 881332 - protein, 17 aa, Mycobacterium
AQRHPLLGRLVYYRATR

SEQ ID NO: 881333 - protein, 23 aa, Mycobacterium
AQRLVAVARLRLLCREFGITEIG

SEQ ID NO: 881334 - protein, 17 aa, Mycobacterium
AQRLWGMKFPLNPQRDL

SEQ ID NO: 881335 - protein, 20 aa, Mycobacterium
AQRRLWRRSPGHIVRGVTGE

SEQ ID NO: 881336 - protein, 19 aa, Mycobacterium
AQSRLWFLHQLSGPSPVYN

SEQ ID NO: 881337 - protein, 22 aa, Mycobacterium
AQTPTLLFPFAAPRVAGDLSEA

SEQ ID NO: 881338 - protein, 20 aa, Mycobacterium
AQTVLPLLHAFRAPQAPLRG

SEQ ID NO: 881339 - protein, 23 aa, Mycobacterium
AQVLADALPWLTALNGKIVVVKY

SEQ ID NO: 881340 - protein, 18 aa, Mycobacterium
AQVRFPLRPFMGMMGVAF

SEQ ID NO: 881341 - protein, 18 aa, Mycobacterium
AQWAAFLPADIAGALAAA

SEQ ID NO: 881342 - protein, 18 aa, Mycobacterium
ARAGLLCLPTLSTHGYEV

SEQ ID NO: 881343 - protein, 18 aa, Mycobacterium
ARAMAMLMLALPGAVFLY

SEQ ID NO: 881344 - protein, 23 aa, Mycobacterium
ARAMAMVILALPGAVFLYNGQEL

SEQ ID NO: 881345 - protein, 19 aa, Mycobacterium
ARAQMIGGIIWGWGKATLE

SEQ ID NO: 881346 - protein, 18 aa, Mycobacterium
ARARRPLIVLGKGAAYAQ

SEQ ID NO: 881347 - protein, 23 aa, Mycobacterium
ARAVLIRITPAGVSALRQARADR

SEQ ID NO: 881348 - protein, 25 aa, Mycobacterium
ARDELLTAIRRLPLLGPPGAQVSYS

SEQ ID NO: 881349 - protein, 17 aa, Mycobacterium
ARDFLTIWFAQLYQHVA

SEQ ID NO: 881350 - protein, 24 aa, Mycobacterium
ARDFQRFLIGKLRDIRAVVLNASL

SEQ ID NO: 881351 - protein, 17 aa, Mycobacterium
ARDMLWLNRSRWNRTTT

SEQ ID NO: 881352 - protein, 18 aa, Mycobacterium
ARDPFGIKPLFLATGAGG

SEQ ID NO: 881353 - protein, 24 aa, Mycobacterium
ARDRKVWLPLRQLTRKRWPNGHVT

SEQ ID NO: 881354 - protein, 24 aa, Mycobacterium
ARDRLIVLLMARGGLRRGEVCGLR

SEQ ID NO: 881355 - protein, 23 aa, Mycobacterium
AREHALLLALRRDPEVDALSVAP

SEQ ID NO: 881356 - protein, 21 aa, Mycobacterium
AREKLLADVLRAASRDGLVSA

SEQ ID NO: 881357 - protein, 24 aa, Mycobacterium
ARENALLERGLLPSPLLLDNAGVD

SEQ ID NO: 881358 - protein, 24 aa, Mycobacterium
ARENALLERGLLPSPLLLDSPGVD

SEQ ID NO: 881359 - protein, 25 aa, Mycobacterium
AREWNQFLHGNPVGWLLNFTGQRFK

SEQ ID NO: 881360 - protein, 19 aa, Mycobacterium
ARFCTQFIKLGLGGCDIGV

SEQ ID NO: 881361 - protein, 17 aa, Mycobacterium
ARFDVLTKPRLFGRRVG

SEQ ID NO: 881362 - protein, 24 aa, Mycobacterium
ARFLDALFPVWRYHPFFTDSDEPV

SEQ ID NO: 881363 - protein, 18 aa, Mycobacterium
ARFSPFQKLIILDVPDDK

SEQ ID NO: 881364 - protein, 19 aa, Mycobacterium
ARFSPFQKLIILDVPDDKV

SEQ ID NO: 881365 - protein, 26 aa, Mycobacterium
ARGATRLVIAPWFLAHGRITDRVAEY

SEQ ID NO: 881366 - protein, 31 aa, Mycobacterium
ARGFPPYHPRLMLKLLLYGYTSGVRSSRKIE

SEQ ID NO: 881367 - protein, 18 aa, Mycobacterium
ARGQYWIHPALPELVENA

SEQ ID NO: 881368 - protein, 20 aa, Mycobacterium
ARGQYWIHPALPEVIENALL

SEQ ID NO: 881369 - protein, 22 aa, Mycobacterium
ARGRDWLVLPGSPPGALLVRPL

SEQ ID NO: 881370 - protein, 19 aa, Mycobacterium
ARGRKPGWSLLLNPTPALV

SEQ ID NO: 881371 - protein, 23 aa, Mycobacterium
ARGYGYGPAFRGLTAMWARGEEL

SEQ ID NO: 881372 - protein, 17 aa, Mycobacterium
ARHETYIGPWLPEPVDT

SEQ ID NO: 881373 - protein, 19 aa, Mycobacterium
ARHMLKFLSSPLWRAYIST

SEQ ID NO: 881374 - protein, 17 aa, Mycobacterium
ARILFSLFSTPSPIRDM

SEQ ID NO: 881375 - protein, 23 aa, Mycobacterium
ARKGFFRVPLIRGTITHPVQGEA

SEQ ID NO: 881376 - protein, 23 aa, Mycobacterium
ARLAGLLGYLKPAPDLAPPVAVQ

SEQ ID NO: 881377 - protein, 22 aa, Mycobacterium
ARLDLAAVFLYAGSILPGLAKL

SEQ ID NO: 881378 - protein, 18 aa, Mycobacterium
ARLDLASVFLYAGSILPG

SEQ ID NO: 881379 - protein, 19 aa, Mycobacterium
ARLERGLLPSPLLLDDPGV

SEQ ID NO: 881380 - protein, 17 aa, Mycobacterium
ARLFPRGLAAFIELRDQ

SEQ ID NO: 881381 - protein, 18 aa, Mycobacterium
ARLFYAYADILLALDRKA

SEQ ID NO: 881382 - protein, 25 aa, Mycobacterium
ARLHTPLPVLAFTPLPEVRSQLALT

SEQ ID NO: 881383 - protein, 20 aa, Mycobacterium
ARLHTPLPVLAFTSLPEVRS

SEQ ID NO: 881384 - protein, 17 aa, Mycobacterium
ARLKAAYAEHPPVPLPG

SEQ ID NO: 881385 - protein, 19 aa, Mycobacterium
ARLLIWTTTPWTLPSNLAV

SEQ ID NO: 881386 - protein, 24 aa, Mycobacterium
ARLLNLPYFPVTPFFPLAGPAGMI

SEQ ID NO: 881387 - protein, 24 aa, Mycobacterium
ARLLVPHLYFWKSAKWVRSIELCD

SEQ ID NO: 881388 - protein, 17 aa, Mycobacterium
ARLLYTLGWHEVPAPSG

SEQ ID NO: 881389 - protein, 25 aa, Mycobacterium
ARLVHHLFVEFAYPRGLFGGQPHGE

SEQ ID NO: 881390 - protein, 19 aa, Mycobacterium
ARLVLGQALAWRGRGREAG

SEQ ID NO: 881391 - protein, 20 aa, Mycobacterium
ARMIPVVSLLLRLLPRETDN

SEQ ID NO: 881392 - protein, 18 aa, Mycobacterium
ARMQRRWSIVMVDEFQDT

SEQ ID NO: 881393 - protein, 17 aa, Mycobacterium
ARPARWLHLLASTPHTF

SEQ ID NO: 881394 - protein, 23 aa, Mycobacterium
ARPDIPIHYLLADTFTICDQYHS

SEQ ID NO: 881395 - protein, 19 aa, Mycobacterium
ARPFLFTDTVGFVRHLPTQ

SEQ ID NO: 881396 - protein, 23 aa, Mycobacterium
ARPKALLLPLGPLAEHNIRTTFA

SEQ ID NO: 881397 - protein, 22 aa, Mycobacterium
ARPSALLLPLGPLAEHNVRTTF

SEQ ID NO: 881398 - protein, 26 aa, Mycobacterium
ARPVLFSTFLMWVLADLFTTLPEVGD

SEQ ID NO: 881399 - protein, 17 aa, Mycobacterium
ARPYRLWFPPGTTVYEI

SEQ ID NO: 881400 - protein, 18 aa, Mycobacterium
ARQLWRSMAGRCGHLYTG

SEQ ID NO: 881401 - protein, 19 aa, Mycobacterium
ARQPVGPCLLITPWNFPMA

SEQ ID NO: 881402 - protein, 17 aa, Mycobacterium
ARQPYYRWRANPITDAE

SEQ ID NO: 881403 - protein, 20 aa, Mycobacterium
ARRDLPWRRPGVSAWQILVS

SEQ ID NO: 881404 - protein, 19 aa, Mycobacterium
ARRKVWTLIPHLQEFLANW

SEQ ID NO: 881405 - protein, 17 aa, Mycobacterium
ARRLGVPESKWVYLHGH

SEQ ID NO: 881406 - protein, 19 aa, Mycobacterium
ARSFLLRLSGIRALGFSPE

SEQ ID NO: 881407 - protein, 23 aa, Mycobacterium
ARSRGRVLLWPDTFINNFDPAVG

SEQ ID NO: 881408 - protein, 19 aa, Mycobacterium
ARTAWLAEGLLMYLPADAQ

SEQ ID NO: 881409 - protein, 22 aa, Mycobacterium
ARTLLIIDLPRPPAPLHLLRLA

SEQ ID NO: 881410 - protein, 19 aa, Mycobacterium
ARVGIWSPNTWHWVVACLA

SEQ ID NO: 881411 - protein, 26 aa, Mycobacterium
ARVKCALLGWMAFKAAVAEARPLDET

SEQ ID NO: 881412 - protein, 25 aa, Mycobacterium
ARVKCALLGWMAFKDALAQAITANA

SEQ ID NO: 881413 - protein, 23 aa, Mycobacterium
ARVVANFIPLPWLGTNGFQEACW

SEQ ID NO: 881414 - protein, 17 aa, Mycobacterium
ARWYPWYRRTAAGLHFM

SEQ ID NO: 881415 - protein, 18 aa, Mycobacterium
ARYKAPKEFLFVDRVRRL

SEQ ID NO: 881416 - protein, 24 aa, Mycobacterium
ARYLDALFPVWRYHPFFTDSDEPV

SEQ ID NO: 881417 - protein, 24 aa, Mycobacterium
ARYLYFGCDVWLNNPLRPLEACGT

SEQ ID NO: 881418 - protein, 24 aa, Mycobacterium
ARYQLLVQYPAVSPALLLKCMLMA

SEQ ID NO: 881419 - protein, 18 aa, Mycobacterium
ARYRRWLAALRGTARLVI

SEQ ID NO: 881420 - protein, 21 aa, Mycobacterium
ARYVWPKFVCALPSEFFAAVR

SEQ ID NO: 881421 - protein, 18 aa, Mycobacterium
ARYWREAFRLPSMNLRKV

SEQ ID NO: 881422 - protein, 22 aa, Mycobacterium
ASAAAPYLKWLTTAAAQAGQAA

SEQ ID NO: 881423 - protein, 17 aa, Mycobacterium
ASAFALWFPIEGGADYG

SEQ ID NO: 881424 - protein, 17 aa, Mycobacterium
ASAFAMWFPIEGGADYG

SEQ ID NO: 881425 - protein, 24 aa, Mycobacterium
ASALDWTVLGPGRLTLDPPTGRIT

SEQ ID NO: 881426 - protein, 23 aa, Mycobacterium
ASCKYMKMITPAALLRCLVEGAD

SEQ ID NO: 881427 - protein, 23 aa, Mycobacterium
ASCTYMKMITPAALLRCLVEGAD

SEQ ID NO: 881428 - protein, 17 aa, Mycobacterium
ASDLALAVIRFARQLRS

SEQ ID NO: 881429 - protein, 21 aa, Mycobacterium
ASDLVPYRTLLTQTPVAVMVG

SEQ ID NO: 881430 - protein, 25 aa, Mycobacterium
ASESAFFMLAFTKIGLMPDGGASAL

SEQ ID NO: 881431 - protein, 25 aa, Mycobacterium
ASESAYFLLAFTKIGLMPDGGASAL

SEQ ID NO: 881432 - protein, 17 aa, Mycobacterium
ASFPRYPLNLLSDLNAF

SEQ ID NO: 881433 - protein, 24 aa, Mycobacterium
ASFRTNVIAPFLLTGALAPAMAER

SEQ ID NO: 881434 - protein, 24 aa, Mycobacterium
ASGKPCLLTPPPWYPILRGTTQQA

SEQ ID NO: 881435 - protein, 24 aa, Mycobacterium
ASHGIPLWRYLIGDKPAAMPLPEI

SEQ ID NO: 881436 - protein, 17 aa, Mycobacterium
ASHHLRWLASANGLLDI

SEQ ID NO: 881437 - protein, 21 aa, Mycobacterium
ASHQALCYFGYLAGYRLVHDA

SEQ ID NO: 881438 - protein, 24 aa, Mycobacterium
ASHRKLLLPHLSAKRIRVIEQFAE

SEQ ID NO: 881439 - protein, 24 aa, Mycobacterium
ASIADPLLAAINEPALALTGRPLI

SEQ ID NO: 881440 - protein, 21 aa, Mycobacterium
ASIAYWRLTGAAAAARNLLAV

SEQ ID NO: 881441 - protein, 24 aa, Mycobacterium
ASILPSFPALLKKQLKGAPMPAPR

SEQ ID NO: 881442 - protein, 24 aa, Mycobacterium
ASIVPHTWLWTSPLGPEVRAVEMV

SEQ ID NO: 881443 - protein, 25 aa, Mycobacterium
ASLFGTHALAYQAIGAQAATFHDGF

SEQ ID NO: 881444 - protein, 17 aa, Mycobacterium
ASLLAPFSLPPQTSDPS

SEQ ID NO: 881445 - protein, 18 aa, Mycobacterium
ASLLVAPYFRSAVESAID

SEQ ID NO: 881446 - protein, 17 aa, Mycobacterium
ASLNPFQQLLQALPNIG

SEQ ID NO: 881447 - protein, 23 aa, Mycobacterium
ASLPDGVLMRRAAFGLATEIGRE

SEQ ID NO: 881448 - protein, 22 aa, Mycobacterium
ASLPDGVLMRRAAYGLATAIAA

SEQ ID NO: 881449 - protein, 24 aa, Mycobacterium
ASLQLGLSLIWTEAKRRGVALTRV

SEQ ID NO: 881450 - protein, 17 aa, Mycobacterium
ASLRDFYIAYRAVVRAK

SEQ ID NO: 881451 - protein, 30 aa, Mycobacterium
ASPATWIDWLVNWYLPISQLFYNTVGLPYF

SEQ ID NO: 881452 - protein, 26 aa, Mycobacterium
ASPGFDIFLWELFGPLVAGARLVFMD

SEQ ID NO: 881453 - protein, 17 aa, Mycobacterium
ASPHNLFPLVFDMLFRG

SEQ ID NO: 881454 - protein, 19 aa, Mycobacterium
ASPLQTLEQDLLAGINAPS

SEQ ID NO: 881455 - protein, 23 aa, Mycobacterium
ASPNPLLLAWIFSQMQERHLPKD

SEQ ID NO: 881456 - protein, 24 aa, Mycobacterium
ASPPVRWPCFYGIDFASPAELIAN

SEQ ID NO: 881457 - protein, 25 aa, Mycobacterium
ASPTRFASRYRVGAAAPGATITTDR

SEQ ID NO: 881458 - protein, 19 aa, Mycobacterium
ASPTYRMALLRWLSVCDIR

SEQ ID NO: 881459 - protein, 17 aa, Mycobacterium
ASQKFLPRALSEGLNRA

SEQ ID NO: 881460 - protein, 22 aa, Mycobacterium
ASQVLLRWNLQLGNAVVFRSAK

SEQ ID NO: 881461 - protein, 23 aa, Mycobacterium
ASRDVDWWLTFSSAAALLGTPGQ

SEQ ID NO: 881462 - protein, 19 aa, Mycobacterium
ASRDVLLTDLFTAFNQRMA

SEQ ID NO: 881463 - protein, 26 aa, Mycobacterium
ASSAWTIGFLALHNWMLALFGEQAQA

SEQ ID NO: 881464 - protein, 25 aa, Mycobacterium
ASSFYWPFGFALLGGRFWVADTGNR

SEQ ID NO: 881465 - protein, 17 aa, Mycobacterium
ASSRMMPVLRISGLTEL

SEQ ID NO: 881466 - protein, 18 aa, Mycobacterium
ASTAHDYLTFARALLGGG

SEQ ID NO: 881467 - protein, 22 aa, Mycobacterium
ASVMTHHRWLRALAVFGGLGLR

SEQ ID NO: 881468 - protein, 20 aa, Mycobacterium
ASVPAAIRLLGALRYDVVLL

SEQ ID NO: 881469 - protein, 18 aa, Mycobacterium
ASWLVGRPAYHAFTFGWL

SEQ ID NO: 881470 - protein, 24 aa, Mycobacterium
ASWQVAKLYWTVIATSALETGLAS

SEQ ID NO: 881471 - protein, 22 aa, Mycobacterium
ASYRWLVHTLTVDVLRDLLPEA

SEQ ID NO: 881472 - protein, 24 aa, Mycobacterium
ATCPEWVYFWLGAARIGAVSAAIN

SEQ ID NO: 881473 - protein, 24 aa, Mycobacterium
ATDALHPGLALRSGPAYTTITATT

SEQ ID NO: 881474 - protein, 17 aa, Mycobacterium
ATEDLVYLLADSGFEVH

SEQ ID NO: 881475 - protein, 29 aa, Mycobacterium
ATERGLLLTTLWYIRVVDPTTLLFTGLTR

SEQ ID NO: 881476 - protein, 29 aa, Mycobacterium
ATERGLLLTTLWYIRVVDPTVLLLTGLTR

SEQ ID NO: 881477 - protein, 22 aa, Mycobacterium
ATERLMLLWAQAEAARLTNVRA

SEQ ID NO: 881478 - protein, 27 aa, Mycobacterium
ATETWRFPAFFHALLDAGIYPPPSAYE

SEQ ID NO: 881479 - protein, 27 aa, Mycobacterium
ATETWRFPPFFHALLERGVYPPCSAFE

SEQ ID NO: 881480 - protein, 28 aa, Mycobacterium
ATFDLYSCFPFPVFVACEALGLAGDDPR

SEQ ID NO: 881481 - protein, 24 aa, Mycobacterium
ATFHDGFVQALSRAASRYAATEVA

SEQ ID NO: 881482 - protein, 20 aa, Mycobacterium
ATFQQRFVQALTAGASAYAG

SEQ ID NO: 881483 - protein, 40 aa, Mycobacterium
ATGAAPLQPVLDLINGPTQALLGRPLIGNGASGAPGTGQA

SEQ ID NO: 881484 - protein, 18 aa, Mycobacterium
ATGIPFLPMSMAKGLLPD

SEQ ID NO: 881485 - protein, 19 aa, Mycobacterium
ATGIPFLPMSMAKGLLPDS

SEQ ID NO: 881486 - protein, 22 aa, Mycobacterium
ATGQFLWQNIFGVWPVTGEVSE

SEQ ID NO: 881487 - protein, 23 aa, Mycobacterium
ATGRFLWQNIFGVWPVSGLENGK

SEQ ID NO: 881488 - protein, 23 aa, Mycobacterium
ATGWLTLLQTWINDAWKAGLPDA

SEQ ID NO: 881489 - protein, 23 aa, Mycobacterium
ATHHDLYLWLPHPSDALWQTLAS

SEQ ID NO: 881490 - protein, 17 aa, Mycobacterium
ATHPLLWKSGALHRSPD

SEQ ID NO: 881491 - protein, 20 aa, Mycobacterium
ATHRFLAELPGYRGWQWAVV

SEQ ID NO: 881492 - protein, 19 aa, Mycobacterium
ATIALPYDIAGALTGFHTD

SEQ ID NO: 881493 - protein, 20 aa, Mycobacterium
ATIPSFLRYGAYPQIVVVRE

SEQ ID NO: 881494 - protein, 23 aa, Mycobacterium
ATITPWNYPLQMAVWKVIPALAA

SEQ ID NO: 881495 - protein, 24 aa, Mycobacterium
ATITPWNYPLQMAVWKVIPALAAG

SEQ ID NO: 881496 - protein, 25 aa, Mycobacterium
ATITPWNYPLQMAVWKVLPALAAGC

SEQ ID NO: 881497 - protein, 25 aa, Mycobacterium
ATKGLIYYHFRSKFDIFLAVYEDGM

SEQ ID NO: 881498 - protein, 17 aa, Mycobacterium
ATKYPWLQAVPAYGVAI

SEQ ID NO: 881499 - protein, 20 aa, Mycobacterium
ATLGPRFTPPKLLRAKVAEG

SEQ ID NO: 881500 - protein, 17 aa, Mycobacterium
ATLLDYFPDDFLLVIDE

SEQ ID NO: 881501 - protein, 19 aa, Mycobacterium
ATLTLIPRFDPRKALEVIE

SEQ ID NO: 881502 - protein, 21 aa, Mycobacterium
ATMFFLTRRWPDLLTWTSQAS

SEQ ID NO: 881503 - protein, 25 aa, Mycobacterium
ATMSQLLYLRVPALNALFPDYRGSV

SEQ ID NO: 881504 - protein, 18 aa, Mycobacterium
ATNYDVMFVPQGIGADLI

SEQ ID NO: 881505 - protein, 26 aa, Mycobacterium
ATPEMFRWWFWWHSFEPERYSLWHPW

SEQ ID NO: 881506 - protein, 24 aa, Mycobacterium
ATPGFIEMAWQAPIYLIAGGLGVE

SEQ ID NO: 881507 - protein, 17 aa, Mycobacterium
ATPIMRWLHDFDGPVDE

SEQ ID NO: 881508 - protein, 18 aa, Mycobacterium
ATPIMRWLHSVDGPVEQF

SEQ ID NO: 881509 - protein, 18 aa, Mycobacterium
ATPIMRWLHSVEGPVEQF

SEQ ID NO: 881510 - protein, 18 aa, Mycobacterium
ATPSRLVLLAPWLDVSMS

SEQ ID NO: 881511 - protein, 23 aa, Mycobacterium
ATQPLDWFAVFSSAAALLGSPGQ

SEQ ID NO: 881512 - protein, 24 aa, Mycobacterium
ATQTLPLRPFRTMAINIDGSLPTG

SEQ ID NO: 881513 - protein, 24 aa, Mycobacterium
ATRDAYLPGLWFKTGDRADVDENG

SEQ ID NO: 881514 - protein, 24 aa, Mycobacterium
ATRDFTLGLAGLPPTFQTAFQAVL

SEQ ID NO: 881515 - protein, 24 aa, Mycobacterium
ATRELDWWLGFSSTASLLGSPGQT

SEQ ID NO: 881516 - protein, 21 aa, Mycobacterium
ATRRRVLALGIRLLDHGHFRS

SEQ ID NO: 881517 - protein, 23 aa, Mycobacterium
ATRRSIFIPILRVAAIEPDAVTL

SEQ ID NO: 881518 - protein, 24 aa, Mycobacterium
ATSPFLDYHPRWAPSPFPAVLCVS

SEQ ID NO: 881519 - protein, 27 aa, Mycobacterium
ATSQGIAFIPWFPLASGPLAAPDGPLR

SEQ ID NO: 881520 - protein, 17 aa, Mycobacterium
ATSWEAMLQPYVPGRWL

SEQ ID NO: 881521 - protein, 26 aa, Mycobacterium
ATTLFGALLPRYLATRVYAALLEAAA

SEQ ID NO: 881522 - protein, 23 aa, Mycobacterium
ATTPTYLRYAIYPNIVVIRQDNG

SEQ ID NO: 881523 - protein, 26 aa, Mycobacterium
ATTYDPIILDFLWENTYHYDIGPRIF

SEQ ID NO: 881524 - protein, 24 aa, Mycobacterium
ATVAHAWSALLRAALRTAARVTGP

SEQ ID NO: 881525 - protein, 18 aa, Mycobacterium
ATVPPALVTANRTLLAQL

SEQ ID NO: 881526 - protein, 18 aa, Mycobacterium
ATVPYFSLAMLPGGRRRA

SEQ ID NO: 881527 - protein, 24 aa, Mycobacterium
ATVQGLVLGGYRFAEFRSAKTAPK

SEQ ID NO: 881528 - protein, 21 aa, Mycobacterium
ATVSFAWRIRLISSATIDARV

SEQ ID NO: 881529 - protein, 18 aa, Mycobacterium
ATWGWMLQLYGLRSSRSW

SEQ ID NO: 881530 - protein, 17 aa, Mycobacterium
ATYLAECLLLGTGTPTT

SEQ ID NO: 881531 - protein, 20 aa, Mycobacterium
ATYRWPMVPALALLAAMPAL

SEQ ID NO: 881532 - protein, 23 aa, Mycobacterium
AVACAVRLQRAPLAPIRLRIGVH

SEQ ID NO: 881533 - protein, 19 aa, Mycobacterium
AVAELFGAYARGYQIIGAQ

SEQ ID NO: 881534 - protein, 18 aa, Mycobacterium
AVAFIRRARRMLPGDPEF

SEQ ID NO: 881535 - protein, 22 aa, Mycobacterium
AVAVQPYLAWLTYTAESAAHAG

SEQ ID NO: 881536 - protein, 23 aa, Mycobacterium
AVDAVSWRILLEDFNIAWAQHHG

SEQ ID NO: 881537 - protein, 23 aa, Mycobacterium
AVDAVSWRILLEDLNIAWAQHRS

SEQ ID NO: 881538 - protein, 22 aa, Mycobacterium
AVDGGWWVLGVHTPAAAECLRG

SEQ ID NO: 881539 - protein, 23 aa, Mycobacterium
AVDGVSWRILLEDLNIAWAQHHG

SEQ ID NO: 881540 - protein, 23 aa, Mycobacterium
AVDGVSWRILLEDLNIAWAQHHS

SEQ ID NO: 881541 - protein, 18 aa, Mycobacterium
AVDLLRRVIDARLAFLIS

SEQ ID NO: 881542 - protein, 23 aa, Mycobacterium
AVDPALPVLGLAGSVFFGAAEEL

SEQ ID NO: 881543 - protein, 17 aa, Mycobacterium
AVDPLLPEVAWSWLVEA

SEQ ID NO: 881544 - protein, 23 aa, Mycobacterium
AVDRVRPLLGCYGDPVLHVGPAG

SEQ ID NO: 881545 - protein, 19 aa, Mycobacterium
AVELILHLPLIVAIANTAH

SEQ ID NO: 881546 - protein, 17 aa, Mycobacterium
AVELSSFQLYWAPSLRP

SEQ ID NO: 881547 - protein, 18 aa, Mycobacterium
AVEQKFLMDGAFLSVFGV

SEQ ID NO: 881548 - protein, 20 aa, Mycobacterium
AVEVALFRLLESWGIHPDFV

SEQ ID NO: 881549 - protein, 25 aa, Mycobacterium
AVEVALFRLLESWGIHPDLVLGHSI

SEQ ID NO: 881550 - protein, 23 aa, Mycobacterium
AVEVALYRLLESWGIRPDFVMGH

SEQ ID NO: 881551 - protein, 23 aa, Mycobacterium
AVEVALYRLLESWGVRPDFVMGH

SEQ ID NO: 881552 - protein, 22 aa, Mycobacterium
AVFARGLLHRLFTRAYLPSPDL

SEQ ID NO: 881553 - protein, 25 aa, Mycobacterium
AVFDTAFFFGLPPAAAIYALDRAVA

SEQ ID NO: 881554 - protein, 20 aa, Mycobacterium
AVFEPFLTLWRSAAIHPEAR

SEQ ID NO: 881555 - protein, 21 aa, Mycobacterium
AVFETFFRKLPPSRSYIVAAG

SEQ ID NO: 881556 - protein, 19 aa, Mycobacterium
AVFLLHGWPQTWQEWLPIL

SEQ ID NO: 881557 - protein, 19 aa, Mycobacterium
AVFLQYPWQVLPEELVKPI

SEQ ID NO: 881558 - protein, 17 aa, Mycobacterium
AVFRPAPVPRTLETMPE

SEQ ID NO: 881559 - protein, 25 aa, Mycobacterium
AVGDIFFPRVFLRRGQFLPAGTVTL

SEQ ID NO: 881560 - protein, 18 aa, Mycobacterium
AVGDWMLLAAIEALIDGH

SEQ ID NO: 881561 - protein, 18 aa, Mycobacterium
AVGLPGPPRRILGPFAGV

SEQ ID NO: 881562 - protein, 18 aa, Mycobacterium
AVGWFGDGGAGGAGGPVV

SEQ ID NO: 881563 - protein, 25 aa, Mycobacterium
AVGWTVPKFYWTVTAISAMTAGLQA

SEQ ID NO: 881564 - protein, 25 aa, Mycobacterium
AVGWVPWIGILAPQINFFYYLFEPI

SEQ ID NO: 881565 - protein, 19 aa, Mycobacterium
AVHNFWYRDAVWRRYDEMD

SEQ ID NO: 881566 - protein, 18 aa, Mycobacterium
AVHPTMWIRMWFSDGDKS

SEQ ID NO: 881567 - protein, 23 aa, Mycobacterium
AVHSLLMYRYLVPLVLVVGSLVP

SEQ ID NO: 881568 - protein, 18 aa, Mycobacterium
AVILMALDAPPRSFWRID

SEQ ID NO: 881569 - protein, 20 aa, Mycobacterium
AVLAPRLPIPDEFGLCRYLA

SEQ ID NO: 881570 - protein, 24 aa, Mycobacterium
AVLDNPLRKVVLARALRLTADAPL

SEQ ID NO: 881571 - protein, 41 aa, Mycobacterium
AVLDPTQIVNWLIYQPLHAAGQQFWVVSPIGSTLGGVINTI

SEQ ID NO: 881572 - protein, 25 aa, Mycobacterium
AVLFSPMSFLRRPACWMQLLATSGR

SEQ ID NO: 881573 - protein, 21 aa, Mycobacterium
AVLGFRWQLVIFASPLLGVLC

SEQ ID NO: 881574 - protein, 18 aa, Mycobacterium
AVLKMLALQFIMSDPKHI

SEQ ID NO: 881575 - protein, 19 aa, Mycobacterium
AVLLGLFKALPGDLSILYP

SEQ ID NO: 881576 - protein, 17 aa, Mycobacterium
AVLMEMMWSFRANGMWS

SEQ ID NO: 881577 - protein, 19 aa, Mycobacterium
AVLNRLWRLVNDRLNYLTP

SEQ ID NO: 881578 - protein, 18 aa, Mycobacterium
AVLPFASWLSATASVAEQ

SEQ ID NO: 881579 - protein, 22 aa, Mycobacterium
AVLPHRPPLATYFLPNNRGKKS

SEQ ID NO: 881580 - protein, 19 aa, Mycobacterium
AVLQLVWLSLAGLPPEKLT

SEQ ID NO: 881581 - protein, 23 aa, Mycobacterium
AVLRFHYQLARFPLQLIEDRVVT

SEQ ID NO: 881582 - protein, 24 aa, Mycobacterium
AVLRLHYQLARFPLQLIEDRVVTR

SEQ ID NO: 881583 - protein, 20 aa, Mycobacterium
AVLRLQYRIARTPLQLFESS

SEQ ID NO: 881584 - protein, 24 aa, Mycobacterium
AVLSRRPRMLYDYFHQLFAQVTNP

SEQ ID NO: 881585 - protein, 25 aa, Mycobacterium
AVLSRRPRMLYDYFQQLFAQVTNPP

SEQ ID NO: 881586 - protein, 19 aa, Mycobacterium
AVLTGWWLRRMVAVRQPLR

SEQ ID NO: 881587 - protein, 23 aa, Mycobacterium
AVNAPTQTLFGRDLIGNGTDGAA

SEQ ID NO: 881588 - protein, 25 aa, Mycobacterium
AVNDKIFFQIYWLGDRDAILARAER

SEQ ID NO: 881589 - protein, 24 aa, Mycobacterium
AVNDKIFFQIYWLGSRDAIAARME

SEQ ID NO: 881590 - protein, 17 aa, Mycobacterium
AVNFPDVLFIAGKYQVK

SEQ ID NO: 881591 - protein, 17 aa, Mycobacterium
AVNFYGQLLQILKNRLL

SEQ ID NO: 881592 - protein, 22 aa, Mycobacterium
AVNGLINVWFKTPYRITRLLEQ

SEQ ID NO: 881593 - protein, 23 aa, Mycobacterium
AVNGPTQFLLGRPLIGNGADGTA

SEQ ID NO: 881594 - protein, 24 aa, Mycobacterium
AVNGQLFIVYGPTVTLLAAPTVEA

SEQ ID NO: 881595 - protein, 23 aa, Mycobacterium
AVNTPTQALFGRPLIGNGANGTA

SEQ ID NO: 881596 - protein, 21 aa, Mycobacterium
AVPAPLLRWGINQFDLDQRPT

SEQ ID NO: 881597 - protein, 26 aa, Mycobacterium
AVPGKFYWMTPTQLRWRPLSFWPAHT

SEQ ID NO: 881598 - protein, 17 aa, Mycobacterium
AVPIVMRAVPAVLFLMG

SEQ ID NO: 881599 - protein, 19 aa, Mycobacterium
AVPLNFRLTAAEIAFLVGD

SEQ ID NO: 881600 - protein, 24 aa, Mycobacterium
AVPSQWRRLLHGWPGLRTRGLTAL

SEQ ID NO: 881601 - protein, 18 aa, Mycobacterium
AVPTFLLPANPVGALVVF

SEQ ID NO: 881602 - protein, 17 aa, Mycobacterium
AVQLWPHRHGTDAMFTA

SEQ ID NO: 881603 - protein, 25 aa, Mycobacterium
AVQYRLPITFLLFDNHAHAMCVTRE

SEQ ID NO: 881604 - protein, 30 aa, Mycobacterium
AVRHLPYYGRWLRFVTWWPIADGAAHLTVI

SEQ ID NO: 881605 - protein, 20 aa, Mycobacterium
AVRILARAWLYIIWHCWQDN

SEQ ID NO: 881606 - protein, 17 aa, Mycobacterium
AVRILERFPSRLALPKA

SEQ ID NO: 881607 - protein, 23 aa, Mycobacterium
AVRKLPIFGGPFRWDDLEWLRAE

SEQ ID NO: 881608 - protein, 23 aa, Mycobacterium
AVRKLPIFGGPFRWDDLEWLRSE

SEQ ID NO: 881609 - protein, 23 aa, Mycobacterium
AVRKLPIFGGPFRWDDLEWLRSQ

SEQ ID NO: 881610 - protein, 17 aa, Mycobacterium
AVRLLVACALITTSPRA

SEQ ID NO: 881611 - protein, 21 aa, Mycobacterium
AVRLPRQIPYTVACDILLTGR

SEQ ID NO: 881612 - protein, 21 aa, Mycobacterium
AVRLPRQIPYTVACDLLLTGR

SEQ ID NO: 881613 - protein, 20 aa, Mycobacterium
AVRLVRQIPYTIACDMLLTG

SEQ ID NO: 881614 - protein, 25 aa, Mycobacterium
AVRNIWRFWYQIPISLPVIGPRMIS

SEQ ID NO: 881615 - protein, 18 aa, Mycobacterium
AVRRFWLGRAELDAIFAK

SEQ ID NO: 881616 - protein, 19 aa, Mycobacterium
AVRVIVLTGAPPAFCSGAQ

SEQ ID NO: 881617 - protein, 25 aa, Mycobacterium
AVSFWVLPPEINSLRMFIGAGSAPM

SEQ ID NO: 881618 - protein, 18 aa, Mycobacterium
AVSKLYYIHGFLRARMQL

SEQ ID NO: 881619 - protein, 18 aa, Mycobacterium
AVSLFYAIDARCGELGVD

SEQ ID NO: 881620 - protein, 17 aa, Mycobacterium
AVSSFFGAYARDYQAFS

SEQ ID NO: 881621 - protein, 23 aa, Mycobacterium
AVSWVRYPYLPSHPQYDLARRQM

SEQ ID NO: 881622 - protein, 18 aa, Mycobacterium
AVTFDLRWKAACGLPITA

SEQ ID NO: 881623 - protein, 21 aa, Mycobacterium
AVTFWAAIPHYVSQPPNPKAT

SEQ ID NO: 881624 - protein, 17 aa, Mycobacterium
AVTGSINPLGNAGAHGA

SEQ ID NO: 881625 - protein, 25 aa, Mycobacterium
AVTHIPLFKILGFGGPGDANTTFEE

SEQ ID NO: 881626 - protein, 19 aa, Mycobacterium
AVTLPLHWTADGLPLGVQF

SEQ ID NO: 881627 - protein, 17 aa, Mycobacterium
AVTMFIPAFLRYDLREV

SEQ ID NO: 881628 - protein, 24 aa, Mycobacterium
AVVAPLLSRSLILQLRPLTSDDIR

SEQ ID NO: 881629 - protein, 24 aa, Mycobacterium
AVVLHRYLGWRLSGYDPATHLGGV

SEQ ID NO: 881630 - protein, 24 aa, Mycobacterium
AVVLLMWAGILAYLDRCDYTYVTG

SEQ ID NO: 881631 - protein, 19 aa, Mycobacterium
AVVMTYWNPVLRYGVDAFA

SEQ ID NO: 881632 - protein, 20 aa, Mycobacterium
AVVMTYWNPVLRYGVDAFAR

SEQ ID NO: 881633 - protein, 19 aa, Mycobacterium
AVVVPYFWSDQYDVKIQCL

SEQ ID NO: 881634 - protein, 20 aa, Mycobacterium
AVWGHRISHWLWLRGARLAA

SEQ ID NO: 881635 - protein, 20 aa, Mycobacterium
AVWLARRGLRVWACDISPVA

SEQ ID NO: 881636 - protein, 18 aa, Mycobacterium
AVWRIRRAAPLLPTVLLG

SEQ ID NO: 881637 - protein, 17 aa, Mycobacterium
AWAFDRVLMPVIVRWGI

SEQ ID NO: 881638 - protein, 18 aa, Mycobacterium
AWDLPLVFGPIALAYNLP

SEQ ID NO: 881639 - protein, 18 aa, Mycobacterium
AWEFVWVVDPPLFEPAED

SEQ ID NO: 881640 - protein, 17 aa, Mycobacterium
AWEWELADRLRLASACA

SEQ ID NO: 881641 - protein, 17 aa, Mycobacterium
AWHAGVGMYPWLPANMG

SEQ ID NO: 881642 - protein, 17 aa, Mycobacterium
AWHAGVGMYPWLPTNMG

SEQ ID NO: 881643 - protein, 19 aa, Mycobacterium
AWIAHIWQPPFAGKRLRRR

SEQ ID NO: 881644 - protein, 23 aa, Mycobacterium
AWLDGLVAWRRAAGLPAATINWG

SEQ ID NO: 881645 - protein, 21 aa, Mycobacterium
AWLRELWGGPFMLKGVMRVDD

SEQ ID NO: 881646 - protein, 18 aa, Mycobacterium
AWLVEGLLPFLSVAAQDL

SEQ ID NO: 881647 - protein, 18 aa, Mycobacterium
AWMFQRFLHNLRRYSDAR

SEQ ID NO: 881648 - protein, 17 aa, Mycobacterium
AWNENYGGFWFLSSYDA

SEQ ID NO: 881649 - protein, 22 aa, Mycobacterium
AWNVPFFLAANKLGPALLAGCT

SEQ ID NO: 881650 - protein, 21 aa, Mycobacterium
AWNVPLFLALNKIGPAFLAGC

SEQ ID NO: 881651 - protein, 22 aa, Mycobacterium
AWNVPLFLAVNKLGPALLAGCT

SEQ ID NO: 881652 - protein, 23 aa, Mycobacterium
AWNVPLFLAVNKLGPALLAGCTV

SEQ ID NO: 881653 - protein, 17 aa, Mycobacterium
AWPKLKQHYGERLEQLY

SEQ ID NO: 881654 - protein, 22 aa, Mycobacterium
AWQVPKFYWTVTSDSALRTGIA

SEQ ID NO: 881655 - protein, 17 aa, Mycobacterium
AWRFITPPSAFISTVMV

SEQ ID NO: 881656 - protein, 17 aa, Mycobacterium
AWRGFSRWLMRAYDVLV

SEQ ID NO: 881657 - protein, 26 aa, Mycobacterium
AWRLPMGFTAWPPWRPGVLFTGDSLG

SEQ ID NO: 881658 - protein, 24 aa, Mycobacterium
AWRRRPCWYLIATEDRMIPLAAQR

SEQ ID NO: 881659 - protein, 17 aa, Mycobacterium
AWRSFSCWLMRAYDILV

SEQ ID NO: 881660 - protein, 17 aa, Mycobacterium
AWSRITYWRALLTSAVD

SEQ ID NO: 881661 - protein, 18 aa, Mycobacterium
AWSRITYWRALLTSAVDQ

SEQ ID NO: 881662 - protein, 17 aa, Mycobacterium
AWSRVTYWRALLAAAVD

SEQ ID NO: 881663 - protein, 18 aa, Mycobacterium
AWTRPFLAPYGVDIPIRV

SEQ ID NO: 881664 - protein, 18 aa, Mycobacterium
AWTTGLIRWEDDPQPGWY

SEQ ID NO: 881665 - protein, 17 aa, Mycobacterium
AWVLPEVPLLVSPSVEE

SEQ ID NO: 881666 - protein, 23 aa, Mycobacterium
AYAYDLLAFARWLRDEQLGVAEV

SEQ ID NO: 881667 - protein, 17 aa, Mycobacterium
AYDAYLRLHLLSHRLVA

SEQ ID NO: 881668 - protein, 17 aa, Mycobacterium
AYEALLCRIASLGIAYL

SEQ ID NO: 881669 - protein, 23 aa, Mycobacterium
AYEDRPTLVLPGSGKTITGTAVG

SEQ ID NO: 881670 - protein, 21 aa, Mycobacterium
AYFAALLGLPFIAVMTASTSP

SEQ ID NO: 881671 - protein, 20 aa, Mycobacterium
AYFFLPGISALRYLAALKDE

SEQ ID NO: 881672 - protein, 25 aa, Mycobacterium
AYGTLDIPVYIPFTGAIGPITIQEF

SEQ ID NO: 881673 - protein, 18 aa, Mycobacterium
AYGYDLLAFCRWLGSVDV

SEQ ID NO: 881674 - protein, 17 aa, Mycobacterium
AYKYPRLVWLVDALPKG

SEQ ID NO: 881675 - protein, 17 aa, Mycobacterium
AYLALRAWGLPVSEHTT

SEQ ID NO: 881676 - protein, 17 aa, Mycobacterium
AYLGVRVNAIAPGLIRS

SEQ ID NO: 881677 - protein, 17 aa, Mycobacterium
AYLHKRAADLPPAVGVL

SEQ ID NO: 881678 - protein, 18 aa, Mycobacterium
AYLHKRAADLPPAVGVLV

SEQ ID NO: 881679 - protein, 20 aa, Mycobacterium
AYMLEIFAFRYKIICGAHAT

SEQ ID NO: 881680 - protein, 18 aa, Mycobacterium
AYMLEILPALGFLHSVGL

SEQ ID NO: 881681 - protein, 17 aa, Mycobacterium
AYNLPLVFVVDTPGALP

SEQ ID NO: 881682 - protein, 23 aa, Mycobacterium
AYQRHFFPIYAASAKLQSWTIFA

SEQ ID NO: 881683 - protein, 17 aa, Mycobacterium
AYRAQLPQTAPPSSSPR

SEQ ID NO: 881684 - protein, 20 aa, Mycobacterium
AYRCPYIARYLTVAVTYGLA

SEQ ID NO: 881685 - protein, 21 aa, Mycobacterium
AYRGPWQFESFAREILLDIAA

SEQ ID NO: 881686 - protein, 20 aa, Mycobacterium
AYRGPWQYETLAREILLDIA

SEQ ID NO: 881687 - protein, 22 aa, Mycobacterium
AYRGPWQYETLSREILLDIAAR

SEQ ID NO: 881688 - protein, 23 aa, Mycobacterium
AYSIDLYTLLPVGELWVAAARLR

SEQ ID NO: 881689 - protein, 19 aa, Mycobacterium
AYTLPWTVRPFAPGELDEL

SEQ ID NO: 881690 - protein, 22 aa, Mycobacterium
CAELLYRAGLPRALYAIVPGPG

SEQ ID NO: 881691 - protein, 23 aa, Mycobacterium
CAELLYRAGLPRALYAIVPGPGS

SEQ ID NO: 881692 - protein, 23 aa, Mycobacterium
CAELLYRAGLPRALYAVVPGPGS

SEQ ID NO: 881693 - protein, 18 aa, Mycobacterium
CAGLRYNLFFDDRTLDGD

SEQ ID NO: 881694 - protein, 22 aa, Mycobacterium
CAGLRYQLFFDDRTLDGDLTVD

SEQ ID NO: 881695 - protein, 19 aa, Mycobacterium
CARMFIFIGAAPRTEWLDG

SEQ ID NO: 881696 - protein, 19 aa, Mycobacterium
CDDAPFYTLGPLATDIAPA

SEQ ID NO: 881697 - protein, 29 aa, Mycobacterium
CDSPGFTVPYYWWTFNMPTDHGEVLLENV

SEQ ID NO: 881698 - protein, 17 aa, Mycobacterium
CEEAPFYTLGPLATDIA

SEQ ID NO: 881699 - protein, 28 aa, Mycobacterium
CEEPVWLQWFLILAKKMRFMGLAKLNPV

SEQ ID NO: 881700 - protein, 20 aa, Mycobacterium
CEFPFSRLYEKLGLPAAAQD

SEQ ID NO: 881701 - protein, 21 aa, Mycobacterium
CELIDFWRFNVAFARQILAQQ

SEQ ID NO: 881702 - protein, 17 aa, Mycobacterium
CEQFGIDFPLFAFSHCR

SEQ ID NO: 881703 - protein, 18 aa, Mycobacterium
CERFPVFGKAFDAAAEAL

SEQ ID NO: 881704 - protein, 19 aa, Mycobacterium
CFAALRWLTALPSVDPARV

SEQ ID NO: 881705 - protein, 23 aa, Mycobacterium
CFNIPIVLLVDVPGFLPGTDQEY

SEQ ID NO: 881706 - protein, 17 aa, Mycobacterium
CFPMLSFLDAGVPPLSA

SEQ ID NO: 881707 - protein, 19 aa, Mycobacterium
CFQIDLTWRTVCNGFVIAE

SEQ ID NO: 881708 - protein, 18 aa, Mycobacterium
CGFDTPYPPARLERLWLP

SEQ ID NO: 881709 - protein, 20 aa, Mycobacterium
CGGPCWHWKGSVWGYTCTDC

SEQ ID NO: 881710 - protein, 17 aa, Mycobacterium
CGLLHFRTQRWSDVLGL

SEQ ID NO: 881711 - protein, 17 aa, Mycobacterium
CGLPLFCLPPGGGISWA

SEQ ID NO: 881712 - protein, 23 aa, Mycobacterium
CGMFGNIIRLLPPLTIGDELLNE

SEQ ID NO: 881713 - protein, 22 aa, Mycobacterium
CGNEPMILLIGSLQVIWSAHES

SEQ ID NO: 881714 - protein, 25 aa, Mycobacterium
CGQRPISMLYLIPTLHNPLGYILGA

SEQ ID NO: 881715 - protein, 17 aa, Mycobacterium
CGSAPAPIWLWHNVEDR

SEQ ID NO: 881716 - protein, 17 aa, Mycobacterium
CGYLQWLRELVGQQAWI

SEQ ID NO: 881717 - protein, 17 aa, Mycobacterium
CGYRRFFSITSLAGLRQ

SEQ ID NO: 881718 - protein, 17 aa, Mycobacterium
CIFLNRPGWPKGIGCAL

SEQ ID NO: 881719 - protein, 19 aa, Mycobacterium
CISRQLWWGHRIPIWHGPN

SEQ ID NO: 881720 - protein, 22 aa, Mycobacterium
CKCYCRLHHLIKTFWPGFSDAQ

SEQ ID NO: 881721 - protein, 20 aa, Mycobacterium
CKYMKMITPAALLRCLVEGA

SEQ ID NO: 881722 - protein, 26 aa, Mycobacterium
CLDRYARLFAWLGLWERHTDLAVIPA

SEQ ID NO: 881723 - protein, 18 aa, Mycobacterium
CLGLLFDTIFGTGSLLLT

SEQ ID NO: 881724 - protein, 23 aa, Mycobacterium
CLQMHLLYLSFAIAVRARAADDA

SEQ ID NO: 881725 - protein, 18 aa, Mycobacterium
CLRTLVRHRLAVAHPGYD

SEQ ID NO: 881726 - protein, 23 aa, Mycobacterium
CMSSSLPTLFRRAADYQRQITLT

SEQ ID NO: 881727 - protein, 17 aa, Mycobacterium
CNFYEGKEPRRLNYGCY

SEQ ID NO: 881728 - protein, 22 aa, Mycobacterium
CPFDPLIFFRPRVERLFGFHYR

SEQ ID NO: 881729 - protein, 17 aa, Mycobacterium
CPGFIETPLFDSVMGLP

SEQ ID NO: 881730 - protein, 24 aa, Mycobacterium
CPLTWPWNLLGWPSINVPAGFTVD

SEQ ID NO: 881731 - protein, 25 aa, Mycobacterium
CPPTAWMPLWQWLLHVRPAPSSRWR

SEQ ID NO: 881732 - protein, 25 aa, Mycobacterium
CPYTWPWNLLGWPAINVPAGFTVEG

SEQ ID NO: 881733 - protein, 17 aa, Mycobacterium
CQGAWTGSQWLMVEEAS

SEQ ID NO: 881734 - protein, 18 aa, Mycobacterium
CQVVTYRFWAERLGIQVD

SEQ ID NO: 881735 - protein, 24 aa, Mycobacterium
CRGTYALTVPFLQRFFALAKSTAA

SEQ ID NO: 881736 - protein, 25 aa, Mycobacterium
CRKVVIELLAWQFASPVRWIETQDL

SEQ ID NO: 881737 - protein, 17 aa, Mycobacterium
CRLFTEPVFRAALISGL

SEQ ID NO: 881738 - protein, 20 aa, Mycobacterium
CRSAGYWALPYPVAERLARP

SEQ ID NO: 881739 - protein, 21 aa, Mycobacterium
CSIRTPWWRTPSLWAPDLFLL

SEQ ID NO: 881740 - protein, 17 aa, Mycobacterium
CSSRFPYYLETYGFHSI

SEQ ID NO: 881741 - protein, 17 aa, Mycobacterium
CTFSWPPRIDLPGYKPT

SEQ ID NO: 881742 - protein, 22 aa, Mycobacterium
CTGAPVWHPLSGKLLAVVTVST

SEQ ID NO: 881743 - protein, 24 aa, Mycobacterium
CTGKTWHMVPPTIRYDLVGQKPDH

SEQ ID NO: 881744 - protein, 20 aa, Mycobacterium
CTRFLLVGPPGPPPARTGAD

SEQ ID NO: 881745 - protein, 24 aa, Mycobacterium
CTRRRLPLLIAPPNVLFATVSRYV

SEQ ID NO: 881746 - protein, 17 aa, Mycobacterium
CTTALPMLLLNRCSVDT

SEQ ID NO: 881747 - protein, 21 aa, Mycobacterium
CTVTLRRGQILLFYTDGLIEA

SEQ ID NO: 881748 - protein, 17 aa, Mycobacterium
CVDFVLPPDRLAAAVLA

SEQ ID NO: 881749 - protein, 19 aa, Mycobacterium
CVRAALPLLRAAEWARIVN

SEQ ID NO: 881750 - protein, 25 aa, Mycobacterium
CVRAALPLLRKAQWARIVNFSAHST

SEQ ID NO: 881751 - protein, 25 aa, Mycobacterium
CVRTALPLLRKAQWARIVNFSAHST

SEQ ID NO: 881752 - protein, 19 aa, Mycobacterium
CYAGPFFRYERPQAGRYRQ

SEQ ID NO: 881753 - protein, 17 aa, Mycobacterium
CYDYLGHVLFAWHLPEL

SEQ ID NO: 881754 - protein, 23 aa, Mycobacterium
CYNIPIVLLVDVPGFLPGTDQEY

SEQ ID NO: 881755 - protein, 18 aa, Mycobacterium
CYSGPFFRYERPQAGRYR

SEQ ID NO: 881756 - protein, 24 aa, Mycobacterium
DAAALLHRLSLKVPVRHFVLFSSI

SEQ ID NO: 881757 - protein, 18 aa, Mycobacterium
DAAGFIYFAGRRGDWIRV

SEQ ID NO: 881758 - protein, 18 aa, Mycobacterium
DAALFVLDRWMRPVPPGV

SEQ ID NO: 881759 - protein, 21 aa, Mycobacterium
DAALTVRLLLAPDIDVRFGLG

SEQ ID NO: 881760 - protein, 20 aa, Mycobacterium
DAALTVRLLLAPDTDVRFGI

SEQ ID NO: 881761 - protein, 24 aa, Mycobacterium
DAAQWIVRVVLSLAYWPLASSRVE

SEQ ID NO: 881762 - protein, 24 aa, Mycobacterium
DAARFLLLTPPLPLPARAPYGVLA

SEQ ID NO: 881763 - protein, 17 aa, Mycobacterium
DAARPFIFDTGLAPAAV

SEQ ID NO: 881764 - protein, 20 aa, Mycobacterium
DAARPFIFDTGLAPAAVGAA

SEQ ID NO: 881765 - protein, 20 aa, Mycobacterium
DAATKYPWLRPPGGGKFGAY

SEQ ID NO: 881766 - protein, 19 aa, Mycobacterium
DAAWFYPRPSPLARRIKNH

SEQ ID NO: 881767 - protein, 19 aa, Mycobacterium
DACIFLNRPGFAGGTGCAL

SEQ ID NO: 881768 - protein, 19 aa, Mycobacterium
DADLLNFSFLLLVAGNETT

SEQ ID NO: 881769 - protein, 23 aa, Mycobacterium
DADPRLAPLLAWRQQLVDSGAVA

SEQ ID NO: 881770 - protein, 22 aa, Mycobacterium
DADPYLPLITPFLDDLRGELDE

SEQ ID NO: 881771 - protein, 22 aa, Mycobacterium
DADWALFSRLMPVLPTTTESSG

SEQ ID NO: 881772 - protein, 24 aa, Mycobacterium
DAEALADLFRLLGPLTAEEIAQRC

SEQ ID NO: 881773 - protein, 18 aa, Mycobacterium
DAERPLWVKPESLQPIGA

SEQ ID NO: 881774 - protein, 25 aa, Mycobacterium
DAEYLLTRFIAWWVNQLEAHDFDTG

SEQ ID NO: 881775 - protein, 20 aa, Mycobacterium
DAFAYARRTLGLPATVVDWG

SEQ ID NO: 881776 - protein, 26 aa, Mycobacterium
DAFGDKVLPLYLPAGAGLIGLLSQIH

SEQ ID NO: 881777 - protein, 17 aa, Mycobacterium
DAFPKFMWMPSREVARA

SEQ ID NO: 881778 - protein, 18 aa, Mycobacterium
DAFTLAGIPAGGLFSGAE

SEQ ID NO: 881779 - protein, 21 aa, Mycobacterium
DAFTRLMFSLLTTGIAPTTFY

SEQ ID NO: 881780 - protein, 25 aa, Mycobacterium
DAGIALRFQLLWYPSTTFDTSLPSF

SEQ ID NO: 881781 - protein, 21 aa, Mycobacterium
DAGRWYALALAATAADMVGAA

SEQ ID NO: 881782 - protein, 23 aa, Mycobacterium
DAHLYLKRLLGWSAFLGGPDRYL

SEQ ID NO: 881783 - protein, 23 aa, Mycobacterium
DAHLYLKRLLSWSAFLGGPDRYL

SEQ ID NO: 881784 - protein, 22 aa, Mycobacterium
DAIFLPLLRVLFNSWFRVEVSG

SEQ ID NO: 881785 - protein, 18 aa, Mycobacterium
DAIRLEFATHFWGTLSMT

SEQ ID NO: 881786 - protein, 25 aa, Mycobacterium
DAIVRPLLRFFFRSWFRVEVSGIEN

SEQ ID NO: 881787 - protein, 24 aa, Mycobacterium
DALDRALIDLATYFRDALLVSAKA

SEQ ID NO: 881788 - protein, 21 aa, Mycobacterium
DALLPVPPDPVATLILTELRS

SEQ ID NO: 881789 - protein, 20 aa, Mycobacterium
DALNLPWLAMGAVGFISVWG

SEQ ID NO: 881790 - protein, 25 aa, Mycobacterium
DALRELHHVMLWAAFRYSTKPQAVP

SEQ ID NO: 881791 - protein, 21 aa, Mycobacterium
DALRRRHLVPQPPYGQGVAAA

SEQ ID NO: 881792 - protein, 25 aa, Mycobacterium
DALSWLRTMYALGRSAFQLGVLERG

SEQ ID NO: 881793 - protein, 17 aa, Mycobacterium
DALTAWIAGCHHAGRPV

SEQ ID NO: 881794 - protein, 24 aa, Mycobacterium
DALVRPLLRFFSRSWFRVEVSGIE

SEQ ID NO: 881795 - protein, 18 aa, Mycobacterium
DAMWLRFCAAIDLPDLAS

SEQ ID NO: 881796 - protein, 27 aa, Mycobacterium
DAPGFDVPYYWWTFNMPTDHGEVALTD

SEQ ID NO: 881797 - protein, 23 aa, Mycobacterium
DAPLGYLLYRVASLLRPEVSAVL

SEQ ID NO: 881798 - protein, 24 aa, Mycobacterium
DAQPRARFGLVLRYRAAPAHHRRS

SEQ ID NO: 881799 - protein, 23 aa, Mycobacterium
DAQTPTLLFPFAAPRVAGDMSEV

SEQ ID NO: 881800 - protein, 19 aa, Mycobacterium
DAQTPTLLFPFAAPRVVGD

SEQ ID NO: 881801 - protein, 20 aa, Mycobacterium
DARAYRLPWPDGTVVYEIDQ

SEQ ID NO: 881802 - protein, 23 aa, Mycobacterium
DARDLAVFFLTGLYALLATGAHH

SEQ ID NO: 881803 - protein, 20 aa, Mycobacterium
DARGYRLTWPEGMTLFEIDQ

SEQ ID NO: 881804 - protein, 22 aa, Mycobacterium
DARLRDLLCTVLTPLDCDIVQA

SEQ ID NO: 881805 - protein, 20 aa, Mycobacterium
DARTWRLPWPDGTVVYELDQ

SEQ ID NO: 881806 - protein, 17 aa, Mycobacterium
DARVLLEHLGVPRWRLM

SEQ ID NO: 881807 - protein, 17 aa, Mycobacterium
DARVVFVRYALPGETVR

SEQ ID NO: 881808 - protein, 24 aa, Mycobacterium
DARWDSVIAVNLLAPLRLTEGLVG

SEQ ID NO: 881809 - protein, 17 aa, Mycobacterium
DATDLPVLLYDIPPRSV

SEQ ID NO: 881810 - protein, 24 aa, Mycobacterium
DATELAMFFLTGLFALLATGTHDP

SEQ ID NO: 881811 - protein, 19 aa, Mycobacterium
DATRLLYTLGWHEVPVPES

SEQ ID NO: 881812 - protein, 17 aa, Mycobacterium
DATTFSFGIANPGFWNV

SEQ ID NO: 881813 - protein, 19 aa, Mycobacterium
DATYRAVLALLLLTGSMGR

SEQ ID NO: 881814 - protein, 20 aa, Mycobacterium
DAVDFHRWLQWQLDDQLTAA

SEQ ID NO: 881815 - protein, 20 aa, Mycobacterium
DAVEFWWPFAEATPSDREVD

SEQ ID NO: 881816 - protein, 27 aa, Mycobacterium
DAVFLARALLRDPAWIWRAAEQLGHQL

SEQ ID NO: 881817 - protein, 20 aa, Mycobacterium
DAVFLFDVLLHQVSPDWDAI

SEQ ID NO: 881818 - protein, 19 aa, Mycobacterium
DAVTFDLRWKAACGLPITA

SEQ ID NO: 881819 - protein, 22 aa, Mycobacterium
DAWASYRWCAFYGFMLSIPMAV

SEQ ID NO: 881820 - protein, 21 aa, Mycobacterium
DAWLSARRDLLDRRNRMRELA

SEQ ID NO: 881821 - protein, 17 aa, Mycobacterium
DAWPPTSWYADWVSGLD

SEQ ID NO: 881822 - protein, 24 aa, Mycobacterium
DAWQRFGVWLLHKHFDPEPGEVFV

SEQ ID NO: 881823 - protein, 17 aa, Mycobacterium
DAWVWDMYRPARFVKQV

SEQ ID NO: 881824 - protein, 17 aa, Mycobacterium
DAWWGPTVPLEGAPWFA

SEQ ID NO: 881825 - protein, 17 aa, Mycobacterium
DAYFPLGWPMACHVMGD

SEQ ID NO: 881826 - protein, 18 aa, Mycobacterium
DAYFQFPVAKYGIALDNW

SEQ ID NO: 881827 - protein, 25 aa, Mycobacterium
DAYLRLHLLSHRLVAPHGLNAGGFF

SEQ ID NO: 881828 - protein, 26 aa, Mycobacterium
DAYLRLHLLSHRLVAPHGLNAGGLFG

SEQ ID NO: 881829 - protein, 18 aa, Mycobacterium
DAYRALKAWGLPVSDHTA

SEQ ID NO: 881830 - protein, 21 aa, Mycobacterium
DCERLLRRRLASLRPDDAILG

SEQ ID NO: 881831 - protein, 24 aa, Mycobacterium
DCFSANEFLLYEALGLCGEGEAGK

SEQ ID NO: 881832 - protein, 17 aa, Mycobacterium
DCFSANELLLYEALGLC

SEQ ID NO: 881833 - protein, 21 aa, Mycobacterium
DCGFGWYFYDFGTAVSFIEHD

SEQ ID NO: 881834 - protein, 19 aa, Mycobacterium
DCIAFFWFRDAPDGVPGLT

SEQ ID NO: 881835 - protein, 22 aa, Mycobacterium
DCPHFDYSLPAYYLILPSEVSS

SEQ ID NO: 881836 - protein, 17 aa, Mycobacterium
DCTAIRWGLWQAAGVVA

SEQ ID NO: 881837 - protein, 22 aa, Mycobacterium
DCVPWLRWTTPDGGLFVWCELA

SEQ ID NO: 881838 - protein, 22 aa, Mycobacterium
DDALALIYLFASPDAEVVGIAS

SEQ ID NO: 881839 - protein, 21 aa, Mycobacterium
DDALALLYLLASPEAELVGIA

SEQ ID NO: 881840 - protein, 23 aa, Mycobacterium
DDALNLPWLAMGAIGFISVIGHL

SEQ ID NO: 881841 - protein, 23 aa, Mycobacterium
DDALNLPWLAMGALGFISVWGHL

SEQ ID NO: 881842 - protein, 23 aa, Mycobacterium
DDAPPRLFLSRYAKATAPKPAPP

SEQ ID NO: 881843 - protein, 24 aa, Mycobacterium
DDDKGLWLSIIDKLGLPFTDVFLA

SEQ ID NO: 881844 - protein, 23 aa, Mycobacterium
DDDLADLFLPRPLRWLVSATRPA

SEQ ID NO: 881845 - protein, 24 aa, Mycobacterium
DDDLAELFLPTPLRWLVAATRAAP

SEQ ID NO: 881846 - protein, 18 aa, Mycobacterium
DDDLIAGAAYRWLRSWPT

SEQ ID NO: 881847 - protein, 22 aa, Mycobacterium
DDDRFMFGYIPPVFKGQYAETA

SEQ ID NO: 881848 - protein, 24 aa, Mycobacterium
DDDRPFFAYLPFQAPHWPLQAPDE

SEQ ID NO: 881849 - protein, 24 aa, Mycobacterium
DDEALVITHWPPPCRFWNLVVWNQ

SEQ ID NO: 881850 - protein, 19 aa, Mycobacterium
DDEFFVIVRPAPAGTRLLL

SEQ ID NO: 881851 - protein, 17 aa, Mycobacterium
DDEFFVIVRPAPSGTRL

SEQ ID NO: 881852 - protein, 21 aa, Mycobacterium
DDEFFVIVRPAPSGTRLLLSD

SEQ ID NO: 881853 - protein, 24 aa, Mycobacterium
DDEIFAFLLLILPAGVETTYRASG

SEQ ID NO: 881854 - protein, 17 aa, Mycobacterium
DDELLSFFAIPRAMLPR

SEQ ID NO: 881855 - protein, 17 aa, Mycobacterium
DDGFVNVIYRWAKSGDL

SEQ ID NO: 881856 - protein, 26 aa, Mycobacterium
DDHDTIFAWWIRRHLNPPPPLSEWVE

SEQ ID NO: 881857 - protein, 21 aa, Mycobacterium
DDHRFLIARRFILLDQNILQA

SEQ ID NO: 881858 - protein, 18 aa, Mycobacterium
DDLARRLIVLVEPVEAIV

SEQ ID NO: 881859 - protein, 24 aa, Mycobacterium
DDLDYYLVLAKWKLAIVLEQGFQR

SEQ ID NO: 881860 - protein, 18 aa, Mycobacterium
DDLPVLIFFLVNAGYKTT

SEQ ID NO: 881861 - protein, 21 aa, Mycobacterium
DDLRVIDNVRYFAALYGTSPA

SEQ ID NO: 881862 - protein, 20 aa, Mycobacterium
DDLVSPFLGLYRDNNLRPDS

SEQ ID NO: 881863 - protein, 25 aa, Mycobacterium
DDMAPICQLFHTLPIPWVEAEDISN

SEQ ID NO: 881864 - protein, 23 aa, Mycobacterium
DDMARWLMMLLGNGTYNGRRIVA

SEQ ID NO: 881865 - protein, 23 aa, Mycobacterium
DDPEFRAPWSLAKKKRRSSPLSP

SEQ ID NO: 881866 - protein, 24 aa, Mycobacterium
DDPRLWYYRFQTDAIGWNPGVNVL

SEQ ID NO: 881867 - protein, 22 aa, Mycobacterium
DDPVFMLTGPIPATRYALEKTG

SEQ ID NO: 881868 - protein, 20 aa, Mycobacterium
DDRLHWWAGPWPVDERWWDP

SEQ ID NO: 881869 - protein, 20 aa, Mycobacterium
DDRLRWWAGPWPVDERWWDD

SEQ ID NO: 881870 - protein, 21 aa, Mycobacterium
DDVAALLRWLGNGNFLLLGYQ

SEQ ID NO: 881871 - protein, 22 aa, Mycobacterium
DDVAALLRWLGNGNFLLLGYQR

SEQ ID NO: 881872 - protein, 24 aa, Mycobacterium
DDVFLPVIPTPFGFGLWTSHTTPI

SEQ ID NO: 881873 - protein, 19 aa, Mycobacterium
DDVIPFLKTLPAYTALRVR

SEQ ID NO: 881874 - protein, 19 aa, Mycobacterium
DDVLLFKYIIKNTAWQAGK

SEQ ID NO: 881875 - protein, 20 aa, Mycobacterium
DDVLLFKYIIKNTAWQNGKT

SEQ ID NO: 881876 - protein, 26 aa, Mycobacterium
DDVMFTAMPFFWVGGLITGLHAVIHH

SEQ ID NO: 881877 - protein, 29 aa, Mycobacterium
DDVPAYRRWLGTRLPYYANWIRLKSYWGT

SEQ ID NO: 881878 - protein, 26 aa, Mycobacterium
DDVSLWGLLIPLRRAFNQYVNLRPVR

SEQ ID NO: 881879 - protein, 24 aa, Mycobacterium
DDVVLLLYRHPAPLELTFPADVSH

SEQ ID NO: 881880 - protein, 17 aa, Mycobacterium
DDWRWVIDIDLWGSIHT

SEQ ID NO: 881881 - protein, 17 aa, Mycobacterium
DDYDYYPLRLPPEITRI

SEQ ID NO: 881882 - protein, 19 aa, Mycobacterium
DDYGPDLRRWLVARLGLTE

SEQ ID NO: 881883 - protein, 24 aa, Mycobacterium
DEAAQLMIDLFWYGLKGSPEEREA

SEQ ID NO: 881884 - protein, 26 aa, Mycobacterium
DEAPLLATYAFLPVVRTFASAAGIDV

SEQ ID NO: 881885 - protein, 18 aa, Mycobacterium
DEARILRFLAAHGAQPVV

SEQ ID NO: 881886 - protein, 17 aa, Mycobacterium
DECRMFLSMLGIGPSKT

SEQ ID NO: 881887 - protein, 18 aa, Mycobacterium
DECRVFLSMLGIGPAKLA

SEQ ID NO: 881888 - protein, 18 aa, Mycobacterium
DEDLLNFAYLLLVAGNET

SEQ ID NO: 881889 - protein, 23 aa, Mycobacterium
DEEIFSFLRLLLPAGVETTYRSL

SEQ ID NO: 881890 - protein, 17 aa, Mycobacterium
DEFGFFVILLAVAGNET

SEQ ID NO: 881891 - protein, 18 aa, Mycobacterium
DEFGFFVMLLAVAGNETT

SEQ ID NO: 881892 - protein, 23 aa, Mycobacterium
DEGIAWVPYFPLGSALPGFPKVA

SEQ ID NO: 881893 - protein, 17 aa, Mycobacterium
DEGLLVNLPISQALKYG

SEQ ID NO: 881894 - protein, 18 aa, Mycobacterium
DEGVNLLWMAGKRKTWTG

SEQ ID NO: 881895 - protein, 23 aa, Mycobacterium
DEGVWLRPFRTLIYTMPPYICDE

SEQ ID NO: 881896 - protein, 23 aa, Mycobacterium
DEGWLPQSYLPDTYPYVASLSPG

SEQ ID NO: 881897 - protein, 25 aa, Mycobacterium
DEHSDFISYLNLWNYLREQRNELSG

SEQ ID NO: 881898 - protein, 19 aa, Mycobacterium
DELGLPTAPFWFVGSLGEL

SEQ ID NO: 881899 - protein, 18 aa, Mycobacterium
DELIYLAGFFTGLPDRPT

SEQ ID NO: 881900 - protein, 18 aa, Mycobacterium
DELLGFCLLLLIAGHETT

SEQ ID NO: 881901 - protein, 21 aa, Mycobacterium
DELLRSFLDWLFARYREIVDG

SEQ ID NO: 881902 - protein, 24 aa, Mycobacterium
DELPAAALWWRISGALSPTATLAT

SEQ ID NO: 881903 - protein, 25 aa, Mycobacterium
DELRRLIPPWVTLGSRLAAMPKPKR

SEQ ID NO: 881904 - protein, 23 aa, Mycobacterium
DELRRLIPPWVTLGSRMATMPKP

SEQ ID NO: 881905 - protein, 23 aa, Mycobacterium
DELRRWIPLLSRFRVVSVRGPRS

SEQ ID NO: 881906 - protein, 18 aa, Mycobacterium
DEPFLLPAHIDLAALRVK

SEQ ID NO: 881907 - protein, 23 aa, Mycobacterium
DEPTLDALLLMSLSLGLGVTDVA

SEQ ID NO: 881908 - protein, 20 aa, Mycobacterium
DERWPFTYLQVYADAMLDPD

SEQ ID NO: 881909 - protein, 25 aa, Mycobacterium
DESGRPLWPMIIMRTPKGWTGPATV

SEQ ID NO: 881910 - protein, 22 aa, Mycobacterium
DESKLLLWLPSFAPERTLKRMV

SEQ ID NO: 881911 - protein, 18 aa, Mycobacterium
DESLDLRWWPLDALPDGT

SEQ ID NO: 881912 - protein, 25 aa, Mycobacterium
DESLDYFLGLMLRAPFRLARDVIPH

SEQ ID NO: 881913 - protein, 26 aa, Mycobacterium
DESLDYFLNLMLRAPFRLTREVLPHM

SEQ ID NO: 881914 - protein, 25 aa, Mycobacterium
DESLDYVLSLMLRAPFRLTREVLPH

SEQ ID NO: 881915 - protein, 18 aa, Mycobacterium
DESPIVFLRLRKAARKHG

SEQ ID NO: 881916 - protein, 25 aa, Mycobacterium
DESQALVLRFFFAPRPSIRSRRRAL

SEQ ID NO: 881917 - protein, 24 aa, Mycobacterium
DESYTRWGPIQWMAPETLLTLGAH

SEQ ID NO: 881918 - protein, 25 aa, Mycobacterium
DETLDYFLGLMLRAPFRLARDVLPH

SEQ ID NO: 881919 - protein, 23 aa, Mycobacterium
DEVALLMPGVWIERPRFSDEALV

SEQ ID NO: 881920 - protein, 21 aa, Mycobacterium
DEVLRPLRLTRLNPLGLNNAA

SEQ ID NO: 881921 - protein, 26 aa, Mycobacterium
DEVSVAIAGLLRLHGQQYQQFGAHLS

SEQ ID NO: 881922 - protein, 19 aa, Mycobacterium
DEWLTIFGGWRSAVPDIIE

SEQ ID NO: 881923 - protein, 25 aa, Mycobacterium
DFADALAALWQWGLDIDWRPLYAEH

SEQ ID NO: 881924 - protein, 22 aa, Mycobacterium
DFAWSWHILMKGAIILAAVGDP

SEQ ID NO: 881925 - protein, 22 aa, Mycobacterium
DFAWSWHILMKGAIIMAAVGDA

SEQ ID NO: 881926 - protein, 23 aa, Mycobacterium
DFEDYWAFLAFAVAKGGPRLFEG

SEQ ID NO: 881927 - protein, 18 aa, Mycobacterium
DFGFFWITAVTVDGQIAV

SEQ ID NO: 881928 - protein, 18 aa, Mycobacterium
DFLIPNRGVGVLLPEGEQ

SEQ ID NO: 881929 - protein, 22 aa, Mycobacterium
DFNFMLIGAAFYRDTYRRTTDG

SEQ ID NO: 881930 - protein, 19 aa, Mycobacterium
DFNGWWMCMIPRAVAEELG

SEQ ID NO: 881931 - protein, 17 aa, Mycobacterium
DFNPLLRMASGVNWNFF

SEQ ID NO: 881932 - protein, 19 aa, Mycobacterium
DFPEVLLALFRGENTGKLV

SEQ ID NO: 881933 - protein, 21 aa, Mycobacterium
DFPYRQFYPPKATVIQVDIRG

SEQ ID NO: 881934 - protein, 19 aa, Mycobacterium
DFRQLWFGWADPAQILVEY

SEQ ID NO: 881935 - protein, 18 aa, Mycobacterium
DFRQTELFRLLLPARFGG

SEQ ID NO: 881936 - protein, 21 aa, Mycobacterium
DFRTFDFLGIRNWTAGKPIIV

SEQ ID NO: 881937 - protein, 19 aa, Mycobacterium
DFSVWEIFGALLRGRRLLV

SEQ ID NO: 881938 - protein, 18 aa, Mycobacterium
DFTFFPRTVIHRLSPGSA

SEQ ID NO: 881939 - protein, 23 aa, Mycobacterium
DFTNIYFYAVLYHALRASNRIAV

SEQ ID NO: 881940 - protein, 23 aa, Mycobacterium
DFTNIYFYTVLYHALRASNRISI

SEQ ID NO: 881941 - protein, 22 aa, Mycobacterium
DFVKKLLARKTPPKGAGLFVAD

SEQ ID NO: 881942 - protein, 21 aa, Mycobacterium
DFVWQLHVPLSPVVRGRDAAR

SEQ ID NO: 881943 - protein, 26 aa, Mycobacterium
DFWFDPLCPWAWITSRWILEVEKVRD

SEQ ID NO: 881944 - protein, 24 aa, Mycobacterium
DGAGLYPWIPTLKLHYVRIIPAQI

SEQ ID NO: 881945 - protein, 21 aa, Mycobacterium
DGAPLFPYFRDLTPAPVVLGN

SEQ ID NO: 881946 - protein, 20 aa, Mycobacterium
DGAVPLVLLLPGGGAQYVGM

SEQ ID NO: 881947 - protein, 17 aa, Mycobacterium
DGDWPSFPLPLGDTWSS

SEQ ID NO: 881948 - protein, 20 aa, Mycobacterium
DGESLWWALVGRNKRDISLS

SEQ ID NO: 881949 - protein, 20 aa, Mycobacterium
DGFPNLFLISGPGAPAVLAN

SEQ ID NO: 881950 - protein, 17 aa, Mycobacterium
DGFWAAVLHRTAERRAG

SEQ ID NO: 881951 - protein, 24 aa, Mycobacterium
DGGAGGFIIGTYGGNGGGAAGAGG

SEQ ID NO: 881952 - protein, 26 aa, Mycobacterium
DGGDANYAIPWGNSAYAGDGGYGGDG

SEQ ID NO: 881953 - protein, 24 aa, Mycobacterium
DGGIAFTFAIYYLPMPAADPFDTL

SEQ ID NO: 881954 - protein, 27 aa, Mycobacterium
DGGRYAFGANWSLDLPVGGAGGAGGWA

SEQ ID NO: 881955 - protein, 17 aa, Mycobacterium
DGHVAFLVALLFFYELT

SEQ ID NO: 881956 - protein, 17 aa, Mycobacterium
DGHYVVGPLLWQAGLLA

SEQ ID NO: 881957 - protein, 23 aa, Mycobacterium
DGILRRLRLMDLSPPRPGLPADT

SEQ ID NO: 881958 - protein, 18 aa, Mycobacterium
DGLALPMRLALPGAVNRG

SEQ ID NO: 881959 - protein, 19 aa, Mycobacterium
DGLALPMRLALPGAVNRGN

SEQ ID NO: 881960 - protein, 24 aa, Mycobacterium
DGLAVREILLLRLRALLARAHGDD

SEQ ID NO: 881961 - protein, 22 aa, Mycobacterium
DGLLWPEPWLALNPAFEPGGSV

SEQ ID NO: 881962 - protein, 23 aa, Mycobacterium
DGLRAFLSRFLLPAILAGDHARP

SEQ ID NO: 881963 - protein, 21 aa, Mycobacterium
DGLTVWVYRGADWLVPDPHGP

SEQ ID NO: 881964 - protein, 19 aa, Mycobacterium
DGLVAYRRSLGLPAVGINW

SEQ ID NO: 881965 - protein, 22 aa, Mycobacterium
DGLWFFLNEVWPLVLARTPDAH

SEQ ID NO: 881966 - protein, 19 aa, Mycobacterium
DGLWYPLWDANVRLDHSVR

SEQ ID NO: 881967 - protein, 24 aa, Mycobacterium
DGMRLRYVDPFRAELERLGRMVFG

SEQ ID NO: 881968 - protein, 22 aa, Mycobacterium
DGNFVLYTPERPVWHSDTVGSK

SEQ ID NO: 881969 - protein, 18 aa, Mycobacterium
DGPEWICYFPHPHRVVCG

SEQ ID NO: 881970 - protein, 31 aa, Mycobacterium
DGPSIDRPLYRFPVFGFFALSIGAAALGNAR

SEQ ID NO: 881971 - protein, 31 aa, Mycobacterium
DGPVLDRPLYRFPVFGFFALSIGAAALGNAR

SEQ ID NO: 881972 - protein, 23 aa, Mycobacterium
DGPYFVMQWLLRQPRHAILPVAG

SEQ ID NO: 881973 - protein, 23 aa, Mycobacterium
DGPYYFFGVFAKLAKLPSFTPMM

SEQ ID NO: 881974 - protein, 24 aa, Mycobacterium
DGPYYFFGVLARLAALPRFTPMAL

SEQ ID NO: 881975 - protein, 24 aa, Mycobacterium
DGQPLLLTPPPWYPILRGTTQQAL

SEQ ID NO: 881976 - protein, 24 aa, Mycobacterium
DGQSHAWIQAWTGEWRYYDPTNDA

SEQ ID NO: 881977 - protein, 25 aa, Mycobacterium
DGQVQWNMQLLSYLFDHGLDPAEAV

SEQ ID NO: 881978 - protein, 18 aa, Mycobacterium
DGRFTAVLIPLGDGLLAA

SEQ ID NO: 881979 - protein, 23 aa, Mycobacterium
DGRPFRLGFLLHLDRDIPPAQAY

SEQ ID NO: 881980 - protein, 23 aa, Mycobacterium
DGRPLILPVWYRLTDDHLQFVTH

SEQ ID NO: 881981 - protein, 18 aa, Mycobacterium
DGRPLMWWTDPESAFEAW

SEQ ID NO: 881982 - protein, 18 aa, Mycobacterium
DGRRLFVFLGSTIGNLTP

SEQ ID NO: 881983 - protein, 24 aa, Mycobacterium
DGRTPIYGLLWRPHDLDPDRTYPI

SEQ ID NO: 881984 - protein, 23 aa, Mycobacterium
DGRTRMILPDNGLWIISRAAGRN

SEQ ID NO: 881985 - protein, 24 aa, Mycobacterium
DGRVALGWRLKLLVAAYPVLAMKW

SEQ ID NO: 881986 - protein, 23 aa, Mycobacterium
DGSAAFRFLLSPIRIVCANTQSA

SEQ ID NO: 881987 - protein, 20 aa, Mycobacterium
DGSIDALFWSGGLPTSGITD

SEQ ID NO: 881988 - protein, 21 aa, Mycobacterium
DGVLWISPLAGPPGFLRGDEG

SEQ ID NO: 881989 - protein, 31 aa, Mycobacterium
DGWKDLYLPVVRLLEPVLPAGALILADNTES

SEQ ID NO: 881990 - protein, 23 aa, Mycobacterium
DGYGRNFLLPRGLAIMASRGAQR

SEQ ID NO: 881991 - protein, 17 aa, Mycobacterium
DGYLHALRRRHPTRWTW

SEQ ID NO: 881992 - protein, 23 aa, Mycobacterium
DHALPHWAGVVPLALRAGTPEPA

SEQ ID NO: 881993 - protein, 17 aa, Mycobacterium
DHAMWFMRSFRADEWLL

SEQ ID NO: 881994 - protein, 22 aa, Mycobacterium
DHDFRWWVCGYWRMQPCGPGNI

SEQ ID NO: 881995 - protein, 25 aa, Mycobacterium
DHEGKWRVVFFWPKDFTFVCPTEIA

SEQ ID NO: 881996 - protein, 22 aa, Mycobacterium
DHFEFFVFPYAETALTRTTRRS

SEQ ID NO: 881997 - protein, 21 aa, Mycobacterium
DHFEFFVFPYGDTALTRTTRR

SEQ ID NO: 881998 - protein, 21 aa, Mycobacterium
DHFTPFTLIQLEELGFCGKGE

SEQ ID NO: 881999 - protein, 22 aa, Mycobacterium
DHFTPFTLIQLEELGFCGKGEA

SEQ ID NO: 882000 - protein, 26 aa, Mycobacterium
DHGVWLRPFRNLIYVMPPYICTPAEI

SEQ ID NO: 882001 - protein, 17 aa, Mycobacterium
DHHAYLSLMLWLAGPGS

SEQ ID NO: 882002 - protein, 19 aa, Mycobacterium
DHHFLINPYGLLFEEITAS

SEQ ID NO: 882003 - protein, 24 aa, Mycobacterium
DHIDPILLDLLRLGAYQILRTRVD

SEQ ID NO: 882004 - protein, 24 aa, Mycobacterium
DHIGAIPFLLKLRPDIPVVGSKFT

SEQ ID NO: 882005 - protein, 23 aa, Mycobacterium
DHIGAIPFLLKLRPDIPVVGSRF

SEQ ID NO: 882006 - protein, 25 aa, Mycobacterium
DHIGAIPFLLRLRPDIPIVGSKFTL

SEQ ID NO: 882007 - protein, 24 aa, Mycobacterium
DHIGGIPFLLKLRPDIPVVGSKFT

SEQ ID NO: 882008 - protein, 24 aa, Mycobacterium
DHIGGIPFLLKLRPDIPVVGSRFT

SEQ ID NO: 882009 - protein, 17 aa, Mycobacterium
DHIVAHPAIRWVGNANE

SEQ ID NO: 882010 - protein, 23 aa, Mycobacterium
DHLADLGFLPTVTRILAATPAGG

SEQ ID NO: 882011 - protein, 22 aa, Mycobacterium
DHPAPLLLWIHGGPLASWNAWH

SEQ ID NO: 882012 - protein, 22 aa, Mycobacterium
DHPFFARIWPFIVAHEAEPVRA

SEQ ID NO: 882013 - protein, 26 aa, Mycobacterium
DHPGKWRVIFFWPKDFTFVCPTEIAA

SEQ ID NO: 882014 - protein, 25 aa, Mycobacterium
DHPGKWRVVFFWPKDFTFVCPTEIA

SEQ ID NO: 882015 - protein, 23 aa, Mycobacterium
DHQHPLPFLLLVRGSVRARAVVN

SEQ ID NO: 882016 - protein, 19 aa, Mycobacterium
DHQLQRWLLPTVRGEKHEA

SEQ ID NO: 882017 - protein, 23 aa, Mycobacterium
DHVALPFKWAFPRVFRAFAEEDL

SEQ ID NO: 882018 - protein, 24 aa, Mycobacterium
DHVALPFKWAFPRVYRAFAEEGLH

SEQ ID NO: 882019 - protein, 22 aa, Mycobacterium
DIANLAVFLLSDAASFITGQVI

SEQ ID NO: 882020 - protein, 22 aa, Mycobacterium
DIATFACHIYYRGVGWTFVPTT

SEQ ID NO: 882021 - protein, 23 aa, Mycobacterium
DIAWLRELWGGPFMLKGVIRVDD

SEQ ID NO: 882022 - protein, 23 aa, Mycobacterium
DIAWLRELWGGPFMLKGVMRVDD

SEQ ID NO: 882023 - protein, 21 aa, Mycobacterium
DIAWSRITYWRALLASAIDEP

SEQ ID NO: 882024 - protein, 23 aa, Mycobacterium
DIDDEFFVILRPAPSGTRLLLSD

SEQ ID NO: 882025 - protein, 24 aa, Mycobacterium
DIDDEFFVILRPAPSGTRLLLSDA

SEQ ID NO: 882026 - protein, 19 aa, Mycobacterium
DIDLYLRIAPELFLKRCLV

SEQ ID NO: 882027 - protein, 18 aa, Mycobacterium
DIDLYLRIAPELFLKRCV

SEQ ID NO: 882028 - protein, 20 aa, Mycobacterium
DIHFRIEDDLYYPALKDATK

SEQ ID NO: 882029 - protein, 21 aa, Mycobacterium
DIHFRIEDDLYYPALRAATKL

SEQ ID NO: 882030 - protein, 17 aa, Mycobacterium
DIHFRIEDDLYYPALSA

SEQ ID NO: 882031 - protein, 21 aa, Mycobacterium
DIICPPLYLQYAVLGVSRLKS

SEQ ID NO: 882032 - protein, 18 aa, Mycobacterium
DILFFWVARMMMFGTFVG

SEQ ID NO: 882033 - protein, 17 aa, Mycobacterium
DILFLSEAFTRPARLYG

SEQ ID NO: 882034 - protein, 19 aa, Mycobacterium
DIPIYLDLGSLALNGFTIP

SEQ ID NO: 882035 - protein, 20 aa, Mycobacterium
DIPLRAWLFRVADDEHVLVA

SEQ ID NO: 882036 - protein, 25 aa, Mycobacterium
DIRALYAFKRLAWWPYSVAMRQVNA

SEQ ID NO: 882037 - protein, 19 aa, Mycobacterium
DIRGLPWDVWKRELLGLGT

SEQ ID NO: 882038 - protein, 17 aa, Mycobacterium
DIRHNHVALRILQDEAG

SEQ ID NO: 882039 - protein, 17 aa, Mycobacterium
DIRTMFGVLFQDGALFG

SEQ ID NO: 882040 - protein, 17 aa, Mycobacterium
DIWWFRLPKHPDDPQGP

SEQ ID NO: 882041 - protein, 20 aa, Mycobacterium
DIYHWLTVMQELLVLALMGK

SEQ ID NO: 882042 - protein, 18 aa, Mycobacterium
DIYPGWDGLSWASEHVGS

SEQ ID NO: 882043 - protein, 21 aa, Mycobacterium
DKFPRAILNRTFDYGFATGLM

SEQ ID NO: 882044 - protein, 24 aa, Mycobacterium
DKKRPFYFGALTWYMDRLLELVHD

SEQ ID NO: 882045 - protein, 20 aa, Mycobacterium
DKPFMMYWASGCLHGPHHIM

SEQ ID NO: 882046 - protein, 22 aa, Mycobacterium
DKQANLHFIIGKASFDETKLAE

SEQ ID NO: 882047 - protein, 25 aa, Mycobacterium
DKYARLFAWLGLWERHTDLAVIPAD

SEQ ID NO: 882048 - protein, 20 aa, Mycobacterium
DKYNPFVWDVYLTSIEPSAS

SEQ ID NO: 882049 - protein, 23 aa, Mycobacterium
DLAAARWWRKPLVHRWYGFSAMQ

SEQ ID NO: 882050 - protein, 19 aa, Mycobacterium
DLAAARWWRKPLVRRWYGF

SEQ ID NO: 882051 - protein, 23 aa, Mycobacterium
DLAGWLVEALVSHAAIAGAEIAG

SEQ ID NO: 882052 - protein, 19 aa, Mycobacterium
DLALPDLELIFAPAPFYDE

SEQ ID NO: 882053 - protein, 26 aa, Mycobacterium
DLARHTLIWYIDALLDVAPLRILGLL

SEQ ID NO: 882054 - protein, 21 aa, Mycobacterium
DLAWARITYWRALLTSAVDLP

SEQ ID NO: 882055 - protein, 17 aa, Mycobacterium
DLAWSRVTYWRALLAAA

SEQ ID NO: 882056 - protein, 18 aa, Mycobacterium
DLCALWPVPATSTPHAAS

SEQ ID NO: 882057 - protein, 22 aa, Mycobacterium
DLCALWPVPPTSAPHAAPAMAP

SEQ ID NO: 882058 - protein, 17 aa, Mycobacterium
DLDILLLDLPPGTGDIA

SEQ ID NO: 882059 - protein, 23 aa, Mycobacterium
DLDSTLPMLLFSGLMNSGQACVG

SEQ ID NO: 882060 - protein, 23 aa, Mycobacterium
DLEFNLFFLLLINAGGDTTRNLV

SEQ ID NO: 882061 - protein, 22 aa, Mycobacterium
DLEKLWEGLRQLYPVGIDHRDL

SEQ ID NO: 882062 - protein, 21 aa, Mycobacterium
DLERYPLVYFIDSMLQVDDLD

SEQ ID NO: 882063 - protein, 21 aa, Mycobacterium
DLESLWTALKTLYPVGIDHAP

SEQ ID NO: 882064 - protein, 17 aa, Mycobacterium
DLFGPYPLANGYTVVVT

SEQ ID NO: 882065 - protein, 26 aa, Mycobacterium
DLGADLVRFLPWFSHPRLSVAQLSPP

SEQ ID NO: 882066 - protein, 18 aa, Mycobacterium
DLGWYRLPKGSLGANYLK

SEQ ID NO: 882067 - protein, 21 aa, Mycobacterium
DLHLYLRRVMLYRSMFGTPEE

SEQ ID NO: 882068 - protein, 28 aa, Mycobacterium
DLIDRVVFWMLPLDDPLPWLLVDRRAMK

SEQ ID NO: 882069 - protein, 18 aa, Mycobacterium
DLINIRYLTGFTGSAAAL

SEQ ID NO: 882070 - protein, 21 aa, Mycobacterium
DLISAWLYRPPGDGPAPLLVM

SEQ ID NO: 882071 - protein, 17 aa, Mycobacterium
DLITLRKDDWDKVSIAL

SEQ ID NO: 882072 - protein, 21 aa, Mycobacterium
DLKFALVEPLRLLFKDEVRAV

SEQ ID NO: 882073 - protein, 24 aa, Mycobacterium
DLLDEAWWFPAIQWPDGRMQFMLN

SEQ ID NO: 882074 - protein, 17 aa, Mycobacterium
DLLKGVLMPAIMSAVKP

SEQ ID NO: 882075 - protein, 17 aa, Mycobacterium
DLLLLKGKYLVHPELPA

SEQ ID NO: 882076 - protein, 17 aa, Mycobacterium
DLLLQLIFAHRLDVTEV

SEQ ID NO: 882077 - protein, 17 aa, Mycobacterium
DLLPLLEKVAEAGKPLL

SEQ ID NO: 882078 - protein, 19 aa, Mycobacterium
DLLRFYRLAQELVWQWMFG

SEQ ID NO: 882079 - protein, 17 aa, Mycobacterium
DLLRRRGWPALESEHTW

SEQ ID NO: 882080 - protein, 21 aa, Mycobacterium
DLMADWIGWLFAFDDVFDESI

SEQ ID NO: 882081 - protein, 20 aa, Mycobacterium
DLMSLFLPVSPFVELLDIRA

SEQ ID NO: 882082 - protein, 23 aa, Mycobacterium
DLNPTWIWHALYGLILQGCEQAM

SEQ ID NO: 882083 - protein, 19 aa, Mycobacterium
DLPAGSRLLLLWGAANRDP

SEQ ID NO: 882084 - protein, 23 aa, Mycobacterium
DLPDRWWNFLALANAIAGGLFVH

SEQ ID NO: 882085 - protein, 22 aa, Mycobacterium
DLPGMGSLLLPPWTLTRYAPDG

SEQ ID NO: 882086 - protein, 24 aa, Mycobacterium
DLPGTQWQHRRFWRTPTPPPGTAA

SEQ ID NO: 882087 - protein, 18 aa, Mycobacterium
DLPLPHWAGVVPLTLTAG

SEQ ID NO: 882088 - protein, 22 aa, Mycobacterium
DLPLRSWLFTVARNIVIDGSRS

SEQ ID NO: 882089 - protein, 17 aa, Mycobacterium
DLPMLWQIAAHNPWLSV

SEQ ID NO: 882090 - protein, 18 aa, Mycobacterium
DLPPVYLMMFRVLGSLSG

SEQ ID NO: 882091 - protein, 23 aa, Mycobacterium
DLPTLIVAPYFRSAIEAAIDGWR

SEQ ID NO: 882092 - protein, 18 aa, Mycobacterium
DLQWWPPDALPPGTDHAL

SEQ ID NO: 882093 - protein, 21 aa, Mycobacterium
DLRALSLPVLRSWLATAAGAG

SEQ ID NO: 882094 - protein, 26 aa, Mycobacterium
DLRDWRQWWRWVPGASWRHPFGPDSD

SEQ ID NO: 882095 - protein, 21 aa, Mycobacterium
DLRIGGPFRLFPKAAAPGALH

SEQ ID NO: 882096 - protein, 22 aa, Mycobacterium
DLRINWVWNPPWGPDKITEDGR

SEQ ID NO: 882097 - protein, 24 aa, Mycobacterium
DLSADYLLVFRQLVLWPVDADGFI

SEQ ID NO: 882098 - protein, 20 aa, Mycobacterium
DLSFISLALVLDALIACAGP

SEQ ID NO: 882099 - protein, 22 aa, Mycobacterium
DLSWLFMTDWISSPLPGNAPAP

SEQ ID NO: 882100 - protein, 20 aa, Mycobacterium
DLTIGFFLHIPFPPVELFLQ

SEQ ID NO: 882101 - protein, 22 aa, Mycobacterium
DLTSPVAFLQRPARWIHAMANG

SEQ ID NO: 882102 - protein, 21 aa, Mycobacterium
DLTVAFLLMLARRLPTASAFL

SEQ ID NO: 882103 - protein, 24 aa, Mycobacterium
DLTVDLLMPVPGFLIKRGSKSLMD

SEQ ID NO: 882104 - protein, 21 aa, Mycobacterium
DLVGMLLFLLSDQAKWVTGQI

SEQ ID NO: 882105 - protein, 17 aa, Mycobacterium
DLVGWLRDRTDGDALCL

SEQ ID NO: 882106 - protein, 18 aa, Mycobacterium
DLVLFAQSFHWVEPTTAL

SEQ ID NO: 882107 - protein, 17 aa, Mycobacterium
DLVLIYLIQNLPDLTVD

SEQ ID NO: 882108 - protein, 21 aa, Mycobacterium
DLVTLAVLRLGRPVRYEFTRV

SEQ ID NO: 882109 - protein, 18 aa, Mycobacterium
DLWWQDRLGGPFPLSVLK

SEQ ID NO: 882110 - protein, 24 aa, Mycobacterium
DLWYDGLGFWLHRYYRLRYGWWEH

SEQ ID NO: 882111 - protein, 25 aa, Mycobacterium
DMADPTYLRLLPLHQLEGAFGLDDE

SEQ ID NO: 882112 - protein, 17 aa, Mycobacterium
DMALLDLFWTSVGGFGH

SEQ ID NO: 882113 - protein, 27 aa, Mycobacterium
DMAPICQLFHTLPIPWVEPIDISNAVL

SEQ ID NO: 882114 - protein, 23 aa, Mycobacterium
DMDDILWQVPYLPIDPKDVGRTY

SEQ ID NO: 882115 - protein, 18 aa, Mycobacterium
DMDTLLMLLAAAGVAFVI

SEQ ID NO: 882116 - protein, 23 aa, Mycobacterium
DMFQRRVYFLADLPFVEVYLARE

SEQ ID NO: 882117 - protein, 22 aa, Mycobacterium
DMFTRLLLSLLITGVAPRSFYI

SEQ ID NO: 882118 - protein, 24 aa, Mycobacterium
DMGAWPVPNLLALAQQRGISLLTL

SEQ ID NO: 882119 - protein, 23 aa, Mycobacterium
DMGRKFLTKLGILSPAAAAADPG

SEQ ID NO: 882120 - protein, 17 aa, Mycobacterium
DMKLPIALALGWPDRVP

SEQ ID NO: 882121 - protein, 21 aa, Mycobacterium
DMLAAVFWGLGFHARMLTADI

SEQ ID NO: 882122 - protein, 18 aa, Mycobacterium
DMLLLIVAALDQPVLESL

SEQ ID NO: 882123 - protein, 18 aa, Mycobacterium
DMLLLIVAALDQSALVSM

SEQ ID NO: 882124 - protein, 19 aa, Mycobacterium
DMLLLLREVLEVAPAYLSA

SEQ ID NO: 882125 - protein, 18 aa, Mycobacterium
DMPYLGMQVLIEGLALAA

SEQ ID NO: 882126 - protein, 23 aa, Mycobacterium
DMTMRWFPVAEAVRRVFTGEIVN

SEQ ID NO: 882127 - protein, 27 aa, Mycobacterium
DMVTRRYWWHAWWWIPQAIVRGGVDKV

SEQ ID NO: 882128 - protein, 20 aa, Mycobacterium
DNAGRLIGFTSAHCGGPGAT

SEQ ID NO: 882129 - protein, 21 aa, Mycobacterium
DNALLLRAYAHWARRTGDELA

SEQ ID NO: 882130 - protein, 21 aa, Mycobacterium
DNALLLRAYAHWARRTGDPLA

SEQ ID NO: 882131 - protein, 17 aa, Mycobacterium
DNARLHWPPRPEPPRTD

SEQ ID NO: 882132 - protein, 24 aa, Mycobacterium
DNASLAHLLKFDSILGRLPHDVSL

SEQ ID NO: 882133 - protein, 24 aa, Mycobacterium
DNATLAHLLKFDSILGRLPQDVSL

SEQ ID NO: 882134 - protein, 27 aa, Mycobacterium
DNATLAHLLKFDSILGRLPYDVSLEGD

SEQ ID NO: 882135 - protein, 25 aa, Mycobacterium
DNDPVWFWMYVIAALQKISPGVGTR

SEQ ID NO: 882136 - protein, 23 aa, Mycobacterium
DNGLIPLRWALACLLADIGSTAH

SEQ ID NO: 882137 - protein, 22 aa, Mycobacterium
DNLFLRDLVMALRWVRDNVAAF

SEQ ID NO: 882138 - protein, 17 aa, Mycobacterium
DNLKFLIGKGIHAVVGT

SEQ ID NO: 882139 - protein, 17 aa, Mycobacterium
DNPGTWLMHCHNTYHQV

SEQ ID NO: 882140 - protein, 26 aa, Mycobacterium
DNQSGFLHAILPTVALPALPHLSVPA

SEQ ID NO: 882141 - protein, 17 aa, Mycobacterium
DNSFLEILYGYEWELTK

SEQ ID NO: 882142 - protein, 17 aa, Mycobacterium
DNSGLVILLTFGTGIGS

SEQ ID NO: 882143 - protein, 23 aa, Mycobacterium
DNVSAWRFITPPSAFIGAVIVDR

SEQ ID NO: 882144 - protein, 27 aa, Mycobacterium
DPAALQYWHVLGLWKLAIIAEGVMRRA

SEQ ID NO: 882145 - protein, 17 aa, Mycobacterium
DPAGAFFGLWQPLGHRG

SEQ ID NO: 882146 - protein, 20 aa, Mycobacterium
DPALTFAPLTWKMVLVSLGS

SEQ ID NO: 882147 - protein, 25 aa, Mycobacterium
DPALTWLQLRDWLRTRLPEHLVPPT

SEQ ID NO: 882148 - protein, 24 aa, Mycobacterium
DPANQVEFFFLRPKDIAIYVGSGE

SEQ ID NO: 882149 - protein, 33 aa, Mycobacterium
DPAPAAPSLRPISGLLSVVTLGTTLIPNAPTEP

SEQ ID NO: 882150 - protein, 20 aa, Mycobacterium
DPAPLVALYLRRPDAKPLAA

SEQ ID NO: 882151 - protein, 17 aa, Mycobacterium
DPAWLLDTLGLTDAART

SEQ ID NO: 882152 - protein, 19 aa, Mycobacterium
DPCGLLLMLKDIGAPTYIS

SEQ ID NO: 882153 - protein, 20 aa, Mycobacterium
DPDFALARWGVAYAIGPNYN

SEQ ID NO: 882154 - protein, 25 aa, Mycobacterium
DPDGEPFWFPNWTRLVYAGNGLFSS

SEQ ID NO: 882155 - protein, 17 aa, Mycobacterium
DPDILFLSEAFTRPARL

SEQ ID NO: 882156 - protein, 19 aa, Mycobacterium
DPDLLLLFSALELLHAWAL

SEQ ID NO: 882157 - protein, 22 aa, Mycobacterium
DPEIRAPWSLSKPKRRSSPSSR

SEQ ID NO: 882158 - protein, 19 aa, Mycobacterium
DPEWLRWNYATVVWGLATA

SEQ ID NO: 882159 - protein, 22 aa, Mycobacterium
DPFARLHQLWELLLPGVVAEAS

SEQ ID NO: 882160 - protein, 23 aa, Mycobacterium
DPFGLLPPLVRWIGKAMAAVPIL

SEQ ID NO: 882161 - protein, 23 aa, Mycobacterium
DPFHHMVVIYALFPNVVLSVTIA

SEQ ID NO: 882162 - protein, 23 aa, Mycobacterium
DPGDPWAWHEVAALPRHAMRRRR

SEQ ID NO: 882163 - protein, 21 aa, Mycobacterium
DPGEALFDYLRLMVLQCGAAD

SEQ ID NO: 882164 - protein, 23 aa, Mycobacterium
DPGEIQLLPVTKFFPASDVEELY

SEQ ID NO: 882165 - protein, 19 aa, Mycobacterium
DPGIVTARLWRLISAALGV

SEQ ID NO: 882166 - protein, 24 aa, Mycobacterium
DPGNNVEFFFLRPKDIAIYVGSGQ

SEQ ID NO: 882167 - protein, 20 aa, Mycobacterium
DPGPLRRLIATLPALEVPRP

SEQ ID NO: 882168 - protein, 18 aa, Mycobacterium
DPGPLRRLIATLPALEVT

SEQ ID NO: 882169 - protein, 23 aa, Mycobacterium
DPGWANLLDLLAALRLNAEPVRV

SEQ ID NO: 882170 - protein, 18 aa, Mycobacterium
DPHYTYKLEWLAALRDTA

SEQ ID NO: 882171 - protein, 20 aa, Mycobacterium
DPICPFAWVTSRWLLEAAQS

SEQ ID NO: 882172 - protein, 23 aa, Mycobacterium
DPKAWLITTAWRRFIDVARAEAA

SEQ ID NO: 882173 - protein, 22 aa, Mycobacterium
DPKLYLDFYSGLFASSFQPAED

SEQ ID NO: 882174 - protein, 26 aa, Mycobacterium
DPLHPKPVYLFAYDPTAFGGKGRAAI

SEQ ID NO: 882175 - protein, 24 aa, Mycobacterium
DPLSMYLFDLCTLPLNLAGHCGMS

SEQ ID NO: 882176 - protein, 24 aa, Mycobacterium
DPNGEPFWFPNWTRLVYAGDGLFC

SEQ ID NO: 882177 - protein, 19 aa, Mycobacterium
DPNLKFVPLPWPDYYGKAP

SEQ ID NO: 882178 - protein, 27 aa, Mycobacterium
DPPFEGMWWLYVPLAFDDFATVLIIQE

SEQ ID NO: 882179 - protein, 27 aa, Mycobacterium
DPPPLPEPLPDGLLRRAPLGRIAGARS

SEQ ID NO: 882180 - protein, 24 aa, Mycobacterium
DPQGEPFWFPNWTRLVYAGDGLFS

SEQ ID NO: 882181 - protein, 17 aa, Mycobacterium
DPQHRILLETAWRAVEH

SEQ ID NO: 882182 - protein, 17 aa, Mycobacterium
DPQHRLLLETAWRAVEH

SEQ ID NO: 882183 - protein, 17 aa, Mycobacterium
DPQWLLDTLGLTDAART

SEQ ID NO: 882184 - protein, 25 aa, Mycobacterium
DPRLKRPIPFLPDTIGLITGRASAA

SEQ ID NO: 882185 - protein, 23 aa, Mycobacterium
DPRLKRPIPFLPNMIGLITGRAS

SEQ ID NO: 882186 - protein, 24 aa, Mycobacterium
DPRLKRPIPFLPNMIGLITGRASA

SEQ ID NO: 882187 - protein, 23 aa, Mycobacterium
DPRLKRPIPFLPNMVGLITGRAS

SEQ ID NO: 882188 - protein, 24 aa, Mycobacterium
DPRLKRPIPFLPNTVGLITGRASA

SEQ ID NO: 882189 - protein, 21 aa, Mycobacterium
DPRLPALLRWRQQLISSGAVS

SEQ ID NO: 882190 - protein, 21 aa, Mycobacterium
DPRLWYYRFQTAAVGWNPGIN

SEQ ID NO: 882191 - protein, 21 aa, Mycobacterium
DPRTRWLLRELVHALLVKKDH

SEQ ID NO: 882192 - protein, 24 aa, Mycobacterium
DPRYTLWAAWHRSGLQSRWLTASE

SEQ ID NO: 882193 - protein, 24 aa, Mycobacterium
DPSADLILIYLIQNFPDLGVDAAA

SEQ ID NO: 882194 - protein, 21 aa, Mycobacterium
DPSGSGWRWLASALWGEILLS

SEQ ID NO: 882195 - protein, 21 aa, Mycobacterium
DPSWVSLMFLASGLVVDIGGM

SEQ ID NO: 882196 - protein, 24 aa, Mycobacterium
DPTKIAMLGLTFDDVLLLPAASDV

SEQ ID NO: 882197 - protein, 24 aa, Mycobacterium
DPTKVAMLGLTFDDVLLLPAASDV

SEQ ID NO: 882198 - protein, 20 aa, Mycobacterium
DPVCPFAWAASRWLLDAAHK

SEQ ID NO: 882199 - protein, 24 aa, Mycobacterium
DPVNQVEFFFLRPKDIAIYVGSGQ

SEQ ID NO: 882200 - protein, 18 aa, Mycobacterium
DQAWWFPAIAPLPGKAPA

SEQ ID NO: 882201 - protein, 17 aa, Mycobacterium
DQDFRTFDFLGIRNWTA

SEQ ID NO: 882202 - protein, 21 aa, Mycobacterium
DQDLFLRIAPLALGTPVGPEY

SEQ ID NO: 882203 - protein, 23 aa, Mycobacterium
DQELAFLHPLPVRRLWGVGAVTA

SEQ ID NO: 882204 - protein, 20 aa, Mycobacterium
DQFLVLRPLLLDYVLSMPRG

SEQ ID NO: 882205 - protein, 21 aa, Mycobacterium
DQFMTLAKMRAARRLWARVAE

SEQ ID NO: 882206 - protein, 21 aa, Mycobacterium
DQFTRLILSLIATGIAPGSFY

SEQ ID NO: 882207 - protein, 28 aa, Mycobacterium
DQIDVLLMAPMLITRAFLKPMREQGGGR

SEQ ID NO: 882208 - protein, 17 aa, Mycobacterium
DQLALAPLVCLLYAASP

SEQ ID NO: 882209 - protein, 20 aa, Mycobacterium
DQLIGFFINILVLRNDLRDN

SEQ ID NO: 882210 - protein, 17 aa, Mycobacterium
DQLIGFFVNILVLRNDM

SEQ ID NO: 882211 - protein, 22 aa, Mycobacterium
DQNLWRLVVPLLSDRFRIVLFD

SEQ ID NO: 882212 - protein, 25 aa, Mycobacterium
DQRRDWLELFPFLLTRRPESYGALT

SEQ ID NO: 882213 - protein, 17 aa, Mycobacterium
DQSQLYGLLDRVRDLGL

SEQ ID NO: 882214 - protein, 24 aa, Mycobacterium
DQTNFKLVLLTHNFDFFRTLRSRG

SEQ ID NO: 882215 - protein, 22 aa, Mycobacterium
DQVLAKCFLLWAGVLGAISLEV

SEQ ID NO: 882216 - protein, 25 aa, Mycobacterium
DQVMDYIRPLWPYVDPLRAGEFHFT

SEQ ID NO: 882217 - protein, 18 aa, Mycobacterium
DQVWGWSAGLPSGRRTVD

SEQ ID NO: 882218 - protein, 17 aa, Mycobacterium
DQYLTLHGLRLVFERNR

SEQ ID NO: 882219 - protein, 24 aa, Mycobacterium
DRACSWLPIYHDMGLAFLLTAVLS

SEQ ID NO: 882220 - protein, 20 aa, Mycobacterium
DRAMIAACPLTFPWNVLGWP

SEQ ID NO: 882221 - protein, 23 aa, Mycobacterium
DRAVALLAAARRPLVVLGKGAAY

SEQ ID NO: 882222 - protein, 17 aa, Mycobacterium
DRAVLRSNWRRAAEWRP

SEQ ID NO: 882223 - protein, 23 aa, Mycobacterium
DRDKYFPVEIFPKAAALGMGGIY

SEQ ID NO: 882224 - protein, 24 aa, Mycobacterium
DRDLPLLTLPPDVPFRRIVDWAEA

SEQ ID NO: 882225 - protein, 24 aa, Mycobacterium
DRDQIRLWLDLLLERRPGEIATTA

SEQ ID NO: 882226 - protein, 22 aa, Mycobacterium
DRFAGLPHPTILAAAALLGVDE

SEQ ID NO: 882227 - protein, 25 aa, Mycobacterium
DRFANLLLRWLPRTVALPVIRAKNI

SEQ ID NO: 882228 - protein, 19 aa, Mycobacterium
DRFGVVLFFRGAWCPYCVA

SEQ ID NO: 882229 - protein, 26 aa, Mycobacterium
DRGLHVLVFGPFRALRLATALRSAAG

SEQ ID NO: 882230 - protein, 23 aa, Mycobacterium
DRGLHVLVFGPLRALRLATALGC

SEQ ID NO: 882231 - protein, 18 aa, Mycobacterium
DRGLTPQLLLNTYNLRGL

SEQ ID NO: 882232 - protein, 23 aa, Mycobacterium
DRGPGRFFTMRLALSDIGISDIT

SEQ ID NO: 882233 - protein, 27 aa, Mycobacterium
DRGVSWLPFFHDMGLITVLLSPMLGHH

SEQ ID NO: 882234 - protein, 20 aa, Mycobacterium
DRGWAWQVPLLELPQAQFLL

SEQ ID NO: 882235 - protein, 25 aa, Mycobacterium
DRHSGWWRAPLRWMLRASLALRSRL

SEQ ID NO: 882236 - protein, 21 aa, Mycobacterium
DRHWLVPVTAFWQAHRDAAGT

SEQ ID NO: 882237 - protein, 24 aa, Mycobacterium
DRIDPVLLDLLRLGTYQLLRTRVE

SEQ ID NO: 882238 - protein, 24 aa, Mycobacterium
DRIHQGWILTALWVIDTGITAATL

SEQ ID NO: 882239 - protein, 24 aa, Mycobacterium
DRIYSPMPFFWVGGLTMVVLQALS

SEQ ID NO: 882240 - protein, 17 aa, Mycobacterium
DRLALGPLMSGMFGDFA

SEQ ID NO: 882241 - protein, 19 aa, Mycobacterium
DRLIRSGQPWSWDIGFMLG

SEQ ID NO: 882242 - protein, 18 aa, Mycobacterium
DRLLFLPADLSTLGFTAW

SEQ ID NO: 882243 - protein, 21 aa, Mycobacterium
DRLLLFLAAELARKHRSAGLA

SEQ ID NO: 882244 - protein, 19 aa, Mycobacterium
DRLMLPVFKKIIDELLKGG

SEQ ID NO: 882245 - protein, 22 aa, Mycobacterium
DRLPLRCVLGAPLLFGAGRGVT

SEQ ID NO: 882246 - protein, 22 aa, Mycobacterium
DRLPRPYMLIAMDLQGGMSEPD

SEQ ID NO: 882247 - protein, 24 aa, Mycobacterium
DRLVMLGLPFLFFIHADYGCAGVL

SEQ ID NO: 882248 - protein, 17 aa, Mycobacterium
DRMLTHYLRLLDNALRA

SEQ ID NO: 882249 - protein, 25 aa, Mycobacterium
DRMWEFLDRLISIALPRIRDFRGLS

SEQ ID NO: 882250 - protein, 19 aa, Mycobacterium
DRMWSPDIAVWRVGARRDN

SEQ ID NO: 882251 - protein, 18 aa, Mycobacterium
DRNLVPLDALPAGKYLRM

SEQ ID NO: 882252 - protein, 23 aa, Mycobacterium
DRNQLIPGLLRGLAARIAQWHDA

SEQ ID NO: 882253 - protein, 24 aa, Mycobacterium
DRPGFLLNALLLPYLNDVISEYDD

SEQ ID NO: 882254 - protein, 23 aa, Mycobacterium
DRPNLLIKIPATKAGLPAITAVI

SEQ ID NO: 882255 - protein, 20 aa, Mycobacterium
DRPQRRLLMLTVAGLGHGPD

SEQ ID NO: 882256 - protein, 28 aa, Mycobacterium
DRPRGALLQLYLHAIAAGILRSLRTDAV

SEQ ID NO: 882257 - protein, 24 aa, Mycobacterium
DRRGKYLWLLLDSDAALVVHLGMS

SEQ ID NO: 882258 - protein, 23 aa, Mycobacterium
DRRHYSFWPVPVSDVALMAARAA

SEQ ID NO: 882259 - protein, 19 aa, Mycobacterium
DRTGLLVGLLLSSVGVDYA

SEQ ID NO: 882260 - protein, 23 aa, Mycobacterium
DRVGTPWRLTWYRGMAALLNGDY

SEQ ID NO: 882261 - protein, 22 aa, Mycobacterium
DRVTLFRAWYSRRNFGQLAGTA

SEQ ID NO: 882262 - protein, 21 aa, Mycobacterium
DRWQIRWRLGWSFACLEHNVL

SEQ ID NO: 882263 - protein, 24 aa, Mycobacterium
DRYHEYLLAVPWADAVLNPINIRW

SEQ ID NO: 882264 - protein, 23 aa, Mycobacterium
DRYHEYLLAVPWANGVLNPVNIR

SEQ ID NO: 882265 - protein, 24 aa, Mycobacterium
DSAELPLFRYLGGPNAHILPVPMM

SEQ ID NO: 882266 - protein, 23 aa, Mycobacterium
DSAGLALFRYLGGPNAHILPVPM

SEQ ID NO: 882267 - protein, 30 aa, Mycobacterium
DSAPPGWGWVAPYIGMIWPNGDSGKLRAAA

SEQ ID NO: 882268 - protein, 26 aa, Mycobacterium
DSDAHPLYYLEMPPALFAPIVENLAK

SEQ ID NO: 882269 - protein, 28 aa, Mycobacterium
DSDYVDLFLIHWPLPTLYDGDFVSTWKV

SEQ ID NO: 882270 - protein, 30 aa, Mycobacterium
DSFEFFPNFTLLFWVPGWYLTYNYWPTGVD

SEQ ID NO: 882271 - protein, 31 aa, Mycobacterium
DSFEFFPNFTLLLWVPGWYLTYNYWPTDVDK

SEQ ID NO: 882272 - protein, 20 aa, Mycobacterium
DSFEWLVGSDRWRQAAIDRG

SEQ ID NO: 882273 - protein, 28 aa, Mycobacterium
DSFLFFPNFMLLIWEPGWYLTYHYWPTT

SEQ ID NO: 882274 - protein, 22 aa, Mycobacterium
DSFQFFPNFVLIFGSSGFSTHT

SEQ ID NO: 882275 - protein, 27 aa, Mycobacterium
DSFQLFPNFVILFWGQGWYLTYHYWPT

SEQ ID NO: 882276 - protein, 21 aa, Mycobacterium
DSFSGWFLTVLGAARVAFAQF

SEQ ID NO: 882277 - protein, 18 aa, Mycobacterium
DSIGWLRDFLRSHTGGLV

SEQ ID NO: 882278 - protein, 17 aa, Mycobacterium
DSLLPKFTGFSPVLWAL

SEQ ID NO: 882279 - protein, 28 aa, Mycobacterium
DSLRRLALGHWLRRWWPASLREGVGPLD

SEQ ID NO: 882280 - protein, 24 aa, Mycobacterium
DSNLFLRDLVMALRWVKDNISAFG

SEQ ID NO: 882281 - protein, 22 aa, Mycobacterium
DSPEKEFLAPRVRALWGGKPGR

SEQ ID NO: 882282 - protein, 22 aa, Mycobacterium
DSPIPAYLSRLLIAGGRAGSAL

SEQ ID NO: 882283 - protein, 17 aa, Mycobacterium
DSPLRALILRLADDRVV

SEQ ID NO: 882284 - protein, 23 aa, Mycobacterium
DSPMMFLPGVIVAMWGGQVRSLA

SEQ ID NO: 882285 - protein, 22 aa, Mycobacterium
DSPMMFLPGVIVSMWGGQVRSL

SEQ ID NO: 882286 - protein, 26 aa, Mycobacterium
DSQLVDLLMLPFFTHTVTVPALRHRI

SEQ ID NO: 882287 - protein, 27 aa, Mycobacterium
DSRAAIADWLYWKHLSGLLHAALNPKL

SEQ ID NO: 882288 - protein, 20 aa, Mycobacterium
DSRAYRLPWPAGTTVYEIDQ

SEQ ID NO: 882289 - protein, 20 aa, Mycobacterium
DSRAYRLPWPDGTTVFELDR

SEQ ID NO: 882290 - protein, 24 aa, Mycobacterium
DSRLGLFPFRRNLSLFAVDLALLT

SEQ ID NO: 882291 - protein, 23 aa, Mycobacterium
DSRTYTFIAYLGDYYAFTTLTND

SEQ ID NO: 882292 - protein, 23 aa, Mycobacterium
DSVVLPFLLPDTPVVAWWPASAP

SEQ ID NO: 882293 - protein, 25 aa, Mycobacterium
DSWIQIEQFRLLVLRTAWLIDKHHD

SEQ ID NO: 882294 - protein, 24 aa, Mycobacterium
DSYTELIPFRLTVLHAAWLIDQGD

SEQ ID NO: 882295 - protein, 25 aa, Mycobacterium
DSYTELMPFRLAVLHAAWLIDTAGE

SEQ ID NO: 882296 - protein, 25 aa, Mycobacterium
DSYTELMPFRLAVLHAAWMIDTAGE

SEQ ID NO: 882297 - protein, 18 aa, Mycobacterium
DTAFWRQHAFIDNFLGGV

SEQ ID NO: 882298 - protein, 23 aa, Mycobacterium
DTAHPYVLGIPQPVTDRILVEHA

SEQ ID NO: 882299 - protein, 22 aa, Mycobacterium
DTFHAQFVQLLNSGASAYTGAE

SEQ ID NO: 882300 - protein, 17 aa, Mycobacterium
DTFLLAYKTPGAKGFNL

SEQ ID NO: 882301 - protein, 22 aa, Mycobacterium
DTFWVNMIALLMGTAHRIDTVR

SEQ ID NO: 882302 - protein, 26 aa, Mycobacterium
DTGAMYRIVTLWVLRAGVDLTDPAAI

SEQ ID NO: 882303 - protein, 23 aa, Mycobacterium
DTGRWRVPLILRLDPKVGSEDVR

SEQ ID NO: 882304 - protein, 18 aa, Mycobacterium
DTGRWRVPLILRLDPQVG

SEQ ID NO: 882305 - protein, 24 aa, Mycobacterium
DTHAMEWYYPVLGGALRGDAALAR

SEQ ID NO: 882306 - protein, 24 aa, Mycobacterium
DTIDPVLLDLLRLGTYQLLRTRVD

SEQ ID NO: 882307 - protein, 19 aa, Mycobacterium
DTIGTPFLLLAGMEPDLKW

SEQ ID NO: 882308 - protein, 25 aa, Mycobacterium
DTIPNWFFRPLWHRRDRLRPSVPVD

SEQ ID NO: 882309 - protein, 18 aa, Mycobacterium
DTIVLRRSRPLEISTDGG

SEQ ID NO: 882310 - protein, 23 aa, Mycobacterium
DTKMGLFPFRRNLSFYGVDLGMM

SEQ ID NO: 882311 - protein, 17 aa, Mycobacterium
DTLDYLARLIAEGVLHA

SEQ ID NO: 882312 - protein, 17 aa, Mycobacterium
DTLFLYESYPIDTSAFM

SEQ ID NO: 882313 - protein, 22 aa, Mycobacterium
DTMAWFYDPPWTLPFRRRNEVV

SEQ ID NO: 882314 - protein, 26 aa, Mycobacterium
DTNLRRLISLFELLRARSQLIIITHQ

SEQ ID NO: 882315 - protein, 22 aa, Mycobacterium
DTNRGWLPHRLPRPARARCDDP

SEQ ID NO: 882316 - protein, 24 aa, Mycobacterium
DTPDLRFYWEKIEGLRFRRKLRMR

SEQ ID NO: 882317 - protein, 27 aa, Mycobacterium
DTPGFDVPYYWWTFNMPTDHGEVELTD

SEQ ID NO: 882318 - protein, 27 aa, Mycobacterium
DTPGFTVPYYWWTLNMPTDHGEVALED

SEQ ID NO: 882319 - protein, 21 aa, Mycobacterium
DTPYPPARLERLWLPGPDRLL

SEQ ID NO: 882320 - protein, 20 aa, Mycobacterium
DTRAYFRGECLRRFGADIAA

SEQ ID NO: 882321 - protein, 17 aa, Mycobacterium
DTRRRIVMFEQFRAEWL

SEQ ID NO: 882322 - protein, 19 aa, Mycobacterium
DTSLGWRFTNPRFAQMDAG

SEQ ID NO: 882323 - protein, 18 aa, Mycobacterium
DTTFGVVLVLRQLFEELL

SEQ ID NO: 882324 - protein, 24 aa, Mycobacterium
DTTHPLFFNIPTPGPAPADTEESA

SEQ ID NO: 882325 - protein, 23 aa, Mycobacterium
DTTLFRLPIRLALGPTHVAVVVG

SEQ ID NO: 882326 - protein, 23 aa, Mycobacterium
DTTLQRIIGFWYQALRQRALRGD

SEQ ID NO: 882327 - protein, 19 aa, Mycobacterium
DTVGTPFLLLAGMEPDLKW

SEQ ID NO: 882328 - protein, 18 aa, Mycobacterium
DTWNNLALKWFRGINSVL

SEQ ID NO: 882329 - protein, 19 aa, Mycobacterium
DTYDFIEKYPWPEPENLGD

SEQ ID NO: 882330 - protein, 19 aa, Mycobacterium
DTYFPLLRDGTVGLVPEYV

SEQ ID NO: 882331 - protein, 21 aa, Mycobacterium
DTYVPEWMWHSPAAVKRVFLQ

SEQ ID NO: 882332 - protein, 24 aa, Mycobacterium
DVAAAKWWRKPLVRRWYGFAEMQK

SEQ ID NO: 882333 - protein, 21 aa, Mycobacterium
DVAAGLPWPARYPSRVLANDF

SEQ ID NO: 882334 - protein, 22 aa, Mycobacterium
DVADALWYPLWDANIRLDHSVR

SEQ ID NO: 882335 - protein, 27 aa, Mycobacterium
DVAEIYVPFSWFEPMWLENLGFAAEGE

SEQ ID NO: 882336 - protein, 25 aa, Mycobacterium
DVAGPYAWWSWRGKAFDNDAGWRID

SEQ ID NO: 882337 - protein, 20 aa, Mycobacterium
DVAIPFWMRAPGECPGTYAA

SEQ ID NO: 882338 - protein, 20 aa, Mycobacterium
DVAKGLPWPARFPSRVLANE

SEQ ID NO: 882339 - protein, 22 aa, Mycobacterium
DVALLLYRHPAPLELTFPAHAD

SEQ ID NO: 882340 - protein, 22 aa, Mycobacterium
DVANLAMFLLSDAAGFITGQVI

SEQ ID NO: 882341 - protein, 21 aa, Mycobacterium
DVAQARPWPARFPSRVLTNDF

SEQ ID NO: 882342 - protein, 20 aa, Mycobacterium
DVARWLVVYLKRAGGQSQFS

SEQ ID NO: 882343 - protein, 17 aa, Mycobacterium
DVCLWLLRNGVTPEKLT

SEQ ID NO: 882344 - protein, 18 aa, Mycobacterium
DVDAGLFCLRPLPSLKPL

SEQ ID NO: 882345 - protein, 23 aa, Mycobacterium
DVDAWILARCSVPLRLATIAEFI

SEQ ID NO: 882346 - protein, 22 aa, Mycobacterium
DVDDLLWQVPYLPIDPKDVGRT

SEQ ID NO: 882347 - protein, 17 aa, Mycobacterium
DVDLYPRLVCNAAYAVL

SEQ ID NO: 882348 - protein, 28 aa, Mycobacterium
DVDMVFSPFFNALPIRRLGVLPGSGESV

SEQ ID NO: 882349 - protein, 24 aa, Mycobacterium
DVDPSIMWYLWRTANMGVDEIESM

SEQ ID NO: 882350 - protein, 17 aa, Mycobacterium
DVDTDLRWRIVIALATA

SEQ ID NO: 882351 - protein, 25 aa, Mycobacterium
DVDVIFSPFFNALPIRRVGLHTRTD

SEQ ID NO: 882352 - protein, 25 aa, Mycobacterium
DVDVVFSPFFNALPIRRLGLHERAD

SEQ ID NO: 882353 - protein, 26 aa, Mycobacterium
DVDVVFSPFFNALPIRRTGLYQQEGS

SEQ ID NO: 882354 - protein, 24 aa, Mycobacterium
DVEQTFLRRLLTGELRQGALVGVM

SEQ ID NO: 882355 - protein, 22 aa, Mycobacterium
DVESYIYLPLLEELGYVPTEKY

SEQ ID NO: 882356 - protein, 24 aa, Mycobacterium
DVFAEEFLLSRPLLTAIRREDPTV

SEQ ID NO: 882357 - protein, 23 aa, Mycobacterium
DVFAGVLAAWWPQGAETALRRAN

SEQ ID NO: 882358 - protein, 20 aa, Mycobacterium
DVFIGYLRRKLEANGGPRLL

SEQ ID NO: 882359 - protein, 24 aa, Mycobacterium
DVFSEEFLLTRPLLTAIKRTDPTV

SEQ ID NO: 882360 - protein, 18 aa, Mycobacterium
DVFYASRHPELFSSASGI

SEQ ID NO: 882361 - protein, 18 aa, Mycobacterium
DVGFWRLTVPREYGGLGF

SEQ ID NO: 882362 - protein, 24 aa, Mycobacterium
DVGFYGPTGIFIKVGYRGNLVVSG

SEQ ID NO: 882363 - protein, 22 aa, Mycobacterium
DVGLPWFMRGPGAVTGAFALEC

SEQ ID NO: 882364 - protein, 23 aa, Mycobacterium
DVGRWRIPVILGLRSDVGEDDVR

SEQ ID NO: 882365 - protein, 23 aa, Mycobacterium
DVHLYGTIWVTQPAFLRMREQGY

SEQ ID NO: 882366 - protein, 23 aa, Mycobacterium
DVKKALYRVLRQKSMREKIRIEN

SEQ ID NO: 882367 - protein, 24 aa, Mycobacterium
DVKLNLFLFTMLQKTLKGNIFGGG

SEQ ID NO: 882368 - protein, 21 aa, Mycobacterium
DVLIDLIRRYAPKVSLIVTSH

SEQ ID NO: 882369 - protein, 17 aa, Mycobacterium
DVLLFIDNIFRFTQAGS

SEQ ID NO: 882370 - protein, 17 aa, Mycobacterium
DVLPGYLMFRFIVPSRP

SEQ ID NO: 882371 - protein, 19 aa, Mycobacterium
DVLTLFSYPLHPPGKPDRL

SEQ ID NO: 882372 - protein, 18 aa, Mycobacterium
DVLWFRLNWRPGDPQELY

SEQ ID NO: 882373 - protein, 19 aa, Mycobacterium
DVMAALRQPGIGVIAEVKR

SEQ ID NO: 882374 - protein, 18 aa, Mycobacterium
DVMDLAQWLIAENGYYTN

SEQ ID NO: 882375 - protein, 23 aa, Mycobacterium
DVNRPTWVISLTDLLMVAEILSD

SEQ ID NO: 882376 - protein, 24 aa, Mycobacterium
DVPGPYSWWSWRGKAFDNDAGWRI

SEQ ID NO: 882377 - protein, 19 aa, Mycobacterium
DVPGWWHTIQAYVQGEMWP

SEQ ID NO: 882378 - protein, 20 aa, Mycobacterium
DVPLALMIAYLPPGLGKAVE

SEQ ID NO: 882379 - protein, 25 aa, Mycobacterium
DVPPYRPFWAITRYADIMAIERAND

SEQ ID NO: 882380 - protein, 18 aa, Mycobacterium
DVPSNVVVPYFWSDQYDV

SEQ ID NO: 882381 - protein, 23 aa, Mycobacterium
DVPTAVVVPYFWSDQYDVKIQCL

SEQ ID NO: 882382 - protein, 25 aa, Mycobacterium
DVQIDSFEWLIGAPRWREAAAARGD

SEQ ID NO: 882383 - protein, 25 aa, Mycobacterium
DVQIDSFEWLIGSPRWREAAAARGD

SEQ ID NO: 882384 - protein, 17 aa, Mycobacterium
DVRLLLPKPADWSYAEA

SEQ ID NO: 882385 - protein, 21 aa, Mycobacterium
DVSSWRILFEDLNIAWAQHHH

SEQ ID NO: 882386 - protein, 22 aa, Mycobacterium
DVSWDGVWWWTRSDGFLQLAPA

SEQ ID NO: 882387 - protein, 21 aa, Mycobacterium
DVTEAVLWLAGPRSRYVTGVS

SEQ ID NO: 882388 - protein, 17 aa, Mycobacterium
DVTIVEFLPRALPNEDA

SEQ ID NO: 882389 - protein, 27 aa, Mycobacterium
DVTPTLPLTLFTLFQKRLLGSLYGEAN

SEQ ID NO: 882390 - protein, 24 aa, Mycobacterium
DVTRAITLWYTHYYRMGRMIELIQ

SEQ ID NO: 882391 - protein, 22 aa, Mycobacterium
DVVLLLYRHPAPLELNFPADVS

SEQ ID NO: 882392 - protein, 26 aa, Mycobacterium
DVVNAPAQALLGRPLIGNGDDGVAGT

SEQ ID NO: 882393 - protein, 20 aa, Mycobacterium
DVVPYLRWFTFLTAEELAEL

SEQ ID NO: 882394 - protein, 19 aa, Mycobacterium
DVVRYLRWFTFLSAEEIGE

SEQ ID NO: 882395 - protein, 21 aa, Mycobacterium
DVVVDLIYGDPFLAALDATTV

SEQ ID NO: 882396 - protein, 21 aa, Mycobacterium
DVYLRWAVAAFRLATSGVADS

SEQ ID NO: 882397 - protein, 21 aa, Mycobacterium
DVYRWPLIPALAMVAAMPALG

SEQ ID NO: 882398 - protein, 18 aa, Mycobacterium
DWDRTLLFRRLKELHLEF

SEQ ID NO: 882399 - protein, 18 aa, Mycobacterium
DWFTVDWHRAIVDKWRAA

SEQ ID NO: 882400 - protein, 24 aa, Mycobacterium
DWKCWARWRLIRARAPWLTSDLVA

SEQ ID NO: 882401 - protein, 23 aa, Mycobacterium
DWKCWARWRLIRSRAPWLTRDLV

SEQ ID NO: 882402 - protein, 18 aa, Mycobacterium
DWLDIGWVALLNQWMTEA

SEQ ID NO: 882403 - protein, 19 aa, Mycobacterium
DWLDPLIALSFAAAATNRI

SEQ ID NO: 882404 - protein, 18 aa, Mycobacterium
DWLDPMIALSFAAAATST

SEQ ID NO: 882405 - protein, 19 aa, Mycobacterium
DWLELPDPPASWGWGKTAH

SEQ ID NO: 882406 - protein, 18 aa, Mycobacterium
DWMELTGYWWPKHAGRYA

SEQ ID NO: 882407 - protein, 23 aa, Mycobacterium
DWPEGWRFDDLLPYFMRSEASRG

SEQ ID NO: 882408 - protein, 19 aa, Mycobacterium
DWQRLLFDNGWLLPGQPPE

SEQ ID NO: 882409 - protein, 17 aa, Mycobacterium
DWRQWWEWTPGADWRHP

SEQ ID NO: 882410 - protein, 19 aa, Mycobacterium
DWSRPMWMSYLIDGLDGGR

SEQ ID NO: 882411 - protein, 25 aa, Mycobacterium
DWVQHAIWWQVYPLGFVGAFPVPQS

SEQ ID NO: 882412 - protein, 24 aa, Mycobacterium
DYAELYGWNTYYPEALLKQNSFSS

SEQ ID NO: 882413 - protein, 19 aa, Mycobacterium
DYAGFIWFPQLPALDRWRD

SEQ ID NO: 882414 - protein, 23 aa, Mycobacterium
DYETLLRSYRRLLQFLRSRDADG

SEQ ID NO: 882415 - protein, 18 aa, Mycobacterium
DYFKFRYYEKWLGGISQF

SEQ ID NO: 882416 - protein, 22 aa, Mycobacterium
DYFKREAIRLAWTLLTNPVSEG

SEQ ID NO: 882417 - protein, 21 aa, Mycobacterium
DYFSFYLCDLLLKVNGKGGQP

SEQ ID NO: 882418 - protein, 23 aa, Mycobacterium
DYGGELWILDLSPQLAPVGPPRR

SEQ ID NO: 882419 - protein, 19 aa, Mycobacterium
DYGRMRETWLIHLCTDWMG

SEQ ID NO: 882420 - protein, 21 aa, Mycobacterium
DYIRLFLAVRGPLGFTTGFND

SEQ ID NO: 882421 - protein, 24 aa, Mycobacterium
DYLAELTMLILWKSRKKNPETGYA

SEQ ID NO: 882422 - protein, 18 aa, Mycobacterium
DYLPLFVAPQPVRFEDRY

SEQ ID NO: 882423 - protein, 20 aa, Mycobacterium
DYLTMLSWYALCGIVEVGGS

SEQ ID NO: 882424 - protein, 19 aa, Mycobacterium
DYLVVFRQLLLWPIDKSGK

SEQ ID NO: 882425 - protein, 24 aa, Mycobacterium
DYPALIGPRCRAVWLLTVGAEQVD

SEQ ID NO: 882426 - protein, 24 aa, Mycobacterium
DYRRDRWWRDLPPYDLVLDALGGT

SEQ ID NO: 882427 - protein, 21 aa, Mycobacterium
DYVDLYLIHWPAPAVGKYVDA

SEQ ID NO: 882428 - protein, 23 aa, Mycobacterium
DYVDLYLIHWPVPELDEYVASFK

SEQ ID NO: 882429 - protein, 22 aa, Mycobacterium
EAAKPGSYFWFKGGKRAAQLPA

SEQ ID NO: 882430 - protein, 18 aa, Mycobacterium
EAAKPGSYFWLKGGKRPA

SEQ ID NO: 882431 - protein, 17 aa, Mycobacterium
EAAKPGSYFWLKGGSRP

SEQ ID NO: 882432 - protein, 19 aa, Mycobacterium
EAALFRLMRSPLMPITPSA

SEQ ID NO: 882433 - protein, 25 aa, Mycobacterium
EAALSAPLFWIATNAGLDGAVVVSK

SEQ ID NO: 882434 - protein, 17 aa, Mycobacterium
EAASLLMYGRELNWVQQ

SEQ ID NO: 882435 - protein, 30 aa, Mycobacterium
EAERMRLIAIPLWHSYMFAIRKDWGYMTSQ

SEQ ID NO: 882436 - protein, 18 aa, Mycobacterium
EAFIYFYPLVMMDVTRLQ

SEQ ID NO: 882437 - protein, 19 aa, Mycobacterium
EAFTLWRRLLTRSDLPENE

SEQ ID NO: 882438 - protein, 17 aa, Mycobacterium
EAFVPLRIHVLVRFGRW

SEQ ID NO: 882439 - protein, 20 aa, Mycobacterium
EAGFAVRLIVWFPSDREVVV

SEQ ID NO: 882440 - protein, 24 aa, Mycobacterium
EAGPDALIVVLLPDGGRGYMAKIF

SEQ ID NO: 882441 - protein, 34 aa, Mycobacterium
EAGSVFPRTYYLGGLFFLGPINLGASTLTIPTVT

SEQ ID NO: 882442 - protein, 24 aa, Mycobacterium
EAGVARFLPWQFGVDYDLIGRGSP

SEQ ID NO: 882443 - protein, 24 aa, Mycobacterium
EAGVPWVLMHWRPVSDDNPHQVPN

SEQ ID NO: 882444 - protein, 21 aa, Mycobacterium
EAHPWRWRLIDMYDRDLTHKW

SEQ ID NO: 882445 - protein, 17 aa, Mycobacterium
EAIAWHLLETLKPRVPV

SEQ ID NO: 882446 - protein, 19 aa, Mycobacterium
EAIFLPLLRVFFKSWFRVE

SEQ ID NO: 882447 - protein, 21 aa, Mycobacterium
EAIGFMLEILPALGYLHSLGL

SEQ ID NO: 882448 - protein, 21 aa, Mycobacterium
EAIHAVFLYHAIKAGLDMGIV

SEQ ID NO: 882449 - protein, 17 aa, Mycobacterium
EAILRIFGPLLDAAPTL

SEQ ID NO: 882450 - protein, 17 aa, Mycobacterium
EAKIIAERRLWLAVLRA

SEQ ID NO: 882451 - protein, 22 aa, Mycobacterium
EALAAPLYWIAANAGLDGAVAV

SEQ ID NO: 882452 - protein, 21 aa, Mycobacterium
EALAAPLYWIATNAGLDGSVV

SEQ ID NO: 882453 - protein, 24 aa, Mycobacterium
EALETWPLRIFGEALPRHLELIYE

SEQ ID NO: 882454 - protein, 18 aa, Mycobacterium
EALLIAKLGVRFAETPAK

SEQ ID NO: 882455 - protein, 19 aa, Mycobacterium
EALLRILEPFGIREIVQSG

SEQ ID NO: 882456 - protein, 19 aa, Mycobacterium
EALRSLGCRISWAQTLAPA

SEQ ID NO: 882457 - protein, 25 aa, Mycobacterium
EAMVLWPLLVLRTAVLNVSGAQQAA

SEQ ID NO: 882458 - protein, 24 aa, Mycobacterium
EAMVRPRWLWKFGKTLRPPDLRVP

SEQ ID NO: 882459 - protein, 17 aa, Mycobacterium
EAMWPPRGIPRSVLVEQ

SEQ ID NO: 882460 - protein, 18 aa, Mycobacterium
EAPIPLSAKLELLAAIAA

SEQ ID NO: 882461 - protein, 17 aa, Mycobacterium
EAPLLATYAFLPVVRKF

SEQ ID NO: 882462 - protein, 17 aa, Mycobacterium
EAPPDIELIGMLNLLIG

SEQ ID NO: 882463 - protein, 20 aa, Mycobacterium
EAPPWVGPLDVLIVAGDDPG

SEQ ID NO: 882464 - protein, 19 aa, Mycobacterium
EAPVYYNAKWDFWALTRYD

SEQ ID NO: 882465 - protein, 21 aa, Mycobacterium
EAQAWPVLRRHLALLAIEGHD

SEQ ID NO: 882466 - protein, 22 aa, Mycobacterium
EAQLWFDRGLVWAYAFNHEEAI

SEQ ID NO: 882467 - protein, 23 aa, Mycobacterium
EAQRKQWLEPLLAGEIRSAFAMT

SEQ ID NO: 882468 - protein, 23 aa, Mycobacterium
EARAVLPEWFLGSGLTAAAYRGA

SEQ ID NO: 882469 - protein, 17 aa, Mycobacterium
EARRFDVSPAWFAALGA

SEQ ID NO: 882470 - protein, 23 aa, Mycobacterium
EATYKAWFPLTKRWLGFEDAHIT

SEQ ID NO: 882471 - protein, 23 aa, Mycobacterium
EATYKAWFPLTKRWLGFEDAHIV

SEQ ID NO: 882472 - protein, 17 aa, Mycobacterium
EAWFMHIPGMKVIVPST

SEQ ID NO: 882473 - protein, 21 aa, Mycobacterium
EAYFAALLGLPFVAVMPASTS

SEQ ID NO: 882474 - protein, 21 aa, Mycobacterium
EAYLGLLRFLLGLDLVDRVLF

SEQ ID NO: 882475 - protein, 23 aa, Mycobacterium
ECAFDLRLIAPQLPPFDVPSGHT

SEQ ID NO: 882476 - protein, 24 aa, Mycobacterium
EDELAFLHPLPVRRLWGVGAKTAA

SEQ ID NO: 882477 - protein, 22 aa, Mycobacterium
EDHIGAIPFLLKMRPDIPVVGS

SEQ ID NO: 882478 - protein, 26 aa, Mycobacterium
EDIAPFIRFLVSDGWWITGQTILING

SEQ ID NO: 882479 - protein, 24 aa, Mycobacterium
EDIAWLRQLWGGPFMLKGVMRVDD

SEQ ID NO: 882480 - protein, 21 aa, Mycobacterium
EDLPALFLDFLENLPVIGTVV

SEQ ID NO: 882481 - protein, 17 aa, Mycobacterium
EDPFDWLPLEHRSVHAR

SEQ ID NO: 882482 - protein, 26 aa, Mycobacterium
EDPVWALIYGPPAPLRLLLVGGNTVV

SEQ ID NO: 882483 - protein, 23 aa, Mycobacterium
EDRAFGLGLWLVDWRFPNRLNRN

SEQ ID NO: 882484 - protein, 22 aa, Mycobacterium
EDRFMLKDPIYGLGPRVAQLFA

SEQ ID NO: 882485 - protein, 20 aa, Mycobacterium
EDRLLRLRWPCPVPGAMPVS

SEQ ID NO: 882486 - protein, 24 aa, Mycobacterium
EDSTYRGFWDPDGSLHWGVFEDDD

SEQ ID NO: 882487 - protein, 18 aa, Mycobacterium
EDSWLRHLALEGAARRYG

SEQ ID NO: 882488 - protein, 17 aa, Mycobacterium
EDVARFVRRRIFDGTYP

SEQ ID NO: 882489 - protein, 24 aa, Mycobacterium
EDVAWLREQWGGPFLLKGLVRVDD

SEQ ID NO: 882490 - protein, 24 aa, Mycobacterium
EDVNRWWTSLTPQQRQRFMAEHPD

SEQ ID NO: 882491 - protein, 21 aa, Mycobacterium
EDVRTIYLAAWRARVKGITVY

SEQ ID NO: 882492 - protein, 25 aa, Mycobacterium
EDWKDWLRWRVIHGRAFLLTDELIA

SEQ ID NO: 882493 - protein, 18 aa, Mycobacterium
EEAERASLLHLLLDDWVG

SEQ ID NO: 882494 - protein, 26 aa, Mycobacterium
EEANEWPWRAAHLVVTLGSRGARYAG

SEQ ID NO: 882495 - protein, 24 aa, Mycobacterium
EEEAVLLHGLPVRKLWGIGPVAED

SEQ ID NO: 882496 - protein, 24 aa, Mycobacterium
EEELAFLHPLPVRRLWGVGAKTAD

SEQ ID NO: 882497 - protein, 17 aa, Mycobacterium
EEFLRFFTPAPGDGRTF

SEQ ID NO: 882498 - protein, 18 aa, Mycobacterium
EEFLRNMWAEFFRSIWTV

SEQ ID NO: 882499 - protein, 18 aa, Mycobacterium
EEGKPCWLLGLLFSDENG

SEQ ID NO: 882500 - protein, 26 aa, Mycobacterium
EEGLELYFRRAGAWLALLHCLAATDM

SEQ ID NO: 882501 - protein, 18 aa, Mycobacterium
EEIKGLWVLARYDDGRPS

SEQ ID NO: 882502 - protein, 18 aa, Mycobacterium
EELFGQLLSWLLAGMPKL

SEQ ID NO: 882503 - protein, 17 aa, Mycobacterium
EELILQYDLWKAKGLRA

SEQ ID NO: 882504 - protein, 22 aa, Mycobacterium
EELKGLWFYYAGVYKGLPLDDR

SEQ ID NO: 882505 - protein, 22 aa, Mycobacterium
EELLDICFLFLIAGLDTVTDSL

SEQ ID NO: 882506 - protein, 17 aa, Mycobacterium
EELLWEILRSYIDEMLT

SEQ ID NO: 882507 - protein, 23 aa, Mycobacterium
EELSRRFGLPLWRFANSGTEATM

SEQ ID NO: 882508 - protein, 22 aa, Mycobacterium
EELTSWLLLLAGSASDFMTGEV

SEQ ID NO: 882509 - protein, 26 aa, Mycobacterium
EEQKSKWLPDLLAGRALAGFGLTEPG

SEQ ID NO: 882510 - protein, 17 aa, Mycobacterium
EERMEAARWLRGYLREL

SEQ ID NO: 882511 - protein, 17 aa, Mycobacterium
EESPIVFLRLRKGVRKN

SEQ ID NO: 882512 - protein, 23 aa, Mycobacterium
EEVAPWLEVVRKLGVLIGAVSEQ

SEQ ID NO: 882513 - protein, 23 aa, Mycobacterium
EEVEKMVWAIRWGADNIMDLSTG

SEQ ID NO: 882514 - protein, 18 aa, Mycobacterium
EEVKGLWVLARYDDGRPS

SEQ ID NO: 882515 - protein, 22 aa, Mycobacterium
EEWRFFLGLTKRMGLELWFVNF

SEQ ID NO: 882516 - protein, 20 aa, Mycobacterium
EEYLFYPSPSFDVAFIRGTT

SEQ ID NO: 882517 - protein, 19 aa, Mycobacterium
EFAAAVLGIWRLAATAVLI

SEQ ID NO: 882518 - protein, 17 aa, Mycobacterium
EFAFPVAPWMFGAAGRE

SEQ ID NO: 882519 - protein, 17 aa, Mycobacterium
EFALPVPSLVIALLLGV

SEQ ID NO: 882520 - protein, 23 aa, Mycobacterium
EFARYRCFLLGLPEELLPSEPAG

SEQ ID NO: 882521 - protein, 23 aa, Mycobacterium
EFEYRRLRLPAPDWQVLLAVPAD

SEQ ID NO: 882522 - protein, 19 aa, Mycobacterium
EFFATPGYGPWLRENLHYS

SEQ ID NO: 882523 - protein, 18 aa, Mycobacterium
EFFGIEYPILLAPMALVS

SEQ ID NO: 882524 - protein, 18 aa, Mycobacterium
EFGLCRYLAAGLAVLRTV

SEQ ID NO: 882525 - protein, 22 aa, Mycobacterium
EFIDRLWTGVPYQAIWFVQRRR

SEQ ID NO: 882526 - protein, 18 aa, Mycobacterium
EFIRLLRRLWREDDVTHR

SEQ ID NO: 882527 - protein, 18 aa, Mycobacterium
EFKALFQMKFYAVALLRS

SEQ ID NO: 882528 - protein, 23 aa, Mycobacterium
EFKMFYNLPVEGLDIPKSALGAG

SEQ ID NO: 882529 - protein, 20 aa, Mycobacterium
EFLDRLISISLPRIRDFRGL

SEQ ID NO: 882530 - protein, 19 aa, Mycobacterium
EFLDRLVSIALPRIRDFRG

SEQ ID NO: 882531 - protein, 17 aa, Mycobacterium
EFLGDCVLLPCTVTGGV

SEQ ID NO: 882532 - protein, 17 aa, Mycobacterium
EFLLRVLLSFFVAPNVP

SEQ ID NO: 882533 - protein, 20 aa, Mycobacterium
EFLQWFLGTIPIEPIWLCPL

SEQ ID NO: 882534 - protein, 27 aa, Mycobacterium
EFNLKNLYVYFWRWGTWKVFDANADQP

SEQ ID NO: 882535 - protein, 23 aa, Mycobacterium
EFRAGRIATIPLGRFADPIEIAN

SEQ ID NO: 882536 - protein, 25 aa, Mycobacterium
EFRTVPMVWYIPPLSPVVDAVSRDG

SEQ ID NO: 882537 - protein, 17 aa, Mycobacterium
EFTLPAWAPMPVSELLL

SEQ ID NO: 882538 - protein, 22 aa, Mycobacterium
EFTRRDFGLIYQARPRFLDRAI

SEQ ID NO: 882539 - protein, 23 aa, Mycobacterium
EFVAALQAIWRLGAAAVLISPAW

SEQ ID NO: 882540 - protein, 23 aa, Mycobacterium
EFVQFHPTMLFGAAAGGRRPLIT

SEQ ID NO: 882541 - protein, 17 aa, Mycobacterium
EFYFRRWKAPALVSEEF

SEQ ID NO: 882542 - protein, 26 aa, Mycobacterium
EFYKWTQWIFLQIYNAWFDTAAGKAR

SEQ ID NO: 882543 - protein, 23 aa, Mycobacterium
EGADATYMWPWMFSKVADEYDRR

SEQ ID NO: 882544 - protein, 23 aa, Mycobacterium
EGCQLDWWLGFSSVASLLGSPGQ

SEQ ID NO: 882545 - protein, 24 aa, Mycobacterium
EGDPWASFVTYGLLGGAPVLCVSD

SEQ ID NO: 882546 - protein, 28 aa, Mycobacterium
EGDRGLSWLPFFHDMGLITALLAPMIGH

SEQ ID NO: 882547 - protein, 23 aa, Mycobacterium
EGDRYLIVNPFFHTFGYKAGCIA

SEQ ID NO: 882548 - protein, 18 aa, Mycobacterium
EGELFIIGRIKDLLIIYG

SEQ ID NO: 882549 - protein, 24 aa, Mycobacterium
EGFGYIPRGVFLPRTARLLTADKL

SEQ ID NO: 882550 - protein, 20 aa, Mycobacterium
EGFHYLFHPVTQRALALAGD

SEQ ID NO: 882551 - protein, 17 aa, Mycobacterium
EGFLLRRGLVRLAEDGD

SEQ ID NO: 882552 - protein, 22 aa, Mycobacterium
EGGWTLPYLPKPWGRASGPIEQ

SEQ ID NO: 882553 - protein, 20 aa, Mycobacterium
EGHLSPRWVGKLMAGALPDH

SEQ ID NO: 882554 - protein, 23 aa, Mycobacterium
EGIKFFVYANLDYGLKKSGYDSR

SEQ ID NO: 882555 - protein, 26 aa, Mycobacterium
EGKAIIQWRPLQWFAQRPPGRYQRSD

SEQ ID NO: 882556 - protein, 25 aa, Mycobacterium
EGLDAFLRRFLLPALLTNTQPCVDA

SEQ ID NO: 882557 - protein, 22 aa, Mycobacterium
EGLILGSYRFSAFRSAKTAPKD

SEQ ID NO: 882558 - protein, 25 aa, Mycobacterium
EGLKELYTFFTPLLRNLAPCARVVV

SEQ ID NO: 882559 - protein, 17 aa, Mycobacterium
EGLLYERRLIHSAFATA

SEQ ID NO: 882560 - protein, 21 aa, Mycobacterium
EGLRLWVMMETPRSFLRAEEI

SEQ ID NO: 882561 - protein, 25 aa, Mycobacterium
EGLRPLIFALWDMVAAYRAAQPAAV

SEQ ID NO: 882562 - protein, 19 aa, Mycobacterium
EGLSPWLEFVWKPGYADYY

SEQ ID NO: 882563 - protein, 24 aa, Mycobacterium
EGMALAMIATLPPGGHFGSADISV

SEQ ID NO: 882564 - protein, 19 aa, Mycobacterium
EGMLSPWLELPGAADRIAT

SEQ ID NO: 882565 - protein, 23 aa, Mycobacterium
EGPDALVVVLLPDGGRGYLSKIF

SEQ ID NO: 882566 - protein, 26 aa, Mycobacterium
EGPKPWWYRPMYSLFDQFLGAAETDP

SEQ ID NO: 882567 - protein, 24 aa, Mycobacterium
EGPLPQTRFVLRKALSAHLPVILV

SEQ ID NO: 882568 - protein, 23 aa, Mycobacterium
EGPRWFEGLLWFSDMLGEAVHTV

SEQ ID NO: 882569 - protein, 19 aa, Mycobacterium
EGPRWFEGLVWFSDMLGEA

SEQ ID NO: 882570 - protein, 24 aa, Mycobacterium
EGPVVGIWRRAPLQALARLHMLAA

SEQ ID NO: 882571 - protein, 20 aa, Mycobacterium
EGRADWFQWVESNVARRVGS

SEQ ID NO: 882572 - protein, 23 aa, Mycobacterium
EGRTVLYLYPLTGRPGLDIPEGW

SEQ ID NO: 882573 - protein, 17 aa, Mycobacterium
EGRVRPIIGARLPIQRA

SEQ ID NO: 882574 - protein, 24 aa, Mycobacterium
EGTFLLCTFWLAQALAASGQLDRA

SEQ ID NO: 882575 - protein, 23 aa, Mycobacterium
EGVKLPVVLFFHGGGWSVGDLDS

SEQ ID NO: 882576 - protein, 17 aa, Mycobacterium
EGVLDHIMLYPPSVGIA

SEQ ID NO: 882577 - protein, 22 aa, Mycobacterium
EGVRLARVLPLPVAMRLILMGK

SEQ ID NO: 882578 - protein, 19 aa, Mycobacterium
EGWFINQHIIWQVGDEDVA

SEQ ID NO: 882579 - protein, 17 aa, Mycobacterium
EGWMPFGRVFETLSWGR

SEQ ID NO: 882580 - protein, 17 aa, Mycobacterium
EGWQPIFFLPEKAATVW

SEQ ID NO: 882581 - protein, 17 aa, Mycobacterium
EGWRRLLYELSGHRINL

SEQ ID NO: 882582 - protein, 17 aa, Mycobacterium
EGYSPPERPYAPGAFGP

SEQ ID NO: 882583 - protein, 25 aa, Mycobacterium
EHAERFTLLRPLLFTIAYEILGSAT

SEQ ID NO: 882584 - protein, 18 aa, Mycobacterium
EHAFTWILPLMWRMDALY

SEQ ID NO: 882585 - protein, 21 aa, Mycobacterium
EHAFTWILPLMWRMDALYDAR

SEQ ID NO: 882586 - protein, 24 aa, Mycobacterium
EHAVLHLLYSRFWHKVLYDLGYVS

SEQ ID NO: 882587 - protein, 25 aa, Mycobacterium
EHDLSLLLLRVQALRPAWGDPALHR

SEQ ID NO: 882588 - protein, 25 aa, Mycobacterium
EHDLSLLLLRVQALRPAWGDPTWHR

SEQ ID NO: 882589 - protein, 23 aa, Mycobacterium
EHDLSLWLLKVQALRSAWGTPEV

SEQ ID NO: 882590 - protein, 18 aa, Mycobacterium
EHFSLEIIPWADFIGRWT

SEQ ID NO: 882591 - protein, 17 aa, Mycobacterium
EHGFYVLDEFTYPLKWG

SEQ ID NO: 882592 - protein, 18 aa, Mycobacterium
EHGHIFLAQPPLYKLKWQ

SEQ ID NO: 882593 - protein, 19 aa, Mycobacterium
EHLRLPLRRVLWGTDAAVL

SEQ ID NO: 882594 - protein, 20 aa, Mycobacterium
EHQFTVWLAIRLDLLDEVHS

SEQ ID NO: 882595 - protein, 26 aa, Mycobacterium
EHSDFMSYLNLWRYLREQRTEMSGNA

SEQ ID NO: 882596 - protein, 24 aa, Mycobacterium
EHSRSIPLLVWQFREPRLCISSGP

SEQ ID NO: 882597 - protein, 18 aa, Mycobacterium
EIAGLLFISARTVEWHLS

SEQ ID NO: 882598 - protein, 20 aa, Mycobacterium
EIAHAVLFLCSPRASFITGS

SEQ ID NO: 882599 - protein, 23 aa, Mycobacterium
EIARLVPFIEWLRDAYPDHVISA

SEQ ID NO: 882600 - protein, 17 aa, Mycobacterium
EIDLLPVPEFYGGAVYF

SEQ ID NO: 882601 - protein, 17 aa, Mycobacterium
EIEGWMPFGRVFETLSW

SEQ ID NO: 882602 - protein, 23 aa, Mycobacterium
EIERLHRELARQPHPLLGAATWS

SEQ ID NO: 882603 - protein, 17 aa, Mycobacterium
EIFIPEFPVLNFDLNIP

SEQ ID NO: 882604 - protein, 22 aa, Mycobacterium
EIGLLLPCNVLVRADPDRPGDV

SEQ ID NO: 882605 - protein, 20 aa, Mycobacterium
EIGLLLPCNVLVRADPGEPG

SEQ ID NO: 882606 - protein, 25 aa, Mycobacterium
EIGTKYWMDLGMGWQFFAQEDYIRR

SEQ ID NO: 882607 - protein, 27 aa, Mycobacterium
EILGFYGLNYWYPWQVTVLGLGPVWQS

SEQ ID NO: 882608 - protein, 20 aa, Mycobacterium
EILSMWRPSPLIRARRFEKA

SEQ ID NO: 882609 - protein, 17 aa, Mycobacterium
EILWLCESAHLPVIWAT

SEQ ID NO: 882610 - protein, 20 aa, Mycobacterium
EINSLRIFAGAGSAPMLEAA

SEQ ID NO: 882611 - protein, 17 aa, Mycobacterium
EINSLRIFAGTGSGPML

SEQ ID NO: 882612 - protein, 19 aa, Mycobacterium
EINSLRLFSGAGSTSMLEA

SEQ ID NO: 882613 - protein, 17 aa, Mycobacterium
EIPPLFVMSWIDGSSLE

SEQ ID NO: 882614 - protein, 21 aa, Mycobacterium
EIPVFYGHYWRQGSPKHRHDW

SEQ ID NO: 882615 - protein, 20 aa, Mycobacterium
EIRHWLQVFAQRFYSFSQFK

SEQ ID NO: 882616 - protein, 22 aa, Mycobacterium
EIRINWVWNPPWGPDKITDDGR

SEQ ID NO: 882617 - protein, 20 aa, Mycobacterium
EIRLVVYPVLLGSGLALFGE

SEQ ID NO: 882618 - protein, 22 aa, Mycobacterium
EIRTLFGVLFQDGALFGSMNLF

SEQ ID NO: 882619 - protein, 22 aa, Mycobacterium
EIRTLFGVLFQDGALFGSMNLY

SEQ ID NO: 882620 - protein, 24 aa, Mycobacterium
EISDGTLRFLLWAAALLSPQPPSL

SEQ ID NO: 882621 - protein, 20 aa, Mycobacterium
EISNLLLMRGMIGKPGAGLC

SEQ ID NO: 882622 - protein, 18 aa, Mycobacterium
EISWRYFPGFEPLPYDAD

SEQ ID NO: 882623 - protein, 21 aa, Mycobacterium
EIVGAYFPLGWPIACHVQGDA

SEQ ID NO: 882624 - protein, 24 aa, Mycobacterium
EIVLAPFKIPAIPLDFPALSGTVG

SEQ ID NO: 882625 - protein, 17 aa, Mycobacterium
EIVLSNTYDLWFTPWAP

SEQ ID NO: 882626 - protein, 17 aa, Mycobacterium
EIWRFTPLRRLRGLHDG

SEQ ID NO: 882627 - protein, 24 aa, Mycobacterium
EIYEDLSWFCIRAWRFGAAESLGA

SEQ ID NO: 882628 - protein, 19 aa, Mycobacterium
EIYSMWRPSPLIRARRFEK

SEQ ID NO: 882629 - protein, 22 aa, Mycobacterium
EIYVPFSWFEPMWLENLGFMPE

SEQ ID NO: 882630 - protein, 26 aa, Mycobacterium
EKERERLFPLIRRYALAYHVVFIPSH

SEQ ID NO: 882631 - protein, 20 aa, Mycobacterium
EKFGFLLDAFAFGAPPHGGI

SEQ ID NO: 882632 - protein, 20 aa, Mycobacterium
EKICRLIMLYHLDRGWADHL

SEQ ID NO: 882633 - protein, 25 aa, Mycobacterium
EKIDPYLRPLYDALYDMMDAELIPK

SEQ ID NO: 882634 - protein, 22 aa, Mycobacterium
EKLPYILRLFDIQGLSTRSAAS

SEQ ID NO: 882635 - protein, 21 aa, Mycobacterium
EKPSWWRRLLSNRSFQSFLSA

SEQ ID NO: 882636 - protein, 27 aa, Mycobacterium
ELAAPVTHIWYFKGVPSRLGYLLDLAP

SEQ ID NO: 882637 - protein, 17 aa, Mycobacterium
ELADFWRFNVQFARQIL

SEQ ID NO: 882638 - protein, 27 aa, Mycobacterium
ELAKPLHLHRILLQRSWIPIFCSRFGE

SEQ ID NO: 882639 - protein, 23 aa, Mycobacterium
ELAPFRLPLTISPQPAPRLTVDQ

SEQ ID NO: 882640 - protein, 17 aa, Mycobacterium
ELARVWKLLPFEADWFS

SEQ ID NO: 882641 - protein, 18 aa, Mycobacterium
ELAVLILTNLFGQNSARI

SEQ ID NO: 882642 - protein, 18 aa, Mycobacterium
ELAWWVYTCWREGLRRID

SEQ ID NO: 882643 - protein, 23 aa, Mycobacterium
ELCRRWYPRIYFGQPDKGLAHRA

SEQ ID NO: 882644 - protein, 23 aa, Mycobacterium
ELCRRWYPRIYFGQPEKGLAHRA

SEQ ID NO: 882645 - protein, 24 aa, Mycobacterium
ELCRRWYPRIYFGQPEKGLAHRAL

SEQ ID NO: 882646 - protein, 24 aa, Mycobacterium
ELCTLTWTVYSLPGAPILDHYELG

SEQ ID NO: 882647 - protein, 20 aa, Mycobacterium
ELDGLRLITWRGASRAEQGL

SEQ ID NO: 882648 - protein, 25 aa, Mycobacterium
ELEFNLLMLVAPVLRKLAYADAAAG

SEQ ID NO: 882649 - protein, 21 aa, Mycobacterium
ELFGIRLPSPVFMAPIGVIGV

SEQ ID NO: 882650 - protein, 21 aa, Mycobacterium
ELFMQLPWRTEIIEGLLGADL

SEQ ID NO: 882651 - protein, 21 aa, Mycobacterium
ELFMQLPWRTEIIQGLLGADL

SEQ ID NO: 882652 - protein, 22 aa, Mycobacterium
ELGEWLHPFEKFWRARLARLAE

SEQ ID NO: 882653 - protein, 18 aa, Mycobacterium
ELGFTYDTGWYLQFRATE

SEQ ID NO: 882654 - protein, 25 aa, Mycobacterium
ELGKPLYIHRILLQRSWLSIFRGAF

SEQ ID NO: 882655 - protein, 18 aa, Mycobacterium
ELGLPIITPPYWVEGFDP

SEQ ID NO: 882656 - protein, 18 aa, Mycobacterium
ELGLPTAPFWFAGSVGEL

SEQ ID NO: 882657 - protein, 18 aa, Mycobacterium
ELGLPTVPFWFAGSVEEL

SEQ ID NO: 882658 - protein, 19 aa, Mycobacterium
ELGMPPWRVQKAQKQARRW

SEQ ID NO: 882659 - protein, 25 aa, Mycobacterium
ELHDGPFILAGWSLGAVLAYACAVG

SEQ ID NO: 882660 - protein, 23 aa, Mycobacterium
ELHFLGAVLWRRGLHRVLREFVD

SEQ ID NO: 882661 - protein, 20 aa, Mycobacterium
ELHLDWWYDIRRLGPTDVES

SEQ ID NO: 882662 - protein, 23 aa, Mycobacterium
ELHYLGAALWRRGIHRVLHGFVQ

SEQ ID NO: 882663 - protein, 18 aa, Mycobacterium
ELIDYLTMLSWYALCGIV

SEQ ID NO: 882664 - protein, 18 aa, Mycobacterium
ELIGRIGWTCRDVWWAAT

SEQ ID NO: 882665 - protein, 17 aa, Mycobacterium
ELIKRIFDIQRFSPVLV

SEQ ID NO: 882666 - protein, 20 aa, Mycobacterium
ELIRAFWPGALSLVVHQAPS

SEQ ID NO: 882667 - protein, 17 aa, Mycobacterium
ELKEYFARWAYSGPLAA

SEQ ID NO: 882668 - protein, 22 aa, Mycobacterium
ELKINWVWNPPWGPDKITDDGR

SEQ ID NO: 882669 - protein, 21 aa, Mycobacterium
ELKVRFFASARSQGRKLAFRG

SEQ ID NO: 882670 - protein, 27 aa, Mycobacterium
ELLADRLHLLPPLRWRLATVPLDLGHP

SEQ ID NO: 882671 - protein, 18 aa, Mycobacterium
ELLFGPLDVCDCAHCASV

SEQ ID NO: 882672 - protein, 18 aa, Mycobacterium
ELLFLYNGVRPRNVMPVH

SEQ ID NO: 882673 - protein, 17 aa, Mycobacterium
ELLGFCLLLLIAGHETT

SEQ ID NO: 882674 - protein, 17 aa, Mycobacterium
ELLGPRYVLIIRAGAHR

SEQ ID NO: 882675 - protein, 17 aa, Mycobacterium
ELLIGRYIPNLVPRPFT

SEQ ID NO: 882676 - protein, 21 aa, Mycobacterium
ELLLAILRRVPLADTGVALFG

SEQ ID NO: 882677 - protein, 19 aa, Mycobacterium
ELLREFLDWLFARYLEIVD

SEQ ID NO: 882678 - protein, 18 aa, Mycobacterium
ELLSFRPGGSEAAFLFAI

SEQ ID NO: 882679 - protein, 18 aa, Mycobacterium
ELLTPFTTQYFAAISGVW

SEQ ID NO: 882680 - protein, 18 aa, Mycobacterium
ELLYLAPNVWPRNTTRDE

SEQ ID NO: 882681 - protein, 18 aa, Mycobacterium
ELLYLYNAVRPRNVMPVH

SEQ ID NO: 882682 - protein, 18 aa, Mycobacterium
ELMFAIWAAECVFVPLNF

SEQ ID NO: 882683 - protein, 20 aa, Mycobacterium
ELMINLFWRGLKGTPSDAGT

SEQ ID NO: 882684 - protein, 27 aa, Mycobacterium
ELMRKIVIELLAWQFASPVRWIETQDL

SEQ ID NO: 882685 - protein, 20 aa, Mycobacterium
ELPPHLEWTAPFGALSAANW

SEQ ID NO: 882686 - protein, 17 aa, Mycobacterium
ELPYVTLLLRIRGNTAA

SEQ ID NO: 882687 - protein, 18 aa, Mycobacterium
ELQEAFAKAWYKLLHRDM

SEQ ID NO: 882688 - protein, 19 aa, Mycobacterium
ELQILLARWSAAAAILQRG

SEQ ID NO: 882689 - protein, 24 aa, Mycobacterium
ELQLQVYLMLQRPVSWTGGEPADE

SEQ ID NO: 882690 - protein, 20 aa, Mycobacterium
ELQRQWRFACLFISHDLAVV

SEQ ID NO: 882691 - protein, 23 aa, Mycobacterium
ELREFAARFIAHSPFFCMATVGA

SEQ ID NO: 882692 - protein, 23 aa, Mycobacterium
ELRGRLVWAWRADGANPAARVLG

SEQ ID NO: 882693 - protein, 24 aa, Mycobacterium
ELRGYLRRWLAPAIREWAARPVTA

SEQ ID NO: 882694 - protein, 22 aa, Mycobacterium
ELRINWVWNPPWGPDKITDDGR

SEQ ID NO: 882695 - protein, 21 aa, Mycobacterium
ELRLLQTMLALFDLVRKAQGP

SEQ ID NO: 882696 - protein, 19 aa, Mycobacterium
ELRLPLVLMIDTAGPALSA

SEQ ID NO: 882697 - protein, 23 aa, Mycobacterium
ELRQTIPELPWLTRKRIQQEWGV

SEQ ID NO: 882698 - protein, 23 aa, Mycobacterium
ELRRHILTLWQTALIRLSRLKIQ

SEQ ID NO: 882699 - protein, 22 aa, Mycobacterium
ELRRLIPPWVTLGSRLAALPKP

SEQ ID NO: 882700 - protein, 25 aa, Mycobacterium
ELRRRWGGLLSYRYIGRRYAQMDLG

SEQ ID NO: 882701 - protein, 29 aa, Mycobacterium
ELRYLDAAPDWWWPALAFTAVAALDDPQV

SEQ ID NO: 882702 - protein, 23 aa, Mycobacterium
ELSDGTIRFLLWAAALSSPRAPS

SEQ ID NO: 882703 - protein, 25 aa, Mycobacterium
ELSDGTLRFLLWAAALLSPDPPPLM

SEQ ID NO: 882704 - protein, 25 aa, Mycobacterium
ELSDGTLRFLLWAAALLSPQPPSLM

SEQ ID NO: 882705 - protein, 24 aa, Mycobacterium
ELSDGTLRYLLWSAALLSPRPPQL

SEQ ID NO: 882706 - protein, 32 aa, Mycobacterium
ELSGAIRLIYPRETIWWPPVLTMSAVEGTGLT

SEQ ID NO: 882707 - protein, 20 aa, Mycobacterium
ELSKLRLLPFRLSFDGGDAE

SEQ ID NO: 882708 - protein, 19 aa, Mycobacterium
ELSQLRPLPFRLVLDGTEE

SEQ ID NO: 882709 - protein, 19 aa, Mycobacterium
ELSRSLPAPWRVEALVQLA

SEQ ID NO: 882710 - protein, 18 aa, Mycobacterium
ELSSFQLHWAPSVRPVAG

SEQ ID NO: 882711 - protein, 17 aa, Mycobacterium
ELSSFQLYWAPSLRPEA

SEQ ID NO: 882712 - protein, 20 aa, Mycobacterium
ELTERPDLFPAWDSLSEAQQ

SEQ ID NO: 882713 - protein, 24 aa, Mycobacterium
ELVDYVRGVLYFRTGRWPDVLNQF

SEQ ID NO: 882714 - protein, 18 aa, Mycobacterium
ELVRRLCWDWAPVAAAEI

SEQ ID NO: 882715 - protein, 24 aa, Mycobacterium
ELVTLVEWGIPPLAVLRAATVTAA

SEQ ID NO: 882716 - protein, 24 aa, Mycobacterium
ELVTLVNWGLPPLAVLRAATVTAA

SEQ ID NO: 882717 - protein, 20 aa, Mycobacterium
ELWDLLPGYLIFRSIIPGRP

SEQ ID NO: 882718 - protein, 21 aa, Mycobacterium
ELWDLLPGYLIFRSIIPNRPP

SEQ ID NO: 882719 - protein, 26 aa, Mycobacterium
EMARTVLIELLAWQFASPVRWIETQD

SEQ ID NO: 882720 - protein, 27 aa, Mycobacterium
EMGPAIRFLLIELPGDRWRFLITAHHI

SEQ ID NO: 882721 - protein, 24 aa, Mycobacterium
EMHKGPFVLAGWSLGGALAYACAI

SEQ ID NO: 882722 - protein, 17 aa, Mycobacterium
EMLGIRLVPLHVLTGEQ

SEQ ID NO: 882723 - protein, 25 aa, Mycobacterium
EMLLEHNGLKPLPRWNELDPESVRF

SEQ ID NO: 882724 - protein, 17 aa, Mycobacterium
EMMWSFRANGMWSDERG

SEQ ID NO: 882725 - protein, 22 aa, Mycobacterium
EMPLDWFLRPAVKLDFRHLDDG

SEQ ID NO: 882726 - protein, 26 aa, Mycobacterium
EMPVDQYWFWNLRNAVRFDRAVATAA

SEQ ID NO: 882727 - protein, 22 aa, Mycobacterium
EMQINWVWNPPWGPDKITEDGR

SEQ ID NO: 882728 - protein, 25 aa, Mycobacterium
EMRLDMPLLDFFSHGGALKSSWYGD

SEQ ID NO: 882729 - protein, 22 aa, Mycobacterium
EMSAINPVFLLRGALSARAADL

SEQ ID NO: 882730 - protein, 21 aa, Mycobacterium
EMTRVIWKLIKDKLILPHLDI

SEQ ID NO: 882731 - protein, 20 aa, Mycobacterium
ENDIWWCLQPFLNDEPTIPV

SEQ ID NO: 882732 - protein, 18 aa, Mycobacterium
ENGYLLLMRVGDGSNLAT

SEQ ID NO: 882733 - protein, 18 aa, Mycobacterium
ENISPIVVWLGSAEARDV

SEQ ID NO: 882734 - protein, 23 aa, Mycobacterium
ENISPLVVWLGSAESRDVSGRVF

SEQ ID NO: 882735 - protein, 22 aa, Mycobacterium
ENLVLFGRLRGLNRRQAKTRAD

SEQ ID NO: 882736 - protein, 18 aa, Mycobacterium
ENPKCHIAWTTLAGIGQV

SEQ ID NO: 882737 - protein, 18 aa, Mycobacterium
ENTWLAKLPADFFDLIMF

SEQ ID NO: 882738 - protein, 21 aa, Mycobacterium
ENVSPLVVWLGSAGSRDVTGK

SEQ ID NO: 882739 - protein, 19 aa, Mycobacterium
ENWLTGLARWFGQLDVDEA

SEQ ID NO: 882740 - protein, 23 aa, Mycobacterium
ENYRSIWMYLKELEFRQGFIDIP

SEQ ID NO: 882741 - protein, 18 aa, Mycobacterium
EPADYLPLFVAPQPVRFE

SEQ ID NO: 882742 - protein, 17 aa, Mycobacterium
EPAFFGVRPHAVIKGGM

SEQ ID NO: 882743 - protein, 20 aa, Mycobacterium
EPAFFGVRPHAVVKGGAIAW

SEQ ID NO: 882744 - protein, 17 aa, Mycobacterium
EPAHHWLLTLLVGGARA

SEQ ID NO: 882745 - protein, 24 aa, Mycobacterium
EPDFQRAYRELAKQVRLPGFRPGK

SEQ ID NO: 882746 - protein, 25 aa, Mycobacterium
EPDPLLPPQLLPQPWVGAAARSAAA

SEQ ID NO: 882747 - protein, 22 aa, Mycobacterium
EPEAWWWQKWVDPLGQHTEFSG

SEQ ID NO: 882748 - protein, 23 aa, Mycobacterium
EPEDLPWEVPLIELGLDSLMAVR

SEQ ID NO: 882749 - protein, 24 aa, Mycobacterium
EPGIKTYLDLPLFAGRPAPNLAAG

SEQ ID NO: 882750 - protein, 24 aa, Mycobacterium
EPGKLADIVLWEPKFFGIRPEVVF

SEQ ID NO: 882751 - protein, 17 aa, Mycobacterium
EPGMLMYGWRRSSLRGN

SEQ ID NO: 882752 - protein, 24 aa, Mycobacterium
EPHPVWDFLFTYYSLRPRQLRRWH

SEQ ID NO: 882753 - protein, 27 aa, Mycobacterium
EPIGVCGLITPWNWPINQIACKVFPAL

SEQ ID NO: 882754 - protein, 18 aa, Mycobacterium
EPIWLDWVSRWPTPSATA

SEQ ID NO: 882755 - protein, 17 aa, Mycobacterium
EPLESTGIFLIYAALYQ

SEQ ID NO: 882756 - protein, 21 aa, Mycobacterium
EPLFMAGLWTTWRPPGAPKDH

SEQ ID NO: 882757 - protein, 32 aa, Mycobacterium
EPLKVVLNLWRPGWLPWVIHAMRLGAGVRDGI

SEQ ID NO: 882758 - protein, 23 aa, Mycobacterium
EPLLLDWRAPAARAFYTATGANP

SEQ ID NO: 882759 - protein, 17 aa, Mycobacterium
EPLLPIGVLYDPFVERA

SEQ ID NO: 882760 - protein, 19 aa, Mycobacterium
EPLLSYLRKMVFWAAVTPE

SEQ ID NO: 882761 - protein, 19 aa, Mycobacterium
EPLPVGHPLWRTPNTHITP

SEQ ID NO: 882762 - protein, 22 aa, Mycobacterium
EPLVLKPWTMPEPLLPVAIAAH

SEQ ID NO: 882763 - protein, 17 aa, Mycobacterium
EPLWVQLITAYYLAERQ

SEQ ID NO: 882764 - protein, 28 aa, Mycobacterium
EPMPWNGPLFKFALFQVASEEFYLFVSI

SEQ ID NO: 882765 - protein, 20 aa, Mycobacterium
EPNMRWRTFCAELLAIVDKL

SEQ ID NO: 882766 - protein, 24 aa, Mycobacterium
EPPLAPFVIVLFGATGDLAKRKLL

SEQ ID NO: 882767 - protein, 29 aa, Mycobacterium
EPRLWVPDDFAFVRYLAVGLAALHTVNRD

SEQ ID NO: 882768 - protein, 17 aa, Mycobacterium
EPRMLLVHFLRDQLGLT

SEQ ID NO: 882769 - protein, 17 aa, Mycobacterium
EPRMLLVHFLRDQLRLT

SEQ ID NO: 882770 - protein, 23 aa, Mycobacterium
EPRRLARRYLLQGPIALLRAARA

SEQ ID NO: 882771 - protein, 23 aa, Mycobacterium
EPRRLARRYLLQGPIALLRTARA

SEQ ID NO: 882772 - protein, 17 aa, Mycobacterium
EPSPYLPTSRRFFNPIY

SEQ ID NO: 882773 - protein, 19 aa, Mycobacterium
EPSPYLPTSRRFVNPLYLR

SEQ ID NO: 882774 - protein, 20 aa, Mycobacterium
EPSWSYLYRKMIPILVADGH

SEQ ID NO: 882775 - protein, 24 aa, Mycobacterium
EPTTWAYYPWRRCVVHLVGPRAFH

SEQ ID NO: 882776 - protein, 21 aa, Mycobacterium
EPVTDSWYLTSIQAGFEPWSG

SEQ ID NO: 882777 - protein, 19 aa, Mycobacterium
EPWQVPKFYWAVMADSAFE

SEQ ID NO: 882778 - protein, 24 aa, Mycobacterium
EPWRAAPLLEYLRKMVFWSEVTPS

SEQ ID NO: 882779 - protein, 28 aa, Mycobacterium
EPWVRDYLFLRGLLGTSILWFELDRDGN

SEQ ID NO: 882780 - protein, 25 aa, Mycobacterium
EQAEDVWFPLFRPVSGAEPGRLPVD

SEQ ID NO: 882781 - protein, 25 aa, Mycobacterium
EQAGLRPWIATLKLHYVRIIPTEIT

SEQ ID NO: 882782 - protein, 18 aa, Mycobacterium
EQEYAMGPGIRRLLRLGM

SEQ ID NO: 882783 - protein, 24 aa, Mycobacterium
EQEYELIVYWWPTPDKASVAGAIL

SEQ ID NO: 882784 - protein, 22 aa, Mycobacterium
EQFHTDFVRALLTGAGAYSGAE

SEQ ID NO: 882785 - protein, 23 aa, Mycobacterium
EQGPTRGWWEPTVQRYLLTDSQT

SEQ ID NO: 882786 - protein, 25 aa, Mycobacterium
EQIEDVWLPLFRPATAEASAALPGD

SEQ ID NO: 882787 - protein, 23 aa, Mycobacterium
EQKKFFLPKIAAGKLHFSIGYSE

SEQ ID NO: 882788 - protein, 23 aa, Mycobacterium
EQKKFFLPRIAAGNLHFSIGYSE

SEQ ID NO: 882789 - protein, 21 aa, Mycobacterium
EQLFYLRARGIPEAQARRLVV

SEQ ID NO: 882790 - protein, 20 aa, Mycobacterium
EQLFYLRARGIPEDQARRLV

SEQ ID NO: 882791 - protein, 20 aa, Mycobacterium
EQLGILARFAGAALVAKEDT

SEQ ID NO: 882792 - protein, 22 aa, Mycobacterium
EQLIAAAAYLWARQWSAAGGDL

SEQ ID NO: 882793 - protein, 21 aa, Mycobacterium
EQLMPHWLLALQDAAKRRGTT

SEQ ID NO: 882794 - protein, 18 aa, Mycobacterium
EQLPLIWKRLIDAGMESG

SEQ ID NO: 882795 - protein, 24 aa, Mycobacterium
EQMSALLMAIFLRGMTPGEITRWT

SEQ ID NO: 882796 - protein, 24 aa, Mycobacterium
EQMSALLMAIFWRGMDSGETARWT

SEQ ID NO: 882797 - protein, 26 aa, Mycobacterium
EQNIAFLFLPGWKWTLRWDTGKRKWD

SEQ ID NO: 882798 - protein, 22 aa, Mycobacterium
EQRKQWLEPLLAGEIRSAFSMT

SEQ ID NO: 882799 - protein, 22 aa, Mycobacterium
EQRKQWLEPLLGGEIRSAFSMT

SEQ ID NO: 882800 - protein, 17 aa, Mycobacterium
EQRLPVIASDRVYFVGQ

SEQ ID NO: 882801 - protein, 22 aa, Mycobacterium
EQRPRRFAYPPNLFVVDGGAPQ

SEQ ID NO: 882802 - protein, 17 aa, Mycobacterium
EQRRQWLKPLLDGEIRS

SEQ ID NO: 882803 - protein, 21 aa, Mycobacterium
EQRRWLAPWYSLVPLQAGQAE

SEQ ID NO: 882804 - protein, 18 aa, Mycobacterium
EQRRWLAPWYSSVPLQSG

SEQ ID NO: 882805 - protein, 22 aa, Mycobacterium
EQRTQWLEPLLAGEIRSAFAMT

SEQ ID NO: 882806 - protein, 27 aa, Mycobacterium
EQSLVERLIPDFLWIDTEYTAKLSLDG

SEQ ID NO: 882807 - protein, 26 aa, Mycobacterium
EQSLVERLIPDFLWIDTEYTAKVSLD

SEQ ID NO: 882808 - protein, 17 aa, Mycobacterium
EQSPIVGIWHSGGARLA

SEQ ID NO: 882809 - protein, 25 aa, Mycobacterium
EQSTLYLPVFAEGALFYVGDPHMAM

SEQ ID NO: 882810 - protein, 24 aa, Mycobacterium
EQVEDVWFPLFRPTTETERAALPD

SEQ ID NO: 882811 - protein, 24 aa, Mycobacterium
EQVWPLLRSIPLRELRRTGLLGKL

SEQ ID NO: 882812 - protein, 21 aa, Mycobacterium
EQWRAIRGFLHDLRAGRRHVN

SEQ ID NO: 882813 - protein, 24 aa, Mycobacterium
ERAKGMLMLIYGLSDSAAFELLRW

SEQ ID NO: 882814 - protein, 24 aa, Mycobacterium
ERARQMLRFLSSPLWRAYTSTYVE

SEQ ID NO: 882815 - protein, 23 aa, Mycobacterium
ERDAAMGPGLRRLLRLSVPSPVK

SEQ ID NO: 882816 - protein, 23 aa, Mycobacterium
ERDLRVIIYGWLAFTFEICRQRI

SEQ ID NO: 882817 - protein, 22 aa, Mycobacterium
ERDRWHFIPFAGGARACIGEHF

SEQ ID NO: 882818 - protein, 26 aa, Mycobacterium
EREGVNLTFLPFFAKAAVEALKTHPN

SEQ ID NO: 882819 - protein, 29 aa, Mycobacterium
ERELDLLLDGRKLLWWAMSRFTTLGNLPY

SEQ ID NO: 882820 - protein, 23 aa, Mycobacterium
ERERLFPLIRRYAVAFHVVFIPS

SEQ ID NO: 882821 - protein, 19 aa, Mycobacterium
EREYWIRRSWRSTGASIRE

SEQ ID NO: 882822 - protein, 18 aa, Mycobacterium
ERFGTLLDEPLIPSSLRT

SEQ ID NO: 882823 - protein, 18 aa, Mycobacterium
ERFLLLWAEGSMTIAVPS

SEQ ID NO: 882824 - protein, 21 aa, Mycobacterium
ERFLNTPWWISPLPSARTRAM

SEQ ID NO: 882825 - protein, 19 aa, Mycobacterium
ERFTALRPLLFTIAYEILG

SEQ ID NO: 882826 - protein, 18 aa, Mycobacterium
ERFTLLRPLLFTIVYEIL

SEQ ID NO: 882827 - protein, 21 aa, Mycobacterium
ERGAPVVFPLNGVVPGFQKAI

SEQ ID NO: 882828 - protein, 23 aa, Mycobacterium
ERGIAFVPFFPLGSAFVPDNPVL

SEQ ID NO: 882829 - protein, 17 aa, Mycobacterium
ERGIPLLRPARPNADEF

SEQ ID NO: 882830 - protein, 24 aa, Mycobacterium
ERGTPPWWPMRQLVRALGADADEV

SEQ ID NO: 882831 - protein, 17 aa, Mycobacterium
ERHMFWFDLMKPMTSNA

SEQ ID NO: 882832 - protein, 21 aa, Mycobacterium
ERLDGDPLWLLLISGSGNAKT

SEQ ID NO: 882833 - protein, 23 aa, Mycobacterium
ERLGFGELRWAISGAAPIPKETL

SEQ ID NO: 882834 - protein, 24 aa, Mycobacterium
ERLGLLGLPFLFYIDAAEGRASVI

SEQ ID NO: 882835 - protein, 27 aa, Mycobacterium
ERLIDPDRLWLWLRANGLDFSGARLTD

SEQ ID NO: 882836 - protein, 21 aa, Mycobacterium
ERLRRLGLPFLFYVDAAQGRA

SEQ ID NO: 882837 - protein, 24 aa, Mycobacterium
ERPDYLPLFVAPQPVSFEPAVVDD

SEQ ID NO: 882838 - protein, 18 aa, Mycobacterium
ERRHLLLLGWTKMRDGQL

SEQ ID NO: 882839 - protein, 24 aa, Mycobacterium
ERRRLQFLRLLLDEPNVLLLDEPT

SEQ ID NO: 882840 - protein, 23 aa, Mycobacterium
ERRRYSPWLAYSQSKLANLLFTS

SEQ ID NO: 882841 - protein, 23 aa, Mycobacterium
ERSARWILPLLWRRWSPGYRGAD

SEQ ID NO: 882842 - protein, 22 aa, Mycobacterium
ERSKLYWDFWEQFRSRVVSEYP

SEQ ID NO: 882843 - protein, 24 aa, Mycobacterium
ERSLNIDFLLGYLRELLPRRPDLK

SEQ ID NO: 882844 - protein, 30 aa, Mycobacterium
ERSLNIDFLLGYLRELLPRRPDLKLIVTSA

SEQ ID NO: 882845 - protein, 31 aa, Mycobacterium
ERSLNIDFLLGYLRELLPRRPDLKLIVTSAT

SEQ ID NO: 882846 - protein, 27 aa, Mycobacterium
ERSLNIDFLLGYLRRLLPRRPDLKVIV

SEQ ID NO: 882847 - protein, 24 aa, Mycobacterium
ERSTPPWWPMRQLVRALGADADEV

SEQ ID NO: 882848 - protein, 17 aa, Mycobacterium
ERTFLACEGAPRAIVHF

SEQ ID NO: 882849 - protein, 18 aa, Mycobacterium
ERTKLPVIPWVVSAKSLS

SEQ ID NO: 882850 - protein, 25 aa, Mycobacterium
ERVGWQWRLVWYKAVADLLTGDYDS

SEQ ID NO: 882851 - protein, 25 aa, Mycobacterium
ERVGWRWRLIWYKAVAELLTGDYDS

SEQ ID NO: 882852 - protein, 24 aa, Mycobacterium
ERVGWRWRLVWFRAVSELLTADYD

SEQ ID NO: 882853 - protein, 18 aa, Mycobacterium
ERWPAFWDWAYETLPNDS

SEQ ID NO: 882854 - protein, 18 aa, Mycobacterium
ERWQLLATAWLDLPGRPA

SEQ ID NO: 882855 - protein, 20 aa, Mycobacterium
ERYKLVWKNRLGFARLAIQH

SEQ ID NO: 882856 - protein, 25 aa, Mycobacterium
ERYSMDWYYPILGGALRGPAAAARI

SEQ ID NO: 882857 - protein, 17 aa, Mycobacterium
ESAPGLFLVLDPDLRIV

SEQ ID NO: 882858 - protein, 23 aa, Mycobacterium
ESEQTFLFRLLSGELRQGALTGI

SEQ ID NO: 882859 - protein, 22 aa, Mycobacterium
ESERLLRGFLTPALWDAGLYCR

SEQ ID NO: 882860 - protein, 18 aa, Mycobacterium
ESHWWAHRALWHLIFSGV

SEQ ID NO: 882861 - protein, 24 aa, Mycobacterium
ESKRLMRDYPYLAGFLRAVRAENA

SEQ ID NO: 882862 - protein, 22 aa, Mycobacterium
ESKRWAFYPWRKTVVSILGPRS

SEQ ID NO: 882863 - protein, 20 aa, Mycobacterium
ESLDCWPVNFALLGKGNTVS

SEQ ID NO: 882864 - protein, 21 aa, Mycobacterium
ESLWHVDYFMRVMAGAAIEAN

SEQ ID NO: 882865 - protein, 18 aa, Mycobacterium
ESLWRLLCEQVGAAALVV

SEQ ID NO: 882866 - protein, 17 aa, Mycobacterium
ESNAMWALSIPVPFSVP

SEQ ID NO: 882867 - protein, 26 aa, Mycobacterium
ESNPERVWGWYLWRHYLVATVEPNEG

SEQ ID NO: 882868 - protein, 17 aa, Mycobacterium
ESPIVFLRLRKAARKHK

SEQ ID NO: 882869 - protein, 26 aa, Mycobacterium
ESPRETWLRLLLIRAGFPRPQTQIPV

SEQ ID NO: 882870 - protein, 23 aa, Mycobacterium
ESQLALPQWLADLLPAPLPRGTV

SEQ ID NO: 882871 - protein, 23 aa, Mycobacterium
ESQRAFFYGLVLDGALFANAQAE

SEQ ID NO: 882872 - protein, 17 aa, Mycobacterium
ESRAYKMWLPPLTDPTP

SEQ ID NO: 882873 - protein, 17 aa, Mycobacterium
ESRTITFLDIPAAPGFG

SEQ ID NO: 882874 - protein, 25 aa, Mycobacterium
ESSADLFTVLPLGELWIAASRLRQV

SEQ ID NO: 882875 - protein, 19 aa, Mycobacterium
ESTRPLVICDLGMPRDVDP

SEQ ID NO: 882876 - protein, 23 aa, Mycobacterium
ESTWDRRPRWFRKIAGMATGVGD

SEQ ID NO: 882877 - protein, 25 aa, Mycobacterium
ESVPMYKLRRYFPPDSRPGQSPVGP

SEQ ID NO: 882878 - protein, 24 aa, Mycobacterium
ESVPMYKLRRYFPPDTRPGHAPVG

SEQ ID NO: 882879 - protein, 23 aa, Mycobacterium
ESWSFALALRLAAFDLLRADGTD

SEQ ID NO: 882880 - protein, 22 aa, Mycobacterium
ESWSFALALRLAAYELLRADES

SEQ ID NO: 882881 - protein, 27 aa, Mycobacterium
ETDAPLVITMIWLHAAMPRVFRGRSVF

SEQ ID NO: 882882 - protein, 17 aa, Mycobacterium
ETDQVFGWVAFEFGLYR

SEQ ID NO: 882883 - protein, 24 aa, Mycobacterium
ETEDLQLLGLLPPAPADANPPDDE

SEQ ID NO: 882884 - protein, 22 aa, Mycobacterium
ETERWLRERLAVLRPGEHVLGE

SEQ ID NO: 882885 - protein, 19 aa, Mycobacterium
ETFHMAQLIPWIEANFRTY

SEQ ID NO: 882886 - protein, 17 aa, Mycobacterium
ETFLTSELPEWLSANRS

SEQ ID NO: 882887 - protein, 22 aa, Mycobacterium
ETFPPFPFPAVFTLLRGPRSIK

SEQ ID NO: 882888 - protein, 29 aa, Mycobacterium
ETFYFAHVTFFYYLLIRVVEQLHFDGSMP

SEQ ID NO: 882889 - protein, 17 aa, Mycobacterium
ETGIRPGVLYRSSELSK

SEQ ID NO: 882890 - protein, 22 aa, Mycobacterium
ETGMVNVLCSQGIWARHRKLAQ

SEQ ID NO: 882891 - protein, 17 aa, Mycobacterium
ETHWWAHRALWHLIFSG

SEQ ID NO: 882892 - protein, 18 aa, Mycobacterium
ETHWWAHRALWHLIFSGA

SEQ ID NO: 882893 - protein, 20 aa, Mycobacterium
ETIEFFWGLGIPVYEVWGES

SEQ ID NO: 882894 - protein, 20 aa, Mycobacterium
ETLEFFWGLGIPVYEVWGES

SEQ ID NO: 882895 - protein, 25 aa, Mycobacterium
ETLFDALLPRYVATRVYAALLEAAA

SEQ ID NO: 882896 - protein, 23 aa, Mycobacterium
ETLIALVRLRELIDRYPLRGIKG

SEQ ID NO: 882897 - protein, 21 aa, Mycobacterium
ETLRRVFLSRLGITPSAYRDR

SEQ ID NO: 882898 - protein, 20 aa, Mycobacterium
ETMLPFCWRGVSLHAGGAGR

SEQ ID NO: 882899 - protein, 24 aa, Mycobacterium
ETMNPDWPLPLFDLARIASDRGDV

SEQ ID NO: 882900 - protein, 21 aa, Mycobacterium
ETPVWTFLGPRPASWWLRRWV

SEQ ID NO: 882901 - protein, 26 aa, Mycobacterium
ETSDFMSYLNLWRYLRERRSALSGSG

SEQ ID NO: 882902 - protein, 24 aa, Mycobacterium
ETSILPLLQSFLPAPFNAIPNPFE

SEQ ID NO: 882903 - protein, 17 aa, Mycobacterium
ETSLLWALLQTGSAGGP

SEQ ID NO: 882904 - protein, 17 aa, Mycobacterium
ETSLLWGLLQTASAGGL

SEQ ID NO: 882905 - protein, 19 aa, Mycobacterium
ETTRPLVICDLGMPRDVDP

SEQ ID NO: 882906 - protein, 27 aa, Mycobacterium
ETVIPYYPYFSFVQRPFEMRPEHLRLL

SEQ ID NO: 882907 - protein, 26 aa, Mycobacterium
ETWRYPAFFHGLLSRGVYPPASAFET

SEQ ID NO: 882908 - protein, 26 aa, Mycobacterium
ETWVERPHYLPLFVAPQPIPEAIDED

SEQ ID NO: 882909 - protein, 25 aa, Mycobacterium
ETWVERPHYMPLFVAPQPISEPVAG

SEQ ID NO: 882910 - protein, 17 aa, Mycobacterium
ETYLDIHRIIAAASLTG

SEQ ID NO: 882911 - protein, 18 aa, Mycobacterium
EVADGLWYPLWDANIRLD

SEQ ID NO: 882912 - protein, 23 aa, Mycobacterium
EVAEKLWYPLWDANIRLDHSVRT

SEQ ID NO: 882913 - protein, 17 aa, Mycobacterium
EVAKLWPWADLEPFAAF

SEQ ID NO: 882914 - protein, 17 aa, Mycobacterium
EVALLKILALQFIMSDP

SEQ ID NO: 882915 - protein, 24 aa, Mycobacterium
EVALLKILALQFIMSDPRHLGTQA

SEQ ID NO: 882916 - protein, 19 aa, Mycobacterium
EVANLLRWLVDGNFTLLGY

SEQ ID NO: 882917 - protein, 17 aa, Mycobacterium
EVDCPHFDYSLPAYYLI

SEQ ID NO: 882918 - protein, 22 aa, Mycobacterium
EVDRPAFLVSPLISHAAAEPLD

SEQ ID NO: 882919 - protein, 22 aa, Mycobacterium
EVEFAFFVILLAVAGNETTRNA

SEQ ID NO: 882920 - protein, 23 aa, Mycobacterium
EVEFAFFVILLAVAGNETTRNAM

SEQ ID NO: 882921 - protein, 20 aa, Mycobacterium
EVERPDLVIGWWAVPTILEH

SEQ ID NO: 882922 - protein, 23 aa, Mycobacterium
EVETLRYFWPRLSPGAFVLLDDY

SEQ ID NO: 882923 - protein, 17 aa, Mycobacterium
EVFRALLALILIVLRRD

SEQ ID NO: 882924 - protein, 24 aa, Mycobacterium
EVGKLADLVLWEPAFFGVRPDLVL

SEQ ID NO: 882925 - protein, 31 aa, Mycobacterium
EVGKLADLVLWEPAFFGVRPHAVLKGGMIAW

SEQ ID NO: 882926 - protein, 24 aa, Mycobacterium
EVGKRPPGHLWRWELRPLDDDRTQ

SEQ ID NO: 882927 - protein, 26 aa, Mycobacterium
EVGKVADLVIWKPAFFGVKPQVVLKN

SEQ ID NO: 882928 - protein, 17 aa, Mycobacterium
EVGWSMLPVARSVLRRI

SEQ ID NO: 882929 - protein, 18 aa, Mycobacterium
EVGWSMLPVARSVLRRIG

SEQ ID NO: 882930 - protein, 20 aa, Mycobacterium
EVGWSMLPVARTALRRIGND

SEQ ID NO: 882931 - protein, 19 aa, Mycobacterium
EVIHYWALDGGWDCFAEHY

SEQ ID NO: 882932 - protein, 17 aa, Mycobacterium
EVIHYWALEGGWECFAN

SEQ ID NO: 882933 - protein, 17 aa, Mycobacterium
EVILNKLGPALAAGNTV

SEQ ID NO: 882934 - protein, 18 aa, Mycobacterium
EVIYLYNGPNGLVSFDMT

SEQ ID NO: 882935 - protein, 21 aa, Mycobacterium
EVLIDLIRRYAPKIALIVTSH

SEQ ID NO: 882936 - protein, 18 aa, Mycobacterium
EVLPLLYLHGLSTSDFGP

SEQ ID NO: 882937 - protein, 25 aa, Mycobacterium
EVLTKPRWFFSFAKTLRPPDLRVPN

SEQ ID NO: 882938 - protein, 25 aa, Mycobacterium
EVMPEDLIKFGLIPEFIGRLPIVAS

SEQ ID NO: 882939 - protein, 24 aa, Mycobacterium
EVRAAIGGLLPYLDRLKLTDAPLE

SEQ ID NO: 882940 - protein, 18 aa, Mycobacterium
EVRLTAPILLLDGASMWF

SEQ ID NO: 882941 - protein, 17 aa, Mycobacterium
EVSLAIAGLFSAHAKQY

SEQ ID NO: 882942 - protein, 18 aa, Mycobacterium
EVSSNVVVPYFWSDQYDV

SEQ ID NO: 882943 - protein, 45 aa, Mycobacterium
EVSTAIAALFSQHAKTYQLLAAELAAIPDRFTKTVLASANSYASA

SEQ ID NO: 882944 - protein, 23 aa, Mycobacterium
EVTHYLFKHPKVDFIWVTGGPKI

SEQ ID NO: 882945 - protein, 17 aa, Mycobacterium
EVTLNGHHWLKDVYIQD

SEQ ID NO: 882946 - protein, 24 aa, Mycobacterium
EVTRRVIVPLGLRDTYWPAPDDTG

SEQ ID NO: 882947 - protein, 17 aa, Mycobacterium
EVVALTPARLLLIVITD

SEQ ID NO: 882948 - protein, 23 aa, Mycobacterium
EVVPIRVYRWKPTPLGGAFDQLV

SEQ ID NO: 882949 - protein, 17 aa, Mycobacterium
EVWPMAGPGLPTQPLQG

SEQ ID NO: 882950 - protein, 17 aa, Mycobacterium
EVYRFWRDLENLPRFMH

SEQ ID NO: 882951 - protein, 20 aa, Mycobacterium
EVYRLRQPVLLIWGREDRVN

SEQ ID NO: 882952 - protein, 21 aa, Mycobacterium
EVYTLLPPLLPAPGRENPTVT

SEQ ID NO: 882953 - protein, 21 aa, Mycobacterium
EWHKYWIDTRLQWYVDLGIDP

SEQ ID NO: 882954 - protein, 20 aa, Mycobacterium
EWHYFFQNNLRWRNLRKITI

SEQ ID NO: 882955 - protein, 20 aa, Mycobacterium
EWICYFPHPHRVVCGGISIL

SEQ ID NO: 882956 - protein, 22 aa, Mycobacterium
EWIPDWLWKLNLKILGPFAVWV

SEQ ID NO: 882957 - protein, 17 aa, Mycobacterium
EWLALFDELGIPASPLR

SEQ ID NO: 882958 - protein, 17 aa, Mycobacterium
EWLKAQGVPFRGGAGPS

SEQ ID NO: 882959 - protein, 22 aa, Mycobacterium
EWLTVLLRRDLGLLLLINVPGG

SEQ ID NO: 882960 - protein, 20 aa, Mycobacterium
EWMQLLIVTVRIATLPGLLS

SEQ ID NO: 882961 - protein, 18 aa, Mycobacterium
EWPLFLDVWVEHVVEEVA

SEQ ID NO: 882962 - protein, 18 aa, Mycobacterium
EWTLPVWAPMPVSELLLG

SEQ ID NO: 882963 - protein, 17 aa, Mycobacterium
EWVLRRPPLHGLTPSAH

SEQ ID NO: 882964 - protein, 19 aa, Mycobacterium
EWVMAQWRWDTLAARLAGL

SEQ ID NO: 882965 - protein, 22 aa, Mycobacterium
EWVTWWLAVSRIGALAVPLSTL

SEQ ID NO: 882966 - protein, 23 aa, Mycobacterium
EYELLRRNQILFTYLHLAASRAC

SEQ ID NO: 882967 - protein, 21 aa, Mycobacterium
EYGIDTVWFGAAAPLALLAPR

SEQ ID NO: 882968 - protein, 18 aa, Mycobacterium
EYGLLRRGQILFTYLHLA

SEQ ID NO: 882969 - protein, 21 aa, Mycobacterium
EYGLTPLVRLVSWGVAGVAPH

SEQ ID NO: 882970 - protein, 17 aa, Mycobacterium
EYILAFLGSMQAGMIAV

SEQ ID NO: 882971 - protein, 24 aa, Mycobacterium
EYLGPMTWYWDLMFDRTPGGMTVL

SEQ ID NO: 882972 - protein, 18 aa, Mycobacterium
EYPGDFWVYARNKIMVAA

SEQ ID NO: 882973 - protein, 17 aa, Mycobacterium
EYPLLGPWGAARVFGPQ

SEQ ID NO: 882974 - protein, 25 aa, Mycobacterium
EYRTVPMVWYIPPLSPVVDAVSRDG

SEQ ID NO: 882975 - protein, 22 aa, Mycobacterium
EYSHLTLSWVYDWMAQGVPVVA

SEQ ID NO: 882976 - protein, 23 aa, Mycobacterium
EYSIDLFTLLPLGELWVAAARMR

SEQ ID NO: 882977 - protein, 18 aa, Mycobacterium
FAADLARMYIRYAERHGW

SEQ ID NO: 882978 - protein, 19 aa, Mycobacterium
FAADLARMYIRYAERHGWK

SEQ ID NO: 882979 - protein, 19 aa, Mycobacterium
FAADLARMYIRYAERHGWN

SEQ ID NO: 882980 - protein, 23 aa, Mycobacterium
FAADPLLHKLIGLLARVAAALDE

SEQ ID NO: 882981 - protein, 22 aa, Mycobacterium
FAAGVPTWWRTMEAKVAKLSNL

SEQ ID NO: 882982 - protein, 19 aa, Mycobacterium
FAAMLPWLAFSRLLGRRAA

SEQ ID NO: 882983 - protein, 19 aa, Mycobacterium
FAARPFGMLFGFAGYHAFT

SEQ ID NO: 882984 - protein, 19 aa, Mycobacterium
FAARRWQWHDLAVGRTAIV

SEQ ID NO: 882985 - protein, 22 aa, Mycobacterium
FADDWALRRFAGISNLPAVPQH

SEQ ID NO: 882986 - protein, 25 aa, Mycobacterium
FADELAWWVYICWREGLCRIDPGDL

SEQ ID NO: 882987 - protein, 21 aa, Mycobacterium
FAEALQLIRLLWNADGPIDFT

SEQ ID NO: 882988 - protein, 20 aa, Mycobacterium
FAELFLPTPLRWLVGATRFA

SEQ ID NO: 882989 - protein, 18 aa, Mycobacterium
FAFGVPLLQRITSDTAAR

SEQ ID NO: 882990 - protein, 19 aa, Mycobacterium
FAFGVPLLQRITSGTAARP

SEQ ID NO: 882991 - protein, 17 aa, Mycobacterium
FAFSSWVRSVSNPLFDP

SEQ ID NO: 882992 - protein, 18 aa, Mycobacterium
FAGAVGPRLPWIPGLPPG

SEQ ID NO: 882993 - protein, 17 aa, Mycobacterium
FAILALQAPVAGDLREV

SEQ ID NO: 882994 - protein, 21 aa, Mycobacterium
FAKEIFLGRFPLELIHPFPKP

SEQ ID NO: 882995 - protein, 18 aa, Mycobacterium
FALPIPSLVICELLGVPY

SEQ ID NO: 882996 - protein, 21 aa, Mycobacterium
FALTGLLLDHLLPVPGSRVIT

SEQ ID NO: 882997 - protein, 17 aa, Mycobacterium
FALVAHLLPLLRAGGAR

SEQ ID NO: 882998 - protein, 17 aa, Mycobacterium
FALVEFIPGAPYILIGS

SEQ ID NO: 882999 - protein, 25 aa, Mycobacterium
FAPICRTFHILPIPWVTAADITNAV

SEQ ID NO: 883000 - protein, 17 aa, Mycobacterium
FAQSRLWFIDQLHGPSP

SEQ ID NO: 883001 - protein, 24 aa, Mycobacterium
FARDWALRRFAGISNLPAAPQRLG

SEQ ID NO: 883002 - protein, 17 aa, Mycobacterium
FARGFLLTKRDIDWFQA

SEQ ID NO: 883003 - protein, 18 aa, Mycobacterium
FARGLLNRLFTRAYIPGK

SEQ ID NO: 883004 - protein, 18 aa, Mycobacterium
FARGLLNRLFTRAYLPGA

SEQ ID NO: 883005 - protein, 24 aa, Mycobacterium
FARHPGFVHSFPPMPLQPNGFMTP

SEQ ID NO: 883006 - protein, 26 aa, Mycobacterium
FASAYWHWFFLIQPAPLPETLIGADP

SEQ ID NO: 883007 - protein, 17 aa, Mycobacterium
FASLLEFITSGPVVAAV

SEQ ID NO: 883008 - protein, 17 aa, Mycobacterium
FASLPYRIMHEFQIPLY

SEQ ID NO: 883009 - protein, 21 aa, Mycobacterium
FASLVFYSSWFKLHHPAAFCA

SEQ ID NO: 883010 - protein, 23 aa, Mycobacterium
FASLWTYERLLFPADPVESYAGT

SEQ ID NO: 883011 - protein, 21 aa, Mycobacterium
FATLRREAPISFWPAVEYEGF

SEQ ID NO: 883012 - protein, 22 aa, Mycobacterium
FATLRREAPLSFWPAIEMEGFE

SEQ ID NO: 883013 - protein, 21 aa, Mycobacterium
FATYPILAVQGWAAFHDLKLR

SEQ ID NO: 883014 - protein, 18 aa, Mycobacterium
FAVAIARFRLLVAALHAA

SEQ ID NO: 883015 - protein, 19 aa, Mycobacterium
FAVLKWIDEPYPDLAWRYN

SEQ ID NO: 883016 - protein, 18 aa, Mycobacterium
FAVQWRALALVATTADLV

SEQ ID NO: 883017 - protein, 19 aa, Mycobacterium
FAYHGYPWLIHRLAYRRAN

SEQ ID NO: 883018 - protein, 20 aa, Mycobacterium
FAYHGYPWLIHRLAYRRANH

SEQ ID NO: 883019 - protein, 18 aa, Mycobacterium
FAYRVLRAWLHTLRDRLT

SEQ ID NO: 883020 - protein, 17 aa, Mycobacterium
FCEIFPPDNFPLYFYRK

SEQ ID NO: 883021 - protein, 22 aa, Mycobacterium
FCELYDLRTLWQVAAHNPWLSV

SEQ ID NO: 883022 - protein, 18 aa, Mycobacterium
FCVLLPDATLVAAQIFAL

SEQ ID NO: 883023 - protein, 21 aa, Mycobacterium
FDADFFAPWAKLAAVRTPTIA

SEQ ID NO: 883024 - protein, 17 aa, Mycobacterium
FDAYLTMRGLKTLVLRM

SEQ ID NO: 883025 - protein, 19 aa, Mycobacterium
FDCSGLVMWAFQQAGISLP

SEQ ID NO: 883026 - protein, 20 aa, Mycobacterium
FDCSGLVMWAFQQAGISLPH

SEQ ID NO: 883027 - protein, 23 aa, Mycobacterium
FDDLIRTLARRPLSWRLVLTIGE

SEQ ID NO: 883028 - protein, 17 aa, Mycobacterium
FDDLPRHRVAPPPLPAA

SEQ ID NO: 883029 - protein, 25 aa, Mycobacterium
FDDLVRLFPPLFPMLEAQDPDAALQ

SEQ ID NO: 883030 - protein, 21 aa, Mycobacterium
FDDLVTPFLGLYRDDNMRPDS

SEQ ID NO: 883031 - protein, 17 aa, Mycobacterium
FDEACAGPWWALAANHP

SEQ ID NO: 883032 - protein, 20 aa, Mycobacterium
FDEACWLVFLATHFGFHRHN

SEQ ID NO: 883033 - protein, 23 aa, Mycobacterium
FDEAVFFQWLDKMPGAWSHGGAR

SEQ ID NO: 883034 - protein, 23 aa, Mycobacterium
FDEVLRPTWYTPTSKRIAAVGRR

SEQ ID NO: 883035 - protein, 18 aa, Mycobacterium
FDGGLWWLRARLTTPIDG

SEQ ID NO: 883036 - protein, 18 aa, Mycobacterium
FDGRRVALMLAVHPLCPL

SEQ ID NO: 883037 - protein, 18 aa, Mycobacterium
FDHFGWLGGFFAMDLPAT

SEQ ID NO: 883038 - protein, 20 aa, Mycobacterium
FDIYLLDFPGYGLSAKPPEP

SEQ ID NO: 883039 - protein, 18 aa, Mycobacterium
FDLARLIEILLRWNLDDT

SEQ ID NO: 883040 - protein, 18 aa, Mycobacterium
FDLLLQLIFAHRLDVTEV

SEQ ID NO: 883041 - protein, 18 aa, Mycobacterium
FDNPWLFDVARTPNPHFG

SEQ ID NO: 883042 - protein, 17 aa, Mycobacterium
FDPDIWQVAYLIAPVAG

SEQ ID NO: 883043 - protein, 25 aa, Mycobacterium
FDPERFQWWKVLGTLWWGVGLAAQA

SEQ ID NO: 883044 - protein, 18 aa, Mycobacterium
FDRAFKELAKQVRLPGFR

SEQ ID NO: 883045 - protein, 17 aa, Mycobacterium
FDRFGADLPPLEGIYLA

SEQ ID NO: 883046 - protein, 19 aa, Mycobacterium
FDRRAIFKVFRRVSSGISP

SEQ ID NO: 883047 - protein, 17 aa, Mycobacterium
FDSMLIKLSCRGRDFPT

SEQ ID NO: 883048 - protein, 20 aa, Mycobacterium
FDTIIEMWLPLAWSLNMVNR

SEQ ID NO: 883049 - protein, 19 aa, Mycobacterium
FDTLFLYENYPIDAGALSG

SEQ ID NO: 883050 - protein, 18 aa, Mycobacterium
FDTLFLYENYPIDAGAMM

SEQ ID NO: 883051 - protein, 20 aa, Mycobacterium
FDTPILVPPQAAMLGTGAIV

SEQ ID NO: 883052 - protein, 17 aa, Mycobacterium
FDVLLHQVSPDWDAILE

SEQ ID NO: 883053 - protein, 18 aa, Mycobacterium
FDVPAFDGFWAAGALRLP

SEQ ID NO: 883054 - protein, 20 aa, Mycobacterium
FDVPDQLELLARYTRHFVAC

SEQ ID NO: 883055 - protein, 20 aa, Mycobacterium
FDVPIIFRAPFVHALAMSWT

SEQ ID NO: 883056 - protein, 27 aa, Mycobacterium
FDVTPPPWLEPGQWWALVRVGCAGGLV

SEQ ID NO: 883057 - protein, 21 aa, Mycobacterium
FDWLLRFRWRARAAAWEEGQP

SEQ ID NO: 883058 - protein, 18 aa, Mycobacterium
FDWVRDLLSYLPPNNATD

SEQ ID NO: 883059 - protein, 19 aa, Mycobacterium
FDWVRDLLSYLPPNNATDP

SEQ ID NO: 883060 - protein, 20 aa, Mycobacterium
FDYFKFRYYEKWLGGISQFF

SEQ ID NO: 883061 - protein, 17 aa, Mycobacterium
FDYLAFTKGFDGAAIRK

SEQ ID NO: 883062 - protein, 18 aa, Mycobacterium
FEAALTALLPQLSPPRPG

SEQ ID NO: 883063 - protein, 24 aa, Mycobacterium
FEDPAYVPLLLRAYELWAGLAADS

SEQ ID NO: 883064 - protein, 18 aa, Mycobacterium
FEFQTLLASTQLAKCFHL

SEQ ID NO: 883065 - protein, 17 aa, Mycobacterium
FEFRWHDQFALSLDPDT

SEQ ID NO: 883066 - protein, 19 aa, Mycobacterium
FEGFPLMLLTSIGAKSGAE

SEQ ID NO: 883067 - protein, 20 aa, Mycobacterium
FEHFGLRLRRQLPLGPTGAG

SEQ ID NO: 883068 - protein, 17 aa, Mycobacterium
FEHLGRLLIVDCGVLFP

SEQ ID NO: 883069 - protein, 23 aa, Mycobacterium
FELWNAWFRVWTIGTLYGVNGQM

SEQ ID NO: 883070 - protein, 18 aa, Mycobacterium
FENLWGTELLAEPGLRIP

SEQ ID NO: 883071 - protein, 20 aa, Mycobacterium
FEPLIAIRPGYWRPANFAAA

SEQ ID NO: 883072 - protein, 21 aa, Mycobacterium
FEPLLLDWRAPMARPFYVATA

SEQ ID NO: 883073 - protein, 17 aa, Mycobacterium
FEPPGVLGLIDWALETI

SEQ ID NO: 883074 - protein, 25 aa, Mycobacterium
FERVLELAPWLKKPPPRGGFPMVSF

SEQ ID NO: 883075 - protein, 23 aa, Mycobacterium
FETLLALAGYYFAVGDLARSTGV

SEQ ID NO: 883076 - protein, 18 aa, Mycobacterium
FEVWALWGMALRATVDAL

SEQ ID NO: 883077 - protein, 18 aa, Mycobacterium
FEWLIGSQRWRDSAIARG

SEQ ID NO: 883078 - protein, 17 aa, Mycobacterium
FEWLIGSQRWRESAAQR

SEQ ID NO: 883079 - protein, 18 aa, Mycobacterium
FEWLPMLSRVLGSAQLVP

SEQ ID NO: 883080 - protein, 20 aa, Mycobacterium
FFAKNFLPLLTSTRSIIENL

SEQ ID NO: 883081 - protein, 18 aa, Mycobacterium
FFCFPEVDIRIPFTDGMA

SEQ ID NO: 883082 - protein, 23 aa, Mycobacterium
FFDDLISPFLGLYRDDNLRPNSS

SEQ ID NO: 883083 - protein, 22 aa, Mycobacterium
FFDDLVTPFLGLYRDDNLRADS

SEQ ID NO: 883084 - protein, 22 aa, Mycobacterium
FFDDLVTPFLGLYRDDNLRPDS

SEQ ID NO: 883085 - protein, 23 aa, Mycobacterium
FFDDLVTPFLGLYRDDNLRPNSS

SEQ ID NO: 883086 - protein, 17 aa, Mycobacterium
FFDLPYTAPVDAATGKP

SEQ ID NO: 883087 - protein, 17 aa, Mycobacterium
FFEEIGIADVPLVGGKN

SEQ ID NO: 883088 - protein, 18 aa, Mycobacterium
FFGAYARDYQAFSVQVEA

SEQ ID NO: 883089 - protein, 21 aa, Mycobacterium
FFGDRRKAFLEDLAVVTGGQV

SEQ ID NO: 883090 - protein, 18 aa, Mycobacterium
FFGIPPVGSLVNAPRGEQ

SEQ ID NO: 883091 - protein, 19 aa, Mycobacterium
FFGLFLDPTWVYTCAYFER

SEQ ID NO: 883092 - protein, 25 aa, Mycobacterium
FFGLLIRICLGIAAWLRGAFATAGP

SEQ ID NO: 883093 - protein, 18 aa, Mycobacterium
FFGSFVFGTPGFPLSDVP

SEQ ID NO: 883094 - protein, 19 aa, Mycobacterium
FFGSLLEFITSGPLVAAVL

SEQ ID NO: 883095 - protein, 17 aa, Mycobacterium
FFLLADFEALNASLVED

SEQ ID NO: 883096 - protein, 17 aa, Mycobacterium
FFMYGVDGEPLFMAGLW

SEQ ID NO: 883097 - protein, 23 aa, Mycobacterium
FFVGRWPLKFIPPIAVGRGLRPE

SEQ ID NO: 883098 - protein, 17 aa, Mycobacterium
FGAPYLRDSLLAAGALC

SEQ ID NO: 883099 - protein, 17 aa, Mycobacterium
FGARVEQLPLIWKRLID

SEQ ID NO: 883100 - protein, 25 aa, Mycobacterium
FGAYARGYQIIGAQAAMFHAEFVRA

SEQ ID NO: 883101 - protein, 27 aa, Mycobacterium
FGDRVVWVPWRRPGFQLGLDIADIKRR

SEQ ID NO: 883102 - protein, 20 aa, Mycobacterium
FGFSPFLDITAESWSRIIDV

SEQ ID NO: 883103 - protein, 18 aa, Mycobacterium
FGFWPRFLTGLLAKTAAE

SEQ ID NO: 883104 - protein, 23 aa, Mycobacterium
FGGDLLFIGCTPIVWAGPIANWI

SEQ ID NO: 883105 - protein, 23 aa, Mycobacterium
FGGDLLFIGCTPIVWAGPIANWV

SEQ ID NO: 883106 - protein, 20 aa, Mycobacterium
FGGFGGWGGQSGLIGSGGNG

SEQ ID NO: 883107 - protein, 23 aa, Mycobacterium
FGGGSMFLLLGILSALWERQTSG

SEQ ID NO: 883108 - protein, 17 aa, Mycobacterium
FGHPSFRYYGWGPRMWW

SEQ ID NO: 883109 - protein, 18 aa, Mycobacterium
FGHPSFRYYGWGPRMWWW

SEQ ID NO: 883110 - protein, 23 aa, Mycobacterium
FGHRTLYEILRFCAFFAATGDTD

SEQ ID NO: 883111 - protein, 17 aa, Mycobacterium
FGHWWYEGPTWLQRVLR

SEQ ID NO: 883112 - protein, 19 aa, Mycobacterium
FGIHPVLLDAALHALGVAD

SEQ ID NO: 883113 - protein, 17 aa, Mycobacterium
FGLCRYLAAGLAVVHAV

SEQ ID NO: 883114 - protein, 22 aa, Mycobacterium
FGLSWQIVPARLYELLTDPDPA

SEQ ID NO: 883115 - protein, 17 aa, Mycobacterium
FGLWQKFGTDYPFETQR

SEQ ID NO: 883116 - protein, 17 aa, Mycobacterium
FGPLRRVRAVLAAATRC

SEQ ID NO: 883117 - protein, 18 aa, Mycobacterium
FGPPPLGPGAPPLERLLA

SEQ ID NO: 883118 - protein, 17 aa, Mycobacterium
FGPSWAWPKPVQAHIPV

SEQ ID NO: 883119 - protein, 25 aa, Mycobacterium
FGRHPSFVHSFPPMPVQPNGFMTAD

SEQ ID NO: 883120 - protein, 17 aa, Mycobacterium
FGRLIFIGSVSGSWGIG

SEQ ID NO: 883121 - protein, 19 aa, Mycobacterium
FGRLRWAQLRDRVFGRTDA

SEQ ID NO: 883122 - protein, 23 aa, Mycobacterium
FGRPLDYQPWIGFPGAIAGEWQG

SEQ ID NO: 883123 - protein, 23 aa, Mycobacterium
FGRPLDYQPWISFPGAIAGEWQG

SEQ ID NO: 883124 - protein, 20 aa, Mycobacterium
FGRPMILKRFVKGIATEAIF

SEQ ID NO: 883125 - protein, 27 aa, Mycobacterium
FGSLRFAVAFCYARFLRRGRKAPGFFV

SEQ ID NO: 883126 - protein, 22 aa, Mycobacterium
FGTHALEYQAISTQLSVFHEQF

SEQ ID NO: 883127 - protein, 23 aa, Mycobacterium
FGTLATWLVFVLNVALGSVDAPG

SEQ ID NO: 883128 - protein, 18 aa, Mycobacterium
FGVLARLAVLPSLTPILL

SEQ ID NO: 883129 - protein, 17 aa, Mycobacterium
FGVPPPDVIRRLGALGL

SEQ ID NO: 883130 - protein, 27 aa, Mycobacterium
FHAFAVQMNLISPLWFAIRAYRQMQTQ

SEQ ID NO: 883131 - protein, 27 aa, Mycobacterium
FHAFAVQMNLISPLWFAIRAYRQMRTQ

SEQ ID NO: 883132 - protein, 19 aa, Mycobacterium
FHAQFERVLAAGAQAYSGA

SEQ ID NO: 883133 - protein, 17 aa, Mycobacterium
FHDLRHYLASLLIARGC

SEQ ID NO: 883134 - protein, 18 aa, Mycobacterium
FHDMGMVGFLTIPMFFGA

SEQ ID NO: 883135 - protein, 17 aa, Mycobacterium
FHDMGMVGFLTIPMYFG

SEQ ID NO: 883136 - protein, 37 aa, Mycobacterium
FHEPFGVVGLIIPWNFPLLLAMWKLAPALAAGNTVVL

SEQ ID NO: 883137 - protein, 22 aa, Mycobacterium
FHGLGLGMLMLTIALGGTVLTH

SEQ ID NO: 883138 - protein, 17 aa, Mycobacterium
FHIYARIAPRWEFRQVR

SEQ ID NO: 883139 - protein, 25 aa, Mycobacterium
FHNNKLPLYFISPTPFNLLGIDRWV

SEQ ID NO: 883140 - protein, 22 aa, Mycobacterium
FHNRRALLDVPRLGPKAFEQCA

SEQ ID NO: 883141 - protein, 18 aa, Mycobacterium
FHQLRRLVVALAATPDAP

SEQ ID NO: 883142 - protein, 18 aa, Mycobacterium
FHRWFSQALSAAAGSYAS

SEQ ID NO: 883143 - protein, 19 aa, Mycobacterium
FHTNAVPLYFISPTPFNLL

SEQ ID NO: 883144 - protein, 19 aa, Mycobacterium
FHYLQSWLLPSLGLRATIF

SEQ ID NO: 883145 - protein, 17 aa, Mycobacterium
FIDLFGPYPLANGYTVV

SEQ ID NO: 883146 - protein, 17 aa, Mycobacterium
FIFLLWQRRRTTLRTRI

SEQ ID NO: 883147 - protein, 17 aa, Mycobacterium
FIGLINALSAFPKPLIC

SEQ ID NO: 883148 - protein, 17 aa, Mycobacterium
FIMLIAENHWRVAEEPV

SEQ ID NO: 883149 - protein, 17 aa, Mycobacterium
FIMLITENHWRVVEQPV

SEQ ID NO: 883150 - protein, 17 aa, Mycobacterium
FIRTCDCYNIPIVLLVD

SEQ ID NO: 883151 - protein, 20 aa, Mycobacterium
FKADVLASALPWLKQLHGKI

SEQ ID NO: 883152 - protein, 17 aa, Mycobacterium
FKALGKPGLYALTRLML

SEQ ID NO: 883153 - protein, 19 aa, Mycobacterium
FKALMAERVPLYRQVATMR

SEQ ID NO: 883154 - protein, 17 aa, Mycobacterium
FKAMFQMKFYGVALFRS

SEQ ID NO: 883155 - protein, 19 aa, Mycobacterium
FKGHLYIAGRIKDLVIIDG

SEQ ID NO: 883156 - protein, 23 aa, Mycobacterium
FKGSWLCLWLHALGAEVTGLALD

SEQ ID NO: 883157 - protein, 23 aa, Mycobacterium
FKPPYLPFATLWNFVSELAAHPL

SEQ ID NO: 883158 - protein, 18 aa, Mycobacterium
FKRLVTDWQLRGGPGGVP

SEQ ID NO: 883159 - protein, 18 aa, Mycobacterium
FKRNIYIHPFLEDDLKGI

SEQ ID NO: 883160 - protein, 26 aa, Mycobacterium
FLADKVVRWWLPERWAFVDQVPRTSV

SEQ ID NO: 883161 - protein, 23 aa, Mycobacterium
FLADPRVRPLPPMPACAVAACTR

SEQ ID NO: 883162 - protein, 17 aa, Mycobacterium
FLALVDYAHKPGALAAV

SEQ ID NO: 883163 - protein, 18 aa, Mycobacterium
FLAVELSSFQLHWAPSVR

SEQ ID NO: 883164 - protein, 27 aa, Mycobacterium
FLDLINAPTQALLGRPLIGNGADGATV

SEQ ID NO: 883165 - protein, 22 aa, Mycobacterium
FLDRSLIGRVPLIGGVLSLLTS

SEQ ID NO: 883166 - protein, 27 aa, Mycobacterium
FLERFHGLYIPILDLPFFGATPANAYP

SEQ ID NO: 883167 - protein, 19 aa, Mycobacterium
FLEYLDMFYNLGLAGRAMR

SEQ ID NO: 883168 - protein, 17 aa, Mycobacterium
FLFRLIPPRADFAQTMT

SEQ ID NO: 883169 - protein, 18 aa, Mycobacterium
FLHIPFPPVELFLQMPWR

SEQ ID NO: 883170 - protein, 17 aa, Mycobacterium
FLHIPFPPVELFMQLPW

SEQ ID NO: 883171 - protein, 18 aa, Mycobacterium
FLHNVMGLWLLSETLRQY

SEQ ID NO: 883172 - protein, 17 aa, Mycobacterium
FLLVGVLAALWERERSG

SEQ ID NO: 883173 - protein, 26 aa, Mycobacterium
FLMDGAFLSVFGVPIQVTLDGRLPEL

SEQ ID NO: 883174 - protein, 23 aa, Mycobacterium
FLMRHRITMLCIPPSLLALMDAE

SEQ ID NO: 883175 - protein, 18 aa, Mycobacterium
FLPEHRVLFSGDLLTRGI

SEQ ID NO: 883176 - protein, 17 aa, Mycobacterium
FLPHVLRYNASLPSKFM

SEQ ID NO: 883177 - protein, 17 aa, Mycobacterium
FLPKIAAGDLHFSIGYS

SEQ ID NO: 883178 - protein, 18 aa, Mycobacterium
FLPLVRRLARFLPADLRV

SEQ ID NO: 883179 - protein, 18 aa, Mycobacterium
FLPNRFRLLVRCARVAAV

SEQ ID NO: 883180 - protein, 17 aa, Mycobacterium
FLPRLILSASTAATGCR

SEQ ID NO: 883181 - protein, 21 aa, Mycobacterium
FLQQGYLMRPIISTLVFGRDP

SEQ ID NO: 883182 - protein, 24 aa, Mycobacterium
FLRAIHEMLLSDAFWDDIFRELGN

SEQ ID NO: 883183 - protein, 26 aa, Mycobacterium
FLREIPQELLNWRRLAPKPSFSAPVS

SEQ ID NO: 883184 - protein, 20 aa, Mycobacterium
FLRLETEGWLRLYPKRGALV

SEQ ID NO: 883185 - protein, 17 aa, Mycobacterium
FLRMPYQRDALARRGVI

SEQ ID NO: 883186 - protein, 19 aa, Mycobacterium
FLRRFSLLDSLYMIPPPRI

SEQ ID NO: 883187 - protein, 24 aa, Mycobacterium
FLRTIHEMLLSDAFWDEIFRELGN

SEQ ID NO: 883188 - protein, 17 aa, Mycobacterium
FLRYRKELDQRAGDGLT

SEQ ID NO: 883189 - protein, 20 aa, Mycobacterium
FLSEPWWCRMLVLSAARTAR

SEQ ID NO: 883190 - protein, 18 aa, Mycobacterium
FLTHLFLMDKLGDLPLYE

SEQ ID NO: 883191 - protein, 17 aa, Mycobacterium
FLTPRDSLRQRCVVHRL

SEQ ID NO: 883192 - protein, 18 aa, Mycobacterium
FLVPPERIHGLVFAGLRA

SEQ ID NO: 883193 - protein, 17 aa, Mycobacterium
FLWCQLFSEPGAGSDLA

SEQ ID NO: 883194 - protein, 17 aa, Mycobacterium
FLYRKRFHKRAETQLTI

SEQ ID NO: 883195 - protein, 17 aa, Mycobacterium
FMFDLKAPGVTVRPIVQ

SEQ ID NO: 883196 - protein, 17 aa, Mycobacterium
FMLKDPIYGLGPRLAQL

SEQ ID NO: 883197 - protein, 18 aa, Mycobacterium
FMRAFRADEWLLYDQSSP

SEQ ID NO: 883198 - protein, 17 aa, Mycobacterium
FMRILRNSQLLDVLLHD

SEQ ID NO: 883199 - protein, 18 aa, Mycobacterium
FMRPFRADEWLLYDQTSP

SEQ ID NO: 883200 - protein, 19 aa, Mycobacterium
FMSYLNLWRYLGEQRRALS

SEQ ID NO: 883201 - protein, 19 aa, Mycobacterium
FMTLAKMRAARQLWARVAE

SEQ ID NO: 883202 - protein, 20 aa, Mycobacterium
FNAMPPLDHRAPGPALALLA

SEQ ID NO: 883203 - protein, 17 aa, Mycobacterium
FNAPYLRDALLSAGALC

SEQ ID NO: 883204 - protein, 18 aa, Mycobacterium
FNDAWMSSYGFLRSRLDG

SEQ ID NO: 883205 - protein, 18 aa, Mycobacterium
FNDFVIVALIRSALYRAA

SEQ ID NO: 883206 - protein, 17 aa, Mycobacterium
FNEVIHYWALDGGWDCF

SEQ ID NO: 883207 - protein, 18 aa, Mycobacterium
FNIPIIMLVDVPGFLPGT

SEQ ID NO: 883208 - protein, 22 aa, Mycobacterium
FNIPIIMLVDVPGFLPGTGQEY

SEQ ID NO: 883209 - protein, 19 aa, Mycobacterium
FNTGFFNWGDRNTGLWNSG

SEQ ID NO: 883210 - protein, 19 aa, Mycobacterium
FNWLEALGFQFERSYYPGK

SEQ ID NO: 883211 - protein, 17 aa, Mycobacterium
FPAWVRFSPLKPSHLDP

SEQ ID NO: 883212 - protein, 28 aa, Mycobacterium
FPGEPWAVPKFYWSVFSTRAFEAGLAAL

SEQ ID NO: 883213 - protein, 22 aa, Mycobacterium
FPGEQEILFPAGSKFYVISKTV

SEQ ID NO: 883214 - protein, 23 aa, Mycobacterium
FPGEQEILFPAGSKFYVVNKTID

SEQ ID NO: 883215 - protein, 17 aa, Mycobacterium
FPGLYLLITGTPAFFEG

SEQ ID NO: 883216 - protein, 20 aa, Mycobacterium
FPGQWWGPASWRRKPHRSRG

SEQ ID NO: 883217 - protein, 17 aa, Mycobacterium
FPGVFRGALDAGARRIT

SEQ ID NO: 883218 - protein, 18 aa, Mycobacterium
FPGWIRLATKMSGKFKAS

SEQ ID NO: 883219 - protein, 20 aa, Mycobacterium
FPLDHVGGLVMFHIRDVWLR

SEQ ID NO: 883220 - protein, 19 aa, Mycobacterium
FPLRSGFEFFLRKGLQLGL

SEQ ID NO: 883221 - protein, 25 aa, Mycobacterium
FPNCAQWLIAWLAAARIGALTVPLS

SEQ ID NO: 883222 - protein, 17 aa, Mycobacterium
FPNLPSWISLRLLENRT

SEQ ID NO: 883223 - protein, 19 aa, Mycobacterium
FPPDDFPLYFYRKPSAPDL

SEQ ID NO: 883224 - protein, 21 aa, Mycobacterium
FPPTAKPMFLVPAIPSAEGGH

SEQ ID NO: 883225 - protein, 20 aa, Mycobacterium
FPQIAQFYRRKFRHILVDEY

SEQ ID NO: 883226 - protein, 17 aa, Mycobacterium
FPRVVPVGFYWTGERIV

SEQ ID NO: 883227 - protein, 17 aa, Mycobacterium
FPRYHPRWAWWLTGVPV

SEQ ID NO: 883228 - protein, 19 aa, Mycobacterium
FPSPWLLVVAALLAQAEGA

SEQ ID NO: 883229 - protein, 20 aa, Mycobacterium
FPTLIDLYLQGRLPLDKFVS

SEQ ID NO: 883230 - protein, 18 aa, Mycobacterium
FPVFFIQDGIKFPDFVHA

SEQ ID NO: 883231 - protein, 19 aa, Mycobacterium
FPVSQFLKFGPHAAAGGLG

SEQ ID NO: 883232 - protein, 19 aa, Mycobacterium
FPYAWPRKPVLAENVVCTS

SEQ ID NO: 883233 - protein, 23 aa, Mycobacterium
FPYPVTVGYMYILKLHHLVDDKI

SEQ ID NO: 883234 - protein, 19 aa, Mycobacterium
FPYSWNPRYPARIGVMPRD

SEQ ID NO: 883235 - protein, 17 aa, Mycobacterium
FQAILGRPLIGDGADGI

SEQ ID NO: 883236 - protein, 23 aa, Mycobacterium
FQDPRLLPWRTVMANLGFVQHER

SEQ ID NO: 883237 - protein, 21 aa, Mycobacterium
FQHFNLFPHMTVIDNITLAPL

SEQ ID NO: 883238 - protein, 24 aa, Mycobacterium
FQHFNLFPHRSVLANVALAPRRLR

SEQ ID NO: 883239 - protein, 21 aa, Mycobacterium
FQHFNLFPHRTVLDNVALAPR

SEQ ID NO: 883240 - protein, 26 aa, Mycobacterium
FQHTSEALTPLLWVPGVAAELAEAAS

SEQ ID NO: 883241 - protein, 17 aa, Mycobacterium
FQIDLTWRTICNGFTIV

SEQ ID NO: 883242 - protein, 18 aa, Mycobacterium
FQIGRWQYRDLIREQIHP

SEQ ID NO: 883243 - protein, 18 aa, Mycobacterium
FQLAFTRVGLMPDGGASA

SEQ ID NO: 883244 - protein, 19 aa, Mycobacterium
FQLFMDRLYRVLLSDAGLD

SEQ ID NO: 883245 - protein, 19 aa, Mycobacterium
FQLRRPLFEPLPGTLPEPE

SEQ ID NO: 883246 - protein, 23 aa, Mycobacterium
FQNPRLLPWRRALANVTFALRDG

SEQ ID NO: 883247 - protein, 19 aa, Mycobacterium
FQQFNLFPHRSVLDNVTLG

SEQ ID NO: 883248 - protein, 22 aa, Mycobacterium
FQQPRLFPWRTVGGNIDLALKY

SEQ ID NO: 883249 - protein, 17 aa, Mycobacterium
FQRAALLEWRSVRKNIL

SEQ ID NO: 883250 - protein, 24 aa, Mycobacterium
FQRTPIWVFPKPDMEIKSVGRWVL

SEQ ID NO: 883251 - protein, 23 aa, Mycobacterium
FRAGHFPGLQWPLTLGHEIAGAV

SEQ ID NO: 883252 - protein, 17 aa, Mycobacterium
FRDTLIMAYQWPADRQS

SEQ ID NO: 883253 - protein, 17 aa, Mycobacterium
FRELLFNPETLPDLLRF

SEQ ID NO: 883254 - protein, 18 aa, Mycobacterium
FRERWFSWANPAETMLAY

SEQ ID NO: 883255 - protein, 17 aa, Mycobacterium
FRFIAFPIPVADFSGAL

SEQ ID NO: 883256 - protein, 20 aa, Mycobacterium
FRFPTFVGAFKYYTSYTLKT

SEQ ID NO: 883257 - protein, 21 aa, Mycobacterium
FRGAQVPIIWLNWGTRSDRAN

SEQ ID NO: 883258 - protein, 26 aa, Mycobacterium
FRIDPVLARSWLLVNGAQYERFAPAS

SEQ ID NO: 883259 - protein, 18 aa, Mycobacterium
FRLALPRVMLRFAGGREI

SEQ ID NO: 883260 - protein, 17 aa, Mycobacterium
FRMWLRDAVRRVADGCL

SEQ ID NO: 883261 - protein, 22 aa, Mycobacterium
FRNRKALLDVPRLGPKAFEQCA

SEQ ID NO: 883262 - protein, 19 aa, Mycobacterium
FRPLVFDGLFLQLPIGSVD

SEQ ID NO: 883263 - protein, 17 aa, Mycobacterium
FRQLLAGRDFAVNDMIA

SEQ ID NO: 883264 - protein, 21 aa, Mycobacterium
FRQLLPPPIREIPLLLGGSGE

SEQ ID NO: 883265 - protein, 17 aa, Mycobacterium
FRQTRYWPRLRAAGGAP

SEQ ID NO: 883266 - protein, 19 aa, Mycobacterium
FRRAVPPVPAPTARRASRR

SEQ ID NO: 883267 - protein, 27 aa, Mycobacterium
FRRDHVGFIFQFFNLIPTLTAKENVEV

SEQ ID NO: 883268 - protein, 23 aa, Mycobacterium
FRRSPWVGWSELFRVLVRLLGAG

SEQ ID NO: 883269 - protein, 18 aa, Mycobacterium
FRSTPIPVCLWFFDTDKG

SEQ ID NO: 883270 - protein, 20 aa, Mycobacterium
FRSWYIMYFQLPVAPEHSAS

SEQ ID NO: 883271 - protein, 17 aa, Mycobacterium
FRTTPYLPLSWQRKAVQ

SEQ ID NO: 883272 - protein, 23 aa, Mycobacterium
FRTVPMVWYIPPLSPVVDAIGRD

SEQ ID NO: 883273 - protein, 17 aa, Mycobacterium
FSAPYLRDSLLAAGALC

SEQ ID NO: 883274 - protein, 24 aa, Mycobacterium
FSDAALVLGFERRSWRTNSGPHGV

SEQ ID NO: 883275 - protein, 18 aa, Mycobacterium
FSDGFFLTKRDMDWFMDH

SEQ ID NO: 883276 - protein, 17 aa, Mycobacterium
FSEEYLAPVWPLERVKQ

SEQ ID NO: 883277 - protein, 18 aa, Mycobacterium
FSFGIANPGFWNVGSANI

SEQ ID NO: 883278 - protein, 17 aa, Mycobacterium
FSFGLWTIGWNGNDPFG

SEQ ID NO: 883279 - protein, 17 aa, Mycobacterium
FSIPAWSARIGFQMLDP

SEQ ID NO: 883280 - protein, 17 aa, Mycobacterium
FSKYFAMTGWRLGWLLV

SEQ ID NO: 883281 - protein, 25 aa, Mycobacterium
FSKYPTFLHSFAPMPFKPVARDGKP

SEQ ID NO: 883282 - protein, 19 aa, Mycobacterium
FSLAMLPGGRRRASVVGSV

SEQ ID NO: 883283 - protein, 21 aa, Mycobacterium
FSPLPRIFYTAAVSDLFINPV

SEQ ID NO: 883284 - protein, 17 aa, Mycobacterium
FSTAITGGLFFAPAADF

SEQ ID NO: 883285 - protein, 17 aa, Mycobacterium
FSVLLLPGPVPTPVVAF

SEQ ID NO: 883286 - protein, 19 aa, Mycobacterium
FSWPGVHYLSGFYGPLERA

SEQ ID NO: 883287 - protein, 19 aa, Mycobacterium
FTAFPKQIWRQIWSNNPLS

SEQ ID NO: 883288 - protein, 18 aa, Mycobacterium
FTARPWCLGWHWCGWLEN

SEQ ID NO: 883289 - protein, 19 aa, Mycobacterium
FTAVHPVWLRELAKRWCRW

SEQ ID NO: 883290 - protein, 17 aa, Mycobacterium
FTEVLTRLPHVLFDVRI

SEQ ID NO: 883291 - protein, 17 aa, Mycobacterium
FTFMTPAAFVRRPGRWI

SEQ ID NO: 883292 - protein, 18 aa, Mycobacterium
FTFMTPAAFVRRPGRWIR

SEQ ID NO: 883293 - protein, 29 aa, Mycobacterium
FTGLSARRIPLPTYAFVRRRFWLSSDSVG

SEQ ID NO: 883294 - protein, 34 aa, Mycobacterium
FTIDSLPLEVFLPFAPFYILYDFGPVTVDATTYD

SEQ ID NO: 883295 - protein, 18 aa, Mycobacterium
FTLGFRFKPWRSAKSIAD

SEQ ID NO: 883296 - protein, 20 aa, Mycobacterium
FTLPSLFGVGLMPSFQLGTA

SEQ ID NO: 883297 - protein, 19 aa, Mycobacterium
FTNDYEWDLLLSKTGWTEA

SEQ ID NO: 883298 - protein, 18 aa, Mycobacterium
FTNDYEWELLLSKTGWSE

SEQ ID NO: 883299 - protein, 17 aa, Mycobacterium
FTPFTLIQLEELGFCGR

SEQ ID NO: 883300 - protein, 19 aa, Mycobacterium
FTPPVGLMFVLWDTDETIT

SEQ ID NO: 883301 - protein, 17 aa, Mycobacterium
FTRGSAMGARTTCPART

SEQ ID NO: 883302 - protein, 18 aa, Mycobacterium
FTWSFFIEPSLGFTRHLK

SEQ ID NO: 883303 - protein, 19 aa, Mycobacterium
FTYVVGWPHLWRAYKKFSD

SEQ ID NO: 883304 - protein, 18 aa, Mycobacterium
FVAFVGAALEYKAGERLP

SEQ ID NO: 883305 - protein, 19 aa, Mycobacterium
FVAGWLGPAILYPRLARAV

SEQ ID NO: 883306 - protein, 19 aa, Mycobacterium
FVAKLLARKTPPKGAAIFV

SEQ ID NO: 883307 - protein, 18 aa, Mycobacterium
FVDFIRALSEEQVFFPPT

SEQ ID NO: 883308 - protein, 18 aa, Mycobacterium
FVDRSLLDVVWPLVGRFT

SEQ ID NO: 883309 - protein, 19 aa, Mycobacterium
FVIPPLVFPLRRSLEAGIG

SEQ ID NO: 883310 - protein, 17 aa, Mycobacterium
FVIVRPAPAGTRLLLSD

SEQ ID NO: 883311 - protein, 19 aa, Mycobacterium
FVKFHWKPRLGVHSLIWDE

SEQ ID NO: 883312 - protein, 17 aa, Mycobacterium
FVKWYSQSQAERFNARG

SEQ ID NO: 883313 - protein, 17 aa, Mycobacterium
FVLAPVADWQREIYSLV

SEQ ID NO: 883314 - protein, 17 aa, Mycobacterium
FVLDEWLHPVPAGVTGE

SEQ ID NO: 883315 - protein, 17 aa, Mycobacterium
FVLDGWLRPVPVGVVGE

SEQ ID NO: 883316 - protein, 23 aa, Mycobacterium
FVLQFPLWWYSVPAILKGWIDRV

SEQ ID NO: 883317 - protein, 17 aa, Mycobacterium
FVLVFDKAALSGDGPIN

SEQ ID NO: 883318 - protein, 19 aa, Mycobacterium
FVNALRPIEWRYTNDPAWV

SEQ ID NO: 883319 - protein, 21 aa, Mycobacterium
FVNPHDIVLFPAWSRRMPFGP

SEQ ID NO: 883320 - protein, 19 aa, Mycobacterium
FVPFTELALPLTATGHHDG

SEQ ID NO: 883321 - protein, 17 aa, Mycobacterium
FVPILRVTAIEPGAVTL

SEQ ID NO: 883322 - protein, 17 aa, Mycobacterium
FVPLPFVHQSSPLYLAG

SEQ ID NO: 883323 - protein, 21 aa, Mycobacterium
FVPLRIHVLVRFGRWDDLIAE

SEQ ID NO: 883324 - protein, 20 aa, Mycobacterium
FVPRRFRLMLTASGVNRFAG

SEQ ID NO: 883325 - protein, 17 aa, Mycobacterium
FVPSLKPVNRRATELLL

SEQ ID NO: 883326 - protein, 17 aa, Mycobacterium
FVPYFLGQRTPPWNRAT

SEQ ID NO: 883327 - protein, 17 aa, Mycobacterium
FVPYSPLGRGFLTGTVR

SEQ ID NO: 883328 - protein, 18 aa, Mycobacterium
FVQLMATSAGRYATAEAA

SEQ ID NO: 883329 - protein, 17 aa, Mycobacterium
FVQLVASNVLGLNAPAI

SEQ ID NO: 883330 - protein, 20 aa, Mycobacterium
FVQLVRSNFFGFNAPAIMAA

SEQ ID NO: 883331 - protein, 17 aa, Mycobacterium
FVRLVLSNVFGQNAPAI

SEQ ID NO: 883332 - protein, 20 aa, Mycobacterium
FVRQFPFNLLLKDVDRRIRT

SEQ ID NO: 883333 - protein, 24 aa, Mycobacterium
FVSTYGWRAYALPALVALTAVVVY

SEQ ID NO: 883334 - protein, 28 aa, Mycobacterium
FVTKDRWSMEWYYPILGGALRGPRAQAR

SEQ ID NO: 883335 - protein, 17 aa, Mycobacterium
FVVLRWLDNPSPPEVTV

SEQ ID NO: 883336 - protein, 23 aa, Mycobacterium
FVVNFLLVPYLLAAIRMAESGFA

SEQ ID NO: 883337 - protein, 17 aa, Mycobacterium
FVVQPRRFPGGSIGALA

SEQ ID NO: 883338 - protein, 17 aa, Mycobacterium
FVWPWLVGRRQVVVSSY

SEQ ID NO: 883339 - protein, 17 aa, Mycobacterium
FWDKLSGAMFRLAGALG

SEQ ID NO: 883340 - protein, 25 aa, Mycobacterium
FWFDPLCPWAWITSRWILEVEKVRD

SEQ ID NO: 883341 - protein, 24 aa, Mycobacterium
FWFDPLCPWAWITSRWVLEAEKVR

SEQ ID NO: 883342 - protein, 18 aa, Mycobacterium
FWPAPLPFSLLHVDTGHN

SEQ ID NO: 883343 - protein, 24 aa, Mycobacterium
FWTEKLPVLPVLQALFVGGKKLAP

SEQ ID NO: 883344 - protein, 19 aa, Mycobacterium
FYENVLGFRFWWELDPPDG

SEQ ID NO: 883345 - protein, 19 aa, Mycobacterium
FYGDLYSYNRFRCSRLGSG

SEQ ID NO: 883346 - protein, 20 aa, Mycobacterium
FYGLNYWYPFQVTALGLGPI

SEQ ID NO: 883347 - protein, 17 aa, Mycobacterium
FYGPQFALTFPVLTHHG

SEQ ID NO: 883348 - protein, 18 aa, Mycobacterium
FYIAIGGIPPRQGRMPLG

SEQ ID NO: 883349 - protein, 25 aa, Mycobacterium
FYKWTQWIFLQIYNAWFDAAANKAR

SEQ ID NO: 883350 - protein, 20 aa, Mycobacterium
FYKWTQWIFLQIYNAWYDEQ

SEQ ID NO: 883351 - protein, 25 aa, Mycobacterium
FYNNDPLWYAWPNHMKLFFNNKGVV

SEQ ID NO: 883352 - protein, 24 aa, Mycobacterium
FYPRSPYAVAKLYSYWITKNYREA

SEQ ID NO: 883353 - protein, 19 aa, Mycobacterium
FYSGFYLPMYWSSRAKLTN

SEQ ID NO: 883354 - protein, 18 aa, Mycobacterium
FYVLLADGTLRVGGMLFS

SEQ ID NO: 883355 - protein, 18 aa, Mycobacterium
GAAALWFALDTDLPVIVD

SEQ ID NO: 883356 - protein, 17 aa, Mycobacterium
GAAFYRDQYRRTAAGWR

SEQ ID NO: 883357 - protein, 17 aa, Mycobacterium
GAAFYRDTYRRTTDGWK

SEQ ID NO: 883358 - protein, 23 aa, Mycobacterium
GAAGGAGGLLWGNGGNGGSGAAG

SEQ ID NO: 883359 - protein, 18 aa, Mycobacterium
GAAGWLYGAGGSGGAGGA

SEQ ID NO: 883360 - protein, 22 aa, Mycobacterium
GAAHFLEHLLFKATPTRTAVQI

SEQ ID NO: 883361 - protein, 22 aa, Mycobacterium
GAAHFLEHLLFKSTPTRSAADI

SEQ ID NO: 883362 - protein, 23 aa, Mycobacterium
GAAHFLEHLLFKSTPTRSAVDIA

SEQ ID NO: 883363 - protein, 23 aa, Mycobacterium
GAAHFLEHLLFKSTPTRTAVDIA

SEQ ID NO: 883364 - protein, 23 aa, Mycobacterium
GAAIGLLDLLLASGGDLVTVLLG

SEQ ID NO: 883365 - protein, 23 aa, Mycobacterium
GAAIGLLDLLLASGGDLVTVLVG

SEQ ID NO: 883366 - protein, 20 aa, Mycobacterium
GAALALPVLRAAVATLSSMA

SEQ ID NO: 883367 - protein, 17 aa, Mycobacterium
GAALFVLVFAKGAFPAE

SEQ ID NO: 883368 - protein, 18 aa, Mycobacterium
GAAPLITAVVPPAADPVS

SEQ ID NO: 883369 - protein, 26 aa, Mycobacterium
GAAPMPLPLLHRALATWPDTKFVQVY

SEQ ID NO: 883370 - protein, 25 aa, Mycobacterium
GAAPMPLPLLHRALSTWPDTRFVQV

SEQ ID NO: 883371 - protein, 20 aa, Mycobacterium
GAAQFFLLLVGPRKMRTALI

SEQ ID NO: 883372 - protein, 19 aa, Mycobacterium
GAARLFGIGGAGGAGGHGV

SEQ ID NO: 883373 - protein, 18 aa, Mycobacterium
GAARLWGTGGHGGSGGAG

SEQ ID NO: 883374 - protein, 20 aa, Mycobacterium
GADARYLWPSMFARVADEYD

SEQ ID NO: 883375 - protein, 17 aa, Mycobacterium
GADLRALSLPVLRSWLA

SEQ ID NO: 883376 - protein, 17 aa, Mycobacterium
GADPWGWVLGGGEDHAL

SEQ ID NO: 883377 - protein, 25 aa, Mycobacterium
GADTVLVLPFDVAIPGGFPGTARSF

SEQ ID NO: 883378 - protein, 19 aa, Mycobacterium
GAELLLGTRRLAGGSSTSL

SEQ ID NO: 883379 - protein, 23 aa, Mycobacterium
GAELVLPHRWLQPGALVAIIEDT

SEQ ID NO: 883380 - protein, 34 aa, Mycobacterium
GAESDALLVQPAHTLSQAWITSPLGQVVDPVINA

SEQ ID NO: 883381 - protein, 25 aa, Mycobacterium
GAETPVWTFLGPRPAHWWVRRRLHE

SEQ ID NO: 883382 - protein, 19 aa, Mycobacterium
GAEWLVIRALSDLAGEDSR

SEQ ID NO: 883383 - protein, 17 aa, Mycobacterium
GAFAARLWLPMLRAERD

SEQ ID NO: 883384 - protein, 28 aa, Mycobacterium
GAFEPGTPWLLRFFDQINWYPVSGEELL

SEQ ID NO: 883385 - protein, 20 aa, Mycobacterium
GAFLLFDHDWAPPAAKLRSY

SEQ ID NO: 883386 - protein, 25 aa, Mycobacterium
GAFSYSHVLWLLLLSMGFGSRLHLF

SEQ ID NO: 883387 - protein, 17 aa, Mycobacterium
GAFWANDLLWLMDTRYL

SEQ ID NO: 883388 - protein, 20 aa, Mycobacterium
GAGDGFARYWLHNGWVTMGG

SEQ ID NO: 883389 - protein, 18 aa, Mycobacterium
GAGFLSRFPGRVLNSHPA

SEQ ID NO: 883390 - protein, 20 aa, Mycobacterium
GAGGFGVFPGGQTGQNGTDG

SEQ ID NO: 883391 - protein, 19 aa, Mycobacterium
GAGGLLFGPGGVGGAGGAS

SEQ ID NO: 883392 - protein, 18 aa, Mycobacterium
GAGGLLWGNGGNGGSGAA

SEQ ID NO: 883393 - protein, 23 aa, Mycobacterium
GAGGRGGWLIGTGGAGGLGGVGG

SEQ ID NO: 883394 - protein, 30 aa, Mycobacterium
GAGGTGLPGVPPPFGSGDYLAGSGGNGGNA

SEQ ID NO: 883395 - protein, 18 aa, Mycobacterium
GAGGWAGLIGAGGAGGVG

SEQ ID NO: 883396 - protein, 20 aa, Mycobacterium
GAGGWLYGNGGIGGQGGAGA

SEQ ID NO: 883397 - protein, 25 aa, Mycobacterium
GAGHPILYVAQMWDWIFPLGDTPDY

SEQ ID NO: 883398 - protein, 21 aa, Mycobacterium
GAGLWPLLALLASAADDPAGA

SEQ ID NO: 883399 - protein, 30 aa, Mycobacterium
GAGPLYYPRFLTELPYLGQALLLGIPGPSS

SEQ ID NO: 883400 - protein, 24 aa, Mycobacterium
GAGPPPPMLWRVVELFVGDLWPNG

SEQ ID NO: 883401 - protein, 19 aa, Mycobacterium
GAIFHHFRDKDTLFFELAR

SEQ ID NO: 883402 - protein, 23 aa, Mycobacterium
GAIIRDLDLLRPIYAPTAAYGHF

SEQ ID NO: 883403 - protein, 17 aa, Mycobacterium
GAIRLVIQVLPRLDGFG

SEQ ID NO: 883404 - protein, 28 aa, Mycobacterium
GAITPWNFPLGLAMWKIAPALLAGNTVV

SEQ ID NO: 883405 - protein, 29 aa, Mycobacterium
GAITPWNSPLLLLTWKLAAGLAAGCTFVV

SEQ ID NO: 883406 - protein, 21 aa, Mycobacterium
GAKAWLGTALALKPLLRIDDG

SEQ ID NO: 883407 - protein, 23 aa, Mycobacterium
GAKGPVLLWPDTFTNYLAPEVGR

SEQ ID NO: 883408 - protein, 18 aa, Mycobacterium
GAKTWITNARRSGLIALL

SEQ ID NO: 883409 - protein, 23 aa, Mycobacterium
GALDDWCYELAWPARPAPDTETS

SEQ ID NO: 883410 - protein, 18 aa, Mycobacterium
GALGFRYDTGLYLQFRAA

SEQ ID NO: 883411 - protein, 30 aa, Mycobacterium
GALLFPGARGWITYLWVPPFASEKVRRRLR

SEQ ID NO: 883412 - protein, 17 aa, Mycobacterium
GALLLPYRMFLAAAEEL

SEQ ID NO: 883413 - protein, 20 aa, Mycobacterium
GALLLRREIACVPLLHGGGH

SEQ ID NO: 883414 - protein, 25 aa, Mycobacterium
GALLPPALKWRLFFASQGKNPKYLH

SEQ ID NO: 883415 - protein, 19 aa, Mycobacterium
GALLQFRRDLWPLIAREVE

SEQ ID NO: 883416 - protein, 18 aa, Mycobacterium
GALRRYHEALGVPISTLP

SEQ ID NO: 883417 - protein, 25 aa, Mycobacterium
GALVFWRLIALFRPVTSEYLDRVAR

SEQ ID NO: 883418 - protein, 25 aa, Mycobacterium
GALVVFEVMVRPLIRLALGRRQSQR

SEQ ID NO: 883419 - protein, 17 aa, Mycobacterium
GAMGFKFQFITLAGFHA

SEQ ID NO: 883420 - protein, 20 aa, Mycobacterium
GAMGFKFQFITLAGFHALNY

SEQ ID NO: 883421 - protein, 18 aa, Mycobacterium
GAMYRIATLAVLRAGADL

SEQ ID NO: 883422 - protein, 19 aa, Mycobacterium
GAMYRMVTLAVLRAGIDPA

SEQ ID NO: 883423 - protein, 25 aa, Mycobacterium
GANGLLGGGWGPFGGASGGAGGAGG

SEQ ID NO: 883424 - protein, 17 aa, Mycobacterium
GANLRVFYALHRRYRPG

SEQ ID NO: 883425 - protein, 23 aa, Mycobacterium
GANPCLLTPPPWYPILRGTTQQA

SEQ ID NO: 883426 - protein, 25 aa, Mycobacterium
GANTGINGIALAPAGPGGTGGGGGS

SEQ ID NO: 883427 - protein, 18 aa, Mycobacterium
GAPAFWYQPSRNGAPPVT

SEQ ID NO: 883428 - protein, 30 aa, Mycobacterium
GAPAGWGWVAPYIGMIWPNGDPAKLRAAAA

SEQ ID NO: 883429 - protein, 29 aa, Mycobacterium
GAPAGWSWVAPYIGMIWPTGDSAKLRAAA

SEQ ID NO: 883430 - protein, 25 aa, Mycobacterium
GAPALRMQLLWYPATTWDTSLPSFA

SEQ ID NO: 883431 - protein, 19 aa, Mycobacterium
GAPAQFGSTGFAGGDGGAG

SEQ ID NO: 883432 - protein, 17 aa, Mycobacterium
GAPFHRLCFGLAAGGVG

SEQ ID NO: 883433 - protein, 18 aa, Mycobacterium
GAPGLRLALALPPIEVAV

SEQ ID NO: 883434 - protein, 19 aa, Mycobacterium
GAPLLFYLDAGIPPLSAMA

SEQ ID NO: 883435 - protein, 24 aa, Mycobacterium
GAQEILLPALLPRGPYETTNRWTE

SEQ ID NO: 883436 - protein, 23 aa, Mycobacterium
GAQWDAALGYWQQLRTDPGAVFD

SEQ ID NO: 883437 - protein, 21 aa, Mycobacterium
GARLLVLRRLAYPDDARLGPS

SEQ ID NO: 883438 - protein, 22 aa, Mycobacterium
GARPWLPHFYLGHGIGVNAAEM

SEQ ID NO: 883439 - protein, 26 aa, Mycobacterium
GASAFNGFLNLAIGLTDGVMASAGPG

SEQ ID NO: 883440 - protein, 21 aa, Mycobacterium
GASAIPLGPDLIGKGGAGGAG

SEQ ID NO: 883441 - protein, 17 aa, Mycobacterium
GASALICIRPHTLSIVG

SEQ ID NO: 883442 - protein, 23 aa, Mycobacterium
GASGPLYGTFFLRMAPALGTDDT

SEQ ID NO: 883443 - protein, 17 aa, Mycobacterium
GASLLFGNGGAGGLGGG

SEQ ID NO: 883444 - protein, 23 aa, Mycobacterium
GASPAYWYRAVLWNVLMSADQTL

SEQ ID NO: 883445 - protein, 24 aa, Mycobacterium
GASSDIWKNIFWLQQRPGISTAEE

SEQ ID NO: 883446 - protein, 23 aa, Mycobacterium
GASTWLEPLIWRGFENLNIPLLD

SEQ ID NO: 883447 - protein, 17 aa, Mycobacterium
GASYFVLVFAKGAFPAE

SEQ ID NO: 883448 - protein, 18 aa, Mycobacterium
GATFRVESAVKARWQTPA

SEQ ID NO: 883449 - protein, 20 aa, Mycobacterium
GATKMWMARLYPTYQRNTCL

SEQ ID NO: 883450 - protein, 18 aa, Mycobacterium
GATVGPFTYLRPGTNLGA

SEQ ID NO: 883451 - protein, 21 aa, Mycobacterium
GATWSRWGEPLLPIGVLYDPF

SEQ ID NO: 883452 - protein, 25 aa, Mycobacterium
GAVALILLGIRRYGFARPPLLGSTS

SEQ ID NO: 883453 - protein, 25 aa, Mycobacterium
GAVIYFLRKVIWFLPDFTVECYHDQ

SEQ ID NO: 883454 - protein, 17 aa, Mycobacterium
GAVRLVLALLPHWRERK

SEQ ID NO: 883455 - protein, 20 aa, Mycobacterium
GAVVYFLRKLIWTVPDFTAE

SEQ ID NO: 883456 - protein, 22 aa, Mycobacterium
GAVWSGWYRWGLRRRTRRVDHP

SEQ ID NO: 883457 - protein, 19 aa, Mycobacterium
GAYAPLPWLPDEVTKQIVD

SEQ ID NO: 883458 - protein, 20 aa, Mycobacterium
GAYAPLPWLPDSVTTQIVDE

SEQ ID NO: 883459 - protein, 19 aa, Mycobacterium
GAYLFGWDPLLQPGLPEAT

SEQ ID NO: 883460 - protein, 21 aa, Mycobacterium
GAYTQLPFKLAWAITIHKSQG

SEQ ID NO: 883461 - protein, 18 aa, Mycobacterium
GCAARRVLALLPQRIPLA

SEQ ID NO: 883462 - protein, 27 aa, Mycobacterium
GCILVFHIMPFWYFNAISPAWGQNSDP

SEQ ID NO: 883463 - protein, 18 aa, Mycobacterium
GCLAGWLSTEFPPHVLTG

SEQ ID NO: 883464 - protein, 17 aa, Mycobacterium
GCPFAPPPGVMALAEAR

SEQ ID NO: 883465 - protein, 20 aa, Mycobacterium
GCSSRFPYYLETYGFHSIHG

SEQ ID NO: 883466 - protein, 18 aa, Mycobacterium
GCSWLPLYHDMGLSFLLA

SEQ ID NO: 883467 - protein, 17 aa, Mycobacterium
GCTPLGPVGWAQGLGSA

SEQ ID NO: 883468 - protein, 25 aa, Mycobacterium
GDAEELLWLQAPPPATGSGTSGSTS

SEQ ID NO: 883469 - protein, 24 aa, Mycobacterium
GDAQAWYRILLYGPMHNPVIDVGV

SEQ ID NO: 883470 - protein, 24 aa, Mycobacterium
GDARSELWFFYHLGRILREKLAGS

SEQ ID NO: 883471 - protein, 24 aa, Mycobacterium
GDARSELWFFYHLGRKLREKLAGS

SEQ ID NO: 883472 - protein, 24 aa, Mycobacterium
GDARSELWFFYHLGRKLREKLSGS

SEQ ID NO: 883473 - protein, 24 aa, Mycobacterium
GDARSELWFFYHLGRRLRDKLGGS

SEQ ID NO: 883474 - protein, 23 aa, Mycobacterium
GDATRLLYTLGWHEVAVPPVAGE

SEQ ID NO: 883475 - protein, 24 aa, Mycobacterium
GDATRLLYTLGWHEVPPPASEEAG

SEQ ID NO: 883476 - protein, 25 aa, Mycobacterium
GDATRLLYTLGWHEVPPPPSADDAV

SEQ ID NO: 883477 - protein, 18 aa, Mycobacterium
GDCDQLMPEYLRFVKGVV

SEQ ID NO: 883478 - protein, 23 aa, Mycobacterium
GDCPSFITVIPDPNAKRLKHIPD

SEQ ID NO: 883479 - protein, 24 aa, Mycobacterium
GDERPFFAYLPFQAPHWPLQAPDE

SEQ ID NO: 883480 - protein, 22 aa, Mycobacterium
GDFLFAALHRAGLANQAVCVDA

SEQ ID NO: 883481 - protein, 29 aa, Mycobacterium
GDGGAFDDGFFLIFGDPGIDGDPGGPPDG

SEQ ID NO: 883482 - protein, 21 aa, Mycobacterium
GDGGLAPGAMFGNGGHGGTGG

SEQ ID NO: 883483 - protein, 24 aa, Mycobacterium
GDGGRGFGIGKGGFGGGGGSAGLT

SEQ ID NO: 883484 - protein, 18 aa, Mycobacterium
GDGVLYWQVPRTATLDSA

SEQ ID NO: 883485 - protein, 19 aa, Mycobacterium
GDGWFWPNAAAHPSLPRGA

SEQ ID NO: 883486 - protein, 21 aa, Mycobacterium
GDIPWNLIWALLKEVAEAYLA

SEQ ID NO: 883487 - protein, 18 aa, Mycobacterium
GDITLGERLILSSGFVAV

SEQ ID NO: 883488 - protein, 19 aa, Mycobacterium
GDITLGERLILSSGFVAVT

SEQ ID NO: 883489 - protein, 17 aa, Mycobacterium
GDIWWRREFYEARNANG

SEQ ID NO: 883490 - protein, 23 aa, Mycobacterium
GDLALAQLRRALPKALFVSAHTG

SEQ ID NO: 883491 - protein, 22 aa, Mycobacterium
GDLELELFRYGLKASLNGYLGA

SEQ ID NO: 883492 - protein, 17 aa, Mycobacterium
GDLFGGLFGQRAQPRAS

SEQ ID NO: 883493 - protein, 20 aa, Mycobacterium
GDLFWCQLFSEPGAGSDLAA

SEQ ID NO: 883494 - protein, 17 aa, Mycobacterium
GDLKWFLRALPAVIEDY

SEQ ID NO: 883495 - protein, 21 aa, Mycobacterium
GDLPAFAELLSRLPWPLNKTT

SEQ ID NO: 883496 - protein, 18 aa, Mycobacterium
GDMGLALPILAPGGVASA

SEQ ID NO: 883497 - protein, 18 aa, Mycobacterium
GDMGLSLPILAPGGVAAA

SEQ ID NO: 883498 - protein, 23 aa, Mycobacterium
GDPGLMALFRRLAADRLKVVAGD

SEQ ID NO: 883499 - protein, 23 aa, Mycobacterium
GDPVALRRVLPSPATLVVKDGAR

SEQ ID NO: 883500 - protein, 22 aa, Mycobacterium
GDPWPVLRRWAATQPRAAIVER

SEQ ID NO: 883501 - protein, 23 aa, Mycobacterium
GDRDVVLVFFPLAFTGICQRELD

SEQ ID NO: 883502 - protein, 20 aa, Mycobacterium
GDRFPLMPIPSWMDNPIDPI

SEQ ID NO: 883503 - protein, 23 aa, Mycobacterium
GDRIAFFYYFGVERFSPDGDAYA

SEQ ID NO: 883504 - protein, 23 aa, Mycobacterium
GDRRRWYLRLIPQVLDSMCTTSP

SEQ ID NO: 883505 - protein, 25 aa, Mycobacterium
GDSGFPMLPPLMPPPISAGSGWRKR

SEQ ID NO: 883506 - protein, 23 aa, Mycobacterium
GDSPPHFAPLPDTGPYQLPERAQ

SEQ ID NO: 883507 - protein, 24 aa, Mycobacterium
GDVDEELLLRLKAWRLDVAKEQKV

SEQ ID NO: 883508 - protein, 29 aa, Mycobacterium
GDVRGLRGWIRLFANLPAKRLRILALLDP

SEQ ID NO: 883509 - protein, 17 aa, Mycobacterium
GDVVVLWLPSGIDYATC

SEQ ID NO: 883510 - protein, 18 aa, Mycobacterium
GDWRQWWRWVPGACWRHP

SEQ ID NO: 883511 - protein, 17 aa, Mycobacterium
GDYFALALALEELGKVD

SEQ ID NO: 883512 - protein, 17 aa, Mycobacterium
GDYFALCLTLEELARAD

SEQ ID NO: 883513 - protein, 18 aa, Mycobacterium
GDYFPFVFNIRDWNVIMS

SEQ ID NO: 883514 - protein, 23 aa, Mycobacterium
GEAEFLPLLRRLGRFLPTDVRVV

SEQ ID NO: 883515 - protein, 19 aa, Mycobacterium
GEAHWFFRGLLGDSSLFVL

SEQ ID NO: 883516 - protein, 18 aa, Mycobacterium
GEALFAFLRSMVLQWGAA

SEQ ID NO: 883517 - protein, 25 aa, Mycobacterium
GEDRDYILELLLAGTTAGLPYEDCV

SEQ ID NO: 883518 - protein, 23 aa, Mycobacterium
GEDRLLRLRWPCPVPGALPVSEV

SEQ ID NO: 883519 - protein, 25 aa, Mycobacterium
GEEVAPWLDLVRKLGLLVGALSAEL

SEQ ID NO: 883520 - protein, 25 aa, Mycobacterium
GEEVAPWLELVRKLGLLVGALADAP

SEQ ID NO: 883521 - protein, 20 aa, Mycobacterium
GEFLSPKWRKMWKPVVCAVQ

SEQ ID NO: 883522 - protein, 18 aa, Mycobacterium
GEGALAFVLQPLSAALAA

SEQ ID NO: 883523 - protein, 26 aa, Mycobacterium
GEGATFFLPVFAEGALFYVGDPHMAM

SEQ ID NO: 883524 - protein, 17 aa, Mycobacterium
GEGWLVELQADSASLDA

SEQ ID NO: 883525 - protein, 23 aa, Mycobacterium
GEHPRFLHSFPPMPLQYKGLMTS

SEQ ID NO: 883526 - protein, 19 aa, Mycobacterium
GEIELLPITKFFPATDVVT

SEQ ID NO: 883527 - protein, 25 aa, Mycobacterium
GEIMAPILYRVQWLVRQIPDPHAVS

SEQ ID NO: 883528 - protein, 20 aa, Mycobacterium
GEIRLSEFMLPPIHLNPVDG

SEQ ID NO: 883529 - protein, 19 aa, Mycobacterium
GELLFLYNGVRPRNVMPVH

SEQ ID NO: 883530 - protein, 22 aa, Mycobacterium
GENLTPGPTWPPGAPDPAAPAD

SEQ ID NO: 883531 - protein, 20 aa, Mycobacterium
GERADWWWYDPFQPQPPPTH

SEQ ID NO: 883532 - protein, 23 aa, Mycobacterium
GERAHCWWYQPFQPQPPPAPPPA

SEQ ID NO: 883533 - protein, 23 aa, Mycobacterium
GERFRARFFGRNVNVPLMIIAIG

SEQ ID NO: 883534 - protein, 23 aa, Mycobacterium
GERFRARFFGRNVNVPLMIIGIG

SEQ ID NO: 883535 - protein, 24 aa, Mycobacterium
GERLYTLDYYLRLAESIVAAGAHV

SEQ ID NO: 883536 - protein, 23 aa, Mycobacterium
GERPHYMPLFVAPQPIEAEERAN

SEQ ID NO: 883537 - protein, 18 aa, Mycobacterium
GERQLLAVALLWGLAQAA

SEQ ID NO: 883538 - protein, 24 aa, Mycobacterium
GERQLLAVALLWGLARAAGQPLPV

SEQ ID NO: 883539 - protein, 17 aa, Mycobacterium
GERRWLDAATRLLNLAL

SEQ ID NO: 883540 - protein, 22 aa, Mycobacterium
GERTLYRRFPTKADLVLAALEQ

SEQ ID NO: 883541 - protein, 23 aa, Mycobacterium
GETLEEYWWAAEQMLTWDGEPAN

SEQ ID NO: 883542 - protein, 24 aa, Mycobacterium
GETLEEYWWAAEQMLTWPDEPANM

SEQ ID NO: 883543 - protein, 24 aa, Mycobacterium
GETLEEYWWAAEQMLTWPDPDKPA

SEQ ID NO: 883544 - protein, 24 aa, Mycobacterium
GEVADKLWYPLWDANIRLDHSVRT

SEQ ID NO: 883545 - protein, 27 aa, Mycobacterium
GEVLPALWHWVYFLDWPPTAALGTDGH

SEQ ID NO: 883546 - protein, 17 aa, Mycobacterium
GEYFLDRYLAHSGDVAP

SEQ ID NO: 883547 - protein, 18 aa, Mycobacterium
GEYFLGLGYVAAAQAALA

SEQ ID NO: 883548 - protein, 21 aa, Mycobacterium
GEYGYHLPYFHQMLAAGAVDC

SEQ ID NO: 883549 - protein, 25 aa, Mycobacterium
GEYSLDLFALLPLGELWVAAARNRQ

SEQ ID NO: 883550 - protein, 19 aa, Mycobacterium
GFAALWYASAVAGDPLVAM

SEQ ID NO: 883551 - protein, 18 aa, Mycobacterium
GFATIFWTWQTLYAARVG

SEQ ID NO: 883552 - protein, 21 aa, Mycobacterium
GFDGLPGEPPDIPPIGGLGGK

SEQ ID NO: 883553 - protein, 19 aa, Mycobacterium
GFDLLFFADVFGLRSPWNG

SEQ ID NO: 883554 - protein, 22 aa, Mycobacterium
GFDTIIEMWLPLAWSLNMVNRS

SEQ ID NO: 883555 - protein, 17 aa, Mycobacterium
GFDVWWFRLPRPETDEM

SEQ ID NO: 883556 - protein, 20 aa, Mycobacterium
GFEAWLLLRSLETAGLRFER

SEQ ID NO: 883557 - protein, 17 aa, Mycobacterium
GFEPLAWVRALAAEDPV

SEQ ID NO: 883558 - protein, 24 aa, Mycobacterium
GFERPVLLLWPRTLPFFPFAHAER

SEQ ID NO: 883559 - protein, 18 aa, Mycobacterium
GFFGLSWPREYGGQELPP

SEQ ID NO: 883560 - protein, 18 aa, Mycobacterium
GFHTLKLQTFLTAGPKEA

SEQ ID NO: 883561 - protein, 20 aa, Mycobacterium
GFILDGFPRSLQQAKALHEM

SEQ ID NO: 883562 - protein, 24 aa, Mycobacterium
GFLGRYLVLEWLRRLRAVGGKLIC

SEQ ID NO: 883563 - protein, 25 aa, Mycobacterium
GFLGRYLVLQWLRELEQVDGTLICL

SEQ ID NO: 883564 - protein, 31 aa, Mycobacterium
GFLLWQSAYSEMWFTDAYWPEFRRVDFLRAL

SEQ ID NO: 883565 - protein, 36 aa, Mycobacterium
GFLLWQSAYSEMWFTEAYWPAFRRVDFLRALRDYTA

SEQ ID NO: 883566 - protein, 31 aa, Mycobacterium
GFLLWQSAYSEMWFTEAYWPEFRRVDFLRAL

SEQ ID NO: 883567 - protein, 21 aa, Mycobacterium
GFNSGFFNWGTANSGLFSLSK

SEQ ID NO: 883568 - protein, 19 aa, Mycobacterium
GFPHYFLLPQYSSASSYRI

SEQ ID NO: 883569 - protein, 23 aa, Mycobacterium
GFPNLFLADPPPWQPGRDAVQRI

SEQ ID NO: 883570 - protein, 18 aa, Mycobacterium
GFPVPIRHWLRAGELLDW

SEQ ID NO: 883571 - protein, 19 aa, Mycobacterium
GFPVPIRHWLRSGALLDWA

SEQ ID NO: 883572 - protein, 22 aa, Mycobacterium
GFQRLLWRLPITLFRAHLGFLV

SEQ ID NO: 883573 - protein, 19 aa, Mycobacterium
GFRGCYRYVKEPELFALEL

SEQ ID NO: 883574 - protein, 17 aa, Mycobacterium
GFRLLQRLGADVADYGF

SEQ ID NO: 883575 - protein, 18 aa, Mycobacterium
GFSPLRLPPDLDFTSLFH

SEQ ID NO: 883576 - protein, 19 aa, Mycobacterium
GFVAVELLFLPGTYATCPA

SEQ ID NO: 883577 - protein, 20 aa, Mycobacterium
GFVAVELLFLPGTYATCPAC

SEQ ID NO: 883578 - protein, 18 aa, Mycobacterium
GFVFQHYAAFKHLSVRDN

SEQ ID NO: 883579 - protein, 26 aa, Mycobacterium
GFVLLDGWKELYLPVIRLLEPSLSAG

SEQ ID NO: 883580 - protein, 18 aa, Mycobacterium
GFVNVIYRWAKSGDLSAA

SEQ ID NO: 883581 - protein, 20 aa, Mycobacterium
GFVSLLHILAADAPVLIAID

SEQ ID NO: 883582 - protein, 24 aa, Mycobacterium
GFVVNFLLVPYLLSAIRMVEGGVA

SEQ ID NO: 883583 - protein, 21 aa, Mycobacterium
GFYQLMRNLPQERLALAVGAV

SEQ ID NO: 883584 - protein, 21 aa, Mycobacterium
GGAAGLLFGPGGSGGAGGATF

SEQ ID NO: 883585 - protein, 24 aa, Mycobacterium
GGADSLLVFPFDVAIDGGFPGTAT

SEQ ID NO: 883586 - protein, 25 aa, Mycobacterium
GGAGGATGWFGSTGMTGAGGAGGHG

SEQ ID NO: 883587 - protein, 25 aa, Mycobacterium
GGAGGRGGWLWSAGGDGGAGGLGGT

SEQ ID NO: 883588 - protein, 21 aa, Mycobacterium
GGAGGWLFGPGGVGGAGGSSS

SEQ ID NO: 883589 - protein, 24 aa, Mycobacterium
GGAGSSPGFLSPAGNGGAGGDAGT

SEQ ID NO: 883590 - protein, 17 aa, Mycobacterium
GGAGVVSGLSAFPGGIG

SEQ ID NO: 883591 - protein, 23 aa, Mycobacterium
GGAILVKCQHDLSLGTHPMDVSA

SEQ ID NO: 883592 - protein, 22 aa, Mycobacterium
GGAIMDMLFPPGTQARVPIAAL

SEQ ID NO: 883593 - protein, 20 aa, Mycobacterium
GGANNAWLGGAAGSGGTGGS

SEQ ID NO: 883594 - protein, 23 aa, Mycobacterium
GGAPFLSPVRLASVVWTPLDAGT

SEQ ID NO: 883595 - protein, 23 aa, Mycobacterium
GGAPNPYIWPENLPRVNARGGPG

SEQ ID NO: 883596 - protein, 25 aa, Mycobacterium
GGAQTFFMPLWMLAVALGKWLPSPS

SEQ ID NO: 883597 - protein, 24 aa, Mycobacterium
GGAYLPTTVYLPSTVRLAVSDPAL

SEQ ID NO: 883598 - protein, 22 aa, Mycobacterium
GGDAGLLGLNGAGGHGGGGGMG

SEQ ID NO: 883599 - protein, 24 aa, Mycobacterium
GGDGGDGFGLWNPGEGGRGGSGGD

SEQ ID NO: 883600 - protein, 22 aa, Mycobacterium
GGDGGWLFGSGGNGAAGAAGQA

SEQ ID NO: 883601 - protein, 23 aa, Mycobacterium
GGDGSFLWDSPPNTNVYIGDAGG

SEQ ID NO: 883602 - protein, 17 aa, Mycobacterium
GGDMIAALFAAIETNPT

SEQ ID NO: 883603 - protein, 17 aa, Mycobacterium
GGDPWRVLQRAGELLRR

SEQ ID NO: 883604 - protein, 17 aa, Mycobacterium
GGEWYVARLFPGPLSAD

SEQ ID NO: 883605 - protein, 17 aa, Mycobacterium
GGFGIHPVLLDAALHAL

SEQ ID NO: 883606 - protein, 22 aa, Mycobacterium
GGFVLFYHLLWELTHVCFEHSG

SEQ ID NO: 883607 - protein, 25 aa, Mycobacterium
GGFVVPFLNPLLVWDFRLPRVVSIN

SEQ ID NO: 883608 - protein, 27 aa, Mycobacterium
GGGGGKSGWLGLAGALGGGGTGGSGGA

SEQ ID NO: 883609 - protein, 23 aa, Mycobacterium
GGGLNRGLFNNGFLNIGIANSGD

SEQ ID NO: 883610 - protein, 28 aa, Mycobacterium
GGGLTLAVDFLGFGLFHGGAGGDGGAAT

SEQ ID NO: 883611 - protein, 22 aa, Mycobacterium
GGGYPPQPGYPPPPRQPDQGGG

SEQ ID NO: 883612 - protein, 21 aa, Mycobacterium
GGHAGLLWSSGGAGGAGAFSV

SEQ ID NO: 883613 - protein, 17 aa, Mycobacterium
GGHAIGPHWLSAGGFEA

SEQ ID NO: 883614 - protein, 19 aa, Mycobacterium
GGIGGLLLGLDGYNAPTST

SEQ ID NO: 883615 - protein, 24 aa, Mycobacterium
GGILLITHYTRILRYIRPEFVHVF

SEQ ID NO: 883616 - protein, 25 aa, Mycobacterium
GGKDNWFWIKVPVGYLFTIANPRTD

SEQ ID NO: 883617 - protein, 24 aa, Mycobacterium
GGKDNWFWIKVPVGYLYTIANPRT

SEQ ID NO: 883618 - protein, 22 aa, Mycobacterium
GGKGGLLFGAGGEGGAGGTGGA

SEQ ID NO: 883619 - protein, 23 aa, Mycobacterium
GGKPFGVDLLLPPKYVGADEGGI

SEQ ID NO: 883620 - protein, 17 aa, Mycobacterium
GGLFIRMSWHAAGTYRI

SEQ ID NO: 883621 - protein, 20 aa, Mycobacterium
GGLHLWLRLPDQTDLDRLVR

SEQ ID NO: 883622 - protein, 22 aa, Mycobacterium
GGLNRYFTDLFTALRTRGDIEL

SEQ ID NO: 883623 - protein, 20 aa, Mycobacterium
GGLPFFPNLPSWISLRLLEN

SEQ ID NO: 883624 - protein, 17 aa, Mycobacterium
GGLPPVPVVLPKPVRQL

SEQ ID NO: 883625 - protein, 17 aa, Mycobacterium
GGLTWPLGLAVDADGDL

SEQ ID NO: 883626 - protein, 19 aa, Mycobacterium
GGLVLLKPLRAALEDGNRI

SEQ ID NO: 883627 - protein, 20 aa, Mycobacterium
GGMAFLVRSLLDAGLLRDDV

SEQ ID NO: 883628 - protein, 20 aa, Mycobacterium
GGMELLLCCDIVLAADTALI

SEQ ID NO: 883629 - protein, 22 aa, Mycobacterium
GGMGGDYFALALALEELGKVDQ

SEQ ID NO: 883630 - protein, 20 aa, Mycobacterium
GGMSGLLLGLDGYNAPTSTS

SEQ ID NO: 883631 - protein, 26 aa, Mycobacterium
GGNGGFGGMALFIGSGGNGGAGGNAV

SEQ ID NO: 883632 - protein, 21 aa, Mycobacterium
GGNGGWLFGQGGAGGIGGSGA

SEQ ID NO: 883633 - protein, 26 aa, Mycobacterium
GGNNNWFAAYAYWYFKLYGHEKVKLL

SEQ ID NO: 883634 - protein, 26 aa, Mycobacterium
GGNNNWFAAYAYWYFKLYGHQDVKLL

SEQ ID NO: 883635 - protein, 26 aa, Mycobacterium
GGNNNWFAAYAYWYFKLYGHQNVKLL

SEQ ID NO: 883636 - protein, 28 aa, Mycobacterium
GGNNNWFAAYAYWYFKLYGHRDVKLLDG

SEQ ID NO: 883637 - protein, 22 aa, Mycobacterium
GGNPCLLTPPPWYPILRGTTQQ

SEQ ID NO: 883638 - protein, 25 aa, Mycobacterium
GGNPGFLRLLSPKLLRWPDYLGNSM

SEQ ID NO: 883639 - protein, 26 aa, Mycobacterium
GGNPLHPLALPLLRPRQVIMLGRPTL

SEQ ID NO: 883640 - protein, 24 aa, Mycobacterium
GGPAPIFQWLIYPRTDFAGRTRSA

SEQ ID NO: 883641 - protein, 25 aa, Mycobacterium
GGPGAWLLAVPPYHIAGLQVLVRSV

SEQ ID NO: 883642 - protein, 24 aa, Mycobacterium
GGPHLKFQLLWYPGTTSDLSLPSV

SEQ ID NO: 883643 - protein, 18 aa, Mycobacterium
GGPRPLVFFPGDGSLVLG

SEQ ID NO: 883644 - protein, 24 aa, Mycobacterium
GGQEILFPALLPRAPYEATNRWTE

SEQ ID NO: 883645 - protein, 20 aa, Mycobacterium
GGQFVLWRDALDAVPTAGDG

SEQ ID NO: 883646 - protein, 24 aa, Mycobacterium
GGQKPWLPHFYLGHGIGTSAAEMP

SEQ ID NO: 883647 - protein, 24 aa, Mycobacterium
GGQTWPLYAPLVVSDARTAASLAS

SEQ ID NO: 883648 - protein, 21 aa, Mycobacterium
GGRGGLLFGVGGAGGAGGDGL

SEQ ID NO: 883649 - protein, 23 aa, Mycobacterium
GGRGGWISFLSGQGAGGAGGDGG

SEQ ID NO: 883650 - protein, 21 aa, Mycobacterium
GGRGGWLLGIGGSGGFGGFGQ

SEQ ID NO: 883651 - protein, 23 aa, Mycobacterium
GGRGIHVYLRIAARWDFIEVRRA

SEQ ID NO: 883652 - protein, 18 aa, Mycobacterium
GGRRLFVFLGSTIGNLTP

SEQ ID NO: 883653 - protein, 24 aa, Mycobacterium
GGRYQKVILSRRLELPFAVDFPAT

SEQ ID NO: 883654 - protein, 18 aa, Mycobacterium
GGSGWRWLASALWAEILL

SEQ ID NO: 883655 - protein, 24 aa, Mycobacterium
GGSKPWLPHFYLGHGIGVNAAEMP

SEQ ID NO: 883656 - protein, 23 aa, Mycobacterium
GGSYYVEWLTHQLAQRARAHIEE

SEQ ID NO: 883657 - protein, 23 aa, Mycobacterium
GGSYYVEWLTHQLAQRARAHINE

SEQ ID NO: 883658 - protein, 23 aa, Mycobacterium
GGSYYVEWLTYQLAEKARGHIRE

SEQ ID NO: 883659 - protein, 25 aa, Mycobacterium
GGTGGGLFGLLGHSGSTGAAGAAGN

SEQ ID NO: 883660 - protein, 23 aa, Mycobacterium
GGTKPWLPHFYLGHGIGVNAAEM

SEQ ID NO: 883661 - protein, 19 aa, Mycobacterium
GGTSGLLLGLDGFNAPAST

SEQ ID NO: 883662 - protein, 19 aa, Mycobacterium
GGTYNLFHYSLAKLGIDVS

SEQ ID NO: 883663 - protein, 24 aa, Mycobacterium
GGTYNLFHYTLPKLGIEVSFVEDP

SEQ ID NO: 883664 - protein, 24 aa, Mycobacterium
GGTYNLLHYTLPKLGIETTFVENP

SEQ ID NO: 883665 - protein, 23 aa, Mycobacterium
GGVFRILLCLAEARPFVLLPKFE

SEQ ID NO: 883666 - protein, 18 aa, Mycobacterium
GGVLFGDGGIGGAGGGGG

SEQ ID NO: 883667 - protein, 21 aa, Mycobacterium
GGVMPRFPLPLGKSGPHPERV

SEQ ID NO: 883668 - protein, 18 aa, Mycobacterium
GGWLLGNGGAGGAGGVGG

SEQ ID NO: 883669 - protein, 23 aa, Mycobacterium
GGWRLAPPLLVDQLAGLKPPAPL

SEQ ID NO: 883670 - protein, 18 aa, Mycobacterium
GGYLSLAFHLVHPQRVAA

SEQ ID NO: 883671 - protein, 25 aa, Mycobacterium
GHAPIRYHSLILAAWRGSEPTAIRL

SEQ ID NO: 883672 - protein, 22 aa, Mycobacterium
GHARLTRFLIRYSRGAWREAQA

SEQ ID NO: 883673 - protein, 18 aa, Mycobacterium
GHATRWRPWRSYATQYLW

SEQ ID NO: 883674 - protein, 24 aa, Mycobacterium
GHDLDFRTLFPRRSKGLAGALDFA

SEQ ID NO: 883675 - protein, 20 aa, Mycobacterium
GHDVLLVPTLLTTTPPYALL

SEQ ID NO: 883676 - protein, 19 aa, Mycobacterium
GHEQLFDTLFLYESYPIDT

SEQ ID NO: 883677 - protein, 24 aa, Mycobacterium
GHERTLMWMAFANRLEQLLEDYRP

SEQ ID NO: 883678 - protein, 24 aa, Mycobacterium
GHFALTGLLLERLLPVPGSRVVTV

SEQ ID NO: 883679 - protein, 18 aa, Mycobacterium
GHFGLFFIGAGEELFLST

SEQ ID NO: 883680 - protein, 18 aa, Mycobacterium
GHFGLFFIGASDQLVLSS

SEQ ID NO: 883681 - protein, 21 aa, Mycobacterium
GHHPFIDLPYRPGHEAVGVVE

SEQ ID NO: 883682 - protein, 23 aa, Mycobacterium
GHKPWLPHFYLGHGIGTGAAEMP

SEQ ID NO: 883683 - protein, 23 aa, Mycobacterium
GHKPWLPHFYLGHGIGTYPAEAP

SEQ ID NO: 883684 - protein, 20 aa, Mycobacterium
GHLPAYAVPLFVRVVPELAH

SEQ ID NO: 883685 - protein, 18 aa, Mycobacterium
GHLWWIRSQLRSLLVEDV

SEQ ID NO: 883686 - protein, 18 aa, Mycobacterium
GHLYRLFAKLGINTREQL

SEQ ID NO: 883687 - protein, 18 aa, Mycobacterium
GHSYIVYAPLMLGATTVL

SEQ ID NO: 883688 - protein, 17 aa, Mycobacterium
GHSYWWGGNLMGVKDRP

SEQ ID NO: 883689 - protein, 20 aa, Mycobacterium
GHVLFAWHLPELWRRFTITM

SEQ ID NO: 883690 - protein, 20 aa, Mycobacterium
GIAFVPYFPLATGGLGDDDE

SEQ ID NO: 883691 - protein, 20 aa, Mycobacterium
GIAHRLGMRPSWVLDLHNGG

SEQ ID NO: 883692 - protein, 20 aa, Mycobacterium
GIAHRLGMRPSWVLDLNNGG

SEQ ID NO: 883693 - protein, 22 aa, Mycobacterium
GIALSPYRFPTGWFIVAFSSEL

SEQ ID NO: 883694 - protein, 17 aa, Mycobacterium
GIALVPWSPLKNGFLSG

SEQ ID NO: 883695 - protein, 19 aa, Mycobacterium
GIDLPRRVFAHGFLLNRGE

SEQ ID NO: 883696 - protein, 19 aa, Mycobacterium
GIDLRPFWTLGVAALMRDL

SEQ ID NO: 883697 - protein, 22 aa, Mycobacterium
GIDNWRWAGVPIYLRTGKKMAE

SEQ ID NO: 883698 - protein, 30 aa, Mycobacterium
GIDSFLFFPNFMLLIWAPGWYLTYHYWPTT

SEQ ID NO: 883699 - protein, 19 aa, Mycobacterium
GIELPRRVFAHGFLLNRGE

SEQ ID NO: 883700 - protein, 24 aa, Mycobacterium
GIERKAIRVILGNPLIAITMLRHD

SEQ ID NO: 883701 - protein, 23 aa, Mycobacterium
GIEWITWWLAVSRIGAVAVPLST

SEQ ID NO: 883702 - protein, 17 aa, Mycobacterium
GIFLPHVLRYNASLPSK

SEQ ID NO: 883703 - protein, 19 aa, Mycobacterium
GIFTFGWGPVLHQLAAGLG

SEQ ID NO: 883704 - protein, 26 aa, Mycobacterium
GIGEQYELVLYWWPRADLSGVENAIL

SEQ ID NO: 883705 - protein, 24 aa, Mycobacterium
GIGGFFEKTFAPLGLRKIQAQVLE

SEQ ID NO: 883706 - protein, 19 aa, Mycobacterium
GIGLTLFPLTSGSKGLHLY

SEQ ID NO: 883707 - protein, 17 aa, Mycobacterium
GIHFLRDAYLKRYPDYP

SEQ ID NO: 883708 - protein, 17 aa, Mycobacterium
GIIAPFDLALERELWRW

SEQ ID NO: 883709 - protein, 23 aa, Mycobacterium
GIIPAVLHYYWRFVPEADEDGVV

SEQ ID NO: 883710 - protein, 29 aa, Mycobacterium
GIPARPVIIGPITFLLLSKAVDGGGAPIE

SEQ ID NO: 883711 - protein, 18 aa, Mycobacterium
GIPILYPWANRLSSMGYG

SEQ ID NO: 883712 - protein, 17 aa, Mycobacterium
GIPLEKWNLYSEPVHAA

SEQ ID NO: 883713 - protein, 19 aa, Mycobacterium
GIPQPWLRDLAKRWARWRL

SEQ ID NO: 883714 - protein, 18 aa, Mycobacterium
GIPSLILWTAGDQPMWGS

SEQ ID NO: 883715 - protein, 22 aa, Mycobacterium
GIPSTLWQKSLLPIVRTVMKIP

SEQ ID NO: 883716 - protein, 25 aa, Mycobacterium
GIPVMLRPLVLAKLMDGRTTVMVTG

SEQ ID NO: 883717 - protein, 18 aa, Mycobacterium
GIQSFFDLPLITGRAAPE

SEQ ID NO: 883718 - protein, 23 aa, Mycobacterium
GIRCFGFAPLRLPPDLDFAALFH

SEQ ID NO: 883719 - protein, 20 aa, Mycobacterium
GIRCFGFSPLRLPPDLDFTS

SEQ ID NO: 883720 - protein, 19 aa, Mycobacterium
GIRGLLPYSVAKGGLEALT

SEQ ID NO: 883721 - protein, 30 aa, Mycobacterium
GIRSGHVLHWWFPVYDPAFAQLSPGWILLR

SEQ ID NO: 883722 - protein, 20 aa, Mycobacterium
GISDFLWLRIMNVPDVLGKR

SEQ ID NO: 883723 - protein, 18 aa, Mycobacterium
GISEWILPTLISSAPREI

SEQ ID NO: 883724 - protein, 24 aa, Mycobacterium
GISRPTFYFYFPSKEAVLLTLLDR

SEQ ID NO: 883725 - protein, 24 aa, Mycobacterium
GISRPTFYFYFRSKNAVLLSLLDQ

SEQ ID NO: 883726 - protein, 19 aa, Mycobacterium
GISVLVWHPALNVYSGYAH

SEQ ID NO: 883727 - protein, 20 aa, Mycobacterium
GITWILPRLAGWGAAADLLL

SEQ ID NO: 883728 - protein, 23 aa, Mycobacterium
GIVFQQYALLPWRTARKNIEFGL

SEQ ID NO: 883729 - protein, 20 aa, Mycobacterium
GIVGLMRTLANALAPHRIRV

SEQ ID NO: 883730 - protein, 17 aa, Mycobacterium
GIVRFYADLLRGYEFSD

SEQ ID NO: 883731 - protein, 17 aa, Mycobacterium
GIVVLPQDLPITAVSET

SEQ ID NO: 883732 - protein, 17 aa, Mycobacterium
GIVWFRGLLRKLADDGC

SEQ ID NO: 883733 - protein, 18 aa, Mycobacterium
GKDFAVRQIPLREITKAV

SEQ ID NO: 883734 - protein, 30 aa, Mycobacterium; identical to SEQ ID NO: 766505

SEQ ID NO: 883735 - protein, 19 aa, Mycobacterium
GKFGLTWPWESLHVEALAW

SEQ ID NO: 883736 - protein, 20 aa, Mycobacterium
GKGTPGWRWLDVRALATRLV

SEQ ID NO: 883737 - protein, 25 aa, Mycobacterium
GKHSAIAALPWFWSDQYDLKLQIAG

SEQ ID NO: 883738 - protein, 21 aa, Mycobacterium
GKPAHPLIINGWVRTGHSDEQ

SEQ ID NO: 883739 - protein, 18 aa, Mycobacterium
GKPFHQLPFALTPGPPIP

SEQ ID NO: 883740 - protein, 22 aa, Mycobacterium
GKPYGVDLLLPPKYVGAEQGGI

SEQ ID NO: 883741 - protein, 22 aa, Mycobacterium
GKQWFTVHRTIFRLALPGGTPR

SEQ ID NO: 883742 - protein, 21 aa, Mycobacterium
GKRLVLRYRPMGLIGVIGPWN

SEQ ID NO: 883743 - protein, 25 aa, Mycobacterium
GKSKKIAALPWFWSDQYDLKLQIAG

SEQ ID NO: 883744 - protein, 21 aa, Mycobacterium
GKWLPYYASLIERSAAFPPPP

SEQ ID NO: 883745 - protein, 19 aa, Mycobacterium
GKWTAALIGSWWSTPSTEL

SEQ ID NO: 883746 - protein, 22 aa, Mycobacterium
GLADSLILRQRYPVPGAPYGLA

SEQ ID NO: 883747 - protein, 22 aa, Mycobacterium
GLAEPLPLVRMVLAATAEDRRI

SEQ ID NO: 883748 - protein, 24 aa, Mycobacterium
GLAGIPWFLIEALLEQGADDLTIV

SEQ ID NO: 883749 - protein, 18 aa, Mycobacterium
GLAIPGPAGLAAPAAPVG

SEQ ID NO: 883750 - protein, 17 aa, Mycobacterium
GLALAWGVPFYGVNHLG

SEQ ID NO: 883751 - protein, 17 aa, Mycobacterium
GLALLQYRIERTLSEWV

SEQ ID NO: 883752 - protein, 18 aa, Mycobacterium
GLALWQNQIERILAEWVG

SEQ ID NO: 883753 - protein, 17 aa, Mycobacterium
GLARRGFPLLLVARRRE

SEQ ID NO: 883754 - protein, 19 aa, Mycobacterium
GLARYPLPMAPAAAAQQAG

SEQ ID NO: 883755 - protein, 23 aa, Mycobacterium
GLDAFLRRFLLPALLADTQRCVT

SEQ ID NO: 883756 - protein, 23 aa, Mycobacterium
GLDAFLRRFLLPPLLTTTRSCAD

SEQ ID NO: 883757 - protein, 24 aa, Mycobacterium
GLDAPLLAWLHAPGADYAAALHAD

SEQ ID NO: 883758 - protein, 17 aa, Mycobacterium
GLDARAWRLGWPDGTTV

SEQ ID NO: 883759 - protein, 19 aa, Mycobacterium
GLDARAWRLPWPGGTVVYE

SEQ ID NO: 883760 - protein, 22 aa, Mycobacterium
GLDARAYRLPWAAGTTVFEIDQ

SEQ ID NO: 883761 - protein, 22 aa, Mycobacterium
GLDARAYRLPWPADMTVFEIDQ

SEQ ID NO: 883762 - protein, 23 aa, Mycobacterium
GLDARAYRLPWPAGTTVFEIDQP

SEQ ID NO: 883763 - protein, 17 aa, Mycobacterium
GLDARAYRLPWPDGTVV

SEQ ID NO: 883764 - protein, 26 aa, Mycobacterium
GLDARGVFWLPPYHDFGLISVILSGL

SEQ ID NO: 883765 - protein, 25 aa, Mycobacterium
GLDARPYRLPWPTGMRVYEIDQPEV

SEQ ID NO: 883766 - protein, 23 aa, Mycobacterium
GLDLAIIYLPPPYDPAVLEPLAQ

SEQ ID NO: 883767 - protein, 21 aa, Mycobacterium
GLDLFAGLGLLQSVGEPVEVG

SEQ ID NO: 883768 - protein, 23 aa, Mycobacterium
GLDLPDLELIFAPAPFYDEGLPA

SEQ ID NO: 883769 - protein, 26 aa, Mycobacterium
GLDNAFRRRWFGWINPAQTMVAYAQS

SEQ ID NO: 883770 - protein, 27 aa, Mycobacterium
GLDNAFRRRWFGWINPAQTMVAYAQSV

SEQ ID NO: 883771 - protein, 17 aa, Mycobacterium
GLDSRAWRLPWPDGTTV

SEQ ID NO: 883772 - protein, 17 aa, Mycobacterium
GLDSRAWRLPWPDGTVV

SEQ ID NO: 883773 - protein, 22 aa, Mycobacterium
GLDSRAYRLPWPAGTTVFEVDQ

SEQ ID NO: 883774 - protein, 23 aa, Mycobacterium
GLDSRAYRLWWPRGTTVYEIDRP

SEQ ID NO: 883775 - protein, 23 aa, Mycobacterium
GLDTRAYRLLWPAGTVVYEIDQP

SEQ ID NO: 883776 - protein, 22 aa, Mycobacterium
GLDTRAYRLPWPGGTTVYEIDQ

SEQ ID NO: 883777 - protein, 25 aa, Mycobacterium
GLDYVDLYLIHWPAPSLGNYVNSFG

SEQ ID NO: 883778 - protein, 25 aa, Mycobacterium
GLETRGVFWLPPYHDFGLISVILST

SEQ ID NO: 883779 - protein, 20 aa, Mycobacterium
GLEYILAFLGSMQAGLIAVP

SEQ ID NO: 883780 - protein, 21 aa, Mycobacterium
GLFGLFRMGLPTNFGLSGYSG

SEQ ID NO: 883781 - protein, 17 aa, Mycobacterium
GLFSTVYKEYLMKALPA

SEQ ID NO: 883782 - protein, 17 aa, Mycobacterium
GLGGLGGFGGSGGTGGQ

SEQ ID NO: 883783 - protein, 25 aa, Mycobacterium
GLGKRYLIVLPFLTPAIASLWVGTV

SEQ ID NO: 883784 - protein, 17 aa, Mycobacterium
GLGLPFFAQSMYMIADG

SEQ ID NO: 883785 - protein, 25 aa, Mycobacterium
GLGMALLPIIGWLPDGIAPVDAMPA

SEQ ID NO: 883786 - protein, 26 aa, Mycobacterium
GLGNRYLFVLPFLTPAIASLWVGLVT

SEQ ID NO: 883787 - protein, 20 aa, Mycobacterium
GLGPISIPIVDVPAAPGFGN

SEQ ID NO: 883788 - protein, 17 aa, Mycobacterium
GLGSTLQIANRAAAATI

SEQ ID NO: 883789 - protein, 25 aa, Mycobacterium
GLGTWRFHVERSGSISWFGLDGMEH

SEQ ID NO: 883790 - protein, 17 aa, Mycobacterium
GLGTYRFFLDCVGHIDD

SEQ ID NO: 883791 - protein, 24 aa, Mycobacterium
GLHQGLALQIPPYKYAHPDDLLAR

SEQ ID NO: 883792 - protein, 24 aa, Mycobacterium
GLHRRYLIVLPFLTPTIASLWVGT

SEQ ID NO: 883793 - protein, 19 aa, Mycobacterium
GLIDLLLAAGGELVTVLTG

SEQ ID NO: 883794 - protein, 25 aa, Mycobacterium
GLIKAAWIDTWRLPAAPPGTVKIVV

SEQ ID NO: 883795 - protein, 25 aa, Mycobacterium
GLINAPALALLHRPLIGDGTDGAAG

SEQ ID NO: 883796 - protein, 26 aa, Mycobacterium
GLINAPTQTLLGRPLIGDGAAGTATN

SEQ ID NO: 883797 - protein, 17 aa, Mycobacterium
GLIRSVKPLPKSGWRKA

SEQ ID NO: 883798 - protein, 18 aa, Mycobacterium
GLKPLVRLVSWGSAGVAP

SEQ ID NO: 883799 - protein, 20 aa, Mycobacterium
GLKQELPPDFKLPPGVFGPD

SEQ ID NO: 883800 - protein, 28 aa, Mycobacterium
GLLAALGDPLLWSIPLHWAGVHAGILAN

SEQ ID NO: 883801 - protein, 22 aa, Mycobacterium
GLLLTTLWYIREVDPTTLLLTG

SEQ ID NO: 883802 - protein, 22 aa, Mycobacterium
GLLPDILFTSLLRRAINTAHLA

SEQ ID NO: 883803 - protein, 21 aa, Mycobacterium
GLLPIKIPIIDIAAAPGFGNS

SEQ ID NO: 883804 - protein, 17 aa, Mycobacterium
GLLPTWGLSVRLPQKVG

SEQ ID NO: 883805 - protein, 19 aa, Mycobacterium
GLLPTWGLSVRLPQKVGIG

SEQ ID NO: 883806 - protein, 18 aa, Mycobacterium
GLLPTWGLSVRLPQKVGV

SEQ ID NO: 883807 - protein, 20 aa, Mycobacterium
GLLRQLFFVIPPERIHTLVF

SEQ ID NO: 883808 - protein, 18 aa, Mycobacterium
GLLTLSLLPRFTHQLYTV

SEQ ID NO: 883809 - protein, 28 aa, Mycobacterium
GLLVNFPLSQWLKFAPPIAYGALPKDAL

SEQ ID NO: 883810 - protein, 19 aa, Mycobacterium
GLLVNLPISQALKYGNKPV

SEQ ID NO: 883811 - protein, 17 aa, Mycobacterium
GLMGWGLTLSIWCSEWV

SEQ ID NO: 883812 - protein, 18 aa, Mycobacterium
GLMQAPMSALQPLQSMMG

SEQ ID NO: 883813 - protein, 19 aa, Mycobacterium
GLMQPWRFIRITDTGLRRR

SEQ ID NO: 883814 - protein, 25 aa, Mycobacterium
GLNPIDWKIVAGFMRELMPVDLPAG

SEQ ID NO: 883815 - protein, 24 aa, Mycobacterium
GLNRHFMYPIPYWLGLDIDTLIPR

SEQ ID NO: 883816 - protein, 18 aa, Mycobacterium
GLNSWLTGMFDRGAWRPA

SEQ ID NO: 883817 - protein, 25 aa, Mycobacterium
GLPANPVWWTWLGNDYLPLVRDYLP

SEQ ID NO: 883818 - protein, 17 aa, Mycobacterium
GLPFLPMSMAKGLLPDT

SEQ ID NO: 883819 - protein, 24 aa, Mycobacterium
GLPLTLWLARFLKFIQTEIFPGGH

SEQ ID NO: 883820 - protein, 18 aa, Mycobacterium
GLQERTFPYLFSPAANRA

SEQ ID NO: 883821 - protein, 17 aa, Mycobacterium
GLQVPPYAYAHPDDLLA

SEQ ID NO: 883822 - protein, 29 aa, Mycobacterium
GLRAGIPMLIRWLWLDQPIWAAGIEELGV

SEQ ID NO: 883823 - protein, 17 aa, Mycobacterium
GLRALYLYTATFQDAAV

SEQ ID NO: 883824 - protein, 18 aa, Mycobacterium
GLRFPLFVKAVAGGGGRG

SEQ ID NO: 883825 - protein, 25 aa, Mycobacterium
GLRKLLLQEWLRFGWYFLITRRDPK

SEQ ID NO: 883826 - protein, 20 aa, Mycobacterium
GLRNALLASGYRIAPRKLLL

SEQ ID NO: 883827 - protein, 19 aa, Mycobacterium
GLRVVPWLWEAPPTDRRYY

SEQ ID NO: 883828 - protein, 17 aa, Mycobacterium
GLRVVPWLWNAPPTDRR

SEQ ID NO: 883829 - protein, 21 aa, Mycobacterium
GLSCFFLPRILPDGTRNRMFL

SEQ ID NO: 883830 - protein, 22 aa, Mycobacterium
GLSELWFVTRLMRTAPVSREMV

SEQ ID NO: 883831 - protein, 24 aa, Mycobacterium
GLSGGIVWLPNNPLMRADGIADSH

SEQ ID NO: 883832 - protein, 23 aa, Mycobacterium
GLSGGIVWLPNNPLMRAEGIADT

SEQ ID NO: 883833 - protein, 24 aa, Mycobacterium
GLSGGMVWLPNNPLMRADGIPDSH

SEQ ID NO: 883834 - protein, 18 aa, Mycobacterium
GLSLFFVPKFIPNFETGE

SEQ ID NO: 883835 - protein, 22 aa, Mycobacterium
GLSLFYVPKFLFDPETFELGPR

SEQ ID NO: 883836 - protein, 24 aa, Mycobacterium
GLSRPTFYFYFPSKDAVLFTLFER

SEQ ID NO: 883837 - protein, 24 aa, Mycobacterium
GLSVADYRLAMAELFAPFSKVAAK

SEQ ID NO: 883838 - protein, 18 aa, Mycobacterium
GLSVPDLGWAPPAAPSGG

SEQ ID NO: 883839 - protein, 18 aa, Mycobacterium
GLSVPRFPTALSTALRPL

SEQ ID NO: 883840 - protein, 20 aa, Mycobacterium
GLSWLIILRKRENFRRAFAG

SEQ ID NO: 883841 - protein, 23 aa, Mycobacterium
GLTAPMSLMRFIKFILTEIFPGG

SEQ ID NO: 883842 - protein, 20 aa, Mycobacterium
GLTGQLCAVAFLLTGRETGR

SEQ ID NO: 883843 - protein, 19 aa, Mycobacterium
GLTLSWLLRNLATRGPKSL

SEQ ID NO: 883844 - protein, 24 aa, Mycobacterium
GLVDHFLFEFADPRRLFGLGGQIH

SEQ ID NO: 883845 - protein, 17 aa, Mycobacterium
GLVGLLNTLAIEGAKYG

SEQ ID NO: 883846 - protein, 21 aa, Mycobacterium
GLVRWLLRRKAISSLPEGYDV

SEQ ID NO: 883847 - protein, 18 aa, Mycobacterium
GLWTAYYLKRADPSLRVV

SEQ ID NO: 883848 - protein, 18 aa, Mycobacterium
GLWTTWRPPGAPKDHAPL

SEQ ID NO: 883849 - protein, 21 aa, Mycobacterium
GLYLIGMPFLRRRKSTLIDGA

SEQ ID NO: 883850 - protein, 19 aa, Mycobacterium
GLYPVLTRLVAKKKLKDVW

SEQ ID NO: 883851 - protein, 18 aa, Mycobacterium
GLYYTLLNTHLSPSEIAY

SEQ ID NO: 883852 - protein, 20 aa, Mycobacterium
GMAYVRFAIATPLMYRLATV

SEQ ID NO: 883853 - protein, 19 aa, Mycobacterium
GMCGVEYFGHPWEFGPRKA

SEQ ID NO: 883854 - protein, 25 aa, Mycobacterium
GMELACWDLLIYYLRDLAQSYPDLL

SEQ ID NO: 883855 - protein, 21 aa, Mycobacterium
GMFGNIIRLLPPLTIGDELLA

SEQ ID NO: 883856 - protein, 19 aa, Mycobacterium
GMFTFGWGPVLHQLAAGLG

SEQ ID NO: 883857 - protein, 24 aa, Mycobacterium
GMGGAAGWLGFGGAGGAGGFGGVV

SEQ ID NO: 883858 - protein, 26 aa, Mycobacterium
GMGGASGFSIVFPPGQDGGGGGIGGS

SEQ ID NO: 883859 - protein, 18 aa, Mycobacterium
GMGGDYFALALALEELGK

SEQ ID NO: 883860 - protein, 28 aa, Mycobacterium
GMGGTGGHGSFLFGAAGASCNGGAGGAG

SEQ ID NO: 883861 - protein, 19 aa, Mycobacterium
GMGIDRLLMALTGLGIRET

SEQ ID NO: 883862 - protein, 20 aa, Mycobacterium
GMGIDRLMMALTGLSIRETV

SEQ ID NO: 883863 - protein, 18 aa, Mycobacterium
GMGRALIAPLRIGLREAG

SEQ ID NO: 883864 - protein, 18 aa, Mycobacterium
GMGRALIGPLRIGLRQAG

SEQ ID NO: 883865 - protein, 18 aa, Mycobacterium
GMGWYFYDFGTAVSFFED

SEQ ID NO: 883866 - protein, 18 aa, Mycobacterium
GMHLLRCPTVGRALEVLS

SEQ ID NO: 883867 - protein, 22 aa, Mycobacterium
GMKLDFLLTVDWDYYKKFMSVN

SEQ ID NO: 883868 - protein, 20 aa, Mycobacterium
GMKLDLLLSVPWDYYKKFMS

SEQ ID NO: 883869 - protein, 25 aa, Mycobacterium
GMKLDLLLTVPWDYYRKFMSVNHDG

SEQ ID NO: 883870 - protein, 20 aa, Mycobacterium
GMLFSPGYPGFLRGLAAGGP

SEQ ID NO: 883871 - protein, 20 aa, Mycobacterium
GMLFSPGYPGFLRGVIAGGA

SEQ ID NO: 883872 - protein, 29 aa, Mycobacterium
GMRAGVPMLLLWLWLDQPIWASAVSRLEV

SEQ ID NO: 883873 - protein, 24 aa, Mycobacterium
GMRKLLLQEWLRYGWYFLISRRDP

SEQ ID NO: 883874 - protein, 17 aa, Mycobacterium
GMRRFLPSSPTSLYVYA

SEQ ID NO: 883875 - protein, 34 aa, Mycobacterium
GMRWAMRHLPFYGRWYRFLVLWPGSDKGLDAAES

SEQ ID NO: 883876 - protein, 26 aa, Mycobacterium
GMTDTLYRMPWSTMFPLGISSAVIGI

SEQ ID NO: 883877 - protein, 29 aa, Mycobacterium
GMTEPLYLMPWSTMFPLGISAATIGIAEG

SEQ ID NO: 883878 - protein, 19 aa, Mycobacterium
GMTMALLEAAALRDCLFEG

SEQ ID NO: 883879 - protein, 19 aa, Mycobacterium
GMTPLILMPGPVNRGMIFL

SEQ ID NO: 883880 - protein, 19 aa, Mycobacterium
GMVNVVCSVGLWARYRKLA

SEQ ID NO: 883881 - protein, 21 aa, Mycobacterium
GMVQFVPYFLGARTPPYPTAT

SEQ ID NO: 883882 - protein, 18 aa, Mycobacterium
GMVYFTVLLPLAQGIGMY

SEQ ID NO: 883883 - protein, 18 aa, Mycobacterium
GMWPAWWLSNDDPGRSGE

SEQ ID NO: 883884 - protein, 21 aa, Mycobacterium
GMYVHALLRYPVKSMLGEAVA

SEQ ID NO: 883885 - protein, 17 aa, Mycobacterium
GMYWWGPASAAMLAATG

SEQ ID NO: 883886 - protein, 20 aa, Mycobacterium
GNAGVLFGPGGIGGSGGQGM

SEQ ID NO: 883887 - protein, 28 aa, Mycobacterium
GNGDLIKKLLPILAPIVLAYIGKQFSQQ

SEQ ID NO: 883888 - protein, 23 aa, Mycobacterium
GNGGSGGFAFTFGTGNIIAGVGG

SEQ ID NO: 883889 - protein, 20 aa, Mycobacterium
GNIPLVYQYRHPFGRRLWEL

SEQ ID NO: 883890 - protein, 17 aa, Mycobacterium
GNMFALVEFIPGAPYIL

SEQ ID NO: 883891 - protein, 24 aa, Mycobacterium
GNNNWFAAYAYWYFKLYGHEKVKL

SEQ ID NO: 883892 - protein, 25 aa, Mycobacterium
GNNNWFAAYAYWYFKLYGHEKVKLL

SEQ ID NO: 883893 - protein, 24 aa, Mycobacterium
GNNNWFAAYAYWYFKLYGHQNVKL

SEQ ID NO: 883894 - protein, 19 aa, Mycobacterium
GNPDYGMRLSWDFLARSTA

SEQ ID NO: 883895 - protein, 25 aa, Mycobacterium
GNPLHPLALPLLRPKQVIMLGRPTL

SEQ ID NO: 883896 - protein, 18 aa, Mycobacterium
GNQWAWWGTPGPGAVVTG

SEQ ID NO: 883897 - protein, 28 aa, Mycobacterium
GNRDLLRQLLPIVLPIVLAYIGNQLGSG

SEQ ID NO: 883898 - protein, 30 aa, Mycobacterium
GNSDLIKQLLPILTPIVLAFVAKKLTGGGA

SEQ ID NO: 883899 - protein, 23 aa, Mycobacterium
GNSGLLNFGALQSGIRNLGSTIS

SEQ ID NO: 883900 - protein, 20 aa, Mycobacterium
GNYMTSFPSLWHVIDEDTGR

SEQ ID NO: 883901 - protein, 26 aa, Mycobacterium
GNYSNGLLWRGDYQGLLGFTYESTVP

SEQ ID NO: 883902 - protein, 24 aa, Mycobacterium
GPAGLGVFVGVPTFGDGGGGGAGG

SEQ ID NO: 883903 - protein, 21 aa, Mycobacterium
GPAHISYFDPAPLLTAIDPGR

SEQ ID NO: 883904 - protein, 23 aa, Mycobacterium
GPALKFQLLWYPSTMWDATLPSF

SEQ ID NO: 883905 - protein, 24 aa, Mycobacterium
GPDAIIPPTFLTTAGRWAPAGVRV

SEQ ID NO: 883906 - protein, 26 aa, Mycobacterium
GPDDALFVRPFLKYQIIAVAAPNSPV

SEQ ID NO: 883907 - protein, 22 aa, Mycobacterium
GPDGVLRWLALDGRPIHQFTVA

SEQ ID NO: 883908 - protein, 24 aa, Mycobacterium
GPDGVPRWLALDGTPLHHATVAAS

SEQ ID NO: 883909 - protein, 22 aa, Mycobacterium
GPDQPALWRAVAIRGVTTAAAT

SEQ ID NO: 883910 - protein, 23 aa, Mycobacterium
GPDWSFWPNRFLGSADPAVIGHR

SEQ ID NO: 883911 - protein, 19 aa, Mycobacterium
GPEPVLMLPMTLPGAGIAP

SEQ ID NO: 883912 - protein, 23 aa, Mycobacterium
GPEQILIELLPQAGLAALARGRI

SEQ ID NO: 883913 - protein, 22 aa, Mycobacterium
GPFTPGFRIVPFGDAAALERAI

SEQ ID NO: 883914 - protein, 18 aa, Mycobacterium
GPGGWLWGDGGDGGSGTP

SEQ ID NO: 883915 - protein, 23 aa, Mycobacterium
GPGSPLKFLVRAAGWPGGRTRVL

SEQ ID NO: 883916 - protein, 23 aa, Mycobacterium
GPGWSAWPIAPKAAAIPAGGMLD

SEQ ID NO: 883917 - protein, 19 aa, Mycobacterium
GPGYGLPWSVQTWLPGVVA

SEQ ID NO: 883918 - protein, 25 aa, Mycobacterium
GPIDRFHRRLLWPIRSSAGEVIGFG

SEQ ID NO: 883919 - protein, 25 aa, Mycobacterium
GPIDRFHRRLLWPIRTAAGEVIGFG

SEQ ID NO: 883920 - protein, 29 aa, Mycobacterium
GPIERFLEWWAPFANFLYDTAGLPFFGAG

SEQ ID NO: 883921 - protein, 23 aa, Mycobacterium
GPIGIGLWFALRGKGLESVYVAE

SEQ ID NO: 883922 - protein, 25 aa, Mycobacterium
GPIGKILRLIPLTKPLFGSYREKIA

SEQ ID NO: 883923 - protein, 24 aa, Mycobacterium
GPIPPIAFQLLWYPSTMWDQTLPS

SEQ ID NO: 883924 - protein, 17 aa, Mycobacterium
GPISIPILDLPTAPGFG

SEQ ID NO: 883925 - protein, 24 aa, Mycobacterium
GPKGFLDFPIPIDGLYLGGAGCHG

SEQ ID NO: 883926 - protein, 22 aa, Mycobacterium
GPLVGIWRRAPLQALARLHMLA

SEQ ID NO: 883927 - protein, 25 aa, Mycobacterium
GPMDRFHRRLLWPIRSSAGEVIGFG

SEQ ID NO: 883928 - protein, 18 aa, Mycobacterium
GPMFIRMAWHAAGTYRVG

SEQ ID NO: 883929 - protein, 23 aa, Mycobacterium
GPNILRAFTFPLEKVRVLIVGQD

SEQ ID NO: 883930 - protein, 30 aa, Mycobacterium
GPNQLGTFLYWMLWKRPGLDIYLLKSNLRL

SEQ ID NO: 883931 - protein, 21 aa, Mycobacterium
GPPVLPQWPLADGVAALAGAF

SEQ ID NO: 883932 - protein, 26 aa, Mycobacterium
GPQSLRPRLIWFAYRRLKEGRPIVTH

SEQ ID NO: 883933 - protein, 20 aa, Mycobacterium
GPQVPLYFLGAQVIGMYPLG

SEQ ID NO: 883934 - protein, 21 aa, Mycobacterium
GPRALLPATVLARWFRTERVR

SEQ ID NO: 883935 - protein, 17 aa, Mycobacterium
GPRLPWIPGLPPGMATW

SEQ ID NO: 883936 - protein, 28 aa, Mycobacterium
GPRTFGPYEIPLFSFPGPGFANSTTSPS

SEQ ID NO: 883937 - protein, 22 aa, Mycobacterium
GPSAPLRLLLVNGVPVVADDEL

SEQ ID NO: 883938 - protein, 19 aa, Mycobacterium
GPSQWLLRLLATQTQRAEL

SEQ ID NO: 883939 - protein, 19 aa, Mycobacterium
GPTALLAPAWVPWDQRVRP

SEQ ID NO: 883940 - protein, 18 aa, Mycobacterium
GPTAVLSGAYEAAAAAAK

SEQ ID NO: 883941 - protein, 20 aa, Mycobacterium
GPTQAIFGRPLIGDGAAGTA

SEQ ID NO: 883942 - protein, 18 aa, Mycobacterium
GPTTTTYYMIPTQNLPLL

SEQ ID NO: 883943 - protein, 18 aa, Mycobacterium
GPTVPLEGAPWFALSERN

SEQ ID NO: 883944 - protein, 23 aa, Mycobacterium
GPVDFVLLDGWKDLYLPVIELLE

SEQ ID NO: 883945 - protein, 24 aa, Mycobacterium
GPVSIGHAFLFRQLTEDLIYFTHG

SEQ ID NO: 883946 - protein, 17 aa, Mycobacterium
GPWKLIIAQHFASADEL

SEQ ID NO: 883947 - protein, 19 aa, Mycobacterium
GPWNFPVNLVVLPASAAFA

SEQ ID NO: 883948 - protein, 24 aa, Mycobacterium
GPYPERIIPCQLPWLLDPSAGAQL

SEQ ID NO: 883949 - protein, 21 aa, Mycobacterium
GPYVQLWPHRHGTDAMFAAAL

SEQ ID NO: 883950 - protein, 24 aa, Mycobacterium
GPYYFFGVLARLAALPSLTPILLP

SEQ ID NO: 883951 - protein, 22 aa, Mycobacterium
GQAGGAGGILWGNGGNGGSGGV

SEQ ID NO: 883952 - protein, 22 aa, Mycobacterium
GQEILLPALLPRAPYETTNRWT

SEQ ID NO: 883953 - protein, 18 aa, Mycobacterium
GQERLWLDHIVAGDLFGN

SEQ ID NO: 883954 - protein, 24 aa, Mycobacterium
GQGALLQLGLLQLAAQLAVSNGFT

SEQ ID NO: 883955 - protein, 25 aa, Mycobacterium
GQGHPILYVAQMWDWIYPLGEDPDY

SEQ ID NO: 883956 - protein, 18 aa, Mycobacterium
GQGWFWPAAAAHPSLPRG

SEQ ID NO: 883957 - protein, 23 aa, Mycobacterium
GQGWTSWLLQRVLRELLLDPRVT

SEQ ID NO: 883958 - protein, 28 aa, Mycobacterium
GQHISTLLLTLLFRFMRPLVEHGHIFLA

SEQ ID NO: 883959 - protein, 24 aa, Mycobacterium
GQHKLAFLAFLPYSGVLLNWGKLP

SEQ ID NO: 883960 - protein, 21 aa, Mycobacterium
GQIEDLWTVMYRGGFYRGGGI

SEQ ID NO: 883961 - protein, 18 aa, Mycobacterium
GQIYLLDNPLLRDPLTAS

SEQ ID NO: 883962 - protein, 21 aa, Mycobacterium
GQLDWMVLFSSCGYLAGFPGQ

SEQ ID NO: 883963 - protein, 23 aa, Mycobacterium
GQLGQLFTAPLAALAQPLQQLPQ

SEQ ID NO: 883964 - protein, 19 aa, Mycobacterium
GQLLPQPVRPIPILIGGGG

SEQ ID NO: 883965 - protein, 20 aa, Mycobacterium
GQLPVWWPDLVENGFHVVHV

SEQ ID NO: 883966 - protein, 24 aa, Mycobacterium
GQMLADLRWIGESLAAAAAGYAQM

SEQ ID NO: 883967 - protein, 17 aa, Mycobacterium
GQMPIHMRLPKLKGFKN

SEQ ID NO: 883968 - protein, 23 aa, Mycobacterium
GQMPIHMRLPKLKGFKNRFRTEY

SEQ ID NO: 883969 - protein, 21 aa, Mycobacterium
GQPFYNFLLTVLFEWGVAVHD

SEQ ID NO: 883970 - protein, 23 aa, Mycobacterium
GQPLDWFCLFSSGAALLGSPGQG

SEQ ID NO: 883971 - protein, 23 aa, Mycobacterium
GQPLDWFCLFSSGAALMGSPGQG

SEQ ID NO: 883972 - protein, 20 aa, Mycobacterium
GQPLLRIWPVSAHTPAALTA

SEQ ID NO: 883973 - protein, 20 aa, Mycobacterium
GQPPIPPWASPPPPPSLQAT

SEQ ID NO: 883974 - protein, 23 aa, Mycobacterium
GQQATWDRLWPQLGRQARDGDEP

SEQ ID NO: 883975 - protein, 18 aa, Mycobacterium
GQSLWRIPGQRARRAVRG

SEQ ID NO: 883976 - protein, 25 aa, Mycobacterium
GQTGARFWPWLAYSGAILRGTKLST

SEQ ID NO: 883977 - protein, 28 aa, Mycobacterium
GQVAPWNYPMMMAIWKICPAVAAGNTVV

SEQ ID NO: 883978 - protein, 28 aa, Mycobacterium
GQVTPWNYPFMMAIWKIGPALAAGNTVV

SEQ ID NO: 883979 - protein, 23 aa, Mycobacterium
GQVWLMPHNPLFEPIPGNDAAIL

SEQ ID NO: 883980 - protein, 21 aa, Mycobacterium
GRAAFLPPYLISGQGLAVDTT

SEQ ID NO: 883981 - protein, 25 aa, Mycobacterium
GRALWPILLSIWEWERRWVPEQRDA

SEQ ID NO: 883982 - protein, 26 aa, Mycobacterium
GRAYSPRFMWMWPNARISVMGGEQAA

SEQ ID NO: 883983 - protein, 25 aa, Mycobacterium
GRDAPLLHWVIFEEEYFRAGAPGRA

SEQ ID NO: 883984 - protein, 23 aa, Mycobacterium
GRDDLWRLFVYDPSLDRKPTDSE

SEQ ID NO: 883985 - protein, 32 aa, Mycobacterium
GRDDVFFWYTSPSWMMWNFQVAGLLVGATIVC

SEQ ID NO: 883986 - protein, 18 aa, Mycobacterium
GRDLAALWRRALGLAGGP

SEQ ID NO: 883987 - protein, 23 aa, Mycobacterium
GRDLSLVYDIPLGLSLTAALKRT

SEQ ID NO: 883988 - protein, 17 aa, Mycobacterium
GREDYWLARLKASNAPT

SEQ ID NO: 883989 - protein, 20 aa, Mycobacterium
GRFFALPWYYRSGYDVVMYT

SEQ ID NO: 883990 - protein, 18 aa, Mycobacterium
GRFQILLLELMGSTLLLL

SEQ ID NO: 883991 - protein, 24 aa, Mycobacterium
GRGALLQLGLLQLALRLAVDNGFI

SEQ ID NO: 883992 - protein, 24 aa, Mycobacterium
GRGALLQLGLLQLALRLAVENGFI

SEQ ID NO: 883993 - protein, 21 aa, Mycobacterium
GRGFFFEKVFPAFWGLKATKN

SEQ ID NO: 883994 - protein, 29 aa, Mycobacterium
GRGLFFKTLYPALWRFPPIKPFRGAYVLL

SEQ ID NO: 883995 - protein, 20 aa, Mycobacterium
GRGPGRFWGVYGLKKAIAVV

SEQ ID NO: 883996 - protein, 19 aa, Mycobacterium
GRGYLDMFTFFASSALGMN

SEQ ID NO: 883997 - protein, 24 aa, Mycobacterium
GRHHRFRLFGPGPVLVRRGGHQAA

SEQ ID NO: 883998 - protein, 18 aa, Mycobacterium
GRIARILGPRGLMPNPKT

SEQ ID NO: 883999 - protein, 20 aa, Mycobacterium
GRIGWTCRDIWWAATQDPRA

SEQ ID NO: 884000 - protein, 20 aa, Mycobacterium
GRILTAMSVFFFGLVTAPNH

SEQ ID NO: 884001 - protein, 17 aa, Mycobacterium
GRILVPINFRLAPAEIE

SEQ ID NO: 884002 - protein, 26 aa, Mycobacterium
GRKRGHWMWFVFPQLRGLGSSPTADR

SEQ ID NO: 884003 - protein, 25 aa, Mycobacterium
GRKRTHWIWFVFPQLRGLGRSPTAH

SEQ ID NO: 884004 - protein, 25 aa, Mycobacterium
GRKRTHWMWFVFPQLRGLGHSPMAD

SEQ ID NO: 884005 - protein, 17 aa, Mycobacterium
GRLAILDWLLSGPGDRW

SEQ ID NO: 884006 - protein, 17 aa, Mycobacterium
GRLAKPADIGWAAAFLA

SEQ ID NO: 884007 - protein, 19 aa, Mycobacterium
GRLLAPNEFFVLLSTADHE

SEQ ID NO: 884008 - protein, 18 aa, Mycobacterium
GRLLFDPLRAKLAEYARL

SEQ ID NO: 884009 - protein, 17 aa, Mycobacterium
GRLLIIDCGVLFPTHDE

SEQ ID NO: 884010 - protein, 18 aa, Mycobacterium
GRLLIVDCGVLFPTHDEP

SEQ ID NO: 884011 - protein, 20 aa, Mycobacterium
GRLPRPVLTDLQWAIREGRE

SEQ ID NO: 884012 - protein, 27 aa, Mycobacterium
GRLQFQHQLLLVPLLDTLFDSASWREL

SEQ ID NO: 884013 - protein, 18 aa, Mycobacterium
GRLTAWFKEFVLTGVPWG

SEQ ID NO: 884014 - protein, 21 aa, Mycobacterium
GRLTITLASHGGFKLDSCTSN

SEQ ID NO: 884015 - protein, 18 aa, Mycobacterium
GRLYQYWRRNLDPERYRR

SEQ ID NO: 884016 - protein, 24 aa, Mycobacterium
GRNDLWRLFVYDPALNRKPSDSEI

SEQ ID NO: 884017 - protein, 17 aa, Mycobacterium
GRPAIDMLTWQMALCRP

SEQ ID NO: 884018 - protein, 17 aa, Mycobacterium
GRPAVVTPLLLASAYHA

SEQ ID NO: 884019 - protein, 27 aa, Mycobacterium
GRPLHLHRILLQRSWIAIFWGRFAQAV

SEQ ID NO: 884020 - protein, 17 aa, Mycobacterium
GRPLIGNGTPGAAGSGA

SEQ ID NO: 884021 - protein, 17 aa, Mycobacterium
GRPLIGNGTPGAAGSGT

SEQ ID NO: 884022 - protein, 18 aa, Mycobacterium
GRPLMAWMFQRFLHNLRR

SEQ ID NO: 884023 - protein, 21 aa, Mycobacterium
GRPRGYLRKFGLSRVRVRELV

SEQ ID NO: 884024 - protein, 20 aa, Mycobacterium
GRPVVLIHGWPLHSDSWAHQ

SEQ ID NO: 884025 - protein, 23 aa, Mycobacterium
GRQLPLRLVYVIPAADVPGGSAQ

SEQ ID NO: 884026 - protein, 24 aa, Mycobacterium
GRQRAIPLISFISRQMDLRKWFAD

SEQ ID NO: 884027 - protein, 27 aa, Mycobacterium
GRRELLQRLLPLVLPIVLAYLGNQLRP

SEQ ID NO: 884028 - protein, 21 aa, Mycobacterium
GRRFWIVGLEPERHWPALCRA

SEQ ID NO: 884029 - protein, 19 aa, Mycobacterium
GRRIAPLRKLPPARPLPRR

SEQ ID NO: 884030 - protein, 17 aa, Mycobacterium
GRRLWELPAGLLDLGGE

SEQ ID NO: 884031 - protein, 27 aa, Mycobacterium
GRRQTLERLKYLPLAPFRVSYAYTNYG

SEQ ID NO: 884032 - protein, 19 aa, Mycobacterium
GRRTARLDTLFALTKALGA

SEQ ID NO: 884033 - protein, 26 aa, Mycobacterium
GRRVHLDLDPLLPFPGWHEHAPAVEE

SEQ ID NO: 884034 - protein, 23 aa, Mycobacterium
GRRVLEMLPIPPIALNLRTGVAM

SEQ ID NO: 884035 - protein, 18 aa, Mycobacterium
GRRWPLYGPAMLGKSIHS

SEQ ID NO: 884036 - protein, 18 aa, Mycobacterium
GRRYLDMFTFVASSALGM

SEQ ID NO: 884037 - protein, 17 aa, Mycobacterium
GRSWPLADVRLLAPILA

SEQ ID NO: 884038 - protein, 21 aa, Mycobacterium
GRTCLLTPPPWYPILRGTTQQ

SEQ ID NO: 884039 - protein, 18 aa, Mycobacterium
GRTFFLATRLLAPDQRPA

SEQ ID NO: 884040 - protein, 25 aa, Mycobacterium
GRTRFRPHFFPFTEPSAEVDIWFPD

SEQ ID NO: 884041 - protein, 25 aa, Mycobacterium
GRTRFRPHFFPFTEPSAEVDIWFPG

SEQ ID NO: 884042 - protein, 19 aa, Mycobacterium
GRVRWYGPDELRFGYRTSI

SEQ ID NO: 884043 - protein, 20 aa, Mycobacterium
GRVTLPFWMIYDSAGDRDGV

SEQ ID NO: 884044 - protein, 20 aa, Mycobacterium
GRWELSWWAGPWPIDERWWE

SEQ ID NO: 884045 - protein, 18 aa, Mycobacterium
GRWSWRWDPAFVTSNFQF

SEQ ID NO: 884046 - protein, 17 aa, Mycobacterium
GRYRPFYLRNLLDAVQG

SEQ ID NO: 884047 - protein, 23 aa, Mycobacterium
GRYSPYAVYLLGGDPGLLAPVRD

SEQ ID NO: 884048 - protein, 22 aa, Mycobacterium
GRYVIGRLIWQAGLLAPVEGPL

SEQ ID NO: 884049 - protein, 17 aa, Mycobacterium
GSAFWLRTAATLDFDPL

SEQ ID NO: 884050 - protein, 17 aa, Mycobacterium
GSAQPLWALWRFGTEPG

SEQ ID NO: 884051 - protein, 22 aa, Mycobacterium
GSARFWWFGVIPAWTHHLTIKR

SEQ ID NO: 884052 - protein, 18 aa, Mycobacterium
GSAWIYPGAIPLAPVYRW

SEQ ID NO: 884053 - protein, 25 aa, Mycobacterium
GSEALALLRLPLVLPAVQLAGRIAG

SEQ ID NO: 884054 - protein, 22 aa, Mycobacterium
GSEGLLVLPYLAGERTPVFDPQ

SEQ ID NO: 884055 - protein, 20 aa, Mycobacterium
GSFPFFVGPAGAIAKSAFDK

SEQ ID NO: 884056 - protein, 22 aa, Mycobacterium
GSFWWSWRHQLTGLRDARVVAV

SEQ ID NO: 884057 - protein, 25 aa, Mycobacterium
GSGGTVDLAFPGTAGHGGDGGAGGG

SEQ ID NO: 884058 - protein, 23 aa, Mycobacterium
GSGPAYFLLMVEALVDAGVAAGL

SEQ ID NO: 884059 - protein, 18 aa, Mycobacterium
GSGPRYGFRPTIMSRPPA

SEQ ID NO: 884060 - protein, 26 aa, Mycobacterium
GSGRRPLYYLEMPPALFAPIVENLAA

SEQ ID NO: 884061 - protein, 17 aa, Mycobacterium
GSHLLLAAGRRPNTDDL

SEQ ID NO: 884062 - protein, 18 aa, Mycobacterium
GSITLLPLYFELDGSFPN

SEQ ID NO: 884063 - protein, 19 aa, Mycobacterium
GSITLLPLYFELDGSFPNH

SEQ ID NO: 884064 - protein, 22 aa, Mycobacterium
GSLAALGAMWLARRRRCVDAQQ

SEQ ID NO: 884065 - protein, 24 aa, Mycobacterium
GSLEIFLTPQLPPPMVRIYGATPI

SEQ ID NO: 884066 - protein, 22 aa, Mycobacterium
GSLGFLYDTGLYLRFRATDPDG

SEQ ID NO: 884067 - protein, 17 aa, Mycobacterium
GSLIRWFQTLIGGAELT

SEQ ID NO: 884068 - protein, 17 aa, Mycobacterium
GSLVVGYRIGCGIIGGP

SEQ ID NO: 884069 - protein, 18 aa, Mycobacterium
GSPAGELLDPLVNAPFES

SEQ ID NO: 884070 - protein, 23 aa, Mycobacterium
GSPHGGTWLPWLTDRGFTAVHSQ

SEQ ID NO: 884071 - protein, 17 aa, Mycobacterium
GSPLLGLMLPYSPIHHL

SEQ ID NO: 884072 - protein, 25 aa, Mycobacterium
GSPWAVPLSWLLPPRIALQILMTGD

SEQ ID NO: 884073 - protein, 17 aa, Mycobacterium
GSQPWPFPRSLMVGFHA

SEQ ID NO: 884074 - protein, 19 aa, Mycobacterium
GSRFYFLTGAGALLQLGLL

SEQ ID NO: 884075 - protein, 23 aa, Mycobacterium
GSRPPLLKRIVLQTAARLSPRGR

SEQ ID NO: 884076 - protein, 25 aa, Mycobacterium
GSRVEFWAFDLLYLDGRSLLRARYQ

SEQ ID NO: 884077 - protein, 25 aa, Mycobacterium
GSRVEFWAFDLLYLDGRSLLRARYR

SEQ ID NO: 884078 - protein, 19 aa, Mycobacterium
GSSPWFFEDALARGLRLGA

SEQ ID NO: 884079 - protein, 26 aa, Mycobacterium
GSVENYVAVPWFWTHQYSAKLQIAGK

SEQ ID NO: 884080 - protein, 23 aa, Mycobacterium
GSVRWVSPEFLRFGYRTSVLKHS

SEQ ID NO: 884081 - protein, 19 aa, Mycobacterium
GSYHCGLTFQFAHGPYASS

SEQ ID NO: 884082 - protein, 18 aa, Mycobacterium
GSYYVEWLTHQLAERARA

SEQ ID NO: 884083 - protein, 23 aa, Mycobacterium
GSYYVEWLTHQLAQKARAHIAEV

SEQ ID NO: 884084 - protein, 19 aa, Mycobacterium
GTACAHLLLWRADAPWERL

SEQ ID NO: 884085 - protein, 25 aa, Mycobacterium
GTADLFLWPTLYLWEFPKPTISAIH

SEQ ID NO: 884086 - protein, 25 aa, Mycobacterium
GTADLFLWPTLYLWEFPKPTISQIH

SEQ ID NO: 884087 - protein, 26 aa, Mycobacterium
GTADLFLWPTLYLWEFPKPTISQIHG

SEQ ID NO: 884088 - protein, 20 aa, Mycobacterium
GTAHLGPLAIHGQSGDPGQS

SEQ ID NO: 884089 - protein, 18 aa, Mycobacterium
GTAYQTFWTNLLNTIPGG

SEQ ID NO: 884090 - protein, 25 aa, Mycobacterium
GTEQLSHTFALIDLLPWGRQEEWLD

SEQ ID NO: 884091 - protein, 24 aa, Mycobacterium
GTEQLSHTFALIDLLPYGRQEQWQ

SEQ ID NO: 884092 - protein, 24 aa, Mycobacterium
GTEQLSHTFALIDVLPWGRQEEWL

SEQ ID NO: 884093 - protein, 18 aa, Mycobacterium
GTEVKALWWDEGRRQWQI

SEQ ID NO: 884094 - protein, 24 aa, Mycobacterium
GTGGALLPLLLFASARAAIPFTPL

SEQ ID NO: 884095 - protein, 24 aa, Mycobacterium
GTGGALLPLLLFASARAAVPVTPL

SEQ ID NO: 884096 - protein, 23 aa, Mycobacterium
GTGGALLPLLLFSSARANTAFTP

SEQ ID NO: 884097 - protein, 25 aa, Mycobacterium
GTGGAMLPLLIFASARAGLPFTSIN

SEQ ID NO: 884098 - protein, 18 aa, Mycobacterium
GTGGLFEAAGSGGAGGVG

SEQ ID NO: 884099 - protein, 18 aa, Mycobacterium
GTGGLLWGNGGIGGQGGT

SEQ ID NO: 884100 - protein, 19 aa, Mycobacterium
GTGPRYGFRLTIMPRPLSG

SEQ ID NO: 884101 - protein, 29 aa, Mycobacterium
GTIDSPLWRDGLWLRLALPRALAGADPAA

SEQ ID NO: 884102 - protein, 18 aa, Mycobacterium
GTITVRYRRLTPLGRLHS

SEQ ID NO: 884103 - protein, 23 aa, Mycobacterium
GTLSYFPLWGYATQPAIELAERL

SEQ ID NO: 884104 - protein, 21 aa, Mycobacterium
GTLYPAFWRFPPVKPYRGVFA

SEQ ID NO: 884105 - protein, 18 aa, Mycobacterium
GTMGLILRGSDELKKQVL

SEQ ID NO: 884106 - protein, 19 aa, Mycobacterium
GTNLDPLFDVLLEHVPPPQ

SEQ ID NO: 884107 - protein, 20 aa, Mycobacterium
GTPCLLTPPPWYPILRGTTQ

SEQ ID NO: 884108 - protein, 22 aa, Mycobacterium
GTPLWGGWITGPTWLGPEEFAR

SEQ ID NO: 884109 - protein, 17 aa, Mycobacterium
GTQWILRRPPFGRLQAG

SEQ ID NO: 884110 - protein, 19 aa, Mycobacterium
GTSGLLLGLDGFNAPASAS

SEQ ID NO: 884111 - protein, 17 aa, Mycobacterium
GTSGLLLGLDGFNAPTS

SEQ ID NO: 884112 - protein, 23 aa, Mycobacterium
GTVLLEYPVWMWHWARPGDPAVP

SEQ ID NO: 884113 - protein, 18 aa, Mycobacterium
GTVLLMLAALRRLPQLDR

SEQ ID NO: 884114 - protein, 23 aa, Mycobacterium
GTVRNWPWRRLALSKTANTYSRL

SEQ ID NO: 884115 - protein, 24 aa, Mycobacterium
GTVRNWPWRRLALSKTANTYSRLA

SEQ ID NO: 884116 - protein, 20 aa, Mycobacterium
GTWTIRFFMPAKWTLDALPV

SEQ ID NO: 884117 - protein, 24 aa, Mycobacterium
GTYTFHRRVLQLLQWHCPPTLWHL

SEQ ID NO: 884118 - protein, 23 aa, Mycobacterium
GVAFDILRRWLIARGFDVAFIRN

SEQ ID NO: 884119 - protein, 21 aa, Mycobacterium
GVAHQLLLLNAALGGPALVDA

SEQ ID NO: 884120 - protein, 26 aa, Mycobacterium
GVALEWLRYRAGLASTPLIPVIGPRT

SEQ ID NO: 884121 - protein, 28 aa, Mycobacterium
GVAVAAHNPLLLRLLKGLRVALDRTSET

SEQ ID NO: 884122 - protein, 23 aa, Mycobacterium
GVAVRGFPNYFFITGPDAAAQGR

SEQ ID NO: 884123 - protein, 24 aa, Mycobacterium
GVAVRGFPNYFFITGPDPDAQARY

SEQ ID NO: 884124 - protein, 17 aa, Mycobacterium
GVDALILLLNGYVGYAT

SEQ ID NO: 884125 - protein, 19 aa, Mycobacterium
GVDHLWLHPVLVGRDRWHE

SEQ ID NO: 884126 - protein, 17 aa, Mycobacterium
GVDLLLPPKYVGAEQGG

SEQ ID NO: 884127 - protein, 18 aa, Mycobacterium
GVDPLILRQAYPVPQDPY

SEQ ID NO: 884128 - protein, 25 aa, Mycobacterium
GVDYLDLYLIHWPVPENNKFVDTFK

SEQ ID NO: 884129 - protein, 25 aa, Mycobacterium
GVEPKPLKGMPPFSGPQGPFAGITS

SEQ ID NO: 884130 - protein, 18 aa, Mycobacterium
GVEWRMIQLLILEGDRLT

SEQ ID NO: 884131 - protein, 19 aa, Mycobacterium
GVEYPIPEPFLVIATQNPV

SEQ ID NO: 884132 - protein, 23 aa, Mycobacterium
GVFVKFHWKPLLGVHSLLWDECQ

SEQ ID NO: 884133 - protein, 17 aa, Mycobacterium
GVGFARRRVSPKTRYVL

SEQ ID NO: 884134 - protein, 23 aa, Mycobacterium
GVGFAYFQMDWPAVTQWLAEARN

SEQ ID NO: 884135 - protein, 23 aa, Mycobacterium
GVGGAGGISLLWGSGGDGGDGGA

SEQ ID NO: 884136 - protein, 24 aa, Mycobacterium
GVGGPSCQWLLKSPAHLWQLEALL

SEQ ID NO: 884137 - protein, 30 aa, Mycobacterium
GVGHPILYVAQAWDWIFPLTEDPNYEPAAA

SEQ ID NO: 884138 - protein, 24 aa, Mycobacterium
GVGKGTIYLYWPSKLELFGAVFTR

SEQ ID NO: 884139 - protein, 18 aa, Mycobacterium
GVGLWLPARTMAGLADDP

SEQ ID NO: 884140 - protein, 23 aa, Mycobacterium
GVGRSGFYFYFDSKYSVLAQMVG

SEQ ID NO: 884141 - protein, 25 aa, Mycobacterium
GVINAPTQALLGRPLIGDGTAGAPG

SEQ ID NO: 884142 - protein, 27 aa, Mycobacterium
GVITPFNFPIAIPAWKIAPALVYGNAV

SEQ ID NO: 884143 - protein, 27 aa, Mycobacterium
GVIWQTLYPFDWLARLPIPVNRRFRSA

SEQ ID NO: 884144 - protein, 19 aa, Mycobacterium
GVKRFVMVSYFGAGPDHGL

SEQ ID NO: 884145 - protein, 19 aa, Mycobacterium
GVLGADFRPLVFDGLFLQL

SEQ ID NO: 884146 - protein, 19 aa, Mycobacterium
GVLGKVRFLYFSPREYIVI

SEQ ID NO: 884147 - protein, 25 aa, Mycobacterium
GVLGPAGTAPIPPSSLPAATGTRGD

SEQ ID NO: 884148 - protein, 26 aa, Mycobacterium
GVLLGIMPWNFPYYQVARFACPNLLV

SEQ ID NO: 884149 - protein, 24 aa, Mycobacterium
GVLNERWLTYYRKLPPAAVMNDLR

SEQ ID NO: 884150 - protein, 26 aa, Mycobacterium
GVLNSPTQALLGRPLIGDGAAGAPGQ

SEQ ID NO: 884151 - protein, 20 aa, Mycobacterium
GVMLSALWVAPTGQLVLIVH

SEQ ID NO: 884152 - protein, 19 aa, Mycobacterium
GVMLVLFSTPWRLEGFQRD

SEQ ID NO: 884153 - protein, 17 aa, Mycobacterium
GVMLWFIQDESGLHLRC

SEQ ID NO: 884154 - protein, 17 aa, Mycobacterium
GVMQLTHPAFLILDSPD

SEQ ID NO: 884155 - protein, 18 aa, Mycobacterium
GVMQLTHPAFLILDSPDG

SEQ ID NO: 884156 - protein, 19 aa, Mycobacterium
GVMWACVFMRTGARRVHFG

SEQ ID NO: 884157 - protein, 25 aa, Mycobacterium
GVNGQLFIVYGPTVTLIAAPTAERQ

SEQ ID NO: 884158 - protein, 24 aa, Mycobacterium
GVNLTYLPFIARAVIDALKLHPNV

SEQ ID NO: 884159 - protein, 18 aa, Mycobacterium
GVPESKWVYLHGHSDLVE

SEQ ID NO: 884160 - protein, 24 aa, Mycobacterium
GVPGGRLHALPQPVLRPPTRVDDV

SEQ ID NO: 884161 - protein, 18 aa, Mycobacterium
GVPGIIFGPALSGGNSGL

SEQ ID NO: 884162 - protein, 23 aa, Mycobacterium
GVPLVFLTAFYGLSDLAGVRAGQ

SEQ ID NO: 884163 - protein, 23 aa, Mycobacterium
GVPVAFLTAWYGLADLAGVRAGE

SEQ ID NO: 884164 - protein, 22 aa, Mycobacterium
GVRDWWSMDWLWSALHLNDGTH

SEQ ID NO: 884165 - protein, 21 aa, Mycobacterium
GVRPRVWFGEGWITSVLDLYH

SEQ ID NO: 884166 - protein, 22 aa, Mycobacterium
GVRPWLPHFYLGHGIGVNAAEM

SEQ ID NO: 884167 - protein, 18 aa, Mycobacterium
GVRSMLSFQLFTFGENLG

SEQ ID NO: 884168 - protein, 28 aa, Mycobacterium
GVSIPDYPNFFLVLGPYGYVFGPYHMLI

SEQ ID NO: 884169 - protein, 26 aa, Mycobacterium
GVSKALFYFYFPRKEDVLFEVGVLST

SEQ ID NO: 884170 - protein, 22 aa, Mycobacterium
GVTPMRWIIDQRVLRARRLLEE

SEQ ID NO: 884171 - protein, 21 aa, Mycobacterium
GVTPRRFLALANPGLRELLDR

SEQ ID NO: 884172 - protein, 19 aa, Mycobacterium
GVTRFVMVSYFGAGPDHGV

SEQ ID NO: 884173 - protein, 17 aa, Mycobacterium
GVTRWRDGLPRIVHLLA

SEQ ID NO: 884174 - protein, 26 aa, Mycobacterium
GVTSEHPLWLFTLRAQSWTADYGTTA

SEQ ID NO: 884175 - protein, 23 aa, Mycobacterium
GVTSFKFFMAYKGVFLSDDGQIL

SEQ ID NO: 884176 - protein, 19 aa, Mycobacterium
GVTSFKLFMAYPGVYYSDD

SEQ ID NO: 884177 - protein, 27 aa, Mycobacterium
GVTSRGLLRAPLLDRPLPTLLVCGSHT

SEQ ID NO: 884178 - protein, 31 aa, Mycobacterium
GVVGLVTPWNFPIAIPAWKMAPALVSGNAVV

SEQ ID NO: 884179 - protein, 19 aa, Mycobacterium
GVVLAPRKQWPTGLAKLGI

SEQ ID NO: 884180 - protein, 20 aa, Mycobacterium
GVVLFLDELVLWLAFSVRDT

SEQ ID NO: 884181 - protein, 23 aa, Mycobacterium
GVVNFFGQLLQLLKNRLLLTDLL

SEQ ID NO: 884182 - protein, 20 aa, Mycobacterium
GVVNFYGQLLQLLKNRLLLS

SEQ ID NO: 884183 - protein, 21 aa, Mycobacterium
GVVRPDLVIGWWAVPTILEHG

SEQ ID NO: 884184 - protein, 20 aa, Mycobacterium
GVVSILTPWNFPHSLNVMKL

SEQ ID NO: 884185 - protein, 21 aa, Mycobacterium
GVVWVLMHWRPVSAANPHQVP

SEQ ID NO: 884186 - protein, 19 aa, Mycobacterium
GVWELFWPDFPTNGLYKFR

SEQ ID NO: 884187 - protein, 23 aa, Mycobacterium
GVWELFWPGFPADGLYKFRVHGA

SEQ ID NO: 884188 - protein, 20 aa, Mycobacterium
GVYAAWFTLLGHGPTMGTVV

SEQ ID NO: 884189 - protein, 20 aa, Mycobacterium
GVYAAWFTLLGHGPVTGTVV

SEQ ID NO: 884190 - protein, 22 aa, Mycobacterium
GWHAEWLVLRECLRLAGGAAQT

SEQ ID NO: 884191 - protein, 17 aa, Mycobacterium
GWHALRKIASRITTPLL

SEQ ID NO: 884192 - protein, 17 aa, Mycobacterium
GWHLLPELAADGALLAS

SEQ ID NO: 884193 - protein, 18 aa, Mycobacterium
GWHPKAEDLLWRPDLQQP

SEQ ID NO: 884194 - protein, 24 aa, Mycobacterium
GWIGHRALWIPSLLLHTVGAKTGK

SEQ ID NO: 884195 - protein, 17 aa, Mycobacterium
GWIMIAAYDPARWNALC

SEQ ID NO: 884196 - protein, 17 aa, Mycobacterium
GWIYLAGRTADWMRVDG

SEQ ID NO: 884197 - protein, 24 aa, Mycobacterium
GWLGRFLTLQWLERLAPVGGTLIT

SEQ ID NO: 884198 - protein, 17 aa, Mycobacterium
GWLLNFTGQRFKGMGKI

SEQ ID NO: 884199 - protein, 18 aa, Mycobacterium
GWLLTTAPSGLLPFTSRL

SEQ ID NO: 884200 - protein, 17 aa, Mycobacterium
GWLLTTFLQSAGAETFV

SEQ ID NO: 884201 - protein, 19 aa, Mycobacterium
GWLVAVPELHSLRAPGHTC

SEQ ID NO: 884202 - protein, 23 aa, Mycobacterium
GWPENWWMWHKVIPALAAAGYRV

SEQ ID NO: 884203 - protein, 23 aa, Mycobacterium
GWPNQQFALLFPDWLTADPDARA

SEQ ID NO: 884204 - protein, 20 aa, Mycobacterium
GWREYMWHLYWHFGPDYTQK

SEQ ID NO: 884205 - protein, 19 aa, Mycobacterium
GWRISIPAMLCYWSELTRP

SEQ ID NO: 884206 - protein, 17 aa, Mycobacterium
GWRRVLLLADADGYLFT

SEQ ID NO: 884207 - protein, 21 aa, Mycobacterium
GWRWHTWHLYPLHPGGSGGTV

SEQ ID NO: 884208 - protein, 17 aa, Mycobacterium
GWVRMDFIVPSRGLIGF

SEQ ID NO: 884209 - protein, 19 aa, Mycobacterium
GWYNTYFFNQPALEDALEA

SEQ ID NO: 884210 - protein, 26 aa, Mycobacterium
GYAERMLLSAPLLLPIPNGLDFKHAA

SEQ ID NO: 884211 - protein, 26 aa, Mycobacterium
GYAERMLLSAPLLLPIPRDLNPKHAA

SEQ ID NO: 884212 - protein, 18 aa, Mycobacterium
GYCEVTAPKWYFVYNHIK

SEQ ID NO: 884213 - protein, 19 aa, Mycobacterium
GYCFQIDLTWRAINNGFSV

SEQ ID NO: 884214 - protein, 24 aa, Mycobacterium
GYDAIVMFLDELVLWLAFRVRDAE

SEQ ID NO: 884215 - protein, 20 aa, Mycobacterium
GYDILFFWVARMMMFGTFVA

SEQ ID NO: 884216 - protein, 18 aa, Mycobacterium
GYDLAYFHRMLAAGAVDC

SEQ ID NO: 884217 - protein, 25 aa, Mycobacterium
GYEDLAWFCVRAWRFGAPASYGAGG

SEQ ID NO: 884218 - protein, 17 aa, Mycobacterium
GYFCKRPCFHDEYLQAF

SEQ ID NO: 884219 - protein, 22 aa, Mycobacterium
GYGRNYLLPRGLAIVASRGAQK

SEQ ID NO: 884220 - protein, 23 aa, Mycobacterium
GYGRNYLLPRGLAIVATRGAERQ

SEQ ID NO: 884221 - protein, 20 aa, Mycobacterium
GYLDFARFGPPSYAVLDATA

SEQ ID NO: 884222 - protein, 24 aa, Mycobacterium
GYLGRFLCLDWLERLAPTGGTVIC

SEQ ID NO: 884223 - protein, 18 aa, Mycobacterium
GYLIVEPVKRDGSTGSSI

SEQ ID NO: 884224 - protein, 19 aa, Mycobacterium
GYLMFRFIVPSRPPTRRTV

SEQ ID NO: 884225 - protein, 21 aa, Mycobacterium
GYLVTPVPLLYRPTSNTLVGH

SEQ ID NO: 884226 - protein, 23 aa, Mycobacterium
GYNPFSALWYNTEGLPYFSVGMG

SEQ ID NO: 884227 - protein, 20 aa, Mycobacterium
GYRGCYRYIKEPDLFALELS

SEQ ID NO: 884228 - protein, 17 aa, Mycobacterium
GYRLLQRLGADVADYGF

SEQ ID NO: 884229 - protein, 18 aa, Mycobacterium
GYRTNEILRWLFTPDESL

SEQ ID NO: 884230 - protein, 25 aa, Mycobacterium
GYSERMLLSAPLLLPVPNGLDFKHA

SEQ ID NO: 884231 - protein, 24 aa, Mycobacterium
GYSWGPLAWMLLAQALGQRGMPVE

SEQ ID NO: 884232 - protein, 18 aa, Mycobacterium
GYVALPAYLAARGGLTGR

SEQ ID NO: 884233 - protein, 24 aa, Mycobacterium
GYVLRRLLRRIIRAAKLLGVEQPI

SEQ ID NO: 884234 - protein, 24 aa, Mycobacterium
GYVLRRLLRRIIRAAKLLGVEQPV

SEQ ID NO: 884235 - protein, 19 aa, Mycobacterium
GYVPPFPYFMDSPNAFRVL

SEQ ID NO: 884236 - protein, 18 aa, Mycobacterium
HAADYQRLAGQAAALHTQ

SEQ ID NO: 884237 - protein, 24 aa, Mycobacterium
HAAEHPLWYRFATANPPRLGAESD

SEQ ID NO: 884238 - protein, 17 aa, Mycobacterium
HAALMWSLMRRDEQFRS

SEQ ID NO: 884239 - protein, 18 aa, Mycobacterium
HAAVFWIARGRTATRETA

SEQ ID NO: 884240 - protein, 20 aa, Mycobacterium
HAAWFLHVQGVLVPAAGGVG

SEQ ID NO: 884241 - protein, 21 aa, Mycobacterium
HAELASLLRFILELLGDYGLE

SEQ ID NO: 884242 - protein, 25 aa, Mycobacterium
HAERFTLLRPLLFTIAYEMLGSATE

SEQ ID NO: 884243 - protein, 23 aa, Mycobacterium
HAERLELLFAQRVRILAAMERLT

SEQ ID NO: 884244 - protein, 18 aa, Mycobacterium
HAFFVPPVIARFLDAGEA

SEQ ID NO: 884245 - protein, 18 aa, Mycobacterium
HAFFVPPVIARFLQAGEA

SEQ ID NO: 884246 - protein, 18 aa, Mycobacterium
HAFGRRLWELPAGLLDSA

SEQ ID NO: 884247 - protein, 18 aa, Mycobacterium
HAFGRRLWELPAGLLDVA

SEQ ID NO: 884248 - protein, 23 aa, Mycobacterium
HAGLDLLPRLLLRGGDRGDELDV

SEQ ID NO: 884249 - protein, 25 aa, Mycobacterium
HAGYMFKLWDQLVWGSTLVVPPTPW

SEQ ID NO: 884250 - protein, 21 aa, Mycobacterium
HAIWWQVYPLGFVGAFPANQP

SEQ ID NO: 884251 - protein, 20 aa, Mycobacterium
HAIWWQVYPLGSVGAFPASE

SEQ ID NO: 884252 - protein, 20 aa, Mycobacterium
HALAPRYHDGAPGAGGVGGD

SEQ ID NO: 884253 - protein, 19 aa, Mycobacterium
HALLLALRKDPQVTALWVA

SEQ ID NO: 884254 - protein, 17 aa, Mycobacterium
HALRLRRLHYVRTARRR

SEQ ID NO: 884255 - protein, 21 aa, Mycobacterium
HAPFRIGFLERDAWLRCMHTA

SEQ ID NO: 884256 - protein, 20 aa, Mycobacterium
HAPFRIGYLERDAWLRCMHT

SEQ ID NO: 884257 - protein, 18 aa, Mycobacterium
HAPPFRFFAHADAVFFMF

SEQ ID NO: 884258 - protein, 17 aa, Mycobacterium
HAPPYNRRSRFPHRWWW

SEQ ID NO: 884259 - protein, 21 aa, Mycobacterium
HAQQYQALSAQIARFHDQFVR

SEQ ID NO: 884260 - protein, 18 aa, Mycobacterium
HAQSYQALSAQMAAFHDR

SEQ ID NO: 884261 - protein, 17 aa, Mycobacterium
HARFTQMLSAGANEYSL

SEQ ID NO: 884262 - protein, 25 aa, Mycobacterium
HARILCAMPFFWIGGLLAATGALHE

SEQ ID NO: 884263 - protein, 25 aa, Mycobacterium
HASGRIKLAWFLLHVARYLPALIYS

SEQ ID NO: 884264 - protein, 23 aa, Mycobacterium
HASLPVMVWIPGGAFVFGAGQLE

SEQ ID NO: 884265 - protein, 23 aa, Mycobacterium
HASWRSVLWARWPGAGPPPQFES

SEQ ID NO: 884266 - protein, 28 aa, Mycobacterium
HATDDPRPVMLWAYDPLAFNGEGKAAIA

SEQ ID NO: 884267 - protein, 25 aa, Mycobacterium
HAVKSMFFGWPLISEDLALATITFT

SEQ ID NO: 884268 - protein, 23 aa, Mycobacterium
HAVLHLLYARFWHKVLYDLGHVS

SEQ ID NO: 884269 - protein, 23 aa, Mycobacterium
HAVVMTYWNPVLRYGIDAFARDL

SEQ ID NO: 884270 - protein, 17 aa, Mycobacterium
HAWAIPRLTGQAKAAFV

SEQ ID NO: 884271 - protein, 22 aa, Mycobacterium
HAWSCFFAPWIAEATIFVYNYG

SEQ ID NO: 884272 - protein, 22 aa, Mycobacterium
HAWSCFFAPWIAEATIFVYNYR

SEQ ID NO: 884273 - protein, 25 aa, Mycobacterium
HAYHQVPLGTFLWLTKKHLGAHIED

SEQ ID NO: 884274 - protein, 17 aa, Mycobacterium
HAYLSLMLWLAGPGSQQ

SEQ ID NO: 884275 - protein, 22 aa, Mycobacterium
HCALPLHRRFGLAATARASFAV

SEQ ID NO: 884276 - protein, 18 aa, Mycobacterium
HCAMPLHRRFGLAATARA

SEQ ID NO: 884277 - protein, 24 aa, Mycobacterium
HCDAKTLSLCRYLRRWYPKAEVIR

SEQ ID NO: 884278 - protein, 17 aa, Mycobacterium
HDALLALLPLVGVWRGE

SEQ ID NO: 884279 - protein, 17 aa, Mycobacterium
HDDLILLFAIRSIANYS

SEQ ID NO: 884280 - protein, 22 aa, Mycobacterium
HDDWRWVIDIDLWGSIHAVEAF

SEQ ID NO: 884281 - protein, 23 aa, Mycobacterium
HDDWRWVIDIDLWGSIHAVEAFL

SEQ ID NO: 884282 - protein, 23 aa, Mycobacterium
HDGRIWYRTGDLVRYWPDGTLEF

SEQ ID NO: 884283 - protein, 18 aa, Mycobacterium
HDIAAGRLTLFVGGAEPA

SEQ ID NO: 884284 - protein, 20 aa, Mycobacterium
HDIAWPKVHLFWGDERYVPE

SEQ ID NO: 884285 - protein, 18 aa, Mycobacterium
HDIPRMLDLYRAGRLKLD

SEQ ID NO: 884286 - protein, 19 aa, Mycobacterium
HDIVLFPAWVRRSPVEPSP

SEQ ID NO: 884287 - protein, 18 aa, Mycobacterium
HDLEYWRPLWQALVDTET

SEQ ID NO: 884288 - protein, 17 aa, Mycobacterium
HDLSLGTHPMDVSAGTG

SEQ ID NO: 884289 - protein, 23 aa, Mycobacterium
HDLYQRWPFFRSVLSNMAQVLAK

SEQ ID NO: 884290 - protein, 23 aa, Mycobacterium
HDMQRYFLEPLPVSLRQALVRNV

SEQ ID NO: 884291 - protein, 29 aa, Mycobacterium
HDPVWYDHLPYLPFPPNWPVFAPKDKIGD

SEQ ID NO: 884292 - protein, 30 aa, Mycobacterium
HDPVWYDHLPYLPFPPNWPVFAPKDKIGDW

SEQ ID NO: 884293 - protein, 17 aa, Mycobacterium
HDQLFDTLFLYENYPID

SEQ ID NO: 884294 - protein, 24 aa, Mycobacterium
HDRHGLYYLEMPPALFAPIVENLA

SEQ ID NO: 884295 - protein, 24 aa, Mycobacterium
HDTVEVFIPMKGKWIIIWGDEGEH

SEQ ID NO: 884296 - protein, 25 aa, Mycobacterium
HDVSRSWLYFGLIRFRVGALDEADE

SEQ ID NO: 884297 - protein, 18 aa, Mycobacterium
HDVVLFPAWVRFSPLKPS

SEQ ID NO: 884298 - protein, 24 aa, Mycobacterium
HEELSFLRPLPVQALWGVGSVTAE

SEQ ID NO: 884299 - protein, 20 aa, Mycobacterium
HEFYIRDVLLDWSRDDPNHL

SEQ ID NO: 884300 - protein, 18 aa, Mycobacterium
HEGRDWMYVLSGKLRLIL

SEQ ID NO: 884301 - protein, 18 aa, Mycobacterium
HEHSVVIPFLLPDTPVVA

SEQ ID NO: 884302 - protein, 22 aa, Mycobacterium
HELEFFFFVLAFAGSDTTKNAL

SEQ ID NO: 884303 - protein, 18 aa, Mycobacterium
HELIYRPLRHPDGPPQPQ

SEQ ID NO: 884304 - protein, 23 aa, Mycobacterium
HELYERWPFFRSVLSNMAQVLAK

SEQ ID NO: 884305 - protein, 25 aa, Mycobacterium
HERSLNIDFLLGYLRELLPRRPDLK

SEQ ID NO: 884306 - protein, 27 aa, Mycobacterium
HERSLNIDFLLGYLRELLPRRPDLKII

SEQ ID NO: 884307 - protein, 25 aa, Mycobacterium
HERSLNIDFLLGYLRELLPRRPDLR

SEQ ID NO: 884308 - protein, 23 aa, Mycobacterium
HESLGWDLGALRKAWNLAKHEVA

SEQ ID NO: 884309 - protein, 19 aa, Mycobacterium
HEYLANYHLAWFIAITRGD

SEQ ID NO: 884310 - protein, 17 aa, Mycobacterium
HFDHWTRKFLAAHPRSV

SEQ ID NO: 884311 - protein, 22 aa, Mycobacterium
HFELKMFFAVFLGAGFVTTTHL

SEQ ID NO: 884312 - protein, 24 aa, Mycobacterium
HFGKPLVVLPLFWDQYENAQRIDE

SEQ ID NO: 884313 - protein, 21 aa, Mycobacterium
HFLDLMLRAPFRLARDVLPHM

SEQ ID NO: 884314 - protein, 17 aa, Mycobacterium
HFQEWWVRYRAQVPTHS

SEQ ID NO: 884315 - protein, 18 aa, Mycobacterium
HFRIEDDLYYPALSAATK

SEQ ID NO: 884316 - protein, 23 aa, Mycobacterium
HFSLPALLLLISGLPKFLSLEEG

SEQ ID NO: 884317 - protein, 23 aa, Mycobacterium
HFSLPALQLLISGLPKFLNLEEG

SEQ ID NO: 884318 - protein, 18 aa, Mycobacterium
HFSSKDELLLALIDRIMA

SEQ ID NO: 884319 - protein, 19 aa, Mycobacterium
HFTPFTLIQLEELGFCGRG

SEQ ID NO: 884320 - protein, 19 aa, Mycobacterium
HFTPYTLIQLEELGFCGKG

SEQ ID NO: 884321 - protein, 23 aa, Mycobacterium
HGADPWWDIAIRLLIKYANLRLM

SEQ ID NO: 884322 - protein, 22 aa, Mycobacterium
HGALAYLLKPFTFAAFRDRLER

SEQ ID NO: 884323 - protein, 20 aa, Mycobacterium
HGDYRLDNLLFDPDLRRVAV

SEQ ID NO: 884324 - protein, 28 aa, Mycobacterium
HGFEPEHPWLLRFFDRISWYPVSAEELL

SEQ ID NO: 884325 - protein, 26 aa, Mycobacterium
HGGILLITHYTRILRYIRPQFVHVFV

SEQ ID NO: 884326 - protein, 22 aa, Mycobacterium
HGGVRPFGWLYAASRDPSVPLV

SEQ ID NO: 884327 - protein, 22 aa, Mycobacterium
HGIQLWVNLPARDKFLTPAYQA

SEQ ID NO: 884328 - protein, 18 aa, Mycobacterium
HGIQLWVNLPRKDKFAAP

SEQ ID NO: 884329 - protein, 20 aa, Mycobacterium
HGIVGLMRTLANALAPHSIR

SEQ ID NO: 884330 - protein, 20 aa, Mycobacterium
HGIVGLMRTLANALAPLNIR

SEQ ID NO: 884331 - protein, 18 aa, Mycobacterium
HGLGPWDWAAGALIAREA

SEQ ID NO: 884332 - protein, 20 aa, Mycobacterium
HGLLLLRHLSDLVNTGWPVL

SEQ ID NO: 884333 - protein, 19 aa, Mycobacterium
HGLLLLRHVADLVKTGWPV

SEQ ID NO: 884334 - protein, 23 aa, Mycobacterium
HGLLTLSLLPRFMHELYSVEGVK

SEQ ID NO: 884335 - protein, 20 aa, Mycobacterium
HGNRLLAPNEYIITLGRHDF

SEQ ID NO: 884336 - protein, 26 aa, Mycobacterium
HGPAIRFLLIELPGAQWRLVLTAHHI

SEQ ID NO: 884337 - protein, 17 aa, Mycobacterium
HGRAPRLWLVTEGGLVV

SEQ ID NO: 884338 - protein, 17 aa, Mycobacterium
HGRDEIWRFTPLRRLRG

SEQ ID NO: 884339 - protein, 22 aa, Mycobacterium
HGRDEIWRFTPLRRLRGLHNGT

SEQ ID NO: 884340 - protein, 17 aa, Mycobacterium
HGRPLWYLMPDGVVQYV

SEQ ID NO: 884341 - protein, 17 aa, Mycobacterium
HGRTIAPALRRAARKKP

SEQ ID NO: 884342 - protein, 19 aa, Mycobacterium
HGSIPVLRPEWPRAALSVG

SEQ ID NO: 884343 - protein, 24 aa, Mycobacterium
HGVLKRILLIYREGIHRLQVGDPA

SEQ ID NO: 884344 - protein, 18 aa, Mycobacterium
HGVQLWVNLPKKDKFAPP

SEQ ID NO: 884345 - protein, 18 aa, Mycobacterium
HGWIHSELRRRCGGPPIA

SEQ ID NO: 884346 - protein, 19 aa, Mycobacterium
HHCAWPLHRRFGIAASARA

SEQ ID NO: 884347 - protein, 23 aa, Mycobacterium
HHELHLWLPHPSAALWRSLADLH

SEQ ID NO: 884348 - protein, 23 aa, Mycobacterium
HHPPMRAFLAVPITIRETVFGNL

SEQ ID NO: 884349 - protein, 24 aa, Mycobacterium
HHQPVYYLVFLTRAPHGRWIFGDA

SEQ ID NO: 884350 - protein, 17 aa, Mycobacterium
HHRILLPERLGPGRVRL

SEQ ID NO: 884351 - protein, 17 aa, Mycobacterium
HHRPSIAYVLTKLAIVL

SEQ ID NO: 884352 - protein, 24 aa, Mycobacterium
HHSRRGLLLLVGRRRRLLKYVAKV

SEQ ID NO: 884353 - protein, 24 aa, Mycobacterium
HHSRRGLLLLVGRRRRLLKYVAQV

SEQ ID NO: 884354 - protein, 25 aa, Mycobacterium
HHSRRGLLLLVGRRRRLLKYVAQVD

SEQ ID NO: 884355 - protein, 29 aa, Mycobacterium
HHSWRYHLAVRRWAIDLPALYAEVRKTRP

SEQ ID NO: 884356 - protein, 23 aa, Mycobacterium
HHVNRWFYDCPPAFHRTLGDMYV

SEQ ID NO: 884357 - protein, 29 aa, Mycobacterium
HIETLQWRYYLAWWLWNGHEFDPAAARTR

SEQ ID NO: 884358 - protein, 23 aa, Mycobacterium
HIGGYMRVLLKPGGLAQLPMDRI

SEQ ID NO: 884359 - protein, 24 aa, Mycobacterium
HILPQQALLYRLCGDRNPLHSDPA

SEQ ID NO: 884360 - protein, 19 aa, Mycobacterium
HILTLSPPVLLGREWLKPT

SEQ ID NO: 884361 - protein, 20 aa, Mycobacterium
HISIPLLLRVSSQGWGHYLE

SEQ ID NO: 884362 - protein, 22 aa, Mycobacterium
HITTRQWQLPPGALLIVEDAAT

SEQ ID NO: 884363 - protein, 22 aa, Mycobacterium
HKITPFVLTLRLLVIALRHNEI

SEQ ID NO: 884364 - protein, 23 aa, Mycobacterium
HKSLTMFLVPLDSPGIEIQGIRT

SEQ ID NO: 884365 - protein, 23 aa, Mycobacterium
HKSLTMFLVPLDTPGIEIQGIRT

SEQ ID NO: 884366 - protein, 21 aa, Mycobacterium
HKSLTMFLVPLDTPGVEIQGI

SEQ ID NO: 884367 - protein, 25 aa, Mycobacterium
HLASKHRFIAAQFVALFGDGLWLRN

SEQ ID NO: 884368 - protein, 21 aa, Mycobacterium
HLCAAWLVEAYLLIGARSQAE

SEQ ID NO: 884369 - protein, 18 aa, Mycobacterium
HLDNRPRFLDRILDVTGT

SEQ ID NO: 884370 - protein, 23 aa, Mycobacterium
HLDPTMFAAFMPGALELTVEEGI

SEQ ID NO: 884371 - protein, 18 aa, Mycobacterium
HLGLPRWASHPGMLFRVD

SEQ ID NO: 884372 - protein, 20 aa, Mycobacterium
HLGPFLLTNLLLEPIVAAER

SEQ ID NO: 884373 - protein, 18 aa, Mycobacterium
HLGREQLPLDDRARWLYA

SEQ ID NO: 884374 - protein, 19 aa, Mycobacterium
HLLESWIPLLALFAHDPGR

SEQ ID NO: 884375 - protein, 17 aa, Mycobacterium
HLLLRFDGAKWIAIDNG

SEQ ID NO: 884376 - protein, 19 aa, Mycobacterium
HLLMARHMFTLWAPKRAGV

SEQ ID NO: 884377 - protein, 17 aa, Mycobacterium
HLLSLGYSKELLPERLI

SEQ ID NO: 884378 - protein, 17 aa, Mycobacterium
HLMYGGWWTFPVPDIER

SEQ ID NO: 884379 - protein, 23 aa, Mycobacterium
HLPAAPYLHLFLARGRVSVEGIG

SEQ ID NO: 884380 - protein, 21 aa, Mycobacterium
HLPGVKYLWPQGTYLAWLDCR

SEQ ID NO: 884381 - protein, 23 aa, Mycobacterium
HLPQGLGIIGLLIDEPKPLRLDD

SEQ ID NO: 884382 - protein, 17 aa, Mycobacterium
HLPVWVPGALFSVGDGH

SEQ ID NO: 884383 - protein, 17 aa, Mycobacterium
HLPWQWGAAWFLDQLTD

SEQ ID NO: 884384 - protein, 18 aa, Mycobacterium
HLPWQWGAAWFLDQLTDG

SEQ ID NO: 884385 - protein, 20 aa, Mycobacterium
HLQGHWLLARLGKRVLRPGG

SEQ ID NO: 884386 - protein, 19 aa, Mycobacterium
HLRGHFLLTRNAAAYWRSK

SEQ ID NO: 884387 - protein, 20 aa, Mycobacterium
HLRPFVMIPWLDVDPAAEVP

SEQ ID NO: 884388 - protein, 21 aa, Mycobacterium
HLRRGLYWRGLKTPLGMAPPQ

SEQ ID NO: 884389 - protein, 17 aa, Mycobacterium
HLRSLLRPGGQLRYLEH

SEQ ID NO: 884390 - protein, 20 aa, Mycobacterium
HLSPTLWWFIRRSGMPKESV

SEQ ID NO: 884391 - protein, 18 aa, Mycobacterium
HLTTLFPPVRPRGFLEVR

SEQ ID NO: 884392 - protein, 18 aa, Mycobacterium
HLTTLFPPVRPRQWLEIR

SEQ ID NO: 884393 - protein, 17 aa, Mycobacterium
HLVLCDAFRHPAVLAKQ

SEQ ID NO: 884394 - protein, 18 aa, Mycobacterium
HLVLCDAFRHPAVLAKQA

SEQ ID NO: 884395 - protein, 18 aa, Mycobacterium
HLVRAMPQLVPLLPSMSP

SEQ ID NO: 884396 - protein, 21 aa, Mycobacterium
HLVTRWLATFAFFRAAMAAAA

SEQ ID NO: 884397 - protein, 24 aa, Mycobacterium
HLVTRWLATFTFFRAALGVAAPRL

SEQ ID NO: 884398 - protein, 20 aa, Mycobacterium
HLWRKGIAALPRQLTRKPKG

SEQ ID NO: 884399 - protein, 17 aa, Mycobacterium
HMFWFDLMKPMTSNATG

SEQ ID NO: 884400 - protein, 18 aa, Mycobacterium
HMRLPKLKGFRNRFRTEY

SEQ ID NO: 884401 - protein, 18 aa, Mycobacterium
HMRRLLRESWYNDLPAQL

SEQ ID NO: 884402 - protein, 30 aa, Mycobacterium
HMWFGDLVTMKWWDDLWLNESFATFASVLC

SEQ ID NO: 884403 - protein, 30 aa, Mycobacterium
HMWFGDLVTMQWWDDLWLNESFATFASVLC

SEQ ID NO: 884404 - protein, 18 aa, Mycobacterium
HNLFPLVFDMLFRGETPR

SEQ ID NO: 884405 - protein, 17 aa, Mycobacterium
HNPSLLGLVGMGLPGDI

SEQ ID NO: 884406 - protein, 19 aa, Mycobacterium
HNSQPWRWIAVGPTLQLWA

SEQ ID NO: 884407 - protein, 21 aa, Mycobacterium
HNTFQLRRPLLEPLPGTLPEP

SEQ ID NO: 884408 - protein, 20 aa, Mycobacterium
HPAVMDAWFKPYLGAGLHLA

SEQ ID NO: 884409 - protein, 21 aa, Mycobacterium
HPAVRWVRYPYLPSHPQYDLA

SEQ ID NO: 884410 - protein, 25 aa, Mycobacterium
HPAVSWVRYPFLPSHPQYNLAKRQM

SEQ ID NO: 884411 - protein, 21 aa, Mycobacterium
HPCGVFSWRPPPSLITALSDL

SEQ ID NO: 884412 - protein, 19 aa, Mycobacterium
HPECKMNFLASPLLVVAYA

SEQ ID NO: 884413 - protein, 21 aa, Mycobacterium
HPFAWLPMLSRVLATARLLPD

SEQ ID NO: 884414 - protein, 17 aa, Mycobacterium
HPFFARIWPVIAAHEAQ

SEQ ID NO: 884415 - protein, 19 aa, Mycobacterium
HPFHRFLARALVLDSVLGS

SEQ ID NO: 884416 - protein, 19 aa, Mycobacterium
HPGLDRILQWDLRFGMDVV

SEQ ID NO: 884417 - protein, 18 aa, Mycobacterium
HPIPIYLATLSPAMLRLT

SEQ ID NO: 884418 - protein, 19 aa, Mycobacterium
HPLGHRWRWEFEALSPNLT

SEQ ID NO: 884419 - protein, 20 aa, Mycobacterium
HPPVWFMRQAGRSLPEYRAV

SEQ ID NO: 884420 - protein, 18 aa, Mycobacterium
HPPYRPFWAITKHADIMA

SEQ ID NO: 884421 - protein, 20 aa, Mycobacterium
HPRAPFRYLGMLPWVGAVAD

SEQ ID NO: 884422 - protein, 20 aa, Mycobacterium
HPRETLWRPPVLTMSAMEGT

SEQ ID NO: 884423 - protein, 18 aa, Mycobacterium
HPRWAWWVTSVPLLREFA

SEQ ID NO: 884424 - protein, 24 aa, Mycobacterium
HPVFDFLFTYYSLKPRRLRVWHPG

SEQ ID NO: 884425 - protein, 17 aa, Mycobacterium
HPYLGRPNLTVLTGAVV

SEQ ID NO: 884426 - protein, 18 aa, Mycobacterium
HQHWRDMGIFPVISELAL

SEQ ID NO: 884427 - protein, 17 aa, Mycobacterium
HQMWAAQFISYEKPRTW

SEQ ID NO: 884428 - protein, 20 aa, Mycobacterium
HQQWLPRLPPPYVVAVVALA

SEQ ID NO: 884429 - protein, 18 aa, Mycobacterium
HQYVDLVAMFRPITRWAD

SEQ ID NO: 884430 - protein, 18 aa, Mycobacterium
HRDARKRVLAMRRTFRKH

SEQ ID NO: 884431 - protein, 19 aa, Mycobacterium
HRFLAHLPGYQGWQWAAVV

SEQ ID NO: 884432 - protein, 20 aa, Mycobacterium
HRGPFLVCAALRDSIQAAVA

SEQ ID NO: 884433 - protein, 17 aa, Mycobacterium
HRKGWAAPAWPVKYGGQ

SEQ ID NO: 884434 - protein, 21 aa, Mycobacterium
HRKLAVFWRHLPPGPLAEDLA

SEQ ID NO: 884435 - protein, 17 aa, Mycobacterium
HRKLGLPAMPLGGSTAP

SEQ ID NO: 884436 - protein, 23 aa, Mycobacterium
HRLALLWPEMYPRLLRIMDADPI

SEQ ID NO: 884437 - protein, 19 aa, Mycobacterium
HRLELASPDRWWAQVQAIP

SEQ ID NO: 884438 - protein, 18 aa, Mycobacterium
HRLHRLPIWMRPLAWLPR

SEQ ID NO: 884439 - protein, 23 aa, Mycobacterium
HRLPIWMRPLAWLPRPDLRRPGR

SEQ ID NO: 884440 - protein, 27 aa, Mycobacterium
HRPTFDVLFDLWFPPALGARFVEVGEE

SEQ ID NO: 884441 - protein, 19 aa, Mycobacterium
HRRLLWPIRVSSGETIGFG

SEQ ID NO: 884442 - protein, 22 aa, Mycobacterium
HRSGALWILNSEALGRIGLAEH

SEQ ID NO: 884443 - protein, 31 aa, Mycobacterium
HRSLANIFSVRLPWQWLGRPAGRRRFRGDRP

SEQ ID NO: 884444 - protein, 25 aa, Mycobacterium
HRTDPLLLLPLLRCMAPVPVLLLHC

SEQ ID NO: 884445 - protein, 21 aa, Mycobacterium
HRWIRIWRTRVGPMTLDDAEI

SEQ ID NO: 884446 - protein, 25 aa, Mycobacterium
HSAGIGPLRWLPATPALLADDPEWG

SEQ ID NO: 884447 - protein, 23 aa, Mycobacterium
HSAGIGPLRWLPATPTLLANDPA

SEQ ID NO: 884448 - protein, 24 aa, Mycobacterium
HSDFIAYLNLWRYLQDQRSQLSGS

SEQ ID NO: 884449 - protein, 22 aa, Mycobacterium
HSDFMSYLNLWHYLRGQRKSLS

SEQ ID NO: 884450 - protein, 26 aa, Mycobacterium
HSDFTSFLNLWWYLTEQRKERSGSSF

SEQ ID NO: 884451 - protein, 30 aa, Mycobacterium
HSDYPLQALLYSVVLHRFLRWRLPDYHPDR

SEQ ID NO: 884452 - protein, 34 aa, Mycobacterium
HSDYPLQALLYSVVLHRFLSWRLPGYRPEEHLGG

SEQ ID NO: 884453 - protein, 26 aa, Mycobacterium
HSDYPLQALLYTVVLHRFLRWRQPGY

SEQ ID NO: 884454 - protein, 19 aa, Mycobacterium
HSDYPLQALLYVVVLHRFL

SEQ ID NO: 884455 - protein, 19 aa, Mycobacterium
HSLAKFPEPLAPLAAAHRA

SEQ ID NO: 884456 - protein, 20 aa, Mycobacterium
HSLALQRLDLTPLLELDMRL

SEQ ID NO: 884457 - protein, 21 aa, Mycobacterium
HSLEWIWMQSPLFRQFRGDDW

SEQ ID NO: 884458 - protein, 18 aa, Mycobacterium
HSMFFPQRFRSPLSIAFP

SEQ ID NO: 884459 - protein, 17 aa, Mycobacterium
HSPGAVAFIRRARRMLP

SEQ ID NO: 884460 - protein, 17 aa, Mycobacterium
HTACILCECNCGIVVQV

SEQ ID NO: 884461 - protein, 25 aa, Mycobacterium
HTDEVVLPFFWQGVSLHAAGASAVR

SEQ ID NO: 884462 - protein, 17 aa, Mycobacterium
HTGFRALLSPYLTRKFA

SEQ ID NO: 884463 - protein, 18 aa, Mycobacterium
HTGIRVSGAFNTGFQQSG

SEQ ID NO: 884464 - protein, 23 aa, Mycobacterium
HTNKVPLYFISPTPFNLLGVDRW

SEQ ID NO: 884465 - protein, 18 aa, Mycobacterium
HTPIRSVLSFKLFRGSQT

SEQ ID NO: 884466 - protein, 19 aa, Mycobacterium
HTPYRKLVMPFFTAPAVAA

SEQ ID NO: 884467 - protein, 23 aa, Mycobacterium
HTRMRPHYFPFTEPSAEVDVWFE

SEQ ID NO: 884468 - protein, 18 aa, Mycobacterium
HTSTRFRNLWSHHEVAHA

SEQ ID NO: 884469 - protein, 18 aa, Mycobacterium
HTTSRVWAFQLQSILARL

SEQ ID NO: 884470 - protein, 18 aa, Mycobacterium
HTYDFVMQQWEILKPLMS

SEQ ID NO: 884471 - protein, 25 aa, Mycobacterium
HVAFLVALLFFYELTGGMAAVEAAQ

SEQ ID NO: 884472 - protein, 24 aa, Mycobacterium
HVAKFSQFFGFLWPGEYRAFSNAG

SEQ ID NO: 884473 - protein, 19 aa, Mycobacterium
HVALFGAVLQRLGFDFYGI

SEQ ID NO: 884474 - protein, 19 aa, Mycobacterium
HVAQLRLIASLLNKGFSSA

SEQ ID NO: 884475 - protein, 21 aa, Mycobacterium
HVELAWWRQVLAGLPGDISIA

SEQ ID NO: 884476 - protein, 17 aa, Mycobacterium
HVFLRIATDWDFIEVRR

SEQ ID NO: 884477 - protein, 19 aa, Mycobacterium
HVLFTWHLPELWRRFTITL

SEQ ID NO: 884478 - protein, 19 aa, Mycobacterium
HVLLWLLDDNPRLGDRIAG

SEQ ID NO: 884479 - protein, 18 aa, Mycobacterium
HVLVFGAFRPLGLATTLR

SEQ ID NO: 884480 - protein, 21 aa, Mycobacterium
HVLWWQVYPLGFVGVHPADTA

SEQ ID NO: 884481 - protein, 17 aa, Mycobacterium
HVPALRALPEYDLRAVA

SEQ ID NO: 884482 - protein, 17 aa, Mycobacterium
HVPFRITPLARDAWLRC

SEQ ID NO: 884483 - protein, 25 aa, Mycobacterium
HVRDVFRIFLTRLRLMLAEDDPLFE

SEQ ID NO: 884484 - protein, 21 aa, Mycobacterium
HVRRLWLRSVPPEAAMLELLL

SEQ ID NO: 884485 - protein, 22 aa, Mycobacterium
HVSNWLRPWLPSLLALSANSRV

SEQ ID NO: 884486 - protein, 19 aa, Mycobacterium
HVTTLAWLSLGPTGSNNEA

SEQ ID NO: 884487 - protein, 18 aa, Mycobacterium
HVYDIVRGKRWPSAYSGR

SEQ ID NO: 884488 - protein, 20 aa, Mycobacterium
HWITMPYAVAWLWCYSMETI

SEQ ID NO: 884489 - protein, 21 aa, Mycobacterium
HWQMLPRILAITVRDGKVCAL

SEQ ID NO: 884490 - protein, 18 aa, Mycobacterium
HWQRFWLVDPLDGTKEFI

SEQ ID NO: 884491 - protein, 21 aa, Mycobacterium
HWQTAAVLFGIWWIGAEVVLS

SEQ ID NO: 884492 - protein, 22 aa, Mycobacterium
HWQTAAVLFGVWWIGAEAVLAG

SEQ ID NO: 884493 - protein, 19 aa, Mycobacterium
HWWQAPLRWSIRGALAARS

SEQ ID NO: 884494 - protein, 18 aa, Mycobacterium
HYAAFKHLTVWENVAFGL

SEQ ID NO: 884495 - protein, 18 aa, Mycobacterium
HYLLKPWDPPQEKFYPVI

SEQ ID NO: 884496 - protein, 17 aa, Mycobacterium
HYMAPLLGTSSPRRADL

SEQ ID NO: 884497 - protein, 19 aa, Mycobacterium
HYTFWFVPSLKPVNRRATE

SEQ ID NO: 884498 - protein, 17 aa, Mycobacterium
IAAFRRAIQSWWHDGWD

SEQ ID NO: 884499 - protein, 23 aa, Mycobacterium
IAAPLALLPPWDDALERSDREHH

SEQ ID NO: 884500 - protein, 25 aa, Mycobacterium
IAATGGLIGLWPMGFRRLGMRDVDD

SEQ ID NO: 884501 - protein, 18 aa, Mycobacterium
IAAYAGGLVPILCLTKTD

SEQ ID NO: 884502 - protein, 17 aa, Mycobacterium
IADLTSFQWLGPSSAAM

SEQ ID NO: 884503 - protein, 24 aa, Mycobacterium
IADPPAWFGVIRPAQLLASSDSGA

SEQ ID NO: 884504 - protein, 21 aa, Mycobacterium
IADQLARRRLGYGRGARMAFE

SEQ ID NO: 884505 - protein, 25 aa, Mycobacterium
IADQVRWIWLLLDDTLRAEGIYVNP

SEQ ID NO: 884506 - protein, 23 aa, Mycobacterium
IADYGFFGILPFLLGNRADRPPF

SEQ ID NO: 884507 - protein, 20 aa, Mycobacterium
IAEAWLPFHVPMSYHGAFTN

SEQ ID NO: 884508 - protein, 24 aa, Mycobacterium
IAEEYYISFLLDRSNRTYLAMCSV

SEQ ID NO: 884509 - protein, 25 aa, Mycobacterium
IAEGGWVLPYLPKPWGRAAGPVEQI

SEQ ID NO: 884510 - protein, 24 aa, Mycobacterium
IAEGGWVLPYLPTPWGRAASPVEQ

SEQ ID NO: 884511 - protein, 17 aa, Mycobacterium
IAELAAMMPMRVIGMLL

SEQ ID NO: 884512 - protein, 24 aa, Mycobacterium
IAEQQADCFAGVYLRWVAAGNSPR

SEQ ID NO: 884513 - protein, 19 aa, Mycobacterium
IAERFFAYFAACDWDSLAT

SEQ ID NO: 884514 - protein, 20 aa, Mycobacterium
IAEYLGLPQLTHVRKLSLEG

SEQ ID NO: 884515 - protein, 20 aa, Mycobacterium
IAFPALFRRFPSLEPAEDFA

SEQ ID NO: 884516 - protein, 18 aa, Mycobacterium
IAFVLLQADRFWADFCTR

SEQ ID NO: 884517 - protein, 23 aa, Mycobacterium
IAGFFKELPGKALDWGKNLVHGL

SEQ ID NO: 884518 - protein, 18 aa, Mycobacterium
IAGLIYSGAIDTGIACGI

SEQ ID NO: 884519 - protein, 17 aa, Mycobacterium
IAGLPFPLSSAILPRFL

SEQ ID NO: 884520 - protein, 18 aa, Mycobacterium
IAGLPFPLSSAMLPRFLY

SEQ ID NO: 884521 - protein, 18 aa, Mycobacterium
IAGMRPWDDPWGRPFLDR

SEQ ID NO: 884522 - protein, 18 aa, Mycobacterium
IAGMRPYDLPWGRPLLGV

SEQ ID NO: 884523 - protein, 18 aa, Mycobacterium
IAGMRPYDPPWGRPLLGV

SEQ ID NO: 884524 - protein, 22 aa, Mycobacterium
IAGRWQLIAFAAPLLGVLCSIS

SEQ ID NO: 884525 - protein, 19 aa, Mycobacterium
IAHRLGMIDPDAWAFVWVV

SEQ ID NO: 884526 - protein, 18 aa, Mycobacterium
IAHRLGMKPNWVIDLHNG

SEQ ID NO: 884527 - protein, 19 aa, Mycobacterium
IAIDPQHRLLLQTSWEAVE

SEQ ID NO: 884528 - protein, 19 aa, Mycobacterium
IAIRASTGGRRALGAFASG

SEQ ID NO: 884529 - protein, 19 aa, Mycobacterium
IAIVPRLLKWEKQRIAARV

SEQ ID NO: 884530 - protein, 19 aa, Mycobacterium
IALVDLFRYPTVSSLAVYL

SEQ ID NO: 884531 - protein, 21 aa, Mycobacterium
IALYLNFDMLGSPNAGYFVLD

SEQ ID NO: 884532 - protein, 19 aa, Mycobacterium
IANRLLPCLPTLLALSASS

SEQ ID NO: 884533 - protein, 21 aa, Mycobacterium
IAPRTLLCLSTWRAGGHLSDT

SEQ ID NO: 884534 - protein, 17 aa, Mycobacterium
IAQTVGWRLWMGVAFGL

SEQ ID NO: 884535 - protein, 21 aa, Mycobacterium
IARLLPFVEWLRDAYPHQLIS

SEQ ID NO: 884536 - protein, 17 aa, Mycobacterium
IARPLPERAVIARAAQI

SEQ ID NO: 884537 - protein, 20 aa, Mycobacterium
IARPMYIARGWLSWEGPTSV

SEQ ID NO: 884538 - protein, 20 aa, Mycobacterium
IARRVFATCRKLGLGTVAVY

SEQ ID NO: 884539 - protein, 25 aa, Mycobacterium
IASQKYLPRWLSEGLNRLLGGEHVF

SEQ ID NO: 884540 - protein, 24 aa, Mycobacterium
IASQLIGLAMTRYVWQIEPIASMS

SEQ ID NO: 884541 - protein, 22 aa, Mycobacterium
IATLERQLQLLDKLIGAATQDL

SEQ ID NO: 884542 - protein, 25 aa, Mycobacterium
IATLYPVRRMVFVGGLLPVPGHSFV

SEQ ID NO: 884543 - protein, 17 aa, Mycobacterium
IATYLDLPLFAGRPARA

SEQ ID NO: 884544 - protein, 23 aa, Mycobacterium
IAVEDLVYLLRDSGIHTEVDLDA

SEQ ID NO: 884545 - protein, 17 aa, Mycobacterium
IAVTRLVLGPKMRVQAP

SEQ ID NO: 884546 - protein, 17 aa, Mycobacterium
IAWNYPMQLLARAVAPA

SEQ ID NO: 884547 - protein, 24 aa, Mycobacterium
IAWTTWHMIFWWSTALAHVRGLTP

SEQ ID NO: 884548 - protein, 18 aa, Mycobacterium
IAYLLEILPALSYLHSIG

SEQ ID NO: 884549 - protein, 18 aa, Mycobacterium
IAYLLEILPALTYLHSIG

SEQ ID NO: 884550 - protein, 19 aa, Mycobacterium
ICFLIRSYMLPLADLAAFE

SEQ ID NO: 884551 - protein, 18 aa, Mycobacterium
ICHCWRAPMIAQMAKAHA

SEQ ID NO: 884552 - protein, 17 aa, Mycobacterium
ICQMFHTLPIPWVEAED

SEQ ID NO: 884553 - protein, 19 aa, Mycobacterium
ICQMFHTLPIPWVEPIDIS

SEQ ID NO: 884554 - protein, 17 aa, Mycobacterium
ICRLDFKGRRRELMRPG

SEQ ID NO: 884555 - protein, 17 aa, Mycobacterium
IDAGWLLDYWSDRVYRL

SEQ ID NO: 884556 - protein, 19 aa, Mycobacterium
IDALLLVRLPYHLSSVTQV

SEQ ID NO: 884557 - protein, 18 aa, Mycobacterium
IDAMLLVRLPYHLSSVTQ

SEQ ID NO: 884558 - protein, 17 aa, Mycobacterium
IDATWRWAAIIATAWQT

SEQ ID NO: 884559 - protein, 24 aa, Mycobacterium
IDDALALIYLLASPDADVLGIAST

SEQ ID NO: 884560 - protein, 23 aa, Mycobacterium
IDDEFFIILRPAPSGTRLLLSDA

SEQ ID NO: 884561 - protein, 19 aa, Mycobacterium
IDGALRFSWSHLTGEVPWD

SEQ ID NO: 884562 - protein, 23 aa, Mycobacterium
IDGFRFLAVRELAKQRLALRDEL

SEQ ID NO: 884563 - protein, 23 aa, Mycobacterium
IDGFWAAVLHRTAQRRGELPSNA

SEQ ID NO: 884564 - protein, 20 aa, Mycobacterium
IDGLWAAVLHRTAERRAGVL

SEQ ID NO: 884565 - protein, 24 aa, Mycobacterium
IDGRGMFLTCKFGIEAMLATGGGA

SEQ ID NO: 884566 - protein, 27 aa, Mycobacterium
IDHIIGLFRLWWIPAGAAPTHGTYVRY

SEQ ID NO: 884567 - protein, 25 aa, Mycobacterium
IDHIIGLFRLWWIPEGAAPTEGTYV

SEQ ID NO: 884568 - protein, 27 aa, Mycobacterium
IDHIIGLFRLWWIPQGLPPTDGTYVRY

SEQ ID NO: 884569 - protein, 26 aa, Mycobacterium
IDHIIGLFRLWWIPRGAPPTEGTYVR

SEQ ID NO: 884570 - protein, 27 aa, Mycobacterium
IDHIIGMFRLWWIPKGAAPTDGTYVRY

SEQ ID NO: 884571 - protein, 27 aa, Mycobacterium
IDINYLGPIRLLLGLLPAMRESGRGHI

SEQ ID NO: 884572 - protein, 19 aa, Mycobacterium
IDIPLFPLVAREFSYFGSF

SEQ ID NO: 884573 - protein, 18 aa, Mycobacterium
IDIVWAIVRTFQGIAHLE

SEQ ID NO: 884574 - protein, 18 aa, Mycobacterium
IDLLLLDEPTRGLDIGAK

SEQ ID NO: 884575 - protein, 21 aa, Mycobacterium
IDNWRWAGVPIYLRTGKRMAE

SEQ ID NO: 884576 - protein, 17 aa, Mycobacterium
IDPALLRPGRLEKLVFV

SEQ ID NO: 884577 - protein, 24 aa, Mycobacterium
IDPDPMFVPHLLGPLLLGQGIHLV

SEQ ID NO: 884578 - protein, 21 aa, Mycobacterium
IDPDVLFLAEAFTRPARLFGL

SEQ ID NO: 884579 - protein, 23 aa, Mycobacterium
IDPRTRWLLRELIHALLVKKDHR

SEQ ID NO: 884580 - protein, 22 aa, Mycobacterium
IDPRTRWLLRELVYALLVKKDH

SEQ ID NO: 884581 - protein, 17 aa, Mycobacterium
IDPYFDDLFLMAADRRH

SEQ ID NO: 884582 - protein, 21 aa, Mycobacterium
IDQLFIAPFHPGYLAQGLYTP

SEQ ID NO: 884583 - protein, 22 aa, Mycobacterium
IDQTTILLAPYFRQLLTEEQLA

SEQ ID NO: 884584 - protein, 17 aa, Mycobacterium
IDRGYPLFVEYLGILGA

SEQ ID NO: 884585 - protein, 21 aa, Mycobacterium
IDRIRRAHLLLAMFNALQPGV

SEQ ID NO: 884586 - protein, 21 aa, Mycobacterium
IDRLFAYWELRAMISQLLGSG

SEQ ID NO: 884587 - protein, 24 aa, Mycobacterium
IDRMRAWPLWWGSSAAWHGPQVLD

SEQ ID NO: 884588 - protein, 23 aa, Mycobacterium
IDSIALLPLYFQLDGSFPNHEAN

SEQ ID NO: 884589 - protein, 17 aa, Mycobacterium
IDSLWLYDHLYGPGMPD

SEQ ID NO: 884590 - protein, 20 aa, Mycobacterium
IDSVLPMFFEFVGNSVLVAH

SEQ ID NO: 884591 - protein, 17 aa, Mycobacterium
IDTPLIFLQNTTGFMVG

SEQ ID NO: 884592 - protein, 24 aa, Mycobacterium
IDTSLPNWWPSILAPAVAGAGALR

SEQ ID NO: 884593 - protein, 23 aa, Mycobacterium
IDTSLPNWWPSILAPIVAGVGAW

SEQ ID NO: 884594 - protein, 26 aa, Mycobacterium
IDTTYPLHRYFLWAKHNELTLGPATV

SEQ ID NO: 884595 - protein, 18 aa, Mycobacterium
IDVKGLRLTLTQAAWRLS

SEQ ID NO: 884596 - protein, 26 aa, Mycobacterium
IDVTYPLHRYFLWAKQIELSLGSAPQ

SEQ ID NO: 884597 - protein, 19 aa, Mycobacterium
IDWFTVDWHRAIVDKWREA

SEQ ID NO: 884598 - protein, 20 aa, Mycobacterium
IDWRWLTVPLAPGPGESWLR

SEQ ID NO: 884599 - protein, 23 aa, Mycobacterium
IEAAFLEYLDMFYNLGLAGRAMR

SEQ ID NO: 884600 - protein, 23 aa, Mycobacterium
IEAAFLEYLEMFYNLGIAGRAMR

SEQ ID NO: 884601 - protein, 27 aa, Mycobacterium
IEALAGVFDFAFPPAPWMFGAAGREHM

SEQ ID NO: 884602 - protein, 17 aa, Mycobacterium
IEAVFRPAPVPRTLETM

SEQ ID NO: 884603 - protein, 18 aa, Mycobacterium
IEIEMIRLLTLKAAYLMD

SEQ ID NO: 884604 - protein, 17 aa, Mycobacterium
IEIMGMLMLLIGGGFDT

SEQ ID NO: 884605 - protein, 18 aa, Mycobacterium
IEKAFPGRFLLGVGVGHP

SEQ ID NO: 884606 - protein, 23 aa, Mycobacterium
IEKPLHIHRILLQRSWIAIMRGD

SEQ ID NO: 884607 - protein, 17 aa, Mycobacterium
IELGLRHFLADGFGAFT

SEQ ID NO: 884608 - protein, 18 aa, Mycobacterium
IELLPKKAKDRLLELSID

SEQ ID NO: 884609 - protein, 17 aa, Mycobacterium
IELLPKQAKDRLLELSI

SEQ ID NO: 884610 - protein, 17 aa, Mycobacterium
IEMGTIPEFMWLQVDDV

SEQ ID NO: 884611 - protein, 18 aa, Mycobacterium
IENYYLPIAAYEAALRQA

SEQ ID NO: 884612 - protein, 19 aa, Mycobacterium
IEPLWARFYDFGAGRLPAF

SEQ ID NO: 884613 - protein, 17 aa, Mycobacterium
IEPTAMLQFWRGSTQSG

SEQ ID NO: 884614 - protein, 22 aa, Mycobacterium
IEPWVFMNWRRAAYYLFTAEVI

SEQ ID NO: 884615 - protein, 17 aa, Mycobacterium
IEQDLLGAVNAPTQVLF

SEQ ID NO: 884616 - protein, 19 aa, Mycobacterium
IEQLIPLMPTIIGFIRDFV

SEQ ID NO: 884617 - protein, 18 aa, Mycobacterium
IERGLGLTALLRSTLTTE

SEQ ID NO: 884618 - protein, 19 aa, Mycobacterium
IERGLWLTALLADTLTAVR

SEQ ID NO: 884619 - protein, 21 aa, Mycobacterium
IERIGALLTQGNAAAASPTIN

SEQ ID NO: 884620 - protein, 17 aa, Mycobacterium
IEVRDGDIFLFPGEKPR

SEQ ID NO: 884621 - protein, 20 aa, Mycobacterium
IEVRPMTDFWPGLAGYMEVD

SEQ ID NO: 884622 - protein, 29 aa, Mycobacterium
IEYLEADPLLKFVPLPWPDYYGKAPKARL

SEQ ID NO: 884623 - protein, 19 aa, Mycobacterium
IEYPILLAPMALVSGGRLA

SEQ ID NO: 884624 - protein, 23 aa, Mycobacterium
IEYPLEIAGWDRKKRWYRAQELL

SEQ ID NO: 884625 - protein, 21 aa, Mycobacterium
IFAVLYWRMLTPPPLDRLPTV

SEQ ID NO: 884626 - protein, 18 aa, Mycobacterium
IFAYHGYPWLIHRLAYRH

SEQ ID NO: 884627 - protein, 18 aa, Mycobacterium
IFDAEPDFFWSPINSLED

SEQ ID NO: 884628 - protein, 26 aa, Mycobacterium
IFDVNLWAPLMWTSLVVKAWMGEHGG

SEQ ID NO: 884629 - protein, 19 aa, Mycobacterium
IFGVNHLWRRIRAANLPVA

SEQ ID NO: 884630 - protein, 19 aa, Mycobacterium
IFNDRFYVPFRLSAKNKHR

SEQ ID NO: 884631 - protein, 18 aa, Mycobacterium
IFNLVWNTLLALGFEWGV

SEQ ID NO: 884632 - protein, 20 aa, Mycobacterium
IFPPDNFPLYFYRKPSAPDL

SEQ ID NO: 884633 - protein, 18 aa, Mycobacterium
IFRHSGVIFLRRKLDDPL

SEQ ID NO: 884634 - protein, 25 aa, Mycobacterium
IFSVQYRLPGYYRWLLYEADHAGAY

SEQ ID NO: 884635 - protein, 18 aa, Mycobacterium
IFSVQYRLPNYYRWLLYE

SEQ ID NO: 884636 - protein, 19 aa, Mycobacterium
IFTWHLAIAMRPKLWMFNS

SEQ ID NO: 884637 - protein, 20 aa, Mycobacterium
IFVADFLPRVWAGCDALGLG

SEQ ID NO: 884638 - protein, 20 aa, Mycobacterium
IFVPLNFRLARPELEFLCTD

SEQ ID NO: 884639 - protein, 18 aa, Mycobacterium
IFVVSPLRINPWALVGHQ

SEQ ID NO: 884640 - protein, 25 aa, Mycobacterium
IGCSWLPLYHDMGLTFLLSAAVGGT

SEQ ID NO: 884641 - protein, 21 aa, Mycobacterium
IGDLPFLYQPGMLSAAWGVGI

SEQ ID NO: 884642 - protein, 24 aa, Mycobacterium
IGEIPLDDWLWTLGINLWGPIHGC

SEQ ID NO: 884643 - protein, 22 aa, Mycobacterium
IGFTWEHPIHLLLRRARANSVL

SEQ ID NO: 884644 - protein, 26 aa, Mycobacterium
IGGDALAEILLPFGVPRFFQTDPSQF

SEQ ID NO: 884645 - protein, 28 aa, Mycobacterium
IGGEGPVILFWPSLLMTGSMWAAQAEYF

SEQ ID NO: 884646 - protein, 22 aa, Mycobacterium
IGGFAGLFALKGGYREPVLAAS

SEQ ID NO: 884647 - protein, 17 aa, Mycobacterium
IGGYAERMLLSAPLLLP

SEQ ID NO: 884648 - protein, 18 aa, Mycobacterium
IGHPFWFSRRLFGELTQL

SEQ ID NO: 884649 - protein, 17 aa, Mycobacterium
IGIAGVPGSLPSGSTGG

SEQ ID NO: 884650 - protein, 17 aa, Mycobacterium
IGIVPRTLEAMLAAGAH

SEQ ID NO: 884651 - protein, 18 aa, Mycobacterium
IGKRYRFHPLALSNFLAA

SEQ ID NO: 884652 - protein, 17 aa, Mycobacterium
IGLALNCEITPWGRFAR

SEQ ID NO: 884653 - protein, 24 aa, Mycobacterium
IGLAPVLVLAWLPQLVGRRQAMRL

SEQ ID NO: 884654 - protein, 19 aa, Mycobacterium
IGLLRQHLSPGQLIHGIVT

SEQ ID NO: 884655 - protein, 18 aa, Mycobacterium
IGLPLTRDLISRAGISIA

SEQ ID NO: 884656 - protein, 28 aa, Mycobacterium
IGLRPWPQSPWWVFYYYGSPEQPGCQEA

SEQ ID NO: 884657 - protein, 20 aa, Mycobacterium
IGLVTFFEFLMRLATVDPNV

SEQ ID NO: 884658 - protein, 18 aa, Mycobacterium
IGMPATPRFLGHGQLLVA

SEQ ID NO: 884659 - protein, 18 aa, Mycobacterium
IGMVFQRPNPFPTMSIRD

SEQ ID NO: 884660 - protein, 20 aa, Mycobacterium
IGNMFGLYELVPGAPYVLAG

SEQ ID NO: 884661 - protein, 22 aa, Mycobacterium
IGNMWLALRFDGPLQTPALIAA

SEQ ID NO: 884662 - protein, 18 aa, Mycobacterium
IGRQLARRRLGYGRGARM

SEQ ID NO: 884663 - protein, 30 aa, Mycobacterium
IGTDLLPLLQPLLLFVPRPILSALDAPLRV

SEQ ID NO: 884664 - protein, 26 aa, Mycobacterium
IGVLYGRRALLNALPPFLTGGSMIET

SEQ ID NO: 884665 - protein, 24 aa, Mycobacterium
IGVSLPLLRSLLGRAGLSVASLWA

SEQ ID NO: 884666 - protein, 18 aa, Mycobacterium
IGWRSFECYLPIIQVSGA

SEQ ID NO: 884667 - protein, 20 aa, Mycobacterium
IHDYFWRWDTDWFWCSRAFG

SEQ ID NO: 884668 - protein, 21 aa, Mycobacterium
IHDYFWRWDTDWFWCSRAFGA

SEQ ID NO: 884669 - protein, 20 aa, Mycobacterium
IHEPLWIPTPTDSRLRQACA

SEQ ID NO: 884670 - protein, 17 aa, Mycobacterium
IHEWLEVRPFLGDSDAC

SEQ ID NO: 884671 - protein, 19 aa, Mycobacterium
IHFQEWWVRYRAKVPTHSF

SEQ ID NO: 884672 - protein, 18 aa, Mycobacterium
IHFQEWWVRYRAQVPTHS

SEQ ID NO: 884673 - protein, 25 aa, Mycobacterium
IHLRDRLLWALLWDTGIRIGEALGL

SEQ ID NO: 884674 - protein, 19 aa, Mycobacterium
IHLTGLDKTFPLYPALDDA

SEQ ID NO: 884675 - protein, 18 aa, Mycobacterium
IHLVFRGGLRRAGVPSTQ

SEQ ID NO: 884676 - protein, 19 aa, Mycobacterium
IHMRLPKLKGFKNRFRTEY

SEQ ID NO: 884677 - protein, 17 aa, Mycobacterium
IHQVAVNPLYMALNGGS

SEQ ID NO: 884678 - protein, 26 aa, Mycobacterium
IHRVSWLWALLLFRRRRIPDGAWIHA

SEQ ID NO: 884679 - protein, 23 aa, Mycobacterium
IHYNLTQVFYLFQAAAKYMIGQG

SEQ ID NO: 884680 - protein, 17 aa, Mycobacterium
IHYWALDGGWECFANHY

SEQ ID NO: 884681 - protein, 17 aa, Mycobacterium
IHYWALEGGWECFANHY

SEQ ID NO: 884682 - protein, 24 aa, Mycobacterium
IIDVPWDGVWWWSRPDGSLQLVPF

SEQ ID NO: 884683 - protein, 17 aa, Mycobacterium
IILHPYIELYLGESFFS

SEQ ID NO: 884684 - protein, 18 aa, Mycobacterium
IIMLVDVPGFLPGTGQEY

SEQ ID NO: 884685 - protein, 26 aa, Mycobacterium
IINLLLDLQALFGLSYLFVSHDLSVI

SEQ ID NO: 884686 - protein, 17 aa, Mycobacterium
IIPLIRAKRMRVIAKVL

SEQ ID NO: 884687 - protein, 20 aa, Mycobacterium
IIPVLRTIDYRAALPGGPLA

SEQ ID NO: 884688 - protein, 17 aa, Mycobacterium
IIRLDHPGVLVIEGGPG

SEQ ID NO: 884689 - protein, 25 aa, Mycobacterium
IISDFLGPINWMRPLRAIAGRHEVL

SEQ ID NO: 884690 - protein, 26 aa, Mycobacterium
IISDFLGPINWMRPLRAIGGRHEVLG

SEQ ID NO: 884691 - protein, 20 aa, Mycobacterium
IISLTLLPKMTPRSAGRYFL

SEQ ID NO: 884692 - protein, 23 aa, Mycobacterium
IITLAKWLRVNMIALALTEGSEE

SEQ ID NO: 884693 - protein, 25 aa, Mycobacterium
IKDALTPTLLFPFAAPRVGGDLSEA

SEQ ID NO: 884694 - protein, 23 aa, Mycobacterium
IKGINPFLGPFGALFIVLSGGYF

SEQ ID NO: 884695 - protein, 17 aa, Mycobacterium
IKINWVWNPPWGPDKIT

SEQ ID NO: 884696 - protein, 23 aa, Mycobacterium
IKNAIDWLSRPFGNGALKGKPLA

SEQ ID NO: 884697 - protein, 18 aa, Mycobacterium
IKNLRLPLLILHSPTDNT

SEQ ID NO: 884698 - protein, 19 aa, Mycobacterium
IKSLRLPLLILHSPTDNTV

SEQ ID NO: 884699 - protein, 17 aa, Mycobacterium
IKVLDLSTLLPGPLATL

SEQ ID NO: 884700 - protein, 19 aa, Mycobacterium
ILARELWDHTLTKLSWRHP

SEQ ID NO: 884701 - protein, 24 aa, Mycobacterium
ILCDPWLNPAYFTSWFPFPDNSAL

SEQ ID NO: 884702 - protein, 18 aa, Mycobacterium
ILDGFPRSTEQAKALHAM

SEQ ID NO: 884703 - protein, 17 aa, Mycobacterium
ILDIRPFTRGHTLVLPK

SEQ ID NO: 884704 - protein, 22 aa, Mycobacterium
ILHSHYWLSGQVGWLAADRWAV

SEQ ID NO: 884705 - protein, 19 aa, Mycobacterium
ILHYLPLPVPYTVGDARSF

SEQ ID NO: 884706 - protein, 17 aa, Mycobacterium
ILIFAWGATVPMIAHAA

SEQ ID NO: 884707 - protein, 17 aa, Mycobacterium
ILLGGVLYVPLLTRMLT

SEQ ID NO: 884708 - protein, 20 aa, Mycobacterium
ILLITHYTRILRYIQPQFVH

SEQ ID NO: 884709 - protein, 20 aa, Mycobacterium
ILPITWAYIRMMGAAGLRSA

SEQ ID NO: 884710 - protein, 22 aa, Mycobacterium
ILPQQALLYRLCGDRNPLHSDP

SEQ ID NO: 884711 - protein, 21 aa, Mycobacterium
ILQFAKFPLWKDLDESWEALS

SEQ ID NO: 884712 - protein, 17 aa, Mycobacterium
ILRIFGPLLDAAPTLGA

SEQ ID NO: 884713 - protein, 18 aa, Mycobacterium
ILRLHLVHLLQTLSPHTA

SEQ ID NO: 884714 - protein, 17 aa, Mycobacterium
ILRLKARLWFVHRGVEK

SEQ ID NO: 884715 - protein, 18 aa, Mycobacterium
ILRLLLAHPAYTAGRLRI

SEQ ID NO: 884716 - protein, 18 aa, Mycobacterium
ILSKRLPPYMVPAAVVVL

SEQ ID NO: 884717 - protein, 24 aa, Mycobacterium
ILTALWALIGYRLPTPIPRITYAD

SEQ ID NO: 884718 - protein, 17 aa, Mycobacterium
ILTAMSVFFFGLVDTPN

SEQ ID NO: 884719 - protein, 17 aa, Mycobacterium
ILVPINFRLAPAEIEYI

SEQ ID NO: 884720 - protein, 17 aa, Mycobacterium
ILWHRSFHELFLNDAAL

SEQ ID NO: 884721 - protein, 20 aa, Mycobacterium
ILYVAQAWDWIFPLGDNPDY

SEQ ID NO: 884722 - protein, 24 aa, Mycobacterium
IMARLRSPLLPVVKDRRLLGVITA

SEQ ID NO: 884723 - protein, 18 aa, Mycobacterium
IMIAAYDPARWNALCDAL

SEQ ID NO: 884724 - protein, 17 aa, Mycobacterium
IMSFRLFGSDKALAALN

SEQ ID NO: 884725 - protein, 24 aa, Mycobacterium
INCPGWVEAFRWLKPILSTRLGEL

SEQ ID NO: 884726 - protein, 23 aa, Mycobacterium
INERIHRLIRERGYLAFGLKLFT

SEQ ID NO: 884727 - protein, 24 aa, Mycobacterium
INGFGTPWWADDLAALATTPVGGV

SEQ ID NO: 884728 - protein, 18 aa, Mycobacterium
INGWKPVKDVIYSAASAL

SEQ ID NO: 884729 - protein, 18 aa, Mycobacterium
INHPRFILHFTPTSSSWL

SEQ ID NO: 884730 - protein, 20 aa, Mycobacterium
INLHHVFLLTRAFLPAMVDR

SEQ ID NO: 884731 - protein, 17 aa, Mycobacterium
INLLLDLQDRFGLSYLF

SEQ ID NO: 884732 - protein, 18 aa, Mycobacterium
INLTAARLMWWTSPADHS

SEQ ID NO: 884733 - protein, 18 aa, Mycobacterium
INMIPFPSFFADDFTILD

SEQ ID NO: 884734 - protein, 23 aa, Mycobacterium
INNVLAFPGVFRGALDAGARRIT

SEQ ID NO: 884735 - protein, 22 aa, Mycobacterium
INPHPMFVPWLVGPLLTCPPSR

SEQ ID NO: 884736 - protein, 17 aa, Mycobacterium
INQLYWNLADYAGSPRR

SEQ ID NO: 884737 - protein, 21 aa, Mycobacterium
INRILAYVAPILLGGPVTAVD

SEQ ID NO: 884738 - protein, 26 aa, Mycobacterium
INRVKTWLQFPQWFYMNNPPNVFEPP

SEQ ID NO: 884739 - protein, 24 aa, Mycobacterium
INSPGWVGLMRWLKPVLSTPIGET

SEQ ID NO: 884740 - protein, 21 aa, Mycobacterium
INVTGVFRYTDTWPAAIHLVS

SEQ ID NO: 884741 - protein, 20 aa, Mycobacterium
IPAWLIFDQQYRDRYIFAGL

SEQ ID NO: 884742 - protein, 21 aa, Mycobacterium
IPAWLIFDQQYRDRYIFAGLQ

SEQ ID NO: 884743 - protein, 19 aa, Mycobacterium
IPCSFVLTMLRDPALPLLE

SEQ ID NO: 884744 - protein, 20 aa, Mycobacterium
IPDIAIPLVFRLLGESGAHA

SEQ ID NO: 884745 - protein, 19 aa, Mycobacterium
IPEAYRGRRLAWSDSWLTS

SEQ ID NO: 884746 - protein, 18 aa, Mycobacterium
IPELPWLARKRIQDDWGV

SEQ ID NO: 884747 - protein, 20 aa, Mycobacterium
IPFAIPYTKPLKFASGEVHT

SEQ ID NO: 884748 - protein, 20 aa, Mycobacterium
IPFSIPYTKPLRFASGEVHA

SEQ ID NO: 884749 - protein, 20 aa, Mycobacterium
IPGLLTWRGLARVMSESPAR

SEQ ID NO: 884750 - protein, 17 aa, Mycobacterium
IPGPLKWDLTMGVATDT

SEQ ID NO: 884751 - protein, 18 aa, Mycobacterium
IPLDDALRPKWLFGATVH

SEQ ID NO: 884752 - protein, 18 aa, Mycobacterium
IPLPASLQQFLAGLPSVG

SEQ ID NO: 884753 - protein, 18 aa, Mycobacterium
IPLYFRLLGETGSHASIL

SEQ ID NO: 884754 - protein, 19 aa, Mycobacterium
IPPKLAIPMRVIASIVAIS

SEQ ID NO: 884755 - protein, 23 aa, Mycobacterium
IPPQADWLDPMIALSFAAAASSR

SEQ ID NO: 884756 - protein, 18 aa, Mycobacterium
IPPSLQWLRPFAPAFRPR

SEQ ID NO: 884757 - protein, 20 aa, Mycobacterium
IPPTRGWRKVLYRGTFKLIN

SEQ ID NO: 884758 - protein, 17 aa, Mycobacterium
IPRIVFGAYPGLPGGEN

SEQ ID NO: 884759 - protein, 23 aa, Mycobacterium
IPRPVDWRWPWGEVLDVLDDVGT

SEQ ID NO: 884760 - protein, 23 aa, Mycobacterium
IPTKEVILYFSPAGLVVVAPLPD

SEQ ID NO: 884761 - protein, 19 aa, Mycobacterium
IPVPYVYPVDLRYLLSPPV

SEQ ID NO: 884762 - protein, 20 aa, Mycobacterium
IPVYRFVLRAYAAQLVQDHA

SEQ ID NO: 884763 - protein, 17 aa, Mycobacterium
IPWVLAWSQSRVMLPGW

SEQ ID NO: 884764 - protein, 19 aa, Mycobacterium
IPWWWRPSGALFDQFLGAA

SEQ ID NO: 884765 - protein, 19 aa, Mycobacterium
IPYPAPRLERWYLPSTDRI

SEQ ID NO: 884766 - protein, 20 aa, Mycobacterium
IPYPGFWLVPQWRTDEILLD

SEQ ID NO: 884767 - protein, 17 aa, Mycobacterium
IQFLPFNTVYQLAAERA

SEQ ID NO: 884768 - protein, 25 aa, Mycobacterium
IQFNSLFLDPYLWKLQIGGKRLVQK

SEQ ID NO: 884769 - protein, 25 aa, Mycobacterium
IQFNTLFLDPYLWKLQVGGKRLVQR

SEQ ID NO: 884770 - protein, 17 aa, Mycobacterium
IQLYYRRAKAWAAAFAD

SEQ ID NO: 884771 - protein, 18 aa, Mycobacterium
IQMPIAVDPEWDRPGRAV

SEQ ID NO: 884772 - protein, 23 aa, Mycobacterium
IQRVKFLCHWYLPASQRHKGRFT

SEQ ID NO: 884773 - protein, 19 aa, Mycobacterium
IQSPKWLELVEPYGFTEAE

SEQ ID NO: 884774 - protein, 21 aa, Mycobacterium
IRAALPLLRAADWARVVTLSA

SEQ ID NO: 884775 - protein, 18 aa, Mycobacterium
IRADGYWPQLAARLTEAA

SEQ ID NO: 884776 - protein, 18 aa, Mycobacterium
IRADRFWMMGPPTPADEV

SEQ ID NO: 884777 - protein, 19 aa, Mycobacterium
IRADRFWMMGPPTPADQVV

SEQ ID NO: 884778 - protein, 24 aa, Mycobacterium
IRALYAFKRLAWWPYSVAMRQVNV

SEQ ID NO: 884779 - protein, 20 aa, Mycobacterium
IRALYLFKRTMWLPYSIAMK

SEQ ID NO: 884780 - protein, 23 aa, Mycobacterium
IRASLPLLRSADWARIVTLSAHS

SEQ ID NO: 884781 - protein, 19 aa, Mycobacterium
IRAWAYQIVDLAGDYRVIA

SEQ ID NO: 884782 - protein, 17 aa, Mycobacterium
IRCFGFSPLRLPPDLDF

SEQ ID NO: 884783 - protein, 18 aa, Mycobacterium
IRCFGFSPLRLPPDLDFT

SEQ ID NO: 884784 - protein, 21 aa, Mycobacterium
IRDGLLYLFLPPLEQVDDFVD

SEQ ID NO: 884785 - protein, 22 aa, Mycobacterium
IREQLPGLWLLASLYFRADVRG

SEQ ID NO: 884786 - protein, 17 aa, Mycobacterium
IRFAAHAPTWRETGRAS

SEQ ID NO: 884787 - protein, 18 aa, Mycobacterium
IRFPELAAYPFVVLDRDH

SEQ ID NO: 884788 - protein, 17 aa, Mycobacterium
IRFVAVLPRLTPATDLG

SEQ ID NO: 884789 - protein, 18 aa, Mycobacterium
IRFYEDLGLLPPPARSAS

SEQ ID NO: 884790 - protein, 20 aa, Mycobacterium
IRILFIFDPRRQAILLLGGD

SEQ ID NO: 884791 - protein, 18 aa, Mycobacterium
IRKPWWSTPSLWVPDLFM

SEQ ID NO: 884792 - protein, 22 aa, Mycobacterium
IRNLLPLFAVFKPTVVVSVPRV

SEQ ID NO: 884793 - protein, 19 aa, Mycobacterium
IRPELVVPLVIFLASRACT

SEQ ID NO: 884794 - protein, 22 aa, Mycobacterium
IRQPVPPFKWWRGLRARTLLEE

SEQ ID NO: 884795 - protein, 21 aa, Mycobacterium
IRRFWPRRLRRSSFYWKLVAY

SEQ ID NO: 884796 - protein, 18 aa, Mycobacterium
IRRRLIPAGTWSGQATFR

SEQ ID NO: 884797 - protein, 23 aa, Mycobacterium
IRSAGAIFVGPWAPVSLGDYCAG

SEQ ID NO: 884798 - protein, 24 aa, Mycobacterium
IRSAGAIFVGPWAPVSLGDYCAGS

SEQ ID NO: 884799 - protein, 21 aa, Mycobacterium
IRSVSWLPLYHDMGLIMIMFP

SEQ ID NO: 884800 - protein, 18 aa, Mycobacterium
IRVLAIAPSLFLTGLTAM

SEQ ID NO: 884801 - protein, 18 aa, Mycobacterium
IRVLAIAPSLFLTGLTSM

SEQ ID NO: 884802 - protein, 18 aa, Mycobacterium
IRVRVLPTWLRLDARFGS

SEQ ID NO: 884803 - protein, 17 aa, Mycobacterium
IRVYRWHPAPPGGEFDQ

SEQ ID NO: 884804 - protein, 18 aa, Mycobacterium
IRWTIVRYKPPEGMTLNG

SEQ ID NO: 884805 - protein, 25 aa, Mycobacterium
IRYIDRFLMFYIRTADRLQRTAPWV

SEQ ID NO: 884806 - protein, 25 aa, Mycobacterium
IRYIDRYLMFYIRTADRLQRTAPWQ

SEQ ID NO: 884807 - protein, 24 aa, Mycobacterium
ISAPGWFLPTIITPTVSPIPPFNQ

SEQ ID NO: 884808 - protein, 21 aa, Mycobacterium
ISAVLPMFFEFAGNSVFVAHN

SEQ ID NO: 884809 - protein, 24 aa, Mycobacterium
ISDFLGPINWMRPLRAIAGRHEVL

SEQ ID NO: 884810 - protein, 23 aa, Mycobacterium
ISDNLVSAAPFWEKPRDLADVLT

SEQ ID NO: 884811 - protein, 26 aa, Mycobacterium
ISGSGPAYFFLLVEALVDAGVASGLT

SEQ ID NO: 884812 - protein, 17 aa, Mycobacterium
ISHWLWRRNARLVARAL

SEQ ID NO: 884813 - protein, 28 aa, Mycobacterium
ISPFNFPAMVPMWFFPIAIAAGNTVVVK

SEQ ID NO: 884814 - protein, 17 aa, Mycobacterium
ISPVDYMLYTPLLPDVA

SEQ ID NO: 884815 - protein, 20 aa, Mycobacterium
ISPVTLRQALLGKVLTVGDA

SEQ ID NO: 884816 - protein, 17 aa, Mycobacterium
ISQWWCAFGKKRRGRKG

SEQ ID NO: 884817 - protein, 23 aa, Mycobacterium
ISRPTFYFYFPSKEAVLLSLIDP

SEQ ID NO: 884818 - protein, 23 aa, Mycobacterium
ISRPTFYFYFPSKEAVLLTLLDR

SEQ ID NO: 884819 - protein, 18 aa, Mycobacterium
ISSGPYRFVYRKRFHKKC

SEQ ID NO: 884820 - protein, 23 aa, Mycobacterium
ISTALVLMTERYFYRAFTQGTSL

SEQ ID NO: 884821 - protein, 18 aa, Mycobacterium
ISTLPWPASKWTSSRDLP

SEQ ID NO: 884822 - protein, 18 aa, Mycobacterium
ISTLSGMYWWGPASAAML

SEQ ID NO: 884823 - protein, 20 aa, Mycobacterium
ISTRAVLPEWFIGSGLTAAA

SEQ ID NO: 884824 - protein, 25 aa, Mycobacterium
ISTRLFQFMPRRVLLPLLKNQHPSL

SEQ ID NO: 884825 - protein, 18 aa, Mycobacterium
ISTWPWPETFNGITVNGV

SEQ ID NO: 884826 - protein, 20 aa, Mycobacterium
ISVAYFFNPRLDARIPVLEL

SEQ ID NO: 884827 - protein, 21 aa, Mycobacterium
ISYAFAIYYLPKPSADPFATL

SEQ ID NO: 884828 - protein, 17 aa, Mycobacterium
ISYFYWSPSFSQVYSEL

SEQ ID NO: 884829 - protein, 28 aa, Mycobacterium
ITAETRLYLPMPFFWVGGFGSGILSTLL

SEQ ID NO: 884830 - protein, 24 aa, Mycobacterium
ITAFNFPVAVWAWNAALALVCGDP

SEQ ID NO: 884831 - protein, 18 aa, Mycobacterium
ITAPPYPPSILLTGIIVN

SEQ ID NO: 884832 - protein, 18 aa, Mycobacterium
ITAPPYPPSILLTGVIVN

SEQ ID NO: 884833 - protein, 17 aa, Mycobacterium
ITDAFFLGVIPLLLDPT

SEQ ID NO: 884834 - protein, 18 aa, Mycobacterium
ITDFFRYFTKLTADRREN

SEQ ID NO: 884835 - protein, 21 aa, Mycobacterium
ITERVLPAVLLLKAVGLAAQR

SEQ ID NO: 884836 - protein, 22 aa, Mycobacterium
ITFGPFLQWALGAQAKEILGLW

SEQ ID NO: 884837 - protein, 17 aa, Mycobacterium
ITFGWLHAVRRGQARLH

SEQ ID NO: 884838 - protein, 23 aa, Mycobacterium
ITGTALATLLILKSKYAKKHETS

SEQ ID NO: 884839 - protein, 17 aa, Mycobacterium
ITIARYWRQWADPRLVV

SEQ ID NO: 884840 - protein, 18 aa, Mycobacterium
ITIAYLKTRFQFGRAIGS

SEQ ID NO: 884841 - protein, 18 aa, Mycobacterium
ITIIMGLVFQTKYLNGLA

SEQ ID NO: 884842 - protein, 17 aa, Mycobacterium
ITIPQFNYPAPAHWYFP

SEQ ID NO: 884843 - protein, 17 aa, Mycobacterium
ITNLLLLRGMIGKPGAG

SEQ ID NO: 884844 - protein, 26 aa, Mycobacterium
ITPFNFPAMIPLWKAGPALACGNAFI

SEQ ID NO: 884845 - protein, 27 aa, Mycobacterium
ITPFNFPAMIPLWKAGPALACGNAFIL

SEQ ID NO: 884846 - protein, 26 aa, Mycobacterium
ITPFNFPAMIPLWKAGPALACGNAFL

SEQ ID NO: 884847 - protein, 27 aa, Mycobacterium
ITPMDFLGDILLWPRLIHKYRGTMTAA

SEQ ID NO: 884848 - protein, 22 aa, Mycobacterium
ITPWNFPHQINLAKIGPALAAG

SEQ ID NO: 884849 - protein, 18 aa, Mycobacterium
ITPWNFPMTIASWGFAPA

SEQ ID NO: 884850 - protein, 17 aa, Mycobacterium
ITRLPEWYRYNAALLLA

SEQ ID NO: 884851 - protein, 17 aa, Mycobacterium
ITVADVPNLFFLLGPNT

SEQ ID NO: 884852 - protein, 22 aa, Mycobacterium
ITYVALRRWLLLRLARRYGKVF

SEQ ID NO: 884853 - protein, 17 aa, Mycobacterium
IVALIRSALYRAAVNHG

SEQ ID NO: 884854 - protein, 17 aa, Mycobacterium
IVDGWWWTDGELAQRLA

SEQ ID NO: 884855 - protein, 20 aa, Mycobacterium
IVDPSWFNWPALPVAMADTI

SEQ ID NO: 884856 - protein, 21 aa, Mycobacterium
IVDPSWFNWPALPVAMADTIV

SEQ ID NO: 884857 - protein, 18 aa, Mycobacterium
IVEFLKAKWATELDYRLI

SEQ ID NO: 884858 - protein, 17 aa, Mycobacterium
IVFHTLLRRIPTLKLAI

SEQ ID NO: 884859 - protein, 19 aa, Mycobacterium
IVFLRLRKAARKHKVPVYA

SEQ ID NO: 884860 - protein, 18 aa, Mycobacterium
IVFLRLRKAARKNGLPVY

SEQ ID NO: 884861 - protein, 19 aa, Mycobacterium
IVFLRLRKGVRKNGVQVVA

SEQ ID NO: 884862 - protein, 25 aa, Mycobacterium
IVFQRTPIWCFPKLDVPLPAAARWA

SEQ ID NO: 884863 - protein, 21 aa, Mycobacterium
IVGTHWWNPAPLIPLVEVVQA

SEQ ID NO: 884864 - protein, 18 aa, Mycobacterium
IVHLLRRFDVPIAGAHVV

SEQ ID NO: 884865 - protein, 18 aa, Mycobacterium
IVIFAPLPVLTVTVEDRS

SEQ ID NO: 884866 - protein, 18 aa, Mycobacterium
IVIGGGMCFTFLAAQGFS

SEQ ID NO: 884867 - protein, 19 aa, Mycobacterium
IVIGGGMCFTFLAAQGFSV

SEQ ID NO: 884868 - protein, 20 aa, Mycobacterium
IVIVRRAIRRLLLRGDSPET

SEQ ID NO: 884869 - protein, 17 aa, Mycobacterium
IVLFVYYEPSILADPEL

SEQ ID NO: 884870 - protein, 17 aa, Mycobacterium
IVLQFMIDDLLQEPLLS

SEQ ID NO: 884871 - protein, 18 aa, Mycobacterium
IVLSPHWPEYLGALGFPI

SEQ ID NO: 884872 - protein, 20 aa, Mycobacterium
IVMDGWSLPILLREILANYY

SEQ ID NO: 884873 - protein, 22 aa, Mycobacterium
IVMDGWSLPILLREILTSYYGE

SEQ ID NO: 884874 - protein, 22 aa, Mycobacterium
IVMQWITPRWDLPATYELGYRI

SEQ ID NO: 884875 - protein, 18 aa, Mycobacterium
IVNNGAFTPALYGFGGNG

SEQ ID NO: 884876 - protein, 19 aa, Mycobacterium
IVPAAVIFDLPVGGWRCRP

SEQ ID NO: 884877 - protein, 17 aa, Mycobacterium
IVPVPWRLSLKAVAAAL

SEQ ID NO: 884878 - protein, 26 aa, Mycobacterium
IVPWNVPQFLIMPKLIPALIAGCAVI

SEQ ID NO: 884879 - protein, 18 aa, Mycobacterium
IVQKYLIERGLAQYVTDY

SEQ ID NO: 884880 - protein, 23 aa, Mycobacterium
IVRAHRLYGLLYAARRSPVAWTD

SEQ ID NO: 884881 - protein, 24 aa, Mycobacterium
IVRRSNALLDWAYGRQFRYTESMS

SEQ ID NO: 884882 - protein, 17 aa, Mycobacterium
IVRTLEALERLPLSYRL

SEQ ID NO: 884883 - protein, 19 aa, Mycobacterium
IVRTSMIVAFPRSPMLTAY

SEQ ID NO: 884884 - protein, 19 aa, Mycobacterium
IVSFWLKPYGFFDRNPALD

SEQ ID NO: 884885 - protein, 18 aa, Mycobacterium
IVTPGSWRREPIAGIPAS

SEQ ID NO: 884886 - protein, 18 aa, Mycobacterium
IVVVLPDFGERYLSTPLF

SEQ ID NO: 884887 - protein, 18 aa, Mycobacterium
IVVVLPDFGERYLSTVLF

SEQ ID NO: 884888 - protein, 18 aa, Mycobacterium
IVVWAPPRHSFYTDLLVS

SEQ ID NO: 884889 - protein, 17 aa, Mycobacterium
IVVWLGSAEARDVTGKM

SEQ ID NO: 884890 - protein, 18 aa, Mycobacterium
IWAAECVFVPLNFKLHPR

SEQ ID NO: 884891 - protein, 20 aa, Mycobacterium
IWIGPRFVIPSLAMRARVRE

SEQ ID NO: 884892 - protein, 18 aa, Mycobacterium
IWQVAYLIAPVAGWVHKS

SEQ ID NO: 884893 - protein, 18 aa, Mycobacterium
IWVFKQLWDKGLAYEGNR

SEQ ID NO: 884894 - protein, 19 aa, Mycobacterium
IWWQIYPLGFVGAHPADPP

SEQ ID NO: 884895 - protein, 20 aa, Mycobacterium
IYFGAPLLWAERLVSTWLAD

SEQ ID NO: 884896 - protein, 17 aa, Mycobacterium
IYGGWYLLYRYWPTSHN

SEQ ID NO: 884897 - protein, 19 aa, Mycobacterium
IYLGLPYYGRWLLAVARVL

SEQ ID NO: 884898 - protein, 17 aa, Mycobacterium
IYRLMWFGGARNYDVLN

SEQ ID NO: 884899 - protein, 25 aa, Mycobacterium
IYSGGYWLVPLLKSLGGALGALKES

SEQ ID NO: 884900 - protein, 23 aa, Mycobacterium
IYSVQYRLPSYYRWLLYEADHRG

SEQ ID NO: 884901 - protein, 32 aa, Mycobacterium
IYVTEVRWWGARPLWFALWSGVFERFPGLRWG

SEQ ID NO: 884902 - protein, 31 aa, Mycobacterium
IYVTEVRWWGARPLWFALWSGVFERFPRLRW

SEQ ID NO: 884903 - protein, 32 aa, Mycobacterium
IYVTEVRWWGVRPLWFALWSGVFERFPGLRWG

SEQ ID NO: 884904 - protein, 29 aa, Mycobacterium
IYVTEVRWWGVRPLWFALWSGVFERFPRL

SEQ ID NO: 884905 - protein, 20 aa, Mycobacterium
KAALDLLWPVLTPETVLAEL

SEQ ID NO: 884906 - protein, 22 aa, Mycobacterium
KADPGLLRWFEDPKIGGIELKG

SEQ ID NO: 884907 - protein, 21 aa, Mycobacterium
KAFAPYGLRPTAFKPSYGIAE

SEQ ID NO: 884908 - protein, 18 aa, Mycobacterium
KAFDMVFAEALWAELHDK

SEQ ID NO: 884909 - protein, 17 aa, Mycobacterium
KAGRRFALLAPIVATHR

SEQ ID NO: 884910 - protein, 29 aa, Mycobacterium
KAHIRNWRWAGVPFYLRTGKRMSQRFSEI

SEQ ID NO: 884911 - protein, 21 aa, Mycobacterium
KAHLPADAWPPTSWYADWVSG

SEQ ID NO: 884912 - protein, 24 aa, Mycobacterium
KAHLPPGAWPPTSWYADWVSGLDV

SEQ ID NO: 884913 - protein, 23 aa, Mycobacterium
KAIDDLYFIKLWTSADGAIHEDH

SEQ ID NO: 884914 - protein, 24 aa, Mycobacterium
KALTPLYKGLVTPALTPISDLLTQ

SEQ ID NO: 884915 - protein, 18 aa, Mycobacterium
KAMQFLRGGRRWLLKSPQ

SEQ ID NO: 884916 - protein, 21 aa, Mycobacterium
KAPYGYYEYLPGWWAPQVPGP

SEQ ID NO: 884917 - protein, 21 aa, Mycobacterium
KARLWFVHRGVEKLFEGRPPN

SEQ ID NO: 884918 - protein, 17 aa, Mycobacterium
KARVEDIYLPYKPKRRT

SEQ ID NO: 884919 - protein, 23 aa, Mycobacterium
KARVEDIYLPYKPKRRTKAQIAR

SEQ ID NO: 884920 - protein, 23 aa, Mycobacterium
KASVMTHHRWLRALAVFGGMGLR

SEQ ID NO: 884921 - protein, 26 aa, Mycobacterium
KAVSPWWLQRRLLLSGIRAISPAVDV

SEQ ID NO: 884922 - protein, 18 aa, Mycobacterium
KAWLGTALALKPILRIDD

SEQ ID NO: 884923 - protein, 18 aa, Mycobacterium
KAWWVGNIVYLWDGEHYV

SEQ ID NO: 884924 - protein, 22 aa, Mycobacterium
KAYLRMLSRIAGMGFLVVAVDA

SEQ ID NO: 884925 - protein, 17 aa, Mycobacterium
KCALLGWMAFKDALVQA

SEQ ID NO: 884926 - protein, 17 aa, Mycobacterium
KCIGLPTGLLLPSPELL

SEQ ID NO: 884927 - protein, 17 aa, Mycobacterium
KCQLPVTLPQLLGLVQA

SEQ ID NO: 884928 - protein, 20 aa, Mycobacterium
KDAELLGVPWILVVGRGWAN

SEQ ID NO: 884929 - protein, 24 aa, Mycobacterium
KDCRPLYYLEMPPSLFAPIVENLA

SEQ ID NO: 884930 - protein, 18 aa, Mycobacterium
KDDGLAWVPYGPKDPAFP

SEQ ID NO: 884931 - protein, 22 aa, Mycobacterium
KDDWFWIKVPVGYLYTIANPRT

SEQ ID NO: 884932 - protein, 18 aa, Mycobacterium
KDFGAIMPMRVISALLGI

SEQ ID NO: 884933 - protein, 25 aa, Mycobacterium
KDGRWIQLVFLQPDKFWVGFCRRMG

SEQ ID NO: 884934 - protein, 24 aa, Mycobacterium
KDGYGRNFLLPRGLAIVASRGAQK

SEQ ID NO: 884935 - protein, 27 aa, Mycobacterium
KDGYGRNYLLPRGLAIVASRGAERQAE

SEQ ID NO: 884936 - protein, 26 aa, Mycobacterium
KDGYGRNYLLPRGLAIVATRGAQRQA

SEQ ID NO: 884937 - protein, 19 aa, Mycobacterium
KDLLFPWRTVLENVVLGLE

SEQ ID NO: 884938 - protein, 23 aa, Mycobacterium
KDLLPLLEKVIQGGKPLLIIAED

SEQ ID NO: 884939 - protein, 20 aa, Mycobacterium
KDLLPLLEKVIQSGKPLLII

SEQ ID NO: 884940 - protein, 22 aa, Mycobacterium
KDPWLRRNLLPAYRAGSRRILF

SEQ ID NO: 884941 - protein, 21 aa, Mycobacterium
KDRRVMPALRRLGWHVTTVVK

SEQ ID NO: 884942 - protein, 18 aa, Mycobacterium
KDTWLRRQLTPQFRPGCK

SEQ ID NO: 884943 - protein, 25 aa, Mycobacterium
KDWKGKLKFLAKKIPFAGTLAEIGT

SEQ ID NO: 884944 - protein, 27 aa, Mycobacterium
KDYEGKWRIIFFWPKDFTFVCPTEIAA

SEQ ID NO: 884945 - protein, 19 aa, Mycobacterium
KEFVLTGVPWGLRREGRKP

SEQ ID NO: 884946 - protein, 24 aa, Mycobacterium
KEIKINWVWVPPWGPDKITDDGRE

SEQ ID NO: 884947 - protein, 22 aa, Mycobacterium
KEIRHWLQVFAQRFYSFSQFKR

SEQ ID NO: 884948 - protein, 21 aa, Mycobacterium
KELIAWLPTLLGLGADDLIVI

SEQ ID NO: 884949 - protein, 22 aa, Mycobacterium
KELIAWLPTLLGLGPRDVVVVP

SEQ ID NO: 884950 - protein, 21 aa, Mycobacterium
KELIRAFWPGALSLVVHQAPS

SEQ ID NO: 884951 - protein, 17 aa, Mycobacterium
KELPVVGFIWQVLGRIG

SEQ ID NO: 884952 - protein, 26 aa, Mycobacterium
KELVLKGILWSLRREGRKPGATSWLK

SEQ ID NO: 884953 - protein, 23 aa, Mycobacterium
KEMWDAFYEEYLAPVWPLERMKQ

SEQ ID NO: 884954 - protein, 23 aa, Mycobacterium
KENLPPGAWPHTGWYAEWVSGQD

SEQ ID NO: 884955 - protein, 20 aa, Mycobacterium
KEPFGVVGLIFPWNGPIFNA

SEQ ID NO: 884956 - protein, 28 aa, Mycobacterium
KEPIGVCGLITPWNWPINQIACKVFPAL

SEQ ID NO: 884957 - protein, 20 aa, Mycobacterium
KEPYSVVGLIFPWNGPIFNA

SEQ ID NO: 884958 - protein, 22 aa, Mycobacterium
KEQLGILARFAGAALVAKEDTV

SEQ ID NO: 884959 - protein, 23 aa, Mycobacterium
KEQPLWRVLVALSIRHVGPTAAR

SEQ ID NO: 884960 - protein, 19 aa, Mycobacterium
KERWPAFWDWAYKTLPDDS

SEQ ID NO: 884961 - protein, 26 aa, Mycobacterium
KERYSMDWYYPILGSALRGPAADARI

SEQ ID NO: 884962 - protein, 21 aa, Mycobacterium
KETLRLHPPLIILMRVAKGEF

SEQ ID NO: 884963 - protein, 22 aa, Mycobacterium
KETWLRLLLRDAGLPPVSTQIL

SEQ ID NO: 884964 - protein, 18 aa, Mycobacterium
KETWVRLLLIRAGLPRPQ

SEQ ID NO: 884965 - protein, 17 aa, Mycobacterium
KEVFGAVTGRDDVKREG

SEQ ID NO: 884966 - protein, 24 aa, Mycobacterium
KEVQFRLGFLLDVGLQYLSLSRAA

SEQ ID NO: 884967 - protein, 18 aa, Mycobacterium
KEWGWAKPMWIWAGRTSR

SEQ ID NO: 884968 - protein, 21 aa, Mycobacterium
KEWHQYWIDTRLQWYVDLGID

SEQ ID NO: 884969 - protein, 20 aa, Mycobacterium
KEWLLFGPFAGWSPKFLKMG

SEQ ID NO: 884970 - protein, 25 aa, Mycobacterium
KEYASRGTWIWPPGPSLRLIADTIE

SEQ ID NO: 884971 - protein, 17 aa, Mycobacterium
KFDLLGLGMLSALHYCI

SEQ ID NO: 884972 - protein, 23 aa, Mycobacterium
KFDLVGWLPAYLHWYGLAMRRPM

SEQ ID NO: 884973 - protein, 23 aa, Mycobacterium
KFDLVGWLPSYLHWYGLAMRGPV

SEQ ID NO: 884974 - protein, 18 aa, Mycobacterium
KFFALLRDWTTRYRHGTV

SEQ ID NO: 884975 - protein, 18 aa, Mycobacterium
KFGKLPFETLFEPAIHYA

SEQ ID NO: 884976 - protein, 26 aa, Mycobacterium
KFLAEKVVRWWLPERWAFVEEIPRTS

SEQ ID NO: 884977 - protein, 19 aa, Mycobacterium
KFLEEPLWPPENFDGLAAL

SEQ ID NO: 884978 - protein, 17 aa, Mycobacterium
KFPGRLVVGLAVSRLGT

SEQ ID NO: 884979 - protein, 17 aa, Mycobacterium
KFSTKIVALNLLGALSV

SEQ ID NO: 884980 - protein, 22 aa, Mycobacterium
KFTAALIGPWWSAPSTELRAGA

SEQ ID NO: 884981 - protein, 20 aa, Mycobacterium
KFVPLPWPDYYGKAPKARLD

SEQ ID NO: 884982 - protein, 17 aa, Mycobacterium
KFYVRLFGWKPHAMGES

SEQ ID NO: 884983 - protein, 22 aa, Mycobacterium
KFYWMSTTQLRWRPIDFWPADT

SEQ ID NO: 884984 - protein, 25 aa, Mycobacterium
KGALAIYHRILPPQGWFDDPNPDIA

SEQ ID NO: 884985 - protein, 26 aa, Mycobacterium
KGAMYPQWLVANLWQKKWLTDDVIPS

SEQ ID NO: 884986 - protein, 21 aa, Mycobacterium
KGDWAMVLLPLLHRDPRVWAD

SEQ ID NO: 884987 - protein, 24 aa, Mycobacterium
KGEKLLVFLPLAHVLARALTIGAF

SEQ ID NO: 884988 - protein, 25 aa, Mycobacterium
KGETLEEYWWAAEQMLTWPGEPANM

SEQ ID NO: 884989 - protein, 25 aa, Mycobacterium
KGETLEEYWWAAEQMLTWPNEPANM

SEQ ID NO: 884990 - protein, 17 aa, Mycobacterium
KGGIKPVSVWLSHEYVR

SEQ ID NO: 884991 - protein, 20 aa, Mycobacterium
KGGLPLLPDIFGSVGMTGIN

SEQ ID NO: 884992 - protein, 17 aa, Mycobacterium
KGKLLEYYLAVADPMVT

SEQ ID NO: 884993 - protein, 25 aa, Mycobacterium
KGLKGLYEFFTPLLRNLGHSGRVVV

SEQ ID NO: 884994 - protein, 21 aa, Mycobacterium
KGLSCFMLPRILPDGTRNRML

SEQ ID NO: 884995 - protein, 20 aa, Mycobacterium
KGLYEFFTPLLRNLGHSARV

SEQ ID NO: 884996 - protein, 21 aa, Mycobacterium
KGMAVLLAALPKLVARFPDVE

SEQ ID NO: 884997 - protein, 22 aa, Mycobacterium
KGRILTAMSVFFFGLLTVPNHL

SEQ ID NO: 884998 - protein, 21 aa, Mycobacterium
KGRILTAMSVFFFGLVDAPNH

SEQ ID NO: 884999 - protein, 22 aa, Mycobacterium
KGRILTAMSVFFFGLVDAPNHL

SEQ ID NO: 885000 - protein, 17 aa, Mycobacterium
KGRKVIVYFYPAASTPG

SEQ ID NO: 885001 - protein, 18 aa, Mycobacterium
KGSLAHVPGLYRLLRIPP

SEQ ID NO: 885002 - protein, 25 aa, Mycobacterium
KHEGLTMFLVPLKAPGITMRRIKEV

SEQ ID NO: 885003 - protein, 19 aa, Mycobacterium
KHIGWYLHGFPAGSELRRA

SEQ ID NO: 885004 - protein, 23 aa, Mycobacterium
KHKDACIFLNRPGFKGGPGCALH

SEQ ID NO: 885005 - protein, 22 aa, Mycobacterium
KHKDACIFLNRPGFPGGVGCAL

SEQ ID NO: 885006 - protein, 22 aa, Mycobacterium
KHLLESWIPLLALFAHAGAHDW

SEQ ID NO: 885007 - protein, 17 aa, Mycobacterium
KHPTWYYWPQGGKRAEA

SEQ ID NO: 885008 - protein, 18 aa, Mycobacterium
KHRLARSLFLYALCNGWI

SEQ ID NO: 885009 - protein, 17 aa, Mycobacterium
KHRVFHYPGGLVDFVKH

SEQ ID NO: 885010 - protein, 23 aa, Mycobacterium
KHSAIAALPWFWSDQYDLKLQIA

SEQ ID NO: 885011 - protein, 22 aa, Mycobacterium
KHSLNYWYRMFAPAFDTSLGLE

SEQ ID NO: 885012 - protein, 21 aa, Mycobacterium
KHVAWYLHGFPAGADLRRALA

SEQ ID NO: 885013 - protein, 22 aa, Mycobacterium
KHVAWYLHGFPAGSDLRRALAL

SEQ ID NO: 885014 - protein, 20 aa, Mycobacterium
KHWNAFIAAVRPPWASELYS

SEQ ID NO: 885015 - protein, 19 aa, Mycobacterium
KIAARIRKVFGRRVRIRDV

SEQ ID NO: 885016 - protein, 20 aa, Mycobacterium
KIDFWLWLDAGFEDHAIEAW

SEQ ID NO: 885017 - protein, 17 aa, Mycobacterium
KIDPYLRPLYDALHDMM

SEQ ID NO: 885018 - protein, 18 aa, Mycobacterium
KIDPYLRPLYDALHDMMD

SEQ ID NO: 885019 - protein, 23 aa, Mycobacterium
KIDPYLRPLYDALYDMMDPELIA

SEQ ID NO: 885020 - protein, 17 aa, Mycobacterium
KIEALLRILEPFGIREI

SEQ ID NO: 885021 - protein, 25 aa, Mycobacterium
KIGYPPMRVWGVPAAGLWAHRLGDQ

SEQ ID NO: 885022 - protein, 19 aa, Mycobacterium
KIIVGSGLPYTIVRATQFQ

SEQ ID NO: 885023 - protein, 24 aa, Mycobacterium
KILAADILVLSSPIWLGHPASVTQ

SEQ ID NO: 885024 - protein, 20 aa, Mycobacterium
KILPEFTSYRRWCELMWHRA

SEQ ID NO: 885025 - protein, 20 aa, Mycobacterium
KIPFFTDGVPPFFLTPGLDV

SEQ ID NO: 885026 - protein, 17 aa, Mycobacterium
KIPTPAARWAFCNGMTP

SEQ ID NO: 885027 - protein, 18 aa, Mycobacterium
KIRRQLMHVLLDELRRNL

SEQ ID NO: 885028 - protein, 18 aa, Mycobacterium
KITPLWLPGPDPEPHYRP

SEQ ID NO: 885029 - protein, 20 aa, Mycobacterium
KIVRYHLLLPNTATRRDLAD

SEQ ID NO: 885030 - protein, 22 aa, Mycobacterium
KKALLLGGTLYRGGVQATPPGW

SEQ ID NO: 885031 - protein, 18 aa, Mycobacterium
KKAVLLVFFPLAFTGVCQ

SEQ ID NO: 885032 - protein, 23 aa, Mycobacterium
KKEGPLYALFLNCTLKKGPEVSN

SEQ ID NO: 885033 - protein, 22 aa, Mycobacterium
KKEGPLYALFLNCTLKSAPEVS

SEQ ID NO: 885034 - protein, 22 aa, Mycobacterium
KKKDPFYVWRYGLESYHSVFNY

SEQ ID NO: 885035 - protein, 23 aa, Mycobacterium
KKVAPLFGFEWRVDDPGGAVSQT

SEQ ID NO: 885036 - protein, 17 aa, Mycobacterium
KKWINWAIQFFYSSPAY

SEQ ID NO: 885037 - protein, 20 aa, Mycobacterium
KLAYFPLWSYATEPAIELAD

SEQ ID NO: 885038 - protein, 19 aa, Mycobacterium
KLEMPLIDFFSRGGSLKSS

SEQ ID NO: 885039 - protein, 24 aa, Mycobacterium
KLERLGLWGLMPRPVYDALIWCTF

SEQ ID NO: 885040 - protein, 24 aa, Mycobacterium
KLFGDNFFYILYFQEPGVADADLN

SEQ ID NO: 885041 - protein, 19 aa, Mycobacterium
KLFLLGRGEMQFFPVFRSR

SEQ ID NO: 885042 - protein, 18 aa, Mycobacterium
KLFNSVGIVFKGSGFYRT

SEQ ID NO: 885043 - protein, 18 aa, Mycobacterium
KLFSWTWWRSGRGRRLGG

SEQ ID NO: 885044 - protein, 20 aa, Mycobacterium
KLGEYLLFAQAVANAVVIDP

SEQ ID NO: 885045 - protein, 22 aa, Mycobacterium
KLHGNRLLAPNEYIITLGMHDF

SEQ ID NO: 885046 - protein, 27 aa, Mycobacterium
KLLGPVGDLLPILRIPGDTAFNVANVI

SEQ ID NO: 885047 - protein, 18 aa, Mycobacterium
KLLVNARWLPYVIAHGLL

SEQ ID NO: 885048 - protein, 18 aa, Mycobacterium
KLLVWDLMRRPRVTRMAE

SEQ ID NO: 885049 - protein, 18 aa, Mycobacterium
KLMSAFALGLRLPADYFV

SEQ ID NO: 885050 - protein, 20 aa, Mycobacterium
KLPFETLFEPAIHYAHNGFL

SEQ ID NO: 885051 - protein, 23 aa, Mycobacterium
KLPGMLHLAILRSPYAHATINSI

SEQ ID NO: 885052 - protein, 23 aa, Mycobacterium
KLPISLLRHAVAPHPTINQAWDP

SEQ ID NO: 885053 - protein, 17 aa, Mycobacterium
KLPPARPLPRRRACRRV

SEQ ID NO: 885054 - protein, 19 aa, Mycobacterium
KLREFLGTMLNLPTPEQAA

SEQ ID NO: 885055 - protein, 19 aa, Mycobacterium
KLRIVKYLAYGWSSLRSRP

SEQ ID NO: 885056 - protein, 17 aa, Mycobacterium
KLSVRVGIVPPGKNSAP

SEQ ID NO: 885057 - protein, 17 aa, Mycobacterium
KLTEIPVLWAYARDLYQ

SEQ ID NO: 885058 - protein, 20 aa, Mycobacterium
KLTSFALWGGGVLDLRYADF

SEQ ID NO: 885059 - protein, 22 aa, Mycobacterium
KLVFHRPILAGDKLWFDSYLDS

SEQ ID NO: 885060 - protein, 19 aa, Mycobacterium
KLWASWRLICARAPYLTDP

SEQ ID NO: 885061 - protein, 18 aa, Mycobacterium
KLWRGAMQLGIEMRVGPV

SEQ ID NO: 885062 - protein, 18 aa, Mycobacterium
KLWVDMAHFAGLVAAGLH

SEQ ID NO: 885063 - protein, 20 aa, Mycobacterium
KMALIRRYAGLRPAGISTVE

SEQ ID NO: 885064 - protein, 24 aa, Mycobacterium
KMFGENFFYILYFQEPGVADAELN

SEQ ID NO: 885065 - protein, 18 aa, Mycobacterium
KMMAYLPTAFAPAAFRWL

SEQ ID NO: 885066 - protein, 20 aa, Mycobacterium
KMNFLASPLLVVAYALAGTL

SEQ ID NO: 885067 - protein, 20 aa, Mycobacterium
KMQLESIFRELIFRAPGLRV

SEQ ID NO: 885068 - protein, 19 aa, Mycobacterium
KMRAGMLALLSYARAGDVV

SEQ ID NO: 885069 - protein, 21 aa, Mycobacterium
KNAIDWLSRPFGDGALKGKPL

SEQ ID NO: 885070 - protein, 27 aa, Mycobacterium
KNFIDDFVLYWSFLAFALVRGGRRTFG

SEQ ID NO: 885071 - protein, 19 aa, Mycobacterium
KNLLPLFAVFKPTVVVSVP

SEQ ID NO: 885072 - protein, 24 aa, Mycobacterium
KNNIEGQLLPAFKKAWSAGGGAYD

SEQ ID NO: 885073 - protein, 26 aa, Mycobacterium
KNPVLQLFIDVLIRLTARYALQSRTD

SEQ ID NO: 885074 - protein, 22 aa, Mycobacterium
KNPVLQLFIDVLMRLTTRYALA

SEQ ID NO: 885075 - protein, 22 aa, Mycobacterium
KNWKLLKWLDEPAPFIDWRNRE

SEQ ID NO: 885076 - protein, 17 aa, Mycobacterium
KPAARVGIWSPNTWHWV

SEQ ID NO: 885077 - protein, 17 aa, Mycobacterium
KPAFRNELWQQRFPGLD

SEQ ID NO: 885078 - protein, 21 aa, Mycobacterium
KPFFGSLLEFITSGPVVAAVV

SEQ ID NO: 885079 - protein, 18 aa, Mycobacterium
KPFSFRVLVARLRALVRR

SEQ ID NO: 885080 - protein, 29 aa, Mycobacterium
KPLDHWDFYMALGYFKIAIIAAGIAYRAR

SEQ ID NO: 885081 - protein, 21 aa, Mycobacterium
KPLEVVLFHHRPERYEFCVTL

SEQ ID NO: 885082 - protein, 20 aa, Mycobacterium
KPPLRVFFGERPLEIAKADY

SEQ ID NO: 885083 - protein, 18 aa, Mycobacterium
KPPRMLVLLHLDGSVDRP

SEQ ID NO: 885084 - protein, 20 aa, Mycobacterium
KPQFWPLWEAAADANLPVAV

SEQ ID NO: 885085 - protein, 23 aa, Mycobacterium
KQAILDALIRRLDEWRSLECIRA

SEQ ID NO: 885086 - protein, 17 aa, Mycobacterium
KQKVQFQRYTRNSPLRL

SEQ ID NO: 885087 - protein, 21 aa, Mycobacterium
KQLLLKIGWPAEDLAGYVDGE

SEQ ID NO: 885088 - protein, 21 aa, Mycobacterium
KQLLLKIGWPAEDLAGYVNGE

SEQ ID NO: 885089 - protein, 20 aa, Mycobacterium
KQMLLKIGWPAEDLAGYVDG

SEQ ID NO: 885090 - protein, 23 aa, Mycobacterium
KQQPLWRVLVALSIRHVGPTAAR

SEQ ID NO: 885091 - protein, 21 aa, Mycobacterium
KQRIAPLVPLLDGDRIYIFGS

SEQ ID NO: 885092 - protein, 17 aa, Mycobacterium
KRDAVVTPLLLASAYHA

SEQ ID NO: 885093 - protein, 18 aa, Mycobacterium
KRFWRTGAVSFWVLPPEI

SEQ ID NO: 885094 - protein, 20 aa, Mycobacterium
KRHEILQLELLKPKIAILDE

SEQ ID NO: 885095 - protein, 18 aa, Mycobacterium
KRHEILQLGLLKPKIAIL

SEQ ID NO: 885096 - protein, 21 aa, Mycobacterium
KRHEILQLGLLKPKIAILDET

SEQ ID NO: 885097 - protein, 18 aa, Mycobacterium
KRHEILQLGLLKPKIAVL

SEQ ID NO: 885098 - protein, 25 aa, Mycobacterium
KRIERGLWLTALLRATLTAVRRTAA

SEQ ID NO: 885099 - protein, 22 aa, Mycobacterium
KRITAILPFYPYARQDKKHRGR

SEQ ID NO: 885100 - protein, 19 aa, Mycobacterium
KRIVLKTVVLLSPRTRRLN

SEQ ID NO: 885101 - protein, 28 aa, Mycobacterium
KRLLGGAWELWWLKTPLPGVVWCNTPHM

SEQ ID NO: 885102 - protein, 27 aa, Mycobacterium
KRLMDLIHLWLIHRFKAEIVYYVTPTE

SEQ ID NO: 885103 - protein, 23 aa, Mycobacterium
KRNRPVLVFVLDAGMPGLTQGKP

SEQ ID NO: 885104 - protein, 24 aa, Mycobacterium
KRQQFLTDLSLLGGLLIASADTAG

SEQ ID NO: 885105 - protein, 18 aa, Mycobacterium
KRQYGYYVWPFLLDGQLV

SEQ ID NO: 885106 - protein, 23 aa, Mycobacterium
KRQYGYYVWPLLMDGRLVARVDL

SEQ ID NO: 885107 - protein, 21 aa, Mycobacterium
KRTGWAACWLLLGLNGHRLSS

SEQ ID NO: 885108 - protein, 22 aa, Mycobacterium
KRTSDLIPLCHQLALTGVDVDF

SEQ ID NO: 885109 - protein, 22 aa, Mycobacterium
KRTSELIPLCHQLALTGVDIEF

SEQ ID NO: 885110 - protein, 21 aa, Mycobacterium
KRYWYHAWWFYAHSIVRGGID

SEQ ID NO: 885111 - protein, 23 aa, Mycobacterium
KSAVYFIAAKLLRNAGLGPTVIV

SEQ ID NO: 885112 - protein, 23 aa, Mycobacterium
KSDLRGLFRWWGLYTQREQGYDG

SEQ ID NO: 885113 - protein, 22 aa, Mycobacterium
KSEPHWYPYVPRMSRLQKRLIR

SEQ ID NO: 885114 - protein, 20 aa, Mycobacterium
KSLTMFLVPLDSPGIEIQGI

SEQ ID NO: 885115 - protein, 17 aa, Mycobacterium
KSQLFHYFPGGKDQLML

SEQ ID NO: 885116 - protein, 25 aa, Mycobacterium
KSRFPHRWWWVVLTEEPFPRFSVVR

SEQ ID NO: 885117 - protein, 20 aa, Mycobacterium
KSSWTLKISLLGKSLIELLH

SEQ ID NO: 885118 - protein, 23 aa, Mycobacterium
KSVAAFRLALPRAMLRFAGGREI

SEQ ID NO: 885119 - protein, 18 aa, Mycobacterium
KSVGAFRLALPRVMLRFA

SEQ ID NO: 885120 - protein, 24 aa, Mycobacterium
KSVIYELLWFLRGDSNVRWLQEHG

SEQ ID NO: 885121 - protein, 21 aa, Mycobacterium
KSVVYELLWFLRGDSNVAWLH

SEQ ID NO: 885122 - protein, 22 aa, Mycobacterium
KSVVYELLWFLRGDSNVAWLHE

SEQ ID NO: 885123 - protein, 22 aa, Mycobacterium
KSVVYELLWFLRGDSNVGWLQQ

SEQ ID NO: 885124 - protein, 23 aa, Mycobacterium
KSYKEFWQQWIWEDWAGSYIERL

SEQ ID NO: 885125 - protein, 28 aa, Mycobacterium
KTDPLVLRPWTMPDPLLPIAVAPRAKTD

SEQ ID NO: 885126 - protein, 17 aa, Mycobacterium
KTFAFGVPLLQRITSDT

SEQ ID NO: 885127 - protein, 17 aa, Mycobacterium
KTFFLATRLLTPAQRPA

SEQ ID NO: 885128 - protein, 25 aa, Mycobacterium
KTFGENFFYILYFQEPGVADAELNS

SEQ ID NO: 885129 - protein, 25 aa, Mycobacterium
KTFGENFFYILYFQQPGVADAELNG

SEQ ID NO: 885130 - protein, 22 aa, Mycobacterium
KTFGPTTGLWILLLAKGGGDTT

SEQ ID NO: 885131 - protein, 19 aa, Mycobacterium
KTIYLATQMLLDDAPKALV

SEQ ID NO: 885132 - protein, 25 aa, Mycobacterium
KTKSIAWHWELMFTRPLTGYDIAAQ

SEQ ID NO: 885133 - protein, 19 aa, Mycobacterium
KTLAAFLWAIDTLVQEKEA

SEQ ID NO: 885134 - protein, 20 aa, Mycobacterium
KTLWGIPWTESESQAAGTGL

SEQ ID NO: 885135 - protein, 25 aa, Mycobacterium
KTPAIRFLLIELPDNRWHLVITAHH

SEQ ID NO: 885136 - protein, 23 aa, Mycobacterium
KTPTQVLLRWNLQLGNAVIFGSS

SEQ ID NO: 885137 - protein, 25 aa, Mycobacterium
KTQHRFFEMLQACVTLAAFGDSSGQ

SEQ ID NO: 885138 - protein, 19 aa, Mycobacterium
KTVALWRVLVALSIRHVGP

SEQ ID NO: 885139 - protein, 22 aa, Mycobacterium
KVAKWWIPERWSFVSEIPRTSV

SEQ ID NO: 885140 - protein, 24 aa, Mycobacterium
KVARFLFGLARRYGPNWLAGAQLA

SEQ ID NO: 885141 - protein, 24 aa, Mycobacterium
KVATWWIPERWAFVPEIPRTSVGK

SEQ ID NO: 885142 - protein, 22 aa, Mycobacterium
KVFNGIFWKHLLERGIPAGSPG

SEQ ID NO: 885143 - protein, 24 aa, Mycobacterium
KVGPDGLVVVLLPDGGRGYLSKVF

SEQ ID NO: 885144 - protein, 26 aa, Mycobacterium
KVHEAPAYRWPLVPALALVAAMPALG

SEQ ID NO: 885145 - protein, 21 aa, Mycobacterium
KVILKLFGPLLDAAATLGAGL

SEQ ID NO: 885146 - protein, 17 aa, Mycobacterium
KVKHRVFHYPGGLVDFV

SEQ ID NO: 885147 - protein, 22 aa, Mycobacterium
KVLRALTFLRGPRTWVLKSPQH

SEQ ID NO: 885148 - protein, 22 aa, Mycobacterium
KVNMTLLRFISFILKEIYPGGK

SEQ ID NO: 885149 - protein, 19 aa, Mycobacterium
KVPLPLLWGEYRPGELVRG

SEQ ID NO: 885150 - protein, 17 aa, Mycobacterium
KVPVRHFVLFSSISGLI

SEQ ID NO: 885151 - protein, 17 aa, Mycobacterium
KVRFLYFSPREYIVIFG

SEQ ID NO: 885152 - protein, 21 aa, Mycobacterium
KVTDFLMLCESFRLPVISLCD

SEQ ID NO: 885153 - protein, 22 aa, Mycobacterium
KVVPDFLWINGEYTARVSLNAL

SEQ ID NO: 885154 - protein, 21 aa, Mycobacterium
KWDKLFRFLALDRLQARLHRW

SEQ ID NO: 885155 - protein, 21 aa, Mycobacterium
KWDKLFRFLALDRLQSRLHRW

SEQ ID NO: 885156 - protein, 17 aa, Mycobacterium
KWELPVIGAVRPPRAVL

SEQ ID NO: 885157 - protein, 17 aa, Mycobacterium
KWERFITAVRLLAERLG

SEQ ID NO: 885158 - protein, 21 aa, Mycobacterium
KWIDEPYPDLAWRYNPDRPET

SEQ ID NO: 885159 - protein, 28 aa, Mycobacterium
KWKPFNLGNLLYNTLLMLLFEWGVGTQH

SEQ ID NO: 885160 - protein, 20 aa, Mycobacterium
KWNLMAWWSAKMLMAARNDI

SEQ ID NO: 885161 - protein, 17 aa, Mycobacterium
KWSAPLGFLAQTPPAVT

SEQ ID NO: 885162 - protein, 17 aa, Mycobacterium
KWSLLIIALLDDGSMRF

SEQ ID NO: 885163 - protein, 26 aa, Mycobacterium
KWTAALIGPWWPASATILRAAAQHWI

SEQ ID NO: 885164 - protein, 19 aa, Mycobacterium
KYCDQRSLTEALTEALTES

SEQ ID NO: 885165 - protein, 17 aa, Mycobacterium
KYEIVLSNTYDLWFTPW

SEQ ID NO: 885166 - protein, 20 aa, Mycobacterium
KYFAMTGWRLGWLLVPDELK

SEQ ID NO: 885167 - protein, 31 aa, Mycobacterium
KYGYSYKVLGIKFNYPFKYSFDIPAITIPSI

SEQ ID NO: 885168 - protein, 22 aa, Mycobacterium
KYLGLRADPLWLIAHLSRAGWL

SEQ ID NO: 885169 - protein, 18 aa, Mycobacterium
KYLGVQAGPLWLIAHLSR

SEQ ID NO: 885170 - protein, 17 aa, Mycobacterium
KYLWLTLDDSAALVVHL

SEQ ID NO: 885171 - protein, 22 aa, Mycobacterium
KYPNYLHSFAPMPYQPVGEGAE

SEQ ID NO: 885172 - protein, 19 aa, Mycobacterium
KYRVVWQDFASGAPLTAQM

SEQ ID NO: 885173 - protein, 21 aa, Mycobacterium
LAAALPMVTWLQTASTQAKTR

SEQ ID NO: 885174 - protein, 19 aa, Mycobacterium
LAAAPFADLLWMETKTADL

SEQ ID NO: 885175 - protein, 17 aa, Mycobacterium
LAAARWWRKPLVQRWYG

SEQ ID NO: 885176 - protein, 18 aa, Mycobacterium
LAADFLPPVWLPDDRTRS

SEQ ID NO: 885177 - protein, 25 aa, Mycobacterium
LAAGQPIPLLWMHKADDPRNYVGDV

SEQ ID NO: 885178 - protein, 18 aa, Mycobacterium
LAAHGWRLNSASIRDLFA

SEQ ID NO: 885179 - protein, 17 aa, Mycobacterium
LAAKPLLLILDVKKPRP

SEQ ID NO: 885180 - protein, 17 aa, Mycobacterium
LAALPHLLLLDAVGASE

SEQ ID NO: 885181 - protein, 24 aa, Mycobacterium
LAALRAIMPRLLSVGPWATLALAK

SEQ ID NO: 885182 - protein, 17 aa, Mycobacterium
LAALRRLPTLDAAVRED

SEQ ID NO: 885183 - protein, 19 aa, Mycobacterium
LAANLWPLGVFPNADSIAG

SEQ ID NO: 885184 - protein, 25 aa, Mycobacterium
LAAQWLIRVFLALWYWPMHDEEAEK

SEQ ID NO: 885185 - protein, 19 aa, Mycobacterium
LAAVPWLPVQLGGAVGTHA

SEQ ID NO: 885186 - protein, 20 aa, Mycobacterium
LAAVRLNAALLPAMYTRGAG

SEQ ID NO: 885187 - protein, 19 aa, Mycobacterium
LADAPALPRRIGRCALASQ

SEQ ID NO: 885188 - protein, 23 aa, Mycobacterium
LADGPVVLFFYPAANTPGCTAEA

SEQ ID NO: 885189 - protein, 22 aa, Mycobacterium
LADHAVLGVMLFPGTGFLELVI

SEQ ID NO: 885190 - protein, 18 aa, Mycobacterium
LADLLWRMGIRTLGQFAA

SEQ ID NO: 885191 - protein, 23 aa, Mycobacterium
LADPLAFLLRKEGFEATIVNDGP

SEQ ID NO: 885192 - protein, 22 aa, Mycobacterium
LADPLAFLLRKEGFEATVVGDG

SEQ ID NO: 885193 - protein, 17 aa, Mycobacterium
LADRLPAYMVPAAVVVL

SEQ ID NO: 885194 - protein, 27 aa, Mycobacterium
LADRYPKWWQAPLRWAFRTALGARASL

SEQ ID NO: 885195 - protein, 17 aa, Mycobacterium
LADVRLLAPILASKVVC

SEQ ID NO: 885196 - protein, 23 aa, Mycobacterium
LAEFAALRWQWHDLEVGRTAIVP

SEQ ID NO: 885197 - protein, 21 aa, Mycobacterium
LAEGLLFERRIFHSAFGTADQ

SEQ ID NO: 885198 - protein, 17 aa, Mycobacterium
LAEGLLIYLPPDAQDRL

SEQ ID NO: 885199 - protein, 20 aa, Mycobacterium
LAEGLLYERRLFHSTFATED

SEQ ID NO: 885200 - protein, 19 aa, Mycobacterium
LAEGVLIGWLPPEAELRLL

SEQ ID NO: 885201 - protein, 24 aa, Mycobacterium
LAEHDLLACWLLESAGLPVDDARR

SEQ ID NO: 885202 - protein, 23 aa, Mycobacterium
LAEHDVLACWLLEAGGLAADRAP

SEQ ID NO: 885203 - protein, 19 aa, Mycobacterium
LAEKDIWWCLQPFLDDEDA

SEQ ID NO: 885204 - protein, 21 aa, Mycobacterium
LAELLLLWRHGTPDHREVVYL

SEQ ID NO: 885205 - protein, 21 aa, Mycobacterium
LAELLTIRRYAHLWADPRMVI

SEQ ID NO: 885206 - protein, 23 aa, Mycobacterium
LAELSQLRLLPFRLVLDGTREID

SEQ ID NO: 885207 - protein, 24 aa, Mycobacterium
LAELSQLRLLPFRLVLDGTTEIDA

SEQ ID NO: 885208 - protein, 17 aa, Mycobacterium
LAERALIPVLPSIEEFP

SEQ ID NO: 885209 - protein, 18 aa, Mycobacterium
LAEWFLRRFSLLDSLYMI

SEQ ID NO: 885210 - protein, 17 aa, Mycobacterium
LAEWFLRRTSLLDSLYL

SEQ ID NO: 885211 - protein, 24 aa, Mycobacterium
LAFDLIHRLWLDLGHDVQYVQNVT

SEQ ID NO: 885212 - protein, 23 aa, Mycobacterium
LAFDLIHRLWLDLGHEVRYVQNV

SEQ ID NO: 885213 - protein, 20 aa, Mycobacterium
LAFGLPRYPRALLDSIRYAR

SEQ ID NO: 885214 - protein, 19 aa, Mycobacterium
LAFLDIRPITRGHTLVIPK

SEQ ID NO: 885215 - protein, 17 aa, Mycobacterium
LAFPFLREKIHGRSDPK

SEQ ID NO: 885216 - protein, 21 aa, Mycobacterium
LAGFLLGPTLFNIGFANDGVG

SEQ ID NO: 885217 - protein, 19 aa, Mycobacterium
LAGGFFWLYNVISFPQYSI

SEQ ID NO: 885218 - protein, 25 aa, Mycobacterium
LAGILPSFPALLKKQLKGAPMPAPR

SEQ ID NO: 885219 - protein, 19 aa, Mycobacterium
LAGILPSFPALLRKQLKGA

SEQ ID NO: 885220 - protein, 23 aa, Mycobacterium
LAGIPWFLIEALLEQGADDLTIV

SEQ ID NO: 885221 - protein, 17 aa, Mycobacterium
LAGLARYPLPMAPAAAA

SEQ ID NO: 885222 - protein, 17 aa, Mycobacterium
LAGLLRTPLFTLERVRV

SEQ ID NO: 885223 - protein, 23 aa, Mycobacterium
LAGTVLRFVPPLAALSAAPITFD

SEQ ID NO: 885224 - protein, 18 aa, Mycobacterium
LAGWQTWLAAADRDTWGL

SEQ ID NO: 885225 - protein, 21 aa, Mycobacterium
LAHQALPQINFGIGNLGNLNI

SEQ ID NO: 885226 - protein, 21 aa, Mycobacterium
LAHVPGLYRLLRIPPEAVDYF

SEQ ID NO: 885227 - protein, 27 aa, Mycobacterium
LAHWDFYMALAYFKLAIIAAGIDYRRR

SEQ ID NO: 885228 - protein, 20 aa, Mycobacterium
LAILGFWLTTQAPPAMRLCH

SEQ ID NO: 885229 - protein, 20 aa, Mycobacterium
LAILGYWLTSQAPPAMRLCH

SEQ ID NO: 885230 - protein, 18 aa, Mycobacterium
LAIPPAWNEVWISPHING

SEQ ID NO: 885231 - protein, 20 aa, Mycobacterium
LAIYRRNVAIQPLFSGAAMG

SEQ ID NO: 885232 - protein, 24 aa, Mycobacterium
LAKGERILVFLPLAHVLARAITIG

SEQ ID NO: 885233 - protein, 17 aa, Mycobacterium
LAKRWARWRLSTGLGLE

SEQ ID NO: 885234 - protein, 17 aa, Mycobacterium
LALAFEYDLFFPPALCA

SEQ ID NO: 885235 - protein, 18 aa, Mycobacterium
LALALQLLDRGYFRAGGE

SEQ ID NO: 885236 - protein, 18 aa, Mycobacterium
LALDWYLFETGVRSQRLA

SEQ ID NO: 885237 - protein, 20 aa, Mycobacterium
LALGIFLRRAGFDDFTIFDR

SEQ ID NO: 885238 - protein, 19 aa, Mycobacterium
LALGPLMSGMFGDFAAADA

SEQ ID NO: 885239 - protein, 17 aa, Mycobacterium
LALHRYLGLTPSRLLAL

SEQ ID NO: 885240 - protein, 23 aa, Mycobacterium
LALKLINNLLFAANAQLLCAATH

SEQ ID NO: 885241 - protein, 18 aa, Mycobacterium
LALPLALYRAVTAFGRVA

SEQ ID NO: 885242 - protein, 19 aa, Mycobacterium
LALPLALYRAVTAFGRVAV

SEQ ID NO: 885243 - protein, 17 aa, Mycobacterium
LALPYPGVLPEGPPPSK

SEQ ID NO: 885244 - protein, 19 aa, Mycobacterium
LALSLLLLSPAALNTLPGL

SEQ ID NO: 885245 - protein, 20 aa, Mycobacterium
LALTALWRHYGVTPDLVIGH

SEQ ID NO: 885246 - protein, 19 aa, Mycobacterium
LALTALWRSYGVTPDAVIG

SEQ ID NO: 885247 - protein, 18 aa, Mycobacterium
LALWSRRLLGEAITQAQL

SEQ ID NO: 885248 - protein, 18 aa, Mycobacterium
LAMGVWRWGLGEIRYEQL

SEQ ID NO: 885249 - protein, 17 aa, Mycobacterium
LAMRRPMLRWTGGGLAA

SEQ ID NO: 885250 - protein, 17 aa, Mycobacterium
LANQLMAFHDQFAQALT

SEQ ID NO: 885251 - protein, 24 aa, Mycobacterium
LANYFAGALLLPYLRFLEAAEDVR

SEQ ID NO: 885252 - protein, 26 aa, Mycobacterium
LANYFAGALLLPYRPFLDAAASTRYD

SEQ ID NO: 885253 - protein, 18 aa, Mycobacterium
LANYYAGALLLPYRMFLA

SEQ ID NO: 885254 - protein, 19 aa, Mycobacterium
LAPGFLPRLILSASTAATG

SEQ ID NO: 885255 - protein, 28 aa, Mycobacterium
LAPHLVKPLPFLFPLTKRGWERPYIAAG

SEQ ID NO: 885256 - protein, 27 aa, Mycobacterium
LAPHLVKPLPFLFPLTSRWWERPYVAA

SEQ ID NO: 885257 - protein, 28 aa, Mycobacterium
LAPHLVKPMPFLFPLTNRVWERPYVAAG

SEQ ID NO: 885258 - protein, 18 aa, Mycobacterium
LAPLHLTQLAIPAMRERR

SEQ ID NO: 885259 - protein, 18 aa, Mycobacterium
LAPLTFISVFGYQAQWAM

SEQ ID NO: 885260 - protein, 23 aa, Mycobacterium
LAPLTTLRIGPVARRMLTCTSTE

SEQ ID NO: 885261 - protein, 17 aa, Mycobacterium
LAPSLFRLRIPGGRAHL

SEQ ID NO: 885262 - protein, 23 aa, Mycobacterium
LAPVLPLIRRLLIDDAADSGVIV

SEQ ID NO: 885263 - protein, 17 aa, Mycobacterium
LAPVPWIDHVCTARLLG

SEQ ID NO: 885264 - protein, 23 aa, Mycobacterium
LAPVRFFNPLSMRFAKKATIDDI

SEQ ID NO: 885265 - protein, 18 aa, Mycobacterium
LAQAPAEPMLIWAKPRRC

SEQ ID NO: 885266 - protein, 17 aa, Mycobacterium
LAQLQWRPAGLGPEAMV

SEQ ID NO: 885267 - protein, 17 aa, Mycobacterium
LAQLQWRPELLAPEVML

SEQ ID NO: 885268 - protein, 19 aa, Mycobacterium
LARCSLASWLALQGALFEL

SEQ ID NO: 885269 - protein, 18 aa, Mycobacterium
LARDFLLTWFVHAAYEVD

SEQ ID NO: 885270 - protein, 22 aa, Mycobacterium
LARDFLLTWFVTLAWEVAEAKR

SEQ ID NO: 885271 - protein, 25 aa, Mycobacterium
LARFPGFYIPFLDVPFTGATPPNSP

SEQ ID NO: 885272 - protein, 24 aa, Mycobacterium
LARFPGFYIPFLDVSFNGATPAAN

SEQ ID NO: 885273 - protein, 17 aa, Mycobacterium
LARGWRIFFAHRTFAWS

SEQ ID NO: 885274 - protein, 18 aa, Mycobacterium
LARILFSLFTTPSPIRNL

SEQ ID NO: 885275 - protein, 21 aa, Mycobacterium
LARLHTPLPLLAFTAWPEVRS

SEQ ID NO: 885276 - protein, 32 aa, Mycobacterium
LARLLGLPYFPITPLFPWAGPAGLIPLPSKWH

SEQ ID NO: 885277 - protein, 23 aa, Mycobacterium
LARLLGLPYFPVTPLFPAAGPLG

SEQ ID NO: 885278 - protein, 25 aa, Mycobacterium
LARLNAIYLLWRLKESPHWPAIRDA

SEQ ID NO: 885279 - protein, 18 aa, Mycobacterium
LARNVFHWVFAFADGGLA

SEQ ID NO: 885280 - protein, 24 aa, Mycobacterium
LARPVPFIYPLQTRFDRAYAGLGI

SEQ ID NO: 885281 - protein, 22 aa, Mycobacterium
LARQLWTMQLPFGIGLPALVAV

SEQ ID NO: 885282 - protein, 17 aa, Mycobacterium
LARRLAPGGLLVAGFQL

SEQ ID NO: 885283 - protein, 20 aa, Mycobacterium
LARRMLFPSLYRLAAAGRLP

SEQ ID NO: 885284 - protein, 22 aa, Mycobacterium
LARRPYWIHPALTEVVENALLA

SEQ ID NO: 885285 - protein, 19 aa, Mycobacterium
LARRYLRDDLPFALALVIR

SEQ ID NO: 885286 - protein, 23 aa, Mycobacterium
LARSWRWLPPWPDSVDGIAVMKR

SEQ ID NO: 885287 - protein, 19 aa, Mycobacterium
LARWGFTLQGGYAAAAARA

SEQ ID NO: 885288 - protein, 18 aa, Mycobacterium
LASALPWLKQLHGKIVVV

SEQ ID NO: 885289 - protein, 26 aa, Mycobacterium
LASDQAFFLLAFTKIGLMPDGGASAL

SEQ ID NO: 885290 - protein, 26 aa, Mycobacterium
LASEEAFFMLAFTKIGLMPDGGASAL

SEQ ID NO: 885291 - protein, 18 aa, Mycobacterium
LASFKIWRTATVGGNICL

SEQ ID NO: 885292 - protein, 20 aa, Mycobacterium
LASLLVAPYFRSAIESAVDS

SEQ ID NO: 885293 - protein, 20 aa, Mycobacterium
LASLPLPAPGLGSGGYSLTA

SEQ ID NO: 885294 - protein, 24 aa, Mycobacterium
LASWNAWHWRWNPWLMAAGGYAVL

SEQ ID NO: 885295 - protein, 17 aa, Mycobacterium
LATALPQLLPMLRGFNL

SEQ ID NO: 885296 - protein, 19 aa, Mycobacterium
LATGKLPRFASAALALSVV

SEQ ID NO: 885297 - protein, 19 aa, Mycobacterium
LATGRPPRWIQPVVDGLGL

SEQ ID NO: 885298 - protein, 26 aa, Mycobacterium
LATGRPPRWITPIVDALGFAPISVCA

SEQ ID NO: 885299 - protein, 22 aa, Mycobacterium
LATINRLPVLLLPADTFATRVS

SEQ ID NO: 885300 - protein, 19 aa, Mycobacterium
LATPIIHWLQGVPGPVDQF

SEQ ID NO: 885301 - protein, 18 aa, Mycobacterium
LATQMLLDDAPKALVTLE

SEQ ID NO: 885302 - protein, 23 aa, Mycobacterium
LATQRTRLPLPYAQARLLSTIED

SEQ ID NO: 885303 - protein, 18 aa, Mycobacterium
LATYAFLPVVRKFAEAAG

SEQ ID NO: 885304 - protein, 24 aa, Mycobacterium
LATYSFLPIIRAFAGPAGIDVQTS

SEQ ID NO: 885305 - protein, 23 aa, Mycobacterium
LAVELSSFQLHWAPSLRPEAGVV

SEQ ID NO: 885306 - protein, 18 aa, Mycobacterium
LAVELSSFQLHWAPSVRP

SEQ ID NO: 885307 - protein, 24 aa, Mycobacterium
LAVGHWLRRWWPASQRDDIAGLDR

SEQ ID NO: 885308 - protein, 17 aa, Mycobacterium
LAVIFEWGIALHGIHSE

SEQ ID NO: 885309 - protein, 17 aa, Mycobacterium
LAVLPGMVARRAGGILI

SEQ ID NO: 885310 - protein, 19 aa, Mycobacterium
LAVLPKLTPILLPDTARTN

SEQ ID NO: 885311 - protein, 21 aa, Mycobacterium
LAVMPLFHMAGFGWALAGLWE

SEQ ID NO: 885312 - protein, 30 aa, Mycobacterium
LAVRTYRDVLLWNRDPNSSAWSPFSRQPVM

SEQ ID NO: 885313 - protein, 23 aa, Mycobacterium
LAVSDPALPLGWADVWMGCQFPS

SEQ ID NO: 885314 - protein, 18 aa, Mycobacterium
LAVYRPLLEPLGLTHPQY

SEQ ID NO: 885315 - protein, 19 aa, Mycobacterium
LAWTVYSLPGAPAVDHYEL

SEQ ID NO: 885316 - protein, 20 aa, Mycobacterium
LAYALVRWKNALLGITFFNL

SEQ ID NO: 885317 - protein, 18 aa, Mycobacterium
LAYARRVMGLPATTVNWG

SEQ ID NO: 885318 - protein, 21 aa, Mycobacterium
LAYGLIYWYFDSKDVLFHSLM

SEQ ID NO: 885319 - protein, 17 aa, Mycobacterium
LAYLGLRLGYRSIAEAV

SEQ ID NO: 885320 - protein, 18 aa, Mycobacterium
LAYLRACNRLWALADPDG

SEQ ID NO: 885321 - protein, 21 aa, Mycobacterium
LAYNMHYIMLGIAGNLMSEEQ

SEQ ID NO: 885322 - protein, 22 aa, Mycobacterium
LCALSWTVYSLPGAPVLDHHEL

SEQ ID NO: 885323 - protein, 17 aa, Mycobacterium
LCFGFHPYLHIPDVARG

SEQ ID NO: 885324 - protein, 17 aa, Mycobacterium
LCFGFHPYLQLPGVPRT

SEQ ID NO: 885325 - protein, 22 aa, Mycobacterium
LCGRLIGMPLERSKPLWEMWVI

SEQ ID NO: 885326 - protein, 17 aa, Mycobacterium
LCNLWKLPKGMVLHPDA

SEQ ID NO: 885327 - protein, 22 aa, Mycobacterium
LCPFDPLIFFRPRVERLFGGFH

SEQ ID NO: 885328 - protein, 21 aa, Mycobacterium
LCPFDPLIFFRPRVQRLFDFH

SEQ ID NO: 885329 - protein, 19 aa, Mycobacterium
LCREKYCDQRSLTEALTEA

SEQ ID NO: 885330 - protein, 18 aa, Mycobacterium
LCRIILQGLATRSPTDAA

SEQ ID NO: 885331 - protein, 19 aa, Mycobacterium
LCRKHHLLKTFWTGWRDEQ

SEQ ID NO: 885332 - protein, 17 aa, Mycobacterium
LCRLSLGYAQLWQGDLT

SEQ ID NO: 885333 - protein, 23 aa, Mycobacterium
LCRRWYPRIYFGQPTKGLAHRAL

SEQ ID NO: 885334 - protein, 19 aa, Mycobacterium
LCRRWYPRIYFGQPVKGLA

SEQ ID NO: 885335 - protein, 19 aa, Mycobacterium
LCRTLPWPAYLTEAFQNLG

SEQ ID NO: 885336 - protein, 18 aa, Mycobacterium
LCVAVFLGLGRSLTVLGV

SEQ ID NO: 885337 - protein, 25 aa, Mycobacterium
LDAAALLHRLSLKVPARHFVLFSSI

SEQ ID NO: 885338 - protein, 19 aa, Mycobacterium
LDAFVQWRRVRGLPATAIA

SEQ ID NO: 885339 - protein, 18 aa, Mycobacterium
LDAKVLWQLKRALPGPFT

SEQ ID NO: 885340 - protein, 19 aa, Mycobacterium
LDALWPMLTPETLLSELYT

SEQ ID NO: 885341 - protein, 17 aa, Mycobacterium
LDAMRWLADSVPIFGVN

SEQ ID NO: 885342 - protein, 20 aa, Mycobacterium
LDARAYRLPWPADTVVYELD

SEQ ID NO: 885343 - protein, 19 aa, Mycobacterium
LDARLIPRLGLRPDIRRVP

SEQ ID NO: 885344 - protein, 18 aa, Mycobacterium
LDAYLKQSRRYPGGVLAI

SEQ ID NO: 885345 - protein, 26 aa, Mycobacterium
LDDEAIIAFLRLLLPAGLETTYRSSG

SEQ ID NO: 885346 - protein, 24 aa, Mycobacterium
LDDVVLDYLFLDASFFRMHPGSPA

SEQ ID NO: 885347 - protein, 26 aa, Mycobacterium
LDEGQRLLIFLPLAHVLARSLTLSAF

SEQ ID NO: 885348 - protein, 24 aa, Mycobacterium
LDEISAWRFIVPPAAFLGSLLVDT

SEQ ID NO: 885349 - protein, 19 aa, Mycobacterium
LDGFLYLDCLIGRYARSAK

SEQ ID NO: 885350 - protein, 23 aa, Mycobacterium
LDGLSLPLLRSWLSAGAAAGAAR

SEQ ID NO: 885351 - protein, 19 aa, Mycobacterium
LDGVFRSAISVAALVVRCR

SEQ ID NO: 885352 - protein, 21 aa, Mycobacterium
LDGYLYLDCLIGRHARSAKRA

SEQ ID NO: 885353 - protein, 19 aa, Mycobacterium
LDHAMWFMRAFRADEWLLY

SEQ ID NO: 885354 - protein, 20 aa, Mycobacterium
LDHAMWFMRAFRADEWLLYD

SEQ ID NO: 885355 - protein, 21 aa, Mycobacterium
LDHAMWFMRPFRADEWLLYDQ

SEQ ID NO: 885356 - protein, 24 aa, Mycobacterium
LDHAMWFMRPFRADEWLLYDQSSP

SEQ ID NO: 885357 - protein, 17 aa, Mycobacterium
LDHFLLQADLTVVVPGP

SEQ ID NO: 885358 - protein, 18 aa, Mycobacterium
LDHLLTWGVLAAPLTLVP

SEQ ID NO: 885359 - protein, 18 aa, Mycobacterium
LDIARWRRRRRDELAALG

SEQ ID NO: 885360 - protein, 20 aa, Mycobacterium
LDIDLYLRIAPELFLKRCVV

SEQ ID NO: 885361 - protein, 17 aa, Mycobacterium
LDKVVLARALRLTAEAP

SEQ ID NO: 885362 - protein, 26 aa, Mycobacterium
LDKYARLFAWLGLWERHTDLAVIPAD

SEQ ID NO: 885363 - protein, 21 aa, Mycobacterium
LDLAIIYLPPPYDPAVLEPLA

SEQ ID NO: 885364 - protein, 22 aa, Mycobacterium
LDLAIVYLPPPYDPAVLEPLAE

SEQ ID NO: 885365 - protein, 24 aa, Mycobacterium
LDLDALIGGFRPLFRALDPDQINA

SEQ ID NO: 885366 - protein, 18 aa, Mycobacterium
LDLFRSPAAAQSFVIDPD

SEQ ID NO: 885367 - protein, 18 aa, Mycobacterium
LDLFRSPASAAAFIADPD

SEQ ID NO: 885368 - protein, 18 aa, Mycobacterium
LDLFTWLPTTHPASFFAT

SEQ ID NO: 885369 - protein, 19 aa, Mycobacterium
LDLGWLLVCWPDGPNPIDA

SEQ ID NO: 885370 - protein, 20 aa, Mycobacterium
LDLLLDGHTLLWRTLGRLGR

SEQ ID NO: 885371 - protein, 27 aa, Mycobacterium
LDLLLQRRKLLWWTLSRFTTLSNLPFR

SEQ ID NO: 885372 - protein, 19 aa, Mycobacterium
LDLRWWPLDALPDGTDFGL

SEQ ID NO: 885373 - protein, 18 aa, Mycobacterium
LDLRWWPLDKLPEGVDFG

SEQ ID NO: 885374 - protein, 18 aa, Mycobacterium
LDLSFGDLQFGNRDTTAI

SEQ ID NO: 885375 - protein, 28 aa, Mycobacterium
LDLVDRVLFWMLPLDDPLPWLVADRRAV

SEQ ID NO: 885376 - protein, 21 aa, Mycobacterium
LDLYPFVLPGPVLEKMRLIHE

SEQ ID NO: 885377 - protein, 17 aa, Mycobacterium
LDMPLIDFFSRGGSLKS

SEQ ID NO: 885378 - protein, 18 aa, Mycobacterium
LDMPLVDFFSHGGSLKSS

SEQ ID NO: 885379 - protein, 17 aa, Mycobacterium
LDMRRYHLLLAGASWVA

SEQ ID NO: 885380 - protein, 24 aa, Mycobacterium
LDPDPMFVPKLLGPLLIAEGVHLV

SEQ ID NO: 885381 - protein, 23 aa, Mycobacterium
LDPTMLVPLLRLLAAGEPVTVEA

SEQ ID NO: 885382 - protein, 21 aa, Mycobacterium
LDRALIDLATYFRDALMVSAG

SEQ ID NO: 885383 - protein, 25 aa, Mycobacterium
LDRDAIRWWLVLATLRWGVICLYQA

SEQ ID NO: 885384 - protein, 17 aa, Mycobacterium
LDRGFFFARAEPMRSYC

SEQ ID NO: 885385 - protein, 17 aa, Mycobacterium
LDRLFPRSVFHSLRQAE

SEQ ID NO: 885386 - protein, 19 aa, Mycobacterium
LDRNLIGHIPLIGGGLSLL

SEQ ID NO: 885387 - protein, 18 aa, Mycobacterium
LDRRLLLGMLAQLPPGAG

SEQ ID NO: 885388 - protein, 18 aa, Mycobacterium
LDRRLLLGMLSGLPPGAG

SEQ ID NO: 885389 - protein, 24 aa, Mycobacterium
LDRSKPLWELWFIEGLEGGRVAVV

SEQ ID NO: 885390 - protein, 24 aa, Mycobacterium
LDRSTFRWWLTVATLRWGVICRHQ

SEQ ID NO: 885391 - protein, 18 aa, Mycobacterium
LDRSVLHVLLDRPRKRNA

SEQ ID NO: 885392 - protein, 18 aa, Mycobacterium
LDRTLHLPALRPGEVNRA

SEQ ID NO: 885393 - protein, 18 aa, Mycobacterium
LDSLLFDDPGLVAEAPLP

SEQ ID NO: 885394 - protein, 17 aa, Mycobacterium
LDSPPFYDPWFAKARTT

SEQ ID NO: 885395 - protein, 24 aa, Mycobacterium
LDSPQPLWALWRFGIDPSATRLTM

SEQ ID NO: 885396 - protein, 20 aa, Mycobacterium
LDSRLLARLPLLHPDGLREH

SEQ ID NO: 885397 - protein, 19 aa, Mycobacterium
LDSWPMNIVLLGKGNTVSA

SEQ ID NO: 885398 - protein, 19 aa, Mycobacterium
LDTLLRLLHPVIPFITEAL

SEQ ID NO: 885399 - protein, 18 aa, Mycobacterium
LDTVGMLFSPGYPGFLRG

SEQ ID NO: 885400 - protein, 29 aa, Mycobacterium
LDVDLVFSPFFNALPIRRLGIHEKAESLA

SEQ ID NO: 885401 - protein, 24 aa, Mycobacterium
LDVDWYDWLIERVRLWPDVKRRND

SEQ ID NO: 885402 - protein, 25 aa, Mycobacterium
LDVGVTSIYWYFRKKGELLDAMTDR

SEQ ID NO: 885403 - protein, 29 aa, Mycobacterium
LDVINAPTQALLDRPLIGNGANGAAGTGA

SEQ ID NO: 885404 - protein, 26 aa, Mycobacterium
LDVINAPTQLLLNRPLIGNGTDGTAA

SEQ ID NO: 885405 - protein, 18 aa, Mycobacterium
LDVLLQWFLADVRPKFPN

SEQ ID NO: 885406 - protein, 18 aa, Mycobacterium
LDVWRRPDLAPGGRAPVL

SEQ ID NO: 885407 - protein, 18 aa, Mycobacterium
LDWYIAMACFKLAIVIEG

SEQ ID NO: 885408 - protein, 18 aa, Mycobacterium
LDYLSWLLGSTGNNTNPA

SEQ ID NO: 885409 - protein, 19 aa, Mycobacterium
LDYVIGFFAAIKAGTIAVP

SEQ ID NO: 885410 - protein, 17 aa, Mycobacterium
LDYYLVLAKWKLAIVLE

SEQ ID NO: 885411 - protein, 18 aa, Mycobacterium
LEAFVPLRTHVLVRFGRW

SEQ ID NO: 885412 - protein, 26 aa, Mycobacterium
LEAGLRLISLLRPLWLRGGRTLEGIA

SEQ ID NO: 885413 - protein, 23 aa, Mycobacterium
LEFEALVALLRFPARFFTTAPVS

SEQ ID NO: 885414 - protein, 20 aa, Mycobacterium
LEFHTRLAQALSAGAGAYSG

SEQ ID NO: 885415 - protein, 19 aa, Mycobacterium
LEFIQFHPTMLFDGSSGGR

SEQ ID NO: 885416 - protein, 22 aa, Mycobacterium
LEFLDHIIAHPSLRWVGNANEL

SEQ ID NO: 885417 - protein, 17 aa, Mycobacterium
LEFLDHIVAHPAIRWVG

SEQ ID NO: 885418 - protein, 19 aa, Mycobacterium
LEFPPYVQSVLPPAPPPMP

SEQ ID NO: 885419 - protein, 20 aa, Mycobacterium
LEGGRQLVFCDLGMPRDVDP

SEQ ID NO: 885420 - protein, 17 aa, Mycobacterium
LEGIRILDLTRALSGPF

SEQ ID NO: 885421 - protein, 18 aa, Mycobacterium
LEHLSFFVLDGWLRQVPV

SEQ ID NO: 885422 - protein, 19 aa, Mycobacterium
LEHWRWMWETNVMGTLRVT

SEQ ID NO: 885423 - protein, 26 aa, Mycobacterium
LEHYYMITYPGLPLLEPLRALPVIGD

SEQ ID NO: 885424 - protein, 17 aa, Mycobacterium
LEIIPWADFIGRWTAEE

SEQ ID NO: 885425 - protein, 19 aa, Mycobacterium
LEIRDLLFARLLQYRAFKH

SEQ ID NO: 885426 - protein, 18 aa, Mycobacterium
LELAPFHKILYSSDGFGP

SEQ ID NO: 885427 - protein, 24 aa, Mycobacterium
LELARRLAREWLGYEFDPTSKSAE

SEQ ID NO: 885428 - protein, 22 aa, Mycobacterium
LELAWPALPPDTFSTAAVLPPL

SEQ ID NO: 885429 - protein, 20 aa, Mycobacterium
LELLNCLLLLFMAGLDTVSN

SEQ ID NO: 885430 - protein, 17 aa, Mycobacterium
LELLVIVSFVRGLSVRD

SEQ ID NO: 885431 - protein, 20 aa, Mycobacterium
LELMVDLKAPLPGFLVKKGA

SEQ ID NO: 885432 - protein, 24 aa, Mycobacterium
LEMPPLPVWFAGRDTVLKFLAERA

SEQ ID NO: 885433 - protein, 18 aa, Mycobacterium
LENLFFKEKRYDLARVGR

SEQ ID NO: 885434 - protein, 25 aa, Mycobacterium
LENYYMITYPGLPILEPLRAIPVIG

SEQ ID NO: 885435 - protein, 18 aa, Mycobacterium
LEPGLTLALEPWFGRGTD

SEQ ID NO: 885436 - protein, 20 aa, Mycobacterium
LEPNMRWRTFCAELLAIIEK

SEQ ID NO: 885437 - protein, 17 aa, Mycobacterium
LEPWFARTTDRIRFDRD

SEQ ID NO: 885438 - protein, 25 aa, Mycobacterium
LEQKKFRINLFDLPMTLLPGMLTSP

SEQ ID NO: 885439 - protein, 17 aa, Mycobacterium
LERAATLARDWFLEHLV

SEQ ID NO: 885440 - protein, 17 aa, Mycobacterium
LERGLLPSPLLMEGSGV

SEQ ID NO: 885441 - protein, 21 aa, Mycobacterium
LERIYWAFCTHLGYLVSNNSF

SEQ ID NO: 885442 - protein, 19 aa, Mycobacterium
LERLGVGLWLPAATMARLA

SEQ ID NO: 885443 - protein, 19 aa, Mycobacterium
LERLLPVKCFYLPTAVRGF

SEQ ID NO: 885444 - protein, 19 aa, Mycobacterium
LERQLQLLDKLIGAATKDL

SEQ ID NO: 885445 - protein, 19 aa, Mycobacterium
LERRYLLVPGLRSSATYVL

SEQ ID NO: 885446 - protein, 20 aa, Mycobacterium
LESAIRLALLDALSAAAEEI

SEQ ID NO: 885447 - protein, 19 aa, Mycobacterium
LETDQVFGWIAFEFGVYRY

SEQ ID NO: 885448 - protein, 21 aa, Mycobacterium
LETFAVLPWDTSFARVFCRLY

SEQ ID NO: 885449 - protein, 25 aa, Mycobacterium
LEVAAAKWWRKPLVRRWYGFAEMQK

SEQ ID NO: 885450 - protein, 18 aa, Mycobacterium
LEVARYLLPKLRAVNFVI

SEQ ID NO: 885451 - protein, 22 aa, Mycobacterium
LEVGLWALLEHWGIRPDFVLGH

SEQ ID NO: 885452 - protein, 18 aa, Mycobacterium
LEVVIAYRLLFGIYSGIV

SEQ ID NO: 885453 - protein, 29 aa, Mycobacterium
LEWAIDRDGLLWWLQARPITTLPGDPNEM

SEQ ID NO: 885454 - protein, 23 aa, Mycobacterium
LEWFATIPLWLDLGELRVVHACW

SEQ ID NO: 885455 - protein, 18 aa, Mycobacterium
LEWFLDNVPITPIWLCPL

SEQ ID NO: 885456 - protein, 19 aa, Mycobacterium
LEYIIAFYGAMAAGFIAVP

SEQ ID NO: 885457 - protein, 19 aa, Mycobacterium
LEYTLRWRNVPKPSIAAVQ

SEQ ID NO: 885458 - protein, 19 aa, Mycobacterium
LEYVIAFLGALQAGFIAVP

SEQ ID NO: 885459 - protein, 17 aa, Mycobacterium
LFAWRILDYWNWTNRPD

SEQ ID NO: 885460 - protein, 17 aa, Mycobacterium
LFCLRPLPSLKPLERDA

SEQ ID NO: 885461 - protein, 19 aa, Mycobacterium
LFDPLRAALADYLGLDFLA

SEQ ID NO: 885462 - protein, 20 aa, Mycobacterium
LFDTLFLYENYPIDAGALLG

SEQ ID NO: 885463 - protein, 19 aa, Mycobacterium
LFELPRLAPVYPSAAGLVA

SEQ ID NO: 885464 - protein, 20 aa, Mycobacterium
LFESLLPRYLTTRVYEALLE

SEQ ID NO: 885465 - protein, 19 aa, Mycobacterium
LFETALPPRLYVRPSAVRT

SEQ ID NO: 885466 - protein, 19 aa, Mycobacterium
LFFADVFGLRSPWNGNWRK

SEQ ID NO: 885467 - protein, 17 aa, Mycobacterium
LFFVIPPERIHTLVFGF

SEQ ID NO: 885468 - protein, 17 aa, Mycobacterium
LFGHWWYEGPTWLARVL

SEQ ID NO: 885469 - protein, 18 aa, Mycobacterium
LFGPLLNLGLRRFLRKLR

SEQ ID NO: 885470 - protein, 22 aa, Mycobacterium
LFGTWHYWWQAHLLDCLIDAQQ

SEQ ID NO: 885471 - protein, 23 aa, Mycobacterium
LFGTWHYWWQAHLLDCLLDAQLR

SEQ ID NO: 885472 - protein, 20 aa, Mycobacterium
LFHQLPLLPEWLLPWLLRLY

SEQ ID NO: 885473 - protein, 18 aa, Mycobacterium
LFIIGRIKDLLIIYGRNH

SEQ ID NO: 885474 - protein, 17 aa, Mycobacterium
LFIMGRIKDLLIVDGRN

SEQ ID NO: 885475 - protein, 19 aa, Mycobacterium
LFIPVDRLTGWAWVPLTTD

SEQ ID NO: 885476 - protein, 17 aa, Mycobacterium
LFIVGRIKDLLIIRGRN

SEQ ID NO: 885477 - protein, 17 aa, Mycobacterium
LFIVGRMKDLLIIRGRN

SEQ ID NO: 885478 - protein, 18 aa, Mycobacterium
LFLLLFTSGTTGASKAVK

SEQ ID NO: 885479 - protein, 21 aa, Mycobacterium
LFLSLPWFYRAGYDVLLYTLP

SEQ ID NO: 885480 - protein, 25 aa, Mycobacterium
LFMAGLWSVWKPAKDASPLLSCTII

SEQ ID NO: 885481 - protein, 20 aa, Mycobacterium
LFMQLPWRTEIIQGLLGADL

SEQ ID NO: 885482 - protein, 17 aa, Mycobacterium
LFNELLPHGYPFVNKQM

SEQ ID NO: 885483 - protein, 20 aa, Mycobacterium
LFNPETLPDLLRFTGPFNFS

SEQ ID NO: 885484 - protein, 22 aa, Mycobacterium
LFPGEMFADLFPSRRGRPSVPA

SEQ ID NO: 885485 - protein, 17 aa, Mycobacterium
LFPLICRYALAYHVVFI

SEQ ID NO: 885486 - protein, 19 aa, Mycobacterium
LFQAAPWPSVAPLTLFGHS

SEQ ID NO: 885487 - protein, 17 aa, Mycobacterium
LFQAGPWHRAAPLRLFG

SEQ ID NO: 885488 - protein, 21 aa, Mycobacterium
LFRIAPPEWMLPFLARNHPAL

SEQ ID NO: 885489 - protein, 17 aa, Mycobacterium
LFRLLLPARFGGLQASF

SEQ ID NO: 885490 - protein, 19 aa, Mycobacterium
LFRRRLVTPFIRAGAAVLS

SEQ ID NO: 885491 - protein, 18 aa, Mycobacterium
LFRSLWRLDFIAVALNTG

SEQ ID NO: 885492 - protein, 20 aa, Mycobacterium
LFRVTWALRIWHDLPNCIAT

SEQ ID NO: 885493 - protein, 20 aa, Mycobacterium
LFTHLRPLLFTIAYEMLGSA

SEQ ID NO: 885494 - protein, 17 aa, Mycobacterium
LFTLYTETPHRLAAAAS

SEQ ID NO: 885495 - protein, 19 aa, Mycobacterium
LFTNDYEWDLLLSKTGWSE

SEQ ID NO: 885496 - protein, 17 aa, Mycobacterium
LFVLDRWLRQLPTEVVG

SEQ ID NO: 885497 - protein, 19 aa, Mycobacterium
LFVMLLAECWRWGADEGAV

SEQ ID NO: 885498 - protein, 17 aa, Mycobacterium
LFVWRRYHPSRPKGKAL

SEQ ID NO: 885499 - protein, 21 aa, Mycobacterium
LGADICYILTPYFECSGKPGV

SEQ ID NO: 885500 - protein, 17 aa, Mycobacterium
LGADLLAVVARLNRLAT

SEQ ID NO: 885501 - protein, 18 aa, Mycobacterium
LGAGLRPWRLAKVLPATA

SEQ ID NO: 885502 - protein, 23 aa, Mycobacterium
LGAMGFKFQFITLAGFHALNYSM

SEQ ID NO: 885503 - protein, 22 aa, Mycobacterium
LGASSRRWAWWTGSVALAAAKI

SEQ ID NO: 885504 - protein, 28 aa, Mycobacterium
LGAVNAPTMAVLGRPLIGDGVDAAAGSG

SEQ ID NO: 885505 - protein, 17 aa, Mycobacterium
LGAWLAQGITAAAQLGV

SEQ ID NO: 885506 - protein, 21 aa, Mycobacterium
LGDAWVWDMYRPARFVKQVRV

SEQ ID NO: 885507 - protein, 19 aa, Mycobacterium
LGDLAYTLARRRGFRAARS

SEQ ID NO: 885508 - protein, 18 aa, Mycobacterium
LGFNLFQHAIARAVIYGT

SEQ ID NO: 885509 - protein, 19 aa, Mycobacterium
LGFPVFSRGLAIRGTGKSY

SEQ ID NO: 885510 - protein, 24 aa, Mycobacterium
LGGDGGDARWLGRGGVGGVGGAGE

SEQ ID NO: 885511 - protein, 18 aa, Mycobacterium
LGGFLTLRWTYCDPPSEL

SEQ ID NO: 885512 - protein, 18 aa, Mycobacterium
LGGFWIINAPDLDAALKW

SEQ ID NO: 885513 - protein, 28 aa, Mycobacterium
LGGGSLLPGLFGFGPFAPTTGSPAVAEG

SEQ ID NO: 885514 - protein, 18 aa, Mycobacterium
LGGNAWLLGSGGTGGTGG

SEQ ID NO: 885515 - protein, 29 aa, Mycobacterium
LGGYAERMLLSAPLLLPVPNGLDAGPAAL

SEQ ID NO: 885516 - protein, 23 aa, Mycobacterium
LGHFAFTGLLLDNLLDVPGSRVV

SEQ ID NO: 885517 - protein, 19 aa, Mycobacterium
LGHFEFTRLLFPALVAADG

SEQ ID NO: 885518 - protein, 17 aa, Mycobacterium
LGHLWRWELQPAGEGRT

SEQ ID NO: 885519 - protein, 23 aa, Mycobacterium
LGHPGLIAPLTFTSAPAMACNQR

SEQ ID NO: 885520 - protein, 23 aa, Mycobacterium
LGHVLFAWHLPELWRRFTIALRR

SEQ ID NO: 885521 - protein, 28 aa, Mycobacterium
LGIDRWVRNFFYLTYFDSFEGAHSRVFV

SEQ ID NO: 885522 - protein, 25 aa, Mycobacterium
LGIGFTAVLPRLTPATGLGAAAVAA

SEQ ID NO: 885523 - protein, 18 aa, Mycobacterium
LGIKPLYLTLTPDRIRFA

SEQ ID NO: 885524 - protein, 17 aa, Mycobacterium
LGIPRRLLPRLRPAGTH

SEQ ID NO: 885525 - protein, 22 aa, Mycobacterium
LGITCLWLMPFYPTARKDDGYD

SEQ ID NO: 885526 - protein, 18 aa, Mycobacterium
LGKGWRPKVWPPVRRIDG

SEQ ID NO: 885527 - protein, 28 aa, Mycobacterium
LGLDYLDLYLIHWPAPKLGKYVESFEGM

SEQ ID NO: 885528 - protein, 27 aa, Mycobacterium
LGLDYVDLYLIHWPAPAAGKYVDAFGG

SEQ ID NO: 885529 - protein, 17 aa, Mycobacterium
LGLLLQSESVELADLGM

SEQ ID NO: 885530 - protein, 18 aa, Mycobacterium
LGLLPIGYADGVYRALSG

SEQ ID NO: 885531 - protein, 27 aa, Mycobacterium
LGLMLPYSPIHHLLLAPVPGGRGPVPD

SEQ ID NO: 885532 - protein, 18 aa, Mycobacterium
LGLRLLDLGYFRAGGEKY

SEQ ID NO: 885533 - protein, 25 aa, Mycobacterium
LGLTSPMSLLRFIKFILTEIFPGGR

SEQ ID NO: 885534 - protein, 18 aa, Mycobacterium
LGLWFRNMAMRTMNFGPL

SEQ ID NO: 885535 - protein, 21 aa, Mycobacterium
LGMALCRYVLAFPPLVDMSRD

SEQ ID NO: 885536 - protein, 22 aa, Mycobacterium
LGMLRRRLGLDTAWIASFRSGM

SEQ ID NO: 885537 - protein, 18 aa, Mycobacterium
LGMPPWRVQKAQKQARRW

SEQ ID NO: 885538 - protein, 19 aa, Mycobacterium
LGNAPRYGFRPTIMGRPPA

SEQ ID NO: 885539 - protein, 20 aa, Mycobacterium
LGNGWFWPAAAAHPSLPRGA

SEQ ID NO: 885540 - protein, 24 aa, Mycobacterium
LGNLAFFVLDGWLRPVPVGVVGEL

SEQ ID NO: 885541 - protein, 20 aa, Mycobacterium
LGNLRYLSFPSMPPLDGPAG

SEQ ID NO: 885542 - protein, 19 aa, Mycobacterium
LGPALLKFAPGLAAAYLPG

SEQ ID NO: 885543 - protein, 17 aa, Mycobacterium
LGPHFSFTWFRGSPIGR

SEQ ID NO: 885544 - protein, 19 aa, Mycobacterium
LGPISIVLLDIPAAPGFGN

SEQ ID NO: 885545 - protein, 17 aa, Mycobacterium
LGPLMRRALAAAGVQRP

SEQ ID NO: 885546 - protein, 17 aa, Mycobacterium
LGPTMRRALDAAGIERP

SEQ ID NO: 885547 - protein, 22 aa, Mycobacterium
LGPVAWLLGLRIVPMLAPGSAD

SEQ ID NO: 885548 - protein, 23 aa, Mycobacterium
LGPVDWTIFDIPAVTGLFNSTSS

SEQ ID NO: 885549 - protein, 17 aa, Mycobacterium
LGPVIRPAIRALLDVQR

SEQ ID NO: 885550 - protein, 23 aa, Mycobacterium
LGQPPIPPWASPPPPPSLQATRD

SEQ ID NO: 885551 - protein, 19 aa, Mycobacterium
LGRFPALTIPILGITFHGA

SEQ ID NO: 885552 - protein, 27 aa, Mycobacterium
LGRGPLIRFLLIEMPAQRWRLVVTAHH

SEQ ID NO: 885553 - protein, 19 aa, Mycobacterium
LGRGRFFPPLFPPEGMMAE

SEQ ID NO: 885554 - protein, 19 aa, Mycobacterium
LGRGYRWLQLIDAAGLPLH

SEQ ID NO: 885555 - protein, 17 aa, Mycobacterium
LGRKYPWALGRPASEVW

SEQ ID NO: 885556 - protein, 27 aa, Mycobacterium
LGRPLPLHRILLQRSWIAIFWSRFAEA

SEQ ID NO: 885557 - protein, 20 aa, Mycobacterium
LGRPPRMLVLLHLDGSSDRP

SEQ ID NO: 885558 - protein, 18 aa, Mycobacterium
LGRRVRRVRLSPGALRGI

SEQ ID NO: 885559 - protein, 21 aa, Mycobacterium
LGRVLFNELLPPGYPFVNKQM

SEQ ID NO: 885560 - protein, 21 aa, Mycobacterium
LGRVLFNELLPRGYPFVNKQM

SEQ ID NO: 885561 - protein, 22 aa, Mycobacterium
LGRVLFNELLPVGYPFVNKQMH

SEQ ID NO: 885562 - protein, 19 aa, Mycobacterium
LGRWLPEMFGTPGDPKLGA

SEQ ID NO: 885563 - protein, 17 aa, Mycobacterium
LGRYLVLQWLERLELAD

SEQ ID NO: 885564 - protein, 20 aa, Mycobacterium
LGSCFGFFPLRLSRNGFDAT

SEQ ID NO: 885565 - protein, 20 aa, Mycobacterium
LGSQPWPFPRSIMLGFHAIG

SEQ ID NO: 885566 - protein, 25 aa, Mycobacterium
LGSWNTWHWRWNPWLLTAHGYAVLM

SEQ ID NO: 885567 - protein, 22 aa, Mycobacterium
LGTGLFLWQNIFGVWPSDGEVT

SEQ ID NO: 885568 - protein, 25 aa, Mycobacterium
LGTNLLGPFALTNLLLPKVRSQIIN

SEQ ID NO: 885569 - protein, 24 aa, Mycobacterium
LGVMPWNFPVYQIARFAAPNLVLG

SEQ ID NO: 885570 - protein, 18 aa, Mycobacterium
LGVVASFTPWNGATILSW

SEQ ID NO: 885571 - protein, 19 aa, Mycobacterium
LGVYWLFGGFLRKRRNIRD

SEQ ID NO: 885572 - protein, 17 aa, Mycobacterium
LGWGWAKFAFNGWKALS

SEQ ID NO: 885573 - protein, 18 aa, Mycobacterium
LGWHLLGELAGSAPLLAA

SEQ ID NO: 885574 - protein, 17 aa, Mycobacterium
LGYGLLRHLAHATGLDA

SEQ ID NO: 885575 - protein, 21 aa, Mycobacterium
LGYRVRRLAGRVVWLAPPDAP

SEQ ID NO: 885576 - protein, 19 aa, Mycobacterium
LHAALARYPRELPFLAPFN

SEQ ID NO: 885577 - protein, 17 aa, Mycobacterium
LHAMTLLDIQFIVATAA

SEQ ID NO: 885578 - protein, 18 aa, Mycobacterium
LHAPLDVLLVRKLGVPAH

SEQ ID NO: 885579 - protein, 21 aa, Mycobacterium
LHAPLDVLLVRKLGVPLHSEL

SEQ ID NO: 885580 - protein, 28 aa, Mycobacterium
LHAVNSGAPLWDWMKSIPGFDGGGLVSG

SEQ ID NO: 885581 - protein, 19 aa, Mycobacterium
LHDADVYRWPLIPALAMVA

SEQ ID NO: 885582 - protein, 19 aa, Mycobacterium
LHDALLALLPLVGVWRGEG

SEQ ID NO: 885583 - protein, 25 aa, Mycobacterium
LHDLYQRWPFFRSVLSNLAQVLAKS

SEQ ID NO: 885584 - protein, 23 aa, Mycobacterium
LHDLYQRWPFFRSVLSNMAQVMA

SEQ ID NO: 885585 - protein, 24 aa, Mycobacterium
LHDWQQWWDWVPGAYWRHPFGPGS

SEQ ID NO: 885586 - protein, 17 aa, Mycobacterium
LHELPGQRLWFPVPGMY

SEQ ID NO: 885587 - protein, 20 aa, Mycobacterium
LHGHLGWPAAVSYRIVALTR

SEQ ID NO: 885588 - protein, 19 aa, Mycobacterium
LHGWPQTWYAWRKVIPLLA

SEQ ID NO: 885589 - protein, 18 aa, Mycobacterium
LHHPVDELAPETGLDLFA

SEQ ID NO: 885590 - protein, 17 aa, Mycobacterium
LHLAILRSPYAHARIVS

SEQ ID NO: 885591 - protein, 18 aa, Mycobacterium
LHLFLRRIKVDEAFNGSV

SEQ ID NO: 885592 - protein, 18 aa, Mycobacterium
LHLWRYGIDPEDVAGVLA

SEQ ID NO: 885593 - protein, 18 aa, Mycobacterium
LHLYLRRVALYRAMFGSP

SEQ ID NO: 885594 - protein, 20 aa, Mycobacterium
LHNRFRNLLGRRLRGARLGT

SEQ ID NO: 885595 - protein, 19 aa, Mycobacterium
LHNSQPWRWVAASGAVDLF

SEQ ID NO: 885596 - protein, 18 aa, Mycobacterium
LHPMSAPMTLRWLRDRFA

SEQ ID NO: 885597 - protein, 17 aa, Mycobacterium
LHPPLIILMRVAQDEFE

SEQ ID NO: 885598 - protein, 18 aa, Mycobacterium
LHPPLIILMRVAQDEFEV

SEQ ID NO: 885599 - protein, 17 aa, Mycobacterium
LHQEWMLIALRTEWQVG

SEQ ID NO: 885600 - protein, 25 aa, Mycobacterium
LHQQLIKVLPLWLRLERFAVWLIFE

SEQ ID NO: 885601 - protein, 25 aa, Mycobacterium
LHSWYMLLFQIPRLPEWLFGFNETE

SEQ ID NO: 885602 - protein, 19 aa, Mycobacterium
LHVFTSAALALRAQDRTTR

SEQ ID NO: 885603 - protein, 17 aa, Mycobacterium
LHWLLWAHRDLKVYLLK

SEQ ID NO: 885604 - protein, 24 aa, Mycobacterium
LIAGAAYRWLRSWPTAPADPWDVP

SEQ ID NO: 885605 - protein, 19 aa, Mycobacterium
LIAGLRRLLDGSPGVMFVT

SEQ ID NO: 885606 - protein, 21 aa, Mycobacterium
LIALTRLRELIDRYPLRGIKG

SEQ ID NO: 885607 - protein, 23 aa, Mycobacterium
LIALTRLRELIDRYPLRGIKGPM

SEQ ID NO: 885608 - protein, 20 aa, Mycobacterium
LIAMRSKRYFRLLDALDAMV

SEQ ID NO: 885609 - protein, 25 aa, Mycobacterium
LIASQLIGFALLRYVWKIEPIASMP

SEQ ID NO: 885610 - protein, 25 aa, Mycobacterium
LIATQLIGFALLRYVWKIEPIASMP

SEQ ID NO: 885611 - protein, 18 aa, Mycobacterium
LIAWLPTLLGLGAADTVV

SEQ ID NO: 885612 - protein, 17 aa, Mycobacterium
LICVPPYHIAGVSAALS

SEQ ID NO: 885613 - protein, 18 aa, Mycobacterium
LIDAVKFTPALTGPHAQL

SEQ ID NO: 885614 - protein, 24 aa, Mycobacterium
LIDLKNWALLKWLDEPCTFYDWRG

SEQ ID NO: 885615 - protein, 20 aa, Mycobacterium
LIDPALLRPGRMERLVFVEP

SEQ ID NO: 885616 - protein, 19 aa, Mycobacterium
LIDQLLLRGALVRGLQVCA

SEQ ID NO: 885617 - protein, 25 aa, Mycobacterium
LIDRATRWLLNYRPLPLAVGAEINR

SEQ ID NO: 885618 - protein, 22 aa, Mycobacterium
LIDRPMEFLGNLLLLIVGGNDT

SEQ ID NO: 885619 - protein, 24 aa, Mycobacterium
LIDRVVFWMLPVDDLLPWLLVDRR

SEQ ID NO: 885620 - protein, 18 aa, Mycobacterium
LIERMALPTVFFAEGGGG

SEQ ID NO: 885621 - protein, 18 aa, Mycobacterium
LIFGPLRLQFWVCGVFEV

SEQ ID NO: 885622 - protein, 24 aa, Mycobacterium
LIGKSFRFHPIELAAFMCALEAAV

SEQ ID NO: 885623 - protein, 18 aa, Mycobacterium
LIGPLRIGLQRAGVPVLL

SEQ ID NO: 885624 - protein, 18 aa, Mycobacterium
LIGPLRIGLQRAGVPVVL

SEQ ID NO: 885625 - protein, 19 aa, Mycobacterium
LIGPPFIIARFMKYLELEE

SEQ ID NO: 885626 - protein, 26 aa, Mycobacterium
LIIGAWNFPFYLTIGPLVGAVAAGNT

SEQ ID NO: 885627 - protein, 25 aa, Mycobacterium
LIIGAWNYPFYLTLGPAVGAIAAGN

SEQ ID NO: 885628 - protein, 19 aa, Mycobacterium
LIIGGGMCFTFLAAQGFSV

SEQ ID NO: 885629 - protein, 18 aa, Mycobacterium
LIIGGGMCFTFLAAQGLS

SEQ ID NO: 885630 - protein, 17 aa, Mycobacterium
LIILRKRDNFRAAFDGF

SEQ ID NO: 885631 - protein, 18 aa, Mycobacterium
LIKAAWIEDWRLPAAPPG

SEQ ID NO: 885632 - protein, 19 aa, Mycobacterium
LILACTFPVLSTKASMGLP

SEQ ID NO: 885633 - protein, 17 aa, Mycobacterium
LILMRHAKSAYPPGVDD

SEQ ID NO: 885634 - protein, 18 aa, Mycobacterium
LILSCGAALHHCVVALAA

SEQ ID NO: 885635 - protein, 18 aa, Mycobacterium
LIMLYHLDRAWADHLAFL

SEQ ID NO: 885636 - protein, 18 aa, Mycobacterium
LIMLYHLDRGWADHLAYL

SEQ ID NO: 885637 - protein, 25 aa, Mycobacterium
LINFPVSQWLKFAPPIAYGALPKDA

SEQ ID NO: 885638 - protein, 23 aa, Mycobacterium
LINMIPFPSFLADDFTILDGLLA

SEQ ID NO: 885639 - protein, 24 aa, Mycobacterium
LINPHPMFVPWLVGPLLTGDGIHL

SEQ ID NO: 885640 - protein, 22 aa, Mycobacterium
LIQRQLMFVTPSKPLRRSWLDE

SEQ ID NO: 885641 - protein, 19 aa, Mycobacterium
LIRAGYIRPVGPGLYSWLP

SEQ ID NO: 885642 - protein, 19 aa, Mycobacterium
LIRPTLLRLGPATHVLLVL

SEQ ID NO: 885643 - protein, 18 aa, Mycobacterium
LIRVLRVALYPTKIVLDF

SEQ ID NO: 885644 - protein, 17 aa, Mycobacterium
LITHYTRILRYIQPQFV

SEQ ID NO: 885645 - protein, 17 aa, Mycobacterium
LITPVPLPRKLSADLLR

SEQ ID NO: 885646 - protein, 19 aa, Mycobacterium
LITSDTLRRIPLGDILARV

SEQ ID NO: 885647 - protein, 18 aa, Mycobacterium
LIYDLRIGPAWQGLAFGV

SEQ ID NO: 885648 - protein, 23 aa, Mycobacterium
LIYHGWYLLYRYWPTSHNTHKFE

SEQ ID NO: 885649 - protein, 19 aa, Mycobacterium
LKAMQFLRGGRRWLLKSPQ

SEQ ID NO: 885650 - protein, 23 aa, Mycobacterium
LKARLWFVHRGIEKLFEGRNALG

SEQ ID NO: 885651 - protein, 23 aa, Mycobacterium
LKARLWFVHRGVEKLFEGRNALG

SEQ ID NO: 885652 - protein, 25 aa, Mycobacterium
LKDIALYLNFDMLGSPNPGYFTYDG

SEQ ID NO: 885653 - protein, 20 aa, Mycobacterium
LKEIDGWLGLSLLVDRQSGT

SEQ ID NO: 885654 - protein, 24 aa, Mycobacterium
LKETLRLHPPLIILMRVAKGEFEV

SEQ ID NO: 885655 - protein, 18 aa, Mycobacterium
LKFALVEPLRLLFKDEVR

SEQ ID NO: 885656 - protein, 20 aa, Mycobacterium
LKHRLARSLFLYALCNGFIG

SEQ ID NO: 885657 - protein, 20 aa, Mycobacterium
LKHRLARSLFLYALCNGWID

SEQ ID NO: 885658 - protein, 20 aa, Mycobacterium
LKHRLARSLFLYALCNGWIN

SEQ ID NO: 885659 - protein, 19 aa, Mycobacterium
LKPYYRFLCKRPLSNDEYL

SEQ ID NO: 885660 - protein, 19 aa, Mycobacterium
LKRLYREFPSKAHLVRAVL

SEQ ID NO: 885661 - protein, 23 aa, Mycobacterium
LKRYWYHAWWFYAHTIVRGGIDK

SEQ ID NO: 885662 - protein, 21 aa, Mycobacterium
LKRYWYHAWWFYPHSIVRGGI

SEQ ID NO: 885663 - protein, 20 aa, Mycobacterium
LKVVIPRRPIWAYSAPGSGA

SEQ ID NO: 885664 - protein, 25 aa, Mycobacterium
LLADGPVVLFFYPAAMTPGCTKEAC

SEQ ID NO: 885665 - protein, 19 aa, Mycobacterium
LLADLSFADYLMWVRRDDG

SEQ ID NO: 885666 - protein, 17 aa, Mycobacterium
LLADQIDWLLAGGGLDW

SEQ ID NO: 885667 - protein, 26 aa, Mycobacterium
LLAELDRVWRRLPFDASWYSSNELAR

SEQ ID NO: 885668 - protein, 17 aa, Mycobacterium
LLALILIVLRRDTGAAG

SEQ ID NO: 885669 - protein, 18 aa, Mycobacterium
LLAMLQRREAWEIVDYVN

SEQ ID NO: 885670 - protein, 23 aa, Mycobacterium
LLARLFGLPYFPITPLFPLAGPA

SEQ ID NO: 885671 - protein, 30 aa, Mycobacterium
LLARLFGLPYFPITPLFPLAGPMGLVPLPS

SEQ ID NO: 885672 - protein, 18 aa, Mycobacterium
LLARLHATFWGRLPERRG

SEQ ID NO: 885673 - protein, 17 aa, Mycobacterium
LLARQVGVPYILVALNK

SEQ ID NO: 885674 - protein, 17 aa, Mycobacterium
LLASFPYPHVLSLTARL

SEQ ID NO: 885675 - protein, 24 aa, Mycobacterium
LLAVELSSFQLHWAPSLRPEAGVV

SEQ ID NO: 885676 - protein, 25 aa, Mycobacterium
LLAVGDLIIGWRLLVQAGVAHAALA

SEQ ID NO: 885677 - protein, 27 aa, Mycobacterium
LLAVINTPTQTLLGRPLIGNGADGAPG

SEQ ID NO: 885678 - protein, 20 aa, Mycobacterium
LLAVLGYFAALLYNGAGRYE

SEQ ID NO: 885679 - protein, 18 aa, Mycobacterium
LLAVVARLNRLATQRTRL

SEQ ID NO: 885680 - protein, 26 aa, Mycobacterium
LLCAFVKWQGLRLLEDQLRELRQRNV

SEQ ID NO: 885681 - protein, 26 aa, Mycobacterium
LLCGRMILWHVLFRFSAMYARKVPYR

SEQ ID NO: 885682 - protein, 25 aa, Mycobacterium
LLCPFDPLIFFRPRVKRLFGFHYRI

SEQ ID NO: 885683 - protein, 28 aa, Mycobacterium
LLDAINAPTQALLGRPLIGNGANAAPGS

SEQ ID NO: 885684 - protein, 22 aa, Mycobacterium
LLDEAWWFPAIQWPDGRMQFML

SEQ ID NO: 885685 - protein, 23 aa, Mycobacterium
LLDEAWWFPAIQWPDGRMQFMLN

SEQ ID NO: 885686 - protein, 27 aa, Mycobacterium
LLDEGQRLLIFLPLAHVLARSLTLSAF

SEQ ID NO: 885687 - protein, 25 aa, Mycobacterium
LLDETSVFWCPLPLFHTAGLATLTA

SEQ ID NO: 885688 - protein, 24 aa, Mycobacterium
LLDKWGIRVVPLHILLDGTDLRDG

SEQ ID NO: 885689 - protein, 22 aa, Mycobacterium
LLDLFLRIIVELFRRHWSSTGQ

SEQ ID NO: 885690 - protein, 24 aa, Mycobacterium
LLDLINAPALALFGRPWIGNGADG

SEQ ID NO: 885691 - protein, 17 aa, Mycobacterium
LLDLLLIGVLRIWFDND

SEQ ID NO: 885692 - protein, 19 aa, Mycobacterium
LLDMKRFHLLLAGASWMAE

SEQ ID NO: 885693 - protein, 18 aa, Mycobacterium
LLDMKRFHLLLAGASWVA

SEQ ID NO: 885694 - protein, 17 aa, Mycobacterium
LLDWPAKLRLLEGFRNR

SEQ ID NO: 885695 - protein, 17 aa, Mycobacterium
LLDWPAKLRLLEGFRQR

SEQ ID NO: 885696 - protein, 22 aa, Mycobacterium
LLEGLLARRRGWFEARWVRIAM

SEQ ID NO: 885697 - protein, 18 aa, Mycobacterium
LLEIAPRCALITPSAPHE

SEQ ID NO: 885698 - protein, 17 aa, Mycobacterium
LLELLYSTGARISEAVG

SEQ ID NO: 885699 - protein, 19 aa, Mycobacterium
LLELYRLIELLRPGTFTSV

SEQ ID NO: 885700 - protein, 17 aa, Mycobacterium
LLEPLRGLLADGLPAYG

SEQ ID NO: 885701 - protein, 18 aa, Mycobacterium
LLESPLGQLLYAAGSGTL

SEQ ID NO: 885702 - protein, 19 aa, Mycobacterium
LLESPLGQLLYAAGTGKLA

SEQ ID NO: 885703 - protein, 18 aa, Mycobacterium
LLEVVRPATFLFAAGQET

SEQ ID NO: 885704 - protein, 24 aa, Mycobacterium
LLFDAGWMRWGWPTRIGGLGGSPM

SEQ ID NO: 885705 - protein, 19 aa, Mycobacterium
LLFDTIFGTGSLLLTDLRK

SEQ ID NO: 885706 - protein, 17 aa, Mycobacterium
LLFLHVWDFATPVEEIL

SEQ ID NO: 885707 - protein, 18 aa, Mycobacterium
LLFPFAAGVPTWWRTMEA

SEQ ID NO: 885708 - protein, 19 aa, Mycobacterium
LLFVELGKRLAPGPFLACT

SEQ ID NO: 885709 - protein, 17 aa, Mycobacterium
LLGAYRFTEFRSAKTAP

SEQ ID NO: 885710 - protein, 21 aa, Mycobacterium
LLGDLGLLEPLRGLLADGLPA

SEQ ID NO: 885711 - protein, 19 aa, Mycobacterium
LLGFDFCGVLLPDEQSRHL

SEQ ID NO: 885712 - protein, 24 aa, Mycobacterium
LLGIMPWNYPYYQVARFAGPNLVV

SEQ ID NO: 885713 - protein, 17 aa, Mycobacterium
LLGIPMRVAVLGALRST

SEQ ID NO: 885714 - protein, 21 aa, Mycobacterium
LLGLMLPYSPIHHLLLAPVPG

SEQ ID NO: 885715 - protein, 18 aa, Mycobacterium
LLGRPLIGNGADGAAPGQ

SEQ ID NO: 885716 - protein, 29 aa, Mycobacterium
LLGVDRWIRNFFYLTYFDSFEGTHSRVFV

SEQ ID NO: 885717 - protein, 17 aa, Mycobacterium
LLGVLPMGGDPDSAMFA

SEQ ID NO: 885718 - protein, 17 aa, Mycobacterium
LLHAFRAPQAPLRGAPE

SEQ ID NO: 885719 - protein, 19 aa, Mycobacterium
LLHAGFSPPLVWRVMERFG

SEQ ID NO: 885720 - protein, 20 aa, Mycobacterium
LLHDLLSITLPVWRRMEDRF

SEQ ID NO: 885721 - protein, 26 aa, Mycobacterium
LLHETLETPLPWPPPFWKSAADQGLT

SEQ ID NO: 885722 - protein, 18 aa, Mycobacterium
LLHGLPVRRLWGIGPVAE

SEQ ID NO: 885723 - protein, 17 aa, Mycobacterium
LLHRLRHLLNRLNRAVP

SEQ ID NO: 885724 - protein, 18 aa, Mycobacterium
LLIAFGLAWARFVGTGAP

SEQ ID NO: 885725 - protein, 18 aa, Mycobacterium
LLIGQLIDRSGMAWCISA

SEQ ID NO: 885726 - protein, 18 aa, Mycobacterium
LLIGQLIDRSGMAWCISN

SEQ ID NO: 885727 - protein, 18 aa, Mycobacterium
LLIGQLIDRSGMAWCISS

SEQ ID NO: 885728 - protein, 17 aa, Mycobacterium
LLIRAALPHMYRNEFGR

SEQ ID NO: 885729 - protein, 18 aa, Mycobacterium
LLIRAGYVRPIAPGLYSW

SEQ ID NO: 885730 - protein, 19 aa, Mycobacterium
LLITHYTRILRYIQPQFVH

SEQ ID NO: 885731 - protein, 20 aa, Mycobacterium
LLITHYTRILRYIQPQFVHV

SEQ ID NO: 885732 - protein, 18 aa, Mycobacterium
LLKLPIPVQRRVAAGVLS

SEQ ID NO: 885733 - protein, 17 aa, Mycobacterium
LLKPPFPDPGTPLQLVH

SEQ ID NO: 885734 - protein, 18 aa, Mycobacterium
LLKYYPHLLALSASSPWW

SEQ ID NO: 885735 - protein, 19 aa, Mycobacterium
LLLDLDLLEPLRGLLAHGL

SEQ ID NO: 885736 - protein, 22 aa, Mycobacterium
LLLDLQARFKLSYLFVSHDLSV

SEQ ID NO: 885737 - protein, 18 aa, Mycobacterium
LLLEIGPRPVLTAAALGA

SEQ ID NO: 885738 - protein, 17 aa, Mycobacterium
LLLERFLRHFAGYADKP

SEQ ID NO: 885739 - protein, 17 aa, Mycobacterium
LLLFSALELLHAWALIH

SEQ ID NO: 885740 - protein, 18 aa, Mycobacterium
LLLGLDGFNAPASASPIH

SEQ ID NO: 885741 - protein, 18 aa, Mycobacterium
LLLGLDGFNAPASTSPLH

SEQ ID NO: 885742 - protein, 18 aa, Mycobacterium
LLLGLDGYNAPTSTSPIH

SEQ ID NO: 885743 - protein, 17 aa, Mycobacterium
LLLILDVKKPRPSDIAI

SEQ ID NO: 885744 - protein, 19 aa, Mycobacterium
LLLLDFLRRSGETPIVLLH

SEQ ID NO: 885745 - protein, 19 aa, Mycobacterium
LLLLDGNSLAFRAFYALPA

SEQ ID NO: 885746 - protein, 17 aa, Mycobacterium
LLLLDMWEHAFYLQYKN

SEQ ID NO: 885747 - protein, 18 aa, Mycobacterium
LLLLLFTSGTTGASKAVK

SEQ ID NO: 885748 - protein, 17 aa, Mycobacterium
LLLLYDLLGIADPQVEL

SEQ ID NO: 885749 - protein, 17 aa, Mycobacterium
LLLTLEQRLLLTQKYPG

SEQ ID NO: 885750 - protein, 20 aa, Mycobacterium
LLMGWLIPPPWEPQGRPPVA

SEQ ID NO: 885751 - protein, 31 aa, Mycobacterium
LLNAVNGPTQAWLGRPLIGNGTDGAAGTGQA

SEQ ID NO: 885752 - protein, 19 aa, Mycobacterium
LLNLLIYIKSYLDGTLTFR

SEQ ID NO: 885753 - protein, 28 aa, Mycobacterium
LLNLVNAPTQALFGRPLIGNGADGAAGT

SEQ ID NO: 885754 - protein, 30 aa, Mycobacterium
LLNLVNAPTQALLNRPLIGNGANGAAGTGA

SEQ ID NO: 885755 - protein, 28 aa, Mycobacterium
LLNVVNAPTQALLGRALIGNGANGADGT

SEQ ID NO: 885756 - protein, 18 aa, Mycobacterium
LLNYYPHLLALSASSPWW

SEQ ID NO: 885757 - protein, 19 aa, Mycobacterium
LLPCLPTLLALSASSPFWA

SEQ ID NO: 885758 - protein, 23 aa, Mycobacterium
LLPETLWIEPLWKTLLSNKAILA

SEQ ID NO: 885759 - protein, 21 aa, Mycobacterium
LLPEVAWSWLVEALESRMEHV

SEQ ID NO: 885760 - protein, 20 aa, Mycobacterium
LLPEVAWSWLVEALESRTEH

SEQ ID NO: 885761 - protein, 24 aa, Mycobacterium
LLPEWLLPWLLRLYWRRWSPGYDA

SEQ ID NO: 885762 - protein, 20 aa, Mycobacterium
LLPLIPLVPKRALQGLGGLF

SEQ ID NO: 885763 - protein, 22 aa, Mycobacterium
LLPQEWLRFGWFFLVTRHDPKG

SEQ ID NO: 885764 - protein, 25 aa, Mycobacterium
LLPQEWLRFGWFFLVTRRDPGGLLE

SEQ ID NO: 885765 - protein, 19 aa, Mycobacterium
LLPVPWVEPVDIANAVLFL

SEQ ID NO: 885766 - protein, 17 aa, Mycobacterium
LLQIVRPDRAYFGEKDY

SEQ ID NO: 885767 - protein, 24 aa, Mycobacterium
LLQKWAIRVVPLHILLDGADLRDG

SEQ ID NO: 885768 - protein, 27 aa, Mycobacterium
LLQQLRPDLEIWYTLPVLPSGLTADGL

SEQ ID NO: 885769 - protein, 25 aa, Mycobacterium
LLQSPQPLWALWRFGTDPAFTRISM

SEQ ID NO: 885770 - protein, 17 aa, Mycobacterium
LLQVLQWQQPRGRWVLK

SEQ ID NO: 885771 - protein, 29 aa, Mycobacterium
LLRDRIHQGWILNALWLIDTGVTAAALPR

SEQ ID NO: 885772 - protein, 19 aa, Mycobacterium
LLREAVLTEGWRLHPDTDP

SEQ ID NO: 885773 - protein, 25 aa, Mycobacterium
LLRFDGRRWLLARRIILFDESVIRM

SEQ ID NO: 885774 - protein, 20 aa, Mycobacterium
LLRGLPPRPVLVGASLGGFT

SEQ ID NO: 885775 - protein, 22 aa, Mycobacterium
LLRGNPLFAMDLVAAALAVSAA

SEQ ID NO: 885776 - protein, 26 aa, Mycobacterium
LLRKGERLLVFLPLAHVLARSLSMSA

SEQ ID NO: 885777 - protein, 18 aa, Mycobacterium
LLRLWADYLDMPPLRVDP

SEQ ID NO: 885778 - protein, 26 aa, Mycobacterium
LLRPGQRLLVFLPLAHVLARSLTLSA

SEQ ID NO: 885779 - protein, 17 aa, Mycobacterium
LLRSFFHPLVRLRNKVP

SEQ ID NO: 885780 - protein, 18 aa, Mycobacterium
LLRTWFAGLFEAGFAGAD

SEQ ID NO: 885781 - protein, 25 aa, Mycobacterium
LLSGGPVVLFFYPAAMTPGCTKEAC

SEQ ID NO: 885782 - protein, 18 aa, Mycobacterium
LLSRSLILQLQPLADNDI

SEQ ID NO: 885783 - protein, 17 aa, Mycobacterium
LLSRSLILQLQPLTPAD

SEQ ID NO: 885784 - protein, 25 aa, Mycobacterium
LLSSGPVVLFFYPAAMTPGCTKEAC

SEQ ID NO: 885785 - protein, 25 aa, Mycobacterium
LLSSRFPMWMAWGPDLTFFCNDAYR

SEQ ID NO: 885786 - protein, 22 aa, Mycobacterium
LLSTRWLPMPFLADRKALPTGS

SEQ ID NO: 885787 - protein, 26 aa, Mycobacterium
LLTADIMGPLLRIPRHPLALTRFGVP

SEQ ID NO: 885788 - protein, 21 aa, Mycobacterium
LLTAVLSGMPLWQAPTGAFSA

SEQ ID NO: 885789 - protein, 18 aa, Mycobacterium
LLTHLLLPQLQASRSGDA

SEQ ID NO: 885790 - protein, 26 aa, Mycobacterium
LLTPGQRLLVFLPLAHVLARALTLSA

SEQ ID NO: 885791 - protein, 19 aa, Mycobacterium
LLVAAWLPWSHGRYFDPIA

SEQ ID NO: 885792 - protein, 18 aa, Mycobacterium
LLVAIMPWEGHNYEDAII

SEQ ID NO: 885793 - protein, 17 aa, Mycobacterium
LLVKLDWLFTGSGDRWT

SEQ ID NO: 885794 - protein, 23 aa, Mycobacterium
LLVLHAAWLLDTVGIMGALSAVS

SEQ ID NO: 885795 - protein, 17 aa, Mycobacterium
LLVLLRKRLVEFETTGS

SEQ ID NO: 885796 - protein, 22 aa, Mycobacterium
LLVPLRAVLKERVALAPAPPPA

SEQ ID NO: 885797 - protein, 19 aa, Mycobacterium
LLVPPYTLGAWLGDGTSAA

SEQ ID NO: 885798 - protein, 20 aa, Mycobacterium
LLVQLYLHFKIVWPAFGKQF

SEQ ID NO: 885799 - protein, 19 aa, Mycobacterium
LLVSWLPQYHDFGLIFMAL

SEQ ID NO: 885800 - protein, 20 aa, Mycobacterium
LMACLAYTWKQVVTTPLFAE

SEQ ID NO: 885801 - protein, 20 aa, Mycobacterium
LMATFLRFATGIAGPKPQLD

SEQ ID NO: 885802 - protein, 17 aa, Mycobacterium
LMHPWWPLKGSDAEANR

SEQ ID NO: 885803 - protein, 19 aa, Mycobacterium
LMLSAPLPLPAAGAVCVQV

SEQ ID NO: 885804 - protein, 18 aa, Mycobacterium
LMLSWIRDVPALGAAARR

SEQ ID NO: 885805 - protein, 19 aa, Mycobacterium
LMLSWIRDVPSLGAVARGL

SEQ ID NO: 885806 - protein, 23 aa, Mycobacterium
LMLTPILSIFYTQAGLSAPDGRC

SEQ ID NO: 885807 - protein, 18 aa, Mycobacterium
LMLTVPYQGLGNAAISAV

SEQ ID NO: 885808 - protein, 24 aa, Mycobacterium
LMPDKPFFMYFAPGATHAPHHVPK

SEQ ID NO: 885809 - protein, 23 aa, Mycobacterium
LMPDVLHWLGIRTIHRLVSMSNM

SEQ ID NO: 885810 - protein, 17 aa, Mycobacterium
LMPLGYPSGIFWLRATM

SEQ ID NO: 885811 - protein, 19 aa, Mycobacterium
LMPVKLKWGISLGALIMHL

SEQ ID NO: 885812 - protein, 17 aa, Mycobacterium
LMRALWRPGWTEFEGAF

SEQ ID NO: 885813 - protein, 19 aa, Mycobacterium
LMRIYALIRLAYRVLPDRL

SEQ ID NO: 885814 - protein, 18 aa, Mycobacterium
LMRRSGVIFLRRKLDDPL

SEQ ID NO: 885815 - protein, 27 aa, Mycobacterium
LMRSRTLMRAPIWIYRARAGAVFGSRM

SEQ ID NO: 885816 - protein, 26 aa, Mycobacterium
LMSAWQWLHFRFGLPKPPLEPLAVER

SEQ ID NO: 885817 - protein, 30 aa, Mycobacterium
LMTLFMGHLYGWIITLRPSGAFFPVEQLLV

SEQ ID NO: 885818 - protein, 17 aa, Mycobacterium
LMVLPPLMHGAAQWAVF

SEQ ID NO: 885819 - protein, 27 aa, Mycobacterium
LNAINAPFDALTGRPLIGNGTPGAAGS

SEQ ID NO: 885820 - protein, 25 aa, Mycobacterium
LNAVHFELLWLLNKRDYYGHITDED

SEQ ID NO: 885821 - protein, 25 aa, Mycobacterium
LNAVNAPFQAFTDRPLIGNGVAGAP

SEQ ID NO: 885822 - protein, 24 aa, Mycobacterium
LNFMLIGAAFYRDTYRRTDAGWKI

SEQ ID NO: 885823 - protein, 25 aa, Mycobacterium
LNFMLIGAAFYRDTYRRTEAGWKIS

SEQ ID NO: 885824 - protein, 26 aa, Mycobacterium
LNGGVTLPLLLPIGLGFVVLDVPFDG

SEQ ID NO: 885825 - protein, 20 aa, Mycobacterium
LNGPFFLCRAALPHLLETGG

SEQ ID NO: 885826 - protein, 17 aa, Mycobacterium
LNHLLSLGYSKELLPER

SEQ ID NO: 885827 - protein, 18 aa, Mycobacterium
LNIPVDIPIYLDLGSLAL

SEQ ID NO: 885828 - protein, 26 aa, Mycobacterium
LNLINGPTQALLGRPLIGNGADGTAP

SEQ ID NO: 885829 - protein, 18 aa, Mycobacterium
LNLMLIARRPGPLADTAD

SEQ ID NO: 885830 - protein, 18 aa, Mycobacterium
LNMAALWNLPVLFCCENN

SEQ ID NO: 885831 - protein, 17 aa, Mycobacterium
LNMTLSQRWGRLFVSVG

SEQ ID NO: 885832 - protein, 17 aa, Mycobacterium
LNNWIRQGTVQRGLVVS

SEQ ID NO: 885833 - protein, 17 aa, Mycobacterium
LNNWIRQGVVERGLVVS

SEQ ID NO: 885834 - protein, 18 aa, Mycobacterium
LNNWIRQGVVERGLVVSG

SEQ ID NO: 885835 - protein, 20 aa, Mycobacterium
LNNWSLLKWLDEPCSFYDWR

SEQ ID NO: 885836 - protein, 20 aa, Mycobacterium
LNPFEQLLALLPNIGIGNKG

SEQ ID NO: 885837 - protein, 21 aa, Mycobacterium
LNPVFNRLPVRWLYLPWAAEG

SEQ ID NO: 885838 - protein, 18 aa, Mycobacterium
LNQWLMEQLIMIDALKRG

SEQ ID NO: 885839 - protein, 24 aa, Mycobacterium
LNRPGYLRFDFSWQGALSEAQRQE

SEQ ID NO: 885840 - protein, 20 aa, Mycobacterium
LNRPGYLRFDFSWQGPLTED

SEQ ID NO: 885841 - protein, 18 aa, Mycobacterium
LNRYFSPCADRFSDLLLA

SEQ ID NO: 885842 - protein, 20 aa, Mycobacterium
LNSWLYWPHTEPIGAMLFLH

SEQ ID NO: 885843 - protein, 19 aa, Mycobacterium
LNTWLMEQLIMIDALKRGS

SEQ ID NO: 885844 - protein, 21 aa, Mycobacterium
LNTWTLLKWLDEPCPFYDWRV

SEQ ID NO: 885845 - protein, 18 aa, Mycobacterium
LNVAFQMLYARYPDITAA

SEQ ID NO: 885846 - protein, 21 aa, Mycobacterium
LNWESVPLRLFAGGIAKLWDP

SEQ ID NO: 885847 - protein, 23 aa, Mycobacterium
LNWKSRPYLAWPAYGQSKLANLL

SEQ ID NO: 885848 - protein, 17 aa, Mycobacterium
LNYYPHLLALSASSPWW

SEQ ID NO: 885849 - protein, 21 aa, Mycobacterium
LPAAPARWLLLRIPFATVGPE

SEQ ID NO: 885850 - protein, 17 aa, Mycobacterium
LPADSHLLLLWGAANRD

SEQ ID NO: 885851 - protein, 27 aa, Mycobacterium
LPAEMPAAALWWRLAGTLAPPSLEGTD

SEQ ID NO: 885852 - protein, 22 aa, Mycobacterium
LPAFGKLLSSFPWPLNKTTTVA

SEQ ID NO: 885853 - protein, 21 aa, Mycobacterium
LPAFVELLIATGCRPNEVLAT

SEQ ID NO: 885854 - protein, 19 aa, Mycobacterium
LPAKLAIPMRVIASVAAIL

SEQ ID NO: 885855 - protein, 18 aa, Mycobacterium
LPALPPWLATDIDNWNII

SEQ ID NO: 885856 - protein, 24 aa, Mycobacterium
LPATHIGGLWWILTCLMRGGLCIT

SEQ ID NO: 885857 - protein, 25 aa, Mycobacterium
LPDELPAAALWWRLAAELTPAAALD

SEQ ID NO: 885858 - protein, 25 aa, Mycobacterium
LPDELPAAALWWRLAAELTPAATVD

SEQ ID NO: 885859 - protein, 20 aa, Mycobacterium
LPDFLSIEIFRPLDLAMVVD

SEQ ID NO: 885860 - protein, 25 aa, Mycobacterium
LPDGPLPVMFYIYGGGYFLGSSSSP

SEQ ID NO: 885861 - protein, 24 aa, Mycobacterium
LPDGTPFPTLYYLTHPALTAAASR

SEQ ID NO: 885862 - protein, 20 aa, Mycobacterium
LPDGTPFPTLYYLTHPELTA

SEQ ID NO: 885863 - protein, 20 aa, Mycobacterium
LPDVGVVNALRWRPHPWGDD

SEQ ID NO: 885864 - protein, 18 aa, Mycobacterium
LPEVAWSWLVDALDARAN

SEQ ID NO: 885865 - protein, 17 aa, Mycobacterium
LPEVAWSWLVDALEQRA

SEQ ID NO: 885866 - protein, 20 aa, Mycobacterium
LPEVAWSWLVDALESRMEQV

SEQ ID NO: 885867 - protein, 18 aa, Mycobacterium
LPEVAWSWLVEALESRTE

SEQ ID NO: 885868 - protein, 18 aa, Mycobacterium
LPFSRIRVLRRLARRPMS

SEQ ID NO: 885869 - protein, 18 aa, Mycobacterium
LPFTIRLAALAQLRIRML

SEQ ID NO: 885870 - protein, 20 aa, Mycobacterium
LPGLFVWRRYHPTPAPERGV

SEQ ID NO: 885871 - protein, 23 aa, Mycobacterium
LPGLLLSHYLWPHHYLQLQYFER

SEQ ID NO: 885872 - protein, 20 aa, Mycobacterium
LPGMGSLLLPPWTLTRYAPD

SEQ ID NO: 885873 - protein, 20 aa, Mycobacterium
LPGRPPLPTLFLPHNRGKKS

SEQ ID NO: 885874 - protein, 23 aa, Mycobacterium
LPHAPYLHLFIARGAVGCEGAGD

SEQ ID NO: 885875 - protein, 17 aa, Mycobacterium
LPILIGATQPRMLALTA

SEQ ID NO: 885876 - protein, 24 aa, Mycobacterium
LPKPDLTLGPFLRPLYAAPGVQSA

SEQ ID NO: 885877 - protein, 23 aa, Mycobacterium
LPKRRWWGWGINPQFRILRQPGQ

SEQ ID NO: 885878 - protein, 18 aa, Mycobacterium
LPLAPMQANLWYLQQLAP

SEQ ID NO: 885879 - protein, 21 aa, Mycobacterium
LPLFHDMGMVGFLTVPMFFGA

SEQ ID NO: 885880 - protein, 19 aa, Mycobacterium
LPLRLVYVIPRREKHREPA

SEQ ID NO: 885881 - protein, 17 aa, Mycobacterium
LPLVRRLGRFLPTDVRV

SEQ ID NO: 885882 - protein, 25 aa, Mycobacterium
LPNGRPHLVAMWYAILDGEIWFETK

SEQ ID NO: 885883 - protein, 18 aa, Mycobacterium
LPNVPYFAVAYYGVLRAG

SEQ ID NO: 885884 - protein, 20 aa, Mycobacterium
LPPGWPMLVASWLAQAEGAR

SEQ ID NO: 885885 - protein, 19 aa, Mycobacterium
LPPKLAIPMRVIASVAAIL

SEQ ID NO: 885886 - protein, 23 aa, Mycobacterium
LPPKLVIPMRVIMSVAAILCQLD

SEQ ID NO: 885887 - protein, 18 aa, Mycobacterium
LPPLEGIYLAAFAGQPVL

SEQ ID NO: 885888 - protein, 21 aa, Mycobacterium
LPPQPVPLFDSLFALVQNALD

SEQ ID NO: 885889 - protein, 17 aa, Mycobacterium
LPQALAVFLAPPSWEAL

SEQ ID NO: 885890 - protein, 25 aa, Mycobacterium
LPQDATLVSWLPFYHDMGLVLGVCA

SEQ ID NO: 885891 - protein, 19 aa, Mycobacterium
LPQEWLRFGWYFLVSRRDL

SEQ ID NO: 885892 - protein, 17 aa, Mycobacterium
LPRALSEGLNRALGGEH

SEQ ID NO: 885893 - protein, 17 aa, Mycobacterium
LPRFDTISYRDLWANVG

SEQ ID NO: 885894 - protein, 17 aa, Mycobacterium
LPRGRTRPLWWTLRRPH

SEQ ID NO: 885895 - protein, 19 aa, Mycobacterium
LPRIPMRFPMYLPGPNRVM

SEQ ID NO: 885896 - protein, 19 aa, Mycobacterium
LPRLPWWLRPFARFRADDH

SEQ ID NO: 885897 - protein, 17 aa, Mycobacterium
LPRPITVDLFRGLAELE

SEQ ID NO: 885898 - protein, 18 aa, Mycobacterium
LPRPPLFLMASSAAVYGS

SEQ ID NO: 885899 - protein, 19 aa, Mycobacterium
LPTAFAPAAFRWLGLRDMP

SEQ ID NO: 885900 - protein, 26 aa, Mycobacterium
LPTATRWFRLMSAWLMLAARPDLIGK

SEQ ID NO: 885901 - protein, 17 aa, Mycobacterium
LPTHWPWTDQWLMLWRN

SEQ ID NO: 885902 - protein, 20 aa, Mycobacterium
LPTPAVAYLTGAYDADFGVM

SEQ ID NO: 885903 - protein, 20 aa, Mycobacterium
LPTPAVAYLTGAYGAAFGVM

SEQ ID NO: 885904 - protein, 30 aa, Mycobacterium; identical to SEQ ID NO: 136038

SEQ ID NO: 885905 - protein, 19 aa, Mycobacterium
LPTTVMPFILRGATLAGID

SEQ ID NO: 885906 - protein, 23 aa, Mycobacterium
LPTWGLTTLLPLSVGRGLARRMS

SEQ ID NO: 885907 - protein, 21 aa, Mycobacterium
LPTYAFMRQRFWLTPHLAGSV

SEQ ID NO: 885908 - protein, 17 aa, Mycobacterium
LPVPWVEPVDVANAVVF

SEQ ID NO: 885909 - protein, 25 aa, Mycobacterium
LPVYDKPLVYYPLSTLIMAGIRDIL

SEQ ID NO: 885910 - protein, 25 aa, Mycobacterium
LPVYDKPLVYYPLSTLIMAGVRDIL

SEQ ID NO: 885911 - protein, 17 aa, Mycobacterium
LPWPYRVVDLAAAVLRP

SEQ ID NO: 885912 - protein, 17 aa, Mycobacterium
LPYPGVLPEGPPPSKAF

SEQ ID NO: 885913 - protein, 18 aa, Mycobacterium
LPYSWRGISLHAAAAKRI

SEQ ID NO: 885914 - protein, 21 aa, Mycobacterium
LQATSIKLRQAVDGKCGKPKQ

SEQ ID NO: 885915 - protein, 18 aa, Mycobacterium
LQAVQPYLIWLRETAQQA

SEQ ID NO: 885916 - protein, 17 aa, Mycobacterium
LQEFLFGLDLDDDTRRR

SEQ ID NO: 885917 - protein, 23 aa, Mycobacterium
LQEKIRSLRLPLLILHSPTDNTV

SEQ ID NO: 885918 - protein, 23 aa, Mycobacterium
LQERLDALLRLEGFRDWADIDVD

SEQ ID NO: 885919 - protein, 17 aa, Mycobacterium
LQFLERLSGWFEFVWKP

SEQ ID NO: 885920 - protein, 17 aa, Mycobacterium
LQFLPRALAAAGGRPVL

SEQ ID NO: 885921 - protein, 19 aa, Mycobacterium
LQGGFGRTLDTAAKAYASA

SEQ ID NO: 885922 - protein, 19 aa, Mycobacterium
LQGHWLLARLGKRVLRPGG

SEQ ID NO: 885923 - protein, 18 aa, Mycobacterium
LQGLHRLWPPLIDFTHRA

SEQ ID NO: 885924 - protein, 18 aa, Mycobacterium
LQGQWYLHLFAPGQPDLN

SEQ ID NO: 885925 - protein, 21 aa, Mycobacterium
LQHALPITFGYRVACWTAPLL

SEQ ID NO: 885926 - protein, 18 aa, Mycobacterium
LQHWDWLSSMAELSIKIA

SEQ ID NO: 885927 - protein, 19 aa, Mycobacterium
LQIRAAGLDAPLLAWLHAP

SEQ ID NO: 885928 - protein, 19 aa, Mycobacterium
LQIVFQTLLRRVPTMELAV

SEQ ID NO: 885929 - protein, 23 aa, Mycobacterium
LQLALTRLWRVYGVEPDAVIGHS

SEQ ID NO: 885930 - protein, 18 aa, Mycobacterium
LQLLPLTPFIPQRAVARG

SEQ ID NO: 885931 - protein, 23 aa, Mycobacterium
LQLRSLPFRPIGIGPLVAARMWQ

SEQ ID NO: 885932 - protein, 21 aa, Mycobacterium
LQMSSPCQVLWTTLGSPVHRN

SEQ ID NO: 885933 - protein, 23 aa, Mycobacterium
LQNPILSLMFFLTSSRIFGRGKG

SEQ ID NO: 885934 - protein, 17 aa, Mycobacterium
LQPILRFWRVFERADIG

SEQ ID NO: 885935 - protein, 19 aa, Mycobacterium
LQPLQSMMGMFASPGALGM

SEQ ID NO: 885936 - protein, 17 aa, Mycobacterium
LQPLWLVRGRISEGRSW

SEQ ID NO: 885937 - protein, 18 aa, Mycobacterium
LQQIFVVQGKPAIYARTA

SEQ ID NO: 885938 - protein, 24 aa, Mycobacterium
LQRHVTLISLWWSHLRNKGRTGAP

SEQ ID NO: 885939 - protein, 19 aa, Mycobacterium
LQRIFTFQSLYAGVAPRDA

SEQ ID NO: 885940 - protein, 25 aa, Mycobacterium
LQRIKDLVIPPAWKKVWISPHPNGH

SEQ ID NO: 885941 - protein, 25 aa, Mycobacterium
LQRIKDLVIPPAWKNVWISPHANGH

SEQ ID NO: 885942 - protein, 26 aa, Mycobacterium
LQRIKDLVIPPAWQKVWIAPYPNGHI

SEQ ID NO: 885943 - protein, 17 aa, Mycobacterium
LQRPLPILIGATQPRML

SEQ ID NO: 885944 - protein, 17 aa, Mycobacterium
LQRRIGFPVIVKTVADV

SEQ ID NO: 885945 - protein, 22 aa, Mycobacterium
LQRSWVHVLPSRKEGWGLAVVE

SEQ ID NO: 885946 - protein, 20 aa, Mycobacterium
LQRVYEVPVLLRFGGRLVPD

SEQ ID NO: 885947 - protein, 28 aa, Mycobacterium
LQSDYVDLFLIHWPLPTLYGGDFVSTWK

SEQ ID NO: 885948 - protein, 20 aa, Mycobacterium
LQSLTPPPPLRVLMSTGSPF

SEQ ID NO: 885949 - protein, 25 aa, Mycobacterium
LQSPQPLWALWRFGTDPGFTRISME

SEQ ID NO: 885950 - protein, 30 aa, Mycobacterium
LQTASLDHALWFLRPFRADEWMLYDETSPS

SEQ ID NO: 885951 - protein, 34 aa, Mycobacterium
LQVLERDVLGLVNAPTQALLGRPIIGNGADGAPG

SEQ ID NO: 885952 - protein, 17 aa, Mycobacterium
LQWGLVRLSVRDGTVLP

SEQ ID NO: 885953 - protein, 18 aa, Mycobacterium
LQWIVYEEEYFRAGAPGR

SEQ ID NO: 885954 - protein, 18 aa, Mycobacterium
LQWVVFEEEYFRAGAPGR

SEQ ID NO: 885955 - protein, 18 aa, Mycobacterium
LQYDLWKAKGLRAVPPTA

SEQ ID NO: 885956 - protein, 19 aa, Mycobacterium
LQYMYAFARFLDARWVADA

SEQ ID NO: 885957 - protein, 29 aa, Mycobacterium
LRAGLVDRILAYLAPMLLGGNVPAVEDVG

SEQ ID NO: 885958 - protein, 27 aa, Mycobacterium
LRAGVPMLILWLWLDQPMWAEAVSALE

SEQ ID NO: 885959 - protein, 18 aa, Mycobacterium
LRAIPWVLAWSQSRVMLP

SEQ ID NO: 885960 - protein, 17 aa, Mycobacterium
LRALTGAGGAYAAAEAA

SEQ ID NO: 885961 - protein, 17 aa, Mycobacterium
LRALVRLVIYWGQEALA

SEQ ID NO: 885962 - protein, 19 aa, Mycobacterium
LRAMQFLRGGRRWLLKSPQ

SEQ ID NO: 885963 - protein, 25 aa, Mycobacterium
LRARGARRLVIAPWFLAPGLITDGV

SEQ ID NO: 885964 - protein, 19 aa, Mycobacterium
LRARHFVRWLTIWNDTVDA

SEQ ID NO: 885965 - protein, 25 aa, Mycobacterium
LRAVAAFRLALPRTMLRFAGGREIT

SEQ ID NO: 885966 - protein, 19 aa, Mycobacterium
LRCWFAEPPGWLEHRIKEH

SEQ ID NO: 885967 - protein, 20 aa, Mycobacterium
LRDDPRIRRFAETELRALLA

SEQ ID NO: 885968 - protein, 23 aa, Mycobacterium
LRDGRWYWHWDPAFMTKPGDDPE

SEQ ID NO: 885969 - protein, 21 aa, Mycobacterium
LRDHSWGPRSWQAPWFCRWMH

SEQ ID NO: 885970 - protein, 24 aa, Mycobacterium
LRDKIPLVMLLEGAGFRPGGGHYG

SEQ ID NO: 885971 - protein, 23 aa, Mycobacterium
LRDKIPLVMLLEGAGFRPTGGHY

SEQ ID NO: 885972 - protein, 23 aa, Mycobacterium
LRDKIPLVMLLEGAGFRPTGTHY

SEQ ID NO: 885973 - protein, 21 aa, Mycobacterium
LRDLLKFDFYFADSAAFHQNV

SEQ ID NO: 885974 - protein, 18 aa, Mycobacterium
LRDLYPGLPLLLLTAKDS

SEQ ID NO: 885975 - protein, 21 aa, Mycobacterium
LRDPLLQFGRPLDVDARAAVV

SEQ ID NO: 885976 - protein, 18 aa, Mycobacterium
LRDRFLFSLLAASGLRVG

SEQ ID NO: 885977 - protein, 18 aa, Mycobacterium
LRDRFLLALLYDAGMRIG

SEQ ID NO: 885978 - protein, 23 aa, Mycobacterium
LRDRHPAWRLLRAGNASLVLSFL

SEQ ID NO: 885979 - protein, 18 aa, Mycobacterium
LRDRLIVEMLYATGIRVS

SEQ ID NO: 885980 - protein, 20 aa, Mycobacterium
LRDRVPMVMLLEGAGFRPSG

SEQ ID NO: 885981 - protein, 23 aa, Mycobacterium
LRDTWAIREVPLHILLDGADLRD

SEQ ID NO: 885982 - protein, 20 aa, Mycobacterium
LRDWRQWWTWVPGACWKHPK

SEQ ID NO: 885983 - protein, 30 aa, Mycobacterium
LREAPILALGIWRWGLGEIPYRQLEHRLGP

SEQ ID NO: 885984 - protein, 17 aa, Mycobacterium
LREGDGVHWWTWAGARA

SEQ ID NO: 885985 - protein, 19 aa, Mycobacterium
LREHLGIDRWLLYGGSWAS

SEQ ID NO: 885986 - protein, 18 aa, Mycobacterium
LRELLAPVRYHHVVVAVR

SEQ ID NO: 885987 - protein, 17 aa, Mycobacterium
LREWLRRGGKPARLIDI

SEQ ID NO: 885988 - protein, 17 aa, Mycobacterium
LRFLKFLRESIFPGGEV

SEQ ID NO: 885989 - protein, 19 aa, Mycobacterium
LRFPHHPLMLARFGTPTVL

SEQ ID NO: 885990 - protein, 17 aa, Mycobacterium
LRFRLRWRDFRVTIDVN

SEQ ID NO: 885991 - protein, 22 aa, Mycobacterium
LRGRFRWWGLYTQREQGYDGTF

SEQ ID NO: 885992 - protein, 18 aa, Mycobacterium
LRGWEVLWLAQRAATRAT

SEQ ID NO: 885993 - protein, 19 aa, Mycobacterium
LRHLSLWWTWTPGASWRHP

SEQ ID NO: 885994 - protein, 23 aa, Mycobacterium
LRHPRWWFDLLTTEPLAFASLDR

SEQ ID NO: 885995 - protein, 18 aa, Mycobacterium
LRHRGLHARWLSWDDPET

SEQ ID NO: 885996 - protein, 20 aa, Mycobacterium
LRILWEELLPRFEKIEVIGE

SEQ ID NO: 885997 - protein, 19 aa, Mycobacterium
LRIVDNVRYFATLYGFDGR

SEQ ID NO: 885998 - protein, 25 aa, Mycobacterium
LRKGERLLVFLPLAHVLARSLSMSA

SEQ ID NO: 885999 - protein, 25 aa, Mycobacterium
LRKGQWGAPLLFYLDAGIPPLSALA

SEQ ID NO: 886000 - protein, 21 aa, Mycobacterium
LRKIFGKVGVVFKGSGFYRTD

SEQ ID NO: 886001 - protein, 17 aa, Mycobacterium
LRKLLPQEWLRFGWFFL

SEQ ID NO: 886002 - protein, 17 aa, Mycobacterium
LRLEGSAVFRWAAFEMG

SEQ ID NO: 886003 - protein, 18 aa, Mycobacterium
LRLEGSAVFRWAAFEMGK

SEQ ID NO: 886004 - protein, 18 aa, Mycobacterium
LRLEGTAVFRWAAFEMGK

SEQ ID NO: 886005 - protein, 17 aa, Mycobacterium
LRLGIARALIVASPDDR

SEQ ID NO: 886006 - protein, 19 aa, Mycobacterium
LRLGLDIMLIGVWNAFQVA

SEQ ID NO: 886007 - protein, 18 aa, Mycobacterium
LRLGVPWYAYDTVTFRGE

SEQ ID NO: 886008 - protein, 19 aa, Mycobacterium
LRLLRSLRAFRRSPLFSPD

SEQ ID NO: 886009 - protein, 25 aa, Mycobacterium
LRLPAVTRSLLLYRYRRLLEAQRAA

SEQ ID NO: 886010 - protein, 22 aa, Mycobacterium
LRLQHLVPEWLWLLGRRVVNAD

SEQ ID NO: 886011 - protein, 17 aa, Mycobacterium
LRLTLTQAAWRLSEDLP

SEQ ID NO: 886012 - protein, 21 aa, Mycobacterium
LRMEADWEAAYLLALRAAWQA

SEQ ID NO: 886013 - protein, 19 aa, Mycobacterium
LRMYSGPGSAPLLAAVAAW

SEQ ID NO: 886014 - protein, 33 aa, Mycobacterium
LRNEAIIVVPRWWKALWYLERLSPALSMRTAAV

SEQ ID NO: 886015 - protein, 19 aa, Mycobacterium
LRNEWLFGQSWGIDVAVST

SEQ ID NO: 886016 - protein, 19 aa, Mycobacterium
LRNLYLLPSSPLQELRNQL

SEQ ID NO: 886017 - protein, 20 aa, Mycobacterium
LRNMAFYNFGLRLLRHVREA

SEQ ID NO: 886018 - protein, 20 aa, Mycobacterium
LRNMAFYNFPLRLLKRTRDA

SEQ ID NO: 886019 - protein, 23 aa, Mycobacterium
LRNPIVERLILPWFGYEMWGYMH

SEQ ID NO: 886020 - protein, 17 aa, Mycobacterium
LRNRALLELLYSTGARI

SEQ ID NO: 886021 - protein, 19 aa, Mycobacterium
LRNRALLELLYSTGARISE

SEQ ID NO: 886022 - protein, 18 aa, Mycobacterium
LRPHLLAVAYRLTGTYAD

SEQ ID NO: 886023 - protein, 17 aa, Mycobacterium
LRPLPPYTGPPDALGAL

SEQ ID NO: 886024 - protein, 21 aa, Mycobacterium
LRPLRAPRWLPTPARRRARAA

SEQ ID NO: 886025 - protein, 18 aa, Mycobacterium
LRPQLILLDVYLPDMTGL

SEQ ID NO: 886026 - protein, 18 aa, Mycobacterium
LRPVFAYWGWHAVTTEEP

SEQ ID NO: 886027 - protein, 27 aa, Mycobacterium
LRPVLFSTFLMWVLADLFTFLPEVGDL

SEQ ID NO: 886028 - protein, 27 aa, Mycobacterium
LRPVLFSTFLMWVLADLFTYLPEVGDL

SEQ ID NO: 886029 - protein, 22 aa, Mycobacterium
LRQGKFLASRLLPWARSGHLAA

SEQ ID NO: 886030 - protein, 17 aa, Mycobacterium
LRQKVVMPTLPTAAPRW

SEQ ID NO: 886031 - protein, 25 aa, Mycobacterium
LRQLRTDYLDLLFLHVWDFATPVEE

SEQ ID NO: 886032 - protein, 19 aa, Mycobacterium
LRQPVRFYDSIKVLLAAAE

SEQ ID NO: 886033 - protein, 18 aa, Mycobacterium
LRQRGVLVLVGLGAQPGP

SEQ ID NO: 886034 - protein, 17 aa, Mycobacterium
LRQTIPELPWLSRKRIQ

SEQ ID NO: 886035 - protein, 19 aa, Mycobacterium
LRREAPISFWPPIELAGLT

SEQ ID NO: 886036 - protein, 26 aa, Mycobacterium
LRREAPVSFWPALELPGFTGGAGHWA

SEQ ID NO: 886037 - protein, 18 aa, Mycobacterium
LRRFSLLDSLYMIPPPRI

SEQ ID NO: 886038 - protein, 17 aa, Mycobacterium
LRRGQTLIGFLAPRNAD

SEQ ID NO: 886039 - protein, 23 aa, Mycobacterium
LRRNYKVLLCYGDPAWFSATLGA

SEQ ID NO: 886040 - protein, 24 aa, Mycobacterium
LRRPDLLVSLLTYWQHHPALSYLF

SEQ ID NO: 886041 - protein, 19 aa, Mycobacterium
LRRPDLLVSLLTYWQRHPA

SEQ ID NO: 886042 - protein, 27 aa, Mycobacterium
LRRRRGILRLRVLLCLRALAAGARAQT

SEQ ID NO: 886043 - protein, 22 aa, Mycobacterium
LRRRRMVVLPWLTPTIASWWVG

SEQ ID NO: 886044 - protein, 23 aa, Mycobacterium
LRRRWLNPEFYLFRHGLRLDEVT

SEQ ID NO: 886045 - protein, 18 aa, Mycobacterium
LRRSLIAMRSKRYFRLLD

SEQ ID NO: 886046 - protein, 18 aa, Mycobacterium
LRRVAHEVGFFYLVGHGV

SEQ ID NO: 886047 - protein, 23 aa, Mycobacterium
LRRYRMWCRLLRAGALLATGHDL

SEQ ID NO: 886048 - protein, 20 aa, Mycobacterium
LRSELKMLPALPVAELRAQA

SEQ ID NO: 886049 - protein, 24 aa, Mycobacterium
LRSKIPLVMLLEGAGFRAAAGEHY

SEQ ID NO: 886050 - protein, 22 aa, Mycobacterium
LRSTFVYLGWLCGAPADPAALR

SEQ ID NO: 886051 - protein, 25 aa, Mycobacterium
LRSWYILYFQLPWLPERSASWVPRL

SEQ ID NO: 886052 - protein, 28 aa, Mycobacterium
LRTEIDNWRWAGVPIFLRAGKALPERVT

SEQ ID NO: 886053 - protein, 26 aa, Mycobacterium
LRTENSVMFVIPWGSHWIIGTTDTDW

SEQ ID NO: 886054 - protein, 19 aa, Mycobacterium
LRTPVRRFVLFSSITGLLG

SEQ ID NO: 886055 - protein, 27 aa, Mycobacterium
LRVLQDLYARWPFFRTVLSNMAQVLAK

SEQ ID NO: 886056 - protein, 19 aa, Mycobacterium
LRYFVKRYTLKRGALAFGK

SEQ ID NO: 886057 - protein, 19 aa, Mycobacterium
LRYFWPQLVGDTRWELIDS

SEQ ID NO: 886058 - protein, 22 aa, Mycobacterium
LSADGIAALIRRLPRPLVVVDE

SEQ ID NO: 886059 - protein, 18 aa, Mycobacterium
LSALAWTVYSLPGAPAVD

SEQ ID NO: 886060 - protein, 25 aa, Mycobacterium
LSALKRPWFPIIPTQDWNALINTWG

SEQ ID NO: 886061 - protein, 27 aa, Mycobacterium
LSAQIARFHDQFVRSLSGAAQTYASAE

SEQ ID NO: 886062 - protein, 23 aa, Mycobacterium
LSARPRMLFDYFQQLFAQVTNPP

SEQ ID NO: 886063 - protein, 23 aa, Mycobacterium
LSCGPYRFVYRKRFHKKCETELT

SEQ ID NO: 886064 - protein, 24 aa, Mycobacterium
LSCQIVTWRFWAAKLGISVDDISA

SEQ ID NO: 886065 - protein, 25 aa, Mycobacterium
LSDGTLRYLLWAAALLTPRPPQLLV

SEQ ID NO: 886066 - protein, 26 aa, Mycobacterium
LSDLELYLFFSLLFSAGAETTRNAVG

SEQ ID NO: 886067 - protein, 22 aa, Mycobacterium
LSDLLWSFAPPPRRRPATLSEI

SEQ ID NO: 886068 - protein, 28 aa, Mycobacterium
LSDNFVTYLGWLYSWGSPLTLIGDDVDQ

SEQ ID NO: 886069 - protein, 18 aa, Mycobacterium
LSDRLWSARLLADAPREI

SEQ ID NO: 886070 - protein, 24 aa, Mycobacterium
LSEIRHWLMVFAQRFYSFSQFKRS

SEQ ID NO: 886071 - protein, 24 aa, Mycobacterium
LSEYPYLVPLIDREIRRPTYVFAA

SEQ ID NO: 886072 - protein, 28 aa, Mycobacterium
LSFASLVFYSAWFKLHHPAAFCAALLRA

SEQ ID NO: 886073 - protein, 28 aa, Mycobacterium
LSFASLVFYSSWFKLHHPAAFCAALLRA

SEQ ID NO: 886074 - protein, 19 aa, Mycobacterium
LSFHLGYHGLPIPGLLPGF

SEQ ID NO: 886075 - protein, 18 aa, Mycobacterium
LSFPFLREKIHGRSNPRI

SEQ ID NO: 886076 - protein, 20 aa, Mycobacterium
LSFQLLWYPVVTADLSLPSF

SEQ ID NO: 886077 - protein, 25 aa, Mycobacterium
LSGAIRLIYPRESLWRPPVLTMSAV

SEQ ID NO: 886078 - protein, 24 aa, Mycobacterium
LSGALRLIYPHDTLWRPPVLTMSA

SEQ ID NO: 886079 - protein, 23 aa, Mycobacterium
LSGPYLAGVQRWCPPRRWVDIGT

SEQ ID NO: 886080 - protein, 27 aa, Mycobacterium
LSGSRKIRWLIKATLPYAPRKFFAAVE

SEQ ID NO: 886081 - protein, 22 aa, Mycobacterium
LSIGSFRFWFIGQRWEWSDEVA

SEQ ID NO: 886082 - protein, 17 aa, Mycobacterium
LSIIFDGGVGGAGGAAG

SEQ ID NO: 886083 - protein, 18 aa, Mycobacterium
LSLDDACLLMFPRRDLTA

SEQ ID NO: 886084 - protein, 18 aa, Mycobacterium
LSLKLIDPPPSLSRARRE

SEQ ID NO: 886085 - protein, 22 aa, Mycobacterium
LSLPALQLLISSLPKFLNLEKG

SEQ ID NO: 886086 - protein, 17 aa, Mycobacterium
LSLPLLIGFPTAIDGRV

SEQ ID NO: 886087 - protein, 18 aa, Mycobacterium
LSMLRRIGHYRWFAAIFK

SEQ ID NO: 886088 - protein, 19 aa, Mycobacterium
LSPLAFLDSLGTNGSLTRA

SEQ ID NO: 886089 - protein, 20 aa, Mycobacterium
LSRAYPYCPLALALTDGTEL

SEQ ID NO: 886090 - protein, 18 aa, Mycobacterium
LSRFPELVAAAPKGLFLT

SEQ ID NO: 886091 - protein, 23 aa, Mycobacterium
LSRPTFYFYFKSKDAVLLSLLEP

SEQ ID NO: 886092 - protein, 21 aa, Mycobacterium
LSRRGWLNLPDWPPAMPSLVL

SEQ ID NO: 886093 - protein, 18 aa, Mycobacterium
LSRRRIFVPILRVTAIEP

SEQ ID NO: 886094 - protein, 26 aa, Mycobacterium
LSRRRPELSWFPWLSRHLRDAEPGRA

SEQ ID NO: 886095 - protein, 20 aa, Mycobacterium
LSRTPVHEAFLRLAAEDLLE

SEQ ID NO: 886096 - protein, 18 aa, Mycobacterium
LSSLARWGFTLQGGYAAA

SEQ ID NO: 886097 - protein, 18 aa, Mycobacterium
LSSRFSMWMAWGPELTFF

SEQ ID NO: 886098 - protein, 19 aa, Mycobacterium
LSTLFFHGFIDRGLTDWAG

SEQ ID NO: 886099 - protein, 26 aa, Mycobacterium
LSTRLFQFMPRRLLLPLLKSQHPGLK

SEQ ID NO: 886100 - protein, 18 aa, Mycobacterium
LSVDQLLGSGWKGGAGSA

SEQ ID NO: 886101 - protein, 27 aa, Mycobacterium
LSVINAPTEALLGRPLIGDGANGSAPG

SEQ ID NO: 886102 - protein, 30 aa, Mycobacterium
LSVQAGQFHQWFTQTLSGAGLSYASAEAAN

SEQ ID NO: 886103 - protein, 21 aa, Mycobacterium
LSWFDHVFFVSAWWGWQDHFR

SEQ ID NO: 886104 - protein, 22 aa, Mycobacterium
LSYLGFTQWALLTDPPPELATA

SEQ ID NO: 886105 - protein, 21 aa, Mycobacterium
LTADPRLIGFLLRFARNSTAS

SEQ ID NO: 886106 - protein, 19 aa, Mycobacterium
LTAKLRAHWARRLPPTIVG

SEQ ID NO: 886107 - protein, 18 aa, Mycobacterium
LTALWALIGYRIPTPIPR

SEQ ID NO: 886108 - protein, 25 aa, Mycobacterium
LTAPSTRQWLFPSPLLRARQARGHL

SEQ ID NO: 886109 - protein, 26 aa, Mycobacterium
LTDEAIFSFLRLLLPAGLETTYRSSG

SEQ ID NO: 886110 - protein, 26 aa, Mycobacterium
LTDLELYLFFSLLFSAGAETTRNAVA

SEQ ID NO: 886111 - protein, 25 aa, Mycobacterium
LTDLRRGVVFLPFHYGYWDTGDDGG

SEQ ID NO: 886112 - protein, 20 aa, Mycobacterium
LTDRVLLAFGLHQALRLGKP

SEQ ID NO: 886113 - protein, 19 aa, Mycobacterium
LTEFRLLSFLVLHAGQAFT

SEQ ID NO: 886114 - protein, 18 aa, Mycobacterium
LTERPDLFPAWDSLSDTQ

SEQ ID NO: 886115 - protein, 20 aa, Mycobacterium
LTETQLWQLAFRLVCDFDGD

SEQ ID NO: 886116 - protein, 18 aa, Mycobacterium
LTFAGRLWSRIVAEVGRD

SEQ ID NO: 886117 - protein, 20 aa, Mycobacterium
LTFLAVRRWYGWSAGRIINL

SEQ ID NO: 886118 - protein, 18 aa, Mycobacterium
LTFRLTGRWVGSQMNAVC

SEQ ID NO: 886119 - protein, 25 aa, Mycobacterium
LTGALLYIPLLTRMLMNLNAMGLSE

SEQ ID NO: 886120 - protein, 23 aa, Mycobacterium
LTGPATFAALTAGAAVAAIHSRV

SEQ ID NO: 886121 - protein, 20 aa, Mycobacterium
LTGRPLIGNGLPGSAGSGVA

SEQ ID NO: 886122 - protein, 19 aa, Mycobacterium
LTHKLYFFELSTSPSVIWV

SEQ ID NO: 886123 - protein, 24 aa, Mycobacterium
LTHTFGLARWRDAFWALADQGESG

SEQ ID NO: 886124 - protein, 24 aa, Mycobacterium
LTHTRRMHLLAQFLFRGDRIHLPV

SEQ ID NO: 886125 - protein, 18 aa, Mycobacterium
LTIGFFLHIPFPPVELFM

SEQ ID NO: 886126 - protein, 25 aa, Mycobacterium
LTIHDYLWRWDTDWFWCSRAFGAQN

SEQ ID NO: 886127 - protein, 19 aa, Mycobacterium
LTLAPPVAAAWNPLVDSLS

SEQ ID NO: 886128 - protein, 19 aa, Mycobacterium
LTLPAKFRDSLAGGLMVTK

SEQ ID NO: 886129 - protein, 22 aa, Mycobacterium
LTLPDLELIFAPAPFFDEGIGV

SEQ ID NO: 886130 - protein, 18 aa, Mycobacterium
LTLRVPPLRLCTDNGAMI

SEQ ID NO: 886131 - protein, 17 aa, Mycobacterium
LTLSWLLRNLSSRHPRS

SEQ ID NO: 886132 - protein, 21 aa, Mycobacterium
LTLTQLWRSYGVQPDLVIGHS

SEQ ID NO: 886133 - protein, 17 aa, Mycobacterium
LTMFLVPLDSPGITMRR

SEQ ID NO: 886134 - protein, 17 aa, Mycobacterium
LTNSFFFGYGENAGVVA

SEQ ID NO: 886135 - protein, 21 aa, Mycobacterium
LTPLEFAYFVIQLMVAGNETS

SEQ ID NO: 886136 - protein, 19 aa, Mycobacterium
LTPQLLLNTYNLRGLAEQG

SEQ ID NO: 886137 - protein, 20 aa, Mycobacterium
LTQILAWDLPLTKKIGDLLA

SEQ ID NO: 886138 - protein, 17 aa, Mycobacterium
LTRAALPAMRRQRDGHI

SEQ ID NO: 886139 - protein, 25 aa, Mycobacterium
LTRALSFLPTFPFPKETLTNWMRGD

SEQ ID NO: 886140 - protein, 21 aa, Mycobacterium
LTRFQLLLAAFTWSLYGVTGR

SEQ ID NO: 886141 - protein, 21 aa, Mycobacterium
LTRISALLDLLGSPQLSYPSI

SEQ ID NO: 886142 - protein, 17 aa, Mycobacterium
LTRRRIFVPILRVTAIE

SEQ ID NO: 886143 - protein, 20 aa, Mycobacterium
LTRRYAIFVVSPLRINPWAL

SEQ ID NO: 886144 - protein, 20 aa, Mycobacterium
LTRVRELIDRYPLRGIKGPM

SEQ ID NO: 886145 - protein, 22 aa, Mycobacterium
LTSDDFPVLWPVGTRWADNDMF

SEQ ID NO: 886146 - protein, 17 aa, Mycobacterium
LTTLFPPVRPRQWLEIR

SEQ ID NO: 886147 - protein, 23 aa, Mycobacterium
LTTYLRTLPADGWLRVLCSTNQI

SEQ ID NO: 886148 - protein, 21 aa, Mycobacterium
LTVFGALRLIQGFTPALEESK

SEQ ID NO: 886149 - protein, 19 aa, Mycobacterium
LTVLALRDGVIPPTLNLDN

SEQ ID NO: 886150 - protein, 23 aa, Mycobacterium
LTVPLIAVILRRGYGLGAQAMCG

SEQ ID NO: 886151 - protein, 18 aa, Mycobacterium
LTVPPPALVTGAVVIGAP

SEQ ID NO: 886152 - protein, 17 aa, Mycobacterium
LTVQVRIPLIGGKLERM

SEQ ID NO: 886153 - protein, 24 aa, Mycobacterium
LTVVLKLFSIVRPDRAYFGEKDYQ

SEQ ID NO: 886154 - protein, 21 aa, Mycobacterium
LTVVLKLLQIVRPDRAYFGEK

SEQ ID NO: 886155 - protein, 17 aa, Mycobacterium
LTWPLHISLLLAKEYAL

SEQ ID NO: 886156 - protein, 17 aa, Mycobacterium
LTYNIAGLPFPLSSAML

SEQ ID NO: 886157 - protein, 20 aa, Mycobacterium
LVAAVYLRFLRELPLHTDVN

SEQ ID NO: 886158 - protein, 22 aa, Mycobacterium
LVAAVYLRLLRDLPLHTDVNDT

SEQ ID NO: 886159 - protein, 19 aa, Mycobacterium
LVAERWPTVQEWALLGEEH

SEQ ID NO: 886160 - protein, 20 aa, Mycobacterium
LVARIPPRWGSLTRELLAVN

SEQ ID NO: 886161 - protein, 20 aa, Mycobacterium
LVARLRALLRRRGAGSGGLA

SEQ ID NO: 886162 - protein, 17 aa, Mycobacterium
LVAWADIYDAHAAVFAE

SEQ ID NO: 886163 - protein, 23 aa, Mycobacterium
LVDDRWVWLPTVLDGRVFTHRLS

SEQ ID NO: 886164 - protein, 17 aa, Mycobacterium
LVDFWATWCGPCKMVAP

SEQ ID NO: 886165 - protein, 19 aa, Mycobacterium
LVDGALAWFLERGGRTLLT

SEQ ID NO: 886166 - protein, 17 aa, Mycobacterium
LVDGGLNLKWGHLGADN

SEQ ID NO: 886167 - protein, 25 aa, Mycobacterium
LVDGIPFKWWEKLGIIPPGWVARDA

SEQ ID NO: 886168 - protein, 18 aa, Mycobacterium
LVDLLWRMGIRTIGAFAE

SEQ ID NO: 886169 - protein, 24 aa, Mycobacterium
LVDSNYLHVYTWLRAFDAEGLPVT

SEQ ID NO: 886170 - protein, 19 aa, Mycobacterium
LVEILGALRLGPVAPVGSE

SEQ ID NO: 886171 - protein, 21 aa, Mycobacterium
LVENFLWMTFGLPAEPYHADP

SEQ ID NO: 886172 - protein, 17 aa, Mycobacterium
LVERVPWLSVIPAYFVG

SEQ ID NO: 886173 - protein, 19 aa, Mycobacterium
LVEWGLPPLAVLRAATTTA

SEQ ID NO: 886174 - protein, 20 aa, Mycobacterium
LVEWMSPLLIAYLEAGVEIP

SEQ ID NO: 886175 - protein, 17 aa, Mycobacterium
LVEYVIMGQVLTAGAGQ

SEQ ID NO: 886176 - protein, 17 aa, Mycobacterium
LVFFFDEAHLLFADASK

SEQ ID NO: 886177 - protein, 17 aa, Mycobacterium
LVFFPGDGSLVLGTDAP

SEQ ID NO: 886178 - protein, 17 aa, Mycobacterium
LVFSPFTPYLRSRGVPP

SEQ ID NO: 886179 - protein, 17 aa, Mycobacterium
LVGILRENDFRAGAIDT

SEQ ID NO: 886180 - protein, 21 aa, Mycobacterium
LVGLARYPLPMAPVAAAEQAG

SEQ ID NO: 886181 - protein, 17 aa, Mycobacterium
LVGLYPTSDGRYISFVM

SEQ ID NO: 886182 - protein, 22 aa, Mycobacterium
LVGPFDVFTGAALWLAGQGREQ

SEQ ID NO: 886183 - protein, 20 aa, Mycobacterium
LVGRYWAIDEIKPARLHGNL

SEQ ID NO: 886184 - protein, 18 aa, Mycobacterium
LVGSSLPWLLPRTLHDLE

SEQ ID NO: 886185 - protein, 23 aa, Mycobacterium
LVGTSRVLLSLRPDLRMPIVETT

SEQ ID NO: 886186 - protein, 17 aa, Mycobacterium
LVHLPRGFRWLWGQTRC

SEQ ID NO: 886187 - protein, 18 aa, Mycobacterium
LVHSLHGYFLRPGNPNEP

SEQ ID NO: 886188 - protein, 24 aa, Mycobacterium
LVHVYLRRALISAELWPVALKEID

SEQ ID NO: 886189 - protein, 23 aa, Mycobacterium
LVHVYLRRALTSTELWPVSLQEV

SEQ ID NO: 886190 - protein, 20 aa, Mycobacterium
LVIGWWAVPTILEHGSPEQI

SEQ ID NO: 886191 - protein, 19 aa, Mycobacterium
LVILARYMQILSPAFLDAI

SEQ ID NO: 886192 - protein, 17 aa, Mycobacterium
LVILIAYGTMSDAEARA

SEQ ID NO: 886193 - protein, 19 aa, Mycobacterium
LVILLHGFGSFWWSWRHQL

SEQ ID NO: 886194 - protein, 20 aa, Mycobacterium
LVILLHGFGSFWWSWRHQLT

SEQ ID NO: 886195 - protein, 21 aa, Mycobacterium
LVKICRLIMLYHLDRAWADHL

SEQ ID NO: 886196 - protein, 18 aa, Mycobacterium
LVKLIWRMFRARVFGDRM

SEQ ID NO: 886197 - protein, 25 aa, Mycobacterium
LVKLRRYFDHPLFVEMFADAVAAAA

SEQ ID NO: 886198 - protein, 23 aa, Mycobacterium
LVLCPSGLDFLAGFFGCVYAGAA

SEQ ID NO: 886199 - protein, 31 aa, Mycobacterium
LVLDDLHWAAKPTLLLLRHLLRFGEHARMQI

SEQ ID NO: 886200 - protein, 19 aa, Mycobacterium
LVLDGWLRPVPPGVVGELY

SEQ ID NO: 886201 - protein, 18 aa, Mycobacterium
LVLGSWTLLGLLDRAVDL

SEQ ID NO: 886202 - protein, 21 aa, Mycobacterium
LVLKPWTMPEPLLPVAIQAHA

SEQ ID NO: 886203 - protein, 27 aa, Mycobacterium
LVLLLHGFGSFWWSWRHQLGALPGARV

SEQ ID NO: 886204 - protein, 17 aa, Mycobacterium
LVLLQQFHDILPGSSIA

SEQ ID NO: 886205 - protein, 18 aa, Mycobacterium
LVLPMWQRLEPVWGPARD

SEQ ID NO: 886206 - protein, 19 aa, Mycobacterium
LVLRINFLGMRQFTESLLD

SEQ ID NO: 886207 - protein, 17 aa, Mycobacterium
LVMPFFTAPAVAAMEPQ

SEQ ID NO: 886208 - protein, 26 aa, Mycobacterium
LVNPHPMFVPWLVGPLLTREGIHLVK

SEQ ID NO: 886209 - protein, 24 aa, Mycobacterium
LVNPNPMFVPWLVGPLLTGEGIHL

SEQ ID NO: 886210 - protein, 20 aa, Mycobacterium
LVNVLPLQNVEQDLLNLVNA

SEQ ID NO: 886211 - protein, 17 aa, Mycobacterium
LVPALRSLSARTAVPTS

SEQ ID NO: 886212 - protein, 20 aa, Mycobacterium
LVPGPLQWLRPLAPAFEPTR

SEQ ID NO: 886213 - protein, 21 aa, Mycobacterium
LVPQHLMRRLFFTAATVDAAT

SEQ ID NO: 886214 - protein, 17 aa, Mycobacterium
LVPSPLYDSLLAKVITH

SEQ ID NO: 886215 - protein, 18 aa, Mycobacterium
LVPTFLVVLRREPGQHLG

SEQ ID NO: 886216 - protein, 18 aa, Mycobacterium
LVQLVLTNLFGQNAPAIA

SEQ ID NO: 886217 - protein, 18 aa, Mycobacterium
LVQRIPGMRAKLFDAARL

SEQ ID NO: 886218 - protein, 19 aa, Mycobacterium
LVRAPLWVISVTVLGDLGG

SEQ ID NO: 886219 - protein, 17 aa, Mycobacterium
LVRRRNLPIMFPLEVRF

SEQ ID NO: 886220 - protein, 25 aa, Mycobacterium
LVRWRHPVWGLLLPDSFIGIAESTN

SEQ ID NO: 886221 - protein, 19 aa, Mycobacterium
LVSALWWVQWRITKSPEDA

SEQ ID NO: 886222 - protein, 20 aa, Mycobacterium
LVSFEVFLRPALRAAMGLTD

SEQ ID NO: 886223 - protein, 18 aa, Mycobacterium
LVSLLTYWQRHPALSYLF

SEQ ID NO: 886224 - protein, 21 aa, Mycobacterium
LVSMFAPITRWAAGIPTPRAI

SEQ ID NO: 886225 - protein, 17 aa, Mycobacterium
LVSYVRGVLYFRTKRWP

SEQ ID NO: 886226 - protein, 24 aa, Mycobacterium
LVSYVRGVLYFRTKRWPDVLAQFP

SEQ ID NO: 886227 - protein, 22 aa, Mycobacterium
LVTDWLLNWSLTKYIPVTCVVT

SEQ ID NO: 886228 - protein, 17 aa, Mycobacterium
LVTLVEWGLPPLAVLRA

SEQ ID NO: 886229 - protein, 18 aa, Mycobacterium
LVTLVHWGMSPMAVLRAA

SEQ ID NO: 886230 - protein, 23 aa, Mycobacterium
LVTNVLLAPLYPAALLAKQLASV

SEQ ID NO: 886231 - protein, 23 aa, Mycobacterium
LVVLARYMQILSPAFLAAIGCPL

SEQ ID NO: 886232 - protein, 17 aa, Mycobacterium
LVVLERFPVPVLAIAED

SEQ ID NO: 886233 - protein, 17 aa, Mycobacterium
LVVLRREPGQHLGGLRV

SEQ ID NO: 886234 - protein, 18 aa, Mycobacterium
LVVRGFFGELIQKIAVPA

SEQ ID NO: 886235 - protein, 17 aa, Mycobacterium
LVVSHILHLLLTGKLRT

SEQ ID NO: 886236 - protein, 24 aa, Mycobacterium
LVVSPAMLLLWIRGVRFLYSLDPY

SEQ ID NO: 886237 - protein, 26 aa, Mycobacterium
LVVVRPIGFEPMRWIRALAAEEPLPS

SEQ ID NO: 886238 - protein, 17 aa, Mycobacterium
LVWGALTPRIISLDVEY

SEQ ID NO: 886239 - protein, 17 aa, Mycobacterium
LVWLPMVDALKKLSYAH

SEQ ID NO: 886240 - protein, 17 aa, Mycobacterium
LVWNILLAARNEGYGGT

SEQ ID NO: 886241 - protein, 18 aa, Mycobacterium
LVYDGLWFSPLKSALESF

SEQ ID NO: 886242 - protein, 17 aa, Mycobacterium
LVYLLADSGFEVHIDLP

SEQ ID NO: 886243 - protein, 17 aa, Mycobacterium
LWAFRISGAQASVGTQI

SEQ ID NO: 886244 - protein, 19 aa, Mycobacterium
LWALTFLRRRGVSASAVLL

SEQ ID NO: 886245 - protein, 17 aa, Mycobacterium
LWDTILPFAGYAFNKSH

SEQ ID NO: 886246 - protein, 18 aa, Mycobacterium
LWFLHQLSGPSPVYNMAV

SEQ ID NO: 886247 - protein, 18 aa, Mycobacterium
LWFNRILPFARNLQAGEP

SEQ ID NO: 886248 - protein, 17 aa, Mycobacterium
LWQLKRALPGPFTRTLG

SEQ ID NO: 886249 - protein, 17 aa, Mycobacterium
LWQLKRTMPGTFTHAMG

SEQ ID NO: 886250 - protein, 17 aa, Mycobacterium
LWQVPYLPIDPKDVGRN

SEQ ID NO: 886251 - protein, 18 aa, Mycobacterium
LWQVYGVDRPALKDPTFV

SEQ ID NO: 886252 - protein, 19 aa, Mycobacterium
LWQYWRDQLAGELPKLGLA

SEQ ID NO: 886253 - protein, 19 aa, Mycobacterium
LWRNLLKCRARIDDNGSVQ

SEQ ID NO: 886254 - protein, 18 aa, Mycobacterium
LWSGMTWQYWLATRRFKE

SEQ ID NO: 886255 - protein, 17 aa, Mycobacterium
LWSVWWGMQTAFPLLKD

SEQ ID NO: 886256 - protein, 29 aa, Mycobacterium
LWVTNPVPGLLRWLPRLWPSWRIEFWEDR

SEQ ID NO: 886257 - protein, 18 aa, Mycobacterium
LYCRFHGWRYKLDGSLHA

SEQ ID NO: 886258 - protein, 19 aa, Mycobacterium
LYCVVLHRFLRWRQPGYSA

SEQ ID NO: 886259 - protein, 20 aa, Mycobacterium
LYDAPELVIPFLVPDGAHSY

SEQ ID NO: 886260 - protein, 21 aa, Mycobacterium
LYDGFTFLTLAWLEALGICAD

SEQ ID NO: 886261 - protein, 17 aa, Mycobacterium
LYDLPMLWQIAAHNPWL

SEQ ID NO: 886262 - protein, 17 aa, Mycobacterium
LYGLLDRVRDLGLELVS

SEQ ID NO: 886263 - protein, 18 aa, Mycobacterium
LYGWLHYSLRRTWDYFVR

SEQ ID NO: 886264 - protein, 19 aa, Mycobacterium
LYKASWRFTPFFWQEIDEG

SEQ ID NO: 886265 - protein, 18 aa, Mycobacterium
LYKIAERLPLRAALLWSR

SEQ ID NO: 886266 - protein, 18 aa, Mycobacterium
LYLLADSQLLFWKRDGRP

SEQ ID NO: 886267 - protein, 18 aa, Mycobacterium
LYLRDLVLALQWVRDNIA

SEQ ID NO: 886268 - protein, 20 aa, Mycobacterium
LYLRDLVMALQWIQDNIAEF

SEQ ID NO: 886269 - protein, 17 aa, Mycobacterium
LYLTLTPDRIRFASSLP

SEQ ID NO: 886270 - protein, 21 aa, Mycobacterium
LYQSWAAAYLPLVRVLRTLAA

SEQ ID NO: 886271 - protein, 17 aa, Mycobacterium
LYRDLIALRRTDPDLAD

SEQ ID NO: 886272 - protein, 18 aa, Mycobacterium
LYRYFPSKVHLLVSALER

SEQ ID NO: 886273 - protein, 17 aa, Mycobacterium
LYTLWAPRWRDAGDEWE

SEQ ID NO: 886274 - protein, 23 aa, Mycobacterium
LYTPTHWKYLTSGLLGLARGTDA

SEQ ID NO: 886275 - protein, 24 aa, Mycobacterium
LYVERYMKLLAPDWALLADPSFIG

SEQ ID NO: 886276 - protein, 17 aa, Mycobacterium
LYWAPLKDFTAQRTKLT

SEQ ID NO: 886277 - protein, 20 aa, Mycobacterium
MAALANFFRIKPAYFTDDEY

SEQ ID NO: 886278 - protein, 19 aa, Mycobacterium
MAALWKLPVLFLCENNLYA

SEQ ID NO: 886279 - protein, 24 aa, Mycobacterium
MAAWVILRAIDALLLMPLPNRLDL

SEQ ID NO: 886280 - protein, 17 aa, Mycobacterium
MADFWETALFRAGLYRG

SEQ ID NO: 886281 - protein, 19 aa, Mycobacterium
MADLGFLPGVTRILAATPN

SEQ ID NO: 886282 - protein, 21 aa, Mycobacterium
MAFVRRPYRWIKQLGIEAAYG

SEQ ID NO: 886283 - protein, 28 aa, Mycobacterium
MAFVVNQLHWLIIILDSYPPVPHRLTGP

SEQ ID NO: 886284 - protein, 21 aa, Mycobacterium
MAHFFYIHFGLPTYFKNVFEG

SEQ ID NO: 886285 - protein, 22 aa, Mycobacterium
MAHFYYIHFGFPTYFKNVFEGH

SEQ ID NO: 886286 - protein, 24 aa, Mycobacterium
MAHYAPFGLLTPAAWVALHAQRYM

SEQ ID NO: 886287 - protein, 26 aa, Mycobacterium
MAHYSMGWIPLWARLAAVAPNLLNTV

SEQ ID NO: 886288 - protein, 24 aa, Mycobacterium
MAKHFLRHPRLLGALPVLRDANKI

SEQ ID NO: 886289 - protein, 18 aa, Mycobacterium
MALALRLGAYELLCSDGV

SEQ ID NO: 886290 - protein, 17 aa, Mycobacterium
MALQPFLDYAFGFRRGQ

SEQ ID NO: 886291 - protein, 20 aa, Mycobacterium
MALSLLLLSPAALNTLPGLT

SEQ ID NO: 886292 - protein, 17 aa, Mycobacterium
MAMLMLALPGAVFLYNG

SEQ ID NO: 886293 - protein, 17 aa, Mycobacterium
MAMYGLGPLAGLDGGGF

SEQ ID NO: 886294 - protein, 22 aa, Mycobacterium
MANSIWPYVAWLRATAAATEQS

SEQ ID NO: 886295 - protein, 24 aa, Mycobacterium
MAPDRPFFAYWAPGATHAPHHVAP

SEQ ID NO: 886296 - protein, 19 aa, Mycobacterium
MAPFILMPGPINRGMIYLH

SEQ ID NO: 886297 - protein, 19 aa, Mycobacterium
MAPHLWRFLLYQPVVASAG

SEQ ID NO: 886298 - protein, 26 aa, Mycobacterium
MAPICQLFHTLPIPWVEPIDISNAVL

SEQ ID NO: 886299 - protein, 18 aa, Mycobacterium
MAPLLGTSSPRRADLLSA

SEQ ID NO: 886300 - protein, 25 aa, Mycobacterium
MARFLYWGCDIWLNNPLRPLEACGT

SEQ ID NO: 886301 - protein, 17 aa, Mycobacterium
MATRTAFFDEFFLGAAD

SEQ ID NO: 886302 - protein, 18 aa, Mycobacterium
MAVGLAVWRLGAGRSVPG

SEQ ID NO: 886303 - protein, 20 aa, Mycobacterium
MAWGVGGWLLTTFLQSAGAE

SEQ ID NO: 886304 - protein, 22 aa, Mycobacterium
MAYLVKPFTVSDLVPAIELAVS

SEQ ID NO: 886305 - protein, 22 aa, Mycobacterium
MCGGRWWQPIALAAYEQNPKRT

SEQ ID NO: 886306 - protein, 18 aa, Mycobacterium
MCGMEYFGHPWEFGPRRT

SEQ ID NO: 886307 - protein, 23 aa, Mycobacterium
MDDMLWQVPYLPIDPKDVGRTYE

SEQ ID NO: 886308 - protein, 20 aa, Mycobacterium
MDEWQRLFLFSRADTIYGGS

SEQ ID NO: 886309 - protein, 25 aa, Mycobacterium
MDPPDWLDFIFVTAVPLILSSVSSC

SEQ ID NO: 886310 - protein, 23 aa, Mycobacterium
MDQAWWFPAFAPLPGGEPTVMLA

SEQ ID NO: 886311 - protein, 20 aa, Mycobacterium
MDQAWWFPAIAPLPGKAPAV

SEQ ID NO: 886312 - protein, 22 aa, Mycobacterium
MDRFHRRLLWPIRASGGEVIGF

SEQ ID NO: 886313 - protein, 17 aa, Mycobacterium
MDRYPLVSALSRPLIVK

SEQ ID NO: 886314 - protein, 26 aa, Mycobacterium
MDSVLMPIGPRRALWARLGDSLRPRH

SEQ ID NO: 886315 - protein, 17 aa, Mycobacterium
MDSWTVPLYQLVTQRQA

SEQ ID NO: 886316 - protein, 23 aa, Mycobacterium
MDTHPFAWLPMLSRVLGSAELVA

SEQ ID NO: 886317 - protein, 25 aa, Mycobacterium
MDVPIDLNLFIDLPSPIPNVTIPLG

SEQ ID NO: 886318 - protein, 19 aa, Mycobacterium
MDWPAFPALIPDPRGWTLP

SEQ ID NO: 886319 - protein, 17 aa, Mycobacterium
MDWYTVLACFKLGIILE

SEQ ID NO: 886320 - protein, 24 aa, Mycobacterium
MEHAVLHLLYSRFWHKVLYDLGHV

SEQ ID NO: 886321 - protein, 23 aa, Mycobacterium
MELLDEVILMLRRLHQPVIAAVN

SEQ ID NO: 886322 - protein, 20 aa, Mycobacterium
MELNYALFFLTQTVVRGMIA

SEQ ID NO: 886323 - protein, 20 aa, Mycobacterium
MEPSPYLPTSRRFVNPLYLR

SEQ ID NO: 886324 - protein, 17 aa, Mycobacterium
MFAGFFHGAAMVAAQGV

SEQ ID NO: 886325 - protein, 24 aa, Mycobacterium
MFGTWHYWWQAHLLDCLIDAELRD

SEQ ID NO: 886326 - protein, 20 aa, Mycobacterium
MFHAEFVRALDIGAGAYWAT

SEQ ID NO: 886327 - protein, 25 aa, Mycobacterium
MFPDEREILFPAGTKFYVIDKTLDA

SEQ ID NO: 886328 - protein, 21 aa, Mycobacterium
MFQEPALFPWLTSAANVELAL

SEQ ID NO: 886329 - protein, 19 aa, Mycobacterium
MFSILPRIPISRSPAYNLI

SEQ ID NO: 886330 - protein, 20 aa, Mycobacterium
MFTLGFRFKPWPSARSIADG

SEQ ID NO: 886331 - protein, 19 aa, Mycobacterium
MFTLGFRFKPWRSAKSIAD

SEQ ID NO: 886332 - protein, 19 aa, Mycobacterium
MFTLGFRFKPWTSAKSIAD

SEQ ID NO: 886333 - protein, 23 aa, Mycobacterium
MGCLPLFHVFGLTCGLNASVIAG

SEQ ID NO: 886334 - protein, 24 aa, Mycobacterium
MGDGYWVWLIRLASGATSVGIVAD

SEQ ID NO: 886335 - protein, 19 aa, Mycobacterium
MGEHLQLLKGWHPVASVSN

SEQ ID NO: 886336 - protein, 17 aa, Mycobacterium
MGGGDMIAALFAAIETN

SEQ ID NO: 886337 - protein, 19 aa, Mycobacterium
MGIPILYPWANRLGANTYT

SEQ ID NO: 886338 - protein, 22 aa, Mycobacterium
MGKTLAFGVPLLNRITAGVGVR

SEQ ID NO: 886339 - protein, 27 aa, Mycobacterium
MGLDHKLTLGAWFKPALYALRTARRVR

SEQ ID NO: 886340 - protein, 21 aa, Mycobacterium
MGLELWFVNFFGGGGGRFMES

SEQ ID NO: 886341 - protein, 24 aa, Mycobacterium
MGLISAYMFILLLGGSTHAMSPLD

SEQ ID NO: 886342 - protein, 17 aa, Mycobacterium
MGLVWYYANSNPAMSRV

SEQ ID NO: 886343 - protein, 21 aa, Mycobacterium
MGNVTAWRFLSPPSAFLEGLT

SEQ ID NO: 886344 - protein, 26 aa, Mycobacterium
MGSAYLFNGLFFSLPWFYRCGYDVVL

SEQ ID NO: 886345 - protein, 17 aa, Mycobacterium
MGTVPPLPGFNAALRRI

SEQ ID NO: 886346 - protein, 20 aa, Mycobacterium
MGVAWMLRPSAEGPIIVQHG

SEQ ID NO: 886347 - protein, 22 aa, Mycobacterium
MGVPPTLWQKSLLPIVRTVMKL

SEQ ID NO: 886348 - protein, 26 aa, Mycobacterium
MGVVNAPAQALLGRPLIGNGANGADG

SEQ ID NO: 886349 - protein, 17 aa, Mycobacterium
MGWLAQRGYVPLGYKGD

SEQ ID NO: 886350 - protein, 17 aa, Mycobacterium
MHIPGMKVIVPSTPRDG

SEQ ID NO: 886351 - protein, 18 aa, Mycobacterium
MHIPGMKVIVPSTPRDGK

SEQ ID NO: 886352 - protein, 18 aa, Mycobacterium
MHLLRDKQLWWRVGRKHG

SEQ ID NO: 886353 - protein, 22 aa, Mycobacterium
MHRKILLPHLSAKRVRIIEEFA

SEQ ID NO: 886354 - protein, 18 aa, Mycobacterium
MHVLGTSAYVPDLLLRAP

SEQ ID NO: 886355 - protein, 17 aa, Mycobacterium
MHVLGTSAYVPELLMKA

SEQ ID NO: 886356 - protein, 18 aa, Mycobacterium
MIADLTSFQWLGPSSAAM

SEQ ID NO: 886357 - protein, 17 aa, Mycobacterium
MIFPNLFIAEIQVFNIQ

SEQ ID NO: 886358 - protein, 18 aa, Mycobacterium
MIGPALLLLSDAGSFITG

SEQ ID NO: 886359 - protein, 17 aa, Mycobacterium
MINLFWHGLRGAPEERE

SEQ ID NO: 886360 - protein, 19 aa, Mycobacterium
MIPLFYDWLFGMMVSTAGT

SEQ ID NO: 886361 - protein, 17 aa, Mycobacterium
MIQAILSAPVDLLFNGG

SEQ ID NO: 886362 - protein, 20 aa, Mycobacterium
MIRIMVFYGEVLALAYTGQF

SEQ ID NO: 886363 - protein, 17 aa, Mycobacterium
MIRLTAGMWWVPVWLLR

SEQ ID NO: 886364 - protein, 18 aa, Mycobacterium
MISALVAMRRLSVASASR

SEQ ID NO: 886365 - protein, 17 aa, Mycobacterium
MIYYPLTTLMMAGIRDI

SEQ ID NO: 886366 - protein, 17 aa, Mycobacterium
MKDGSIDALFWSGGLPT

SEQ ID NO: 886367 - protein, 18 aa, Mycobacterium
MKILGAGFLSRFPGRVLN

SEQ ID NO: 886368 - protein, 19 aa, Mycobacterium
MKIRLSFLSGFVLDGLPGW

SEQ ID NO: 886369 - protein, 18 aa, Mycobacterium
MKLDFLITVDWDYYKKFM

SEQ ID NO: 886370 - protein, 18 aa, Mycobacterium
MKLDLLLTVPLDYYKKFM

SEQ ID NO: 886371 - protein, 24 aa, Mycobacterium
MKSEQFLHWVPVPKGLTFYISVPH

SEQ ID NO: 886372 - protein, 20 aa, Mycobacterium
MKSLHLILRHFKMPGFLVPE

SEQ ID NO: 886373 - protein, 25 aa, Mycobacterium
MLASFILLRRLLLLAWMGTHSHSKE

SEQ ID NO: 886374 - protein, 18 aa, Mycobacterium
MLAVPWIDPLDVANAALF

SEQ ID NO: 886375 - protein, 20 aa, Mycobacterium
MLDIAQWRRRRRDELAALGD

SEQ ID NO: 886376 - protein, 18 aa, Mycobacterium
MLDRLFPRSIFYSLRLAE

SEQ ID NO: 886377 - protein, 18 aa, Mycobacterium
MLELLLGAWLAQGITAAA

SEQ ID NO: 886378 - protein, 18 aa, Mycobacterium
MLFPHLYGELPARAVISV

SEQ ID NO: 886379 - protein, 18 aa, Mycobacterium
MLFSPGYPGFLRGVVAVG

SEQ ID NO: 886380 - protein, 17 aa, Mycobacterium
MLGFLLRTPLAGPARKQ

SEQ ID NO: 886381 - protein, 17 aa, Mycobacterium
MLGGIFGLSSNGANIGN

SEQ ID NO: 886382 - protein, 21 aa, Mycobacterium
MLHSPPMYRAFRPDLAEPTRE

SEQ ID NO: 886383 - protein, 23 aa, Mycobacterium
MLHSPPMYRAFRPDLKEPTRADA

SEQ ID NO: 886384 - protein, 23 aa, Mycobacterium
MLKQPLWFQRAQAAALMVADSVR

SEQ ID NO: 886385 - protein, 17 aa, Mycobacterium
MLLDRLFPRSVFYSLRL

SEQ ID NO: 886386 - protein, 19 aa, Mycobacterium
MLLVHFLRDQLRLTGTHWG

SEQ ID NO: 886387 - protein, 17 aa, Mycobacterium
MLMLIYRVDDDTAFELL

SEQ ID NO: 886388 - protein, 17 aa, Mycobacterium
MLPVARTALRRIGNDAD

SEQ ID NO: 886389 - protein, 25 aa, Mycobacterium
MLQSVQPYLLWLRETALQSAQMATS

SEQ ID NO: 886390 - protein, 17 aa, Mycobacterium
MLRLIRRYGPIMTMPIL

SEQ ID NO: 886391 - protein, 25 aa, Mycobacterium
MLRNVWRFWYQIPISLPVIGPRVIS

SEQ ID NO: 886392 - protein, 17 aa, Mycobacterium
MLRVLLYPDQMLDEAWV

SEQ ID NO: 886393 - protein, 18 aa, Mycobacterium
MLTYNIAGLPFPLSSAIL

SEQ ID NO: 886394 - protein, 17 aa, Mycobacterium
MLVLGPLGESFGRIRDV

SEQ ID NO: 886395 - protein, 17 aa, Mycobacterium
MLVPFSWQRISLHAAGA

SEQ ID NO: 886396 - protein, 19 aa, Mycobacterium
MLWQVPYLPIDPKDVGRTY

SEQ ID NO: 886397 - protein, 18 aa, Mycobacterium
MLYAFQGAFGPLIAPGFI

SEQ ID NO: 886398 - protein, 17 aa, Mycobacterium
MLYALRDTGPDADRLRV

SEQ ID NO: 886399 - protein, 18 aa, Mycobacterium
MMEMHVLAPLHLTQLAIP

SEQ ID NO: 886400 - protein, 18 aa, Mycobacterium
MMKALLDAGLLRGDCLTV

SEQ ID NO: 886401 - protein, 17 aa, Mycobacterium
MMWTTWSDQLLVGLPST

SEQ ID NO: 886402 - protein, 24 aa, Mycobacterium
MNTHGTIGFPMQSAFDAAHAARGG

SEQ ID NO: 886403 - protein, 19 aa, Mycobacterium
MPAPLFDALLDDALLDGAK

SEQ ID NO: 886404 - protein, 24 aa, Mycobacterium
MPAPPPPVLAPRRKTRQLMVGDVG

SEQ ID NO: 886405 - protein, 25 aa, Mycobacterium
MPARLLRFWFGLRNQAAYSLEDMAD

SEQ ID NO: 886406 - protein, 18 aa, Mycobacterium
MPELWRRFTITLRRTLRR

SEQ ID NO: 886407 - protein, 18 aa, Mycobacterium
MPEVWGIRLEGELPQWCS

SEQ ID NO: 886408 - protein, 19 aa, Mycobacterium
MPIKVPWSLPAARPAHTGD

SEQ ID NO: 886409 - protein, 18 aa, Mycobacterium
MPIPVRIIAALLGLPESD

SEQ ID NO: 886410 - protein, 17 aa, Mycobacterium
MPLKFRDGAHFAALDAG

SEQ ID NO: 886411 - protein, 23 aa, Mycobacterium
MPNVARSLLLYRYRRLPEARRAA

SEQ ID NO: 886412 - protein, 17 aa, Mycobacterium
MPPGHRLIAGALATEGK

SEQ ID NO: 886413 - protein, 18 aa, Mycobacterium
MPPKMLHMILPRADYQIV

SEQ ID NO: 886414 - protein, 20 aa, Mycobacterium
MPPLPVWFTGRDPVLRFLAA

SEQ ID NO: 886415 - protein, 18 aa, Mycobacterium
MPPTLLHTWFELLSPEQI

SEQ ID NO: 886416 - protein, 21 aa, Mycobacterium
MPQFGPFARSYLAGLLAGLRT

SEQ ID NO: 886417 - protein, 17 aa, Mycobacterium
MPVLRISGLTELVSVEL

SEQ ID NO: 886418 - protein, 19 aa, Mycobacterium
MPYVLKLADLGWQAACLSD

SEQ ID NO: 886419 - protein, 20 aa, Mycobacterium
MQAWLRFYRNSLHALESGTA

SEQ ID NO: 886420 - protein, 22 aa, Mycobacterium
MQLALTALWRSYGVQPDLVIGH

SEQ ID NO: 886421 - protein, 22 aa, Mycobacterium
MQLNYFSPLRLIRGFAPGMVER

SEQ ID NO: 886422 - protein, 17 aa, Mycobacterium
MQMVTPFLPDYIAEPED

SEQ ID NO: 886423 - protein, 26 aa, Mycobacterium
MRAGIPTLILWLWLDQPVWAVGVNQL

SEQ ID NO: 886424 - protein, 18 aa, Mycobacterium
MRAIGIPVYLLPGNHDPL

SEQ ID NO: 886425 - protein, 20 aa, Mycobacterium
MRAIVQAAWRRPSTGRWLVV

SEQ ID NO: 886426 - protein, 24 aa, Mycobacterium
MRIALPALLRRFPTLALAEPFEDV

SEQ ID NO: 886427 - protein, 20 aa, Mycobacterium
MRLDMPLVDFFSRGGALKSS

SEQ ID NO: 886428 - protein, 17 aa, Mycobacterium
MRLFAAGVLKPLPVRAF

SEQ ID NO: 886429 - protein, 17 aa, Mycobacterium
MRLLSQPGLDPDAHIDL

SEQ ID NO: 886430 - protein, 19 aa, Mycobacterium
MRPLLRFPHHPLMLARFGT

SEQ ID NO: 886431 - protein, 23 aa, Mycobacterium
MRRHCTMYLTYWTAGDTRNRGRE

SEQ ID NO: 886432 - protein, 21 aa, Mycobacterium
MRRTLWLVGVEDLPFIQSAAS

SEQ ID NO: 886433 - protein, 19 aa, Mycobacterium
MRVIAPHWALLTALARHAS

SEQ ID NO: 886434 - protein, 18 aa, Mycobacterium
MRVLGTSAYIPELLMRAP

SEQ ID NO: 886435 - protein, 18 aa, Mycobacterium
MRYKWRKWLYFDCNWKVA

SEQ ID NO: 886436 - protein, 18 aa, Mycobacterium
MRYLKGCQYYFIDEAIDV

SEQ ID NO: 886437 - protein, 21 aa, Mycobacterium
MSALLMAIFLRGMTGHEIARW

SEQ ID NO: 886438 - protein, 18 aa, Mycobacterium
MSDLRFLKFLRESIFPGG

SEQ ID NO: 886439 - protein, 22 aa, Mycobacterium
MSGWSLIYLGVLSKYGVAMFHG

SEQ ID NO: 886440 - protein, 20 aa, Mycobacterium
MSPAAFIRRPLRWLREMAVK

SEQ ID NO: 886441 - protein, 20 aa, Mycobacterium
MSRFFLRNALVARLLSEASW

SEQ ID NO: 886442 - protein, 22 aa, Mycobacterium
MSSSLPTLFRRAADYQRQITLT

SEQ ID NO: 886443 - protein, 23 aa, Mycobacterium
MSVELFGIRFPSPIFMAPIGVIG

SEQ ID NO: 886444 - protein, 21 aa, Mycobacterium
MSVFFFDHLLRTAGVPNHLAG

SEQ ID NO: 886445 - protein, 25 aa, Mycobacterium
MSWDRVVDKFWWLAGPFCERALGDE

SEQ ID NO: 886446 - protein, 17 aa, Mycobacterium
MTAAVTPYVAWLQAGAA

SEQ ID NO: 886447 - protein, 26 aa, Mycobacterium
MTGWQRLHFRFGLPAPLLEPLAVERL

SEQ ID NO: 886448 - protein, 17 aa, Mycobacterium
MTHAWLITGPPGSGRSV

SEQ ID NO: 886449 - protein, 25 aa, Mycobacterium
MTLTSRFPIVLWLSPTDLFLMYNDA

SEQ ID NO: 886450 - protein, 22 aa, Mycobacterium
MTPPALMKAILKAPADLLWNGG

SEQ ID NO: 886451 - protein, 26 aa, Mycobacterium
MVAALRRFWMFHGMLSEGFQWTSRAL

SEQ ID NO: 886452 - protein, 23 aa, Mycobacterium
MVDGGPWRFARTWLANLRHPAMM

SEQ ID NO: 886453 - protein, 18 aa, Mycobacterium
MVFPPWFERFQIKYFNPA

SEQ ID NO: 886454 - protein, 18 aa, Mycobacterium
MVFPPWFERFQIKYINPA

SEQ ID NO: 886455 - protein, 18 aa, Mycobacterium
MVGFLTIPMFFGAELVKV

SEQ ID NO: 886456 - protein, 18 aa, Mycobacterium
MVGLAALWRTVGVTPRAV

SEQ ID NO: 886457 - protein, 17 aa, Mycobacterium
MVHVALLGPRRPGVSLA

SEQ ID NO: 886458 - protein, 17 aa, Mycobacterium
MVLAYFGSKEQLYIACV

SEQ ID NO: 886459 - protein, 24 aa, Mycobacterium
MVLLAAFGALIRRYTHTDDFLVAT

SEQ ID NO: 886460 - protein, 20 aa, Mycobacterium
MVLNTWIRQGLVARGMVVSG

SEQ ID NO: 886461 - protein, 17 aa, Mycobacterium
MVLTSTHWPWIGDRTRH

SEQ ID NO: 886462 - protein, 17 aa, Mycobacterium
MVMPLSFHLGYHGLPIP

SEQ ID NO: 886463 - protein, 17 aa, Mycobacterium
MVNVLCAPGVWARHRKL

SEQ ID NO: 886464 - protein, 18 aa, Mycobacterium
MVPPQWFAMWARRHQHEY

SEQ ID NO: 886465 - protein, 20 aa, Mycobacterium
MVQFVPFFLGQRTPPYATAT

SEQ ID NO: 886466 - protein, 20 aa, Mycobacterium
MVQFVPYFLGQRTPPYPTAT

SEQ ID NO: 886467 - protein, 25 aa, Mycobacterium
MVRDIWRFWYQIPIMLPVIGPRVIA

SEQ ID NO: 886468 - protein, 18 aa, Mycobacterium
MVRFIGVDGYRWMIRCVV

SEQ ID NO: 886469 - protein, 19 aa, Mycobacterium
MVSWLPFYHDMGLIQGVFA

SEQ ID NO: 886470 - protein, 19 aa, Mycobacterium
MVVNHLIFHFATHKLPFGG

SEQ ID NO: 886471 - protein, 23 aa, Mycobacterium
MWGMDLINFLGVKWGLTSPATAA

SEQ ID NO: 886472 - protein, 19 aa, Mycobacterium
MWLTRQLIARLLGTFGPSL

SEQ ID NO: 886473 - protein, 17 aa, Mycobacterium
MWQYLLHRYTQQDALLV

SEQ ID NO: 886474 - protein, 17 aa, Mycobacterium
MYFALHRRGALQPGETV

SEQ ID NO: 886475 - protein, 18 aa, Mycobacterium
MYLGDGMMLEAPYTGSVV

SEQ ID NO: 886476 - protein, 18 aa, Mycobacterium
MYLQTVMLLLRAEGLHSC

SEQ ID NO: 886477 - protein, 17 aa, Mycobacterium
MYPLGPIFHGSGLNITV

SEQ ID NO: 886478 - protein, 17 aa, Mycobacterium
MYRNQVWFPYPGSNVVL

SEQ ID NO: 886479 - protein, 21 aa, Mycobacterium
MYRRMWVLRLLDMALEEMRAD

SEQ ID NO: 886480 - protein, 17 aa, Mycobacterium
NAARRLRIVPAEGPAST

SEQ ID NO: 886481 - protein, 27 aa, Mycobacterium
NAEISLPWQLPGRLLLARAYAAVGEVI

SEQ ID NO: 886482 - protein, 25 aa, Mycobacterium
NAFGDKVLPLYLPTGLPSCEGLIGL

SEQ ID NO: 886483 - protein, 22 aa, Mycobacterium
NAFGLPEFLPSRLTVDLFRAAR

SEQ ID NO: 886484 - protein, 22 aa, Mycobacterium
NAGEFQSLLGIGKGGDGGTGGD

SEQ ID NO: 886485 - protein, 25 aa, Mycobacterium
NAINAPAQSLFGRPLIGDGANATTP

SEQ ID NO: 886486 - protein, 24 aa, Mycobacterium
NAKQRLRECWLWSRAYTISGGSSE

SEQ ID NO: 886487 - protein, 23 aa, Mycobacterium
NALDILLADWPGERTLACLQGEF

SEQ ID NO: 886488 - protein, 22 aa, Mycobacterium
NALFFGHGLNIHFGLIKPPANV

SEQ ID NO: 886489 - protein, 20 aa, Mycobacterium
NALGLFGHGGAGGAGGYDVT

SEQ ID NO: 886490 - protein, 18 aa, Mycobacterium
NALKLLLLLGERPQIRLS

SEQ ID NO: 886491 - protein, 21 aa, Mycobacterium
NALVLRQRLLLRGIPAEIVEI

SEQ ID NO: 886492 - protein, 25 aa, Mycobacterium
NALVQMVLSNWFGLNAPAIAHIEGL

SEQ ID NO: 886493 - protein, 19 aa, Mycobacterium
NAMGPDFWRELPLIFTELD

SEQ ID NO: 886494 - protein, 23 aa, Mycobacterium
NAMSWFWYLMALHPDARDRMLAE

SEQ ID NO: 886495 - protein, 21 aa, Mycobacterium
NAMWALSIPVPFSVPVGAGAG

SEQ ID NO: 886496 - protein, 18 aa, Mycobacterium
NAPALLGLIGLWYSNFMG

SEQ ID NO: 886497 - protein, 21 aa, Mycobacterium
NAPTQALLGRPLIGDGATGAA

SEQ ID NO: 886498 - protein, 21 aa, Mycobacterium
NAPVLLGLIGLWYNNFFGAET

SEQ ID NO: 886499 - protein, 18 aa, Mycobacterium
NAPVLLGLIGLWYSNFMG

SEQ ID NO: 886500 - protein, 20 aa, Mycobacterium
NAPVLLGLIGLWYSNFMGAQ

SEQ ID NO: 886501 - protein, 20 aa, Mycobacterium
NAQLDWPLAEALRYPARLID

SEQ ID NO: 886502 - protein, 19 aa, Mycobacterium
NAQNGAFNLGFGDITFGDK

SEQ ID NO: 886503 - protein, 19 aa, Mycobacterium
NAQQGAFNLGFGDITLGNK

SEQ ID NO: 886504 - protein, 19 aa, Mycobacterium
NARLAARLTGWRIDIRSDD

SEQ ID NO: 886505 - protein, 34 aa, Mycobacterium
NASPLQPLLDLINAPTQAILGRPLIGNGSNGTYP

SEQ ID NO: 886506 - protein, 17 aa, Mycobacterium
NATGWKIGWACGAPELI

SEQ ID NO: 886507 - protein, 22 aa, Mycobacterium
NATIVSWLPFYHDMGLVLGVCA

SEQ ID NO: 886508 - protein, 27 aa, Mycobacterium
NATLAHLLKFDSILGRLPYDVSLEGED

SEQ ID NO: 886509 - protein, 21 aa, Mycobacterium
NATLPYVLKLAGRGWRDACRA

SEQ ID NO: 886510 - protein, 24 aa, Mycobacterium
NATMPYVLALADKGWRQACRDDAA

SEQ ID NO: 886511 - protein, 18 aa, Mycobacterium
NATRARIVLFRKPIERRA

SEQ ID NO: 886512 - protein, 24 aa, Mycobacterium
NATSQLYYVLYGRGFAAVNGQLVG

SEQ ID NO: 886513 - protein, 24 aa, Mycobacterium
NATSQLYYVLYGRGFAAVNGRLIE

SEQ ID NO: 886514 - protein, 27 aa, Mycobacterium
NAVNAPTQALLGRPLIGNGTDGAPGTG

SEQ ID NO: 886515 - protein, 18 aa, Mycobacterium
NCLAPGMWPAWWLSNDDP

SEQ ID NO: 886516 - protein, 18 aa, Mycobacterium
NCPGWVGITRWLKPVLST

SEQ ID NO: 886517 - protein, 22 aa, Mycobacterium
NCRPLPVFLFDGAVLSERVIAP

SEQ ID NO: 886518 - protein, 17 aa, Mycobacterium
NCTIAMVDWLFSGKLMQ

SEQ ID NO: 886519 - protein, 25 aa, Mycobacterium
NCTIPALFRVLFRGGWRGTVAEVLA

SEQ ID NO: 886520 - protein, 17 aa, Mycobacterium
NDFLIAVARMRALDPVT

SEQ ID NO: 886521 - protein, 21 aa, Mycobacterium
NDLHNEWLFGRSWGIDVAVST

SEQ ID NO: 886522 - protein, 18 aa, Mycobacterium
NDPEILHYLPLPVPYTVG

SEQ ID NO: 886523 - protein, 18 aa, Mycobacterium
NEAKWFWFEGNFGAYEEN

SEQ ID NO: 886524 - protein, 24 aa, Mycobacterium
NEEVAPWLDLVRKLGVLAASLSDG

SEQ ID NO: 886525 - protein, 23 aa, Mycobacterium
NEEVAPWLDLVRKLGVLAATLSD

SEQ ID NO: 886526 - protein, 27 aa, Mycobacterium
NEGFGYIPWGVFLPRTARLLAADERVD

SEQ ID NO: 886527 - protein, 21 aa, Mycobacterium
NELEFFFFVLAFAGSDTTKNA

SEQ ID NO: 886528 - protein, 23 aa, Mycobacterium
NELLKPLPLVPYTPKWLARKMEV

SEQ ID NO: 886529 - protein, 19 aa, Mycobacterium
NELVALVISNLFGQNAPAI

SEQ ID NO: 886530 - protein, 27 aa, Mycobacterium
NEMARIVLIELLAWQFASPVRWIETQD

SEQ ID NO: 886531 - protein, 19 aa, Mycobacterium
NENYGGFWFLSSYDAVSRT

SEQ ID NO: 886532 - protein, 24 aa, Mycobacterium
NEPGGFWTAFLIALRTALPEFGGG

SEQ ID NO: 886533 - protein, 22 aa, Mycobacterium
NESEAQQWRWSPAHLVVTCGAR

SEQ ID NO: 886534 - protein, 25 aa, Mycobacterium
NESFWSILAAFPKPVIAAVETYALG

SEQ ID NO: 886535 - protein, 24 aa, Mycobacterium
NESLLLPLLRPLFNRWFRVDVTGV

SEQ ID NO: 886536 - protein, 17 aa, Mycobacterium
NETPPYFVLIERALRDE

SEQ ID NO: 886537 - protein, 19 aa, Mycobacterium
NFFGLVRLTREVLPHLRAQ

SEQ ID NO: 886538 - protein, 22 aa, Mycobacterium
NFGCVWVNCHIPLVAEMPHGGF

SEQ ID NO: 886539 - protein, 21 aa, Mycobacterium
NFGLPLSILFGVAGAPVAGLD

SEQ ID NO: 886540 - protein, 17 aa, Mycobacterium
NFKTFFPTRLEFHDYLS

SEQ ID NO: 886541 - protein, 18 aa, Mycobacterium
NFMLIGAAFYRDQYRRTA

SEQ ID NO: 886542 - protein, 18 aa, Mycobacterium
NFPGPRPAFGTPSYFAQL

SEQ ID NO: 886543 - protein, 19 aa, Mycobacterium
NFPVFFIQDGIKFPDLVHA

SEQ ID NO: 886544 - protein, 18 aa, Mycobacterium
NFQIILVDTPGLHRPRTL

SEQ ID NO: 886545 - protein, 17 aa, Mycobacterium
NFRLERAASVAAGATVA

SEQ ID NO: 886546 - protein, 19 aa, Mycobacterium
NFVVYTADKPVWHTDTKGK

SEQ ID NO: 886547 - protein, 26 aa, Mycobacterium
NGAAGIIPAVLYYALHYTPQGAADPD

SEQ ID NO: 886548 - protein, 23 aa, Mycobacterium
NGAAILLRTLPLVAGGKSLGAAV

SEQ ID NO: 886549 - protein, 19 aa, Mycobacterium
NGAGWNFGFGNSGSFNLGF

SEQ ID NO: 886550 - protein, 25 aa, Mycobacterium
NGAPPIAFQLLWYPSTMWDASLPSF

SEQ ID NO: 886551 - protein, 17 aa, Mycobacterium
NGARPFLFTDTVGFVRH

SEQ ID NO: 886552 - protein, 27 aa, Mycobacterium
NGEVTLPLLLPLGLGLVVLDIPFDGIL

SEQ ID NO: 886553 - protein, 21 aa, Mycobacterium
NGFAYRFALPRAIAFAMRGVA

SEQ ID NO: 886554 - protein, 20 aa, Mycobacterium
NGFFYRLMPPFCIGTAAAGV

SEQ ID NO: 886555 - protein, 17 aa, Mycobacterium
NGGLLYGNGGAGGVGGT

SEQ ID NO: 886556 - protein, 24 aa, Mycobacterium
NGGNAGAFALFGNGGNGGNGGVGV

SEQ ID NO: 886557 - protein, 24 aa, Mycobacterium
NGGNAGALGVIPGVQGEYGGAANG

SEQ ID NO: 886558 - protein, 23 aa, Mycobacterium
NGGSGGLLFGGGGIGGTGGTGAA

SEQ ID NO: 886559 - protein, 21 aa, Mycobacterium
NGHLLLPPWFIDKAGPDGIEA

SEQ ID NO: 886560 - protein, 26 aa, Mycobacterium
NGLPLTLWLARFLKFIQTEIFPGGHP

SEQ ID NO: 886561 - protein, 21 aa, Mycobacterium
NGLYLPIVDVLFNGATPPDSP

SEQ ID NO: 886562 - protein, 17 aa, Mycobacterium
NGMLRQYFPKRTDLPRW

SEQ ID NO: 886563 - protein, 22 aa, Mycobacterium
NGPTEALLGRPLIGNGADGTAP

SEQ ID NO: 886564 - protein, 24 aa, Mycobacterium
NGQLFQFVLFQTGVDEFYLFGCCH

SEQ ID NO: 886565 - protein, 17 aa, Mycobacterium
NGQVFIVYGPRVTLVSA

SEQ ID NO: 886566 - protein, 22 aa, Mycobacterium
NGRWYMPWISLEDHIRALEFAL

SEQ ID NO: 886567 - protein, 24 aa, Mycobacterium
NGSNQLVVWWLLDPPTGARSINLL

SEQ ID NO: 886568 - protein, 24 aa, Mycobacterium
NGSSWIFPLFRDFADLYKKMPQNF

SEQ ID NO: 886569 - protein, 25 aa, Mycobacterium
NGWLGRWLVLDWLERLAPNGGKVYA

SEQ ID NO: 886570 - protein, 17 aa, Mycobacterium
NGYPRLLCMTRMSTFAE

SEQ ID NO: 886571 - protein, 17 aa, Mycobacterium
NHNGYLLRWDNEGFLFD

SEQ ID NO: 886572 - protein, 25 aa, Mycobacterium
NHSRRVFFFGALQGLRRGIHPNLEL

SEQ ID NO: 886573 - protein, 17 aa, Mycobacterium
NHWAGVLYPPGLPAARR

SEQ ID NO: 886574 - protein, 24 aa, Mycobacterium
NIDARVFFHPLSTTPPFAGSPGGK

SEQ ID NO: 886575 - protein, 19 aa, Mycobacterium
NIFNLVYNTLLALLFEWGV

SEQ ID NO: 886576 - protein, 19 aa, Mycobacterium
NILLAALRPAAVLAKTLAT

SEQ ID NO: 886577 - protein, 18 aa, Mycobacterium
NIPKNPFDAIPYVRKLVG

SEQ ID NO: 886578 - protein, 17 aa, Mycobacterium
NIRPGVPVLFLDTGYHF

SEQ ID NO: 886579 - protein, 17 aa, Mycobacterium
NIYIHPFLEDDLKGIID

SEQ ID NO: 886580 - protein, 20 aa, Mycobacterium
NIYYRRALMLAACFGRHTTY

SEQ ID NO: 886581 - protein, 21 aa, Mycobacterium
NKAQIYAWRKGIKTLYYIRLR

SEQ ID NO: 886582 - protein, 27 aa, Mycobacterium
NKAYTPWYLVRYWRLLKFKLANPHIVT

SEQ ID NO: 886583 - protein, 21 aa, Mycobacterium
NKRLLYVYYTNKETLFDIVVA

SEQ ID NO: 886584 - protein, 23 aa, Mycobacterium
NKTLLTSLFFLGNSLYLPTGFAP

SEQ ID NO: 886585 - protein, 22 aa, Mycobacterium
NKYRLVFDKLALKAGDRLLDVG

SEQ ID NO: 886586 - protein, 25 aa, Mycobacterium
NLAHWPGFLVLYYAALRPLHDDGSL

SEQ ID NO: 886587 - protein, 25 aa, Mycobacterium
NLASRFSYWIPFSIPVLAPALMRRG

SEQ ID NO: 886588 - protein, 23 aa, Mycobacterium
NLEFLDHIVAHPAIRWVGNANEL

SEQ ID NO: 886589 - protein, 24 aa, Mycobacterium
NLEGLWLLQAMLGIPQLAPELRGR

SEQ ID NO: 886590 - protein, 17 aa, Mycobacterium
NLFRDPVEAASYVADPE

SEQ ID NO: 886591 - protein, 18 aa, Mycobacterium
NLGYWDGGEWWGAGPGAH

SEQ ID NO: 886592 - protein, 18 aa, Mycobacterium
NLIHLATVMWFDGPALGN

SEQ ID NO: 886593 - protein, 20 aa, Mycobacterium
NLKLRFLSWGAAPASDTLLR

SEQ ID NO: 886594 - protein, 29 aa, Mycobacterium
NLMRFYRLAQTLLWQWMWDRITAAATDRA

SEQ ID NO: 886595 - protein, 25 aa, Mycobacterium
NLPIALWPGMKIGQLCILRLTSPAE

SEQ ID NO: 886596 - protein, 26 aa, Mycobacterium
NLPITLWPGMKIGQLCILKLTSPSEH

SEQ ID NO: 886597 - protein, 26 aa, Mycobacterium
NLPITLWPGMKIGQLCLLRLTSPAEH

SEQ ID NO: 886598 - protein, 26 aa, Mycobacterium
NLPITLWPGMKIGQLCLLRLTSPAEN

SEQ ID NO: 886599 - protein, 26 aa, Mycobacterium
NLPITLWPGMKIGQLCLLRLTSPAQH

SEQ ID NO: 886600 - protein, 22 aa, Mycobacterium
NLPNWLPLTFRIGDGDWLDLDA

SEQ ID NO: 886601 - protein, 23 aa, Mycobacterium
NLQPLIFGLWHMVARYHAARPQV

SEQ ID NO: 886602 - protein, 24 aa, Mycobacterium
NLREIWIPRGMFSEGYRWLDLALT

SEQ ID NO: 886603 - protein, 20 aa, Mycobacterium
NLRPGRLYPGVTGPLVGNPP

SEQ ID NO: 886604 - protein, 17 aa, Mycobacterium
NLSPWLEFVWKPGYADY

SEQ ID NO: 886605 - protein, 18 aa, Mycobacterium
NLTSGDFPVLWPVLTRWA

SEQ ID NO: 886606 - protein, 21 aa, Mycobacterium
NLVLLRISAFGRRGPWRQRSA

SEQ ID NO: 886607 - protein, 21 aa, Mycobacterium
NLYGFAWNPMTLVGILKNIKG

SEQ ID NO: 886608 - protein, 19 aa, Mycobacterium
NLYLAFGMLSWHLNDRELR

SEQ ID NO: 886609 - protein, 20 aa, Mycobacterium
NLYLRDLVMALRWVRDNIAS

SEQ ID NO: 886610 - protein, 19 aa, Mycobacterium
NMFVLRLDAIGFWQRLHHT

SEQ ID NO: 886611 - protein, 18 aa, Mycobacterium
NMRWRTFCAELLAIADKL

SEQ ID NO: 886612 - protein, 17 aa, Mycobacterium
NMVVIYALFPNIVLSVT

SEQ ID NO: 886613 - protein, 26 aa, Mycobacterium
NMVVPTWMYGPPIQLYIGLVAQQRGI

SEQ ID NO: 886614 - protein, 30 aa, Mycobacterium
NNLARRILDARLMWVWLATHEYFMVDVDAA

SEQ ID NO: 886615 - protein, 17 aa, Mycobacterium
NNYRPQFYFRTTDVTGV

SEQ ID NO: 886616 - protein, 25 aa, Mycobacterium
NPERVWGWYLWRHYLVADVQPNTGH

SEQ ID NO: 886617 - protein, 24 aa, Mycobacterium
NPFAPLLLVLLQFQAGIKIDFRSE

SEQ ID NO: 886618 - protein, 25 aa, Mycobacterium
NPFAPLLLVLLQFQAGIKIDFRSEV

SEQ ID NO: 886619 - protein, 21 aa, Mycobacterium
NPFDGLIDIVWAIVRTFQGIA

SEQ ID NO: 886620 - protein, 23 aa, Mycobacterium
NPFHHMVVIYALFPNIVLSVTIA

SEQ ID NO: 886621 - protein, 19 aa, Mycobacterium
NPGLRRYWPWTAVGRRMAE

SEQ ID NO: 886622 - protein, 24 aa, Mycobacterium
NPHKIAMLGLTFDDVLLLPAASDV

SEQ ID NO: 886623 - protein, 18 aa, Mycobacterium
NPMRIFWELTKRMPPNAI

SEQ ID NO: 886624 - protein, 19 aa, Mycobacterium
NPPLLFSAIYLADSAQACM

SEQ ID NO: 886625 - protein, 20 aa, Mycobacterium
NPPMIRYPIPPMIHGATQSA

SEQ ID NO: 886626 - protein, 19 aa, Mycobacterium
NPPPLMPLYLRRPDAKPLA

SEQ ID NO: 886627 - protein, 23 aa, Mycobacterium
NPRDVLVVFFPLAFTGVCEGELG

SEQ ID NO: 886628 - protein, 19 aa, Mycobacterium
NPRLTLLGALPTLYDSRTT

SEQ ID NO: 886629 - protein, 21 aa, Mycobacterium
NPVLQLFIEILMRLTRRYALT

SEQ ID NO: 886630 - protein, 22 aa, Mycobacterium
NPVLSILIRRAALSAPPLAATL

SEQ ID NO: 886631 - protein, 18 aa, Mycobacterium
NPVYFALLARRRMDLYGA

SEQ ID NO: 886632 - protein, 20 aa, Mycobacterium
NPWIPFTPLTDKVFLKYWKV

SEQ ID NO: 886633 - protein, 25 aa, Mycobacterium
NPYAAFFVFWLGWPTSEVPGLYLTA

SEQ ID NO: 886634 - protein, 17 aa, Mycobacterium
NPYQLSWWINRFTEIFQ

SEQ ID NO: 886635 - protein, 21 aa, Mycobacterium
NQLGDVWFLLATLLGHRSAEV

SEQ ID NO: 886636 - protein, 23 aa, Mycobacterium
NQSWIIPLKLTLLQQIAGALDFI

SEQ ID NO: 886637 - protein, 22 aa, Mycobacterium
NQTLAHLLKFDSILGRLPQDVS

SEQ ID NO: 886638 - protein, 20 aa, Mycobacterium
NQTRFWNKFYDVVLEAHGDR

SEQ ID NO: 886639 - protein, 20 aa, Mycobacterium
NRATMLLFMQGRRGAAPEVR

SEQ ID NO: 886640 - protein, 23 aa, Mycobacterium
NRAWRLYRRLGFTDILRGYYFAG

SEQ ID NO: 886641 - protein, 24 aa, Mycobacterium
NRDGILKATWLRGIERFQRRAMAA

SEQ ID NO: 886642 - protein, 23 aa, Mycobacterium
NRDGILTAAWLRALERFQTRALA

SEQ ID NO: 886643 - protein, 19 aa, Mycobacterium
NREVRWRPEHFWKSGTAID

SEQ ID NO: 886644 - protein, 18 aa, Mycobacterium
NREVRWRPESFWDSGTSV

SEQ ID NO: 886645 - protein, 20 aa, Mycobacterium
NRGDPLMFKLGVGQVIQGWD

SEQ ID NO: 886646 - protein, 18 aa, Mycobacterium
NRGLLPPSFALVGFARRD

SEQ ID NO: 886647 - protein, 24 aa, Mycobacterium
NRGSQFYLALYWAAELAAQTEDVE

SEQ ID NO: 886648 - protein, 24 aa, Mycobacterium
NRGSQFYLALYWAQELAAQNDDED

SEQ ID NO: 886649 - protein, 23 aa, Mycobacterium
NRGSQFYLAMYWAQELAAQNEDQ

SEQ ID NO: 886650 - protein, 18 aa, Mycobacterium
NRLFTLEWEPVPLPTAAG

SEQ ID NO: 886651 - protein, 21 aa, Mycobacterium
NRLHVLLTHLMPAGAPRGLTA

SEQ ID NO: 886652 - protein, 18 aa, Mycobacterium
NRLLAPNEYIITLSVHDS

SEQ ID NO: 886653 - protein, 18 aa, Mycobacterium
NRLTLWGRRLLGEAITQA

SEQ ID NO: 886654 - protein, 20 aa, Mycobacterium
NRPHLILDGLRLAAAMVGAD

SEQ ID NO: 886655 - protein, 17 aa, Mycobacterium
NRPHLVLDGLRLAAALV

SEQ ID NO: 886656 - protein, 18 aa, Mycobacterium
NRPHLVLDGLRLAATIVG

SEQ ID NO: 886657 - protein, 20 aa, Mycobacterium
NRPHLVLDGLRLAATLVAAD

SEQ ID NO: 886658 - protein, 23 aa, Mycobacterium
NRPVILHWLGSMFDPALTGYWGH

SEQ ID NO: 886659 - protein, 21 aa, Mycobacterium
NRRALLDVPRLGPKAFEQCAG

SEQ ID NO: 886660 - protein, 18 aa, Mycobacterium
NRRIGPHRRFAFASVPLA

SEQ ID NO: 886661 - protein, 27 aa, Mycobacterium
NRRSKFPHRWWWVTLTDEPFPRFSTVR

SEQ ID NO: 886662 - protein, 25 aa, Mycobacterium
NRRSRFPHRWWWVTLTDEAFPRLSV

SEQ ID NO: 886663 - protein, 25 aa, Mycobacterium
NRRSRFPHRWWWVVLSEEAFPRLAV

SEQ ID NO: 886664 - protein, 20 aa, Mycobacterium
NRTGWLYPFASELVTPAEAR

SEQ ID NO: 886665 - protein, 25 aa, Mycobacterium
NRVKTWLQFPQWFYLDLPVNTMVAP

SEQ ID NO: 886666 - protein, 24 aa, Mycobacterium
NRVVIIPGLQYKALTTGGRLVPRN

SEQ ID NO: 886667 - protein, 26 aa, Mycobacterium
NSDLINKLLPILAPIVLAYLGRKLSG

SEQ ID NO: 886668 - protein, 19 aa, Mycobacterium
NSIAWLLWHSARVQDIQLA

SEQ ID NO: 886669 - protein, 17 aa, Mycobacterium
NSLFINVNCWGRLVTGV

SEQ ID NO: 886670 - protein, 18 aa, Mycobacterium
NSLFITVNCWGRLVSGVG

SEQ ID NO: 886671 - protein, 26 aa, Mycobacterium
NSPAQALLGRPLFGNGINGAPGTGQD

SEQ ID NO: 886672 - protein, 25 aa, Mycobacterium
NSTLCSYLDKLLWILTGNFAKPGGQ

SEQ ID NO: 886673 - protein, 25 aa, Mycobacterium
NSTLCSYLNKLLWILTGNFAKKGGQ

SEQ ID NO: 886674 - protein, 22 aa, Mycobacterium
NSTLCSYLNKLLWVLTGNFAKR

SEQ ID NO: 886675 - protein, 22 aa, Mycobacterium
NSTLCSYLNKMLWILTGNFAKR

SEQ ID NO: 886676 - protein, 23 aa, Mycobacterium
NSTRARIVLFRKPIERRAKDTDE

SEQ ID NO: 886677 - protein, 18 aa, Mycobacterium
NSTRARIVLFRKPIERRV

SEQ ID NO: 886678 - protein, 34 aa, Mycobacterium
NSVINFAWAEARYFLPPLPPLPGLALQTTTDANG

SEQ ID NO: 886679 - protein, 22 aa, Mycobacterium
NSWLDAFAYWRRAQGLPTTAIA

SEQ ID NO: 886680 - protein, 20 aa, Mycobacterium
NTFPSWPLAHPFRFVAHNGE

SEQ ID NO: 886681 - protein, 21 aa, Mycobacterium
NTFVRLVMSNLFGFNAPAIAA

SEQ ID NO: 886682 - protein, 17 aa, Mycobacterium
NTGFFNSGGLNSGFANF

SEQ ID NO: 886683 - protein, 31 aa, Mycobacterium
NTGPLQQLLTLINAPLLAATGRPLIGNGANG

SEQ ID NO: 886684 - protein, 26 aa, Mycobacterium
NTILKAAGFRWFRTLGVWGIAGSRDR

SEQ ID NO: 886685 - protein, 24 aa, Mycobacterium
NTKCLCRIHHLLKTFWLGWSDRQL

SEQ ID NO: 886686 - protein, 23 aa, Mycobacterium
NTPIFFIRDPLKFQHFIRSQKRR

SEQ ID NO: 886687 - protein, 17 aa, Mycobacterium
NTQPWRWVADGARLDLF

SEQ ID NO: 886688 - protein, 23 aa, Mycobacterium
NTRTWIQKYIFPGGLLPSAEAIA

SEQ ID NO: 886689 - protein, 18 aa, Mycobacterium
NVCTWLCFVTIGPLFVFG

SEQ ID NO: 886690 - protein, 23 aa, Mycobacterium
NVEDFKFFWVTGLTADGKIVVAN

SEQ ID NO: 886691 - protein, 22 aa, Mycobacterium
NVEYFLWLRAQTDRPLSDDTLS

SEQ ID NO: 886692 - protein, 18 aa, Mycobacterium
NVFHWVFAFADGGLATPQ

SEQ ID NO: 886693 - protein, 17 aa, Mycobacterium
NVGFFNTGDNNSGFGNI

SEQ ID NO: 886694 - protein, 21 aa, Mycobacterium
NVHGLFWTLNAALPALRQSEP

SEQ ID NO: 886695 - protein, 27 aa, Mycobacterium
NVIGVSLPLLRRLLGRAGLSVAALWAG

SEQ ID NO: 886696 - protein, 22 aa, Mycobacterium
NVKGVFLLTRALTPLLRAGATD

SEQ ID NO: 886697 - protein, 24 aa, Mycobacterium
NVLGRLHFALAPQGTLFLGHAEML

SEQ ID NO: 886698 - protein, 21 aa, Mycobacterium
NVLLIALHYRVGGSVWGVGDT

SEQ ID NO: 886699 - protein, 17 aa, Mycobacterium
NVLLLRACRERLLRLGF

SEQ ID NO: 886700 - protein, 17 aa, Mycobacterium
NVLRFLPPLAISDDLLL

SEQ ID NO: 886701 - protein, 19 aa, Mycobacterium
NVLSVLSWMHPPTSGAYAS

SEQ ID NO: 886702 - protein, 17 aa, Mycobacterium
NVLTFAGRLWSRIVAEV

SEQ ID NO: 886703 - protein, 19 aa, Mycobacterium
NVMQLTHPAFLLLDTPDGK

SEQ ID NO: 886704 - protein, 21 aa, Mycobacterium
NVNPIYNWPLPRLAVNIVGSD

SEQ ID NO: 886705 - protein, 18 aa, Mycobacterium
NVPTPFGLFPPVSPLTVA

SEQ ID NO: 886706 - protein, 20 aa, Mycobacterium
NVQGYLLYRFVDEDTTVVWV

SEQ ID NO: 886707 - protein, 18 aa, Mycobacterium
NVRGTYFLVAQLAPGMFA

SEQ ID NO: 886708 - protein, 23 aa, Mycobacterium
NVRPVKFLPGVLSPLRNADDHEL

SEQ ID NO: 886709 - protein, 18 aa, Mycobacterium
NVSAWRFITPPSAFISTV

SEQ ID NO: 886710 - protein, 18 aa, Mycobacterium
NVSLPWSKVVVLNPGVQT

SEQ ID NO: 886711 - protein, 33 aa, Mycobacterium
NVSPLQDLLGLINAPTQALLGRPLIGNGTNGTA

SEQ ID NO: 886712 - protein, 26 aa, Mycobacterium
NVSRAALLIVALTERPDLLLAATEDA

SEQ ID NO: 886713 - protein, 21 aa, Mycobacterium
NVVVPVRAGFHLLVAAANDAG

SEQ ID NO: 886714 - protein, 19 aa, Mycobacterium
NVVVPYFWSDQYDVKIQCL

SEQ ID NO: 886715 - protein, 21 aa, Mycobacterium
NVYYRRALLLAACFGRAADHP

SEQ ID NO: 886716 - protein, 23 aa, Mycobacterium
NVYYRRALMLAACFGRSVEYPQR

SEQ ID NO: 886717 - protein, 19 aa, Mycobacterium
NWALVISGPLFTASGITPL

SEQ ID NO: 886718 - protein, 17 aa, Mycobacterium
NWDSLPLRLFAGGNAKF

SEQ ID NO: 886719 - protein, 24 aa, Mycobacterium
NWEPEPLRWLGVRGLYIAYKLADR

SEQ ID NO: 886720 - protein, 17 aa, Mycobacterium
NWPWRRLVLSRSANVYA

SEQ ID NO: 886721 - protein, 18 aa, Mycobacterium
NWVTNFAPAAPPLQIIGP

SEQ ID NO: 886722 - protein, 19 aa, Mycobacterium
NYDMSMARFLYWGCDIWLN

SEQ ID NO: 886723 - protein, 23 aa, Mycobacterium
NYEYGFFWYLYNDAGIEMEVKLT

SEQ ID NO: 886724 - protein, 19 aa, Mycobacterium
NYEYLVYWRLYQDGNIECE

SEQ ID NO: 886725 - protein, 20 aa, Mycobacterium
NYEYLVYWRLYQDGNIECEV

SEQ ID NO: 886726 - protein, 19 aa, Mycobacterium
NYLGGVGLVLRLLPGMRAR

SEQ ID NO: 886727 - protein, 25 aa, Mycobacterium
NYSNGFLWRGDYQGLITISYSSTIP

SEQ ID NO: 886728 - protein, 21 aa, Mycobacterium
NYSNGLLWRGDYQGLWGIDYA

SEQ ID NO: 886729 - protein, 18 aa, Mycobacterium
NYYTMYFALHRRGALQPG

SEQ ID NO: 886730 - protein, 18 aa, Mycobacterium
PAAAPFGIVLSNTGLGNT

SEQ ID NO: 886731 - protein, 19 aa, Mycobacterium
PAAIRLLRALKGSGALLPL

SEQ ID NO: 886732 - protein, 20 aa, Mycobacterium
PAALLYTALLAWGAGRGATR

SEQ ID NO: 886733 - protein, 17 aa, Mycobacterium
PAAPPWVWVAASALLDG

SEQ ID NO: 886734 - protein, 18 aa, Mycobacterium
PAAPYLHLFVTRGRIDLD

SEQ ID NO: 886735 - protein, 17 aa, Mycobacterium
PAARWAFCNGMTPAQRR

SEQ ID NO: 886736 - protein, 26 aa, Mycobacterium
PAAVSPWWLQRRLLLAGIRATSPAVD

SEQ ID NO: 886737 - protein, 26 aa, Mycobacterium
PAAVSPWWMQRRLLLSGIRAISPAVD

SEQ ID NO: 886738 - protein, 24 aa, Mycobacterium
PADGASNWYLEFARLAPLMEKDTH

SEQ ID NO: 886739 - protein, 23 aa, Mycobacterium
PADLNFLWLPLAHAFGKVMLSLP

SEQ ID NO: 886740 - protein, 18 aa, Mycobacterium
PADLPWIDPLLSATERIR

SEQ ID NO: 886741 - protein, 28 aa, Mycobacterium
PADMPGVWAVMAWARRQPMYSDPAMRTT

SEQ ID NO: 886742 - protein, 27 aa, Mycobacterium
PADPPFEGMWWLYLPIAFDDFAVVLII

SEQ ID NO: 886743 - protein, 27 aa, Mycobacterium
PADPPFEGMWWLYVPMAFDDFAIVLII

SEQ ID NO: 886744 - protein, 26 aa, Mycobacterium
PADPPFEGMWWLYVPMAFDEFSIVLI

SEQ ID NO: 886745 - protein, 21 aa, Mycobacterium
PADYQLLLALRAYADVVLVGA

SEQ ID NO: 886746 - protein, 18 aa, Mycobacterium
PAEDFIPPQLRRATQKLL

SEQ ID NO: 886747 - protein, 23 aa, Mycobacterium
PAEGLPYRWPHPWLVDQQGARQQ

SEQ ID NO: 886748 - protein, 23 aa, Mycobacterium
PAFDELLRRLPWPLNLTTSVNKC

SEQ ID NO: 886749 - protein, 21 aa, Mycobacterium
PAFFPPIVAIALPFEHQHPSE

SEQ ID NO: 886750 - protein, 27 aa, Mycobacterium
PAFGTPSYFAQLAFAVLHVLALPITVP

SEQ ID NO: 886751 - protein, 17 aa, Mycobacterium
PAFLLNHMLVWGFTGQV

SEQ ID NO: 886752 - protein, 21 aa, Mycobacterium
PAGLLYLAGPMAWTFGLPIVP

SEQ ID NO: 886753 - protein, 23 aa, Mycobacterium
PAGLLYLIGPMAWTLGYPIVPML

SEQ ID NO: 886754 - protein, 19 aa, Mycobacterium
PAGMALMKRLMVRPGQVVS

SEQ ID NO: 886755 - protein, 23 aa, Mycobacterium
PAGNDWVLAFWGIVMAGGIAVAV

SEQ ID NO: 886756 - protein, 17 aa, Mycobacterium
PAGRRWPLYGPAMLGKS

SEQ ID NO: 886757 - protein, 26 aa, Mycobacterium
PAIAHDVAPFLPPPFRDLAESVLGAA

SEQ ID NO: 886758 - protein, 27 aa, Mycobacterium
PAIDMLTWQMALCRPLWRCYGKILECD

SEQ ID NO: 886759 - protein, 19 aa, Mycobacterium
PAIMFPKVSTLPLGVPQPR

SEQ ID NO: 886760 - protein, 20 aa, Mycobacterium
PAISLPLHWTADGLPLGVQF

SEQ ID NO: 886761 - protein, 21 aa, Mycobacterium
PAISVPLHWTPAGLPLGVQFV

SEQ ID NO: 886762 - protein, 23 aa, Mycobacterium
PAKYLNRLSDLLFILARAANPDG

SEQ ID NO: 886763 - protein, 17 aa, Mycobacterium
PALLEWLKAQGVPFRGG

SEQ ID NO: 886764 - protein, 28 aa, Mycobacterium
PALPIMTTTMLFFVRDMCSQSFCVRAVR

SEQ ID NO: 886765 - protein, 19 aa, Mycobacterium
PALQVLLYPITDWVSETRS

SEQ ID NO: 886766 - protein, 24 aa, Mycobacterium
PALRDLGWFRFLTGRLDGPDGAPL

SEQ ID NO: 886767 - protein, 22 aa, Mycobacterium
PALVAYAEPLLHVGPLGSGQRV

SEQ ID NO: 886768 - protein, 18 aa, Mycobacterium
PALYHWFIGDGMVHGIRI

SEQ ID NO: 886769 - protein, 21 aa, Mycobacterium
PAMIHVDLYRLLDRPGTALLG

SEQ ID NO: 886770 - protein, 23 aa, Mycobacterium
PAMNFFPAVLTPTGLTLPFGEVT

SEQ ID NO: 886771 - protein, 19 aa, Mycobacterium
PANAFVMSFLGAVSALNGA

SEQ ID NO: 886772 - protein, 22 aa, Mycobacterium
PAPATPWLATTVRLAWRAKLMI

SEQ ID NO: 886773 - protein, 17 aa, Mycobacterium
PAPIWLWHNVEDRLGIS

SEQ ID NO: 886774 - protein, 19 aa, Mycobacterium
PAPPAPTLAPRRKTRQLNV

SEQ ID NO: 886775 - protein, 21 aa, Mycobacterium
PAPPRWVLGVVRRLPWLSVVP

SEQ ID NO: 886776 - protein, 25 aa, Mycobacterium
PAPQANFVWLPLGARTRDFFERAAD

SEQ ID NO: 886777 - protein, 18 aa, Mycobacterium
PAPWLVTDKYWPPVRRID

SEQ ID NO: 886778 - protein, 21 aa, Mycobacterium
PAPWRVEALVLLAFSAYARGD

SEQ ID NO: 886779 - protein, 18 aa, Mycobacterium
PAQALLGRPLIGNGIDGT

SEQ ID NO: 886780 - protein, 18 aa, Mycobacterium
PAQGAVYVLLLKADGLQS

SEQ ID NO: 886781 - protein, 24 aa, Mycobacterium
PAQPAPVLIFLPGGAWVHGRCMGQ

SEQ ID NO: 886782 - protein, 18 aa, Mycobacterium
PAQPTIPLGPPPPDSPER

SEQ ID NO: 886783 - protein, 18 aa, Mycobacterium
PAQVLIRWHIQLGNIVIP

SEQ ID NO: 886784 - protein, 18 aa, Mycobacterium
PAQVLIRWSLQLGNIVIP

SEQ ID NO: 886785 - protein, 20 aa, Mycobacterium
PAQYWRAVIKAYFDAFGSHR

SEQ ID NO: 886786 - protein, 20 aa, Mycobacterium
PARIMTVDDLHRAAAAATDV

SEQ ID NO: 886787 - protein, 26 aa, Mycobacterium
PARVKCALLGWTAFKAALAEAHGPEN

SEQ ID NO: 886788 - protein, 17 aa, Mycobacterium
PARYPSRVLANDFVAQW

SEQ ID NO: 886789 - protein, 20 aa, Mycobacterium
PASHHLRWLASANALLDIPE

SEQ ID NO: 886790 - protein, 22 aa, Mycobacterium
PASHHLRWLASANALLEIPEDD

SEQ ID NO: 886791 - protein, 24 aa, Mycobacterium
PASHYSLGWLPRWAKLGSAVPRLA

SEQ ID NO: 886792 - protein, 22 aa, Mycobacterium
PASLKDRWLLRNRPHLILDGLR

SEQ ID NO: 886793 - protein, 18 aa, Mycobacterium
PASQFLKFAPHPGLGPLP

SEQ ID NO: 886794 - protein, 23 aa, Mycobacterium
PASRPRIRLAYRLTPRRVLGPQR

SEQ ID NO: 886795 - protein, 24 aa, Mycobacterium
PATGLPWMAEYVEEFGLIPPPADR

SEQ ID NO: 886796 - protein, 18 aa, Mycobacterium
PATPWLASTVRVAWRAKL

SEQ ID NO: 886797 - protein, 24 aa, Mycobacterium
PAVDGGWWVLGLRSPAAAECLRTV

SEQ ID NO: 886798 - protein, 20 aa, Mycobacterium
PAVHRLDAAHLFRLALENAP

SEQ ID NO: 886799 - protein, 18 aa, Mycobacterium
PAVIFRTPYDKRGMVSQL

SEQ ID NO: 886800 - protein, 19 aa, Mycobacterium
PAVIRAVILMALDAPPRSF

SEQ ID NO: 886801 - protein, 22 aa, Mycobacterium
PAVKWKAFFKRQLGNPKYLHDG

SEQ ID NO: 886802 - protein, 21 aa, Mycobacterium
PAVPILVHPAPRSVLGEVAAA

SEQ ID NO: 886803 - protein, 23 aa, Mycobacterium
PAVRRRVIRLWLLAGGAQDLNDN

SEQ ID NO: 886804 - protein, 19 aa, Mycobacterium
PAWLVFDQRYRDRYIFAGL

SEQ ID NO: 886805 - protein, 17 aa, Mycobacterium
PAYAAMMRQGYGRFVFV

SEQ ID NO: 886806 - protein, 24 aa, Mycobacterium
PAYTGRMFTAPIPALRLPEESMDP

SEQ ID NO: 886807 - protein, 17 aa, Mycobacterium
PAYVYPLFEQALRVARG

SEQ ID NO: 886808 - protein, 17 aa, Mycobacterium
PCFILEYKKDRHARVAL

SEQ ID NO: 886809 - protein, 18 aa, Mycobacterium
PCFPTVSELWLRLLEAYR

SEQ ID NO: 886810 - protein, 18 aa, Mycobacterium
PCGYLAWLRELVGPSAWI

SEQ ID NO: 886811 - protein, 23 aa, Mycobacterium
PCGYLTWLRELLGPDAWIVIEKI

SEQ ID NO: 886812 - protein, 25 aa, Mycobacterium
PDAFTRLIFSLLVTGIAPSSFYEAT

SEQ ID NO: 886813 - protein, 23 aa, Mycobacterium
PDARLFIAAFPPGGRFGVPGIDH

SEQ ID NO: 886814 - protein, 24 aa, Mycobacterium
PDARRFRRFLTHTVWPSIRDTGSY

SEQ ID NO: 886815 - protein, 21 aa, Mycobacterium
PDAWAFTWVVDAPLFEPADDA

SEQ ID NO: 886816 - protein, 27 aa, Mycobacterium
PDDPPFEGMWWLYIPMAFDDFGIVIII

SEQ ID NO: 886817 - protein, 25 aa, Mycobacterium
PDDPVPMMLLPTIPTMVWGGNVRMI

SEQ ID NO: 886818 - protein, 22 aa, Mycobacterium
PDEFLWNRPIARLLAFGRGQHF

SEQ ID NO: 886819 - protein, 22 aa, Mycobacterium
PDEIMLLAPNVWPRNLVRGADG

SEQ ID NO: 886820 - protein, 25 aa, Mycobacterium
PDEKWALLPLTPFIPKAAARRLADV

SEQ ID NO: 886821 - protein, 24 aa, Mycobacterium
PDELRRWIPLLSRFRVVSVRGPRS

SEQ ID NO: 886822 - protein, 17 aa, Mycobacterium
PDELTGLYLYLASEASS

SEQ ID NO: 886823 - protein, 19 aa, Mycobacterium
PDFATGLAPLRWGTGFMLG

SEQ ID NO: 886824 - protein, 18 aa, Mycobacterium
PDFIRLGLMLALERRPTE

SEQ ID NO: 886825 - protein, 23 aa, Mycobacterium
PDFTTVLWRKLVLNALAGLMALS

SEQ ID NO: 886826 - protein, 23 aa, Mycobacterium
PDGFTETLTWWQIYRRAKIVAEE

SEQ ID NO: 886827 - protein, 19 aa, Mycobacterium
PDGLTAWLLLSCEGLHAGA

SEQ ID NO: 886828 - protein, 23 aa, Mycobacterium
PDGRTWWIPPAHVDPYRTPRSNW

SEQ ID NO: 886829 - protein, 21 aa, Mycobacterium
PDHFYHPFGLLPSPQHIPLSH

SEQ ID NO: 886830 - protein, 26 aa, Mycobacterium
PDHQRWLGTRLPFYANWIRLKSYWGT

SEQ ID NO: 886831 - protein, 17 aa, Mycobacterium
PDIWQVAYLIAPVAGWV

SEQ ID NO: 886832 - protein, 17 aa, Mycobacterium
PDLAWRYNPDRPETIHP

SEQ ID NO: 886833 - protein, 25 aa, Mycobacterium
PDLAYEFLPVVWRVIQHYGIDVGGR

SEQ ID NO: 886834 - protein, 17 aa, Mycobacterium
PDLFLLRQIHRAPRLTV

SEQ ID NO: 886835 - protein, 19 aa, Mycobacterium
PDLLPLLELVAKEGKPLLI

SEQ ID NO: 886836 - protein, 25 aa, Mycobacterium
PDLTIGFFLHIPFPPVELFMQLPWR

SEQ ID NO: 886837 - protein, 20 aa, Mycobacterium
PDLVPIFLNALPAPLIEAAD

SEQ ID NO: 886838 - protein, 22 aa, Mycobacterium
PDPGPLRRLIATLPALEVPRPD

SEQ ID NO: 886839 - protein, 25 aa, Mycobacterium
PDQAAYRVLWFVSSPSNISGATIPE

SEQ ID NO: 886840 - protein, 19 aa, Mycobacterium
PDQGAWLQPFRPLSALLTA

SEQ ID NO: 886841 - protein, 20 aa, Mycobacterium
PDQGAWLQPFRPLSALLTAR

SEQ ID NO: 886842 - protein, 25 aa, Mycobacterium
PDRELAFLHPLPVRRLWGVGAKTAD

SEQ ID NO: 886843 - protein, 25 aa, Mycobacterium
PDRELAFLHPLPVRRLWGVGAKTAE

SEQ ID NO: 886844 - protein, 22 aa, Mycobacterium
PDRNLFMPMAFHLGYHSLPIGN

SEQ ID NO: 886845 - protein, 24 aa, Mycobacterium
PDRPTLVPAERYYSPAFAALEVKR

SEQ ID NO: 886846 - protein, 28 aa, Mycobacterium
PDSPLGWLWQILFGTTFPTSISALLTDL

SEQ ID NO: 886847 - protein, 24 aa, Mycobacterium
PDSTLVSWLPFYHDMGLVLGVCAP

SEQ ID NO: 886848 - protein, 26 aa, Mycobacterium
PDTLTQWDLMAWTLPKAANRFWMLSE

SEQ ID NO: 886849 - protein, 23 aa, Mycobacterium
PDTTIVSWLPFYHDMGLVLGVCA

SEQ ID NO: 886850 - protein, 25 aa, Mycobacterium
PDTTVVSWLPFFHDMGLMFGIIMPL

SEQ ID NO: 886851 - protein, 25 aa, Mycobacterium
PDVATWLNKPLPPGLARWQRDHGHQ

SEQ ID NO: 886852 - protein, 20 aa, Mycobacterium
PDVNNLYWNMSLWGDYNVVL

SEQ ID NO: 886853 - protein, 18 aa, Mycobacterium
PDVRYFGATFFTYVGKAL

SEQ ID NO: 886854 - protein, 18 aa, Mycobacterium
PDVSFTFRQFYPDALVEA

SEQ ID NO: 886855 - protein, 20 aa, Mycobacterium
PDVTIGFFLHIPFPPVELFM

SEQ ID NO: 886856 - protein, 20 aa, Mycobacterium
PDWMLQTRLKALRIFDRKPM

SEQ ID NO: 886857 - protein, 18 aa, Mycobacterium
PDWVLPRWGAEAPGAVGR

SEQ ID NO: 886858 - protein, 20 aa, Mycobacterium
PDYLAIMRDCGFTRMGVWSE

SEQ ID NO: 886859 - protein, 25 aa, Mycobacterium
PDYPAALYANFFPRYLRGISDDADA

SEQ ID NO: 886860 - protein, 17 aa, Mycobacterium
PEAFFQFPTSKYGLALD

SEQ ID NO: 886861 - protein, 17 aa, Mycobacterium
PEANSIAWLLWHSARVQ

SEQ ID NO: 886862 - protein, 25 aa, Mycobacterium
PEARQQFWELIRLLAADGTTIVLTT

SEQ ID NO: 886863 - protein, 25 aa, Mycobacterium
PEDLVGMCLFLLSDQARWITGQIFN

SEQ ID NO: 886864 - protein, 24 aa, Mycobacterium
PEDRFMLKDPIYGLGPRVAQLVAG

SEQ ID NO: 886865 - protein, 25 aa, Mycobacterium
PEFVIALRAIWRLGAAAVLISPAWK

SEQ ID NO: 886866 - protein, 26 aa, Mycobacterium
PEFVVALRAIWRLGAAAVLLSPAWKQ

SEQ ID NO: 886867 - protein, 22 aa, Mycobacterium
PEGADPFVFLFSESSGRVLVAV

SEQ ID NO: 886868 - protein, 18 aa, Mycobacterium
PEGFFGRMLAAIRPYRPS

SEQ ID NO: 886869 - protein, 19 aa, Mycobacterium
PEGFQWRGLYVERLCLAVP

SEQ ID NO: 886870 - protein, 18 aa, Mycobacterium
PEHDLLACWLLEVAGIAV

SEQ ID NO: 886871 - protein, 23 aa, Mycobacterium
PEIAQFQWRTKVYWVNGTHSRSS

SEQ ID NO: 886872 - protein, 21 aa, Mycobacterium
PEINSLRMFGGAGSAPMLSAA

SEQ ID NO: 886873 - protein, 20 aa, Mycobacterium
PEINSSRMFAGAGAAPMLDA

SEQ ID NO: 886874 - protein, 18 aa, Mycobacterium
PEINSVRMFAGAGAAPML

SEQ ID NO: 886875 - protein, 20 aa, Mycobacterium
PELAQFTWRTRHNWVSGTHS

SEQ ID NO: 886876 - protein, 20 aa, Mycobacterium
PELGGFRWLTVGPPGQEDVS

SEQ ID NO: 886877 - protein, 23 aa, Mycobacterium
PELVKGMAWGLAPYTAAIGGGDP

SEQ ID NO: 886878 - protein, 18 aa, Mycobacterium
PELVWLGAAIIIGAGSTS

SEQ ID NO: 886879 - protein, 17 aa, Mycobacterium
PEMGLVGRQLWDQSGLT

SEQ ID NO: 886880 - protein, 18 aa, Mycobacterium
PEMGLVGRQLWQQSGLTP

SEQ ID NO: 886881 - protein, 18 aa, Mycobacterium
PEMLSFVLKHTPLKMCWV

SEQ ID NO: 886882 - protein, 23 aa, Mycobacterium
PENISPLVVWLGSAESRDVTGKV

SEQ ID NO: 886883 - protein, 21 aa, Mycobacterium
PENLAYFAVRWKNVLRQAAVY

SEQ ID NO: 886884 - protein, 19 aa, Mycobacterium
PENVSPLVVWLGSPESREV

SEQ ID NO: 886885 - protein, 23 aa, Mycobacterium
PEPALSWLRDTFPAALVAPVAAY

SEQ ID NO: 886886 - protein, 24 aa, Mycobacterium
PEPLRHFYIAYRALVRAKVDCIRF

SEQ ID NO: 886887 - protein, 21 aa, Mycobacterium
PEPYRLLVGGYRDLVQRIVDR

SEQ ID NO: 886888 - protein, 18 aa, Mycobacterium
PEQGAWLQPFRPLSSLLN

SEQ ID NO: 886889 - protein, 18 aa, Mycobacterium
PEQGAWLQPFRPLSSLLT

SEQ ID NO: 886890 - protein, 22 aa, Mycobacterium
PEQKFLRHLLSGELRQGALAGV

SEQ ID NO: 886891 - protein, 23 aa, Mycobacterium
PERDAWYEAYFAWELALLKETEG

SEQ ID NO: 886892 - protein, 23 aa, Mycobacterium
PERILSTGPLLFAAIRTLGRGPV

SEQ ID NO: 886893 - protein, 17 aa, Mycobacterium
PERLLLEDVPDSSLVCV

SEQ ID NO: 886894 - protein, 25 aa, Mycobacterium
PERVWGWYLWRHYLVADVAPNPGHQ

SEQ ID NO: 886895 - protein, 20 aa, Mycobacterium
PESPDAPLLLIFPHAGAGAS

SEQ ID NO: 886896 - protein, 26 aa, Mycobacterium
PETLFDALLPRYIATRVYAALLEAAA

SEQ ID NO: 886897 - protein, 18 aa, Mycobacterium
PEVELFPGWIRLATKMSG

SEQ ID NO: 886898 - protein, 21 aa, Mycobacterium
PEVIRFLAYTGLRWGEMAALR

SEQ ID NO: 886899 - protein, 20 aa, Mycobacterium
PEVNSLRMFTGAGSAPMLDA

SEQ ID NO: 886900 - protein, 19 aa, Mycobacterium
PEVSLPPWLATNLANWNTI

SEQ ID NO: 886901 - protein, 18 aa, Mycobacterium
PEWALWYSGYLQARLWDR

SEQ ID NO: 886902 - protein, 20 aa, Mycobacterium
PEWFCELTWPAKPLAAHHDP

SEQ ID NO: 886903 - protein, 22 aa, Mycobacterium
PEWFYIVRFNLAELWHGYTGTT

SEQ ID NO: 886904 - protein, 17 aa, Mycobacterium
PEWVLPPEDIPFIYPDE

SEQ ID NO: 886905 - protein, 21 aa, Mycobacterium
PFAMVLPIRLSGTRPPIWCPS

SEQ ID NO: 886906 - protein, 22 aa, Mycobacterium
PFAVLRLQYQVARLPLQLIEDQ

SEQ ID NO: 886907 - protein, 18 aa, Mycobacterium
PFDAIPYVRKLVGDVLHG

SEQ ID NO: 886908 - protein, 18 aa, Mycobacterium
PFDHPLWVLYSSGTTGLP

SEQ ID NO: 886909 - protein, 19 aa, Mycobacterium
PFFELLARIGARTPRRVVD

SEQ ID NO: 886910 - protein, 22 aa, Mycobacterium
PFFGDRRKAFLDDLAIVTGGQV

SEQ ID NO: 886911 - protein, 23 aa, Mycobacterium
PFFGDRRKAFLEDLAIVTGGQVI

SEQ ID NO: 886912 - protein, 19 aa, Mycobacterium
PFFGSLLEFITSAPVVAAI

SEQ ID NO: 886913 - protein, 19 aa, Mycobacterium
PFFGSLLEFITSGPLVAAI

SEQ ID NO: 886914 - protein, 19 aa, Mycobacterium
PFFGSLLEFITSGPVVAAI

SEQ ID NO: 886915 - protein, 19 aa, Mycobacterium
PFFVIAVFARGLLHRLFTR

SEQ ID NO: 886916 - protein, 18 aa, Mycobacterium
PFHNMVVIYALFPNIVLS

SEQ ID NO: 886917 - protein, 20 aa, Mycobacterium
PFLAPYGVDIPIRVIREQIV

SEQ ID NO: 886918 - protein, 17 aa, Mycobacterium
PFLLPDIPVVAWWPDVA

SEQ ID NO: 886919 - protein, 24 aa, Mycobacterium
PFLLSVGDLLLAWLLLQQAEIALN

SEQ ID NO: 886920 - protein, 23 aa, Mycobacterium
PFNSMASFLWWKLEPAIAELERL

SEQ ID NO: 886921 - protein, 17 aa, Mycobacterium
PFPSFFADDFTILDGLL

SEQ ID NO: 886922 - protein, 18 aa, Mycobacterium
PFSYLRPGTVLGADGKLG

SEQ ID NO: 886923 - protein, 18 aa, Mycobacterium
PFYDPWFAKARTSGAIEA

SEQ ID NO: 886924 - protein, 17 aa, Mycobacterium
PFYDPWFAKARTTGAIE

SEQ ID NO: 886925 - protein, 18 aa, Mycobacterium
PFYDPWFAKARTTGAIES

SEQ ID NO: 886926 - protein, 17 aa, Mycobacterium
PFYVWDFAERFKEDVID

SEQ ID NO: 886927 - protein, 17 aa, Mycobacterium
PGAALFVLDRWLRPVPP

SEQ ID NO: 886928 - protein, 27 aa, Mycobacterium
PGADIRFWAFDLLYLDGKSLLRTKYRD

SEQ ID NO: 886929 - protein, 17 aa, Mycobacterium
PGAFWLPRRLGGGAPTP

SEQ ID NO: 886930 - protein, 29 aa, Mycobacterium
PGAGPLYYPNFITTLPYLGQVLLQGGVPG

SEQ ID NO: 886931 - protein, 25 aa, Mycobacterium
PGAIIRDLNLLRPIYAPTAAYGHFG

SEQ ID NO: 886932 - protein, 20 aa, Mycobacterium
PGAMIRRALYYRYLLRWQPA

SEQ ID NO: 886933 - protein, 17 aa, Mycobacterium
PGARRHLLSWGIGECGI

SEQ ID NO: 886934 - protein, 22 aa, Mycobacterium
PGARVIFIERLRYLGDLPLSLD

SEQ ID NO: 886935 - protein, 18 aa, Mycobacterium
PGASYFVLVFDKAALSGD

SEQ ID NO: 886936 - protein, 17 aa, Mycobacterium
PGAVAFIRRARRMLPGD

SEQ ID NO: 886937 - protein, 22 aa, Mycobacterium
PGAYICVYPFVRSLEWYLLPDE

SEQ ID NO: 886938 - protein, 25 aa, Mycobacterium
PGDPLRLPGFPFQFFCYKRIAAVNA

SEQ ID NO: 886939 - protein, 23 aa, Mycobacterium
PGDPTLRRLLPDFYKLDPGDPMT

SEQ ID NO: 886940 - protein, 17 aa, Mycobacterium
PGDWLYFVTIDGQGTTL

SEQ ID NO: 886941 - protein, 20 aa, Mycobacterium
PGFKGWLKKVFFGGSGQVPI

SEQ ID NO: 886942 - protein, 20 aa, Mycobacterium
PGFVRVGSPTRLWWPDFPGN

SEQ ID NO: 886943 - protein, 22 aa, Mycobacterium
PGGLSCFFLPRVLPDGSRNRMR

SEQ ID NO: 886944 - protein, 25 aa, Mycobacterium
PGGRAHLLNCYLWLAPDGVTLIDTG

SEQ ID NO: 886945 - protein, 24 aa, Mycobacterium
PGGRDELWRFTPLKRLRGLHDGSA

SEQ ID NO: 886946 - protein, 24 aa, Mycobacterium
PGGRDELWRFTPLRRLRGLHDGTA

SEQ ID NO: 886947 - protein, 23 aa, Mycobacterium
PGGRYGWRVSLPAMMSYWSELAR

SEQ ID NO: 886948 - protein, 17 aa, Mycobacterium
PGHWLLARLGKRVLRPG

SEQ ID NO: 886949 - protein, 17 aa, Mycobacterium
PGIEFSALVASPNGAKR

SEQ ID NO: 886950 - protein, 23 aa, Mycobacterium
PGIKTYLDLPLIAGRPLAAMSKG

SEQ ID NO: 886951 - protein, 20 aa, Mycobacterium
PGIVWLRELLHRLAGRGCTV

SEQ ID NO: 886952 - protein, 22 aa, Mycobacterium
PGKAPAKLLEARFGREAMLDQV

SEQ ID NO: 886953 - protein, 23 aa, Mycobacterium
PGKDLWWFWTGLTPSYPEDGWDV

SEQ ID NO: 886954 - protein, 23 aa, Mycobacterium
PGKGPFNRMLLPSSTPPLEPDDP

SEQ ID NO: 886955 - protein, 18 aa, Mycobacterium
PGKGWRLIQAVVAFPDVE

SEQ ID NO: 886956 - protein, 23 aa, Mycobacterium
PGKIRRFLTIARLLAPVAVPLVY

SEQ ID NO: 886957 - protein, 24 aa, Mycobacterium
PGLDTRAWRLPWLNDTVIFEVDRP

SEQ ID NO: 886958 - protein, 20 aa, Mycobacterium
PGLGTWWGSWRRFLPAGQDQ

SEQ ID NO: 886959 - protein, 20 aa, Mycobacterium
PGLQLLHCIAFDAAVTGGQT

SEQ ID NO: 886960 - protein, 21 aa, Mycobacterium
PGLRLAWMVLPADIVPDVLDA

SEQ ID NO: 886961 - protein, 17 aa, Mycobacterium
PGLVKLRRLVDEGFFGR

SEQ ID NO: 886962 - protein, 17 aa, Mycobacterium
PGLVPSPLYDSLLAKVI

SEQ ID NO: 886963 - protein, 23 aa, Mycobacterium
PGLYFRPMLIPISIHLCEDPERG

SEQ ID NO: 886964 - protein, 18 aa, Mycobacterium
PGNDHHFLINPYGLLFEE

SEQ ID NO: 886965 - protein, 18 aa, Mycobacterium
PGNLVIIMSFVHLDEAER

SEQ ID NO: 886966 - protein, 23 aa, Mycobacterium
PGNPLAILVPFSAAVMDVAAIGA

SEQ ID NO: 886967 - protein, 22 aa, Mycobacterium
PGNTRFVVLLPLQAPPPDGDSS

SEQ ID NO: 886968 - protein, 25 aa, Mycobacterium
PGPKGFLDFPIPIGGLYLGGAGCHG

SEQ ID NO: 886969 - protein, 23 aa, Mycobacterium
PGPLAIPSMEYPSAAAAADEMDW

SEQ ID NO: 886970 - protein, 22 aa, Mycobacterium
PGQPPPPLWSLVQSFVLEAWPD

SEQ ID NO: 886971 - protein, 20 aa, Mycobacterium
PGRAMVILMLMRYVDGDLGE

SEQ ID NO: 886972 - protein, 20 aa, Mycobacterium
PGRGWQHRWALSVLNSALGG

SEQ ID NO: 886973 - protein, 25 aa, Mycobacterium
PGRLSWAMLRPLYTAALRALAADVI

SEQ ID NO: 886974 - protein, 20 aa, Mycobacterium
PGSILVPFSWQQVSLHAAGA

SEQ ID NO: 886975 - protein, 22 aa, Mycobacterium
PGSVLLVLPTLRLIKLTSVVEN

SEQ ID NO: 886976 - protein, 17 aa, Mycobacterium
PGTINRFVFALPAIHDR

SEQ ID NO: 886977 - protein, 23 aa, Mycobacterium
PGTKLMILPPLIHGAAQWSVMTA

SEQ ID NO: 886978 - protein, 24 aa, Mycobacterium
PGTVFLNVNWSFKAPVRPGDVITG

SEQ ID NO: 886979 - protein, 20 aa, Mycobacterium
PGWAYGLYTAIAAPMAAGIS

SEQ ID NO: 886980 - protein, 19 aa, Mycobacterium
PGWHALRKLAARITTPLLP

SEQ ID NO: 886981 - protein, 19 aa, Mycobacterium
PGWHALRRLAARITTPLLP

SEQ ID NO: 886982 - protein, 19 aa, Mycobacterium
PGWIASMTDFWLTGAGLAI

SEQ ID NO: 886983 - protein, 26 aa, Mycobacterium
PHAMTGTLVWFLPPFVDDISGPPVSG

SEQ ID NO: 886984 - protein, 19 aa, Mycobacterium
PHDIVLFPAWVRRNPLKPS

SEQ ID NO: 886985 - protein, 19 aa, Mycobacterium
PHDPPWHRPLLGIRRTVTH

SEQ ID NO: 886986 - protein, 18 aa, Mycobacterium
PHFDHAMAAYYLILPSEV

SEQ ID NO: 886987 - protein, 19 aa, Mycobacterium
PHFEYALAAYYLILPSEVS

SEQ ID NO: 886988 - protein, 17 aa, Mycobacterium
PHGLWTRNYKEMMNEMA

SEQ ID NO: 886989 - protein, 19 aa, Mycobacterium
PHGWIHNELRRRCGGPPIA

SEQ ID NO: 886990 - protein, 24 aa, Mycobacterium
PHLRRYLWCYVAQAAEPGLDLLRG

SEQ ID NO: 886991 - protein, 26 aa, Mycobacterium
PHLVKPLPFLFPLTKRWWERPYIAAG

SEQ ID NO: 886992 - protein, 18 aa, Mycobacterium
PHPELLRAWDLPATADGL

SEQ ID NO: 886993 - protein, 19 aa, Mycobacterium
PHPELLRAWDLPATADGLA

SEQ ID NO: 886994 - protein, 25 aa, Mycobacterium
PHPLAHLRAFVLIPWLDVDPDATLT

SEQ ID NO: 886995 - protein, 26 aa, Mycobacterium
PHPLAHLRAFVMIPWLAIDPDAQLTV

SEQ ID NO: 886996 - protein, 18 aa, Mycobacterium
PHPTPLDPWTWTALQRCI

SEQ ID NO: 886997 - protein, 17 aa, Mycobacterium
PIALEFLLQLLAPLDVA

SEQ ID NO: 886998 - protein, 19 aa, Mycobacterium
PIARTRLTLATPGMGALMG

SEQ ID NO: 886999 - protein, 25 aa, Mycobacterium
PIASPLPHPLLLRVPVDEDVLSVIT

SEQ ID NO: 887000 - protein, 17 aa, Mycobacterium
PIDPEWGPGWHLGVVGL

SEQ ID NO: 887001 - protein, 30 aa, Mycobacterium
PIERFLEWYAPFANFFYDTLGLPFFGAGIT

SEQ ID NO: 887002 - protein, 26 aa, Mycobacterium
PIGAVLLSWLPLFHDMGLILGICAPL

SEQ ID NO: 887003 - protein, 17 aa, Mycobacterium
PIGSPAYLPFFPELART

SEQ ID NO: 887004 - protein, 17 aa, Mycobacterium
PIIAGNLFRFELLRTRH

SEQ ID NO: 887005 - protein, 24 aa, Mycobacterium
PIIGTPWLTSFAQRSRFAEAFGSM

SEQ ID NO: 887006 - protein, 27 aa, Mycobacterium
PIIMTAQRLLPARLFLKFLARMHGLKV

SEQ ID NO: 887007 - protein, 25 aa, Mycobacterium
PIISRFRWLTVLPAYFIGIGVRPEH

SEQ ID NO: 887008 - protein, 17 aa, Mycobacterium
PIKLPFFVGRWPLKFIP

SEQ ID NO: 887009 - protein, 22 aa, Mycobacterium
PILGTPWIANLARRSRFAEAFR

SEQ ID NO: 887010 - protein, 22 aa, Mycobacterium
PILHLPSHWPWAQQWLTLWRNT

SEQ ID NO: 887011 - protein, 18 aa, Mycobacterium
PILWGDMPTLPLYRQQRT

SEQ ID NO: 887012 - protein, 25 aa, Mycobacterium
PIMGTPWLTSFAQRSRFAEAFGSVG

SEQ ID NO: 887013 - protein, 18 aa, Mycobacterium
PIMIELNLGFQPTAQAAR

SEQ ID NO: 887014 - protein, 17 aa, Mycobacterium
PIPLPLKTSYAWAETDF

SEQ ID NO: 887015 - protein, 17 aa, Mycobacterium
PIPLRPRPFRTNTVVST

SEQ ID NO: 887016 - protein, 18 aa, Mycobacterium
PIPWSYMEAYIRAYQALL

SEQ ID NO: 887017 - protein, 19 aa, Mycobacterium
PIQSSILGAFPRGTSVKVS

SEQ ID NO: 887018 - protein, 17 aa, Mycobacterium
PIRPLYTRVLLKLGGEM

SEQ ID NO: 887019 - protein, 26 aa, Mycobacterium
PITEQHLDVPLYWQCWKLDSAVVAQV

SEQ ID NO: 887020 - protein, 21 aa, Mycobacterium
PITRPRIRFAYQLTPRRVLGE

SEQ ID NO: 887021 - protein, 18 aa, Mycobacterium
PITTPFGLFDCDVPCDAA

SEQ ID NO: 887022 - protein, 17 aa, Mycobacterium
PITTPFGLYDCDVPCDG

SEQ ID NO: 887023 - protein, 19 aa, Mycobacterium
PITWPLHISLLLAKEYALT

SEQ ID NO: 887024 - protein, 20 aa, Mycobacterium
PIVFLRLRKAARKHGLPVYA

SEQ ID NO: 887025 - protein, 19 aa, Mycobacterium
PIVVRLLVTAMRHAAVSRE

SEQ ID NO: 887026 - protein, 17 aa, Mycobacterium
PIWLHTYNYHRGHTALG

SEQ ID NO: 887027 - protein, 18 aa, Mycobacterium
PIWLWHNVEDRLGISEIV

SEQ ID NO: 887028 - protein, 17 aa, Mycobacterium
PIYALNILLATATDLWA

SEQ ID NO: 887029 - protein, 21 aa, Mycobacterium
PIYALPSYFMAAGTPLYAMSS

SEQ ID NO: 887030 - protein, 26 aa, Mycobacterium
PKAIRELFTIRLRLELLATEWALPRL

SEQ ID NO: 887031 - protein, 21 aa, Mycobacterium
PKAPPPPPPPPPPPTTRMRWP

SEQ ID NO: 887032 - protein, 22 aa, Mycobacterium
PKARFLPTRLAAIPALLADVLR

SEQ ID NO: 887033 - protein, 23 aa, Mycobacterium
PKASVMTHYRWLRALAGFGGLGL

SEQ ID NO: 887034 - protein, 23 aa, Mycobacterium
PKASVMTHYRWLRGMSGIGDMAL

SEQ ID NO: 887035 - protein, 23 aa, Mycobacterium
PKDADWALFSRLMPILPTTVESS

SEQ ID NO: 887036 - protein, 18 aa, Mycobacterium
PKDISVVHPILLFSLMKG

SEQ ID NO: 887037 - protein, 19 aa, Mycobacterium
PKESWLRLVLIDAGLPRPT

SEQ ID NO: 887038 - protein, 23 aa, Mycobacterium
PKESWLRLVLIQAGLPRPQTQIP

SEQ ID NO: 887039 - protein, 23 aa, Mycobacterium
PKETWLRLLLLDDGLPRPQTQIR

SEQ ID NO: 887040 - protein, 18 aa, Mycobacterium
PKFTGFSPVIWSLISGAG

SEQ ID NO: 887041 - protein, 19 aa, Mycobacterium
PKGIFPWYAPGRDDFLGEF

SEQ ID NO: 887042 - protein, 24 aa, Mycobacterium
PKHKRLTLFLIPMDRPGFTVRPIP

SEQ ID NO: 887043 - protein, 25 aa, Mycobacterium
PKHTRIFRLFNFSPALFSLPLAVDR

SEQ ID NO: 887044 - protein, 22 aa, Mycobacterium
PKHWTLLKWLDDPVPFFNWRAG

SEQ ID NO: 887045 - protein, 19 aa, Mycobacterium
PKLFIFPHAGGTPQYYVPF

SEQ ID NO: 887046 - protein, 22 aa, Mycobacterium
PKLLTPAPFFDATVVTAIESGL

SEQ ID NO: 887047 - protein, 19 aa, Mycobacterium
PKLVFFFDEAHLLFADASK

SEQ ID NO: 887048 - protein, 19 aa, Mycobacterium
PKLYPHMWSWDAAFVAVGL

SEQ ID NO: 887049 - protein, 23 aa, Mycobacterium
PKPKRLTLFLIPMDRPGITVRPI

SEQ ID NO: 887050 - protein, 24 aa, Mycobacterium
PKRLGSFMDGRLWKMLLGSSRGLG

SEQ ID NO: 887051 - protein, 21 aa, Mycobacterium
PKVFFVNWFRRGHDGHFLWPG

SEQ ID NO: 887052 - protein, 20 aa, Mycobacterium
PKVMKPILQLAPDLSCPLLG

SEQ ID NO: 887053 - protein, 20 aa, Mycobacterium
PKYDSWLTQAPWQFNADLHL

SEQ ID NO: 887054 - protein, 22 aa, Mycobacterium
PLAGLHFFPAPALPAGMLSTLA

SEQ ID NO: 887055 - protein, 24 aa, Mycobacterium
PLAHLAFFVLDKFLRRVSAGAVGE

SEQ ID NO: 887056 - protein, 25 aa, Mycobacterium
PLAHLAFFVLDRWLRPVPAGVVGEL

SEQ ID NO: 887057 - protein, 21 aa, Mycobacterium
PLCRRLVMSVPFFKAVQRPNV

SEQ ID NO: 887058 - protein, 24 aa, Mycobacterium
PLDFLSDILLWPKLIDKYRATMTA

SEQ ID NO: 887059 - protein, 25 aa, Mycobacterium
PLDPAWLLDILGLTDAARTTYRRLS

SEQ ID NO: 887060 - protein, 19 aa, Mycobacterium
PLDPRWLLDTLGLTDAART

SEQ ID NO: 887061 - protein, 19 aa, Mycobacterium
PLDRRLLLTVLADLAPGSG

SEQ ID NO: 887062 - protein, 18 aa, Mycobacterium
PLDVLLVRKLGVPAHSEL

SEQ ID NO: 887063 - protein, 20 aa, Mycobacterium
PLEHLAFFVLDGWLRKVPVG

SEQ ID NO: 887064 - protein, 20 aa, Mycobacterium
PLERDTCWPWLEAEWRLVSE

SEQ ID NO: 887065 - protein, 26 aa, Mycobacterium
PLFMAGLWSVWKPAKEGSPLLSCTII

SEQ ID NO: 887066 - protein, 17 aa, Mycobacterium
PLFMRILRNSQLLDVLL

SEQ ID NO: 887067 - protein, 22 aa, Mycobacterium
PLGERAQWWWYQPFEPQPPPSA

SEQ ID NO: 887068 - protein, 20 aa, Mycobacterium
PLGGSLYELCQVRYGLQADS

SEQ ID NO: 887069 - protein, 23 aa, Mycobacterium
PLGRGFILLLHKLIHQLMSELEA

SEQ ID NO: 887070 - protein, 19 aa, Mycobacterium
PLGRGFRPKVWPPVRRIDG

SEQ ID NO: 887071 - protein, 17 aa, Mycobacterium
PLHILQQQTLNAINAPF

SEQ ID NO: 887072 - protein, 24 aa, Mycobacterium
PLIREMMIYALRWPIDRGPADAAS

SEQ ID NO: 887073 - protein, 22 aa, Mycobacterium
PLIREMMIYGLRWPIDRADGDE

SEQ ID NO: 887074 - protein, 19 aa, Mycobacterium
PLITNMIRLLKLPIAVQRR

SEQ ID NO: 887075 - protein, 20 aa, Mycobacterium
PLLAAINAPALALTGRPLIG

SEQ ID NO: 887076 - protein, 25 aa, Mycobacterium
PLLATYAFLPILRAFAEPAGIKIKS

SEQ ID NO: 887077 - protein, 20 aa, Mycobacterium
PLLATYAFLPIVRAFAEPAG

SEQ ID NO: 887078 - protein, 21 aa, Mycobacterium
PLLDLGWLLATWRQPDGSSVF

SEQ ID NO: 887079 - protein, 17 aa, Mycobacterium
PLLDVLLARGIDAPYSC

SEQ ID NO: 887080 - protein, 20 aa, Mycobacterium
PLLERLMGWVLTYPFNMTTN

SEQ ID NO: 887081 - protein, 29 aa, Mycobacterium
PLLGLMLPYSPIHHLLLAPVPGADAAAPE

SEQ ID NO: 887082 - protein, 18 aa, Mycobacterium
PLLGPWGAARVFGPQKGA

SEQ ID NO: 887083 - protein, 18 aa, Mycobacterium
PLMRAVLLTNAGRSALIL

SEQ ID NO: 887084 - protein, 17 aa, Mycobacterium
PLNFYSLYRAHDLHFIV

SEQ ID NO: 887085 - protein, 18 aa, Mycobacterium
PLNFYSLYRAHDLHFIVY

SEQ ID NO: 887086 - protein, 18 aa, Mycobacterium
PLNIPVVIHLPFQGLLVP

SEQ ID NO: 887087 - protein, 22 aa, Mycobacterium
PLNLPIMTSLYLLGAPSTSKLY

SEQ ID NO: 887088 - protein, 22 aa, Mycobacterium
PLPATHIGGLWWILNGLMHGAS

SEQ ID NO: 887089 - protein, 20 aa, Mycobacterium
PLPEPLPVGPTRRAPLGLIA

SEQ ID NO: 887090 - protein, 19 aa, Mycobacterium
PLPFVHQSAPLYLAGAARP

SEQ ID NO: 887091 - protein, 18 aa, Mycobacterium
PLPFVHQSSPLYLAGAAR

SEQ ID NO: 887092 - protein, 19 aa, Mycobacterium
PLPFVHQSSPLYLAGAARP

SEQ ID NO: 887093 - protein, 17 aa, Mycobacterium
PLPFVHQSSPLYLAGGA

SEQ ID NO: 887094 - protein, 19 aa, Mycobacterium
PLPFVHQSSPLYLAGGSRP

SEQ ID NO: 887095 - protein, 20 aa, Mycobacterium
PLPGTALFVLDRWLRQLPTE

SEQ ID NO: 887096 - protein, 19 aa, Mycobacterium
PLPKFDFIPSALLPAWISD

SEQ ID NO: 887097 - protein, 17 aa, Mycobacterium
PLPLFGELAARPARRVV

SEQ ID NO: 887098 - protein, 17 aa, Mycobacterium
PLPMVSWLYEYGNYRRF

SEQ ID NO: 887099 - protein, 17 aa, Mycobacterium
PLPPKRAGLLVGALYRI

SEQ ID NO: 887100 - protein, 24 aa, Mycobacterium
PLPRWQIALYWRTDGLPLWTDAEL

SEQ ID NO: 887101 - protein, 23 aa, Mycobacterium
PLPRWQIALYWRTDGRPLWTDDT

SEQ ID NO: 887102 - protein, 23 aa, Mycobacterium
PLPRWQIGLYWRADGEPLWSDDR

SEQ ID NO: 887103 - protein, 23 aa, Mycobacterium
PLPRWQIGLYWRRDGQPLWSDPE

SEQ ID NO: 887104 - protein, 18 aa, Mycobacterium
PLPTVWPGSAYPLGATYD

SEQ ID NO: 887105 - protein, 17 aa, Mycobacterium
PLPTWTHRRLWLSGGGQ

SEQ ID NO: 887106 - protein, 18 aa, Mycobacterium
PLPWSIMHKVKAPTLLTW

SEQ ID NO: 887107 - protein, 20 aa, Mycobacterium
PLRALILRLADDRVVLGLNY

SEQ ID NO: 887108 - protein, 24 aa, Mycobacterium
PLRDIWLLRMRAALAGARGAGGDY

SEQ ID NO: 887109 - protein, 18 aa, Mycobacterium
PLRTHVLVRFGRWQELIA

SEQ ID NO: 887110 - protein, 26 aa, Mycobacterium
PLSFAQSRLWFIYKYEGPSATYNVPL

SEQ ID NO: 887111 - protein, 17 aa, Mycobacterium
PLSGLIFPGWDTAAESP

SEQ ID NO: 887112 - protein, 17 aa, Mycobacterium
PLSIDLLVDLWLDKQRF

SEQ ID NO: 887113 - protein, 17 aa, Mycobacterium
PLSLMLLATAIAQQGRI

SEQ ID NO: 887114 - protein, 19 aa, Mycobacterium
PLSLPLLMSGLDGRFSHKT

SEQ ID NO: 887115 - protein, 22 aa, Mycobacterium
PLTDLGWLEMLWAQPVGINSHP

SEQ ID NO: 887116 - protein, 17 aa, Mycobacterium
PLTDQVFLKYWKVDPVR

SEQ ID NO: 887117 - protein, 19 aa, Mycobacterium
PLTLPAVYRWCGLHARYLI

SEQ ID NO: 887118 - protein, 17 aa, Mycobacterium
PLTLTVPFVVPLVGVVP

SEQ ID NO: 887119 - protein, 19 aa, Mycobacterium
PLTVPIWYYYTAGGELWIP

SEQ ID NO: 887120 - protein, 18 aa, Mycobacterium
PLTWPLHISLLLAKEFAL

SEQ ID NO: 887121 - protein, 17 aa, Mycobacterium
PLVAYLIATVDLPEPAV

SEQ ID NO: 887122 - protein, 23 aa, Mycobacterium
PLVLKPWTMPEPLLPIAIQAHAK

SEQ ID NO: 887123 - protein, 19 aa, Mycobacterium
PLVSVILRRGYGLGAQAMT

SEQ ID NO: 887124 - protein, 17 aa, Mycobacterium
PLVTAVLPPAADAVSLQ

SEQ ID NO: 887125 - protein, 26 aa, Mycobacterium
PLVYLAQAWDWIFPLGPDANYEPDRS

SEQ ID NO: 887126 - protein, 26 aa, Mycobacterium
PLYKMPWSTMFPLGISSATIGICEGA

SEQ ID NO: 887127 - protein, 20 aa, Mycobacterium
PLYLLDFLRQSGETPIVLLH

SEQ ID NO: 887128 - protein, 24 aa, Mycobacterium
PMDRFHRRLLWPIRSSAGEVIGFG

SEQ ID NO: 887129 - protein, 18 aa, Mycobacterium
PMDVWWFRLPRHPGDPRG

SEQ ID NO: 887130 - protein, 17 aa, Mycobacterium
PMECAFFSLRGLALLTD

SEQ ID NO: 887131 - protein, 18 aa, Mycobacterium
PMFLLYDYSFLPEGASSK

SEQ ID NO: 887132 - protein, 18 aa, Mycobacterium
PMFLLYDYSFLPHGATSK

SEQ ID NO: 887133 - protein, 19 aa, Mycobacterium
PMFLLYDYSFLPQGAGTKA

SEQ ID NO: 887134 - protein, 18 aa, Mycobacterium
PMFTLMLARAKLIGTTIR

SEQ ID NO: 887135 - protein, 17 aa, Mycobacterium
PMGWQSSRLEFLRAWLA

SEQ ID NO: 887136 - protein, 18 aa, Mycobacterium
PMIRYPIPPMIHGATQSS

SEQ ID NO: 887137 - protein, 20 aa, Mycobacterium
PMIYFGPFTPAISPLGLPAV

SEQ ID NO: 887138 - protein, 19 aa, Mycobacterium
PMIYYPLTTLMMAGIRDIQ

SEQ ID NO: 887139 - protein, 17 aa, Mycobacterium
PMLTFRLWRPLSHDTME

SEQ ID NO: 887140 - protein, 17 aa, Mycobacterium
PMPNLVPLSLSLWAGIY

SEQ ID NO: 887141 - protein, 19 aa, Mycobacterium
PMPRALMWALHEHLLGANP

SEQ ID NO: 887142 - protein, 17 aa, Mycobacterium
PMRLALPGAVNRGNAAQ

SEQ ID NO: 887143 - protein, 19 aa, Mycobacterium
PMRWLVRGIWPERSAGVLG

SEQ ID NO: 887144 - protein, 23 aa, Mycobacterium
PMTDLLLGLIRRGTTQDLINYRT

SEQ ID NO: 887145 - protein, 19 aa, Mycobacterium
PMTGVWPRVPRRFWHVGPM

SEQ ID NO: 887146 - protein, 19 aa, Mycobacterium
PMTWPWNVLGWPSINVPAG

SEQ ID NO: 887147 - protein, 18 aa, Mycobacterium
PMVFDLMSGIYWRPGESG

SEQ ID NO: 887148 - protein, 23 aa, Mycobacterium
PMVYYPLSTLMLAGIRDILVITT

SEQ ID NO: 887149 - protein, 20 aa, Mycobacterium
PNAEFFAAPLSWQQELWPTE

SEQ ID NO: 887150 - protein, 29 aa, Mycobacterium
PNAPMRSVHLWALPQPLPAPPSLTLATEA

SEQ ID NO: 887151 - protein, 21 aa, Mycobacterium
PNELLKPLPLAPYTPRWLARK

SEQ ID NO: 887152 - protein, 17 aa, Mycobacterium
PNFRPRLTTAEDARALL

SEQ ID NO: 887153 - protein, 24 aa, Mycobacterium
PNGRYGWRISLPAMMAYWSELARD

SEQ ID NO: 887154 - protein, 22 aa, Mycobacterium
PNLVFQLLWYPSCVGDLALPSF

SEQ ID NO: 887155 - protein, 18 aa, Mycobacterium
PNLWRLLCEQVGAAALVI

SEQ ID NO: 887156 - protein, 25 aa, Mycobacterium
PNPLHPLALPLLRPKQVIMLGRPTL

SEQ ID NO: 887157 - protein, 32 aa, Mycobacterium
PNQKWAPRYLGQPIYNLLLTLLFEWGVAVHDM

SEQ ID NO: 887158 - protein, 24 aa, Mycobacterium
PNRAMRLEALPGWTWGPRSRRTSA

SEQ ID NO: 887159 - protein, 20 aa, Mycobacterium
PNTHGFAMLRALRAIEERDV

SEQ ID NO: 887160 - protein, 22 aa, Mycobacterium
PPALIKAILKAPVDLLWNGGIG

SEQ ID NO: 887161 - protein, 19 aa, Mycobacterium
PPALKWKAFFKRQASNPKY

SEQ ID NO: 887162 - protein, 19 aa, Mycobacterium
PPAMKWKMFFSRQAANRNY

SEQ ID NO: 887163 - protein, 22 aa, Mycobacterium
PPAQHQLLKPFTARYFEAISGV

SEQ ID NO: 887164 - protein, 24 aa, Mycobacterium
PPASLVLFSPLIDLTFGLSAARER

SEQ ID NO: 887165 - protein, 20 aa, Mycobacterium
PPDIELIGMLNLLIGGGFDT

SEQ ID NO: 887166 - protein, 23 aa, Mycobacterium
PPDMKLPIALALGWPARVAGAAA

SEQ ID NO: 887167 - protein, 23 aa, Mycobacterium
PPDMRLPIALALGWPRRVPGAAA

SEQ ID NO: 887168 - protein, 22 aa, Mycobacterium
PPEGLPYRWPHPWLLDKKSAAQ

SEQ ID NO: 887169 - protein, 20 aa, Mycobacterium
PPEHLIFIFATTEPEKVLPT

SEQ ID NO: 887170 - protein, 23 aa, Mycobacterium
PPELYAWLRYDPIPVRDDLAKAL

SEQ ID NO: 887171 - protein, 19 aa, Mycobacterium
PPESLPIKGFLSFDLARVD

SEQ ID NO: 887172 - protein, 18 aa, Mycobacterium
PPFAPWIPKWLWALQRRM

SEQ ID NO: 887173 - protein, 18 aa, Mycobacterium
PPFLKRLVLRTAARLSRR

SEQ ID NO: 887174 - protein, 19 aa, Mycobacterium
PPGNLWRWELSPVNAELTT

SEQ ID NO: 887175 - protein, 19 aa, Mycobacterium
PPGPPMPEPPPAPPAPPEP

SEQ ID NO: 887176 - protein, 29 aa, Mycobacterium
PPGTWTAALIGAWWPAPSTALRAGAQHWN

SEQ ID NO: 887177 - protein, 27 aa, Mycobacterium
PPGVVPKPLKGMPPFSGPQGPFAGIAA

SEQ ID NO: 887178 - protein, 26 aa, Mycobacterium
PPHGWINLHFSLLPAWRGAAPVQAAI

SEQ ID NO: 887179 - protein, 22 aa, Mycobacterium
PPKDYFALLALLKRSLTEDEVV

SEQ ID NO: 887180 - protein, 19 aa, Mycobacterium
PPKGRRWLNKKLGLDNVFL

SEQ ID NO: 887181 - protein, 17 aa, Mycobacterium
PPKLAIPMRVIASVAAI

SEQ ID NO: 887182 - protein, 26 aa, Mycobacterium
PPKRAGLLVGALYRIAKRRLGEVPEP

SEQ ID NO: 887183 - protein, 17 aa, Mycobacterium
PPLLEVVRPATFLFAAG

SEQ ID NO: 887184 - protein, 20 aa, Mycobacterium
PPLLEVVRPATFLFAAGQET

SEQ ID NO: 887185 - protein, 19 aa, Mycobacterium
PPLLRSFAAAPPLVSDIDL

SEQ ID NO: 887186 - protein, 18 aa, Mycobacterium
PPLPFLQYPYVVALIELD

SEQ ID NO: 887187 - protein, 17 aa, Mycobacterium
PPLPGFNAALRRITAEH

SEQ ID NO: 887188 - protein, 18 aa, Mycobacterium
PPLVWRVMERFGVTNFTA

SEQ ID NO: 887189 - protein, 19 aa, Mycobacterium
PPMIRLPIPPMIHGATQSA

SEQ ID NO: 887190 - protein, 23 aa, Mycobacterium
PPMQAFLGMPVIIRGAVYGSLYV

SEQ ID NO: 887191 - protein, 23 aa, Mycobacterium
PPPAPLDPFAPPPPPPAPAPFDA

SEQ ID NO: 887192 - protein, 24 aa, Mycobacterium
PPPDRFLIGLAVLSLLAAAAEHQP

SEQ ID NO: 887193 - protein, 25 aa, Mycobacterium
PPPPKLPLPPMPIGGPPPAPPEPPP

SEQ ID NO: 887194 - protein, 17 aa, Mycobacterium
PPPPLPPLPPGGDPTLP

SEQ ID NO: 887195 - protein, 22 aa, Mycobacterium
PPPRRSIPVPVLYTLGALGSLR

SEQ ID NO: 887196 - protein, 23 aa, Mycobacterium
PPQLVRAILLAPVDLFFNGGIGT

SEQ ID NO: 887197 - protein, 21 aa, Mycobacterium
PPRELQPMWRRAIETPAAQQA

SEQ ID NO: 887198 - protein, 17 aa, Mycobacterium
PPRPAIPPLLRGYLRLG

SEQ ID NO: 887199 - protein, 17 aa, Mycobacterium
PPRPPMPIGGPPPTPPA

SEQ ID NO: 887200 - protein, 25 aa, Mycobacterium
PPTDLFGDWLALARLRLLRATVPSA

SEQ ID NO: 887201 - protein, 25 aa, Mycobacterium
PPTTFPKWLGRSWIRSAMLRYGENP

SEQ ID NO: 887202 - protein, 20 aa, Mycobacterium
PPVLLDKKWLKPTAYMMAKF

SEQ ID NO: 887203 - protein, 24 aa, Mycobacterium
PPVLRLFGDLLYLDRYWLEEQQVC

SEQ ID NO: 887204 - protein, 23 aa, Mycobacterium
PPVMKKYVWPWLAARRQIVVNCY

SEQ ID NO: 887205 - protein, 24 aa, Mycobacterium
PPVREALMRALLRLAARRQPHEIA

SEQ ID NO: 887206 - protein, 19 aa, Mycobacterium
PPWHPMPFHANFDTPIYDS

SEQ ID NO: 887207 - protein, 19 aa, Mycobacterium
PPWWLKPANKVFIQLSRLG

SEQ ID NO: 887208 - protein, 19 aa, Mycobacterium
PPWWLKPANKVFIQMSRLG

SEQ ID NO: 887209 - protein, 19 aa, Mycobacterium
PPYVVRWLVTGHEATVYPG

SEQ ID NO: 887210 - protein, 25 aa, Mycobacterium
PQAGNLFLSLADRIPFALTAWTVGV

SEQ ID NO: 887211 - protein, 18 aa, Mycobacterium
PQAIWPRVRRALAAVGLA

SEQ ID NO: 887212 - protein, 21 aa, Mycobacterium
PQAPPLPIPLAPQPPVPPPPS

SEQ ID NO: 887213 - protein, 28 aa, Mycobacterium
PQAPPMLPPLAPHPPIPPPPSPPPGKPP

SEQ ID NO: 887214 - protein, 20 aa, Mycobacterium
PQFGPFARSYLAGLIAGLRS

SEQ ID NO: 887215 - protein, 18 aa, Mycobacterium
PQFWPLWEAAVDAGWPVA

SEQ ID NO: 887216 - protein, 18 aa, Mycobacterium
PQFWPLWEAAVEAGLPVA

SEQ ID NO: 887217 - protein, 27 aa, Mycobacterium
PQGWVNLHFSLLPAWRGAAPVQAAIAA

SEQ ID NO: 887218 - protein, 19 aa, Mycobacterium
PQHRLFLQTVFHAFEDAGY

SEQ ID NO: 887219 - protein, 26 aa, Mycobacterium
PQIWPGRAIYRIWPDFDVQPLIDASS

SEQ ID NO: 887220 - protein, 18 aa, Mycobacterium
PQLFRYWAEHLDPDRARR

SEQ ID NO: 887221 - protein, 20 aa, Mycobacterium
PQLTHVLTPFLPDWVAEPDE

SEQ ID NO: 887222 - protein, 21 aa, Mycobacterium
PQMLSFVLKHTPLKMCWVPGY

SEQ ID NO: 887223 - protein, 24 aa, Mycobacterium
PQPAQGWMFAAMPLSFLGLNDNSL

SEQ ID NO: 887224 - protein, 26 aa, Mycobacterium
PQQDIPAMLALWRAGRLPVEKLKSDD

SEQ ID NO: 887225 - protein, 25 aa, Mycobacterium
PQQMGWFRFYFADQHWEWSAEVQRM

SEQ ID NO: 887226 - protein, 20 aa, Mycobacterium
PQQNMWWWDVLRHGRNSEYA

SEQ ID NO: 887227 - protein, 25 aa, Mycobacterium
PQQPDMIYQFLPIRWGTIGMAGVEF

SEQ ID NO: 887228 - protein, 23 aa, Mycobacterium
PQQRAWLNLVRPLTIVEGFALLS

SEQ ID NO: 887229 - protein, 25 aa, Mycobacterium
PQRAGWFRFYFTDQRWEWSDQVHRI

SEQ ID NO: 887230 - protein, 18 aa, Mycobacterium
PQREDLVDLLWRMGIRTI

SEQ ID NO: 887231 - protein, 22 aa, Mycobacterium
PQRGWRRWVYAVTRINFGLSPD

SEQ ID NO: 887232 - protein, 17 aa, Mycobacterium
PQRIIPLQLPWLADPQL

SEQ ID NO: 887233 - protein, 23 aa, Mycobacterium
PQRQFGYYVWPFLLDGRLVGRVD

SEQ ID NO: 887234 - protein, 21 aa, Mycobacterium
PQTWYAWRKVIPLLAGEFEVI

SEQ ID NO: 887235 - protein, 26 aa, Mycobacterium
PQVDAKILWLFKRAVPATYTRALGLV

SEQ ID NO: 887236 - protein, 19 aa, Mycobacterium
PQWAPQWWSEIPLPPEPEP

SEQ ID NO: 887237 - protein, 20 aa, Mycobacterium
PQWWGMARALLERPGIFRDA

SEQ ID NO: 887238 - protein, 17 aa, Mycobacterium
PRAALFVLDGWLRPVPA

SEQ ID NO: 887239 - protein, 23 aa, Mycobacterium
PRAGELCAPVRFLVRRDSVVMEL

SEQ ID NO: 887240 - protein, 26 aa, Mycobacterium
PRAHLRAFVLVPWLALEPGAVLTVDG

SEQ ID NO: 887241 - protein, 20 aa, Mycobacterium
PRALILAELLERIAASADRL

SEQ ID NO: 887242 - protein, 22 aa, Mycobacterium
PRARLIFNFPKPATLARILRDA

SEQ ID NO: 887243 - protein, 18 aa, Mycobacterium
PRDLLLDAYLLRAMGIAG

SEQ ID NO: 887244 - protein, 29 aa, Mycobacterium
PRELARTVFIELLAWQFASPVRWIETQDL

SEQ ID NO: 887245 - protein, 28 aa, Mycobacterium
PRELARVVLIELLAWQFASPVRWIETQD

SEQ ID NO: 887246 - protein, 22 aa, Mycobacterium
PRESYLRLLLIDAGLPRPQTQI

SEQ ID NO: 887247 - protein, 23 aa, Mycobacterium
PRETWLRLLFVDAGLPYPTTQYV

SEQ ID NO: 887248 - protein, 17 aa, Mycobacterium
PRFVQPYLWALDSLHRV

SEQ ID NO: 887249 - protein, 22 aa, Mycobacterium
PRGIVYLLRRYDVKLDGAHVVV

SEQ ID NO: 887250 - protein, 23 aa, Mycobacterium
PRGNLAFRWFLADGVPARPQVRL

SEQ ID NO: 887251 - protein, 23 aa, Mycobacterium
PRGQPRLLGFHWTKIHLDDPGLG

SEQ ID NO: 887252 - protein, 17 aa, Mycobacterium
PRGVGTKGVWRLPDRRA

SEQ ID NO: 887253 - protein, 28 aa, Mycobacterium
PRHGWINLHFSLLPAWRGAAPVQAAIAA

SEQ ID NO: 887254 - protein, 19 aa, Mycobacterium
PRHIPLQRLPLPRPTAAVS

SEQ ID NO: 887255 - protein, 26 aa, Mycobacterium
PRHRAIQWWRSPHWLCPYGATAVSRA

SEQ ID NO: 887256 - protein, 17 aa, Mycobacterium
PRHRVAPPPLPAALLDL

SEQ ID NO: 887257 - protein, 18 aa, Mycobacterium
PRHVALVRRIPFTDAGKI

SEQ ID NO: 887258 - protein, 24 aa, Mycobacterium
PRIDAVLPMFLEFARGAVLVAHNA

SEQ ID NO: 887259 - protein, 18 aa, Mycobacterium
PRIPLPEILPHNLVLSNV

SEQ ID NO: 887260 - protein, 18 aa, Mycobacterium
PRIPMRFPMYLPGPNRVM

SEQ ID NO: 887261 - protein, 17 aa, Mycobacterium
PRIVRPLSNILGPVLFQ

SEQ ID NO: 887262 - protein, 24 aa, Mycobacterium
PRIVVARKWLGLQGLFGRGTVLAA

SEQ ID NO: 887263 - protein, 18 aa, Mycobacterium
PRLGLRPDIRRVPILGLG

SEQ ID NO: 887264 - protein, 28 aa, Mycobacterium
PRLGWVNLHFSLLPAWRGAAPVQASIAA

SEQ ID NO: 887265 - protein, 24 aa, Mycobacterium
PRLSSFSIAGWLRGKSRTQAVSEV

SEQ ID NO: 887266 - protein, 17 aa, Mycobacterium
PRNLKLRFLSWGAAPAS

SEQ ID NO: 887267 - protein, 23 aa, Mycobacterium
PRPGELCAPVRFLVREDTVVMEL

SEQ ID NO: 887268 - protein, 26 aa, Mycobacterium
PRPQGAFVRFLFQPYVWPEDSETAMN

SEQ ID NO: 887269 - protein, 19 aa, Mycobacterium
PRPWMIDRALRHLLTDITG

SEQ ID NO: 887270 - protein, 18 aa, Mycobacterium
PRRALWEKLGGPLKPRHL

SEQ ID NO: 887271 - protein, 18 aa, Mycobacterium
PRRFYCRATWHEAPLDSE

SEQ ID NO: 887272 - protein, 20 aa, Mycobacterium
PRRITLTLPAVQRSREVWLV

SEQ ID NO: 887273 - protein, 17 aa, Mycobacterium
PRRLFFAARSRFADDVT

SEQ ID NO: 887274 - protein, 17 aa, Mycobacterium
PRRLLDLALNIGCDFSI

SEQ ID NO: 887275 - protein, 20 aa, Mycobacterium
PRTWLLVATGLLRLSEATAT

SEQ ID NO: 887276 - protein, 18 aa, Mycobacterium
PRVFMLFIGGFGVYLDIC

SEQ ID NO: 887277 - protein, 19 aa, Mycobacterium
PRVLLLPLGPLAEHNIRAT

SEQ ID NO: 887278 - protein, 21 aa, Mycobacterium
PRVPLPTYPFERERLWMSPPR

SEQ ID NO: 887279 - protein, 19 aa, Mycobacterium
PRVPPTPATWGWMLQLYGL

SEQ ID NO: 887280 - protein, 18 aa, Mycobacterium
PRWLEFLRRWDPAGWPRP

SEQ ID NO: 887281 - protein, 21 aa, Mycobacterium
PRWLGLPARLALQALIGRVRV

SEQ ID NO: 887282 - protein, 30 aa, Mycobacterium
PRWLHADPWNFWVLRPWSFSVTHADHFVNS

SEQ ID NO: 887283 - protein, 22 aa, Mycobacterium
PRWVRWLRVLPLDRGLAIPMVH

SEQ ID NO: 887284 - protein, 17 aa, Mycobacterium
PRWYRPVGALYDQFLGA

SEQ ID NO: 887285 - protein, 23 aa, Mycobacterium
PRYILWAAWHRSGLQNRWLAAID

SEQ ID NO: 887286 - protein, 21 aa, Mycobacterium
PSADVILIYLIQNLPSMSVDV

SEQ ID NO: 887287 - protein, 22 aa, Mycobacterium
PSDFVLWQKTLTGSLNGGCNPR

SEQ ID NO: 887288 - protein, 20 aa, Mycobacterium
PSDGWRLLLYKMSGGLINLG

SEQ ID NO: 887289 - protein, 17 aa, Mycobacterium
PSDLLLLKGKYLVHPEL

SEQ ID NO: 887290 - protein, 23 aa, Mycobacterium
PSDPKFFYLKRKVLDSAPFPEPA

SEQ ID NO: 887291 - protein, 17 aa, Mycobacterium
PSELLFGRMMIGNGADA

SEQ ID NO: 887292 - protein, 25 aa, Mycobacterium
PSERQWLLLELWTWKEATTKALGTG

SEQ ID NO: 887293 - protein, 23 aa, Mycobacterium
PSFRYHGWGPRMWTWVQMMGLRK

SEQ ID NO: 887294 - protein, 22 aa, Mycobacterium
PSHHYLAAYHWLDAGFGAHAVV

SEQ ID NO: 887295 - protein, 19 aa, Mycobacterium
PSHHYLAAYRWLDSAFPES

SEQ ID NO: 887296 - protein, 22 aa, Mycobacterium
PSHHYLAAYRWLDTGFGAHAVV

SEQ ID NO: 887297 - protein, 22 aa, Mycobacterium
PSHHYLAAYRWLETGFGAHAVV

SEQ ID NO: 887298 - protein, 18 aa, Mycobacterium
PSHKLLIRAGYIRPVAPG

SEQ ID NO: 887299 - protein, 18 aa, Mycobacterium
PSITLAPLYFELDGNFPN

SEQ ID NO: 887300 - protein, 17 aa, Mycobacterium
PSLALTGRPLIGNGADG

SEQ ID NO: 887301 - protein, 22 aa, Mycobacterium
PSLGFFVLDGWLRPVPVGVVGE

SEQ ID NO: 887302 - protein, 20 aa, Mycobacterium
PSLWAPDLFLLRQIHRAPRL

SEQ ID NO: 887303 - protein, 25 aa, Mycobacterium
PSNEPLPVMFFIYGGGYLLGSSATP

SEQ ID NO: 887304 - protein, 24 aa, Mycobacterium
PSPDLWQRYLGILFDGLRPEGAHP

SEQ ID NO: 887305 - protein, 20 aa, Mycobacterium
PSPFVPWLPDIPGRDDFPGA

SEQ ID NO: 887306 - protein, 23 aa, Mycobacterium
PSQANFIWLPLGARTTDFTEQAA

SEQ ID NO: 887307 - protein, 21 aa, Mycobacterium
PSQLALAWLLKRSPAMLPIPG

SEQ ID NO: 887308 - protein, 17 aa, Mycobacterium
PSQWFPYFPVRVGAMTP

SEQ ID NO: 887309 - protein, 18 aa, Mycobacterium
PSRAFWRHQLQGLIPCLF

SEQ ID NO: 887310 - protein, 21 aa, Mycobacterium
PSRLRMVELLRTGPLSVGEIA

SEQ ID NO: 887311 - protein, 17 aa, Mycobacterium
PSRRRVYRPPSPPTPQT

SEQ ID NO: 887312 - protein, 23 aa, Mycobacterium
PSVAIPLGPFLPTAAELSATLGT

SEQ ID NO: 887313 - protein, 22 aa, Mycobacterium
PSVLEPWTGLWPPSLAGLRGDA

SEQ ID NO: 887314 - protein, 18 aa, Mycobacterium
PSVLLPLWDSELGTGLVS

SEQ ID NO: 887315 - protein, 18 aa, Mycobacterium
PSVRFNPILLKPGGDRTS

SEQ ID NO: 887316 - protein, 18 aa, Mycobacterium
PSVRFNPILLKPGSDRTS

SEQ ID NO: 887317 - protein, 17 aa, Mycobacterium
PSWNGQYAITFMVGPKA

SEQ ID NO: 887318 - protein, 22 aa, Mycobacterium
PSYEWPGHKPGQYVRLGLVIDG

SEQ ID NO: 887319 - protein, 17 aa, Mycobacterium
PSYLHWYGLAMRGPVLR

SEQ ID NO: 887320 - protein, 17 aa, Mycobacterium
PSYLRYGAYPYIVVVRE

SEQ ID NO: 887321 - protein, 18 aa, Mycobacterium
PSYQHPPAWDLAGRRDRH

SEQ ID NO: 887322 - protein, 20 aa, Mycobacterium
PTAAPQRRPSAGPAGLPSCT

SEQ ID NO: 887323 - protein, 18 aa, Mycobacterium
PTADLVLIYLIQNLPDLT

SEQ ID NO: 887324 - protein, 17 aa, Mycobacterium
PTALWTGWALRLSPPAL

SEQ ID NO: 887325 - protein, 20 aa, Mycobacterium
PTAPTLPGGWQGSAQTASES

SEQ ID NO: 887326 - protein, 23 aa, Mycobacterium
PTAWLAEGLLIYLPPDAQDRLFD

SEQ ID NO: 887327 - protein, 18 aa, Mycobacterium
PTAWLAEGLLPYLPADAQ

SEQ ID NO: 887328 - protein, 17 aa, Mycobacterium
PTDTRAYFRGECLRRFG

SEQ ID NO: 887329 - protein, 25 aa, Mycobacterium
PTEATIVSWLPFYHDMGLVLGVCAP

SEQ ID NO: 887330 - protein, 22 aa, Mycobacterium
PTEEPLWSESWYFDFAAPSQDI

SEQ ID NO: 887331 - protein, 24 aa, Mycobacterium
PTEFTLLRYFMINAGTVLSKPKIL

SEQ ID NO: 887332 - protein, 19 aa, Mycobacterium
PTFVLFTTGFLEAGYRRFL

SEQ ID NO: 887333 - protein, 23 aa, Mycobacterium
PTGAVLLQLRWWCLEGRHDPVDE

SEQ ID NO: 887334 - protein, 23 aa, Mycobacterium
PTGRDLFYLLAPAPNLAAGAVDW

SEQ ID NO: 887335 - protein, 20 aa, Mycobacterium
PTGWILEGLLPYLPGAAQDA

SEQ ID NO: 887336 - protein, 24 aa, Mycobacterium
PTILDQFHIPPLPYMQGAPLTDPS

SEQ ID NO: 887337 - protein, 20 aa, Mycobacterium
PTKTLPLVQLLPFLKSQEAS

SEQ ID NO: 887338 - protein, 18 aa, Mycobacterium
PTLAPRRKTRQLNVGGVG

SEQ ID NO: 887339 - protein, 20 aa, Mycobacterium
PTLFAWRIADYWKWTRYPDP

SEQ ID NO: 887340 - protein, 23 aa, Mycobacterium
PTLGMMMFTLFQKRLLGSLYGEA

SEQ ID NO: 887341 - protein, 20 aa, Mycobacterium
PTLIVDPYFRDAIEAAIDSW

SEQ ID NO: 887342 - protein, 23 aa, Mycobacterium
PTLPQQALLYRLCGDRNPLHSDP

SEQ ID NO: 887343 - protein, 18 aa, Mycobacterium
PTLYRWFASKEELLATFS

SEQ ID NO: 887344 - protein, 17 aa, Mycobacterium
PTMFSILPRIPISRSPA

SEQ ID NO: 887345 - protein, 19 aa, Mycobacterium
PTNVPRWLSLPARLVMQSL

SEQ ID NO: 887346 - protein, 23 aa, Mycobacterium
PTPDHFIPFLYFAGIASASTDSV

SEQ ID NO: 887347 - protein, 22 aa, Mycobacterium
PTPIMHNVALIYAWWSSADAVH

SEQ ID NO: 887348 - protein, 18 aa, Mycobacterium
PTPIMHWLHSVPGPVERF

SEQ ID NO: 887349 - protein, 18 aa, Mycobacterium
PTQALLGRPLIGDGADGT

SEQ ID NO: 887350 - protein, 18 aa, Mycobacterium
PTQALLGRPLIGNGANGT

SEQ ID NO: 887351 - protein, 18 aa, Mycobacterium
PTQALTGRPLIGNGTPGA

SEQ ID NO: 887352 - protein, 21 aa, Mycobacterium
PTQIRTPFGTIPLPHVEVTTP

SEQ ID NO: 887353 - protein, 19 aa, Mycobacterium
PTRVWGVPAAGLWAHRLGD

SEQ ID NO: 887354 - protein, 17 aa, Mycobacterium
PTRWRLILTVPDSAPRE

SEQ ID NO: 887355 - protein, 17 aa, Mycobacterium
PTSVPAFRPGAQFKAVV

SEQ ID NO: 887356 - protein, 22 aa, Mycobacterium
PTVALPLFAGWRTMPLAGDAPA

SEQ ID NO: 887357 - protein, 19 aa, Mycobacterium
PTVPMLPNGWAPETGGSAA

SEQ ID NO: 887358 - protein, 17 aa, Mycobacterium
PVALGYWDVIPALLAGC

SEQ ID NO: 887359 - protein, 18 aa, Mycobacterium
PVAVARRKLLAGQRPLLD

SEQ ID NO: 887360 - protein, 19 aa, Mycobacterium
PVAWFYDPPWTIPCLRRNE

SEQ ID NO: 887361 - protein, 19 aa, Mycobacterium
PVCPFSWVTAHWLLDAAQS

SEQ ID NO: 887362 - protein, 24 aa, Mycobacterium
PVDDTWLPKPARPVPPWPTVQREA

SEQ ID NO: 887363 - protein, 24 aa, Mycobacterium
PVDNPFFAWLWKTLSTHETESVRR

SEQ ID NO: 887364 - protein, 17 aa, Mycobacterium
PVDWFARRTALVDANTG

SEQ ID NO: 887365 - protein, 18 aa, Mycobacterium
PVEIMRLCAALWLDACAD

SEQ ID NO: 887366 - protein, 18 aa, Mycobacterium
PVELPFTGLNFPAGVAVD

SEQ ID NO: 887367 - protein, 19 aa, Mycobacterium
PVFFFGHSMGGLLAFEVAR

SEQ ID NO: 887368 - protein, 19 aa, Mycobacterium
PVFLQYPWQVLPDELVKPL

SEQ ID NO: 887369 - protein, 17 aa, Mycobacterium
PVFRPPLDMARLFGAPT

SEQ ID NO: 887370 - protein, 28 aa, Mycobacterium
PVGFEAWIGWFLYRLSPGLMRGALGIAQ

SEQ ID NO: 887371 - protein, 19 aa, Mycobacterium
PVGFKWFVGGLLDGTIGFG

SEQ ID NO: 887372 - protein, 18 aa, Mycobacterium
PVGWLYPSERSGAPLREA

SEQ ID NO: 887373 - protein, 17 aa, Mycobacterium
PVIEWLAMRPGSRELWL

SEQ ID NO: 887374 - protein, 23 aa, Mycobacterium
PVILSAMPFFWIGGLLAAMGALH

SEQ ID NO: 887375 - protein, 17 aa, Mycobacterium
PVIPLAHLAYSGLAAVM

SEQ ID NO: 887376 - protein, 26 aa, Mycobacterium
PVISNMIRLLRLPIAVQRRVAAGVLS

SEQ ID NO: 887377 - protein, 20 aa, Mycobacterium
PVLARSWLLVNGAHYERFQA

SEQ ID NO: 887378 - protein, 18 aa, Mycobacterium
PVLAWLHPPGTDFAPAIA

SEQ ID NO: 887379 - protein, 28 aa, Mycobacterium
PVLLCRKVLIELLAWQFASPVRWIETQD

SEQ ID NO: 887380 - protein, 24 aa, Mycobacterium
PVLLDAIYHPWPTPLAAAVTDAGG

SEQ ID NO: 887381 - protein, 19 aa, Mycobacterium
PVLLDLLRLGAYQLLRTRV

SEQ ID NO: 887382 - protein, 17 aa, Mycobacterium
PVLLGVLPMGGDPDSAM

SEQ ID NO: 887383 - protein, 33 aa, Mycobacterium
PVLLILDDLHWAAKPTLLLLRHLLRFGDHARVQ

SEQ ID NO: 887384 - protein, 19 aa, Mycobacterium
PVLLIMGLGAQLLLWRTGF

SEQ ID NO: 887385 - protein, 26 aa, Mycobacterium
PVLNRISYLLWRFYFERGVGGSVVIP

SEQ ID NO: 887386 - protein, 21 aa, Mycobacterium
PVLRKLVWRLPARLQPKPEAV

SEQ ID NO: 887387 - protein, 20 aa, Mycobacterium
PVLRLFGDLLYLDRYWREEQ

SEQ ID NO: 887388 - protein, 27 aa, Mycobacterium
PVLTTAAIGMFFPGPYRIPKASFSYKT

SEQ ID NO: 887389 - protein, 25 aa, Mycobacterium
PVLTTAAIGMFFPGPYRVPKASFNY

SEQ ID NO: 887390 - protein, 19 aa, Mycobacterium
PVLVDFWATWCGPCKMVAP

SEQ ID NO: 887391 - protein, 19 aa, Mycobacterium
PVLVDLWATWCGPCRMVSP

SEQ ID NO: 887392 - protein, 17 aa, Mycobacterium
PVLWTQQVLTTGALRAV

SEQ ID NO: 887393 - protein, 26 aa, Mycobacterium
PVNPESWFIYGLYRLSPSFSRTLTGI

SEQ ID NO: 887394 - protein, 20 aa, Mycobacterium
PVNQLIMIKLALNSALLQQG

SEQ ID NO: 887395 - protein, 18 aa, Mycobacterium
PVNRVGAYLPAGRFPLLA

SEQ ID NO: 887396 - protein, 21 aa, Mycobacterium
PVPGHGWRLALLKATFGLVNV

SEQ ID NO: 887397 - protein, 21 aa, Mycobacterium
PVPKPVAVPVLWLGAAERVSA

SEQ ID NO: 887398 - protein, 23 aa, Mycobacterium
PVPLWQHILVGKRLFDLFAYDAD

SEQ ID NO: 887399 - protein, 21 aa, Mycobacterium
PVPLWQHVLVGKRLFDLFDYQ

SEQ ID NO: 887400 - protein, 20 aa, Mycobacterium
PVPRQVLVPVLPPNADELAT

SEQ ID NO: 887401 - protein, 18 aa, Mycobacterium
PVPVAGSWLLLIELAGDT

SEQ ID NO: 887402 - protein, 17 aa, Mycobacterium
PVPVRVFYMGRGFAKAT

SEQ ID NO: 887403 - protein, 20 aa, Mycobacterium
PVPWWWRPSGALFDQFLGAA

SEQ ID NO: 887404 - protein, 17 aa, Mycobacterium
PVQALTGRPLIANGANA

SEQ ID NO: 887405 - protein, 20 aa, Mycobacterium
PVQFVLLDGWKDLYLPVVRL

SEQ ID NO: 887406 - protein, 17 aa, Mycobacterium
PVQTLGQAWLGSPAGEL

SEQ ID NO: 887407 - protein, 23 aa, Mycobacterium
PVRAEWLAPLLDPVPALVVHDGV

SEQ ID NO: 887408 - protein, 24 aa, Mycobacterium
PVRELRRTGLLDKLLLLAGVPETP

SEQ ID NO: 887409 - protein, 19 aa, Mycobacterium
PVRIWHEGRFLGDVAKLLV

SEQ ID NO: 887410 - protein, 21 aa, Mycobacterium
PVRMFTVLFALGRLPGWIAHW

SEQ ID NO: 887411 - protein, 17 aa, Mycobacterium
PVRPLAPYVLKAAYWMA

SEQ ID NO: 887412 - protein, 20 aa, Mycobacterium
PVRSFLLRLGGIRALGYSPE

SEQ ID NO: 887413 - protein, 22 aa, Mycobacterium
PVRVDTWGGWLWINMDPDCEPL

SEQ ID NO: 887414 - protein, 19 aa, Mycobacterium
PVSTWWPWRGRTVHIARAP

SEQ ID NO: 887415 - protein, 19 aa, Mycobacterium
PVSVLYLFSLIGDLLPAGV

SEQ ID NO: 887416 - protein, 17 aa, Mycobacterium
PVSWYWKSDDRANFLKV

SEQ ID NO: 887417 - protein, 19 aa, Mycobacterium
PVTNYDVMFVPQGIGADLI

SEQ ID NO: 887418 - protein, 23 aa, Mycobacterium
PVTWGWMLQLYALRSAHSWGIGD

SEQ ID NO: 887419 - protein, 26 aa, Mycobacterium
PVVARGWRTPLRFLFIDGGHTEEAAQ

SEQ ID NO: 887420 - protein, 24 aa, Mycobacterium
PVVATPIMRWLYSLDGPIDEFNQT

SEQ ID NO: 887421 - protein, 22 aa, Mycobacterium
PVVFLTAYYGLSVLAGLRAGQR

SEQ ID NO: 887422 - protein, 17 aa, Mycobacterium
PVVIGPVTFLLLSKAVD

SEQ ID NO: 887423 - protein, 22 aa, Mycobacterium
PVVQLLRLRLLDGSPAMLERAA

SEQ ID NO: 887424 - protein, 17 aa, Mycobacterium
PVWIVGELTDWVGHPPE

SEQ ID NO: 887425 - protein, 25 aa, Mycobacterium
PVWPVMTWLFAWCFARRGWAERSAT

SEQ ID NO: 887426 - protein, 19 aa, Mycobacterium
PVWTFLGPRPANWWIRRRL

SEQ ID NO: 887427 - protein, 24 aa, Mycobacterium
PVYDKPLIYYPLSTLMMAGIRDIL

SEQ ID NO: 887428 - protein, 18 aa, Mycobacterium
PVYFALLARRRMDLFGAT

SEQ ID NO: 887429 - protein, 19 aa, Mycobacterium
PVYFALLARRRMDLYGATL

SEQ ID NO: 887430 - protein, 18 aa, Mycobacterium
PVYVPLTADPRLIGFLLR

SEQ ID NO: 887431 - protein, 18 aa, Mycobacterium
PWDSIYGLPLRLSGEARR

SEQ ID NO: 887432 - protein, 17 aa, Mycobacterium
PWFAGGTVLVLRRIRTE

SEQ ID NO: 887433 - protein, 19 aa, Mycobacterium
PWHPLPFHAVFDAPLYGEI

SEQ ID NO: 887434 - protein, 18 aa, Mycobacterium
PWLAGVALDWVLDGAVRA

SEQ ID NO: 887435 - protein, 20 aa, Mycobacterium
PWLGLYWLLGGFLRKRRNVR

SEQ ID NO: 887436 - protein, 17 aa, Mycobacterium
PWLRRVGRWLADHPGGG

SEQ ID NO: 887437 - protein, 17 aa, Mycobacterium
PWMADLIREFALCPPPT

SEQ ID NO: 887438 - protein, 18 aa, Mycobacterium
PWNFPLMLETWKVAPALA

SEQ ID NO: 887439 - protein, 24 aa, Mycobacterium
PWNTPLFIAALKLGPALAAGCTVV

SEQ ID NO: 887440 - protein, 19 aa, Mycobacterium
PWNYPQALAVMKIAPALAA

SEQ ID NO: 887441 - protein, 17 aa, Mycobacterium
PWPARYPSRVLANDFVA

SEQ ID NO: 887442 - protein, 19 aa, Mycobacterium
PWPLLRTFAAGPALSREAA

SEQ ID NO: 887443 - protein, 24 aa, Mycobacterium
PWPSWRTHPLLFPFLHGHSGGILR

SEQ ID NO: 887444 - protein, 17 aa, Mycobacterium
PWRFWLASTPEVSAYRR

SEQ ID NO: 887445 - protein, 18 aa, Mycobacterium
PWTKKLWVYDLRTNQHFT

SEQ ID NO: 887446 - protein, 22 aa, Mycobacterium
PWTVPKVYWTVFGLSAFRAAKQ

SEQ ID NO: 887447 - protein, 18 aa, Mycobacterium
PWVLAITCPYRDAAERNA

SEQ ID NO: 887448 - protein, 26 aa, Mycobacterium
PWVVPKFYWTILGLSAFLAGRQALTP

SEQ ID NO: 887449 - protein, 20 aa, Mycobacterium
PWWEWAATFERAFSAAYDAL

SEQ ID NO: 887450 - protein, 20 aa, Mycobacterium
PWWEWAATYERAFSAAYDAL

SEQ ID NO: 887451 - protein, 17 aa, Mycobacterium
PWWLKYVNKVMIGLSKV

SEQ ID NO: 887452 - protein, 24 aa, Mycobacterium
PYASALVFWFGWPASEVPGMYLSV

SEQ ID NO: 887453 - protein, 18 aa, Mycobacterium
PYASATFPWYLLGRQVHV

SEQ ID NO: 887454 - protein, 19 aa, Mycobacterium
PYCYAVDLRFLLSPPVGAT

SEQ ID NO: 887455 - protein, 25 aa, Mycobacterium
PYGFPYLAWVLGRLLRKLDLGVVDV

SEQ ID NO: 887456 - protein, 24 aa, Mycobacterium
PYGTPGWVELLPDSGYWLPKDQLP

SEQ ID NO: 887457 - protein, 18 aa, Mycobacterium
PYMAFQTFWRFIDELSGP

SEQ ID NO: 887458 - protein, 17 aa, Mycobacterium
PYMTFLAAYATLLHRYT

SEQ ID NO: 887459 - protein, 17 aa, Mycobacterium
PYNVAVPALLRILTEFD

SEQ ID NO: 887460 - protein, 18 aa, Mycobacterium
PYPPARLEKLWLPGVDRL

SEQ ID NO: 887461 - protein, 19 aa, Mycobacterium
PYPPARLEKWWLPGPDRLL

SEQ ID NO: 887462 - protein, 23 aa, Mycobacterium
PYPTARFDGFWIIDVPSKDEAKK

SEQ ID NO: 887463 - protein, 23 aa, Mycobacterium
PYQGFQLGSLWYISLDYINHQTS

SEQ ID NO: 887464 - protein, 21 aa, Mycobacterium
PYRRLAFTFHTFTKDLTTVGL

SEQ ID NO: 887465 - protein, 19 aa, Mycobacterium
PYSSYLWRDIAPALAQHRS

SEQ ID NO: 887466 - protein, 21 aa, Mycobacterium
PYVDIWQAVKPHRLGLKAWPS

SEQ ID NO: 887467 - protein, 23 aa, Mycobacterium
PYVDMTLWPKFDYASAANAGIDD

SEQ ID NO: 887468 - protein, 17 aa, Mycobacterium
PYVVWLRATAELCEQSA

SEQ ID NO: 887469 - protein, 18 aa, Mycobacterium
PYYRVLELAPWLSRPRPN

SEQ ID NO: 887470 - protein, 23 aa, Mycobacterium
QAAASAIPAFNLGLGNIGDFNLG

SEQ ID NO: 887471 - protein, 31 aa, Mycobacterium
QAAPGLFLFCAVLAFSRWRFVRFATDERAST

SEQ ID NO: 887472 - protein, 22 aa, Mycobacterium
QAAWAQLLTWLTGNYDVAFGTT

SEQ ID NO: 887473 - protein, 18 aa, Mycobacterium
QAAWRRPSTGRWLVVLIE

SEQ ID NO: 887474 - protein, 22 aa, Mycobacterium
QACGLPLLRRPPSVDTAWRAHS

SEQ ID NO: 887475 - protein, 23 aa, Mycobacterium
QADVLMLFYLLSSDELLALFGRL

SEQ ID NO: 887476 - protein, 25 aa, Mycobacterium
QAEVSGLIWLPIGPPIDVAAYVEEK

SEQ ID NO: 887477 - protein, 25 aa, Mycobacterium
QAFARDFFLLWAPYPNSYKRFRDGT

SEQ ID NO: 887478 - protein, 26 aa, Mycobacterium
QAGELLTLPIPPLLREIATHLDRGSA

SEQ ID NO: 887479 - protein, 26 aa, Mycobacterium
QAGELLTLPIPPLLREIATHLDRGTA

SEQ ID NO: 887480 - protein, 18 aa, Mycobacterium
QAGGLLWGNGGAGGSGAP

SEQ ID NO: 887481 - protein, 18 aa, Mycobacterium
QAGGPGGWLWGDGGDGGS

SEQ ID NO: 887482 - protein, 23 aa, Mycobacterium
QAGKLPVTLFTAGGIATPADAAM

SEQ ID NO: 887483 - protein, 22 aa, Mycobacterium
QAGLAMLAPIWGYAPLLDIDDA

SEQ ID NO: 887484 - protein, 23 aa, Mycobacterium
QAGLAMLAPIWGYAPLLDIDDRT

SEQ ID NO: 887485 - protein, 18 aa, Mycobacterium
QAGLLTRLMYRYAKKRFG

SEQ ID NO: 887486 - protein, 19 aa, Mycobacterium
QAHAGILPPLFSGLIRMPA

SEQ ID NO: 887487 - protein, 22 aa, Mycobacterium
QAIGPGWLYLTAHRRGQAAPAD

SEQ ID NO: 887488 - protein, 18 aa, Mycobacterium
QAIPLPRHHLDAVAVIES

SEQ ID NO: 887489 - protein, 20 aa, Mycobacterium
QALAVFLAPPSWEALVDRLT

SEQ ID NO: 887490 - protein, 32 aa, Mycobacterium
QALAVINAPTNALLGRPLIGNGTDGLAGTGAA

SEQ ID NO: 887491 - protein, 21 aa, Mycobacterium
QALDGWPMNILMLGKGNTVNP

SEQ ID NO: 887492 - protein, 23 aa, Mycobacterium
QALIRDVWQPLYLLDPAPRPRID

SEQ ID NO: 887493 - protein, 18 aa, Mycobacterium
QALLARVLTFPMPTAAAV

SEQ ID NO: 887494 - protein, 19 aa, Mycobacterium
QALLYAVVLHRYLGWRLSG

SEQ ID NO: 887495 - protein, 18 aa, Mycobacterium
QALLYCVVLHRFLRWRQP

SEQ ID NO: 887496 - protein, 24 aa, Mycobacterium
QALLYVVVLHRFLRWRQPGYDPRR

SEQ ID NO: 887497 - protein, 24 aa, Mycobacterium
QALQSLPGLSGFNLGIGNIGTGNI

SEQ ID NO: 887498 - protein, 19 aa, Mycobacterium
QALRILAGCPFLNGLRARK

SEQ ID NO: 887499 - protein, 17 aa, Mycobacterium
QALRVLDALRVDIAFIG

SEQ ID NO: 887500 - protein, 18 aa, Mycobacterium
QALTFLRGPRTWVLKSPQ

SEQ ID NO: 887501 - protein, 21 aa, Mycobacterium
QALVYYYFPTMDDLFVEVLRA

SEQ ID NO: 887502 - protein, 24 aa, Mycobacterium
QALYREGFFGLSWPREYGGRELAP

SEQ ID NO: 887503 - protein, 19 aa, Mycobacterium
QAPILVRQYLRSRAAWPIF

SEQ ID NO: 887504 - protein, 18 aa, Mycobacterium
QAPYRPFWAITKHADIMA

SEQ ID NO: 887505 - protein, 22 aa, Mycobacterium
QAQDFFFRKIIRDKGQALAYVA

SEQ ID NO: 887506 - protein, 21 aa, Mycobacterium
QAQLVGWLEGLFHGIQTALFA

SEQ ID NO: 887507 - protein, 23 aa, Mycobacterium
QARRYSPWLAYSQSKLANLLFTS

SEQ ID NO: 887508 - protein, 25 aa, Mycobacterium
QASGRIKLAWFLLNAARYMPVLVYA

SEQ ID NO: 887509 - protein, 26 aa, Mycobacterium
QASGRIKLAWFLLNAARYMPVLVYAA

SEQ ID NO: 887510 - protein, 25 aa, Mycobacterium
QASHRIKLAWFLLNAARYMPAQVFA

SEQ ID NO: 887511 - protein, 25 aa, Mycobacterium
QAVLARLLPALVLPGFLLAQSRHDN

SEQ ID NO: 887512 - protein, 24 aa, Mycobacterium
QAWSQLFPIQQLLRGLPRIPIPPC

SEQ ID NO: 887513 - protein, 26 aa, Mycobacterium
QAYEDLAWFCIRAWRFGAPASLGAGG

SEQ ID NO: 887514 - protein, 24 aa, Mycobacterium
QAYRTLFLQELLKRGVLGQSFVTS

SEQ ID NO: 887515 - protein, 22 aa, Mycobacterium
QDASMLMYPFSMAMSPLMNLMS

SEQ ID NO: 887516 - protein, 24 aa, Mycobacterium
QDGHPVLAAVLRKGYKLGDRVLRT

SEQ ID NO: 887517 - protein, 23 aa, Mycobacterium
QDHGFEFAVLPWPDYYGSVPGAR

SEQ ID NO: 887518 - protein, 32 aa, Mycobacterium
QDLLGAVNAPTQVLFGRGLIGDGANGTAPGQA

SEQ ID NO: 887519 - protein, 17 aa, Mycobacterium
QDLLREAVLTEGWRLHP

SEQ ID NO: 887520 - protein, 27 aa, Mycobacterium
QDLPLLQPLRDIPFIGPPLANLIQPDL

SEQ ID NO: 887521 - protein, 25 aa, Mycobacterium
QDLYRRWPFFATVLSNMAQVLAKSD

SEQ ID NO: 887522 - protein, 23 aa, Mycobacterium
QDRLLLPLPMFHVAALTTVIMCA

SEQ ID NO: 887523 - protein, 26 aa, Mycobacterium
QEAVDRWWWPALMMFGPPDADSPNTA

SEQ ID NO: 887524 - protein, 24 aa, Mycobacterium
QEDFIGIHFFSPVDKMPLVEIIRG

SEQ ID NO: 887525 - protein, 17 aa, Mycobacterium
QEDPGLVWAWYQNRRIQ

SEQ ID NO: 887526 - protein, 24 aa, Mycobacterium
QEHDLSLWLLRVQALRSAWGTPEA

SEQ ID NO: 887527 - protein, 24 aa, Mycobacterium
QEHDLSLWLLRVQALRSAWGTPEV

SEQ ID NO: 887528 - protein, 24 aa, Mycobacterium
QELYDLWTLWHIASTNPWLSVTPV

SEQ ID NO: 887529 - protein, 22 aa, Mycobacterium
QEPPRRLIGWKKVALEPGESKA

SEQ ID NO: 887530 - protein, 22 aa, Mycobacterium
QEPRLFPWRSLAGNVAYGLPRG

SEQ ID NO: 887531 - protein, 23 aa, Mycobacterium
QERYEFFFVAPPLPITAAVGSPV

SEQ ID NO: 887532 - protein, 26 aa, Mycobacterium
QESFKRHVGLPPLTYLREVRLIRAHA

SEQ ID NO: 887533 - protein, 24 aa, Mycobacterium
QESTLGLIFHWADQKGLPLLDIKD

SEQ ID NO: 887534 - protein, 23 aa, Mycobacterium
QESTLGLIFHWADQRGLPLLDLK

SEQ ID NO: 887535 - protein, 22 aa, Mycobacterium
QETRLRLVLVRRGLPRPVTQVP

SEQ ID NO: 887536 - protein, 17 aa, Mycobacterium
QEWLDRNLVPLDALPAG

SEQ ID NO: 887537 - protein, 19 aa, Mycobacterium
QEWMLIALRTEWQVGEVTY

SEQ ID NO: 887538 - protein, 23 aa, Mycobacterium
QEWVRFGWFFLVTRRDPRGLAEW

SEQ ID NO: 887539 - protein, 24 aa, Mycobacterium
QEYFLVDRHFFLARPDLINAGRTL

SEQ ID NO: 887540 - protein, 20 aa, Mycobacterium
QFDQRLLLRRVQRGAVGLGP

SEQ ID NO: 887541 - protein, 22 aa, Mycobacterium
QFEAMLRDDLWLRNAAHANAMA

SEQ ID NO: 887542 - protein, 20 aa, Mycobacterium
QFFNEFYALDLVLTETPRGP

SEQ ID NO: 887543 - protein, 19 aa, Mycobacterium
QFFNEFYALDLVLTQTPSG

SEQ ID NO: 887544 - protein, 18 aa, Mycobacterium
QFGFFPQRRLRGLALHDG

SEQ ID NO: 887545 - protein, 21 aa, Mycobacterium
QFGLNWFPWILRGVYPPPGNP

SEQ ID NO: 887546 - protein, 18 aa, Mycobacterium
QFGPRWLVPPLVAVFSPE

SEQ ID NO: 887547 - protein, 20 aa, Mycobacterium
QFMTIAKFRAARNLWARVAE

SEQ ID NO: 887548 - protein, 25 aa, Mycobacterium
QFNSLFLDPYLWKLQVGSKRLVQKA

SEQ ID NO: 887549 - protein, 18 aa, Mycobacterium
QFNYPAPALWYFPTQANG

SEQ ID NO: 887550 - protein, 18 aa, Mycobacterium
QFPMGLGLVSQFFGRYFS

SEQ ID NO: 887551 - protein, 18 aa, Mycobacterium
QFTRLILSLIATGVAPGS

SEQ ID NO: 887552 - protein, 18 aa, Mycobacterium
QFVPWPQLVIYRNQGRLL

SEQ ID NO: 887553 - protein, 19 aa, Mycobacterium
QFYLSLFWAQALAEQTEDA

SEQ ID NO: 887554 - protein, 21 aa, Mycobacterium
QGALALWSGWLGTDLSRFDLD

SEQ ID NO: 887555 - protein, 22 aa, Mycobacterium
QGARTIALWEPALLPDLAGENG

SEQ ID NO: 887556 - protein, 23 aa, Mycobacterium
QGDRYLIVNPFFHIFGYKAGCIA

SEQ ID NO: 887557 - protein, 20 aa, Mycobacterium
QGIPYRVPFPQSLPSQETTP

SEQ ID NO: 887558 - protein, 18 aa, Mycobacterium
QGIRLHAPLPAAGKLSVV

SEQ ID NO: 887559 - protein, 19 aa, Mycobacterium
QGMLSPWLELPGAADQIAS

SEQ ID NO: 887560 - protein, 17 aa, Mycobacterium
QGPFLRSTLPIAGFAVL

SEQ ID NO: 887561 - protein, 22 aa, Mycobacterium
QGQALVFWDCYRPHDVQVKMFQ

SEQ ID NO: 887562 - protein, 17 aa, Mycobacterium
QGRALLPWMLGYQVPMW

SEQ ID NO: 887563 - protein, 20 aa, Mycobacterium
QGSAGTTGAWRAGGDGGSGG

SEQ ID NO: 887564 - protein, 18 aa, Mycobacterium
QGTRLIPIPGAPPALTAI

SEQ ID NO: 887565 - protein, 23 aa, Mycobacterium
QGVDHVLVIPFFDNLYAAWESQL

SEQ ID NO: 887566 - protein, 19 aa, Mycobacterium
QGVGFRWWTRSRALELVLT

SEQ ID NO: 887567 - protein, 20 aa, Mycobacterium
QGWIRLFVNIGSPAQLRVIA

SEQ ID NO: 887568 - protein, 20 aa, Mycobacterium
QHALLFGPPPLGPGAPPLER

SEQ ID NO: 887569 - protein, 25 aa, Mycobacterium
QHGWGHVLFGKIPDWLGITDPSTGL

SEQ ID NO: 887570 - protein, 18 aa, Mycobacterium
QHIYQWCMDFLGPEGLLY

SEQ ID NO: 887571 - protein, 29 aa, Mycobacterium
QHLSSPPWYIRIWDFLKSIPIPVWDQLLN

SEQ ID NO: 887572 - protein, 28 aa, Mycobacterium
QHNLARLAELLLLWRHGAPDHREVVYLA

SEQ ID NO: 887573 - protein, 19 aa, Mycobacterium
QHNLARLAELLLLWRHGTP

SEQ ID NO: 887574 - protein, 18 aa, Mycobacterium
QHPAVGRLVLFGQQLLIA

SEQ ID NO: 887575 - protein, 24 aa, Mycobacterium
QHPTRLHWYVPQSIRWIDRLKGVS

SEQ ID NO: 887576 - protein, 17 aa, Mycobacterium
QHRDWLRLMARLSTTMA

SEQ ID NO: 887577 - protein, 18 aa, Mycobacterium
QHRILLETAWRAVEHSGY

SEQ ID NO: 887578 - protein, 17 aa, Mycobacterium
QHRLLLETAWRAIEHSG

SEQ ID NO: 887579 - protein, 18 aa, Mycobacterium
QHRLLLETAWRAVEHSGI

SEQ ID NO: 887580 - protein, 18 aa, Mycobacterium
QHVGWFRFYFADERWEWS

SEQ ID NO: 887581 - protein, 17 aa, Mycobacterium
QHYSVFGLLPIAVGQKS

SEQ ID NO: 887582 - protein, 25 aa, Mycobacterium
QIDGPLPRRLLVLALTLSGEQPIVA

SEQ ID NO: 887583 - protein, 17 aa, Mycobacterium
QIGLAWLLAHAPNILLI

SEQ ID NO: 887584 - protein, 21 aa, Mycobacterium
QIGYSLLFRLASGSLLGPDRP

SEQ ID NO: 887585 - protein, 21 aa, Mycobacterium
QIGYSLLFRLASGSLLGPNRP

SEQ ID NO: 887586 - protein, 20 aa, Mycobacterium
QIHLVGAFRLASTVLPGMLE

SEQ ID NO: 887587 - protein, 19 aa, Mycobacterium
QILAERKLFRVLTEGGPSL

SEQ ID NO: 887588 - protein, 24 aa, Mycobacterium
QINFFYYLFEPIVQSGLFNTLDWL

SEQ ID NO: 887589 - protein, 24 aa, Mycobacterium
QINNVLAFPGVFRGALAAGARRIT

SEQ ID NO: 887590 - protein, 24 aa, Mycobacterium
QINNVLAFPGVFRGALDAGARQIT

SEQ ID NO: 887591 - protein, 18 aa, Mycobacterium
QIRPWVPGMYRTLGADGF

SEQ ID NO: 887592 - protein, 21 aa, Mycobacterium
QIRVQSAWWPVQVPAAQLAAA

SEQ ID NO: 887593 - protein, 19 aa, Mycobacterium
QIVFHTLLRRIPTLRLAIP

SEQ ID NO: 887594 - protein, 18 aa, Mycobacterium
QIYAYPFITAKTARVLSN

SEQ ID NO: 887595 - protein, 23 aa, Mycobacterium
QKADLRLIVIDYLQLMTSGKKVE

SEQ ID NO: 887596 - protein, 17 aa, Mycobacterium
QKFGFWPRFLTGLLAKT

SEQ ID NO: 887597 - protein, 17 aa, Mycobacterium
QKFLMDGAFLSVFGVPI

SEQ ID NO: 887598 - protein, 22 aa, Mycobacterium
QKGTLFQWLTEMYPVWGRLDAE

SEQ ID NO: 887599 - protein, 19 aa, Mycobacterium
QKLTALENLRFFASLYAGP

SEQ ID NO: 887600 - protein, 19 aa, Mycobacterium
QKNWFLPRILSGDDRWCQG

SEQ ID NO: 887601 - protein, 21 aa, Mycobacterium
QKQIDHFLAMELLYKNQDDYN

SEQ ID NO: 887602 - protein, 21 aa, Mycobacterium
QKQRWLPRVISGDAVLAIAMT

SEQ ID NO: 887603 - protein, 21 aa, Mycobacterium
QKRIVVVGHFFGRQVWAGEEH

SEQ ID NO: 887604 - protein, 24 aa, Mycobacterium
QKRQQFLTDLSLVGGLLIASADTA

SEQ ID NO: 887605 - protein, 21 aa, Mycobacterium
QKSHMLFPEFSDFFSGFPSFA

SEQ ID NO: 887606 - protein, 21 aa, Mycobacterium
QLAAPQRFWVTKPFFDMGDVE

SEQ ID NO: 887607 - protein, 24 aa, Mycobacterium
QLAEALLLLLCGVGFYAGFVGSYR

SEQ ID NO: 887608 - protein, 19 aa, Mycobacterium
QLALTLRLISGLTAAEIAR

SEQ ID NO: 887609 - protein, 19 aa, Mycobacterium
QLAMYQLAVAAGLIADGDE

SEQ ID NO: 887610 - protein, 18 aa, Mycobacterium
QLARRRLGYGRGARMAFE

SEQ ID NO: 887611 - protein, 18 aa, Mycobacterium
QLARRRLGYGRGARMKFE

SEQ ID NO: 887612 - protein, 17 aa, Mycobacterium
QLARRRLGYGRGARMTF

SEQ ID NO: 887613 - protein, 23 aa, Mycobacterium
QLAVTPVLLLLWIRGVRFMYSVD

SEQ ID NO: 887614 - protein, 20 aa, Mycobacterium
QLERLFAGVYLNLAPVILDA

SEQ ID NO: 887615 - protein, 17 aa, Mycobacterium
QLFGAMGFTWENDLQFA

SEQ ID NO: 887616 - protein, 18 aa, Mycobacterium
QLFHYFPGGKDQLMLAVA

SEQ ID NO: 887617 - protein, 21 aa, Mycobacterium
QLFRFVLFQTQAEEFYLFGCC

SEQ ID NO: 887618 - protein, 18 aa, Mycobacterium
QLFRRPGLRIGHHHQPPA

SEQ ID NO: 887619 - protein, 18 aa, Mycobacterium
QLFYLRARGIPEDQARRL

SEQ ID NO: 887620 - protein, 19 aa, Mycobacterium
QLGMPPWRVQKAQKQARHW

SEQ ID NO: 887621 - protein, 19 aa, Mycobacterium
QLGMPPWRVQKAQKQARRW

SEQ ID NO: 887622 - protein, 18 aa, Mycobacterium
QLGPFLHWLLWAHRDLKV

SEQ ID NO: 887623 - protein, 20 aa, Mycobacterium
QLGRLRVLLGAALDGKKLSA

SEQ ID NO: 887624 - protein, 17 aa, Mycobacterium
QLGWRLMGPSLRAGFGL

SEQ ID NO: 887625 - protein, 19 aa, Mycobacterium
QLIFGGEPLRWPTVRRVRA

SEQ ID NO: 887626 - protein, 18 aa, Mycobacterium
QLIGFFINILVLRNNLDG

SEQ ID NO: 887627 - protein, 21 aa, Mycobacterium
QLLAVALLWGLAQAAGQPLPM

SEQ ID NO: 887628 - protein, 19 aa, Mycobacterium
QLLFAHPGYVRAAHGMALP

SEQ ID NO: 887629 - protein, 17 aa, Mycobacterium
QLLFLEAGFPQGAYVDI

SEQ ID NO: 887630 - protein, 18 aa, Mycobacterium
QLLMIGWGSSYGPIGEAC

SEQ ID NO: 887631 - protein, 17 aa, Mycobacterium
QLLMVAVRIASLPGLLS

SEQ ID NO: 887632 - protein, 18 aa, Mycobacterium
QLLPIPPIALQLRTVISM

SEQ ID NO: 887633 - protein, 25 aa, Mycobacterium
QLLRSWYMFYFQLPLLPERSARWIL

SEQ ID NO: 887634 - protein, 18 aa, Mycobacterium
QLLYWAQVLLIARGLTLD

SEQ ID NO: 887635 - protein, 18 aa, Mycobacterium
QLLYWTQVLMISRGLSLD

SEQ ID NO: 887636 - protein, 18 aa, Mycobacterium
QLMTLYPSLSSDQAWAML

SEQ ID NO: 887637 - protein, 20 aa, Mycobacterium
QLPFWILINPYGSGQIHYSS

SEQ ID NO: 887638 - protein, 19 aa, Mycobacterium
QLPTFIPRIVFGAYPGLPG

SEQ ID NO: 887639 - protein, 19 aa, Mycobacterium
QLPVLRAQLRWMEAVLATW

SEQ ID NO: 887640 - protein, 20 aa, Mycobacterium
QLPVLRAQLRWMEAVLAVWH

SEQ ID NO: 887641 - protein, 22 aa, Mycobacterium
QLQYFERFFLPSLAKEARPRFA

SEQ ID NO: 887642 - protein, 17 aa, Mycobacterium
QLRATIPELPWLSRKRI

SEQ ID NO: 887643 - protein, 20 aa, Mycobacterium
QLRFQIGRWAYRDLIREQIG

SEQ ID NO: 887644 - protein, 21 aa, Mycobacterium
QLRFTAPPRLELSLLASALPE

SEQ ID NO: 887645 - protein, 20 aa, Mycobacterium
QLRLLQQYFFVSCSLQHVLH

SEQ ID NO: 887646 - protein, 18 aa, Mycobacterium
QLRPLIGVALQEVALDLW

SEQ ID NO: 887647 - protein, 24 aa, Mycobacterium
QLRTMGRLLGWRLGLDGVDPKGTV

SEQ ID NO: 887648 - protein, 21 aa, Mycobacterium
QLSMWIWRELATLLPMMSAVS

SEQ ID NO: 887649 - protein, 20 aa, Mycobacterium
QLTALLRDILELPLPVIIAV

SEQ ID NO: 887650 - protein, 18 aa, Mycobacterium
QLVFCDLGMPRDVDPTVA

SEQ ID NO: 887651 - protein, 22 aa, Mycobacterium
QLVGLRQALRILLTNPTLTADE

SEQ ID NO: 887652 - protein, 17 aa, Mycobacterium
QLVIFASPLLGVLCSAY

SEQ ID NO: 887653 - protein, 18 aa, Mycobacterium
QLVMLAMSNLFGLNAPAI

SEQ ID NO: 887654 - protein, 23 aa, Mycobacterium
QLVRSNFLGLFGPAIAAAEAQYE

SEQ ID NO: 887655 - protein, 21 aa, Mycobacterium
QLVTRYLATYAFYRGAFSPAA

SEQ ID NO: 887656 - protein, 17 aa, Mycobacterium
QLYDLEALPEHLIVVGS

SEQ ID NO: 887657 - protein, 17 aa, Mycobacterium
QLYHYFKDRSELVKAVV

SEQ ID NO: 887658 - protein, 17 aa, Mycobacterium
QLYLLSSGFPFLPLSHH

SEQ ID NO: 887659 - protein, 19 aa, Mycobacterium
QMHLLYLSFAIAVGKRAGA

SEQ ID NO: 887660 - protein, 32 aa, Mycobacterium
QMVSTRAAHLHAEFVHSLTRAGAAYAAAEAVN

SEQ ID NO: 887661 - protein, 22 aa, Mycobacterium
QNDVEFFFLRPKDIAIYVGSGE

SEQ ID NO: 887662 - protein, 22 aa, Mycobacterium
QNEDVWLPLFRPTAEPETAALP

SEQ ID NO: 887663 - protein, 25 aa, Mycobacterium
QNELTLMGWLPLRFTWLDLTEYPQR

SEQ ID NO: 887664 - protein, 23 aa, Mycobacterium
QNLALFTKFWRKALPTLSNSAFM

SEQ ID NO: 887665 - protein, 22 aa, Mycobacterium
QNPRLLPWRRALANVTFALPQA

SEQ ID NO: 887666 - protein, 24 aa, Mycobacterium
QNVARWLVLYLRRPGGQTQFAAPV

SEQ ID NO: 887667 - protein, 21 aa, Mycobacterium
QPASILILFAPGAPREDYFEG

SEQ ID NO: 887668 - protein, 17 aa, Mycobacterium
QPFLALVDYAHKPGALA

SEQ ID NO: 887669 - protein, 20 aa, Mycobacterium
QPHLVAMWYAVLNGEVWFET

SEQ ID NO: 887670 - protein, 17 aa, Mycobacterium
QPIKPMRWLVRGIWPER

SEQ ID NO: 887671 - protein, 22 aa, Mycobacterium
QPLRNILLAIMFEWGIALQGWE

SEQ ID NO: 887672 - protein, 17 aa, Mycobacterium
QPPAFLRALGERTDWTD

SEQ ID NO: 887673 - protein, 17 aa, Mycobacterium
QPPAPTLSPRRTTRQLM

SEQ ID NO: 887674 - protein, 21 aa, Mycobacterium
QPPGHLWRWELSPVNAELTTV

SEQ ID NO: 887675 - protein, 17 aa, Mycobacterium
QPPLWRKAIRGSALEDL

SEQ ID NO: 887676 - protein, 20 aa, Mycobacterium
QPRFLEPYLWALDSLHRRGA

SEQ ID NO: 887677 - protein, 17 aa, Mycobacterium
QPRLRPPFPAVAGLYAS

SEQ ID NO: 887678 - protein, 17 aa, Mycobacterium
QPRLRPPFPAVAGLYGC

SEQ ID NO: 887679 - protein, 20 aa, Mycobacterium
QPRRFVFWREFPLGPAGKIL

SEQ ID NO: 887680 - protein, 18 aa, Mycobacterium
QPTAWLAEGLLPYLPADA

SEQ ID NO: 887681 - protein, 20 aa, Mycobacterium
QPVHLLQPLRNLLLAVIFEW

SEQ ID NO: 887682 - protein, 23 aa, Mycobacterium
QPVPRLIWFYFDGADLTVYSMPK

SEQ ID NO: 887683 - protein, 24 aa, Mycobacterium
QQADCFAGVYLFWVADGKSPRFTL

SEQ ID NO: 887684 - protein, 19 aa, Mycobacterium
QQALHAFRKFGFQLVIVAT

SEQ ID NO: 887685 - protein, 23 aa, Mycobacterium
QQDIAFVPYFPLGSAFPGFPKVS

SEQ ID NO: 887686 - protein, 24 aa, Mycobacterium
QQDQWQLLYLLRTIVTGMTPQQAI

SEQ ID NO: 887687 - protein, 30 aa, Mycobacterium
QQDVLGLINAPTQALLGRGLIGDGAAGTAS

SEQ ID NO: 887688 - protein, 25 aa, Mycobacterium
QQGVGFIPWFPLASGPLAAPDGPLR

SEQ ID NO: 887689 - protein, 22 aa, Mycobacterium
QQIRLPGFRPGKAPRKLLEARV

SEQ ID NO: 887690 - protein, 17 aa, Mycobacterium
QQIVRVAAPDLQKARKV

SEQ ID NO: 887691 - protein, 24 aa, Mycobacterium
QQKVLLARWLITEPDLFILDEPTR

SEQ ID NO: 887692 - protein, 20 aa, Mycobacterium
QQLPALRMINWRTAARAVAA

SEQ ID NO: 887693 - protein, 23 aa, Mycobacterium
QQRSGLALMFLFDDVLTDAGANE

SEQ ID NO: 887694 - protein, 26 aa, Mycobacterium
QRAVRTIAWLPWLVCPLSAPAGAGKT

SEQ ID NO: 887695 - protein, 21 aa, Mycobacterium
QRFDRELWRKLIDSDILSSAA

SEQ ID NO: 887696 - protein, 25 aa, Mycobacterium
QRFGEHFFYILYFQQPGVADAELNG

SEQ ID NO: 887697 - protein, 26 aa, Mycobacterium
QRIKDLVIPPAWKNVWISPSPNGHIQ

SEQ ID NO: 887698 - protein, 18 aa, Mycobacterium
QRIPMLMTLLSAAAPDAG

SEQ ID NO: 887699 - protein, 23 aa, Mycobacterium
QRKLMAPFFVWLTVGLYDPPVRE

SEQ ID NO: 887700 - protein, 19 aa, Mycobacterium
QRLAGQAAALHTQLERVLS

SEQ ID NO: 887701 - protein, 23 aa, Mycobacterium
QRLGLPAPDWQVLLAVPAELAGQ

SEQ ID NO: 887702 - protein, 21 aa, Mycobacterium
QRLPAAAPYRSFVSWLAARDR

SEQ ID NO: 887703 - protein, 20 aa, Mycobacterium
QRLQLLTWLIAHGRLEIKLA

SEQ ID NO: 887704 - protein, 20 aa, Mycobacterium
QRRAIWVFAKPDFPIPRAAR

SEQ ID NO: 887705 - protein, 23 aa, Mycobacterium
QRRLLAPFFVWLTVGLYDPPVRE

SEQ ID NO: 887706 - protein, 17 aa, Mycobacterium
QRRLTGIDEIVLSLTAK

SEQ ID NO: 887707 - protein, 24 aa, Mycobacterium
QRSIFLPRGIPGRAYWFFARTAHH

SEQ ID NO: 887708 - protein, 23 aa, Mycobacterium
QRSLWFLYQLAPDNPAYTLTYAG

SEQ ID NO: 887709 - protein, 17 aa, Mycobacterium
QRSWFRRDHRVRWLDVS

SEQ ID NO: 887710 - protein, 21 aa, Mycobacterium
QRSWVHVLPSRKEGWGLAVTE

SEQ ID NO: 887711 - protein, 19 aa, Mycobacterium
QRTADGLWYPLWDANVRLD

SEQ ID NO: 887712 - protein, 19 aa, Mycobacterium
QRTILRLLDFSISAAGVMR

SEQ ID NO: 887713 - protein, 23 aa, Mycobacterium
QRTLWAPYWQLLMNALDTKWGAI

SEQ ID NO: 887714 - protein, 30 aa, Mycobacterium
QRTPMPFAGPLFRFALFRTRADQFHLFACC

SEQ ID NO: 887715 - protein, 19 aa, Mycobacterium
QRVFYGWAQVWRTKAREAE

SEQ ID NO: 887716 - protein, 19 aa, Mycobacterium
QRVFYGWAQVWRTKSREAE

SEQ ID NO: 887717 - protein, 20 aa, Mycobacterium
QRVFYGWAQVWRTKSREAEA

SEQ ID NO: 887718 - protein, 20 aa, Mycobacterium
QRVFYGWAQVWRTKSRQAEA

SEQ ID NO: 887719 - protein, 20 aa, Mycobacterium
QRVGRFRFFLDGHRWEWSDA

SEQ ID NO: 887720 - protein, 23 aa, Mycobacterium
QRWIDFLHRWDPARWPRANPRAT

SEQ ID NO: 887721 - protein, 27 aa, Mycobacterium
QRWLEWQKLFLSIIPFPEISAARAMPM

SEQ ID NO: 887722 - protein, 17 aa, Mycobacterium
QRWRDLLLTLEQRLLLT

SEQ ID NO: 887723 - protein, 24 aa, Mycobacterium
QSAELPLFRYLGGPNAHILPVPMM

SEQ ID NO: 887724 - protein, 27 aa, Mycobacterium
QSATAMWHWFFHLQPDLPELLVAGNTE

SEQ ID NO: 887725 - protein, 21 aa, Mycobacterium
QSAWPQHLWPALSTAGFANEL

SEQ ID NO: 887726 - protein, 23 aa, Mycobacterium
QSISPLTLRQALLGKVLTVGDAV

SEQ ID NO: 887727 - protein, 17 aa, Mycobacterium
QSKNPVLQLFIDVLMRL

SEQ ID NO: 887728 - protein, 17 aa, Mycobacterium
QSKYLVYQYLPSRYGMN

SEQ ID NO: 887729 - protein, 20 aa, Mycobacterium
QSLGILRRPLSTSLLSAADI

SEQ ID NO: 887730 - protein, 23 aa, Mycobacterium
QSLLVRSLVAWFWEQPLRAPLIR

SEQ ID NO: 887731 - protein, 29 aa, Mycobacterium
QSLRPVIFSTFLMWLLADLFTVLDEVGDI

SEQ ID NO: 887732 - protein, 23 aa, Mycobacterium
QSRRYSPWLAYGQSKLANLLFTS

SEQ ID NO: 887733 - protein, 18 aa, Mycobacterium
QSRWQFGVLGPPGAADAG

SEQ ID NO: 887734 - protein, 18 aa, Mycobacterium
QSRWQFGVLGPPGALEAG

SEQ ID NO: 887735 - protein, 18 aa, Mycobacterium
QSSRLEFLRAWLAGSDNA

SEQ ID NO: 887736 - protein, 24 aa, Mycobacterium
QSVPMFKLRRYFPPDARPGAQIVG

SEQ ID NO: 887737 - protein, 21 aa, Mycobacterium
QSWPFPIVPIVLIVAHPRNLP

SEQ ID NO: 887738 - protein, 18 aa, Mycobacterium
QTALSWMMWNFRLAGLLV

SEQ ID NO: 887739 - protein, 18 aa, Mycobacterium
QTFPLVPAALLACAIPTG

SEQ ID NO: 887740 - protein, 18 aa, Mycobacterium
QTFWRFIDELSGPGLPPV

SEQ ID NO: 887741 - protein, 20 aa, Mycobacterium
QTLRLGLIPTVAPYVLPMVL

SEQ ID NO: 887742 - protein, 19 aa, Mycobacterium
QTPEFLINWDNGNELFGDL

SEQ ID NO: 887743 - protein, 23 aa, Mycobacterium
QTPGMLTPWLELPGAADRLAAWS

SEQ ID NO: 887744 - protein, 23 aa, Mycobacterium
QTPPSPPTLLWPIGVPFSDGLNT

SEQ ID NO: 887745 - protein, 23 aa, Mycobacterium
QTTKLLNNLLFTANLATAATALS

SEQ ID NO: 887746 - protein, 20 aa, Mycobacterium
QTVLWMRMLDRLAGPNPPAI

SEQ ID NO: 887747 - protein, 22 aa, Mycobacterium
QTYALFPFMSVWDNVAFGLRYQ

SEQ ID NO: 887748 - protein, 18 aa, Mycobacterium
QVALAWLISLPGVVAIPG

SEQ ID NO: 887749 - protein, 24 aa, Mycobacterium
QVALPYLVFAQYLALFSSLEYGKT

SEQ ID NO: 887750 - protein, 29 aa, Mycobacterium
QVAPGLFLFCAVLAFSRWRFVRFATDERA

SEQ ID NO: 887751 - protein, 24 aa, Mycobacterium
QVARPPLLKRIVLQTAARLSRRGR

SEQ ID NO: 887752 - protein, 23 aa, Mycobacterium
QVATLFRLWLRDAVRRVADGVLE

SEQ ID NO: 887753 - protein, 23 aa, Mycobacterium
QVDSIPLVVLIHGGAWQSKLGAD

SEQ ID NO: 887754 - protein, 18 aa, Mycobacterium
QVFFVNWFRRGEDHRFLW

SEQ ID NO: 887755 - protein, 19 aa, Mycobacterium
QVFIVYGPRVTLVSAPAAE

SEQ ID NO: 887756 - protein, 19 aa, Mycobacterium
QVFTPFLRQWHKVGWRAPA

SEQ ID NO: 887757 - protein, 19 aa, Mycobacterium
QVFYLRARGIPEDQARRLI

SEQ ID NO: 887758 - protein, 24 aa, Mycobacterium
QVGLRGYWPPRDTFDWMLEQKMTW

SEQ ID NO: 887759 - protein, 23 aa, Mycobacterium
QVGQTYRLLLLPPGSEMQIVRPI

SEQ ID NO: 887760 - protein, 20 aa, Mycobacterium
QVIILTCSPQRYADVRSARH

SEQ ID NO: 887761 - protein, 26 aa, Mycobacterium
QVILPLWNAWSFLQLYAPKPGTWRTD

SEQ ID NO: 887762 - protein, 20 aa, Mycobacterium
QVIRRFYHQLPAWIDQATRE

SEQ ID NO: 887763 - protein, 17 aa, Mycobacterium
QVLLFPFAAGVATWWRT

SEQ ID NO: 887764 - protein, 18 aa, Mycobacterium
QVLLFPFAAGVATWWRTV

SEQ ID NO: 887765 - protein, 20 aa, Mycobacterium
QVLLPFWNAYSFLALYAPKV

SEQ ID NO: 887766 - protein, 20 aa, Mycobacterium
QVLLPLWNAYSFLALYAPKV

SEQ ID NO: 887767 - protein, 25 aa, Mycobacterium
QVLPAKLPRWLSLPAQLVMQALIGH

SEQ ID NO: 887768 - protein, 22 aa, Mycobacterium
QVNMTLLRFISFILKEIYPGGK

SEQ ID NO: 887769 - protein, 18 aa, Mycobacterium
QVPLLLDEYTRNPSTGSF

SEQ ID NO: 887770 - protein, 20 aa, Mycobacterium
QVREQLLILPIIGVLDSQRA

SEQ ID NO: 887771 - protein, 19 aa, Mycobacterium
QVRFSWVRPALAGPPAWEL

SEQ ID NO: 887772 - protein, 21 aa, Mycobacterium
QVRGYTLRLPLDVLVVASANP

SEQ ID NO: 887773 - protein, 21 aa, Mycobacterium
QVSAFAEMFFAYLDLISAAGV

SEQ ID NO: 887774 - protein, 24 aa, Mycobacterium
QVSRGLLLLWQGGPYRDEALELLS

SEQ ID NO: 887775 - protein, 23 aa, Mycobacterium
QVTAGWRPIFARLPFESAVLFTR

SEQ ID NO: 887776 - protein, 22 aa, Mycobacterium
QVTPVLRRLEYLRFSALSGRES

SEQ ID NO: 887777 - protein, 21 aa, Mycobacterium
QVYERLMELLLNGTLKAGDPV

SEQ ID NO: 887778 - protein, 19 aa, Mycobacterium
QWAAFARAALFPALVRGLD

SEQ ID NO: 887779 - protein, 25 aa, Mycobacterium
QWEVPLMLFVIATPEILTAASSDLA

SEQ ID NO: 887780 - protein, 19 aa, Mycobacterium
QWEVTLAPANLPWLPDHTV

SEQ ID NO: 887781 - protein, 22 aa, Mycobacterium
QWGIPRLSILFWSMGDVPLAHQ

SEQ ID NO: 887782 - protein, 26 aa, Mycobacterium
QWHQLARAFLMFVTQRWPDVLLTAAE

SEQ ID NO: 887783 - protein, 25 aa, Mycobacterium
QWHQLARAFLMYTTQRWPDVLLTAA

SEQ ID NO: 887784 - protein, 18 aa, Mycobacterium
QWLKPLLDGEIRSAFSMT

SEQ ID NO: 887785 - protein, 18 aa, Mycobacterium
QWLLALPPHHIAGMQVLL

SEQ ID NO: 887786 - protein, 25 aa, Mycobacterium
QWLTLRYITRLLLRLGCREDAAVLY

SEQ ID NO: 887787 - protein, 18 aa, Mycobacterium
QWPKFAAALLAQTPVRGA

SEQ ID NO: 887788 - protein, 17 aa, Mycobacterium
QWPPWRLVAGIPTTTIA

SEQ ID NO: 887789 - protein, 17 aa, Mycobacterium
QWWIDRIKACYPLLYRR

SEQ ID NO: 887790 - protein, 23 aa, Mycobacterium
QYAAMLWLARLLGGIRPPLTRSG

SEQ ID NO: 887791 - protein, 19 aa, Mycobacterium
QYKLVWKNRLGFARLAIQH

SEQ ID NO: 887792 - protein, 17 aa, Mycobacterium
QYPAFGLFGLGPVGGFD

SEQ ID NO: 887793 - protein, 18 aa, Mycobacterium
QYRELLQEFLFGLDLDDD

SEQ ID NO: 887794 - protein, 19 aa, Mycobacterium
QYRLPNYYRWLLYEADHAG

SEQ ID NO: 887795 - protein, 18 aa, Mycobacterium
QYRRLFMRLPPDAPKHRA

SEQ ID NO: 887796 - protein, 21 aa, Mycobacterium
QYVDLLTRTLRLWIADLRRSA

SEQ ID NO: 887797 - protein, 19 aa, Mycobacterium
RAAAGPTLGLLAAGADEVS

SEQ ID NO: 887798 - protein, 25 aa, Mycobacterium
RAAGRVKLSWFLLHAARYLPPQLFA

SEQ ID NO: 887799 - protein, 20 aa, Mycobacterium
RAAHLPRWPLIVLRTPKGWT

SEQ ID NO: 887800 - protein, 18 aa, Mycobacterium
RAALALLVWERRGESVRA

SEQ ID NO: 887801 - protein, 17 aa, Mycobacterium
RAALLVVALSERPDLLM

SEQ ID NO: 887802 - protein, 18 aa, Mycobacterium
RAALPAMRRQRDGHIVQI

SEQ ID NO: 887803 - protein, 17 aa, Mycobacterium
RAALPMLRAAEWARIVT

SEQ ID NO: 887804 - protein, 20 aa, Mycobacterium
RAAMAACCWVTAGKAGRAER

SEQ ID NO: 887805 - protein, 23 aa, Mycobacterium
RAARRLFAAAYRPGWRLSGFTGH

SEQ ID NO: 887806 - protein, 22 aa, Mycobacterium
RAARRLYRLPLAIARLARSGRI

SEQ ID NO: 887807 - protein, 24 aa, Mycobacterium
RADFLRLFRRALGGVPPAPTPIAG

SEQ ID NO: 887808 - protein, 23 aa, Mycobacterium
RADLLAAVRLPSGYFGGVGTDVV

SEQ ID NO: 887809 - protein, 23 aa, Mycobacterium
RADLVIGAVLRPGAKAPSLVSNS

SEQ ID NO: 887810 - protein, 20 aa, Mycobacterium
RADQTLPWHPGRCAAVLIGD

SEQ ID NO: 887811 - protein, 30 aa, Mycobacterium
RADRPLPWQLPARLLLARAYAALGRAVDGE

SEQ ID NO: 887812 - protein, 17 aa, Mycobacterium
RAEFLAERFLRVLSAPA

SEQ ID NO: 887813 - protein, 19 aa, Mycobacterium
RAEIRALFRSSKVGLIAGC

SEQ ID NO: 887814 - protein, 18 aa, Mycobacterium
RAERINRWRVATAEASYS

SEQ ID NO: 887815 - protein, 23 aa, Mycobacterium
RAETLLHLGVMPPGFVGASLNPV

SEQ ID NO: 887816 - protein, 22 aa, Mycobacterium
RAETLLHLKVMPPGFVGASLNP

SEQ ID NO: 887817 - protein, 20 aa, Mycobacterium
RAFCARLLGIAAQRVRVIAR

SEQ ID NO: 887818 - protein, 20 aa, Mycobacterium
RAFCARLLGIAAQRVRVIMR

SEQ ID NO: 887819 - protein, 19 aa, Mycobacterium
RAFLDGKVATWWIPERWAF

SEQ ID NO: 887820 - protein, 26 aa, Mycobacterium
RAFTPWYLVRYFRLLKFKLANPHIIT

SEQ ID NO: 887821 - protein, 17 aa, Mycobacterium
RAGELLDWAYGLAASSQ

SEQ ID NO: 887822 - protein, 24 aa, Mycobacterium
RAGLIHDWFTFPFLPDAHEDRAGV

SEQ ID NO: 887823 - protein, 21 aa, Mycobacterium
RAGMGIQYLLLRSGPMTMPPS

SEQ ID NO: 887824 - protein, 20 aa, Mycobacterium
RAGPFGMPILDDAVAWFVGR

SEQ ID NO: 887825 - protein, 21 aa, Mycobacterium
RAGTYTWIPFGGGVRRCLGAT

SEQ ID NO: 887826 - protein, 20 aa, Mycobacterium
RAGWAVGWKKDAFWGREALT

SEQ ID NO: 887827 - protein, 20 aa, Mycobacterium
RAHAPWFHWGTTAVVARLVQ

SEQ ID NO: 887828 - protein, 20 aa, Mycobacterium
RAHCPQVRFLHLAGSPALIG

SEQ ID NO: 887829 - protein, 18 aa, Mycobacterium
RAIIAACPLTWPWNLLGW

SEQ ID NO: 887830 - protein, 18 aa, Mycobacterium
RAIIAACPYTWPWNLLGW

SEQ ID NO: 887831 - protein, 17 aa, Mycobacterium
RAIPFDLLITNLGIQDL

SEQ ID NO: 887832 - protein, 18 aa, Mycobacterium
RAKHLVLFDFSLAKASAA

SEQ ID NO: 887833 - protein, 24 aa, Mycobacterium
RAKLSPWIPTLKLHYVRVIPTGIT

SEQ ID NO: 887834 - protein, 18 aa, Mycobacterium
RAKMMTKVFGLPAGADAG

SEQ ID NO: 887835 - protein, 21 aa, Mycobacterium
RAKMSLLRHGFVKIFCRPATG

SEQ ID NO: 887836 - protein, 19 aa, Mycobacterium
RAKYKRGFPISWLADEFGV

SEQ ID NO: 887837 - protein, 25 aa, Mycobacterium
RALAARPRVLLLDEPFAALDAGLRV

SEQ ID NO: 887838 - protein, 29 aa, Mycobacterium
RALGLKRKLVLGPWFRPVYRILVAARRLR

SEQ ID NO: 887839 - protein, 20 aa, Mycobacterium
RALIGPLRIGLRQAGVPVLL

SEQ ID NO: 887840 - protein, 17 aa, Mycobacterium
RALLDPLGYARDVGSMA

SEQ ID NO: 887841 - protein, 18 aa, Mycobacterium
RALLLCYRQRRWYLEGSY

SEQ ID NO: 887842 - protein, 19 aa, Mycobacterium
RALLSPYLTRKFALTYADE

SEQ ID NO: 887843 - protein, 18 aa, Mycobacterium
RALLTGYLLYTLGGDKRY

SEQ ID NO: 887844 - protein, 17 aa, Mycobacterium
RALLYRYFPDKRAFYTA

SEQ ID NO: 887845 - protein, 17 aa, Mycobacterium
RALPLDGVVFRDLLDGG

SEQ ID NO: 887846 - protein, 17 aa, Mycobacterium
RALPLHGVVFRDLVDGG

SEQ ID NO: 887847 - protein, 23 aa, Mycobacterium
RALRFWEVMYPSPPPGLAGPDDD

SEQ ID NO: 887848 - protein, 23 aa, Mycobacterium
RALRFWEVMYPSPPPGLAGPGDE

SEQ ID NO: 887849 - protein, 22 aa, Mycobacterium
RALRFWEVMYPSPPPGPAVGAS

SEQ ID NO: 887850 - protein, 21 aa, Mycobacterium
RALSWTVYSVPRIPPGAYIEL

SEQ ID NO: 887851 - protein, 18 aa, Mycobacterium
RALTGNDWLALLLEPAES

SEQ ID NO: 887852 - protein, 19 aa, Mycobacterium
RALVKFWDALGGDGVFGGS

SEQ ID NO: 887853 - protein, 17 aa, Mycobacterium
RALVLIDFFGNAVAQGL

SEQ ID NO: 887854 - protein, 18 aa, Mycobacterium
RALYRAGFFGLSWPREYG

SEQ ID NO: 887855 - protein, 22 aa, Mycobacterium
RAMRMALLPERLPAAEALSWGL

SEQ ID NO: 887856 - protein, 24 aa, Mycobacterium
RAMVAAAAPYSGWLSTAAARAAAA

SEQ ID NO: 887857 - protein, 19 aa, Mycobacterium
RAMVAACPLTFPWNVLGWP

SEQ ID NO: 887858 - protein, 24 aa, Mycobacterium
RANVTQWLAWVLMILTGAMNRPGG

SEQ ID NO: 887859 - protein, 21 aa, Mycobacterium
RAPLDVFLVRKLGVPQWQELA

SEQ ID NO: 887860 - protein, 18 aa, Mycobacterium
RAPWRPELMPADPTWPVQ

SEQ ID NO: 887861 - protein, 17 aa, Mycobacterium
RAPYILVQQLVPVMIER

SEQ ID NO: 887862 - protein, 18 aa, Mycobacterium
RAQALALSLLLLSPAALN

SEQ ID NO: 887863 - protein, 18 aa, Mycobacterium
RAQKFYVRLFGWKPHAMG

SEQ ID NO: 887864 - protein, 21 aa, Mycobacterium
RAQLMMLIATNFFGQNLPAIA

SEQ ID NO: 887865 - protein, 26 aa, Mycobacterium
RARHIHDFPALWYVPAAGLVYIAAAG

SEQ ID NO: 887866 - protein, 20 aa, Mycobacterium
RARIVLFRKPIERRAKDTLE

SEQ ID NO: 887867 - protein, 17 aa, Mycobacterium
RARIVLFRKPIERRVKG

SEQ ID NO: 887868 - protein, 20 aa, Mycobacterium
RARLPLIRDLPVVLAYAASA

SEQ ID NO: 887869 - protein, 22 aa, Mycobacterium
RARQMLRFLSSPLWRAYTSTYI

SEQ ID NO: 887870 - protein, 17 aa, Mycobacterium
RARREVYPGPWLPEPVL

SEQ ID NO: 887871 - protein, 20 aa, Mycobacterium
RARRLYASRGWLPWLGPTSV

SEQ ID NO: 887872 - protein, 17 aa, Mycobacterium
RARRRLAALRLLRYRML

SEQ ID NO: 887873 - protein, 19 aa, Mycobacterium
RASLLHLLLDDWVGAALVS

SEQ ID NO: 887874 - protein, 19 aa, Mycobacterium
RASLMTRLLWRYAKRRFGE

SEQ ID NO: 887875 - protein, 17 aa, Mycobacterium
RASQLALTLRLISGLTA

SEQ ID NO: 887876 - protein, 29 aa, Mycobacterium
RASQTWRYPPFFHALLDAGIYPPCSAFEA

SEQ ID NO: 887877 - protein, 21 aa, Mycobacterium
RAVFWVPPYHDFGLISGILSA

SEQ ID NO: 887878 - protein, 23 aa, Mycobacterium
RAVIALLHRLGFAAATVFVGVDG

SEQ ID NO: 887879 - protein, 20 aa, Mycobacterium
RAVPVRGLAQYLWRFKRGAG

SEQ ID NO: 887880 - protein, 21 aa, Mycobacterium
RAVRPWAPHDYVPWSRGRDFA

SEQ ID NO: 887881 - protein, 28 aa, Mycobacterium
RAVTAAMPMVLWLRMLSLQAHKRALQAS

SEQ ID NO: 887882 - protein, 17 aa, Mycobacterium
RAWAYQIADLAGDYRVI

SEQ ID NO: 887883 - protein, 17 aa, Mycobacterium
RAWLKLVRPLVITEGFA

SEQ ID NO: 887884 - protein, 20 aa, Mycobacterium
RAWRAPLQFLFIDGGHSEDA

SEQ ID NO: 887885 - protein, 18 aa, Mycobacterium
RAWRLPWPAGTTVFELDQ

SEQ ID NO: 887886 - protein, 17 aa, Mycobacterium
RAWRLPWPDGTTVYELD

SEQ ID NO: 887887 - protein, 17 aa, Mycobacterium
RAWRLPWPDGTVVYELD

SEQ ID NO: 887888 - protein, 17 aa, Mycobacterium
RAWRLSWPDAVTVYELE

SEQ ID NO: 887889 - protein, 18 aa, Mycobacterium
RAYRLKWPDGMAVYEIDQ

SEQ ID NO: 887890 - protein, 17 aa, Mycobacterium
RAYRLPWPPQTVVYEID

SEQ ID NO: 887891 - protein, 22 aa, Mycobacterium
RAYTTFLLGQLLLEVSARGASL

SEQ ID NO: 887892 - protein, 25 aa, Mycobacterium
RCGAISRILAYVAPILLGGPVTAVD

SEQ ID NO: 887893 - protein, 21 aa, Mycobacterium
RCKWRKWLYFQCNWKVAMEAF

SEQ ID NO: 887894 - protein, 23 aa, Mycobacterium
RCRLVTERLWPTLLEPLRSREQA

SEQ ID NO: 887895 - protein, 18 aa, Mycobacterium
RCRLVTERLWPTLMEPLR

SEQ ID NO: 887896 - protein, 23 aa, Mycobacterium
RCRLVTQRLWPTLLEPLRTREQA

SEQ ID NO: 887897 - protein, 17 aa, Mycobacterium
RCRRWFGALPLARRPRG

SEQ ID NO: 887898 - protein, 19 aa, Mycobacterium
RCWLYLGFTRLASGALQAA

SEQ ID NO: 887899 - protein, 17 aa, Mycobacterium
RDALAGRVLLGAAISDV

SEQ ID NO: 887900 - protein, 17 aa, Mycobacterium
RDATWVSVRWFRPGGSR

SEQ ID NO: 887901 - protein, 25 aa, Mycobacterium
RDAVPFSAYLFYKWAAHPGAEPDGW

SEQ ID NO: 887902 - protein, 23 aa, Mycobacterium
RDAVVVHPTWWTPNRVTRLRDIA

SEQ ID NO: 887903 - protein, 23 aa, Mycobacterium
RDDRTMFLFIFRAPREGTIAAPK

SEQ ID NO: 887904 - protein, 24 aa, Mycobacterium
RDELMAMCFLLITAGYETTVNLIG

SEQ ID NO: 887905 - protein, 24 aa, Mycobacterium
RDESKWVPLLWRRDLDAGHWAPFS

SEQ ID NO: 887906 - protein, 25 aa, Mycobacterium
RDFHTFNLAYRPPLYRVRTHDGLAL

SEQ ID NO: 887907 - protein, 22 aa, Mycobacterium
RDFQRFLIGKLRDIRAVVLNAS

SEQ ID NO: 887908 - protein, 17 aa, Mycobacterium
RDFSVLWAAFRELAEDD

SEQ ID NO: 887909 - protein, 22 aa, Mycobacterium
RDGALPLQFLFSGTIFVKSDRG

SEQ ID NO: 887910 - protein, 23 aa, Mycobacterium
RDGALPLQFLFSGTIFVKSERGF

SEQ ID NO: 887911 - protein, 17 aa, Mycobacterium
RDGFLYFAGRRGDWIRV

SEQ ID NO: 887912 - protein, 18 aa, Mycobacterium
RDGGWWVLGVGAPAMAQC

SEQ ID NO: 887913 - protein, 24 aa, Mycobacterium
RDGLRAFLSRFLLPAILAGDHARP

SEQ ID NO: 887914 - protein, 19 aa, Mycobacterium
RDGLRLPWIPGVRGDTRTI

SEQ ID NO: 887915 - protein, 21 aa, Mycobacterium
RDGLRPLIFALWEMVKKYRDA

SEQ ID NO: 887916 - protein, 17 aa, Mycobacterium
RDGNFVVYTADKPVWHT

SEQ ID NO: 887917 - protein, 25 aa, Mycobacterium
RDGRWIQLVFLQPDKFWAGFCERVG

SEQ ID NO: 887918 - protein, 25 aa, Mycobacterium
RDGRWIQLVFLQPDKFWAGFCRRMG

SEQ ID NO: 887919 - protein, 21 aa, Mycobacterium
RDGRWYWHWDPAFMTKPGDDP

SEQ ID NO: 887920 - protein, 27 aa, Mycobacterium
RDGTNIRAWLFKILTNTWINAYHTAQR

SEQ ID NO: 887921 - protein, 23 aa, Mycobacterium
RDGVLRWWAGPWPVDERWWDPQN

SEQ ID NO: 887922 - protein, 22 aa, Mycobacterium
RDIRFVRLWFTDVLGYLKSVSI

SEQ ID NO: 887923 - protein, 19 aa, Mycobacterium
RDIVDFWLTELGLDDLRTC

SEQ ID NO: 887924 - protein, 22 aa, Mycobacterium
RDKIPLVMLLEGAGFRPTGVHY

SEQ ID NO: 887925 - protein, 26 aa, Mycobacterium
RDLFPSLRFALTFSYARFLRRGRKAP

SEQ ID NO: 887926 - protein, 19 aa, Mycobacterium
RDLLKFEFYFADSAAYREH

SEQ ID NO: 887927 - protein, 17 aa, Mycobacterium
RDLLLDAYLLRAMGIAG

SEQ ID NO: 887928 - protein, 18 aa, Mycobacterium
RDLLWTPTDLYPAEVLTG

SEQ ID NO: 887929 - protein, 23 aa, Mycobacterium
RDLPALISAPDRLFRIPQGVPTD

SEQ ID NO: 887930 - protein, 20 aa, Mycobacterium
RDLVDYWLFVIDVAGGDDIP

SEQ ID NO: 887931 - protein, 24 aa, Mycobacterium
RDMAEMFAWLRPTDLVWRYWVNNY

SEQ ID NO: 887932 - protein, 22 aa, Mycobacterium
RDMGLMLGEYWDLGPLAADCAA

SEQ ID NO: 887933 - protein, 21 aa, Mycobacterium
RDMVLFIGHPARWADWGSLEY

SEQ ID NO: 887934 - protein, 20 aa, Mycobacterium
RDNMLFTNWPRPVLTTAEGD

SEQ ID NO: 887935 - protein, 26 aa, Mycobacterium
RDNPQRVWGWYLWRHYLVADVQPNAG

SEQ ID NO: 887936 - protein, 18 aa, Mycobacterium
RDNRFIAFVLLQADRFWA

SEQ ID NO: 887937 - protein, 23 aa, Mycobacterium
RDPWRLDGPWRTPLIAVAHGWCM

SEQ ID NO: 887938 - protein, 17 aa, Mycobacterium
RDPYTVALLGAIAGREL

SEQ ID NO: 887939 - protein, 19 aa, Mycobacterium
RDQLNEFFLLLAIAGNETT

SEQ ID NO: 887940 - protein, 20 aa, Mycobacterium
RDQLNEFFLLLAIAGNETTR

SEQ ID NO: 887941 - protein, 17 aa, Mycobacterium
RDRAKMFALLRASLRQQ

SEQ ID NO: 887942 - protein, 19 aa, Mycobacterium
RDRDFTCFYLRAGELIAAD

SEQ ID NO: 887943 - protein, 23 aa, Mycobacterium
RDRGLTWLPLYHDMGLTFLLTGF

SEQ ID NO: 887944 - protein, 26 aa, Mycobacterium
RDRIHQGWILTALWLIDTGVTAAALE

SEQ ID NO: 887945 - protein, 25 aa, Mycobacterium
RDRIHQGWILTALWVIDTGVTAATL

SEQ ID NO: 887946 - protein, 20 aa, Mycobacterium
RDRLLDQVWGWSAGLPSGRR

SEQ ID NO: 887947 - protein, 17 aa, Mycobacterium
RDRLWLGLTQCGSPRLI

SEQ ID NO: 887948 - protein, 37 aa, Mycobacterium
RDSPSLSVVPPPPAWYLVGSFLGPTAWPSGNPAMLRL

SEQ ID NO: 887949 - protein, 25 aa, Mycobacterium
RDSQLGLFPFRRNLSLFAVDLGLLT

SEQ ID NO: 887950 - protein, 24 aa, Mycobacterium
RDTDGWFWLGRIAGPYFYDADEQA

SEQ ID NO: 887951 - protein, 19 aa, Mycobacterium
RDTLIYERGGWYFTSRALQ

SEQ ID NO: 887952 - protein, 24 aa, Mycobacterium
RDTYDALFDLFFPAALGARTVLDD

SEQ ID NO: 887953 - protein, 25 aa, Mycobacterium
RDTYDAMFDLWFPAALGARAVITEE

SEQ ID NO: 887954 - protein, 18 aa, Mycobacterium
RDVLAAGDFWGGAASVAC

SEQ ID NO: 887955 - protein, 25 aa, Mycobacterium
RDWGRAFAWMGMPDEYFASSGNAPI

SEQ ID NO: 887956 - protein, 20 aa, Mycobacterium
RDWMYVLSGKLRLILGEQDF

SEQ ID NO: 887957 - protein, 20 aa, Mycobacterium
RDWRQWWDWAPGASWRHPFG

SEQ ID NO: 887958 - protein, 20 aa, Mycobacterium
RDWRQWWDWAPGASWRHPWG

SEQ ID NO: 887959 - protein, 27 aa, Mycobacterium
RDWTISRQLWWGHRIPIWYGPNGEQVC

SEQ ID NO: 887960 - protein, 17 aa, Mycobacterium
RDWWSMDWMWSALHLDD

SEQ ID NO: 887961 - protein, 17 aa, Mycobacterium
RDYFDFFDMLKATARGL

SEQ ID NO: 887962 - protein, 19 aa, Mycobacterium
RDYLTDLFPILELGTSAKM

SEQ ID NO: 887963 - protein, 20 aa, Mycobacterium
RDYLTDLFPILELGTSAKML

SEQ ID NO: 887964 - protein, 19 aa, Mycobacterium
REATAWLQLATAALIQLRA

SEQ ID NO: 887965 - protein, 21 aa, Mycobacterium
REAWPVLRRNLSVLALRGADP

SEQ ID NO: 887966 - protein, 23 aa, Mycobacterium
REELLDICFLFLIAGLDTVTDSL

SEQ ID NO: 887967 - protein, 18 aa, Mycobacterium
REFTDACEILLLLKDNLA

SEQ ID NO: 887968 - protein, 17 aa, Mycobacterium
REFVRLWEHLLTDGGFA

SEQ ID NO: 887969 - protein, 24 aa, Mycobacterium
REGIKHLKFIFYDWNRLGDGEAQR

SEQ ID NO: 887970 - protein, 19 aa, Mycobacterium
REGQWGAPLLFYLDAGIPP

SEQ ID NO: 887971 - protein, 24 aa, Mycobacterium
REGSNLTAWLYRILHNTWINLYRK

SEQ ID NO: 887972 - protein, 25 aa, Mycobacterium
REGSQWLALLLEPPSNAVAPGTPEW

SEQ ID NO: 887973 - protein, 25 aa, Mycobacterium
REGVNLTFLPFFARAVIDALKIHPN

SEQ ID NO: 887974 - protein, 21 aa, Mycobacterium
REHAHRLLNERLLTIEWEPRE

SEQ ID NO: 887975 - protein, 21 aa, Mycobacterium
REHALLLALRKDPQVTGLAIA

SEQ ID NO: 887976 - protein, 22 aa, Mycobacterium
REHALLLALRRDPEVEGLAVAP

SEQ ID NO: 887977 - protein, 22 aa, Mycobacterium
REHPVPLLFVHGGWHGAWCWEH

SEQ ID NO: 887978 - protein, 23 aa, Mycobacterium
REIDDVWHYLLRWALMFGVTEDL

SEQ ID NO: 887979 - protein, 18 aa, Mycobacterium
REIGVPTVFNLLGPLTNP

SEQ ID NO: 887980 - protein, 22 aa, Mycobacterium
REKLFPLIRRYALAYHVVFIPP

SEQ ID NO: 887981 - protein, 23 aa, Mycobacterium
REKLFPLIRRYALAYHVVFIPPA

SEQ ID NO: 887982 - protein, 25 aa, Mycobacterium
RELDLGWIIFLHRFFQDLAEVATLP

SEQ ID NO: 887983 - protein, 18 aa, Mycobacterium
RELGVPTVFNLLGPLTNP

SEQ ID NO: 887984 - protein, 18 aa, Mycobacterium
RELKQKFYELLASRLADR

SEQ ID NO: 887985 - protein, 22 aa, Mycobacterium
RELLRLWADYLDMPPLRVDPAT

SEQ ID NO: 887986 - protein, 19 aa, Mycobacterium
RELLWEPMRLYPADIISAI

SEQ ID NO: 887987 - protein, 18 aa, Mycobacterium
RELPWRRPIASLNYLLSS

SEQ ID NO: 887988 - protein, 25 aa, Mycobacterium
REMTTLLRRILEVPLPVIAAIDGHV

SEQ ID NO: 887989 - protein, 23 aa, Mycobacterium
RENALLERGLLPSPLLLDDPGVD

SEQ ID NO: 887990 - protein, 23 aa, Mycobacterium
RENALLERGLLPSPLLLDRPGVD

SEQ ID NO: 887991 - protein, 23 aa, Mycobacterium
RENLVLFGRLRGLSRRRAKARAD

SEQ ID NO: 887992 - protein, 23 aa, Mycobacterium
RENVVALTVLWLLNIGEYLQDLT

SEQ ID NO: 887993 - protein, 19 aa, Mycobacterium
REQLPLDDRARWLYAKAIQ

SEQ ID NO: 887994 - protein, 23 aa, Mycobacterium
RERGYAYFLYPPEVPLTETAYDR

SEQ ID NO: 887995 - protein, 24 aa, Mycobacterium
RERGYAYFLYPPHAPLTETAYDRL

SEQ ID NO: 887996 - protein, 22 aa, Mycobacterium
RERIPLVVLIWEDGGYGLIEWK

SEQ ID NO: 887997 - protein, 17 aa, Mycobacterium
RERLGFGELRWAVSGAA

SEQ ID NO: 887998 - protein, 17 aa, Mycobacterium
RESYLRLLLIDAGLARP

SEQ ID NO: 887999 - protein, 17 aa, Mycobacterium
RETLFPLICRYAEAYHV

SEQ ID NO: 888000 - protein, 17 aa, Mycobacterium
RETWLRMVLIDAGLPVP

SEQ ID NO: 888001 - protein, 24 aa, Mycobacterium
RETYDALFDLYFPAALGAKTVLDD

SEQ ID NO: 888002 - protein, 24 aa, Mycobacterium
RETYDAMFDLWFPAALGARAVVAE

SEQ ID NO: 888003 - protein, 24 aa, Mycobacterium
RETYDAMFDLWFPAALGARAVVTD

SEQ ID NO: 888004 - protein, 21 aa, Mycobacterium
REVARILGPLLPAAHRDALSD

SEQ ID NO: 888005 - protein, 17 aa, Mycobacterium
REVLDYRDPLWPHHAKA

SEQ ID NO: 888006 - protein, 23 aa, Mycobacterium
REVQDVWTWVRPYYDARAMAAAA

SEQ ID NO: 888007 - protein, 17 aa, Mycobacterium
REWLDRNLVPLEKLPQG

SEQ ID NO: 888008 - protein, 22 aa, Mycobacterium
REWVAMFLDWLAQPVTRAALPG

SEQ ID NO: 888009 - protein, 20 aa, Mycobacterium
REYESLWSAVRFDDPARPAA

SEQ ID NO: 888010 - protein, 18 aa, Mycobacterium
REYLWAEADRHLWIADDR

SEQ ID NO: 888011 - protein, 25 aa, Mycobacterium
REYWRGPVWPVLTWLFCWAFERRGW

SEQ ID NO: 888012 - protein, 24 aa, Mycobacterium
RFAEFYRRWSLVTTRVWPTLLQPL

SEQ ID NO: 888013 - protein, 18 aa, Mycobacterium
RFAGAMLGLGPQGPNGTS

SEQ ID NO: 888014 - protein, 19 aa, Mycobacterium
RFAPFLWQEIEDGILPALY

SEQ ID NO: 888015 - protein, 20 aa, Mycobacterium
RFATYPVLAVQGWAAFHDLK

SEQ ID NO: 888016 - protein, 24 aa, Mycobacterium
RFAVRAFDWLTWRLSKKLEDAQRG

SEQ ID NO: 888017 - protein, 19 aa, Mycobacterium
RFCVALFGLLRAGAIPVMC

SEQ ID NO: 888018 - protein, 21 aa, Mycobacterium
RFFDRVWRPEQLPAALLGAMR

SEQ ID NO: 888019 - protein, 18 aa, Mycobacterium
RFFGNRTWWPRLSSTVTG

SEQ ID NO: 888020 - protein, 17 aa, Mycobacterium
RFFLDGHRWEWSDAVAR

SEQ ID NO: 888021 - protein, 17 aa, Mycobacterium
RFGRIIFIGSVSGMWGI

SEQ ID NO: 888022 - protein, 17 aa, Mycobacterium
RFHFTDQRWEWSEQVQR

SEQ ID NO: 888023 - protein, 18 aa, Mycobacterium
RFHHLLKTFWTGPGGWHD

SEQ ID NO: 888024 - protein, 19 aa, Mycobacterium
RFHHLLKTFWTGPGGWHDR

SEQ ID NO: 888025 - protein, 24 aa, Mycobacterium
RFHNYLYDKLGLDFLYKAFSTTDI

SEQ ID NO: 888026 - protein, 18 aa, Mycobacterium
RFHRPILAGDKLFFHTYL

SEQ ID NO: 888027 - protein, 20 aa, Mycobacterium
RFHRRLLWPIRASSGEVIGF

SEQ ID NO: 888028 - protein, 19 aa, Mycobacterium
RFHTVYWPAFLMSAGIELP

SEQ ID NO: 888029 - protein, 25 aa, Mycobacterium
RFHTVYWPAFLMSAGLPLPKRIFAH

SEQ ID NO: 888030 - protein, 18 aa, Mycobacterium
RFIGIPAAFPKLFRSEVD

SEQ ID NO: 888031 - protein, 20 aa, Mycobacterium
RFITRWLGPAILYPRMMSLV

SEQ ID NO: 888032 - protein, 18 aa, Mycobacterium
RFLAGLPLPYIPSARDIA

SEQ ID NO: 888033 - protein, 17 aa, Mycobacterium
RFLALREQGKAGYLLTY

SEQ ID NO: 888034 - protein, 32 aa, Mycobacterium
RFLAQPTWRHGVMKLIFMEVPLRAVPGLRIRA

SEQ ID NO: 888035 - protein, 23 aa, Mycobacterium
RFLLAVGDLLIGWRLLVQAGVAH

SEQ ID NO: 888036 - protein, 17 aa, Mycobacterium
RFMVNYLRLFATDPAER

SEQ ID NO: 888037 - protein, 18 aa, Mycobacterium
RFNEAFGPFGFPPKAIKP

SEQ ID NO: 888038 - protein, 27 aa, Mycobacterium
RFPEVVVRPLIRFANPTRQLLVQAERS

SEQ ID NO: 888039 - protein, 17 aa, Mycobacterium
RFPFFDYPYIVVLVELA

SEQ ID NO: 888040 - protein, 17 aa, Mycobacterium
RFPFFDYPYIVVLVELD

SEQ ID NO: 888041 - protein, 17 aa, Mycobacterium
RFPTFDWPRIDAPYIRP

SEQ ID NO: 888042 - protein, 24 aa, Mycobacterium
RFQFVLARLEVLLGPLHVAPGAAR

SEQ ID NO: 888043 - protein, 21 aa, Mycobacterium
RFRERVLPRVPARRWGAADDI

SEQ ID NO: 888044 - protein, 18 aa, Mycobacterium
RFRPSWLPIPMRSIQRLV

SEQ ID NO: 888045 - protein, 19 aa, Mycobacterium
RFRRSIQTILLAALGRTIA

SEQ ID NO: 888046 - protein, 29 aa, Mycobacterium
RFSKIFDVNLWAPLLWTSLAVKGWMGEHG

SEQ ID NO: 888047 - protein, 24 aa, Mycobacterium
RFSMNYVFALYALPGPMTISQMGR

SEQ ID NO: 888048 - protein, 17 aa, Mycobacterium
RFTITWLAAEARKPGSY

SEQ ID NO: 888049 - protein, 28 aa, Mycobacterium
RFTKIFDVNLWAPLLWTSLAVKSWMGEH

SEQ ID NO: 888050 - protein, 29 aa, Mycobacterium
RFTKIFDVNLWAPLLWTSLVVKSWMGEHG

SEQ ID NO: 888051 - protein, 19 aa, Mycobacterium
RFTMLPWTHTFTTTIPAVF

SEQ ID NO: 888052 - protein, 17 aa, Mycobacterium
RFVVLTTQWLPGSDELT

SEQ ID NO: 888053 - protein, 17 aa, Mycobacterium
RFWGVYGLKKAIAVVEI

SEQ ID NO: 888054 - protein, 18 aa, Mycobacterium
RFWHKVLYDLGYVSSREP

SEQ ID NO: 888055 - protein, 22 aa, Mycobacterium
RFYEGLLGFQFWWELDPPDSAT

SEQ ID NO: 888056 - protein, 17 aa, Mycobacterium
RGAIIWFTGLPASGKST

SEQ ID NO: 888057 - protein, 18 aa, Mycobacterium
RGAPILAMGVWRWGLGEI

SEQ ID NO: 888058 - protein, 26 aa, Mycobacterium
RGAPILAMGVWRWGLGEIAYEQLHRR

SEQ ID NO: 888059 - protein, 25 aa, Mycobacterium
RGARAMLLWDFFSKAVRDVWSAAGS

SEQ ID NO: 888060 - protein, 20 aa, Mycobacterium
RGARIFVELSAHPALLFNMG

SEQ ID NO: 888061 - protein, 22 aa, Mycobacterium
RGARRLVIAPWFLAPGLITDRV

SEQ ID NO: 888062 - protein, 31 aa, Mycobacterium
RGASWLPLYHDMGLLMLMFPLCGGRMTLMSP

SEQ ID NO: 888063 - protein, 23 aa, Mycobacterium
RGCSIARLILLDALLTVPNSDVL

SEQ ID NO: 888064 - protein, 25 aa, Mycobacterium
RGDDRPFFMWYDWMAGGWGGRSTKD

SEQ ID NO: 888065 - protein, 24 aa, Mycobacterium
RGDDVLHWFWQAFPVVQESAVHEL

SEQ ID NO: 888066 - protein, 17 aa, Mycobacterium
RGELLDYLPIPHLHPGD

SEQ ID NO: 888067 - protein, 17 aa, Mycobacterium
RGFFCFPEVDIRIPFTD

SEQ ID NO: 888068 - protein, 23 aa, Mycobacterium
RGFHIYARIHPRWPFKQVRLAAE

SEQ ID NO: 888069 - protein, 18 aa, Mycobacterium
RGFQAADVLARWPVPGPD

SEQ ID NO: 888070 - protein, 21 aa, Mycobacterium
RGGTLKLMRPLFGAGLGGRLG

SEQ ID NO: 888071 - protein, 23 aa, Mycobacterium
RGGTLRLMRPLFAAGLGGRLGDG

SEQ ID NO: 888072 - protein, 20 aa, Mycobacterium
RGIAFVPFFPLGAAFMRPNP

SEQ ID NO: 888073 - protein, 21 aa, Mycobacterium
RGIPVILRPAVLAKLMDGRTT

SEQ ID NO: 888074 - protein, 25 aa, Mycobacterium
RGIPVILRPVVLAKLMTGYTTLMVT

SEQ ID NO: 888075 - protein, 24 aa, Mycobacterium
RGIPVLLRPVVLAKLMAGRTTLMV

SEQ ID NO: 888076 - protein, 20 aa, Mycobacterium
RGISLLTLGFMQATPDGKLA

SEQ ID NO: 888077 - protein, 24 aa, Mycobacterium
RGKAVLLKLIWRMFRARVFGDRMA

SEQ ID NO: 888078 - protein, 17 aa, Mycobacterium
RGKKAVLLVFFPLAFTG

SEQ ID NO: 888079 - protein, 26 aa, Mycobacterium
RGKRAVWVPWVIRPMAFTTRFVPQVL

SEQ ID NO: 888080 - protein, 23 aa, Mycobacterium
RGKWAYYRLVPAALDALGGVFVV

SEQ ID NO: 888081 - protein, 17 aa, Mycobacterium
RGKYLWLTLDDSAALVV

SEQ ID NO: 888082 - protein, 21 aa, Mycobacterium
RGKYRLGFAIPRLAHVAGGQN

SEQ ID NO: 888083 - protein, 25 aa, Mycobacterium
RGLEPFTFRPALTVGWRLWMDIGFK

SEQ ID NO: 888084 - protein, 25 aa, Mycobacterium
RGLFDGALDLWLALTAAALAGAAKR

SEQ ID NO: 888085 - protein, 18 aa, Mycobacterium
RGLFLQPVDGEPGWFHYH

SEQ ID NO: 888086 - protein, 17 aa, Mycobacterium
RGLFQAGPWHRAAPLRL

SEQ ID NO: 888087 - protein, 17 aa, Mycobacterium
RGLFVHSAPWAVPSLGL

SEQ ID NO: 888088 - protein, 19 aa, Mycobacterium
RGLHRAALPEKPWFGPTSW

SEQ ID NO: 888089 - protein, 23 aa, Mycobacterium
RGLLPFRVWQFYDAMVGFAKSRQ

SEQ ID NO: 888090 - protein, 18 aa, Mycobacterium
RGLTYFMFDLKAPGVTVR

SEQ ID NO: 888091 - protein, 21 aa, Mycobacterium
RGNLAFRWFLADELPTRPEVK

SEQ ID NO: 888092 - protein, 24 aa, Mycobacterium
RGNSPLWHYNFLRRPPIPPDSDLI

SEQ ID NO: 888093 - protein, 23 aa, Mycobacterium
RGPDRYRWRLLAGPKTVWDSELI

SEQ ID NO: 888094 - protein, 19 aa, Mycobacterium
RGPGRFWGVYGLKKAIAVV

SEQ ID NO: 888095 - protein, 17 aa, Mycobacterium
RGPVRLEVVQFLAGEGM

SEQ ID NO: 888096 - protein, 17 aa, Mycobacterium
RGPWQYETLTREMLLDC

SEQ ID NO: 888097 - protein, 17 aa, Mycobacterium
RGQPFLALVDYAHKPGA

SEQ ID NO: 888098 - protein, 18 aa, Mycobacterium
RGRFRWWGLYTQREQGYD

SEQ ID NO: 888099 - protein, 19 aa, Mycobacterium
RGRKVIVYFYPAASTPGCT

SEQ ID NO: 888100 - protein, 19 aa, Mycobacterium
RGRLPLDPQLRRLPIRIVA

SEQ ID NO: 888101 - protein, 20 aa, Mycobacterium
RGRPLWELYLIQGLSGGRVA

SEQ ID NO: 888102 - protein, 19 aa, Mycobacterium
RGRRLAWSDSWLTSPGGGN

SEQ ID NO: 888103 - protein, 21 aa, Mycobacterium
RGRTRPLWWTLRRPHRPLTYH

SEQ ID NO: 888104 - protein, 24 aa, Mycobacterium
RGSKNVLLVFFPLAFTGICQGELD

SEQ ID NO: 888105 - protein, 17 aa, Mycobacterium
RGTFRVRDFLRHANYSL

SEQ ID NO: 888106 - protein, 17 aa, Mycobacterium
RGTFYFHFPTKEQVLVE

SEQ ID NO: 888107 - protein, 25 aa, Mycobacterium
RGTKDVLLVFFPLAFTGICQGELDQ

SEQ ID NO: 888108 - protein, 21 aa, Mycobacterium
RGTTYALLWALAHRDRVRSVS

SEQ ID NO: 888109 - protein, 25 aa, Mycobacterium
RGVSWLPFFHDMGLITVLLTSVLGH

SEQ ID NO: 888110 - protein, 21 aa, Mycobacterium
RGVYLMCRQFLPAMTTRGRGD

SEQ ID NO: 888111 - protein, 20 aa, Mycobacterium
RGWRSPLQLLFIDGGHTEAA

SEQ ID NO: 888112 - protein, 18 aa, Mycobacterium
RGYEVSVYYLPNGTLFAM

SEQ ID NO: 888113 - protein, 17 aa, Mycobacterium
RGYFCFPEVDIRIPFNA

SEQ ID NO: 888114 - protein, 20 aa, Mycobacterium
RGYPLFVEYLGILGAEIERV

SEQ ID NO: 888115 - protein, 17 aa, Mycobacterium
RGYTLRLPLDVLVVASA

SEQ ID NO: 888116 - protein, 25 aa, Mycobacterium
RGYVLRRLLRRIIRSTKLLGVEKPM

SEQ ID NO: 888117 - protein, 19 aa, Mycobacterium
RGYVLRRLLRRVIRSAKLL

SEQ ID NO: 888118 - protein, 18 aa, Mycobacterium
RHAFGRRLWELPAGLLDV

SEQ ID NO: 888119 - protein, 25 aa, Mycobacterium
RHAGWLRAPLRWALRASLAVRSRLM

SEQ ID NO: 888120 - protein, 18 aa, Mycobacterium
RHAKLFRAELTMPLILLG

SEQ ID NO: 888121 - protein, 17 aa, Mycobacterium
RHDARVVFVRYALPGET

SEQ ID NO: 888122 - protein, 26 aa, Mycobacterium
RHDGEWFELIWPLWRSGRSAITRFPG

SEQ ID NO: 888123 - protein, 19 aa, Mycobacterium
RHFGWLTRWYAFSSADLGS

SEQ ID NO: 888124 - protein, 20 aa, Mycobacterium
RHFQDEILFLFPFDGSGFDR

SEQ ID NO: 888125 - protein, 18 aa, Mycobacterium
RHGFVKIFCRPATGVVIG

SEQ ID NO: 888126 - protein, 24 aa, Mycobacterium
RHHAALLALRYRLWHGRGPGLPPN

SEQ ID NO: 888127 - protein, 23 aa, Mycobacterium
RHIHDFPALWYVPAAGAVYVAAA

SEQ ID NO: 888128 - protein, 19 aa, Mycobacterium
RHILPFVLVNRLAQDRDAP

SEQ ID NO: 888129 - protein, 24 aa, Mycobacterium
RHLGLLAVIAKSFARIHWQNLANF

SEQ ID NO: 888130 - protein, 29 aa, Mycobacterium
RHLPFYGRWYRFLLLWPGADKGLDAARTD

SEQ ID NO: 888131 - protein, 23 aa, Mycobacterium
RHLPRWMYVPDAALPALLDEGTS

SEQ ID NO: 888132 - protein, 17 aa, Mycobacterium
RHPSLCLFASWSAPDSP

SEQ ID NO: 888133 - protein, 28 aa, Mycobacterium
RHRCVGFVFQFFNLLPTLSAWENVAVPK

SEQ ID NO: 888134 - protein, 21 aa, Mycobacterium
RHRDRYRWASWSGRLGIDGTA

SEQ ID NO: 888135 - protein, 24 aa, Mycobacterium
RHRFSPFFIDYFITPLVAAVWSCA

SEQ ID NO: 888136 - protein, 18 aa, Mycobacterium
RHRILQRPAHFQRLLRKS

SEQ ID NO: 888137 - protein, 19 aa, Mycobacterium
RHTFGLALLQYRIERTLSE

SEQ ID NO: 888138 - protein, 22 aa, Mycobacterium
RHVNRWFYDCPPAFHRSLGDMY

SEQ ID NO: 888139 - protein, 20 aa, Mycobacterium
RIAKYWTLNPHPTLIPAIES

SEQ ID NO: 888140 - protein, 23 aa, Mycobacterium
RIALPTYPFRQTRYWPRLRAAGG

SEQ ID NO: 888141 - protein, 28 aa, Mycobacterium
RIDHIIGLFRLWWIPKGALPLEGTYVRY

SEQ ID NO: 888142 - protein, 28 aa, Mycobacterium
RIDHVAGLWRLWWIPPGDGPDKGTYVHY

SEQ ID NO: 888143 - protein, 26 aa, Mycobacterium
RIDHVAGLWRLWWIPPGDGPDRGTYV

SEQ ID NO: 888144 - protein, 24 aa, Mycobacterium
RIEDTWQYFYKGAYWRRGPVTMTA

SEQ ID NO: 888145 - protein, 19 aa, Mycobacterium
RIEDVWLPLFRPRTDAQPR

SEQ ID NO: 888146 - protein, 17 aa, Mycobacterium
RIEGFLLRRGLVRLAED

SEQ ID NO: 888147 - protein, 17 aa, Mycobacterium
RIERFLLLWAEGSMTIA

SEQ ID NO: 888148 - protein, 21 aa, Mycobacterium
RIERGLALTALLRATLTTVRT

SEQ ID NO: 888149 - protein, 25 aa, Mycobacterium
RIEYKLRDWLFARQRYWGEPFPIVY

SEQ ID NO: 888150 - protein, 18 aa, Mycobacterium
RIFAVWLAARFLQLRSTT

SEQ ID NO: 888151 - protein, 24 aa, Mycobacterium
RIFCPRWVGLFRWLKPVLSTSVGE

SEQ ID NO: 888152 - protein, 17 aa, Mycobacterium
RIFDYLMVSLRSLPLVI

SEQ ID NO: 888153 - protein, 18 aa, Mycobacterium
RIFGPYEIPIVNFSGTGF

SEQ ID NO: 888154 - protein, 17 aa, Mycobacterium
RIFVTDISRWREVGLVH

SEQ ID NO: 888155 - protein, 17 aa, Mycobacterium
RIFYRIGFTPWDGHPLA

SEQ ID NO: 888156 - protein, 21 aa, Mycobacterium
RIGAALRWFGLDGVEHPASAD

SEQ ID NO: 888157 - protein, 20 aa, Mycobacterium
RIGLLVCWDIWFPETARIVA

SEQ ID NO: 888158 - protein, 19 aa, Mycobacterium
RIGVRLWQVGSLAPQARNL

SEQ ID NO: 888159 - protein, 19 aa, Mycobacterium
RIHLLPMLRWKCVESPLGL

SEQ ID NO: 888160 - protein, 17 aa, Mycobacterium
RIIARLLPEVRDLRRMG

SEQ ID NO: 888161 - protein, 18 aa, Mycobacterium
RIKFILFRHEQAAGFAAA

SEQ ID NO: 888162 - protein, 17 aa, Mycobacterium
RILALLDPPVESLMLTP

SEQ ID NO: 888163 - protein, 19 aa, Mycobacterium
RILERFPSRLALPKAHVVG

SEQ ID NO: 888164 - protein, 17 aa, Mycobacterium
RILLRFGLHQALRLGKP

SEQ ID NO: 888165 - protein, 17 aa, Mycobacterium
RILPIDLATSPLRALAT

SEQ ID NO: 888166 - protein, 20 aa, Mycobacterium
RINHWLWLRGARLIARITAE

SEQ ID NO: 888167 - protein, 17 aa, Mycobacterium
RIPFLREPFGETITTIG

SEQ ID NO: 888168 - protein, 17 aa, Mycobacterium
RIPFVPMPHAALSGFYG

SEQ ID NO: 888169 - protein, 18 aa, Mycobacterium
RIPRHPLALTRFGVPTVL

SEQ ID NO: 888170 - protein, 20 aa, Mycobacterium
RIPVWFMRQAGRSLPEYRAL

SEQ ID NO: 888171 - protein, 18 aa, Mycobacterium
RIQAMLGALLELFQARAL

SEQ ID NO: 888172 - protein, 18 aa, Mycobacterium
RIQLMAFAYDGAWAEYTV

SEQ ID NO: 888173 - protein, 18 aa, Mycobacterium
RIQPLRLHYARTLQIWAA

SEQ ID NO: 888174 - protein, 21 aa, Mycobacterium
RIQQILLPTLLDWLSDTPDPD

SEQ ID NO: 888175 - protein, 22 aa, Mycobacterium
RIQSILLPTLLDWLADTPDPDA

SEQ ID NO: 888176 - protein, 28 aa, Mycobacterium
RIRPIRVGRILDLPMRRTSMSLMWCSSV

SEQ ID NO: 888177 - protein, 20 aa, Mycobacterium
RIRQRFPHTLAAKLKLLPTP

SEQ ID NO: 888178 - protein, 17 aa, Mycobacterium
RIRRFAETELRALLAHD

SEQ ID NO: 888179 - protein, 17 aa, Mycobacterium
RIRRLLRLSATNTLDAQ

SEQ ID NO: 888180 - protein, 19 aa, Mycobacterium
RIRVLRRLARRPMSVKEVA

SEQ ID NO: 888181 - protein, 19 aa, Mycobacterium
RISHWLWLRGARLAARALA

SEQ ID NO: 888182 - protein, 19 aa, Mycobacterium
RISHWLWNRGARLVARILN

SEQ ID NO: 888183 - protein, 23 aa, Mycobacterium
RISLPPELIYLVRFPLGVRSAMS

SEQ ID NO: 888184 - protein, 18 aa, Mycobacterium
RITPVRIWHEGRFLGDVA

SEQ ID NO: 888185 - protein, 18 aa, Mycobacterium
RIVLFRKPIERRAKDTVE

SEQ ID NO: 888186 - protein, 18 aa, Mycobacterium
RIVLFRKPIERRVKGSDE

SEQ ID NO: 888187 - protein, 20 aa, Mycobacterium
RIVLSPLWPEYLGALGFPIH

SEQ ID NO: 888188 - protein, 18 aa, Mycobacterium
RIWVMRRTTIAFIYTTFF

SEQ ID NO: 888189 - protein, 26 aa, Mycobacterium
RIYCPDWVGLFRWLKPVLSTPLGELP

SEQ ID NO: 888190 - protein, 27 aa, Mycobacterium
RKFLADRVVRWWLPERWAFADQVPRTS

SEQ ID NO: 888191 - protein, 22 aa, Mycobacterium
RKGFFRVPLIRGTITHPVQGEA

SEQ ID NO: 888192 - protein, 32 aa, Mycobacterium
RKGVRFIPLHGPLPYRPLALAWRTANQSPSVR

SEQ ID NO: 888193 - protein, 21 aa, Mycobacterium
RKHIAWYLHGFPAGGDIRRAL

SEQ ID NO: 888194 - protein, 20 aa, Mycobacterium
RKHIAWYLHGFPAGSDVRRA

SEQ ID NO: 888195 - protein, 20 aa, Mycobacterium
RKIIELNLLSALLVSQRANA

SEQ ID NO: 888196 - protein, 21 aa, Mycobacterium
RKKLFRGLFRGTGKYYSGVKW

SEQ ID NO: 888197 - protein, 17 aa, Mycobacterium
RKNFFRVPLIGGTITHP

SEQ ID NO: 888198 - protein, 22 aa, Mycobacterium
RKPALHVLLWQRALEPEKEKWA

SEQ ID NO: 888199 - protein, 26 aa, Mycobacterium
RKPTGYDWFVLWTLSPDSLHVLEVYL

SEQ ID NO: 888200 - protein, 21 aa, Mycobacterium
RKPWLPHFYLGHGIGTYPAEA

SEQ ID NO: 888201 - protein, 24 aa, Mycobacterium
RKRSHWMWFVFPQLRGLGGSPTAV

SEQ ID NO: 888202 - protein, 21 aa, Mycobacterium
RKTHLFGPLDRQYFTAGSDAV

SEQ ID NO: 888203 - protein, 21 aa, Mycobacterium
RKVIIYFYPAAMTPGCTKQAC

SEQ ID NO: 888204 - protein, 22 aa, Mycobacterium
RKVTRFPIILLGTEYWSGLLDW

SEQ ID NO: 888205 - protein, 19 aa, Mycobacterium
RKVVPLRKSLAGYAAWVTG

SEQ ID NO: 888206 - protein, 21 aa, Mycobacterium
RKWRKLFPPGTLPQAAPGSPI

SEQ ID NO: 888207 - protein, 20 aa, Mycobacterium
RLADGLYRYSLLDIIEVASE

SEQ ID NO: 888208 - protein, 22 aa, Mycobacterium
RLAFRYLLDTLLERPMSRRLIE

SEQ ID NO: 888209 - protein, 18 aa, Mycobacterium
RLAIWSPNSWHWPIACLG

SEQ ID NO: 888210 - protein, 23 aa, Mycobacterium
RLAKGFLRFNFHLLYGSSLPARL

SEQ ID NO: 888211 - protein, 17 aa, Mycobacterium
RLALRERGIPLWLDSPM

SEQ ID NO: 888212 - protein, 18 aa, Mycobacterium
RLAMITYLGGPFPQVHDP

SEQ ID NO: 888213 - protein, 24 aa, Mycobacterium
RLAVLWPEVYPRLLRVMDADPICQ

SEQ ID NO: 888214 - protein, 18 aa, Mycobacterium
RLCCACFDGNYPIELPKE

SEQ ID NO: 888215 - protein, 18 aa, Mycobacterium
RLDIDRWLIAVSALPRRD

SEQ ID NO: 888216 - protein, 20 aa, Mycobacterium
RLDWVFETFPRLAERRSQVG

SEQ ID NO: 888217 - protein, 19 aa, Mycobacterium
RLEALPGWPTGPLSPVHIS

SEQ ID NO: 888218 - protein, 22 aa, Mycobacterium
RLFSTVYKEYLMKALPAMATAV

SEQ ID NO: 888219 - protein, 17 aa, Mycobacterium
RLFTAPVPALRLPEESM

SEQ ID NO: 888220 - protein, 21 aa, Mycobacterium
RLGFGDLRWAVSGAAPIPKET

SEQ ID NO: 888221 - protein, 25 aa, Mycobacterium
RLGGAGRWLLALPAHHIAGLQVLVR

SEQ ID NO: 888222 - protein, 19 aa, Mycobacterium
RLGHLQAVTLHRLLGSRPD

SEQ ID NO: 888223 - protein, 25 aa, Mycobacterium
RLGIRCFGFAPLRLPPDLDFAALFH

SEQ ID NO: 888224 - protein, 21 aa, Mycobacterium
RLGLFPFRRNLSFYAVDLALM

SEQ ID NO: 888225 - protein, 23 aa, Mycobacterium
RLGLFPFRRNLTFYALDLGLMSF

SEQ ID NO: 888226 - protein, 20 aa, Mycobacterium
RLGMMLFGPLLNLGLRRFLR

SEQ ID NO: 888227 - protein, 19 aa, Mycobacterium
RLGYLFQDYNLLQSLTSVE

SEQ ID NO: 888228 - protein, 23 aa, Mycobacterium
RLHAKLFYQPLLESIAPAGLEIA

SEQ ID NO: 888229 - protein, 21 aa, Mycobacterium
RLHDYLLAWPQHHAALLAVEI

SEQ ID NO: 888230 - protein, 18 aa, Mycobacterium
RLHGYLYMVLHANVIHGL

SEQ ID NO: 888231 - protein, 17 aa, Mycobacterium
RLHLLSHRLTKPHEANL

SEQ ID NO: 888232 - protein, 18 aa, Mycobacterium
RLHLWYFGDARRRQQPEL

SEQ ID NO: 888233 - protein, 17 aa, Mycobacterium
RLHPYLTVRILNQVPGL

SEQ ID NO: 888234 - protein, 17 aa, Mycobacterium
RLHVLVFGAFRPLGLAT

SEQ ID NO: 888235 - protein, 19 aa, Mycobacterium
RLHWYVPKSIRLIDVFKGL

SEQ ID NO: 888236 - protein, 19 aa, Mycobacterium
RLHWYVPPSVRWIDRLKGV

SEQ ID NO: 888237 - protein, 17 aa, Mycobacterium
RLIADLESWLVAITGYD

SEQ ID NO: 888238 - protein, 19 aa, Mycobacterium
RLIEILLRWNLDDTTDGPR

SEQ ID NO: 888239 - protein, 23 aa, Mycobacterium
RLIHPHEALWRPPVLTMSAVEGT

SEQ ID NO: 888240 - protein, 20 aa, Mycobacterium
RLITIILMRCGLRITDALRL

SEQ ID NO: 888241 - protein, 20 aa, Mycobacterium
RLITVILMRCGLRITDALRL

SEQ ID NO: 888242 - protein, 20 aa, Mycobacterium
RLKAFFARQWRQMPAAHFMA

SEQ ID NO: 888243 - protein, 22 aa, Mycobacterium
RLKKNLGPWWDFLVTDVTLGTS

SEQ ID NO: 888244 - protein, 23 aa, Mycobacterium
RLKRPVPFLPARIGLITGRASAA

SEQ ID NO: 888245 - protein, 20 aa, Mycobacterium
RLLASFPYPHLLTVTARLAD

SEQ ID NO: 888246 - protein, 21 aa, Mycobacterium
RLLDAIYNPWPTPLATAVQAA

SEQ ID NO: 888247 - protein, 24 aa, Mycobacterium
RLLDRASRWFLLNRPQPLSIAAEA

SEQ ID NO: 888248 - protein, 20 aa, Mycobacterium
RLLEHRLQLQRLKRTHLLPP

SEQ ID NO: 888249 - protein, 17 aa, Mycobacterium
RLLLIRAGLPRPQTQIP

SEQ ID NO: 888250 - protein, 18 aa, Mycobacterium
RLLLPKPADWSYAEAAAI

SEQ ID NO: 888251 - protein, 20 aa, Mycobacterium
RLLNLLIYIKGYLDGTLTFR

SEQ ID NO: 888252 - protein, 17 aa, Mycobacterium
RLLPFRLSFDGGDAEDH

SEQ ID NO: 888253 - protein, 20 aa, Mycobacterium
RLLRAHRGLKLLLMAWARYE

SEQ ID NO: 888254 - protein, 20 aa, Mycobacterium
RLLTLIRRIEQLPIPTVAVV

SEQ ID NO: 888255 - protein, 22 aa, Mycobacterium
RLLTLLLFDIGSFAGLAPLLSS

SEQ ID NO: 888256 - protein, 17 aa, Mycobacterium
RLLYGRYLGWASGTKRH

SEQ ID NO: 888257 - protein, 17 aa, Mycobacterium
RLMAYLPTAIAPAAFRW

SEQ ID NO: 888258 - protein, 26 aa, Mycobacterium
RLMDVIHLWLIHRFKAEIVYYVTPTE

SEQ ID NO: 888259 - protein, 20 aa, Mycobacterium
RLMLEMHVLGPLQLSQLAIP

SEQ ID NO: 888260 - protein, 20 aa, Mycobacterium
RLMNYVWYRNVPAGPELTEM

SEQ ID NO: 888261 - protein, 18 aa, Mycobacterium
RLNIPWRRDFNALVYVLS

SEQ ID NO: 888262 - protein, 18 aa, Mycobacterium
RLNRALVSALWWVQWRIT

SEQ ID NO: 888263 - protein, 22 aa, Mycobacterium
RLPAHAGVFLRLIAQRAPDLHR

SEQ ID NO: 888264 - protein, 20 aa, Mycobacterium
RLPAPLLAPAYLFAAAVGWV

SEQ ID NO: 888265 - protein, 20 aa, Mycobacterium
RLPEWYRYNAALLLADRTSV

SEQ ID NO: 888266 - protein, 17 aa, Mycobacterium
RLPGFRPGKAPRKLLEA

SEQ ID NO: 888267 - protein, 27 aa, Mycobacterium
RLPGFRPGRAPVKLLEARFGREAMLDQ

SEQ ID NO: 888268 - protein, 24 aa, Mycobacterium
RLPKVTRSLLLYRYRRLPEARRAA

SEQ ID NO: 888269 - protein, 23 aa, Mycobacterium
RLPRIPFPFPLYLREPRKVVVVH

SEQ ID NO: 888270 - protein, 18 aa, Mycobacterium
RLPVIASDRVYFVGQPVA

SEQ ID NO: 888271 - protein, 20 aa, Mycobacterium
RLQLAWPRYDAMRTELAVGQ

SEQ ID NO: 888272 - protein, 20 aa, Mycobacterium
RLQQLWPRYDAMRIELAVGQ

SEQ ID NO: 888273 - protein, 22 aa, Mycobacterium
RLRAFLLDKVAKWWIPERWSFV

SEQ ID NO: 888274 - protein, 17 aa, Mycobacterium
RLRAISRNLLRRYRFYR

SEQ ID NO: 888275 - protein, 23 aa, Mycobacterium
RLRDLLKFDFYFADSAAFRANIA

SEQ ID NO: 888276 - protein, 17 aa, Mycobacterium
RLREEYVGPWLPEPLLV

SEQ ID NO: 888277 - protein, 18 aa, Mycobacterium
RLRELIIMRIGWVTDSVY

SEQ ID NO: 888278 - protein, 20 aa, Mycobacterium
RLRIGWFEGGIAWVPWALQD

SEQ ID NO: 888279 - protein, 19 aa, Mycobacterium
RLRILGYDDLLLRLSKALA

SEQ ID NO: 888280 - protein, 17 aa, Mycobacterium
RLRLMSQTLERLLPIPP

SEQ ID NO: 888281 - protein, 20 aa, Mycobacterium
RLRLVKYLAYGWSSLRSRPA

SEQ ID NO: 888282 - protein, 18 aa, Mycobacterium
RLRMHQRWPIVMVDEFQD

SEQ ID NO: 888283 - protein, 19 aa, Mycobacterium
RLRPAFAYWGFRAVAGTEP

SEQ ID NO: 888284 - protein, 20 aa, Mycobacterium
RLRPAFAYWGWRAVATDEPD

SEQ ID NO: 888285 - protein, 21 aa, Mycobacterium
RLRPAFAYWGWRAVATGEPDS

SEQ ID NO: 888286 - protein, 17 aa, Mycobacterium
RLRPPFPAVAGLYASPT

SEQ ID NO: 888287 - protein, 18 aa, Mycobacterium
RLRQTIPELPWLSRKRIQ

SEQ ID NO: 888288 - protein, 21 aa, Mycobacterium
RLRQVWPRYDAMRIELAVGQL

SEQ ID NO: 888289 - protein, 20 aa, Mycobacterium
RLRTLIGSYVILIVKYRKQV

SEQ ID NO: 888290 - protein, 20 aa, Mycobacterium
RLRTTIPELPWLARKRIQDD

SEQ ID NO: 888291 - protein, 21 aa, Mycobacterium
RLRVLERLEVVARRLPVAQYA

SEQ ID NO: 888292 - protein, 24 aa, Mycobacterium
RLSDAWVWDLFRPARFVKHVRVIT

SEQ ID NO: 888293 - protein, 23 aa, Mycobacterium
RLSPLMLAFRRAAVERGFSAADD

SEQ ID NO: 888294 - protein, 23 aa, Mycobacterium
RLSRPFFVWLTVGLYHPAVRERL

SEQ ID NO: 888295 - protein, 23 aa, Mycobacterium
RLSRPLFVMPTKGVWTSGFGYRW

SEQ ID NO: 888296 - protein, 18 aa, Mycobacterium
RLSWLVLRHLYAAALRAL

SEQ ID NO: 888297 - protein, 21 aa, Mycobacterium
RLTAGMWWVPVWLLRALEVIV

SEQ ID NO: 888298 - protein, 21 aa, Mycobacterium
RLTFLAVRRWYGWSAGRIINI

SEQ ID NO: 888299 - protein, 22 aa, Mycobacterium
RLTFLAVRRWYGWSAGRIINLD

SEQ ID NO: 888300 - protein, 22 aa, Mycobacterium
RLTFLAVRRWYGWSAGRIVNID

SEQ ID NO: 888301 - protein, 24 aa, Mycobacterium
RLTYPDIRLVYWAGGNPFHHHQNL

SEQ ID NO: 888302 - protein, 17 aa, Mycobacterium
RLVLTSRQYGIEPQQLF

SEQ ID NO: 888303 - protein, 18 aa, Mycobacterium
RLVNPVMGLLLRSPFAGA

SEQ ID NO: 888304 - protein, 19 aa, Mycobacterium
RLVPDFLWISTEHTARVSL

SEQ ID NO: 888305 - protein, 18 aa, Mycobacterium
RLVPEFLWISTEHTARVS

SEQ ID NO: 888306 - protein, 18 aa, Mycobacterium
RLVPQHLMRRLFFTAATV

SEQ ID NO: 888307 - protein, 23 aa, Mycobacterium
RLVPQHLMRRLFFTAATVDAATL

SEQ ID NO: 888308 - protein, 18 aa, Mycobacterium
RLVRLHQLHLLQTLSPHT

SEQ ID NO: 888309 - protein, 17 aa, Mycobacterium
RLVRQIPYTVACDILLT

SEQ ID NO: 888310 - protein, 18 aa, Mycobacterium
RLVRQIPYTVACDLLLTG

SEQ ID NO: 888311 - protein, 17 aa, Mycobacterium
RLVWLVDALPKGPTGKV

SEQ ID NO: 888312 - protein, 26 aa, Mycobacterium
RLWHAVPCFPTISELWLRLLEAYRDG

SEQ ID NO: 888313 - protein, 17 aa, Mycobacterium
RLYILPFIDGRTQLGKL

SEQ ID NO: 888314 - protein, 18 aa, Mycobacterium
RMEIALTYIYGIGRTRSK

SEQ ID NO: 888315 - protein, 18 aa, Mycobacterium
RMEIALTYIYGIGRTRSN

SEQ ID NO: 888316 - protein, 17 aa, Mycobacterium
RMEIALTYIYGVGRTRS

SEQ ID NO: 888317 - protein, 17 aa, Mycobacterium
RMFAGAGAAPMLDAAAA

SEQ ID NO: 888318 - protein, 17 aa, Mycobacterium
RMFIFIGAAPRTDWLDG

SEQ ID NO: 888319 - protein, 20 aa, Mycobacterium
RMGELFAPFTKIAAGNPFAA

SEQ ID NO: 888320 - protein, 21 aa, Mycobacterium
RMGLPVPDWQVLLAVPADLAA

SEQ ID NO: 888321 - protein, 18 aa, Mycobacterium
RMGQWWYYARSFEGKQYG

SEQ ID NO: 888322 - protein, 17 aa, Mycobacterium
RMLFDYFQQLFAQVTNP

SEQ ID NO: 888323 - protein, 17 aa, Mycobacterium
RMLIDALAARLRVAQRH

SEQ ID NO: 888324 - protein, 18 aa, Mycobacterium
RMLLVHFLRDQLGLTGTH

SEQ ID NO: 888325 - protein, 19 aa, Mycobacterium
RMLLVHFLRDQLGLTGTHW

SEQ ID NO: 888326 - protein, 20 aa, Mycobacterium
RMLLVHFLRDQLRLTGTHWG

SEQ ID NO: 888327 - protein, 17 aa, Mycobacterium
RMMLPPFQREAVAHQAQ

SEQ ID NO: 888328 - protein, 18 aa, Mycobacterium
RNAPLLWRFWPALSAGCD

SEQ ID NO: 888329 - protein, 19 aa, Mycobacterium
RNCRTWLGIALMMQGHLAE

SEQ ID NO: 888330 - protein, 17 aa, Mycobacterium
RNFYALDRLWRDCPIVP

SEQ ID NO: 888331 - protein, 18 aa, Mycobacterium
RNGLPVPLKPYFEADWRF

SEQ ID NO: 888332 - protein, 23 aa, Mycobacterium
RNHMRDMLFLFKGTPSTSPYCTW

SEQ ID NO: 888333 - protein, 17 aa, Mycobacterium
RNLLESFTLLSNVSRLF

SEQ ID NO: 888334 - protein, 18 aa, Mycobacterium
RNLLKPNQFPYTTKTGWT

SEQ ID NO: 888335 - protein, 21 aa, Mycobacterium
RNLPAIFRPAAAALGPVLFQS

SEQ ID NO: 888336 - protein, 22 aa, Mycobacterium
RNLTMFLVPLDSPGIEIQGIRT

SEQ ID NO: 888337 - protein, 18 aa, Mycobacterium
RNMAFYNFPLRLLKRTWD

SEQ ID NO: 888338 - protein, 25 aa, Mycobacterium
RNPEKVWAWYLWRHYMMARVAPNEA

SEQ ID NO: 888339 - protein, 28 aa, Mycobacterium
RNSQSWRFAPFFHALLDAGVYPPCSAFE

SEQ ID NO: 888340 - protein, 24 aa, Mycobacterium
RNVLRLLGPLLRPILRAVFVVQRR

SEQ ID NO: 888341 - protein, 17 aa, Mycobacterium
RNYRLLTRALVLGSAPP

SEQ ID NO: 888342 - protein, 21 aa, Mycobacterium
RPAFAYWGWRAITDDPDPWNP

SEQ ID NO: 888343 - protein, 18 aa, Mycobacterium
RPAIPPLLRGYLRLGAQA

SEQ ID NO: 888344 - protein, 20 aa, Mycobacterium
RPAISLPLYQTPKGLPLGVQ

SEQ ID NO: 888345 - protein, 17 aa, Mycobacterium
RPAIYRLWRSKAHLIHE

SEQ ID NO: 888346 - protein, 18 aa, Mycobacterium
RPASWWLRRWVHEVAVHR

SEQ ID NO: 888347 - protein, 21 aa, Mycobacterium
RPDGLPVWIYQFKISPHPTIP

SEQ ID NO: 888348 - protein, 26 aa, Mycobacterium
RPDGLPVWIYQFKVSPHRGIPQAPPG

SEQ ID NO: 888349 - protein, 18 aa, Mycobacterium
RPDLDWDKGKTLRWVIDH

SEQ ID NO: 888350 - protein, 25 aa, Mycobacterium
RPDRLPVWIYQFKISPHRTIPRATT

SEQ ID NO: 888351 - protein, 26 aa, Mycobacterium
RPEDVFLPVIPTPFGFGLWTSHTTPI

SEQ ID NO: 888352 - protein, 19 aa, Mycobacterium
RPELFLGVFERRAQRGPAG

SEQ ID NO: 888353 - protein, 21 aa, Mycobacterium
RPELRLLWKVIGLAATVEGAL

SEQ ID NO: 888354 - protein, 23 aa, Mycobacterium
RPEWFYIVRFNLSQLWHGYTGPG

SEQ ID NO: 888355 - protein, 19 aa, Mycobacterium
RPFDAVLDYLWGSPAEQTL

SEQ ID NO: 888356 - protein, 18 aa, Mycobacterium
RPFGPPGFLFLDPPDHTR

SEQ ID NO: 888357 - protein, 17 aa, Mycobacterium
RPFSVFYSLAVLSVGQE

SEQ ID NO: 888358 - protein, 20 aa, Mycobacterium
RPGAFHRLSPPWQPMRLIAE

SEQ ID NO: 888359 - protein, 22 aa, Mycobacterium
RPGAIHRLFPPWQPLRIEAEAA

SEQ ID NO: 888360 - protein, 25 aa, Mycobacterium
RPGVHWIREFLPTPKLREVLSAATV

SEQ ID NO: 888361 - protein, 17 aa, Mycobacterium
RPGYLRFDFNWQGALSD

SEQ ID NO: 888362 - protein, 17 aa, Mycobacterium
RPGYLRFDFNWQGPLSD

SEQ ID NO: 888363 - protein, 18 aa, Mycobacterium
RPHLILHTGDLFDAFRPG

SEQ ID NO: 888364 - protein, 17 aa, Mycobacterium
RPHPLFSAFIRAAMEYK

SEQ ID NO: 888365 - protein, 20 aa, Mycobacterium
RPIAPLLDGLRRLGVRLDGD

SEQ ID NO: 888366 - protein, 17 aa, Mycobacterium
RPIFAYRGWQAVTTEDP

SEQ ID NO: 888367 - protein, 20 aa, Mycobacterium
RPIPGPLKWDLTLGVATDTR

SEQ ID NO: 888368 - protein, 17 aa, Mycobacterium
RPIWFRRSGFQPAAVGA

SEQ ID NO: 888369 - protein, 20 aa, Mycobacterium
RPLLRPYLRGCLLESVRLWP

SEQ ID NO: 888370 - protein, 19 aa, Mycobacterium
RPLWVKPESLQPIGAFKMR

SEQ ID NO: 888371 - protein, 19 aa, Mycobacterium
RPMEFLGNLVLLIVGGNDT

SEQ ID NO: 888372 - protein, 21 aa, Mycobacterium
RPPFWQNLVELGWLGLHVDEE

SEQ ID NO: 888373 - protein, 21 aa, Mycobacterium
RPPFWQQLVELGWLGLHIGEE

SEQ ID NO: 888374 - protein, 19 aa, Mycobacterium
RPPRMLVLLHLDGSVERPS

SEQ ID NO: 888375 - protein, 21 aa, Mycobacterium
RPPYYIYCRAIDSGKFREVSA

SEQ ID NO: 888376 - protein, 22 aa, Mycobacterium
RPQALLLPLGPLAEHNIRATFA

SEQ ID NO: 888377 - protein, 24 aa, Mycobacterium
RPQAYLIYALLVCPTKDGRWLQFA

SEQ ID NO: 888378 - protein, 27 aa, Mycobacterium
RPQGRPPLVLWVLGPLLLCDVAERSAA

SEQ ID NO: 888379 - protein, 23 aa, Mycobacterium
RPQRPQLVLARIARAVPALLWPN

SEQ ID NO: 888380 - protein, 19 aa, Mycobacterium
RPRDVVALMRWAAPALRPA

SEQ ID NO: 888381 - protein, 17 aa, Mycobacterium
RPRFFGKPFFQLAQALL

SEQ ID NO: 888382 - protein, 18 aa, Mycobacterium
RPRKPLLPPPPQPPGREP

SEQ ID NO: 888383 - protein, 23 aa, Mycobacterium
RPRLAPLVYLRIDGKMFIVGSFA

SEQ ID NO: 888384 - protein, 19 aa, Mycobacterium
RPRLRYWLDRLSTDGILAH

SEQ ID NO: 888385 - protein, 19 aa, Mycobacterium
RPRPLYPIPLLLGGSGPRM

SEQ ID NO: 888386 - protein, 19 aa, Mycobacterium
RPRVLLLDEPLAALDALTR

SEQ ID NO: 888387 - protein, 20 aa, Mycobacterium
RPRVLLLPLGPLAEHNIRAT

SEQ ID NO: 888388 - protein, 18 aa, Mycobacterium
RPRWAKRLQPGPVADLLA

SEQ ID NO: 888389 - protein, 20 aa, Mycobacterium
RPRWFLQWAKTLHPPELRVP

SEQ ID NO: 888390 - protein, 17 aa, Mycobacterium
RPTAWIAEGLFGYLPSE

SEQ ID NO: 888391 - protein, 18 aa, Mycobacterium
RPTAWIAEGLLPYLPPDA

SEQ ID NO: 888392 - protein, 20 aa, Mycobacterium
RPTLYRWFASKEELLATFSR

SEQ ID NO: 888393 - protein, 26 aa, Mycobacterium
RPTPPWPTPKYRWPDSPPSTPISSAF

SEQ ID NO: 888394 - protein, 22 aa, Mycobacterium
RPVAPGLYSWLPLGLRVLRRIE

SEQ ID NO: 888395 - protein, 27 aa, Mycobacterium
RPVLFSTFLMWILANLFTKLPEIGDVD

SEQ ID NO: 888396 - protein, 26 aa, Mycobacterium
RPVMFSTFLMWVLADLFTTLPEVGDV

SEQ ID NO: 888397 - protein, 23 aa, Mycobacterium
RPVPLWQHVLVGKRLFDLFDYRH

SEQ ID NO: 888398 - protein, 23 aa, Mycobacterium
RPVPLWQHVLVGKRLFDLFDYRS

SEQ ID NO: 888399 - protein, 21 aa, Mycobacterium
RPVPVRIYRAAPTPAPVVVYC

SEQ ID NO: 888400 - protein, 24 aa, Mycobacterium
RPVRVDTWGGWLWINMDPDCEPLA

SEQ ID NO: 888401 - protein, 18 aa, Mycobacterium
RPVVGIIAPWNYPVANAL

SEQ ID NO: 888402 - protein, 25 aa, Mycobacterium
RPVVIGPITFLLLSKGVDGAGAPIE

SEQ ID NO: 888403 - protein, 22 aa, Mycobacterium
RPWARPLSHWSMGWLPLSARLA

SEQ ID NO: 888404 - protein, 19 aa, Mycobacterium
RPWILDTLPIVLSAAEWEV

SEQ ID NO: 888405 - protein, 17 aa, Mycobacterium
RPWWDAILIVEYPTPQA

SEQ ID NO: 888406 - protein, 19 aa, Mycobacterium
RPWWLDRLRLLTWVIVDPA

SEQ ID NO: 888407 - protein, 21 aa, Mycobacterium
RPYTAGPCRVAFDAPLVVTNP

SEQ ID NO: 888408 - protein, 20 aa, Mycobacterium
RQAAIALDWLRKHGYQDLAS

SEQ ID NO: 888409 - protein, 23 aa, Mycobacterium
RQAALNRLLFPGPAKELEDHREA

SEQ ID NO: 888410 - protein, 21 aa, Mycobacterium
RQAIWPHRMFSLLAGFVEAGE

SEQ ID NO: 888411 - protein, 20 aa, Mycobacterium
RQCVAIARAIFFGARVLILD

SEQ ID NO: 888412 - protein, 17 aa, Mycobacterium
RQFYESVFGWPVLLEVP

SEQ ID NO: 888413 - protein, 22 aa, Mycobacterium
RQGWPALNLFYNTAFDAAHQLI

SEQ ID NO: 888414 - protein, 19 aa, Mycobacterium
RQHLLRSILPLRESGLTAD

SEQ ID NO: 888415 - protein, 22 aa, Mycobacterium
RQKLLAIWIIGDTPNAFYSCVD

SEQ ID NO: 888416 - protein, 29 aa, Mycobacterium
RQKRLMTLIHLWLVHRFKADAVYYVTPTE

SEQ ID NO: 888417 - protein, 28 aa, Mycobacterium
RQKRLMTLIHLWLVHRFKADGVIYVTPT

SEQ ID NO: 888418 - protein, 18 aa, Mycobacterium
RQLLFWTWLAYGGRLLRG

SEQ ID NO: 888419 - protein, 18 aa, Mycobacterium
RQLPLRLVYVIPSQQTGS

SEQ ID NO: 888420 - protein, 17 aa, Mycobacterium
RQLQLLDKLIGAAMKDL

SEQ ID NO: 888421 - protein, 23 aa, Mycobacterium
RQLRYFWPRVVGDIGWQLLDSKF

SEQ ID NO: 888422 - protein, 23 aa, Mycobacterium
RQLRYFWPRVVGDIGWQLLDTKF

SEQ ID NO: 888423 - protein, 22 aa, Mycobacterium
RQLRYFWPRVVGDTGWQLLDSK

SEQ ID NO: 888424 - protein, 22 aa, Mycobacterium
RQLRYFWPRVVGDTGWQLLDTK

SEQ ID NO: 888425 - protein, 19 aa, Mycobacterium
RQLYDLDALPQHLIVVGSG

SEQ ID NO: 888426 - protein, 19 aa, Mycobacterium
RQLYDLEALPQHLIVVGSG

SEQ ID NO: 888427 - protein, 18 aa, Mycobacterium
RQLYNLEALPEHLIVVGS

SEQ ID NO: 888428 - protein, 24 aa, Mycobacterium
RQNRPLRWLPLEELAKPQALAQVT

SEQ ID NO: 888429 - protein, 26 aa, Mycobacterium
RQNSVLQMLLLLLRDPKNLQPAEPAR

SEQ ID NO: 888430 - protein, 18 aa, Mycobacterium
RQPGLLERSARWRPWRSY

SEQ ID NO: 888431 - protein, 32 aa, Mycobacterium; identical to SEQ ID NO: 136365

SEQ ID NO: 888432 - protein, 29 aa, Mycobacterium
RQPMAWAGPLFRFALFRTSPNQFFLFFCL

SEQ ID NO: 888433 - protein, 20 aa, Mycobacterium
RQPVPPFKWWRGLRARQLLE

SEQ ID NO: 888434 - protein, 19 aa, Mycobacterium
RQPWWAPIVDIPAGPAVLI

SEQ ID NO: 888435 - protein, 24 aa, Mycobacterium
RQRDDGRWIWRWDPAFITSNLEFL

SEQ ID NO: 888436 - protein, 22 aa, Mycobacterium
RQRGFIVLRWLDNPSPPDVTVS

SEQ ID NO: 888437 - protein, 21 aa, Mycobacterium
RQRLATLIRLFLLGTDEPRDR

SEQ ID NO: 888438 - protein, 20 aa, Mycobacterium
RQRRLTGIDEIVLSLTAKGL

SEQ ID NO: 888439 - protein, 22 aa, Mycobacterium
RQRVMIAMAIALNPALIIADEP

SEQ ID NO: 888440 - protein, 19 aa, Mycobacterium
RQTLWPERLFSILAGFVEA

SEQ ID NO: 888441 - protein, 20 aa, Mycobacterium
RQVDRWLAFLDAYKVRELPG

SEQ ID NO: 888442 - protein, 20 aa, Mycobacterium
RQVIDLVRRLAGQGLGVVLI

SEQ ID NO: 888443 - protein, 21 aa, Mycobacterium
RQVLLPFWNAYSFLALYAPKV

SEQ ID NO: 888444 - protein, 24 aa, Mycobacterium
RQVSAPLYYQFLTSTKRLTTADAD

SEQ ID NO: 888445 - protein, 18 aa, Mycobacterium
RQWLLFGPFAGWSPKFLK

SEQ ID NO: 888446 - protein, 17 aa, Mycobacterium
RQWWEWTPGADWRHPFG

SEQ ID NO: 888447 - protein, 17 aa, Mycobacterium
RQYFPKRTDLPRWSAEE

SEQ ID NO: 888448 - protein, 18 aa, Mycobacterium
RQYLFWTWAIYSGRLLHG

SEQ ID NO: 888449 - protein, 17 aa, Mycobacterium
RRAIDVLRFFGSAGWRP

SEQ ID NO: 888450 - protein, 25 aa, Mycobacterium
RRALSEPLRWIAFNAGFEGGDVVDV

SEQ ID NO: 888451 - protein, 17 aa, Mycobacterium
RRAYGESPYSYLMTRRI

SEQ ID NO: 888452 - protein, 23 aa, Mycobacterium
RRCRLVTERLWPTLLEPLRTRDQ

SEQ ID NO: 888453 - protein, 18 aa, Mycobacterium
RREFVAKLLARKTPPKGA

SEQ ID NO: 888454 - protein, 17 aa, Mycobacterium
RREIACVPLLHGGGHER

SEQ ID NO: 888455 - protein, 19 aa, Mycobacterium
RREIGVPTVFNLLGPLTNP

SEQ ID NO: 888456 - protein, 24 aa, Mycobacterium
RRENLPLLEPLRNLGLGALADQLN

SEQ ID NO: 888457 - protein, 18 aa, Mycobacterium
RREWDDLPFVICVFGNGD

SEQ ID NO: 888458 - protein, 18 aa, Mycobacterium
RRFGSRAGLMLVLLDEEE

SEQ ID NO: 888459 - protein, 22 aa, Mycobacterium
RRFLAAFAPFGLRPDALRPGYG

SEQ ID NO: 888460 - protein, 17 aa, Mycobacterium
RRFLTHEVWPAIRDTGS

SEQ ID NO: 888461 - protein, 20 aa, Mycobacterium
RRFRAWIRWNAAIMVHRAQR

SEQ ID NO: 888462 - protein, 19 aa, Mycobacterium
RRFRELWAVLPELADVTHS

SEQ ID NO: 888463 - protein, 21 aa, Mycobacterium
RRFTHTVLLRLPPRIDRSTVE

SEQ ID NO: 888464 - protein, 17 aa, Mycobacterium
RRFYESVFSWPVLIEVP

SEQ ID NO: 888465 - protein, 25 aa, Mycobacterium
RRGARRLVIAPWFLAPGFITDGVST

SEQ ID NO: 888466 - protein, 26 aa, Mycobacterium
RRGHRHGVLAGQLRGFLALPGQQRPQ

SEQ ID NO: 888467 - protein, 24 aa, Mycobacterium
RRGIPVLLRPVVLADLMAGYRTLM

SEQ ID NO: 888468 - protein, 23 aa, Mycobacterium
RRGKYLWLVLDGPGQPDTALVVH

SEQ ID NO: 888469 - protein, 22 aa, Mycobacterium
RRGMRRYWRGWGRRRRWGRHHG

SEQ ID NO: 888470 - protein, 18 aa, Mycobacterium
RRGQILFTYLHLAASLPC

SEQ ID NO: 888471 - protein, 18 aa, Mycobacterium
RRGSPFCGLLYAGLAITT

SEQ ID NO: 888472 - protein, 22 aa, Mycobacterium
RRHAILRNFPIIGHLRFLLEAV

SEQ ID NO: 888473 - protein, 25 aa, Mycobacterium
RRHIYLEEVFLFPPLRDAGIVMPIF

SEQ ID NO: 888474 - protein, 25 aa, Mycobacterium
RRHIYLEEVFLFPPLREAGIVMPIF

SEQ ID NO: 888475 - protein, 21 aa, Mycobacterium
RRHRAALRALWYRMSRYGNRA

SEQ ID NO: 888476 - protein, 20 aa, Mycobacterium
RRHVLLGARLPRPHSRPDGH

SEQ ID NO: 888477 - protein, 17 aa, Mycobacterium
RRHVVLNATWMETTGGP

SEQ ID NO: 888478 - protein, 21 aa, Mycobacterium
RRIAGHLGGFRRTPATLREGA

SEQ ID NO: 888479 - protein, 21 aa, Mycobacterium
RRIDPLWRRTSYSGLIRAAEQ

SEQ ID NO: 888480 - protein, 18 aa, Mycobacterium
RRIMARLNWRKLGPGPTQ

SEQ ID NO: 888481 - protein, 17 aa, Mycobacterium
RRIPLSPAMFHAIGWVS

SEQ ID NO: 888482 - protein, 21 aa, Mycobacterium
RRIPVWFMRQAGRSLPEYRAL

SEQ ID NO: 888483 - protein, 18 aa, Mycobacterium
RRIVRWPRQVLAEFGLIL

SEQ ID NO: 888484 - protein, 18 aa, Mycobacterium
RRKDLLPLISFLTRSHAE

SEQ ID NO: 888485 - protein, 19 aa, Mycobacterium
RRKYRLLQRLGKSSPDARL

SEQ ID NO: 888486 - protein, 20 aa, Mycobacterium
RRLAPRWWPTAMKKFVWPWL

SEQ ID NO: 888487 - protein, 17 aa, Mycobacterium
RRLELRSILLDTGAGPG

SEQ ID NO: 888488 - protein, 19 aa, Mycobacterium
RRLIGLFEMLRDRSQLIII

SEQ ID NO: 888489 - protein, 22 aa, Mycobacterium
RRLIVRGFFAEIIQKIAVPAVR

SEQ ID NO: 888490 - protein, 18 aa, Mycobacterium
RRLKRLPGFGDQKARIFL

SEQ ID NO: 888491 - protein, 17 aa, Mycobacterium
RRLLIEAAWHHRASYRN

SEQ ID NO: 888492 - protein, 19 aa, Mycobacterium
RRLLRLCARYSAHPTVIFA

SEQ ID NO: 888493 - protein, 18 aa, Mycobacterium
RRLLWPIKQKYGNKISWA

SEQ ID NO: 888494 - protein, 24 aa, Mycobacterium
RRLQTDYIDLYWLHIWDANTPIEE

SEQ ID NO: 888495 - protein, 18 aa, Mycobacterium
RRLWTVLIFMLWHAIFVE

SEQ ID NO: 888496 - protein, 17 aa, Mycobacterium
RRLYRDLIALRRTDPDL

SEQ ID NO: 888497 - protein, 22 aa, Mycobacterium
RRMAWYWARIWIEVTPVRVLWW

SEQ ID NO: 888498 - protein, 21 aa, Mycobacterium
RRMRLTHYMALMLGAARAEFD

SEQ ID NO: 888499 - protein, 22 aa, Mycobacterium
RRPVGVVGLITAWNAPVHIAMR

SEQ ID NO: 888500 - protein, 24 aa, Mycobacterium
RRQLQYFWPRLVGDTGWELLDSKF

SEQ ID NO: 888501 - protein, 24 aa, Mycobacterium
RRQVLRLWQTALIRLFRLQISDEI

SEQ ID NO: 888502 - protein, 20 aa, Mycobacterium
RRRCGWFDAVVARYATRVNG

SEQ ID NO: 888503 - protein, 18 aa, Mycobacterium
RRRFAYRWHPFAIDPEVD

SEQ ID NO: 888504 - protein, 20 aa, Mycobacterium
RRRIVMFEQFRAEWLWHKDL

SEQ ID NO: 888505 - protein, 21 aa, Mycobacterium
RRRIYWLSLPLDYGLSGTTAA

SEQ ID NO: 888506 - protein, 19 aa, Mycobacterium
RRRLHLLEPLRYQLVDIPW

SEQ ID NO: 888507 - protein, 20 aa, Mycobacterium
RRRLQLMLVLLSEPNVLVLD

SEQ ID NO: 888508 - protein, 17 aa, Mycobacterium
RRRPIWFRRSGFQPAAV

SEQ ID NO: 888509 - protein, 17 aa, Mycobacterium
RRRRGHIPFTKPAKKAL

SEQ ID NO: 888510 - protein, 26 aa, Mycobacterium
RRRRPQLLFQPRLRLQRLRAGGEQQP

SEQ ID NO: 888511 - protein, 22 aa, Mycobacterium
RRRVALCKLLLSKPDLLLLDEP

SEQ ID NO: 888512 - protein, 20 aa, Mycobacterium
RRRWGIREVPLHVLVDGVDL

SEQ ID NO: 888513 - protein, 19 aa, Mycobacterium
RRSIPLPVSYLLAAIGTVK

SEQ ID NO: 888514 - protein, 18 aa, Mycobacterium
RRTFTATYLILAAGTWGT

SEQ ID NO: 888515 - protein, 21 aa, Mycobacterium
RRTLEIPIRRTDLAFWEIRSG

SEQ ID NO: 888516 - protein, 25 aa, Mycobacterium
RRVFGDRFMYILYFQEPGPADAELA

SEQ ID NO: 888517 - protein, 25 aa, Mycobacterium
RRVGFIFQFFNLLPTLSAWENVAIP

SEQ ID NO: 888518 - protein, 20 aa, Mycobacterium
RRVLEMLPIPPIALQLRTGV

SEQ ID NO: 888519 - protein, 19 aa, Mycobacterium
RRVLPVLQSLAWFGLDRVD

SEQ ID NO: 888520 - protein, 22 aa, Mycobacterium
RRVPIWLPYIRGERTPFHDPDR

SEQ ID NO: 888521 - protein, 21 aa, Mycobacterium
RRVPVWLPYIRGERTPFHDPD

SEQ ID NO: 888522 - protein, 23 aa, Mycobacterium
RRVRLMRWGLVPPWAKAGPDGGL

SEQ ID NO: 888523 - protein, 18 aa, Mycobacterium
RRVWRALLTIPYGETRSY

SEQ ID NO: 888524 - protein, 21 aa, Mycobacterium
RRWAGVPFYLRTGKRLGRRVT

SEQ ID NO: 888525 - protein, 17 aa, Mycobacterium
RRYILDCALRWMRDFHA

SEQ ID NO: 888526 - protein, 27 aa, Mycobacterium
RRYLTRAELLWRWPPFSATADCASVKP

SEQ ID NO: 888527 - protein, 18 aa, Mycobacterium
RRYPFPPFTSLDGPYRTV

SEQ ID NO: 888528 - protein, 20 aa, Mycobacterium
RSAGNLLLLRGFLTAGRENG

SEQ ID NO: 888529 - protein, 20 aa, Mycobacterium
RSAGNPLLLRGFLTAGRESG

SEQ ID NO: 888530 - protein, 22 aa, Mycobacterium
RSALVYYYFDTLDDLYIAVLRN

SEQ ID NO: 888531 - protein, 23 aa, Mycobacterium
RSDGRWIWRWDPAFISSNFDVLQ

SEQ ID NO: 888532 - protein, 17 aa, Mycobacterium
RSFECYLPIIQVSGATT

SEQ ID NO: 888533 - protein, 17 aa, Mycobacterium
RSFLLRLGGIRALGFSP

SEQ ID NO: 888534 - protein, 17 aa, Mycobacterium
RSFLLRLGGIRAVGYSP

SEQ ID NO: 888535 - protein, 18 aa, Mycobacterium
RSFSDFPTILRSISERLG

SEQ ID NO: 888536 - protein, 17 aa, Mycobacterium
RSFYLQFDGKHELLLAL

SEQ ID NO: 888537 - protein, 17 aa, Mycobacterium
RSGALWILNSEALGRVG

SEQ ID NO: 888538 - protein, 17 aa, Mycobacterium
RSGFGTAILLRHHFRRG

SEQ ID NO: 888539 - protein, 17 aa, Mycobacterium
RSGLARKLSFTGSTKVG

SEQ ID NO: 888540 - protein, 17 aa, Mycobacterium
RSGLVYVPLFGGFGPEP

SEQ ID NO: 888541 - protein, 18 aa, Mycobacterium
RSGWLNGIKHWQVDYSGA

SEQ ID NO: 888542 - protein, 18 aa, Mycobacterium
RSHLAPFLPGHPFAPELP

SEQ ID NO: 888543 - protein, 25 aa, Mycobacterium
RSIMDLAVPFTYFLGSLAPAYDRLN

SEQ ID NO: 888544 - protein, 18 aa, Mycobacterium
RSLLFVPGDRPERFEKAL

SEQ ID NO: 888545 - protein, 17 aa, Mycobacterium
RSLLRPGGQLRYLEHVA

SEQ ID NO: 888546 - protein, 17 aa, Mycobacterium
RSLRQLVVPLRQLNVVT

SEQ ID NO: 888547 - protein, 20 aa, Mycobacterium
RSLVFPVKRLADLGFKILAT

SEQ ID NO: 888548 - protein, 18 aa, Mycobacterium
RSLVFPVKRLADLGFTVL

SEQ ID NO: 888549 - protein, 27 aa, Mycobacterium
RSMMALMVEAPFLLIRAALPHMYRNEF

SEQ ID NO: 888550 - protein, 17 aa, Mycobacterium
RSNFFGFNAPAIMAAES

SEQ ID NO: 888551 - protein, 21 aa, Mycobacterium
RSQVERYFAWHYLAEIWARQC

SEQ ID NO: 888552 - protein, 25 aa, Mycobacterium
RSRERGYAYFLYPPNKPLTETAYDR

SEQ ID NO: 888553 - protein, 21 aa, Mycobacterium
RSRLLALFKSPRPGTAPLRGC

SEQ ID NO: 888554 - protein, 19 aa, Mycobacterium
RSRLMLDIAQWRRRRRDEL

SEQ ID NO: 888555 - protein, 20 aa, Mycobacterium
RSRLMLDIASWRRRRREELA

SEQ ID NO: 888556 - protein, 17 aa, Mycobacterium
RSRMLFDYFQQLFAQVT

SEQ ID NO: 888557 - protein, 30 aa, Mycobacterium
RSRPLITNMIRLLRLPIPVQRRVAAGVLSA

SEQ ID NO: 888558 - protein, 22 aa, Mycobacterium
RSRPWVTYVVWNAGLRGFDNHL

SEQ ID NO: 888559 - protein, 18 aa, Mycobacterium
RSRRFAYPPNLFVVDGGA

SEQ ID NO: 888560 - protein, 20 aa, Mycobacterium
RSRTHHYPFRLLAPRTMRPL

SEQ ID NO: 888561 - protein, 23 aa, Mycobacterium
RSTAEWLALLRQLEIPAAPLNTP

SEQ ID NO: 888562 - protein, 24 aa, Mycobacterium
RSTGLFLWQNIFGVWPADGAVTDE

SEQ ID NO: 888563 - protein, 17 aa, Mycobacterium
RSTYKMVFGHRGINIPV

SEQ ID NO: 888564 - protein, 19 aa, Mycobacterium
RSVKPLPKSGWRKAVHRLS

SEQ ID NO: 888565 - protein, 23 aa, Mycobacterium
RSVPARRLPGYLLSFRRGSRSNI

SEQ ID NO: 888566 - protein, 29 aa, Mycobacterium
RSVSWLPLYHDMGLLMILFPLCGGRITLM

SEQ ID NO: 888567 - protein, 23 aa, Mycobacterium
RSVWTLLRRRNGVLPAIEQALHT

SEQ ID NO: 888568 - protein, 20 aa, Mycobacterium
RSWQLKLDLRRDGDRIKMSK

SEQ ID NO: 888569 - protein, 17 aa, Mycobacterium
RSWRLVNVLSLTGASLV

SEQ ID NO: 888570 - protein, 21 aa, Mycobacterium
RSWYIAYFQLPWLPERSAAWL

SEQ ID NO: 888571 - protein, 21 aa, Mycobacterium
RTALWGIHLVFRGGLRRAGVP

SEQ ID NO: 888572 - protein, 17 aa, Mycobacterium
RTATLRLLLAAIQTEEV

SEQ ID NO: 888573 - protein, 25 aa, Mycobacterium
RTAWEWLVHLYEKWAAGLDFAVPSF

SEQ ID NO: 888574 - protein, 25 aa, Mycobacterium
RTEIDNWRWAGVPVFLRAGKALPER

SEQ ID NO: 888575 - protein, 25 aa, Mycobacterium
RTEKSLLFVIPWGSHWIVGTTDTDW

SEQ ID NO: 888576 - protein, 25 aa, Mycobacterium
RTEKSVLFVIPWGNHWIIGTTDTEW

SEQ ID NO: 888577 - protein, 18 aa, Mycobacterium
RTEPWLGPASLSMAAAAQ

SEQ ID NO: 888578 - protein, 23 aa, Mycobacterium
RTERFHVSVLFWLSATVSIHEHG

SEQ ID NO: 888579 - protein, 20 aa, Mycobacterium
RTFEWMFTKYRLGGGGLSVY

SEQ ID NO: 888580 - protein, 17 aa, Mycobacterium
RTFFLATRLLAPDQRPA

SEQ ID NO: 888581 - protein, 27 aa, Mycobacterium
RTFMDSHPFVWLPILSRVLGTAELVPH

SEQ ID NO: 888582 - protein, 24 aa, Mycobacterium
RTGLSIAKVIKLLRPLRSATITIN

SEQ ID NO: 888583 - protein, 20 aa, Mycobacterium
RTHFFDEYFLAAAAAGIRQV

SEQ ID NO: 888584 - protein, 30 aa, Mycobacterium
RTIDINYLGPIWLLLGLLPAMREAGRGHIV

SEQ ID NO: 888585 - protein, 29 aa, Mycobacterium
RTIDINYLGPIWLLLGLLPAMRESGRGHV

SEQ ID NO: 888586 - protein, 25 aa, Mycobacterium
RTIGGTDFVWLPRGLTRDSERFGTR

SEQ ID NO: 888587 - protein, 19 aa, Mycobacterium
RTITFLDIPAAPGFGNTTA

SEQ ID NO: 888588 - protein, 19 aa, Mycobacterium
RTIWRYFRCKESCVEPVLA

SEQ ID NO: 888589 - protein, 19 aa, Mycobacterium
RTLAGFLNLQGVRPADMPL

SEQ ID NO: 888590 - protein, 22 aa, Mycobacterium
RTLGPFTWLKKPAVDGPPAQRD

SEQ ID NO: 888591 - protein, 20 aa, Mycobacterium
RTLIDLATYFRDALVLSFGA

SEQ ID NO: 888592 - protein, 21 aa, Mycobacterium
RTLREQIPGLPLLLLTAKDSV

SEQ ID NO: 888593 - protein, 21 aa, Mycobacterium
RTMALGLLLPGFTSPVYSAIV

SEQ ID NO: 888594 - protein, 18 aa, Mycobacterium
RTPAFWRFARRHWRTGIT

SEQ ID NO: 888595 - protein, 20 aa, Mycobacterium
RTPDLIPLCHQLALTGVDVD

SEQ ID NO: 888596 - protein, 21 aa, Mycobacterium
RTQLEVILPYFLHYADTEQRQ

SEQ ID NO: 888597 - protein, 20 aa, Mycobacterium
RTQVPLLLDEYTRNASTGSF

SEQ ID NO: 888598 - protein, 17 aa, Mycobacterium
RTREPVWIVGELTDWVG

SEQ ID NO: 888599 - protein, 18 aa, Mycobacterium
RTRFLLIGVPGPPPPRTG

SEQ ID NO: 888600 - protein, 24 aa, Mycobacterium
RTRIRPHFFPFTEPSAEVDVWFAN

SEQ ID NO: 888601 - protein, 24 aa, Mycobacterium
RTRIRPHFFPFTEPSAEVDVWFAS

SEQ ID NO: 888602 - protein, 21 aa, Mycobacterium
RTRLIELFELFDPADPEVIAG

SEQ ID NO: 888603 - protein, 21 aa, Mycobacterium
RTSDLIPLCHQLALTGVDVDF

SEQ ID NO: 888604 - protein, 22 aa, Mycobacterium
RTSDLVPLCHPLAITGVDIDFT

SEQ ID NO: 888605 - protein, 18 aa, Mycobacterium
RTTLLDWLRETLGLTGAK

SEQ ID NO: 888606 - protein, 19 aa, Mycobacterium
RTVWIPRPLGALAFVMRWV

SEQ ID NO: 888607 - protein, 18 aa, Mycobacterium
RTWDLLLPALVEPASLDY

SEQ ID NO: 888608 - protein, 20 aa, Mycobacterium
RTWMIDTLLALLQTPSPSGR

SEQ ID NO: 888609 - protein, 41 aa, Mycobacterium
RTYNALLEAVLWFLARKLPGFIKWLLRRIAIKNLPAGYDVD

SEQ ID NO: 888610 - protein, 18 aa, Mycobacterium
RTYWLSRSIPDDQFLLYA

SEQ ID NO: 888611 - protein, 19 aa, Mycobacterium
RVAILLPAHWQTAAVLFGV

SEQ ID NO: 888612 - protein, 19 aa, Mycobacterium
RVALCKLLLSKPDLLLLDE

SEQ ID NO: 888613 - protein, 19 aa, Mycobacterium
RVAVLARDWFIDHLSPAAL

SEQ ID NO: 888614 - protein, 25 aa, Mycobacterium
RVEYKLRDWLFARQRYWGEPFPVVY

SEQ ID NO: 888615 - protein, 18 aa, Mycobacterium
RVFALRPHFEWRGLGFIS

SEQ ID NO: 888616 - protein, 18 aa, Mycobacterium
RVFHYPGGLVDFVKHINR

SEQ ID NO: 888617 - protein, 19 aa, Mycobacterium
RVFISMKQPLYIAISPDNM

SEQ ID NO: 888618 - protein, 18 aa, Mycobacterium
RVFLELGPHPVLLGNIRE

SEQ ID NO: 888619 - protein, 18 aa, Mycobacterium
RVFLTYFTRKSAFKRFGF

SEQ ID NO: 888620 - protein, 19 aa, Mycobacterium
RVFRPLDVDLRWVAALLLR

SEQ ID NO: 888621 - protein, 21 aa, Mycobacterium
RVFRRYVGVPVKWVLCRYRLQ

SEQ ID NO: 888622 - protein, 22 aa, Mycobacterium
RVGDLIALVRPLVGDTPLGAHF

SEQ ID NO: 888623 - protein, 20 aa, Mycobacterium
RVGLLPTWGLSVRLPQKVGV

SEQ ID NO: 888624 - protein, 25 aa, Mycobacterium
RVGNRLRPWLPLLLGLTANSAIYRN

SEQ ID NO: 888625 - protein, 23 aa, Mycobacterium
RVGWQWRLVWYRAVSELLTGDYD

SEQ ID NO: 888626 - protein, 17 aa, Mycobacterium
RVIFVDYLSLLPPEGQP

SEQ ID NO: 888627 - protein, 18 aa, Mycobacterium
RVIGVLTLLWPTPRQFDA

SEQ ID NO: 888628 - protein, 18 aa, Mycobacterium
RVIPRLWRDWGPQGYDTG

SEQ ID NO: 888629 - protein, 23 aa, Mycobacterium
RVKCALLGWMAFKDALAQACSDR

SEQ ID NO: 888630 - protein, 17 aa, Mycobacterium
RVKQLLLKIGWPAEDLA

SEQ ID NO: 888631 - protein, 19 aa, Mycobacterium
RVLAALHGWLAPLPPEGAS

SEQ ID NO: 888632 - protein, 17 aa, Mycobacterium
RVLALALQLLDRGYFRA

SEQ ID NO: 888633 - protein, 27 aa, Mycobacterium
RVLAVLPFFHIYGLVVLLNVQLKLGAE

SEQ ID NO: 888634 - protein, 17 aa, Mycobacterium
RVLDFPTGFHYDFRTPE

SEQ ID NO: 888635 - protein, 19 aa, Mycobacterium
RVLFSGDLLTRGIVKVVWS

SEQ ID NO: 888636 - protein, 18 aa, Mycobacterium
RVLFVDYLTLLPPAGVGA

SEQ ID NO: 888637 - protein, 17 aa, Mycobacterium
RVLFVDYLTLLPPAGVP

SEQ ID NO: 888638 - protein, 23 aa, Mycobacterium
RVLGPSYRLFYERPVHLVRGQGS

SEQ ID NO: 888639 - protein, 17 aa, Mycobacterium
RVLLCQGDIADPAVPEL

SEQ ID NO: 888640 - protein, 20 aa, Mycobacterium
RVLLEHLGVPRWRLMGVFGD

SEQ ID NO: 888641 - protein, 17 aa, Mycobacterium
RVLLLDEPFAALDAGLR

SEQ ID NO: 888642 - protein, 17 aa, Mycobacterium
RVLQRAGELLRRGGECL

SEQ ID NO: 888643 - protein, 17 aa, Mycobacterium
RVLTGPRWRLGARDLTA

SEQ ID NO: 888644 - protein, 17 aa, Mycobacterium
RVPAIWISDRRPKLGWC

SEQ ID NO: 888645 - protein, 19 aa, Mycobacterium
RVPALVRWPGVIPAGVASG

SEQ ID NO: 888646 - protein, 34 aa, Mycobacterium
RVPGRLVWFAMTIWQFLHFKFGLPKPLLEPLAVE

SEQ ID NO: 888647 - protein, 17 aa, Mycobacterium
RVPLIGGTITHPVQGED

SEQ ID NO: 888648 - protein, 18 aa, Mycobacterium
RVPLILRLDPQVGPEDIR

SEQ ID NO: 888649 - protein, 18 aa, Mycobacterium
RVPRMLGVFSIGRAINPR

SEQ ID NO: 888650 - protein, 18 aa, Mycobacterium
RVPVFLLPANPVSALVVF

SEQ ID NO: 888651 - protein, 20 aa, Mycobacterium
RVPVWFMRQAGRSLPEYREL

SEQ ID NO: 888652 - protein, 23 aa, Mycobacterium
RVRFDLTVDLLVPLPGFVVRRGA

SEQ ID NO: 888653 - protein, 22 aa, Mycobacterium
RVRLHPYFTVRILNQVPGLRKL

SEQ ID NO: 888654 - protein, 17 aa, Mycobacterium
RVRLHPYLTVRILNQVP

SEQ ID NO: 888655 - protein, 20 aa, Mycobacterium
RVRLMRWGLVPPWAKAGADG

SEQ ID NO: 888656 - protein, 18 aa, Mycobacterium
RVRLPLLKLTVAVPDPKR

SEQ ID NO: 888657 - protein, 25 aa, Mycobacterium
RVRNAGAIFLGPWSPVSLGDYCAGS

SEQ ID NO: 888658 - protein, 24 aa, Mycobacterium
RVSARVYPALVPLSHPLATVNGAF

SEQ ID NO: 888659 - protein, 24 aa, Mycobacterium
RVSARVYPALVPLTHPLATVNGAF

SEQ ID NO: 888660 - protein, 18 aa, Mycobacterium
RVSIFLWGAWNGVLSLNL

SEQ ID NO: 888661 - protein, 18 aa, Mycobacterium
RVSTLPRPLRPLRNAGIR

SEQ ID NO: 888662 - protein, 20 aa, Mycobacterium
RVTNPSPYMYLLHAPDSEGG

SEQ ID NO: 888663 - protein, 17 aa, Mycobacterium
RVTYVRWAGLPSHPHHD

SEQ ID NO: 888664 - protein, 18 aa, Mycobacterium
RVVLLRRLLGCRGTARVR

SEQ ID NO: 888665 - protein, 18 aa, Mycobacterium
RVVNPMLGFLLRTPLAGP

SEQ ID NO: 888666 - protein, 27 aa, Mycobacterium
RVVPLDINLPWFMRGPGAVTGTFALES

SEQ ID NO: 888667 - protein, 17 aa, Mycobacterium
RVWKALLTIPYGETRSY

SEQ ID NO: 888668 - protein, 21 aa, Mycobacterium
RVWTFLGPRPAGWWIRRRANE

SEQ ID NO: 888669 - protein, 24 aa, Mycobacterium
RVWVPAAAPLPAVWVPGADLRAAD

SEQ ID NO: 888670 - protein, 25 aa, Mycobacterium
RVYCPGWVALFRWIKPVLSTPVGEL

SEQ ID NO: 888671 - protein, 18 aa, Mycobacterium
RWAIREVPLHILLDGVDL

SEQ ID NO: 888672 - protein, 24 aa, Mycobacterium
RWALKFGFPLMPVDGILVGTAAMA

SEQ ID NO: 888673 - protein, 20 aa, Mycobacterium
RWDMPYLGMQVLIEGLALAA

SEQ ID NO: 888674 - protein, 17 aa, Mycobacterium
RWERFITAVRLLAEQLG

SEQ ID NO: 888675 - protein, 17 aa, Mycobacterium
RWFDFYSCFPSAVEAAI

SEQ ID NO: 888676 - protein, 18 aa, Mycobacterium
RWFEIDPCYVFHPLNGYS

SEQ ID NO: 888677 - protein, 18 aa, Mycobacterium
RWHHLALVMWYPDQGSEV

SEQ ID NO: 888678 - protein, 18 aa, Mycobacterium
RWISMSWRRCGVFPPSSA

SEQ ID NO: 888679 - protein, 23 aa, Mycobacterium
RWKESAFQLAWLLDILGAQGETP

SEQ ID NO: 888680 - protein, 22 aa, Mycobacterium
RWKETAFQYAWLLAAAGCDDSG

SEQ ID NO: 888681 - protein, 22 aa, Mycobacterium
RWKETAFQYAWLLAAAGCDTEA

SEQ ID NO: 888682 - protein, 20 aa, Mycobacterium
RWKFLIVWQLAVQGAQRYGQ

SEQ ID NO: 888683 - protein, 18 aa, Mycobacterium
RWLVLYLRRPGGQTQFAA

SEQ ID NO: 888684 - protein, 20 aa, Mycobacterium
RWMVVFLQRPGGQAQFSVWA

SEQ ID NO: 888685 - protein, 20 aa, Mycobacterium
RWMVVFLQRPGGQAQFSVWS

SEQ ID NO: 888686 - protein, 25 aa, Mycobacterium
RWPEMMWLEFLFDRLGGPEVFEAAY

SEQ ID NO: 888687 - protein, 19 aa, Mycobacterium
RWQLHWRLGWSFACLTHRC

SEQ ID NO: 888688 - protein, 24 aa, Mycobacterium
RWQLSWRLPWIFTCQVHSCLLVDV

SEQ ID NO: 888689 - protein, 20 aa, Mycobacterium
RWQRLLFDNGWLLPSQPPEY

SEQ ID NO: 888690 - protein, 17 aa, Mycobacterium
RWRAHGFDLDFTELVFL

SEQ ID NO: 888691 - protein, 17 aa, Mycobacterium
RWRQPVIGMPTTPRFLG

SEQ ID NO: 888692 - protein, 17 aa, Mycobacterium
RWRVDRTSLHLYTDPGM

SEQ ID NO: 888693 - protein, 25 aa, Mycobacterium
RWSAWLVGPWWPAPPGSPAAGVSYW

SEQ ID NO: 888694 - protein, 24 aa, Mycobacterium
RWTQDSFFPWIWRRLRGLSSADGR

SEQ ID NO: 888695 - protein, 17 aa, Mycobacterium
RWVPLPFGRQAIDEFGT

SEQ ID NO: 888696 - protein, 18 aa, Mycobacterium
RWYWHWDPQFISGTAAFP

SEQ ID NO: 888697 - protein, 21 aa, Mycobacterium
RYAGWWEIIAIYEPNSLEFID

SEQ ID NO: 888698 - protein, 17 aa, Mycobacterium
RYDFLIPNRGVGVLLPE

SEQ ID NO: 888699 - protein, 17 aa, Mycobacterium
RYGLPTNSWILFGSPTH

SEQ ID NO: 888700 - protein, 23 aa, Mycobacterium
RYGVPASALLYRAGQRKLIGGQE

SEQ ID NO: 888701 - protein, 21 aa, Mycobacterium
RYHPRWAWWLTGVPVLREFLV

SEQ ID NO: 888702 - protein, 22 aa, Mycobacterium
RYKWRKWLYFDCNWKVALEAFN

SEQ ID NO: 888703 - protein, 21 aa, Mycobacterium
RYLDVPLYWQHWKFESSTLSA

SEQ ID NO: 888704 - protein, 18 aa, Mycobacterium
RYLRQLPLPYGQGRIQQV

SEQ ID NO: 888705 - protein, 18 aa, Mycobacterium
RYMGWFDGNPARLWQHPP

SEQ ID NO: 888706 - protein, 20 aa, Mycobacterium
RYNEVIHYWALDGGWECFAN

SEQ ID NO: 888707 - protein, 18 aa, Mycobacterium
RYNEVIHYWALEGGWECF

SEQ ID NO: 888708 - protein, 17 aa, Mycobacterium
RYNLPVLAPPIPRTVRF

SEQ ID NO: 888709 - protein, 24 aa, Mycobacterium
RYNPDYLPGTLLPPGIRATADAAE

SEQ ID NO: 888710 - protein, 24 aa, Mycobacterium
RYPAGMDWVLAFWGVVMAGGIAVA

SEQ ID NO: 888711 - protein, 17 aa, Mycobacterium
RYPMWLAAKMSTLANSR

SEQ ID NO: 888712 - protein, 17 aa, Mycobacterium
RYPRALLDSIRYARSLG

SEQ ID NO: 888713 - protein, 17 aa, Mycobacterium
RYPYLPSHPQYDLAKRQ

SEQ ID NO: 888714 - protein, 17 aa, Mycobacterium
RYQFLRWGQGAFRDFKV

SEQ ID NO: 888715 - protein, 17 aa, Mycobacterium
RYQLPVLAPPIPRTVRF

SEQ ID NO: 888716 - protein, 17 aa, Mycobacterium
RYRAWIRWNAAIMVHRA

SEQ ID NO: 888717 - protein, 23 aa, Mycobacterium
RYRGRDFCWWLGVLGKWDMAAPP

SEQ ID NO: 888718 - protein, 24 aa, Mycobacterium
RYTFPYLLSALPDLDRLLLFGTHP

SEQ ID NO: 888719 - protein, 22 aa, Mycobacterium
RYTWPRFVCALPREFFAAVRAE

SEQ ID NO: 888720 - protein, 21 aa, Mycobacterium
RYTWPRFVCGLPREFFAAVRA

SEQ ID NO: 888721 - protein, 21 aa, Mycobacterium
RYTWPRFVCGLPREFFAAVRT

SEQ ID NO: 888722 - protein, 24 aa, Mycobacterium
RYVDRFLMYYIRTADRLQRTAPWV

SEQ ID NO: 888723 - protein, 24 aa, Mycobacterium
RYVDRFVMYYIRTADRLQRTAPWV

SEQ ID NO: 888724 - protein, 20 aa, Mycobacterium
RYYMLPMLDMWTDVFANPGK

SEQ ID NO: 888725 - protein, 20 aa, Mycobacterium
SAAALAQVWGATAGPTAVLS

SEQ ID NO: 888726 - protein, 24 aa, Mycobacterium
SAALARTTGLLAAAEDEVSTAIAS

SEQ ID NO: 888727 - protein, 22 aa, Mycobacterium
SAAQPYLVWLTTASVQAEQAAS

SEQ ID NO: 888728 - protein, 24 aa, Mycobacterium
SAAQVILRWHLQLGNVVIPKSVTP

SEQ ID NO: 888729 - protein, 23 aa, Mycobacterium
SAEFLTELFGLPSPKPFGHFMVV

SEQ ID NO: 888730 - protein, 20 aa, Mycobacterium
SAELLQLLFLEAGFPQGAYV

SEQ ID NO: 888731 - protein, 22 aa, Mycobacterium
SAELPLFRYIGGPNAHIMPVPM

SEQ ID NO: 888732 - protein, 21 aa, Mycobacterium
SAESYLVFEKLLDAAAKSGAN

SEQ ID NO: 888733 - protein, 22 aa, Mycobacterium
SAFNQLLASFPWPLNKTTTVDK

SEQ ID NO: 888734 - protein, 19 aa, Mycobacterium
SAFVLLALQAPVAGDLRAI

SEQ ID NO: 888735 - protein, 24 aa, Mycobacterium
SAGARIFFVDYLTMLPPAGTPAPP

SEQ ID NO: 888736 - protein, 25 aa, Mycobacterium
SAGAYLDWLFRYLVSALRTLPRVMV

SEQ ID NO: 888737 - protein, 20 aa, Mycobacterium
SAGLPYRYFGTRSGLLIALV

SEQ ID NO: 888738 - protein, 23 aa, Mycobacterium
SAGPPPWYLYRFVARGAVGVATA

SEQ ID NO: 888739 - protein, 17 aa, Mycobacterium
SAHAAILPLYYLRRADI

SEQ ID NO: 888740 - protein, 26 aa, Mycobacterium
SAIAQQLAPWQQALALPAADADFSLS

SEQ ID NO: 888741 - protein, 21 aa, Mycobacterium
SAIAVVARRAGSGPGVTACPA

SEQ ID NO: 888742 - protein, 21 aa, Mycobacterium
SAKPYLALGLSFRDGGLAPET

SEQ ID NO: 888743 - protein, 20 aa, Mycobacterium
SALDRWWKLRLEWAKGQDPL

SEQ ID NO: 888744 - protein, 21 aa, Mycobacterium
SALGALRLIQAFTPALEKSHG

SEQ ID NO: 888745 - protein, 21 aa, Mycobacterium
SALSAPLYWIATNAGLDGSVV

SEQ ID NO: 888746 - protein, 24 aa, Mycobacterium
SALSSPLYWIATNAGLDGAVVVNK

SEQ ID NO: 888747 - protein, 17 aa, Mycobacterium
SALVSFEVFLRPALRAA

SEQ ID NO: 888748 - protein, 17 aa, Mycobacterium
SALVVFEVMVRPLIRLS

SEQ ID NO: 888749 - protein, 20 aa, Mycobacterium
SAMTAIEWLFWRSTMKVDNA

SEQ ID NO: 888750 - protein, 31 aa, Mycobacterium
SAPAGWGWIAPYIGMIWPTGNLSKLRTAASE

SEQ ID NO: 888751 - protein, 24 aa, Mycobacterium
SAPDKPFLLYLAPGATHSPHHVWP

SEQ ID NO: 888752 - protein, 20 aa, Mycobacterium
SAPIRLLWRLVYATPVRNFD

SEQ ID NO: 888753 - protein, 29 aa, Mycobacterium
SAPQHGLPIMLWAYDPLTFGGKGRAAIAI

SEQ ID NO: 888754 - protein, 23 aa, Mycobacterium
SAPTIFPRHISVPTIPALARARR

SEQ ID NO: 888755 - protein, 22 aa, Mycobacterium
SARVYPALVPLEHPLASVNGAF

SEQ ID NO: 888756 - protein, 23 aa, Mycobacterium
SASILPITWMYIRMMGADGLRAA

SEQ ID NO: 888757 - protein, 24 aa, Mycobacterium
SASMVTIMTALWFEQLRSGDRVSV

SEQ ID NO: 888758 - protein, 17 aa, Mycobacterium
SAVILPQGSFQTLLQAP

SEQ ID NO: 888759 - protein, 20 aa, Mycobacterium
SAVNAPSLALTGRPLIGNGA

SEQ ID NO: 888760 - protein, 18 aa, Mycobacterium
SAWLLGTGGTGGAGGWAA

SEQ ID NO: 888761 - protein, 17 aa, Mycobacterium
SAWLYRPAGGGPAPLLV

SEQ ID NO: 888762 - protein, 20 aa, Mycobacterium
SAYLGHVIVLWSWALKQPAV

SEQ ID NO: 888763 - protein, 24 aa, Mycobacterium
SCAADLPWKALLRSNIHAISVDVS

SEQ ID NO: 888764 - protein, 18 aa, Mycobacterium
SCFLLPRILPDGSRNRMF

SEQ ID NO: 888765 - protein, 17 aa, Mycobacterium
SCLWQVYGVDRPALKDP

SEQ ID NO: 888766 - protein, 22 aa, Mycobacterium
SCTYMKMITPAALLRCLVEGRD

SEQ ID NO: 888767 - protein, 24 aa, Mycobacterium
SDADLTYWRRALTPLPDPLELPGA

SEQ ID NO: 888768 - protein, 23 aa, Mycobacterium
SDADVIRYLRWFTFLSAEELAEL

SEQ ID NO: 888769 - protein, 28 aa, Mycobacterium
SDARSRPVMLWPYDPLAFNGKGRAAIAI

SEQ ID NO: 888770 - protein, 20 aa, Mycobacterium
SDDRIFLISPLASVTGVLQA

SEQ ID NO: 888771 - protein, 23 aa, Mycobacterium
SDFLGPINWMRPLRAIAARHEVL

SEQ ID NO: 888772 - protein, 22 aa, Mycobacterium
SDFYVLFVEYWLRAQRDNQLRE

SEQ ID NO: 888773 - protein, 24 aa, Mycobacterium
SDLELYLFFSLLFSAGAETTRNAV

SEQ ID NO: 888774 - protein, 20 aa, Mycobacterium
SDLLLDWLTAHYGRGYVAAR

SEQ ID NO: 888775 - protein, 21 aa, Mycobacterium
SDLVGILLYLASDESKFMTGQ

SEQ ID NO: 888776 - protein, 18 aa, Mycobacterium
SDRGWLLTSTPLPELRAA

SEQ ID NO: 888777 - protein, 23 aa, Mycobacterium
SDRILTYALYIDPPLGRAGMTVA

SEQ ID NO: 888778 - protein, 22 aa, Mycobacterium
SDRLINLLIYIKGYLDGTLTFR

SEQ ID NO: 888779 - protein, 17 aa, Mycobacterium
SDRLLNLLIYIKGYLDG

SEQ ID NO: 888780 - protein, 17 aa, Mycobacterium
SDRLLNLLIYIKSYLDG

SEQ ID NO: 888781 - protein, 24 aa, Mycobacterium
SDRPLPVMFFIHGGAYFLGSSATP

SEQ ID NO: 888782 - protein, 24 aa, Mycobacterium
SDRQRHRLALWARRLLGEAVTQAQ

SEQ ID NO: 888783 - protein, 24 aa, Mycobacterium
SDRQRHRLALWSRRLLGEAITQAQ

SEQ ID NO: 888784 - protein, 25 aa, Mycobacterium
SDSALPPFLTPGLTGPGLVDPRINA

SEQ ID NO: 888785 - protein, 25 aa, Mycobacterium
SDSMPALHLLPLAAALDVLPVLATD

SEQ ID NO: 888786 - protein, 24 aa, Mycobacterium
SDTSLFVRPFLKYQIITVVAPNSP

SEQ ID NO: 888787 - protein, 23 aa, Mycobacterium
SDVAAWPATLGRLLAVGGPDAIY

SEQ ID NO: 888788 - protein, 18 aa, Mycobacterium
SDVFWPAVVFTLVTLLDD

SEQ ID NO: 888789 - protein, 22 aa, Mycobacterium
SDYPYLVPLIDREMLRPTYVFA

SEQ ID NO: 888790 - protein, 22 aa, Mycobacterium
SEAIALLRLPLVLPAVQVAGRV

SEQ ID NO: 888791 - protein, 25 aa, Mycobacterium
SEALAAPLYWIATNAGLDGAVAVHK

SEQ ID NO: 888792 - protein, 25 aa, Mycobacterium
SEALAAPLYWIATNAGLDGAVAVSK

SEQ ID NO: 888793 - protein, 24 aa, Mycobacterium
SEALALLRLPLVLPSLQIAGKVAG

SEQ ID NO: 888794 - protein, 18 aa, Mycobacterium
SEALLLRVDRRNQVLISD

SEQ ID NO: 888795 - protein, 26 aa, Mycobacterium
SEEAIYSFLRLLLPAGLETTYRSSGN

SEQ ID NO: 888796 - protein, 24 aa, Mycobacterium
SEEVAPWLDLVRKLGVLAAALSDG

SEQ ID NO: 888797 - protein, 17 aa, Mycobacterium
SEEVPVVVLLWSPRSDA

SEQ ID NO: 888798 - protein, 19 aa, Mycobacterium
SEGLLYERRLFHSAFATDD

SEQ ID NO: 888799 - protein, 18 aa, Mycobacterium
SEGLLYERRLFHSTFATE

SEQ ID NO: 888800 - protein, 20 aa, Mycobacterium
SEGLPYRWPHPWLVDTKTAA

SEQ ID NO: 888801 - protein, 25 aa, Mycobacterium
SEGQLNITLLFGFSPRFPFPDSYQE

SEQ ID NO: 888802 - protein, 24 aa, Mycobacterium
SEGTLLFGRFAFSVRYTWFRNWVN

SEQ ID NO: 888803 - protein, 23 aa, Mycobacterium
SEGYRWLDLALTALPPLPSPERI

SEQ ID NO: 888804 - protein, 21 aa, Mycobacterium
SEIELLPITKFFPATDVAILA

SEQ ID NO: 888805 - protein, 17 aa, Mycobacterium
SELALTYLLIGHDLAVI

SEQ ID NO: 888806 - protein, 27 aa, Mycobacterium
SELPVGDYWFWNLRNIVRFDKAIAAAV

SEQ ID NO: 888807 - protein, 21 aa, Mycobacterium
SELYIPYSWYEPMWMENIGLA

SEQ ID NO: 888808 - protein, 23 aa, Mycobacterium
SENGWRTFFRGLANDGVQGPSVA

SEQ ID NO: 888809 - protein, 24 aa, Mycobacterium
SENNYPYTYWWLKGYNDAVAEVAV

SEQ ID NO: 888810 - protein, 23 aa, Mycobacterium
SEPEALWRFLWKGHCAIGEVPAE

SEQ ID NO: 888811 - protein, 23 aa, Mycobacterium
SEPLIDAIPLWKRPQDGAIITGW

SEQ ID NO: 888812 - protein, 22 aa, Mycobacterium
SEPLIDAIPLWKRPQDGAVITG

SEQ ID NO: 888813 - protein, 18 aa, Mycobacterium
SEPLWYSGPSWLAPVALK

SEQ ID NO: 888814 - protein, 18 aa, Mycobacterium
SERWYLEQLYAAVGIQGS

SEQ ID NO: 888815 - protein, 17 aa, Mycobacterium
SEWLWVLDPIDGTSNFV

SEQ ID NO: 888816 - protein, 22 aa, Mycobacterium
SFASLVFYSSWFKLHHPAAFCA

SEQ ID NO: 888817 - protein, 17 aa, Mycobacterium
SFELHTMSQILLLHAVL

SEQ ID NO: 888818 - protein, 19 aa, Mycobacterium
SFEVFIRPALRLAMGLPDP

SEQ ID NO: 888819 - protein, 18 aa, Mycobacterium
SFEVFIRPALRSAMGLPD

SEQ ID NO: 888820 - protein, 19 aa, Mycobacterium
SFEVFIRPALRTAMGLPDP

SEQ ID NO: 888821 - protein, 23 aa, Mycobacterium
SFGAPMDVWWFRLPRRPDDPTGL

SEQ ID NO: 888822 - protein, 19 aa, Mycobacterium
SFHVFVVYPWIRFLDRNPE

SEQ ID NO: 888823 - protein, 19 aa, Mycobacterium
SFKLFMAYPGVYYSTDGQI

SEQ ID NO: 888824 - protein, 18 aa, Mycobacterium
SFLPPPYFQAETIADFMV

SEQ ID NO: 888825 - protein, 18 aa, Mycobacterium
SFPALLRKQLKGAPMPAP

SEQ ID NO: 888826 - protein, 20 aa, Mycobacterium
SFPVQYFYHLYRSDELQIFL

SEQ ID NO: 888827 - protein, 18 aa, Mycobacterium
SFQIILVDTPGLHRPRTL

SEQ ID NO: 888828 - protein, 26 aa, Mycobacterium
SFQLFPNFVILFWGQGWYLTYHYWPT

SEQ ID NO: 888829 - protein, 21 aa, Mycobacterium
SFRLNPAPWLGVYWLFGGFLR

SEQ ID NO: 888830 - protein, 17 aa, Mycobacterium
SFRWASARGYRLAARLV

SEQ ID NO: 888831 - protein, 22 aa, Mycobacterium
SFRYHGWGPRMWTWVQMMGLRK

SEQ ID NO: 888832 - protein, 27 aa, Mycobacterium
SFSKYFAMTGWRLGWLLVPEKLRRAVD

SEQ ID NO: 888833 - protein, 17 aa, Mycobacterium
SGALLTLAPPVAAAWNP

SEQ ID NO: 888834 - protein, 24 aa, Mycobacterium
SGCQAEVIRIPWADGSLVALPGQP

SEQ ID NO: 888835 - protein, 20 aa, Mycobacterium
SGDFPVLWPVLTRWADNDMF

SEQ ID NO: 888836 - protein, 29 aa, Mycobacterium
SGDNGFVYVAPLFTISFTSGVFSSGAFTS

SEQ ID NO: 888837 - protein, 18 aa, Mycobacterium
SGEGFVRRLWWRTVVDLP

SEQ ID NO: 888838 - protein, 22 aa, Mycobacterium
SGFDTLIDLWLPLSWALNQVNR

SEQ ID NO: 888839 - protein, 17 aa, Mycobacterium
SGFWHWAVANLPADVTE

SEQ ID NO: 888840 - protein, 23 aa, Mycobacterium
SGGRRIWQLADHDTLLVGWRVTP

SEQ ID NO: 888841 - protein, 24 aa, Mycobacterium
SGHNGGAGGLLWGNGGDGGAGAAG

SEQ ID NO: 888842 - protein, 24 aa, Mycobacterium
SGIEVINQWYYNPAYLAIMQNCAY

SEQ ID NO: 888843 - protein, 17 aa, Mycobacterium
SGITPLMGGLYGLALPT

SEQ ID NO: 888844 - protein, 22 aa, Mycobacterium
SGKFTDFFESNLGKRMVKAARS

SEQ ID NO: 888845 - protein, 23 aa, Mycobacterium
SGKTLAAFLWALDSLARCPDRTA

SEQ ID NO: 888846 - protein, 23 aa, Mycobacterium
SGKTLAAFLWALDSLARSADRPA

SEQ ID NO: 888847 - protein, 18 aa, Mycobacterium
SGLDTRAYRLGWPGGMTV

SEQ ID NO: 888848 - protein, 21 aa, Mycobacterium
SGLFNSFFWIDRTAGIGGVIA

SEQ ID NO: 888849 - protein, 17 aa, Mycobacterium
SGLPLFPYMKIHVTPLA

SEQ ID NO: 888850 - protein, 23 aa, Mycobacterium
SGMRWWAQWTPFTYPFNMTQQPA

SEQ ID NO: 888851 - protein, 25 aa, Mycobacterium
SGNVEYFLWLRAQTDRWLAGDELVD

SEQ ID NO: 888852 - protein, 18 aa, Mycobacterium
SGQPWSWDIGFMLGTGLQ

SEQ ID NO: 888853 - protein, 17 aa, Mycobacterium
SGRDEIWRFTPLRRLRG

SEQ ID NO: 888854 - protein, 25 aa, Mycobacterium
SGSGPAYFFLLVEALVDAGVAVGLS

SEQ ID NO: 888855 - protein, 23 aa, Mycobacterium
SGSGPAYFFLMAEAMVDAGVAVG

SEQ ID NO: 888856 - protein, 25 aa, Mycobacterium
SGSGPAYFFLMVEALIDAGVAAGLS

SEQ ID NO: 888857 - protein, 24 aa, Mycobacterium
SGSGPAYFFLMVEALVDAGVAAGL

SEQ ID NO: 888858 - protein, 24 aa, Mycobacterium
SGSGPAYFFLMVEALVDAGVDAGL

SEQ ID NO: 888859 - protein, 20 aa, Mycobacterium
SGTFLWVDPVADLALLVLTD

SEQ ID NO: 888860 - protein, 24 aa, Mycobacterium
SGTKNIVFVLTLDKPATSPVSVAY

SEQ ID NO: 888861 - protein, 21 aa, Mycobacterium
SGVIFLRRKLDDPLYKFVLRQ

SEQ ID NO: 888862 - protein, 25 aa, Mycobacterium
SGVWELFWPGFPLEGLYKFRVHGAD

SEQ ID NO: 888863 - protein, 25 aa, Mycobacterium
SGVWELFWPGFPPDGLYKFRVHGAD

SEQ ID NO: 888864 - protein, 25 aa, Mycobacterium
SGYATFRSVLWARWPSAGPPPFFDS

SEQ ID NO: 888865 - protein, 18 aa, Mycobacterium
SGYDIPYPAPRLERWYLP

SEQ ID NO: 888866 - protein, 24 aa, Mycobacterium
SHELRTPLMLILEPARRLLESTEP

SEQ ID NO: 888867 - protein, 17 aa, Mycobacterium
SHKLLIRAGYIRPVAPG

SEQ ID NO: 888868 - protein, 17 aa, Mycobacterium
SHKLLIRAGYIRPVGPG

SEQ ID NO: 888869 - protein, 23 aa, Mycobacterium
SHNALYLELYDSLLGLMDHYMRG

SEQ ID NO: 888870 - protein, 25 aa, Mycobacterium
SHNEIYLQFYDLLLPTIHRAVEAGP

SEQ ID NO: 888871 - protein, 27 aa, Mycobacterium
SHRLAALDVPVPFWMRAPGECPGTYAA

SEQ ID NO: 888872 - protein, 17 aa, Mycobacterium
SHWLTIPALKAFGAIPV

SEQ ID NO: 888873 - protein, 17 aa, Mycobacterium
SHWLTLPALKAFGAIPV

SEQ ID NO: 888874 - protein, 18 aa, Mycobacterium
SHYLWTWTDEPAGALRAR

SEQ ID NO: 888875 - protein, 24 aa, Mycobacterium
SIAATLWWALELTGSDARIPAAGL

SEQ ID NO: 888876 - protein, 24 aa, Mycobacterium
SIAQPLTNLSLQCKLPISPSQAMG

SEQ ID NO: 888877 - protein, 20 aa, Mycobacterium
SIARLICEMYFGLGILESPE

SEQ ID NO: 888878 - protein, 20 aa, Mycobacterium
SIATWVGFLGFFVNRFEPLT

SEQ ID NO: 888879 - protein, 19 aa, Mycobacterium
SIDLLVDLWLDKQRFVVSG

SEQ ID NO: 888880 - protein, 24 aa, Mycobacterium
SIEALYPHFLATDPIAQTATRALQ

SEQ ID NO: 888881 - protein, 24 aa, Mycobacterium
SIEPWVFMNWRRAAYYLFTAEVID

SEQ ID NO: 888882 - protein, 24 aa, Mycobacterium
SIEPWVFMNWRRASYYLYLNEVID

SEQ ID NO: 888883 - protein, 22 aa, Mycobacterium
SIGPILQIPGIRGALRSTSAPV

SEQ ID NO: 888884 - protein, 20 aa, Mycobacterium
SIGWLRAFLQNHNGGLVVIS

SEQ ID NO: 888885 - protein, 19 aa, Mycobacterium
SIGWLRSFLQNHDGGLVVI

SEQ ID NO: 888886 - protein, 23 aa, Mycobacterium
SIHREWLLIELRTDWFYGANSYP

SEQ ID NO: 888887 - protein, 19 aa, Mycobacterium
SIIMFLNLARQFFPLLSIP

SEQ ID NO: 888888 - protein, 23 aa, Mycobacterium
SIKFYETLGFSLKFRDGAHFAAL

SEQ ID NO: 888889 - protein, 18 aa, Mycobacterium
SILLAALRRPAVLAKQLA

SEQ ID NO: 888890 - protein, 22 aa, Mycobacterium
SILPITWAYIRMMGPDGLRAAS

SEQ ID NO: 888891 - protein, 18 aa, Mycobacterium
SINPLGNAGAHGANGTGG

SEQ ID NO: 888892 - protein, 25 aa, Mycobacterium
SIPDNPWRGSFAQLYLAAVQAGIAA

SEQ ID NO: 888893 - protein, 17 aa, Mycobacterium
SIPRYFYALFAIDLTNK

SEQ ID NO: 888894 - protein, 22 aa, Mycobacterium
SIPSVFIPELLALHARGRFPIE

SEQ ID NO: 888895 - protein, 23 aa, Mycobacterium
SIPTSPYALTTWLNALWSNPLTT

SEQ ID NO: 888896 - protein, 17 aa, Mycobacterium
SIRAGYAGLLHQALTSL

SEQ ID NO: 888897 - protein, 17 aa, Mycobacterium
SISLLRHGRLWGLIACH

SEQ ID NO: 888898 - protein, 22 aa, Mycobacterium
SIVYELLWFLRGDSNVRWLQER

SEQ ID NO: 888899 - protein, 18 aa, Mycobacterium
SIYGVWRGVLEYFDAHVV

SEQ ID NO: 888900 - protein, 17 aa, Mycobacterium
SIYRPLLEPLGLTHPQY

SEQ ID NO: 888901 - protein, 25 aa, Mycobacterium
SKAPKRWWWVALTDEPFPRLSAVRD

SEQ ID NO: 888902 - protein, 24 aa, Mycobacterium
SKGLQFPVVYLPFAFNRNVQPRDV

SEQ ID NO: 888903 - protein, 28 aa, Mycobacterium
SKGLQFPVVYLPFAFNRYVPEPDLVLFH

SEQ ID NO: 888904 - protein, 24 aa, Mycobacterium
SKGLQFPVVYLPFSFNRYVPEREY

SEQ ID NO: 888905 - protein, 22 aa, Mycobacterium
SKGLQYPIVYLPFAFNRNTQDS

SEQ ID NO: 888906 - protein, 23 aa, Mycobacterium
SKGLQYPVVYLPFAFNRNIQERE

SEQ ID NO: 888907 - protein, 21 aa, Mycobacterium
SKPMLYLYYGSKEELFGACLD

SEQ ID NO: 888908 - protein, 21 aa, Mycobacterium
SKPMLYLYYGSKEELFGACLH

SEQ ID NO: 888909 - protein, 26 aa, Mycobacterium
SKSLAPGLRLGWLALPAALVDGVVET

SEQ ID NO: 888910 - protein, 19 aa, Mycobacterium
SKTPFFMYGVDGEPLFMAG

SEQ ID NO: 888911 - protein, 27 aa, Mycobacterium
SKYYAMTGWRLGWLLVPAELRRAVDRL

SEQ ID NO: 888912 - protein, 24 aa, Mycobacterium
SLADPLAFLLRKEGFEATVVTDGQ

SEQ ID NO: 888913 - protein, 24 aa, Mycobacterium
SLADPLAFLLRKEGFEATVVTDGS

SEQ ID NO: 888914 - protein, 23 aa, Mycobacterium
SLADPLAFLLRKEGFETTVVTDG

SEQ ID NO: 888915 - protein, 23 aa, Mycobacterium
SLDPRFPVFDLLAEPLLANDFGK

SEQ ID NO: 888916 - protein, 23 aa, Mycobacterium
SLDSLPFYDPWFAKARTSGAIEA

SEQ ID NO: 888917 - protein, 23 aa, Mycobacterium
SLDSPPFYDPWFAKARAAGAIEA

SEQ ID NO: 888918 - protein, 23 aa, Mycobacterium
SLDSPPFYDPWFAKARTGGAIEA

SEQ ID NO: 888919 - protein, 18 aa, Mycobacterium
SLDSPPFYDPWFAKARTS

SEQ ID NO: 888920 - protein, 23 aa, Mycobacterium
SLDSPPFYDPWFAKARTSGAIEA

SEQ ID NO: 888921 - protein, 20 aa, Mycobacterium
SLDSPPFYDPWFAKARTTGA

SEQ ID NO: 888922 - protein, 19 aa, Mycobacterium
SLELPWRRPIASLNYLLSS

SEQ ID NO: 888923 - protein, 18 aa, Mycobacterium
SLENGLLTGIRKLARPKL

SEQ ID NO: 888924 - protein, 18 aa, Mycobacterium
SLEPGISFIIRPSEPTQA

SEQ ID NO: 888925 - protein, 26 aa, Mycobacterium
SLERILRALGLIGWKWTPNGDGIVLS

SEQ ID NO: 888926 - protein, 24 aa, Mycobacterium
SLETTICLIYVPFVGCVLHVSVTV

SEQ ID NO: 888927 - protein, 17 aa, Mycobacterium
SLEWIPDWLWKLNLKIL

SEQ ID NO: 888928 - protein, 20 aa, Mycobacterium
SLEYILAFLGSMQAGLIAVP

SEQ ID NO: 888929 - protein, 25 aa, Mycobacterium
SLFHDQFVQALNGGGFLYAATEAAS

SEQ ID NO: 888930 - protein, 18 aa, Mycobacterium
SLFRWMKSPLMPITPEAI

SEQ ID NO: 888931 - protein, 19 aa, Mycobacterium
SLFTIAGVPYLLGIQSYLL

SEQ ID NO: 888932 - protein, 19 aa, Mycobacterium
SLGCDWIPRYYAAGQSPLC

SEQ ID NO: 888933 - protein, 29 aa, Mycobacterium
SLGLPSHGLPWYPLLRLPVNLARSAAALT

SEQ ID NO: 888934 - protein, 17 aa, Mycobacterium
SLGPMMIMLPRTRLGDA

SEQ ID NO: 888935 - protein, 24 aa, Mycobacterium
SLGTRGRMLSLFRDHLGRIDRPRW

SEQ ID NO: 888936 - protein, 24 aa, Mycobacterium
SLHTVGMLFSPGYPGFLRGVTASG

SEQ ID NO: 888937 - protein, 22 aa, Mycobacterium
SLISMFLDFYRPLVEAGMVYVT

SEQ ID NO: 888938 - protein, 18 aa, Mycobacterium
SLLDAISLGFLPFNRRNF

SEQ ID NO: 888939 - protein, 20 aa, Mycobacterium
SLLGFHWTKIHDASLGEVYV

SEQ ID NO: 888940 - protein, 28 aa, Mycobacterium
SLLNAINAPSLALLGRPLIGNGADGAPG

SEQ ID NO: 888941 - protein, 21 aa, Mycobacterium
SLLRVEIYRAFRTELVPDDSD

SEQ ID NO: 888942 - protein, 23 aa, Mycobacterium
SLLVRSLVAWFWDEPLRAPLIRH

SEQ ID NO: 888943 - protein, 24 aa, Mycobacterium
SLLVRSLVAWFWDEPLRAPLIRHG

SEQ ID NO: 888944 - protein, 26 aa, Mycobacterium
SLMDTHPFMWLPMLSRVLGSAQLLPE

SEQ ID NO: 888945 - protein, 25 aa, Mycobacterium
SLNHPYLDTVLFILGITRGEIEAAD

SEQ ID NO: 888946 - protein, 26 aa, Mycobacterium
SLNLPRPAVWLLEQWLTHSAVLRSRV

SEQ ID NO: 888947 - protein, 19 aa, Mycobacterium
SLNVLLWQRALEPERDKWS

SEQ ID NO: 888948 - protein, 18 aa, Mycobacterium
SLNWFPLDHVGGLVMFHI

SEQ ID NO: 888949 - protein, 25 aa, Mycobacterium
SLPDDFILYWGFLATAQVLTGRYSF

SEQ ID NO: 888950 - protein, 22 aa, Mycobacterium
SLPDGALMRRAAYGLAAEIIGE

SEQ ID NO: 888951 - protein, 22 aa, Mycobacterium
SLPGSIFPLPALPPWLATDIDN

SEQ ID NO: 888952 - protein, 19 aa, Mycobacterium
SLPQWFAGTWHRAAVLRYG

SEQ ID NO: 888953 - protein, 19 aa, Mycobacterium
SLQIRRWPIKPFAQRAYQL

SEQ ID NO: 888954 - protein, 20 aa, Mycobacterium
SLQLWVMIETPRAFLRAEEV

SEQ ID NO: 888955 - protein, 20 aa, Mycobacterium
SLQNFYIAYRAVVRAKVDCV

SEQ ID NO: 888956 - protein, 21 aa, Mycobacterium
SLRAFYIAYRAVVRAKVDCVR

SEQ ID NO: 888957 - protein, 18 aa, Mycobacterium
SLRLLLRRIFESAGGTHD

SEQ ID NO: 888958 - protein, 28 aa, Mycobacterium
SLRPVIFSTFLMWLLADLFAVLPEVGDV

SEQ ID NO: 888959 - protein, 24 aa, Mycobacterium
SLRSLPLVMLIGRPEARIPVVSFA

SEQ ID NO: 888960 - protein, 17 aa, Mycobacterium
SLRTQVPLLLDEYTRNA

SEQ ID NO: 888961 - protein, 19 aa, Mycobacterium
SLRTQVPLLLDEYTRNPST

SEQ ID NO: 888962 - protein, 19 aa, Mycobacterium
SLRTWLYRIATNRCLNARR

SEQ ID NO: 888963 - protein, 20 aa, Mycobacterium
SLSDYLGWSAAIPASECAFS

SEQ ID NO: 888964 - protein, 25 aa, Mycobacterium
SLSHPYLDTVLFLLGITRGEIEAAD

SEQ ID NO: 888965 - protein, 26 aa, Mycobacterium
SLTGPRNLLLMVWLRSLDALPQLEGT

SEQ ID NO: 888966 - protein, 18 aa, Mycobacterium
SLTLLPRLTSRAAGRYFV

SEQ ID NO: 888967 - protein, 22 aa, Mycobacterium
SLTLYLQLYLGGFGLELSDIES

SEQ ID NO: 888968 - protein, 18 aa, Mycobacterium
SLTMFLVPLGTPGVEIQG

SEQ ID NO: 888969 - protein, 20 aa, Mycobacterium
SLTQILAWDLPLTKKLSDQV

SEQ ID NO: 888970 - protein, 27 aa, Mycobacterium
SLTRSLSFFTVFPWVKEPLTNWLRGDY

SEQ ID NO: 888971 - protein, 25 aa, Mycobacterium
SLVERKWRWYYLPIARPRGHDAWSE

SEQ ID NO: 888972 - protein, 24 aa, Mycobacterium
SLVERLVPDFLWISTEHTAQVSLD

SEQ ID NO: 888973 - protein, 22 aa, Mycobacterium
SLVQMVLSNWFGLNAPAIAQLE

SEQ ID NO: 888974 - protein, 17 aa, Mycobacterium
SLWLTFSYKGECIESNL

SEQ ID NO: 888975 - protein, 19 aa, Mycobacterium
SLYIAVLVKQLELLCERFG

SEQ ID NO: 888976 - protein, 18 aa, Mycobacterium
SMAKLWWQAFMATDVRAV

SEQ ID NO: 888977 - protein, 24 aa, Mycobacterium
SMASAFWPYVTWTSMVATQAGEAA

SEQ ID NO: 888978 - protein, 24 aa, Mycobacterium
SMDRPGLLALLTRALERAGADIVW

SEQ ID NO: 888979 - protein, 22 aa, Mycobacterium
SMEAAVFPYLAWMNITGMQAEQ

SEQ ID NO: 888980 - protein, 24 aa, Mycobacterium
SMFESLLATLPYPMLMAARLKSLG

SEQ ID NO: 888981 - protein, 20 aa, Mycobacterium
SMGAMKLILLMGLRADVDRF

SEQ ID NO: 888982 - protein, 23 aa, Mycobacterium
SMISAIAPFISWLSAVAAQAEEA

SEQ ID NO: 888983 - protein, 19 aa, Mycobacterium
SMIVAFPRSPMLTAYAAWD

SEQ ID NO: 888984 - protein, 19 aa, Mycobacterium
SMKTVEWLFWRSTKRVENE

SEQ ID NO: 888985 - protein, 17 aa, Mycobacterium
SMLALMDILSEVGVPAG

SEQ ID NO: 888986 - protein, 18 aa, Mycobacterium
SMLRPELGLAAMQQLLIA

SEQ ID NO: 888987 - protein, 23 aa, Mycobacterium
SMLSAVMPYVNWLGVLAAQAEET

SEQ ID NO: 888988 - protein, 17 aa, Mycobacterium
SMLTLLQKNLQGTIFGG

SEQ ID NO: 888989 - protein, 18 aa, Mycobacterium
SMMMSPMMQLLNSANSAG

SEQ ID NO: 888990 - protein, 23 aa, Mycobacterium
SMPQWHTYFPPIGGFRFSMFTIP

SEQ ID NO: 888991 - protein, 19 aa, Mycobacterium
SMQIAALFGAHGQSFQAVS

SEQ ID NO: 888992 - protein, 18 aa, Mycobacterium
SMRTLVWRRWPTTGLAAP

SEQ ID NO: 888993 - protein, 21 aa, Mycobacterium
SMSISLLRQGRLWGLIACHHY

SEQ ID NO: 888994 - protein, 26 aa, Mycobacterium
SMTRLWARMWLLRFTWQRAIDSGDLT

SEQ ID NO: 888995 - protein, 17 aa, Mycobacterium
SMWMAWGPELTFFCNSA

SEQ ID NO: 888996 - protein, 22 aa, Mycobacterium
SMWSQWLTLPAAAGPIVLAFNA

SEQ ID NO: 888997 - protein, 18 aa, Mycobacterium
SMYPLGPIFHGSGLNITV

SEQ ID NO: 888998 - protein, 26 aa, Mycobacterium
SNFSRRRSLRRLPRLTRLAVRCTSDG

SEQ ID NO: 888999 - protein, 21 aa, Mycobacterium
SNTYIRLVSPFRLTTTALKDI

SEQ ID NO: 889000 - protein, 20 aa, Mycobacterium
SNVVVPYFWSDQYDVKIQCL

SEQ ID NO: 889001 - protein, 18 aa, Mycobacterium
SPALLLKCMLMAATEGIA

SEQ ID NO: 889002 - protein, 27 aa, Mycobacterium
SPASLFTIPGVPYLLGIQSYLTPQAGA

SEQ ID NO: 889003 - protein, 20 aa, Mycobacterium
SPAWGFCMWAIAPDQMYSVE

SEQ ID NO: 889004 - protein, 21 aa, Mycobacterium
SPAYLPFFPELARTGLHVIGC

SEQ ID NO: 889005 - protein, 18 aa, Mycobacterium
SPELVRRLIIKALPRLQP

SEQ ID NO: 889006 - protein, 23 aa, Mycobacterium
SPFGWTFPYAWPHTPILAANAVC

SEQ ID NO: 889007 - protein, 27 aa, Mycobacterium
SPFNFPAMVPMWFFPVAIAAGNTVVLK

SEQ ID NO: 889008 - protein, 17 aa, Mycobacterium
SPILLVRGDARSGARLE

SEQ ID NO: 889009 - protein, 19 aa, Mycobacterium
SPIVGIWHSGGARLAEGVR

SEQ ID NO: 889010 - protein, 20 aa, Mycobacterium
SPIVGIWHSGGARLAEGVRA

SEQ ID NO: 889011 - protein, 24 aa, Mycobacterium
SPKETWLRLLLIDAGFPRPQTQIA

SEQ ID NO: 889012 - protein, 20 aa, Mycobacterium
SPLDFLKRPSSWLRLISDVR

SEQ ID NO: 889013 - protein, 36 aa, Mycobacterium
SPLRKPKFPAALAPESPLPDLKPRWERPTTAPDSET

SEQ ID NO: 889014 - protein, 20 aa, Mycobacterium
SPPFVVRWLSDGHEATVYPG

SEQ ID NO: 889015 - protein, 21 aa, Mycobacterium
SPPHRAIILNCAFNAGGFATA

SEQ ID NO: 889016 - protein, 23 aa, Mycobacterium
SPPVKWPCFYGIDFATPAELIAN

SEQ ID NO: 889017 - protein, 21 aa, Mycobacterium
SPPVLLGREWLKPTAYMMAKF

SEQ ID NO: 889018 - protein, 22 aa, Mycobacterium
SPPVRWPCFYGIDFATPAELIA

SEQ ID NO: 889019 - protein, 20 aa, Mycobacterium
SPPYLELTPDPWLVAVFREE

SEQ ID NO: 889020 - protein, 20 aa, Mycobacterium
SPRESYLRLFLIDAGLPRPQ

SEQ ID NO: 889021 - protein, 23 aa, Mycobacterium
SPRESYLRLLLIDAGFPRPRSQI

SEQ ID NO: 889022 - protein, 17 aa, Mycobacterium
SPRETWLRLLLIDAGYP

SEQ ID NO: 889023 - protein, 25 aa, Mycobacterium
SPRMRRDLPLLYRLCSGITGGIQIR

SEQ ID NO: 889024 - protein, 20 aa, Mycobacterium
SPRPATVWIAQDGSHRLVRA

SEQ ID NO: 889025 - protein, 32 aa, Mycobacterium
SPTPFNLLGIDRWIRNFFYLTYFDSFEGEHSR

SEQ ID NO: 889026 - protein, 18 aa, Mycobacterium
SPVFLYMDGDFPQGLDKA

SEQ ID NO: 889027 - protein, 30 aa, Mycobacterium
SPYLLNGAFFALPWFFRNGYDVLLYTLPFH

SEQ ID NO: 889028 - protein, 23 aa, Mycobacterium
SQAYERIFMWFAARDWDAMAEVV

SEQ ID NO: 889029 - protein, 22 aa, Mycobacterium
SQHPDLFWALRGGGGNFGVATA

SEQ ID NO: 889030 - protein, 18 aa, Mycobacterium
SQIVPWVNAVIPISKILP

SEQ ID NO: 889031 - protein, 26 aa, Mycobacterium
SQLISTVPPLLKWFATRPLIAGVVTV

SEQ ID NO: 889032 - protein, 22 aa, Mycobacterium
SQLLYWTQVLMIARGLSLDDVY

SEQ ID NO: 889033 - protein, 21 aa, Mycobacterium
SQLLYWTQVLMLARGLSLDDV

SEQ ID NO: 889034 - protein, 21 aa, Mycobacterium
SQLLYWTQVLMVARGLSLDDV

SEQ ID NO: 889035 - protein, 21 aa, Mycobacterium
SQLLYWTQVLMVSRGLTLDDV

SEQ ID NO: 889036 - protein, 22 aa, Mycobacterium
SQLVRILIRQLLPTGAIGLGDI

SEQ ID NO: 889037 - protein, 17 aa, Mycobacterium
SQLYGLLDRVRDLGLEL

SEQ ID NO: 889038 - protein, 25 aa, Mycobacterium
SQRGWRHWLYVMTRINLGLSPDEIY

SEQ ID NO: 889039 - protein, 25 aa, Mycobacterium
SQTPPSPPTLLWPIGVPFSDGLNSL

SEQ ID NO: 889040 - protein, 21 aa, Mycobacterium
SQYKDVILGLLFLKYLSDADT

SEQ ID NO: 889041 - protein, 20 aa, Mycobacterium
SRAYKMWLPPLVDPTPLDEL

SEQ ID NO: 889042 - protein, 25 aa, Mycobacterium
SRDELMARLWLRSIARYQDGVLTAL

SEQ ID NO: 889043 - protein, 25 aa, Mycobacterium
SRDKFPRAILPRTFDYGFATGLMVK

SEQ ID NO: 889044 - protein, 23 aa, Mycobacterium
SREPWVWGPRMLVGLDISASATL

SEQ ID NO: 889045 - protein, 17 aa, Mycobacterium
SRFLIARQPVGPCLLIT

SEQ ID NO: 889046 - protein, 26 aa, Mycobacterium
SRFSFRVRYLWFRAWVNSPAGARLGL

SEQ ID NO: 889047 - protein, 18 aa, Mycobacterium
SRFTGKFWKLLGAATDKN

SEQ ID NO: 889048 - protein, 20 aa, Mycobacterium
SRGMLWLEPLIEVATPNGRV

SEQ ID NO: 889049 - protein, 20 aa, Mycobacterium
SRGWLYRHFPDKSELLGAAI

SEQ ID NO: 889050 - protein, 23 aa, Mycobacterium
SRGWLYRHFPDKVSLLGAAIVRL

SEQ ID NO: 889051 - protein, 24 aa, Mycobacterium
SRHLHHLTLPRPGDWRQLCEQVSQ

SEQ ID NO: 889052 - protein, 24 aa, Mycobacterium
SRHWYRYHHLFGELLRAELHRCEP

SEQ ID NO: 889053 - protein, 17 aa, Mycobacterium
SRIDQLFIAPFHPGYLA

SEQ ID NO: 889054 - protein, 20 aa, Mycobacterium
SRIKLPKLGWVKFRASRSLD

SEQ ID NO: 889055 - protein, 19 aa, Mycobacterium
SRLALPRWLAESLPAPLPR

SEQ ID NO: 889056 - protein, 21 aa, Mycobacterium
SRLLAPILTPIIYRAAISARA

SEQ ID NO: 889057 - protein, 23 aa, Mycobacterium
SRLTFLAVRRWFGWSAGRIINLD

SEQ ID NO: 889058 - protein, 23 aa, Mycobacterium
SRLTFLAVRRWYGWSAGRIINLD

SEQ ID NO: 889059 - protein, 23 aa, Mycobacterium
SRLTFLAVRRWYGWSAGRIVNLD

SEQ ID NO: 889060 - protein, 17 aa, Mycobacterium
SRLTTALALAQWIEEHR

SEQ ID NO: 889061 - protein, 20 aa, Mycobacterium
SRMFPKITSLPLGVPRPRMI

SEQ ID NO: 889062 - protein, 29 aa, Mycobacterium
SRMYGLLRRLLFLLPPERVHKLVFAVLRG

SEQ ID NO: 889063 - protein, 19 aa, Mycobacterium
SRPKLYRFFTDKEALFAAV

SEQ ID NO: 889064 - protein, 23 aa, Mycobacterium
SRPLITNMIRLLKLPIPVQRRVA

SEQ ID NO: 889065 - protein, 17 aa, Mycobacterium
SRQLPWLRRLGVVYTYD

SEQ ID NO: 889066 - protein, 24 aa, Mycobacterium
SRQRPEIDWFPWLAQQLRGASPGA

SEQ ID NO: 889067 - protein, 20 aa, Mycobacterium
SRRALLLRLLAEHLPDWQPV

SEQ ID NO: 889068 - protein, 18 aa, Mycobacterium
SRRDLPWRRPDVGAWQIL

SEQ ID NO: 889069 - protein, 19 aa, Mycobacterium
SRRGLLELAWPALPPDTFS

SEQ ID NO: 889070 - protein, 18 aa, Mycobacterium
SRRHAFLASLLGIRHLVL

SEQ ID NO: 889071 - protein, 23 aa, Mycobacterium
SRRLWTLLIFMLWHAIFVDHSVV

SEQ ID NO: 889072 - protein, 23 aa, Mycobacterium
SRRLWTLLIFMLWHAIFVERSVV

SEQ ID NO: 889073 - protein, 22 aa, Mycobacterium
SRRLWTVLIFMLWHAIFVEHSV

SEQ ID NO: 889074 - protein, 24 aa, Mycobacterium
SRRLWTVLIFMLWHSIFVEKTVHP

SEQ ID NO: 889075 - protein, 23 aa, Mycobacterium
SRRTVPLPPWLAKRMADYLAEVH

SEQ ID NO: 889076 - protein, 17 aa, Mycobacterium
SRRTYYLVGLRQFCRYA

SEQ ID NO: 889077 - protein, 17 aa, Mycobacterium
SRRWAGPAFLLNQMLVW

SEQ ID NO: 889078 - protein, 18 aa, Mycobacterium
SRTLIFLPLAHVLARGIA

SEQ ID NO: 889079 - protein, 22 aa, Mycobacterium
SRVLGLHFFNPVPVLPLVEVIN

SEQ ID NO: 889080 - protein, 19 aa, Mycobacterium
SRWAAYWPPGATEAAFRWA

SEQ ID NO: 889081 - protein, 18 aa, Mycobacterium
SRYSYLVSLLPPQIIKDL

SEQ ID NO: 889082 - protein, 22 aa, Mycobacterium
SSAWTLGFYTLHNWMLALFSEE

SEQ ID NO: 889083 - protein, 25 aa, Mycobacterium
SSEPGVYFLGLPWQSRRGSSFLWGV

SEQ ID NO: 889084 - protein, 20 aa, Mycobacterium
SSFERPFDAIVGRYVLTFQA

SEQ ID NO: 889085 - protein, 17 aa, Mycobacterium
SSFQLYWAPSLRPEAGV

SEQ ID NO: 889086 - protein, 28 aa, Mycobacterium
SSGLMNTGFLPFWNQPVYIDYSPAGTGT

SEQ ID NO: 889087 - protein, 20 aa, Mycobacterium
SSGRGLWELAWPPLSSAGAP

SEQ ID NO: 889088 - protein, 24 aa, Mycobacterium
SSGRIKLAWFLLNAARYMPAQLYA

SEQ ID NO: 889089 - protein, 22 aa, Mycobacterium
SSHTWFVLTYLLGKPGVRNYDG

SEQ ID NO: 889090 - protein, 27 aa, Mycobacterium
SSIAKYAMVLLLRRVWTATLGLAGRVA

SEQ ID NO: 889091 - protein, 20 aa, Mycobacterium
SSIPTYFMAAATPLYGMSSI

SEQ ID NO: 889092 - protein, 23 aa, Mycobacterium
SSLISMFLDFYRPLVEAGMVYVT

SEQ ID NO: 889093 - protein, 23 aa, Mycobacterium
SSLLTFAAILPLVVIAGPVDLPI

SEQ ID NO: 889094 - protein, 23 aa, Mycobacterium
SSLTLYLQLYLGGFGLELSDIEA

SEQ ID NO: 889095 - protein, 18 aa, Mycobacterium
SSMWFDALGRRLPAPYLP

SEQ ID NO: 889096 - protein, 18 aa, Mycobacterium
SSPLWRAYISTYVEGYQL

SEQ ID NO: 889097 - protein, 23 aa, Mycobacterium
SSQMMGFALMRYVWKIEPVASMT

SEQ ID NO: 889098 - protein, 23 aa, Mycobacterium
SSRITLWAMAWLARAHFVSGDWD

SEQ ID NO: 889099 - protein, 24 aa, Mycobacterium
SSRLLANQFLYGAPFPVPIPDVMR

SEQ ID NO: 889100 - protein, 21 aa, Mycobacterium
SSSFSFFHYVDMLGLTAKPFP

SEQ ID NO: 889101 - protein, 22 aa, Mycobacterium
SSSGWLFVSSWKADADSLRMRP

SEQ ID NO: 889102 - protein, 25 aa, Mycobacterium
SSTLPPLFSTLIKRPLRRLVDNDTP

SEQ ID NO: 889103 - protein, 21 aa, Mycobacterium
SSTWPLLKDLPYLGISVLGEA

SEQ ID NO: 889104 - protein, 25 aa, Mycobacterium
SSVLIQMMWAMRGLGMWSDARGTNM

SEQ ID NO: 889105 - protein, 24 aa, Mycobacterium
SSVLSMMMWSFRGMGMWSDERGVN

SEQ ID NO: 889106 - protein, 29 aa, Mycobacterium
STAIASLFSASAQEYQMVSTRAAHLHAEF

SEQ ID NO: 889107 - protein, 17 aa, Mycobacterium
STEYLFYRDADGDYWLA

SEQ ID NO: 889108 - protein, 24 aa, Mycobacterium
STFLHRAFDQLLFDVGLHQLPVTL

SEQ ID NO: 889109 - protein, 26 aa, Mycobacterium
STFRPGRALPLTLLLHSLALGQSQFA

SEQ ID NO: 889110 - protein, 27 aa, Mycobacterium
STHDEPMIPLYIFYSMFGFQRTGDGLW

SEQ ID NO: 889111 - protein, 23 aa, Mycobacterium
STIALAWLLRRSPVIVPIPGTKS

SEQ ID NO: 889112 - protein, 23 aa, Mycobacterium
STITPRWLLHLLSWVPVEAGIYR

SEQ ID NO: 889113 - protein, 21 aa, Mycobacterium
STLCSYLNKMLWILTGNFAKQ

SEQ ID NO: 889114 - protein, 21 aa, Mycobacterium
STLGLIFHWADQQGLALLDLK

SEQ ID NO: 889115 - protein, 27 aa, Mycobacterium
STLLESFLFYSGFYLPMYWSSRAKLTN

SEQ ID NO: 889116 - protein, 21 aa, Mycobacterium
STLLLKVAHRWALSGRRALYI

SEQ ID NO: 889117 - protein, 22 aa, Mycobacterium
STLVSWLPFYHDMGLVLGVCAA

SEQ ID NO: 889118 - protein, 20 aa, Mycobacterium
STLVSYLNKMLWILTGNFAK

SEQ ID NO: 889119 - protein, 23 aa, Mycobacterium
STPAWRVFAKYYYPFITRHGADD

SEQ ID NO: 889120 - protein, 20 aa, Mycobacterium
STPFAHAGYMFKLWDQLVWG

SEQ ID NO: 889121 - protein, 25 aa, Mycobacterium
STPFDAFIRLISPTRLFTTAFKDIQ

SEQ ID NO: 889122 - protein, 21 aa, Mycobacterium
STPLFFAQAIGRFVRSRRPGE

SEQ ID NO: 889123 - protein, 21 aa, Mycobacterium
STPLFFAQAIGRFVRSRRQGE

SEQ ID NO: 889124 - protein, 20 aa, Mycobacterium
STPPAIFRWTDRDTLLYALG

SEQ ID NO: 889125 - protein, 17 aa, Mycobacterium
STPPLLEVVRPATFLFA

SEQ ID NO: 889126 - protein, 26 aa, Mycobacterium
STRVEFWAFDILFLDGRLLTKATYTD

SEQ ID NO: 889127 - protein, 26 aa, Mycobacterium
STRVEFWAFDILWLDGRSLLRAKYSD

SEQ ID NO: 889128 - protein, 24 aa, Mycobacterium
STSQHFVWLRESLPLKEKLPLKAG

SEQ ID NO: 889129 - protein, 18 aa, Mycobacterium
STVRRWLRRLPAAHLERI

SEQ ID NO: 889130 - protein, 23 aa, Mycobacterium
STVYYWMFGGWLRKRRNIRDMTK

SEQ ID NO: 889131 - protein, 19 aa, Mycobacterium
STWHRWIAQYGGMNANEAK

SEQ ID NO: 889132 - protein, 21 aa, Mycobacterium
STWLLPRLVGLARARRMLLLG

SEQ ID NO: 889133 - protein, 20 aa, Mycobacterium
STYKWETFLTSELPEWLSAN

SEQ ID NO: 889134 - protein, 17 aa, Mycobacterium
SVAAFPAPWLVTDKYWP

SEQ ID NO: 889135 - protein, 20 aa, Mycobacterium
SVAVVGLFRGLGQDYQLFGA

SEQ ID NO: 889136 - protein, 21 aa, Mycobacterium
SVAVVGLFRGLGQDYQLFGAQ

SEQ ID NO: 889137 - protein, 23 aa, Mycobacterium
SVDRALLVLELLADLGKAGVTEV

SEQ ID NO: 889138 - protein, 20 aa, Mycobacterium
SVDWPLLVQAGWVGLDAPES

SEQ ID NO: 889139 - protein, 21 aa, Mycobacterium
SVELFGMRFPSPIFMAPIGVI

SEQ ID NO: 889140 - protein, 18 aa, Mycobacterium
SVFVAPWYPPVQLARQLA

SEQ ID NO: 889141 - protein, 22 aa, Mycobacterium
SVGPIYLPLIDIPASPGYFNST

SEQ ID NO: 889142 - protein, 18 aa, Mycobacterium
SVGTPFLLLAGMEPDLKW

SEQ ID NO: 889143 - protein, 17 aa, Mycobacterium
SVIPHVLVPGLAAALRA

SEQ ID NO: 889144 - protein, 21 aa, Mycobacterium
SVIYELLWFLRGESNVRWLQE

SEQ ID NO: 889145 - protein, 22 aa, Mycobacterium
SVLDYMRRILYAGVATFQSLGT

SEQ ID NO: 889146 - protein, 17 aa, Mycobacterium
SVLIRRAALAAPALGAT

SEQ ID NO: 889147 - protein, 25 aa, Mycobacterium
SVLLPLVPLLPRWLVRRTVGVAAGN

SEQ ID NO: 889148 - protein, 20 aa, Mycobacterium
SVLRMFEMYPGYLQSFSQTL

SEQ ID NO: 889149 - protein, 20 aa, Mycobacterium
SVLVPFAWQGVTLHAAGASA

SEQ ID NO: 889150 - protein, 24 aa, Mycobacterium
SVLVQMMWAMRGIGIWSDVRGTNM

SEQ ID NO: 889151 - protein, 24 aa, Mycobacterium
SVLYPTGRLLDAPLPAWTHSTLLL

SEQ ID NO: 889152 - protein, 19 aa, Mycobacterium
SVNALAPLPLIPAYSISKA

SEQ ID NO: 889153 - protein, 20 aa, Mycobacterium
SVPAFRPGAQFKAVVAGAQK

SEQ ID NO: 889154 - protein, 18 aa, Mycobacterium
SVPAFRPGAQFKAVVSGA

SEQ ID NO: 889155 - protein, 24 aa, Mycobacterium
SVPMYKLRRYFPPDNRPGQPPVGP

SEQ ID NO: 889156 - protein, 17 aa, Mycobacterium
SVPMYKLRRYFPPDVRG

SEQ ID NO: 889157 - protein, 19 aa, Mycobacterium
SVPMYRLRRYFPPDSRPGA

SEQ ID NO: 889158 - protein, 17 aa, Mycobacterium
SVPPLLEVVRPATFLFA

SEQ ID NO: 889159 - protein, 29 aa, Mycobacterium
SVPRFASAWLWRLRWPLPLLGMGADIPDG

SEQ ID NO: 889160 - protein, 18 aa, Mycobacterium
SVRAFAWVGSHAPRRMWL

SEQ ID NO: 889161 - protein, 18 aa, Mycobacterium
SVRFLGAALTATTGIKGT

SEQ ID NO: 889162 - protein, 23 aa, Mycobacterium
SVSRTMFGWLLGGLSRTSLGNTA

SEQ ID NO: 889163 - protein, 24 aa, Mycobacterium
SVTEKWLRELLIAKDWIYSQQDSR

SEQ ID NO: 889164 - protein, 19 aa, Mycobacterium
SVTFPWYLLGRQVHIRGAV

SEQ ID NO: 889165 - protein, 25 aa, Mycobacterium
SVTQRLFLISLQLSAVLPLARMPAV

SEQ ID NO: 889166 - protein, 20 aa, Mycobacterium
SVVAPLLSRSLILQLQPLTP

SEQ ID NO: 889167 - protein, 23 aa, Mycobacterium
SVVAPLLSRSLILQLQPLTPADV

SEQ ID NO: 889168 - protein, 24 aa, Mycobacterium
SVVAPLLSRSLILQLRPLDADDIR

SEQ ID NO: 889169 - protein, 24 aa, Mycobacterium
SVVAPLLSRSLILQLRPLSADDIR

SEQ ID NO: 889170 - protein, 20 aa, Mycobacterium
SVVLPFLLPDTPVVAWWPAV

SEQ ID NO: 889171 - protein, 19 aa, Mycobacterium
SVVSWLPFYHDMGFVLGVI

SEQ ID NO: 889172 - protein, 18 aa, Mycobacterium
SVVTLLRGLASGGAAVVL

SEQ ID NO: 889173 - protein, 17 aa, Mycobacterium
SVWELWGPLLYGGCVVM

SEQ ID NO: 889174 - protein, 22 aa, Mycobacterium
SWEAMLQPYVPGRWLYRPLSVN

SEQ ID NO: 889175 - protein, 17 aa, Mycobacterium
SWFKLHHPAAFCAALLR

SEQ ID NO: 889176 - protein, 17 aa, Mycobacterium
SWILPRLAGWGAAMDLL

SEQ ID NO: 889177 - protein, 21 aa, Mycobacterium
SWLDAFTHWRQLQGLPATSIA

SEQ ID NO: 889178 - protein, 21 aa, Mycobacterium
SWRSVLWRRWPAAGAPPFFAS

SEQ ID NO: 889179 - protein, 21 aa, Mycobacterium
SWRSVLWRRWPVAGPPPFFLS

SEQ ID NO: 889180 - protein, 20 aa, Mycobacterium
SWSRITYWRALLASALDQAP

SEQ ID NO: 889181 - protein, 20 aa, Mycobacterium
SWTVPLYQLVTQRQAPLPAY

SEQ ID NO: 889182 - protein, 18 aa, Mycobacterium
SWVLADPLRWLTIADRYG

SEQ ID NO: 889183 - protein, 21 aa, Mycobacterium
SWYRIPAFYFACPATVLGPYD

SEQ ID NO: 889184 - protein, 17 aa, Mycobacterium
SWYTLFHQLPLLPEWLL

SEQ ID NO: 889185 - protein, 27 aa, Mycobacterium
SYDVSPIQLQLLYIPPTTGLGNTSSSP

SEQ ID NO: 889186 - protein, 22 aa, Mycobacterium
SYEFFCNAGLLLDKRLEELGAS

SEQ ID NO: 889187 - protein, 19 aa, Mycobacterium
SYEMPLILNVPTFTICAAT

SEQ ID NO: 889188 - protein, 17 aa, Mycobacterium
SYFVLVFDKAALSGDGP

SEQ ID NO: 889189 - protein, 18 aa, Mycobacterium
SYFVYRLIKRLKKSANNA

SEQ ID NO: 889190 - protein, 19 aa, Mycobacterium
SYFVYRLIKRLKKSANNAP

SEQ ID NO: 889191 - protein, 21 aa, Mycobacterium
SYGWSLMRIGALLRRSDMSLL

SEQ ID NO: 889192 - protein, 20 aa, Mycobacterium
SYGWSLMRIGALLRRTDMSL

SEQ ID NO: 889193 - protein, 20 aa, Mycobacterium
SYIWFFLCPVVPELAIRSRA

SEQ ID NO: 889194 - protein, 20 aa, Mycobacterium
SYLALLDALRWLGLNWDEGP

SEQ ID NO: 889195 - protein, 18 aa, Mycobacterium
SYLLIWTTTPWTLPSNQA

SEQ ID NO: 889196 - protein, 19 aa, Mycobacterium
SYLYRTMIPPLAAGGYRVL

SEQ ID NO: 889197 - protein, 17 aa, Mycobacterium
SYNHWAGVLYPPGLPAA

SEQ ID NO: 889198 - protein, 21 aa, Mycobacterium
SYPDRIIGCQLPWLLDPELGA

SEQ ID NO: 889199 - protein, 24 aa, Mycobacterium
SYPDRIIPCQLPWLLDPDVGAQMI

SEQ ID NO: 889200 - protein, 24 aa, Mycobacterium
SYPERIIPCQLPWLLDPDLGARMI

SEQ ID NO: 889201 - protein, 33 aa, Mycobacterium
SYQALSAQMAAFHDRFMNALAGASGSYASAEAA

SEQ ID NO: 889202 - protein, 19 aa, Mycobacterium
SYQLTIYIFRYGEGTAMAI

SEQ ID NO: 889203 - protein, 23 aa, Mycobacterium
SYTELMPFRLAVLHAAWLIDTAG

SEQ ID NO: 889204 - protein, 21 aa, Mycobacterium
SYYLPRLIGIAKTKQLMLTNR

SEQ ID NO: 889205 - protein, 22 aa, Mycobacterium
SYYVEWLTHQLAQKARAHIAEV

SEQ ID NO: 889206 - protein, 20 aa, Mycobacterium
TAAAPYVAWLATAGAQAEQA

SEQ ID NO: 889207 - protein, 22 aa, Mycobacterium
TAADLGPLRWLPAIPDVLAADP

SEQ ID NO: 889208 - protein, 17 aa, Mycobacterium
TAAPGKPLLLLSAYDLA

SEQ ID NO: 889209 - protein, 19 aa, Mycobacterium
TAAPPLRRLLREILREQRR

SEQ ID NO: 889210 - protein, 19 aa, Mycobacterium
TAAQVLLRWSIQLGNVVIS

SEQ ID NO: 889211 - protein, 24 aa, Mycobacterium
TADLDLDWWLTFSSVASLLGAPGQ

SEQ ID NO: 889212 - protein, 17 aa, Mycobacterium
TAEAYLGLLRFLLGLDL

SEQ ID NO: 889213 - protein, 25 aa, Mycobacterium
TAELTIVSWLPFYHDMGLVLGVCAP

SEQ ID NO: 889214 - protein, 25 aa, Mycobacterium
TAERGLFDFFFLAEGLRLREHRERI

SEQ ID NO: 889215 - protein, 26 aa, Mycobacterium
TAERGLFDFFFLAEGLRLREHRGKIH

SEQ ID NO: 889216 - protein, 25 aa, Mycobacterium
TAERGLFDFFFLAEGLRLREHRGRI

SEQ ID NO: 889217 - protein, 23 aa, Mycobacterium
TAERTMLNLLCHLSGVATATAAW

SEQ ID NO: 889218 - protein, 20 aa, Mycobacterium
TAFLELCPFAAWGTKFPVGG

SEQ ID NO: 889219 - protein, 24 aa, Mycobacterium
TAFNFPVAVWAWNIAVALVCGDTV

SEQ ID NO: 889220 - protein, 21 aa, Mycobacterium
TAFNFPVAVWSWNTAIALVCG

SEQ ID NO: 889221 - protein, 23 aa, Mycobacterium
TAFPRTHWQKIWSNNPIVICSAA

SEQ ID NO: 889222 - protein, 22 aa, Mycobacterium
TAFVRLLRYLPGGTLLESGYLP

SEQ ID NO: 889223 - protein, 26 aa, Mycobacterium
TAGFNVPYYWWTLNMPTDHGEVELTN

SEQ ID NO: 889224 - protein, 29 aa, Mycobacterium
TAGHSGSWWIFWPTLLLTLVSDFNALTGP

SEQ ID NO: 889225 - protein, 27 aa, Mycobacterium
TAGPGTKLLVLPPLIHGAAQWTVMTAL

SEQ ID NO: 889226 - protein, 18 aa, Mycobacterium
TAGRISYLLGLRGPAAAI

SEQ ID NO: 889227 - protein, 24 aa, Mycobacterium
TAHLDLDWWLSFSSAASMLGSPGQ

SEQ ID NO: 889228 - protein, 23 aa, Mycobacterium
TAKAAEPLLLILDVEKPRSADIS

SEQ ID NO: 889229 - protein, 17 aa, Mycobacterium
TALRFLGKTLTWGELRG

SEQ ID NO: 889230 - protein, 20 aa, Mycobacterium
TALRRRAVRGWLLAAGARDL

SEQ ID NO: 889231 - protein, 22 aa, Mycobacterium
TALWDLKGKLLGLPVCRLLGMA

SEQ ID NO: 889232 - protein, 19 aa, Mycobacterium
TALWKEHLLVRLDVEPFSR

SEQ ID NO: 889233 - protein, 22 aa, Mycobacterium
TAMDVCLWLLRNSVDPGQLSWI

SEQ ID NO: 889234 - protein, 18 aa, Mycobacterium
TAMVLGEPFMLPAHIDFA

SEQ ID NO: 889235 - protein, 22 aa, Mycobacterium
TANIALLHFLDGEKRYIIAPQG

SEQ ID NO: 889236 - protein, 22 aa, Mycobacterium
TAPLLATRWATAFLTGARPAEL

SEQ ID NO: 889237 - protein, 18 aa, Mycobacterium
TAPLLPGYPRTGPTVLFL

SEQ ID NO: 889238 - protein, 18 aa, Mycobacterium
TAQLLPRPIGLIIGLQLS

SEQ ID NO: 889239 - protein, 25 aa, Mycobacterium
TARGIAFVPFFPLGAAFVQPNPVLT

SEQ ID NO: 889240 - protein, 20 aa, Mycobacterium
TARHFIWTLLEPEKAFAEWR

SEQ ID NO: 889241 - protein, 21 aa, Mycobacterium
TARIALLHFLDGEKRYIIAPV

SEQ ID NO: 889242 - protein, 21 aa, Mycobacterium
TARPEWLWAAAHRLGIGPEAA

SEQ ID NO: 889243 - protein, 23 aa, Mycobacterium
TARRGVLGWLLPLVSRFPTLSMA

SEQ ID NO: 889244 - protein, 18 aa, Mycobacterium
TARRLRTMGWRHDGALVK

SEQ ID NO: 889245 - protein, 17 aa, Mycobacterium
TARWTRYLGTVSGPLML

SEQ ID NO: 889246 - protein, 25 aa, Mycobacterium
TATCPEWIYFWLGAARIGAVSAAVN

SEQ ID NO: 889247 - protein, 20 aa, Mycobacterium
TATPWLAAFAQRSPFAEAFR

SEQ ID NO: 889248 - protein, 22 aa, Mycobacterium
TATVLAQALLKAGLRLVAAGVN

SEQ ID NO: 889249 - protein, 25 aa, Mycobacterium
TAVAMLVAIFRARPSPFYVMDEVEA

SEQ ID NO: 889250 - protein, 23 aa, Mycobacterium
TAVLPGRPPLATLFLPHNRGKKS

SEQ ID NO: 889251 - protein, 19 aa, Mycobacterium
TAWLLLSCEGLHAGAREAL

SEQ ID NO: 889252 - protein, 23 aa, Mycobacterium
TAYLGHVIVLWSWALKQPNPDTA

SEQ ID NO: 889253 - protein, 19 aa, Mycobacterium
TCDFLEWFLDNVPITPIWL

SEQ ID NO: 889254 - protein, 23 aa, Mycobacterium
TCPAWVYFWLGAARIGAVSAAVN

SEQ ID NO: 889255 - protein, 18 aa, Mycobacterium
TCWPWLEAEWRLVSEHVR

SEQ ID NO: 889256 - protein, 18 aa, Mycobacterium
TCWRDYRLGMLQAPLITV

SEQ ID NO: 889257 - protein, 18 aa, Mycobacterium
TCYDIRFPGLYTDLARRG

SEQ ID NO: 889258 - protein, 30 aa, Mycobacterium
TDALRRLALGHWLRRWWPASIREGIAELDP

SEQ ID NO: 889259 - protein, 26 aa, Mycobacterium
TDAMPALHLLPLADLLGVVPVLATDV

SEQ ID NO: 889260 - protein, 28 aa, Mycobacterium
TDAPGFHVPFYWWTFNMPTDHGEVELTN

SEQ ID NO: 889261 - protein, 24 aa, Mycobacterium
TDDFPLAMAWAHLRTLRLADGPDE

SEQ ID NO: 889262 - protein, 20 aa, Mycobacterium
TDDGFAYRIVYVDPALVFES

SEQ ID NO: 889263 - protein, 25 aa, Mycobacterium
TDEAIYSFLRLLLPAGLETTYRSSG

SEQ ID NO: 889264 - protein, 19 aa, Mycobacterium
TDEAPLLATYAFLPIVRAF

SEQ ID NO: 889265 - protein, 20 aa, Mycobacterium
TDELLQRMLFESCLLHAGQA

SEQ ID NO: 889266 - protein, 17 aa, Mycobacterium
TDFGLHPALFDAALHVA

SEQ ID NO: 889267 - protein, 23 aa, Mycobacterium
TDGLPVWIYQFKISPHPSIPHAP

SEQ ID NO: 889268 - protein, 17 aa, Mycobacterium
TDGMIRIMVFYGEVLAL

SEQ ID NO: 889269 - protein, 25 aa, Mycobacterium
TDGSRPVMLWAYDPEAFNGWGKAAI

SEQ ID NO: 889270 - protein, 21 aa, Mycobacterium
TDGVYEFMFVASPLPLTGASG

SEQ ID NO: 889271 - protein, 19 aa, Mycobacterium
TDIGWLEMLWMQPVGVNSH

SEQ ID NO: 889272 - protein, 22 aa, Mycobacterium
TDLAWARITYWRALLTSAVDLT

SEQ ID NO: 889273 - protein, 26 aa, Mycobacterium
TDLLNEAWWFPAIQWPDGRMQFMLNE

SEQ ID NO: 889274 - protein, 21 aa, Mycobacterium
TDLPVLLYDIPPRSVIPIETE

SEQ ID NO: 889275 - protein, 21 aa, Mycobacterium
TDNILWLLKQAFYFSLTSVNE

SEQ ID NO: 889276 - protein, 18 aa, Mycobacterium
TDPQGALALWSGWLGTDL

SEQ ID NO: 889277 - protein, 23 aa, Mycobacterium
TDPRTWLLLATGKLSFAEAKGTG

SEQ ID NO: 889278 - protein, 19 aa, Mycobacterium
TDPVLAWLYVLDAWEGGLP

SEQ ID NO: 889279 - protein, 20 aa, Mycobacterium
TDPVLAWLYVLDAWEGGLPS

SEQ ID NO: 889280 - protein, 22 aa, Mycobacterium
TDQALWLEWVFDPAQQWQFPDF

SEQ ID NO: 889281 - protein, 23 aa, Mycobacterium
TDQGRQLRWFGLDGAEHTGGPLV

SEQ ID NO: 889282 - protein, 25 aa, Mycobacterium
TDRRHYSFWPVPVSDIALMAARAAR

SEQ ID NO: 889283 - protein, 24 aa, Mycobacterium
TDSMPALHLLPLADALGVLPVLAT

SEQ ID NO: 889284 - protein, 24 aa, Mycobacterium
TDSMPALHLLPLAGVLGVLPVLAT

SEQ ID NO: 889285 - protein, 24 aa, Mycobacterium
TDSRGLFFEWFTDAGFTEFAGHQF

SEQ ID NO: 889286 - protein, 24 aa, Mycobacterium
TDVDVWVLARRGLPLRLATLGEFM

SEQ ID NO: 889287 - protein, 20 aa, Mycobacterium
TDWAQLLEGCGFDRVLVSEH

SEQ ID NO: 889288 - protein, 26 aa, Mycobacterium
TEAAEWHWPVRHLVITRGARGASYVS

SEQ ID NO: 889289 - protein, 24 aa, Mycobacterium
TEAEQTFLLRLLGGELRQGALAGI

SEQ ID NO: 889290 - protein, 26 aa, Mycobacterium
TEALALLRLPLLLPTLRLLGRVGGPL

SEQ ID NO: 889291 - protein, 18 aa, Mycobacterium
TEARSWLYPSRHLVTTLG

SEQ ID NO: 889292 - protein, 23 aa, Mycobacterium
TEAYLGYALWRLSPTVMKVIARL

SEQ ID NO: 889293 - protein, 19 aa, Mycobacterium
TEDLAAMMGLGEPAAQLGG

SEQ ID NO: 889294 - protein, 20 aa, Mycobacterium
TEGLLYERRLFHSAFATADQ

SEQ ID NO: 889295 - protein, 18 aa, Mycobacterium
TEGPLAEGYFIAPTVLEL

SEQ ID NO: 889296 - protein, 17 aa, Mycobacterium
TEGWLRLYPKRGALVVP

SEQ ID NO: 889297 - protein, 27 aa, Mycobacterium
TEHHLDVPLFWQCWKLDSPLVQAITDA

SEQ ID NO: 889298 - protein, 24 aa, Mycobacterium
TELAFPCVWIAPWTRADGLVPLRH

SEQ ID NO: 889299 - protein, 17 aa, Mycobacterium
TELLHTSTRFRNLWSHH

SEQ ID NO: 889300 - protein, 25 aa, Mycobacterium
TELRRHILTLWQTALIRLSRLKISD

SEQ ID NO: 889301 - protein, 25 aa, Mycobacterium
TENGLLLTTLWYIREVDPTTLLLTG

SEQ ID NO: 889302 - protein, 26 aa, Mycobacterium
TEPAVFVWLGVIFYLTPDAAGSTLDY

SEQ ID NO: 889303 - protein, 24 aa, Mycobacterium
TEPEQTFLLRLLGGELRQGALAGI

SEQ ID NO: 889304 - protein, 19 aa, Mycobacterium
TEPGLRWPDLSLAGGRVGY

SEQ ID NO: 889305 - protein, 17 aa, Mycobacterium
TEPLYKMPWSTMFPLGI

SEQ ID NO: 889306 - protein, 23 aa, Mycobacterium
TEPWYVVTFGGGATPTPTSLGAA

SEQ ID NO: 889307 - protein, 26 aa, Mycobacterium
TEQGIGFIPWFPLAAGPLAAPDGPLQ

SEQ ID NO: 889308 - protein, 24 aa, Mycobacterium
TEQLSHTFPLIDILPWGRQEVWQD

SEQ ID NO: 889309 - protein, 23 aa, Mycobacterium
TEQLSYMFGLIDLLPWGRQEQWQ

SEQ ID NO: 889310 - protein, 21 aa, Mycobacterium
TERFTMLRPLLFTIAYEILGS

SEQ ID NO: 889311 - protein, 17 aa, Mycobacterium
TERGLLLTTLWYIREVD

SEQ ID NO: 889312 - protein, 25 aa, Mycobacterium
TERGLLLTTLWYIREVDPAVLLLTG

SEQ ID NO: 889313 - protein, 27 aa, Mycobacterium
TERLSLLGLPFLFFIDAAQGRASVLYH

SEQ ID NO: 889314 - protein, 20 aa, Mycobacterium
TEVQKIFVRLLTLPVPTVAA

SEQ ID NO: 889315 - protein, 18 aa, Mycobacterium
TEYPLLGPWGAARVFGPQ

SEQ ID NO: 889316 - protein, 20 aa, Mycobacterium
TFANPWLFDLARTPNPHFGF

SEQ ID NO: 889317 - protein, 17 aa, Mycobacterium
TFAVLLAAGLRGVEKGY

SEQ ID NO: 889318 - protein, 18 aa, Mycobacterium
TFDALYPKGLQWYWRGDF

SEQ ID NO: 889319 - protein, 26 aa, Mycobacterium
TFDPSIWEIFWPLIVGARLVIAEPEA

SEQ ID NO: 889320 - protein, 21 aa, Mycobacterium
TFEWAFRWLAANRPPASPPRL

SEQ ID NO: 889321 - protein, 24 aa, Mycobacterium
TFEYQALLFIPKHAPFDLFNRDAS

SEQ ID NO: 889322 - protein, 20 aa, Mycobacterium
TFEYQALLFIPSHAPFDLFQ

SEQ ID NO: 889323 - protein, 17 aa, Mycobacterium
TFFNPKWLKKTLVEGTK

SEQ ID NO: 889324 - protein, 19 aa, Mycobacterium
TFFVATAPRYSFVSSSLAK

SEQ ID NO: 889325 - protein, 18 aa, Mycobacterium
TFGPPWPGLGAYGVSKAA

SEQ ID NO: 889326 - protein, 19 aa, Mycobacterium
TFGPPWPGLGAYGVSKAAL

SEQ ID NO: 889327 - protein, 18 aa, Mycobacterium
TFHAQFVQLMATSAGRYA

SEQ ID NO: 889328 - protein, 21 aa, Mycobacterium
TFHTQFVRALNLSGGAYAAAD

SEQ ID NO: 889329 - protein, 18 aa, Mycobacterium
TFLIQPYQNIVRLTVSHA

SEQ ID NO: 889330 - protein, 19 aa, Mycobacterium
TFPLGMETGWWATAPTLIV

SEQ ID NO: 889331 - protein, 19 aa, Mycobacterium
TFPSWPLAHPFRFVAHNGE

SEQ ID NO: 889332 - protein, 20 aa, Mycobacterium
TFPSWPLAHPFRRIAHNGEI

SEQ ID NO: 889333 - protein, 19 aa, Mycobacterium
TFPSWPLAHPFRRVAHNGE

SEQ ID NO: 889334 - protein, 25 aa, Mycobacterium
TFSWPPQIYLPGYKPVTKPHGKQVR

SEQ ID NO: 889335 - protein, 21 aa, Mycobacterium
TFVKFHWKPRLGVHSLVWEEC

SEQ ID NO: 889336 - protein, 17 aa, Mycobacterium
TFVLFTSGFLEAGYRRF

SEQ ID NO: 889337 - protein, 26 aa, Mycobacterium
TGALKWASRPLKFAKLLPATIGVIPA

SEQ ID NO: 889338 - protein, 24 aa, Mycobacterium
TGALLYIPLLTRMLINLNAWGLSE

SEQ ID NO: 889339 - protein, 24 aa, Mycobacterium
TGALWRDFGLPPFERLRVIACGTS

SEQ ID NO: 889340 - protein, 23 aa, Mycobacterium
TGALWRDFGLPSFERLRVIGCGT

SEQ ID NO: 889341 - protein, 25 aa, Mycobacterium
TGAPGRAWLFFGARNRALDFLYADE

SEQ ID NO: 889342 - protein, 17 aa, Mycobacterium
TGDAQLLMIGWGSSYGP

SEQ ID NO: 889343 - protein, 17 aa, Mycobacterium
TGDFRFFAAPGSWTLRA

SEQ ID NO: 889344 - protein, 24 aa, Mycobacterium
TGDRWDAAFAYWQQLRTDPGAVFD

SEQ ID NO: 889345 - protein, 23 aa, Mycobacterium
TGDRYLIVNPFFHIFGYKAGCIA

SEQ ID NO: 889346 - protein, 27 aa, Mycobacterium
TGELLLKKIWLAALRRGLTAASLGTDI

SEQ ID NO: 889347 - protein, 19 aa, Mycobacterium
TGERFLDMFTFFASSALGM

SEQ ID NO: 889348 - protein, 24 aa, Mycobacterium
TGETWWGFIRHGVVPDLVTMGKPM

SEQ ID NO: 889349 - protein, 17 aa, Mycobacterium
TGFERFLPLLFAYDLPP

SEQ ID NO: 889350 - protein, 23 aa, Mycobacterium
TGFKGPWLALLLLSRGHQVSGLA

SEQ ID NO: 889351 - protein, 17 aa, Mycobacterium
TGFKWLARAGSPGTTLV

SEQ ID NO: 889352 - protein, 20 aa, Mycobacterium
TGFVPGFWGAVLAGLIVVPS

SEQ ID NO: 889353 - protein, 23 aa, Mycobacterium
TGGATLPLLIFASARAGLTFTPI

SEQ ID NO: 889354 - protein, 23 aa, Mycobacterium
TGGFVLFYHLLWELTHVCFEHPG

SEQ ID NO: 889355 - protein, 17 aa, Mycobacterium
TGGLISFLGGHGTGGAG

SEQ ID NO: 889356 - protein, 25 aa, Mycobacterium
TGGNGGILGLGLPPGTAGTGGTGGT

SEQ ID NO: 889357 - protein, 18 aa, Mycobacterium
TGGPLPKFDFIPSALLPA

SEQ ID NO: 889358 - protein, 26 aa, Mycobacterium
TGHGAFVVPFFRKAAFLTLAMCESEV

SEQ ID NO: 889359 - protein, 28 aa, Mycobacterium
TGIDPAAASPWWLQRRLLLCGIRATSPA

SEQ ID NO: 889360 - protein, 19 aa, Mycobacterium
TGIDPAAVSPWWLQRRLLL

SEQ ID NO: 889361 - protein, 19 aa, Mycobacterium
TGIDPAAVSPWWMQRRLLL

SEQ ID NO: 889362 - protein, 25 aa, Mycobacterium
TGIDPGAVSPWWLQRRLLMCGMRVT

SEQ ID NO: 889363 - protein, 20 aa, Mycobacterium
TGIFLIYAALYQLAKHFPDR

SEQ ID NO: 889364 - protein, 25 aa, Mycobacterium
TGKYYSGVKWTWYRPIYAGRPVLAE

SEQ ID NO: 889365 - protein, 18 aa, Mycobacterium
TGLIYIPGLFAFTDELVA

SEQ ID NO: 889366 - protein, 26 aa, Mycobacterium
TGLLTFLSFFLAYAYYGAAKSIAGDF

SEQ ID NO: 889367 - protein, 21 aa, Mycobacterium
TGLPYPLMHPWWPLKGSDAEA

SEQ ID NO: 889368 - protein, 21 aa, Mycobacterium
TGLVQWLCAPTTYLDGDRPVD

SEQ ID NO: 889369 - protein, 27 aa, Mycobacterium
TGMGPQWWQMCRGLLDVFPVFTDSIHR

SEQ ID NO: 889370 - protein, 19 aa, Mycobacterium
TGMLFFLASSRILNWGKGV

SEQ ID NO: 889371 - protein, 25 aa, Mycobacterium
TGNTHYYMFLTQDLPLLQPLRDIPF

SEQ ID NO: 889372 - protein, 23 aa, Mycobacterium
TGNTQYYMLLTQNLPLVQPIRDI

SEQ ID NO: 889373 - protein, 25 aa, Mycobacterium
TGNYPFSIGPIYIWNDPSPIGTTVF

SEQ ID NO: 889374 - protein, 24 aa, Mycobacterium
TGPAYYLMDFPIESFTPLFVMSRI

SEQ ID NO: 889375 - protein, 17 aa, Mycobacterium
TGPFVPEKWYRVLTEEQ

SEQ ID NO: 889376 - protein, 17 aa, Mycobacterium
TGPVFRLTLLRQSPHEH

SEQ ID NO: 889377 - protein, 17 aa, Mycobacterium
TGPYRFLYRKRFHKRAE

SEQ ID NO: 889378 - protein, 25 aa, Mycobacterium
TGQGALLQLGLLQLALRLAVDNGFI

SEQ ID NO: 889379 - protein, 22 aa, Mycobacterium
TGQGGISFLAPGGQTGGDGSTG

SEQ ID NO: 889380 - protein, 23 aa, Mycobacterium
TGQNGGILFGNGGSGWNSDVVGM

SEQ ID NO: 889381 - protein, 17 aa, Mycobacterium
TGRPAISLPLYQTPKGL

SEQ ID NO: 889382 - protein, 17 aa, Mycobacterium
TGRPPFLLDSHRPRLAL

SEQ ID NO: 889383 - protein, 22 aa, Mycobacterium
TGRQVFGTLPWHADLWLDSEDA

SEQ ID NO: 889384 - protein, 25 aa, Mycobacterium
TGRVIGVLILLWPTPRQFDAAELDM

SEQ ID NO: 889385 - protein, 21 aa, Mycobacterium
TGRVLPMCPIPLQIEADVSGL

SEQ ID NO: 889386 - protein, 17 aa, Mycobacterium
TGRWWSDVRWFKAPPDV

SEQ ID NO: 889387 - protein, 25 aa, Mycobacterium
TGSGKTLAAFLWAIDRLADPAREPS

SEQ ID NO: 889388 - protein, 25 aa, Mycobacterium
TGSGKTYAFLLPLVARLATSGTPRD

SEQ ID NO: 889389 - protein, 23 aa, Mycobacterium
TGSLPVMVWIPGGAFVYGAGQFQ

SEQ ID NO: 889390 - protein, 23 aa, Mycobacterium
TGSPFWLRMAPNLDFDPLTDVNG

SEQ ID NO: 889391 - protein, 23 aa, Mycobacterium
TGTPGDWWTVFALVPDALKHSVQ

SEQ ID NO: 889392 - protein, 17 aa, Mycobacterium
TGTPPMPTMPFTPPPAA

SEQ ID NO: 889393 - protein, 23 aa, Mycobacterium
TGTPPMPTMPFTPPPAATPDTTE

SEQ ID NO: 889394 - protein, 18 aa, Mycobacterium
TGTPPPFGTGAPGGSGGT

SEQ ID NO: 889395 - protein, 25 aa, Mycobacterium
TGVNTTFPPFPPAPPIMAAPGAPEA

SEQ ID NO: 889396 - protein, 25 aa, Mycobacterium
TGVPPAGWGWLPLLTGLAVAHTLRE

SEQ ID NO: 889397 - protein, 25 aa, Mycobacterium
TGVYKPYVDITLWPYPDGSGYNFSD

SEQ ID NO: 889398 - protein, 25 aa, Mycobacterium
TGYIPIIGAPWLPDLVRRSPWGEMF

SEQ ID NO: 889399 - protein, 17 aa, Mycobacterium
TGYKLLIADVIGGTLKA

SEQ ID NO: 889400 - protein, 26 aa, Mycobacterium
TGYSWGPLAWMLLAQALGQLGLTVEA

SEQ ID NO: 889401 - protein, 21 aa, Mycobacterium
THAHLLFEAYALDAVLPSRFG

SEQ ID NO: 889402 - protein, 26 aa, Mycobacterium
THDEPMIPIYIFYSMFGFQRTGDGLW

SEQ ID NO: 889403 - protein, 22 aa, Mycobacterium
THDYFWRWDTDWFWCSRAFGAQ

SEQ ID NO: 889404 - protein, 19 aa, Mycobacterium
THGAAVRKLWVSAGPPPCV

SEQ ID NO: 889405 - protein, 17 aa, Mycobacterium
THHDLHLWLPHPSDALW

SEQ ID NO: 889406 - protein, 18 aa, Mycobacterium
THLAFFVLDGWMRQVPAG

SEQ ID NO: 889407 - protein, 25 aa, Mycobacterium
THNEPMIPIYIFYSMFGFQRTGDGL

SEQ ID NO: 889408 - protein, 26 aa, Mycobacterium
THNEPMIPIYIFYSMFGFQRTGDSFW

SEQ ID NO: 889409 - protein, 24 aa, Mycobacterium
THNEPMIPVYIFYSMFGFQRTGDG

SEQ ID NO: 889410 - protein, 17 aa, Mycobacterium
THPFRWIAAAVRSLIPA

SEQ ID NO: 889411 - protein, 17 aa, Mycobacterium
THPRLIRELLTTVYQHT

SEQ ID NO: 889412 - protein, 22 aa, Mycobacterium
THQNFCWLLSTLGPLGSSEAAE

SEQ ID NO: 889413 - protein, 20 aa, Mycobacterium
THRAIMLAKITGAPLYVVHV

SEQ ID NO: 889414 - protein, 19 aa, Mycobacterium
THRFPPPWCVALSGGPDSL

SEQ ID NO: 889415 - protein, 24 aa, Mycobacterium
THRNPLVMLVGPPPMRCPAMPGAG

SEQ ID NO: 889416 - protein, 21 aa, Mycobacterium
THSSWAFAQLGAFLSYKAARA

SEQ ID NO: 889417 - protein, 26 aa, Mycobacterium
THTMVPFFYGYIGYAALAGLDVACWD

SEQ ID NO: 889418 - protein, 21 aa, Mycobacterium
TIALAWLLRRSPVIVPIPGTS

SEQ ID NO: 889419 - protein, 18 aa, Mycobacterium
TIARLWDHIGDKGIGFCL

SEQ ID NO: 889420 - protein, 17 aa, Mycobacterium
TIETIPLRIPLKAGSTP

SEQ ID NO: 889421 - protein, 28 aa, Mycobacterium
TIGGYAERMLLSAPLLLPVPNGLDFRHA

SEQ ID NO: 889422 - protein, 24 aa, Mycobacterium
TIGPLTIPLIDIPAGPGFGNSSTS

SEQ ID NO: 889423 - protein, 22 aa, Mycobacterium
TIHDYLWRWDSDWFWCSRAFGV

SEQ ID NO: 889424 - protein, 23 aa, Mycobacterium
TIHDYLWRWDTDWFWCSRAFGAQ

SEQ ID NO: 889425 - protein, 23 aa, Mycobacterium
TIKLPRTILMYPMTLISQAAHLV

SEQ ID NO: 889426 - protein, 18 aa, Mycobacterium
TIMTSLWFQQLQAGDRVS

SEQ ID NO: 889427 - protein, 20 aa, Mycobacterium
TINRFVFALPAIHDRVYLGL

SEQ ID NO: 889428 - protein, 20 aa, Mycobacterium
TINRRFSLPGLPAPYVIAQV

SEQ ID NO: 889429 - protein, 20 aa, Mycobacterium
TIPEIPINLPLSVPLHIPVE

SEQ ID NO: 889430 - protein, 19 aa, Mycobacterium
TIPEIPWHYDVTAPIEIPI

SEQ ID NO: 889431 - protein, 17 aa, Mycobacterium
TIPILGITFHGATPTAG

SEQ ID NO: 889432 - protein, 17 aa, Mycobacterium
TIPLATELAWAPEEIRE

SEQ ID NO: 889433 - protein, 24 aa, Mycobacterium
TIQEFTIPSLPLDALVYINGTPIP

SEQ ID NO: 889434 - protein, 20 aa, Mycobacterium
TIQLTAFLRGLPADGWLRII

SEQ ID NO: 889435 - protein, 24 aa, Mycobacterium
TIRLPKTILMYPMTLASQAAHIVM

SEQ ID NO: 889436 - protein, 23 aa, Mycobacterium
TIRNDLLILLRRLHRRDGVDRIV

SEQ ID NO: 889437 - protein, 18 aa, Mycobacterium
TIRQHVYDIVRGKRWPSA

SEQ ID NO: 889438 - protein, 20 aa, Mycobacterium
TIRYFKLEKWMAWQRYLLRG

SEQ ID NO: 889439 - protein, 17 aa, Mycobacterium
TIRYYEHIGLLPDPRRV

SEQ ID NO: 889440 - protein, 23 aa, Mycobacterium
TISELPYAGPLLPGGKRIYLATG

SEQ ID NO: 889441 - protein, 24 aa, Mycobacterium
TITRTLMRELLPPQLQRLDGIELA

SEQ ID NO: 889442 - protein, 17 aa, Mycobacterium
TIWFAQLYQHVADARQR

SEQ ID NO: 889443 - protein, 17 aa, Mycobacterium
TIYRWWPSRPALVADVM

SEQ ID NO: 889444 - protein, 20 aa, Mycobacterium
TKFDLSLDPLVPLPGFVIKR

SEQ ID NO: 889445 - protein, 23 aa, Mycobacterium
TKGRLIDYYLAVGGGPMLTALRD

SEQ ID NO: 889446 - protein, 22 aa, Mycobacterium
TKGSPLAWLLTMAHRRAVDRVR

SEQ ID NO: 889447 - protein, 26 aa, Mycobacterium
TKKTELLFVALFLKLLKPGGRAAVIV

SEQ ID NO: 889448 - protein, 25 aa, Mycobacterium
TKNMFALGLLSWMYHRPLEGTEQFL

SEQ ID NO: 889449 - protein, 27 aa, Mycobacterium
TKPHRGYWYLKKYGLPFMYWNLMLKGL

SEQ ID NO: 889450 - protein, 18 aa, Mycobacterium
TKPIGVTYPWTPPLAERV

SEQ ID NO: 889451 - protein, 25 aa, Mycobacterium
TKTLRFNFFVLKLPVRPPALVAKQA

SEQ ID NO: 889452 - protein, 21 aa, Mycobacterium
TKYILIPTHDLPLLNPLRAVP

SEQ ID NO: 889453 - protein, 17 aa, Mycobacterium
TLAGIPAGGLFSGAEEK

SEQ ID NO: 889454 - protein, 25 aa, Mycobacterium
TLAHLLKFDSILGRLPFDVSLEGQD

SEQ ID NO: 889455 - protein, 21 aa, Mycobacterium
TLAHLLKFDSILGRLPHDVSL

SEQ ID NO: 889456 - protein, 17 aa, Mycobacterium
TLALRWLVTFSRARREK

SEQ ID NO: 889457 - protein, 22 aa, Mycobacterium
TLARLLWGLAYQRLPGTLVLID

SEQ ID NO: 889458 - protein, 21 aa, Mycobacterium
TLAVSVPRWLPERLCWLLSDE

SEQ ID NO: 889459 - protein, 30 aa, Mycobacterium
TLDIYRIGQYIAWRLWINIAFDLTSDPQEL

SEQ ID NO: 889460 - protein, 24 aa, Mycobacterium
TLDTLLRLLHPVIPFITEALWQAL

SEQ ID NO: 889461 - protein, 19 aa, Mycobacterium
TLEMPLIDFFSRGGSLKSS

SEQ ID NO: 889462 - protein, 18 aa, Mycobacterium
TLENGLLTGIRKLARPKL

SEQ ID NO: 889463 - protein, 17 aa, Mycobacterium
TLFACYGQTYQTLGIAA

SEQ ID NO: 889464 - protein, 23 aa, Mycobacterium
TLFESLLPRYVTTRVYAALLESA

SEQ ID NO: 889465 - protein, 21 aa, Mycobacterium
TLFEWLTTLYPLWSHLDADLE

SEQ ID NO: 889466 - protein, 25 aa, Mycobacterium
TLFGTWHYWWQAHLLDCLVDAQVRD

SEQ ID NO: 889467 - protein, 19 aa, Mycobacterium
TLFRLLMGLREPAISAVLV

SEQ ID NO: 889468 - protein, 20 aa, Mycobacterium
TLFRMWLRDAVRRVADAALE

SEQ ID NO: 889469 - protein, 20 aa, Mycobacterium
TLFRMWLRDAVRRVATGVLE

SEQ ID NO: 889470 - protein, 18 aa, Mycobacterium
TLGLLAAGADEVSVGIAA

SEQ ID NO: 889471 - protein, 23 aa, Mycobacterium
TLGRVLFNELLPVGYPFVNKQMH

SEQ ID NO: 889472 - protein, 20 aa, Mycobacterium
TLGYPIVPMLTPGSLDFNGV

SEQ ID NO: 889473 - protein, 19 aa, Mycobacterium
TLIQHLIRWVISSQQFESK

SEQ ID NO: 889474 - protein, 19 aa, Mycobacterium
TLKAIRRLGLSIPGDVAFV

SEQ ID NO: 889475 - protein, 25 aa, Mycobacterium
TLLALTRLRELLDRYPLRGIKGPMG

SEQ ID NO: 889476 - protein, 23 aa, Mycobacterium
TLLDLFLRIIVELFRRHWTSTGQ

SEQ ID NO: 889477 - protein, 24 aa, Mycobacterium
TLLEAAILQWYWLKDKFPGDDQWN

SEQ ID NO: 889478 - protein, 18 aa, Mycobacterium
TLLFPFAAPRVVGDLSEA

SEQ ID NO: 889479 - protein, 18 aa, Mycobacterium
TLLIIDLPRPPAPLHLVR

SEQ ID NO: 889480 - protein, 17 aa, Mycobacterium
TLLKLLHPVMPFVTETL

SEQ ID NO: 889481 - protein, 19 aa, Mycobacterium
TLLPSWLTYLPPGTTPQVF

SEQ ID NO: 889482 - protein, 22 aa, Mycobacterium
TLLYPLFNLWGPAYHDKYSNVT

SEQ ID NO: 889483 - protein, 20 aa, Mycobacterium
TLMAFLRRLYALAPRLGHLL

SEQ ID NO: 889484 - protein, 28 aa, Mycobacterium
TLMDTHPFGWLPLLSRVLASAQLVPGAA

SEQ ID NO: 889485 - protein, 26 aa, Mycobacterium
TLMDTHPFTWLPLLSRVLGSAELLPD

SEQ ID NO: 889486 - protein, 26 aa, Mycobacterium
TLNGHHWLKDVYIQDGLLRLGSETVE

SEQ ID NO: 889487 - protein, 28 aa, Mycobacterium
TLPHPLAHLRAFVLIPWLAVDPDARLTV

SEQ ID NO: 889488 - protein, 17 aa, Mycobacterium
TLPIPWVEPIDISNAVL

SEQ ID NO: 889489 - protein, 20 aa, Mycobacterium
TLPRPPLFLMASSAAVYGSR

SEQ ID NO: 889490 - protein, 25 aa, Mycobacterium
TLQGRFLEYLPPPLAPTLFRAQSKR

SEQ ID NO: 889491 - protein, 19 aa, Mycobacterium
TLQSFLPPPLDALPNPFED

SEQ ID NO: 889492 - protein, 23 aa, Mycobacterium
TLSAYLLMQLLEAAGLPPGVINL

SEQ ID NO: 889493 - protein, 17 aa, Mycobacterium
TLSGFWHWAVANLPADV

SEQ ID NO: 889494 - protein, 21 aa, Mycobacterium
TLSPWPTWPLVLRTSPAHAEG

SEQ ID NO: 889495 - protein, 22 aa, Mycobacterium
TLSVFLQLMLFPDTPRSVLRSL

SEQ ID NO: 889496 - protein, 25 aa, Mycobacterium
TLSVTRRRHLLAQFLFRGDAVDLPV

SEQ ID NO: 889497 - protein, 23 aa, Mycobacterium
TLTEFRLFHFLVRHAGQAFTRTR

SEQ ID NO: 889498 - protein, 24 aa, Mycobacterium
TLTLETVPNPILTPGFHGLHIHSV

SEQ ID NO: 889499 - protein, 17 aa, Mycobacterium
TLTVPFVVPLVGVVPQT

SEQ ID NO: 889500 - protein, 21 aa, Mycobacterium
TLVLNAPWWNPALLARDIATT

SEQ ID NO: 889501 - protein, 25 aa, Mycobacterium
TLWAVLARTLPAPWRVEALVLLAFS

SEQ ID NO: 889502 - protein, 18 aa, Mycobacterium
TLYIQLYLGGFGLELSDI

SEQ ID NO: 889503 - protein, 19 aa, Mycobacterium
TLYIQLYLGGFGLELSDIE

SEQ ID NO: 889504 - protein, 20 aa, Mycobacterium
TLYIQLYLGGFGLELSDIES

SEQ ID NO: 889505 - protein, 17 aa, Mycobacterium
TLYRWFSSKQDLLDAFV

SEQ ID NO: 889506 - protein, 18 aa, Mycobacterium
TMDRLFRAVAADVGLAAA

SEQ ID NO: 889507 - protein, 21 aa, Mycobacterium
TMGIPILYPWANRLGANTYTA

SEQ ID NO: 889508 - protein, 20 aa, Mycobacterium
TMKVGLWSVWWGMQTAFPLL

SEQ ID NO: 889509 - protein, 18 aa, Mycobacterium
TMLQVILGLLPVASGSVR

SEQ ID NO: 889510 - protein, 20 aa, Mycobacterium
TMMSPLSFIQRPALWFDVMN

SEQ ID NO: 889511 - protein, 21 aa, Mycobacterium
TMPFAALHFFPARALELGGFQ

SEQ ID NO: 889512 - protein, 18 aa, Mycobacterium
TMPRRAPALTAPLLVIHG

SEQ ID NO: 889513 - protein, 17 aa, Mycobacterium
TMPSYLRYGAYPYIVVV

SEQ ID NO: 889514 - protein, 17 aa, Mycobacterium
TMPYVLALAERGWRAAC

SEQ ID NO: 889515 - protein, 19 aa, Mycobacterium
TNHIPWRRPIASLNYLLSS

SEQ ID NO: 889516 - protein, 23 aa, Mycobacterium
TNHVWAVLGWYGVLKAGLVPVAT

SEQ ID NO: 889517 - protein, 17 aa, Mycobacterium
TNIYFYCVLYHALRASN

SEQ ID NO: 889518 - protein, 24 aa, Mycobacterium
TNLKAWLYRILTNTYINIYRKKQR

SEQ ID NO: 889519 - protein, 24 aa, Mycobacterium
TNLKAWLYRILTNTYINSYRKRQR

SEQ ID NO: 889520 - protein, 23 aa, Mycobacterium
TNLLGPFALTNLLLPRVRSQIIN

SEQ ID NO: 889521 - protein, 25 aa, Mycobacterium
TNLRRLISLFELLRARSQLIIITHQ

SEQ ID NO: 889522 - protein, 20 aa, Mycobacterium
TNNPWIRFHVPRQWPPWRLV

SEQ ID NO: 889523 - protein, 17 aa, Mycobacterium
TNPPVEGAFYWLSNREV

SEQ ID NO: 889524 - protein, 22 aa, Mycobacterium
TNPSPYMYLIQVPNDHGSVEFS

SEQ ID NO: 889525 - protein, 23 aa, Mycobacterium
TNPSPYMYLLNIPDADGGLDFSI

SEQ ID NO: 889526 - protein, 20 aa, Mycobacterium
TNRPAADYLRVGLRRLEYRG

SEQ ID NO: 889527 - protein, 23 aa, Mycobacterium
TNRPPLLKRLVLQTAARLSRRGR

SEQ ID NO: 889528 - protein, 20 aa, Mycobacterium
TPAMWSWWFGWHGCDTRRYK

SEQ ID NO: 889529 - protein, 23 aa, Mycobacterium
TPAQVLLRWNLQLGNAVVFRSAN

SEQ ID NO: 889530 - protein, 23 aa, Mycobacterium
TPAQVLLRWNLQLGNAVVFRSSQ

SEQ ID NO: 889531 - protein, 21 aa, Mycobacterium
TPARRVRYPMWLAAKMSTLAN

SEQ ID NO: 889532 - protein, 25 aa, Mycobacterium
TPEFLRWFLDEIPIEPVWVCPLRLR

SEQ ID NO: 889533 - protein, 17 aa, Mycobacterium
TPEMYRLIGINAGRHAK

SEQ ID NO: 889534 - protein, 20 aa, Mycobacterium
TPFNHPMLILARSLSAALAN

SEQ ID NO: 889535 - protein, 22 aa, Mycobacterium
TPGGMWFTVALAAIANRLGGDF

SEQ ID NO: 889536 - protein, 18 aa, Mycobacterium
TPGLRRLIADLESWLVAI

SEQ ID NO: 889537 - protein, 20 aa, Mycobacterium
TPGQWYLHLFDPAQPDLNWN

SEQ ID NO: 889538 - protein, 22 aa, Mycobacterium
TPGRSWRHRWALSVLHSALGGG

SEQ ID NO: 889539 - protein, 24 aa, Mycobacterium
TPGSAWLLPGLFAPSPELPPPARK

SEQ ID NO: 889540 - protein, 22 aa, Mycobacterium
TPGYGPWLRENLHYSQALRIGD

SEQ ID NO: 889541 - protein, 22 aa, Mycobacterium
TPKPLRGMPPFSGPQGPFAAIT

SEQ ID NO: 889542 - protein, 19 aa, Mycobacterium
TPLFFAQAIGRFVRSRRAG

SEQ ID NO: 889543 - protein, 19 aa, Mycobacterium
TPLFFAQAIGRYVRSRTPG

SEQ ID NO: 889544 - protein, 18 aa, Mycobacterium
TPLFFAQAVGRFVRSRRP

SEQ ID NO: 889545 - protein, 17 aa, Mycobacterium
TPLIWRLDTFWVSMRDQ

SEQ ID NO: 889546 - protein, 18 aa, Mycobacterium
TPLPIQLPEPMAAQLRAA

SEQ ID NO: 889547 - protein, 19 aa, Mycobacterium
TPLTDKVFLKYWKVDPVRG

SEQ ID NO: 889548 - protein, 20 aa, Mycobacterium
TPLTMLLLAKLMADAGLPKG

SEQ ID NO: 889549 - protein, 18 aa, Mycobacterium
TPLVRRLAGFLPADVRVR

SEQ ID NO: 889550 - protein, 24 aa, Mycobacterium
TPMDPALYLLWARANVVAGYRYSV

SEQ ID NO: 889551 - protein, 26 aa, Mycobacterium
TPPPAPFWAARHRLLLGWVKMLDGQL

SEQ ID NO: 889552 - protein, 20 aa, Mycobacterium
TPPYFVLIERALRDEGTSAH

SEQ ID NO: 889553 - protein, 22 aa, Mycobacterium
TPQAFRLWRNLGLRGFTGAGMP

SEQ ID NO: 889554 - protein, 20 aa, Mycobacterium
TPQHWKYLTSGLLGLQHGTD

SEQ ID NO: 889555 - protein, 17 aa, Mycobacterium
TPQPVLPRPMFGAAPAA

SEQ ID NO: 889556 - protein, 20 aa, Mycobacterium
TPRMWDWWFGWHGTDTRRYK

SEQ ID NO: 889557 - protein, 17 aa, Mycobacterium
TPRSRLLALFKSPRPGT

SEQ ID NO: 889558 - protein, 17 aa, Mycobacterium
TPRTLQSFASPSALPAA

SEQ ID NO: 889559 - protein, 22 aa, Mycobacterium
TPSAVVYLIKLGGPLDARKVIS

SEQ ID NO: 889560 - protein, 19 aa, Mycobacterium
TPTQAIFGRPLIGDGANGT

SEQ ID NO: 889561 - protein, 24 aa, Mycobacterium
TPTRWVYYAWRRAVVRVPEPGLFR

SEQ ID NO: 889562 - protein, 20 aa, Mycobacterium
TPVFFIRDPMKFQNFIRSQK

SEQ ID NO: 889563 - protein, 18 aa, Mycobacterium
TPVGLCAKVIRRDPRPHR

SEQ ID NO: 889564 - protein, 22 aa, Mycobacterium
TPVGQLPLTMPLLELGVPPDLV

SEQ ID NO: 889565 - protein, 18 aa, Mycobacterium
TPVLYRPAAIAAAATRGA

SEQ ID NO: 889566 - protein, 19 aa, Mycobacterium
TPWMKWLLRAGPADYALAL

SEQ ID NO: 889567 - protein, 17 aa, Mycobacterium
TPWNFPHQINLAKIGPA

SEQ ID NO: 889568 - protein, 17 aa, Mycobacterium
TPWNYPLYQVVAKVLPA

SEQ ID NO: 889569 - protein, 17 aa, Mycobacterium
TPWVWPTMHLNPPNWIA

SEQ ID NO: 889570 - protein, 21 aa, Mycobacterium
TPYLKLLSQLFGDRLMIANAT

SEQ ID NO: 889571 - protein, 17 aa, Mycobacterium
TPYLKLLSQLFGDRLMV

SEQ ID NO: 889572 - protein, 19 aa, Mycobacterium
TPYPPARLERLWLPGPDRL

SEQ ID NO: 889573 - protein, 29 aa, Mycobacterium
TPYSRMWGAYLSGMWLYRLSFAKAKWHSL

SEQ ID NO: 889574 - protein, 27 aa, Mycobacterium
TPYSRMWGAYLSGMWLYRLSFAKVKWH

SEQ ID NO: 889575 - protein, 17 aa, Mycobacterium
TQALLGRPLIGNGADGS

SEQ ID NO: 889576 - protein, 24 aa, Mycobacterium
TQAQAAFQPYLAWMGTVIAMAQQR

SEQ ID NO: 889577 - protein, 22 aa, Mycobacterium
TQAWDALLPARVFAFTAGASVT

SEQ ID NO: 889578 - protein, 17 aa, Mycobacterium
TQCQPGWLLAPPIAYGA

SEQ ID NO: 889579 - protein, 28 aa, Mycobacterium
TQDLPLDQYWFWNLRNTVRFDKAIAAAV

SEQ ID NO: 889580 - protein, 17 aa, Mycobacterium
TQDWFRFERLMVAARCV

SEQ ID NO: 889581 - protein, 23 aa, Mycobacterium
TQIDRFIGWPRLPKMAGIAVLYT

SEQ ID NO: 889582 - protein, 18 aa, Mycobacterium
TQILAWDLPLTRKIRERA

SEQ ID NO: 889583 - protein, 17 aa, Mycobacterium
TQKFLTRPKLPLMEQLR

SEQ ID NO: 889584 - protein, 18 aa, Mycobacterium
TQLDVSLRRFGIDTTFVG

SEQ ID NO: 889585 - protein, 18 aa, Mycobacterium
TQLELGGKAPFVVFDDAD

SEQ ID NO: 889586 - protein, 18 aa, Mycobacterium
TQLRWRPIDFWPADTTVS

SEQ ID NO: 889587 - protein, 22 aa, Mycobacterium
TQLRWRPLSFWPAHTAVTVDAG

SEQ ID NO: 889588 - protein, 19 aa, Mycobacterium
TQMPLLLDEYTRNAATGSF

SEQ ID NO: 889589 - protein, 23 aa, Mycobacterium
TQNKIFIVPLGVKRLLLGGLVEP

SEQ ID NO: 889590 - protein, 18 aa, Mycobacterium
TQPLIRLPLSTEALSRRL

SEQ ID NO: 889591 - protein, 24 aa, Mycobacterium
TQRFVRALLTGYLLYTLGGDKAYR

SEQ ID NO: 889592 - protein, 20 aa, Mycobacterium
TQRYFLVSYPRKMDALTRLL

SEQ ID NO: 889593 - protein, 21 aa, Mycobacterium
TQVLVDLLWGLAVDAGFYSDQ

SEQ ID NO: 889594 - protein, 21 aa, Mycobacterium
TQWDALCHFFWRGKMYNGHRV

SEQ ID NO: 889595 - protein, 21 aa, Mycobacterium
TRAALYFYFGSKQEVLTALVA

SEQ ID NO: 889596 - protein, 23 aa, Mycobacterium
TRADLLIGAVLLPGGKAPELVSN

SEQ ID NO: 889597 - protein, 24 aa, Mycobacterium
TRDKLIVLLMARGGLRRGEVCGLR

SEQ ID NO: 889598 - protein, 19 aa, Mycobacterium
TRDLMLVSPIILYDHPQIA

SEQ ID NO: 889599 - protein, 24 aa, Mycobacterium
TRDRLDWTILRPGLLTDTAPTGSV

SEQ ID NO: 889600 - protein, 17 aa, Mycobacterium
TRDWFLSWLGRAYPELV

SEQ ID NO: 889601 - protein, 17 aa, Mycobacterium
TRFRTLYPNVYVPKTSE

SEQ ID NO: 889602 - protein, 21 aa, Mycobacterium
TRGLFRRVILHSAPLGLAYQA

SEQ ID NO: 889603 - protein, 21 aa, Mycobacterium
TRGSFYWHFTDMKAYRAALVA

SEQ ID NO: 889604 - protein, 26 aa, Mycobacterium
TRHLPYYGRWLRFVSWWPIADALDEQ

SEQ ID NO: 889605 - protein, 17 aa, Mycobacterium
TRHPYGLALWQNQIERI

SEQ ID NO: 889606 - protein, 18 aa, Mycobacterium
TRLIELFDLFDPADPAVI

SEQ ID NO: 889607 - protein, 18 aa, Mycobacterium
TRLIELFELFDPADPEVI

SEQ ID NO: 889608 - protein, 21 aa, Mycobacterium
TRLLEFVLSLLKDYGLDDYYL

SEQ ID NO: 889609 - protein, 24 aa, Mycobacterium
TRLLGPAYRLFYERPVHLVRGRGS

SEQ ID NO: 889610 - protein, 24 aa, Mycobacterium
TRLRDLLKFDFYFADSATFRDHIA

SEQ ID NO: 889611 - protein, 26 aa, Mycobacterium
TRLTMHALLLDLWRRHGFGVLLITHD

SEQ ID NO: 889612 - protein, 20 aa, Mycobacterium
TRLVSLVLTNLFGQHAPAIA

SEQ ID NO: 889613 - protein, 18 aa, Mycobacterium
TRMMRRAYDKWWAAELEA

SEQ ID NO: 889614 - protein, 22 aa, Mycobacterium
TRNVWGGIWTRPGLDRRSRSLI

SEQ ID NO: 889615 - protein, 19 aa, Mycobacterium
TRQPSLNVLLWQRALEPER

SEQ ID NO: 889616 - protein, 24 aa, Mycobacterium
TRQRAAITALLKRTDEFKSAQDLH

SEQ ID NO: 889617 - protein, 22 aa, Mycobacterium
TRRAIIKLLLEGPITAGQIGER

SEQ ID NO: 889618 - protein, 18 aa, Mycobacterium
TRREVPFVLVNRSVADYP

SEQ ID NO: 889619 - protein, 19 aa, Mycobacterium
TRRLLRHYVMLALTAMPEA

SEQ ID NO: 889620 - protein, 23 aa, Mycobacterium
TRRWAGVPFFLRTGKRLARRVTE

SEQ ID NO: 889621 - protein, 26 aa, Mycobacterium
TRSTAPPRILWLDPATAGQLIFEVRA

SEQ ID NO: 889622 - protein, 17 aa, Mycobacterium
TRTFFRYFADKQAVVFA

SEQ ID NO: 889623 - protein, 25 aa, Mycobacterium
TRVRRAFWLLERFAPALGSRWATEL

SEQ ID NO: 889624 - protein, 19 aa, Mycobacterium
TRWRRPVIGMPATPRFLGH

SEQ ID NO: 889625 - protein, 22 aa, Mycobacterium
TRYHSLTILPESLPPVLEVTAH

SEQ ID NO: 889626 - protein, 18 aa, Mycobacterium
TSAHWHVRRWPHVPILLV

SEQ ID NO: 889627 - protein, 23 aa, Mycobacterium
TSAPFSEIWYLLTGQTTLPTSLG

SEQ ID NO: 889628 - protein, 23 aa, Mycobacterium
TSDLLLALWHRVPLSRLAVDGDA

SEQ ID NO: 889629 - protein, 20 aa, Mycobacterium
TSFVWLHRGLFRDALPGATR

SEQ ID NO: 889630 - protein, 24 aa, Mycobacterium
TSGALPVMVWIPGGAFVYGAGQLQ

SEQ ID NO: 889631 - protein, 22 aa, Mycobacterium
TSGLAFMPSALTPTYCASKAAL

SEQ ID NO: 889632 - protein, 21 aa, Mycobacterium
TSGLTLFVVPFDPAAPAQGIE

SEQ ID NO: 889633 - protein, 21 aa, Mycobacterium
TSGVLWGALLTALGARLGDTG

SEQ ID NO: 889634 - protein, 18 aa, Mycobacterium
TSHWLTIPALKAFGAIPV

SEQ ID NO: 889635 - protein, 26 aa, Mycobacterium
TSLGAAAVDLSGTSCGLICNGQDGTG

SEQ ID NO: 889636 - protein, 18 aa, Mycobacterium
TSLKIPFFTDGVPPFFLT

SEQ ID NO: 889637 - protein, 24 aa, Mycobacterium
TSLQLLLTFPFPNFGIKQSVRGDY

SEQ ID NO: 889638 - protein, 28 aa, Mycobacterium
TSNPGWLQWLIDWYMPISQLIYNTVGLP

SEQ ID NO: 889639 - protein, 17 aa, Mycobacterium
TSPASPTRFASRYRVGA

SEQ ID NO: 889640 - protein, 21 aa, Mycobacterium
TSPEYLWRNPAFPTAVELTRL

SEQ ID NO: 889641 - protein, 26 aa, Mycobacterium
TSQGIGFIPWFPLAAGPLAAADGPLQ

SEQ ID NO: 889642 - protein, 21 aa, Mycobacterium
TSRHRLLQGWAYMQDGQLAAA

SEQ ID NO: 889643 - protein, 17 aa, Mycobacterium
TSSAVVVPYFWSDQYDV

SEQ ID NO: 889644 - protein, 17 aa, Mycobacterium
TSTFEPLIAIRPGYWRP

SEQ ID NO: 889645 - protein, 18 aa, Mycobacterium
TSWEVFARRLPAGRRYGV

SEQ ID NO: 889646 - protein, 25 aa, Mycobacterium
TSYALFLLYMLFETPAGRALLGPAA

SEQ ID NO: 889647 - protein, 18 aa, Mycobacterium
TTAAAILGLLPPGGRMTG

SEQ ID NO: 889648 - protein, 24 aa, Mycobacterium
TTDGLTAWLLLSCEALHAGAREAL

SEQ ID NO: 889649 - protein, 21 aa, Mycobacterium
TTDPVLAWLYVLDAWEGGIPS

SEQ ID NO: 889650 - protein, 20 aa, Mycobacterium
TTELFLERLGLTSLTDLPDI

SEQ ID NO: 889651 - protein, 17 aa, Mycobacterium
TTETMLPFCWRGVSLHA

SEQ ID NO: 889652 - protein, 17 aa, Mycobacterium
TTFSFGIANPGFWNVGS

SEQ ID NO: 889653 - protein, 18 aa, Mycobacterium
TTGPWEPWLHALPVEFAS

SEQ ID NO: 889654 - protein, 40 aa, Mycobacterium
TTGTSPLQLAINAVSAPAQSLLARPIIGNGANATTPGGNG

SEQ ID NO: 889655 - protein, 23 aa, Mycobacterium
TTIWVLRGHAFLGYWRTDSALST

SEQ ID NO: 889656 - protein, 17 aa, Mycobacterium
TTKVSFLPPPYFQAETI

SEQ ID NO: 889657 - protein, 21 aa, Mycobacterium
TTLELIMTGPLAWLAGRTAGS

SEQ ID NO: 889658 - protein, 24 aa, Mycobacterium
TTLFESLLPRYLTTRVYAALLESA

SEQ ID NO: 889659 - protein, 24 aa, Mycobacterium
TTLFESLLPRYLTTRVYAAMLESA

SEQ ID NO: 889660 - protein, 21 aa, Mycobacterium
TTLLNAFTWVLYGQFTKDFEK

SEQ ID NO: 889661 - protein, 23 aa, Mycobacterium
TTLNLPMDGILVPAGPYTATIPD

SEQ ID NO: 889662 - protein, 23 aa, Mycobacterium
TTLRFNFFVLKLPVRPPALVAKQ

SEQ ID NO: 889663 - protein, 17 aa, Mycobacterium
TTMKPYLAPPLPGAQPA

SEQ ID NO: 889664 - protein, 19 aa, Mycobacterium
TTNPPVEGAFYWLNNREVR

SEQ ID NO: 889665 - protein, 24 aa, Mycobacterium
TTNPPVEGAFYWLNNREVRWRPES

SEQ ID NO: 889666 - protein, 19 aa, Mycobacterium
TTPIRWLIEQRIQASLALL

SEQ ID NO: 889667 - protein, 22 aa, Mycobacterium
TTPLFYGWWIAGAKYLMAHDPT

SEQ ID NO: 889668 - protein, 17 aa, Mycobacterium
TTPLRLFWARDYSDYHP

SEQ ID NO: 889669 - protein, 30 aa, Mycobacterium
TTPLRRLALGHWLRRWWPASQRDGIAGLDR

SEQ ID NO: 889670 - protein, 24 aa, Mycobacterium
TTPWRLYPLVPSRFLRGIYWAMAS

SEQ ID NO: 889671 - protein, 19 aa, Mycobacterium
TTQLPLKPSLAHKPTPQTK

SEQ ID NO: 889672 - protein, 19 aa, Mycobacterium
TTRLEFYFRRWKAPALVSE

SEQ ID NO: 889673 - protein, 21 aa, Mycobacterium
TTTEHRLKWRPWLKNPADATE

SEQ ID NO: 889674 - protein, 23 aa, Mycobacterium
TTTGWMMWNYLVGGLLVGATIVL

SEQ ID NO: 889675 - protein, 25 aa, Mycobacterium
TTTLNFNFFVLKLPIRPPALVAKQA

SEQ ID NO: 889676 - protein, 26 aa, Mycobacterium
TTTYYMIPTQNLPLLEPLRALPLGNT

SEQ ID NO: 889677 - protein, 20 aa, Mycobacterium
TTVMPFILRGVALLGMDSVL

SEQ ID NO: 889678 - protein, 18 aa, Mycobacterium
TVAAWPRLVRRLPVLGPW

SEQ ID NO: 889679 - protein, 17 aa, Mycobacterium
TVALRRHVVLNATWMET

SEQ ID NO: 889680 - protein, 23 aa, Mycobacterium
TVARWLVLYLRRPGGQTQFAAPV

SEQ ID NO: 889681 - protein, 27 aa, Mycobacterium
TVDRVAFHWWLVLATLRWGVICRFQAE

SEQ ID NO: 889682 - protein, 23 aa, Mycobacterium
TVEGLILGSYRFTAFRSAKTAPK

SEQ ID NO: 889683 - protein, 21 aa, Mycobacterium
TVEHYLRIPFALTKSAVPHMR

SEQ ID NO: 889684 - protein, 23 aa, Mycobacterium
TVEVPLLWRKRLLRKAIDFADPL

SEQ ID NO: 889685 - protein, 17 aa, Mycobacterium
TVFFERFPLTANGKLDR

SEQ ID NO: 889686 - protein, 17 aa, Mycobacterium
TVFPGHWYSAEPSAPLS

SEQ ID NO: 889687 - protein, 17 aa, Mycobacterium
TVFQCPFCHAWELRDQR

SEQ ID NO: 889688 - protein, 26 aa, Mycobacterium
TVFQRTPIWCFPKFDVPLSRTARAMM

SEQ ID NO: 889689 - protein, 22 aa, Mycobacterium
TVGARLLLLRRLAHPEDTRLGP

SEQ ID NO: 889690 - protein, 25 aa, Mycobacterium
TVGARMMLLRRLAFPDDARLGEPLR

SEQ ID NO: 889691 - protein, 17 aa, Mycobacterium
TVGKYAESLLTLGWAEE

SEQ ID NO: 889692 - protein, 22 aa, Mycobacterium
TVGLFTYPVLMAADILLYQTNV

SEQ ID NO: 889693 - protein, 22 aa, Mycobacterium
TVGNRIIWFFKPAPLPDKMVNH

SEQ ID NO: 889694 - protein, 24 aa, Mycobacterium
TVGPALLLPLRAPDAVPGVLIVLR

SEQ ID NO: 889695 - protein, 19 aa, Mycobacterium
TVGSYAPKLPWPWGLVDFA

SEQ ID NO: 889696 - protein, 23 aa, Mycobacterium
TVGWRLWMDIGFKLASDPDELRE

SEQ ID NO: 889697 - protein, 22 aa, Mycobacterium
TVIGIDLLYLGPITIPQINITG

SEQ ID NO: 889698 - protein, 18 aa, Mycobacterium
TVIWRKLVLNALAGLMAL

SEQ ID NO: 889699 - protein, 23 aa, Mycobacterium
TVLRLDWLLAIPDEDWQPVAPAS

SEQ ID NO: 889700 - protein, 18 aa, Mycobacterium
TVMEGFHYLFHPVTQRAL

SEQ ID NO: 889701 - protein, 19 aa, Mycobacterium
TVMPFILRGVALLGIDSVQ

SEQ ID NO: 889702 - protein, 19 aa, Mycobacterium
TVMPFILRGVALLGMESVL

SEQ ID NO: 889703 - protein, 17 aa, Mycobacterium
TVMSPAAFIRRPLRWLR

SEQ ID NO: 889704 - protein, 22 aa, Mycobacterium
TVPLGMIILRKAYGLGAMAMAG

SEQ ID NO: 889705 - protein, 22 aa, Mycobacterium
TVPLGMIILRKGYGLGAMAMAG

SEQ ID NO: 889706 - protein, 17 aa, Mycobacterium
TVPPLPGFNAALRRITA

SEQ ID NO: 889707 - protein, 17 aa, Mycobacterium
TVPPPVIAANRALLATL

SEQ ID NO: 889708 - protein, 21 aa, Mycobacterium
TVPPRWLFLRIETDEGLVGWG

SEQ ID NO: 889709 - protein, 24 aa, Mycobacterium
TVPQPTEFWIPPGATLRIIGPGDK

SEQ ID NO: 889710 - protein, 26 aa, Mycobacterium
TVPVQRPILAPIYLPDIRVACTPYKG

SEQ ID NO: 889711 - protein, 17 aa, Mycobacterium
TVQNWPLVIGALLPENA

SEQ ID NO: 889712 - protein, 17 aa, Mycobacterium
TVRYRRLTPLGRLHSEA

SEQ ID NO: 889713 - protein, 24 aa, Mycobacterium
TVSEGNFRCRVGHAWTADALLRAR

SEQ ID NO: 889714 - protein, 19 aa, Mycobacterium
TVTWFLPYFQEVVSGPTVG

SEQ ID NO: 889715 - protein, 25 aa, Mycobacterium
TVVAGTVALWLWIPAKTTPTVAVLM

SEQ ID NO: 889716 - protein, 23 aa, Mycobacterium
TVVARFLPYPFTAGSLVIEHPAG

SEQ ID NO: 889717 - protein, 25 aa, Mycobacterium
TVVKQLLGVYIWYGDMAALLMTVKK

SEQ ID NO: 889718 - protein, 18 aa, Mycobacterium
TVVLHRFLRWRQPGYDPA

SEQ ID NO: 889719 - protein, 29 aa, Mycobacterium
TVVLKVLRFLGTLPILEPLLPLPGAAQHV

SEQ ID NO: 889720 - protein, 20 aa, Mycobacterium
TVVPYYPYFSFVQRPFEMSV

SEQ ID NO: 889721 - protein, 23 aa, Mycobacterium
TVVRSWLQQLLAKALKEDPDLSE

SEQ ID NO: 889722 - protein, 17 aa, Mycobacterium
TVVWLPRFFTESAMEDL

SEQ ID NO: 889723 - protein, 17 aa, Mycobacterium
TVWIAQDGSHRLVRANV

SEQ ID NO: 889724 - protein, 21 aa, Mycobacterium
TVYAAPLMLPLGKGLVVFTSS

SEQ ID NO: 889725 - protein, 18 aa, Mycobacterium
TVYKEYLMKALPAMATAV

SEQ ID NO: 889726 - protein, 19 aa, Mycobacterium
TVYYWAFGGWLRKRRNIRD

SEQ ID NO: 889727 - protein, 23 aa, Mycobacterium
TWADLPWLRSLTKLPLILKGICH

SEQ ID NO: 889728 - protein, 21 aa, Mycobacterium
TWAEALWRFSLAPLQHACAFY

SEQ ID NO: 889729 - protein, 19 aa, Mycobacterium
TWALLTRPIALMTILANVV

SEQ ID NO: 889730 - protein, 21 aa, Mycobacterium
TWANPWPMYRALRDHDPVHHV

SEQ ID NO: 889731 - protein, 20 aa, Mycobacterium
TWEHPCHLYVRRARSGLQLF

SEQ ID NO: 889732 - protein, 24 aa, Mycobacterium
TWHGRSPRLWLITGGGLAVHDGEP

SEQ ID NO: 889733 - protein, 23 aa, Mycobacterium
TWKMDIHPWWVAFTQGAGVTTLA

SEQ ID NO: 889734 - protein, 19 aa, Mycobacterium
TWLLPRLVGLARARRMLLL

SEQ ID NO: 889735 - protein, 18 aa, Mycobacterium
TWLPLLRSGPDGQAESLI

SEQ ID NO: 889736 - protein, 17 aa, Mycobacterium
TWRGLARVMSESPARIV

SEQ ID NO: 889737 - protein, 24 aa, Mycobacterium
TYAGPKYIWALELAPIVAGTELTP

SEQ ID NO: 889738 - protein, 17 aa, Mycobacterium
TYATWWIRQAITRAMAD

SEQ ID NO: 889739 - protein, 17 aa, Mycobacterium
TYFYVLLADGTLRVGGM

SEQ ID NO: 889740 - protein, 17 aa, Mycobacterium
TYKWETFLTSELPQYLA

SEQ ID NO: 889741 - protein, 25 aa, Mycobacterium
TYQSTLRLLHYYAFPAELVGRDDVW

SEQ ID NO: 889742 - protein, 20 aa, Mycobacterium
TYRAVLAMLLLTGSMGRNGG

SEQ ID NO: 889743 - protein, 19 aa, Mycobacterium
TYRFWAERLGIQVDSLSAS

SEQ ID NO: 889744 - protein, 20 aa, Mycobacterium
TYYMIPTEHLPLLAPLRFIP

SEQ ID NO: 889745 - protein, 19 aa, Mycobacterium
VAAARPYIAWLSGASALAE

SEQ ID NO: 889746 - protein, 24 aa, Mycobacterium
VAADRPWRFWLPGYPEVSAYRRSP

SEQ ID NO: 889747 - protein, 21 aa, Mycobacterium
VAAHAPYLAWLTRASADSAAA

SEQ ID NO: 889748 - protein, 23 aa, Mycobacterium
VAAKEPWFLDAYRRAWDWADSVG

SEQ ID NO: 889749 - protein, 25 aa, Mycobacterium
VAALQLGWRWLPRRLTLEPLAYNRY

SEQ ID NO: 889750 - protein, 20 aa, Mycobacterium
VAALRFFWPRLTPGAFVLLD

SEQ ID NO: 889751 - protein, 17 aa, Mycobacterium
VAALRWWMDTHRYAAVA

SEQ ID NO: 889752 - protein, 30 aa, Mycobacterium
VAANRSAFLKLVQSNWLGLNAPAIMATEGH

SEQ ID NO: 889753 - protein, 28 aa, Mycobacterium
VAAPVMIWSIAHAAWPLGRFWPVVSRPR

SEQ ID NO: 889754 - protein, 18 aa, Mycobacterium
VAASLRYVAAWNSAFLPS

SEQ ID NO: 889755 - protein, 19 aa, Mycobacterium
VAAVYLRFLRDLPLHTDVN

SEQ ID NO: 889756 - protein, 18 aa, Mycobacterium
VACTPWYEPFGIVPLEAM

SEQ ID NO: 889757 - protein, 17 aa, Mycobacterium
VADGLWYPLWDANVRLD

SEQ ID NO: 889758 - protein, 25 aa, Mycobacterium
VADRPKLAWFLLQAVRYTPHQLFAE

SEQ ID NO: 889759 - protein, 22 aa, Mycobacterium
VADVWRLFDSLHLALRVVIAGQ

SEQ ID NO: 889760 - protein, 22 aa, Mycobacterium
VAEDWLTGVWAFIQGVKSHALV

SEQ ID NO: 889761 - protein, 25 aa, Mycobacterium
VAEIELLPVIKFFPASDVLALYRLG

SEQ ID NO: 889762 - protein, 17 aa, Mycobacterium
VAELLFDVLGPTALDSG

SEQ ID NO: 889763 - protein, 17 aa, Mycobacterium
VAELLVWDRAVRADVDD

SEQ ID NO: 889764 - protein, 23 aa, Mycobacterium
VAELRRMFGIPDYFIRVQTADLA

SEQ ID NO: 889765 - protein, 23 aa, Mycobacterium
VAEPLWIPTPVDPRLRRACALIA

SEQ ID NO: 889766 - protein, 24 aa, Mycobacterium
VAERTYVLLTFISGLLLALSRGDR

SEQ ID NO: 889767 - protein, 20 aa, Mycobacterium
VAEWLIRWLRETGVSVLLMD

SEQ ID NO: 889768 - protein, 19 aa, Mycobacterium
VAFLTAWYGLSDLAGVRSG

SEQ ID NO: 889769 - protein, 17 aa, Mycobacterium
VAGRLAAAGWPLAGIEV

SEQ ID NO: 889770 - protein, 19 aa, Mycobacterium
VAGWFQFQPLWDDVIRTAP

SEQ ID NO: 889771 - protein, 25 aa, Mycobacterium
VAHAQWLLNRLAPTGLNRLASRFLA

SEQ ID NO: 889772 - protein, 24 aa, Mycobacterium
VAHVYLRRALTSTELWPVALKEID

SEQ ID NO: 889773 - protein, 32 aa, Mycobacterium
VAIISPFNFPAMVPLWFIPVALAAGNTVVLKP

SEQ ID NO: 889774 - protein, 17 aa, Mycobacterium
VAKRLMHVLGTSAYVPE

SEQ ID NO: 889775 - protein, 21 aa, Mycobacterium
VAKWWIPERWAFIAEVPRTSV

SEQ ID NO: 889776 - protein, 17 aa, Mycobacterium
VALAWLISLPGVVAIPG

SEQ ID NO: 889777 - protein, 18 aa, Mycobacterium
VALHRVRFQLGDSALPVA

SEQ ID NO: 889778 - protein, 20 aa, Mycobacterium
VALLGRFLLPLDIARRRLAG

SEQ ID NO: 889779 - protein, 17 aa, Mycobacterium
VALMLAVHPLCPLSARQ

SEQ ID NO: 889780 - protein, 19 aa, Mycobacterium
VALPALPHLSVPAISIPGI

SEQ ID NO: 889781 - protein, 22 aa, Mycobacterium
VALPGMLHLAILRSPYAHARIA

SEQ ID NO: 889782 - protein, 23 aa, Mycobacterium
VALPGMLHLAILRSPYAHARIVS

SEQ ID NO: 889783 - protein, 20 aa, Mycobacterium
VALTPIMRWFNSVASLVAGL

SEQ ID NO: 889784 - protein, 24 aa, Mycobacterium
VALTSRFPIVLWLDPTELFLMYND

SEQ ID NO: 889785 - protein, 23 aa, Mycobacterium
VAMDWYTRCITALRLTPVSTKAV

SEQ ID NO: 889786 - protein, 20 aa, Mycobacterium
VAMLVAIFRARPSPFYIMDE

SEQ ID NO: 889787 - protein, 19 aa, Mycobacterium
VANALYWIEQFHIDGLRVD

SEQ ID NO: 889788 - protein, 20 aa, Mycobacterium
VAPDAFFQFPTSKYGLALDN

SEQ ID NO: 889789 - protein, 24 aa, Mycobacterium
VAPDKPFFLYFAPGATHSPHHVPK

SEQ ID NO: 889790 - protein, 17 aa, Mycobacterium
VAPEAFFQFPTSKYGLA

SEQ ID NO: 889791 - protein, 21 aa, Mycobacterium
VAPEAFFQFPTSKYGLALDNW

SEQ ID NO: 889792 - protein, 22 aa, Mycobacterium
VAPGLYSWLPLGLRVLRRIERI

SEQ ID NO: 889793 - protein, 17 aa, Mycobacterium
VAPHRYFPRLRLELDKG

SEQ ID NO: 889794 - protein, 21 aa, Mycobacterium
VAPVYLYRFDFATPLLRVARL

SEQ ID NO: 889795 - protein, 26 aa, Mycobacterium
VAPVYLYRFDYSTPLLKLLLVNAAHA

SEQ ID NO: 889796 - protein, 25 aa, Mycobacterium
VAPVYLYRFDYSTPLLKLLLVRAAH

SEQ ID NO: 889797 - protein, 25 aa, Mycobacterium
VAPVYLYRFDYSTPLLKVLLVRAAH

SEQ ID NO: 889798 - protein, 26 aa, Mycobacterium
VAPWNYPMMMAVWKFAPALAAGCTVV

SEQ ID NO: 889799 - protein, 24 aa, Mycobacterium
VAQIRLYRPFPAEALLAALPPTVR

SEQ ID NO: 889800 - protein, 17 aa, Mycobacterium
VAQLTKPVRWDLCTATL

SEQ ID NO: 889801 - protein, 23 aa, Mycobacterium
VARGWRTPLRFLFIDGGHTEDAA

SEQ ID NO: 889802 - protein, 22 aa, Mycobacterium
VARLRALVRRGVPQRPAVLTAG

SEQ ID NO: 889803 - protein, 18 aa, Mycobacterium
VARLWPFADLTPFAAFGW

SEQ ID NO: 889804 - protein, 20 aa, Mycobacterium
VARPDLVIGWWAAPTILEHG

SEQ ID NO: 889805 - protein, 29 aa, Mycobacterium
VARQILASSYIWFFLCPVAPEIAIRSRAQ

SEQ ID NO: 889806 - protein, 23 aa, Mycobacterium
VARSGFYFYFDSKYAVLAVIIAE

SEQ ID NO: 889807 - protein, 19 aa, Mycobacterium
VARTRLTLATPGMGAIFAA

SEQ ID NO: 889808 - protein, 17 aa, Mycobacterium
VARWIRRFAGHAVSPEK

SEQ ID NO: 889809 - protein, 21 aa, Mycobacterium
VARWLVLYLRRPGGQTQFAAP

SEQ ID NO: 889810 - protein, 19 aa, Mycobacterium
VARYVAELLVWDRAVRADV

SEQ ID NO: 889811 - protein, 23 aa, Mycobacterium
VASALDWLLYDWLMAHRTDPDSA

SEQ ID NO: 889812 - protein, 18 aa, Mycobacterium
VASLLDWPMARWIEFFDA

SEQ ID NO: 889813 - protein, 24 aa, Mycobacterium
VASQTIGFALMRYVWRIEPVASMR

SEQ ID NO: 889814 - protein, 17 aa, Mycobacterium
VATIAWLGYEPPGTDIS

SEQ ID NO: 889815 - protein, 18 aa, Mycobacterium
VATLRYFWPRLSPGAFVL

SEQ ID NO: 889816 - protein, 19 aa, Mycobacterium
VATPIMRWLQSIEGPIEQF

SEQ ID NO: 889817 - protein, 19 aa, Mycobacterium
VATPIMRWLQTVDGPIDDF

SEQ ID NO: 889818 - protein, 22 aa, Mycobacterium
VATSIWPHGRWRLAFRGEANHA

SEQ ID NO: 889819 - protein, 17 aa, Mycobacterium
VATWLQTMFAIVPLAVG

SEQ ID NO: 889820 - protein, 19 aa, Mycobacterium
VAVGTLYRYFPSKVHLLVS

SEQ ID NO: 889821 - protein, 22 aa, Mycobacterium
VAVKEPWFLDAYRRAWEWADAT

SEQ ID NO: 889822 - protein, 20 aa, Mycobacterium
VAVLKILALQFIMSDPRHLE

SEQ ID NO: 889823 - protein, 23 aa, Mycobacterium
VAVPALLHLLAEFPSIRTVMVMV

SEQ ID NO: 889824 - protein, 19 aa, Mycobacterium
VAVPRPLWAFRISGAQASV

SEQ ID NO: 889825 - protein, 22 aa, Mycobacterium
VAWNVPFFLAANKLGPALLAGC

SEQ ID NO: 889826 - protein, 18 aa, Mycobacterium
VAYLLPFIEAEKAQSGST

SEQ ID NO: 889827 - protein, 24 aa, Mycobacterium
VCAQILPWNYPLASAISKLAPALA

SEQ ID NO: 889828 - protein, 19 aa, Mycobacterium
VCESFAIPWLVIRALSDLA

SEQ ID NO: 889829 - protein, 17 aa, Mycobacterium
VCFPERWLDLRYVGPAR

SEQ ID NO: 889830 - protein, 21 aa, Mycobacterium
VCGYRRFFSITSLAGIRQEDR

SEQ ID NO: 889831 - protein, 18 aa, Mycobacterium
VCLDLDWRPAWRVAAIPS

SEQ ID NO: 889832 - protein, 18 aa, Mycobacterium
VCPLPLRETKRIVMGHGG

SEQ ID NO: 889833 - protein, 23 aa, Mycobacterium
VCQDFVHLTLILLRSMGIPGRYV

SEQ ID NO: 889834 - protein, 22 aa, Mycobacterium
VCQDFVHLTLMLLRGMGIPAHY

SEQ ID NO: 889835 - protein, 31 aa, Mycobacterium
VCVAIVPWNFPLLLGIWKIGPALAAGNSVVI

SEQ ID NO: 889836 - protein, 30 aa, Mycobacterium
VCVLIAPWNYPLLQMSWKVAPALAAGCTMV

SEQ ID NO: 889837 - protein, 24 aa, Mycobacterium
VDAATWIIVQLLGSTIRYVVDEPP

SEQ ID NO: 889838 - protein, 21 aa, Mycobacterium
VDASLIHLIGFAPDGRIASLR

SEQ ID NO: 889839 - protein, 25 aa, Mycobacterium
VDDDLAELFLPRPLRWLVSATRPTT

SEQ ID NO: 889840 - protein, 23 aa, Mycobacterium
VDDELRWMWLTSQAALHLWDDAH

SEQ ID NO: 889841 - protein, 18 aa, Mycobacterium
VDDFVLYWGFLALAQVRG

SEQ ID NO: 889842 - protein, 21 aa, Mycobacterium
VDDFVLYWGFLALAQVRGGRH

SEQ ID NO: 889843 - protein, 17 aa, Mycobacterium
VDDFYRRLIADPALTHF

SEQ ID NO: 889844 - protein, 17 aa, Mycobacterium
VDDLNVIALRYLPDDRL

SEQ ID NO: 889845 - protein, 25 aa, Mycobacterium
VDDPLAMYLFDLCTLPLNLAGHCGM

SEQ ID NO: 889846 - protein, 23 aa, Mycobacterium
VDDPLRIVLVAPPYFDIPPKGYG

SEQ ID NO: 889847 - protein, 17 aa, Mycobacterium
VDEHLIGFPPQFSLRRI

SEQ ID NO: 889848 - protein, 21 aa, Mycobacterium
VDELLRSFLDWLFARYREIVD

SEQ ID NO: 889849 - protein, 21 aa, Mycobacterium
VDFLLLDGWKDLYLPVIELLE

SEQ ID NO: 889850 - protein, 18 aa, Mycobacterium
VDFWAPWCGPCRAFAPTF

SEQ ID NO: 889851 - protein, 19 aa, Mycobacterium
VDFWASWCGPCRAFGPVYE

SEQ ID NO: 889852 - protein, 24 aa, Mycobacterium
VDGPAVSCPLLVWVKTRDPKAYAG

SEQ ID NO: 889853 - protein, 23 aa, Mycobacterium
VDGPYSWWSWRGKAFDNDAGWRI

SEQ ID NO: 889854 - protein, 25 aa, Mycobacterium
VDGSLFVRPFLKYQIITVVAPNSPL

SEQ ID NO: 889855 - protein, 19 aa, Mycobacterium
VDGSWRGPASAAMAAAAAP

SEQ ID NO: 889856 - protein, 22 aa, Mycobacterium
VDGVSWRILLEDFNIAWAQHHN

SEQ ID NO: 889857 - protein, 22 aa, Mycobacterium
VDGVSWRILLEDFNIAWAQHHS

SEQ ID NO: 889858 - protein, 22 aa, Mycobacterium
VDGVSWRILLEDLNIAWAQHHG

SEQ ID NO: 889859 - protein, 22 aa, Mycobacterium
VDGVSWRILLEDLNIAWAQHHS

SEQ ID NO: 889860 - protein, 22 aa, Mycobacterium
VDGVSWRILLEDLNIAWAQHRA

SEQ ID NO: 889861 - protein, 22 aa, Mycobacterium
VDGVSWRILLEDLNIAWAQHRG

SEQ ID NO: 889862 - protein, 22 aa, Mycobacterium
VDGVSWRILLEDLNIAWAQQQS

SEQ ID NO: 889863 - protein, 28 aa, Mycobacterium
VDIRALYLFKRTLWWPYSVAMRVANYAF

SEQ ID NO: 889864 - protein, 23 aa, Mycobacterium
VDLGYFLFFDRVYSAGIGLPRLE

SEQ ID NO: 889865 - protein, 17 aa, Mycobacterium
VDLLCAFVKWQGLRLLE

SEQ ID NO: 889866 - protein, 17 aa, Mycobacterium
VDLVAMFRPITRWADGV

SEQ ID NO: 889867 - protein, 17 aa, Mycobacterium
VDPLFMRILRNSQLLDV

SEQ ID NO: 889868 - protein, 27 aa, Mycobacterium
VDPNGPFFLVPWTWRQHLWPTEKFELA

SEQ ID NO: 889869 - protein, 18 aa, Mycobacterium
VDPSWFNWPALPVAMADT

SEQ ID NO: 889870 - protein, 24 aa, Mycobacterium
VDQPLIPAPLPFRFPFPSFATCIA

SEQ ID NO: 889871 - protein, 25 aa, Mycobacterium
VDRAAFRWWLVLATLRWGVICRYQA

SEQ ID NO: 889872 - protein, 25 aa, Mycobacterium
VDRGAFHWWLVLATLRWGVICQYQA

SEQ ID NO: 889873 - protein, 17 aa, Mycobacterium
VDRIWFAPNVWPREVPE

SEQ ID NO: 889874 - protein, 26 aa, Mycobacterium
VDRVKTWLQFPQWFYLNIPVNTMVAP

SEQ ID NO: 889875 - protein, 23 aa, Mycobacterium
VDSNYLHIDAWLRAFATAGIDVE

SEQ ID NO: 889876 - protein, 19 aa, Mycobacterium
VDSPVGLLAWILDKFADWS

SEQ ID NO: 889877 - protein, 26 aa, Mycobacterium
VDVEFSPFFNALPIRRLGLHEQAASV

SEQ ID NO: 889878 - protein, 25 aa, Mycobacterium
VDVKFNLFLFTMLQKTLKGNIFGGG

SEQ ID NO: 889879 - protein, 20 aa, Mycobacterium
VDWFSVDWHRAIVDKWRAAG

SEQ ID NO: 889880 - protein, 26 aa, Mycobacterium
VDWLADGWLPLLHKWFDLAVASGIPE

SEQ ID NO: 889881 - protein, 20 aa, Mycobacterium
VDYIDLYLVHWPDPTTPAAE

SEQ ID NO: 889882 - protein, 17 aa, Mycobacterium
VDYLMRLQMIYTAIEDA

SEQ ID NO: 889883 - protein, 18 aa, Mycobacterium
VEAMPYFARALFALSPVA

SEQ ID NO: 889884 - protein, 20 aa, Mycobacterium
VECFTLAMRLITESRLAGTI

SEQ ID NO: 889885 - protein, 20 aa, Mycobacterium
VEDLVALAVLRLGRPVRYEF

SEQ ID NO: 889886 - protein, 23 aa, Mycobacterium
VEDMLWQVPYLPIDPKDVGRTYE

SEQ ID NO: 889887 - protein, 24 aa, Mycobacterium
VEERGFEWLLFDDHSYFPVDTPDS

SEQ ID NO: 889888 - protein, 20 aa, Mycobacterium
VEFGPLFDGVDYRPFEQLHD

SEQ ID NO: 889889 - protein, 18 aa, Mycobacterium
VEFMLLDRLFPRSVFYSL

SEQ ID NO: 889890 - protein, 19 aa, Mycobacterium
VEGAFYWLSNREVRWRPAE

SEQ ID NO: 889891 - protein, 17 aa, Mycobacterium
VEGHLYRLFAKLGINTR

SEQ ID NO: 889892 - protein, 19 aa, Mycobacterium
VEGSWFWVDGQNAHWRPEH

SEQ ID NO: 889893 - protein, 18 aa, Mycobacterium
VEGWMPFGRVFETLAWGR

SEQ ID NO: 889894 - protein, 19 aa, Mycobacterium
VEHAFTWILPLMWRMDAIY

SEQ ID NO: 889895 - protein, 24 aa, Mycobacterium
VEHAFTWILPLMWRMDAIYAARKS

SEQ ID NO: 889896 - protein, 20 aa, Mycobacterium
VEHAWLEGWLLRAGSPTGRD

SEQ ID NO: 889897 - protein, 17 aa, Mycobacterium
VEIWPIVHFQAPTQPIG

SEQ ID NO: 889898 - protein, 20 aa, Mycobacterium
VELPDLPWPDPDAWLAALAA

SEQ ID NO: 889899 - protein, 18 aa, Mycobacterium
VELSAHPSLLYPLGDIVG

SEQ ID NO: 889900 - protein, 26 aa, Mycobacterium
VEPGDRIAIWSPNTWHWVVASLATHY

SEQ ID NO: 889901 - protein, 17 aa, Mycobacterium
VEPWVRATLVGPLTLRH

SEQ ID NO: 889902 - protein, 18 aa, Mycobacterium
VERALIAAYAGGLVPILC

SEQ ID NO: 889903 - protein, 24 aa, Mycobacterium
VERDLRVIIFGWIAFTFEICRQRI

SEQ ID NO: 889904 - protein, 18 aa, Mycobacterium
VERIELFAEALLAGGRPA

SEQ ID NO: 889905 - protein, 27 aa, Mycobacterium
VERLWLALSRLLPPPWRAEALVLLGFS

SEQ ID NO: 889906 - protein, 22 aa, Mycobacterium
VERNWFRRVLTGEKLPAIFGST

SEQ ID NO: 889907 - protein, 19 aa, Mycobacterium
VERPDLVIGWWAAPTILEH

SEQ ID NO: 889908 - protein, 21 aa, Mycobacterium
VERYRLVMDAYLQGLEKAKEA

SEQ ID NO: 889909 - protein, 18 aa, Mycobacterium
VESAVKARWQTPASAVFS

SEQ ID NO: 889910 - protein, 21 aa, Mycobacterium
VEVALFAVLRHWGVQPDFVMG

SEQ ID NO: 889911 - protein, 24 aa, Mycobacterium
VEVAMLQLLRHWGIRPDFVLGHSV

SEQ ID NO: 889912 - protein, 22 aa, Mycobacterium
VEVWPMFGTFEPSRREGSQWLA

SEQ ID NO: 889913 - protein, 17 aa, Mycobacterium
VEVYLAREWARCGDLDG

SEQ ID NO: 889914 - protein, 20 aa, Mycobacterium
VEWFLQNVPIEPIWLCPLRL

SEQ ID NO: 889915 - protein, 18 aa, Mycobacterium
VEWLFWRSTKRVENEQRR

SEQ ID NO: 889916 - protein, 24 aa, Mycobacterium
VEYKLRDWLFARQRYWGEPFPIVY

SEQ ID NO: 889917 - protein, 17 aa, Mycobacterium
VEYLDLIGLLPEVLAVY

SEQ ID NO: 889918 - protein, 20 aa, Mycobacterium
VFETWLHQLAGWFGQLDIGD

SEQ ID NO: 889919 - protein, 19 aa, Mycobacterium
VFFVNWFRRGDDGGFLWPG

SEQ ID NO: 889920 - protein, 19 aa, Mycobacterium
VFGALWITQAALPYLREQR

SEQ ID NO: 889921 - protein, 17 aa, Mycobacterium
VFGLWQPLEHRGFEVIG

SEQ ID NO: 889922 - protein, 25 aa, Mycobacterium
VFGPVELTLALLPALRRAHGQVVFI

SEQ ID NO: 889923 - protein, 26 aa, Mycobacterium
VFGPVELTLALLPALRRARGQVIFIN

SEQ ID NO: 889924 - protein, 18 aa, Mycobacterium
VFIGYLRRKLEAGGAPRL

SEQ ID NO: 889925 - protein, 19 aa, Mycobacterium
VFIGYLRRKLEAGGAPRLL

SEQ ID NO: 889926 - protein, 17 aa, Mycobacterium
VFIGYLRRKLEAHGGPR

SEQ ID NO: 889927 - protein, 18 aa, Mycobacterium
VFIGYLRRKLEANGAPRL

SEQ ID NO: 889928 - protein, 17 aa, Mycobacterium
VFLHGLGLNRRVYIRLL

SEQ ID NO: 889929 - protein, 17 aa, Mycobacterium
VFLPVIATPFGFGIWTS

SEQ ID NO: 889930 - protein, 18 aa, Mycobacterium
VFLQYPWGVLPENMLTPI

SEQ ID NO: 889931 - protein, 19 aa, Mycobacterium
VFLTALYGLSVLAGLRAGE

SEQ ID NO: 889932 - protein, 19 aa, Mycobacterium
VFLTALYGLSVLGGLRAGE

SEQ ID NO: 889933 - protein, 22 aa, Mycobacterium
VFMGPLFILLGRPKIEGLENIP

SEQ ID NO: 889934 - protein, 17 aa, Mycobacterium
VFNAPFSNFWLTPRQHR

SEQ ID NO: 889935 - protein, 17 aa, Mycobacterium
VFPPWFERFQIKYFNPA

SEQ ID NO: 889936 - protein, 17 aa, Mycobacterium
VFPRPMFSAMHAVAAGL

SEQ ID NO: 889937 - protein, 30 aa, Mycobacterium
VFQRTPIWCFPKFDFPLPAALRWAMRIPGG

SEQ ID NO: 889938 - protein, 24 aa, Mycobacterium
VFQRTPIWCFPKLDVALPAPARWA

SEQ ID NO: 889939 - protein, 24 aa, Mycobacterium
VFQRTPIWCFPKLDVPLPAPARWA

SEQ ID NO: 889940 - protein, 30 aa, Mycobacterium
VFQRTPIWCLPKFDFAVPRPLSALLRLAPG

SEQ ID NO: 889941 - protein, 25 aa, Mycobacterium
VFQRTPIWCLPKLDFPVPRLARGFL

SEQ ID NO: 889942 - protein, 20 aa, Mycobacterium
VFRRYVGVPVKWVLCRYRLQ

SEQ ID NO: 889943 - protein, 25 aa, Mycobacterium
VFSEEFLLQRPLLTAIRRTDPTVLL

SEQ ID NO: 889944 - protein, 23 aa, Mycobacterium
VFSEEFLLQRPLLTAIRRTEPTV

SEQ ID NO: 889945 - protein, 24 aa, Mycobacterium
VFSEEFLLTRPLLTAIRRTEPTVL

SEQ ID NO: 889946 - protein, 18 aa, Mycobacterium
VFSQLPRFQALALSAVNT

SEQ ID NO: 889947 - protein, 17 aa, Mycobacterium
VFSRFRRAVTDTGLYKD

SEQ ID NO: 889948 - protein, 18 aa, Mycobacterium
VFSRFSIPAWSARIGFQM

SEQ ID NO: 889949 - protein, 17 aa, Mycobacterium
VGADSLLLLLFTSGTTG

SEQ ID NO: 889950 - protein, 24 aa, Mycobacterium
VGAITPWNFPFNIPSRKLGPALAA

SEQ ID NO: 889951 - protein, 29 aa, Mycobacterium
VGAITPWNFPLLLTLWKVGPAIAAGNSVV

SEQ ID NO: 889952 - protein, 19 aa, Mycobacterium
VGAPFLASLTRAAAAQSAS

SEQ ID NO: 889953 - protein, 24 aa, Mycobacterium
VGDVGPIVLPPIRITGPTLTGNIG

SEQ ID NO: 889954 - protein, 23 aa, Mycobacterium
VGEPLHLGLARLGLLDQPGHLRQ

SEQ ID NO: 889955 - protein, 25 aa, Mycobacterium
VGEVAELLWYPLWDANIRLDHSVRT

SEQ ID NO: 889956 - protein, 18 aa, Mycobacterium
VGFKWFVDGLIGGTIGFG

SEQ ID NO: 889957 - protein, 19 aa, Mycobacterium
VGFKWFVDGLIGGTIGFGG

SEQ ID NO: 889958 - protein, 19 aa, Mycobacterium
VGFKWFVDGLVGGSIGFGG

SEQ ID NO: 889959 - protein, 20 aa, Mycobacterium
VGGFPITFGWLHAVRRGQAR

SEQ ID NO: 889960 - protein, 17 aa, Mycobacterium
VGGFPVRFGWISAIRRG

SEQ ID NO: 889961 - protein, 23 aa, Mycobacterium
VGGRTLSFWTPPGIYTVLDKGNP

SEQ ID NO: 889962 - protein, 22 aa, Mycobacterium
VGGVPTLLWRLIEEIRPDDCVV

SEQ ID NO: 889963 - protein, 23 aa, Mycobacterium
VGGWALGPYTLLTPTAIDDTITQ

SEQ ID NO: 889964 - protein, 18 aa, Mycobacterium
VGGWLFDMRMAGWNVGVA

SEQ ID NO: 889965 - protein, 20 aa, Mycobacterium
VGHSYIVYAPLLLGATTVLY

SEQ ID NO: 889966 - protein, 18 aa, Mycobacterium
VGIAALFTDHAQQYDVVL

SEQ ID NO: 889967 - protein, 23 aa, Mycobacterium
VGIDNWRWAGVPIYLRTGKKMAE

SEQ ID NO: 889968 - protein, 17 aa, Mycobacterium
VGIVLLLRDVLARSLFE

SEQ ID NO: 889969 - protein, 26 aa, Mycobacterium
VGKNPPLLPRPWYSYTLTGLIGALKD

SEQ ID NO: 889970 - protein, 26 aa, Mycobacterium
VGKVNVKLYWDLKISPITFSDITISG

SEQ ID NO: 889971 - protein, 27 aa, Mycobacterium
VGLDLAIIYLPPPLTPAILEPLAAAIT

SEQ ID NO: 889972 - protein, 19 aa, Mycobacterium
VGLFTYPVLMAADVLLYDT

SEQ ID NO: 889973 - protein, 27 aa, Mycobacterium
VGLIIPWNGPFFVAMLKVAPALAAGCS

SEQ ID NO: 889974 - protein, 19 aa, Mycobacterium
VGLLFLQWANLLGVNVIGT

SEQ ID NO: 889975 - protein, 18 aa, Mycobacterium
VGLLLRGLLGLARQPLRA

SEQ ID NO: 889976 - protein, 19 aa, Mycobacterium
VGLLLTQWATSLAASVITT

SEQ ID NO: 889977 - protein, 22 aa, Mycobacterium
VGLMQPWRFIRITDAALRRRIH

SEQ ID NO: 889978 - protein, 24 aa, Mycobacterium
VGLQPLVFGLWRMISEYNAARPEV

SEQ ID NO: 889979 - protein, 23 aa, Mycobacterium
VGNKTWFPAWQFDGRRLRADLPR

SEQ ID NO: 889980 - protein, 17 aa, Mycobacterium
VGNNFPVFFIQDGIKFP

SEQ ID NO: 889981 - protein, 28 aa, Mycobacterium
VGPALLITPWNFPMLMIARKAGAALAAG

SEQ ID NO: 889982 - protein, 23 aa, Mycobacterium
VGPESLFLLLFTSGTTGASKAVK

SEQ ID NO: 889983 - protein, 18 aa, Mycobacterium
VGPGLYSWLPLGLKVLRK

SEQ ID NO: 889984 - protein, 21 aa, Mycobacterium
VGPGLYSWLPLGLRVLRNIER

SEQ ID NO: 889985 - protein, 17 aa, Mycobacterium
VGPLSVPPSWAPPAPVA

SEQ ID NO: 889986 - protein, 28 aa, Mycobacterium
VGQIIPWNFPILMATWKLAPALAAGNAV

SEQ ID NO: 889987 - protein, 29 aa, Mycobacterium
VGQIIPWNFPLLMAVWKLAPALAAGNCVV

SEQ ID NO: 889988 - protein, 17 aa, Mycobacterium
VGRLHRIQAALAQPLVG

SEQ ID NO: 889989 - protein, 26 aa, Mycobacterium
VGRTLLIIDLLRLPAPLLAPAYLFAA

SEQ ID NO: 889990 - protein, 23 aa, Mycobacterium
VGRWFTPGFLAADPGRKAAYQQM

SEQ ID NO: 889991 - protein, 27 aa, Mycobacterium
VGSNPIDILAWLLGYNGQASGGLGGIF

SEQ ID NO: 889992 - protein, 18 aa, Mycobacterium
VGTPFLLLAGLEPDLRWE

SEQ ID NO: 889993 - protein, 18 aa, Mycobacterium
VGTVIYWHALRAMGIDDQ

SEQ ID NO: 889994 - protein, 19 aa, Mycobacterium
VGVDPWSWVLGGGEDHALV

SEQ ID NO: 889995 - protein, 29 aa, Mycobacterium
VGVITPFNFPIAIPAWKIAPALVYGNTVV

SEQ ID NO: 889996 - protein, 19 aa, Mycobacterium
VGVITWMHTFSPAKMWIRG

SEQ ID NO: 889997 - protein, 30 aa, Mycobacterium
VGVQDAINAPFLQFTGRPLVGPGTDGAPGT

SEQ ID NO: 889998 - protein, 17 aa, Mycobacterium
VGYLYNGYIGAGLLTGV

SEQ ID NO: 889999 - protein, 22 aa, Mycobacterium
VHAHYATYPALAAWVCHRLAGT

SEQ ID NO: 890000 - protein, 19 aa, Mycobacterium
VHDWGSALGFYRALRYPEQ

SEQ ID NO: 890001 - protein, 20 aa, Mycobacterium
VHDYFWRWDTDWFWCSRAFG

SEQ ID NO: 890002 - protein, 20 aa, Mycobacterium
VHFVQMWVIPDRAGLTPGYE

SEQ ID NO: 890003 - protein, 18 aa, Mycobacterium
VHLWATPEPLPPAPGSAL

SEQ ID NO: 890004 - protein, 18 aa, Mycobacterium
VHNLGRPPRMLVLLHLDG

SEQ ID NO: 890005 - protein, 18 aa, Mycobacterium
VHPGDLVILIAYGTMSDA

SEQ ID NO: 890006 - protein, 26 aa, Mycobacterium
VHPGTDALLLFAILHTLAERGWIRRP

SEQ ID NO: 890007 - protein, 17 aa, Mycobacterium
VHPLALTLLHPQQVIML

SEQ ID NO: 890008 - protein, 20 aa, Mycobacterium
VHQRIVQLLNSASGAYASAE

SEQ ID NO: 890009 - protein, 17 aa, Mycobacterium
VHRQRLRRRLGPAGLDP

SEQ ID NO: 890010 - protein, 19 aa, Mycobacterium
VHRVPAIMFPKVSTLPLGV

SEQ ID NO: 890011 - protein, 23 aa, Mycobacterium
VHTHHRLLGITWLPLGTTAHKQG

SEQ ID NO: 890012 - protein, 18 aa, Mycobacterium
VHTLPMLYALRDTGPDAD

SEQ ID NO: 890013 - protein, 19 aa, Mycobacterium
VHVRSWQWAFRGLISQDYL

SEQ ID NO: 890014 - protein, 25 aa, Mycobacterium
VIADGAVWLVQARPITTLGSAGSTA

SEQ ID NO: 890015 - protein, 17 aa, Mycobacterium
VIALRYLPDDRLSPLPD

SEQ ID NO: 890016 - protein, 22 aa, Mycobacterium
VIAPWNFPMPIACWGFAPALAA

SEQ ID NO: 890017 - protein, 17 aa, Mycobacterium
VIAQLKFPGYFLVVHDI

SEQ ID NO: 890018 - protein, 23 aa, Mycobacterium
VIARLFGLPYFPVTPLFPAAGPV

SEQ ID NO: 890019 - protein, 19 aa, Mycobacterium
VIFLRRKLDDPLYKYVLRQ

SEQ ID NO: 890020 - protein, 19 aa, Mycobacterium
VIGAWNFPFALTLGPAVGA

SEQ ID NO: 890021 - protein, 17 aa, Mycobacterium
VIGGGMCFTFLAAQGLP

SEQ ID NO: 890022 - protein, 21 aa, Mycobacterium
VIGWWAVPTILEHGSPELIEQ

SEQ ID NO: 890023 - protein, 25 aa, Mycobacterium
VIHDSFRQLWFGWSDPARVLVEYAQ

SEQ ID NO: 890024 - protein, 18 aa, Mycobacterium
VIIDYWGIIKADIGIRDG

SEQ ID NO: 890025 - protein, 26 aa, Mycobacterium
VIISDFLGPINWMRPLRAIAARHEVL

SEQ ID NO: 890026 - protein, 27 aa, Mycobacterium
VIISDFLGPINWMRPLRAISARHEVLA

SEQ ID NO: 890027 - protein, 26 aa, Mycobacterium
VIISDFLGPINWMRPLRAVAARHEVL

SEQ ID NO: 890028 - protein, 19 aa, Mycobacterium
VIKPLFLRIPALRGMLPAV

SEQ ID NO: 890029 - protein, 21 aa, Mycobacterium
VIKRFPIGVLLGIMPWNFPYY

SEQ ID NO: 890030 - protein, 17 aa, Mycobacterium
VILLRAKGIPVIVGAGP

SEQ ID NO: 890031 - protein, 17 aa, Mycobacterium
VILLTFGTGIGSAVIHN

SEQ ID NO: 890032 - protein, 17 aa, Mycobacterium
VILSLLGLPESDFPRML

SEQ ID NO: 890033 - protein, 24 aa, Mycobacterium
VINAPTQTLLGRPLIGDGAAGTAA

SEQ ID NO: 890034 - protein, 23 aa, Mycobacterium
VINDTIWVLPDPAAATSALDQRK

SEQ ID NO: 890035 - protein, 18 aa, Mycobacterium
VINHLLYHAVIPKLPFGG

SEQ ID NO: 890036 - protein, 25 aa, Mycobacterium
VIPPTFLCILGYAAQKWFLQHCGIA

SEQ ID NO: 890037 - protein, 22 aa, Mycobacterium
VISIPTMILFKDGQPVKRIVGA

SEQ ID NO: 890038 - protein, 17 aa, Mycobacterium
VISRLHFALGAQGTLFL

SEQ ID NO: 890039 - protein, 25 aa, Mycobacterium
VISSLTAMYWWGPASVSMLATAGPF

SEQ ID NO: 890040 - protein, 25 aa, Mycobacterium
VITPFNFPIAIPAWKIAPALAYGNA

SEQ ID NO: 890041 - protein, 22 aa, Mycobacterium
VITPWNFPMTIAAWGFAPALAA

SEQ ID NO: 890042 - protein, 23 aa, Mycobacterium
VIVAPMFHAWGFSQLLLAASFAC

SEQ ID NO: 890043 - protein, 18 aa, Mycobacterium
VIVGLQLALTRLWRVYGV

SEQ ID NO: 890044 - protein, 17 aa, Mycobacterium
VIVYFYPAASTPGCTKQ

SEQ ID NO: 890045 - protein, 18 aa, Mycobacterium
VIVYFYPAASTPGCTKQA

SEQ ID NO: 890046 - protein, 17 aa, Mycobacterium
VIYLQSHPMWLAARQRE

SEQ ID NO: 890047 - protein, 25 aa, Mycobacterium
VKAAPDPPWGLRAPPATAAPADSAA

SEQ ID NO: 890048 - protein, 23 aa, Mycobacterium
VKAAPDQWPALTAPPATAAPADS

SEQ ID NO: 890049 - protein, 22 aa, Mycobacterium
VKANLFYRGLAFHRFPVIGDTL

SEQ ID NO: 890050 - protein, 27 aa, Mycobacterium
VKDAVDVLWFFFGYTGFFTLLDDNGWS

SEQ ID NO: 890051 - protein, 22 aa, Mycobacterium
VKDLHLPWQWGARWFLDQLVDG

SEQ ID NO: 890052 - protein, 21 aa, Mycobacterium
VKDPWLRRQLTPHFRPGCKRM

SEQ ID NO: 890053 - protein, 24 aa, Mycobacterium
VKGSPLAWLLTMAHRRAIDRVRAE

SEQ ID NO: 890054 - protein, 18 aa, Mycobacterium
VKIPLPRKLAKGSLAHVP

SEQ ID NO: 890055 - protein, 21 aa, Mycobacterium
VKWQLLMSAWLDLPGRPSLVG

SEQ ID NO: 890056 - protein, 19 aa, Mycobacterium
VKYHSVLLAAWRGNEDVAT

SEQ ID NO: 890057 - protein, 19 aa, Mycobacterium
VLAEWFLRRFSLLDSLYMI

SEQ ID NO: 890058 - protein, 25 aa, Mycobacterium
VLAEWFLRRFSLLDSLYMVPPPRII

SEQ ID NO: 890059 - protein, 24 aa, Mycobacterium
VLAEWFLRRISLLDSLYMVPSPLI

SEQ ID NO: 890060 - protein, 24 aa, Mycobacterium
VLAEWFLRRISLLDSLYTVPSAPI

SEQ ID NO: 890061 - protein, 19 aa, Mycobacterium
VLAIYRPLLEPLGLTHPQY

SEQ ID NO: 890062 - protein, 24 aa, Mycobacterium
VLALIKVLLAFQHRMYPPAANFTA

SEQ ID NO: 890063 - protein, 17 aa, Mycobacterium
VLAMKWGMRRLALQTAI

SEQ ID NO: 890064 - protein, 24 aa, Mycobacterium
VLAPLRLHYLRWLLFDVGSGLHFQ

SEQ ID NO: 890065 - protein, 17 aa, Mycobacterium
VLAPLTPAAIFLVATID

SEQ ID NO: 890066 - protein, 17 aa, Mycobacterium
VLAPLTPAAIFLVVTID

SEQ ID NO: 890067 - protein, 17 aa, Mycobacterium
VLAPLTPAAVFLVATID

SEQ ID NO: 890068 - protein, 21 aa, Mycobacterium
VLARIRPVLGAYGDPILHAGD

SEQ ID NO: 890069 - protein, 17 aa, Mycobacterium
VLARRRLIIYSWGANEL

SEQ ID NO: 890070 - protein, 18 aa, Mycobacterium
VLARTLEWGLGAYVGVPL

SEQ ID NO: 890071 - protein, 19 aa, Mycobacterium
VLAVYRPLLEPLGLTHPQY

SEQ ID NO: 890072 - protein, 17 aa, Mycobacterium
VLAWLHPPGFDFGPALL

SEQ ID NO: 890073 - protein, 19 aa, Mycobacterium
VLAYPRVIWVAGGLLKGAS

SEQ ID NO: 890074 - protein, 23 aa, Mycobacterium
VLAYPRVVWLAGGLLKGASVDAE

SEQ ID NO: 890075 - protein, 17 aa, Mycobacterium
VLDALRVDIAFIGTNAI

SEQ ID NO: 890076 - protein, 17 aa, Mycobacterium
VLDAWLRPVPPGVVGEL

SEQ ID NO: 890077 - protein, 25 aa, Mycobacterium
VLDIDALTLAFRALLRSYPVLATQI

SEQ ID NO: 890078 - protein, 19 aa, Mycobacterium
VLDLLGLPAECGVGFVTGA

SEQ ID NO: 890079 - protein, 17 aa, Mycobacterium
VLDVWLRPVPPGTVGEL

SEQ ID NO: 890080 - protein, 20 aa, Mycobacterium
VLELAWTTGLIKWEDDPQPG

SEQ ID NO: 890081 - protein, 25 aa, Mycobacterium
VLEPLRLHYLRWILFDVGSGLHFQY

SEQ ID NO: 890082 - protein, 17 aa, Mycobacterium
VLFAFRELLNARKEEVA

SEQ ID NO: 890083 - protein, 18 aa, Mycobacterium
VLFGRLYGLRKSRARQRA

SEQ ID NO: 890084 - protein, 18 aa, Mycobacterium
VLGFLLRTPLAGSLGNQL

SEQ ID NO: 890085 - protein, 18 aa, Mycobacterium
VLGGRVFRPLDVDLRWVA

SEQ ID NO: 890086 - protein, 21 aa, Mycobacterium
VLGIWPILPEEFTLLDAIFAM

SEQ ID NO: 890087 - protein, 22 aa, Mycobacterium
VLGKGVWLYLRPDNPMGFRIGI

SEQ ID NO: 890088 - protein, 17 aa, Mycobacterium
VLGLCHSVYWTMVGLCE

SEQ ID NO: 890089 - protein, 18 aa, Mycobacterium
VLGLHFFNPVPVLPLVEL

SEQ ID NO: 890090 - protein, 20 aa, Mycobacterium
VLGLHFFNPVPVLPLVELVC

SEQ ID NO: 890091 - protein, 17 aa, Mycobacterium
VLHGVQLWVALPAAARD

SEQ ID NO: 890092 - protein, 18 aa, Mycobacterium
VLHVIWRQKIYPGIGAPS

SEQ ID NO: 890093 - protein, 17 aa, Mycobacterium
VLHYHRVYLLGGSAAVD

SEQ ID NO: 890094 - protein, 18 aa, Mycobacterium
VLIFVPGGAWVHGKAMGQ

SEQ ID NO: 890095 - protein, 28 aa, Mycobacterium
VLIIGPWNYPLYLSLAPLVAAVAAGNCA

SEQ ID NO: 890096 - protein, 19 aa, Mycobacterium
VLLEMLVKPPLKSASREER

SEQ ID NO: 890097 - protein, 17 aa, Mycobacterium
VLLKLLHPVMPFVTEVL

SEQ ID NO: 890098 - protein, 18 aa, Mycobacterium
VLLPLWNAYTFLALYAPE

SEQ ID NO: 890099 - protein, 17 aa, Mycobacterium
VLLVFFPLAFTGVCQGE

SEQ ID NO: 890100 - protein, 18 aa, Mycobacterium
VLMLPMTLPGAGIAPTLS

SEQ ID NO: 890101 - protein, 18 aa, Mycobacterium
VLPAPRPIRTLLIAAGSG

SEQ ID NO: 890102 - protein, 18 aa, Mycobacterium
VLPEWFIGSGLTAAAYRG

SEQ ID NO: 890103 - protein, 17 aa, Mycobacterium
VLPIWRESELRFVTAQL

SEQ ID NO: 890104 - protein, 17 aa, Mycobacterium
VLPPLLVPRAFVPVAAL

SEQ ID NO: 890105 - protein, 22 aa, Mycobacterium
VLPQQALLYRLCGDRNPLHSDP

SEQ ID NO: 890106 - protein, 18 aa, Mycobacterium
VLPSWRDLEVLLQVLPRS

SEQ ID NO: 890107 - protein, 17 aa, Mycobacterium
VLQALTFLRGPRTWVLK

SEQ ID NO: 890108 - protein, 17 aa, Mycobacterium
VLQLFIEVSMRLTRRFA

SEQ ID NO: 890109 - protein, 23 aa, Mycobacterium
VLQPGMALALEPWWGRGTARLIV

SEQ ID NO: 890110 - protein, 23 aa, Mycobacterium
VLRKLREQIPGLPLLLLTAKDSV

SEQ ID NO: 890111 - protein, 17 aa, Mycobacterium
VLRLGRPVRYEFTRVDE

SEQ ID NO: 890112 - protein, 17 aa, Mycobacterium
VLRLHLLHLLQTVSYNS

SEQ ID NO: 890113 - protein, 20 aa, Mycobacterium
VLRRHILENPAWYTAYTPYQ

SEQ ID NO: 890114 - protein, 18 aa, Mycobacterium
VLRYELMGRLLPNSMFLQ

SEQ ID NO: 890115 - protein, 23 aa, Mycobacterium
VLSARIWIAQVGRIPLLLLDSDI

SEQ ID NO: 890116 - protein, 17 aa, Mycobacterium
VLSIPYQGLGNAAISGV

SEQ ID NO: 890117 - protein, 18 aa, Mycobacterium
VLTDRDFGEWARGPWPAI

SEQ ID NO: 890118 - protein, 23 aa, Mycobacterium
VLTEDFFLIQKLQKYAREAIDGY

SEQ ID NO: 890119 - protein, 19 aa, Mycobacterium
VLTERFLRYYAGYVDKSHG

SEQ ID NO: 890120 - protein, 21 aa, Mycobacterium
VLTFAGSLWWRTVQEIGEEYP

SEQ ID NO: 890121 - protein, 17 aa, Mycobacterium
VLTISPPLNMNPRWLGA

SEQ ID NO: 890122 - protein, 18 aa, Mycobacterium
VLTRPCVLFSKLNPRIPR

SEQ ID NO: 890123 - protein, 25 aa, Mycobacterium
VLTTAAIGMFFPGPYRVPKASFNYK

SEQ ID NO: 890124 - protein, 21 aa, Mycobacterium
VLVLINHYPLRDVGWRGSLQS

SEQ ID NO: 890125 - protein, 17 aa, Mycobacterium
VLVVHGGPWFRDSWGFD

SEQ ID NO: 890126 - protein, 22 aa, Mycobacterium
VLYARRQLLSELPPFLTGGSMI

SEQ ID NO: 890127 - protein, 17 aa, Mycobacterium
VLYTLRRALQSDNLFDS

SEQ ID NO: 890128 - protein, 17 aa, Mycobacterium
VLYTSLLRRAITTANIA

SEQ ID NO: 890129 - protein, 17 aa, Mycobacterium
VMAALREPGIAVIAEVK

SEQ ID NO: 890130 - protein, 17 aa, Mycobacterium
VMAALREPGIGVIAEVK

SEQ ID NO: 890131 - protein, 21 aa, Mycobacterium
VMAIFYLRLPATFGIGTYGVS

SEQ ID NO: 890132 - protein, 18 aa, Mycobacterium
VMGLLLRSPFAGAARKQF

SEQ ID NO: 890133 - protein, 18 aa, Mycobacterium
VMKALLDAGLLRGDCLTV

SEQ ID NO: 890134 - protein, 19 aa, Mycobacterium
VMMRHRDGMRLRYVDPFRA

SEQ ID NO: 890135 - protein, 17 aa, Mycobacterium
VMNHIYVTKTLVGAGLA

SEQ ID NO: 890136 - protein, 17 aa, Mycobacterium
VMQLTHPAFLILDSPDG

SEQ ID NO: 890137 - protein, 17 aa, Mycobacterium
VMRALLDAGLLHGDCLT

SEQ ID NO: 890138 - protein, 18 aa, Mycobacterium
VMRALLDAGLLHGDCLTV

SEQ ID NO: 890139 - protein, 18 aa, Mycobacterium
VMRPLPESWAELGFLIAV

SEQ ID NO: 890140 - protein, 28 aa, Mycobacterium
VMSAKIIWDVAFYWGFIGLLYMNNRYAR

SEQ ID NO: 890141 - protein, 25 aa, Mycobacterium
VMTAYRIGFRFIWEQTLAAARASGM

SEQ ID NO: 890142 - protein, 20 aa, Mycobacterium
VMTPTAWWRVPMQSLVGGLA

SEQ ID NO: 890143 - protein, 22 aa, Mycobacterium
VMTPTAWWRVPMQSLVGGLATD

SEQ ID NO: 890144 - protein, 17 aa, Mycobacterium
VMTTPLFYGWWIAGAKY

SEQ ID NO: 890145 - protein, 17 aa, Mycobacterium
VMWACVFMRTGARRVHF

SEQ ID NO: 890146 - protein, 18 aa, Mycobacterium
VNAAQPIWWLVRALEFGQ

SEQ ID NO: 890147 - protein, 39 aa, Mycobacterium
VNASPLQTLEQNVLAAINAPSQALTARPLFGDGADGAPG

SEQ ID NO: 890148 - protein, 20 aa, Mycobacterium
VNDLFLPLRYGQVALREKMP

SEQ ID NO: 890149 - protein, 24 aa, Mycobacterium
VNGFGTPWWADDLAALAGTPVGGV

SEQ ID NO: 890150 - protein, 18 aa, Mycobacterium
VNGHLHLPALRAALEREV

SEQ ID NO: 890151 - protein, 23 aa, Mycobacterium
VNGQLFIVYGPSVTLVAAPTAEK

SEQ ID NO: 890152 - protein, 17 aa, Mycobacterium
VNIGGVFWAIHAAIPHF

SEQ ID NO: 890153 - protein, 23 aa, Mycobacterium
VNKLGTMGLILRGSDDLKKQVLP

SEQ ID NO: 890154 - protein, 23 aa, Mycobacterium
VNKLGTMGLILRGSEDLKKQVLP

SEQ ID NO: 890155 - protein, 26 aa, Mycobacterium
VNLGTFVAVAPWWHPIRLAHQMAYLD

SEQ ID NO: 890156 - protein, 22 aa, Mycobacterium
VNLLFEPIMPMKPIVLPGVGET

SEQ ID NO: 890157 - protein, 18 aa, Mycobacterium
VNPHDIVLFPAWARRNPL

SEQ ID NO: 890158 - protein, 17 aa, Mycobacterium
VNPLIRVLRVALYPTKI

SEQ ID NO: 890159 - protein, 19 aa, Mycobacterium
VNPWQWCRWLLIEPAELAD

SEQ ID NO: 890160 - protein, 24 aa, Mycobacterium
VNRILAYVAPILLGGPITAVDDVG

SEQ ID NO: 890161 - protein, 17 aa, Mycobacterium
VNRLLLRNVSVVGVGWG

SEQ ID NO: 890162 - protein, 19 aa, Mycobacterium
VNRPDLVIGWWAAPTILEH

SEQ ID NO: 890163 - protein, 24 aa, Mycobacterium
VNRPFRTLYMEYLMKTLPEVARAV

SEQ ID NO: 890164 - protein, 26 aa, Mycobacterium
VNRVKTWLQFPKWFYDNLPVNTMTEP

SEQ ID NO: 890165 - protein, 27 aa, Mycobacterium
VNRVKTWLQFPQWFYFNIPVNTMVAPR

SEQ ID NO: 890166 - protein, 26 aa, Mycobacterium
VNRVKTWLQFPQWFYLNIPVNTMVAP

SEQ ID NO: 890167 - protein, 17 aa, Mycobacterium
VNVPGFPNLFLLAGPGS

SEQ ID NO: 890168 - protein, 26 aa, Mycobacterium
VNVTANLLLLQGLLPRMAAAGFGRVV

SEQ ID NO: 890169 - protein, 17 aa, Mycobacterium
VNVYPIVVLRKAPQPEL

SEQ ID NO: 890170 - protein, 23 aa, Mycobacterium
VNWNFFGSFVFGTPGFPLSDVPL

SEQ ID NO: 890171 - protein, 19 aa, Mycobacterium
VPACALLPPVFRYGVNILA

SEQ ID NO: 890172 - protein, 17 aa, Mycobacterium
VPAGRVIVLPWDKHIAA

SEQ ID NO: 890173 - protein, 21 aa, Mycobacterium
VPALLHLLAEFPSIRTVMVMV

SEQ ID NO: 890174 - protein, 17 aa, Mycobacterium
VPALQRVLFIGTADWDT

SEQ ID NO: 890175 - protein, 21 aa, Mycobacterium
VPAYIRPQFCEGRGPFRWVAL

SEQ ID NO: 890176 - protein, 24 aa, Mycobacterium
VPCFPTISELWLRLLEAYRDSFFV

SEQ ID NO: 890177 - protein, 24 aa, Mycobacterium
VPDAQLPDLLLLDDLLGIAAPGAE

SEQ ID NO: 890178 - protein, 23 aa, Mycobacterium
VPDDFALVRYFAAGLAVLHVVLP

SEQ ID NO: 890179 - protein, 17 aa, Mycobacterium
VPDFPNLFLIYGPGTHL

SEQ ID NO: 890180 - protein, 18 aa, Mycobacterium
VPDFVFWLGGAALAGATV

SEQ ID NO: 890181 - protein, 17 aa, Mycobacterium
VPDLGWAPPAAPSGGDR

SEQ ID NO: 890182 - protein, 22 aa, Mycobacterium
VPEWFRYNAGLLAAQRTAVLPG

SEQ ID NO: 890183 - protein, 17 aa, Mycobacterium
VPEWLWQSPAAVKRAFL

SEQ ID NO: 890184 - protein, 24 aa, Mycobacterium
VPEYIGNLLLYFQPDSTATMLDAV

SEQ ID NO: 890185 - protein, 17 aa, Mycobacterium
VPFFPLGAAFMRPNPVL

SEQ ID NO: 890186 - protein, 17 aa, Mycobacterium
VPFSWQRISLHAAGATA

SEQ ID NO: 890187 - protein, 17 aa, Mycobacterium
VPGDIIWAPAIDGAFVL

SEQ ID NO: 890188 - protein, 18 aa, Mycobacterium
VPGDIIWAPAIDGAFVLT

SEQ ID NO: 890189 - protein, 18 aa, Mycobacterium
VPGGWWPPLMLEPGWVSD

SEQ ID NO: 890190 - protein, 18 aa, Mycobacterium
VPGKFYWMSTTQLRWRPI

SEQ ID NO: 890191 - protein, 23 aa, Mycobacterium
VPGSALWFMHQLANGWSGVKDFL

SEQ ID NO: 890192 - protein, 21 aa, Mycobacterium
VPGVLLALRRIGERPGLTVGI

SEQ ID NO: 890193 - protein, 28 aa, Mycobacterium
VPHYGIGYGLLRYLYAPTARLLGDGRPA

SEQ ID NO: 890194 - protein, 18 aa, Mycobacterium
VPIDIWWFRLPKHPDDPQ

SEQ ID NO: 890195 - protein, 18 aa, Mycobacterium
VPIHVYRWKPTPAGGDFD

SEQ ID NO: 890196 - protein, 19 aa, Mycobacterium
VPIPYVYPVDLRFLLAPPV

SEQ ID NO: 890197 - protein, 26 aa, Mycobacterium
VPIREPILPFWLTKASRPRFQRLWGT

SEQ ID NO: 890198 - protein, 19 aa, Mycobacterium
VPKFYWAVMADSAFEAGWR

SEQ ID NO: 890199 - protein, 25 aa, Mycobacterium
VPLAHLALFVLDKWLRPVPTGVVGE

SEQ ID NO: 890200 - protein, 21 aa, Mycobacterium
VPLAIDLLIDLKLDKSRFKVA

SEQ ID NO: 890201 - protein, 17 aa, Mycobacterium
VPLAPPTSPAPPAPPPT

SEQ ID NO: 890202 - protein, 20 aa, Mycobacterium
VPLEWRRLLHGWPDMTARDL

SEQ ID NO: 890203 - protein, 17 aa, Mycobacterium
VPLLFMHGLLLSRKAYL

SEQ ID NO: 890204 - protein, 20 aa, Mycobacterium
VPLRVHVLVRFGRWADLIAT

SEQ ID NO: 890205 - protein, 20 aa, Mycobacterium
VPMFLLYDYSFLPSGATTKA

SEQ ID NO: 890206 - protein, 22 aa, Mycobacterium
VPPDRWGLVPLLAGVAIVDAVA

SEQ ID NO: 890207 - protein, 23 aa, Mycobacterium
VPPHPCPLSFILAPTLIAHGTQQ

SEQ ID NO: 890208 - protein, 25 aa, Mycobacterium
VPPPPPAFVPPPPPPPLNYPQPRLR

SEQ ID NO: 890209 - protein, 23 aa, Mycobacterium
VPPQLPYPKWLPPPAPPEGINPP

SEQ ID NO: 890210 - protein, 17 aa, Mycobacterium
VPQFPNFFIVYGPGTHL

SEQ ID NO: 890211 - protein, 22 aa, Mycobacterium
VPQRAGWFRFYFEGHRWVWSDQ

SEQ ID NO: 890212 - protein, 18 aa, Mycobacterium
VPRAWRELLHGWPGLDAA

SEQ ID NO: 890213 - protein, 20 aa, Mycobacterium
VPSLLGLFLSLPGVNEWRTL

SEQ ID NO: 890214 - protein, 18 aa, Mycobacterium
VPSLLGSVLLLPEARELR

SEQ ID NO: 890215 - protein, 22 aa, Mycobacterium
VPSPLDNPWLLLIELARDSDPT

SEQ ID NO: 890216 - protein, 21 aa, Mycobacterium
VPTAGLPIGGWFGAPSPFAGV

SEQ ID NO: 890217 - protein, 27 aa, Mycobacterium
VPTIGWLTWHIVYWWSGALASLSGDTP

SEQ ID NO: 890218 - protein, 17 aa, Mycobacterium
VPTLILWSTADQPYWGN

SEQ ID NO: 890219 - protein, 17 aa, Mycobacterium
VPTSLIFHRFPRGYTMS

SEQ ID NO: 890220 - protein, 24 aa, Mycobacterium
VPVERPMPWPIYLPSVRVAATPHH

SEQ ID NO: 890221 - protein, 19 aa, Mycobacterium
VPVLPATWPLQVVGSTSGS

SEQ ID NO: 890222 - protein, 18 aa, Mycobacterium
VPVRIYRGGPSPAPVVVY

SEQ ID NO: 890223 - protein, 20 aa, Mycobacterium
VPVRVYRWKPTPLGGTFDQL

SEQ ID NO: 890224 - protein, 26 aa, Mycobacterium
VPWNMPQFLIATKLVPALLAGCTVIL

SEQ ID NO: 890225 - protein, 26 aa, Mycobacterium
VPWNMPQFLIVTKLVPALLAGCAVVL

SEQ ID NO: 890226 - protein, 19 aa, Mycobacterium
VPWWWRPSGALFDQFLGAA

SEQ ID NO: 890227 - protein, 17 aa, Mycobacterium
VPYFAVAYYGVLRAGGV

SEQ ID NO: 890228 - protein, 22 aa, Mycobacterium
VPYYRVLELAPWLGWPRPNFPV

SEQ ID NO: 890229 - protein, 24 aa, Mycobacterium
VQAGLAMLAPIWGFEPLLDTEDSV

SEQ ID NO: 890230 - protein, 18 aa, Mycobacterium
VQARAGWAVGWKKDAFWG

SEQ ID NO: 890231 - protein, 25 aa, Mycobacterium
VQDAYLRAWEYRPWRAEALYAIARQ

SEQ ID NO: 890232 - protein, 21 aa, Mycobacterium
VQIGKFRLVFLTGPKSAGDDS

SEQ ID NO: 890233 - protein, 17 aa, Mycobacterium
VQIYARLVMIWTSAAAN

SEQ ID NO: 890234 - protein, 20 aa, Mycobacterium
VQLILKFIPGMRDRGFGHIV

SEQ ID NO: 890235 - protein, 18 aa, Mycobacterium
VQLTTYLRRRPAPGWMRV

SEQ ID NO: 890236 - protein, 20 aa, Mycobacterium
VQMCRAFLPVLRQRPEANIT

SEQ ID NO: 890237 - protein, 19 aa, Mycobacterium
VQMMPWLEPEPVRWAIDNV

SEQ ID NO: 890238 - protein, 24 aa, Mycobacterium
VQPCPPLVLWDLTAGPDPTPTPED

SEQ ID NO: 890239 - protein, 23 aa, Mycobacterium
VQPEIFFAPPRIWEKLRAITASD

SEQ ID NO: 890240 - protein, 23 aa, Mycobacterium
VQPQPILAPLTPAAIFLVATIDA

SEQ ID NO: 890241 - protein, 18 aa, Mycobacterium
VQQILLDAINAPTQALLG

SEQ ID NO: 890242 - protein, 20 aa, Mycobacterium
VQQIWMPYHWGYSGLVDGDV

SEQ ID NO: 890243 - protein, 18 aa, Mycobacterium
VQRFVMVSYFGAGPNHGV

SEQ ID NO: 890244 - protein, 17 aa, Mycobacterium
VQRLEALPGWPTGPLSP

SEQ ID NO: 890245 - protein, 17 aa, Mycobacterium
VQRLLFDAGWMRWGWPT

SEQ ID NO: 890246 - protein, 19 aa, Mycobacterium
VQRTWPELIPLLQSGRLDV

SEQ ID NO: 890247 - protein, 22 aa, Mycobacterium
VQRTWPELIPLLQSGRLDVDGI

SEQ ID NO: 890248 - protein, 22 aa, Mycobacterium
VQRVFFGWAQVWRTKSRDAEAI

SEQ ID NO: 890249 - protein, 21 aa, Mycobacterium
VQRVFFGWAQVWRTKSREAEA

SEQ ID NO: 890250 - protein, 24 aa, Mycobacterium
VQRVKTWLQFPQWFYNDSPPNTMV

SEQ ID NO: 890251 - protein, 26 aa, Mycobacterium
VQRVKTWLQFPQWFYNNLPVNTMVAP

SEQ ID NO: 890252 - protein, 22 aa, Mycobacterium
VQRVRPLLSCYGDPVLHVGPTG

SEQ ID NO: 890253 - protein, 20 aa, Mycobacterium
VQSVLLPRLLHWMSYAPDPD

SEQ ID NO: 890254 - protein, 17 aa, Mycobacterium
VQVLLRLSFALNSIGEL

SEQ ID NO: 890255 - protein, 17 aa, Mycobacterium
VRASFLPQIYFAGVNLA

SEQ ID NO: 890256 - protein, 27 aa, Mycobacterium
VRATRIEFWAFDLLFLDGRSLLRARYR

SEQ ID NO: 890257 - protein, 27 aa, Mycobacterium
VRATRIEFWAFDLLYLDGRSLLRAKYQ

SEQ ID NO: 890258 - protein, 29 aa, Mycobacterium
VRAWRLPMGFTAWPPWRPGVLFAGDSLGA

SEQ ID NO: 890259 - protein, 24 aa, Mycobacterium
VRDRERILWFLAEIARRYDPHDEQ

SEQ ID NO: 890260 - protein, 20 aa, Mycobacterium
VRDWWSMDWIWSALHLDDGT

SEQ ID NO: 890261 - protein, 24 aa, Mycobacterium
VREQVPVRLVLRLPEWQLAVPQVG

SEQ ID NO: 890262 - protein, 17 aa, Mycobacterium
VRFIGVDGYRWMIRCVI

SEQ ID NO: 890263 - protein, 20 aa, Mycobacterium
VRFLAPLLAAIVTSAGCGAL

SEQ ID NO: 890264 - protein, 17 aa, Mycobacterium
VRFLPYGIAVSVLDTTP

SEQ ID NO: 890265 - protein, 18 aa, Mycobacterium
VRGHYMAPLLGTSSPRRA

SEQ ID NO: 890266 - protein, 19 aa, Mycobacterium
VRGVLYFRTKRWPDVLNQF

SEQ ID NO: 890267 - protein, 18 aa, Mycobacterium
VRHRLLAAWIAMLSGDLS

SEQ ID NO: 890268 - protein, 18 aa, Mycobacterium
VRIRHRLADWLRAAHITG

SEQ ID NO: 890269 - protein, 17 aa, Mycobacterium
VRKFLRTLPAAERPRMI

SEQ ID NO: 890270 - protein, 19 aa, Mycobacterium
VRKLFDVNYFGAVDMIKAV

SEQ ID NO: 890271 - protein, 21 aa, Mycobacterium
VRKLFEVNYFGAVNMIKAVLP

SEQ ID NO: 890272 - protein, 18 aa, Mycobacterium
VRLLVYYAAWHLDRNHHM

SEQ ID NO: 890273 - protein, 18 aa, Mycobacterium
VRLMLDQYWPSVPHVLIE

SEQ ID NO: 890274 - protein, 19 aa, Mycobacterium
VRLMRWGLVPPWVKAGEDG

SEQ ID NO: 890275 - protein, 22 aa, Mycobacterium
VRLRRLRRLLKWIYHIESRKAQ

SEQ ID NO: 890276 - protein, 20 aa, Mycobacterium
VRLVRQIPYTVACDLLLTGR

SEQ ID NO: 890277 - protein, 17 aa, Mycobacterium
VRMVLTNWFGQNCLAIA

SEQ ID NO: 890278 - protein, 24 aa, Mycobacterium
VRNPDPLLLLFDPLPNTGVVVIQG

SEQ ID NO: 890279 - protein, 19 aa, Mycobacterium
VRNWPWRRLVLSKTANTYS

SEQ ID NO: 890280 - protein, 22 aa, Mycobacterium
VRPAFAYWGWRSVIEPADAVAG

SEQ ID NO: 890281 - protein, 17 aa, Mycobacterium
VRPGVPVLFLDTGYHFA

SEQ ID NO: 890282 - protein, 24 aa, Mycobacterium
VRPQPLGAFGLPLGYLLVPAGSDT

SEQ ID NO: 890283 - protein, 18 aa, Mycobacterium
VRPVLLDGLAVLLLEPPR

SEQ ID NO: 890284 - protein, 17 aa, Mycobacterium
VRPVSQLDPRLGQRRLR

SEQ ID NO: 890285 - protein, 19 aa, Mycobacterium
VRRGLWLTGGRRPWVALKL

SEQ ID NO: 890286 - protein, 17 aa, Mycobacterium
VRRHRLMETFLVQELGY

SEQ ID NO: 890287 - protein, 17 aa, Mycobacterium
VRRRVIRRWLLAGGATG

SEQ ID NO: 890288 - protein, 22 aa, Mycobacterium
VRRSNALLDWAYGRRFRYSEHM

SEQ ID NO: 890289 - protein, 19 aa, Mycobacterium
VRRYIIGCALRWMRDFHAD

SEQ ID NO: 890290 - protein, 23 aa, Mycobacterium
VRSSLGLLAMRRLRKLLAGRMSV

SEQ ID NO: 890291 - protein, 23 aa, Mycobacterium
VRTGLQVAPFCDLVLDVAGAQVF

SEQ ID NO: 890292 - protein, 23 aa, Mycobacterium
VRTKLLYMYFPDEFVPVSSRAAI

SEQ ID NO: 890293 - protein, 23 aa, Mycobacterium
VRTQLEVILPYFLHYANAEQRER

SEQ ID NO: 890294 - protein, 22 aa, Mycobacterium
VRTRLIELFELFDPADPEVIAG

SEQ ID NO: 890295 - protein, 22 aa, Mycobacterium
VRTRLIELFELFDPADPEVVAG

SEQ ID NO: 890296 - protein, 18 aa, Mycobacterium
VRTRLVELFELFDPADPE

SEQ ID NO: 890297 - protein, 25 aa, Mycobacterium
VRTTFGFRLGFFGPFAIADQAGLDV

SEQ ID NO: 890298 - protein, 22 aa, Mycobacterium
VRTTGLLAVAPYVARLTPELLS

SEQ ID NO: 890299 - protein, 18 aa, Mycobacterium
VRVARGGVIKVLAGGAIT

SEQ ID NO: 890300 - protein, 17 aa, Mycobacterium
VRVLEQMWLNALWGGPI

SEQ ID NO: 890301 - protein, 18 aa, Mycobacterium
VRVRALPSWLRLDARFGS

SEQ ID NO: 890302 - protein, 17 aa, Mycobacterium
VRVVRQPWWAPIVDIPA

SEQ ID NO: 890303 - protein, 25 aa, Mycobacterium
VRWKNALLGITFFNLSRRRPELIKS

SEQ ID NO: 890304 - protein, 18 aa, Mycobacterium
VRWLLRRKAINSLPAGYD

SEQ ID NO: 890305 - protein, 17 aa, Mycobacterium
VRWWSAIALLRCLASSP

SEQ ID NO: 890306 - protein, 26 aa, Mycobacterium
VRYIDRFLMFYIRTADRLQRTAPWVE

SEQ ID NO: 890307 - protein, 25 aa, Mycobacterium
VRYIDRFLMYYIRTADRLQRTAPWV

SEQ ID NO: 890308 - protein, 24 aa, Mycobacterium
VRYIDRFLMYYVRTADRLQRTAPW

SEQ ID NO: 890309 - protein, 18 aa, Mycobacterium
VRYQDRLLLPLPMFHVAA

SEQ ID NO: 890310 - protein, 17 aa, Mycobacterium
VSALGLPSLGLAAATPL

SEQ ID NO: 890311 - protein, 29 aa, Mycobacterium
VSAQAAAFHQRFVVALAAAAGSYGRAESA

SEQ ID NO: 890312 - protein, 17 aa, Mycobacterium
VSAWALLRKRAWFEAGS

SEQ ID NO: 890313 - protein, 22 aa, Mycobacterium
VSDKIDFWLWLDAGFDDHAIEA

SEQ ID NO: 890314 - protein, 18 aa, Mycobacterium
VSDKIDFWLWLDAGFEDH

SEQ ID NO: 890315 - protein, 23 aa, Mycobacterium
VSELPFVLPIVELGFDYPDYLLA

SEQ ID NO: 890316 - protein, 24 aa, Mycobacterium
VSGAALLVLDKWLRPVPAGVVGEL

SEQ ID NO: 890317 - protein, 24 aa, Mycobacterium
VSGPLPVMFFIHGGGYFLGSSATP

SEQ ID NO: 890318 - protein, 22 aa, Mycobacterium
VSIPYFPNYLSLASPYAFIGLN

SEQ ID NO: 890319 - protein, 23 aa, Mycobacterium
VSKGLQYPIVYLPFAFNRNTQDR

SEQ ID NO: 890320 - protein, 20 aa, Mycobacterium
VSKYWVIDEIRPARIHANLP

SEQ ID NO: 890321 - protein, 20 aa, Mycobacterium
VSKYWVIDEIRPARIHANVP

SEQ ID NO: 890322 - protein, 23 aa, Mycobacterium
VSLAPFQYYYWGDLLDGAIFDHE

SEQ ID NO: 890323 - protein, 18 aa, Mycobacterium
VSLAYLTDLLFARSVVSI

SEQ ID NO: 890324 - protein, 26 aa, Mycobacterium
VSLGTFVAVVPWWNPIRLATQIAYLD

SEQ ID NO: 890325 - protein, 26 aa, Mycobacterium
VSLGTFVVVAPWWHPVRLAHQIAYLD

SEQ ID NO: 890326 - protein, 21 aa, Mycobacterium
VSLGWLPPSYIPTGYPYAPSV

SEQ ID NO: 890327 - protein, 27 aa, Mycobacterium
VSLRSLPLVILIGRPEARIPVLSFAFH

SEQ ID NO: 890328 - protein, 21 aa, Mycobacterium
VSLVLDWRRPVKLFIETKHPV

SEQ ID NO: 890329 - protein, 18 aa, Mycobacterium
VSNGRWQLSWRLPWIFTC

SEQ ID NO: 890330 - protein, 18 aa, Mycobacterium
VSNQFGYGQLIFAALGNA

SEQ ID NO: 890331 - protein, 24 aa, Mycobacterium
VSNRLRPWLHLLLALTANSAIYRG

SEQ ID NO: 890332 - protein, 24 aa, Mycobacterium
VSNSRIVVGGLWGNGGHGGTGGTG

SEQ ID NO: 890333 - protein, 20 aa, Mycobacterium
VSPPPWLDPGQWWALVRVGC

SEQ ID NO: 890334 - protein, 23 aa, Mycobacterium
VSPSMLPVLLPEGVERLLVAGVV

SEQ ID NO: 890335 - protein, 17 aa, Mycobacterium
VSQKFWPRRIAEGLNRM

SEQ ID NO: 890336 - protein, 25 aa, Mycobacterium
VSQPYLDVVLFILGITRAEIEAADA

SEQ ID NO: 890337 - protein, 21 aa, Mycobacterium
VSRELTWIGSFRFVDEITDAV

SEQ ID NO: 890338 - protein, 28 aa, Mycobacterium
VSRSVKYFLNRIGLFPTYVRQILSESEF

SEQ ID NO: 890339 - protein, 24 aa, Mycobacterium
VSRSWLYFGLIRLGIGRLQEANTC

SEQ ID NO: 890340 - protein, 19 aa, Mycobacterium
VSRYWAIDEIRPAFIHVHL

SEQ ID NO: 890341 - protein, 25 aa, Mycobacterium
VSSQAALFHDQFVQALTTGASSYAS

SEQ ID NO: 890342 - protein, 22 aa, Mycobacterium
VSSTDYVRLLFPGGRKPTIWDN

SEQ ID NO: 890343 - protein, 23 aa, Mycobacterium
VSTAIAAFFSAHAADYQRLAGQA

SEQ ID NO: 890344 - protein, 18 aa, Mycobacterium
VSTLFQPLLSTIPMQLFS

SEQ ID NO: 890345 - protein, 22 aa, Mycobacterium
VSTYGWRAYALPVLAVLTAVVM

SEQ ID NO: 890346 - protein, 25 aa, Mycobacterium
VSVEVALFIRLLGVPVIVVALPGTR

SEQ ID NO: 890347 - protein, 19 aa, Mycobacterium
VSVLYLMSLIGDLLPPGVI

SEQ ID NO: 890348 - protein, 18 aa, Mycobacterium
VSVPLVPGETLLESARRA

SEQ ID NO: 890349 - protein, 23 aa, Mycobacterium
VSVPYFPNYLGLASPFAFSGLSF

SEQ ID NO: 890350 - protein, 25 aa, Mycobacterium
VSVRAAAFHYRFVASLFAGTESYVA

SEQ ID NO: 890351 - protein, 18 aa, Mycobacterium
VSVTLPRRILVSRVDVII

SEQ ID NO: 890352 - protein, 23 aa, Mycobacterium
VSWLPLFHDMGMIGFLTVPMYFA

SEQ ID NO: 890353 - protein, 23 aa, Mycobacterium
VSWLPLFHDMGMIGFLTVPMYFG

SEQ ID NO: 890354 - protein, 18 aa, Mycobacterium
VSWLPLFHDMGMVGFLTV

SEQ ID NO: 890355 - protein, 19 aa, Mycobacterium
VSWRVLLEDLNIAWGQHHH

SEQ ID NO: 890356 - protein, 17 aa, Mycobacterium
VSWVRYPYLSSHPQYDL

SEQ ID NO: 890357 - protein, 25 aa, Mycobacterium
VTAARRTWPSPLLPALPSLMDDSGG

SEQ ID NO: 890358 - protein, 18 aa, Mycobacterium
VTAPRWLGLPARLALQAL

SEQ ID NO: 890359 - protein, 17 aa, Mycobacterium
VTAVLPPAADAVSLQTA

SEQ ID NO: 890360 - protein, 22 aa, Mycobacterium
VTEAVLWLVGPRARYVTGVSIP

SEQ ID NO: 890361 - protein, 23 aa, Mycobacterium
VTGDRFASILDPFGHRWTVMTRV

SEQ ID NO: 890362 - protein, 24 aa, Mycobacterium
VTGHDLLFDTLFLYENYPIDTSVP

SEQ ID NO: 890363 - protein, 26 aa, Mycobacterium
VTGHGAFILPVFRKARFLTLAMCEAE

SEQ ID NO: 890364 - protein, 26 aa, Mycobacterium
VTGHGSFVVPFFRKVRFLTLAMCEAE

SEQ ID NO: 890365 - protein, 24 aa, Mycobacterium
VTHAFNRWLLDDWTFNYQDRIFPV

SEQ ID NO: 890366 - protein, 21 aa, Mycobacterium
VTHDRWFARTFTRFLIFGEDG

SEQ ID NO: 890367 - protein, 20 aa, Mycobacterium
VTHRPVGPCLLITPWNFPLA

SEQ ID NO: 890368 - protein, 24 aa, Mycobacterium
VTLMSPLTFLQRPALWFDVMDRVR

SEQ ID NO: 890369 - protein, 17 aa, Mycobacterium
VTLNLAGLTLLQKSLRG

SEQ ID NO: 890370 - protein, 24 aa, Mycobacterium
VTLNSLIPLKLRWGISLGALIMHL

SEQ ID NO: 890371 - protein, 21 aa, Mycobacterium
VTLPGMLHLAILRSPYAHARI

SEQ ID NO: 890372 - protein, 17 aa, Mycobacterium
VTLSPGFRERWFSWANP

SEQ ID NO: 890373 - protein, 25 aa, Mycobacterium
VTNPSPYMYLLQIPNSAGAIDFSIV

SEQ ID NO: 890374 - protein, 25 aa, Mycobacterium
VTPAMWVWWFGWHGCDTRRYKLWHP

SEQ ID NO: 890375 - protein, 24 aa, Mycobacterium
VTPKPLKGMPPFSGPQGPFAGITA

SEQ ID NO: 890376 - protein, 19 aa, Mycobacterium
VTPVMLLLWIRGVRFMYTV

SEQ ID NO: 890377 - protein, 26 aa, Mycobacterium
VTRIVLGPRWLVPPALLVTSPQGAHD

SEQ ID NO: 890378 - protein, 21 aa, Mycobacterium
VTRLLPRFDTLTYAQVWSRVQ

SEQ ID NO: 890379 - protein, 23 aa, Mycobacterium
VTRPALALLGLLPGPVAGAVRTG

SEQ ID NO: 890380 - protein, 18 aa, Mycobacterium
VTSIYWYFRKKDDLLNAM

SEQ ID NO: 890381 - protein, 26 aa, Mycobacterium
VTSKLRFNFFVLKLPIRPPALVAKQI

SEQ ID NO: 890382 - protein, 25 aa, Mycobacterium
VTSPLGAWLLLALVAPVARGAVREQ

SEQ ID NO: 890383 - protein, 24 aa, Mycobacterium
VTTKIGFLPPPYFQAETIADFMVL

SEQ ID NO: 890384 - protein, 26 aa, Mycobacterium
VTTKLHFNFFVLKLPIRPPALVAKQI

SEQ ID NO: 890385 - protein, 18 aa, Mycobacterium
VTTLPAYNLKLFLDGILQ

SEQ ID NO: 890386 - protein, 17 aa, Mycobacterium
VTTPQMFTYQLLDRARA

SEQ ID NO: 890387 - protein, 17 aa, Mycobacterium
VTTRTFFRYFADKQAVV

SEQ ID NO: 890388 - protein, 18 aa, Mycobacterium
VTVALVVPLFEWYRQLLP

SEQ ID NO: 890389 - protein, 23 aa, Mycobacterium
VTVKTVATGILTPGLHGLHVHEI

SEQ ID NO: 890390 - protein, 19 aa, Mycobacterium
VTYRLWRDLARGWRITMPN

SEQ ID NO: 890391 - protein, 17 aa, Mycobacterium
VVAALHWDGPVSGLIAS

SEQ ID NO: 890392 - protein, 18 aa, Mycobacterium
VVAGRWLWPRNPLTGQFP

SEQ ID NO: 890393 - protein, 22 aa, Mycobacterium
VVAPEAFFQFPTSKYGLALDNW

SEQ ID NO: 890394 - protein, 17 aa, Mycobacterium
VVAPLLSRSLILQLQPL

SEQ ID NO: 890395 - protein, 22 aa, Mycobacterium
VVAPMFHAWGFSQLIFAASMAC

SEQ ID NO: 890396 - protein, 19 aa, Mycobacterium
VVAPWFLSPGLLLDRVRAE

SEQ ID NO: 890397 - protein, 20 aa, Mycobacterium
VVATPIIRWLHGLGGNVGEF

SEQ ID NO: 890398 - protein, 21 aa, Mycobacterium
VVATPIMLWLQSLDGPLKEFN

SEQ ID NO: 890399 - protein, 20 aa, Mycobacterium
VVATPIMRWLQTIDGPIDEF

SEQ ID NO: 890400 - protein, 25 aa, Mycobacterium
VVDLSIYEPLFWILGAQTSAYDQLG

SEQ ID NO: 890401 - protein, 26 aa, Mycobacterium
VVDPVINAPFEAAIGRDLIGNGAPGV

SEQ ID NO: 890402 - protein, 23 aa, Mycobacterium
VVDTGFWSFPRSCNPTGALISSV

SEQ ID NO: 890403 - protein, 17 aa, Mycobacterium
VVEAVKFLLRPDIDHLV

SEQ ID NO: 890404 - protein, 19 aa, Mycobacterium
VVEFMLLDRLFPRSVFYSL

SEQ ID NO: 890405 - protein, 18 aa, Mycobacterium
VVFARFPEQWQKLLDDRS

SEQ ID NO: 890406 - protein, 21 aa, Mycobacterium
VVFEIMVRPLIRLSLGKRQPM

SEQ ID NO: 890407 - protein, 22 aa, Mycobacterium
VVFEVMVRPLIRLSLGKRQAMR

SEQ ID NO: 890408 - protein, 17 aa, Mycobacterium
VVGAITPWNFPLGLAMW

SEQ ID NO: 890409 - protein, 31 aa, Mycobacterium
VVGIDPAAVSPWWLQRRLMLCGIRAISPAVD

SEQ ID NO: 890410 - protein, 19 aa, Mycobacterium
VVGIVLLLRDVLARSLFEK

SEQ ID NO: 890411 - protein, 30 aa, Mycobacterium; identical to SEQ ID NO: 134875

SEQ ID NO: 890412 - protein, 29 aa, Mycobacterium
VVGQIIPWNFPLLMASWKLAPALAAGNTV

SEQ ID NO: 890413 - protein, 29 aa, Mycobacterium
VVGQIIPWNFPLLMATWKLAPALAAGNAV

SEQ ID NO: 890414 - protein, 21 aa, Mycobacterium
VVGRYWVIDDISPARIHANVP

SEQ ID NO: 890415 - protein, 23 aa, Mycobacterium
VVHIRLYRPFPAQAVLTALPPTV

SEQ ID NO: 890416 - protein, 17 aa, Mycobacterium
VVHKLRRVLSGLDPHQA

SEQ ID NO: 890417 - protein, 23 aa, Mycobacterium
VVIAVPMWLTLPPAGKWPREIVC

SEQ ID NO: 890418 - protein, 17 aa, Mycobacterium
VVIGPLYCPIHETTPGP

SEQ ID NO: 890419 - protein, 19 aa, Mycobacterium
VVIPFLLPDIPVVVWWPDI

SEQ ID NO: 890420 - protein, 17 aa, Mycobacterium
VVKLHRWLQEAYEYVNR

SEQ ID NO: 890421 - protein, 17 aa, Mycobacterium
VVKTLMLTLFDSAFTAG

SEQ ID NO: 890422 - protein, 17 aa, Mycobacterium
VVLALRHQAIPPSLNFA

SEQ ID NO: 890423 - protein, 26 aa, Mycobacterium
VVLAVMPWNFPLWQAVRFAAPALMAG

SEQ ID NO: 890424 - protein, 18 aa, Mycobacterium
VVLDLVYGKPFIAALDAT

SEQ ID NO: 890425 - protein, 26 aa, Mycobacterium
VVLLDDIWWFHFALSGVITPLEDLFD

SEQ ID NO: 890426 - protein, 23 aa, Mycobacterium
VVLLMWAGILAYLDRYGYDYVTG

SEQ ID NO: 890427 - protein, 17 aa, Mycobacterium
VVLLTFGTGIGSAVINN

SEQ ID NO: 890428 - protein, 18 aa, Mycobacterium
VVLMLPFVRRVAEADLVL

SEQ ID NO: 890429 - protein, 17 aa, Mycobacterium
VVLVPDVYYREGNWQPF

SEQ ID NO: 890430 - protein, 18 aa, Mycobacterium
VVMTYWNPVLRYGVDAFA

SEQ ID NO: 890431 - protein, 17 aa, Mycobacterium
VVNALWRLGALSLGRAP

SEQ ID NO: 890432 - protein, 18 aa, Mycobacterium
VVNLLSWRYRDPGLLLAG

SEQ ID NO: 890433 - protein, 17 aa, Mycobacterium
VVNWPWRRLVLSRSANV

SEQ ID NO: 890434 - protein, 18 aa, Mycobacterium
VVPDIPISRIPIVLSLGS

SEQ ID NO: 890435 - protein, 21 aa, Mycobacterium
VVPIRVYRWKPTPLGGEFDQL

SEQ ID NO: 890436 - protein, 18 aa, Mycobacterium
VVPLFDWYQHLLPDRLHQ

SEQ ID NO: 890437 - protein, 18 aa, Mycobacterium
VVPLFEWYRQLLPDRLHQ

SEQ ID NO: 890438 - protein, 28 aa, Mycobacterium
VVPQLDAKILWQLKRALPGQFTRALGLV

SEQ ID NO: 890439 - protein, 19 aa, Mycobacterium
VVQRARDMLWLNRSRWNRT

SEQ ID NO: 890440 - protein, 22 aa, Mycobacterium
VVQRMLASRFRPLALLGTDRRL

SEQ ID NO: 890441 - protein, 20 aa, Mycobacterium
VVRPIGFEPLAWVRALAAED

SEQ ID NO: 890442 - protein, 19 aa, Mycobacterium
VVRQEPRLSWAIGDRADGT

SEQ ID NO: 890443 - protein, 18 aa, Mycobacterium
VVRRLPWLSVVPAYFVGV

SEQ ID NO: 890444 - protein, 20 aa, Mycobacterium
VVRRPLGVVASFTPWNGATI

SEQ ID NO: 890445 - protein, 22 aa, Mycobacterium
VVRSWLLDLLAKALKEDPGFDA

SEQ ID NO: 890446 - protein, 20 aa, Mycobacterium
VVRSWLQSLLAKALKEDPGF

SEQ ID NO: 890447 - protein, 22 aa, Mycobacterium
VVRVVPIPPIALGLRTGVAILS

SEQ ID NO: 890448 - protein, 18 aa, Mycobacterium
VVSILTPWNFPHCLNVMK

SEQ ID NO: 890449 - protein, 18 aa, Mycobacterium
VVSILTPWNFPHSLNVMK

SEQ ID NO: 890450 - protein, 24 aa, Mycobacterium
VVSIPTMILFKDGAPVKRIVGAKG

SEQ ID NO: 890451 - protein, 23 aa, Mycobacterium
VVSIPTMILFKDGEPVKRIVGAK

SEQ ID NO: 890452 - protein, 21 aa, Mycobacterium
VVSKYWVIDEIRPARIHANVP

SEQ ID NO: 890453 - protein, 19 aa, Mycobacterium
VVSVLTPWNFPHCLNVMKL

SEQ ID NO: 890454 - protein, 23 aa, Mycobacterium
VVSWLPLFHDMGMMGFLIVPMCR

SEQ ID NO: 890455 - protein, 22 aa, Mycobacterium
VVSWLPLFHDMGMMGLLIIPMY

SEQ ID NO: 890456 - protein, 25 aa, Mycobacterium
VVTPLSASTLLWPGGRIPEEVLEVQ

SEQ ID NO: 890457 - protein, 19 aa, Mycobacterium
VVVLWLPSGIDYATCYAAA

SEQ ID NO: 890458 - protein, 23 aa, Mycobacterium
VVVRPIGFEPLQWVRALAAEDAV

SEQ ID NO: 890459 - protein, 23 aa, Mycobacterium
VVVRPIGFEPLQWVRALAAEDPV

SEQ ID NO: 890460 - protein, 23 aa, Mycobacterium
VVVRPIGFEPLQWVRALAAEEPV

SEQ ID NO: 890461 - protein, 24 aa, Mycobacterium
VVVRPIGFEPLTWVRALAAEDPIP

SEQ ID NO: 890462 - protein, 21 aa, Mycobacterium
VVVRPVGFSPLTWVRALTAEE

SEQ ID NO: 890463 - protein, 18 aa, Mycobacterium
VWAIGYRPDYRWIAASAF

SEQ ID NO: 890464 - protein, 18 aa, Mycobacterium
VWELFWPGMTLGALYKFR

SEQ ID NO: 890465 - protein, 17 aa, Mycobacterium
VWIAQVGRIPLLLLDSD

SEQ ID NO: 890466 - protein, 17 aa, Mycobacterium
VWKMCSISQWWCAFGKK

SEQ ID NO: 890467 - protein, 19 aa, Mycobacterium
VWLPLFRPRTDAQPRPLPV

SEQ ID NO: 890468 - protein, 21 aa, Mycobacterium
VWLRPFRNLVYAMPPYICAPD

SEQ ID NO: 890469 - protein, 24 aa, Mycobacterium
VWPVMTWLFSWCFARRGWAERARL

SEQ ID NO: 890470 - protein, 17 aa, Mycobacterium
VWRIRRVAPLLPTVLLG

SEQ ID NO: 890471 - protein, 20 aa, Mycobacterium
VWTFTGPRPGGWWLRRRLHE

SEQ ID NO: 890472 - protein, 18 aa, Mycobacterium
VWWTEIFRVLRPGGSYFA

SEQ ID NO: 890473 - protein, 17 aa, Mycobacterium
VYAALRRAADTRCDGRS

SEQ ID NO: 890474 - protein, 20 aa, Mycobacterium
VYDGLWYSPLKRALESFVAH

SEQ ID NO: 890475 - protein, 18 aa, Mycobacterium
VYDGLWYSPLKRSLEAFV

SEQ ID NO: 890476 - protein, 21 aa, Mycobacterium
VYDQLPAYALPLFVRLVQAMA

SEQ ID NO: 890477 - protein, 25 aa, Mycobacterium
VYEDLAWFCIRAWRFGATESHAAGG

SEQ ID NO: 890478 - protein, 18 aa, Mycobacterium
VYERLWRPAAFYLASGVT

SEQ ID NO: 890479 - protein, 22 aa, Mycobacterium
VYGVDPLILRQAYPVSQAPYGL

SEQ ID NO: 890480 - protein, 22 aa, Mycobacterium
VYGWLLICDPPQQSLTALAAAL

SEQ ID NO: 890481 - protein, 17 aa, Mycobacterium
VYLRLRKAVRKNGVQVM

SEQ ID NO: 890482 - protein, 24 aa, Mycobacterium
VYLSPAPIYHAAPLRFCGFVQSMG

SEQ ID NO: 890483 - protein, 23 aa, Mycobacterium
VYLTAPLLTMLPPRGLTGVRTLL

SEQ ID NO: 890484 - protein, 17 aa, Mycobacterium
VYPIVVLRKAPQPELAR

SEQ ID NO: 890485 - protein, 21 aa, Mycobacterium
VYPLIWNILLAARSEGYGGTI

SEQ ID NO: 890486 - protein, 19 aa, Mycobacterium
VYQFGWFPDFPDPDNYLTP

SEQ ID NO: 890487 - protein, 23 aa, Mycobacterium
VYQNLAVVPLMPVWRNFFLGQEL

SEQ ID NO: 890488 - protein, 24 aa, Mycobacterium
VYQRTPIWIFPKFDPTTPRAVKTF

SEQ ID NO: 890489 - protein, 18 aa, Mycobacterium
VYVIPRREKHREPATSSE

SEQ ID NO: 890490 - protein, 20 aa, Mycobacterium
VYVPFSWFEPMWLENLGFAP

SEQ ID NO: 890491 - protein, 17 aa, Mycobacterium
VYYYFPTMDDLFVEVLR

SEQ ID NO: 890492 - protein, 23 aa, Mycobacterium
WAAFRLLFVTWLAGPLEPKKAAE

SEQ ID NO: 890493 - protein, 18 aa, Mycobacterium
WAALAHVPALRALPEYDL

SEQ ID NO: 890494 - protein, 18 aa, Mycobacterium
WAAPLPLMIPRRIAMELV

SEQ ID NO: 890495 - protein, 18 aa, Mycobacterium
WAATFLRRRGAGACAVLL

SEQ ID NO: 890496 - protein, 19 aa, Mycobacterium
WAAYALWVFTLFGHPDVRL

SEQ ID NO: 890497 - protein, 20 aa, Mycobacterium
WAAYALWVFTLFGHPDVRLL

SEQ ID NO: 890498 - protein, 22 aa, Mycobacterium
WAAYALWVFTLFGHPDVRLLDG

SEQ ID NO: 890499 - protein, 21 aa, Mycobacterium
WAAYALWVFTLFGHPDVRLLN

SEQ ID NO: 890500 - protein, 22 aa, Mycobacterium
WAAYALWVFTLFGHPDVRLLNG

SEQ ID NO: 890501 - protein, 18 aa, Mycobacterium
WADANVWRRVVPKGWFYN

SEQ ID NO: 890502 - protein, 20 aa, Mycobacterium
WAEMLMRMYIRWAEKHDYPV

SEQ ID NO: 890503 - protein, 17 aa, Mycobacterium
WALAWFATTRIGAVAVP

SEQ ID NO: 890504 - protein, 18 aa, Mycobacterium
WALHQYLVGLRRRYPWLH

SEQ ID NO: 890505 - protein, 20 aa, Mycobacterium
WALLHALPRLVATGIPVLLG

SEQ ID NO: 890506 - protein, 31 aa, Mycobacterium
WAMRHLPFYGRWYRFLVLWPGSDKGLDAAEG

SEQ ID NO: 890507 - protein, 23 aa, Mycobacterium
WAPVPLLSVALYRKYRPATFAEV

SEQ ID NO: 890508 - protein, 17 aa, Mycobacterium
WAQLLMVAVRIASLPGL

SEQ ID NO: 890509 - protein, 18 aa, Mycobacterium
WAQPLPSTFARWREYRRL

SEQ ID NO: 890510 - protein, 18 aa, Mycobacterium
WARWRVIRARAAWLTDEV

SEQ ID NO: 890511 - protein, 17 aa, Mycobacterium
WAYYPWRRAVVAVLGPR

SEQ ID NO: 890512 - protein, 18 aa, Mycobacterium
WCDHLILAVPLTDATRGL

SEQ ID NO: 890513 - protein, 17 aa, Mycobacterium
WCDPVWLDFPGIAFGRP

SEQ ID NO: 890514 - protein, 21 aa, Mycobacterium
WCISRQLWWGHRIPIWHGPDG

SEQ ID NO: 890515 - protein, 24 aa, Mycobacterium
WCISRQLWWGHRIPIWHGPGGEIV

SEQ ID NO: 890516 - protein, 24 aa, Mycobacterium
WCISRQLWWGHRIPIWYGPDGEKV

SEQ ID NO: 890517 - protein, 23 aa, Mycobacterium
WCISRQLWWGHRIPIWYGPGGEQ

SEQ ID NO: 890518 - protein, 22 aa, Mycobacterium
WCISRQLWWGHRIPIWYGPNGE

SEQ ID NO: 890519 - protein, 17 aa, Mycobacterium
WCMDWPAVAAAAAAGLP

SEQ ID NO: 890520 - protein, 17 aa, Mycobacterium
WCTLLTIDPRRGLVGHH

SEQ ID NO: 890521 - protein, 20 aa, Mycobacterium
WDDLPWLRSLTDLPLILKGL

SEQ ID NO: 890522 - protein, 20 aa, Mycobacterium
WDDLPWLRSLTKLPLIVKGV

SEQ ID NO: 890523 - protein, 24 aa, Mycobacterium
WDFDALWTALKTLYPVSLKPEELI

SEQ ID NO: 890524 - protein, 19 aa, Mycobacterium
WDFPIKEFHPFPRALLGVG

SEQ ID NO: 890525 - protein, 18 aa, Mycobacterium
WDGILTDPLAWHFAFHQC

SEQ ID NO: 890526 - protein, 22 aa, Mycobacterium
WDLETLWTALKTLYPVGIDHRD

SEQ ID NO: 890527 - protein, 17 aa, Mycobacterium
WDLPAMMLQFLRSGAPA

SEQ ID NO: 890528 - protein, 18 aa, Mycobacterium
WDPAFTQHYYRPVGFDDG

SEQ ID NO: 890529 - protein, 17 aa, Mycobacterium
WDPLLQPGLPEATLHWL

SEQ ID NO: 890530 - protein, 17 aa, Mycobacterium
WDPLLQPGLPEPTLAWL

SEQ ID NO: 890531 - protein, 23 aa, Mycobacterium
WDQAVIDDFWLLREYLPDAARIN

SEQ ID NO: 890532 - protein, 18 aa, Mycobacterium
WDRRPGWFRKVAGLATGV

SEQ ID NO: 890533 - protein, 25 aa, Mycobacterium
WDVRFYAPPWTLPFLRRNEIAIPVD

SEQ ID NO: 890534 - protein, 17 aa, Mycobacterium
WEANRKIFLYPENWIEP

SEQ ID NO: 890535 - protein, 17 aa, Mycobacterium
WEFALLRAALDRGLPVL

SEQ ID NO: 890536 - protein, 20 aa, Mycobacterium
WEGLQLGIRRFDAALGGLGG

SEQ ID NO: 890537 - protein, 18 aa, Mycobacterium
WELGFDYLRDNMALRLED

SEQ ID NO: 890538 - protein, 17 aa, Mycobacterium
WEMPPYVGWYRGAQDII

SEQ ID NO: 890539 - protein, 17 aa, Mycobacterium
WEPWLHALPVEFASAEQ

SEQ ID NO: 890540 - protein, 17 aa, Mycobacterium
WEQFSLWAEDIFKIVRF

SEQ ID NO: 890541 - protein, 19 aa, Mycobacterium
WFAALGAGLTLPWLASLDP

SEQ ID NO: 890542 - protein, 20 aa, Mycobacterium
WFADPWGVVFILVEKSRPER

SEQ ID NO: 890543 - protein, 20 aa, Mycobacterium
WFADPWGVVFILVEKSRPQR

SEQ ID NO: 890544 - protein, 17 aa, Mycobacterium
WFALWSGVFERFPRLRW

SEQ ID NO: 890545 - protein, 17 aa, Mycobacterium
WFDFSARYWGVLFRVYS

SEQ ID NO: 890546 - protein, 24 aa, Mycobacterium
WFDHVFYISVWWGWQDHFREIVNV

SEQ ID NO: 890547 - protein, 17 aa, Mycobacterium
WFEPMWLENLGFAPEGE

SEQ ID NO: 890548 - protein, 18 aa, Mycobacterium
WFFEDALARGLRLGASAA

SEQ ID NO: 890549 - protein, 24 aa, Mycobacterium
WFGDQPFAVWPWAAPKLGGARPVV

SEQ ID NO: 890550 - protein, 19 aa, Mycobacterium
WFMRAFRADEWLLYDQSSP

SEQ ID NO: 890551 - protein, 20 aa, Mycobacterium
WFNHSMLYAFQGAFGPLIAP

SEQ ID NO: 890552 - protein, 19 aa, Mycobacterium
WFRYHQLFRDFLRHRLSRE

SEQ ID NO: 890553 - protein, 17 aa, Mycobacterium
WFTLLGHGPTMGTVVPG

SEQ ID NO: 890554 - protein, 17 aa, Mycobacterium
WFVLMPTPIWDQLFKPL

SEQ ID NO: 890555 - protein, 18 aa, Mycobacterium
WGAGFPRRWWWGQAHDFG

SEQ ID NO: 890556 - protein, 24 aa, Mycobacterium
WGDPRCPLWLKAETLQPIGAFKIR

SEQ ID NO: 890557 - protein, 19 aa, Mycobacterium
WGGLQCDPTLFFEATRRLA

SEQ ID NO: 890558 - protein, 31 aa, Mycobacterium; identical to SEQ ID NO: 134887

SEQ ID NO: 890559 - protein, 31 aa, Mycobacterium
WGIDSWLFYPNFMLLIWEPGWYLTYHYWPTA

SEQ ID NO: 890560 - protein, 18 aa, Mycobacterium
WGIEVPMEILPLLTIRDL

SEQ ID NO: 890561 - protein, 20 aa, Mycobacterium
WGSLQWMWVWFDPADSRTPE

SEQ ID NO: 890562 - protein, 17 aa, Mycobacterium
WGVIALPDKPGLDAAGM

SEQ ID NO: 890563 - protein, 17 aa, Mycobacterium
WGVLAAPLTLVPAPTRR

SEQ ID NO: 890564 - protein, 28 aa, Mycobacterium
WGVLARALPAPWRAEALVLLAFSAYVRG

SEQ ID NO: 890565 - protein, 18 aa, Mycobacterium
WGWDDILPIFKRFEDNEF

SEQ ID NO: 890566 - protein, 17 aa, Mycobacterium
WHALRKLAARITTPLLP

SEQ ID NO: 890567 - protein, 18 aa, Mycobacterium
WHLKRHIPNPYRWGAGLI

SEQ ID NO: 890568 - protein, 26 aa, Mycobacterium
WHMAAPCPVWLKQAWIDLLGPEVIWE

SEQ ID NO: 890569 - protein, 18 aa, Mycobacterium
WHPIRLAHQMAYLDIISN

SEQ ID NO: 890570 - protein, 20 aa, Mycobacterium
WHPMDLLVLLFGVGLAWAQS

SEQ ID NO: 890571 - protein, 18 aa, Mycobacterium
WHPVRLAHQIAYLDILSN

SEQ ID NO: 890572 - protein, 23 aa, Mycobacterium
WHQLARTFLMYRTQRWPDVLLAA

SEQ ID NO: 890573 - protein, 21 aa, Mycobacterium
WHQYWIDTRLQWYVDLGIDRD

SEQ ID NO: 890574 - protein, 19 aa, Mycobacterium
WHVVRSDELWFWHAGGPLE

SEQ ID NO: 890575 - protein, 21 aa, Mycobacterium
WHYHDCVFQWLFITKGWLELQ

SEQ ID NO: 890576 - protein, 24 aa, Mycobacterium
WIEMESFRLLVLRTAWLIDKHQDY

SEQ ID NO: 890577 - protein, 19 aa, Mycobacterium
WIFRTIFEPWEKHPRMLQA

SEQ ID NO: 890578 - protein, 17 aa, Mycobacterium
WIGSFRFVDEITDAVAA

SEQ ID NO: 890579 - protein, 24 aa, Mycobacterium
WIHSHALHIFLLHLPDFLGHPDGI

SEQ ID NO: 890580 - protein, 21 aa, Mycobacterium
WIKPRDAWLIDRATLQPGPTF

SEQ ID NO: 890581 - protein, 17 aa, Mycobacterium
WILEIHLVDRPRGFGGF

SEQ ID NO: 890582 - protein, 18 aa, Mycobacterium
WILRRPPFGRLQAGAHDV

SEQ ID NO: 890583 - protein, 21 aa, Mycobacterium
WIMPRDAWLIDRATLQPGPTF

SEQ ID NO: 890584 - protein, 25 aa, Mycobacterium
WINSHALHIYLLHAPDFLGYPDIVG

SEQ ID NO: 890585 - protein, 17 aa, Mycobacterium
WIRQGLVARGMVVSGEY

SEQ ID NO: 890586 - protein, 31 aa, Mycobacterium
WISGEFSKLVQFILNLVNAPSELLFGRMMIG

SEQ ID NO: 890587 - protein, 21 aa, Mycobacterium
WIVRVVMSLAVWPIGDAAAEA

SEQ ID NO: 890588 - protein, 17 aa, Mycobacterium
WIVWQLTGRYVRNISTA

SEQ ID NO: 890589 - protein, 23 aa, Mycobacterium
WIYGGLTLNPLFWPARHDETLLM

SEQ ID NO: 890590 - protein, 18 aa, Mycobacterium
WIYLAGRTPDWMRINGEN

SEQ ID NO: 890591 - protein, 27 aa, Mycobacterium
WKKYNIFNLVWNTLLALLFEWGVALQH

SEQ ID NO: 890592 - protein, 20 aa, Mycobacterium
WKYLMALFNSKIDEHADPKV

SEQ ID NO: 890593 - protein, 18 aa, Mycobacterium
WKYLMALFSSKIDEYADP

SEQ ID NO: 890594 - protein, 17 aa, Mycobacterium
WKYLMALFSSKVDEYAD

SEQ ID NO: 890595 - protein, 18 aa, Mycobacterium
WKYLMALFSSKVDEYADP

SEQ ID NO: 890596 - protein, 17 aa, Mycobacterium
WKYLTALFNAKIDEHAD

SEQ ID NO: 890597 - protein, 17 aa, Mycobacterium
WLAFSRLLGRRAAGLPF

SEQ ID NO: 890598 - protein, 17 aa, Mycobacterium
WLDAFMQWRRAQGLPAT

SEQ ID NO: 890599 - protein, 19 aa, Mycobacterium
WLDALVTWRRASGLPAAVI

SEQ ID NO: 890600 - protein, 26 aa, Mycobacterium
WLDVYRNFWTFFFHTFWKVREIRTMW

SEQ ID NO: 890601 - protein, 17 aa, Mycobacterium
WLFLAHADQFHRPGDFF

SEQ ID NO: 890602 - protein, 17 aa, Mycobacterium
WLGYEPPGTDISVAEAG

SEQ ID NO: 890603 - protein, 17 aa, Mycobacterium
WLHGWRLTFGGEDIGWE

SEQ ID NO: 890604 - protein, 20 aa, Mycobacterium
WLIRVFLGLWAWPLKDPAAE

SEQ ID NO: 890605 - protein, 18 aa, Mycobacterium
WLKLCFRYYSDWDLQTTS

SEQ ID NO: 890606 - protein, 17 aa, Mycobacterium
WLLALPAHHVAGFQVLV

SEQ ID NO: 890607 - protein, 17 aa, Mycobacterium
WLLMNPSREASLEAAIA

SEQ ID NO: 890608 - protein, 18 aa, Mycobacterium
WLLVELRSDWFFGGTTYG

SEQ ID NO: 890609 - protein, 18 aa, Mycobacterium
WLQVIWDLLTGSGPAWWQ

SEQ ID NO: 890610 - protein, 21 aa, Mycobacterium
WLREGLRFWMRTAITHQLFTW

SEQ ID NO: 890611 - protein, 19 aa, Mycobacterium
WLRLVLIDAGLPRPTTQIR

SEQ ID NO: 890612 - protein, 19 aa, Mycobacterium
WLRPFRNLVYAMPPYICSD

SEQ ID NO: 890613 - protein, 18 aa, Mycobacterium
WLRRFVGLGGASRTTQRN

SEQ ID NO: 890614 - protein, 17 aa, Mycobacterium
WLRRLGVVYTYDAPWHR

SEQ ID NO: 890615 - protein, 19 aa, Mycobacterium
WLRTMFAIMPLPVGTRDQD

SEQ ID NO: 890616 - protein, 17 aa, Mycobacterium
WLTRWYAFSSADLGSSP

SEQ ID NO: 890617 - protein, 19 aa, Mycobacterium
WLTSWSKPGLIPVALVIVN

SEQ ID NO: 890618 - protein, 19 aa, Mycobacterium
WLTSWSKPGLIPVALVVVN

SEQ ID NO: 890619 - protein, 17 aa, Mycobacterium
WLTVLLRRDLGLVVMMG

SEQ ID NO: 890620 - protein, 17 aa, Mycobacterium
WLVSAPPSVVVGGVVNG

SEQ ID NO: 890621 - protein, 19 aa, Mycobacterium
WMHLGIDLFWFALPPAQLD

SEQ ID NO: 890622 - protein, 17 aa, Mycobacterium
WMPFGRVFETLAWGRRH

SEQ ID NO: 890623 - protein, 17 aa, Mycobacterium
WMQRWPIRSYAARKWFT

SEQ ID NO: 890624 - protein, 17 aa, Mycobacterium
WMVDTLLALLQTPSPAG

SEQ ID NO: 890625 - protein, 18 aa, Mycobacterium
WMVLSALDRALLNAPDTP

SEQ ID NO: 890626 - protein, 20 aa, Mycobacterium
WMVPTRLALVRRLGSIELDL

SEQ ID NO: 890627 - protein, 17 aa, Mycobacterium
WMWAMVRDAVLDRVLNA

SEQ ID NO: 890628 - protein, 17 aa, Mycobacterium
WNFPHQINLAKIGPALA

SEQ ID NO: 890629 - protein, 20 aa, Mycobacterium
WNFPLNLVVLPAVAAFAAGN

SEQ ID NO: 890630 - protein, 17 aa, Mycobacterium
WNFPVQLTVLPAAAAFA

SEQ ID NO: 890631 - protein, 19 aa, Mycobacterium
WNQQTWRRVLDGGHWLPFS

SEQ ID NO: 890632 - protein, 18 aa, Mycobacterium
WPAKSLPVPLVVALIGAH

SEQ ID NO: 890633 - protein, 18 aa, Mycobacterium
WPELIPLLQSGRLDVDGI

SEQ ID NO: 890634 - protein, 19 aa, Mycobacterium
WPEPLGRLAFTFRYRGHRL

SEQ ID NO: 890635 - protein, 17 aa, Mycobacterium
WPFLFRLTTIKKPETRA

SEQ ID NO: 890636 - protein, 18 aa, Mycobacterium
WPSFPLPLGDTWSSTRGD

SEQ ID NO: 890637 - protein, 17 aa, Mycobacterium
WPSLLMTGDLWAGQAAR

SEQ ID NO: 890638 - protein, 18 aa, Mycobacterium
WPTAMKKFVWPWLVGRRQ

SEQ ID NO: 890639 - protein, 19 aa, Mycobacterium
WPWTDQWLMLWRNTIGYSP

SEQ ID NO: 890640 - protein, 18 aa, Mycobacterium
WQDIFGKDNFFLELMDHG

SEQ ID NO: 890641 - protein, 17 aa, Mycobacterium
WQHLPFAAQWHSDNELA

SEQ ID NO: 890642 - protein, 17 aa, Mycobacterium
WQRLLFDNGWLLPGQPP

SEQ ID NO: 890643 - protein, 19 aa, Mycobacterium
WQRSWALACQKAFAGLEVD

SEQ ID NO: 890644 - protein, 20 aa, Mycobacterium
WQTAGVLLGIWWAGAELVFG

SEQ ID NO: 890645 - protein, 17 aa, Mycobacterium
WRAGRLPVEKLKSDDLP

SEQ ID NO: 890646 - protein, 18 aa, Mycobacterium
WRALGWWLVGTSRAMLSL

SEQ ID NO: 890647 - protein, 17 aa, Mycobacterium
WRAPLRFLFIDGGHSEA

SEQ ID NO: 890648 - protein, 17 aa, Mycobacterium
WRDLLLTLEQRLLLTQK

SEQ ID NO: 890649 - protein, 23 aa, Mycobacterium
WRDPRVWWQLRNPFRPSWGEPYT

SEQ ID NO: 890650 - protein, 19 aa, Mycobacterium
WRFTPFFWQEIDEGILPAL

SEQ ID NO: 890651 - protein, 23 aa, Mycobacterium
WRHGQWYTARLRPGPLRPAERRT

SEQ ID NO: 890652 - protein, 21 aa, Mycobacterium
WRHQLQGLIPCLFPATRSGTS

SEQ ID NO: 890653 - protein, 17 aa, Mycobacterium
WRHWLYVTTRINLGLSP

SEQ ID NO: 890654 - protein, 17 aa, Mycobacterium
WRIDFLDGMPVPYWVIR

SEQ ID NO: 890655 - protein, 17 aa, Mycobacterium
WRIDWNTLLDASVPIAL

SEQ ID NO: 890656 - protein, 17 aa, Mycobacterium
WRLRRRYGLPVHDIAPM

SEQ ID NO: 890657 - protein, 20 aa, Mycobacterium
WRRVLDGGHWLPFSHPQVLA

SEQ ID NO: 890658 - protein, 17 aa, Mycobacterium
WRTRDRKGYHVEYGYSC

SEQ ID NO: 890659 - protein, 19 aa, Mycobacterium
WRVIPAVSMTLALAARYAS

SEQ ID NO: 890660 - protein, 17 aa, Mycobacterium
WRVNCLGPFLGIRTALP

SEQ ID NO: 890661 - protein, 17 aa, Mycobacterium
WRVVKLWERIKAPLLDA

SEQ ID NO: 890662 - protein, 18 aa, Mycobacterium
WSFLYRKMIPILVAAGHR

SEQ ID NO: 890663 - protein, 17 aa, Mycobacterium
WSHPGAPAFWYQPSRNG

SEQ ID NO: 890664 - protein, 25 aa, Mycobacterium
WSLDRLVTFFSSRRLRRVRLLKRVA

SEQ ID NO: 890665 - protein, 23 aa, Mycobacterium
WSLFTRLMPILPTTETSSGAGMA

SEQ ID NO: 890666 - protein, 22 aa, Mycobacterium
WSLFTRLMPVLPTTETSSGAGM

SEQ ID NO: 890667 - protein, 17 aa, Mycobacterium
WSLMRRDEQFRSALASR

SEQ ID NO: 890668 - protein, 20 aa, Mycobacterium
WSMALSLRLAAYELLRADGS

SEQ ID NO: 890669 - protein, 19 aa, Mycobacterium
WSYLYRKMIPVLAAAGHRV

SEQ ID NO: 890670 - protein, 20 aa, Mycobacterium
WTLDGYLRHGGYRGLRTALG

SEQ ID NO: 890671 - protein, 17 aa, Mycobacterium
WTQWIFLQIYNAWFDRD

SEQ ID NO: 890672 - protein, 17 aa, Mycobacterium
WTVLIFMLWHAIFVEQS

SEQ ID NO: 890673 - protein, 18 aa, Mycobacterium
WVALFRWVKPVLSSAVGE

SEQ ID NO: 890674 - protein, 17 aa, Mycobacterium
WVAVRPPPLFGTEPDAR

SEQ ID NO: 890675 - protein, 20 aa, Mycobacterium
WVDANVWRRIVPKGWFYNVM

SEQ ID NO: 890676 - protein, 18 aa, Mycobacterium
WVFAPRPPADGTPPVLLF

SEQ ID NO: 890677 - protein, 17 aa, Mycobacterium
WVGSHAPRRMWLPLVGR

SEQ ID NO: 890678 - protein, 17 aa, Mycobacterium
WVHPLRAPRRLPGMLTG

SEQ ID NO: 890679 - protein, 20 aa, Mycobacterium
WVMISRILDLLFIHAVREWS

SEQ ID NO: 890680 - protein, 17 aa, Mycobacterium
WVNLPKKDKFAPPRYQA

SEQ ID NO: 890681 - protein, 17 aa, Mycobacterium
WVQLYLGPLAVALGDRV

SEQ ID NO: 890682 - protein, 18 aa, Mycobacterium
WVRLLREAGIPTGPVHDM

SEQ ID NO: 890683 - protein, 17 aa, Mycobacterium
WVRYPFLGTHPQYELAK

SEQ ID NO: 890684 - protein, 21 aa, Mycobacterium
WVVRIVLSLMYWPAESEDVER

SEQ ID NO: 890685 - protein, 19 aa, Mycobacterium
WVVRVVLSLVYWPGEDEEA

SEQ ID NO: 890686 - protein, 18 aa, Mycobacterium
WVYLPKACTWRQVPDGPT

SEQ ID NO: 890687 - protein, 17 aa, Mycobacterium
WWDDALAWSGATRSLMP

SEQ ID NO: 890688 - protein, 17 aa, Mycobacterium
WWDWAPGASWRHPFGPD

SEQ ID NO: 890689 - protein, 19 aa, Mycobacterium
WWEWAATYERAFSAAYDAL

SEQ ID NO: 890690 - protein, 17 aa, Mycobacterium
WWEWAATYERAFTAAYD

SEQ ID NO: 890691 - protein, 19 aa, Mycobacterium
WWFRLPRHPGDPRGLAGVL

SEQ ID NO: 890692 - protein, 18 aa, Mycobacterium
WWLHLQVFSIQRAPRKLK

SEQ ID NO: 890693 - protein, 17 aa, Mycobacterium
WWLKQAFYFSLTAVNDA

SEQ ID NO: 890694 - protein, 18 aa, Mycobacterium
WWRVVDLWQRIKAPLLDA

SEQ ID NO: 890695 - protein, 17 aa, Mycobacterium
WWRWVPGACWRHPFGPH

SEQ ID NO: 890696 - protein, 17 aa, Mycobacterium
WYELGRKLAPKGTGAVL

SEQ ID NO: 890697 - protein, 17 aa, Mycobacterium
WYFQRYITHLPAGGEIV

SEQ ID NO: 890698 - protein, 19 aa, Mycobacterium
WYRIPAFYFACPATVLGPY

SEQ ID NO: 890699 - protein, 20 aa, Mycobacterium
WYRIPAFYFACPATVLGPYD

SEQ ID NO: 890700 - protein, 17 aa, Mycobacterium
WYTVLACFKLGIILEGT

SEQ ID NO: 890701 - protein, 20 aa, Mycobacterium
WYYKFRLPERDPSTGRYPWI

SEQ ID NO: 890702 - protein, 24 aa, Mycobacterium
YAALIGPRCRAVWLLTARAETVGP

SEQ ID NO: 890703 - protein, 17 aa, Mycobacterium
YAAPYLRDSLLAAGALC

SEQ ID NO: 890704 - protein, 21 aa, Mycobacterium
YAAYLGWAVRLARPGALIVAD

SEQ ID NO: 890705 - protein, 17 aa, Mycobacterium
YADWIFCLVRTDPNAPK

SEQ ID NO: 890706 - protein, 18 aa, Mycobacterium
YADWIFCLVRTDPQAPKR

SEQ ID NO: 890707 - protein, 20 aa, Mycobacterium
YAEGLRALYLYTATYQDAAV

SEQ ID NO: 890708 - protein, 24 aa, Mycobacterium
YAEIGLLGFALITDALGGVDVCLN

SEQ ID NO: 890709 - protein, 24 aa, Mycobacterium
YAEIGLLGFALITDALGGVNVCLN

SEQ ID NO: 890710 - protein, 26 aa, Mycobacterium
YAEQMLLSAPLLLPIPNGLDPRHAAL

SEQ ID NO: 890711 - protein, 22 aa, Mycobacterium
YAFQRQRFWLPPAPTGSVDPAG

SEQ ID NO: 890712 - protein, 19 aa, Mycobacterium
YAFQRRHYWLAAPTPTPAT

SEQ ID NO: 890713 - protein, 20 aa, Mycobacterium
YAGELLFLYNGIRPRHVMPV

SEQ ID NO: 890714 - protein, 20 aa, Mycobacterium
YAGLFVRMSWHAAGTYRIFD

SEQ ID NO: 890715 - protein, 17 aa, Mycobacterium
YAIPFPPLGERFDRLTE

SEQ ID NO: 890716 - protein, 18 aa, Mycobacterium
YAKTWRTLAKLSLPNKYL

SEQ ID NO: 890717 - protein, 17 aa, Mycobacterium
YALNILLATATDLWALR

SEQ ID NO: 890718 - protein, 21 aa, Mycobacterium
YAMGPGIRRLLRLGMTAPLKA

SEQ ID NO: 890719 - protein, 20 aa, Mycobacterium
YAMTTLIDLAPRPALPDITE

SEQ ID NO: 890720 - protein, 22 aa, Mycobacterium
YAPNRTGWLLPFASQLVSSSEA

SEQ ID NO: 890721 - protein, 22 aa, Mycobacterium
YAPQRWKYLTSGLLGLQRGTDA

SEQ ID NO: 890722 - protein, 21 aa, Mycobacterium
YAPRLWRYWAQHLDPDRARRD

SEQ ID NO: 890723 - protein, 21 aa, Mycobacterium
YAPVYFYRYDYAPGALRIAGM

SEQ ID NO: 890724 - protein, 17 aa, Mycobacterium
YAPYHQHFLIARLDLDI

SEQ ID NO: 890725 - protein, 21 aa, Mycobacterium
YARALFADDLRPLPLDAPMVV

SEQ ID NO: 890726 - protein, 22 aa, Mycobacterium
YARLYAWLGLWERRTDLAVIPA

SEQ ID NO: 890727 - protein, 26 aa, Mycobacterium
YASYRNMLWTRWPSSGPPPYFDSVDH

SEQ ID NO: 890728 - protein, 24 aa, Mycobacterium
YATTPVSWFLFPALTRHHTRQQAR

SEQ ID NO: 890729 - protein, 18 aa, Mycobacterium
YAVGLHLLPDLRLQELAL

SEQ ID NO: 890730 - protein, 20 aa, Mycobacterium
YAWWHERWRLINVLRKRDRI

SEQ ID NO: 890731 - protein, 20 aa, Mycobacterium
YCLRDYFRILAWKRGSTPGL

SEQ ID NO: 890732 - protein, 25 aa, Mycobacterium
YDAYLRLHLLSHRLVAPHGLNADGL

SEQ ID NO: 890733 - protein, 19 aa, Mycobacterium
YDDARLLVHAIRRVWKLTE

SEQ ID NO: 890734 - protein, 20 aa, Mycobacterium
YDDARLLVHAIRRVWQLTEF

SEQ ID NO: 890735 - protein, 25 aa, Mycobacterium
YDELIARTQWWGRQMLIWGVHVHVG

SEQ ID NO: 890736 - protein, 21 aa, Mycobacterium
YDGFTFLTIAWLEALGICADG

SEQ ID NO: 890737 - protein, 20 aa, Mycobacterium
YDGFTYLTIAWLEALGICGD

SEQ ID NO: 890738 - protein, 19 aa, Mycobacterium
YDGFTYLTLAWLEALGVCG

SEQ ID NO: 890739 - protein, 18 aa, Mycobacterium
YDGLLAWLRGLVGTGYVA

SEQ ID NO: 890740 - protein, 18 aa, Mycobacterium
YDIDLWSRMSRELGLPSL

SEQ ID NO: 890741 - protein, 22 aa, Mycobacterium
YDILTPLIWRLDTFWLSMRDQT

SEQ ID NO: 890742 - protein, 18 aa, Mycobacterium
YDMSMARLLYWGCDVWLN

SEQ ID NO: 890743 - protein, 18 aa, Mycobacterium
YDVAYWWKIKGGKLIHLP

SEQ ID NO: 890744 - protein, 20 aa, Mycobacterium
YDYYPLRLPPEITRITASLR

SEQ ID NO: 890745 - protein, 18 aa, Mycobacterium
YEALLAWGRRRGATRAHL

SEQ ID NO: 890746 - protein, 18 aa, Mycobacterium
YEALRPYRSSAEDLDALQ

SEQ ID NO: 890747 - protein, 22 aa, Mycobacterium
YEDLAWFCVRAWRFGAPASLGA

SEQ ID NO: 890748 - protein, 17 aa, Mycobacterium
YEDLYMLPAARQFVPVV

SEQ ID NO: 890749 - protein, 18 aa, Mycobacterium
YEDRPTLVLPGSGKTITG

SEQ ID NO: 890750 - protein, 20 aa, Mycobacterium
YEDWAAQWLALRPAADVGER

SEQ ID NO: 890751 - protein, 17 aa, Mycobacterium
YEGLLGFEFWWELDAPD

SEQ ID NO: 890752 - protein, 24 aa, Mycobacterium
YEIRTLFGVLFQDGALFGSMNIYD

SEQ ID NO: 890753 - protein, 17 aa, Mycobacterium
YERLWRPTSFYLASGIT

SEQ ID NO: 890754 - protein, 17 aa, Mycobacterium
YETTVRLYILPFIDGRT

SEQ ID NO: 890755 - protein, 18 aa, Mycobacterium
YEWAILDLAILAVGAVTV

SEQ ID NO: 890756 - protein, 22 aa, Mycobacterium
YEYGFFWYFYNDASIEVEVKLS

SEQ ID NO: 890757 - protein, 19 aa, Mycobacterium
YEYLTYWRFYQDGNIECEV

SEQ ID NO: 890758 - protein, 18 aa, Mycobacterium
YEYLVYWRFYQDGNIECE

SEQ ID NO: 890759 - protein, 19 aa, Mycobacterium
YFAALLGLPFVAVMPAATS

SEQ ID NO: 890760 - protein, 25 aa, Mycobacterium
YFAGALLLPYVLFLDAAQSVRYDID

SEQ ID NO: 890761 - protein, 17 aa, Mycobacterium
YFALCLTLEELARADQS

SEQ ID NO: 890762 - protein, 17 aa, Mycobacterium
YFAVAYYGVLRAGGVVV

SEQ ID NO: 890763 - protein, 18 aa, Mycobacterium
YFCFPEVDIRIPFNAGMA

SEQ ID NO: 890764 - protein, 18 aa, Mycobacterium
YFEDDVHLWDWAAGALIA

SEQ ID NO: 890765 - protein, 24 aa, Mycobacterium
YFEDPGYVPLLLRSYELWERLAID

SEQ ID NO: 890766 - protein, 17 aa, Mycobacterium
YFLPLDKAGIDPFVTAY

SEQ ID NO: 890767 - protein, 17 aa, Mycobacterium
YFRLLPQGLVQRLVPKP

SEQ ID NO: 890768 - protein, 26 aa, Mycobacterium
YFSMTGWRLGWMLVPRRFLRAVDRLS

SEQ ID NO: 890769 - protein, 24 aa, Mycobacterium
YGASPMPLPLLRQALEAWPNTDFM

SEQ ID NO: 890770 - protein, 23 aa, Mycobacterium
YGDFFSFYLCDIVLKLNGKGGQP

SEQ ID NO: 890771 - protein, 17 aa, Mycobacterium
YGDLFPHAVRWKGTTYL

SEQ ID NO: 890772 - protein, 23 aa, Mycobacterium
YGGLSWWGNFGEFGFLTKLRSEQ

SEQ ID NO: 890773 - protein, 24 aa, Mycobacterium
YGGTYNLFHYSLAKLGIEVSFVED

SEQ ID NO: 890774 - protein, 17 aa, Mycobacterium
YGKPQFWPLWEAAADAN

SEQ ID NO: 890775 - protein, 25 aa, Mycobacterium
YGLGYISPWVKLPAPVKFAFADESI

SEQ ID NO: 890776 - protein, 20 aa, Mycobacterium
YGLKPLVRLVSWGVAGVAPN

SEQ ID NO: 890777 - protein, 23 aa, Mycobacterium
YGLLRPRQVLFTYLHLAASRACT

SEQ ID NO: 890778 - protein, 17 aa, Mycobacterium
YGLLRPVTGSASVLLCN

SEQ ID NO: 890779 - protein, 19 aa, Mycobacterium
YGLYLSMLRRIGHYRWFAA

SEQ ID NO: 890780 - protein, 19 aa, Mycobacterium
YGNFILLGTILVGAPITSY

SEQ ID NO: 890781 - protein, 21 aa, Mycobacterium
YGNVLRFLPPLSMPDHLLDEG

SEQ ID NO: 890782 - protein, 18 aa, Mycobacterium
YGPLFIRMAWHAAGTYRV

SEQ ID NO: 890783 - protein, 18 aa, Mycobacterium
YGQLLQLLKNRLLLSELR

SEQ ID NO: 890784 - protein, 17 aa, Mycobacterium
YGQLLQLLKNRLLLTDL

SEQ ID NO: 890785 - protein, 20 aa, Mycobacterium
YGRNFLLPRGMAIVASRGAQ

SEQ ID NO: 890786 - protein, 18 aa, Mycobacterium
YGRRELLAAMPPFLTGGS

SEQ ID NO: 890787 - protein, 23 aa, Mycobacterium
YGSGWWPFLTPPERIAERLDYLK

SEQ ID NO: 890788 - protein, 18 aa, Mycobacterium
YGSRWRLAFGYPAARFDA

SEQ ID NO: 890789 - protein, 20 aa, Mycobacterium
YGTVWRVDFLWRSARLIGEY

SEQ ID NO: 890790 - protein, 18 aa, Mycobacterium
YGTYRRQLSLGDGIDTGA

SEQ ID NO: 890791 - protein, 24 aa, Mycobacterium
YGVDPLILRQAYPVPRAPYGLAGS

SEQ ID NO: 890792 - protein, 17 aa, Mycobacterium
YGVSRLFPAALRRAARS

SEQ ID NO: 890793 - protein, 18 aa, Mycobacterium
YGWHPHAWRYAFAHNATG

SEQ ID NO: 890794 - protein, 17 aa, Mycobacterium
YGYFMRRLAERPANLAF

SEQ ID NO: 890795 - protein, 22 aa, Mycobacterium
YHDLRIIDNVRYFAALYGYNRQ

SEQ ID NO: 890796 - protein, 17 aa, Mycobacterium
YHLYLQPGPDIVDEAGG

SEQ ID NO: 890797 - protein, 24 aa, Mycobacterium
YHPKWAWWITKIPALREVLVSNLV

SEQ ID NO: 890798 - protein, 18 aa, Mycobacterium
YHRLWEPKIPLGRIGRPE

SEQ ID NO: 890799 - protein, 18 aa, Mycobacterium
YHRLWEPKIPLGRLGRPD

SEQ ID NO: 890800 - protein, 24 aa, Mycobacterium
YHTNGFATFFFLLAGDHLVILEKF

SEQ ID NO: 890801 - protein, 24 aa, Mycobacterium
YHVSPWVIMLPLDSTGEHLLDVDA

SEQ ID NO: 890802 - protein, 18 aa, Mycobacterium
YIALWRTLLGLDLMATVD

SEQ ID NO: 890803 - protein, 17 aa, Mycobacterium
YIASWYAAPLLAAQDRA

SEQ ID NO: 890804 - protein, 25 aa, Mycobacterium
YIDVKGLCLTLWQAAWRVSEDLPSD

SEQ ID NO: 890805 - protein, 20 aa, Mycobacterium
YIEYLTAVPWLGAALNAVNI

SEQ ID NO: 890806 - protein, 24 aa, Mycobacterium
YIGFFLCPVVPELFFRSGIGVKLV

SEQ ID NO: 890807 - protein, 17 aa, Mycobacterium
YIHHAYPTYFKNVIEGH

SEQ ID NO: 890808 - protein, 18 aa, Mycobacterium
YIHRLRKYIGAYLAILGS

SEQ ID NO: 890809 - protein, 25 aa, Mycobacterium
YILDFGWFPFPLPPLPSFPVPGAAG

SEQ ID NO: 890810 - protein, 21 aa, Mycobacterium
YIPIIGAPWLADLVRRSPWAE

SEQ ID NO: 890811 - protein, 18 aa, Mycobacterium
YIPLLEELGFMPSKKFAD

SEQ ID NO: 890812 - protein, 20 aa, Mycobacterium
YIPLVGWAMSASFQAPICAA

SEQ ID NO: 890813 - protein, 23 aa, Mycobacterium
YIQDLPALVDWLAERFPKCVVSY

SEQ ID NO: 890814 - protein, 18 aa, Mycobacterium
YIQSLLDDWSFPATDPAV

SEQ ID NO: 890815 - protein, 18 aa, Mycobacterium
YIQSLLDEWSFPATDPAV

SEQ ID NO: 890816 - protein, 28 aa, Mycobacterium
YKCRVRKPWWRVPYLRPADLFLTYMNAD

SEQ ID NO: 890817 - protein, 25 aa, Mycobacterium
YKCRVRTPWYLVPLVEPADLLLTCM

SEQ ID NO: 890818 - protein, 24 aa, Mycobacterium
YKCSIRTPWWRTPSLWIPDLFMLR

SEQ ID NO: 890819 - protein, 22 aa, Mycobacterium
YKFFPFAAWQAGAWWVLRFNFG

SEQ ID NO: 890820 - protein, 19 aa, Mycobacterium
YKGHLYIAGRIKDLVIIDG

SEQ ID NO: 890821 - protein, 22 aa, Mycobacterium
YKKLLLAMLQRRDAWQIVDMVN

SEQ ID NO: 890822 - protein, 20 aa, Mycobacterium
YKMPANQFNLAWSADRIGAM

SEQ ID NO: 890823 - protein, 19 aa, Mycobacterium
YKMPPNHFDLAWSADKVGA

SEQ ID NO: 890824 - protein, 25 aa, Mycobacterium
YLADKVVRWWLPERWTFVDEIPRTS

SEQ ID NO: 890825 - protein, 18 aa, Mycobacterium
YLANYHMAWYAVICRRGG

SEQ ID NO: 890826 - protein, 19 aa, Mycobacterium
YLARPVFQPLFYDSNQREL

SEQ ID NO: 890827 - protein, 24 aa, Mycobacterium
YLDTGAMYRIVTLNALRAGVDLDD

SEQ ID NO: 890828 - protein, 19 aa, Mycobacterium
YLDWLPTLLAVRERGRRAY

SEQ ID NO: 890829 - protein, 24 aa, Mycobacterium
YLEETFLFPPLRKAGIMKPIFVML

SEQ ID NO: 890830 - protein, 18 aa, Mycobacterium
YLEFAYIPDEIHALFDHI

SEQ ID NO: 890831 - protein, 18 aa, Mycobacterium
YLFAFLDDHSRLLPGYRW

SEQ ID NO: 890832 - protein, 17 aa, Mycobacterium
YLFAPDAALPLISRRDD

SEQ ID NO: 890833 - protein, 18 aa, Mycobacterium
YLFKHPQVDFIWVTGGPK

SEQ ID NO: 890834 - protein, 18 aa, Mycobacterium
YLGARLWRNGIGAAMQSF

SEQ ID NO: 890835 - protein, 18 aa, Mycobacterium
YLGFDIFYRVEGSGPPLL

SEQ ID NO: 890836 - protein, 20 aa, Mycobacterium
YLGFTQWALLQDPPPELAAA

SEQ ID NO: 890837 - protein, 19 aa, Mycobacterium
YLGFTQWALLTDPPPELAA

SEQ ID NO: 890838 - protein, 18 aa, Mycobacterium
YLGLLRFLFGLDLIDRVV

SEQ ID NO: 890839 - protein, 18 aa, Mycobacterium
YLGLLRFLLGLDLIDRVV

SEQ ID NO: 890840 - protein, 20 aa, Mycobacterium
YLGPFLLTHLLLPQLQASRS

SEQ ID NO: 890841 - protein, 19 aa, Mycobacterium
YLGPITIPQINITGPVLSF

SEQ ID NO: 890842 - protein, 25 aa, Mycobacterium
YLHKDIGPAWAFLGWARPGSDWERR

SEQ ID NO: 890843 - protein, 17 aa, Mycobacterium
YLHLFDPAQPDLNWNNP

SEQ ID NO: 890844 - protein, 18 aa, Mycobacterium
YLISGLPFIFLPKESQNL

SEQ ID NO: 890845 - protein, 17 aa, Mycobacterium
YLKPLLEGKIRSAFAMT

SEQ ID NO: 890846 - protein, 27 aa, Mycobacterium
YLLAVGDLIIGWRLLVQAGVAHAALAN

SEQ ID NO: 890847 - protein, 26 aa, Mycobacterium
YLLAVGDLLIGWRLLVQAGVAHAALA

SEQ ID NO: 890848 - protein, 17 aa, Mycobacterium
YLPRYRLAGADIGLRRG

SEQ ID NO: 890849 - protein, 19 aa, Mycobacterium
YLPVIRLLEPSLSAGALIV

SEQ ID NO: 890850 - protein, 19 aa, Mycobacterium
YLQIPMDRWVFPYAGTDSH

SEQ ID NO: 890851 - protein, 19 aa, Mycobacterium
YLRLFLIDAGLPRPQTQLP

SEQ ID NO: 890852 - protein, 18 aa, Mycobacterium
YLSLMLWLAGPGSQQFDV

SEQ ID NO: 890853 - protein, 19 aa, Mycobacterium
YLSNLLPLRLQLDAQLHVA

SEQ ID NO: 890854 - protein, 21 aa, Mycobacterium
YLSPAPIYHTAPLKWCGGVQA

SEQ ID NO: 890855 - protein, 19 aa, Mycobacterium
YLSTSLFAFWIVDSAYSLD

SEQ ID NO: 890856 - protein, 23 aa, Mycobacterium
YLSYFPPSAWSYPPPLPASEATP

SEQ ID NO: 890857 - protein, 23 aa, Mycobacterium
YLSYFPPSAWSYPPSLPASGTTA

SEQ ID NO: 890858 - protein, 19 aa, Mycobacterium
YLTFAVLLAAGLRGIEKNY

SEQ ID NO: 890859 - protein, 18 aa, Mycobacterium
YLTSGLLGLQRGTDAGDL

SEQ ID NO: 890860 - protein, 19 aa, Mycobacterium
YLVLQWLERLELADGKLIC

SEQ ID NO: 890861 - protein, 18 aa, Mycobacterium
YLVSLLPRRIVDDLGARV

SEQ ID NO: 890862 - protein, 19 aa, Mycobacterium
YLYNFWRDAANPRGLWRRT

SEQ ID NO: 890863 - protein, 20 aa, Mycobacterium
YLYRFDFATPMLRLLRLGAA

SEQ ID NO: 890864 - protein, 18 aa, Mycobacterium
YMAARGIGFLGWNTRFRG

SEQ ID NO: 890865 - protein, 17 aa, Mycobacterium
YMYLTQDLPLVQPIRDI

SEQ ID NO: 890866 - protein, 22 aa, Mycobacterium
YNDITAWRWTELPAALGVPDAL

SEQ ID NO: 890867 - protein, 18 aa, Mycobacterium
YNEIVISCPLLLTLPAVG

SEQ ID NO: 890868 - protein, 22 aa, Mycobacterium
YNRALHLFWLVITDKPQKVRRQ

SEQ ID NO: 890869 - protein, 23 aa, Mycobacterium
YPAGVDWVLAFWGTVMAGGVVVP

SEQ ID NO: 890870 - protein, 17 aa, Mycobacterium
YPAQFWPLTLNLGNLTI

SEQ ID NO: 890871 - protein, 26 aa, Mycobacterium
YPFRRGLTFYYLDLALMSVLQPDRVR

SEQ ID NO: 890872 - protein, 25 aa, Mycobacterium
YPGVHAIWLHRINHWLWLRGARLIA

SEQ ID NO: 890873 - protein, 22 aa, Mycobacterium
YPHPRLMPDFWQFPTVSMGLGP

SEQ ID NO: 890874 - protein, 19 aa, Mycobacterium
YPLTVFVLPGPQLGFRVEY

SEQ ID NO: 890875 - protein, 21 aa, Mycobacterium
YPNSVYAQPWFQTANFGAALP

SEQ ID NO: 890876 - protein, 21 aa, Mycobacterium
YPPEGLPYRWPHPWLVDRKSA

SEQ ID NO: 890877 - protein, 24 aa, Mycobacterium
YPRGNLAFRWFLADGVPARPEVKL

SEQ ID NO: 890878 - protein, 19 aa, Mycobacterium
YPVYGLLVEFLAYTGLRAA

SEQ ID NO: 890879 - protein, 17 aa, Mycobacterium
YQALWRWSVEDPGAFWA

SEQ ID NO: 890880 - protein, 18 aa, Mycobacterium
YQASWRLTPFFWQEIDEG

SEQ ID NO: 890881 - protein, 17 aa, Mycobacterium
YQDLAVVSLMPVWRNFF

SEQ ID NO: 890882 - protein, 24 aa, Mycobacterium
YQFNALFLDPYLWKLQLGGKRLVQ

SEQ ID NO: 890883 - protein, 25 aa, Mycobacterium
YQFNALFLDPYLWKLQVGGKRLVQK

SEQ ID NO: 890884 - protein, 18 aa, Mycobacterium
YQGAIYLTFALPAGARAD

SEQ ID NO: 890885 - protein, 17 aa, Mycobacterium
YQLSWFDHVFFVSAWWG

SEQ ID NO: 890886 - protein, 17 aa, Mycobacterium
YQLSWWINRFTEIFQTI

SEQ ID NO: 890887 - protein, 19 aa, Mycobacterium
YQSWSAAYLPLFKVLRTLA

SEQ ID NO: 890888 - protein, 20 aa, Mycobacterium
YQSWSAAYLPLIRVLRTLAA

SEQ ID NO: 890889 - protein, 24 aa, Mycobacterium
YQTFGFAGFFAVAIRFTGLLGGTP

SEQ ID NO: 890890 - protein, 22 aa, Mycobacterium
YQVNYLAPFLLTTRLMDLLVES

SEQ ID NO: 890891 - protein, 18 aa, Mycobacterium
YRALPDFWVWYVPPNENA

SEQ ID NO: 890892 - protein, 18 aa, Mycobacterium
YRFVYRKRFHKKCETQLT

SEQ ID NO: 890893 - protein, 25 aa, Mycobacterium
YRGAKNVLLVFFPLAFTGICQGELD

SEQ ID NO: 890894 - protein, 26 aa, Mycobacterium
YRGAKNVLLVFFPLAFTGICQGELDQ

SEQ ID NO: 890895 - protein, 27 aa, Mycobacterium
YRGHIFWDELFIFPVLNLRLPAVTRSL

SEQ ID NO: 890896 - protein, 25 aa, Mycobacterium
YRGHIFWDELFIFPVLNLRVPTVTR

SEQ ID NO: 890897 - protein, 21 aa, Mycobacterium
YRGLQFFHATGLPLHDIRHVG

SEQ ID NO: 890898 - protein, 20 aa, Mycobacterium
YRGLQFFHATGLPLHEIRHV

SEQ ID NO: 890899 - protein, 22 aa, Mycobacterium
YRHPFKFLSKITPYPGTPLYQA

SEQ ID NO: 890900 - protein, 21 aa, Mycobacterium
YRHSLINLVKLLPVLTGLRMY

SEQ ID NO: 890901 - protein, 18 aa, Mycobacterium
YRIPAFYFACPATVLGPY

SEQ ID NO: 890902 - protein, 17 aa, Mycobacterium
YRIPLFCALSNVAAAPA

SEQ ID NO: 890903 - protein, 20 aa, Mycobacterium
YRKLMAERVPLYRKVATIRI

SEQ ID NO: 890904 - protein, 17 aa, Mycobacterium
YRLMTIRNWATTSQMLS

SEQ ID NO: 890905 - protein, 20 aa, Mycobacterium
YRMPWYQRVMANLLPLALKG

SEQ ID NO: 890906 - protein, 17 aa, Mycobacterium
YRPFWAITKHADIMAIE

SEQ ID NO: 890907 - protein, 22 aa, Mycobacterium
YRPIELWRSQRWLCPYGGAAVA

SEQ ID NO: 890908 - protein, 22 aa, Mycobacterium
YRQLRGFAQRWSDPGWAIEGAA

SEQ ID NO: 890909 - protein, 24 aa, Mycobacterium
YRQSLFWAWLIYGGRLLRGRLPRI

SEQ ID NO: 890910 - protein, 18 aa, Mycobacterium
YRRFFSITSLAGLRQEDR

SEQ ID NO: 890911 - protein, 17 aa, Mycobacterium
YRRLRAKARLKFLIKDW

SEQ ID NO: 890912 - protein, 17 aa, Mycobacterium
YRRLRAKARLKFLVKDW

SEQ ID NO: 890913 - protein, 17 aa, Mycobacterium
YRRMWVLRLLDMALEES

SEQ ID NO: 890914 - protein, 25 aa, Mycobacterium
YRRSFARYPRLIPLLTIHAVNSTQA

SEQ ID NO: 890915 - protein, 21 aa, Mycobacterium
YRSLRDLVLPLRRLTVITGAN

SEQ ID NO: 890916 - protein, 27 aa, Mycobacterium
YRTGEYIAWRLWLHIAFDLTADPAELR

SEQ ID NO: 890917 - protein, 19 aa, Mycobacterium
YRTWLSDRFLPQDILDWPL

SEQ ID NO: 890918 - protein, 24 aa, Mycobacterium
YRVFTPFFRAWRDHGWRAPADSGP

SEQ ID NO: 890919 - protein, 18 aa, Mycobacterium
YRYCGTSFIIPWSAYEVP

SEQ ID NO: 890920 - protein, 18 aa, Mycobacterium
YRYCWIRDQCYAGQAVAA

SEQ ID NO: 890921 - protein, 17 aa, Mycobacterium
YRYFPDKRAFYTAVMQA

SEQ ID NO: 890922 - protein, 24 aa, Mycobacterium
YSETLGMPLKFRDGAHFAALDGGQ

SEQ ID NO: 890923 - protein, 23 aa, Mycobacterium
YSEVAALYFIYFRLCTPRHGIRS

SEQ ID NO: 890924 - protein, 17 aa, Mycobacterium
YSGPFFRYERPQAGRYR

SEQ ID NO: 890925 - protein, 25 aa, Mycobacterium
YSGRYRGCYLLLYSDGTVKLSGYDR

SEQ ID NO: 890926 - protein, 20 aa, Mycobacterium
YSHLTLSWVYDWMAQGVPVV

SEQ ID NO: 890927 - protein, 18 aa, Mycobacterium
YSLDEACLLIFPRRELSA

SEQ ID NO: 890928 - protein, 21 aa, Mycobacterium
YSPLHALLFGLPGDPPGPAAL

SEQ ID NO: 890929 - protein, 24 aa, Mycobacterium
YSVWEIWAPLLYGARLLIVPDGVV

SEQ ID NO: 890930 - protein, 17 aa, Mycobacterium
YSWGPLSLMLLATAIAQ

SEQ ID NO: 890931 - protein, 28 aa, Mycobacterium
YTAISTLLLLYFPFRARRFFYDVDNRRF

SEQ ID NO: 890932 - protein, 17 aa, Mycobacterium
YTCHFPRPGWKLPRRET

SEQ ID NO: 890933 - protein, 21 aa, Mycobacterium
YTEILPMPFLPAGVFDAWGLD

SEQ ID NO: 890934 - protein, 17 aa, Mycobacterium
YTEIMFLATRLAKRQRV

SEQ ID NO: 890935 - protein, 20 aa, Mycobacterium
YTGLWTAYYLKKADPSLRIA

SEQ ID NO: 890936 - protein, 22 aa, Mycobacterium
YTLWAAWHRSGLQRRWLSAAER

SEQ ID NO: 890937 - protein, 22 aa, Mycobacterium
YTLWAAWHRSGLQRRWLSVSER

SEQ ID NO: 890938 - protein, 24 aa, Mycobacterium
YTSPSWMMWNFQVAGLLVGATIVC

SEQ ID NO: 890939 - protein, 17 aa, Mycobacterium
YTYKLEWLAALRDTAAG

SEQ ID NO: 890940 - protein, 22 aa, Mycobacterium
YVAAHVPYLMWLMRASATSAQA

SEQ ID NO: 890941 - protein, 19 aa, Mycobacterium
YVAVTRRFTGAIPGLRASH

SEQ ID NO: 890942 - protein, 20 aa, Mycobacterium
YVDLFLIHWPAPDYGQYVTA

SEQ ID NO: 890943 - protein, 21 aa, Mycobacterium
YVDLYLIHWPVPARGEYVNSF

SEQ ID NO: 890944 - protein, 21 aa, Mycobacterium
YVDLYLIHWPVSQQGKHVDSW

SEQ ID NO: 890945 - protein, 25 aa, Mycobacterium
YVDPRWVRWLPLLPLDRSLSVSIVH

SEQ ID NO: 890946 - protein, 17 aa, Mycobacterium
YVEWLTHQLAERARAHI

SEQ ID NO: 890947 - protein, 17 aa, Mycobacterium
YVEWLTHQLASRAREHI

SEQ ID NO: 890948 - protein, 24 aa, Mycobacterium
YVHPEIEFFLLKNLPDDGTAPIPA

SEQ ID NO: 890949 - protein, 23 aa, Mycobacterium
YVHPEIEFFLLKPGDNDGSPPTP

SEQ ID NO: 890950 - protein, 24 aa, Mycobacterium
YVHPEIEFFLLKPGPEDGSEPVPI

SEQ ID NO: 890951 - protein, 24 aa, Mycobacterium
YVHPEIEFFLLKPGPNDGSVPVPV

SEQ ID NO: 890952 - protein, 24 aa, Mycobacterium
YVHPEIEFFLLKPGPNDGTPPEPA

SEQ ID NO: 890953 - protein, 23 aa, Mycobacterium
YVHPEIEFFLLNPGPEDGTEPVP

SEQ ID NO: 890954 - protein, 20 aa, Mycobacterium
YVPGRWLYRPLSVNYRTPAE

SEQ ID NO: 890955 - protein, 17 aa, Mycobacterium
YVQLWPHRHGTDAMFAG

SEQ ID NO: 890956 - protein, 17 aa, Mycobacterium
YVRLFGWKPHAMGESGQ

SEQ ID NO: 890957 - protein, 23 aa, Mycobacterium
YVTTKEPWFLDAYRRAWEWADST

SEQ ID NO: 890958 - protein, 20 aa, Mycobacterium
YVVGPLLWQAGLLAPVEGGL

SEQ ID NO: 890959 - protein, 19 aa, Mycobacterium
YVVQPLFFPGGDIGHLAVN

SEQ ID NO: 890960 - protein, 18 aa, Mycobacterium
YVYPLFEQALRIANGESM

SEQ ID NO: 890961 - protein, 17 aa, Mycobacterium
YWALPYPVAERLARPTD

SEQ ID NO: 890962 - protein, 19 aa, Mycobacterium
YWIWTTMNRPGRYLVSSGM

SEQ ID NO: 890963 - protein, 23 aa, Mycobacterium
YYDELFIGGQWRKPASPQQLAVI

SEQ ID NO: 890964 - protein, 30 aa, Mycobacterium
YYIIRTHHLPLLTPLRFIPVLGNPLADLVE

SEQ ID NO: 890965 - protein, 22 aa, Mycobacterium
YYILPTENLPLLEPLRAIPVIG

SEQ ID NO: 890966 - protein, 24 aa, Mycobacterium
YYKWTQWIFLQIFNAWFDTDQNRA

SEQ ID NO: 890967 - protein, 18 aa, Mycobacterium
YYMFMTRNLPLLEPLRAI

SEQ ID NO: 890968 - protein, 20 aa, Mycobacterium
YYMRLLIYVTPRRALFWPTR

SEQ ID NO: 890969 - protein, 29 aa, Mycobacterium
YYNKAGLWPYLEKLGFFLVGYGCTTCIGN

SEQ ID NO: 890970 - protein, 19 aa, Mycobacterium
YYRVLELAPWLKWPEPNFP

SEQ ID NO: 890971 - protein, 18 aa, Mycobacterium
YYRVLELAPWLSWPQPNF

SEQ ID NO: 890972 - protein, 4 aa, Mycobacterium
GQSS

SEQ ID NO: 890973 - protein, 6 aa, Mycobacterium
GSFGGG

SEQ ID NO: 890974 - protein, 5 aa, Mycobacterium
AQDDF

SEQ ID NO: 890975 - protein, 5 aa, Mycobacterium
EPSTG

SEQ ID NO: 890976 - protein, 5 aa, Mycobacterium
GSLGG

SEQ ID NO: 890977 - protein, 5 aa, Mycobacterium
PGGSQ

SEQ ID NO: 890978 - protein, 7 aa, Mycobacterium
AGRPTPE

SEQ ID NO: 890979 - protein, 8 aa, Mycobacterium
CSNNYGPY

SEQ ID NO: 890980 - protein, 8 aa, Mycobacterium
EQDGSKQW

SEQ ID NO: 890981 - protein, 6 aa, Mycobacterium
ESSERE

SEQ ID NO: 890982 - protein, 8 aa, Mycobacterium
GGGGGNFG

SEQ ID NO: 890983 - protein, 5 aa, Mycobacterium
PRRYE

SEQ ID NO: 890984 - protein, 6 aa, Mycobacterium
QGERAA

SEQ ID NO: 890985 - protein, 11 aa, Mycobacterium
RRQVEERREGL

SEQ ID NO: 890986 - protein, 5 aa, Mycobacterium
TPAEA

SEQ ID NO: 890987 - protein, 4 aa, Mycobacterium
TQGE

SEQ ID NO: 890988 - protein, 5 aa, Mycobacterium
YSQGA

SEQ ID NO: 890989 - protein, 7 aa, Mycobacterium
AAGRAGG

SEQ ID NO: 890990 - protein, 4 aa, Mycobacterium
AALT

SEQ ID NO: 890991 - protein, 7 aa, Mycobacterium
AEGAKQA

SEQ ID NO: 890992 - protein, 5 aa, Mycobacterium
CEAGG

SEQ ID NO: 890993 - protein, 6 aa, Mycobacterium
CESGGN

SEQ ID NO: 890994 - protein, 4 aa, Mycobacterium
DGAG

SEQ ID NO: 890995 - protein, 8 aa, Mycobacterium
DPSQGMGP

SEQ ID NO: 890996 - protein, 6 aa, Mycobacterium
EPGVGK

SEQ ID NO: 890997 - protein, 4 aa, Mycobacterium
GDPA

SEQ ID NO: 890998 - protein, 9 aa, Mycobacterium
GHGASPQAL

SEQ ID NO: 890999 - protein, 5 aa, Mycobacterium
IDPQR

SEQ ID NO: 891000 - protein, 5 aa, Mycobacterium
KNSAG

SEQ ID NO: 891001 - protein, 4 aa, Mycobacterium
KTQT

SEQ ID NO: 891002 - protein, 8 aa, Mycobacterium
LATSPNTA

SEQ ID NO: 891003 - protein, 6 aa, Mycobacterium
LNGEGI

SEQ ID NO: 891004 - protein, 8 aa, Mycobacterium
LRADPRNQ

SEQ ID NO: 891005 - protein, 7 aa, Mycobacterium
MKADREK

SEQ ID NO: 891006 - protein, 6 aa, Mycobacterium
NDAANT

SEQ ID NO: 891007 - protein, 4 aa, Mycobacterium
NPAG

SEQ ID NO: 891008 - protein, 7 aa, Mycobacterium
NTAADQL

SEQ ID NO: 891009 - protein, 5 aa, Mycobacterium
PEAQW

SEQ ID NO: 891010 - protein, 6 aa, Mycobacterium
PEGTQS

SEQ ID NO: 891011 - protein, 4 aa, Mycobacterium
PGGF

SEQ ID NO: 891012 - protein, 7 aa, Mycobacterium
PGVVDPA

SEQ ID NO: 891013 - protein, 6 aa, Mycobacterium
QGGGPH

SEQ ID NO: 891014 - protein, 9 aa, Mycobacterium
RPGSGREAT

SEQ ID NO: 891015 - protein, 4 aa, Mycobacterium
SDNM

SEQ ID NO: 891016 - protein, 5 aa, Mycobacterium
SGVAG

SEQ ID NO: 891017 - protein, 6 aa, Mycobacterium
SRDGTR

SEQ ID NO: 891018 - protein, 8 aa, Mycobacterium
VAPDHPKI

SEQ ID NO: 891019 - protein, 12 aa, Mycobacterium
YCPGPAVGGSTS

SEQ ID NO: 891020 - protein, 4 aa, Mycobacterium
YSQG

SEQ ID NO: 891021 - protein, 5 aa, Mycobacterium
AAPDV

SEQ ID NO: 891022 - protein, 10 aa, Mycobacterium
ADLGNGPGIQ

SEQ ID NO: 891023 - protein, 6 aa, Mycobacterium
ADPQFD

SEQ ID NO: 891024 - protein, 10 aa, Mycobacterium
AGATGEGAMD

SEQ ID NO: 891025 - protein, 7 aa, Mycobacterium
AGGLPGD

SEQ ID NO: 891026 - protein, 7 aa, Mycobacterium
AGPSVQN

SEQ ID NO: 891027 - protein, 4 aa, Mycobacterium
AKGR

SEQ ID NO: 891028 - protein, 4 aa, Mycobacterium
APGT

SEQ ID NO: 891029 - protein, 6 aa, Mycobacterium
AQDDYN

SEQ ID NO: 891030 - protein, 9 aa, Mycobacterium
ASGIPPANY

SEQ ID NO: 891031 - protein, 7 aa, Mycobacterium
ASVTDGA

SEQ ID NO: 891032 - protein, 7 aa, Mycobacterium
ATGDDKA

SEQ ID NO: 891033 - protein, 8 aa, Mycobacterium
DEEGGRVS

SEQ ID NO: 891034 - protein, 9 aa, Mycobacterium
DESGTTDNF

SEQ ID NO: 891035 - protein, 7 aa, Mycobacterium
DGAPLDD

SEQ ID NO: 891036 - protein, 5 aa, Mycobacterium
DRAGH

SEQ ID NO: 891037 - protein, 4 aa, Mycobacterium
DSSV

SEQ ID NO: 891038 - protein, 8 aa, Mycobacterium
DVAGGSAD

SEQ ID NO: 891039 - protein, 7 aa, Mycobacterium
EADRQSR

SEQ ID NO: 891040 - protein, 7 aa, Mycobacterium
EGGPTYW

SEQ ID NO: 891041 - protein, 7 aa, Mycobacterium
EREPGRA

SEQ ID NO: 891042 - protein, 8 aa, Mycobacterium
ETYPPGST

SEQ ID NO: 891043 - protein, 6 aa, Mycobacterium
FSRPGL

SEQ ID NO: 891044 - protein, 7 aa, Mycobacterium
GCSGQTT

SEQ ID NO: 891045 - protein, 5 aa, Mycobacterium
GEEGR

SEQ ID NO: 891046 - protein, 4 aa, Mycobacterium
GGHG

SEQ ID NO: 891047 - protein, 5 aa, Mycobacterium
GGSAA

SEQ ID NO: 891048 - protein, 7 aa, Mycobacterium
GPGPTFD

SEQ ID NO: 891049 - protein, 6 aa, Mycobacterium
GPPPDA

SEQ ID NO: 891050 - protein, 6 aa, Mycobacterium
GSLGGG

SEQ ID NO: 891051 - protein, 7 aa, Mycobacterium
GYAATSV

SEQ ID NO: 891052 - protein, 6 aa, Mycobacterium
KDNGRI

SEQ ID NO: 891053 - protein, 7 aa, Mycobacterium
KPFPPPC

SEQ ID NO: 891054 - protein, 6 aa, Mycobacterium
KVPADA

SEQ ID NO: 891055 - protein, 6 aa, Mycobacterium
KYPTTV

SEQ ID NO: 891056 - protein, 8 aa, Mycobacterium
MKNPADSA

SEQ ID NO: 891057 - protein, 7 aa, Mycobacterium
MTAKSNS

SEQ ID NO: 891058 - protein, 5 aa, Mycobacterium
NDPRN

SEQ ID NO: 891059 - protein, 12 aa, Mycobacterium
NGTPSDLGGDNM

SEQ ID NO: 891060 - protein, 4 aa, Mycobacterium
PDFR

SEQ ID NO: 891061 - protein, 10 aa, Mycobacterium
PGMPRDTPYS

SEQ ID NO: 891062 - protein, 4 aa, Mycobacterium
PGPV

SEQ ID NO: 891063 - protein, 5 aa, Mycobacterium
PIPIP

SEQ ID NO: 891064 - protein, 10 aa, Mycobacterium
PSPLSSGSAK

SEQ ID NO: 891065 - protein, 6 aa, Mycobacterium
QPNELP

SEQ ID NO: 891066 - protein, 9 aa, Mycobacterium
QSGNGGPAV

SEQ ID NO: 891067 - protein, 7 aa, Mycobacterium
RRTKNNP

SEQ ID NO: 891068 - protein, 7 aa, Mycobacterium
SLEGGKQ

SEQ ID NO: 891069 - protein, 4 aa, Mycobacterium
SPDN

SEQ ID NO: 891070 - protein, 6 aa, Mycobacterium
SPNPGY

SEQ ID NO: 891071 - protein, 5 aa, Mycobacterium
SRTVS

SEQ ID NO: 891072 - protein, 8 aa, Mycobacterium
SSDDGAAE

SEQ ID NO: 891073 - protein, 6 aa, Mycobacterium
SSGLGA

SEQ ID NO: 891074 - protein, 7 aa, Mycobacterium
SSGLGAG

SEQ ID NO: 891075 - protein, 8 aa, Mycobacterium
TADPANRH

SEQ ID NO: 891076 - protein, 8 aa, Mycobacterium
TETDPAIA

SEQ ID NO: 891077 - protein, 6 aa, Mycobacterium
TGDSDV

SEQ ID NO: 891078 - protein, 8 aa, Mycobacterium
TGVGKTEL

SEQ ID NO: 891079 - protein, 7 aa, Mycobacterium
TSGPGEL

SEQ ID NO: 891080 - protein, 6 aa, Mycobacterium
VPESLR

SEQ ID NO: 891081 - protein, 11 aa, Mycobacterium
VTDKSRQPLYD

SEQ ID NO: 891082 - protein, 10 aa, Mycobacterium
VTGSGGIRGP

SEQ ID NO: 891083 - protein, 12 aa, Mycobacterium
VYGPRQDPHGEA

SEQ ID NO: 891084 - protein, 8 aa, Mycobacterium
YGAGPCSG

SEQ ID NO: 891085 - protein, 7 aa, Mycobacterium
YNAAGGH

SEQ ID NO: 891086 - protein, 15 aa, Mycobacterium
YSTDLTARAREGKLD

SEQ ID NO: 891087 - protein, 4 aa, Mycobacterium
AAAT

SEQ ID NO: 891088 - protein, 4 aa, Mycobacterium
AAEA

SEQ ID NO: 891089 - protein, 4 aa, Mycobacterium
AAGA

SEQ ID NO: 891090 - protein, 11 aa, Mycobacterium
AAINPGNSGGA

SEQ ID NO: 891091 - protein, 7 aa, Mycobacterium
AANDPQG

SEQ ID NO: 891092 - protein, 4 aa, Mycobacterium
ADAG

SEQ ID NO: 891093 - protein, 4 aa, Mycobacterium
AEPE

SEQ ID NO: 891094 - protein, 14 aa, Mycobacterium
AETKKTDLNANDID

SEQ ID NO: 891095 - protein, 4 aa, Mycobacterium
AGAS

SEQ ID NO: 891096 - protein, 17 aa, Mycobacterium
AGASGGALGAGADRGGV

SEQ ID NO: 891097 - protein, 7 aa, Mycobacterium
AGERGTD

SEQ ID NO: 891098 - protein, 8 aa, Mycobacterium
AGHHDPAS

SEQ ID NO: 891099 - protein, 10 aa, Mycobacterium
AGPAGSAAAA

SEQ ID NO: 891100 - protein, 8 aa, Mycobacterium
AGWSDDGM

SEQ ID NO: 891101 - protein, 5 aa, Mycobacterium
AHATA

SEQ ID NO: 891102 - protein, 4 aa, Mycobacterium
AKGN

SEQ ID NO: 891103 - protein, 6 aa, Mycobacterium
ANAASK

SEQ ID NO: 891104 - protein, 17 aa, Mycobacterium
ANANNGTRAVGTPGYEA

SEQ ID NO: 891105 - protein, 7 aa, Mycobacterium
ANDPTSV

SEQ ID NO: 891106 - protein, 6 aa, Mycobacterium
APGAAW

SEQ ID NO: 891107 - protein, 6 aa, Mycobacterium
APPGYI

SEQ ID NO: 891108 - protein, 9 aa, Mycobacterium
ARASSSFDR

SEQ ID NO: 891109 - protein, 5 aa, Mycobacterium
ASDMA

SEQ ID NO: 891110 - protein, 8 aa, Mycobacterium
ASGRSAPL

SEQ ID NO: 891111 - protein, 4 aa, Mycobacterium
ASGY

SEQ ID NO: 891112 - protein, 18 aa, Mycobacterium
ASKTGTAEHGTDPRHTPP

SEQ ID NO: 891113 - protein, 19 aa, Mycobacterium
ASKTGTAEHGTDPRNTPPH

SEQ ID NO: 891114 - protein, 10 aa, Mycobacterium
ASSANLGPGF

SEQ ID NO: 891115 - protein, 6 aa, Mycobacterium
ASTVDE

SEQ ID NO: 891116 - protein, 10 aa, Mycobacterium
ASVDDPAGVR

SEQ ID NO: 891117 - protein, 4 aa, Mycobacterium
ATGR

SEQ ID NO: 891118 - protein, 10 aa, Mycobacterium
ATLPEERSRE

SEQ ID NO: 891119 - protein, 6 aa, Mycobacterium
ATTNQQ

SEQ ID NO: 891120 - protein, 8 aa, Mycobacterium
AVRPATPV

SEQ ID NO: 891121 - protein, 4 aa, Mycobacterium
DAAS

SEQ ID NO: 891122 - protein, 8 aa, Mycobacterium
DAGGYKAS

SEQ ID NO: 891123 - protein, 7 aa, Mycobacterium
DATGERI

SEQ ID NO: 891124 - protein, 8 aa, Mycobacterium
DAVSTDDS

SEQ ID NO: 891125 - protein, 9 aa, Mycobacterium
DDTPWGGKP

SEQ ID NO: 891126 - protein, 6 aa, Mycobacterium
DGGGAV

SEQ ID NO: 891127 - protein, 6 aa, Mycobacterium
DGGGSS

SEQ ID NO: 891128 - protein, 4 aa, Mycobacterium
DHEQ

SEQ ID NO: 891129 - protein, 4 aa, Mycobacterium
DHGP

SEQ ID NO: 891130 - protein, 13 aa, Mycobacterium
DKARSRATGGSGL

SEQ ID NO: 891131 - protein, 6 aa, Mycobacterium
DKPGVA

SEQ ID NO: 891132 - protein, 6 aa, Mycobacterium
DNNRQA

SEQ ID NO: 891133 - protein, 4 aa, Mycobacterium
DPAA

SEQ ID NO: 891134 - protein, 8 aa, Mycobacterium
DQGSQAGD

SEQ ID NO: 891135 - protein, 4 aa, Mycobacterium
DRNS

SEQ ID NO: 891136 - protein, 5 aa, Mycobacterium
DRPGV

SEQ ID NO: 891137 - protein, 8 aa, Mycobacterium
DRTPTADR

SEQ ID NO: 891138 - protein, 4 aa, Mycobacterium
DRTQ

SEQ ID NO: 891139 - protein, 10 aa, Mycobacterium
DTGPHNYTDD

SEQ ID NO: 891140 - protein, 7 aa, Mycobacterium
DWPDRPD

SEQ ID NO: 891141 - protein, 5 aa, Mycobacterium
EATGR

SEQ ID NO: 891142 - protein, 8 aa, Mycobacterium
EHAKARGA

SEQ ID NO: 891143 - protein, 6 aa, Mycobacterium
ELPRGD

SEQ ID NO: 891144 - protein, 9 aa, Mycobacterium
EPDSKSSKS

SEQ ID NO: 891145 - protein, 6 aa, Mycobacterium
EPSVED

SEQ ID NO: 891146 - protein, 7 aa, Mycobacterium
ERTTGAV

SEQ ID NO: 891147 - protein, 4 aa, Mycobacterium
ETGV

SEQ ID NO: 891148 - protein, 4 aa, Mycobacterium
EVEN

SEQ ID NO: 891149 - protein, 6 aa, Mycobacterium
EVGPDD

SEQ ID NO: 891150 - protein, 6 aa, Mycobacterium
EYGEKH

SEQ ID NO: 891151 - protein, 9 aa, Mycobacterium
FEGHPDNAA

SEQ ID NO: 891152 - protein, 4 aa, Mycobacterium
FGVQ

SEQ ID NO: 891153 - protein, 10 aa, Mycobacterium
FNTAESENLQ

SEQ ID NO: 891154 - protein, 4 aa, Mycobacterium
FTKP

SEQ ID NO: 891155 - protein, 4 aa, Mycobacterium
GAAG

SEQ ID NO: 891156 - protein, 5 aa, Mycobacterium
GAATG

SEQ ID NO: 891157 - protein, 9 aa, Mycobacterium
GAGSDNTVT

SEQ ID NO: 891158 - protein, 10 aa, Mycobacterium
GALASTGTAY

SEQ ID NO: 891159 - protein, 17 aa, Mycobacterium
GAPAALADSVRNGDTQV

SEQ ID NO: 891160 - protein, 6 aa, Mycobacterium
GDFPES

SEQ ID NO: 891161 - protein, 5 aa, Mycobacterium
GDNEA

SEQ ID NO: 891162 - protein, 6 aa, Mycobacterium
GGATAT

SEQ ID NO: 891163 - protein, 5 aa, Mycobacterium
GGGSS

SEQ ID NO: 891164 - protein, 4 aa, Mycobacterium
GGMG

SEQ ID NO: 891165 - protein, 10 aa, Mycobacterium
GKATGDQGQA

SEQ ID NO: 891166 - protein, 6 aa, Mycobacterium
GNGQTY

SEQ ID NO: 891167 - protein, 4 aa, Mycobacterium
GNVG

SEQ ID NO: 891168 - protein, 9 aa, Mycobacterium
GPGADEFEG

SEQ ID NO: 891169 - protein, 5 aa, Mycobacterium
GPLSD

SEQ ID NO: 891170 - protein, 9 aa, Mycobacterium
GPPGTGKTT

SEQ ID NO: 891171 - protein, 5 aa, Mycobacterium
GPSGF

SEQ ID NO: 891172 - protein, 6 aa, Mycobacterium
GQDRTL

SEQ ID NO: 891173 - protein, 6 aa, Mycobacterium
GQGGAL

SEQ ID NO: 891174 - protein, 8 aa, Mycobacterium
GQVPDGED

SEQ ID NO: 891175 - protein, 11 aa, Mycobacterium
GRLTDGQGRTV

SEQ ID NO: 891176 - protein, 9 aa, Mycobacterium
GRVPDPALP

SEQ ID NO: 891177 - protein, 5 aa, Mycobacterium
GSFGG

SEQ ID NO: 891178 - protein, 4 aa, Mycobacterium
GSGY

SEQ ID NO: 891179 - protein, 9 aa, Mycobacterium
GSNNSGLPL

SEQ ID NO: 891180 - protein, 5 aa, Mycobacterium
GSVGN

SEQ ID NO: 891181 - protein, 8 aa, Mycobacterium
GSWPSATT

SEQ ID NO: 891182 - protein, 4 aa, Mycobacterium
GTAT

SEQ ID NO: 891183 - protein, 4 aa, Mycobacterium
GTGF

SEQ ID NO: 891184 - protein, 5 aa, Mycobacterium
GTPFP

SEQ ID NO: 891185 - protein, 5 aa, Mycobacterium
GTSPN

SEQ ID NO: 891186 - protein, 5 aa, Mycobacterium
GTTSL

SEQ ID NO: 891187 - protein, 5 aa, Mycobacterium
GTYRE

SEQ ID NO: 891188 - protein, 10 aa, Mycobacterium
GVNSDAPARG

SEQ ID NO: 891189 - protein, 19 aa, Mycobacterium
GYDKSWADGRGASPADRRH

SEQ ID NO: 891190 - protein, 6 aa, Mycobacterium
HDGDTV

SEQ ID NO: 891191 - protein, 8 aa, Mycobacterium
HFTPTDPL

SEQ ID NO: 891192 - protein, 6 aa, Mycobacterium
HHGTYR

SEQ ID NO: 891193 - protein, 5 aa, Mycobacterium
HPPPV

SEQ ID NO: 891194 - protein, 9 aa, Mycobacterium
HSGAPRGSA

SEQ ID NO: 891195 - protein, 6 aa, Mycobacterium
HSPEPR

SEQ ID NO: 891196 - protein, 9 aa, Mycobacterium
IDPPPSIQA

SEQ ID NO: 891197 - protein, 6 aa, Mycobacterium
IGGPSA

SEQ ID NO: 891198 - protein, 10 aa, Mycobacterium
IGSSPADGLR

SEQ ID NO: 891199 - protein, 4 aa, Mycobacterium
INGN

SEQ ID NO: 891200 - protein, 5 aa, Mycobacterium
IYPGD

SEQ ID NO: 891201 - protein, 5 aa, Mycobacterium
KAGCT

SEQ ID NO: 891202 - protein, 7 aa, Mycobacterium
KAGRRRY

SEQ ID NO: 891203 - protein, 19 aa, Mycobacterium
KGLAPGGHAAVGASQGGYG

SEQ ID NO: 891204 - protein, 6 aa, Mycobacterium
KGPDLA

SEQ ID NO: 891205 - protein, 4 aa, Mycobacterium
KTPV

SEQ ID NO: 891206 - protein, 5 aa, Mycobacterium
LATPR

SEQ ID NO: 891207 - protein, 5 aa, Mycobacterium
LDGPT

SEQ ID NO: 891208 - protein, 4 aa, Mycobacterium
LEPT

SEQ ID NO: 891209 - protein, 5 aa, Mycobacterium
LGAPC

SEQ ID NO: 891210 - protein, 8 aa, Mycobacterium
LNPSPLGY

SEQ ID NO: 891211 - protein, 8 aa, Mycobacterium
LPRSSGEM

SEQ ID NO: 891212 - protein, 18 aa, Mycobacterium
LRGESERAERDGDLAKAA

SEQ ID NO: 891213 - protein, 7 aa, Mycobacterium
LRTSDPD

SEQ ID NO: 891214 - protein, 7 aa, Mycobacterium
LSGQGTS

SEQ ID NO: 891215 - protein, 9 aa, Mycobacterium
LSTTDPHSR

SEQ ID NO: 891216 - protein, 8 aa, Mycobacterium
LTQGPGFP

SEQ ID NO: 891217 - protein, 7 aa, Mycobacterium
LTRNPAT

SEQ ID NO: 891218 - protein, 6 aa, Mycobacterium
MARGDA

SEQ ID NO: 891219 - protein, 4 aa, Mycobacterium
MSGG

SEQ ID NO: 891220 - protein, 11 aa, Mycobacterium
NAHGTVTGAAG

SEQ ID NO: 891221 - protein, 6 aa, Mycobacterium
NDPPEE

SEQ ID NO: 891222 - protein, 11 aa, Mycobacterium
NNGKSATAISI

SEQ ID NO: 891223 - protein, 5 aa, Mycobacterium
NNSGV

SEQ ID NO: 891224 - protein, 6 aa, Mycobacterium
NPAGWQ

SEQ ID NO: 891225 - protein, 5 aa, Mycobacterium
NPSRP

SEQ ID NO: 891226 - protein, 4 aa, Mycobacterium
NRTY

SEQ ID NO: 891227 - protein, 4 aa, Mycobacterium
NTKG

SEQ ID NO: 891228 - protein, 9 aa, Mycobacterium
NTVNTMPEK

SEQ ID NO: 891229 - protein, 6 aa, Mycobacterium
NVGPNQ

SEQ ID NO: 891230 - protein, 7 aa, Mycobacterium
PAAGYSN

SEQ ID NO: 891231 - protein, 4 aa, Mycobacterium
PERD

SEQ ID NO: 891232 - protein, 4 aa, Mycobacterium
PGGR

SEQ ID NO: 891233 - protein, 4 aa, Mycobacterium
PLPT

SEQ ID NO: 891234 - protein, 4 aa, Mycobacterium
PPGT

SEQ ID NO: 891235 - protein, 4 aa, Mycobacterium
PQPV

SEQ ID NO: 891236 - protein, 7 aa, Mycobacterium
PSPSMGR

SEQ ID NO: 891237 - protein, 4 aa, Mycobacterium
PTQD

SEQ ID NO: 891238 - protein, 5 aa, Mycobacterium
PVTTN

SEQ ID NO: 891239 - protein, 12 aa, Mycobacterium
QAASAAGNPEIR

SEQ ID NO: 891240 - protein, 6 aa, Mycobacterium
QAPGID

SEQ ID NO: 891241 - protein, 9 aa, Mycobacterium
QAQGQAKAI

SEQ ID NO: 891242 - protein, 7 aa, Mycobacterium
QDENETA

SEQ ID NO: 891243 - protein, 4 aa, Mycobacterium
QNGV

SEQ ID NO: 891244 - protein, 6 aa, Mycobacterium
QPPITD

SEQ ID NO: 891245 - protein, 9 aa, Mycobacterium
QSGGANSPA

SEQ ID NO: 891246 - protein, 11 aa, Mycobacterium
RAGDEEATNTD

SEQ ID NO: 891247 - protein, 7 aa, Mycobacterium
RAPRGDE

SEQ ID NO: 891248 - protein, 9 aa, Mycobacterium
RASGEDSGA

SEQ ID NO: 891249 - protein, 7 aa, Mycobacterium
RDHGPTV

SEQ ID NO: 891250 - protein, 7 aa, Mycobacterium
RFAPDGT

SEQ ID NO: 891251 - protein, 8 aa, Mycobacterium
RVTGRGAG

SEQ ID NO: 891252 - protein, 6 aa, Mycobacterium
SAGMGR

SEQ ID NO: 891253 - protein, 6 aa, Mycobacterium
SATEDH

SEQ ID NO: 891254 - protein, 4 aa, Mycobacterium
SAVA

SEQ ID NO: 891255 - protein, 4 aa, Mycobacterium
SGGW

SEQ ID NO: 891256 - protein, 4 aa, Mycobacterium
SGLI

SEQ ID NO: 891257 - protein, 8 aa, Mycobacterium
SKPGTGST

SEQ ID NO: 891258 - protein, 16 aa, Mycobacterium
SPIGRERKTEELSRAS

SEQ ID NO: 891259 - protein, 7 aa, Mycobacterium
SPSYDPN

SEQ ID NO: 891260 - protein, 11 aa, Mycobacterium
SRQAEQTTEAM

SEQ ID NO: 891261 - protein, 10 aa, Mycobacterium
SRQRGQITAG

SEQ ID NO: 891262 - protein, 9 aa, Mycobacterium
SSPNTPGLR

SEQ ID NO: 891263 - protein, 17 aa, Mycobacterium
SSTGLERAEDPLLNGSD

SEQ ID NO: 891264 - protein, 15 aa, Mycobacterium
STGDSVTTYGEPWNM

SEQ ID NO: 891265 - protein, 6 aa, Mycobacterium
SYGARQ

SEQ ID NO: 891266 - protein, 7 aa, Mycobacterium
TDNAPIA

SEQ ID NO: 891267 - protein, 4 aa, Mycobacterium
TDRL

SEQ ID NO: 891268 - protein, 8 aa, Mycobacterium
TDSPTRSV

SEQ ID NO: 891269 - protein, 4 aa, Mycobacterium
TEAD

SEQ ID NO: 891270 - protein, 6 aa, Mycobacterium
TGNGYY

SEQ ID NO: 891271 - protein, 5 aa, Mycobacterium
TGPVG

SEQ ID NO: 891272 - protein, 5 aa, Mycobacterium
TGSLT

SEQ ID NO: 891273 - protein, 10 aa, Mycobacterium
THDPATPYKA

SEQ ID NO: 891274 - protein, 5 aa, Mycobacterium
TKQPI

SEQ ID NO: 891275 - protein, 11 aa, Mycobacterium
TLTSRDQINGQ

SEQ ID NO: 891276 - protein, 5 aa, Mycobacterium
TPPAA

SEQ ID NO: 891277 - protein, 7 aa, Mycobacterium
TPPEHED

SEQ ID NO: 891278 - protein, 5 aa, Mycobacterium
TPTDN

SEQ ID NO: 891279 - protein, 6 aa, Mycobacterium
TSTSSR

SEQ ID NO: 891280 - protein, 7 aa, Mycobacterium
TTEIRSS

SEQ ID NO: 891281 - protein, 5 aa, Mycobacterium
TYGVP

SEQ ID NO: 891282 - protein, 5 aa, Mycobacterium
TYSPP

SEQ ID NO: 891283 - protein, 6 aa, Mycobacterium
TYSPPY

SEQ ID NO: 891284 - protein, 17 aa, Mycobacterium
VERPAPSNLPKPTPGMD

SEQ ID NO: 891285 - protein, 6 aa, Mycobacterium
VGADPL

SEQ ID NO: 891286 - protein, 6 aa, Mycobacterium
VGGPSA

SEQ ID NO: 891287 - protein, 15 aa, Mycobacterium
VGGSATAGAFSRPGL

SEQ ID NO: 891288 - protein, 5 aa, Mycobacterium
VGKTI

SEQ ID NO: 891289 - protein, 7 aa, Mycobacterium
VPDPNVP

SEQ ID NO: 891290 - protein, 5 aa, Mycobacterium
VPGPS

SEQ ID NO: 891291 - protein, 16 aa, Mycobacterium
VRRSRAGVADPNRPTG

SEQ ID NO: 891292 - protein, 9 aa, Mycobacterium
WGPGQDPGT

SEQ ID NO: 891293 - protein, 12 aa, Mycobacterium
WGPSTDPAWKRN

SEQ ID NO: 891294 - protein, 7 aa, Mycobacterium
WKTQRTV

SEQ ID NO: 891295 - protein, 9 aa, Mycobacterium
YARGETPNP

SEQ ID NO: 891296 - protein, 4 aa, Mycobacterium
YPGD

SEQ ID NO: 891297 - protein, 4 aa, Mycobacterium
YPTT

SEQ ID NO: 891298 - protein, 4 aa, Mycobacterium
AAAA

SEQ ID NO: 891299 - protein, 5 aa, Mycobacterium
AAAAA

SEQ ID NO: 891300 - protein, 5 aa, Mycobacterium
AAAAG

SEQ ID NO: 891301 - protein, 6 aa, Mycobacterium
AAAAGA

SEQ ID NO: 891302 - protein, 4 aa, Mycobacterium
AAAG

SEQ ID NO: 891303 - protein, 10 aa, Mycobacterium
AAAGPDQPAL

SEQ ID NO: 891304 - protein, 6 aa, Mycobacterium
AAAGRE

SEQ ID NO: 891305 - protein, 6 aa, Mycobacterium
AAAGSA

SEQ ID NO: 891306 - protein, 5 aa, Mycobacterium
AAART

SEQ ID NO: 891307 - protein, 11 aa, Mycobacterium
AADSYAGAEAA

SEQ ID NO: 891308 - protein, 7 aa, Mycobacterium
AAERVSA

SEQ ID NO: 891309 - protein, 24 aa, Mycobacterium
AAESSGAAVTGGALGPAGGSGAAL

SEQ ID NO: 891310 - protein, 5 aa, Mycobacterium
AAGAA

SEQ ID NO: 891311 - protein, 4 aa, Mycobacterium
AAGG

SEQ ID NO: 891312 - protein, 7 aa, Mycobacterium
AAGGNNG

SEQ ID NO: 891313 - protein, 7 aa, Mycobacterium
AAGLEPS

SEQ ID NO: 891314 - protein, 7 aa, Mycobacterium
AAGLGRA

SEQ ID NO: 891315 - protein, 8 aa, Mycobacterium
AAGPTTAL

SEQ ID NO: 891316 - protein, 10 aa, Mycobacterium
AAGSTAQKNA

SEQ ID NO: 891317 - protein, 4 aa, Mycobacterium
AAMG

SEQ ID NO: 891318 - protein, 5 aa, Mycobacterium
AANEG

SEQ ID NO: 891319 - protein, 13 aa, Mycobacterium
AAPAEAKRCPAGT

SEQ ID NO: 891320 - protein, 7 aa, Mycobacterium
AAPAGGA

SEQ ID NO: 891321 - protein, 7 aa, Mycobacterium
AAPDVGG

SEQ ID NO: 891322 - protein, 5 aa, Mycobacterium
AAPGP

SEQ ID NO: 891323 - protein, 4 aa, Mycobacterium
AAPR

SEQ ID NO: 891324 - protein, 6 aa, Mycobacterium
AAPRAF

SEQ ID NO: 891325 - protein, 20 aa, Mycobacterium
AAPSAAAQSTCAELGGTVDA

SEQ ID NO: 891326 - protein, 5 aa, Mycobacterium
AAPYA

SEQ ID NO: 891327 - protein, 6 aa, Mycobacterium
AAQATT

SEQ ID NO: 891328 - protein, 7 aa, Mycobacterium
AAQGMGA

SEQ ID NO: 891329 - protein, 7 aa, Mycobacterium
AAQSPGT

SEQ ID NO: 891330 - protein, 6 aa, Mycobacterium
AARGGR

SEQ ID NO: 891331 - protein, 13 aa, Mycobacterium
AARKTGEDNDAAH

SEQ ID NO: 891332 - protein, 6 aa, Mycobacterium
AARNGR

SEQ ID NO: 891333 - protein, 9 aa, Mycobacterium
AARRAGVPV

SEQ ID NO: 891334 - protein, 4 aa, Mycobacterium
AASA

SEQ ID NO: 891335 - protein, 5 aa, Mycobacterium
AASGG

SEQ ID NO: 891336 - protein, 6 aa, Mycobacterium
AASSAG

SEQ ID NO: 891337 - protein, 4 aa, Mycobacterium
AATA

SEQ ID NO: 891338 - protein, 4 aa, Mycobacterium
AAVD

SEQ ID NO: 891339 - protein, 6 aa, Mycobacterium
ACPGQT

SEQ ID NO: 891340 - protein, 5 aa, Mycobacterium
ADAAG

SEQ ID NO: 891341 - protein, 6 aa, Mycobacterium
ADDSQL

SEQ ID NO: 891342 - protein, 8 aa, Mycobacterium
ADEPLEGG

SEQ ID NO: 891343 - protein, 4 aa, Mycobacterium
ADER

SEQ ID NO: 891344 - protein, 4 aa, Mycobacterium
ADEV

SEQ ID NO: 891345 - protein, 7 aa, Mycobacterium
ADGAQPY

SEQ ID NO: 891346 - protein, 6 aa, Mycobacterium
ADGTRA

SEQ ID NO: 891347 - protein, 7 aa, Mycobacterium
ADKVNTI

SEQ ID NO: 891348 - protein, 9 aa, Mycobacterium
ADPKRIDGA

SEQ ID NO: 891349 - protein, 4 aa, Mycobacterium
ADPV

SEQ ID NO: 891350 - protein, 10 aa, Mycobacterium
ADRAADSPHR

SEQ ID NO: 891351 - protein, 4 aa, Mycobacterium
ADSG

SEQ ID NO: 891352 - protein, 7 aa, Mycobacterium
ADSGHQE

SEQ ID NO: 891353 - protein, 7 aa, Mycobacterium
ADSPRGV

SEQ ID NO: 891354 - protein, 8 aa, Mycobacterium
ADTGSGSI

SEQ ID NO: 891355 - protein, 11 aa, Mycobacterium
ADYSGKPYDEW

SEQ ID NO: 891356 - protein, 5 aa, Mycobacterium
AEAAE

SEQ ID NO: 891357 - protein, 6 aa, Mycobacterium
AEAYPD

SEQ ID NO: 891358 - protein, 10 aa, Mycobacterium
AEDDDEPYYP

SEQ ID NO: 891359 - protein, 7 aa, Mycobacterium
AEDTRRV

SEQ ID NO: 891360 - protein, 6 aa, Mycobacterium
AEEQGV

SEQ ID NO: 891361 - protein, 5 aa, Mycobacterium
AEGIQ

SEQ ID NO: 891362 - protein, 8 aa, Mycobacterium
AERGADVD

SEQ ID NO: 891363 - protein, 6 aa, Mycobacterium
AETATV

SEQ ID NO: 891364 - protein, 4 aa, Mycobacterium
AETD

SEQ ID NO: 891365 - protein, 5 aa, Mycobacterium
AGAAA

SEQ ID NO: 891366 - protein, 7 aa, Mycobacterium
AGADEIS

SEQ ID NO: 891367 - protein, 4 aa, Mycobacterium
AGAG

SEQ ID NO: 891368 - protein, 7 aa, Mycobacterium
AGAGQAA

SEQ ID NO: 891369 - protein, 5 aa, Mycobacterium
AGAKA

SEQ ID NO: 891370 - protein, 7 aa, Mycobacterium
AGALGAV

SEQ ID NO: 891371 - protein, 4 aa, Mycobacterium
AGCT

SEQ ID NO: 891372 - protein, 27 aa, Mycobacterium
AGDGGAGGAGGTSNTGAGGSGGGAGRG

SEQ ID NO: 891373 - protein, 11 aa, Mycobacterium
AGDSDQGGYNT

SEQ ID NO: 891374 - protein, 6 aa, Mycobacterium
AGESLQ

SEQ ID NO: 891375 - protein, 8 aa, Mycobacterium
AGETMQPQ

SEQ ID NO: 891376 - protein, 4 aa, Mycobacterium
AGFQ

SEQ ID NO: 891377 - protein, 7 aa, Mycobacterium
AGGAGAS

SEQ ID NO: 891378 - protein, 26 aa, Mycobacterium
AGGAGGTGGISGTGVGGGGGHGGNGG

SEQ ID NO: 891379 - protein, 4 aa, Mycobacterium
AGGR

SEQ ID NO: 891380 - protein, 5 aa, Mycobacterium
AGGRT

SEQ ID NO: 891381 - protein, 4 aa, Mycobacterium
AGHT

SEQ ID NO: 891382 - protein, 11 aa, Mycobacterium
AGKQGLSGGNE

SEQ ID NO: 891383 - protein, 6 aa, Mycobacterium
AGLDPA

SEQ ID NO: 891384 - protein, 13 aa, Mycobacterium
AGLPTAASAWPNY

SEQ ID NO: 891385 - protein, 4 aa, Mycobacterium
AGLT

SEQ ID NO: 891386 - protein, 15 aa, Mycobacterium
AGMAPQAKSGVPATP

SEQ ID NO: 891387 - protein, 16 aa, Mycobacterium
AGPATIPLPGPGPGQT

SEQ ID NO: 891388 - protein, 8 aa, Mycobacterium
AGPKGAVA

SEQ ID NO: 891389 - protein, 7 aa, Mycobacterium
AGPRPEM

SEQ ID NO: 891390 - protein, 6 aa, Mycobacterium
AGQVQG

SEQ ID NO: 891391 - protein, 5 aa, Mycobacterium
AGRAD

SEQ ID NO: 891392 - protein, 14 aa, Mycobacterium
AGRDQNVAHPPAST

SEQ ID NO: 891393 - protein, 4 aa, Mycobacterium
AGRL

SEQ ID NO: 891394 - protein, 4 aa, Mycobacterium
AGSP

SEQ ID NO: 891395 - protein, 9 aa, Mycobacterium
AGSQNAQGP

SEQ ID NO: 891396 - protein, 8 aa, Mycobacterium
AGSRPDKV

SEQ ID NO: 891397 - protein, 8 aa, Mycobacterium
AGTGTGKS

SEQ ID NO: 891398 - protein, 7 aa, Mycobacterium
AGVTPSD

SEQ ID NO: 891399 - protein, 18 aa, Mycobacterium
AIAPGASAYDDAHAASDI

SEQ ID NO: 891400 - protein, 9 aa, Mycobacterium
AKANGGEWK

SEQ ID NO: 891401 - protein, 4 aa, Mycobacterium
AKGF

SEQ ID NO: 891402 - protein, 5 aa, Mycobacterium
AKNAD

SEQ ID NO: 891403 - protein, 6 aa, Mycobacterium
AKTGNL

SEQ ID NO: 891404 - protein, 22 aa, Mycobacterium
ALAAPTGGDAQATISSLEAQGN

SEQ ID NO: 891405 - protein, 4 aa, Mycobacterium
ALGH

SEQ ID NO: 891406 - protein, 11 aa, Mycobacterium
ALGRAGTPEDI

SEQ ID NO: 891407 - protein, 8 aa, Mycobacterium
ALSGPVNM

SEQ ID NO: 891408 - protein, 7 aa, Mycobacterium
ALTPGAF

SEQ ID NO: 891409 - protein, 7 aa, Mycobacterium
ALTPQQQ

SEQ ID NO: 891410 - protein, 8 aa, Mycobacterium
ANAGPALT

SEQ ID NO: 891411 - protein, 13 aa, Mycobacterium
ANDEKKDERYTNE

SEQ ID NO: 891412 - protein, 4 aa, Mycobacterium
ANDM

SEQ ID NO: 891413 - protein, 5 aa, Mycobacterium
ANEGE

SEQ ID NO: 891414 - protein, 5 aa, Mycobacterium
ANGTH

SEQ ID NO: 891415 - protein, 6 aa, Mycobacterium
ANGTHS

SEQ ID NO: 891416 - protein, 5 aa, Mycobacterium
ANHNG

SEQ ID NO: 891417 - protein, 8 aa, Mycobacterium
ANQPASRY

SEQ ID NO: 891418 - protein, 6 aa, Mycobacterium
APAGGA

SEQ ID NO: 891419 - protein, 8 aa, Mycobacterium
APAGPNMA

SEQ ID NO: 891420 - protein, 8 aa, Mycobacterium
APGDPGGL

SEQ ID NO: 891421 - protein, 7 aa, Mycobacterium
APHGSGT

SEQ ID NO: 891422 - protein, 13 aa, Mycobacterium
APLTTSSRSGNVG

SEQ ID NO: 891423 - protein, 5 aa, Mycobacterium
APMNN

SEQ ID NO: 891424 - protein, 7 aa, Mycobacterium
APNPRWS

SEQ ID NO: 891425 - protein, 6 aa, Mycobacterium
APPGYV

SEQ ID NO: 891426 - protein, 6 aa, Mycobacterium
APPIST

SEQ ID NO: 891427 - protein, 6 aa, Mycobacterium
APPTGR

SEQ ID NO: 891428 - protein, 4 aa, Mycobacterium
APRC

SEQ ID NO: 891429 - protein, 19 aa, Mycobacterium
APSAGGAKIQNLPGQLPSV

SEQ ID NO: 891430 - protein, 5 aa, Mycobacterium
APSMT

SEQ ID NO: 891431 - protein, 5 aa, Mycobacterium
APSNL

SEQ ID NO: 891432 - protein, 5 aa, Mycobacterium
APTPL

SEQ ID NO: 891433 - protein, 5 aa, Mycobacterium
APTQT

SEQ ID NO: 891434 - protein, 8 aa, Mycobacterium
APVESQYD

SEQ ID NO: 891435 - protein, 7 aa, Mycobacterium
AQDDYNG

SEQ ID NO: 891436 - protein, 7 aa, Mycobacterium
AQDDYSG

SEQ ID NO: 891437 - protein, 5 aa, Mycobacterium
AQLNS

SEQ ID NO: 891438 - protein, 6 aa, Mycobacterium
AQPYGG

SEQ ID NO: 891439 - protein, 4 aa, Mycobacterium
AQRG

SEQ ID NO: 891440 - protein, 6 aa, Mycobacterium
AQSAGG

SEQ ID NO: 891441 - protein, 5 aa, Mycobacterium
AQTPK

SEQ ID NO: 891442 - protein, 8 aa, Mycobacterium
AQVGTNGS

SEQ ID NO: 891443 - protein, 5 aa, Mycobacterium
ARAAG

SEQ ID NO: 891444 - protein, 6 aa, Mycobacterium
ARADGD

SEQ ID NO: 891445 - protein, 12 aa, Mycobacterium
ARAGRGPGGASV

SEQ ID NO: 891446 - protein, 5 aa, Mycobacterium
ARAPW

SEQ ID NO: 891447 - protein, 5 aa, Mycobacterium
ARDDF

SEQ ID NO: 891448 - protein, 4 aa, Mycobacterium
ARGY

SEQ ID NO: 891449 - protein, 7 aa, Mycobacterium
ARLGSGR

SEQ ID NO: 891450 - protein, 4 aa, Mycobacterium
ARNS

SEQ ID NO: 891451 - protein, 5 aa, Mycobacterium
ARPGR

SEQ ID NO: 891452 - protein, 6 aa, Mycobacterium
ARPPLQ

SEQ ID NO: 891453 - protein, 10 aa, Mycobacterium
ARSDEHDAAA

SEQ ID NO: 891454 - protein, 11 aa, Mycobacterium
ARSRATGGTGL

SEQ ID NO: 891455 - protein, 5 aa, Mycobacterium
ASDAA

SEQ ID NO: 891456 - protein, 6 aa, Mycobacterium
ASDPAL

SEQ ID NO: 891457 - protein, 11 aa, Mycobacterium
ASGAHRPTPTI

SEQ ID NO: 891458 - protein, 9 aa, Mycobacterium
ASGGPNCRG

SEQ ID NO: 891459 - protein, 6 aa, Mycobacterium
ASGGRN

SEQ ID NO: 891460 - protein, 4 aa, Mycobacterium
ASGI

SEQ ID NO: 891461 - protein, 9 aa, Mycobacterium
ASGKTGTDI

SEQ ID NO: 891462 - protein, 8 aa, Mycobacterium
ASKAAQEH

SEQ ID NO: 891463 - protein, 8 aa, Mycobacterium
ASPASGWA

SEQ ID NO: 891464 - protein, 7 aa, Mycobacterium
ASRARLD

SEQ ID NO: 891465 - protein, 6 aa, Mycobacterium
ASSCPN

SEQ ID NO: 891466 - protein, 4 aa, Mycobacterium
ATAA

SEQ ID NO: 891467 - protein, 14 aa, Mycobacterium
ATANEGDWKGGTRG

SEQ ID NO: 891468 - protein, 8 aa, Mycobacterium
ATAPSGAR

SEQ ID NO: 891469 - protein, 9 aa, Mycobacterium
ATARDGQPY

SEQ ID NO: 891470 - protein, 10 aa, Mycobacterium
ATDPGAAAQF

SEQ ID NO: 891471 - protein, 15 aa, Mycobacterium
ATDPLRSSARNRGDA

SEQ ID NO: 891472 - protein, 6 aa, Mycobacterium
ATFAGD

SEQ ID NO: 891473 - protein, 6 aa, Mycobacterium
ATFGPD

SEQ ID NO: 891474 - protein, 6 aa, Mycobacterium
ATGDKI

SEQ ID NO: 891475 - protein, 6 aa, Mycobacterium
ATGDRI

SEQ ID NO: 891476 - protein, 7 aa, Mycobacterium
ATGGLGR

SEQ ID NO: 891477 - protein, 4 aa, Mycobacterium
ATGL

SEQ ID NO: 891478 - protein, 7 aa, Mycobacterium
ATGRATN

SEQ ID NO: 891479 - protein, 7 aa, Mycobacterium
ATKAGLP

SEQ ID NO: 891480 - protein, 5 aa, Mycobacterium
ATLET

SEQ ID NO: 891481 - protein, 4 aa, Mycobacterium
ATLG

SEQ ID NO: 891482 - protein, 6 aa, Mycobacterium
ATPNVE

SEQ ID NO: 891483 - protein, 6 aa, Mycobacterium
ATPPAV

SEQ ID NO: 891484 - protein, 6 aa, Mycobacterium
ATPTER

SEQ ID NO: 891485 - protein, 5 aa, Mycobacterium
ATQPY

SEQ ID NO: 891486 - protein, 10 aa, Mycobacterium
ATSAAGSALA

SEQ ID NO: 891487 - protein, 10 aa, Mycobacterium
ATSKRPADAA

SEQ ID NO: 891488 - protein, 5 aa, Mycobacterium
ATTAG

SEQ ID NO: 891489 - protein, 8 aa, Mycobacterium
ATTDPRPF

SEQ ID NO: 891490 - protein, 5 aa, Mycobacterium
AVAAG

SEQ ID NO: 891491 - protein, 8 aa, Mycobacterium
AVDTRGGK

SEQ ID NO: 891492 - protein, 6 aa, Mycobacterium
AVGAGT

SEQ ID NO: 891493 - protein, 11 aa, Mycobacterium
AVGGPDDPEFH

SEQ ID NO: 891494 - protein, 11 aa, Mycobacterium
AVGHDGKAVPV

SEQ ID NO: 891495 - protein, 10 aa, Mycobacterium
AVNRGNAAQA

SEQ ID NO: 891496 - protein, 9 aa, Mycobacterium
AVNRPTPDR

SEQ ID NO: 891497 - protein, 6 aa, Mycobacterium
AVNSST

SEQ ID NO: 891498 - protein, 9 aa, Mycobacterium
AVRDEGDRG

SEQ ID NO: 891499 - protein, 4 aa, Mycobacterium
AWAS

SEQ ID NO: 891500 - protein, 5 aa, Mycobacterium
AWDPG

SEQ ID NO: 891501 - protein, 14 aa, Mycobacterium
AYAASKAGLSSLGE

SEQ ID NO: 891502 - protein, 5 aa, Mycobacterium
AYDSP

SEQ ID NO: 891503 - protein, 10 aa, Mycobacterium
AYSPPGSPVS

SEQ ID NO: 891504 - protein, 6 aa, Mycobacterium
CAADGS

SEQ ID NO: 891505 - protein, 8 aa, Mycobacterium
CASGSEAI

SEQ ID NO: 891506 - protein, 9 aa, Mycobacterium
CATGNTTAK

SEQ ID NO: 891507 - protein, 17 aa, Mycobacterium
CGGPGAQVAAEGAENAG

SEQ ID NO: 891508 - protein, 6 aa, Mycobacterium
CKPGEA

SEQ ID NO: 891509 - protein, 5 aa, Mycobacterium
CPAPG

SEQ ID NO: 891510 - protein, 4 aa, Mycobacterium
DAAP

SEQ ID NO: 891511 - protein, 7 aa, Mycobacterium
DADGISV

SEQ ID NO: 891512 - protein, 6 aa, Mycobacterium
DAGGYK

SEQ ID NO: 891513 - protein, 4 aa, Mycobacterium
DAPV

SEQ ID NO: 891514 - protein, 4 aa, Mycobacterium
DAQD

SEQ ID NO: 891515 - protein, 18 aa, Mycobacterium
DAQRDANGRFPRDASPDD

SEQ ID NO: 891516 - protein, 7 aa, Mycobacterium
DATQLSY

SEQ ID NO: 891517 - protein, 9 aa, Mycobacterium
DAVNGTPVA

SEQ ID NO: 891518 - protein, 10 aa, Mycobacterium
DDDPSYEQYK

SEQ ID NO: 891519 - protein, 4 aa, Mycobacterium
DDGG

SEQ ID NO: 891520 - protein, 7 aa, Mycobacterium
DDHSPTF

SEQ ID NO: 891521 - protein, 9 aa, Mycobacterium
DDNKSDLDA

SEQ ID NO: 891522 - protein, 6 aa, Mycobacterium
DEAKGA

SEQ ID NO: 891523 - protein, 6 aa, Mycobacterium
DEGRRR

SEQ ID NO: 891524 - protein, 8 aa, Mycobacterium
DELGDLDE

SEQ ID NO: 891525 - protein, 7 aa, Mycobacterium
DENGQPH

SEQ ID NO: 891526 - protein, 5 aa, Mycobacterium
DERVT

SEQ ID NO: 891527 - protein, 8 aa, Mycobacterium
DESGTTDN

SEQ ID NO: 891528 - protein, 8 aa, Mycobacterium
DEVGGTWR

SEQ ID NO: 891529 - protein, 4 aa, Mycobacterium
DFEE

SEQ ID NO: 891530 - protein, 7 aa, Mycobacterium
DFKRPSP

SEQ ID NO: 891531 - protein, 16 aa, Mycobacterium
DGANGVDGTGGNGGAG

SEQ ID NO: 891532 - protein, 7 aa, Mycobacterium
DGAYGAQ

SEQ ID NO: 891533 - protein, 10 aa, Mycobacterium
DGDEQARARP

SEQ ID NO: 891534 - protein, 5 aa, Mycobacterium
DGDVR

SEQ ID NO: 891535 - protein, 5 aa, Mycobacterium
DGGGD

SEQ ID NO: 891536 - protein, 12 aa, Mycobacterium
DGKLPGTDTYCP

SEQ ID NO: 891537 - protein, 8 aa, Mycobacterium
DGKPTEGC

SEQ ID NO: 891538 - protein, 12 aa, Mycobacterium
DGPAGSPPDPGK

SEQ ID NO: 891539 - protein, 8 aa, Mycobacterium
DGPSIGES

SEQ ID NO: 891540 - protein, 9 aa, Mycobacterium
DGPVQPDGT

SEQ ID NO: 891541 - protein, 6 aa, Mycobacterium
DGQTVG

SEQ ID NO: 891542 - protein, 6 aa, Mycobacterium
DGSGGT

SEQ ID NO: 891543 - protein, 8 aa, Mycobacterium
DGSLPTNL

SEQ ID NO: 891544 - protein, 7 aa, Mycobacterium
DGSPVTA

SEQ ID NO: 891545 - protein, 9 aa, Mycobacterium
DGSRSDLDA

SEQ ID NO: 891546 - protein, 7 aa, Mycobacterium
DGTLPGN

SEQ ID NO: 891547 - protein, 9 aa, Mycobacterium
DGTSGAPWV

SEQ ID NO: 891548 - protein, 4 aa, Mycobacterium
DGTT

SEQ ID NO: 891549 - protein, 5 aa, Mycobacterium
DGTVA

SEQ ID NO: 891550 - protein, 4 aa, Mycobacterium
DGYR

SEQ ID NO: 891551 - protein, 4 aa, Mycobacterium
DIAR

SEQ ID NO: 891552 - protein, 7 aa, Mycobacterium
DKDNLGR

SEQ ID NO: 891553 - protein, 9 aa, Mycobacterium
DKEGEPHQI

SEQ ID NO: 891554 - protein, 6 aa, Mycobacterium
DKFGGD

SEQ ID NO: 891555 - protein, 7 aa, Mycobacterium
DKGTPFG

SEQ ID NO: 891556 - protein, 7 aa, Mycobacterium
DKPGDHD

SEQ ID NO: 891557 - protein, 8 aa, Mycobacterium
DKSGTTAN

SEQ ID NO: 891558 - protein, 6 aa, Mycobacterium
DKTGQP

SEQ ID NO: 891559 - protein, 6 aa, Mycobacterium
DKWQER

SEQ ID NO: 891560 - protein, 7 aa, Mycobacterium
DLEPGQK

SEQ ID NO: 891561 - protein, 9 aa, Mycobacterium
DMPGSRDQP

SEQ ID NO: 891562 - protein, 6 aa, Mycobacterium
DNGTHS

SEQ ID NO: 891563 - protein, 9 aa, Mycobacterium
DNNGNGARV

SEQ ID NO: 891564 - protein, 7 aa, Mycobacterium
DNNGRQR

SEQ ID NO: 891565 - protein, 8 aa, Mycobacterium
DNPTTGPV

SEQ ID NO: 891566 - protein, 11 aa, Mycobacterium
DPAGTNGGPQL

SEQ ID NO: 891567 - protein, 4 aa, Mycobacterium
DPAR

SEQ ID NO: 891568 - protein, 4 aa, Mycobacterium
DPGI

SEQ ID NO: 891569 - protein, 7 aa, Mycobacterium
DPLPDGE

SEQ ID NO: 891570 - protein, 4 aa, Mycobacterium
DPPP

SEQ ID NO: 891571 - protein, 6 aa, Mycobacterium
DPSRAA

SEQ ID NO: 891572 - protein, 4 aa, Mycobacterium
DPTG

SEQ ID NO: 891573 - protein, 11 aa, Mycobacterium
DPTGKTVVPDP

SEQ ID NO: 891574 - protein, 13 aa, Mycobacterium
DPTPATIESGQTP

SEQ ID NO: 891575 - protein, 6 aa, Mycobacterium
DPVGPR

SEQ ID NO: 891576 - protein, 4 aa, Mycobacterium
DQGT

SEQ ID NO: 891577 - protein, 13 aa, Mycobacterium
DQPSGTRNMNDYS

SEQ ID NO: 891578 - protein, 9 aa, Mycobacterium
DQSGTTDNF

SEQ ID NO: 891579 - protein, 8 aa, Mycobacterium
DQSPPNQQ

SEQ ID NO: 891580 - protein, 7 aa, Mycobacterium
DQSPVNA

SEQ ID NO: 891581 - protein, 4 aa, Mycobacterium
DRDA

SEQ ID NO: 891582 - protein, 8 aa, Mycobacterium
DRGKQFGA

SEQ ID NO: 891583 - protein, 4 aa, Mycobacterium
DRNT

SEQ ID NO: 891584 - protein, 24 aa, Mycobacterium
DRPAAQRFTDKPYEEIPADSDDFS

SEQ ID NO: 891585 - protein, 11 aa, Mycobacterium
DRSRAKGPSRW

SEQ ID NO: 891586 - protein, 8 aa, Mycobacterium
DSAGALQA

SEQ ID NO: 891587 - protein, 8 aa, Mycobacterium
DSAYGAED

SEQ ID NO: 891588 - protein, 7 aa, Mycobacterium
DSDPFYS

SEQ ID NO: 891589 - protein, 8 aa, Mycobacterium
DSGGYNAN

SEQ ID NO: 891590 - protein, 6 aa, Mycobacterium
DSGTFT

SEQ ID NO: 891591 - protein, 10 aa, Mycobacterium
DSPGGSVTAS

SEQ ID NO: 891592 - protein, 5 aa, Mycobacterium
DSSGR

SEQ ID NO: 891593 - protein, 5 aa, Mycobacterium
DSTYN

SEQ ID NO: 891594 - protein, 12 aa, Mycobacterium
DTANWKRDEAVN

SEQ ID NO: 891595 - protein, 14 aa, Mycobacterium
DTAPAAASRGSRVP

SEQ ID NO: 891596 - protein, 4 aa, Mycobacterium
DTDI

SEQ ID NO: 891597 - protein, 5 aa, Mycobacterium
DTEAQ

SEQ ID NO: 891598 - protein, 24 aa, Mycobacterium
DTKPPLQAGDPASSVLNRVEYGDR

SEQ ID NO: 891599 - protein, 5 aa, Mycobacterium
DTMEE

SEQ ID NO: 891600 - protein, 5 aa, Mycobacterium
DTRGG

SEQ ID NO: 891601 - protein, 6 aa, Mycobacterium
DVTGGP

SEQ ID NO: 891602 - protein, 7 aa, Mycobacterium
EAGGDPW

SEQ ID NO: 891603 - protein, 7 aa, Mycobacterium
EAGPNQV

SEQ ID NO: 891604 - protein, 6 aa, Mycobacterium
EANGIE

SEQ ID NO: 891605 - protein, 6 aa, Mycobacterium
EDAPLG

SEQ ID NO: 891606 - protein, 9 aa, Mycobacterium
EDGASEPTV

SEQ ID NO: 891607 - protein, 6 aa, Mycobacterium
EEARSG

SEQ ID NO: 891608 - protein, 4 aa, Mycobacterium
EEDS

SEQ ID NO: 891609 - protein, 8 aa, Mycobacterium
EEQAGAGA

SEQ ID NO: 891610 - protein, 13 aa, Mycobacterium
EGALPPPRKKSRR

SEQ ID NO: 891611 - protein, 4 aa, Mycobacterium
EGLD

SEQ ID NO: 891612 - protein, 4 aa, Mycobacterium
EGMP

SEQ ID NO: 891613 - protein, 17 aa, Mycobacterium
EGSREAAIKQAEGQKQA

SEQ ID NO: 891614 - protein, 4 aa, Mycobacterium
EGST

SEQ ID NO: 891615 - protein, 7 aa, Mycobacterium
EGTREAA

SEQ ID NO: 891616 - protein, 20 aa, Mycobacterium
EIEASPAPSPRTPNYYPGGR

SEQ ID NO: 891617 - protein, 4 aa, Mycobacterium
EIGE

SEQ ID NO: 891618 - protein, 5 aa, Mycobacterium
EKAQS

SEQ ID NO: 891619 - protein, 15 aa, Mycobacterium
EKDPGKTNISRTAGE

SEQ ID NO: 891620 - protein, 5 aa, Mycobacterium
ELPRG

SEQ ID NO: 891621 - protein, 8 aa, Mycobacterium
ENALPGSI

SEQ ID NO: 891622 - protein, 4 aa, Mycobacterium
ENDR

SEQ ID NO: 891623 - protein, 4 aa, Mycobacterium
ENPM

SEQ ID NO: 891624 - protein, 4 aa, Mycobacterium
ENTD

SEQ ID NO: 891625 - protein, 6 aa, Mycobacterium
EPGKTS

SEQ ID NO: 891626 - protein, 6 aa, Mycobacterium
EPGQQT

SEQ ID NO: 891627 - protein, 6 aa, Mycobacterium
EPSSGF

SEQ ID NO: 891628 - protein, 4 aa, Mycobacterium
EQRD

SEQ ID NO: 891629 - protein, 4 aa, Mycobacterium
EQTL

SEQ ID NO: 891630 - protein, 6 aa, Mycobacterium
EQTQAG

SEQ ID NO: 891631 - protein, 7 aa, Mycobacterium
EQTQAGQ

SEQ ID NO: 891632 - protein, 12 aa, Mycobacterium
ERAAGEPHGRPR

SEQ ID NO: 891633 - protein, 10 aa, Mycobacterium
ERTEDGFGQG

SEQ ID NO: 891634 - protein, 5 aa, Mycobacterium
ETDGA

SEQ ID NO: 891635 - protein, 16 aa, Mycobacterium
ETGTAQSLSEATRHGS

SEQ ID NO: 891636 - protein, 7 aa, Mycobacterium
ETPGGAT

SEQ ID NO: 891637 - protein, 5 aa, Mycobacterium
ETSPL

SEQ ID NO: 891638 - protein, 4 aa, Mycobacterium
ETSR

SEQ ID NO: 891639 - protein, 4 aa, Mycobacterium
EVDG

SEQ ID NO: 891640 - protein, 7 aa, Mycobacterium
EVGPDDI

SEQ ID NO: 891641 - protein, 12 aa, Mycobacterium
EWSRSAKGEVGA

SEQ ID NO: 891642 - protein, 5 aa, Mycobacterium
FAGQG

SEQ ID NO: 891643 - protein, 7 aa, Mycobacterium
FAPSNAS

SEQ ID NO: 891644 - protein, 6 aa, Mycobacterium
FASRND

SEQ ID NO: 891645 - protein, 4 aa, Mycobacterium
FGPD

SEQ ID NO: 891646 - protein, 4 aa, Mycobacterium
FGPK

SEQ ID NO: 891647 - protein, 7 aa, Mycobacterium
FNDADGR

SEQ ID NO: 891648 - protein, 5 aa, Mycobacterium
FPAPE

SEQ ID NO: 891649 - protein, 4 aa, Mycobacterium
FPGA

SEQ ID NO: 891650 - protein, 11 aa, Mycobacterium
FPGGGDNGWGS

SEQ ID NO: 891651 - protein, 12 aa, Mycobacterium
FPGGGDNGWGSW

SEQ ID NO: 891652 - protein, 8 aa, Mycobacterium
FPRPDDPL

SEQ ID NO: 891653 - protein, 8 aa, Mycobacterium
FPSSGPYK

SEQ ID NO: 891654 - protein, 4 aa, Mycobacterium
GAAA

SEQ ID NO: 891655 - protein, 5 aa, Mycobacterium
GAAAT

SEQ ID NO: 891656 - protein, 7 aa, Mycobacterium
GAAAVSS

SEQ ID NO: 891657 - protein, 11 aa, Mycobacterium
GAATGRAGAAD

SEQ ID NO: 891658 - protein, 10 aa, Mycobacterium
GADGYGTSKA

SEQ ID NO: 891659 - protein, 5 aa, Mycobacterium
GADPL

SEQ ID NO: 891660 - protein, 15 aa, Mycobacterium
GADRLSATGGALAAP

SEQ ID NO: 891661 - protein, 5 aa, Mycobacterium
GADVG

SEQ ID NO: 891662 - protein, 5 aa, Mycobacterium
GAEPC

SEQ ID NO: 891663 - protein, 6 aa, Mycobacterium
GAEPGD

SEQ ID NO: 891664 - protein, 6 aa, Mycobacterium
GAERLP

SEQ ID NO: 891665 - protein, 4 aa, Mycobacterium
GAGA

SEQ ID NO: 891666 - protein, 4 aa, Mycobacterium
GAGG

SEQ ID NO: 891667 - protein, 10 aa, Mycobacterium
GAGGAPTASA

SEQ ID NO: 891668 - protein, 7 aa, Mycobacterium
GAGPAAM

SEQ ID NO: 891669 - protein, 5 aa, Mycobacterium
GAGQV

SEQ ID NO: 891670 - protein, 9 aa, Mycobacterium
GAHRPTPTI

SEQ ID NO: 891671 - protein, 12 aa, Mycobacterium
GAIGGKTGFTNA

SEQ ID NO: 891672 - protein, 7 aa, Mycobacterium
GAPAALA

SEQ ID NO: 891673 - protein, 7 aa, Mycobacterium
GAPGEDG

SEQ ID NO: 891674 - protein, 4 aa, Mycobacterium
GAPM

SEQ ID NO: 891675 - protein, 7 aa, Mycobacterium
GAPPNGV

SEQ ID NO: 891676 - protein, 4 aa, Mycobacterium
GAPQ

SEQ ID NO: 891677 - protein, 10 aa, Mycobacterium
GAQGHTNTSH

SEQ ID NO: 891678 - protein, 9 aa, Mycobacterium
GARSSLGRK

SEQ ID NO: 891679 - protein, 6 aa, Mycobacterium
GASARW

SEQ ID NO: 891680 - protein, 4 aa, Mycobacterium
GATA

SEQ ID NO: 891681 - protein, 7 aa, Mycobacterium
GCGGPCK

SEQ ID NO: 891682 - protein, 18 aa, Mycobacterium
GCGTSGEQPVTQPSMTTS

SEQ ID NO: 891683 - protein, 6 aa, Mycobacterium
GDAGGP

SEQ ID NO: 891684 - protein, 8 aa, Mycobacterium
GDAGGYKA

SEQ ID NO: 891685 - protein, 20 aa, Mycobacterium
GDAGQSPGTWKQNGQTGGQI

SEQ ID NO: 891686 - protein, 8 aa, Mycobacterium
GDCTETPD

SEQ ID NO: 891687 - protein, 7 aa, Mycobacterium
GDDTTSA

SEQ ID NO: 891688 - protein, 4 aa, Mycobacterium
GDFG

SEQ ID NO: 891689 - protein, 9 aa, Mycobacterium
GDGGPATGR

SEQ ID NO: 891690 - protein, 8 aa, Mycobacterium
GDGRTLQT

SEQ ID NO: 891691 - protein, 8 aa, Mycobacterium
GDKGEPCW

SEQ ID NO: 891692 - protein, 9 aa, Mycobacterium
GDPGLHGPK

SEQ ID NO: 891693 - protein, 17 aa, Mycobacterium
GDQYNAGRHIPPDQARR

SEQ ID NO: 891694 - protein, 7 aa, Mycobacterium
GDTGYTK

SEQ ID NO: 891695 - protein, 8 aa, Mycobacterium
GDTRNRGR

SEQ ID NO: 891696 - protein, 4 aa, Mycobacterium
GDTV

SEQ ID NO: 891697 - protein, 5 aa, Mycobacterium
GDVDP

SEQ ID NO: 891698 - protein, 11 aa, Mycobacterium
GEAAGFGGGGV

SEQ ID NO: 891699 - protein, 11 aa, Mycobacterium
GEADKARNVTR

SEQ ID NO: 891700 - protein, 9 aa, Mycobacterium
GEDNTTITG

SEQ ID NO: 891701 - protein, 6 aa, Mycobacterium
GEGTGL

SEQ ID NO: 891702 - protein, 7 aa, Mycobacterium
GEIEAAD

SEQ ID NO: 891703 - protein, 7 aa, Mycobacterium
GEKYPDG

SEQ ID NO: 891704 - protein, 4 aa, Mycobacterium
GEST

SEQ ID NO: 891705 - protein, 4 aa, Mycobacterium
GFGG

SEQ ID NO: 891706 - protein, 14 aa, Mycobacterium
GGAATAGAFSRPGL

SEQ ID NO: 891707 - protein, 43 aa, Mycobacterium
GGAGGAGGDGATGAAGAQGLTGQTGQTGHDGGAGGAGGAGGRG

SEQ ID NO: 891708 - protein, 6 aa, Mycobacterium
GGAPDD

SEQ ID NO: 891709 - protein, 7 aa, Mycobacterium
GGAQPET

SEQ ID NO: 891710 - protein, 9 aa, Mycobacterium
GGARAARGV

SEQ ID NO: 891711 - protein, 4 aa, Mycobacterium
GGEA

SEQ ID NO: 891712 - protein, 7 aa, Mycobacterium
GGGETAA

SEQ ID NO: 891713 - protein, 8 aa, Mycobacterium
GGGETAAS

SEQ ID NO: 891714 - protein, 8 aa, Mycobacterium
GGGPDAKL

SEQ ID NO: 891715 - protein, 13 aa, Mycobacterium
GGGWGSGALAILR

SEQ ID NO: 891716 - protein, 5 aa, Mycobacterium
GGGWS

SEQ ID NO: 891717 - protein, 10 aa, Mycobacterium
GGHTWPGGKQ

SEQ ID NO: 891718 - protein, 7 aa, Mycobacterium
GGKYPTA

SEQ ID NO: 891719 - protein, 4 aa, Mycobacterium
GGLG

SEQ ID NO: 891720 - protein, 7 aa, Mycobacterium
GGLPQRQ

SEQ ID NO: 891721 - protein, 4 aa, Mycobacterium
GGMP

SEQ ID NO: 891722 - protein, 57 aa, Mycobacterium
GGNGGAGGAGGAGGAGGAGGAGATATTAGTSGGNGGNGGAGGTGGDGGAGGAGGATG

SEQ ID NO: 891723 - protein, 118 aa, Mycobacterium
GGNGGNGGNPGASGAGGSGGTGSRTGAHGLAGTTPTTNAGDGGRGGDGYTSTDPTLNGGAGGNGGNGGDYGNGGAGGNGGNGATGALGTAPPAAGDPGGNGGNGSNGGNGGAGGTGGL

SEQ ID NO: 891724 - protein, 5 aa, Mycobacterium
GGNLA

SEQ ID NO: 891725 - protein, 11 aa, Mycobacterium
GGPGDSGAPVT

SEQ ID NO: 891726 - protein, 25 aa, Mycobacterium
GGQGGTGGNGLTTAGVGGHGGGTGL

SEQ ID NO: 891727 - protein, 5 aa, Mycobacterium
GGQSS

SEQ ID NO: 891728 - protein, 14 aa, Mycobacterium
GGSATAGAFSRPGL

SEQ ID NO: 891729 - protein, 17 aa, Mycobacterium
GGSLDGPSKGVGDGANI

SEQ ID NO: 891730 - protein, 8 aa, Mycobacterium
GGSPQARS

SEQ ID NO: 891731 - protein, 7 aa, Mycobacterium
GGSSEYA

SEQ ID NO: 891732 - protein, 7 aa, Mycobacterium
GGTAPDS

SEQ ID NO: 891733 - protein, 4 aa, Mycobacterium
GGTV

SEQ ID NO: 891734 - protein, 7 aa, Mycobacterium
GGVDGNG

SEQ ID NO: 891735 - protein, 4 aa, Mycobacterium
GGVR

SEQ ID NO: 891736 - protein, 6 aa, Mycobacterium
GHDTKQ

SEQ ID NO: 891737 - protein, 5 aa, Mycobacterium
GHGRS

SEQ ID NO: 891738 - protein, 17 aa, Mycobacterium
GHGTGRGEEGPLSPEKV

SEQ ID NO: 891739 - protein, 37 aa, Mycobacterium
GHNGANDASIGRQVPTGRGGTKDCQASGTSTNSGYPE

SEQ ID NO: 891740 - protein, 5 aa, Mycobacterium
GHTQY

SEQ ID NO: 891741 - protein, 9 aa, Mycobacterium
GHYTNATDA

SEQ ID NO: 891742 - protein, 4 aa, Mycobacterium
GIGG

SEQ ID NO: 891743 - protein, 5 aa, Mycobacterium
GIGGT

SEQ ID NO: 891744 - protein, 10 aa, Mycobacterium
GISKEQVARG

SEQ ID NO: 891745 - protein, 9 aa, Mycobacterium
GKGARLGSG

SEQ ID NO: 891746 - protein, 8 aa, Mycobacterium
GKGNTADW

SEQ ID NO: 891747 - protein, 12 aa, Mycobacterium
GKPDTKISEAPH

SEQ ID NO: 891748 - protein, 4 aa, Mycobacterium
GKQF

SEQ ID NO: 891749 - protein, 7 aa, Mycobacterium
GKSPRFT

SEQ ID NO: 891750 - protein, 7 aa, Mycobacterium
GLATPAA

SEQ ID NO: 891751 - protein, 6 aa, Mycobacterium
GLESSP

SEQ ID NO: 891752 - protein, 8 aa, Mycobacterium
GLGGAATR

SEQ ID NO: 891753 - protein, 4 aa, Mycobacterium
GLGR

SEQ ID NO: 891754 - protein, 8 aa, Mycobacterium
GLRPGGQA

SEQ ID NO: 891755 - protein, 6 aa, Mycobacterium
GLYGRS

SEQ ID NO: 891756 - protein, 7 aa, Mycobacterium
GLYGRSD

SEQ ID NO: 891757 - protein, 5 aa, Mycobacterium
GNATQ

SEQ ID NO: 891758 - protein, 8 aa, Mycobacterium
GNDARTRA

SEQ ID NO: 891759 - protein, 4 aa, Mycobacterium
GNGF

SEQ ID NO: 891760 - protein, 45 aa, Mycobacterium
GNQRRPDESCAPEPVAADPAPRRVRNATADGADIAETTEVAGDPQ

SEQ ID NO: 891761 - protein, 9 aa, Mycobacterium
GNTDCPGNA

SEQ ID NO: 891762 - protein, 7 aa, Mycobacterium
GNTPPIF

SEQ ID NO: 891763 - protein, 8 aa, Mycobacterium
GPDPKGAV

SEQ ID NO: 891764 - protein, 6 aa, Mycobacterium
GPGLAD

SEQ ID NO: 891765 - protein, 7 aa, Mycobacterium
GPGPTFN

SEQ ID NO: 891766 - protein, 14 aa, Mycobacterium
GPGQAEKSLLPGNP

SEQ ID NO: 891767 - protein, 5 aa, Mycobacterium
GPGTL

SEQ ID NO: 891768 - protein, 8 aa, Mycobacterium
GPIPDDKW

SEQ ID NO: 891769 - protein, 4 aa, Mycobacterium
GPIQ

SEQ ID NO: 891770 - protein, 6 aa, Mycobacterium
GPKNQT

SEQ ID NO: 891771 - protein, 4 aa, Mycobacterium
GPLQ

SEQ ID NO: 891772 - protein, 9 aa, Mycobacterium
GPNSGPGHN

SEQ ID NO: 891773 - protein, 6 aa, Mycobacterium
GPPGTV

SEQ ID NO: 891774 - protein, 8 aa, Mycobacterium
GPPPSPIE

SEQ ID NO: 891775 - protein, 5 aa, Mycobacterium
GPPPV

SEQ ID NO: 891776 - protein, 8 aa, Mycobacterium
GPSPTGWQ

SEQ ID NO: 891777 - protein, 17 aa, Mycobacterium
GPTGVIGTNKKDSQDTV

SEQ ID NO: 891778 - protein, 6 aa, Mycobacterium
GPYRYD

SEQ ID NO: 891779 - protein, 7 aa, Mycobacterium
GQAAYNS

SEQ ID NO: 891780 - protein, 4 aa, Mycobacterium
GQFP

SEQ ID NO: 891781 - protein, 6 aa, Mycobacterium
GQGGTI

SEQ ID NO: 891782 - protein, 16 aa, Mycobacterium
GQKGGSWRQTGCSSPL

SEQ ID NO: 891783 - protein, 6 aa, Mycobacterium
GQPAED

SEQ ID NO: 891784 - protein, 12 aa, Mycobacterium
GQPGDSGAPVTV

SEQ ID NO: 891785 - protein, 5 aa, Mycobacterium
GQTVG

SEQ ID NO: 891786 - protein, 10 aa, Mycobacterium
GQVQGVPDTL

SEQ ID NO: 891787 - protein, 4 aa, Mycobacterium
GRAA

SEQ ID NO: 891788 - protein, 8 aa, Mycobacterium
GREEDVAD

SEQ ID NO: 891789 - protein, 6 aa, Mycobacterium
GRGTEA

SEQ ID NO: 891790 - protein, 11 aa, Mycobacterium
GRISEQSSELA

SEQ ID NO: 891791 - protein, 4 aa, Mycobacterium
GRPF

SEQ ID NO: 891792 - protein, 4 aa, Mycobacterium
GRPM

SEQ ID NO: 891793 - protein, 4 aa, Mycobacterium
GRRG

SEQ ID NO: 891794 - protein, 11 aa, Mycobacterium
GRRPKLYGAGA

SEQ ID NO: 891795 - protein, 7 aa, Mycobacterium
GRRPVTA

SEQ ID NO: 891796 - protein, 4 aa, Mycobacterium
GRSR

SEQ ID NO: 891797 - protein, 4 aa, Mycobacterium
GRSV

SEQ ID NO: 891798 - protein, 4 aa, Mycobacterium
GSAA

SEQ ID NO: 891799 - protein, 14 aa, Mycobacterium
GSARVTSPEPEATY

SEQ ID NO: 891800 - protein, 5 aa, Mycobacterium
GSGAD

SEQ ID NO: 891801 - protein, 11 aa, Mycobacterium
GSGGGSVAPPV

SEQ ID NO: 891802 - protein, 9 aa, Mycobacterium
GSPKGYAHP

SEQ ID NO: 891803 - protein, 4 aa, Mycobacterium
GSQM

SEQ ID NO: 891804 - protein, 6 aa, Mycobacterium
GSTEVG

SEQ ID NO: 891805 - protein, 30 aa, Mycobacterium
GSTGTTGAGGNGGTGGNGAIAGNGGAGANG

SEQ ID NO: 891806 - protein, 4 aa, Mycobacterium
GTAD

SEQ ID NO: 891807 - protein, 4 aa, Mycobacterium
GTDA

SEQ ID NO: 891808 - protein, 7 aa, Mycobacterium
GTDPTSD

SEQ ID NO: 891809 - protein, 4 aa, Mycobacterium
GTFA

SEQ ID NO: 891810 - protein, 5 aa, Mycobacterium
GTGAS

SEQ ID NO: 891811 - protein, 10 aa, Mycobacterium
GTGTGGETVG

SEQ ID NO: 891812 - protein, 4 aa, Mycobacterium
GTGV

SEQ ID NO: 891813 - protein, 8 aa, Mycobacterium
GTMESNSP

SEQ ID NO: 891814 - protein, 7 aa, Mycobacterium
GTSGQAE

SEQ ID NO: 891815 - protein, 8 aa, Mycobacterium
GTSHAGLD

SEQ ID NO: 891816 - protein, 12 aa, Mycobacterium
GTTSAARTQLSH

SEQ ID NO: 891817 - protein, 7 aa, Mycobacterium
GTWERNG

SEQ ID NO: 891818 - protein, 13 aa, Mycobacterium
GVAKGSAEPHKTK

SEQ ID NO: 891819 - protein, 4 aa, Mycobacterium
GVDP

SEQ ID NO: 891820 - protein, 7 aa, Mycobacterium
GVETPAA

SEQ ID NO: 891821 - protein, 12 aa, Mycobacterium
GVPSSSAPQAIG

SEQ ID NO: 891822 - protein, 9 aa, Mycobacterium
GVPTPGLPF

SEQ ID NO: 891823 - protein, 12 aa, Mycobacterium
GVRPDSKPWHPS

SEQ ID NO: 891824 - protein, 5 aa, Mycobacterium
GVRPV

SEQ ID NO: 891825 - protein, 10 aa, Mycobacterium
GVSTAGAQGP

SEQ ID NO: 891826 - protein, 6 aa, Mycobacterium
GVYANS

SEQ ID NO: 891827 - protein, 4 aa, Mycobacterium
GYDP

SEQ ID NO: 891828 - protein, 16 aa, Mycobacterium
GYEHPGDPRQPDNTHR

SEQ ID NO: 891829 - protein, 7 aa, Mycobacterium
GYSQGAA

SEQ ID NO: 891830 - protein, 6 aa, Mycobacterium
HDPEVQ

SEQ ID NO: 891831 - protein, 7 aa, Mycobacterium
HDPTARR

SEQ ID NO: 891832 - protein, 5 aa, Mycobacterium
HETDR

SEQ ID NO: 891833 - protein, 12 aa, Mycobacterium
HGGDGANDTIDR

SEQ ID NO: 891834 - protein, 6 aa, Mycobacterium
HGNDDA

SEQ ID NO: 891835 - protein, 6 aa, Mycobacterium
HGPDGQ

SEQ ID NO: 891836 - protein, 6 aa, Mycobacterium
HGSPQV

SEQ ID NO: 891837 - protein, 16 aa, Mycobacterium
HGVSGGAEIRRSDAPR

SEQ ID NO: 891838 - protein, 5 aa, Mycobacterium
HKQSQ

SEQ ID NO: 891839 - protein, 12 aa, Mycobacterium
HNDGRVSPDNID

SEQ ID NO: 891840 - protein, 7 aa, Mycobacterium
HPDDNDK

SEQ ID NO: 891841 - protein, 4 aa, Mycobacterium
HPGD

SEQ ID NO: 891842 - protein, 4 aa, Mycobacterium
HPGV

SEQ ID NO: 891843 - protein, 8 aa, Mycobacterium
HPLPEATG

SEQ ID NO: 891844 - protein, 6 aa, Mycobacterium
HPPDAA

SEQ ID NO: 891845 - protein, 4 aa, Mycobacterium
HTQY

SEQ ID NO: 891846 - protein, 9 aa, Mycobacterium
HTSSGGSIY

SEQ ID NO: 891847 - protein, 5 aa, Mycobacterium
IADAG

SEQ ID NO: 891848 - protein, 4 aa, Mycobacterium
IAGP

SEQ ID NO: 891849 - protein, 9 aa, Mycobacterium
IDASASSQF

SEQ ID NO: 891850 - protein, 9 aa, Mycobacterium
IDEDRRSRE

SEQ ID NO: 891851 - protein, 4 aa, Mycobacterium
IDGQ

SEQ ID NO: 891852 - protein, 10 aa, Mycobacterium
IDPPPSIQDS

SEQ ID NO: 891853 - protein, 6 aa, Mycobacterium
IDPQRD

SEQ ID NO: 891854 - protein, 4 aa, Mycobacterium
IDST

SEQ ID NO: 891855 - protein, 4 aa, Mycobacterium
IGAG

SEQ ID NO: 891856 - protein, 7 aa, Mycobacterium
IGDTERQ

SEQ ID NO: 891857 - protein, 11 aa, Mycobacterium
IGKGAKLGSGK

SEQ ID NO: 891858 - protein, 18 aa, Mycobacterium
IGNAEKPDRTGRQQRNAD

SEQ ID NO: 891859 - protein, 7 aa, Mycobacterium
IGPDPTF

SEQ ID NO: 891860 - protein, 5 aa, Mycobacterium
INGGG

SEQ ID NO: 891861 - protein, 5 aa, Mycobacterium
IPKRR

SEQ ID NO: 891862 - protein, 5 aa, Mycobacterium
IPTHV

SEQ ID NO: 891863 - protein, 5 aa, Mycobacterium
IQPQG

SEQ ID NO: 891864 - protein, 11 aa, Mycobacterium
IRSGAGSNTVH

SEQ ID NO: 891865 - protein, 11 aa, Mycobacterium
IRSGGGSPTVH

SEQ ID NO: 891866 - protein, 4 aa, Mycobacterium
ISNN

SEQ ID NO: 891867 - protein, 4 aa, Mycobacterium
ISRK

SEQ ID NO: 891868 - protein, 6 aa, Mycobacterium
ITAPPF

SEQ ID NO: 891869 - protein, 6 aa, Mycobacterium
ITDKAA

SEQ ID NO: 891870 - protein, 5 aa, Mycobacterium
ITQSG

SEQ ID NO: 891871 - protein, 8 aa, Mycobacterium
KAANLGSD

SEQ ID NO: 891872 - protein, 9 aa, Mycobacterium
KAKTPTDNG

SEQ ID NO: 891873 - protein, 7 aa, Mycobacterium
KANQRLE

SEQ ID NO: 891874 - protein, 6 aa, Mycobacterium
KDRSQV

SEQ ID NO: 891875 - protein, 12 aa, Mycobacterium
KEEDEASKERLE

SEQ ID NO: 891876 - protein, 12 aa, Mycobacterium
KGEDYTPLGSTD

SEQ ID NO: 891877 - protein, 13 aa, Mycobacterium
KGMGSGGAKGCPK

SEQ ID NO: 891878 - protein, 4 aa, Mycobacterium
KIAN

SEQ ID NO: 891879 - protein, 9 aa, Mycobacterium
KKAAKNGDL

SEQ ID NO: 891880 - protein, 14 aa, Mycobacterium
KLPRNATAKIGQTS

SEQ ID NO: 891881 - protein, 12 aa, Mycobacterium
KLQKAAKNGDLP

SEQ ID NO: 891882 - protein, 5 aa, Mycobacterium
KLYGN

SEQ ID NO: 891883 - protein, 5 aa, Mycobacterium
KNELR

SEQ ID NO: 891884 - protein, 5 aa, Mycobacterium
KNGSG

SEQ ID NO: 891885 - protein, 8 aa, Mycobacterium
KNKTPGGG

SEQ ID NO: 891886 - protein, 4 aa, Mycobacterium
KNNT

SEQ ID NO: 891887 - protein, 6 aa, Mycobacterium
KPALRE

SEQ ID NO: 891888 - protein, 8 aa, Mycobacterium
KPGRTYTA

SEQ ID NO: 891889 - protein, 6 aa, Mycobacterium
KPGTTV

SEQ ID NO: 891890 - protein, 8 aa, Mycobacterium
KPTKPGSY

SEQ ID NO: 891891 - protein, 10 aa, Mycobacterium
KQGRTTGNSC

SEQ ID NO: 891892 - protein, 6 aa, Mycobacterium
KQPAVA

SEQ ID NO: 891893 - protein, 7 aa, Mycobacterium
KRSVGGV

SEQ ID NO: 891894 - protein, 4 aa, Mycobacterium
KSNG

SEQ ID NO: 891895 - protein, 17 aa, Mycobacterium
KTDAEKRAAVETTPARK

SEQ ID NO: 891896 - protein, 15 aa, Mycobacterium
KTGYAASAAPITDIW

SEQ ID NO: 891897 - protein, 7 aa, Mycobacterium
KTYANQP

SEQ ID NO: 891898 - protein, 11 aa, Mycobacterium
KVAQQKGAIPG

SEQ ID NO: 891899 - protein, 6 aa, Mycobacterium
KYRGEF

SEQ ID NO: 891900 - protein, 7 aa, Mycobacterium
LADTEDK

SEQ ID NO: 891901 - protein, 9 aa, Mycobacterium
LAEQTGKRI

SEQ ID NO: 891902 - protein, 5 aa, Mycobacterium
LAGPG

SEQ ID NO: 891903 - protein, 8 aa, Mycobacterium
LAHGGQPV

SEQ ID NO: 891904 - protein, 4 aa, Mycobacterium
LAPD

SEQ ID NO: 891905 - protein, 5 aa, Mycobacterium
LDDQA

SEQ ID NO: 891906 - protein, 6 aa, Mycobacterium
LDPIPG

SEQ ID NO: 891907 - protein, 12 aa, Mycobacterium
LDQRRDTSVSEK

SEQ ID NO: 891908 - protein, 4 aa, Mycobacterium
LDVT

SEQ ID NO: 891909 - protein, 4 aa, Mycobacterium
LEAG

SEQ ID NO: 891910 - protein, 5 aa, Mycobacterium
LGGKG

SEQ ID NO: 891911 - protein, 4 aa, Mycobacterium
LGGT

SEQ ID NO: 891912 - protein, 9 aa, Mycobacterium
LGLSGTVTT

SEQ ID NO: 891913 - protein, 8 aa, Mycobacterium
LGNGPGIQ

SEQ ID NO: 891914 - protein, 6 aa, Mycobacterium
LGPART

SEQ ID NO: 891915 - protein, 7 aa, Mycobacterium
LGPDPAF

SEQ ID NO: 891916 - protein, 6 aa, Mycobacterium
LGSAET

SEQ ID NO: 891917 - protein, 9 aa, Mycobacterium
LGSGGSEEQ

SEQ ID NO: 891918 - protein, 16 aa, Mycobacterium
LGVGSETLRTNANADA

SEQ ID NO: 891919 - protein, 7 aa, Mycobacterium
LHDPYTN

SEQ ID NO: 891920 - protein, 6 aa, Mycobacterium
LNPDNT

SEQ ID NO: 891921 - protein, 11 aa, Mycobacterium
LPAPGLGSGGY

SEQ ID NO: 891922 - protein, 6 aa, Mycobacterium
LPAQYA

SEQ ID NO: 891923 - protein, 7 aa, Mycobacterium
LPAQYGG

SEQ ID NO: 891924 - protein, 12 aa, Mycobacterium
LPDGSDAQPSYL

SEQ ID NO: 891925 - protein, 9 aa, Mycobacterium
LPDQPGRST

SEQ ID NO: 891926 - protein, 4 aa, Mycobacterium
LPGG

SEQ ID NO: 891927 - protein, 15 aa, Mycobacterium
LPPPGRDGTGSAEQL

SEQ ID NO: 891928 - protein, 5 aa, Mycobacterium
LPRPE

SEQ ID NO: 891929 - protein, 4 aa, Mycobacterium
LPSS

SEQ ID NO: 891930 - protein, 7 aa, Mycobacterium
LQDGRRR

SEQ ID NO: 891931 - protein, 6 aa, Mycobacterium
LQPGGL

SEQ ID NO: 891932 - protein, 7 aa, Mycobacterium
LQPGGPV

SEQ ID NO: 891933 - protein, 8 aa, Mycobacterium
LREEGTTF

SEQ ID NO: 891934 - protein, 8 aa, Mycobacterium
LRKTGKDL

SEQ ID NO: 891935 - protein, 16 aa, Mycobacterium
LSAASGSYANAEATNT

SEQ ID NO: 891936 - protein, 7 aa, Mycobacterium
LSAPGSR

SEQ ID NO: 891937 - protein, 18 aa, Mycobacterium
LSGQAADPFKIPPGTASG

SEQ ID NO: 891938 - protein, 5 aa, Mycobacterium
LSKGY

SEQ ID NO: 891939 - protein, 6 aa, Mycobacterium
LSKGYG

SEQ ID NO: 891940 - protein, 10 aa, Mycobacterium
LSPEQADNLT

SEQ ID NO: 891941 - protein, 8 aa, Mycobacterium
LSSPEGYK

SEQ ID NO: 891942 - protein, 8 aa, Mycobacterium
LTATTRTG

SEQ ID NO: 891943 - protein, 9 aa, Mycobacterium
LTDPKAGPL

SEQ ID NO: 891944 - protein, 10 aa, Mycobacterium
LTPDGVTGFP

SEQ ID NO: 891945 - protein, 9 aa, Mycobacterium
LTPGARTTI

SEQ ID NO: 891946 - protein, 6 aa, Mycobacterium
MAKGEA

SEQ ID NO: 891947 - protein, 16 aa, Mycobacterium
MGDQTGAALSRSGRQV

SEQ ID NO: 891948 - protein, 9 aa, Mycobacterium
MPSPYTAGN

SEQ ID NO: 891949 - protein, 14 aa, Mycobacterium
MPTSMGKDSTPTAN

SEQ ID NO: 891950 - protein, 9 aa, Mycobacterium
MRPSPTEPG

SEQ ID NO: 891951 - protein, 11 aa, Mycobacterium
MSRGNDNALGP

SEQ ID NO: 891952 - protein, 6 aa, Mycobacterium
MVPPQN

SEQ ID NO: 891953 - protein, 6 aa, Mycobacterium
NAAGGH

SEQ ID NO: 891954 - protein, 10 aa, Mycobacterium
NAAPAGTPVR

SEQ ID NO: 891955 - protein, 7 aa, Mycobacterium
NAGLQHA

SEQ ID NO: 891956 - protein, 10 aa, Mycobacterium
NAHGTVTGAA

SEQ ID NO: 891957 - protein, 8 aa, Mycobacterium
NANGSGAG

SEQ ID NO: 891958 - protein, 4 aa, Mycobacterium
NASQ

SEQ ID NO: 891959 - protein, 7 aa, Mycobacterium
NAVKSGD

SEQ ID NO: 891960 - protein, 5 aa, Mycobacterium
NDAAR

SEQ ID NO: 891961 - protein, 6 aa, Mycobacterium
NDADGS

SEQ ID NO: 891962 - protein, 9 aa, Mycobacterium
NDGETVGVG

SEQ ID NO: 891963 - protein, 4 aa, Mycobacterium
NDGL

SEQ ID NO: 891964 - protein, 4 aa, Mycobacterium
NDNR

SEQ ID NO: 891965 - protein, 4 aa, Mycobacterium
NDPD

SEQ ID NO: 891966 - protein, 4 aa, Mycobacterium
NDPG

SEQ ID NO: 891967 - protein, 7 aa, Mycobacterium
NDPNEVA

SEQ ID NO: 891968 - protein, 5 aa, Mycobacterium
NEPGF

SEQ ID NO: 891969 - protein, 7 aa, Mycobacterium
NEPNLGD

SEQ ID NO: 891970 - protein, 6 aa, Mycobacterium
NEQRDD

SEQ ID NO: 891971 - protein, 12 aa, Mycobacterium
NFEEATPDLSGA

SEQ ID NO: 891972 - protein, 4 aa, Mycobacterium
NFPG

SEQ ID NO: 891973 - protein, 23 aa, Mycobacterium
NFVNSSAKQGEVVGTTPSGATIP

SEQ ID NO: 891974 - protein, 16 aa, Mycobacterium
NGGDRLSATGGALAAP

SEQ ID NO: 891975 - protein, 7 aa, Mycobacterium
NGGGLGQ

SEQ ID NO: 891976 - protein, 49 aa, Mycobacterium
NGGRGGSGAAGQAGGRGGSAGLIGTGGAGGAGGASVSGAGGVGGGGGAG

SEQ ID NO: 891977 - protein, 7 aa, Mycobacterium
NGKGGQP

SEQ ID NO: 891978 - protein, 13 aa, Mycobacterium
NGKPSDLGGDNLP

SEQ ID NO: 891979 - protein, 6 aa, Mycobacterium
NGPAGG

SEQ ID NO: 891980 - protein, 5 aa, Mycobacterium
NGSGN

SEQ ID NO: 891981 - protein, 5 aa, Mycobacterium
NGSTG

SEQ ID NO: 891982 - protein, 5 aa, Mycobacterium
NGTHD

SEQ ID NO: 891983 - protein, 4 aa, Mycobacterium
NGTT

SEQ ID NO: 891984 - protein, 8 aa, Mycobacterium
NKGVPGVK

SEQ ID NO: 891985 - protein, 7 aa, Mycobacterium
NKPGDHD

SEQ ID NO: 891986 - protein, 10 aa, Mycobacterium
NKTAGDAEKL

SEQ ID NO: 891987 - protein, 5 aa, Mycobacterium
NNTPV

SEQ ID NO: 891988 - protein, 9 aa, Mycobacterium
NPAKGKDGV

SEQ ID NO: 891989 - protein, 14 aa, Mycobacterium
NPASAGAQGNTNVT

SEQ ID NO: 891990 - protein, 11 aa, Mycobacterium
NPGGPGESGIE

SEQ ID NO: 891991 - protein, 4 aa, Mycobacterium
NPPA

SEQ ID NO: 891992 - protein, 4 aa, Mycobacterium
NPST

SEQ ID NO: 891993 - protein, 7 aa, Mycobacterium
NPVRGGE

SEQ ID NO: 891994 - protein, 6 aa, Mycobacterium
NQGAQQ

SEQ ID NO: 891995 - protein, 10 aa, Mycobacterium
NQNPAFQGAS

SEQ ID NO: 891996 - protein, 5 aa, Mycobacterium
NRADP

SEQ ID NO: 891997 - protein, 12 aa, Mycobacterium
NRGGSRPAKPIP

SEQ ID NO: 891998 - protein, 16 aa, Mycobacterium
NRPRSFAGAADAVTNR

SEQ ID NO: 891999 - protein, 9 aa, Mycobacterium
NSPGGGYDL

SEQ ID NO: 892000 - protein, 9 aa, Mycobacterium
NTGNGYSGG

SEQ ID NO: 892001 - protein, 5 aa, Mycobacterium
NVGQG

SEQ ID NO: 892002 - protein, 10 aa, Mycobacterium
NYDNPRSTGF

SEQ ID NO: 892003 - protein, 6 aa, Mycobacterium
NYRGSM

SEQ ID NO: 892004 - protein, 6 aa, Mycobacterium
NYTPDN

SEQ ID NO: 892005 - protein, 4 aa, Mycobacterium
PAAA

SEQ ID NO: 892006 - protein, 11 aa, Mycobacterium
PAATDQEVRRA

SEQ ID NO: 892007 - protein, 6 aa, Mycobacterium
PAFSGQ

SEQ ID NO: 892008 - protein, 4 aa, Mycobacterium
PAGA

SEQ ID NO: 892009 - protein, 8 aa, Mycobacterium
PAGAAYGQ

SEQ ID NO: 892010 - protein, 6 aa, Mycobacterium
PAGGAL

SEQ ID NO: 892011 - protein, 7 aa, Mycobacterium
PAGPGCS

SEQ ID NO: 892012 - protein, 5 aa, Mycobacterium
PALPA

SEQ ID NO: 892013 - protein, 11 aa, Mycobacterium
PASDDSPSERE

SEQ ID NO: 892014 - protein, 5 aa, Mycobacterium
PASGA

SEQ ID NO: 892015 - protein, 4 aa, Mycobacterium
PAST

SEQ ID NO: 892016 - protein, 6 aa, Mycobacterium
PATPPP

SEQ ID NO: 892017 - protein, 4 aa, Mycobacterium
PAVT

SEQ ID NO: 892018 - protein, 10 aa, Mycobacterium
PDDTPWGGKP

SEQ ID NO: 892019 - protein, 7 aa, Mycobacterium
PDFTPTD

SEQ ID NO: 892020 - protein, 4 aa, Mycobacterium
PDGR

SEQ ID NO: 892021 - protein, 4 aa, Mycobacterium
PDGS

SEQ ID NO: 892022 - protein, 9 aa, Mycobacterium
PDGSTTVDT

SEQ ID NO: 892023 - protein, 8 aa, Mycobacterium
PDGSVAQT

SEQ ID NO: 892024 - protein, 7 aa, Mycobacterium
PDKVYSG

SEQ ID NO: 892025 - protein, 8 aa, Mycobacterium
PDKVYSGG

SEQ ID NO: 892026 - protein, 4 aa, Mycobacterium
PDQA

SEQ ID NO: 892027 - protein, 5 aa, Mycobacterium
PDVPE

SEQ ID NO: 892028 - protein, 6 aa, Mycobacterium
PEKVNT

SEQ ID NO: 892029 - protein, 5 aa, Mycobacterium
PEQRR

SEQ ID NO: 892030 - protein, 6 aa, Mycobacterium
PFGNDS

SEQ ID NO: 892031 - protein, 5 aa, Mycobacterium
PGAEA

SEQ ID NO: 892032 - protein, 5 aa, Mycobacterium
PGGKT

SEQ ID NO: 892033 - protein, 10 aa, Mycobacterium
PGGPGASAVD

SEQ ID NO: 892034 - protein, 6 aa, Mycobacterium
PGHPAP

SEQ ID NO: 892035 - protein, 4 aa, Mycobacterium
PGLA

SEQ ID NO: 892036 - protein, 4 aa, Mycobacterium
PGPA

SEQ ID NO: 892037 - protein, 5 aa, Mycobacterium
PGPFT

SEQ ID NO: 892038 - protein, 7 aa, Mycobacterium
PGPSAVT

SEQ ID NO: 892039 - protein, 4 aa, Mycobacterium
PGSD

SEQ ID NO: 892040 - protein, 8 aa, Mycobacterium
PGSDRTSQ

SEQ ID NO: 892041 - protein, 5 aa, Mycobacterium
PGSRP

SEQ ID NO: 892042 - protein, 4 aa, Mycobacterium
PGVG

SEQ ID NO: 892043 - protein, 6 aa, Mycobacterium
PHAEAR

SEQ ID NO: 892044 - protein, 11 aa, Mycobacterium
PHSRGLGSSAA

SEQ ID NO: 892045 - protein, 6 aa, Mycobacterium
PICTGG

SEQ ID NO: 892046 - protein, 5 aa, Mycobacterium
PIPAD

SEQ ID NO: 892047 - protein, 7 aa, Mycobacterium
PIPDDKW

SEQ ID NO: 892048 - protein, 8 aa, Mycobacterium
PKTAETAA

SEQ ID NO: 892049 - protein, 5 aa, Mycobacterium
PLGPD

SEQ ID NO: 892050 - protein, 11 aa, Mycobacterium
PLGQPSDASPR

SEQ ID NO: 892051 - protein, 10 aa, Mycobacterium
PLSAPPDRLT

SEQ ID NO: 892052 - protein, 10 aa, Mycobacterium
PNDPNGACGV

SEQ ID NO: 892053 - protein, 4 aa, Mycobacterium
PNGA

SEQ ID NO: 892054 - protein, 5 aa, Mycobacterium
PNGGQ

SEQ ID NO: 892055 - protein, 8 aa, Mycobacterium
PNSGPGHN

SEQ ID NO: 892056 - protein, 9 aa, Mycobacterium
PNSGPGHNS

SEQ ID NO: 892057 - protein, 4 aa, Mycobacterium
PNTA

SEQ ID NO: 892058 - protein, 6 aa, Mycobacterium
PNTNGV

SEQ ID NO: 892059 - protein, 7 aa, Mycobacterium
PPDTPPT

SEQ ID NO: 892060 - protein, 4 aa, Mycobacterium
PPGA

SEQ ID NO: 892061 - protein, 10 aa, Mycobacterium
PPLASTTTDL

SEQ ID NO: 892062 - protein, 5 aa, Mycobacterium
PPLPA

SEQ ID NO: 892063 - protein, 6 aa, Mycobacterium
PPNGTH

SEQ ID NO: 892064 - protein, 10 aa, Mycobacterium
PPPNQFPAAT

SEQ ID NO: 892065 - protein, 6 aa, Mycobacterium
PPPRSH

SEQ ID NO: 892066 - protein, 15 aa, Mycobacterium
PPTSKPHTISAPGLA

SEQ ID NO: 892067 - protein, 4 aa, Mycobacterium
PQAF

SEQ ID NO: 892068 - protein, 15 aa, Mycobacterium
PQASGASSQPQLSRE

SEQ ID NO: 892069 - protein, 4 aa, Mycobacterium
PQYS

SEQ ID NO: 892070 - protein, 10 aa, Mycobacterium
PREDPDLRGK

SEQ ID NO: 892071 - protein, 8 aa, Mycobacterium
PRGTTQGQ

SEQ ID NO: 892072 - protein, 6 aa, Mycobacterium
PRLDNQ

SEQ ID NO: 892073 - protein, 13 aa, Mycobacterium
PSDVADGDDLRRD

SEQ ID NO: 892074 - protein, 8 aa, Mycobacterium
PSFHSTER

SEQ ID NO: 892075 - protein, 4 aa, Mycobacterium
PSGQ

SEQ ID NO: 892076 - protein, 11 aa, Mycobacterium
PSLGKGGDDGA

SEQ ID NO: 892077 - protein, 4 aa, Mycobacterium
PSMG

SEQ ID NO: 892078 - protein, 5 aa, Mycobacterium
PSTGE

SEQ ID NO: 892079 - protein, 8 aa, Mycobacterium
PSTPGTPI

SEQ ID NO: 892080 - protein, 6 aa, Mycobacterium
PSYDPN

SEQ ID NO: 892081 - protein, 14 aa, Mycobacterium
PTAGTGTPTGDYGI

SEQ ID NO: 892082 - protein, 18 aa, Mycobacterium
PTYAGSMTDDKNNSKPKH

SEQ ID NO: 892083 - protein, 4 aa, Mycobacterium
PVAG

SEQ ID NO: 892084 - protein, 13 aa, Mycobacterium
PVNVSPDGDSLIL

SEQ ID NO: 892085 - protein, 5 aa, Mycobacterium
PVPAD

SEQ ID NO: 892086 - protein, 18 aa, Mycobacterium
PVPGPVPTSPANNDFKPG

SEQ ID NO: 892087 - protein, 12 aa, Mycobacterium
PVPTNDPRGLSY

SEQ ID NO: 892088 - protein, 16 aa, Mycobacterium
PVRTSGMTPYVTRMIE

SEQ ID NO: 892089 - protein, 11 aa, Mycobacterium
QAEGTDNPHEA

SEQ ID NO: 892090 - protein, 12 aa, Mycobacterium
QANPAPPVGPAL

SEQ ID NO: 892091 - protein, 4 aa, Mycobacterium
QAPD

SEQ ID NO: 892092 - protein, 9 aa, Mycobacterium
QAPGLGKTK

SEQ ID NO: 892093 - protein, 9 aa, Mycobacterium
QASGGWTDG

SEQ ID NO: 892094 - protein, 8 aa, Mycobacterium
QCGEPNDY

SEQ ID NO: 892095 - protein, 7 aa, Mycobacterium
QDAGAPV

SEQ ID NO: 892096 - protein, 7 aa, Mycobacterium
QEAGTDR

SEQ ID NO: 892097 - protein, 8 aa, Mycobacterium
QEGYQDNS

SEQ ID NO: 892098 - protein, 6 aa, Mycobacterium
QGGQLT

SEQ ID NO: 892099 - protein, 6 aa, Mycobacterium
QGGTAG

SEQ ID NO: 892100 - protein, 4 aa, Mycobacterium
QGKA

SEQ ID NO: 892101 - protein, 6 aa, Mycobacterium
QGQGVA

SEQ ID NO: 892102 - protein, 6 aa, Mycobacterium
QGTEFD

SEQ ID NO: 892103 - protein, 10 aa, Mycobacterium
QKEDAAAQRG

SEQ ID NO: 892104 - protein, 14 aa, Mycobacterium
QKYDPGRVMFSGLN

SEQ ID NO: 892105 - protein, 20 aa, Mycobacterium
QLPPTDPRYVDGSPGSRVPS

SEQ ID NO: 892106 - protein, 5 aa, Mycobacterium
QNDDM

SEQ ID NO: 892107 - protein, 8 aa, Mycobacterium
QNGLSPND

SEQ ID NO: 892108 - protein, 5 aa, Mycobacterium
QNGTV

SEQ ID NO: 892109 - protein, 6 aa, Mycobacterium
QNMSNN

SEQ ID NO: 892110 - protein, 6 aa, Mycobacterium
QNTPAI

SEQ ID NO: 892111 - protein, 8 aa, Mycobacterium
QNTPAIAA

SEQ ID NO: 892112 - protein, 7 aa, Mycobacterium
QPGKTSH

SEQ ID NO: 892113 - protein, 6 aa, Mycobacterium
QPGPVD

SEQ ID NO: 892114 - protein, 8 aa, Mycobacterium
QPGTGSTF

SEQ ID NO: 892115 - protein, 4 aa, Mycobacterium
QPKL

SEQ ID NO: 892116 - protein, 4 aa, Mycobacterium
QPQL

SEQ ID NO: 892117 - protein, 11 aa, Mycobacterium
QPQRAPAMPAS

SEQ ID NO: 892118 - protein, 11 aa, Mycobacterium
QPSSGNGQNYT

SEQ ID NO: 892119 - protein, 5 aa, Mycobacterium
QPVDG

SEQ ID NO: 892120 - protein, 5 aa, Mycobacterium
QRGFQ

SEQ ID NO: 892121 - protein, 7 aa, Mycobacterium
QSDYARM

SEQ ID NO: 892122 - protein, 7 aa, Mycobacterium
QSLTGPT

SEQ ID NO: 892123 - protein, 7 aa, Mycobacterium
QSRSGSG

SEQ ID NO: 892124 - protein, 4 aa, Mycobacterium
QTPE

SEQ ID NO: 892125 - protein, 9 aa, Mycobacterium
QTPPSVAPD

SEQ ID NO: 892126 - protein, 7 aa, Mycobacterium
QTRNADG

SEQ ID NO: 892127 - protein, 21 aa, Mycobacterium
QVRSPSDPGYVPTAPPAMTRD

SEQ ID NO: 892128 - protein, 8 aa, Mycobacterium
QVTQQKGA

SEQ ID NO: 892129 - protein, 12 aa, Mycobacterium
QYEHGRDTAPVV

SEQ ID NO: 892130 - protein, 6 aa, Mycobacterium
QYRSGD

SEQ ID NO: 892131 - protein, 7 aa, Mycobacterium
RAAAEAM

SEQ ID NO: 892132 - protein, 4 aa, Mycobacterium
RAAG

SEQ ID NO: 892133 - protein, 13 aa, Mycobacterium
RAAGLDTPEDLEP

SEQ ID NO: 892134 - protein, 8 aa, Mycobacterium
RAAKATPL

SEQ ID NO: 892135 - protein, 4 aa, Mycobacterium
RAAS

SEQ ID NO: 892136 - protein, 4 aa, Mycobacterium
RADQ

SEQ ID NO: 892137 - protein, 6 aa, Mycobacterium
RAGPPE

SEQ ID NO: 892138 - protein, 7 aa, Mycobacterium
RAGPPEH

SEQ ID NO: 892139 - protein, 6 aa, Mycobacterium
RAPAPS

SEQ ID NO: 892140 - protein, 6 aa, Mycobacterium
RAPTRR

SEQ ID NO: 892141 - protein, 6 aa, Mycobacterium
RCGSPA

SEQ ID NO: 892142 - protein, 7 aa, Mycobacterium
RCSPSDL

SEQ ID NO: 892143 - protein, 5 aa, Mycobacterium
RDDDA

SEQ ID NO: 892144 - protein, 7 aa, Mycobacterium
RDGPRAY

SEQ ID NO: 892145 - protein, 6 aa, Mycobacterium
RDPDDF

SEQ ID NO: 892146 - protein, 4 aa, Mycobacterium
RDTR

SEQ ID NO: 892147 - protein, 7 aa, Mycobacterium
REHPEDS

SEQ ID NO: 892148 - protein, 8 aa, Mycobacterium
RGAERVSA

SEQ ID NO: 892149 - protein, 6 aa, Mycobacterium
RGAPDV

SEQ ID NO: 892150 - protein, 4 aa, Mycobacterium
RGDY

SEQ ID NO: 892151 - protein, 4 aa, Mycobacterium
RGEA

SEQ ID NO: 892152 - protein, 4 aa, Mycobacterium
RGGQ

SEQ ID NO: 892153 - protein, 7 aa, Mycobacterium
RGHPSRE

SEQ ID NO: 892154 - protein, 8 aa, Mycobacterium
RGLAAPGD

SEQ ID NO: 892155 - protein, 7 aa, Mycobacterium
RGPAIRG

SEQ ID NO: 892156 - protein, 5 aa, Mycobacterium
RGPLQ

SEQ ID NO: 892157 - protein, 8 aa, Mycobacterium
RGPNGQNY

SEQ ID NO: 892158 - protein, 18 aa, Mycobacterium
RGSSYSSAVAPGLPARTQ

SEQ ID NO: 892159 - protein, 8 aa, Mycobacterium
RGTVEGTP

SEQ ID NO: 892160 - protein, 7 aa, Mycobacterium
RGVGDQN

SEQ ID NO: 892161 - protein, 10 aa, Mycobacterium
RGVPTPGLPF

SEQ ID NO: 892162 - protein, 13 aa, Mycobacterium
RISQTDTPKPSPS

SEQ ID NO: 892163 - protein, 7 aa, Mycobacterium
RKPAELD

SEQ ID NO: 892164 - protein, 6 aa, Mycobacterium
RLGNGR

SEQ ID NO: 892165 - protein, 12 aa, Mycobacterium
RLGTSPEKDVGF

SEQ ID NO: 892166 - protein, 13 aa, Mycobacterium
RNRAAISAEDPRS

SEQ ID NO: 892167 - protein, 4 aa, Mycobacterium
RPAG

SEQ ID NO: 892168 - protein, 6 aa, Mycobacterium
RPDIPG

SEQ ID NO: 892169 - protein, 7 aa, Mycobacterium
RPDRPSV

SEQ ID NO: 892170 - protein, 4 aa, Mycobacterium
RPEL

SEQ ID NO: 892171 - protein, 5 aa, Mycobacterium
RPGEA

SEQ ID NO: 892172 - protein, 9 aa, Mycobacterium
RPKLYGTGA

SEQ ID NO: 892173 - protein, 6 aa, Mycobacterium
RPMTPD

SEQ ID NO: 892174 - protein, 6 aa, Mycobacterium
RPNEVT

SEQ ID NO: 892175 - protein, 5 aa, Mycobacterium
RPVDP

SEQ ID NO: 892176 - protein, 14 aa, Mycobacterium
RPVSTTGESGNQNT

SEQ ID NO: 892177 - protein, 6 aa, Mycobacterium
RQGGHG

SEQ ID NO: 892178 - protein, 7 aa, Mycobacterium
RQQTGKN

SEQ ID NO: 892179 - protein, 4 aa, Mycobacterium
RRDG

SEQ ID NO: 892180 - protein, 11 aa, Mycobacterium
RRPKLYGSGAN

SEQ ID NO: 892181 - protein, 8 aa, Mycobacterium
RRYDGDER

SEQ ID NO: 892182 - protein, 7 aa, Mycobacterium
RSASRRA

SEQ ID NO: 892183 - protein, 10 aa, Mycobacterium
RSGQTPRDAG

SEQ ID NO: 892184 - protein, 7 aa, Mycobacterium
RSPDGAV

SEQ ID NO: 892185 - protein, 8 aa, Mycobacterium
RTDAPSGL

SEQ ID NO: 892186 - protein, 4 aa, Mycobacterium
RTEP

SEQ ID NO: 892187 - protein, 6 aa, Mycobacterium
RTEPSF

SEQ ID NO: 892188 - protein, 5 aa, Mycobacterium
RTRTP

SEQ ID NO: 892189 - protein, 8 aa, Mycobacterium
RVAGTAPD

SEQ ID NO: 892190 - protein, 8 aa, Mycobacterium
RYAGSGEL

SEQ ID NO: 892191 - protein, 4 aa, Mycobacterium
RYPQ

SEQ ID NO: 892192 - protein, 12 aa, Mycobacterium
RYRDDSAQRGGP

SEQ ID NO: 892193 - protein, 6 aa, Mycobacterium
SADGQT

SEQ ID NO: 892194 - protein, 6 aa, Mycobacterium
SADGTV

SEQ ID NO: 892195 - protein, 6 aa, Mycobacterium
SADGYR

SEQ ID NO: 892196 - protein, 7 aa, Mycobacterium
SAEPLGY

SEQ ID NO: 892197 - protein, 15 aa, Mycobacterium
SAGDSVTTYGETWDM

SEQ ID NO: 892198 - protein, 5 aa, Mycobacterium
SAGGH

SEQ ID NO: 892199 - protein, 6 aa, Mycobacterium
SANRDN

SEQ ID NO: 892200 - protein, 4 aa, Mycobacterium
SAPE

SEQ ID NO: 892201 - protein, 7 aa, Mycobacterium
SAPEGYG

SEQ ID NO: 892202 - protein, 7 aa, Mycobacterium
SAPEPGW

SEQ ID NO: 892203 - protein, 8 aa, Mycobacterium
SAPWAPPV

SEQ ID NO: 892204 - protein, 9 aa, Mycobacterium
SAQSDGNSL

SEQ ID NO: 892205 - protein, 10 aa, Mycobacterium
SASNAWDDAG

SEQ ID NO: 892206 - protein, 6 aa, Mycobacterium
SAVNGL

SEQ ID NO: 892207 - protein, 6 aa, Mycobacterium
SCPPGR

SEQ ID NO: 892208 - protein, 13 aa, Mycobacterium
SDAAGRGPLASPV

SEQ ID NO: 892209 - protein, 4 aa, Mycobacterium
SDAG

SEQ ID NO: 892210 - protein, 6 aa, Mycobacterium
SDFGPA

SEQ ID NO: 892211 - protein, 8 aa, Mycobacterium
SDLPSSTQ

SEQ ID NO: 892212 - protein, 5 aa, Mycobacterium
SDPQF

SEQ ID NO: 892213 - protein, 4 aa, Mycobacterium
SEAA

SEQ ID NO: 892214 - protein, 4 aa, Mycobacterium
SEED

SEQ ID NO: 892215 - protein, 7 aa, Mycobacterium
SEGERDN

SEQ ID NO: 892216 - protein, 7 aa, Mycobacterium
SEGWPGE

SEQ ID NO: 892217 - protein, 8 aa, Mycobacterium
SEGWPGEE

SEQ ID NO: 892218 - protein, 11 aa, Mycobacterium
SELADQKEKLA

SEQ ID NO: 892219 - protein, 4 aa, Mycobacterium
SEPE

SEQ ID NO: 892220 - protein, 9 aa, Mycobacterium
SETYPPGST

SEQ ID NO: 892221 - protein, 9 aa, Mycobacterium
SFGRDPETM

SEQ ID NO: 892222 - protein, 4 aa, Mycobacterium
SGAG

SEQ ID NO: 892223 - protein, 5 aa, Mycobacterium
SGDAD

SEQ ID NO: 892224 - protein, 4 aa, Mycobacterium
SGGA

SEQ ID NO: 892225 - protein, 5 aa, Mycobacterium
SGGAT

SEQ ID NO: 892226 - protein, 4 aa, Mycobacterium
SGGF

SEQ ID NO: 892227 - protein, 5 aa, Mycobacterium
SGIPG

SEQ ID NO: 892228 - protein, 4 aa, Mycobacterium
SGIR

SEQ ID NO: 892229 - protein, 16 aa, Mycobacterium
SGKPTKVFGDGGKTRD

SEQ ID NO: 892230 - protein, 13 aa, Mycobacterium
SGKTGTTEAHRSS

SEQ ID NO: 892231 - protein, 12 aa, Mycobacterium
SGKTGTTESHRS

SEQ ID NO: 892232 - protein, 9 aa, Mycobacterium
SGLAPGSGA

SEQ ID NO: 892233 - protein, 8 aa, Mycobacterium
SGPGSPSV

SEQ ID NO: 892234 - protein, 10 aa, Mycobacterium
SGTTGTPKGV

SEQ ID NO: 892235 - protein, 6 aa, Mycobacterium
SGVQTA

SEQ ID NO: 892236 - protein, 8 aa, Mycobacterium
SGVTPTAV

SEQ ID NO: 892237 - protein, 8 aa, Mycobacterium
SKAPGDKI

SEQ ID NO: 892238 - protein, 8 aa, Mycobacterium
SKAPGDKV

SEQ ID NO: 892239 - protein, 6 aa, Mycobacterium
SKATVA

SEQ ID NO: 892240 - protein, 6 aa, Mycobacterium
SKLSQD

SEQ ID NO: 892241 - protein, 8 aa, Mycobacterium
SKTGARYS

SEQ ID NO: 892242 - protein, 6 aa, Mycobacterium
SKTVSG

SEQ ID NO: 892243 - protein, 5 aa, Mycobacterium
SLADP

SEQ ID NO: 892244 - protein, 8 aa, Mycobacterium
SLDGPTAA

SEQ ID NO: 892245 - protein, 5 aa, Mycobacterium
SLPRG

SEQ ID NO: 892246 - protein, 12 aa, Mycobacterium
SMGKPSRPTPIG

SEQ ID NO: 892247 - protein, 5 aa, Mycobacterium
SNARR

SEQ ID NO: 892248 - protein, 8 aa, Mycobacterium
SNSPSWAD

SEQ ID NO: 892249 - protein, 12 aa, Mycobacterium
SPAARDKADAVL

SEQ ID NO: 892250 - protein, 6 aa, Mycobacterium
SPDGNV

SEQ ID NO: 892251 - protein, 8 aa, Mycobacterium
SPDTVGNY

SEQ ID NO: 892252 - protein, 6 aa, Mycobacterium
SPGGKT

SEQ ID NO: 892253 - protein, 7 aa, Mycobacterium
SPGGKTD

SEQ ID NO: 892254 - protein, 4 aa, Mycobacterium
SPPL

SEQ ID NO: 892255 - protein, 8 aa, Mycobacterium
SPPPRRAQ

SEQ ID NO: 892256 - protein, 4 aa, Mycobacterium
SPRG

SEQ ID NO: 892257 - protein, 4 aa, Mycobacterium
SPRN

SEQ ID NO: 892258 - protein, 5 aa, Mycobacterium
SPSNA

SEQ ID NO: 892259 - protein, 6 aa, Mycobacterium
SPTLPG

SEQ ID NO: 892260 - protein, 4 aa, Mycobacterium
SPVG

SEQ ID NO: 892261 - protein, 7 aa, Mycobacterium
SQRDGLS

SEQ ID NO: 892262 - protein, 4 aa, Mycobacterium
SQRL

SEQ ID NO: 892263 - protein, 10 aa, Mycobacterium
SQSAGMDPTH

SEQ ID NO: 892264 - protein, 5 aa, Mycobacterium
SRAGD

SEQ ID NO: 892265 - protein, 8 aa, Mycobacterium
SRATPRAD

SEQ ID NO: 892266 - protein, 6 aa, Mycobacterium
SRDSTR

SEQ ID NO: 892267 - protein, 10 aa, Mycobacterium
SRKDQEGNDL

SEQ ID NO: 892268 - protein, 5 aa, Mycobacterium
SRPLQ

SEQ ID NO: 892269 - protein, 6 aa, Mycobacterium
SRQRGQ

SEQ ID NO: 892270 - protein, 5 aa, Mycobacterium
SRRPL

SEQ ID NO: 892271 - protein, 9 aa, Mycobacterium
SSANLGPGF

SEQ ID NO: 892272 - protein, 6 aa, Mycobacterium
SSFGPD

SEQ ID NO: 892273 - protein, 18 aa, Mycobacterium
SSITDASAAAAAPTTELA

SEQ ID NO: 892274 - protein, 6 aa, Mycobacterium
SSPDQR

SEQ ID NO: 892275 - protein, 6 aa, Mycobacterium
STAAGY

SEQ ID NO: 892276 - protein, 4 aa, Mycobacterium
STAG

SEQ ID NO: 892277 - protein, 4 aa, Mycobacterium
STAQ

SEQ ID NO: 892278 - protein, 7 aa, Mycobacterium
STATGYG

SEQ ID NO: 892279 - protein, 5 aa, Mycobacterium
STGAF

SEQ ID NO: 892280 - protein, 9 aa, Mycobacterium
STGDAEQYY

SEQ ID NO: 892281 - protein, 8 aa, Mycobacterium
STGGSNAT

SEQ ID NO: 892282 - protein, 5 aa, Mycobacterium
STGTL

SEQ ID NO: 892283 - protein, 11 aa, Mycobacterium
STGTLQDYGPD

SEQ ID NO: 892284 - protein, 14 aa, Mycobacterium
STNYESAIPPRGTQ

SEQ ID NO: 892285 - protein, 8 aa, Mycobacterium
STTDPHSR

SEQ ID NO: 892286 - protein, 13 aa, Mycobacterium
STYPGKEQPYPPQ

SEQ ID NO: 892287 - protein, 11 aa, Mycobacterium
SVGDQGKRNVS

SEQ ID NO: 892288 - protein, 11 aa, Mycobacterium
SVGSQGESNVS

SEQ ID NO: 892289 - protein, 8 aa, Mycobacterium
SVGSQGIA

SEQ ID NO: 892290 - protein, 12 aa, Mycobacterium
SVPSSSAPQAIG

SEQ ID NO: 892291 - protein, 5 aa, Mycobacterium
SVRQA

SEQ ID NO: 892292 - protein, 6 aa, Mycobacterium
SVTDGA

SEQ ID NO: 892293 - protein, 6 aa, Mycobacterium
TAAAYP

SEQ ID NO: 892294 - protein, 8 aa, Mycobacterium
TAAGGKNA

SEQ ID NO: 892295 - protein, 11 aa, Mycobacterium
TAEDPRSTGNN

SEQ ID NO: 892296 - protein, 7 aa, Mycobacterium
TAEGNGN

SEQ ID NO: 892297 - protein, 7 aa, Mycobacterium
TAERGTQ

SEQ ID NO: 892298 - protein, 4 aa, Mycobacterium
TAGA

SEQ ID NO: 892299 - protein, 9 aa, Mycobacterium
TAGHHDPAS

SEQ ID NO: 892300 - protein, 12 aa, Mycobacterium
TAGSNDYSPLES

SEQ ID NO: 892301 - protein, 5 aa, Mycobacterium
TAPSV

SEQ ID NO: 892302 - protein, 4 aa, Mycobacterium
TARG

SEQ ID NO: 892303 - protein, 17 aa, Mycobacterium
TATNGPTPKNPTLPQPS

SEQ ID NO: 892304 - protein, 7 aa, Mycobacterium
TATPPGM

SEQ ID NO: 892305 - protein, 13 aa, Mycobacterium
TATSDGQVYGFSP

SEQ ID NO: 892306 - protein, 5 aa, Mycobacterium
TDDAA

SEQ ID NO: 892307 - protein, 4 aa, Mycobacterium
TDET

SEQ ID NO: 892308 - protein, 8 aa, Mycobacterium
TDGGPTAG

SEQ ID NO: 892309 - protein, 8 aa, Mycobacterium
TDGSPVTA

SEQ ID NO: 892310 - protein, 6 aa, Mycobacterium
TDPDRA

SEQ ID NO: 892311 - protein, 4 aa, Mycobacterium
TDRA

SEQ ID NO: 892312 - protein, 5 aa, Mycobacterium
TDRSG

SEQ ID NO: 892313 - protein, 9 aa, Mycobacterium
TEGDKSPAD

SEQ ID NO: 892314 - protein, 6 aa, Mycobacterium
TFEPPG

SEQ ID NO: 892315 - protein, 12 aa, Mycobacterium
TGATLSGTDGLG

SEQ ID NO: 892316 - protein, 6 aa, Mycobacterium
TGDAPL

SEQ ID NO: 892317 - protein, 4 aa, Mycobacterium
TGDM

SEQ ID NO: 892318 - protein, 6 aa, Mycobacterium
TGFDTG

SEQ ID NO: 892319 - protein, 8 aa, Mycobacterium
TGGDATRI

SEQ ID NO: 892320 - protein, 9 aa, Mycobacterium
TGGDATRIS

SEQ ID NO: 892321 - protein, 4 aa, Mycobacterium
TGIY

SEQ ID NO: 892322 - protein, 4 aa, Mycobacterium
TGLS

SEQ ID NO: 892323 - protein, 9 aa, Mycobacterium
TGPAPVTNA

SEQ ID NO: 892324 - protein, 4 aa, Mycobacterium
TGPQ

SEQ ID NO: 892325 - protein, 8 aa, Mycobacterium
TGRPARGL

SEQ ID NO: 892326 - protein, 5 aa, Mycobacterium
TGRPT

SEQ ID NO: 892327 - protein, 8 aa, Mycobacterium
TGRRSGRT

SEQ ID NO: 892328 - protein, 12 aa, Mycobacterium
TGRSPRHFRKTR

SEQ ID NO: 892329 - protein, 8 aa, Mycobacterium
TGRTGDAG

SEQ ID NO: 892330 - protein, 7 aa, Mycobacterium
TGSATAA

SEQ ID NO: 892331 - protein, 8 aa, Mycobacterium
TGTPGAAW

SEQ ID NO: 892332 - protein, 10 aa, Mycobacterium
TGVETSDRQL

SEQ ID NO: 892333 - protein, 10 aa, Mycobacterium
TGVKNPDYSD

SEQ ID NO: 892334 - protein, 8 aa, Mycobacterium
THQEPGLG

SEQ ID NO: 892335 - protein, 4 aa, Mycobacterium
TIET

SEQ ID NO: 892336 - protein, 17 aa, Mycobacterium
TKPDLTPVTDADRAVET

SEQ ID NO: 892337 - protein, 6 aa, Mycobacterium
TKSRVR

SEQ ID NO: 892338 - protein, 9 aa, Mycobacterium
TLPPGPERD

SEQ ID NO: 892339 - protein, 9 aa, Mycobacterium
TLPPPTPVG

SEQ ID NO: 892340 - protein, 7 aa, Mycobacterium
TLPQNSP

SEQ ID NO: 892341 - protein, 11 aa, Mycobacterium
TMGNRGNSTGP

SEQ ID NO: 892342 - protein, 10 aa, Mycobacterium
TNDPATPYQA

SEQ ID NO: 892343 - protein, 6 aa, Mycobacterium
TNGSAL

SEQ ID NO: 892344 - protein, 6 aa, Mycobacterium
TNLGPA

SEQ ID NO: 892345 - protein, 7 aa, Mycobacterium
TNMGGDD

SEQ ID NO: 892346 - protein, 7 aa, Mycobacterium
TNNGPID

SEQ ID NO: 892347 - protein, 5 aa, Mycobacterium
TPARQ

SEQ ID NO: 892348 - protein, 4 aa, Mycobacterium
TPAT

SEQ ID NO: 892349 - protein, 5 aa, Mycobacterium
TPDYP

SEQ ID NO: 892350 - protein, 5 aa, Mycobacterium
TPDYT

SEQ ID NO: 892351 - protein, 13 aa, Mycobacterium
TPPTAPPGTPGEY

SEQ ID NO: 892352 - protein, 10 aa, Mycobacterium
TPSPPRTGMP

SEQ ID NO: 892353 - protein, 7 aa, Mycobacterium
TQSPGTI

SEQ ID NO: 892354 - protein, 10 aa, Mycobacterium
TRAKSETASS

SEQ ID NO: 892355 - protein, 4 aa, Mycobacterium
TRDG

SEQ ID NO: 892356 - protein, 6 aa, Mycobacterium
TRERQG

SEQ ID NO: 892357 - protein, 4 aa, Mycobacterium
TRGP

SEQ ID NO: 892358 - protein, 4 aa, Mycobacterium
TRIG

SEQ ID NO: 892359 - protein, 6 aa, Mycobacterium
TRQRQG

SEQ ID NO: 892360 - protein, 5 aa, Mycobacterium
TRRGD

SEQ ID NO: 892361 - protein, 8 aa, Mycobacterium
TRSDPSRP

SEQ ID NO: 892362 - protein, 10 aa, Mycobacterium
TSAFSGPTMA

SEQ ID NO: 892363 - protein, 14 aa, Mycobacterium
TSALNPYTNPEGAL

SEQ ID NO: 892364 - protein, 5 aa, Mycobacterium
TSPAI

SEQ ID NO: 892365 - protein, 18 aa, Mycobacterium
TSSAAQPNASPPESGDLT

SEQ ID NO: 892366 - protein, 4 aa, Mycobacterium
TTAD

SEQ ID NO: 892367 - protein, 5 aa, Mycobacterium
TTARM

SEQ ID NO: 892368 - protein, 4 aa, Mycobacterium
TTEP

SEQ ID NO: 892369 - protein, 4 aa, Mycobacterium
TTGP

SEQ ID NO: 892370 - protein, 7 aa, Mycobacterium
TTNPPVE

SEQ ID NO: 892371 - protein, 5 aa, Mycobacterium
TTNPS

SEQ ID NO: 892372 - protein, 5 aa, Mycobacterium
TTPNT

SEQ ID NO: 892373 - protein, 4 aa, Mycobacterium
TTSL

SEQ ID NO: 892374 - protein, 6 aa, Mycobacterium
TTSNPL

SEQ ID NO: 892375 - protein, 12 aa, Mycobacterium
TTVNSRGATTTT

SEQ ID NO: 892376 - protein, 7 aa, Mycobacterium
TTYPDQE

SEQ ID NO: 892377 - protein, 6 aa, Mycobacterium
TVPPPV

SEQ ID NO: 892378 - protein, 5 aa, Mycobacterium
TVTPA

SEQ ID NO: 892379 - protein, 7 aa, Mycobacterium
TVTPDGN

SEQ ID NO: 892380 - protein, 6 aa, Mycobacterium
TYGTPV

SEQ ID NO: 892381 - protein, 4 aa, Mycobacterium
TYTQ

SEQ ID NO: 892382 - protein, 7 aa, Mycobacterium
VAEESGA

SEQ ID NO: 892383 - protein, 6 aa, Mycobacterium
VAESQA

SEQ ID NO: 892384 - protein, 10 aa, Mycobacterium
VAGGADPQAV

SEQ ID NO: 892385 - protein, 8 aa, Mycobacterium
VAGRPVPA

SEQ ID NO: 892386 - protein, 10 aa, Mycobacterium
VANTATTNCT

SEQ ID NO: 892387 - protein, 10 aa, Mycobacterium
VAPRSGGHSY

SEQ ID NO: 892388 - protein, 9 aa, Mycobacterium
VAPVDTQRA

SEQ ID NO: 892389 - protein, 4 aa, Mycobacterium
VAQT

SEQ ID NO: 892390 - protein, 8 aa, Mycobacterium
VDADKDQS

SEQ ID NO: 892391 - protein, 7 aa, Mycobacterium
VDADTYQ

SEQ ID NO: 892392 - protein, 4 aa, Mycobacterium
VDAG

SEQ ID NO: 892393 - protein, 11 aa, Mycobacterium
VDPNADPIEAD

SEQ ID NO: 892394 - protein, 10 aa, Mycobacterium
VDPTDSERGL

SEQ ID NO: 892395 - protein, 7 aa, Mycobacterium
VDQPGVT

SEQ ID NO: 892396 - protein, 7 aa, Mycobacterium
VDQPNPV

SEQ ID NO: 892397 - protein, 10 aa, Mycobacterium
VDRPGKAKAL

SEQ ID NO: 892398 - protein, 8 aa, Mycobacterium
VDSQGYAN

SEQ ID NO: 892399 - protein, 11 aa, Mycobacterium
VEDPGSPGTQD

SEQ ID NO: 892400 - protein, 6 aa, Mycobacterium
VEVTGS

SEQ ID NO: 892401 - protein, 10 aa, Mycobacterium
VGAATARSAA

SEQ ID NO: 892402 - protein, 26 aa, Mycobacterium
VGAHGGPGAALTGRATGTAGAALAAG

SEQ ID NO: 892403 - protein, 4 aa, Mycobacterium
VGAT

SEQ ID NO: 892404 - protein, 11 aa, Mycobacterium
VGATSKGLSGQ

SEQ ID NO: 892405 - protein, 9 aa, Mycobacterium
VGATSKGVC

SEQ ID NO: 892406 - protein, 7 aa, Mycobacterium
VGDGAND

SEQ ID NO: 892407 - protein, 5 aa, Mycobacterium
VGGHN

SEQ ID NO: 892408 - protein, 10 aa, Mycobacterium
VGGNSVYTSN

SEQ ID NO: 892409 - protein, 7 aa, Mycobacterium
VGRSGTG

SEQ ID NO: 892410 - protein, 9 aa, Mycobacterium
VIGPDDDPD

SEQ ID NO: 892411 - protein, 8 aa, Mycobacterium
VKTGPRGE

SEQ ID NO: 892412 - protein, 8 aa, Mycobacterium
VLPDPGPI

SEQ ID NO: 892413 - protein, 8 aa, Mycobacterium
VNSQGYAN

SEQ ID NO: 892414 - protein, 9 aa, Mycobacterium
VPAESTEEE

SEQ ID NO: 892415 - protein, 4 aa, Mycobacterium
VPGA

SEQ ID NO: 892416 - protein, 5 aa, Mycobacterium
VPGPV

SEQ ID NO: 892417 - protein, 4 aa, Mycobacterium
VPGQ

SEQ ID NO: 892418 - protein, 6 aa, Mycobacterium
VPIPAD

SEQ ID NO: 892419 - protein, 12 aa, Mycobacterium
VPPAGDRAAPDV

SEQ ID NO: 892420 - protein, 5 aa, Mycobacterium
VPPEA

SEQ ID NO: 892421 - protein, 6 aa, Mycobacterium
VPPTPI

SEQ ID NO: 892422 - protein, 7 aa, Mycobacterium
VQPDYSS

SEQ ID NO: 892423 - protein, 4 aa, Mycobacterium
VQSN

SEQ ID NO: 892424 - protein, 5 aa, Mycobacterium
VRDPE

SEQ ID NO: 892425 - protein, 6 aa, Mycobacterium
VSAEPK

SEQ ID NO: 892426 - protein, 9 aa, Mycobacterium
VSGPAGGVA

SEQ ID NO: 892427 - protein, 4 aa, Mycobacterium
VSPD

SEQ ID NO: 892428 - protein, 7 aa, Mycobacterium
VSPSMGD

SEQ ID NO: 892429 - protein, 4 aa, Mycobacterium
VTEG

SEQ ID NO: 892430 - protein, 4 aa, Mycobacterium
VTPA

SEQ ID NO: 892431 - protein, 15 aa, Mycobacterium
VTPADGATAHSAAAR

SEQ ID NO: 892432 - protein, 18 aa, Mycobacterium
VTRADGGKNGIGRGYGGA

SEQ ID NO: 892433 - protein, 8 aa, Mycobacterium
VTSERNAV

SEQ ID NO: 892434 - protein, 8 aa, Mycobacterium
VTSGQADA

SEQ ID NO: 892435 - protein, 9 aa, Mycobacterium
VTTNPPVEG

SEQ ID NO: 892436 - protein, 6 aa, Mycobacterium
VTTNPS

SEQ ID NO: 892437 - protein, 9 aa, Mycobacterium
VTVTAGDGV

SEQ ID NO: 892438 - protein, 9 aa, Mycobacterium
VTYTPGADF

SEQ ID NO: 892439 - protein, 10 aa, Mycobacterium
VYSDGKPVTC

SEQ ID NO: 892440 - protein, 12 aa, Mycobacterium
WDPADVDNGDIA

SEQ ID NO: 892441 - protein, 9 aa, Mycobacterium
WETTYSGRE

SEQ ID NO: 892442 - protein, 4 aa, Mycobacterium
WGAD

SEQ ID NO: 892443 - protein, 17 aa, Mycobacterium
WGPKEDPAWARNDPSLQ

SEQ ID NO: 892444 - protein, 7 aa, Mycobacterium
WGPPAKP

SEQ ID NO: 892445 - protein, 11 aa, Mycobacterium
WGPSTDPAWKR

SEQ ID NO: 892446 - protein, 7 aa, Mycobacterium
WGRDPAT

SEQ ID NO: 892447 - protein, 7 aa, Mycobacterium
WKSYGGT

SEQ ID NO: 892448 - protein, 4 aa, Mycobacterium
WPAP

SEQ ID NO: 892449 - protein, 7 aa, Mycobacterium
WTSSSRK

SEQ ID NO: 892450 - protein, 10 aa, Mycobacterium
WYPDGPPRHQ

SEQ ID NO: 892451 - protein, 18 aa, Mycobacterium
YADAANSSYKSAPGAQSL

SEQ ID NO: 892452 - protein, 8 aa, Mycobacterium
YAEDTGTV

SEQ ID NO: 892453 - protein, 6 aa, Mycobacterium
YAPQGA

SEQ ID NO: 892454 - protein, 5 aa, Mycobacterium
YAQGL

SEQ ID NO: 892455 - protein, 16 aa, Mycobacterium
YARGDVDTRGGSTIEQ

SEQ ID NO: 892456 - protein, 8 aa, Mycobacterium
YGAPRKDN

SEQ ID NO: 892457 - protein, 5 aa, Mycobacterium
YGEKH

SEQ ID NO: 892458 - protein, 13 aa, Mycobacterium
YGKTGEAEFPGGS

SEQ ID NO: 892459 - protein, 13 aa, Mycobacterium
YGVPVNSPNGYRT

SEQ ID NO: 892460 - protein, 8 aa, Mycobacterium
YISPGSTL

SEQ ID NO: 892461 - protein, 8 aa, Mycobacterium
YKPRPCDA

SEQ ID NO: 892462 - protein, 9 aa, Mycobacterium
YKPTQSGAY

SEQ ID NO: 892463 - protein, 4 aa, Mycobacterium
YPAG

SEQ ID NO: 892464 - protein, 8 aa, Mycobacterium
YPAGTTVS

SEQ ID NO: 892465 - protein, 9 aa, Mycobacterium
YPDAATGKA

SEQ ID NO: 892466 - protein, 6 aa, Mycobacterium
YPPGST

SEQ ID NO: 892467 - protein, 7 aa, Mycobacterium
YPRNGRP

SEQ ID NO: 892468 - protein, 4 aa, Mycobacterium
YRDP

SEQ ID NO: 892469 - protein, 7 aa, Mycobacterium
YRNGNFP

SEQ ID NO: 892470 - protein, 7 aa, Mycobacterium
YRPGQKP

SEQ ID NO: 892471 - protein, 13 aa, Mycobacterium
YSGPRARGMASSA

SEQ ID NO: 892472 - protein, 7 aa, Mycobacterium
YSGSQYN

SEQ ID NO: 892473 - protein, 20 aa, Mycobacterium
YTPNPNDAPGGPLVERGDRN

SEQ ID NO: 892474 - protein, 20 aa, Mycobacterium
YTPNPNDAPGGPLVERGDRQ

SEQ ID NO: 892475 - protein, 6 aa, Mycobacterium
AAAAAD

SEQ ID NO: 892476 - protein, 14 aa, Mycobacterium
AAAAAGVDPASPTF

SEQ ID NO: 892477 - protein, 9 aa, Mycobacterium
AAAAAPVPI

SEQ ID NO: 892478 - protein, 11 aa, Mycobacterium
AAAADAAAERA

SEQ ID NO: 892479 - protein, 10 aa, Mycobacterium
AAAADDGVSL

SEQ ID NO: 892480 - protein, 22 aa, Mycobacterium
AAAADPAALDPTGNYSGGPVPT

SEQ ID NO: 892481 - protein, 16 aa, Mycobacterium
AAAADPAGTGNSSDIN

SEQ ID NO: 892482 - protein, 8 aa, Mycobacterium
AAAADPCP

SEQ ID NO: 892483 - protein, 5 aa, Mycobacterium
AAAAE

SEQ ID NO: 892484 - protein, 6 aa, Mycobacterium
AAAAER

SEQ ID NO: 892485 - protein, 7 aa, Mycobacterium
AAAAEVT

SEQ ID NO: 892486 - protein, 9 aa, Mycobacterium
AAAAGAGAT

SEQ ID NO: 892487 - protein, 8 aa, Mycobacterium
AAAAGDAV

SEQ ID NO: 892488 - protein, 7 aa, Mycobacterium
AAAAGGD

SEQ ID NO: 892489 - protein, 7 aa, Mycobacterium
AAAAGIA

SEQ ID NO: 892490 - protein, 10 aa, Mycobacterium
AAAAGPSTQS

SEQ ID NO: 892491 - protein, 9 aa, Mycobacterium
AAAAGRSGF

SEQ ID NO: 892492 - protein, 9 aa, Mycobacterium
AAAAGSTTN

SEQ ID NO: 892493 - protein, 7 aa, Mycobacterium
AAAAGVT

SEQ ID NO: 892494 - protein, 5 aa, Mycobacterium
AAAAI

SEQ ID NO: 892495 - protein, 45 aa, Mycobacterium
AAAAIAAAPAALAQPNCSTTSSGAGGRTEVCQSPGNAQISSTPGV

SEQ ID NO: 892496 - protein, 23 aa, Mycobacterium
AAAALGAAKATMADPAAAQRSSG

SEQ ID NO: 892497 - protein, 10 aa, Mycobacterium
AAAALGKEPV

SEQ ID NO: 892498 - protein, 16 aa, Mycobacterium
AAAALTKRHRSGRATQ

SEQ ID NO: 892499 - protein, 8 aa, Mycobacterium
AAAANAMR

SEQ ID NO: 892500 - protein, 9 aa, Mycobacterium
AAAANAMRP

SEQ ID NO: 892501 - protein, 6 aa, Mycobacterium
AAAAPA

SEQ ID NO: 892502 - protein, 18 aa, Mycobacterium
AAAAPAAGADDKVPMGGG

SEQ ID NO: 892503 - protein, 10 aa, Mycobacterium
AAAAPAAPAP

SEQ ID NO: 892504 - protein, 9 aa, Mycobacterium
AAAAPGQRN

SEQ ID NO: 892505 - protein, 8 aa, Mycobacterium
AAAAPGVS

SEQ ID NO: 892506 - protein, 9 aa, Mycobacterium
AAAAPPKDY

SEQ ID NO: 892507 - protein, 9 aa, Mycobacterium
AAAAPPKSY

SEQ ID NO: 892508 - protein, 8 aa, Mycobacterium
AAAAPSNI

SEQ ID NO: 892509 - protein, 9 aa, Mycobacterium
AAAAPTLQE

SEQ ID NO: 892510 - protein, 8 aa, Mycobacterium
AAAAPTTG

SEQ ID NO: 892511 - protein, 8 aa, Mycobacterium
AAAAQLAP

SEQ ID NO: 892512 - protein, 23 aa, Mycobacterium
AAAASEKSAADARAKAEQADAVR

SEQ ID NO: 892513 - protein, 8 aa, Mycobacterium
AAAASGAG

SEQ ID NO: 892514 - protein, 11 aa, Mycobacterium
AAAASGAVATQ

SEQ ID NO: 892515 - protein, 38 aa, Mycobacterium
AAAASNVAGIGSEISAANAAAAVPTTGVTASAADAVSA

SEQ ID NO: 892516 - protein, 8 aa, Mycobacterium
AAAATSGH

SEQ ID NO: 892517 - protein, 6 aa, Mycobacterium
AAACPD

SEQ ID NO: 892518 - protein, 4 aa, Mycobacterium
AAAD

SEQ ID NO: 892519 - protein, 6 aa, Mycobacterium
AAADAD

SEQ ID NO: 892520 - protein, 6 aa, Mycobacterium
AAADAG

SEQ ID NO: 892521 - protein, 9 aa, Mycobacterium
AAADAGAGK

SEQ ID NO: 892522 - protein, 7 aa, Mycobacterium
AAADAGL

SEQ ID NO: 892523 - protein, 12 aa, Mycobacterium
AAADDNPLGPNV

SEQ ID NO: 892524 - protein, 7 aa, Mycobacterium
AAADDVS

SEQ ID NO: 892525 - protein, 5 aa, Mycobacterium
AAADE

SEQ ID NO: 892526 - protein, 14 aa, Mycobacterium
AAADETLSGSNANL

SEQ ID NO: 892527 - protein, 9 aa, Mycobacterium
AAADEVSAA

SEQ ID NO: 892528 - protein, 8 aa, Mycobacterium
AAADEVST

SEQ ID NO: 892529 - protein, 17 aa, Mycobacterium
AAADGEEAEEGDAEPVS

SEQ ID NO: 892530 - protein, 7 aa, Mycobacterium
AAADGGE

SEQ ID NO: 892531 - protein, 18 aa, Mycobacterium
AAADPAAPQPNPNPQLPG

SEQ ID NO: 892532 - protein, 9 aa, Mycobacterium
AAADPADDA

SEQ ID NO: 892533 - protein, 9 aa, Mycobacterium
AAADPAGAA

SEQ ID NO: 892534 - protein, 9 aa, Mycobacterium
AAADPAPPI

SEQ ID NO: 892535 - protein, 18 aa, Mycobacterium
AAADPATPQPSPTQELPG

SEQ ID NO: 892536 - protein, 21 aa, Mycobacterium
AAADPDQPSGPNHGLHTPAQG

SEQ ID NO: 892537 - protein, 8 aa, Mycobacterium
AAADPEAA

SEQ ID NO: 892538 - protein, 15 aa, Mycobacterium
AAADPGLRSTDYQQA

SEQ ID NO: 892539 - protein, 17 aa, Mycobacterium
AAADPNLGKLGGRVSDA

SEQ ID NO: 892540 - protein, 9 aa, Mycobacterium
AAADPPAPR

SEQ ID NO: 892541 - protein, 17 aa, Mycobacterium
AAADPPPPPPLPPPPPP

SEQ ID NO: 892542 - protein, 13 aa, Mycobacterium
AAADPPPPPPNCT

SEQ ID NO: 892543 - protein, 13 aa, Mycobacterium
AAADSAEPGGSPL

SEQ ID NO: 892544 - protein, 8 aa, Mycobacterium
AAAEAEPV

SEQ ID NO: 892545 - protein, 11 aa, Mycobacterium
AAAEDPPNCTP

SEQ ID NO: 892546 - protein, 7 aa, Mycobacterium
AAAELDE

SEQ ID NO: 892547 - protein, 8 aa, Mycobacterium
AAAENGVR

SEQ ID NO: 892548 - protein, 7 aa, Mycobacterium
AAAEPAV

SEQ ID NO: 892549 - protein, 14 aa, Mycobacterium
AAAEPPAAGLGEKT

SEQ ID NO: 892550 - protein, 9 aa, Mycobacterium
AAAEQVESR

SEQ ID NO: 892551 - protein, 5 aa, Mycobacterium
AAAER

SEQ ID NO: 892552 - protein, 11 aa, Mycobacterium
AAAERCGGNPA

SEQ ID NO: 892553 - protein, 6 aa, Mycobacterium
AAAERG

SEQ ID NO: 892554 - protein, 12 aa, Mycobacterium
AAAERSRNDRRA

SEQ ID NO: 892555 - protein, 9 aa, Mycobacterium
AAAESAGQV

SEQ ID NO: 892556 - protein, 13 aa, Mycobacterium
AAAESAGRPVTPL

SEQ ID NO: 892557 - protein, 16 aa, Mycobacterium
AAAFGGAWPVGPAQGD

SEQ ID NO: 892558 - protein, 8 aa, Mycobacterium
AAAGAAGA

SEQ ID NO: 892559 - protein, 14 aa, Mycobacterium
AAAGAALAAAPAGA

SEQ ID NO: 892560 - protein, 9 aa, Mycobacterium
AAAGAPDDK

SEQ ID NO: 892561 - protein, 9 aa, Mycobacterium
AAAGATAQK

SEQ ID NO: 892562 - protein, 6 aa, Mycobacterium
AAAGCP

SEQ ID NO: 892563 - protein, 6 aa, Mycobacterium
AAAGCT

SEQ ID NO: 892564 - protein, 13 aa, Mycobacterium
AAAGDHARAYPAY

SEQ ID NO: 892565 - protein, 9 aa, Mycobacterium
AAAGEDEVS

SEQ ID NO: 892566 - protein, 8 aa, Mycobacterium
AAAGGGAA

SEQ ID NO: 892567 - protein, 10 aa, Mycobacterium
AAAGGGPAAQ

SEQ ID NO: 892568 - protein, 18 aa, Mycobacterium
AAAGGHSGTLSPRKPLTP

SEQ ID NO: 892569 - protein, 8 aa, Mycobacterium
AAAGGPAG

SEQ ID NO: 892570 - protein, 9 aa, Mycobacterium
AAAGGTPTD

SEQ ID NO: 892571 - protein, 5 aa, Mycobacterium
AAAGI

SEQ ID NO: 892572 - protein, 8 aa, Mycobacterium
AAAGLTPK

SEQ ID NO: 892573 - protein, 5 aa, Mycobacterium
AAAGN

SEQ ID NO: 892574 - protein, 8 aa, Mycobacterium
AAAGNPDI

SEQ ID NO: 892575 - protein, 13 aa, Mycobacterium
AAAGNSASQHPDA

SEQ ID NO: 892576 - protein, 10 aa, Mycobacterium
AAAGPAAATT

SEQ ID NO: 892577 - protein, 11 aa, Mycobacterium
AAAGPDKPKLR

SEQ ID NO: 892578 - protein, 10 aa, Mycobacterium
AAAGPGPPYT

SEQ ID NO: 892579 - protein, 8 aa, Mycobacterium
AAAGPSVQ

SEQ ID NO: 892580 - protein, 9 aa, Mycobacterium
AAAGQTQQL

SEQ ID NO: 892581 - protein, 6 aa, Mycobacterium
AAAGRS

SEQ ID NO: 892582 - protein, 28 aa, Mycobacterium
AAAGSPVSRADTDVQPAGSVPIPDGPAQ

SEQ ID NO: 892583 - protein, 8 aa, Mycobacterium
AAAGSTTA

SEQ ID NO: 892584 - protein, 9 aa, Mycobacterium
AAAGTAPQH

SEQ ID NO: 892585 - protein, 9 aa, Mycobacterium
AAAGTDYQR

SEQ ID NO: 892586 - protein, 5 aa, Mycobacterium
AAAGV

SEQ ID NO: 892587 - protein, 13 aa, Mycobacterium
AAAGYRDAATAQR

SEQ ID NO: 892588 - protein, 15 aa, Mycobacterium
AAAKKAAEEKAKSAA

SEQ ID NO: 892589 - protein, 12 aa, Mycobacterium
AAAKTLSASSQT

SEQ ID NO: 892590 - protein, 5 aa, Mycobacterium
AAALA

SEQ ID NO: 892591 - protein, 12 aa, Mycobacterium
AAALAGAANPFA

SEQ ID NO: 892592 - protein, 22 aa, Mycobacterium
AAALGAGKASMAEPAAAERATG

SEQ ID NO: 892593 - protein, 8 aa, Mycobacterium
AAALKDPR

SEQ ID NO: 892594 - protein, 5 aa, Mycobacterium
AAALP

SEQ ID NO: 892595 - protein, 6 aa, Mycobacterium
AAANPG

SEQ ID NO: 892596 - protein, 7 aa, Mycobacterium
AAANPIE

SEQ ID NO: 892597 - protein, 14 aa, Mycobacterium
AAANPTGPASVSGM

SEQ ID NO: 892598 - protein, 10 aa, Mycobacterium
AAANQQVPTT

SEQ ID NO: 892599 - protein, 4 aa, Mycobacterium
AAAP

SEQ ID NO: 892600 - protein, 5 aa, Mycobacterium
AAAPA

SEQ ID NO: 892601 - protein, 7 aa, Mycobacterium
AAAPAAA

SEQ ID NO: 892602 - protein, 14 aa, Mycobacterium
AAAPAGRPADPTEI

SEQ ID NO: 892603 - protein, 26 aa, Mycobacterium
AAAPALAAPALSSTTTSLGGGLGAGL

SEQ ID NO: 892604 - protein, 17 aa, Mycobacterium
AAAPAMADPAADPTDGI

SEQ ID NO: 892605 - protein, 22 aa, Mycobacterium
AAAPAPEAAIGGGGSPAGAGAV

SEQ ID NO: 892606 - protein, 19 aa, Mycobacterium
AAAPASLASSTAPLEGSGW

SEQ ID NO: 892607 - protein, 27 aa, Mycobacterium
AAAPDVVGETYADASSAIEDSGGSPKI

SEQ ID NO: 892608 - protein, 13 aa, Mycobacterium
AAAPDVVGQPYSD

SEQ ID NO: 892609 - protein, 5 aa, Mycobacterium
AAAPG

SEQ ID NO: 892610 - protein, 17 aa, Mycobacterium
AAAPGGTGTDPAGAPRT

SEQ ID NO: 892611 - protein, 17 aa, Mycobacterium
AAAPGIASADATDDYPI

SEQ ID NO: 892612 - protein, 7 aa, Mycobacterium
AAAPGQD

SEQ ID NO: 892613 - protein, 9 aa, Mycobacterium
AAAPGYEPL

SEQ ID NO: 892614 - protein, 6 aa, Mycobacterium
AAAPHR

SEQ ID NO: 892615 - protein, 10 aa, Mycobacterium
AAAPKLALDD

SEQ ID NO: 892616 - protein, 8 aa, Mycobacterium
AAAPPADA

SEQ ID NO: 892617 - protein, 9 aa, Mycobacterium
AAAPPAQAQ

SEQ ID NO: 892618 - protein, 11 aa, Mycobacterium
AAAPPHDPGTY

SEQ ID NO: 892619 - protein, 10 aa, Mycobacterium
AAAPPPPPVP

SEQ ID NO: 892620 - protein, 8 aa, Mycobacterium
AAAPPTCA

SEQ ID NO: 892621 - protein, 13 aa, Mycobacterium
AAAPPVAAAPAPS

SEQ ID NO: 892622 - protein, 10 aa, Mycobacterium
AAAPTAAPGT

SEQ ID NO: 892623 - protein, 8 aa, Mycobacterium
AAAPTNSF

SEQ ID NO: 892624 - protein, 11 aa, Mycobacterium
AAAQADPHNPH

SEQ ID NO: 892625 - protein, 10 aa, Mycobacterium
AAAQGSPNYR

SEQ ID NO: 892626 - protein, 7 aa, Mycobacterium
AAAQIDK

SEQ ID NO: 892627 - protein, 10 aa, Mycobacterium
AAAQKLSDGG

SEQ ID NO: 892628 - protein, 8 aa, Mycobacterium
AAAQLGKP

SEQ ID NO: 892629 - protein, 29 aa, Mycobacterium
AAAQQAQDTAVSGGPRVGSNGVTTVTPTP

SEQ ID NO: 892630 - protein, 11 aa, Mycobacterium
AAAQQRCGSPA

SEQ ID NO: 892631 - protein, 7 aa, Mycobacterium
AAAQRHA

SEQ ID NO: 892632 - protein, 5 aa, Mycobacterium
AAAQS

SEQ ID NO: 892633 - protein, 13 aa, Mycobacterium
AAAQSFSSTTAEL

SEQ ID NO: 892634 - protein, 34 aa, Mycobacterium
AAAQSQRCEQEGKPAVNVTATDSDTQNQNQLRTG

SEQ ID NO: 892635 - protein, 9 aa, Mycobacterium
AAAQTTAVQ

SEQ ID NO: 892636 - protein, 4 aa, Mycobacterium
AAAR

SEQ ID NO: 892637 - protein, 6 aa, Mycobacterium
AAARAG

SEQ ID NO: 892638 - protein, 9 aa, Mycobacterium
AAARAGGAA

SEQ ID NO: 892639 - protein, 12 aa, Mycobacterium
AAARALAGPDTE

SEQ ID NO: 892640 - protein, 7 aa, Mycobacterium
AAARHSR

SEQ ID NO: 892641 - protein, 7 aa, Mycobacterium
AAARSGA

SEQ ID NO: 892642 - protein, 11 aa, Mycobacterium
AAASGKNLGPR

SEQ ID NO: 892643 - protein, 9 aa, Mycobacterium
AAASKNTPA

SEQ ID NO: 892644 - protein, 8 aa, Mycobacterium
AAASMSAA

SEQ ID NO: 892645 - protein, 5 aa, Mycobacterium
AAASN

SEQ ID NO: 892646 - protein, 9 aa, Mycobacterium
AAASPSVAA

SEQ ID NO: 892647 - protein, 6 aa, Mycobacterium
AAASRA

SEQ ID NO: 892648 - protein, 10 aa, Mycobacterium
AAASSSGAAI

SEQ ID NO: 892649 - protein, 8 aa, Mycobacterium
AAASTPPV

SEQ ID NO: 892650 - protein, 8 aa, Mycobacterium
AAASVASG

SEQ ID NO: 892651 - protein, 14 aa, Mycobacterium
AAATAPAQAPVPNL

SEQ ID NO: 892652 - protein, 17 aa, Mycobacterium
AAATAQPPPPAPVPGPL

SEQ ID NO: 892653 - protein, 7 aa, Mycobacterium
AAATDVA

SEQ ID NO: 892654 - protein, 7 aa, Mycobacterium
AAATEEI

SEQ ID NO: 892655 - protein, 7 aa, Mycobacterium
AAATESH

SEQ ID NO: 892656 - protein, 6 aa, Mycobacterium
AAATEW

SEQ ID NO: 892657 - protein, 5 aa, Mycobacterium
AAATG

SEQ ID NO: 892658 - protein, 7 aa, Mycobacterium
AAATGNR

SEQ ID NO: 892659 - protein, 12 aa, Mycobacterium
AAATGQRTPLAR

SEQ ID NO: 892660 - protein, 10 aa, Mycobacterium
AAATNSTPAA

SEQ ID NO: 892661 - protein, 14 aa, Mycobacterium
AAATPAGDSAQTIT

SEQ ID NO: 892662 - protein, 6 aa, Mycobacterium
AAATPY

SEQ ID NO: 892663 - protein, 8 aa, Mycobacterium
AAATRRTT

SEQ ID NO: 892664 - protein, 7 aa, Mycobacterium
AAATTAA

SEQ ID NO: 892665 - protein, 15 aa, Mycobacterium
AAATTNAAAPAGAGS

SEQ ID NO: 892666 - protein, 7 aa, Mycobacterium
AAATTPI

SEQ ID NO: 892667 - protein, 15 aa, Mycobacterium
AAATTPVGSAVPGAF

SEQ ID NO: 892668 - protein, 4 aa, Mycobacterium
AAAV

SEQ ID NO: 892669 - protein, 23 aa, Mycobacterium
AAAVGARNTRAASPSGLDGPGWE

SEQ ID NO: 892670 - protein, 7 aa, Mycobacterium
AAAVPTT

SEQ ID NO: 892671 - protein, 11 aa, Mycobacterium
AAAVRSAGGMP

SEQ ID NO: 892672 - protein, 9 aa, Mycobacterium
AAAYDPANY

SEQ ID NO: 892673 - protein, 6 aa, Mycobacterium
AAAYSG

SEQ ID NO: 892674 - protein, 18 aa, Mycobacterium
AACGGGSATDQPVGEPVY

SEQ ID NO: 892675 - protein, 22 aa, Mycobacterium
AACSAGTVPAPTTGSAGPQNTH

SEQ ID NO: 892676 - protein, 12 aa, Mycobacterium
AADAADDAQSDD

SEQ ID NO: 892677 - protein, 62 aa, Mycobacterium
AADAAGAPAGASGAALATDAGAAAVPTAAADAARARRATGPARTGCAAGSADTAATPGTPAF

SEQ ID NO: 892678 - protein, 8 aa, Mycobacterium
AADAGDAT

SEQ ID NO: 892679 - protein, 8 aa, Mycobacterium
AADAGEQL

SEQ ID NO: 892680 - protein, 11 aa, Mycobacterium
AADAGVSSRTL

SEQ ID NO: 892681 - protein, 6 aa, Mycobacterium
AADALS

SEQ ID NO: 892682 - protein, 5 aa, Mycobacterium
AADAQ

SEQ ID NO: 892683 - protein, 8 aa, Mycobacterium
AADASQDI

SEQ ID NO: 892684 - protein, 34 aa, Mycobacterium
AADCTGEACNGGNGGLLGGNGGDGRYGGAGGKAG

SEQ ID NO: 892685 - protein, 5 aa, Mycobacterium
AADDE

SEQ ID NO: 892686 - protein, 5 aa, Mycobacterium
AADDS

SEQ ID NO: 892687 - protein, 30 aa, Mycobacterium
AADDTKPVDPAPGGAHAEAPSMGTPGRGYA

SEQ ID NO: 892688 - protein, 15 aa, Mycobacterium
AADEALSQATRESLE

SEQ ID NO: 892689 - protein, 6 aa, Mycobacterium
AADEVS

SEQ ID NO: 892690 - protein, 7 aa, Mycobacterium
AADGATF

SEQ ID NO: 892691 - protein, 40 aa, Mycobacterium; identical to SEQ ID NO: 136761

SEQ ID NO: 892692 - protein, 6 aa, Mycobacterium
AADGDA

SEQ ID NO: 892693 - protein, 13 aa, Mycobacterium
AADGDGDGKADVQ

SEQ ID NO: 892694 - protein, 16 aa, Mycobacterium
AADGKTFEGGVGPTLS

SEQ ID NO: 892695 - protein, 8 aa, Mycobacterium
AADGMGGQ

SEQ ID NO: 892696 - protein, 8 aa, Mycobacterium
AADGRPTL

SEQ ID NO: 892697 - protein, 7 aa, Mycobacterium
AADGSDH

SEQ ID NO: 892698 - protein, 7 aa, Mycobacterium
AADGTNY

SEQ ID NO: 892699 - protein, 6 aa, Mycobacterium
AADGTV

SEQ ID NO: 892700 - protein, 12 aa, Mycobacterium
AADHSSTGPATV

SEQ ID NO: 892701 - protein, 9 aa, Mycobacterium
AADKARALT

SEQ ID NO: 892702 - protein, 6 aa, Mycobacterium
AADMSQ

SEQ ID NO: 892703 - protein, 5 aa, Mycobacterium
AADNA

SEQ ID NO: 892704 - protein, 6 aa, Mycobacterium
AADNAQ

SEQ ID NO: 892705 - protein, 16 aa, Mycobacterium
AADNGAPGAPPGAAQT

SEQ ID NO: 892706 - protein, 12 aa, Mycobacterium
AADNLRGQGPAI

SEQ ID NO: 892707 - protein, 11 aa, Mycobacterium
AADPAATRRIT

SEQ ID NO: 892708 - protein, 34 aa, Mycobacterium
AADPAPPPAPVPGLTGTNDAYSPDPPANLPPQQG

SEQ ID NO: 892709 - protein, 7 aa, Mycobacterium
AADPDLE

SEQ ID NO: 892710 - protein, 6 aa, Mycobacterium
AADPDN

SEQ ID NO: 892711 - protein, 7 aa, Mycobacterium
AADPEAF

SEQ ID NO: 892712 - protein, 16 aa, Mycobacterium
AADPGGELANAPKPKF

SEQ ID NO: 892713 - protein, 17 aa, Mycobacterium
AADPGTAAGSSNSGLPR

SEQ ID NO: 892714 - protein, 23 aa, Mycobacterium
AADPNVPAPSPILTAGSDKPECI

SEQ ID NO: 892715 - protein, 7 aa, Mycobacterium
AADPNVV

SEQ ID NO: 892716 - protein, 17 aa, Mycobacterium
AADPPPRVRRFVHAFIR

SEQ ID NO: 892717 - protein, 13 aa, Mycobacterium
AADPPRPAAPRSR

SEQ ID NO: 892718 - protein, 13 aa, Mycobacterium
AADPQAANYRAGQ

SEQ ID NO: 892719 - protein, 11 aa, Mycobacterium
AADPQGEERTV

SEQ ID NO: 892720 - protein, 18 aa, Mycobacterium
AADPQPAPPAPKTTMDHD

SEQ ID NO: 892721 - protein, 8 aa, Mycobacterium
AADPRSDL

SEQ ID NO: 892722 - protein, 28 aa, Mycobacterium
AADPSQCPPDTSAYDYPAPARTYCLGVT

SEQ ID NO: 892723 - protein, 18 aa, Mycobacterium
AADPSQQRRTRPGIMPIG

SEQ ID NO: 892724 - protein, 9 aa, Mycobacterium
AADPSSGWT

SEQ ID NO: 892725 - protein, 9 aa, Mycobacterium
AADPTADWK

SEQ ID NO: 892726 - protein, 47 aa, Mycobacterium
AADPTGPTGGGMGPGGMNGSQFQPPQMPSSMPDYQGGNNQPPLDQNN

SEQ ID NO: 892727 - protein, 8 aa, Mycobacterium
AADQGALD

SEQ ID NO: 892728 - protein, 9 aa, Mycobacterium
AADQLGAGQ

SEQ ID NO: 892729 - protein, 7 aa, Mycobacterium
AADQNGM

SEQ ID NO: 892730 - protein, 7 aa, Mycobacterium
AADQPAH

SEQ ID NO: 892731 - protein, 6 aa, Mycobacterium
AADRAG

SEQ ID NO: 892732 - protein, 6 aa, Mycobacterium
AADRAT

SEQ ID NO: 892733 - protein, 6 aa, Mycobacterium
AADRDS

SEQ ID NO: 892734 - protein, 7 aa, Mycobacterium
AADRHDR

SEQ ID NO: 892735 - protein, 17 aa, Mycobacterium
AADRQGYERPPEETTTF

SEQ ID NO: 892736 - protein, 11 aa, Mycobacterium
AADSANQTKDA

SEQ ID NO: 892737 - protein, 11 aa, Mycobacterium
AADSRTCSGED

SEQ ID NO: 892738 - protein, 9 aa, Mycobacterium
AADTDVPQF

SEQ ID NO: 892739 - protein, 23 aa, Mycobacterium
AADTTGPAGAAIPTGSARAEQEV

SEQ ID NO: 892740 - protein, 6 aa, Mycobacterium
AADTTT

SEQ ID NO: 892741 - protein, 5 aa, Mycobacterium
AADVD

SEQ ID NO: 892742 - protein, 11 aa, Mycobacterium
AADYGTAEDRA

SEQ ID NO: 892743 - protein, 18 aa, Mycobacterium
AAEAAARRGGRRHDAHEA

SEQ ID NO: 892744 - protein, 7 aa, Mycobacterium
AAEAAKA

SEQ ID NO: 892745 - protein, 9 aa, Mycobacterium
AAEAAPAGD

SEQ ID NO: 892746 - protein, 9 aa, Mycobacterium
AAEAAPNLR

SEQ ID NO: 892747 - protein, 7 aa, Mycobacterium
AAEAATA

SEQ ID NO: 892748 - protein, 5 aa, Mycobacterium
AAEAL

SEQ ID NO: 892749 - protein, 11 aa, Mycobacterium
AAEALGEGATV

SEQ ID NO: 892750 - protein, 18 aa, Mycobacterium
AAEAQARRAEARGATLRP

SEQ ID NO: 892751 - protein, 6 aa, Mycobacterium
AAEAQY

SEQ ID NO: 892752 - protein, 25 aa, Mycobacterium
AAEARLRGGPRAAALPAAGTSEGRQ

SEQ ID NO: 892753 - protein, 8 aa, Mycobacterium
AAECGAGT

SEQ ID NO: 892754 - protein, 6 aa, Mycobacterium
AAECPD

SEQ ID NO: 892755 - protein, 7 aa, Mycobacterium
AAEDPRV

SEQ ID NO: 892756 - protein, 8 aa, Mycobacterium
AAEDTRRV

SEQ ID NO: 892757 - protein, 7 aa, Mycobacterium
AAEEGRA

SEQ ID NO: 892758 - protein, 5 aa, Mycobacterium
AAEGA

SEQ ID NO: 892759 - protein, 8 aa, Mycobacterium
AAEGKPTL

SEQ ID NO: 892760 - protein, 6 aa, Mycobacterium
AAEGLS

SEQ ID NO: 892761 - protein, 6 aa, Mycobacterium
AAEGND

SEQ ID NO: 892762 - protein, 15 aa, Mycobacterium
AAEGRAGYGVPGDHG

SEQ ID NO: 892763 - protein, 5 aa, Mycobacterium
AAEGY

SEQ ID NO: 892764 - protein, 18 aa, Mycobacterium
AAEHAPRSAREAAENELS

SEQ ID NO: 892765 - protein, 8 aa, Mycobacterium
AAEKVRDT

SEQ ID NO: 892766 - protein, 7 aa, Mycobacterium
AAELGPR

SEQ ID NO: 892767 - protein, 7 aa, Mycobacterium
AAELNGP

SEQ ID NO: 892768 - protein, 12 aa, Mycobacterium
AAELSDAQRTRV

SEQ ID NO: 892769 - protein, 5 aa, Mycobacterium
AAENQ

SEQ ID NO: 892770 - protein, 6 aa, Mycobacterium
AAENTK

SEQ ID NO: 892771 - protein, 13 aa, Mycobacterium
AAEPEEGDDAGAT

SEQ ID NO: 892772 - protein, 7 aa, Mycobacterium
AAEPISG

SEQ ID NO: 892773 - protein, 10 aa, Mycobacterium
AAEPNPSGWE

SEQ ID NO: 892774 - protein, 9 aa, Mycobacterium
AAEPPSCAS

SEQ ID NO: 892775 - protein, 16 aa, Mycobacterium
AAEPPSCASLGGSVEA

SEQ ID NO: 892776 - protein, 5 aa, Mycobacterium
AAEPR

SEQ ID NO: 892777 - protein, 22 aa, Mycobacterium
AAEPVPTPTPAPGSSATSTVDE

SEQ ID NO: 892778 - protein, 9 aa, Mycobacterium
AAEQRADGS

SEQ ID NO: 892779 - protein, 6 aa, Mycobacterium
AAEQTV

SEQ ID NO: 892780 - protein, 11 aa, Mycobacterium
AAERARNDRRA

SEQ ID NO: 892781 - protein, 5 aa, Mycobacterium
AAERD

SEQ ID NO: 892782 - protein, 9 aa, Mycobacterium
AAERRAGEH

SEQ ID NO: 892783 - protein, 17 aa, Mycobacterium
AAESAGAAVAGGAVSAG

SEQ ID NO: 892784 - protein, 17 aa, Mycobacterium
AAESAGPAVAGGALGAG

SEQ ID NO: 892785 - protein, 9 aa, Mycobacterium
AAESDTTVS

SEQ ID NO: 892786 - protein, 20 aa, Mycobacterium
AAESGKEERTNPNPIPESDP

SEQ ID NO: 892787 - protein, 9 aa, Mycobacterium
AAESGPPLT

SEQ ID NO: 892788 - protein, 7 aa, Mycobacterium
AAESNPI

SEQ ID NO: 892789 - protein, 8 aa, Mycobacterium
AAESNPVD

SEQ ID NO: 892790 - protein, 13 aa, Mycobacterium
AAESSGAAVTGGA

SEQ ID NO: 892791 - protein, 24 aa, Mycobacterium
AAESSGAAVTGGARGPAGGSGAAL

SEQ ID NO: 892792 - protein, 4 aa, Mycobacterium
AAET

SEQ ID NO: 892793 - protein, 7 aa, Mycobacterium
AAETAEA

SEQ ID NO: 892794 - protein, 9 aa, Mycobacterium
AAETASETP

SEQ ID NO: 892795 - protein, 6 aa, Mycobacterium
AAETAT

SEQ ID NO: 892796 - protein, 23 aa, Mycobacterium
AAETEARRRRRSDFSRPDQQRIA

SEQ ID NO: 892797 - protein, 11 aa, Mycobacterium
AAETPAARADA

SEQ ID NO: 892798 - protein, 9 aa, Mycobacterium
AAETPTDRA

SEQ ID NO: 892799 - protein, 10 aa, Mycobacterium
AAEVEQAGGQ

SEQ ID NO: 892800 - protein, 20 aa, Mycobacterium
AAFDAGPVASNGIPTSPEAV

SEQ ID NO: 892801 - protein, 7 aa, Mycobacterium
AAFDNPD

SEQ ID NO: 892802 - protein, 6 aa, Mycobacterium
AAFEPY

SEQ ID NO: 892803 - protein, 20 aa, Mycobacterium
AAFQGEPARPAYATAKAGIG

SEQ ID NO: 892804 - protein, 7 aa, Mycobacterium
AAGAAMA

SEQ ID NO: 892805 - protein, 11 aa, Mycobacterium
AAGAANPQLAG

SEQ ID NO: 892806 - protein, 13 aa, Mycobacterium
AAGAATADRAVRL

SEQ ID NO: 892807 - protein, 6 aa, Mycobacterium
AAGADI

SEQ ID NO: 892808 - protein, 5 aa, Mycobacterium
AAGAE

SEQ ID NO: 892809 - protein, 7 aa, Mycobacterium
AAGAEEA

SEQ ID NO: 892810 - protein, 7 aa, Mycobacterium
AAGAEST

SEQ ID NO: 892811 - protein, 8 aa, Mycobacterium
AAGAGAAA

SEQ ID NO: 892812 - protein, 7 aa, Mycobacterium
AAGAGER

SEQ ID NO: 892813 - protein, 10 aa, Mycobacterium
AAGAGKRPAE

SEQ ID NO: 892814 - protein, 7 aa, Mycobacterium
AAGAGPA

SEQ ID NO: 892815 - protein, 8 aa, Mycobacterium
AAGALRPQ

SEQ ID NO: 892816 - protein, 6 aa, Mycobacterium
AAGAPA

SEQ ID NO: 892817 - protein, 9 aa, Mycobacterium
AAGAPAPVR

SEQ ID NO: 892818 - protein, 14 aa, Mycobacterium
AAGAPDDPEFHPPR

SEQ ID NO: 892819 - protein, 7 aa, Mycobacterium
AAGAPIT

SEQ ID NO: 892820 - protein, 9 aa, Mycobacterium
AAGAPQPTF

SEQ ID NO: 892821 - protein, 14 aa, Mycobacterium
AAGATDTASSPGAA

SEQ ID NO: 892822 - protein, 19 aa, Mycobacterium
AAGAVAPATISPAAGAGVS

SEQ ID NO: 892823 - protein, 16 aa, Mycobacterium
AAGDGEPSPDNIDDAA

SEQ ID NO: 892824 - protein, 11 aa, Mycobacterium
AAGDVSDPAQC

SEQ ID NO: 892825 - protein, 12 aa, Mycobacterium
AAGDYTTAAEDK

SEQ ID NO: 892826 - protein, 9 aa, Mycobacterium
AAGELPAQR

SEQ ID NO: 892827 - protein, 10 aa, Mycobacterium
AAGEPHGRPR

SEQ ID NO: 892828 - protein, 29 aa, Mycobacterium
AAGEQAAKAERASAKSAADAKSAAEQAAA

SEQ ID NO: 892829 - protein, 6 aa, Mycobacterium
AAGFSA

SEQ ID NO: 892830 - protein, 8 aa, Mycobacterium
AAGGAGSL

SEQ ID NO: 892831 - protein, 8 aa, Mycobacterium
AAGGARNA

SEQ ID NO: 892832 - protein, 8 aa, Mycobacterium
AAGGDPWA

SEQ ID NO: 892833 - protein, 24 aa, Mycobacterium
AAGGDRGSRDKAEQPATVRVVDAR

SEQ ID NO: 892834 - protein, 8 aa, Mycobacterium
AAGGFGSA

SEQ ID NO: 892835 - protein, 8 aa, Mycobacterium
AAGGGKSA

SEQ ID NO: 892836 - protein, 8 aa, Mycobacterium
AAGGGQGA

SEQ ID NO: 892837 - protein, 8 aa, Mycobacterium
AAGGGTAM

SEQ ID NO: 892838 - protein, 10 aa, Mycobacterium
AAGGGYAPYE

SEQ ID NO: 892839 - protein, 7 aa, Mycobacterium
AAGGKNG

SEQ ID NO: 892840 - protein, 7 aa, Mycobacterium
AAGGLGA

SEQ ID NO: 892841 - protein, 10 aa, Mycobacterium
AAGGPAGAPI

SEQ ID NO: 892842 - protein, 8 aa, Mycobacterium
AAGGPATA

SEQ ID NO: 892843 - protein, 9 aa, Mycobacterium
AAGGPATAP

SEQ ID NO: 892844 - protein, 9 aa, Mycobacterium
AAGGPELDR

SEQ ID NO: 892845 - protein, 10 aa, Mycobacterium
AAGGPPSAPI

SEQ ID NO: 892846 - protein, 8 aa, Mycobacterium
AAGGPRLD

SEQ ID NO: 892847 - protein, 5 aa, Mycobacterium
AAGGR

SEQ ID NO: 892848 - protein, 9 aa, Mycobacterium
AAGGRNGTF

SEQ ID NO: 892849 - protein, 16 aa, Mycobacterium
AAGGTAADSIADAVDG

SEQ ID NO: 892850 - protein, 15 aa, Mycobacterium
AAGGTALGDEPAKAW

SEQ ID NO: 892851 - protein, 7 aa, Mycobacterium
AAGGTLR

SEQ ID NO: 892852 - protein, 6 aa, Mycobacterium
AAGGTN

SEQ ID NO: 892853 - protein, 8 aa, Mycobacterium
AAGGTSAA

SEQ ID NO: 892854 - protein, 6 aa, Mycobacterium
AAGGVP

SEQ ID NO: 892855 - protein, 4 aa, Mycobacterium
AAGH

SEQ ID NO: 892856 - protein, 8 aa, Mycobacterium
AAGHTQPA

SEQ ID NO: 892857 - protein, 9 aa, Mycobacterium
AAGIDPQSI

SEQ ID NO: 892858 - protein, 10 aa, Mycobacterium
AAGKKPGTDI

SEQ ID NO: 892859 - protein, 10 aa, Mycobacterium
AAGKTPTPQL

SEQ ID NO: 892860 - protein, 8 aa, Mycobacterium
AAGKTPVP

SEQ ID NO: 892861 - protein, 5 aa, Mycobacterium
AAGLA

SEQ ID NO: 892862 - protein, 6 aa, Mycobacterium
AAGLAT

SEQ ID NO: 892863 - protein, 14 aa, Mycobacterium
AAGLTSMSEPSPQV

SEQ ID NO: 892864 - protein, 4 aa, Mycobacterium
AAGN

SEQ ID NO: 892865 - protein, 6 aa, Mycobacterium
AAGNAG

SEQ ID NO: 892866 - protein, 8 aa, Mycobacterium
AAGNDYQR

SEQ ID NO: 892867 - protein, 8 aa, Mycobacterium
AAGNENSV

SEQ ID NO: 892868 - protein, 9 aa, Mycobacterium
AAGNPEQAT

SEQ ID NO: 892869 - protein, 8 aa, Mycobacterium
AAGNPNRP

SEQ ID NO: 892870 - protein, 15 aa, Mycobacterium
AAGNRVSTAPAGVRL

SEQ ID NO: 892871 - protein, 13 aa, Mycobacterium
AAGPAAACEQAGQ

SEQ ID NO: 892872 - protein, 7 aa, Mycobacterium
AAGPCSG

SEQ ID NO: 892873 - protein, 10 aa, Mycobacterium
AAGPDMPADL

SEQ ID NO: 892874 - protein, 9 aa, Mycobacterium
AAGPDQPPL

SEQ ID NO: 892875 - protein, 9 aa, Mycobacterium
AAGPDQPSL

SEQ ID NO: 892876 - protein, 21 aa, Mycobacterium
AAGPEAADAARPLPGPKTPAA

SEQ ID NO: 892877 - protein, 13 aa, Mycobacterium
AAGPGINDNGSGV

SEQ ID NO: 892878 - protein, 6 aa, Mycobacterium
AAGPGT

SEQ ID NO: 892879 - protein, 6 aa, Mycobacterium
AAGPHA

SEQ ID NO: 892880 - protein, 8 aa, Mycobacterium
AAGPNGRN

SEQ ID NO: 892881 - protein, 35 aa, Mycobacterium
AAGPPKATGAPGAPPGGPPGGPGGGLGGPAPKTTV

SEQ ID NO: 892882 - protein, 6 aa, Mycobacterium
AAGPQS

SEQ ID NO: 892883 - protein, 17 aa, Mycobacterium
AAGPTGRAGSAVPATAT

SEQ ID NO: 892884 - protein, 9 aa, Mycobacterium
AAGPTGTVA

SEQ ID NO: 892885 - protein, 28 aa, Mycobacterium
AAGPVGADGGMDAPEPAPAPSPAPNCTA

SEQ ID NO: 892886 - protein, 20 aa, Mycobacterium
AAGPVPAGAHSAPAAIPAAP

SEQ ID NO: 892887 - protein, 4 aa, Mycobacterium
AAGQ

SEQ ID NO: 892888 - protein, 8 aa, Mycobacterium
AAGQDKTQ

SEQ ID NO: 892889 - protein, 198 aa, Mycobacterium
AAGQGGRGGDGSLFGRGGDGGAGGNDDNTSNFTGTDAPKNNATGGRGGNGGRSQLGQAGDGGAGGQAWSESGSATGGAGGTGGGTNYGKAGSGGDGGSGSAWADGKVGKGGVGGNGGGSRADSGSGGAGGTGGDGWGYEEADAQGGNGGAGGLTGGRGGHGGAAESLNGDATGGNGGNGGGARVVGDGGDGGDGGYGW

SEQ ID NO: 892890 - protein, 10 aa, Mycobacterium
AAGQPGPTVL

SEQ ID NO: 892891 - protein, 6 aa, Mycobacterium
AAGQPS

SEQ ID NO: 892892 - protein, 14 aa, Mycobacterium
AAGQQILAQAGFAR

SEQ ID NO: 892893 - protein, 6 aa, Mycobacterium
AAGQSD

SEQ ID NO: 892894 - protein, 9 aa, Mycobacterium
AAGQSLSIS

SEQ ID NO: 892895 - protein, 6 aa, Mycobacterium
AAGRAG

SEQ ID NO: 892896 - protein, 7 aa, Mycobacterium
AAGRAIA

SEQ ID NO: 892897 - protein, 25 aa, Mycobacterium
AAGREATQEPAADRATTAEAPQYDL

SEQ ID NO: 892898 - protein, 9 aa, Mycobacterium
AAGRLADGH

SEQ ID NO: 892899 - protein, 18 aa, Mycobacterium
AAGRRGLTAQSARDASAA

SEQ ID NO: 892900 - protein, 9 aa, Mycobacterium
AAGRSDAAA

SEQ ID NO: 892901 - protein, 4 aa, Mycobacterium
AAGS

SEQ ID NO: 892902 - protein, 10 aa, Mycobacterium
AAGSAGPAVP

SEQ ID NO: 892903 - protein, 9 aa, Mycobacterium
AAGSANPQL

SEQ ID NO: 892904 - protein, 5 aa, Mycobacterium
AAGSE

SEQ ID NO: 892905 - protein, 5 aa, Mycobacterium
AAGSG

SEQ ID NO: 892906 - protein, 44 aa, Mycobacterium
AAGSGGSGGAGGDGAPGDTAGAGGTGGTGSAGGAGGTGGAGGAN

SEQ ID NO: 892907 - protein, 34 aa, Mycobacterium
AAGSPKPPAGLPGAPVPPVAPGGPGGPTPKTTVT

SEQ ID NO: 892908 - protein, 10 aa, Mycobacterium
AAGSSAQTGI

SEQ ID NO: 892909 - protein, 16 aa, Mycobacterium
AAGSSGASGAAGAALA

SEQ ID NO: 892910 - protein, 13 aa, Mycobacterium
AAGSTEPDRTVSA

SEQ ID NO: 892911 - protein, 7 aa, Mycobacterium
AAGSTFN

SEQ ID NO: 892912 - protein, 19 aa, Mycobacterium
AAGTADPKPATGTATQSDR

SEQ ID NO: 892913 - protein, 14 aa, Mycobacterium
AAGTASAAPSSPCA

SEQ ID NO: 892914 - protein, 10 aa, Mycobacterium
AAGTDTVGEA

SEQ ID NO: 892915 - protein, 23 aa, Mycobacterium
AAGTGAMTNTDSASAEYGMPGSE

SEQ ID NO: 892916 - protein, 8 aa, Mycobacterium
AAGTKGLR

SEQ ID NO: 892917 - protein, 8 aa, Mycobacterium
AAGTKSSF

SEQ ID NO: 892918 - protein, 11 aa, Mycobacterium
AAGTKSSFTVP

SEQ ID NO: 892919 - protein, 8 aa, Mycobacterium
AAGTPGPV

SEQ ID NO: 892920 - protein, 7 aa, Mycobacterium
AAGTQQG

SEQ ID NO: 892921 - protein, 16 aa, Mycobacterium
AAGTSTTPGGPAPSPN

SEQ ID NO: 892922 - protein, 5 aa, Mycobacterium
AAGTV

SEQ ID NO: 892923 - protein, 12 aa, Mycobacterium
AAGTYRTDGGKY

SEQ ID NO: 892924 - protein, 6 aa, Mycobacterium
AAGVEA

SEQ ID NO: 892925 - protein, 5 aa, Mycobacterium
AAGVG

SEQ ID NO: 892926 - protein, 14 aa, Mycobacterium
AAGVTSVASESSAV

SEQ ID NO: 892927 - protein, 4 aa, Mycobacterium
AAGY

SEQ ID NO: 892928 - protein, 6 aa, Mycobacterium
AAGYAN

SEQ ID NO: 892929 - protein, 16 aa, Mycobacterium
AAGYQPPGGASAPGTY

SEQ ID NO: 892930 - protein, 7 aa, Mycobacterium
AAGYRSE

SEQ ID NO: 892931 - protein, 8 aa, Mycobacterium
AAHADDAS

SEQ ID NO: 892932 - protein, 10 aa, Mycobacterium
AAHADDKTVT

SEQ ID NO: 892933 - protein, 6 aa, Mycobacterium
AAHAEA

SEQ ID NO: 892934 - protein, 21 aa, Mycobacterium
AAHEADKPIRSYPGPNEIKPK

SEQ ID NO: 892935 - protein, 12 aa, Mycobacterium
AAHEADTGAAAT

SEQ ID NO: 892936 - protein, 12 aa, Mycobacterium
AAHGPDAQLPPG

SEQ ID NO: 892937 - protein, 9 aa, Mycobacterium
AAHGPNPVL

SEQ ID NO: 892938 - protein, 4 aa, Mycobacterium
AAHP

SEQ ID NO: 892939 - protein, 12 aa, Mycobacterium
AAHPAGGPNAEH

SEQ ID NO: 892940 - protein, 7 aa, Mycobacterium
AAHPDTV

SEQ ID NO: 892941 - protein, 7 aa, Mycobacterium
AAHPNVS

SEQ ID NO: 892942 - protein, 15 aa, Mycobacterium
AAHPPAGSAIPDRAP

SEQ ID NO: 892943 - protein, 8 aa, Mycobacterium
AAHPSATA

SEQ ID NO: 892944 - protein, 9 aa, Mycobacterium
AAHPSEPGV

SEQ ID NO: 892945 - protein, 8 aa, Mycobacterium
AAHPSQAQ

SEQ ID NO: 892946 - protein, 8 aa, Mycobacterium
AAHRDGLQ

SEQ ID NO: 892947 - protein, 14 aa, Mycobacterium
AAHSAYKSNGMADQ

SEQ ID NO: 892948 - protein, 22 aa, Mycobacterium
AAHSNYGPAGFTDQAAAFVAGL

SEQ ID NO: 892949 - protein, 4 aa, Mycobacterium
AAHT

SEQ ID NO: 892950 - protein, 7 aa, Mycobacterium
AAHTAAV

SEQ ID NO: 892951 - protein, 12 aa, Mycobacterium
AAIADGNGQQMK

SEQ ID NO: 892952 - protein, 24 aa, Mycobacterium
AAIAGNGNEWTEGPAPVSSGGQWD

SEQ ID NO: 892953 - protein, 8 aa, Mycobacterium
AAIGGQQG

SEQ ID NO: 892954 - protein, 12 aa, Mycobacterium
AAIGSKAGPGAR

SEQ ID NO: 892955 - protein, 6 aa, Mycobacterium
AAIGSQ

SEQ ID NO: 892956 - protein, 10 aa, Mycobacterium
AAIGYPPNGV

SEQ ID NO: 892957 - protein, 6 aa, Mycobacterium
AAIPEA

SEQ ID NO: 892958 - protein, 5 aa, Mycobacterium
AAIPG

SEQ ID NO: 892959 - protein, 4 aa, Mycobacterium
AAKA

SEQ ID NO: 892960 - protein, 15 aa, Mycobacterium
AAKAADEIAAGQLHK

SEQ ID NO: 892961 - protein, 7 aa, Mycobacterium
AAKAEGE

SEQ ID NO: 892962 - protein, 8 aa, Mycobacterium
AAKAGPLP

SEQ ID NO: 892963 - protein, 8 aa, Mycobacterium
AAKAGQIT

SEQ ID NO: 892964 - protein, 7 aa, Mycobacterium
AAKAPVE

SEQ ID NO: 892965 - protein, 8 aa, Mycobacterium
AAKDARAF

SEQ ID NO: 892966 - protein, 4 aa, Mycobacterium
AAKE

SEQ ID NO: 892967 - protein, 12 aa, Mycobacterium
AAKGAGAYAGPR

SEQ ID NO: 892968 - protein, 14 aa, Mycobacterium
AAKGAGAYGTGPRY

SEQ ID NO: 892969 - protein, 34 aa, Mycobacterium
AAKGLPGTKAAYAASKAGLSSLGESLRSEYARGP

SEQ ID NO: 892970 - protein, 7 aa, Mycobacterium
AAKGRGQ

SEQ ID NO: 892971 - protein, 12 aa, Mycobacterium
AAKKGIDHPDSV

SEQ ID NO: 892972 - protein, 9 aa, Mycobacterium
AAKNDSTLR

SEQ ID NO: 892973 - protein, 14 aa, Mycobacterium
AAKNRPGSGFVPVP

SEQ ID NO: 892974 - protein, 14 aa, Mycobacterium
AAKPPAGAPEPKTT

SEQ ID NO: 892975 - protein, 32 aa, Mycobacterium
AAKPSPRDEGESEQAQGRDVRPDRSQREEELS

SEQ ID NO: 892976 - protein, 9 aa, Mycobacterium
AAKRRNTVD

SEQ ID NO: 892977 - protein, 14 aa, Mycobacterium
AAKSEGGKNPQAGL

SEQ ID NO: 892978 - protein, 13 aa, Mycobacterium
AAKSNGGQDPEAG

SEQ ID NO: 892979 - protein, 37 aa, Mycobacterium
AAKTTAPSRSAPMAPAATSAAGRRYQGVGGSGGSGAA

SEQ ID NO: 892980 - protein, 9 aa, Mycobacterium
AAKTTDDTV

SEQ ID NO: 892981 - protein, 15 aa, Mycobacterium
AALADPEPSPPTPVV

SEQ ID NO: 892982 - protein, 11 aa, Mycobacterium
AALADPKRNTA

SEQ ID NO: 892983 - protein, 22 aa, Mycobacterium
AALAGGPLGAVGSGAPGAVGGV

SEQ ID NO: 892984 - protein, 13 aa, Mycobacterium
AALAPAASAAAPT

SEQ ID NO: 892985 - protein, 12 aa, Mycobacterium
AALAPNAEAAQP

SEQ ID NO: 892986 - protein, 13 aa, Mycobacterium
AALASGSAGAALA

SEQ ID NO: 892987 - protein, 29 aa, Mycobacterium
AALASRSAGAALASGALGAAGAGSGCAAG

SEQ ID NO: 892988 - protein, 6 aa, Mycobacterium
AALEGM

SEQ ID NO: 892989 - protein, 16 aa, Mycobacterium
AALGQSGGTAAGQQPF

SEQ ID NO: 892990 - protein, 10 aa, Mycobacterium
AALPEAQARE

SEQ ID NO: 892991 - protein, 6 aa, Mycobacterium
AALPGV

SEQ ID NO: 892992 - protein, 10 aa, Mycobacterium
AALPQAEARE

SEQ ID NO: 892993 - protein, 15 aa, Mycobacterium
AALPSASALGAQPKA

SEQ ID NO: 892994 - protein, 6 aa, Mycobacterium
AALPTP

SEQ ID NO: 892995 - protein, 6 aa, Mycobacterium
AALRDA

SEQ ID NO: 892996 - protein, 4 aa, Mycobacterium
AALS

SEQ ID NO: 892997 - protein, 9 aa, Mycobacterium
AALSGAPVA

SEQ ID NO: 892998 - protein, 10 aa, Mycobacterium
AALSRSGRQV

SEQ ID NO: 892999 - protein, 9 aa, Mycobacterium
AAMDESGRA

SEQ ID NO: 893000 - protein, 13 aa, Mycobacterium
AAMDGNGNKLRET

SEQ ID NO: 893001 - protein, 29 aa, Mycobacterium
AAMPEPPAPTRPAEPAPPVPGLLPAEGAQ

SEQ ID NO: 893002 - protein, 10 aa, Mycobacterium
AANAAAAVST

SEQ ID NO: 893003 - protein, 10 aa, Mycobacterium
AANAARYRDE

SEQ ID NO: 893004 - protein, 14 aa, Mycobacterium
AANAAVDETEAQQP

SEQ ID NO: 893005 - protein, 6 aa, Mycobacterium
AANAPQ

SEQ ID NO: 893006 - protein, 7 aa, Mycobacterium
AANAPQI

SEQ ID NO: 893007 - protein, 6 aa, Mycobacterium
AANDAK

SEQ ID NO: 893008 - protein, 7 aa, Mycobacterium
AANDPQA

SEQ ID NO: 893009 - protein, 14 aa, Mycobacterium
AANKTEPADSRNVA

SEQ ID NO: 893010 - protein, 12 aa, Mycobacterium
AANLTDAQRNRV

SEQ ID NO: 893011 - protein, 11 aa, Mycobacterium
AANPAGAKRIA

SEQ ID NO: 893012 - protein, 5 aa, Mycobacterium
AANPE

SEQ ID NO: 893013 - protein, 8 aa, Mycobacterium
AANPKVKL

SEQ ID NO: 893014 - protein, 6 aa, Mycobacterium
AANPSA

SEQ ID NO: 893015 - protein, 13 aa, Mycobacterium
AANPTYGSDTSAV

SEQ ID NO: 893016 - protein, 8 aa, Mycobacterium
AANSFDTQ

SEQ ID NO: 893017 - protein, 8 aa, Mycobacterium
AANSQVAN

SEQ ID NO: 893018 - protein, 11 aa, Mycobacterium
AANSSSPHPDA

SEQ ID NO: 893019 - protein, 4 aa, Mycobacterium
AANT

SEQ ID NO: 893020 - protein, 6 aa, Mycobacterium
AANTRA

SEQ ID NO: 893021 - protein, 11 aa, Mycobacterium
AANTRSATELD

SEQ ID NO: 893022 - protein, 4 aa, Mycobacterium
AAPA

SEQ ID NO: 893023 - protein, 14 aa, Mycobacterium
AAPAAAASGEGGEY

SEQ ID NO: 893024 - protein, 12 aa, Mycobacterium
AAPAAGADPTVT

SEQ ID NO: 893025 - protein, 8 aa, Mycobacterium
AAPAAGGE

SEQ ID NO: 893026 - protein, 7 aa, Mycobacterium
AAPAASA

SEQ ID NO: 893027 - protein, 16 aa, Mycobacterium
AAPAATGGAASDGTGW

SEQ ID NO: 893028 - protein, 6 aa, Mycobacterium
AAPAAV

SEQ ID NO: 893029 - protein, 12 aa, Mycobacterium
AAPAEAEGNGDD

SEQ ID NO: 893030 - protein, 8 aa, Mycobacterium
AAPAGLGE

SEQ ID NO: 893031 - protein, 8 aa, Mycobacterium
AAPAGLGY

SEQ ID NO: 893032 - protein, 24 aa, Mycobacterium
AAPALPVGGESPSQTISDLEDQGY

SEQ ID NO: 893033 - protein, 22 aa, Mycobacterium
AAPAPAADPAPAPNTAPAPAAR

SEQ ID NO: 893034 - protein, 7 aa, Mycobacterium
AAPAPDV

SEQ ID NO: 893035 - protein, 7 aa, Mycobacterium
AAPAPEV

SEQ ID NO: 893036 - protein, 8 aa, Mycobacterium
AAPAPRGH

SEQ ID NO: 893037 - protein, 7 aa, Mycobacterium
AAPAPRV

SEQ ID NO: 893038 - protein, 5 aa, Mycobacterium
AAPAR

SEQ ID NO: 893039 - protein, 8 aa, Mycobacterium
AAPARADQ

SEQ ID NO: 893040 - protein, 14 aa, Mycobacterium
AAPAREGEPHAAPE

SEQ ID NO: 893041 - protein, 6 aa, Mycobacterium
AAPARV

SEQ ID NO: 893042 - protein, 9 aa, Mycobacterium
AAPASASPE

SEQ ID NO: 893043 - protein, 14 aa, Mycobacterium
AAPATSTLAAQTNG

SEQ ID NO: 893044 - protein, 8 aa, Mycobacterium
AAPAYTAS

SEQ ID NO: 893045 - protein, 17 aa, Mycobacterium
AAPCPEPNFPGVPQAEL

SEQ ID NO: 893046 - protein, 5 aa, Mycobacterium
AAPDA

SEQ ID NO: 893047 - protein, 7 aa, Mycobacterium
AAPDAPQ

SEQ ID NO: 893048 - protein, 7 aa, Mycobacterium
AAPDDAA

SEQ ID NO: 893049 - protein, 5 aa, Mycobacterium
AAPDG

SEQ ID NO: 893050 - protein, 6 aa, Mycobacterium
AAPDIP

SEQ ID NO: 893051 - protein, 17 aa, Mycobacterium
AAPDVGETNGSLSGADS

SEQ ID NO: 893052 - protein, 4 aa, Mycobacterium
AAPE

SEQ ID NO: 893053 - protein, 10 aa, Mycobacterium
AAPEATPPSQ

SEQ ID NO: 893054 - protein, 11 aa, Mycobacterium
AAPEGATKVRR

SEQ ID NO: 893055 - protein, 20 aa, Mycobacterium
AAPENQNWDQAPAPADQPQT

SEQ ID NO: 893056 - protein, 8 aa, Mycobacterium
AAPEPRTK

SEQ ID NO: 893057 - protein, 4 aa, Mycobacterium
AAPG

SEQ ID NO: 893058 - protein, 7 aa, Mycobacterium
AAPGAES

SEQ ID NO: 893059 - protein, 10 aa, Mycobacterium
AAPGAGNAND

SEQ ID NO: 893060 - protein, 11 aa, Mycobacterium
AAPGASLESAP

SEQ ID NO: 893061 - protein, 9 aa, Mycobacterium
AAPGDYGRI

SEQ ID NO: 893062 - protein, 22 aa, Mycobacterium
AAPGGGNQPAPETPRDARHAGG

SEQ ID NO: 893063 - protein, 14 aa, Mycobacterium
AAPGIAAADPSVRP

SEQ ID NO: 893064 - protein, 9 aa, Mycobacterium
AAPGITRAA

SEQ ID NO: 893065 - protein, 8 aa, Mycobacterium
AAPGKSSW

SEQ ID NO: 893066 - protein, 9 aa, Mycobacterium
AAPGLGKTK

SEQ ID NO: 893067 - protein, 10 aa, Mycobacterium
AAPGLGKTKI

SEQ ID NO: 893068 - protein, 13 aa, Mycobacterium
AAPGQPVYAPGSA

SEQ ID NO: 893069 - protein, 15 aa, Mycobacterium
AAPGTASADGTDDYP

SEQ ID NO: 893070 - protein, 24 aa, Mycobacterium
AAPGTLRTGSRGCCSKEDAADARR

SEQ ID NO: 893071 - protein, 6 aa, Mycobacterium
AAPIGD

SEQ ID NO: 893072 - protein, 7 aa, Mycobacterium
AAPITGR

SEQ ID NO: 893073 - protein, 10 aa, Mycobacterium
AAPKPSRDVA

SEQ ID NO: 893074 - protein, 5 aa, Mycobacterium
AAPLG

SEQ ID NO: 893075 - protein, 14 aa, Mycobacterium
AAPLGPAQTERTAN

SEQ ID NO: 893076 - protein, 9 aa, Mycobacterium
AAPLKTGGY

SEQ ID NO: 893077 - protein, 7 aa, Mycobacterium
AAPLPLP

SEQ ID NO: 893078 - protein, 5 aa, Mycobacterium
AAPLR

SEQ ID NO: 893079 - protein, 13 aa, Mycobacterium
AAPLTQGKGGEEM

SEQ ID NO: 893080 - protein, 13 aa, Mycobacterium
AAPLTSAVPSAAA

SEQ ID NO: 893081 - protein, 34 aa, Mycobacterium
AAPNSTSNSIRQTSTPAAAASPGRAEPSRRVVPP

SEQ ID NO: 893082 - protein, 11 aa, Mycobacterium
AAPPASAGPTV

SEQ ID NO: 893083 - protein, 22 aa, Mycobacterium
AAPPATADPGPTPMDPSSAEGA

SEQ ID NO: 893084 - protein, 19 aa, Mycobacterium
AAPPDPSPQPLCPPPHRKQ

SEQ ID NO: 893085 - protein, 23 aa, Mycobacterium
AAPPGEQRSGDAAGGAADLAQRE

SEQ ID NO: 893086 - protein, 12 aa, Mycobacterium
AAPPGKQSPLDG

SEQ ID NO: 893087 - protein, 19 aa, Mycobacterium
AAPPNPSPEPLRDGDTIPL

SEQ ID NO: 893088 - protein, 10 aa, Mycobacterium
AAPPNPSQEL

SEQ ID NO: 893089 - protein, 10 aa, Mycobacterium
AAPPNPSSQL

SEQ ID NO: 893090 - protein, 12 aa, Mycobacterium
AAPPPAAAPAPP

SEQ ID NO: 893091 - protein, 9 aa, Mycobacterium
AAPPPAATR

SEQ ID NO: 893092 - protein, 9 aa, Mycobacterium
AAPPPAETR

SEQ ID NO: 893093 - protein, 13 aa, Mycobacterium
AAPPPHQPGTYPF

SEQ ID NO: 893094 - protein, 14 aa, Mycobacterium
AAPPPNIQGFGTSE

SEQ ID NO: 893095 - protein, 14 aa, Mycobacterium
AAPPPSCSAPALPG

SEQ ID NO: 893096 - protein, 13 aa, Mycobacterium
AAPPTAKSIASVQ

SEQ ID NO: 893097 - protein, 26 aa, Mycobacterium
AAPPTSNPNGKPGVETTFKDDDGSHA

SEQ ID NO: 893098 - protein, 5 aa, Mycobacterium
AAPPV

SEQ ID NO: 893099 - protein, 6 aa, Mycobacterium
AAPPVG

SEQ ID NO: 893100 - protein, 8 aa, Mycobacterium
AAPPVGPR

SEQ ID NO: 893101 - protein, 8 aa, Mycobacterium
AAPPVQPC

SEQ ID NO: 893102 - protein, 6 aa, Mycobacterium
AAPQAK

SEQ ID NO: 893103 - protein, 14 aa, Mycobacterium
AAPQDDDEAEPQSV

SEQ ID NO: 893104 - protein, 16 aa, Mycobacterium
AAPQGVPQPSPTEPAK

SEQ ID NO: 893105 - protein, 6 aa, Mycobacterium
AAPQNL

SEQ ID NO: 893106 - protein, 25 aa, Mycobacterium
AAPQPDGGGGPGGTEPRRPAATPTL

SEQ ID NO: 893107 - protein, 10 aa, Mycobacterium
AAPQSPAPQR

SEQ ID NO: 893108 - protein, 9 aa, Mycobacterium
AAPQSWTKG

SEQ ID NO: 893109 - protein, 28 aa, Mycobacterium
AAPQSWTKGDGSEFNGGAGEGAQKSSGV

SEQ ID NO: 893110 - protein, 8 aa, Mycobacterium
AAPRAWAG

SEQ ID NO: 893111 - protein, 7 aa, Mycobacterium
AAPRGSA

SEQ ID NO: 893112 - protein, 6 aa, Mycobacterium
AAPRLP

SEQ ID NO: 893113 - protein, 15 aa, Mycobacterium
AAPRSLPAAGAQGCT

SEQ ID NO: 893114 - protein, 10 aa, Mycobacterium
AAPSARGHQH

SEQ ID NO: 893115 - protein, 22 aa, Mycobacterium
AAPSATTDGPITTSTAGCADGR

SEQ ID NO: 893116 - protein, 6 aa, Mycobacterium
AAPSGE

SEQ ID NO: 893117 - protein, 7 aa, Mycobacterium
AAPSIDA

SEQ ID NO: 893118 - protein, 10 aa, Mycobacterium
AAPSKVDSVE

SEQ ID NO: 893119 - protein, 6 aa, Mycobacterium
AAPSNI

SEQ ID NO: 893120 - protein, 17 aa, Mycobacterium
AAPSVPAANMPPGSVEQ

SEQ ID NO: 893121 - protein, 6 aa, Mycobacterium
AAPSYR

SEQ ID NO: 893122 - protein, 4 aa, Mycobacterium
AAPT

SEQ ID NO: 893123 - protein, 12 aa, Mycobacterium
AAPTAAADPPGI

SEQ ID NO: 893124 - protein, 13 aa, Mycobacterium
AAPTGDTSADQTI

SEQ ID NO: 893125 - protein, 17 aa, Mycobacterium
AAPTGRGELTSADGRRL

SEQ ID NO: 893126 - protein, 11 aa, Mycobacterium
AAPTITPQSLA

SEQ ID NO: 893127 - protein, 13 aa, Mycobacterium
AAPTTGGRRRRRD

SEQ ID NO: 893128 - protein, 13 aa, Mycobacterium
AAPVGEDDSWELL

SEQ ID NO: 893129 - protein, 5 aa, Mycobacterium
AAPVT

SEQ ID NO: 893130 - protein, 32 aa, Mycobacterium
AAPVTPSGAPNGAVGTTSDINPQNPATLRDGG

SEQ ID NO: 893131 - protein, 7 aa, Mycobacterium
AAPYDQL

SEQ ID NO: 893132 - protein, 11 aa, Mycobacterium
AAPYDRPAGNQ

SEQ ID NO: 893133 - protein, 6 aa, Mycobacterium
AAPYGI

SEQ ID NO: 893134 - protein, 8 aa, Mycobacterium
AAPYGSNG

SEQ ID NO: 893135 - protein, 7 aa, Mycobacterium
AAPYGVP

SEQ ID NO: 893136 - protein, 4 aa, Mycobacterium
AAQA

SEQ ID NO: 893137 - protein, 21 aa, Mycobacterium
AAQAAQVSANPLGSQARLENG

SEQ ID NO: 893138 - protein, 22 aa, Mycobacterium
AAQADGTGPAFGGQGDGNGYGW

SEQ ID NO: 893139 - protein, 14 aa, Mycobacterium
AAQAEQAAAQAAVT

SEQ ID NO: 893140 - protein, 8 aa, Mycobacterium
AAQAEQAG

SEQ ID NO: 893141 - protein, 7 aa, Mycobacterium
AAQAGHD

SEQ ID NO: 893142 - protein, 6 aa, Mycobacterium
AAQAGM

SEQ ID NO: 893143 - protein, 13 aa, Mycobacterium
AAQAGQVKDPAAF

SEQ ID NO: 893144 - protein, 5 aa, Mycobacterium
AAQAN

SEQ ID NO: 893145 - protein, 13 aa, Mycobacterium
AAQAQAVSSQASA

SEQ ID NO: 893146 - protein, 9 aa, Mycobacterium
AAQASGATP

SEQ ID NO: 893147 - protein, 8 aa, Mycobacterium
AAQDDPRM

SEQ ID NO: 893148 - protein, 11 aa, Mycobacterium
AAQDELARAGQ

SEQ ID NO: 893149 - protein, 8 aa, Mycobacterium
AAQGADGS

SEQ ID NO: 893150 - protein, 8 aa, Mycobacterium
AAQGGTAA

SEQ ID NO: 893151 - protein, 8 aa, Mycobacterium
AAQGNDGS

SEQ ID NO: 893152 - protein, 12 aa, Mycobacterium
AAQGQGTPTISG

SEQ ID NO: 893153 - protein, 12 aa, Mycobacterium
AAQGRGTPTIGG

SEQ ID NO: 893154 - protein, 8 aa, Mycobacterium
AAQGRQIA

SEQ ID NO: 893155 - protein, 10 aa, Mycobacterium
AAQGTLTPPH

SEQ ID NO: 893156 - protein, 5 aa, Mycobacterium
AAQMD

SEQ ID NO: 893157 - protein, 12 aa, Mycobacterium
AAQNAAASAPTM

SEQ ID NO: 893158 - protein, 5 aa, Mycobacterium
AAQPA

SEQ ID NO: 893159 - protein, 9 aa, Mycobacterium
AAQPDHLSA

SEQ ID NO: 893160 - protein, 8 aa, Mycobacterium
AAQPGPPV

SEQ ID NO: 893161 - protein, 7 aa, Mycobacterium
AAQPLSQ

SEQ ID NO: 893162 - protein, 8 aa, Mycobacterium
AAQPPVPP

SEQ ID NO: 893163 - protein, 20 aa, Mycobacterium
AAQQAAEKKLADDQAALAAA

SEQ ID NO: 893164 - protein, 24 aa, Mycobacterium
AAQQAAENKLTDDQAALDAAKGQL

SEQ ID NO: 893165 - protein, 7 aa, Mycobacterium
AAQQATI

SEQ ID NO: 893166 - protein, 7 aa, Mycobacterium
AAQQDVE

SEQ ID NO: 893167 - protein, 10 aa, Mycobacterium
AAQQRRYPQG

SEQ ID NO: 893168 - protein, 14 aa, Mycobacterium
AAQRAAETLQPPDR

SEQ ID NO: 893169 - protein, 10 aa, Mycobacterium
AAQRDAEKTV

SEQ ID NO: 893170 - protein, 7 aa, Mycobacterium
AAQRDTG

SEQ ID NO: 893171 - protein, 9 aa, Mycobacterium
AAQRGSNRP

SEQ ID NO: 893172 - protein, 14 aa, Mycobacterium
AAQRLPGTSLDPHG

SEQ ID NO: 893173 - protein, 8 aa, Mycobacterium
AAQRVDPD

SEQ ID NO: 893174 - protein, 10 aa, Mycobacterium
AAQRYSGTAD

SEQ ID NO: 893175 - protein, 12 aa, Mycobacterium
AAQSAGAAGNAR

SEQ ID NO: 893176 - protein, 15 aa, Mycobacterium
AAQSAQNDEALRSGL

SEQ ID NO: 893177 - protein, 10 aa, Mycobacterium
AAQSDFEPLT

SEQ ID NO: 893178 - protein, 16 aa, Mycobacterium
AAQSGSGTLAEDRADE

SEQ ID NO: 893179 - protein, 8 aa, Mycobacterium
AAQSPGGV

SEQ ID NO: 893180 - protein, 12 aa, Mycobacterium
AAQSPSGPAKDA

SEQ ID NO: 893181 - protein, 8 aa, Mycobacterium
AAQSRHDV

SEQ ID NO: 893182 - protein, 11 aa, Mycobacterium
AAQTAKRDQNV

SEQ ID NO: 893183 - protein, 18 aa, Mycobacterium
AAQTETAASQARAAAAAY

SEQ ID NO: 893184 - protein, 10 aa, Mycobacterium
AAQTREATEL

SEQ ID NO: 893185 - protein, 4 aa, Mycobacterium
AAQV

SEQ ID NO: 893186 - protein, 7 aa, Mycobacterium
AAQYEDG

SEQ ID NO: 893187 - protein, 4 aa, Mycobacterium
AARA

SEQ ID NO: 893188 - protein, 30 aa, Mycobacterium
AARAAGAAPVYEGDPGYAPHLDRDGDGVGC

SEQ ID NO: 893189 - protein, 5 aa, Mycobacterium
AARAG

SEQ ID NO: 893190 - protein, 8 aa, Mycobacterium
AARAGDMN

SEQ ID NO: 893191 - protein, 6 aa, Mycobacterium
AARAKL

SEQ ID NO: 893192 - protein, 6 aa, Mycobacterium
AARATG

SEQ ID NO: 893193 - protein, 34 aa, Mycobacterium
AARDNAASAAAQVAEGQRAVDAANGAIEEAQGKF

SEQ ID NO: 893194 - protein, 11 aa, Mycobacterium
AARDPEGAGAV

SEQ ID NO: 893195 - protein, 5 aa, Mycobacterium
AARDV

SEQ ID NO: 893196 - protein, 6 aa, Mycobacterium
AARDVT

SEQ ID NO: 893197 - protein, 7 aa, Mycobacterium
AAREEAA

SEQ ID NO: 893198 - protein, 22 aa, Mycobacterium
AAREGQSMPRIDNSQGGDSLAA

SEQ ID NO: 893199 - protein, 8 aa, Mycobacterium
AARGADVD

SEQ ID NO: 893200 - protein, 11 aa, Mycobacterium
AARGDEPSALG

SEQ ID NO: 893201 - protein, 11 aa, Mycobacterium
AARGDGSAAEV

SEQ ID NO: 893202 - protein, 10 aa, Mycobacterium
AARGDTGTAL

SEQ ID NO: 893203 - protein, 11 aa, Mycobacterium
AARGEVAPDGD

SEQ ID NO: 893204 - protein, 7 aa, Mycobacterium
AARGGVA

SEQ ID NO: 893205 - protein, 14 aa, Mycobacterium
AARGPAYAASTATA

SEQ ID NO: 893206 - protein, 11 aa, Mycobacterium
AARGQGAADLG

SEQ ID NO: 893207 - protein, 11 aa, Mycobacterium
AARGRGGDPVT

SEQ ID NO: 893208 - protein, 5 aa, Mycobacterium
AARGT

SEQ ID NO: 893209 - protein, 6 aa, Mycobacterium
AARGTD

SEQ ID NO: 893210 - protein, 6 aa, Mycobacterium
AARKAG

SEQ ID NO: 893211 - protein, 9 aa, Mycobacterium
AARKKLQDA

SEQ ID NO: 893212 - protein, 23 aa, Mycobacterium
AARKQNLDATQGSEQTVGSTRQT

SEQ ID NO: 893213 - protein, 28 aa, Mycobacterium
AARLGTPYSWGGGKPTGPSLGVERGANT

SEQ ID NO: 893214 - protein, 8 aa, Mycobacterium
AARNDASL

SEQ ID NO: 893215 - protein, 9 aa, Mycobacterium
AARNDSKLR

SEQ ID NO: 893216 - protein, 7 aa, Mycobacterium
AARNTKG

SEQ ID NO: 893217 - protein, 7 aa, Mycobacterium
AARPDGG

SEQ ID NO: 893218 - protein, 6 aa, Mycobacterium
AARQAD

SEQ ID NO: 893219 - protein, 6 aa, Mycobacterium
AARQEP

SEQ ID NO: 893220 - protein, 6 aa, Mycobacterium
AARQHN

SEQ ID NO: 893221 - protein, 12 aa, Mycobacterium
AARQLKAGRSRS

SEQ ID NO: 893222 - protein, 8 aa, Mycobacterium
AARQPRPA

SEQ ID NO: 893223 - protein, 6 aa, Mycobacterium
AARQRG

SEQ ID NO: 893224 - protein, 12 aa, Mycobacterium
AARQSSITQGAA

SEQ ID NO: 893225 - protein, 6 aa, Mycobacterium
AARRAG

SEQ ID NO: 893226 - protein, 6 aa, Mycobacterium
AARRCA

SEQ ID NO: 893227 - protein, 6 aa, Mycobacterium
AARRDA

SEQ ID NO: 893228 - protein, 7 aa, Mycobacterium
AARRDDD

SEQ ID NO: 893229 - protein, 10 aa, Mycobacterium
AARRGRGAPV

SEQ ID NO: 893230 - protein, 11 aa, Mycobacterium
AARRRGDSAPQ

SEQ ID NO: 893231 - protein, 6 aa, Mycobacterium
AARRTR

SEQ ID NO: 893232 - protein, 7 aa, Mycobacterium
AARSEVD

SEQ ID NO: 893233 - protein, 10 aa, Mycobacterium
AARSGDTNGL

SEQ ID NO: 893234 - protein, 10 aa, Mycobacterium
AARSGDTNQL

SEQ ID NO: 893235 - protein, 8 aa, Mycobacterium
AARSLTGA

SEQ ID NO: 893236 - protein, 17 aa, Mycobacterium
AARSPEVKVGAPSEFQT

SEQ ID NO: 893237 - protein, 7 aa, Mycobacterium
AARSPGG

SEQ ID NO: 893238 - protein, 10 aa, Mycobacterium
AARSTPPGPL

SEQ ID NO: 893239 - protein, 4 aa, Mycobacterium
AART

SEQ ID NO: 893240 - protein, 7 aa, Mycobacterium
AARTADA

SEQ ID NO: 893241 - protein, 13 aa, Mycobacterium
AARTASAGRSAHT

SEQ ID NO: 893242 - protein, 7 aa, Mycobacterium
AARTATA

SEQ ID NO: 893243 - protein, 10 aa, Mycobacterium
AARTRYDSFP

SEQ ID NO: 893244 - protein, 13 aa, Mycobacterium
AARTTGPGPKPPA

SEQ ID NO: 893245 - protein, 5 aa, Mycobacterium
AARYT

SEQ ID NO: 893246 - protein, 10 aa, Mycobacterium
AASAAAPQLA

SEQ ID NO: 893247 - protein, 11 aa, Mycobacterium
AASAAGNPEIR

SEQ ID NO: 893248 - protein, 24 aa, Mycobacterium
AASAARSAIDTTSDAKAAAARAEA

SEQ ID NO: 893249 - protein, 9 aa, Mycobacterium
AASAATEQK

SEQ ID NO: 893250 - protein, 8 aa, Mycobacterium
AASADARS

SEQ ID NO: 893251 - protein, 24 aa, Mycobacterium
AASAGALAGRASAAANAPHGALSG

SEQ ID NO: 893252 - protein, 8 aa, Mycobacterium
AASAGPQA

SEQ ID NO: 893253 - protein, 18 aa, Mycobacterium
AASAGSYAATEAANAAAA

SEQ ID NO: 893254 - protein, 13 aa, Mycobacterium
AASANAAPALPAP

SEQ ID NO: 893255 - protein, 6 aa, Mycobacterium
AASAPR

SEQ ID NO: 893256 - protein, 7 aa, Mycobacterium
AASAPVA

SEQ ID NO: 893257 - protein, 9 aa, Mycobacterium
AASAQPDAT

SEQ ID NO: 893258 - protein, 16 aa, Mycobacterium
AASARDASGTFRSGGI

SEQ ID NO: 893259 - protein, 17 aa, Mycobacterium
AASARDVSGTFRSGGMD

SEQ ID NO: 893260 - protein, 15 aa, Mycobacterium
AASATNATTPSAGRR

SEQ ID NO: 893261 - protein, 28 aa, Mycobacterium
AASATTPAAASINAAAPPNTPRTASPAE

SEQ ID NO: 893262 - protein, 18 aa, Mycobacterium
AASAVRSARAVGEAAGGA

SEQ ID NO: 893263 - protein, 10 aa, Mycobacterium
AASCDTEPAI

SEQ ID NO: 893264 - protein, 41 aa, Mycobacterium
AASDGAWGKGAGKSFAGGVGEGAKGNEGTSAAISSTPGSIT

SEQ ID NO: 893265 - protein, 9 aa, Mycobacterium
AASDPTNAA

SEQ ID NO: 893266 - protein, 16 aa, Mycobacterium
AASDRALAGRPVPSTS

SEQ ID NO: 893267 - protein, 5 aa, Mycobacterium
AASGA

SEQ ID NO: 893268 - protein, 16 aa, Mycobacterium
AASGAPAATPKDRACS

SEQ ID NO: 893269 - protein, 10 aa, Mycobacterium
AASGDEPPPL

SEQ ID NO: 893270 - protein, 17 aa, Mycobacterium
AASGGSDGGAAVGAPAA

SEQ ID NO: 893271 - protein, 5 aa, Mycobacterium
AASGH

SEQ ID NO: 893272 - protein, 7 aa, Mycobacterium
AASGIGA

SEQ ID NO: 893273 - protein, 16 aa, Mycobacterium
AASGIGAASAQALAEA

SEQ ID NO: 893274 - protein, 8 aa, Mycobacterium
AASGIGRA

SEQ ID NO: 893275 - protein, 6 aa, Mycobacterium
AASGLS

SEQ ID NO: 893276 - protein, 5 aa, Mycobacterium
AASGN

SEQ ID NO: 893277 - protein, 4 aa, Mycobacterium
AASK

SEQ ID NO: 893278 - protein, 4 aa, Mycobacterium
AASN

SEQ ID NO: 893279 - protein, 41 aa, Mycobacterium
AASNGAWGKGAGKTFKGGVGEGAKGNDGTSAAIKATEGSIT

SEQ ID NO: 893280 - protein, 41 aa, Mycobacterium
AASNGAWGKGTGQTFNGGVGEGAAGNDGTSQALKRTDGSIT

SEQ ID NO: 893281 - protein, 13 aa, Mycobacterium
AASNQSRPEASAN

SEQ ID NO: 893282 - protein, 18 aa, Mycobacterium
AASNRAGRTEIPDPEATA

SEQ ID NO: 893283 - protein, 17 aa, Mycobacterium
AASNRSGRTRIPDPEAA

SEQ ID NO: 893284 - protein, 18 aa, Mycobacterium
AASNRSGRTRIPDPEAAA

SEQ ID NO: 893285 - protein, 17 aa, Mycobacterium
AASNRSGRTSIPDPEAA

SEQ ID NO: 893286 - protein, 7 aa, Mycobacterium
AASNTAT

SEQ ID NO: 893287 - protein, 12 aa, Mycobacterium
AASPAQNPDKLS

SEQ ID NO: 893288 - protein, 8 aa, Mycobacterium
AASPGSGG

SEQ ID NO: 893289 - protein, 10 aa, Mycobacterium
AASPRSGVNA

SEQ ID NO: 893290 - protein, 18 aa, Mycobacterium
AASPSGVASVSPTPGQTV

SEQ ID NO: 893291 - protein, 14 aa, Mycobacterium
AASPSPPTTAVPSS

SEQ ID NO: 893292 - protein, 111 aa, Mycobacterium
AASPTAAAEDTPSSAASTGTEASGTEASGTEASSSPSSDSESPARQRKPSRSEVETAGEDRDARASERSDGDADDAGADRLRADEGPDDEDPADDERETPEPADEEPATAV

SEQ ID NO: 893293 - protein, 8 aa, Mycobacterium
AASPVDKG

SEQ ID NO: 893294 - protein, 6 aa, Mycobacterium
AASREW

SEQ ID NO: 893295 - protein, 5 aa, Mycobacterium
AASRP

SEQ ID NO: 893296 - protein, 9 aa, Mycobacterium
AASSAATRL

SEQ ID NO: 893297 - protein, 16 aa, Mycobacterium
AASSAPLGSQLPEPAA

SEQ ID NO: 893298 - protein, 15 aa, Mycobacterium
AASSLSACSGSAAGQ

SEQ ID NO: 893299 - protein, 65 aa, Mycobacterium
AASSSAAAASSSTSTTASGVPASTSKSANPLSATTAPAPTSASPAPASSPSSSTPKPVAASTSRR

SEQ ID NO: 893300 - protein, 44 aa, Mycobacterium
AASSTSGSLQPLSTPQQTTNPGGLAAQSAAVSQAAASAAATDGI

SEQ ID NO: 893301 - protein, 5 aa, Mycobacterium
AASSY

SEQ ID NO: 893302 - protein, 5 aa, Mycobacterium
AASTE

SEQ ID NO: 893303 - protein, 7 aa, Mycobacterium
AASTPDE

SEQ ID NO: 893304 - protein, 6 aa, Mycobacterium
AASVPG

SEQ ID NO: 893305 - protein, 22 aa, Mycobacterium
AASVTPRSEATTSDLRRPTPRH

SEQ ID NO: 893306 - protein, 5 aa, Mycobacterium
AASYA

SEQ ID NO: 893307 - protein, 7 aa, Mycobacterium
AASYISG

SEQ ID NO: 893308 - protein, 11 aa, Mycobacterium
AATAAGNPQIT

SEQ ID NO: 893309 - protein, 22 aa, Mycobacterium
AATAAPSLNAAPAASTEGQTRA

SEQ ID NO: 893310 - protein, 11 aa, Mycobacterium
AATADKTAANM

SEQ ID NO: 893311 - protein, 9 aa, Mycobacterium
AATAGADPY

SEQ ID NO: 893312 - protein, 9 aa, Mycobacterium
AATAGGSNA

SEQ ID NO: 893313 - protein, 26 aa, Mycobacterium
AATAGQRRIENDTMHGNQQGDPAKAA

SEQ ID NO: 893314 - protein, 27 aa, Mycobacterium
AATAGQRRKENDTMHGNQAGDPAKAAT

SEQ ID NO: 893315 - protein, 7 aa, Mycobacterium
AATAGTR

SEQ ID NO: 893316 - protein, 31 aa, Mycobacterium
AATAGVPNTDEVQAGRLQDAEAASSAISERC

SEQ ID NO: 893317 - protein, 38 aa, Mycobacterium
AATAPTATTSTAATPAKPSDPDRSPAAPVSPLATPQQL

SEQ ID NO: 893318 - protein, 7 aa, Mycobacterium
AATARDY

SEQ ID NO: 893319 - protein, 7 aa, Mycobacterium
AATATGF

SEQ ID NO: 893320 - protein, 7 aa, Mycobacterium
AATATLG

SEQ ID NO: 893321 - protein, 13 aa, Mycobacterium
AATATPAAPAPPY

SEQ ID NO: 893322 - protein, 25 aa, Mycobacterium
AATDADCPRDADSSYYAKRGFGRKS

SEQ ID NO: 893323 - protein, 5 aa, Mycobacterium
AATDE

SEQ ID NO: 893324 - protein, 8 aa, Mycobacterium
AATDGEWD

SEQ ID NO: 893325 - protein, 9 aa, Mycobacterium
AATDPAQAT

SEQ ID NO: 893326 - protein, 6 aa, Mycobacterium
AATDPE

SEQ ID NO: 893327 - protein, 4 aa, Mycobacterium
AATE

SEQ ID NO: 893328 - protein, 9 aa, Mycobacterium
AATENQRGQ

SEQ ID NO: 893329 - protein, 9 aa, Mycobacterium
AATESQRGQ

SEQ ID NO: 893330 - protein, 9 aa, Mycobacterium
AATESQRGT

SEQ ID NO: 893331 - protein, 7 aa, Mycobacterium
AATEYGR

SEQ ID NO: 893332 - protein, 4 aa, Mycobacterium
AATG

SEQ ID NO: 893333 - protein, 8 aa, Mycobacterium
AATGAGAA

SEQ ID NO: 893334 - protein, 8 aa, Mycobacterium
AATGDSPV

SEQ ID NO: 893335 - protein, 5 aa, Mycobacterium
AATGE

SEQ ID NO: 893336 - protein, 11 aa, Mycobacterium
AATGEDVNTPL

SEQ ID NO: 893337 - protein, 12 aa, Mycobacterium
AATGPDAPVGPA

SEQ ID NO: 893338 - protein, 6 aa, Mycobacterium
AATGPG

SEQ ID NO: 893339 - protein, 8 aa, Mycobacterium
AATGQRRE

SEQ ID NO: 893340 - protein, 7 aa, Mycobacterium
AATGRDV

SEQ ID NO: 893341 - protein, 8 aa, Mycobacterium
AATGSAAA

SEQ ID NO: 893342 - protein, 11 aa, Mycobacterium
AATGSAAPLGR

SEQ ID NO: 893343 - protein, 6 aa, Mycobacterium
AATGTS

SEQ ID NO: 893344 - protein, 4 aa, Mycobacterium
AATI

SEQ ID NO: 893345 - protein, 18 aa, Mycobacterium
AATKPVRYGTTGVGTGAQ

SEQ ID NO: 893346 - protein, 5 aa, Mycobacterium
AATLH

SEQ ID NO: 893347 - protein, 6 aa, Mycobacterium
AATMSP

SEQ ID NO: 893348 - protein, 9 aa, Mycobacterium
AATPAGDAV

SEQ ID NO: 893349 - protein, 8 aa, Mycobacterium
AATPFPNR

SEQ ID NO: 893350 - protein, 19 aa, Mycobacterium
AATPGAWAEPGAPTGPGDP

SEQ ID NO: 893351 - protein, 11 aa, Mycobacterium
AATPKRRPVTA

SEQ ID NO: 893352 - protein, 15 aa, Mycobacterium
AATPNPELGDITPAD

SEQ ID NO: 893353 - protein, 9 aa, Mycobacterium
AATPNSQPR

SEQ ID NO: 893354 - protein, 7 aa, Mycobacterium
AATPPAV

SEQ ID NO: 893355 - protein, 13 aa, Mycobacterium
AATPSAAAATPAA

SEQ ID NO: 893356 - protein, 7 aa, Mycobacterium
AATPTTI

SEQ ID NO: 893357 - protein, 7 aa, Mycobacterium
AATRAGA

SEQ ID NO: 893358 - protein, 6 aa, Mycobacterium
AATRKT

SEQ ID NO: 893359 - protein, 15 aa, Mycobacterium
AATRSSGQASSGYGR

SEQ ID NO: 893360 - protein, 9 aa, Mycobacterium
AATSPGPGK

SEQ ID NO: 893361 - protein, 10 aa, Mycobacterium
AATSRGPSVR

SEQ ID NO: 893362 - protein, 23 aa, Mycobacterium
AATSSEDGDAPLTAGDGATYPEW

SEQ ID NO: 893363 - protein, 6 aa, Mycobacterium
AATSTG

SEQ ID NO: 893364 - protein, 6 aa, Mycobacterium
AATTIS

SEQ ID NO: 893365 - protein, 13 aa, Mycobacterium
AATTTSATVTTHA

SEQ ID NO: 893366 - protein, 22 aa, Mycobacterium
AATTTSPGIPDISARQSAAARY

SEQ ID NO: 893367 - protein, 6 aa, Mycobacterium
AATTVS

SEQ ID NO: 893368 - protein, 7 aa, Mycobacterium
AATTWSE

SEQ ID NO: 893369 - protein, 7 aa, Mycobacterium
AATVPGI

SEQ ID NO: 893370 - protein, 4 aa, Mycobacterium
AAVA

SEQ ID NO: 893371 - protein, 23 aa, Mycobacterium
AAVAGRTGAAPTPAVTASASVAS

SEQ ID NO: 893372 - protein, 21 aa, Mycobacterium
AAVAPAAAPAVPSMLSPLAAL

SEQ ID NO: 893373 - protein, 15 aa, Mycobacterium
AAVASTPQTSPAPQI

SEQ ID NO: 893374 - protein, 5 aa, Mycobacterium
AAVAT

SEQ ID NO: 893375 - protein, 5 aa, Mycobacterium
AAVDA

SEQ ID NO: 893376 - protein, 9 aa, Mycobacterium
AAVDNPATV

SEQ ID NO: 893377 - protein, 19 aa, Mycobacterium
AAVDPDKLADPRSPLGELL

SEQ ID NO: 893378 - protein, 6 aa, Mycobacterium
AAVDPG

SEQ ID NO: 893379 - protein, 5 aa, Mycobacterium
AAVEP

SEQ ID NO: 893380 - protein, 5 aa, Mycobacterium
AAVER

SEQ ID NO: 893381 - protein, 9 aa, Mycobacterium
AAVGAGGGA

SEQ ID NO: 893382 - protein, 9 aa, Mycobacterium
AAVGSAAGV

SEQ ID NO: 893383 - protein, 95 aa, Mycobacterium
AAVPAGTTAAAGPAGTTGRTGDGGIRTRSSRHAVTTGAAGAARPNAPAIAAGPTSAAGTTGHGRGGTSPSSPAITADAAGSGAVITGGGAASGMG

SEQ ID NO: 893384 - protein, 5 aa, Mycobacterium
AAVPG

SEQ ID NO: 893385 - protein, 12 aa, Mycobacterium
AAVPSGAGPTAV

SEQ ID NO: 893386 - protein, 24 aa, Mycobacterium
AAVQEEDEEPPAEVKQPPAPAPPW

SEQ ID NO: 893387 - protein, 7 aa, Mycobacterium
AAVSAGN

SEQ ID NO: 893388 - protein, 13 aa, Mycobacterium
AAVTSPSGKPLPK

SEQ ID NO: 893389 - protein, 11 aa, Mycobacterium
AAWKRNDPTVN

SEQ ID NO: 893390 - protein, 6 aa, Mycobacterium
AAWTPS

SEQ ID NO: 893391 - protein, 14 aa, Mycobacterium
AAYAASKAGLSSLG

SEQ ID NO: 893392 - protein, 6 aa, Mycobacterium
AAYAEP

SEQ ID NO: 893393 - protein, 16 aa, Mycobacterium
AAYATYTSGTTGPPKA

SEQ ID NO: 893394 - protein, 12 aa, Mycobacterium
AAYNPGSAGMAI

SEQ ID NO: 893395 - protein, 7 aa, Mycobacterium
AAYPRSL

SEQ ID NO: 893396 - protein, 10 aa, Mycobacterium
AAYSAGSAAL

SEQ ID NO: 893397 - protein, 23 aa, Mycobacterium
ACADESAGPTSDTSTLSISATGV

SEQ ID NO: 893398 - protein, 5 aa, Mycobacterium
ACAPG

SEQ ID NO: 893399 - protein, 14 aa, Mycobacterium
ACARSGPPGGKADY

SEQ ID NO: 893400 - protein, 6 aa, Mycobacterium
ACASGT

SEQ ID NO: 893401 - protein, 7 aa, Mycobacterium
ACASSTE

SEQ ID NO: 893402 - protein, 16 aa, Mycobacterium
ACDEPSPSHPGANPRQ

SEQ ID NO: 893403 - protein, 14 aa, Mycobacterium
ACDGAARQSISGGR

SEQ ID NO: 893404 - protein, 11 aa, Mycobacterium
ACGAGSDCGRC

SEQ ID NO: 893405 - protein, 4 aa, Mycobacterium
ACGE

SEQ ID NO: 893406 - protein, 12 aa, Mycobacterium
ACGESPPKPPAV

SEQ ID NO: 893407 - protein, 6 aa, Mycobacterium
ACGGDV

SEQ ID NO: 893408 - protein, 13 aa, Mycobacterium
ACGGGDSGGDSDT

SEQ ID NO: 893409 - protein, 15 aa, Mycobacterium
ACGGTGGGNGPNSVT

SEQ ID NO: 893410 - protein, 4 aa, Mycobacterium
ACGK

SEQ ID NO: 893411 - protein, 17 aa, Mycobacterium
ACGPGESPAPPSPAALP

SEQ ID NO: 893412 - protein, 10 aa, Mycobacterium
ACGPKTPDYQ

SEQ ID NO: 893413 - protein, 12 aa, Mycobacterium
ACGSEKPAESAL

SEQ ID NO: 893414 - protein, 19 aa, Mycobacterium
ACGSGKAPGSEGGSAPDGA

SEQ ID NO: 893415 - protein, 5 aa, Mycobacterium
ACGSH

SEQ ID NO: 893416 - protein, 11 aa, Mycobacterium
ACGSKDGGCKT

SEQ ID NO: 893417 - protein, 7 aa, Mycobacterium
ACGSPGG

SEQ ID NO: 893418 - protein, 11 aa, Mycobacterium
ACGSTPPPPEL

SEQ ID NO: 893419 - protein, 11 aa, Mycobacterium
ACHNGEEEDTY

SEQ ID NO: 893420 - protein, 8 aa, Mycobacterium
ACNQATDN

SEQ ID NO: 893421 - protein, 5 aa, Mycobacterium
ACPGQ

SEQ ID NO: 893422 - protein, 6 aa, Mycobacterium
ACPGQS

SEQ ID NO: 893423 - protein, 15 aa, Mycobacterium
ACQDPGVGAPTSLPV

SEQ ID NO: 893424 - protein, 21 aa, Mycobacterium
ACQGGPSDVPGGGRGGDADTT

SEQ ID NO: 893425 - protein, 19 aa, Mycobacterium
ACQGPGTGPAKTTSEDTMQ

SEQ ID NO: 893426 - protein, 17 aa, Mycobacterium
ACSARTPSSDASGGKSV

SEQ ID NO: 893427 - protein, 16 aa, Mycobacterium
ACSDGDPICSDGRNPF

SEQ ID NO: 893428 - protein, 19 aa, Mycobacterium
ACSNGASVDPTRPRTEFPP

SEQ ID NO: 893429 - protein, 16 aa, Mycobacterium
ACSSSKPQAGTADTGA

SEQ ID NO: 893430 - protein, 29 aa, Mycobacterium
ACSSTKNSAPQSTNSPATSSVSSQPRTVS

SEQ ID NO: 893431 - protein, 6 aa, Mycobacterium
ACSTNG

SEQ ID NO: 893432 - protein, 20 aa, Mycobacterium
ACTGGAPRVGGACTQPGTDL

SEQ ID NO: 893433 - protein, 5 aa, Mycobacterium
ACTSN

SEQ ID NO: 893434 - protein, 4 aa, Mycobacterium
ADAA

SEQ ID NO: 893435 - protein, 5 aa, Mycobacterium
ADAAA

SEQ ID NO: 893436 - protein, 7 aa, Mycobacterium
ADAAARV

SEQ ID NO: 893437 - protein, 9 aa, Mycobacterium
ADAADGPLR

SEQ ID NO: 893438 - protein, 6 aa, Mycobacterium
ADAADL

SEQ ID NO: 893439 - protein, 8 aa, Mycobacterium
ADAAEAGV

SEQ ID NO: 893440 - protein, 7 aa, Mycobacterium
ADAAEDI

SEQ ID NO: 893441 - protein, 7 aa, Mycobacterium
ADAAEMA

SEQ ID NO: 893442 - protein, 6 aa, Mycobacterium
ADAAGK

SEQ ID NO: 893443 - protein, 6 aa, Mycobacterium
ADAAGV

SEQ ID NO: 893444 - protein, 18 aa, Mycobacterium
ADAAHAAAQSALQAATTM

SEQ ID NO: 893445 - protein, 7 aa, Mycobacterium
ADAAPDL

SEQ ID NO: 893446 - protein, 9 aa, Mycobacterium
ADAARQAVR

SEQ ID NO: 893447 - protein, 9 aa, Mycobacterium
ADAARSQGA

SEQ ID NO: 893448 - protein, 10 aa, Mycobacterium
ADAASASQGA

SEQ ID NO: 893449 - protein, 9 aa, Mycobacterium
ADAASPYEH

SEQ ID NO: 893450 - protein, 10 aa, Mycobacterium
ADAATGTMYG

SEQ ID NO: 893451 - protein, 7 aa, Mycobacterium
ADAAVSA

SEQ ID NO: 893452 - protein, 7 aa, Mycobacterium
ADADAAI

SEQ ID NO: 893453 - protein, 5 aa, Mycobacterium
ADADQ

SEQ ID NO: 893454 - protein, 9 aa, Mycobacterium
ADAEGTAGD

SEQ ID NO: 893455 - protein, 13 aa, Mycobacterium
ADAENDDEHGSAL

SEQ ID NO: 893456 - protein, 17 aa, Mycobacterium
ADAGGPGDPVPGELDDS

SEQ ID NO: 893457 - protein, 8 aa, Mycobacterium
ADAGHPNI

SEQ ID NO: 893458 - protein, 7 aa, Mycobacterium
ADAGHQD

SEQ ID NO: 893459 - protein, 6 aa, Mycobacterium
ADAGNS

SEQ ID NO: 893460 - protein, 8 aa, Mycobacterium
ADAGPALT

SEQ ID NO: 893461 - protein, 7 aa, Mycobacterium
ADAGPLT

SEQ ID NO: 893462 - protein, 4 aa, Mycobacterium
ADAM

SEQ ID NO: 893463 - protein, 15 aa, Mycobacterium
ADANGVKTMRPKEAG

SEQ ID NO: 893464 - protein, 17 aa, Mycobacterium
ADANKGNRADGTPGYDA

SEQ ID NO: 893465 - protein, 17 aa, Mycobacterium
ADANNGTRAVGTPGYEA

SEQ ID NO: 893466 - protein, 7 aa, Mycobacterium
ADAPATD

SEQ ID NO: 893467 - protein, 7 aa, Mycobacterium
ADAPDVP

SEQ ID NO: 893468 - protein, 13 aa, Mycobacterium
ADAPLPPTTAEGQ

SEQ ID NO: 893469 - protein, 7 aa, Mycobacterium
ADAPNMN

SEQ ID NO: 893470 - protein, 11 aa, Mycobacterium
ADAPPGTNQTF

SEQ ID NO: 893471 - protein, 16 aa, Mycobacterium
ADAPPPADGPPPDNGV

SEQ ID NO: 893472 - protein, 7 aa, Mycobacterium
ADAPTPL

SEQ ID NO: 893473 - protein, 15 aa, Mycobacterium
ADAPTVAPGSVRGPA

SEQ ID NO: 893474 - protein, 13 aa, Mycobacterium
ADAPVPASAIEGQ

SEQ ID NO: 893475 - protein, 4 aa, Mycobacterium
ADAQ

SEQ ID NO: 893476 - protein, 9 aa, Mycobacterium
ADAQNRAGR

SEQ ID NO: 893477 - protein, 13 aa, Mycobacterium
ADAQSAGGRTVCT

SEQ ID NO: 893478 - protein, 15 aa, Mycobacterium
ADAQTPAGGVSASVD

SEQ ID NO: 893479 - protein, 11 aa, Mycobacterium
ADARPAQVAGN

SEQ ID NO: 893480 - protein, 23 aa, Mycobacterium
ADASALGYAEADPTADVEGYDAA

SEQ ID NO: 893481 - protein, 7 aa, Mycobacterium
ADATARD

SEQ ID NO: 893482 - protein, 6 aa, Mycobacterium
ADATEA

SEQ ID NO: 893483 - protein, 10 aa, Mycobacterium
ADATESQRAI

SEQ ID NO: 893484 - protein, 12 aa, Mycobacterium
ADATGAALAAGA

SEQ ID NO: 893485 - protein, 7 aa, Mycobacterium
ADATPDR

SEQ ID NO: 893486 - protein, 11 aa, Mycobacterium
ADATQTVATPT

SEQ ID NO: 893487 - protein, 7 aa, Mycobacterium
ADATTAA

SEQ ID NO: 893488 - protein, 8 aa, Mycobacterium
ADATTGTI

SEQ ID NO: 893489 - protein, 10 aa, Mycobacterium
ADAVGKAAPV

SEQ ID NO: 893490 - protein, 5 aa, Mycobacterium
ADAYA

SEQ ID NO: 893491 - protein, 5 aa, Mycobacterium
ADDAE

SEQ ID NO: 893492 - protein, 9 aa, Mycobacterium
ADDAGHCAQ

SEQ ID NO: 893493 - protein, 7 aa, Mycobacterium
ADDAQGA

SEQ ID NO: 893494 - protein, 7 aa, Mycobacterium
ADDARAD

SEQ ID NO: 893495 - protein, 8 aa, Mycobacterium
ADDATKQV

SEQ ID NO: 893496 - protein, 9 aa, Mycobacterium
ADDATKTMT

SEQ ID NO: 893497 - protein, 10 aa, Mycobacterium
ADDDDEPYYP

SEQ ID NO: 893498 - protein, 5 aa, Mycobacterium
ADDDL

SEQ ID NO: 893499 - protein, 15 aa, Mycobacterium
ADDDSLDAFGSNPLD

SEQ ID NO: 893500 - protein, 7 aa, Mycobacterium
ADDEEFA

SEQ ID NO: 893501 - protein, 11 aa, Mycobacterium
ADDEHATADAI

SEQ ID NO: 893502 - protein, 21 aa, Mycobacterium
ADDEHATADAVGKNLGAPVEP

SEQ ID NO: 893503 - protein, 16 aa, Mycobacterium
ADDENDPLFLPTEGAQ

SEQ ID NO: 893504 - protein, 5 aa, Mycobacterium
ADDEV

SEQ ID NO: 893505 - protein, 7 aa, Mycobacterium
ADDEVTT

SEQ ID NO: 893506 - protein, 7 aa, Mycobacterium
ADDFDSA

SEQ ID NO: 893507 - protein, 4 aa, Mycobacterium
ADDG

SEQ ID NO: 893508 - protein, 5 aa, Mycobacterium
ADDGT

SEQ ID NO: 893509 - protein, 6 aa, Mycobacterium
ADDLAA

SEQ ID NO: 893510 - protein, 5 aa, Mycobacterium
ADDNR

SEQ ID NO: 893511 - protein, 5 aa, Mycobacterium
ADDPA

SEQ ID NO: 893512 - protein, 8 aa, Mycobacterium
ADDPGTGV

SEQ ID NO: 893513 - protein, 6 aa, Mycobacterium
ADDPQR

SEQ ID NO: 893514 - protein, 32 aa, Mycobacterium
ADDPQVPGPPIPGIAPDGTVKAAPSAPDRTAY

SEQ ID NO: 893515 - protein, 6 aa, Mycobacterium
ADDQPG

SEQ ID NO: 893516 - protein, 5 aa, Mycobacterium
ADDQV

SEQ ID NO: 893517 - protein, 7 aa, Mycobacterium
ADDRDGF

SEQ ID NO: 893518 - protein, 5 aa, Mycobacterium
ADDRQ

SEQ ID NO: 893519 - protein, 12 aa, Mycobacterium
ADDSGITGYGRY

SEQ ID NO: 893520 - protein, 11 aa, Mycobacterium
ADDSHSSAAGM

SEQ ID NO: 893521 - protein, 5 aa, Mycobacterium
ADDST

SEQ ID NO: 893522 - protein, 4 aa, Mycobacterium
ADDV

SEQ ID NO: 893523 - protein, 5 aa, Mycobacterium
ADDVY

SEQ ID NO: 893524 - protein, 5 aa, Mycobacterium
ADEAA

SEQ ID NO: 893525 - protein, 8 aa, Mycobacterium
ADEDQGAV

SEQ ID NO: 893526 - protein, 7 aa, Mycobacterium
ADEDVSR

SEQ ID NO: 893527 - protein, 121 aa, Mycobacterium
ADEGAGSNGSVSSSSRESTSGATGTSDRESSSSPSKPAATRPSDSDDTETSGPDGDEPNADGSEPTEEDTEPSSTPATSPEPPADPVVEDTTDEALADPDPAESLAPSTLHPESGSTPEPV

SEQ ID NO: 893528 - protein, 5 aa, Mycobacterium
ADEGL

SEQ ID NO: 893529 - protein, 5 aa, Mycobacterium
ADEIS

SEQ ID NO: 893530 - protein, 12 aa, Mycobacterium
ADEKDWYGRALL

SEQ ID NO: 893531 - protein, 5 aa, Mycobacterium
ADELS

SEQ ID NO: 893532 - protein, 23 aa, Mycobacterium
ADEPATESDRQATRRAGRPPNLV

SEQ ID NO: 893533 - protein, 4 aa, Mycobacterium
ADEQ

SEQ ID NO: 893534 - protein, 6 aa, Mycobacterium
ADERLR

SEQ ID NO: 893535 - protein, 15 aa, Mycobacterium
ADESEQSLPQGDDTA

SEQ ID NO: 893536 - protein, 6 aa, Mycobacterium
ADESIS

SEQ ID NO: 893537 - protein, 10 aa, Mycobacterium
ADESPETAQA

SEQ ID NO: 893538 - protein, 7 aa, Mycobacterium
ADESVTR

SEQ ID NO: 893539 - protein, 8 aa, Mycobacterium
ADETDTDV

SEQ ID NO: 893540 - protein, 9 aa, Mycobacterium
ADEVGGTWR

SEQ ID NO: 893541 - protein, 6 aa, Mycobacterium
ADEVSA

SEQ ID NO: 893542 - protein, 9 aa, Mycobacterium
ADEWSGGAY

SEQ ID NO: 893543 - protein, 16 aa, Mycobacterium
ADFAATGEGREHGPNA

SEQ ID NO: 893544 - protein, 14 aa, Mycobacterium
ADFPAGPQRLDGPE

SEQ ID NO: 893545 - protein, 14 aa, Mycobacterium
ADFPAGPQRLSGPE

SEQ ID NO: 893546 - protein, 14 aa, Mycobacterium
ADFPAGRQKLNGPQ

SEQ ID NO: 893547 - protein, 14 aa, Mycobacterium
ADFPAGRQKLTGPQ

SEQ ID NO: 893548 - protein, 8 aa, Mycobacterium
ADFPGKHA

SEQ ID NO: 893549 - protein, 24 aa, Mycobacterium
ADFPGPGETRAPDIASDDGSGLGM

SEQ ID NO: 893550 - protein, 4 aa, Mycobacterium
ADFS

SEQ ID NO: 893551 - protein, 8 aa, Mycobacterium
ADFTGTDT

SEQ ID NO: 893552 - protein, 16 aa, Mycobacterium
ADGAAGGRGGNGGTGG

SEQ ID NO: 893553 - protein, 20 aa, Mycobacterium
ADGAAPQSYRPTVAGDLVTV

SEQ ID NO: 893554 - protein, 11 aa, Mycobacterium
ADGANDASDHV

SEQ ID NO: 893555 - protein, 10 aa, Mycobacterium
ADGANDASGH

SEQ ID NO: 893556 - protein, 11 aa, Mycobacterium
ADGANDATNRI

SEQ ID NO: 893557 - protein, 11 aa, Mycobacterium
ADGAPVSTGSG

SEQ ID NO: 893558 - protein, 19 aa, Mycobacterium
ADGAPVTKAQLGDPAAFTG

SEQ ID NO: 893559 - protein, 8 aa, Mycobacterium
ADGAQAYK

SEQ ID NO: 893560 - protein, 19 aa, Mycobacterium
ADGAQLNPTALGDPAAFTG

SEQ ID NO: 893561 - protein, 5 aa, Mycobacterium
ADGAT

SEQ ID NO: 893562 - protein, 12 aa, Mycobacterium
ADGATRLDERGA

SEQ ID NO: 893563 - protein, 15 aa, Mycobacterium
ADGAVSTLSSDTAVG

SEQ ID NO: 893564 - protein, 10 aa, Mycobacterium
ADGCRGDPAV

SEQ ID NO: 893565 - protein, 7 aa, Mycobacterium
ADGDATD

SEQ ID NO: 893566 - protein, 7 aa, Mycobacterium
ADGDAVQ

SEQ ID NO: 893567 - protein, 6 aa, Mycobacterium
ADGDPD

SEQ ID NO: 893568 - protein, 4 aa, Mycobacterium
ADGE

SEQ ID NO: 893569 - protein, 10 aa, Mycobacterium
ADGEATAAAL

SEQ ID NO: 893570 - protein, 9 aa, Mycobacterium
ADGEKPRVA

SEQ ID NO: 893571 - protein, 7 aa, Mycobacterium
ADGERDN

SEQ ID NO: 893572 - protein, 8 aa, Mycobacterium
ADGGGGSI

SEQ ID NO: 893573 - protein, 10 aa, Mycobacterium
ADGGPASGRG

SEQ ID NO: 893574 - protein, 10 aa, Mycobacterium
ADGGPATGRG

SEQ ID NO: 893575 - protein, 10 aa, Mycobacterium
ADGGPPSGRG

SEQ ID NO: 893576 - protein, 10 aa, Mycobacterium
ADGGPPSGSG

SEQ ID NO: 893577 - protein, 9 aa, Mycobacterium
ADGGPPTGR

SEQ ID NO: 893578 - protein, 7 aa, Mycobacterium
ADGHPGE

SEQ ID NO: 893579 - protein, 14 aa, Mycobacterium
ADGHRGDAPGFEPG

SEQ ID NO: 893580 - protein, 4 aa, Mycobacterium
ADGI

SEQ ID NO: 893581 - protein, 5 aa, Mycobacterium
ADGIG

SEQ ID NO: 893582 - protein, 7 aa, Mycobacterium
ADGINST

SEQ ID NO: 893583 - protein, 7 aa, Mycobacterium
ADGKGPF

SEQ ID NO: 893584 - protein, 5 aa, Mycobacterium
ADGKP

SEQ ID NO: 893585 - protein, 17 aa, Mycobacterium
ADGKPEVTTLSSPKPHH

SEQ ID NO: 893586 - protein, 9 aa, Mycobacterium
ADGKPVGSR

SEQ ID NO: 893587 - protein, 8 aa, Mycobacterium
ADGKPVTK

SEQ ID NO: 893588 - protein, 8 aa, Mycobacterium
ADGKSSTF

SEQ ID NO: 893589 - protein, 11 aa, Mycobacterium
ADGKTALERGD

SEQ ID NO: 893590 - protein, 5 aa, Mycobacterium
ADGKV

SEQ ID NO: 893591 - protein, 5 aa, Mycobacterium
ADGLG

SEQ ID NO: 893592 - protein, 7 aa, Mycobacterium
ADGMPGV

SEQ ID NO: 893593 - protein, 14 aa, Mycobacterium
ADGNRGDSKGFGAG

SEQ ID NO: 893594 - protein, 7 aa, Mycobacterium
ADGNVWG

SEQ ID NO: 893595 - protein, 6 aa, Mycobacterium
ADGPDA

SEQ ID NO: 893596 - protein, 8 aa, Mycobacterium
ADGPDFNN

SEQ ID NO: 893597 - protein, 8 aa, Mycobacterium
ADGPHSGV

SEQ ID NO: 893598 - protein, 8 aa, Mycobacterium
ADGPKFNN

SEQ ID NO: 893599 - protein, 8 aa, Mycobacterium
ADGPKINN

SEQ ID NO: 893600 - protein, 10 aa, Mycobacterium
ADGPKPNNAY

SEQ ID NO: 893601 - protein, 10 aa, Mycobacterium
ADGPQSNNAY

SEQ ID NO: 893602 - protein, 11 aa, Mycobacterium
ADGPRVRAGTR

SEQ ID NO: 893603 - protein, 8 aa, Mycobacterium
ADGPSFNN

SEQ ID NO: 893604 - protein, 8 aa, Mycobacterium
ADGPTAYR

SEQ ID NO: 893605 - protein, 6 aa, Mycobacterium
ADGPVL

SEQ ID NO: 893606 - protein, 15 aa, Mycobacterium
ADGPVPETQKRNDGG

SEQ ID NO: 893607 - protein, 8 aa, Mycobacterium
ADGPVTAA

SEQ ID NO: 893608 - protein, 4 aa, Mycobacterium
ADGQ

SEQ ID NO: 893609 - protein, 7 aa, Mycobacterium
ADGQSLT

SEQ ID NO: 893610 - protein, 6 aa, Mycobacterium
ADGQYE

SEQ ID NO: 893611 - protein, 7 aa, Mycobacterium
ADGRAKL

SEQ ID NO: 893612 - protein, 6 aa, Mycobacterium
ADGRGV

SEQ ID NO: 893613 - protein, 5 aa, Mycobacterium
ADGRT

SEQ ID NO: 893614 - protein, 8 aa, Mycobacterium
ADGRTVKQ

SEQ ID NO: 893615 - protein, 6 aa, Mycobacterium
ADGRVD

SEQ ID NO: 893616 - protein, 6 aa, Mycobacterium
ADGSGN

SEQ ID NO: 893617 - protein, 10 aa, Mycobacterium
ADGSPGARKD

SEQ ID NO: 893618 - protein, 10 aa, Mycobacterium
ADGSPTPAAA

SEQ ID NO: 893619 - protein, 10 aa, Mycobacterium
ADGSSVTPVD

SEQ ID NO: 893620 - protein, 5 aa, Mycobacterium
ADGSY

SEQ ID NO: 893621 - protein, 8 aa, Mycobacterium
ADGTEDQL

SEQ ID NO: 893622 - protein, 13 aa, Mycobacterium
ADGTESALEHGSK

SEQ ID NO: 893623 - protein, 7 aa, Mycobacterium
ADGTGSW

SEQ ID NO: 893624 - protein, 18 aa, Mycobacterium
ADGTPLTKAQLGDPAAFT

SEQ ID NO: 893625 - protein, 7 aa, Mycobacterium
ADGTPVT

SEQ ID NO: 893626 - protein, 8 aa, Mycobacterium
ADGTSRDV

SEQ ID NO: 893627 - protein, 42 aa, Mycobacterium
ADGVEKAVKDTKQAVKKATAKPTKKTQAGSQNNDNDKKDKDA

SEQ ID NO: 893628 - protein, 6 aa, Mycobacterium
ADGYQL

SEQ ID NO: 893629 - protein, 29 aa, Mycobacterium
ADHPTGRLGDGNCQSIPESRTGRAPTTEE

SEQ ID NO: 893630 - protein, 7 aa, Mycobacterium
ADHRPPA

SEQ ID NO: 893631 - protein, 6 aa, Mycobacterium
ADHSPD

SEQ ID NO: 893632 - protein, 4 aa, Mycobacterium
ADIA

SEQ ID NO: 893633 - protein, 6 aa, Mycobacterium
ADIDPR

SEQ ID NO: 893634 - protein, 7 aa, Mycobacterium
ADIPRGG

SEQ ID NO: 893635 - protein, 4 aa, Mycobacterium
ADIT

SEQ ID NO: 893636 - protein, 11 aa, Mycobacterium
ADITPEEAKAA

SEQ ID NO: 893637 - protein, 10 aa, Mycobacterium
ADKAAEEAPD

SEQ ID NO: 893638 - protein, 11 aa, Mycobacterium
ADKAQLAGSAS

SEQ ID NO: 893639 - protein, 17 aa, Mycobacterium
ADKNNNTRAAGTAGFDQ

SEQ ID NO: 893640 - protein, 7 aa, Mycobacterium
ADKPDSH

SEQ ID NO: 893641 - protein, 15 aa, Mycobacterium
ADKPDSIGGSPFTDD

SEQ ID NO: 893642 - protein, 15 aa, Mycobacterium
ADKPDSIGTSPFTEQ

SEQ ID NO: 893643 - protein, 10 aa, Mycobacterium
ADKPEGPWSR

SEQ ID NO: 893644 - protein, 19 aa, Mycobacterium
ADKPESEAHSSVSTTSDPA

SEQ ID NO: 893645 - protein, 9 aa, Mycobacterium
ADKVESVQT

SEQ ID NO: 893646 - protein, 4 aa, Mycobacterium
ADLA

SEQ ID NO: 893647 - protein, 10 aa, Mycobacterium
ADLADPGERA

SEQ ID NO: 893648 - protein, 11 aa, Mycobacterium
ADLAGVGSSVR

SEQ ID NO: 893649 - protein, 9 aa, Mycobacterium
ADLATREEQ

SEQ ID NO: 893650 - protein, 7 aa, Mycobacterium
ADLGEYQ

SEQ ID NO: 893651 - protein, 6 aa, Mycobacterium
ADLPAD

SEQ ID NO: 893652 - protein, 7 aa, Mycobacterium
ADLPATK

SEQ ID NO: 893653 - protein, 10 aa, Mycobacterium
ADLPATKAYR

SEQ ID NO: 893654 - protein, 24 aa, Mycobacterium
ADLPDGAQPQPYEPGDKTAPQGVY

SEQ ID NO: 893655 - protein, 11 aa, Mycobacterium
ADLQSKQSQLQ

SEQ ID NO: 893656 - protein, 7 aa, Mycobacterium
ADLSSPA

SEQ ID NO: 893657 - protein, 15 aa, Mycobacterium
ADLTAKKKSAEAQLA

SEQ ID NO: 893658 - protein, 20 aa, Mycobacterium
ADLTGTSARVRAKKDDGSWG

SEQ ID NO: 893659 - protein, 5 aa, Mycobacterium
ADNAE

SEQ ID NO: 893660 - protein, 9 aa, Mycobacterium
ADNANPDPV

SEQ ID NO: 893661 - protein, 8 aa, Mycobacterium
ADNGDENA

SEQ ID NO: 893662 - protein, 8 aa, Mycobacterium
ADNGPPLT

SEQ ID NO: 893663 - protein, 11 aa, Mycobacterium
ADNLRGEGANI

SEQ ID NO: 893664 - protein, 12 aa, Mycobacterium
ADNLRGQGPTIR

SEQ ID NO: 893665 - protein, 12 aa, Mycobacterium
ADNLRGQGTDIR

SEQ ID NO: 893666 - protein, 4 aa, Mycobacterium
ADNP

SEQ ID NO: 893667 - protein, 5 aa, Mycobacterium
ADNPD

SEQ ID NO: 893668 - protein, 7 aa, Mycobacterium
ADNPFTA

SEQ ID NO: 893669 - protein, 6 aa, Mycobacterium
ADNPGQ

SEQ ID NO: 893670 - protein, 7 aa, Mycobacterium
ADNPLTE

SEQ ID NO: 893671 - protein, 10 aa, Mycobacterium
ADNPPLRAST

SEQ ID NO: 893672 - protein, 13 aa, Mycobacterium
ADNSPETNVGGEH

SEQ ID NO: 893673 - protein, 28 aa, Mycobacterium
ADNYGPTVLPPTEPRYVEGGPGSKVPSI

SEQ ID NO: 893674 - protein, 9 aa, Mycobacterium
ADPAAETAP

SEQ ID NO: 893675 - protein, 7 aa, Mycobacterium
ADPAALT

SEQ ID NO: 893676 - protein, 7 aa, Mycobacterium
ADPAGHQ

SEQ ID NO: 893677 - protein, 8 aa, Mycobacterium
ADPAGPRI

SEQ ID NO: 893678 - protein, 6 aa, Mycobacterium
ADPAGV

SEQ ID NO: 893679 - protein, 8 aa, Mycobacterium
ADPAITPA

SEQ ID NO: 893680 - protein, 7 aa, Mycobacterium
ADPAITT

SEQ ID NO: 893681 - protein, 8 aa, Mycobacterium
ADPAKDEA

SEQ ID NO: 893682 - protein, 7 aa, Mycobacterium
ADPAKVT

SEQ ID NO: 893683 - protein, 18 aa, Mycobacterium
ADPAKVTIGGGSNPGGPD

SEQ ID NO: 893684 - protein, 7 aa, Mycobacterium
ADPALPD

SEQ ID NO: 893685 - protein, 8 aa, Mycobacterium
ADPALSAA

SEQ ID NO: 893686 - protein, 14 aa, Mycobacterium
ADPAPAPAPAPNIP

SEQ ID NO: 893687 - protein, 13 aa, Mycobacterium
ADPAPVPDPVSNI

SEQ ID NO: 893688 - protein, 6 aa, Mycobacterium
ADPAQC

SEQ ID NO: 893689 - protein, 9 aa, Mycobacterium
ADPAQQAAT

SEQ ID NO: 893690 - protein, 8 aa, Mycobacterium
ADPARDAR

SEQ ID NO: 893691 - protein, 8 aa, Mycobacterium
ADPASDAL

SEQ ID NO: 893692 - protein, 25 aa, Mycobacterium
ADPAVTARRGATAEVDARSYARPDP

SEQ ID NO: 893693 - protein, 7 aa, Mycobacterium
ADPAYTE

SEQ ID NO: 893694 - protein, 9 aa, Mycobacterium
ADPCAPGAA

SEQ ID NO: 893695 - protein, 7 aa, Mycobacterium
ADPDADP

SEQ ID NO: 893696 - protein, 8 aa, Mycobacterium
ADPDANAA

SEQ ID NO: 893697 - protein, 10 aa, Mycobacterium
ADPDIPGLAR

SEQ ID NO: 893698 - protein, 22 aa, Mycobacterium
ADPDISADPNPYPDVNNATKFR

SEQ ID NO: 893699 - protein, 5 aa, Mycobacterium
ADPDT

SEQ ID NO: 893700 - protein, 6 aa, Mycobacterium
ADPDTV

SEQ ID NO: 893701 - protein, 14 aa, Mycobacterium
ADPDVAASQATAQS

SEQ ID NO: 893702 - protein, 5 aa, Mycobacterium
ADPEP

SEQ ID NO: 893703 - protein, 11 aa, Mycobacterium
ADPEPPPDARA

SEQ ID NO: 893704 - protein, 6 aa, Mycobacterium
ADPESI

SEQ ID NO: 893705 - protein, 4 aa, Mycobacterium
ADPF

SEQ ID NO: 893706 - protein, 12 aa, Mycobacterium
ADPGDDPTKGPK

SEQ ID NO: 893707 - protein, 12 aa, Mycobacterium
ADPGDPPAPVQP

SEQ ID NO: 893708 - protein, 17 aa, Mycobacterium
ADPGGSGGGDAGGGGGC

SEQ ID NO: 893709 - protein, 22 aa, Mycobacterium
ADPGHGRDQSAQGVSGSGEGGI

SEQ ID NO: 893710 - protein, 6 aa, Mycobacterium
ADPGLN

SEQ ID NO: 893711 - protein, 6 aa, Mycobacterium
ADPGQA

SEQ ID NO: 893712 - protein, 5 aa, Mycobacterium
ADPGR

SEQ ID NO: 893713 - protein, 5 aa, Mycobacterium
ADPGV

SEQ ID NO: 893714 - protein, 7 aa, Mycobacterium
ADPHPAA

SEQ ID NO: 893715 - protein, 12 aa, Mycobacterium
ADPHYDGDVPGM

SEQ ID NO: 893716 - protein, 6 aa, Mycobacterium
ADPKIA

SEQ ID NO: 893717 - protein, 7 aa, Mycobacterium
ADPKSRV

SEQ ID NO: 893718 - protein, 18 aa, Mycobacterium
ADPLAAGTANISNATGTV

SEQ ID NO: 893719 - protein, 10 aa, Mycobacterium
ADPLSTEDSY

SEQ ID NO: 893720 - protein, 7 aa, Mycobacterium
ADPNLGR

SEQ ID NO: 893721 - protein, 8 aa, Mycobacterium
ADPPANCT

SEQ ID NO: 893722 - protein, 10 aa, Mycobacterium
ADPPAPAPEP

SEQ ID NO: 893723 - protein, 9 aa, Mycobacterium
ADPPAPGPV

SEQ ID NO: 893724 - protein, 8 aa, Mycobacterium
ADPPCAPG

SEQ ID NO: 893725 - protein, 19 aa, Mycobacterium
ADPPDGDVDTDVVNDSTSW

SEQ ID NO: 893726 - protein, 8 aa, Mycobacterium
ADPPPASA

SEQ ID NO: 893727 - protein, 8 aa, Mycobacterium
ADPPPNCT

SEQ ID NO: 893728 - protein, 37 aa, Mycobacterium
ADPPPSEPATPSEPATPTPSLPDAPPTSDSPPPQSWP

SEQ ID NO: 893729 - protein, 17 aa, Mycobacterium
ADPPSQAAFNADSSKYM

SEQ ID NO: 893730 - protein, 7 aa, Mycobacterium
ADPQFDS

SEQ ID NO: 893731 - protein, 6 aa, Mycobacterium
ADPQVR

SEQ ID NO: 893732 - protein, 6 aa, Mycobacterium
ADPRGV

SEQ ID NO: 893733 - protein, 9 aa, Mycobacterium
ADPSASRRA

SEQ ID NO: 893734 - protein, 8 aa, Mycobacterium
ADPSATAL

SEQ ID NO: 893735 - protein, 14 aa, Mycobacterium
ADPSEQTSPTAPCD

SEQ ID NO: 893736 - protein, 5 aa, Mycobacterium
ADPSG

SEQ ID NO: 893737 - protein, 8 aa, Mycobacterium
ADPSGTSL

SEQ ID NO: 893738 - protein, 7 aa, Mycobacterium
ADPSVSF

SEQ ID NO: 893739 - protein, 16 aa, Mycobacterium
ADPSVSFSNKSNLVQG

SEQ ID NO: 893740 - protein, 16 aa, Mycobacterium
ADPSVSFSSKSNLVQG

SEQ ID NO: 893741 - protein, 18 aa, Mycobacterium
ADPTAPDVGGRDQSPRRT

SEQ ID NO: 893742 - protein, 6 aa, Mycobacterium
ADPTDA

SEQ ID NO: 893743 - protein, 6 aa, Mycobacterium
ADPTGY

SEQ ID NO: 893744 - protein, 7 aa, Mycobacterium
ADPTNFA

SEQ ID NO: 893745 - protein, 12 aa, Mycobacterium
ADPTPAGNSQLP

SEQ ID NO: 893746 - protein, 12 aa, Mycobacterium
ADPTPPGDSQLP

SEQ ID NO: 893747 - protein, 6 aa, Mycobacterium
ADPTSD

SEQ ID NO: 893748 - protein, 17 aa, Mycobacterium
ADPVPSEHTGPGVTRAS

SEQ ID NO: 893749 - protein, 7 aa, Mycobacterium
ADPVSRS

SEQ ID NO: 893750 - protein, 6 aa, Mycobacterium
ADPWDD

SEQ ID NO: 893751 - protein, 7 aa, Mycobacterium
ADPYRAA

SEQ ID NO: 893752 - protein, 4 aa, Mycobacterium
ADQK

SEQ ID NO: 893753 - protein, 5 aa, Mycobacterium
ADQNS

SEQ ID NO: 893754 - protein, 12 aa, Mycobacterium
ADQPPGVIVLVT

SEQ ID NO: 893755 - protein, 11 aa, Mycobacterium
ADQRDDATAQT

SEQ ID NO: 893756 - protein, 10 aa, Mycobacterium
ADQRDDFSEG

SEQ ID NO: 893757 - protein, 9 aa, Mycobacterium
ADQRDLGGP

SEQ ID NO: 893758 - protein, 18 aa, Mycobacterium
ADQRRTDTTTTLAPGATV

SEQ ID NO: 893759 - protein, 7 aa, Mycobacterium
ADQSSGL

SEQ ID NO: 893760 - protein, 5 aa, Mycobacterium
ADQTG

SEQ ID NO: 893761 - protein, 4 aa, Mycobacterium
ADQV

SEQ ID NO: 893762 - protein, 4 aa, Mycobacterium
ADRA

SEQ ID NO: 893763 - protein, 12 aa, Mycobacterium
ADRAAAAAALTE

SEQ ID NO: 893764 - protein, 9 aa, Mycobacterium
ADRAAAQKA

SEQ ID NO: 893765 - protein, 5 aa, Mycobacterium
ADRAG

SEQ ID NO: 893766 - protein, 15 aa, Mycobacterium
ADRAGGTLPSQSKLL

SEQ ID NO: 893767 - protein, 12 aa, Mycobacterium
ADRAQESSRTTA

SEQ ID NO: 893768 - protein, 5 aa, Mycobacterium
ADRAT

SEQ ID NO: 893769 - protein, 13 aa, Mycobacterium
ADRAYNRAAADGK

SEQ ID NO: 893770 - protein, 9 aa, Mycobacterium
ADRCPASAR

SEQ ID NO: 893771 - protein, 9 aa, Mycobacterium
ADRDCPATE

SEQ ID NO: 893772 - protein, 9 aa, Mycobacterium
ADRDGLRGK

SEQ ID NO: 893773 - protein, 5 aa, Mycobacterium
ADREA

SEQ ID NO: 893774 - protein, 4 aa, Mycobacterium
ADRG

SEQ ID NO: 893775 - protein, 7 aa, Mycobacterium
ADRGRKM

SEQ ID NO: 893776 - protein, 10 aa, Mycobacterium
ADRPAAPNQL

SEQ ID NO: 893777 - protein, 21 aa, Mycobacterium
ADRPRRAEIASTATPWQASTP

SEQ ID NO: 893778 - protein, 7 aa, Mycobacterium
ADRRSRA

SEQ ID NO: 893779 - protein, 5 aa, Mycobacterium
ADRSG

SEQ ID NO: 893780 - protein, 13 aa, Mycobacterium
ADRSGGSLTTQSA

SEQ ID NO: 893781 - protein, 7 aa, Mycobacterium
ADRSGKL

SEQ ID NO: 893782 - protein, 9 aa, Mycobacterium
ADRTAESGY

SEQ ID NO: 893783 - protein, 33 aa, Mycobacterium
ADRTDTRPPPVIPPAPQTSPVQEPGSRPRRYPR

SEQ ID NO: 893784 - protein, 11 aa, Mycobacterium
ADRVTSDPMES

SEQ ID NO: 893785 - protein, 34 aa, Mycobacterium
ADRYNQANGTPGPDQTTLTTGDAGKRVACGVIGS

SEQ ID NO: 893786 - protein, 6 aa, Mycobacterium
ADSARF

SEQ ID NO: 893787 - protein, 9 aa, Mycobacterium
ADSDTPATM

SEQ ID NO: 893788 - protein, 9 aa, Mycobacterium
ADSDTYNDQ

SEQ ID NO: 893789 - protein, 8 aa, Mycobacterium
ADSESLSD

SEQ ID NO: 893790 - protein, 6 aa, Mycobacterium
ADSFTK

SEQ ID NO: 893791 - protein, 20 aa, Mycobacterium
ADSGSPPSSKRSTANTGTSM

SEQ ID NO: 893792 - protein, 5 aa, Mycobacterium
ADSGY

SEQ ID NO: 893793 - protein, 12 aa, Mycobacterium
ADSGYANAAAKG

SEQ ID NO: 893794 - protein, 4 aa, Mycobacterium
ADSI

SEQ ID NO: 893795 - protein, 9 aa, Mycobacterium
ADSIESSTE

SEQ ID NO: 893796 - protein, 8 aa, Mycobacterium
ADSKRYAD

SEQ ID NO: 893797 - protein, 17 aa, Mycobacterium
ADSNGGNRATGTPGYDA

SEQ ID NO: 893798 - protein, 7 aa, Mycobacterium
ADSNQQL

SEQ ID NO: 893799 - protein, 9 aa, Mycobacterium
ADSPDEVGQ

SEQ ID NO: 893800 - protein, 8 aa, Mycobacterium
ADSPPLRD

SEQ ID NO: 893801 - protein, 7 aa, Mycobacterium
ADSPTRL

SEQ ID NO: 893802 - protein, 4 aa, Mycobacterium
ADSR

SEQ ID NO: 893803 - protein, 7 aa, Mycobacterium
ADSRTDS

SEQ ID NO: 893804 - protein, 10 aa, Mycobacterium
ADSTNPAAAS

SEQ ID NO: 893805 - protein, 21 aa, Mycobacterium
ADSTPYRPDPTRAHTPASNYG

SEQ ID NO: 893806 - protein, 8 aa, Mycobacterium
ADSVGRTI

SEQ ID NO: 893807 - protein, 10 aa, Mycobacterium
ADSVNKTKAN

SEQ ID NO: 893808 - protein, 10 aa, Mycobacterium
ADSVNKTKEN

SEQ ID NO: 893809 - protein, 7 aa, Mycobacterium
ADTAADA

SEQ ID NO: 893810 - protein, 8 aa, Mycobacterium
ADTAAGAL

SEQ ID NO: 893811 - protein, 9 aa, Mycobacterium
ADTAGKPSL

SEQ ID NO: 893812 - protein, 10 aa, Mycobacterium
ADTAPSDEFA

SEQ ID NO: 893813 - protein, 5 aa, Mycobacterium
ADTAQ

SEQ ID NO: 893814 - protein, 7 aa, Mycobacterium
ADTAQMD

SEQ ID NO: 893815 - protein, 8 aa, Mycobacterium
ADTAQMDT

SEQ ID NO: 893816 - protein, 16 aa, Mycobacterium
ADTAREQVKRQGKRRR

SEQ ID NO: 893817 - protein, 7 aa, Mycobacterium
ADTATVR

SEQ ID NO: 893818 - protein, 23 aa, Mycobacterium
ADTDAGPEAQIGESAGIGRPNTA

SEQ ID NO: 893819 - protein, 168 aa, Mycobacterium
ADTDGDSGGSVSASAPATRAESGKPASGLSTDRGQTTSPSGGATGAAGDGESDGDDDPAPSGRTTTDDDAAEAEALSRDADSAADDSTADDSADADAEESGDAEDVSAAEDDTDDTPAPTGEAEATPDVATRAQQKPTTPVRTTTATTVSGASAEAAPQTPETGTVTS

SEQ ID NO: 893820 - protein, 23 aa, Mycobacterium
ADTDHARITGTRVQKRGGTDETV

SEQ ID NO: 893821 - protein, 12 aa, Mycobacterium
ADTEPELATTTA

SEQ ID NO: 893822 - protein, 6 aa, Mycobacterium
ADTEQG

SEQ ID NO: 893823 - protein, 5 aa, Mycobacterium
ADTES

SEQ ID NO: 893824 - protein, 12 aa, Mycobacterium
ADTFDGNGDSFR

SEQ ID NO: 893825 - protein, 4 aa, Mycobacterium
ADTG

SEQ ID NO: 893826 - protein, 8 aa, Mycobacterium
ADTGGQTG

SEQ ID NO: 893827 - protein, 8 aa, Mycobacterium
ADTGPASD

SEQ ID NO: 893828 - protein, 5 aa, Mycobacterium
ADTGR

SEQ ID NO: 893829 - protein, 5 aa, Mycobacterium
ADTKP

SEQ ID NO: 893830 - protein, 7 aa, Mycobacterium
ADTPADF

SEQ ID NO: 893831 - protein, 8 aa, Mycobacterium
ADTPEQLQ

SEQ ID NO: 893832 - protein, 6 aa, Mycobacterium
ADTPPQ

SEQ ID NO: 893833 - protein, 7 aa, Mycobacterium
ADTPSGC

SEQ ID NO: 893834 - protein, 11 aa, Mycobacterium
ADTQIPAAGAE

SEQ ID NO: 893835 - protein, 7 aa, Mycobacterium
ADTRVDE

SEQ ID NO: 893836 - protein, 7 aa, Mycobacterium
ADTSARD

SEQ ID NO: 893837 - protein, 8 aa, Mycobacterium
ADTSSWDG

SEQ ID NO: 893838 - protein, 8 aa, Mycobacterium
ADTSTMDR

SEQ ID NO: 893839 - protein, 4 aa, Mycobacterium
ADTY

SEQ ID NO: 893840 - protein, 8 aa, Mycobacterium
ADVAQRQQ

SEQ ID NO: 893841 - protein, 8 aa, Mycobacterium
ADVDNDQD

SEQ ID NO: 893842 - protein, 4 aa, Mycobacterium
ADVG

SEQ ID NO: 893843 - protein, 19 aa, Mycobacterium
ADVGRSSVDGRAAITTAQR

SEQ ID NO: 893844 - protein, 17 aa, Mycobacterium
ADVPAAPPDLSASRAEI

SEQ ID NO: 893845 - protein, 20 aa, Mycobacterium
ADVPADEPEPAPASQPNCTA

SEQ ID NO: 893846 - protein, 18 aa, Mycobacterium
ADVPGGTRADGGNTTAAN

SEQ ID NO: 893847 - protein, 18 aa, Mycobacterium
ADVPPAPPVEPAPPAPVD

SEQ ID NO: 893848 - protein, 14 aa, Mycobacterium
ADVPSALTTPEAPA

SEQ ID NO: 893849 - protein, 5 aa, Mycobacterium
ADVQS

SEQ ID NO: 893850 - protein, 4 aa, Mycobacterium
ADVT

SEQ ID NO: 893851 - protein, 8 aa, Mycobacterium
ADVTDGRF

SEQ ID NO: 893852 - protein, 29 aa, Mycobacterium
ADVTPGAQVPVTTTPPLTRPGQKPRPAFQ

SEQ ID NO: 893853 - protein, 7 aa, Mycobacterium
ADYCNPN

SEQ ID NO: 893854 - protein, 10 aa, Mycobacterium
ADYEVDGDKG

SEQ ID NO: 893855 - protein, 8 aa, Mycobacterium
ADYPDQQA

SEQ ID NO: 893856 - protein, 11 aa, Mycobacterium
ADYSGKPYDQW

SEQ ID NO: 893857 - protein, 7 aa, Mycobacterium
ADYSPAG

SEQ ID NO: 893858 - protein, 4 aa, Mycobacterium
AEAA

SEQ ID NO: 893859 - protein, 15 aa, Mycobacterium
AEAAAAAEVAPDAGL

SEQ ID NO: 893860 - protein, 16 aa, Mycobacterium
AEAAAEQRLKGQQSAF

SEQ ID NO: 893861 - protein, 7 aa, Mycobacterium
AEAADTA

SEQ ID NO: 893862 - protein, 8 aa, Mycobacterium
AEAAPATV

SEQ ID NO: 893863 - protein, 26 aa, Mycobacterium
AEAAPTDGSADPSAGLPGLMIPTEAG

SEQ ID NO: 893864 - protein, 15 aa, Mycobacterium
AEAARPHSGRTVTAS

SEQ ID NO: 893865 - protein, 6 aa, Mycobacterium
AEAASG

SEQ ID NO: 893866 - protein, 15 aa, Mycobacterium
AEAATEQRVKGEQAA

SEQ ID NO: 893867 - protein, 9 aa, Mycobacterium
AEADDPGAH

SEQ ID NO: 893868 - protein, 13 aa, Mycobacterium
AEADMNPEHGPGI

SEQ ID NO: 893869 - protein, 8 aa, Mycobacterium
AEADRQSR

SEQ ID NO: 893870 - protein, 10 aa, Mycobacterium
AEADVAPDKP

SEQ ID NO: 893871 - protein, 21 aa, Mycobacterium
AEAEAVRKGRSDFSREERQRL

SEQ ID NO: 893872 - protein, 6 aa, Mycobacterium
AEAESI

SEQ ID NO: 893873 - protein, 9 aa, Mycobacterium
AEAESPYEP

SEQ ID NO: 893874 - protein, 16 aa, Mycobacterium
AEAETGLRDYGDPTLP

SEQ ID NO: 893875 - protein, 7 aa, Mycobacterium
AEAETGV

SEQ ID NO: 893876 - protein, 15 aa, Mycobacterium
AEAFNDAKNRAQQYA

SEQ ID NO: 893877 - protein, 4 aa, Mycobacterium
AEAG

SEQ ID NO: 893878 - protein, 10 aa, Mycobacterium
AEAGETDVTR

SEQ ID NO: 893879 - protein, 5 aa, Mycobacterium
AEAGG

SEQ ID NO: 893880 - protein, 17 aa, Mycobacterium
AEAGIAATEPDSPARQR

SEQ ID NO: 893881 - protein, 7 aa, Mycobacterium
AEAGNRR

SEQ ID NO: 893882 - protein, 7 aa, Mycobacterium
AEAGRAG

SEQ ID NO: 893883 - protein, 11 aa, Mycobacterium
AEAGRPPGAIH

SEQ ID NO: 893884 - protein, 8 aa, Mycobacterium
AEAGRQGL

SEQ ID NO: 893885 - protein, 18 aa, Mycobacterium
AEAGSGGGVADPSGPIYS

SEQ ID NO: 893886 - protein, 4 aa, Mycobacterium
AEAI

SEQ ID NO: 893887 - protein, 5 aa, Mycobacterium
AEAIG

SEQ ID NO: 893888 - protein, 15 aa, Mycobacterium
AEAKAEQQVKGQQAA

SEQ ID NO: 893889 - protein, 10 aa, Mycobacterium
AEAKMSSEEA

SEQ ID NO: 893890 - protein, 26 aa, Mycobacterium
AEANDLASGDARVPARDGSLGELPAI

SEQ ID NO: 893891 - protein, 9 aa, Mycobacterium
AEAPPADAF

SEQ ID NO: 893892 - protein, 6 aa, Mycobacterium
AEAPRY

SEQ ID NO: 893893 - protein, 11 aa, Mycobacterium
AEAQKAAEGEI

SEQ ID NO: 893894 - protein, 11 aa, Mycobacterium
AEAQKSAAGQI

SEQ ID NO: 893895 - protein, 8 aa, Mycobacterium
AEAQTIPR

SEQ ID NO: 893896 - protein, 4 aa, Mycobacterium
AEAR

SEQ ID NO: 893897 - protein, 21 aa, Mycobacterium
AEARDEARQEADAADQPGTAL

SEQ ID NO: 893898 - protein, 22 aa, Mycobacterium
AEARDEARREATKDRQRAPGTA

SEQ ID NO: 893899 - protein, 12 aa, Mycobacterium
AEARSGAAEVAG

SEQ ID NO: 893900 - protein, 24 aa, Mycobacterium
AEASDLGGIPADAYRQTKAQLRAP

SEQ ID NO: 893901 - protein, 12 aa, Mycobacterium
AEASGQAVANGL

SEQ ID NO: 893902 - protein, 13 aa, Mycobacterium
AEASTRSTTLRGP

SEQ ID NO: 893903 - protein, 5 aa, Mycobacterium
AEATD

SEQ ID NO: 893904 - protein, 7 aa, Mycobacterium
AEATEAA

SEQ ID NO: 893905 - protein, 16 aa, Mycobacterium
AECAPRQAREAAENEL

SEQ ID NO: 893906 - protein, 12 aa, Mycobacterium
AECPSGEEGDLY

SEQ ID NO: 893907 - protein, 10 aa, Mycobacterium
AECSDGKYTQ

SEQ ID NO: 893908 - protein, 12 aa, Mycobacterium
AEDAAAASRYVG

SEQ ID NO: 893909 - protein, 7 aa, Mycobacterium
AEDAAPR

SEQ ID NO: 893910 - protein, 13 aa, Mycobacterium
AEDAMEAEYQRSE

SEQ ID NO: 893911 - protein, 10 aa, Mycobacterium
AEDATGRNPE

SEQ ID NO: 893912 - protein, 7 aa, Mycobacterium
AEDATPR

SEQ ID NO: 893913 - protein, 9 aa, Mycobacterium
AEDEDEPYY

SEQ ID NO: 893914 - protein, 5 aa, Mycobacterium
AEDES

SEQ ID NO: 893915 - protein, 18 aa, Mycobacterium
AEDGKRVTLTDTPAHRAA

SEQ ID NO: 893916 - protein, 7 aa, Mycobacterium
AEDGPLT

SEQ ID NO: 893917 - protein, 8 aa, Mycobacterium
AEDGPREV

SEQ ID NO: 893918 - protein, 17 aa, Mycobacterium
AEDGTKPSGFNDTGSEL

SEQ ID NO: 893919 - protein, 16 aa, Mycobacterium
AEDLPAHGEAVRRRFE

SEQ ID NO: 893920 - protein, 18 aa, Mycobacterium
AEDNASVPRLADNDPSLE

SEQ ID NO: 893921 - protein, 6 aa, Mycobacterium
AEDPRA

SEQ ID NO: 893922 - protein, 5 aa, Mycobacterium
AEDPT

SEQ ID NO: 893923 - protein, 10 aa, Mycobacterium
AEDPTASKIA

SEQ ID NO: 893924 - protein, 8 aa, Mycobacterium
AEDSGLDD

SEQ ID NO: 893925 - protein, 5 aa, Mycobacterium
AEDTR

SEQ ID NO: 893926 - protein, 8 aa, Mycobacterium
AEDTRRVR

SEQ ID NO: 893927 - protein, 4 aa, Mycobacterium
AEEA

SEQ ID NO: 893928 - protein, 4 aa, Mycobacterium
AEED

SEQ ID NO: 893929 - protein, 12 aa, Mycobacterium
AEEELSQLLLPS

SEQ ID NO: 893930 - protein, 8 aa, Mycobacterium
AEEGRDLA

SEQ ID NO: 893931 - protein, 10 aa, Mycobacterium
AEEKDNPTYQ

SEQ ID NO: 893932 - protein, 5 aa, Mycobacterium
AEELG

SEQ ID NO: 893933 - protein, 8 aa, Mycobacterium
AEENPVGP

SEQ ID NO: 893934 - protein, 4 aa, Mycobacterium
AEEP

SEQ ID NO: 893935 - protein, 34 aa, Mycobacterium
AEEPEPADSAPALGVPTEAPSPAPEPTNPQAEAT

SEQ ID NO: 893936 - protein, 6 aa, Mycobacterium
AEEPEV

SEQ ID NO: 893937 - protein, 8 aa, Mycobacterium
AEESARRD

SEQ ID NO: 893938 - protein, 7 aa, Mycobacterium
AEESQQL

SEQ ID NO: 893939 - protein, 9 aa, Mycobacterium
AEESVTNSW

SEQ ID NO: 893940 - protein, 9 aa, Mycobacterium
AEETSDDPA

SEQ ID NO: 893941 - protein, 9 aa, Mycobacterium
AEETSQEPF

SEQ ID NO: 893942 - protein, 7 aa, Mycobacterium
AEETTCS

SEQ ID NO: 893943 - protein, 11 aa, Mycobacterium
AEGALRSARAT

SEQ ID NO: 893944 - protein, 13 aa, Mycobacterium
AEGAMADPTATTL

SEQ ID NO: 893945 - protein, 6 aa, Mycobacterium
AEGDAE

SEQ ID NO: 893946 - protein, 9 aa, Mycobacterium
AEGDAYDSQ

SEQ ID NO: 893947 - protein, 9 aa, Mycobacterium
AEGDAYNGQ

SEQ ID NO: 893948 - protein, 8 aa, Mycobacterium
AEGDRQSR

SEQ ID NO: 893949 - protein, 8 aa, Mycobacterium
AEGDYNNA

SEQ ID NO: 893950 - protein, 11 aa, Mycobacterium
AEGEQESAEEV

SEQ ID NO: 893951 - protein, 12 aa, Mycobacterium
AEGEQTTAEAVG

SEQ ID NO: 893952 - protein, 8 aa, Mycobacterium
AEGERAAQ

SEQ ID NO: 893953 - protein, 7 aa, Mycobacterium
AEGERDN

SEQ ID NO: 893954 - protein, 6 aa, Mycobacterium
AEGERL

SEQ ID NO: 893955 - protein, 6 aa, Mycobacterium
AEGGAG

SEQ ID NO: 893956 - protein, 19 aa, Mycobacterium
AEGIDADAVQRKAAGGLGE

SEQ ID NO: 893957 - protein, 7 aa, Mycobacterium
AEGKNAL

SEQ ID NO: 893958 - protein, 7 aa, Mycobacterium
AEGKNAR

SEQ ID NO: 893959 - protein, 8 aa, Mycobacterium
AEGKPEIS

SEQ ID NO: 893960 - protein, 4 aa, Mycobacterium
AEGL

SEQ ID NO: 893961 - protein, 11 aa, Mycobacterium
AEGPEADSGPL

SEQ ID NO: 893962 - protein, 5 aa, Mycobacterium
AEGPM

SEQ ID NO: 893963 - protein, 6 aa, Mycobacterium
AEGPMQ

SEQ ID NO: 893964 - protein, 27 aa, Mycobacterium
AEGQEPPAEAKAPETAAPEAGSTEITT

SEQ ID NO: 893965 - protein, 6 aa, Mycobacterium
AEGRAE

SEQ ID NO: 893966 - protein, 6 aa, Mycobacterium
AEGRAG

SEQ ID NO: 893967 - protein, 9 aa, Mycobacterium
AEGRTPNPC

SEQ ID NO: 893968 - protein, 16 aa, Mycobacterium
AEGSATGIKQAGKSEQ

SEQ ID NO: 893969 - protein, 20 aa, Mycobacterium
AEGSTTNPYAGSPQSRPGYS

SEQ ID NO: 893970 - protein, 9 aa, Mycobacterium
AEGTACESR

SEQ ID NO: 893971 - protein, 10 aa, Mycobacterium
AEGTAEGGRF

SEQ ID NO: 893972 - protein, 6 aa, Mycobacterium
AEGTDD

SEQ ID NO: 893973 - protein, 13 aa, Mycobacterium
AEGTGEKIDAPAI

SEQ ID NO: 893974 - protein, 9 aa, Mycobacterium
AEGTPVQPG

SEQ ID NO: 893975 - protein, 7 aa, Mycobacterium
AEGTVNG

SEQ ID NO: 893976 - protein, 5 aa, Mycobacterium
AEHAG

SEQ ID NO: 893977 - protein, 6 aa, Mycobacterium
AEHDEM

SEQ ID NO: 893978 - protein, 7 aa, Mycobacterium
AEHPEPG

SEQ ID NO: 893979 - protein, 5 aa, Mycobacterium
AEHPG

SEQ ID NO: 893980 - protein, 8 aa, Mycobacterium
AEHRPAAA

SEQ ID NO: 893981 - protein, 9 aa, Mycobacterium
AEHRPDEAG

SEQ ID NO: 893982 - protein, 13 aa, Mycobacterium
AEIDTADAQNLEE

SEQ ID NO: 893983 - protein, 4 aa, Mycobacterium
AEIE

SEQ ID NO: 893984 - protein, 13 aa, Mycobacterium
AEIKTEDAQNFEE

SEQ ID NO: 893985 - protein, 13 aa, Mycobacterium
AEINTEDAQNLEE

SEQ ID NO: 893986 - protein, 10 aa, Mycobacterium
AEIPSPGGAI

SEQ ID NO: 893987 - protein, 7 aa, Mycobacterium
AEIQEAT

SEQ ID NO: 893988 - protein, 13 aa, Mycobacterium
AEISTADAQNLEE

SEQ ID NO: 893989 - protein, 6 aa, Mycobacterium
AEKDEF

SEQ ID NO: 893990 - protein, 7 aa, Mycobacterium
AEKKRAA

SEQ ID NO: 893991 - protein, 9 aa, Mycobacterium
AEKNRKYED

SEQ ID NO: 893992 - protein, 6 aa, Mycobacterium
AEKNST

SEQ ID NO: 893993 - protein, 8 aa, Mycobacterium
AEKNTEEM

SEQ ID NO: 893994 - protein, 7 aa, Mycobacterium
AEKPDSH

SEQ ID NO: 893995 - protein, 10 aa, Mycobacterium
AEKREEQRAV

SEQ ID NO: 893996 - protein, 12 aa, Mycobacterium
AEKRKTQIRGSS

SEQ ID NO: 893997 - protein, 7 aa, Mycobacterium
AEKRQQV

SEQ ID NO: 893998 - protein, 9 aa, Mycobacterium
AEKRRRGTR

SEQ ID NO: 893999 - protein, 7 aa, Mycobacterium
AELGGGR

SEQ ID NO: 894000 - protein, 7 aa, Mycobacterium
AELGPDV

SEQ ID NO: 894001 - protein, 27 aa, Mycobacterium
AELPNPSAGHESAPLDVTSPDAAAAVA

SEQ ID NO: 894002 - protein, 5 aa, Mycobacterium
AELRP

SEQ ID NO: 894003 - protein, 9 aa, Mycobacterium
AELSDGPDK

SEQ ID NO: 894004 - protein, 12 aa, Mycobacterium
AELSGGQYPAAK

SEQ ID NO: 894005 - protein, 8 aa, Mycobacterium
AELSPTSL

SEQ ID NO: 894006 - protein, 13 aa, Mycobacterium
AELSSAAEGYESA

SEQ ID NO: 894007 - protein, 8 aa, Mycobacterium
AELTGDDT

SEQ ID NO: 894008 - protein, 6 aa, Mycobacterium
AELTSG

SEQ ID NO: 894009 - protein, 10 aa, Mycobacterium
AEMGASASAV

SEQ ID NO: 894010 - protein, 6 aa, Mycobacterium
AENAGK

SEQ ID NO: 894011 - protein, 5 aa, Mycobacterium
AENDA

SEQ ID NO: 894012 - protein, 10 aa, Mycobacterium
AENDDEPYYP

SEQ ID NO: 894013 - protein, 8 aa, Mycobacterium
AENDPRIG

SEQ ID NO: 894014 - protein, 10 aa, Mycobacterium
AENGYNDTNM

SEQ ID NO: 894015 - protein, 7 aa, Mycobacterium
AENISAT

SEQ ID NO: 894016 - protein, 4 aa, Mycobacterium
AENP

SEQ ID NO: 894017 - protein, 10 aa, Mycobacterium
AENPESVPAT

SEQ ID NO: 894018 - protein, 8 aa, Mycobacterium
AENQPARL

SEQ ID NO: 894019 - protein, 17 aa, Mycobacterium
AENREAVGTASDKLASI

SEQ ID NO: 894020 - protein, 5 aa, Mycobacterium
AENSE

SEQ ID NO: 894021 - protein, 7 aa, Mycobacterium
AENSNIE

SEQ ID NO: 894022 - protein, 19 aa, Mycobacterium
AEPAAAPAGAAAVTDGPAK

SEQ ID NO: 894023 - protein, 15 aa, Mycobacterium
AEPAADALAANTGEL

SEQ ID NO: 894024 - protein, 23 aa, Mycobacterium
AEPARGGWQTVPGSRRDASYQRW

SEQ ID NO: 894025 - protein, 7 aa, Mycobacterium
AEPARTL

SEQ ID NO: 894026 - protein, 25 aa, Mycobacterium
AEPDQCSESGIASTVSSVAASTSTY

SEQ ID NO: 894027 - protein, 8 aa, Mycobacterium
AEPDSRAI

SEQ ID NO: 894028 - protein, 15 aa, Mycobacterium
AEPDYTEAQRGDAKA

SEQ ID NO: 894029 - protein, 23 aa, Mycobacterium
AEPEDPAPAVDGTASEAPSAADQ

SEQ ID NO: 894030 - protein, 22 aa, Mycobacterium
AEPEPAPLDAPGVNGELPPPAP

SEQ ID NO: 894031 - protein, 5 aa, Mycobacterium
AEPEQ

SEQ ID NO: 894032 - protein, 6 aa, Mycobacterium
AEPEQV

SEQ ID NO: 894033 - protein, 5 aa, Mycobacterium
AEPER

SEQ ID NO: 894034 - protein, 24 aa, Mycobacterium
AEPETTTEAEPTVEIPDPQGPGCD

SEQ ID NO: 894035 - protein, 8 aa, Mycobacterium
AEPGDVGS

SEQ ID NO: 894036 - protein, 5 aa, Mycobacterium
AEPGK

SEQ ID NO: 894037 - protein, 7 aa, Mycobacterium
AEPGKAS

SEQ ID NO: 894038 - protein, 34 aa, Mycobacterium
AEPGPVTPWPDTRDATGPGVECPQPGQESNLPQT

SEQ ID NO: 894039 - protein, 4 aa, Mycobacterium
AEPH

SEQ ID NO: 894040 - protein, 9 aa, Mycobacterium
AEPHPPEDE

SEQ ID NO: 894041 - protein, 5 aa, Mycobacterium
AEPID

SEQ ID NO: 894042 - protein, 7 aa, Mycobacterium
AEPKATQ

SEQ ID NO: 894043 - protein, 4 aa, Mycobacterium
AEPL

SEQ ID NO: 894044 - protein, 5 aa, Mycobacterium
AEPLG

SEQ ID NO: 894045 - protein, 10 aa, Mycobacterium
AEPLSGRGDA

SEQ ID NO: 894046 - protein, 18 aa, Mycobacterium
AEPPLDEINDSAGDIEIP

SEQ ID NO: 894047 - protein, 8 aa, Mycobacterium
AEPPPEST

SEQ ID NO: 894048 - protein, 5 aa, Mycobacterium
AEPRG

SEQ ID NO: 894049 - protein, 4 aa, Mycobacterium
AEPS

SEQ ID NO: 894050 - protein, 12 aa, Mycobacterium
AEPSECSDPSGM

SEQ ID NO: 894051 - protein, 16 aa, Mycobacterium
AEPSPIPVGDYLATHP

SEQ ID NO: 894052 - protein, 14 aa, Mycobacterium
AEPSRLHAPGRSGQ

SEQ ID NO: 894053 - protein, 9 aa, Mycobacterium
AEPSRTPRG

SEQ ID NO: 894054 - protein, 13 aa, Mycobacterium
AEPTEAETAEAKP

SEQ ID NO: 894055 - protein, 8 aa, Mycobacterium
AEPTGIET

SEQ ID NO: 894056 - protein, 20 aa, Mycobacterium
AEPTPPPPVPGSPNAPSHGS

SEQ ID NO: 894057 - protein, 4 aa, Mycobacterium
AEPY

SEQ ID NO: 894058 - protein, 4 aa, Mycobacterium
AEQA

SEQ ID NO: 894059 - protein, 29 aa, Mycobacterium
AEQARQTAAQASAAAAAYETARATAVPPP

SEQ ID NO: 894060 - protein, 4 aa, Mycobacterium
AEQG

SEQ ID NO: 894061 - protein, 16 aa, Mycobacterium
AEQGATAAESVRDAAQ

SEQ ID NO: 894062 - protein, 20 aa, Mycobacterium
AEQGKKAHDTGYDGRSDYDA

SEQ ID NO: 894063 - protein, 8 aa, Mycobacterium
AEQGRELA

SEQ ID NO: 894064 - protein, 10 aa, Mycobacterium
AEQHDDPNIE

SEQ ID NO: 894065 - protein, 17 aa, Mycobacterium
AEQLEPGAELGPGAQKR

SEQ ID NO: 894066 - protein, 6 aa, Mycobacterium
AEQLKR

SEQ ID NO: 894067 - protein, 5 aa, Mycobacterium
AEQNH

SEQ ID NO: 894068 - protein, 7 aa, Mycobacterium
AEQPCAD

SEQ ID NO: 894069 - protein, 7 aa, Mycobacterium
AEQPNTR

SEQ ID NO: 894070 - protein, 10 aa, Mycobacterium
AEQPSPDDRP

SEQ ID NO: 894071 - protein, 18 aa, Mycobacterium
AEQQPKEQGNTDLSNDQL

SEQ ID NO: 894072 - protein, 5 aa, Mycobacterium
AEQQW

SEQ ID NO: 894073 - protein, 4 aa, Mycobacterium
AEQS

SEQ ID NO: 894074 - protein, 8 aa, Mycobacterium
AEQTGDAR

SEQ ID NO: 894075 - protein, 8 aa, Mycobacterium
AEQTGKRV

SEQ ID NO: 894076 - protein, 9 aa, Mycobacterium
AEQTGKRVR

SEQ ID NO: 894077 - protein, 19 aa, Mycobacterium
AEQTRQTAMQARTAAAAYE

SEQ ID NO: 894078 - protein, 4 aa, Mycobacterium
AERA

SEQ ID NO: 894079 - protein, 11 aa, Mycobacterium
AERAQAQARLQ

SEQ ID NO: 894080 - protein, 4 aa, Mycobacterium
AERD

SEQ ID NO: 894081 - protein, 10 aa, Mycobacterium
AERDEAEAKL

SEQ ID NO: 894082 - protein, 49 aa, Mycobacterium
AERDEAQAKLEAAQREWSTRRGGPAAPASGDRWETGSPGAPAPQGGARR

SEQ ID NO: 894083 - protein, 10 aa, Mycobacterium
AERDEAQARL

SEQ ID NO: 894084 - protein, 6 aa, Mycobacterium
AERDGK

SEQ ID NO: 894085 - protein, 8 aa, Mycobacterium
AERDGSRA

SEQ ID NO: 894086 - protein, 55 aa, Mycobacterium
AERDSAQTRLTTARPVAATAHQPTAAQPGAAVPPSGQWDRSSPAPADSSGAGQWD

SEQ ID NO: 894087 - protein, 5 aa, Mycobacterium
AERDT

SEQ ID NO: 894088 - protein, 9 aa, Mycobacterium
AEREAATVG

SEQ ID NO: 894089 - protein, 8 aa, Mycobacterium
AEREATDL

SEQ ID NO: 894090 - protein, 14 aa, Mycobacterium
AEREPSGDASTTEI

SEQ ID NO: 894091 - protein, 4 aa, Mycobacterium
AERG

SEQ ID NO: 894092 - protein, 7 aa, Mycobacterium
AERGADV

SEQ ID NO: 894093 - protein, 20 aa, Mycobacterium
AERGADVDATVRTATTDDVR

SEQ ID NO: 894094 - protein, 7 aa, Mycobacterium
AERGKKM

SEQ ID NO: 894095 - protein, 4 aa, Mycobacterium
AERH

SEQ ID NO: 894096 - protein, 4 aa, Mycobacterium
AERL

SEQ ID NO: 894097 - protein, 7 aa, Mycobacterium
AERLGGT

SEQ ID NO: 894098 - protein, 9 aa, Mycobacterium
AERPTPPYL

SEQ ID NO: 894099 - protein, 7 aa, Mycobacterium
AERQPIG

SEQ ID NO: 894100 - protein, 4 aa, Mycobacterium
AERR

SEQ ID NO: 894101 - protein, 12 aa, Mycobacterium
AERSAVGGATNA

SEQ ID NO: 894102 - protein, 7 aa, Mycobacterium
AERSGVD

SEQ ID NO: 894103 - protein, 5 aa, Mycobacterium
AERSR

SEQ ID NO: 894104 - protein, 4 aa, Mycobacterium
AERT

SEQ ID NO: 894105 - protein, 18 aa, Mycobacterium
AERTADAHDAATSCLVKS

SEQ ID NO: 894106 - protein, 14 aa, Mycobacterium
AERTEKKETNGRSE

SEQ ID NO: 894107 - protein, 14 aa, Mycobacterium
AERVPGVDAPTLTE

SEQ ID NO: 894108 - protein, 34 aa, Mycobacterium
AERYNQTNGTPGPDETTKSTGDAGKRVACGVIGA

SEQ ID NO: 894109 - protein, 34 aa, Mycobacterium
AERYTQANGASGPDDTTKSTGDAGKRVACGLIDA

SEQ ID NO: 894110 - protein, 10 aa, Mycobacterium
AESAAGKDAR

SEQ ID NO: 894111 - protein, 19 aa, Mycobacterium
AESAAPPSFGAAAPPSQQR

SEQ ID NO: 894112 - protein, 12 aa, Mycobacterium
AESAGAAVAGGA

SEQ ID NO: 894113 - protein, 24 aa, Mycobacterium
AESAGAAVAGGAVGAHGGSGAAGA

SEQ ID NO: 894114 - protein, 18 aa, Mycobacterium
AESAPQGRYDQRAVEQRP

SEQ ID NO: 894115 - protein, 4 aa, Mycobacterium
AESD

SEQ ID NO: 894116 - protein, 7 aa, Mycobacterium
AESDGVR

SEQ ID NO: 894117 - protein, 5 aa, Mycobacterium
AESDP

SEQ ID NO: 894118 - protein, 6 aa, Mycobacterium
AESDQV

SEQ ID NO: 894119 - protein, 16 aa, Mycobacterium
AESGVRAQALKPDGNL

SEQ ID NO: 894120 - protein, 21 aa, Mycobacterium
AESIGGVNGVPSHDKRHRARM

SEQ ID NO: 894121 - protein, 7 aa, Mycobacterium
AESPTGM

SEQ ID NO: 894122 - protein, 10 aa, Mycobacterium
AESRAGQGGP

SEQ ID NO: 894123 - protein, 8 aa, Mycobacterium
AESRAPRG

SEQ ID NO: 894124 - protein, 6 aa, Mycobacterium
AESRES

SEQ ID NO: 894125 - protein, 12 aa, Mycobacterium
AESRGDLPPEVR

SEQ ID NO: 894126 - protein, 13 aa, Mycobacterium
AESSALAAAQAAA

SEQ ID NO: 894127 - protein, 9 aa, Mycobacterium
AESSKAGFT

SEQ ID NO: 894128 - protein, 7 aa, Mycobacterium
AESSSTT

SEQ ID NO: 894129 - protein, 5 aa, Mycobacterium
AESSV

SEQ ID NO: 894130 - protein, 5 aa, Mycobacterium
AESTA

SEQ ID NO: 894131 - protein, 14 aa, Mycobacterium
AESTGLSAKGAKTF

SEQ ID NO: 894132 - protein, 27 aa, Mycobacterium
AESTPTSYTPQQTGASPVRYDSDPLEQ

SEQ ID NO: 894133 - protein, 6 aa, Mycobacterium
AETAAT

SEQ ID NO: 894134 - protein, 5 aa, Mycobacterium
AETAD

SEQ ID NO: 894135 - protein, 10 aa, Mycobacterium
AETADDPMAR

SEQ ID NO: 894136 - protein, 11 aa, Mycobacterium
AETAESVNGVE

SEQ ID NO: 894137 - protein, 5 aa, Mycobacterium
AETAG

SEQ ID NO: 894138 - protein, 12 aa, Mycobacterium
AETAGNQVRDAK

SEQ ID NO: 894139 - protein, 8 aa, Mycobacterium
AETAGSGV

SEQ ID NO: 894140 - protein, 11 aa, Mycobacterium
AETANASPLGT

SEQ ID NO: 894141 - protein, 15 aa, Mycobacterium
AETDDHREKLATARE

SEQ ID NO: 894142 - protein, 13 aa, Mycobacterium
AETDNTKAAQRLA

SEQ ID NO: 894143 - protein, 5 aa, Mycobacterium
AETDP

SEQ ID NO: 894144 - protein, 6 aa, Mycobacterium
AETDPL

SEQ ID NO: 894145 - protein, 4 aa, Mycobacterium
AETE

SEQ ID NO: 894146 - protein, 8 aa, Mycobacterium
AETGDANG

SEQ ID NO: 894147 - protein, 8 aa, Mycobacterium
AETGPSYQ

SEQ ID NO: 894148 - protein, 18 aa, Mycobacterium
AETGQVTGRIEATDPEGF

SEQ ID NO: 894149 - protein, 12 aa, Mycobacterium
AETGTVRVGPAE

SEQ ID NO: 894150 - protein, 8 aa, Mycobacterium
AETKDVKA

SEQ ID NO: 894151 - protein, 5 aa, Mycobacterium
AETLR

SEQ ID NO: 894152 - protein, 15 aa, Mycobacterium
AETPLTVSTSGAAAD

SEQ ID NO: 894153 - protein, 16 aa, Mycobacterium
AETPTGARARVWVADG

SEQ ID NO: 894154 - protein, 10 aa, Mycobacterium
AETPTGPSPR

SEQ ID NO: 894155 - protein, 19 aa, Mycobacterium
AETRARRRNDQNVAAGLAD

SEQ ID NO: 894156 - protein, 8 aa, Mycobacterium
AETRDQVS

SEQ ID NO: 894157 - protein, 28 aa, Mycobacterium
AETRRAAPRSDWTGGAADTYAAGNAEHA

SEQ ID NO: 894158 - protein, 28 aa, Mycobacterium
AETSQAATLPQAPAPFEPPTAGSALPNR

SEQ ID NO: 894159 - protein, 7 aa, Mycobacterium
AETTRAV

SEQ ID NO: 894160 - protein, 6 aa, Mycobacterium
AETTSH

SEQ ID NO: 894161 - protein, 6 aa, Mycobacterium
AEVAAN

SEQ ID NO: 894162 - protein, 16 aa, Mycobacterium
AEVANDAANTPGLAPE

SEQ ID NO: 894163 - protein, 7 aa, Mycobacterium
AEVAPGQ

SEQ ID NO: 894164 - protein, 33 aa, Mycobacterium
AEVARGRWGSGSSPRRSSTGAARPGGAGSSRWR

SEQ ID NO: 894165 - protein, 7 aa, Mycobacterium
AEVDANA

SEQ ID NO: 894166 - protein, 6 aa, Mycobacterium
AEVERP

SEQ ID NO: 894167 - protein, 4 aa, Mycobacterium
AEVG

SEQ ID NO: 894168 - protein, 6 aa, Mycobacterium
AEVQSR

SEQ ID NO: 894169 - protein, 7 aa, Mycobacterium
AEVSGTP

SEQ ID NO: 894170 - protein, 8 aa, Mycobacterium
AEVSPCPA

SEQ ID NO: 894171 - protein, 10 aa, Mycobacterium
AEVTARDREV

SEQ ID NO: 894172 - protein, 6 aa, Mycobacterium
AEVTED

SEQ ID NO: 894173 - protein, 5 aa, Mycobacterium
AEVTG

SEQ ID NO: 894174 - protein, 6 aa, Mycobacterium
AEVTGA

SEQ ID NO: 894175 - protein, 9 aa, Mycobacterium
AEVTNENPF

SEQ ID NO: 894176 - protein, 9 aa, Mycobacterium
AEVTSQDPF

SEQ ID NO: 894177 - protein, 9 aa, Mycobacterium
AEVTSQNPF

SEQ ID NO: 894178 - protein, 15 aa, Mycobacterium
AEVVETDEGLGALDS

SEQ ID NO: 894179 - protein, 7 aa, Mycobacterium
AEWNDDD

SEQ ID NO: 894180 - protein, 8 aa, Mycobacterium
AEYAAAAD

SEQ ID NO: 894181 - protein, 7 aa, Mycobacterium
AEYAKGP

SEQ ID NO: 894182 - protein, 8 aa, Mycobacterium
AEYAKGPV

SEQ ID NO: 894183 - protein, 7 aa, Mycobacterium
AEYATGP

SEQ ID NO: 894184 - protein, 8 aa, Mycobacterium
AEYGPSGV

SEQ ID NO: 894185 - protein, 7 aa, Mycobacterium
AEYGTAA

SEQ ID NO: 894186 - protein, 10 aa, Mycobacterium
AEYKDADGKW

SEQ ID NO: 894187 - protein, 7 aa, Mycobacterium
AEYPSGP

SEQ ID NO: 894188 - protein, 17 aa, Mycobacterium
AEYQGPQARAANGASEY

SEQ ID NO: 894189 - protein, 4 aa, Mycobacterium
AEYR

SEQ ID NO: 894190 - protein, 6 aa, Mycobacterium
AFADET

SEQ ID NO: 894191 - protein, 5 aa, Mycobacterium
AFAEP

SEQ ID NO: 894192 - protein, 16 aa, Mycobacterium
AFAGQASAANTELSQP

SEQ ID NO: 894193 - protein, 5 aa, Mycobacterium
AFDQR

SEQ ID NO: 894194 - protein, 7 aa, Mycobacterium
AFEPPEE

SEQ ID NO: 894195 - protein, 7 aa, Mycobacterium
AFESDDG

SEQ ID NO: 894196 - protein, 8 aa, Mycobacterium
AFESGTSV

SEQ ID NO: 894197 - protein, 7 aa, Mycobacterium
AFGAAPG

SEQ ID NO: 894198 - protein, 8 aa, Mycobacterium
AFGAGRET

SEQ ID NO: 894199 - protein, 19 aa, Mycobacterium
AFGDNNKIDVSSTGIGNTA

SEQ ID NO: 894200 - protein, 13 aa, Mycobacterium
AFGGRGEKMGQTV

SEQ ID NO: 894201 - protein, 6 aa, Mycobacterium
AFGNED

SEQ ID NO: 894202 - protein, 20 aa, Mycobacterium
AFGSDNSQVSADAGGAGGNI

SEQ ID NO: 894203 - protein, 11 aa, Mycobacterium
AFPAGADGAIA

SEQ ID NO: 894204 - protein, 6 aa, Mycobacterium
AFPDDI

SEQ ID NO: 894205 - protein, 7 aa, Mycobacterium
AFPPPEE

SEQ ID NO: 894206 - protein, 6 aa, Mycobacterium
AFPRGA

SEQ ID NO: 894207 - protein, 10 aa, Mycobacterium
AFQQSPEQRR

SEQ ID NO: 894208 - protein, 5 aa, Mycobacterium
AFQTQ

SEQ ID NO: 894209 - protein, 8 aa, Mycobacterium
AFSDPSRV

SEQ ID NO: 894210 - protein, 12 aa, Mycobacterium
AFSGETKATGGV

SEQ ID NO: 894211 - protein, 12 aa, Mycobacterium
AFSGRGEKFGQT

SEQ ID NO: 894212 - protein, 6 aa, Mycobacterium
AFSPAD

SEQ ID NO: 894213 - protein, 33 aa, Mycobacterium
AFTDAENEELAAQPPITGAQYAEGARPVQTGTS

SEQ ID NO: 894214 - protein, 5 aa, Mycobacterium
AFTED

SEQ ID NO: 894215 - protein, 5 aa, Mycobacterium
AFTPT

SEQ ID NO: 894216 - protein, 6 aa, Mycobacterium
AFTPTD

SEQ ID NO: 894217 - protein, 6 aa, Mycobacterium
AFTPTP

SEQ ID NO: 894218 - protein, 5 aa, Mycobacterium
AFTSP

SEQ ID NO: 894219 - protein, 4 aa, Mycobacterium
AGAA

SEQ ID NO: 894220 - protein, 12 aa, Mycobacterium
AGAAAAARAAAA

SEQ ID NO: 894221 - protein, 14 aa, Mycobacterium
AGAAAAIEAADRGA

SEQ ID NO: 894222 - protein, 10 aa, Mycobacterium
AGAAAARTEV

SEQ ID NO: 894223 - protein, 17 aa, Mycobacterium
AGAAAPGAFDGAADYAA

SEQ ID NO: 894224 - protein, 6 aa, Mycobacterium
AGAAAR

SEQ ID NO: 894225 - protein, 8 aa, Mycobacterium
AGAADATR

SEQ ID NO: 894226 - protein, 41 aa, Mycobacterium
AGAADTARASGSAGAALASGALDATGAGSGCTARSAGSACA

SEQ ID NO: 894227 - protein, 7 aa, Mycobacterium
AGAADTR

SEQ ID NO: 894228 - protein, 11 aa, Mycobacterium
AGAAENTANRL

SEQ ID NO: 894229 - protein, 31 aa, Mycobacterium
AGAAETQGTDTQLAQADQAALAARADSAIAG

SEQ ID NO: 894230 - protein, 8 aa, Mycobacterium
AGAAGAGI

SEQ ID NO: 894231 - protein, 7 aa, Mycobacterium
AGAAGPV

SEQ ID NO: 894232 - protein, 13 aa, Mycobacterium
AGAALGADTPGAG

SEQ ID NO: 894233 - protein, 12 aa, Mycobacterium
AGAANASTGDET

SEQ ID NO: 894234 - protein, 14 aa, Mycobacterium
AGAANDVAVSPDTS

SEQ ID NO: 894235 - protein, 11 aa, Mycobacterium
AGAANGEPPDL

SEQ ID NO: 894236 - protein, 95 aa, Mycobacterium
AGAANMGAGNSGSYNTGSFNSGTLNTGDFNGGDHNTGWGNSGNTNTGGINSGDLNTGFGSSADQAVTNSGFGNNGSGNSGFNNTGDTNSGFHNAN

SEQ ID NO: 894237 - protein, 7 aa, Mycobacterium
AGAAPHD

SEQ ID NO: 894238 - protein, 6 aa, Mycobacterium
AGAAPM

SEQ ID NO: 894239 - protein, 9 aa, Mycobacterium
AGAAPNLGS

SEQ ID NO: 894240 - protein, 16 aa, Mycobacterium
AGAAPPSCASLGGSVE

SEQ ID NO: 894241 - protein, 11 aa, Mycobacterium
AGAAPSDSTRA

SEQ ID NO: 894242 - protein, 16 aa, Mycobacterium
AGAAVDAADDSVCSGA

SEQ ID NO: 894243 - protein, 9 aa, Mycobacterium
AGAAVTGGA

SEQ ID NO: 894244 - protein, 7 aa, Mycobacterium
AGADAQD

SEQ ID NO: 894245 - protein, 23 aa, Mycobacterium
AGADEVEVEGNYSSQSGCEADAP

SEQ ID NO: 894246 - protein, 15 aa, Mycobacterium
AGADPADPDPFNPGD

SEQ ID NO: 894247 - protein, 20 aa, Mycobacterium
AGADPDDPAPVPAPAPPNCT

SEQ ID NO: 894248 - protein, 18 aa, Mycobacterium
AGADPDFGRGSSAYDGYW

SEQ ID NO: 894249 - protein, 8 aa, Mycobacterium
AGADPDPV

SEQ ID NO: 894250 - protein, 7 aa, Mycobacterium
AGADQTS

SEQ ID NO: 894251 - protein, 6 aa, Mycobacterium
AGADVG

SEQ ID NO: 894252 - protein, 8 aa, Mycobacterium
AGADVGQV

SEQ ID NO: 894253 - protein, 5 aa, Mycobacterium
AGAEA

SEQ ID NO: 894254 - protein, 16 aa, Mycobacterium
AGAEDGQDDSDPERGG

SEQ ID NO: 894255 - protein, 7 aa, Mycobacterium
AGAEPGT

SEQ ID NO: 894256 - protein, 11 aa, Mycobacterium
AGAEPVDPKEP

SEQ ID NO: 894257 - protein, 7 aa, Mycobacterium
AGAEQVR

SEQ ID NO: 894258 - protein, 23 aa, Mycobacterium
AGAERGRELAETAAEKGAPYAEA

SEQ ID NO: 894259 - protein, 21 aa, Mycobacterium
AGAERSLRSVQDKKPKDAETK

SEQ ID NO: 894260 - protein, 22 aa, Mycobacterium
AGAESAISAETEAAASAAAPAL

SEQ ID NO: 894261 - protein, 6 aa, Mycobacterium
AGAESY

SEQ ID NO: 894262 - protein, 11 aa, Mycobacterium
AGAFGGEPRYS

SEQ ID NO: 894263 - protein, 8 aa, Mycobacterium
AGAGAAGL

SEQ ID NO: 894264 - protein, 16 aa, Mycobacterium
AGAGAAQAGVAVGSAA

SEQ ID NO: 894265 - protein, 28 aa, Mycobacterium
AGAGGNGGVGLGTSGFGGTGGDGGQGGL

SEQ ID NO: 894266 - protein, 9 aa, Mycobacterium
AGAGGQGGL

SEQ ID NO: 894267 - protein, 12 aa, Mycobacterium
AGAGIASASPVV

SEQ ID NO: 894268 - protein, 6 aa, Mycobacterium
AGAGND

SEQ ID NO: 894269 - protein, 33 aa, Mycobacterium
AGAGRGIPTGTCPSVGASGHALGGGLGANSRHA

SEQ ID NO: 894270 - protein, 11 aa, Mycobacterium
AGAGRQPGRFG

SEQ ID NO: 894271 - protein, 6 aa, Mycobacterium
AGAGSY

SEQ ID NO: 894272 - protein, 13 aa, Mycobacterium
AGAGTAPTSGGTL

SEQ ID NO: 894273 - protein, 11 aa, Mycobacterium
AGAGVASADPL

SEQ ID NO: 894274 - protein, 7 aa, Mycobacterium
AGAHGYP

SEQ ID NO: 894275 - protein, 7 aa, Mycobacterium
AGAHPEN

SEQ ID NO: 894276 - protein, 7 aa, Mycobacterium
AGAIGRR

SEQ ID NO: 894277 - protein, 14 aa, Mycobacterium
AGAKAAEALRDNDF

SEQ ID NO: 894278 - protein, 5 aa, Mycobacterium
AGAKP

SEQ ID NO: 894279 - protein, 4 aa, Mycobacterium
AGAL

SEQ ID NO: 894280 - protein, 15 aa, Mycobacterium
AGALNGPDSALGTNI

SEQ ID NO: 894281 - protein, 10 aa, Mycobacterium
AGALPDPGPI

SEQ ID NO: 894282 - protein, 16 aa, Mycobacterium
AGANAYASAEANAAKT

SEQ ID NO: 894283 - protein, 9 aa, Mycobacterium
AGANPGSGF

SEQ ID NO: 894284 - protein, 19 aa, Mycobacterium
AGANSAARAAQHEAAAAAY

SEQ ID NO: 894285 - protein, 4 aa, Mycobacterium
AGAP

SEQ ID NO: 894286 - protein, 10 aa, Mycobacterium
AGAPAARKRA

SEQ ID NO: 894287 - protein, 17 aa, Mycobacterium
AGAPCPGPQAAAQTPDG

SEQ ID NO: 894288 - protein, 12 aa, Mycobacterium
AGAPDPAFRPAG

SEQ ID NO: 894289 - protein, 10 aa, Mycobacterium
AGAPEDTGIP

SEQ ID NO: 894290 - protein, 8 aa, Mycobacterium
AGAPGDPL

SEQ ID NO: 894291 - protein, 18 aa, Mycobacterium
AGAPGGALGAGADRGGVV

SEQ ID NO: 894292 - protein, 9 aa, Mycobacterium
AGAPGSNWA

SEQ ID NO: 894293 - protein, 10 aa, Mycobacterium
AGAPKGSCDT

SEQ ID NO: 894294 - protein, 13 aa, Mycobacterium
AGAPKSYADDPPM

SEQ ID NO: 894295 - protein, 6 aa, Mycobacterium
AGAPLL

SEQ ID NO: 894296 - protein, 18 aa, Mycobacterium
AGAPLQGNDQVVPSAATP

SEQ ID NO: 894297 - protein, 8 aa, Mycobacterium
AGAPPANL

SEQ ID NO: 894298 - protein, 7 aa, Mycobacterium
AGAPPFP

SEQ ID NO: 894299 - protein, 8 aa, Mycobacterium
AGAPRGSC

SEQ ID NO: 894300 - protein, 6 aa, Mycobacterium
AGAPRR

SEQ ID NO: 894301 - protein, 28 aa, Mycobacterium
AGAQAAKAEREAAKSAADAKSAAEQAAA

SEQ ID NO: 894302 - protein, 20 aa, Mycobacterium
AGAQPAPECSASNVAGTVST

SEQ ID NO: 894303 - protein, 12 aa, Mycobacterium
AGAQTDSSHQSN

SEQ ID NO: 894304 - protein, 4 aa, Mycobacterium
AGAR

SEQ ID NO: 894305 - protein, 15 aa, Mycobacterium
AGARAAEALRDNSFD

SEQ ID NO: 894306 - protein, 7 aa, Mycobacterium
AGARPTA

SEQ ID NO: 894307 - protein, 13 aa, Mycobacterium
AGARSANAPYSGG

SEQ ID NO: 894308 - protein, 13 aa, Mycobacterium
AGARVGAGYGPGH

SEQ ID NO: 894309 - protein, 6 aa, Mycobacterium
AGASAA

SEQ ID NO: 894310 - protein, 18 aa, Mycobacterium
AGASAAEAAAAGTEAGRE

SEQ ID NO: 894311 - protein, 13 aa, Mycobacterium
AGASGGALGAGAD

SEQ ID NO: 894312 - protein, 17 aa, Mycobacterium
AGASGGALSAGADRGGV

SEQ ID NO: 894313 - protein, 14 aa, Mycobacterium
AGASGGWGKPPTPL

SEQ ID NO: 894314 - protein, 6 aa, Mycobacterium
AGASGV

SEQ ID NO: 894315 - protein, 8 aa, Mycobacterium
AGASHNLP

SEQ ID NO: 894316 - protein, 14 aa, Mycobacterium
AGASLDAAPASASL

SEQ ID NO: 894317 - protein, 15 aa, Mycobacterium
AGASPSDDATSTRAV

SEQ ID NO: 894318 - protein, 6 aa, Mycobacterium
AGASTR

SEQ ID NO: 894319 - protein, 4 aa, Mycobacterium
AGAT

SEQ ID NO: 894320 - protein, 5 aa, Mycobacterium
AGATD

SEQ ID NO: 894321 - protein, 10 aa, Mycobacterium
AGATGESAMD

SEQ ID NO: 894322 - protein, 15 aa, Mycobacterium
AGATGKTYAAAEGAF

SEQ ID NO: 894323 - protein, 9 aa, Mycobacterium
AGATGSQIA

SEQ ID NO: 894324 - protein, 9 aa, Mycobacterium
AGATPQSVT

SEQ ID NO: 894325 - protein, 6 aa, Mycobacterium
AGATPS

SEQ ID NO: 894326 - protein, 8 aa, Mycobacterium
AGATPTAD

SEQ ID NO: 894327 - protein, 5 aa, Mycobacterium
AGATR

SEQ ID NO: 894328 - protein, 22 aa, Mycobacterium
AGATTALPSSGPAAAAALPGAA

SEQ ID NO: 894329 - protein, 11 aa, Mycobacterium
AGAVPAGEAVP

SEQ ID NO: 894330 - protein, 9 aa, Mycobacterium
AGAVQSGQV

SEQ ID NO: 894331 - protein, 11 aa, Mycobacterium
AGAYPSTEQTL

SEQ ID NO: 894332 - protein, 11 aa, Mycobacterium
AGCAPKAPDYQ

SEQ ID NO: 894333 - protein, 61 aa, Mycobacterium
AGCDSTIDGRPIAGPGAGPIEPSFPTSRPSTSPPSGTAPLPPTTPSPTTPAGAIPLPPDQN

SEQ ID NO: 894334 - protein, 8 aa, Mycobacterium
AGCGGPVP

SEQ ID NO: 894335 - protein, 9 aa, Mycobacterium
AGCGGTVDG

SEQ ID NO: 894336 - protein, 4 aa, Mycobacterium
AGCP

SEQ ID NO: 894337 - protein, 15 aa, Mycobacterium
AGCPDAKPSPPASYC

SEQ ID NO: 894338 - protein, 7 aa, Mycobacterium
AGCQDAQ

SEQ ID NO: 894339 - protein, 7 aa, Mycobacterium
AGCSSGA

SEQ ID NO: 894340 - protein, 25 aa, Mycobacterium
AGCSSHQQPRIASSAPPAAPPTSST

SEQ ID NO: 894341 - protein, 23 aa, Mycobacterium
AGCSTSPDAAEEAFATTEPPALK

SEQ ID NO: 894342 - protein, 4 aa, Mycobacterium
AGDA

SEQ ID NO: 894343 - protein, 18 aa, Mycobacterium
AGDAAADAAAQGTEAGRE

SEQ ID NO: 894344 - protein, 24 aa, Mycobacterium
AGDAELHSSPNPADIPEVPQAEQP

SEQ ID NO: 894345 - protein, 9 aa, Mycobacterium
AGDAGGGQR

SEQ ID NO: 894346 - protein, 14 aa, Mycobacterium
AGDAPAGQSISAED

SEQ ID NO: 894347 - protein, 9 aa, Mycobacterium
AGDATKGQI

SEQ ID NO: 894348 - protein, 6 aa, Mycobacterium
AGDDPQ

SEQ ID NO: 894349 - protein, 7 aa, Mycobacterium
AGDDQRT

SEQ ID NO: 894350 - protein, 8 aa, Mycobacterium
AGDDTAVT

SEQ ID NO: 894351 - protein, 10 aa, Mycobacterium
AGDEEATNTD

SEQ ID NO: 894352 - protein, 6 aa, Mycobacterium
AGDEVS

SEQ ID NO: 894353 - protein, 8 aa, Mycobacterium
AGDEVSAA

SEQ ID NO: 894354 - protein, 8 aa, Mycobacterium
AGDGDPVD

SEQ ID NO: 894355 - protein, 7 aa, Mycobacterium
AGDGEMG

SEQ ID NO: 894356 - protein, 232 aa, Mycobacterium
AGDGGAGGHGGGGGNGGNGAAGANGTNATISGTNGGNAGAGGNGGNGGTGGNGGAGGAATHGSAGANGAGGAGGNGGDGAIAGDGGTGANGDATHFDGGNGGNGANPGIGGLGGAGGTSGDGTTPAAHGTNGTTPTTTNGSGGRGGDGYTSTDPTLNGGKGGTGGNGGDYGNGGAGGNGGNGATGTTGTNPTPHPVTSTAASGANGTADTFNGGTGDNGAYAGQAGGNGGIG

SEQ ID NO: 894357 - protein, 211 aa, Mycobacterium
AGDGGAGGHGGGGGNGGNGAAGANGTNATISGTNGGNAGAGGNGGNGGTGGNGGAGGAATHGSAGANGAGGAGGNGGDGAIAGDGGTGANGDATHFDGGNGGNGANPGIGGLGGAGGTSGDGTTPAAHGTNGTTPTTTNGSGGRGGDGYTSTDPTLNGGKGGTGGNGGDYGNGGAGGNGGNGATGTTGTNPTPHPVTSTANPGTDASGNQT

SEQ ID NO: 894358 - protein, 14 aa, Mycobacterium
AGDHPGDAKTRFSA

SEQ ID NO: 894359 - protein, 14 aa, Mycobacterium
AGDHPINDSDEVQR

SEQ ID NO: 894360 - protein, 5 aa, Mycobacterium
AGDMN

SEQ ID NO: 894361 - protein, 6 aa, Mycobacterium
AGDNRI

SEQ ID NO: 894362 - protein, 7 aa, Mycobacterium
AGDPAWG

SEQ ID NO: 894363 - protein, 9 aa, Mycobacterium
AGDPGTETF

SEQ ID NO: 894364 - protein, 7 aa, Mycobacterium
AGDPGVE

SEQ ID NO: 894365 - protein, 18 aa, Mycobacterium
AGDSAEDAAAQGTEAGRE

SEQ ID NO: 894366 - protein, 8 aa, Mycobacterium
AGDSDGDV

SEQ ID NO: 894367 - protein, 10 aa, Mycobacterium
AGDSNSDATF

SEQ ID NO: 894368 - protein, 9 aa, Mycobacterium
AGDSPSQGI

SEQ ID NO: 894369 - protein, 6 aa, Mycobacterium
AGDSSI

SEQ ID NO: 894370 - protein, 10 aa, Mycobacterium
AGDSTTAVGE

SEQ ID NO: 894371 - protein, 8 aa, Mycobacterium
AGDSTTDV

SEQ ID NO: 894372 - protein, 9 aa, Mycobacterium
AGDVETARK

SEQ ID NO: 894373 - protein, 8 aa, Mycobacterium
AGEAEDGY

SEQ ID NO: 894374 - protein, 22 aa, Mycobacterium
AGEAGAPAAGGAAAAGAAAASG

SEQ ID NO: 894375 - protein, 7 aa, Mycobacterium
AGEAMGN

SEQ ID NO: 894376 - protein, 23 aa, Mycobacterium
AGEAPRRDDPAAGGGSAGHSGGG

SEQ ID NO: 894377 - protein, 7 aa, Mycobacterium
AGEAPYT

SEQ ID NO: 894378 - protein, 5 aa, Mycobacterium
AGEAV

SEQ ID NO: 894379 - protein, 12 aa, Mycobacterium
AGEDESVTPSTL

SEQ ID NO: 894380 - protein, 7 aa, Mycobacterium
AGEFPDG

SEQ ID NO: 894381 - protein, 5 aa, Mycobacterium
AGEGA

SEQ ID NO: 894382 - protein, 11 aa, Mycobacterium
AGEGDGGDGGN

SEQ ID NO: 894383 - protein, 31 aa, Mycobacterium
AGEGGAPAAGGPAAAGGPAAAGGPAAAGATC

SEQ ID NO: 894384 - protein, 6 aa, Mycobacterium
AGEGPV

SEQ ID NO: 894385 - protein, 17 aa, Mycobacterium
AGEGQQTTTDACGPEVG

SEQ ID NO: 894386 - protein, 4 aa, Mycobacterium
AGEI

SEQ ID NO: 894387 - protein, 5 aa, Mycobacterium
AGEIR

SEQ ID NO: 894388 - protein, 5 aa, Mycobacterium
AGEKR

SEQ ID NO: 894389 - protein, 12 aa, Mycobacterium
AGELTGEQRQQA

SEQ ID NO: 894390 - protein, 7 aa, Mycobacterium
AGEPAAG

SEQ ID NO: 894391 - protein, 7 aa, Mycobacterium
AGEPGAD

SEQ ID NO: 894392 - protein, 10 aa, Mycobacterium
AGEPGGDTEP

SEQ ID NO: 894393 - protein, 5 aa, Mycobacterium
AGEPN

SEQ ID NO: 894394 - protein, 62 aa, Mycobacterium
AGEPPGPLPAHRAGRRARRAGRVGRGARRPGDRVQPRAGGGHRDVRAGRRAAPGAAGRRGGG

SEQ ID NO: 894395 - protein, 5 aa, Mycobacterium
AGEPT

SEQ ID NO: 894396 - protein, 7 aa, Mycobacterium
AGEPVPA

SEQ ID NO: 894397 - protein, 7 aa, Mycobacterium
AGEQNRD

SEQ ID NO: 894398 - protein, 8 aa, Mycobacterium
AGEQNRDM

SEQ ID NO: 894399 - protein, 7 aa, Mycobacterium
AGEQTQT

SEQ ID NO: 894400 - protein, 5 aa, Mycobacterium
AGERI

SEQ ID NO: 894401 - protein, 10 aa, Mycobacterium
AGESAGGTSV

SEQ ID NO: 894402 - protein, 5 aa, Mycobacterium
AGESI

SEQ ID NO: 894403 - protein, 8 aa, Mycobacterium
AGESITNA

SEQ ID NO: 894404 - protein, 5 aa, Mycobacterium
AGESV

SEQ ID NO: 894405 - protein, 8 aa, Mycobacterium
AGETMRPQ

SEQ ID NO: 894406 - protein, 23 aa, Mycobacterium
AGETVSRAGGLTNPVTTYENNPY

SEQ ID NO: 894407 - protein, 5 aa, Mycobacterium
AGFAA

SEQ ID NO: 894408 - protein, 12 aa, Mycobacterium
AGFASKTPANQA

SEQ ID NO: 894409 - protein, 5 aa, Mycobacterium
AGFPG

SEQ ID NO: 894410 - protein, 12 aa, Mycobacterium
AGFTNAPCSTST

SEQ ID NO: 894411 - protein, 11 aa, Mycobacterium
AGGAAATQSTD

SEQ ID NO: 894412 - protein, 12 aa, Mycobacterium
AGGAASAAGLPS

SEQ ID NO: 894413 - protein, 17 aa, Mycobacterium
AGGAGGAGGAGGPSYLT

SEQ ID NO: 894414 - protein, 13 aa, Mycobacterium
AGGAGGEGGAGGI

SEQ ID NO: 894415 - protein, 26 aa, Mycobacterium
AGGAGGNGAPDVGGGSPGSGGNGGAG

SEQ ID NO: 894416 - protein, 32 aa, Mycobacterium
AGGAGGRGGNNLANPATDGGAGGAGGNGGAGG

SEQ ID NO: 894417 - protein, 7 aa, Mycobacterium
AGGAGQP

SEQ ID NO: 894418 - protein, 9 aa, Mycobacterium
AGGAGRTAI

SEQ ID NO: 894419 - protein, 5 aa, Mycobacterium
AGGAL

SEQ ID NO: 894420 - protein, 6 aa, Mycobacterium
AGGALG

SEQ ID NO: 894421 - protein, 6 aa, Mycobacterium
AGGALR

SEQ ID NO: 894422 - protein, 9 aa, Mycobacterium
AGGANDASN

SEQ ID NO: 894423 - protein, 31 aa, Mycobacterium
AGGASDRTATSTGVPDPDPIPPGVAEAESFP

SEQ ID NO: 894424 - protein, 8 aa, Mycobacterium
AGGAVTGT

SEQ ID NO: 894425 - protein, 9 aa, Mycobacterium
AGGDDDVES

SEQ ID NO: 894426 - protein, 11 aa, Mycobacterium
AGGDGARSKGL

SEQ ID NO: 894427 - protein, 15 aa, Mycobacterium
AGGDGGSGGAGGTGV

SEQ ID NO: 894428 - protein, 47 aa, Mycobacterium
AGGDGGTGGVGGTNSPGGGPGGDGGSGGNAGLIGTGGAGGNGGNGVE

SEQ ID NO: 894429 - protein, 7 aa, Mycobacterium
AGGDPAA

SEQ ID NO: 894430 - protein, 6 aa, Mycobacterium
AGGDTA

SEQ ID NO: 894431 - protein, 5 aa, Mycobacterium
AGGDY

SEQ ID NO: 894432 - protein, 4 aa, Mycobacterium
AGGF

SEQ ID NO: 894433 - protein, 10 aa, Mycobacterium
AGGFGSADAY

SEQ ID NO: 894434 - protein, 5 aa, Mycobacterium
AGGFN

SEQ ID NO: 894435 - protein, 7 aa, Mycobacterium
AGGFNPQ

SEQ ID NO: 894436 - protein, 6 aa, Mycobacterium
AGGFSA

SEQ ID NO: 894437 - protein, 4 aa, Mycobacterium
AGGG

SEQ ID NO: 894438 - protein, 8 aa, Mycobacterium
AGGGANIP

SEQ ID NO: 894439 - protein, 5 aa, Mycobacterium
AGGGG

SEQ ID NO: 894440 - protein, 17 aa, Mycobacterium
AGGGGLSTWQGDRLHSR

SEQ ID NO: 894441 - protein, 18 aa, Mycobacterium
AGGGGRPAPVDATAAEAV

SEQ ID NO: 894442 - protein, 19 aa, Mycobacterium
AGGGRAAAAPGQDDHGAPV

SEQ ID NO: 894443 - protein, 14 aa, Mycobacterium
AGGGSRRLDSRPPF

SEQ ID NO: 894444 - protein, 6 aa, Mycobacterium
AGGHPA

SEQ ID NO: 894445 - protein, 5 aa, Mycobacterium
AGGIG

SEQ ID NO: 894446 - protein, 6 aa, Mycobacterium
AGGKNG

SEQ ID NO: 894447 - protein, 8 aa, Mycobacterium
AGGLKTGA

SEQ ID NO: 894448 - protein, 8 aa, Mycobacterium
AGGLPAAA

SEQ ID NO: 894449 - protein, 8 aa, Mycobacterium
AGGLPRAQ

SEQ ID NO: 894450 - protein, 9 aa, Mycobacterium
AGGLPTAAI

SEQ ID NO: 894451 - protein, 18 aa, Mycobacterium
AGGLPTASIGDSRSLVEG

SEQ ID NO: 894452 - protein, 8 aa, Mycobacterium
AGGLTTDA

SEQ ID NO: 894453 - protein, 16 aa, Mycobacterium
AGGMTRPVEGAHTGGF

SEQ ID NO: 894454 - protein, 15 aa, Mycobacterium
AGGNGGAGGAGGAAG

SEQ ID NO: 894455 - protein, 24 aa, Mycobacterium
AGGNGGDAGAGVAAADGGDGGNAG

SEQ ID NO: 894456 - protein, 144 aa, Mycobacterium
AGGNGGQGGSGLAGSNGVNPAAVTDPALNGAAGDSNINGNTTWHGTNGDPGTPGGTGVNGGNGGAGGDANDDVANSSGGLAGSGGSGATGGDGGANGGTGGAGGQAASYGYSSGGNGGTGGAGGTGADGGAGGDGGHGGAGGRG

SEQ ID NO: 894457 - protein, 8 aa, Mycobacterium
AGGNRCPT

SEQ ID NO: 894458 - protein, 4 aa, Mycobacterium
AGGP

SEQ ID NO: 894459 - protein, 5 aa, Mycobacterium
AGGPD

SEQ ID NO: 894460 - protein, 8 aa, Mycobacterium
AGGPELDR

SEQ ID NO: 894461 - protein, 14 aa, Mycobacterium
AGGPGAQAAPAPTD

SEQ ID NO: 894462 - protein, 58 aa, Mycobacterium
AGGPGGNGAPSVSGGGSGDGGDGGRGGVFGPGGRGGDGAPNPGGGSPGSGGNGGAGGL

SEQ ID NO: 894463 - protein, 7 aa, Mycobacterium
AGGPNPY

SEQ ID NO: 894464 - protein, 7 aa, Mycobacterium
AGGPSYW

SEQ ID NO: 894465 - protein, 7 aa, Mycobacterium
AGGPTDV

SEQ ID NO: 894466 - protein, 5 aa, Mycobacterium
AGGPV

SEQ ID NO: 894467 - protein, 7 aa, Mycobacterium
AGGPVSA

SEQ ID NO: 894468 - protein, 7 aa, Mycobacterium
AGGQGRA

SEQ ID NO: 894469 - protein, 6 aa, Mycobacterium
AGGQGW

SEQ ID NO: 894470 - protein, 12 aa, Mycobacterium
AGGQLTESVRRR

SEQ ID NO: 894471 - protein, 8 aa, Mycobacterium
AGGRDAGA

SEQ ID NO: 894472 - protein, 5 aa, Mycobacterium
AGGRN

SEQ ID NO: 894473 - protein, 9 aa, Mycobacterium
AGGRPRPDI

SEQ ID NO: 894474 - protein, 16 aa, Mycobacterium
AGGRPTLTAEQAGAAG

SEQ ID NO: 894475 - protein, 10 aa, Mycobacterium
AGGRTYATRP

SEQ ID NO: 894476 - protein, 6 aa, Mycobacterium
AGGRVA

SEQ ID NO: 894477 - protein, 11 aa, Mycobacterium
AGGRVNATNGL

SEQ ID NO: 894478 - protein, 5 aa, Mycobacterium
AGGRW

SEQ ID NO: 894479 - protein, 4 aa, Mycobacterium
AGGS

SEQ ID NO: 894480 - protein, 14 aa, Mycobacterium
AGGSAASALAGATA

SEQ ID NO: 894481 - protein, 14 aa, Mycobacterium
AGGSATSSAWSRRG

SEQ ID NO: 894482 - protein, 6 aa, Mycobacterium
AGGSDV

SEQ ID NO: 894483 - protein, 5 aa, Mycobacterium
AGGSE

SEQ ID NO: 894484 - protein, 8 aa, Mycobacterium
AGGSGTLG

SEQ ID NO: 894485 - protein, 8 aa, Mycobacterium
AGGSGTLS

SEQ ID NO: 894486 - protein, 9 aa, Mycobacterium
AGGSGTLSN

SEQ ID NO: 894487 - protein, 9 aa, Mycobacterium
AGGSHSDSL

SEQ ID NO: 894488 - protein, 5 aa, Mycobacterium
AGGSL

SEQ ID NO: 894489 - protein, 11 aa, Mycobacterium
AGGSLSNFGPA

SEQ ID NO: 894490 - protein, 6 aa, Mycobacterium
AGGSLV

SEQ ID NO: 894491 - protein, 6 aa, Mycobacterium
AGGSTG

SEQ ID NO: 894492 - protein, 15 aa, Mycobacterium
AGGSTIPVERTDPSF

SEQ ID NO: 894493 - protein, 6 aa, Mycobacterium
AGGSWT

SEQ ID NO: 894494 - protein, 4 aa, Mycobacterium
AGGT

SEQ ID NO: 894495 - protein, 8 aa, Mycobacterium
AGGTFSEG

SEQ ID NO: 894496 - protein, 7 aa, Mycobacterium
AGGTLTA

SEQ ID NO: 894497 - protein, 6 aa, Mycobacterium
AGGTNH

SEQ ID NO: 894498 - protein, 7 aa, Mycobacterium
AGGTQRE

SEQ ID NO: 894499 - protein, 14 aa, Mycobacterium
AGGTTAVGQPAWST

SEQ ID NO: 894500 - protein, 8 aa, Mycobacterium
AGGVADAR

SEQ ID NO: 894501 - protein, 5 aa, Mycobacterium
AGGVE

SEQ ID NO: 894502 - protein, 5 aa, Mycobacterium
AGGVG

SEQ ID NO: 894503 - protein, 14 aa, Mycobacterium
AGGVGRALPSWLGF

SEQ ID NO: 894504 - protein, 8 aa, Mycobacterium
AGGVGTSG

SEQ ID NO: 894505 - protein, 6 aa, Mycobacterium
AGGVPV

SEQ ID NO: 894506 - protein, 48 aa, Mycobacterium
AGGYASGGGGADSGAMGAPGGAVDGASSGVGGGGGGMAASAGAATPGM

SEQ ID NO: 894507 - protein, 5 aa, Mycobacterium
AGGYV

SEQ ID NO: 894508 - protein, 6 aa, Mycobacterium
AGGYYG

SEQ ID NO: 894509 - protein, 22 aa, Mycobacterium
AGHGGSNSHAPIPPPHAPTVKP

SEQ ID NO: 894510 - protein, 13 aa, Mycobacterium
AGHIPGATNLPST

SEQ ID NO: 894511 - protein, 7 aa, Mycobacterium
AGHPDFA

SEQ ID NO: 894512 - protein, 19 aa, Mycobacterium
AGHRPSRRAVRPEGLTRRE

SEQ ID NO: 894513 - protein, 11 aa, Mycobacterium
AGIADTSNRIQ

SEQ ID NO: 894514 - protein, 23 aa, Mycobacterium
AGIAGNRQSGAPTNPVTLTSVRV

SEQ ID NO: 894515 - protein, 7 aa, Mycobacterium
AGIGPNT

SEQ ID NO: 894516 - protein, 13 aa, Mycobacterium
AGINASPGLASYT

SEQ ID NO: 894517 - protein, 20 aa, Mycobacterium
AGIPNFTPGLTSASAPAPAA

SEQ ID NO: 894518 - protein, 6 aa, Mycobacterium
AGIPTD

SEQ ID NO: 894519 - protein, 6 aa, Mycobacterium
AGIPTG

SEQ ID NO: 894520 - protein, 15 aa, Mycobacterium
AGIQPGNGSLEVKIP

SEQ ID NO: 894521 - protein, 5 aa, Mycobacterium
AGISD

SEQ ID NO: 894522 - protein, 16 aa, Mycobacterium
AGISQPSMASVLESIV

SEQ ID NO: 894523 - protein, 10 aa, Mycobacterium
AGISSGSFRT

SEQ ID NO: 894524 - protein, 13 aa, Mycobacterium
AGITTGATSATSA

SEQ ID NO: 894525 - protein, 10 aa, Mycobacterium
AGKDPQMPPQ

SEQ ID NO: 894526 - protein, 15 aa, Mycobacterium
AGKEIAGALSPDGKV

SEQ ID NO: 894527 - protein, 9 aa, Mycobacterium
AGKIEPART

SEQ ID NO: 894528 - protein, 8 aa, Mycobacterium
AGKKSLTD

SEQ ID NO: 894529 - protein, 9 aa, Mycobacterium
AGKKSLTDF

SEQ ID NO: 894530 - protein, 6 aa, Mycobacterium
AGKKTL

SEQ ID NO: 894531 - protein, 11 aa, Mycobacterium
AGKPGAATPVI

SEQ ID NO: 894532 - protein, 8 aa, Mycobacterium
AGKPRRPY

SEQ ID NO: 894533 - protein, 14 aa, Mycobacterium
AGKQGLSGGNETWT

SEQ ID NO: 894534 - protein, 4 aa, Mycobacterium
AGKR

SEQ ID NO: 894535 - protein, 5 aa, Mycobacterium
AGKRG

SEQ ID NO: 894536 - protein, 4 aa, Mycobacterium
AGKS

SEQ ID NO: 894537 - protein, 5 aa, Mycobacterium
AGKSL

SEQ ID NO: 894538 - protein, 6 aa, Mycobacterium
AGKSLR

SEQ ID NO: 894539 - protein, 13 aa, Mycobacterium
AGKTVTVTNQGKT

SEQ ID NO: 894540 - protein, 4 aa, Mycobacterium
AGLA

SEQ ID NO: 894541 - protein, 9 aa, Mycobacterium
AGLAPGSGA

SEQ ID NO: 894542 - protein, 9 aa, Mycobacterium
AGLATADGG

SEQ ID NO: 894543 - protein, 11 aa, Mycobacterium
AGLATGPAHGT

SEQ ID NO: 894544 - protein, 11 aa, Mycobacterium
AGLATPDTPVA

SEQ ID NO: 894545 - protein, 11 aa, Mycobacterium
AGLDARPNQKP

SEQ ID NO: 894546 - protein, 9 aa, Mycobacterium
AGLDQDTYT

SEQ ID NO: 894547 - protein, 10 aa, Mycobacterium
AGLDQDTYTK

SEQ ID NO: 894548 - protein, 5 aa, Mycobacterium
AGLDS

SEQ ID NO: 894549 - protein, 9 aa, Mycobacterium
AGLEPARTL

SEQ ID NO: 894550 - protein, 11 aa, Mycobacterium
AGLESQSGNEA

SEQ ID NO: 894551 - protein, 4 aa, Mycobacterium
AGLG

SEQ ID NO: 894552 - protein, 14 aa, Mycobacterium
AGLGGPPSSRTAAD

SEQ ID NO: 894553 - protein, 8 aa, Mycobacterium
AGLGGQGF

SEQ ID NO: 894554 - protein, 8 aa, Mycobacterium
AGLGGQTP

SEQ ID NO: 894555 - protein, 7 aa, Mycobacterium
AGLGPGL

SEQ ID NO: 894556 - protein, 4 aa, Mycobacterium
AGLI

SEQ ID NO: 894557 - protein, 5 aa, Mycobacterium
AGLPA

SEQ ID NO: 894558 - protein, 8 aa, Mycobacterium
AGLPAKAV

SEQ ID NO: 894559 - protein, 7 aa, Mycobacterium
AGLPDLP

SEQ ID NO: 894560 - protein, 7 aa, Mycobacterium
AGLPGPV

SEQ ID NO: 894561 - protein, 5 aa, Mycobacterium
AGLPP

SEQ ID NO: 894562 - protein, 7 aa, Mycobacterium
AGLPPEA

SEQ ID NO: 894563 - protein, 5 aa, Mycobacterium
AGLPR

SEQ ID NO: 894564 - protein, 6 aa, Mycobacterium
AGLPRA

SEQ ID NO: 894565 - protein, 8 aa, Mycobacterium
AGLPTAAI

SEQ ID NO: 894566 - protein, 16 aa, Mycobacterium
AGLPTAAIGGEARVGE

SEQ ID NO: 894567 - protein, 5 aa, Mycobacterium
AGLPV

SEQ ID NO: 894568 - protein, 9 aa, Mycobacterium
AGLRGGGRA

SEQ ID NO: 894569 - protein, 15 aa, Mycobacterium
AGLRRGSGRRCRDPG

SEQ ID NO: 894570 - protein, 5 aa, Mycobacterium
AGLSD

SEQ ID NO: 894571 - protein, 6 aa, Mycobacterium
AGLSGV

SEQ ID NO: 894572 - protein, 8 aa, Mycobacterium
AGLSLGDG

SEQ ID NO: 894573 - protein, 6 aa, Mycobacterium
AGLTAE

SEQ ID NO: 894574 - protein, 6 aa, Mycobacterium
AGLTKQ

SEQ ID NO: 894575 - protein, 22 aa, Mycobacterium
AGLTPDDVDGLASTGQGTLPPV

SEQ ID NO: 894576 - protein, 15 aa, Mycobacterium
AGMAPQAKSGYPATP

SEQ ID NO: 894577 - protein, 4 aa, Mycobacterium
AGMG

SEQ ID NO: 894578 - protein, 6 aa, Mycobacterium
AGMPAP

SEQ ID NO: 894579 - protein, 6 aa, Mycobacterium
AGMPDR

SEQ ID NO: 894580 - protein, 10 aa, Mycobacterium
AGMPPEAVGP

SEQ ID NO: 894581 - protein, 7 aa, Mycobacterium
AGMTSLG

SEQ ID NO: 894582 - protein, 6 aa, Mycobacterium
AGNAAG

SEQ ID NO: 894583 - protein, 9 aa, Mycobacterium
AGNAARTRY

SEQ ID NO: 894584 - protein, 13 aa, Mycobacterium
AGNAARTRYESFP

SEQ ID NO: 894585 - protein, 17 aa, Mycobacterium
AGNADPNNGALQCGAPL

SEQ ID NO: 894586 - protein, 8 aa, Mycobacterium
AGNARFAG

SEQ ID NO: 894587 - protein, 6 aa, Mycobacterium
AGNCSR

SEQ ID NO: 894588 - protein, 7 aa, Mycobacterium
AGNDDAL

SEQ ID NO: 894589 - protein, 6 aa, Mycobacterium
AGNDRT

SEQ ID NO: 894590 - protein, 12 aa, Mycobacterium
AGNDSSLSEDAA

SEQ ID NO: 894591 - protein, 6 aa, Mycobacterium
AGNEFP

SEQ ID NO: 894592 - protein, 20 aa, Mycobacterium
AGNENPALEDPHGQPPQSIA

SEQ ID NO: 894593 - protein, 25 aa, Mycobacterium
AGNENPALEDPYGRPPQSIAGTEAV

SEQ ID NO: 894594 - protein, 4 aa, Mycobacterium
AGNG

SEQ ID NO: 894595 - protein, 74 aa, Mycobacterium
AGNGAAGGLGGNGGTVGTGQSTNGGAGGDGGSGGSAGLFGGGGAGALGGDGGNGVGSDGSGGGAGSGGDGGNGG

SEQ ID NO: 894596 - protein, 22 aa, Mycobacterium
AGNGGSGGNGASSTATSGDGFG

SEQ ID NO: 894597 - protein, 6 aa, Mycobacterium
AGNGRY

SEQ ID NO: 894598 - protein, 7 aa, Mycobacterium
AGNGRYA

SEQ ID NO: 894599 - protein, 17 aa, Mycobacterium
AGNGSTTITGRREPGAR

SEQ ID NO: 894600 - protein, 10 aa, Mycobacterium
AGNHQTPNGT

SEQ ID NO: 894601 - protein, 7 aa, Mycobacterium
AGNLPGD

SEQ ID NO: 894602 - protein, 5 aa, Mycobacterium
AGNNI

SEQ ID NO: 894603 - protein, 4 aa, Mycobacterium
AGNP

SEQ ID NO: 894604 - protein, 16 aa, Mycobacterium
AGPAADGKAPDVEPDV

SEQ ID NO: 894605 - protein, 6 aa, Mycobacterium
AGPAAG

SEQ ID NO: 894606 - protein, 24 aa, Mycobacterium
AGPADTERPVRSITTGRRGYEGEG

SEQ ID NO: 894607 - protein, 7 aa, Mycobacterium
AGPAGGY

SEQ ID NO: 894608 - protein, 9 aa, Mycobacterium
AGPAGSAAA

SEQ ID NO: 894609 - protein, 5 aa, Mycobacterium
AGPAK

SEQ ID NO: 894610 - protein, 5 aa, Mycobacterium
AGPAM

SEQ ID NO: 894611 - protein, 6 aa, Mycobacterium
AGPAPM

SEQ ID NO: 894612 - protein, 10 aa, Mycobacterium
AGPAPSDPRV

SEQ ID NO: 894613 - protein, 8 aa, Mycobacterium
AGPAQADP

SEQ ID NO: 894614 - protein, 31 aa, Mycobacterium
AGPARAGGTTSSPGTADPAAVTTDPADTALA

SEQ ID NO: 894615 - protein, 10 aa, Mycobacterium
AGPASAAPDC

SEQ ID NO: 894616 - protein, 19 aa, Mycobacterium
AGPASAEPVAPDSGTIPEN

SEQ ID NO: 894617 - protein, 20 aa, Mycobacterium
AGPASLASNFSRTSTSAGSF

SEQ ID NO: 894618 - protein, 16 aa, Mycobacterium
AGPATIPTPGPGPGQT

SEQ ID NO: 894619 - protein, 13 aa, Mycobacterium
AGPATPAGGGTVT

SEQ ID NO: 894620 - protein, 10 aa, Mycobacterium
AGPDADAGSR

SEQ ID NO: 894621 - protein, 6 aa, Mycobacterium
AGPDEF

SEQ ID NO: 894622 - protein, 9 aa, Mycobacterium
AGPDRAEKY

SEQ ID NO: 894623 - protein, 8 aa, Mycobacterium
AGPDSAAA

SEQ ID NO: 894624 - protein, 9 aa, Mycobacterium
AGPDTDATT

SEQ ID NO: 894625 - protein, 5 aa, Mycobacterium
AGPDV

SEQ ID NO: 894626 - protein, 15 aa, Mycobacterium
AGPDVRPALGEPAEV

SEQ ID NO: 894627 - protein, 9 aa, Mycobacterium
AGPEEAAGY

SEQ ID NO: 894628 - protein, 7 aa, Mycobacterium
AGPEKQG

SEQ ID NO: 894629 - protein, 7 aa, Mycobacterium
AGPELSR

SEQ ID NO: 894630 - protein, 7 aa, Mycobacterium
AGPFGED

SEQ ID NO: 894631 - protein, 7 aa, Mycobacterium
AGPGAEI

SEQ ID NO: 894632 - protein, 14 aa, Mycobacterium
AGPGEPGPQAPGNA

SEQ ID NO: 894633 - protein, 7 aa, Mycobacterium
AGPGGKY

SEQ ID NO: 894634 - protein, 6 aa, Mycobacterium
AGPGGS

SEQ ID NO: 894635 - protein, 9 aa, Mycobacterium
AGPGHSQGL

SEQ ID NO: 894636 - protein, 14 aa, Mycobacterium
AGPGLSDSRVRDQI

SEQ ID NO: 894637 - protein, 21 aa, Mycobacterium
AGPGNEWSDHTDGYVPTYTTQ

SEQ ID NO: 894638 - protein, 12 aa, Mycobacterium
AGPGNEWSGHTE

SEQ ID NO: 894639 - protein, 11 aa, Mycobacterium
AGPGNEWTGHT

SEQ ID NO: 894640 - protein, 7 aa, Mycobacterium
AGPGSAR

SEQ ID NO: 894641 - protein, 13 aa, Mycobacterium
AGPLPGPAPANRA

SEQ ID NO: 894642 - protein, 6 aa, Mycobacterium
AGPNQI

SEQ ID NO: 894643 - protein, 4 aa, Mycobacterium
AGPP

SEQ ID NO: 894644 - protein, 20 aa, Mycobacterium
AGPPDRPQATKAACGSEDSN

SEQ ID NO: 894645 - protein, 7 aa, Mycobacterium
AGPPGVA

SEQ ID NO: 894646 - protein, 12 aa, Mycobacterium
AGPPPPPGDPSA

SEQ ID NO: 894647 - protein, 9 aa, Mycobacterium
AGPPPSPIE

SEQ ID NO: 894648 - protein, 10 aa, Mycobacterium
AGPPPTPNKI

SEQ ID NO: 894649 - protein, 8 aa, Mycobacterium
AGPQGRVS

SEQ ID NO: 894650 - protein, 6 aa, Mycobacterium
AGPQQR

SEQ ID NO: 894651 - protein, 15 aa, Mycobacterium
AGPRDDTAAAPDPGW

SEQ ID NO: 894652 - protein, 19 aa, Mycobacterium
AGPRTSEGSRGAELDSGTG

SEQ ID NO: 894653 - protein, 5 aa, Mycobacterium
AGPSA

SEQ ID NO: 894654 - protein, 8 aa, Mycobacterium
AGPSGTPL

SEQ ID NO: 894655 - protein, 7 aa, Mycobacterium
AGPSVEN

SEQ ID NO: 894656 - protein, 7 aa, Mycobacterium
AGPTAPV

SEQ ID NO: 894657 - protein, 6 aa, Mycobacterium
AGPTEL

SEQ ID NO: 894658 - protein, 10 aa, Mycobacterium
AGPTESPDSV

SEQ ID NO: 894659 - protein, 7 aa, Mycobacterium
AGPTGLA

SEQ ID NO: 894660 - protein, 9 aa, Mycobacterium
AGPTSAADA

SEQ ID NO: 894661 - protein, 8 aa, Mycobacterium
AGPTSHGT

SEQ ID NO: 894662 - protein, 16 aa, Mycobacterium
AGPWTGPSSASMTAAA

SEQ ID NO: 894663 - protein, 4 aa, Mycobacterium
AGQA

SEQ ID NO: 894664 - protein, 18 aa, Mycobacterium
AGQAERGAWAPIRESHPS

SEQ ID NO: 894665 - protein, 9 aa, Mycobacterium
AGQASYTAA

SEQ ID NO: 894666 - protein, 6 aa, Mycobacterium
AGQATA

SEQ ID NO: 894667 - protein, 5 aa, Mycobacterium
AGQGF

SEQ ID NO: 894668 - protein, 36 aa, Mycobacterium
AGQGPTVAPVPAGAAGAAGAAVGARAPWGDRGQPAC

SEQ ID NO: 894669 - protein, 7 aa, Mycobacterium
AGQGRGA

SEQ ID NO: 894670 - protein, 4 aa, Mycobacterium
AGQI

SEQ ID NO: 894671 - protein, 17 aa, Mycobacterium
AGQISQTASQESAVNGN

SEQ ID NO: 894672 - protein, 24 aa, Mycobacterium
AGQISQTTTQEPAVNGVNAQAGQV

SEQ ID NO: 894673 - protein, 8 aa, Mycobacterium
AGQKVGST

SEQ ID NO: 894674 - protein, 5 aa, Mycobacterium
AGQLG

SEQ ID NO: 894675 - protein, 7 aa, Mycobacterium
AGQNVGS

SEQ ID NO: 894676 - protein, 6 aa, Mycobacterium
AGQPFA

SEQ ID NO: 894677 - protein, 12 aa, Mycobacterium
AGQPPGVIVLVT

SEQ ID NO: 894678 - protein, 4 aa, Mycobacterium
AGQR

SEQ ID NO: 894679 - protein, 13 aa, Mycobacterium
AGQRCGSISSVGN

SEQ ID NO: 894680 - protein, 10 aa, Mycobacterium
AGQRGLQDSG

SEQ ID NO: 894681 - protein, 8 aa, Mycobacterium
AGQSAGGV

SEQ ID NO: 894682 - protein, 8 aa, Mycobacterium
AGQSPARY

SEQ ID NO: 894683 - protein, 20 aa, Mycobacterium
AGQTAAAQERRESADAAAAR

SEQ ID NO: 894684 - protein, 8 aa, Mycobacterium
AGQTMRPQ

SEQ ID NO: 894685 - protein, 7 aa, Mycobacterium
AGQTPGT

SEQ ID NO: 894686 - protein, 9 aa, Mycobacterium
AGQTVQPQP

SEQ ID NO: 894687 - protein, 7 aa, Mycobacterium
AGQTYTA

SEQ ID NO: 894688 - protein, 4 aa, Mycobacterium
AGQV

SEQ ID NO: 894689 - protein, 21 aa, Mycobacterium
AGQVSQTATQEPAINGTSGLA

SEQ ID NO: 894690 - protein, 7 aa, Mycobacterium
AGQVTPD

SEQ ID NO: 894691 - protein, 4 aa, Mycobacterium
AGRA

SEQ ID NO: 894692 - protein, 9 aa, Mycobacterium
AGRAGSLGG

SEQ ID NO: 894693 - protein, 9 aa, Mycobacterium
AGRAPESGL

SEQ ID NO: 894694 - protein, 6 aa, Mycobacterium
AGRARA

SEQ ID NO: 894695 - protein, 10 aa, Mycobacterium
AGRARANGDD

SEQ ID NO: 894696 - protein, 14 aa, Mycobacterium
AGRASRLIDRRPPF

SEQ ID NO: 894697 - protein, 25 aa, Mycobacterium
AGRATATVTTRPGPAVDAAQTSAMS

SEQ ID NO: 894698 - protein, 5 aa, Mycobacterium
AGRAV

SEQ ID NO: 894699 - protein, 4 aa, Mycobacterium
AGRD

SEQ ID NO: 894700 - protein, 11 aa, Mycobacterium
AGRDGSATGAA

SEQ ID NO: 894701 - protein, 11 aa, Mycobacterium
AGRDGSSTGAA

SEQ ID NO: 894702 - protein, 12 aa, Mycobacterium
AGRDGSSTGSAA

SEQ ID NO: 894703 - protein, 8 aa, Mycobacterium
AGRDPGEV

SEQ ID NO: 894704 - protein, 6 aa, Mycobacterium
AGRDPL

SEQ ID NO: 894705 - protein, 9 aa, Mycobacterium
AGRDQALGN

SEQ ID NO: 894706 - protein, 7 aa, Mycobacterium
AGRDRAR

SEQ ID NO: 894707 - protein, 14 aa, Mycobacterium
AGREATNESPTAVG

SEQ ID NO: 894708 - protein, 8 aa, Mycobacterium
AGRGADET

SEQ ID NO: 894709 - protein, 29 aa, Mycobacterium
AGRGAGGMGPRVPNEAAAEEDGEPKRKPT

SEQ ID NO: 894710 - protein, 28 aa, Mycobacterium
AGRGATGAGSRSPSESATNEDEQPQRKP

SEQ ID NO: 894711 - protein, 6 aa, Mycobacterium
AGRGEP

SEQ ID NO: 894712 - protein, 14 aa, Mycobacterium
AGRGGDPQWAAPPP

SEQ ID NO: 894713 - protein, 14 aa, Mycobacterium
AGRGIPTGTCPSVG

SEQ ID NO: 894714 - protein, 6 aa, Mycobacterium
AGRGNR

SEQ ID NO: 894715 - protein, 8 aa, Mycobacterium
AGRGPPSV

SEQ ID NO: 894716 - protein, 6 aa, Mycobacterium
AGRGTR

SEQ ID NO: 894717 - protein, 15 aa, Mycobacterium
AGRGVPTGTCPSVGA

SEQ ID NO: 894718 - protein, 5 aa, Mycobacterium
AGRGW

SEQ ID NO: 894719 - protein, 17 aa, Mycobacterium
AGRHGAVSPPPVAAPPT

SEQ ID NO: 894720 - protein, 13 aa, Mycobacterium
AGRLQRRGGGRGI

SEQ ID NO: 894721 - protein, 11 aa, Mycobacterium
AGRLSREEAAE

SEQ ID NO: 894722 - protein, 8 aa, Mycobacterium
AGRNAGDV

SEQ ID NO: 894723 - protein, 4 aa, Mycobacterium
AGRP

SEQ ID NO: 894724 - protein, 84 aa, Mycobacterium
AGRPAELSAPHGGVPQGLGDAGPSGGHPHGLPPHGGGPHGPGDASHGARHAEPPRDGTAHGTADGGDAHGDDVSGHGLSAEKRD

SEQ ID NO: 894725 - protein, 9 aa, Mycobacterium
AGRPAPSAV

SEQ ID NO: 894726 - protein, 6 aa, Mycobacterium
AGRPGA

SEQ ID NO: 894727 - protein, 61 aa, Mycobacterium
AGRPGDPPPNVPGTPVPLPAQAPPGARTENLAPAGPTPPPSTFAPGFPPGPAAPPGPGNQL

SEQ ID NO: 894728 - protein, 64 aa, Mycobacterium
AGRPGEPAPDAPGTPVPLPPDAPPGARTEPVGPAGPTPPPSTFAPGLPPGPPAPPGPGPQLPDP

SEQ ID NO: 894729 - protein, 8 aa, Mycobacterium
AGRPLDLP

SEQ ID NO: 894730 - protein, 7 aa, Mycobacterium
AGRPLPE

SEQ ID NO: 894731 - protein, 8 aa, Mycobacterium
AGRPPSGL

SEQ ID NO: 894732 - protein, 7 aa, Mycobacterium
AGRPQAV

SEQ ID NO: 894733 - protein, 8 aa, Mycobacterium
AGRPSTFP

SEQ ID NO: 894734 - protein, 5 aa, Mycobacterium
AGRQG

SEQ ID NO: 894735 - protein, 14 aa, Mycobacterium
AGRQRSIDARAREI

SEQ ID NO: 894736 - protein, 11 aa, Mycobacterium
AGRQRSQPVPG

SEQ ID NO: 894737 - protein, 12 aa, Mycobacterium
AGRRALSDGAEG

SEQ ID NO: 894738 - protein, 8 aa, Mycobacterium
AGRRDSLA

SEQ ID NO: 894739 - protein, 7 aa, Mycobacterium
AGRRESL

SEQ ID NO: 894740 - protein, 9 aa, Mycobacterium
AGRRESLAD

SEQ ID NO: 894741 - protein, 9 aa, Mycobacterium
AGRRESLAG

SEQ ID NO: 894742 - protein, 5 aa, Mycobacterium
AGRRI

SEQ ID NO: 894743 - protein, 5 aa, Mycobacterium
AGRRR

SEQ ID NO: 894744 - protein, 18 aa, Mycobacterium
AGRSAYAAARSLSGADAR

SEQ ID NO: 894745 - protein, 10 aa, Mycobacterium
AGRSGRRGQG

SEQ ID NO: 894746 - protein, 16 aa, Mycobacterium
AGRSMGPRRLAGRDGE

SEQ ID NO: 894747 - protein, 7 aa, Mycobacterium
AGRSVAA

SEQ ID NO: 894748 - protein, 10 aa, Mycobacterium
AGRSVSPAAS

SEQ ID NO: 894749 - protein, 6 aa, Mycobacterium
AGRTEA

SEQ ID NO: 894750 - protein, 6 aa, Mycobacterium
AGRTEQ

SEQ ID NO: 894751 - protein, 16 aa, Mycobacterium
AGRTTGRKTKEAAERA

SEQ ID NO: 894752 - protein, 15 aa, Mycobacterium
AGRTTSKLWGLWPFS

SEQ ID NO: 894753 - protein, 26 aa, Mycobacterium
AGRVDGRAVDARGGRELTTVQREDDT

SEQ ID NO: 894754 - protein, 14 aa, Mycobacterium
AGRYETPSYAPEPG

SEQ ID NO: 894755 - protein, 5 aa, Mycobacterium
AGSAE

SEQ ID NO: 894756 - protein, 11 aa, Mycobacterium
AGSAGTLTAPD

SEQ ID NO: 894757 - protein, 11 aa, Mycobacterium
AGSAHAAPPCA

SEQ ID NO: 894758 - protein, 18 aa, Mycobacterium
AGSAPAVAEPNTGNATDM

SEQ ID NO: 894759 - protein, 14 aa, Mycobacterium
AGSAPQRTDGKTAV

SEQ ID NO: 894760 - protein, 8 aa, Mycobacterium
AGSAPTLA

SEQ ID NO: 894761 - protein, 4 aa, Mycobacterium
AGSD

SEQ ID NO: 894762 - protein, 10 aa, Mycobacterium
AGSDAEARSD

SEQ ID NO: 894763 - protein, 19 aa, Mycobacterium
AGSDDQFRTAAGGGPASQW

SEQ ID NO: 894764 - protein, 39 aa, Mycobacterium
AGSDGAQGARVGVPGDPGDPPDPGSGAGQNAVDAAAGRD

SEQ ID NO: 894765 - protein, 23 aa, Mycobacterium
AGSDRAKTDSSSALAQASATPAL

SEQ ID NO: 894766 - protein, 40 aa, Mycobacterium
AGSDSGGESTLETTTTESVVETTAPETTAPETSDGSATVE

SEQ ID NO: 894767 - protein, 8 aa, Mycobacterium
AGSDTGPF

SEQ ID NO: 894768 - protein, 7 aa, Mycobacterium
AGSEDIN

SEQ ID NO: 894769 - protein, 5 aa, Mycobacterium
AGSEL

SEQ ID NO: 894770 - protein, 9 aa, Mycobacterium
AGSEQARYD

SEQ ID NO: 894771 - protein, 22 aa, Mycobacterium
AGSESVEGIDTVEDDTIDQTGS

SEQ ID NO: 894772 - protein, 8 aa, Mycobacterium
AGSFPDGL

SEQ ID NO: 894773 - protein, 11 aa, Mycobacterium
AGSGAPSPDFA

SEQ ID NO: 894774 - protein, 24 aa, Mycobacterium
AGSGGGDPAGGSYPAEMLVDYVRV

SEQ ID NO: 894775 - protein, 24 aa, Mycobacterium
AGSGGGDPGPGSYPADMLIDWIRV

SEQ ID NO: 894776 - protein, 24 aa, Mycobacterium
AGSGGGDPGPGTYPADMLIDWIRV

SEQ ID NO: 894777 - protein, 24 aa, Mycobacterium
AGSGGGDPRGGTYPAEMLVDWIRV

SEQ ID NO: 894778 - protein, 24 aa, Mycobacterium
AGSGGGDPRPGSYPAQMLVDWVRV

SEQ ID NO: 894779 - protein, 24 aa, Mycobacterium
AGSGGGDPSGGTYPADMLVDWVRV

SEQ ID NO: 894780 - protein, 24 aa, Mycobacterium
AGSGGPEQAESTGSGEVSADTSGT

SEQ ID NO: 894781 - protein, 25 aa, Mycobacterium
AGSGGQGQAGTSGFGGFGGSGGSAE

SEQ ID NO: 894782 - protein, 13 aa, Mycobacterium
AGSGGTHASRDKF

SEQ ID NO: 894783 - protein, 8 aa, Mycobacterium
AGSGIGRA

SEQ ID NO: 894784 - protein, 9 aa, Mycobacterium
AGSGIGRAA

SEQ ID NO: 894785 - protein, 10 aa, Mycobacterium
AGSGIPPATY

SEQ ID NO: 894786 - protein, 12 aa, Mycobacterium
AGSGQADLPSAG

SEQ ID NO: 894787 - protein, 14 aa, Mycobacterium
AGSGQVTSYGPPAS

SEQ ID NO: 894788 - protein, 7 aa, Mycobacterium
AGSGTLG

SEQ ID NO: 894789 - protein, 9 aa, Mycobacterium
AGSGTLGDR

SEQ ID NO: 894790 - protein, 7 aa, Mycobacterium
AGSGVDE

SEQ ID NO: 894791 - protein, 5 aa, Mycobacterium
AGSIG

SEQ ID NO: 894792 - protein, 7 aa, Mycobacterium
AGSIGPM

SEQ ID NO: 894793 - protein, 5 aa, Mycobacterium
AGSKS

SEQ ID NO: 894794 - protein, 6 aa, Mycobacterium
AGSMGR

SEQ ID NO: 894795 - protein, 12 aa, Mycobacterium
AGSNAAAITGPV

SEQ ID NO: 894796 - protein, 13 aa, Mycobacterium
AGSNDYAPEDSAG

SEQ ID NO: 894797 - protein, 11 aa, Mycobacterium
AGSNDYSPLES

SEQ ID NO: 894798 - protein, 13 aa, Mycobacterium
AGSNEYGPGDSAG

SEQ ID NO: 894799 - protein, 7 aa, Mycobacterium
AGSNTDL

SEQ ID NO: 894800 - protein, 9 aa, Mycobacterium
AGSPAAATG

SEQ ID NO: 894801 - protein, 17 aa, Mycobacterium
AGSPATAALPAAEPIPG

SEQ ID NO: 894802 - protein, 8 aa, Mycobacterium
AGSPEVDP

SEQ ID NO: 894803 - protein, 8 aa, Mycobacterium
AGSPGGST

SEQ ID NO: 894804 - protein, 11 aa, Mycobacterium
AGSPLPASWPD

SEQ ID NO: 894805 - protein, 8 aa, Mycobacterium
AGSPPTLP

SEQ ID NO: 894806 - protein, 7 aa, Mycobacterium
AGSPQGL

SEQ ID NO: 894807 - protein, 7 aa, Mycobacterium
AGSPSAH

SEQ ID NO: 894808 - protein, 9 aa, Mycobacterium
AGSPSGQGP

SEQ ID NO: 894809 - protein, 8 aa, Mycobacterium
AGSPSTRI

SEQ ID NO: 894810 - protein, 4 aa, Mycobacterium
AGSR

SEQ ID NO: 894811 - protein, 7 aa, Mycobacterium
AGSRPDK

SEQ ID NO: 894812 - protein, 8 aa, Mycobacterium
AGSSATIG

SEQ ID NO: 894813 - protein, 10 aa, Mycobacterium
AGSSCDRPGT

SEQ ID NO: 894814 - protein, 13 aa, Mycobacterium
AGSSGAHQTISGP

SEQ ID NO: 894815 - protein, 9 aa, Mycobacterium
AGSSGTLNV

SEQ ID NO: 894816 - protein, 23 aa, Mycobacterium
AGSSGTLTTPDNYDRADSPSDGI

SEQ ID NO: 894817 - protein, 23 aa, Mycobacterium
AGSSGTLTTPDNYQRTDSPSEGI

SEQ ID NO: 894818 - protein, 60 aa, Mycobacterium
AGSSPLGPAFGPPLGPVPNQPGATPSPVYGQTPPGSPPSIHGGTAPAPAAPTTVTPQAPL

SEQ ID NO: 894819 - protein, 9 aa, Mycobacterium
AGSSTVPGV

SEQ ID NO: 894820 - protein, 4 aa, Mycobacterium
AGSV

SEQ ID NO: 894821 - protein, 11 aa, Mycobacterium
AGSVPVPDGPA

SEQ ID NO: 894822 - protein, 6 aa, Mycobacterium
AGSVTK

SEQ ID NO: 894823 - protein, 13 aa, Mycobacterium
AGSYTAAEAANVT

SEQ ID NO: 894824 - protein, 6 aa, Mycobacterium
AGTAAA

SEQ ID NO: 894825 - protein, 15 aa, Mycobacterium
AGTAAADDKVPLGGG

SEQ ID NO: 894826 - protein, 27 aa, Mycobacterium
AGTAAEKGAPLAEAARARGEKLASKAR

SEQ ID NO: 894827 - protein, 16 aa, Mycobacterium
AGTAEQHAGGHTDSVD

SEQ ID NO: 894828 - protein, 8 aa, Mycobacterium
AGTAGADV

SEQ ID NO: 894829 - protein, 10 aa, Mycobacterium
AGTANADGVN

SEQ ID NO: 894830 - protein, 16 aa, Mycobacterium
AGTAPGGADASPLQSL

SEQ ID NO: 894831 - protein, 14 aa, Mycobacterium
AGTAPLSADGQGVL

SEQ ID NO: 894832 - protein, 6 aa, Mycobacterium
AGTAPR

SEQ ID NO: 894833 - protein, 23 aa, Mycobacterium
AGTARPRLAPPVPSIPGRRGKPT

SEQ ID NO: 894834 - protein, 23 aa, Mycobacterium
AGTARSRLAPPVPSIPGRRSKPT

SEQ ID NO: 894835 - protein, 9 aa, Mycobacterium
AGTASAARD

SEQ ID NO: 894836 - protein, 14 aa, Mycobacterium
AGTASALPGTCDGS

SEQ ID NO: 894837 - protein, 8 aa, Mycobacterium
AGTDSGDL

SEQ ID NO: 894838 - protein, 8 aa, Mycobacterium
AGTDTGPI

SEQ ID NO: 894839 - protein, 9 aa, Mycobacterium
AGTEADEHP

SEQ ID NO: 894840 - protein, 8 aa, Mycobacterium
AGTEDKAA

SEQ ID NO: 894841 - protein, 6 aa, Mycobacterium
AGTEIG

SEQ ID NO: 894842 - protein, 11 aa, Mycobacterium
AGTEPPADLAG

SEQ ID NO: 894843 - protein, 5 aa, Mycobacterium
AGTGA

SEQ ID NO: 894844 - protein, 8 aa, Mycobacterium
AGTGDKAT

SEQ ID NO: 894845 - protein, 5 aa, Mycobacterium
AGTGE

SEQ ID NO: 894846 - protein, 10 aa, Mycobacterium
AGTGFREGSA

SEQ ID NO: 894847 - protein, 5 aa, Mycobacterium
AGTGG

SEQ ID NO: 894848 - protein, 25 aa, Mycobacterium
AGTGGPANDEATSGVGDVPTDTSAT

SEQ ID NO: 894849 - protein, 15 aa, Mycobacterium
AGTGIGSATARRALA

SEQ ID NO: 894850 - protein, 10 aa, Mycobacterium
AGTGLREGSA

SEQ ID NO: 894851 - protein, 8 aa, Mycobacterium
AGTGLYGA

SEQ ID NO: 894852 - protein, 9 aa, Mycobacterium
AGTGPRTAA

SEQ ID NO: 894853 - protein, 5 aa, Mycobacterium
AGTGR

SEQ ID NO: 894854 - protein, 12 aa, Mycobacterium
AGTGSPRGSCDT

SEQ ID NO: 894855 - protein, 16 aa, Mycobacterium
AGTGTIDAEGKVGPIG

SEQ ID NO: 894856 - protein, 15 aa, Mycobacterium
AGTGVANAEPNLDSA

SEQ ID NO: 894857 - protein, 5 aa, Mycobacterium
AGTIS

SEQ ID NO: 894858 - protein, 16 aa, Mycobacterium
AGTLAEAQRAANAAAS

SEQ ID NO: 894859 - protein, 5 aa, Mycobacterium
AGTLG

SEQ ID NO: 894860 - protein, 14 aa, Mycobacterium
AGTNGAGARPGPRY

SEQ ID NO: 894861 - protein, 9 aa, Mycobacterium
AGTNTNQPL

SEQ ID NO: 894862 - protein, 4 aa, Mycobacterium
AGTP

SEQ ID NO: 894863 - protein, 13 aa, Mycobacterium
AGTPADDANQVTR

SEQ ID NO: 894864 - protein, 9 aa, Mycobacterium
AGTPAPSVS

SEQ ID NO: 894865 - protein, 6 aa, Mycobacterium
AGTPEQ

SEQ ID NO: 894866 - protein, 6 aa, Mycobacterium
AGTPFP

SEQ ID NO: 894867 - protein, 5 aa, Mycobacterium
AGTPR

SEQ ID NO: 894868 - protein, 6 aa, Mycobacterium
AGTPRV

SEQ ID NO: 894869 - protein, 11 aa, Mycobacterium
AGTPTRAGRLG

SEQ ID NO: 894870 - protein, 7 aa, Mycobacterium
AGTPTSI

SEQ ID NO: 894871 - protein, 7 aa, Mycobacterium
AGTPVPQ

SEQ ID NO: 894872 - protein, 18 aa, Mycobacterium
AGTQRAARYQDGSQTQIS

SEQ ID NO: 894873 - protein, 7 aa, Mycobacterium
AGTRDSL

SEQ ID NO: 894874 - protein, 5 aa, Mycobacterium
AGTRF

SEQ ID NO: 894875 - protein, 11 aa, Mycobacterium
AGTRMKSDTPK

SEQ ID NO: 894876 - protein, 6 aa, Mycobacterium
AGTSAP

SEQ ID NO: 894877 - protein, 10 aa, Mycobacterium
AGTSFATPDK

SEQ ID NO: 894878 - protein, 8 aa, Mycobacterium
AGTSGAPW

SEQ ID NO: 894879 - protein, 10 aa, Mycobacterium
AGTSTSGAEI

SEQ ID NO: 894880 - protein, 4 aa, Mycobacterium
AGTT

SEQ ID NO: 894881 - protein, 5 aa, Mycobacterium
AGTTS

SEQ ID NO: 894882 - protein, 7 aa, Mycobacterium
AGTVTGV

SEQ ID NO: 894883 - protein, 6 aa, Mycobacterium
AGVAAS

SEQ ID NO: 894884 - protein, 9 aa, Mycobacterium
AGVAASTSS

SEQ ID NO: 894885 - protein, 6 aa, Mycobacterium
AGVAPG

SEQ ID NO: 894886 - protein, 11 aa, Mycobacterium
AGVASANPNDA

SEQ ID NO: 894887 - protein, 9 aa, Mycobacterium
AGVDDSEHA

SEQ ID NO: 894888 - protein, 6 aa, Mycobacterium
AGVDKQ

SEQ ID NO: 894889 - protein, 12 aa, Mycobacterium
AGVDRKDIRTTE

SEQ ID NO: 894890 - protein, 13 aa, Mycobacterium
AGVEPPRSEAPDH

SEQ ID NO: 894891 - protein, 23 aa, Mycobacterium
AGVGATPAHADPAAPGAPGNPVD

SEQ ID NO: 894892 - protein, 10 aa, Mycobacterium
AGVGGAPIGC

SEQ ID NO: 894893 - protein, 6 aa, Mycobacterium
AGVGRT

SEQ ID NO: 894894 - protein, 5 aa, Mycobacterium
AGVGS

SEQ ID NO: 894895 - protein, 18 aa, Mycobacterium
AGVGTGGPSALTAVPAAA

SEQ ID NO: 894896 - protein, 8 aa, Mycobacterium
AGVHPSRV

SEQ ID NO: 894897 - protein, 10 aa, Mycobacterium
AGVKEENADC

SEQ ID NO: 894898 - protein, 13 aa, Mycobacterium
AGVNPGDAPSYAS

SEQ ID NO: 894899 - protein, 36 aa, Mycobacterium
AGVPAAGADPAAALPPMASSGSGPIIGAGSAAAQGI

SEQ ID NO: 894900 - protein, 7 aa, Mycobacterium
AGVPAGG

SEQ ID NO: 894901 - protein, 7 aa, Mycobacterium
AGVPDAA

SEQ ID NO: 894902 - protein, 6 aa, Mycobacterium
AGVPEI

SEQ ID NO: 894903 - protein, 12 aa, Mycobacterium
AGVPESELATRR

SEQ ID NO: 894904 - protein, 6 aa, Mycobacterium
AGVPGL

SEQ ID NO: 894905 - protein, 22 aa, Mycobacterium
AGVPGSPPARLRGRSIATVLCQ

SEQ ID NO: 894906 - protein, 12 aa, Mycobacterium
AGVPTVSAGITG

SEQ ID NO: 894907 - protein, 10 aa, Mycobacterium
AGVQGAPGTR

SEQ ID NO: 894908 - protein, 6 aa, Mycobacterium
AGVQHA

SEQ ID NO: 894909 - protein, 4 aa, Mycobacterium
AGVR

SEQ ID NO: 894910 - protein, 4 aa, Mycobacterium
AGVS

SEQ ID NO: 894911 - protein, 5 aa, Mycobacterium
AGVSA

SEQ ID NO: 894912 - protein, 13 aa, Mycobacterium
AGVSNRPDQAAPP

SEQ ID NO: 894913 - protein, 8 aa, Mycobacterium
AGVSPADL

SEQ ID NO: 894914 - protein, 4 aa, Mycobacterium
AGVT

SEQ ID NO: 894915 - protein, 6 aa, Mycobacterium
AGVTPA

SEQ ID NO: 894916 - protein, 9 aa, Mycobacterium
AGVYGSPGD

SEQ ID NO: 894917 - protein, 5 aa, Mycobacterium
AGWTQ

SEQ ID NO: 894918 - protein, 11 aa, Mycobacterium
AGYADSPTAEA

SEQ ID NO: 894919 - protein, 17 aa, Mycobacterium
AGYAEDRNRPDLAATSR

SEQ ID NO: 894920 - protein, 5 aa, Mycobacterium
AGYAS

SEQ ID NO: 894921 - protein, 18 aa, Mycobacterium
AGYASGDEDTRGGSTIEQ

SEQ ID NO: 894922 - protein, 4 aa, Mycobacterium
AGYD

SEQ ID NO: 894923 - protein, 5 aa, Mycobacterium
AGYDP

SEQ ID NO: 894924 - protein, 8 aa, Mycobacterium
AGYEAARA

SEQ ID NO: 894925 - protein, 14 aa, Mycobacterium
AGYGQGGDIHSPRD

SEQ ID NO: 894926 - protein, 5 aa, Mycobacterium
AGYGY

SEQ ID NO: 894927 - protein, 5 aa, Mycobacterium
AGYLT

SEQ ID NO: 894928 - protein, 4 aa, Mycobacterium
AGYN

SEQ ID NO: 894929 - protein, 14 aa, Mycobacterium
AGYQVEGSAPDSNW

SEQ ID NO: 894930 - protein, 5 aa, Mycobacterium
AGYRE

SEQ ID NO: 894931 - protein, 20 aa, Mycobacterium
AGYRGTPGNPLTVPYHWDQG

SEQ ID NO: 894932 - protein, 4 aa, Mycobacterium
AGYS

SEQ ID NO: 894933 - protein, 6 aa, Mycobacterium
AGYSAE

SEQ ID NO: 894934 - protein, 8 aa, Mycobacterium
AGYSATIG

SEQ ID NO: 894935 - protein, 11 aa, Mycobacterium
AGYSDSPSDEA

SEQ ID NO: 894936 - protein, 8 aa, Mycobacterium
AGYSPTIG

SEQ ID NO: 894937 - protein, 13 aa, Mycobacterium
AGYSRNDDPLTAP

SEQ ID NO: 894938 - protein, 15 aa, Mycobacterium
AGYSRNDDPSTAPVQ

SEQ ID NO: 894939 - protein, 7 aa, Mycobacterium
AGYTEQD

SEQ ID NO: 894940 - protein, 37 aa, Mycobacterium
AHAARTAVDTARNDPKTATARSEAASALSDVADTSSR

SEQ ID NO: 894941 - protein, 8 aa, Mycobacterium
AHADADTY

SEQ ID NO: 894942 - protein, 6 aa, Mycobacterium
AHADDT

SEQ ID NO: 894943 - protein, 9 aa, Mycobacterium
AHADDTDDA

SEQ ID NO: 894944 - protein, 9 aa, Mycobacterium
AHADPDPIS

SEQ ID NO: 894945 - protein, 7 aa, Mycobacterium
AHAEGDL

SEQ ID NO: 894946 - protein, 11 aa, Mycobacterium
AHAEPASTTID

SEQ ID NO: 894947 - protein, 10 aa, Mycobacterium
AHAEPEGDDA

SEQ ID NO: 894948 - protein, 6 aa, Mycobacterium
AHAGLD

SEQ ID NO: 894949 - protein, 12 aa, Mycobacterium
AHAGPGGLGDAD

SEQ ID NO: 894950 - protein, 16 aa, Mycobacterium
AHASLSAAEQVGSYAP

SEQ ID NO: 894951 - protein, 7 aa, Mycobacterium
AHATDAD

SEQ ID NO: 894952 - protein, 10 aa, Mycobacterium
AHDAARSDAA

SEQ ID NO: 894953 - protein, 7 aa, Mycobacterium
AHDATEL

SEQ ID NO: 894954 - protein, 10 aa, Mycobacterium
AHDDSEVGVP

SEQ ID NO: 894955 - protein, 5 aa, Mycobacterium
AHDPK

SEQ ID NO: 894956 - protein, 7 aa, Mycobacterium
AHDQTDA

SEQ ID NO: 894957 - protein, 5 aa, Mycobacterium
AHDSG

SEQ ID NO: 894958 - protein, 4 aa, Mycobacterium
AHDT

SEQ ID NO: 894959 - protein, 9 aa, Mycobacterium
AHDTDKTIQ

SEQ ID NO: 894960 - protein, 4 aa, Mycobacterium
AHDV

SEQ ID NO: 894961 - protein, 5 aa, Mycobacterium
AHEQT

SEQ ID NO: 894962 - protein, 12 aa, Mycobacterium
AHESTPAEQAAT

SEQ ID NO: 894963 - protein, 9 aa, Mycobacterium
AHGDAPGHD

SEQ ID NO: 894964 - protein, 7 aa, Mycobacterium
AHGGPEA

SEQ ID NO: 894965 - protein, 7 aa, Mycobacterium
AHGGTEF

SEQ ID NO: 894966 - protein, 6 aa, Mycobacterium
AHGGTR

SEQ ID NO: 894967 - protein, 8 aa, Mycobacterium
AHGPNPVL

SEQ ID NO: 894968 - protein, 7 aa, Mycobacterium
AHHDSSR

SEQ ID NO: 894969 - protein, 6 aa, Mycobacterium
AHHGEV

SEQ ID NO: 894970 - protein, 5 aa, Mycobacterium
AHHGN

SEQ ID NO: 894971 - protein, 20 aa, Mycobacterium
AHKVGGTLSTSTAQDGGDGW

SEQ ID NO: 894972 - protein, 10 aa, Mycobacterium
AHNGDRDTGI

SEQ ID NO: 894973 - protein, 13 aa, Mycobacterium
AHNTTPDIGQGGC

SEQ ID NO: 894974 - protein, 4 aa, Mycobacterium
AHPD

SEQ ID NO: 894975 - protein, 6 aa, Mycobacterium
AHPDPV

SEQ ID NO: 894976 - protein, 10 aa, Mycobacterium
AHPEDVAKSR

SEQ ID NO: 894977 - protein, 8 aa, Mycobacterium
AHPESAAP

SEQ ID NO: 894978 - protein, 7 aa, Mycobacterium
AHPGANQ

SEQ ID NO: 894979 - protein, 9 aa, Mycobacterium
AHPGANQAV

SEQ ID NO: 894980 - protein, 6 aa, Mycobacterium
AHPGAQ

SEQ ID NO: 894981 - protein, 5 aa, Mycobacterium
AHPGD

SEQ ID NO: 894982 - protein, 8 aa, Mycobacterium
AHPGPEHS

SEQ ID NO: 894983 - protein, 14 aa, Mycobacterium
AHPGPWPPVPPGPH

SEQ ID NO: 894984 - protein, 4 aa, Mycobacterium
AHPM

SEQ ID NO: 894985 - protein, 6 aa, Mycobacterium
AHPNTA

SEQ ID NO: 894986 - protein, 7 aa, Mycobacterium
AHPPAAV

SEQ ID NO: 894987 - protein, 6 aa, Mycobacterium
AHPPYP

SEQ ID NO: 894988 - protein, 7 aa, Mycobacterium
AHPRGAT

SEQ ID NO: 894989 - protein, 7 aa, Mycobacterium
AHPSEPG

SEQ ID NO: 894990 - protein, 8 aa, Mycobacterium
AHPSEPGV

SEQ ID NO: 894991 - protein, 9 aa, Mycobacterium
AHPSGDDQS

SEQ ID NO: 894992 - protein, 21 aa, Mycobacterium
AHQAAQAAKVAPAAQPEPAPV

SEQ ID NO: 894993 - protein, 4 aa, Mycobacterium
AHRH

SEQ ID NO: 894994 - protein, 9 aa, Mycobacterium
AHRNKHGGN

SEQ ID NO: 894995 - protein, 8 aa, Mycobacterium
AHSAGAKV

SEQ ID NO: 894996 - protein, 12 aa, Mycobacterium
AHSDKRTKAQMP

SEQ ID NO: 894997 - protein, 7 aa, Mycobacterium
AHSDVTS

SEQ ID NO: 894998 - protein, 5 aa, Mycobacterium
AHSGE

SEQ ID NO: 894999 - protein, 10 aa, Mycobacterium
AHSNSRRNIT

SEQ ID NO: 895000 - protein, 28 aa, Mycobacterium
AHSPTPTANAADPGRRIDTRTPPGLRAQ

SEQ ID NO: 895001 - protein, 12 aa, Mycobacterium
AHSSVPPRKEID

SEQ ID NO: 895002 - protein, 7 aa, Mycobacterium
AHSVDSS

SEQ ID NO: 895003 - protein, 5 aa, Mycobacterium
AHTDG

SEQ ID NO: 895004 - protein, 4 aa, Mycobacterium
AHTF

SEQ ID NO: 895005 - protein, 4 aa, Mycobacterium
AIAA

SEQ ID NO: 895006 - protein, 5 aa, Mycobacterium
AIAAG

SEQ ID NO: 895007 - protein, 8 aa, Mycobacterium
AIAAGPTA

SEQ ID NO: 895008 - protein, 6 aa, Mycobacterium
AIAASG

SEQ ID NO: 895009 - protein, 7 aa, Mycobacterium
AIAGTEH

SEQ ID NO: 895010 - protein, 19 aa, Mycobacterium
AIAPPDSAQAQIIYPLPPL

SEQ ID NO: 895011 - protein, 4 aa, Mycobacterium
AIAQ

SEQ ID NO: 895012 - protein, 7 aa, Mycobacterium
AIARTDR

SEQ ID NO: 895013 - protein, 4 aa, Mycobacterium
AIAT

SEQ ID NO: 895014 - protein, 11 aa, Mycobacterium
AIATERAGKPV

SEQ ID NO: 895015 - protein, 7 aa, Mycobacterium
AIATGEA

SEQ ID NO: 895016 - protein, 6 aa, Mycobacterium
AIDPNA

SEQ ID NO: 895017 - protein, 5 aa, Mycobacterium
AIDST

SEQ ID NO: 895018 - protein, 6 aa, Mycobacterium
AIDTGR

SEQ ID NO: 895019 - protein, 4 aa, Mycobacterium
AIEA

SEQ ID NO: 895020 - protein, 5 aa, Mycobacterium
AIEGM

SEQ ID NO: 895021 - protein, 9 aa, Mycobacterium
AIEQQTGRS

SEQ ID NO: 895022 - protein, 6 aa, Mycobacterium
AIGAEH

SEQ ID NO: 895023 - protein, 6 aa, Mycobacterium
AIGAGS

SEQ ID NO: 895024 - protein, 10 aa, Mycobacterium
AIGDKGSAEV

SEQ ID NO: 895025 - protein, 22 aa, Mycobacterium
AIGESGATLSRRDLYDAVVKAR

SEQ ID NO: 895026 - protein, 6 aa, Mycobacterium
AIGGGP

SEQ ID NO: 895027 - protein, 5 aa, Mycobacterium
AIGGV

SEQ ID NO: 895028 - protein, 4 aa, Mycobacterium
AIGS

SEQ ID NO: 895029 - protein, 17 aa, Mycobacterium
AIGSAGSQVAAGLGSGA

SEQ ID NO: 895030 - protein, 21 aa, Mycobacterium
AIGSDNSQVSAVSGAGGGNIA

SEQ ID NO: 895031 - protein, 7 aa, Mycobacterium
AIGSGPA

SEQ ID NO: 895032 - protein, 5 aa, Mycobacterium
AIGSS

SEQ ID NO: 895033 - protein, 6 aa, Mycobacterium
AIHPGD

SEQ ID NO: 895034 - protein, 9 aa, Mycobacterium
AINAGSSNR

SEQ ID NO: 895035 - protein, 7 aa, Mycobacterium
AINGQQG

SEQ ID NO: 895036 - protein, 10 aa, Mycobacterium
AINPGNSGGA

SEQ ID NO: 895037 - protein, 16 aa, Mycobacterium
AIPAAAAPLPAPSPSL

SEQ ID NO: 895038 - protein, 7 aa, Mycobacterium
AIPAAPG

SEQ ID NO: 895039 - protein, 10 aa, Mycobacterium
AIPDQGTPAF

SEQ ID NO: 895040 - protein, 5 aa, Mycobacterium
AIPER

SEQ ID NO: 895041 - protein, 9 aa, Mycobacterium
AIPGAEGNG

SEQ ID NO: 895042 - protein, 10 aa, Mycobacterium
AIPGTESKVP

SEQ ID NO: 895043 - protein, 7 aa, Mycobacterium
AIPKGTE

SEQ ID NO: 895044 - protein, 17 aa, Mycobacterium
AIPPDAWSDDPHGDPDW

SEQ ID NO: 895045 - protein, 16 aa, Mycobacterium
AIPPREPATGVGDVPD

SEQ ID NO: 895046 - protein, 16 aa, Mycobacterium
AIPPSAQEIPNPLRGQ

SEQ ID NO: 895047 - protein, 5 aa, Mycobacterium
AIPQP

SEQ ID NO: 895048 - protein, 9 aa, Mycobacterium
AIPQPDDQI

SEQ ID NO: 895049 - protein, 4 aa, Mycobacterium
AIPR

SEQ ID NO: 895050 - protein, 8 aa, Mycobacterium
AIPSAASP

SEQ ID NO: 895051 - protein, 7 aa, Mycobacterium
AIQDNEN

SEQ ID NO: 895052 - protein, 13 aa, Mycobacterium
AIQNNDDKAYRSS

SEQ ID NO: 895053 - protein, 38 aa, Mycobacterium
AIQPPANQGPAPALPGLTGGPPRGHRPSGANDDAPLPR

SEQ ID NO: 895054 - protein, 12 aa, Mycobacterium
AIRSGGPGTAMG

SEQ ID NO: 895055 - protein, 15 aa, Mycobacterium
AISAPTTLASEILVR

SEQ ID NO: 895056 - protein, 10 aa, Mycobacterium
AISGDASPDV

SEQ ID NO: 895057 - protein, 7 aa, Mycobacterium
AISPDGR

SEQ ID NO: 895058 - protein, 16 aa, Mycobacterium
AISQPQPGAAAHPSNV

SEQ ID NO: 895059 - protein, 6 aa, Mycobacterium
AISRAD

SEQ ID NO: 895060 - protein, 5 aa, Mycobacterium
AISRS

SEQ ID NO: 895061 - protein, 9 aa, Mycobacterium
AISSDGDVT

SEQ ID NO: 895062 - protein, 57 aa, Mycobacterium
AISSGGHSPTAPESKESAATITSNATSGTSVTKSDKTSQVNAKGSPAVAEPKTSVAK

SEQ ID NO: 895063 - protein, 9 aa, Mycobacterium
AITDAGRAE

SEQ ID NO: 895064 - protein, 8 aa, Mycobacterium
AITDPGAV

SEQ ID NO: 895065 - protein, 9 aa, Mycobacterium
AITEKTGVT

SEQ ID NO: 895066 - protein, 8 aa, Mycobacterium
AITGTGNA

SEQ ID NO: 895067 - protein, 4 aa, Mycobacterium
AITP

SEQ ID NO: 895068 - protein, 25 aa, Mycobacterium
AITPPQVDPGMVPPDGPPRPEQPMR

SEQ ID NO: 895069 - protein, 6 aa, Mycobacterium
AIYPGD

SEQ ID NO: 895070 - protein, 8 aa, Mycobacterium
AKAAADKV

SEQ ID NO: 895071 - protein, 7 aa, Mycobacterium
AKAAAVT

SEQ ID NO: 895072 - protein, 7 aa, Mycobacterium
AKAAGAD

SEQ ID NO: 895073 - protein, 7 aa, Mycobacterium
AKAAGGS

SEQ ID NO: 895074 - protein, 23 aa, Mycobacterium
AKAAGLGAHGTRAGSPSGIDGPG

SEQ ID NO: 895075 - protein, 22 aa, Mycobacterium
AKAAQLGARDTNVVTPSGLDAP

SEQ ID NO: 895076 - protein, 31 aa, Mycobacterium
AKAASLGATNTHAATPSGLDGPGGSGSSTAH

SEQ ID NO: 895077 - protein, 31 aa, Mycobacterium
AKAASLGATSTHAATPSGLDGPGGSGSSTAH

SEQ ID NO: 895078 - protein, 6 aa, Mycobacterium
AKAEGE

SEQ ID NO: 895079 - protein, 9 aa, Mycobacterium
AKAHTRSGE

SEQ ID NO: 895080 - protein, 9 aa, Mycobacterium
AKANDGETY

SEQ ID NO: 895081 - protein, 9 aa, Mycobacterium
AKANGSEWK

SEQ ID NO: 895082 - protein, 10 aa, Mycobacterium
AKANGSEWKT

SEQ ID NO: 895083 - protein, 10 aa, Mycobacterium
AKAPGSPVPG

SEQ ID NO: 895084 - protein, 6 aa, Mycobacterium
AKAPTK

SEQ ID NO: 895085 - protein, 8 aa, Mycobacterium
AKAPVSKR

SEQ ID NO: 895086 - protein, 4 aa, Mycobacterium
AKAR

SEQ ID NO: 895087 - protein, 20 aa, Mycobacterium
AKARLPSGYAPPAPPPRNSL

SEQ ID NO: 895088 - protein, 6 aa, Mycobacterium
AKATAE

SEQ ID NO: 895089 - protein, 21 aa, Mycobacterium
AKAYGTDDRESSRQQSQPQQQ

SEQ ID NO: 895090 - protein, 20 aa, Mycobacterium
AKAYSTPDHSASHYPAQPQQ

SEQ ID NO: 895091 - protein, 17 aa, Mycobacterium
AKCSDTGPVRPGDPQFP

SEQ ID NO: 895092 - protein, 14 aa, Mycobacterium
AKCTDNPERGSEVP

SEQ ID NO: 895093 - protein, 8 aa, Mycobacterium
AKDAGNGA

SEQ ID NO: 895094 - protein, 13 aa, Mycobacterium
AKDAKRDAAHGAA

SEQ ID NO: 895095 - protein, 8 aa, Mycobacterium
AKDEAQVP

SEQ ID NO: 895096 - protein, 10 aa, Mycobacterium
AKDETQLPIP

SEQ ID NO: 895097 - protein, 8 aa, Mycobacterium
AKDGPTYF

SEQ ID NO: 895098 - protein, 9 aa, Mycobacterium
AKDGPTYYS

SEQ ID NO: 895099 - protein, 10 aa, Mycobacterium
AKDGSESGRR

SEQ ID NO: 895100 - protein, 4 aa, Mycobacterium
AKDL

SEQ ID NO: 895101 - protein, 15 aa, Mycobacterium
AKDRDYRGGTGPNLS

SEQ ID NO: 895102 - protein, 9 aa, Mycobacterium
AKDTPDGSV

SEQ ID NO: 895103 - protein, 13 aa, Mycobacterium
AKDVEKAKSLYPT

SEQ ID NO: 895104 - protein, 16 aa, Mycobacterium
AKDVSGALSQANQKAQ

SEQ ID NO: 895105 - protein, 13 aa, Mycobacterium
AKEATEAFYARIG

SEQ ID NO: 895106 - protein, 9 aa, Mycobacterium
AKEDGDAND

SEQ ID NO: 895107 - protein, 7 aa, Mycobacterium
AKEGKSA

SEQ ID NO: 895108 - protein, 9 aa, Mycobacterium
AKEGNTYYG

SEQ ID NO: 895109 - protein, 13 aa, Mycobacterium
AKESAPTSERDGT

SEQ ID NO: 895110 - protein, 16 aa, Mycobacterium
AKETANGIPNAHSGAL

SEQ ID NO: 895111 - protein, 13 aa, Mycobacterium
AKETDTQLIEPDG

SEQ ID NO: 895112 - protein, 9 aa, Mycobacterium
AKGADGTVT

SEQ ID NO: 895113 - protein, 6 aa, Mycobacterium
AKGADM

SEQ ID NO: 895114 - protein, 7 aa, Mycobacterium
AKGAGAA

SEQ ID NO: 895115 - protein, 14 aa, Mycobacterium
AKGAQVSSAQNDAL

SEQ ID NO: 895116 - protein, 7 aa, Mycobacterium
AKGATLA

SEQ ID NO: 895117 - protein, 8 aa, Mycobacterium
AKGDNGRR

SEQ ID NO: 895118 - protein, 8 aa, Mycobacterium
AKGDPAFN

SEQ ID NO: 895119 - protein, 5 aa, Mycobacterium
AKGED

SEQ ID NO: 895120 - protein, 9 aa, Mycobacterium
AKGEPVNKE

SEQ ID NO: 895121 - protein, 9 aa, Mycobacterium
AKGEQAVKA

SEQ ID NO: 895122 - protein, 8 aa, Mycobacterium
AKGGAGAS

SEQ ID NO: 895123 - protein, 5 aa, Mycobacterium
AKGGK

SEQ ID NO: 895124 - protein, 15 aa, Mycobacterium
AKGGPGGKPGCGSLP

SEQ ID NO: 895125 - protein, 10 aa, Mycobacterium
AKGHYNNSTD

SEQ ID NO: 895126 - protein, 14 aa, Mycobacterium
AKGLGSGGARGCPP

SEQ ID NO: 895127 - protein, 12 aa, Mycobacterium
AKGQTVLSADDR

SEQ ID NO: 895128 - protein, 8 aa, Mycobacterium
AKGSGGNR

SEQ ID NO: 895129 - protein, 10 aa, Mycobacterium
AKGSPQYRGG

SEQ ID NO: 895130 - protein, 8 aa, Mycobacterium
AKGSSAHA

SEQ ID NO: 895131 - protein, 7 aa, Mycobacterium
AKHPDTT

SEQ ID NO: 895132 - protein, 24 aa, Mycobacterium
AKHPNVTVTTQGSGSGAGISQAAA

SEQ ID NO: 895133 - protein, 13 aa, Mycobacterium
AKHRPGAGFSPLP

SEQ ID NO: 895134 - protein, 13 aa, Mycobacterium
AKHRPGAGFTPLP

SEQ ID NO: 895135 - protein, 8 aa, Mycobacterium
AKHSGADL

SEQ ID NO: 895136 - protein, 13 aa, Mycobacterium
AKIPPQPAQDLGE

SEQ ID NO: 895137 - protein, 8 aa, Mycobacterium
AKISGQGN

SEQ ID NO: 895138 - protein, 13 aa, Mycobacterium
AKISQSVAEEEME

SEQ ID NO: 895139 - protein, 6 aa, Mycobacterium
AKKENN

SEQ ID NO: 895140 - protein, 5 aa, Mycobacterium
AKKIA

SEQ ID NO: 895141 - protein, 10 aa, Mycobacterium
AKKKDDIAGA

SEQ ID NO: 895142 - protein, 22 aa, Mycobacterium
AKKTPAKKTPARKKAPAKQASK

SEQ ID NO: 895143 - protein, 9 aa, Mycobacterium
AKLATEPGK

SEQ ID NO: 895144 - protein, 6 aa, Mycobacterium
AKLESS

SEQ ID NO: 895145 - protein, 7 aa, Mycobacterium
AKLGEDV

SEQ ID NO: 895146 - protein, 8 aa, Mycobacterium
AKLGNASG

SEQ ID NO: 895147 - protein, 8 aa, Mycobacterium
AKLPGEAE

SEQ ID NO: 895148 - protein, 6 aa, Mycobacterium
AKLQTT

SEQ ID NO: 895149 - protein, 11 aa, Mycobacterium
AKLSDTDRDRA

SEQ ID NO: 895150 - protein, 10 aa, Mycobacterium
AKLSPAARAE

SEQ ID NO: 895151 - protein, 10 aa, Mycobacterium
AKLTDPAKGQ

SEQ ID NO: 895152 - protein, 5 aa, Mycobacterium
AKLTT

SEQ ID NO: 895153 - protein, 15 aa, Mycobacterium
AKNAAPEPPEPEEPE

SEQ ID NO: 895154 - protein, 33 aa, Mycobacterium
AKNAPRPAGDDTAGPPPGADLGARSDPTPPGRY

SEQ ID NO: 895155 - protein, 10 aa, Mycobacterium
AKNDEPGTPA

SEQ ID NO: 895156 - protein, 5 aa, Mycobacterium
AKNHT

SEQ ID NO: 895157 - protein, 8 aa, Mycobacterium
AKNPDAQV

SEQ ID NO: 895158 - protein, 5 aa, Mycobacterium
AKNPI

SEQ ID NO: 895159 - protein, 5 aa, Mycobacterium
AKNTL

SEQ ID NO: 895160 - protein, 15 aa, Mycobacterium
AKPAEPGPTRYDADA

SEQ ID NO: 895161 - protein, 8 aa, Mycobacterium
AKPAGISR

SEQ ID NO: 895162 - protein, 13 aa, Mycobacterium
AKPALEAAKDEYR

SEQ ID NO: 895163 - protein, 7 aa, Mycobacterium
AKPATDR

SEQ ID NO: 895164 - protein, 7 aa, Mycobacterium
AKPATLA

SEQ ID NO: 895165 - protein, 4 aa, Mycobacterium
AKPD

SEQ ID NO: 895166 - protein, 6 aa, Mycobacterium
AKPDDI

SEQ ID NO: 895167 - protein, 7 aa, Mycobacterium
AKPDKVW

SEQ ID NO: 895168 - protein, 6 aa, Mycobacterium
AKPDSH

SEQ ID NO: 895169 - protein, 9 aa, Mycobacterium
AKPDSQTPF

SEQ ID NO: 895170 - protein, 4 aa, Mycobacterium
AKPG

SEQ ID NO: 895171 - protein, 17 aa, Mycobacterium
AKPGQPQQPEATKTTAY

SEQ ID NO: 895172 - protein, 6 aa, Mycobacterium
AKPGQR

SEQ ID NO: 895173 - protein, 9 aa, Mycobacterium
AKPGQTPTF

SEQ ID NO: 895174 - protein, 13 aa, Mycobacterium
AKPGRTSDPRGLS

SEQ ID NO: 895175 - protein, 6 aa, Mycobacterium
AKPGSG

SEQ ID NO: 895176 - protein, 15 aa, Mycobacterium
AKPGTEVPAVTRGSA

SEQ ID NO: 895177 - protein, 14 aa, Mycobacterium
AKPGTEVPPVSNGH

SEQ ID NO: 895178 - protein, 8 aa, Mycobacterium
AKPGVPQA

SEQ ID NO: 895179 - protein, 23 aa, Mycobacterium
AKPNEGMTAGTGTSGKAQPPSLR

SEQ ID NO: 895180 - protein, 7 aa, Mycobacterium
AKPNVEL

SEQ ID NO: 895181 - protein, 8 aa, Mycobacterium
AKPQRIDG

SEQ ID NO: 895182 - protein, 8 aa, Mycobacterium
AKPQRVDG

SEQ ID NO: 895183 - protein, 15 aa, Mycobacterium
AKPRNPLNTNNSGDQ

SEQ ID NO: 895184 - protein, 18 aa, Mycobacterium
AKPSATTAATIGKPGGAP

SEQ ID NO: 895185 - protein, 9 aa, Mycobacterium
AKPSPGFAD

SEQ ID NO: 895186 - protein, 8 aa, Mycobacterium
AKQAAGDA

SEQ ID NO: 895187 - protein, 8 aa, Mycobacterium
AKQGEDFE

SEQ ID NO: 895188 - protein, 4 aa, Mycobacterium
AKQK

SEQ ID NO: 895189 - protein, 8 aa, Mycobacterium
AKQLSKDG

SEQ ID NO: 895190 - protein, 7 aa, Mycobacterium
AKQNDNL

SEQ ID NO: 895191 - protein, 4 aa, Mycobacterium
AKQP

SEQ ID NO: 895192 - protein, 10 aa, Mycobacterium
AKQPAQPSTL

SEQ ID NO: 895193 - protein, 15 aa, Mycobacterium
AKQPTCPLGTDPAKA

SEQ ID NO: 895194 - protein, 7 aa, Mycobacterium
AKQQNLA

SEQ ID NO: 895195 - protein, 10 aa, Mycobacterium
AKQSGAPVTA

SEQ ID NO: 895196 - protein, 7 aa, Mycobacterium
AKQTGDY

SEQ ID NO: 895197 - protein, 15 aa, Mycobacterium
AKRAGGNQTAVSTDD

SEQ ID NO: 895198 - protein, 9 aa, Mycobacterium
AKRAGGNQV

SEQ ID NO: 895199 - protein, 6 aa, Mycobacterium
AKRDSA

SEQ ID NO: 895200 - protein, 9 aa, Mycobacterium
AKRKDAAAF

SEQ ID NO: 895201 - protein, 8 aa, Mycobacterium
AKRPHPDA

SEQ ID NO: 895202 - protein, 9 aa, Mycobacterium
AKRPHPRGP

SEQ ID NO: 895203 - protein, 10 aa, Mycobacterium
AKRPRRAPTI

SEQ ID NO: 895204 - protein, 12 aa, Mycobacterium
AKRRGTNQLLEA

SEQ ID NO: 895205 - protein, 5 aa, Mycobacterium
AKRRN

SEQ ID NO: 895206 - protein, 9 aa, Mycobacterium
AKRSPRPGH

SEQ ID NO: 895207 - protein, 9 aa, Mycobacterium
AKRTPSVVD

SEQ ID NO: 895208 - protein, 13 aa, Mycobacterium
AKSAGCPLGTDPT

SEQ ID NO: 895209 - protein, 16 aa, Mycobacterium
AKSALEHARDSAEQVK

SEQ ID NO: 895210 - protein, 10 aa, Mycobacterium
AKSAPDGSMT

SEQ ID NO: 895211 - protein, 10 aa, Mycobacterium
AKSDDHDAAA

SEQ ID NO: 895212 - protein, 9 aa, Mycobacterium
AKSDEHDAA

SEQ ID NO: 895213 - protein, 10 aa, Mycobacterium
AKSDEHDAAA

SEQ ID NO: 895214 - protein, 14 aa, Mycobacterium
AKSELPPRFGGPEK

SEQ ID NO: 895215 - protein, 12 aa, Mycobacterium
AKSGAARSTTAQ

SEQ ID NO: 895216 - protein, 6 aa, Mycobacterium
AKSHPE

SEQ ID NO: 895217 - protein, 18 aa, Mycobacterium
AKSKAVGSSGLELSPGDH

SEQ ID NO: 895218 - protein, 8 aa, Mycobacterium
AKSPEFRR

SEQ ID NO: 895219 - protein, 17 aa, Mycobacterium
AKSRLEYAGPDQSAYAD

SEQ ID NO: 895220 - protein, 11 aa, Mycobacterium
AKSSAARDAPY

SEQ ID NO: 895221 - protein, 11 aa, Mycobacterium
AKSSAPRDQPY

SEQ ID NO: 895222 - protein, 8 aa, Mycobacterium
AKSTRRTA

SEQ ID NO: 895223 - protein, 13 aa, Mycobacterium
AKSTSLAPPGCPQ

SEQ ID NO: 895224 - protein, 22 aa, Mycobacterium
AKTAAAAPPPALPSPPPAPGMG

SEQ ID NO: 895225 - protein, 8 aa, Mycobacterium
AKTAGSRV

SEQ ID NO: 895226 - protein, 26 aa, Mycobacterium
AKTAPPPAATTTTTTTSTAPAPSTAA

SEQ ID NO: 895227 - protein, 7 aa, Mycobacterium
AKTDEDK

SEQ ID NO: 895228 - protein, 10 aa, Mycobacterium
AKTDRAGRIE

SEQ ID NO: 895229 - protein, 8 aa, Mycobacterium
AKTDTGPG

SEQ ID NO: 895230 - protein, 5 aa, Mycobacterium
AKTEL

SEQ ID NO: 895231 - protein, 10 aa, Mycobacterium
AKTGATSPQI

SEQ ID NO: 895232 - protein, 6 aa, Mycobacterium
AKTGQV

SEQ ID NO: 895233 - protein, 6 aa, Mycobacterium
AKTPAE

SEQ ID NO: 895234 - protein, 39 aa, Mycobacterium
AKTPEARTTTSAVNSNEPNAADPPPAAAEPPSSPAPADP

SEQ ID NO: 895235 - protein, 6 aa, Mycobacterium
AKTSGA

SEQ ID NO: 895236 - protein, 11 aa, Mycobacterium
AKTSQTPADAG

SEQ ID NO: 895237 - protein, 8 aa, Mycobacterium
AKTTPQRA

SEQ ID NO: 895238 - protein, 7 aa, Mycobacterium
AKVADRY

SEQ ID NO: 895239 - protein, 23 aa, Mycobacterium
AKVEVDGDTYTITGEAAGADMQN

SEQ ID NO: 895240 - protein, 4 aa, Mycobacterium
AKVG

SEQ ID NO: 895241 - protein, 6 aa, Mycobacterium
AKVGES

SEQ ID NO: 895242 - protein, 10 aa, Mycobacterium
AKVGGTPSFP

SEQ ID NO: 895243 - protein, 11 aa, Mycobacterium
AKVNPARERRH

SEQ ID NO: 895244 - protein, 5 aa, Mycobacterium
AKVTP

SEQ ID NO: 895245 - protein, 9 aa, Mycobacterium
AKVTPTANY

SEQ ID NO: 895246 - protein, 6 aa, Mycobacterium
AKVTPV

SEQ ID NO: 895247 - protein, 12 aa, Mycobacterium
AKVTRDGKPVTT

SEQ ID NO: 895248 - protein, 11 aa, Mycobacterium
AKYRGKVTAYD

SEQ ID NO: 895249 - protein, 10 aa, Mycobacterium
AKYSEGNDEP

SEQ ID NO: 895250 - protein, 29 aa, Mycobacterium
AKYSSATEDQKNALGKPLTGDRNAGKRAS

SEQ ID NO: 895251 - protein, 5 aa, Mycobacterium
ALAAD

SEQ ID NO: 895252 - protein, 14 aa, Mycobacterium
ALAAPAGADNPDDN

SEQ ID NO: 895253 - protein, 14 aa, Mycobacterium
ALAAPTGGDAQATI

SEQ ID NO: 895254 - protein, 7 aa, Mycobacterium
ALAASTA

SEQ ID NO: 895255 - protein, 5 aa, Mycobacterium
ALADP

SEQ ID NO: 895256 - protein, 15 aa, Mycobacterium
ALADPDQVPGDPDVV

SEQ ID NO: 895257 - protein, 7 aa, Mycobacterium
ALADPRA

SEQ ID NO: 895258 - protein, 8 aa, Mycobacterium
ALADTGSV

SEQ ID NO: 895259 - protein, 13 aa, Mycobacterium
ALAEQGSPIPPAA

SEQ ID NO: 895260 - protein, 16 aa, Mycobacterium
ALAGAAPAAADDDADD

SEQ ID NO: 895261 - protein, 10 aa, Mycobacterium
ALAGAGDSIA

SEQ ID NO: 895262 - protein, 7 aa, Mycobacterium
ALAGNAS

SEQ ID NO: 895263 - protein, 8 aa, Mycobacterium
ALAGRADD

SEQ ID NO: 895264 - protein, 8 aa, Mycobacterium
ALAGSSGT

SEQ ID NO: 895265 - protein, 7 aa, Mycobacterium
ALAKESA

SEQ ID NO: 895266 - protein, 10 aa, Mycobacterium
ALAQPPRATA

SEQ ID NO: 895267 - protein, 14 aa, Mycobacterium
ALASPAPQTESTGA

SEQ ID NO: 895268 - protein, 12 aa, Mycobacterium
ALASPPPNIQGF

SEQ ID NO: 895269 - protein, 9 aa, Mycobacterium
ALASTGTAY

SEQ ID NO: 895270 - protein, 15 aa, Mycobacterium
ALATASAAAADDDSN

SEQ ID NO: 895271 - protein, 12 aa, Mycobacterium
ALATRTQATAAA

SEQ ID NO: 895272 - protein, 21 aa, Mycobacterium
ALDATGAGSGCAAGSTGSACA

SEQ ID NO: 895273 - protein, 8 aa, Mycobacterium
ALDATGVA

SEQ ID NO: 895274 - protein, 8 aa, Mycobacterium
ALDDDGAS

SEQ ID NO: 895275 - protein, 7 aa, Mycobacterium
ALDDPEP

SEQ ID NO: 895276 - protein, 16 aa, Mycobacterium
ALDEESGADPSRNPNF

SEQ ID NO: 895277 - protein, 10 aa, Mycobacterium
ALDGKSAQLG

SEQ ID NO: 895278 - protein, 10 aa, Mycobacterium
ALDGRGDQIG

SEQ ID NO: 895279 - protein, 6 aa, Mycobacterium
ALDGSE

SEQ ID NO: 895280 - protein, 8 aa, Mycobacterium
ALDGTKNI

SEQ ID NO: 895281 - protein, 6 aa, Mycobacterium
ALDNPE

SEQ ID NO: 895282 - protein, 6 aa, Mycobacterium
ALDSEQ

SEQ ID NO: 895283 - protein, 21 aa, Mycobacterium
ALDTTGAGSGCAARSALAAGT

SEQ ID NO: 895284 - protein, 5 aa, Mycobacterium
ALEDP

SEQ ID NO: 895285 - protein, 13 aa, Mycobacterium
ALEGGENSPNVQT

SEQ ID NO: 895286 - protein, 9 aa, Mycobacterium
ALERSGSRV

SEQ ID NO: 895287 - protein, 4 aa, Mycobacterium
ALGA

SEQ ID NO: 895288 - protein, 11 aa, Mycobacterium
ALGDGATGTTA

SEQ ID NO: 895289 - protein, 17 aa, Mycobacterium
ALGDGNSVTNKALGATN

SEQ ID NO: 895290 - protein, 6 aa, Mycobacterium
ALGDHS

SEQ ID NO: 895291 - protein, 12 aa, Mycobacterium
ALGDPSVAPPGR

SEQ ID NO: 895292 - protein, 9 aa, Mycobacterium
ALGENGDGA

SEQ ID NO: 895293 - protein, 14 aa, Mycobacterium
ALGETGGDAGSNAM

SEQ ID NO: 895294 - protein, 13 aa, Mycobacterium
ALGETSTDAGNNA

SEQ ID NO: 895295 - protein, 21 aa, Mycobacterium
ALGGDNGYSLSAAGTPSSIGA

SEQ ID NO: 895296 - protein, 13 aa, Mycobacterium
ALGNGNSATAKAI

SEQ ID NO: 895297 - protein, 10 aa, Mycobacterium
ALGPPGAVGN

SEQ ID NO: 895298 - protein, 12 aa, Mycobacterium
ALGPQMPSGVQG

SEQ ID NO: 895299 - protein, 7 aa, Mycobacterium
ALGPTGD

SEQ ID NO: 895300 - protein, 4 aa, Mycobacterium
ALGS

SEQ ID NO: 895301 - protein, 11 aa, Mycobacterium
ALGSPTRNPKP

SEQ ID NO: 895302 - protein, 7 aa, Mycobacterium
ALHDSGT

SEQ ID NO: 895303 - protein, 7 aa, Mycobacterium
ALKADAA

SEQ ID NO: 895304 - protein, 8 aa, Mycobacterium
ALKPDDVE

SEQ ID NO: 895305 - protein, 9 aa, Mycobacterium
ALNGDPAGG

SEQ ID NO: 895306 - protein, 8 aa, Mycobacterium
ALNGTKNI

SEQ ID NO: 895307 - protein, 8 aa, Mycobacterium
ALNGTKSI

SEQ ID NO: 895308 - protein, 11 aa, Mycobacterium
ALNSDTNLPPT

SEQ ID NO: 895309 - protein, 6 aa, Mycobacterium
ALPAAG

SEQ ID NO: 895310 - protein, 13 aa, Mycobacterium
ALPADAGNQGASV

SEQ ID NO: 895311 - protein, 8 aa, Mycobacterium
ALPASAAD

SEQ ID NO: 895312 - protein, 7 aa, Mycobacterium
ALPASGK

SEQ ID NO: 895313 - protein, 14 aa, Mycobacterium
ALPASGKLDSFTAE

SEQ ID NO: 895314 - protein, 13 aa, Mycobacterium
ALPDGSSSQPAYL

SEQ ID NO: 895315 - protein, 13 aa, Mycobacterium
ALPDGSSSQPSYL

SEQ ID NO: 895316 - protein, 5 aa, Mycobacterium
ALPEP

SEQ ID NO: 895317 - protein, 18 aa, Mycobacterium
ALPETAATTGALGGSGWT

SEQ ID NO: 895318 - protein, 12 aa, Mycobacterium
ALPGAGGTLTRT

SEQ ID NO: 895319 - protein, 6 aa, Mycobacterium
ALPGDL

SEQ ID NO: 895320 - protein, 7 aa, Mycobacterium
ALPGEGP

SEQ ID NO: 895321 - protein, 22 aa, Mycobacterium
ALPGEGSIRYEPADVTNEDEVA

SEQ ID NO: 895322 - protein, 17 aa, Mycobacterium
ALPGGARDSHETPEQAA

SEQ ID NO: 895323 - protein, 17 aa, Mycobacterium
ALPGTSLGSAAQSAPGH

SEQ ID NO: 895324 - protein, 12 aa, Mycobacterium
ALPLNDPGKDCQ

SEQ ID NO: 895325 - protein, 6 aa, Mycobacterium
ALPNPY

SEQ ID NO: 895326 - protein, 8 aa, Mycobacterium
ALPNVGDG

SEQ ID NO: 895327 - protein, 12 aa, Mycobacterium
ALPPADLPDRIG

SEQ ID NO: 895328 - protein, 16 aa, Mycobacterium
ALPPALGGGNSGVRGA

SEQ ID NO: 895329 - protein, 16 aa, Mycobacterium
ALPPASPLAAPSAAAA

SEQ ID NO: 895330 - protein, 10 aa, Mycobacterium
ALPPDDPVDP

SEQ ID NO: 895331 - protein, 6 aa, Mycobacterium
ALPPDQ

SEQ ID NO: 895332 - protein, 5 aa, Mycobacterium
ALPPE

SEQ ID NO: 895333 - protein, 10 aa, Mycobacterium
ALPPEPEQDT

SEQ ID NO: 895334 - protein, 59 aa, Mycobacterium
ALPPNPRERTVTSSPATSSIPTTVPLTPSGAPTLSGTPTSTPSTTSGAPSLSATPTTTR

SEQ ID NO: 895335 - protein, 7 aa, Mycobacterium
ALPPNTR

SEQ ID NO: 895336 - protein, 9 aa, Mycobacterium
ALPPPAGVP

SEQ ID NO: 895337 - protein, 76 aa, Mycobacterium
ALPPPKPAGAPAEPTPRPVESVPPGKPALEAPSGAPGSVVPGRSEPAFGPHDPASAPVAGSHPAATAVTPGERVSP

SEQ ID NO: 895338 - protein, 8 aa, Mycobacterium
ALPPPVTG

SEQ ID NO: 895339 - protein, 8 aa, Mycobacterium
ALPPTPGH

SEQ ID NO: 895340 - protein, 7 aa, Mycobacterium
ALPRGGV

SEQ ID NO: 895341 - protein, 6 aa, Mycobacterium
ALPRRG

SEQ ID NO: 895342 - protein, 6 aa, Mycobacterium
ALPRRP

SEQ ID NO: 895343 - protein, 7 aa, Mycobacterium
ALPSGGS

SEQ ID NO: 895344 - protein, 9 aa, Mycobacterium
ALPSRTDGQ

SEQ ID NO: 895345 - protein, 5 aa, Mycobacterium
ALPTA

SEQ ID NO: 895346 - protein, 12 aa, Mycobacterium
ALPTNTDGGGLS

SEQ ID NO: 895347 - protein, 8 aa, Mycobacterium
ALQGNTPV

SEQ ID NO: 895348 - protein, 9 aa, Mycobacterium
ALQSGEAQI

SEQ ID NO: 895349 - protein, 8 aa, Mycobacterium
ALQSGGAE

SEQ ID NO: 895350 - protein, 5 aa, Mycobacterium
ALRAQ

SEQ ID NO: 895351 - protein, 13 aa, Mycobacterium
ALRDPGTAEPTLT

SEQ ID NO: 895352 - protein, 8 aa, Mycobacterium
ALRDTDGQ

SEQ ID NO: 895353 - protein, 6 aa, Mycobacterium
ALRERG

SEQ ID NO: 895354 - protein, 8 aa, Mycobacterium
ALRESRDR

SEQ ID NO: 895355 - protein, 8 aa, Mycobacterium
ALRKGGYG

SEQ ID NO: 895356 - protein, 7 aa, Mycobacterium
ALRSRDT

SEQ ID NO: 895357 - protein, 6 aa, Mycobacterium
ALRSTA

SEQ ID NO: 895358 - protein, 5 aa, Mycobacterium
ALRTT

SEQ ID NO: 895359 - protein, 24 aa, Mycobacterium
ALSAGNSAAAAPTTGVLPPAADEV

SEQ ID NO: 895360 - protein, 36 aa, Mycobacterium
ALSARTTKSVAARRAAVGSGASSTRVSAGAPGPAVG

SEQ ID NO: 895361 - protein, 7 aa, Mycobacterium
ALSDHGN

SEQ ID NO: 895362 - protein, 9 aa, Mycobacterium
ALSDPATGA

SEQ ID NO: 895363 - protein, 9 aa, Mycobacterium
ALSDSDAER

SEQ ID NO: 895364 - protein, 7 aa, Mycobacterium
ALSGKQS

SEQ ID NO: 895365 - protein, 10 aa, Mycobacterium
ALSGNGSGAA

SEQ ID NO: 895366 - protein, 18 aa, Mycobacterium
ALSGPGSFGGNKASYVQG

SEQ ID NO: 895367 - protein, 8 aa, Mycobacterium
ALSPPKLA

SEQ ID NO: 895368 - protein, 5 aa, Mycobacterium
ALTAS

SEQ ID NO: 895369 - protein, 8 aa, Mycobacterium
ALTDDGAG

SEQ ID NO: 895370 - protein, 16 aa, Mycobacterium
ALTDSKRKFDEQREQV

SEQ ID NO: 895371 - protein, 8 aa, Mycobacterium
ALTESPGL

SEQ ID NO: 895372 - protein, 7 aa, Mycobacterium
ALTETSQ

SEQ ID NO: 895373 - protein, 11 aa, Mycobacterium
ALTGSKTRPYV

SEQ ID NO: 895374 - protein, 18 aa, Mycobacterium
ALTGTPAQAPAPQPTAQA

SEQ ID NO: 895375 - protein, 13 aa, Mycobacterium
ALTGTTAQKQRWE

SEQ ID NO: 895376 - protein, 14 aa, Mycobacterium
ALTGTVSSVTAEAR

SEQ ID NO: 895377 - protein, 11 aa, Mycobacterium
ALTKRDAAGRV

SEQ ID NO: 895378 - protein, 7 aa, Mycobacterium
ALTNPTP

SEQ ID NO: 895379 - protein, 9 aa, Mycobacterium
ALTPGPADI

SEQ ID NO: 895380 - protein, 9 aa, Mycobacterium
ALTPTQRET

SEQ ID NO: 895381 - protein, 17 aa, Mycobacterium
ALTSAAPATARPSDPGV

SEQ ID NO: 895382 - protein, 8 aa, Mycobacterium
ALTSPTLS

SEQ ID NO: 895383 - protein, 4 aa, Mycobacterium
ALTT

SEQ ID NO: 895384 - protein, 11 aa, Mycobacterium
AMADEPTAPVT

SEQ ID NO: 895385 - protein, 10 aa, Mycobacterium
AMAGRGPVVD

SEQ ID NO: 895386 - protein, 5 aa, Mycobacterium
AMEGM

SEQ ID NO: 895387 - protein, 11 aa, Mycobacterium
AMGPEMPPDLQ

SEQ ID NO: 895388 - protein, 21 aa, Mycobacterium
AMGPTGGPTVGANGVTTVTPT

SEQ ID NO: 895389 - protein, 4 aa, Mycobacterium
AMGR

SEQ ID NO: 895390 - protein, 4 aa, Mycobacterium
AMNG

SEQ ID NO: 895391 - protein, 5 aa, Mycobacterium
AMPAD

SEQ ID NO: 895392 - protein, 32 aa, Mycobacterium
AMPEPPAPTRPGESPPPSPAPIPGLLPAEGTQ

SEQ ID NO: 895393 - protein, 20 aa, Mycobacterium
AMPEPPPPSVPAEPSPPPAN

SEQ ID NO: 895394 - protein, 67 aa, Mycobacterium
AMPGQASAKPDADGGSGMSETSVSGPARAGSGTDATSRSGKPAQSERSAATKPSGGSDPPDRSPREV

SEQ ID NO: 895395 - protein, 6 aa, Mycobacterium
AMPPSV

SEQ ID NO: 895396 - protein, 12 aa, Mycobacterium
AMPPTLAQGANQ

SEQ ID NO: 895397 - protein, 13 aa, Mycobacterium
AMPPTLAQGTNQA

SEQ ID NO: 895398 - protein, 17 aa, Mycobacterium
AMPSQETTPTRGIPSGL

SEQ ID NO: 895399 - protein, 4 aa, Mycobacterium
AMQG

SEQ ID NO: 895400 - protein, 16 aa, Mycobacterium
AMRPQTTTTGGAPMGG

SEQ ID NO: 895401 - protein, 8 aa, Mycobacterium
AMSADSPV

SEQ ID NO: 895402 - protein, 7 aa, Mycobacterium
AMSDNGI

SEQ ID NO: 895403 - protein, 4 aa, Mycobacterium
AMSG

SEQ ID NO: 895404 - protein, 11 aa, Mycobacterium
AMSKGAAESFA

SEQ ID NO: 895405 - protein, 12 aa, Mycobacterium
AMTPPAGSRPPL

SEQ ID NO: 895406 - protein, 10 aa, Mycobacterium
AMTSTLADRD

SEQ ID NO: 895407 - protein, 15 aa, Mycobacterium
ANAAAADDKVPLGGG

SEQ ID NO: 895408 - protein, 8 aa, Mycobacterium
ANAAAPHN

SEQ ID NO: 895409 - protein, 7 aa, Mycobacterium
ANAAARE

SEQ ID NO: 895410 - protein, 10 aa, Mycobacterium
ANAAKNDCPH

SEQ ID NO: 895411 - protein, 7 aa, Mycobacterium
ANAANAR

SEQ ID NO: 895412 - protein, 9 aa, Mycobacterium
ANAAPGDID

SEQ ID NO: 895413 - protein, 9 aa, Mycobacterium
ANAATDGEW

SEQ ID NO: 895414 - protein, 4 aa, Mycobacterium
ANAD

SEQ ID NO: 895415 - protein, 9 aa, Mycobacterium
ANADDDQLT

SEQ ID NO: 895416 - protein, 10 aa, Mycobacterium
ANADGSTPLL

SEQ ID NO: 895417 - protein, 25 aa, Mycobacterium
ANADPAAGAAGLPGSKLGNAAHPAN

SEQ ID NO: 895418 - protein, 7 aa, Mycobacterium
ANAGPAL

SEQ ID NO: 895419 - protein, 8 aa, Mycobacterium
ANAGPSLT

SEQ ID NO: 895420 - protein, 13 aa, Mycobacterium
ANAGRGGNGGNGG

SEQ ID NO: 895421 - protein, 13 aa, Mycobacterium
ANAMEGNGDKLRE

SEQ ID NO: 895422 - protein, 16 aa, Mycobacterium
ANANGGNRADGTPGFN

SEQ ID NO: 895423 - protein, 7 aa, Mycobacterium
ANAPLAA

SEQ ID NO: 895424 - protein, 6 aa, Mycobacterium
ANAPRY

SEQ ID NO: 895425 - protein, 5 aa, Mycobacterium
ANAPV

SEQ ID NO: 895426 - protein, 5 aa, Mycobacterium
ANARR

SEQ ID NO: 895427 - protein, 14 aa, Mycobacterium
ANASQGTDHGTAGP

SEQ ID NO: 895428 - protein, 11 aa, Mycobacterium
ANATAKVSQTS

SEQ ID NO: 895429 - protein, 7 aa, Mycobacterium
ANATPGD

SEQ ID NO: 895430 - protein, 21 aa, Mycobacterium
ANATPYQPDPTRAHTPASTYG

SEQ ID NO: 895431 - protein, 8 aa, Mycobacterium
ANDDVNQQ

SEQ ID NO: 895432 - protein, 7 aa, Mycobacterium
ANDGLAG

SEQ ID NO: 895433 - protein, 5 aa, Mycobacterium
ANDGV

SEQ ID NO: 895434 - protein, 14 aa, Mycobacterium
ANDIDQTGLSVPEA

SEQ ID NO: 895435 - protein, 7 aa, Mycobacterium
ANDPTSL

SEQ ID NO: 895436 - protein, 8 aa, Mycobacterium
ANDPTSVA

SEQ ID NO: 895437 - protein, 14 aa, Mycobacterium
ANDRNRSSNRKPSL

SEQ ID NO: 895438 - protein, 9 aa, Mycobacterium
ANDRVRRGD

SEQ ID NO: 895439 - protein, 10 aa, Mycobacterium
ANDSDPEGNS

SEQ ID NO: 895440 - protein, 11 aa, Mycobacterium
ANDSDPNGDDI

SEQ ID NO: 895441 - protein, 11 aa, Mycobacterium
ANDTDADGDPL

SEQ ID NO: 895442 - protein, 11 aa, Mycobacterium
ANDTDTDGTLN

SEQ ID NO: 895443 - protein, 15 aa, Mycobacterium
ANDTDVDTDNGVDPA

SEQ ID NO: 895444 - protein, 7 aa, Mycobacterium
ANEAARS

SEQ ID NO: 895445 - protein, 5 aa, Mycobacterium
ANEGP

SEQ ID NO: 895446 - protein, 10 aa, Mycobacterium
ANEGQANLSA

SEQ ID NO: 895447 - protein, 8 aa, Mycobacterium
ANENFRRA

SEQ ID NO: 895448 - protein, 20 aa, Mycobacterium
ANEPFSDNTAEGFRAGAEAA

SEQ ID NO: 895449 - protein, 11 aa, Mycobacterium
ANERSAHAQAL

SEQ ID NO: 895450 - protein, 12 aa, Mycobacterium
ANETLSRSADFP

SEQ ID NO: 895451 - protein, 7 aa, Mycobacterium
ANFGNTG

SEQ ID NO: 895452 - protein, 7 aa, Mycobacterium
ANFSAAD

SEQ ID NO: 895453 - protein, 5 aa, Mycobacterium
ANGAD

SEQ ID NO: 895454 - protein, 19 aa, Mycobacterium
ANGANMTQSYAETHPSEPN

SEQ ID NO: 895455 - protein, 8 aa, Mycobacterium
ANGAPARY

SEQ ID NO: 895456 - protein, 12 aa, Mycobacterium
ANGDNDLPLGRE

SEQ ID NO: 895457 - protein, 9 aa, Mycobacterium
ANGEKDNKT

SEQ ID NO: 895458 - protein, 8 aa, Mycobacterium
ANGEPCPT

SEQ ID NO: 895459 - protein, 7 aa, Mycobacterium
ANGEPNH

SEQ ID NO: 895460 - protein, 12 aa, Mycobacterium
ANGETAQQFTPQ

SEQ ID NO: 895461 - protein, 4 aa, Mycobacterium
ANGG

SEQ ID NO: 895462 - protein, 13 aa, Mycobacterium
ANGGAVDERGTAV

SEQ ID NO: 895463 - protein, 13 aa, Mycobacterium
ANGGQTDARGTAV

SEQ ID NO: 895464 - protein, 17 aa, Mycobacterium
ANGGSANVSPISSGVPD

SEQ ID NO: 895465 - protein, 12 aa, Mycobacterium
ANGGTAAVSPRD

SEQ ID NO: 895466 - protein, 23 aa, Mycobacterium
ANGHSSECSDAKNPLGDEPNIDV

SEQ ID NO: 895467 - protein, 7 aa, Mycobacterium
ANGLSAS

SEQ ID NO: 895468 - protein, 7 aa, Mycobacterium
ANGNMQS

SEQ ID NO: 895469 - protein, 7 aa, Mycobacterium
ANGNTTI

SEQ ID NO: 895470 - protein, 10 aa, Mycobacterium
ANGPQTNNAY

SEQ ID NO: 895471 - protein, 5 aa, Mycobacterium
ANGQE

SEQ ID NO: 895472 - protein, 6 aa, Mycobacterium
ANGSDA

SEQ ID NO: 895473 - protein, 5 aa, Mycobacterium
ANGSV

SEQ ID NO: 895474 - protein, 5 aa, Mycobacterium
ANGTE

SEQ ID NO: 895475 - protein, 15 aa, Mycobacterium
ANGTRAYVSNTNSNT

SEQ ID NO: 895476 - protein, 4 aa, Mycobacterium
ANHD

SEQ ID NO: 895477 - protein, 5 aa, Mycobacterium
ANHDN

SEQ ID NO: 895478 - protein, 6 aa, Mycobacterium
ANHNGS

SEQ ID NO: 895479 - protein, 7 aa, Mycobacterium
ANHSPGA

SEQ ID NO: 895480 - protein, 6 aa, Mycobacterium
ANIAPP

SEQ ID NO: 895481 - protein, 7 aa, Mycobacterium
ANIGSTL

SEQ ID NO: 895482 - protein, 9 aa, Mycobacterium
ANIPPERYQ

SEQ ID NO: 895483 - protein, 7 aa, Mycobacterium
ANKATTV

SEQ ID NO: 895484 - protein, 7 aa, Mycobacterium
ANKDRDY

SEQ ID NO: 895485 - protein, 10 aa, Mycobacterium
ANKPGAAAPN

SEQ ID NO: 895486 - protein, 6 aa, Mycobacterium
ANKPGH

SEQ ID NO: 895487 - protein, 9 aa, Mycobacterium
ANKPVAETI

SEQ ID NO: 895488 - protein, 12 aa, Mycobacterium
ANLAAEDAAGFD

SEQ ID NO: 895489 - protein, 11 aa, Mycobacterium
ANLAAEGAASF

SEQ ID NO: 895490 - protein, 4 aa, Mycobacterium
ANLD

SEQ ID NO: 895491 - protein, 27 aa, Mycobacterium
ANLGSGNAGNTNLGSGNTGSTNFGSGN

SEQ ID NO: 895492 - protein, 6 aa, Mycobacterium
ANLGSV

SEQ ID NO: 895493 - protein, 7 aa, Mycobacterium
ANLGTER

SEQ ID NO: 895494 - protein, 5 aa, Mycobacterium
ANMTA

SEQ ID NO: 895495 - protein, 10 aa, Mycobacterium
ANNDGDVSVD

SEQ ID NO: 895496 - protein, 18 aa, Mycobacterium
ANNDGIVSPDNIDDAALS

SEQ ID NO: 895497 - protein, 12 aa, Mycobacterium
ANNLRGQGASIR

SEQ ID NO: 895498 - protein, 18 aa, Mycobacterium
ANNNSPDVRAKAGPAVDA

SEQ ID NO: 895499 - protein, 10 aa, Mycobacterium
ANNPARDRRH

SEQ ID NO: 895500 - protein, 8 aa, Mycobacterium
ANNPIDKD

SEQ ID NO: 895501 - protein, 5 aa, Mycobacterium
ANNTV

SEQ ID NO: 895502 - protein, 8 aa, Mycobacterium
ANPAAAKQ

SEQ ID NO: 895503 - protein, 7 aa, Mycobacterium
ANPAAAT

SEQ ID NO: 895504 - protein, 9 aa, Mycobacterium
ANPAAKTDL

SEQ ID NO: 895505 - protein, 8 aa, Mycobacterium
ANPAAPHT

SEQ ID NO: 895506 - protein, 13 aa, Mycobacterium
ANPAPGSNEPRHP

SEQ ID NO: 895507 - protein, 8 aa, Mycobacterium
ANPAQYGN

SEQ ID NO: 895508 - protein, 9 aa, Mycobacterium
ANPAQYGNE

SEQ ID NO: 895509 - protein, 14 aa, Mycobacterium
ANPDAARDALDNRP

SEQ ID NO: 895510 - protein, 116 aa, Mycobacterium
ANPDAGSDTAGQGPAGADSGAPQVAGPRGTHGQRPSPRPGGPGHTGQAPTHGHSRPPMHTGTRHPGKPPRPGPPRPGHGHPTKTGHPDPPQQTDPSHTPTRPSHTRPTRPPGWPGW

SEQ ID NO: 895511 - protein, 8 aa, Mycobacterium
ANPDPAAM

SEQ ID NO: 895512 - protein, 20 aa, Mycobacterium
ANPDPAAQQRRIETEKVTRA

SEQ ID NO: 895513 - protein, 19 aa, Mycobacterium
ANPDPGAQERRRQTEKVTR

SEQ ID NO: 895514 - protein, 4 aa, Mycobacterium
ANPE

SEQ ID NO: 895515 - protein, 4 aa, Mycobacterium
ANPG

SEQ ID NO: 895516 - protein, 8 aa, Mycobacterium
ANPGAAQL

SEQ ID NO: 895517 - protein, 8 aa, Mycobacterium
ANPGATEL

SEQ ID NO: 895518 - protein, 8 aa, Mycobacterium
ANPGEAAG

SEQ ID NO: 895519 - protein, 8 aa, Mycobacterium
ANPGTITG

SEQ ID NO: 895520 - protein, 7 aa, Mycobacterium
ANPGVTP

SEQ ID NO: 895521 - protein, 5 aa, Mycobacterium
ANPLA

SEQ ID NO: 895522 - protein, 6 aa, Mycobacterium
ANPLAT

SEQ ID NO: 895523 - protein, 4 aa, Mycobacterium
ANPN

SEQ ID NO: 895524 - protein, 4 aa, Mycobacterium
ANPP

SEQ ID NO: 895525 - protein, 22 aa, Mycobacterium
ANPPEGTPTLGYGEARSAGPFT

SEQ ID NO: 895526 - protein, 10 aa, Mycobacterium
ANPPSTNLSR

SEQ ID NO: 895527 - protein, 7 aa, Mycobacterium
ANPQAAR

SEQ ID NO: 895528 - protein, 9 aa, Mycobacterium
ANPQEQADL

SEQ ID NO: 895529 - protein, 5 aa, Mycobacterium
ANPQP

SEQ ID NO: 895530 - protein, 8 aa, Mycobacterium
ANPQTHAD

SEQ ID NO: 895531 - protein, 8 aa, Mycobacterium
ANPQTNEA

SEQ ID NO: 895532 - protein, 4 aa, Mycobacterium
ANPR

SEQ ID NO: 895533 - protein, 5 aa, Mycobacterium
ANPSA

SEQ ID NO: 895534 - protein, 9 aa, Mycobacterium
ANPSENSAI

SEQ ID NO: 895535 - protein, 5 aa, Mycobacterium
ANPST

SEQ ID NO: 895536 - protein, 12 aa, Mycobacterium
ANPSTAYVAGPE

SEQ ID NO: 895537 - protein, 17 aa, Mycobacterium
ANPTQPSNKPFEIEVTC

SEQ ID NO: 895538 - protein, 5 aa, Mycobacterium
ANPVA

SEQ ID NO: 895539 - protein, 8 aa, Mycobacterium
ANPVNYGN

SEQ ID NO: 895540 - protein, 10 aa, Mycobacterium
ANPVPSAGGH

SEQ ID NO: 895541 - protein, 11 aa, Mycobacterium
ANPVRASDGRI

SEQ ID NO: 895542 - protein, 6 aa, Mycobacterium
ANPWQY

SEQ ID NO: 895543 - protein, 5 aa, Mycobacterium
ANQGE

SEQ ID NO: 895544 - protein, 14 aa, Mycobacterium
ANQGISAAADATDA

SEQ ID NO: 895545 - protein, 23 aa, Mycobacterium
ANQGVSSQRELETRGREAGRAAT

SEQ ID NO: 895546 - protein, 6 aa, Mycobacterium
ANQPTG

SEQ ID NO: 895547 - protein, 5 aa, Mycobacterium
ANQPY

SEQ ID NO: 895548 - protein, 24 aa, Mycobacterium
ANQQGGQGATSTSSSAPPGSERIT

SEQ ID NO: 895549 - protein, 23 aa, Mycobacterium
ANQQGSQPNTSPLTSPAPGAERL

SEQ ID NO: 895550 - protein, 5 aa, Mycobacterium
ANQRL

SEQ ID NO: 895551 - protein, 8 aa, Mycobacterium
ANRAEAER

SEQ ID NO: 895552 - protein, 6 aa, Mycobacterium
ANRDAG

SEQ ID NO: 895553 - protein, 17 aa, Mycobacterium
ANRDNIKQTALNGNATL

SEQ ID NO: 895554 - protein, 16 aa, Mycobacterium
ANREGKTTPAPRRKPI

SEQ ID NO: 895555 - protein, 4 aa, Mycobacterium
ANRL

SEQ ID NO: 895556 - protein, 13 aa, Mycobacterium
ANRLGISSGSATD

SEQ ID NO: 895557 - protein, 4 aa, Mycobacterium
ANRN

SEQ ID NO: 895558 - protein, 25 aa, Mycobacterium
ANRPQDAVYPTSEVDNTGKPYDGAN

SEQ ID NO: 895559 - protein, 6 aa, Mycobacterium
ANRQAS

SEQ ID NO: 895560 - protein, 7 aa, Mycobacterium
ANRRARQ

SEQ ID NO: 895561 - protein, 23 aa, Mycobacterium
ANRRRPAPQPRADRAEAPPTGDH

SEQ ID NO: 895562 - protein, 4 aa, Mycobacterium
ANRS

SEQ ID NO: 895563 - protein, 17 aa, Mycobacterium
ANRSGGSLTTQSSLLGS

SEQ ID NO: 895564 - protein, 4 aa, Mycobacterium
ANRT

SEQ ID NO: 895565 - protein, 7 aa, Mycobacterium
ANRTSRR

SEQ ID NO: 895566 - protein, 8 aa, Mycobacterium
ANSAASDA

SEQ ID NO: 895567 - protein, 6 aa, Mycobacterium
ANSADK

SEQ ID NO: 895568 - protein, 6 aa, Mycobacterium
ANSAEK

SEQ ID NO: 895569 - protein, 8 aa, Mycobacterium
ANSAEKLQ

SEQ ID NO: 895570 - protein, 8 aa, Mycobacterium
ANSAEKLR

SEQ ID NO: 895571 - protein, 22 aa, Mycobacterium
ANSAPYEPDPTRAHTPASSYGA

SEQ ID NO: 895572 - protein, 8 aa, Mycobacterium
ANSATGSR

SEQ ID NO: 895573 - protein, 8 aa, Mycobacterium
ANSATPDA

SEQ ID NO: 895574 - protein, 8 aa, Mycobacterium
ANSDKFSS

SEQ ID NO: 895575 - protein, 12 aa, Mycobacterium
ANSEASWEGSPG

SEQ ID NO: 895576 - protein, 9 aa, Mycobacterium
ANSGDTNTG

SEQ ID NO: 895577 - protein, 9 aa, Mycobacterium
ANSGPAGQA

SEQ ID NO: 895578 - protein, 13 aa, Mycobacterium
ANSKCTGTADGAA

SEQ ID NO: 895579 - protein, 6 aa, Mycobacterium
ANSKIA

SEQ ID NO: 895580 - protein, 7 aa, Mycobacterium
ANSNQAA

SEQ ID NO: 895581 - protein, 5 aa, Mycobacterium
ANSPM

SEQ ID NO: 895582 - protein, 10 aa, Mycobacterium
ANSPVPQGSA

SEQ ID NO: 895583 - protein, 9 aa, Mycobacterium
ANSQDPAGG

SEQ ID NO: 895584 - protein, 7 aa, Mycobacterium
ANSRNKL

SEQ ID NO: 895585 - protein, 9 aa, Mycobacterium
ANSTATVAQ

SEQ ID NO: 895586 - protein, 13 aa, Mycobacterium
ANSTLTGPARRGE

SEQ ID NO: 895587 - protein, 11 aa, Mycobacterium
ANSTPTTTPQS

SEQ ID NO: 895588 - protein, 22 aa, Mycobacterium
ANSTPYDPDPMRAHSPASSYGA

SEQ ID NO: 895589 - protein, 17 aa, Mycobacterium
ANSTSYQLQTPTDARAI

SEQ ID NO: 895590 - protein, 7 aa, Mycobacterium
ANSVQPA

SEQ ID NO: 895591 - protein, 12 aa, Mycobacterium
ANTDVGGGANDL

SEQ ID NO: 895592 - protein, 9 aa, Mycobacterium
ANTGSTALD

SEQ ID NO: 895593 - protein, 6 aa, Mycobacterium
ANTHQV

SEQ ID NO: 895594 - protein, 4 aa, Mycobacterium
ANTL

SEQ ID NO: 895595 - protein, 22 aa, Mycobacterium
ANTLTPAAPGGYDEDSPTVQSA

SEQ ID NO: 895596 - protein, 7 aa, Mycobacterium
ANTNAFP

SEQ ID NO: 895597 - protein, 7 aa, Mycobacterium
ANTNTTP

SEQ ID NO: 895598 - protein, 5 aa, Mycobacterium
ANTRG

SEQ ID NO: 895599 - protein, 8 aa, Mycobacterium
ANTSAGYR

SEQ ID NO: 895600 - protein, 5 aa, Mycobacterium
ANTYD

SEQ ID NO: 895601 - protein, 13 aa, Mycobacterium
ANVPARDDAPAMC

SEQ ID NO: 895602 - protein, 7 aa, Mycobacterium
ANVPGDP

SEQ ID NO: 895603 - protein, 9 aa, Mycobacterium
ANVPTPDQL

SEQ ID NO: 895604 - protein, 8 aa, Mycobacterium
ANYGPAGI

SEQ ID NO: 895605 - protein, 19 aa, Mycobacterium
ANYGPAGIGDIDITKVGFM

SEQ ID NO: 895606 - protein, 4 aa, Mycobacterium
APAA

SEQ ID NO: 895607 - protein, 5 aa, Mycobacterium
APAAA

SEQ ID NO: 895608 - protein, 23 aa, Mycobacterium
APAAAAAPGPAPAPGPAPEVATP

SEQ ID NO: 895609 - protein, 11 aa, Mycobacterium
APAAAAARGVT

SEQ ID NO: 895610 - protein, 8 aa, Mycobacterium
APAAADDP

SEQ ID NO: 895611 - protein, 14 aa, Mycobacterium
APAAADSQSSVGCS

SEQ ID NO: 895612 - protein, 10 aa, Mycobacterium
APAAADSTDD

SEQ ID NO: 895613 - protein, 12 aa, Mycobacterium
APAAAEPADPLA

SEQ ID NO: 895614 - protein, 22 aa, Mycobacterium
APAAAGAATADVSVSGPKFTAP

SEQ ID NO: 895615 - protein, 71 aa, Mycobacterium
APAAAPAQRSGGSTQSHGSTPAPATSTAPTTATPAPAAVPAGSQGTPLPAGSQGTPVDEQAPAATPTPTVA

SEQ ID NO: 895616 - protein, 26 aa, Mycobacterium
APAAFGDASAVTTSTLGSAAKLNNGD

SEQ ID NO: 895617 - protein, 10 aa, Mycobacterium
APAAGAAGAP

SEQ ID NO: 895618 - protein, 16 aa, Mycobacterium
APAAGATSGQTPAGIS

SEQ ID NO: 895619 - protein, 13 aa, Mycobacterium
APAAGTPGTPQAV

SEQ ID NO: 895620 - protein, 8 aa, Mycobacterium
APAAHADQ

SEQ ID NO: 895621 - protein, 23 aa, Mycobacterium
APAALGADPAAIEAASDGSPNYR

SEQ ID NO: 895622 - protein, 11 aa, Mycobacterium
APAALGAHPSA

SEQ ID NO: 895623 - protein, 12 aa, Mycobacterium
APAALGANPATI

SEQ ID NO: 895624 - protein, 74 aa, Mycobacterium
APAAPAAPAVPGAAPAAPAVAPAPGAAPAVPGVPPAAAQGLTPAAAAALSPASVPATSNVPGVSQIPGAEGVTQ

SEQ ID NO: 895625 - protein, 21 aa, Mycobacterium
APAAPASAPTGVGVGAGGGAP

SEQ ID NO: 895626 - protein, 16 aa, Mycobacterium
APAAPATAPAVTPAIP

SEQ ID NO: 895627 - protein, 18 aa, Mycobacterium
APAAPTVPPGQHPGLHGI

SEQ ID NO: 895628 - protein, 20 aa, Mycobacterium
APAAPVAPSPATAVTPSIPG

SEQ ID NO: 895629 - protein, 13 aa, Mycobacterium
APAARAASGDNEY

SEQ ID NO: 895630 - protein, 16 aa, Mycobacterium
APAARAESTEADSTTE

SEQ ID NO: 895631 - protein, 4 aa, Mycobacterium
APAD

SEQ ID NO: 895632 - protein, 26 aa, Mycobacterium
APADADPGPWDPTLPATASAGAPGDA

SEQ ID NO: 895633 - protein, 7 aa, Mycobacterium
APADATG

SEQ ID NO: 895634 - protein, 7 aa, Mycobacterium
APAEAAA

SEQ ID NO: 895635 - protein, 9 aa, Mycobacterium
APAEADDGR

SEQ ID NO: 895636 - protein, 32 aa, Mycobacterium
APAEPADPAAPAPDPLALPPADPLAPPPPDPL

SEQ ID NO: 895637 - protein, 12 aa, Mycobacterium
APAEPGGNGAAE

SEQ ID NO: 895638 - protein, 14 aa, Mycobacterium
APAEPPPPPPAQNA

SEQ ID NO: 895639 - protein, 9 aa, Mycobacterium
APAERQQTV

SEQ ID NO: 895640 - protein, 12 aa, Mycobacterium
APAGADPGQGAS

SEQ ID NO: 895641 - protein, 8 aa, Mycobacterium
APAGAVPT

SEQ ID NO: 895642 - protein, 8 aa, Mycobacterium
APAGDTNR

SEQ ID NO: 895643 - protein, 5 aa, Mycobacterium
APAGF

SEQ ID NO: 895644 - protein, 7 aa, Mycobacterium
APAGGAY

SEQ ID NO: 895645 - protein, 16 aa, Mycobacterium
APAGLASAEETAQETI

SEQ ID NO: 895646 - protein, 15 aa, Mycobacterium
APAGPGPSNSADGAA

SEQ ID NO: 895647 - protein, 20 aa, Mycobacterium
APAGPGSSVTTKTAWTGGGG

SEQ ID NO: 895648 - protein, 34 aa, Mycobacterium
APAGPPPGPVPETGPAPGPLPAEAPLEPAEGTPP

SEQ ID NO: 895649 - protein, 12 aa, Mycobacterium
APAGRGAPPSLF

SEQ ID NO: 895650 - protein, 9 aa, Mycobacterium
APAGTAGSW

SEQ ID NO: 895651 - protein, 9 aa, Mycobacterium
APAGTGSSV

SEQ ID NO: 895652 - protein, 7 aa, Mycobacterium
APAGTQI

SEQ ID NO: 895653 - protein, 8 aa, Mycobacterium
APAHADGE

SEQ ID NO: 895654 - protein, 7 aa, Mycobacterium
APAHADP

SEQ ID NO: 895655 - protein, 9 aa, Mycobacterium
APAHADPPC

SEQ ID NO: 895656 - protein, 14 aa, Mycobacterium
APAHSVADANTQQV

SEQ ID NO: 895657 - protein, 12 aa, Mycobacterium
APAKLTDVTPGS

SEQ ID NO: 895658 - protein, 9 aa, Mycobacterium
APAKTTADV

SEQ ID NO: 895659 - protein, 6 aa, Mycobacterium
APALPL

SEQ ID NO: 895660 - protein, 9 aa, Mycobacterium
APALSAASH

SEQ ID NO: 895661 - protein, 12 aa, Mycobacterium
APALSQEKAEKF

SEQ ID NO: 895662 - protein, 15 aa, Mycobacterium
APALTEAPATRALTG

SEQ ID NO: 895663 - protein, 12 aa, Mycobacterium
APALTKGDTAAI

SEQ ID NO: 895664 - protein, 12 aa, Mycobacterium
APANADNKRLND

SEQ ID NO: 895665 - protein, 8 aa, Mycobacterium
APANNPVD

SEQ ID NO: 895666 - protein, 6 aa, Mycobacterium
APANSE

SEQ ID NO: 895667 - protein, 6 aa, Mycobacterium
APANSL

SEQ ID NO: 895668 - protein, 4 aa, Mycobacterium
APAP

SEQ ID NO: 895669 - protein, 5 aa, Mycobacterium
APAPA

SEQ ID NO: 895670 - protein, 23 aa, Mycobacterium
APAPAAPAAPAPAAPVPAAPGMP

SEQ ID NO: 895671 - protein, 9 aa, Mycobacterium
APAPAAPTA

SEQ ID NO: 895672 - protein, 31 aa, Mycobacterium
APAPAPAAPPAAPAPVAPPALPALPQLPGLP

SEQ ID NO: 895673 - protein, 7 aa, Mycobacterium
APAPAPQ

SEQ ID NO: 895674 - protein, 8 aa, Mycobacterium
APAPEAPV

SEQ ID NO: 895675 - protein, 9 aa, Mycobacterium
APAPGPAAP

SEQ ID NO: 895676 - protein, 6 aa, Mycobacterium
APAPLR

SEQ ID NO: 895677 - protein, 10 aa, Mycobacterium
APAPNGQSGP

SEQ ID NO: 895678 - protein, 9 aa, Mycobacterium
APAPNWQRG

SEQ ID NO: 895679 - protein, 14 aa, Mycobacterium
APAPPGGNNRESPE

SEQ ID NO: 895680 - protein, 11 aa, Mycobacterium
APAPPPVGFGN

SEQ ID NO: 895681 - protein, 6 aa, Mycobacterium
APAPSV

SEQ ID NO: 895682 - protein, 9 aa, Mycobacterium
APAPTRGEN

SEQ ID NO: 895683 - protein, 23 aa, Mycobacterium
APAQAAPAMAPVSTGVDATTITA

SEQ ID NO: 895684 - protein, 8 aa, Mycobacterium
APAQADDY

SEQ ID NO: 895685 - protein, 12 aa, Mycobacterium
APAQADDYDAPF

SEQ ID NO: 895686 - protein, 7 aa, Mycobacterium
APAQADI

SEQ ID NO: 895687 - protein, 11 aa, Mycobacterium
APAQADPDTDF

SEQ ID NO: 895688 - protein, 8 aa, Mycobacterium
APAQADSA

SEQ ID NO: 895689 - protein, 7 aa, Mycobacterium
APAQAGV

SEQ ID NO: 895690 - protein, 7 aa, Mycobacterium
APAQAQG

SEQ ID NO: 895691 - protein, 10 aa, Mycobacterium
APAQAVPAQV

SEQ ID NO: 895692 - protein, 14 aa, Mycobacterium
APAQSLSGPRAAAP

SEQ ID NO: 895693 - protein, 5 aa, Mycobacterium
APARA

SEQ ID NO: 895694 - protein, 20 aa, Mycobacterium
APARAARRREIPAGPVRNLP

SEQ ID NO: 895695 - protein, 7 aa, Mycobacterium
APARADD

SEQ ID NO: 895696 - protein, 11 aa, Mycobacterium
APARADDKQDQ

SEQ ID NO: 895697 - protein, 12 aa, Mycobacterium
APARAGLAAAEA

SEQ ID NO: 895698 - protein, 8 aa, Mycobacterium
APARGAPV

SEQ ID NO: 895699 - protein, 20 aa, Mycobacterium
APARPLDPPPPAQAAPTMTT

SEQ ID NO: 895700 - protein, 9 aa, Mycobacterium
APASAAAPQ

SEQ ID NO: 895701 - protein, 12 aa, Mycobacterium
APASAQPGGGAW

SEQ ID NO: 895702 - protein, 18 aa, Mycobacterium
APASAQPVPQNDPPNCTA

SEQ ID NO: 895703 - protein, 13 aa, Mycobacterium
APASGSGKTTVAT

SEQ ID NO: 895704 - protein, 8 aa, Mycobacterium
APASPDPV

SEQ ID NO: 895705 - protein, 6 aa, Mycobacterium
APASTI

SEQ ID NO: 895706 - protein, 6 aa, Mycobacterium
APASVK

SEQ ID NO: 895707 - protein, 7 aa, Mycobacterium
APATADL

SEQ ID NO: 895708 - protein, 30 aa, Mycobacterium
APATALADPPVEPAVDPAAPPQVEGQTGPL

SEQ ID NO: 895709 - protein, 6 aa, Mycobacterium
APATAR

SEQ ID NO: 895710 - protein, 14 aa, Mycobacterium
APATATLQENAGQI

SEQ ID NO: 895711 - protein, 8 aa, Mycobacterium
APATDTLA

SEQ ID NO: 895712 - protein, 30 aa, Mycobacterium
APATGADPEVEPAGAAAAPPPDGAVPSNPP

SEQ ID NO: 895713 - protein, 13 aa, Mycobacterium
APATGTPETAHAA

SEQ ID NO: 895714 - protein, 7 aa, Mycobacterium
APATGTV

SEQ ID NO: 895715 - protein, 49 aa, Mycobacterium
APATNSTNESGVSAQKAAVTAANSNAAANKAVTQSYSPLSTQQTGDTYN

SEQ ID NO: 895716 - protein, 24 aa, Mycobacterium
APATPSTAPSLSGTPTTPSTTTPG

SEQ ID NO: 895717 - protein, 10 aa, Mycobacterium
APATPTGPLD

SEQ ID NO: 895718 - protein, 22 aa, Mycobacterium
APATTAAKTAAGTAAVAEPAAL

SEQ ID NO: 895719 - protein, 8 aa, Mycobacterium
APATVDAR

SEQ ID NO: 895720 - protein, 4 aa, Mycobacterium
APAV

SEQ ID NO: 895721 - protein, 6 aa, Mycobacterium
APAVAG

SEQ ID NO: 895722 - protein, 24 aa, Mycobacterium
APAVAPGQAARDRRPAAHPGARAG

SEQ ID NO: 895723 - protein, 19 aa, Mycobacterium
APAVDPASARGWSASGAGG

SEQ ID NO: 895724 - protein, 26 aa, Mycobacterium
APAVSGVATGAPAATSAAAGSGNGVP

SEQ ID NO: 895725 - protein, 5 aa, Mycobacterium
APAYG

SEQ ID NO: 895726 - protein, 8 aa, Mycobacterium
APAYSDSN

SEQ ID NO: 895727 - protein, 27 aa, Mycobacterium
APCDPPPGFGYTREGTYKGFPGSTVER

SEQ ID NO: 895728 - protein, 16 aa, Mycobacterium
APCPAAASGPGPEALR

SEQ ID NO: 895729 - protein, 17 aa, Mycobacterium
APCPGPQAAAQSPDGRP

SEQ ID NO: 895730 - protein, 16 aa, Mycobacterium
APCPKPQSAAQAPDGR

SEQ ID NO: 895731 - protein, 14 aa, Mycobacterium
APCPTAGDGPGPAA

SEQ ID NO: 895732 - protein, 10 aa, Mycobacterium
APDADTPGMR

SEQ ID NO: 895733 - protein, 5 aa, Mycobacterium
APDAE

SEQ ID NO: 895734 - protein, 8 aa, Mycobacterium
APDAGGAL

SEQ ID NO: 895735 - protein, 13 aa, Mycobacterium
APDAGSGNAEARL

SEQ ID NO: 895736 - protein, 9 aa, Mycobacterium
APDAPARQV

SEQ ID NO: 895737 - protein, 6 aa, Mycobacterium
APDAPV

SEQ ID NO: 895738 - protein, 22 aa, Mycobacterium
APDDDEPPTATPYGYTPDEVKT

SEQ ID NO: 895739 - protein, 11 aa, Mycobacterium
APDDNARAQSM

SEQ ID NO: 895740 - protein, 8 aa, Mycobacterium
APDESPRS

SEQ ID NO: 895741 - protein, 8 aa, Mycobacterium
APDETGII

SEQ ID NO: 895742 - protein, 4 aa, Mycobacterium
APDG

SEQ ID NO: 895743 - protein, 8 aa, Mycobacterium
APDGANSA

SEQ ID NO: 895744 - protein, 8 aa, Mycobacterium
APDGEGGY

SEQ ID NO: 895745 - protein, 5 aa, Mycobacterium
APDLA

SEQ ID NO: 895746 - protein, 7 aa, Mycobacterium
APDLSGA

SEQ ID NO: 895747 - protein, 6 aa, Mycobacterium
APDPTV

SEQ ID NO: 895748 - protein, 5 aa, Mycobacterium
APDQA

SEQ ID NO: 895749 - protein, 9 aa, Mycobacterium
APDRGSSAN

SEQ ID NO: 895750 - protein, 14 aa, Mycobacterium
APDRPSDAQRISTP

SEQ ID NO: 895751 - protein, 8 aa, Mycobacterium
APDRVDAV

SEQ ID NO: 895752 - protein, 11 aa, Mycobacterium
APDSPPQLPPG

SEQ ID NO: 895753 - protein, 7 aa, Mycobacterium
APDTPWQ

SEQ ID NO: 895754 - protein, 12 aa, Mycobacterium
APDTVNTMPEPT

SEQ ID NO: 895755 - protein, 6 aa, Mycobacterium
APEDWT

SEQ ID NO: 895756 - protein, 8 aa, Mycobacterium
APEEARSG

SEQ ID NO: 895757 - protein, 4 aa, Mycobacterium
APEF

SEQ ID NO: 895758 - protein, 4 aa, Mycobacterium
APEG

SEQ ID NO: 895759 - protein, 8 aa, Mycobacterium
APEGCTDG

SEQ ID NO: 895760 - protein, 6 aa, Mycobacterium
APEGRD

SEQ ID NO: 895761 - protein, 4 aa, Mycobacterium
APEL

SEQ ID NO: 895762 - protein, 19 aa, Mycobacterium
APELAKDPTHVAGPAAGAD

SEQ ID NO: 895763 - protein, 9 aa, Mycobacterium
APENPVGEL

SEQ ID NO: 895764 - protein, 21 aa, Mycobacterium
APEPAASWPGERDATRPGPRC

SEQ ID NO: 895765 - protein, 6 aa, Mycobacterium
APEPGW

SEQ ID NO: 895766 - protein, 6 aa, Mycobacterium
APEPTV

SEQ ID NO: 895767 - protein, 21 aa, Mycobacterium
APEQEKALAAEKGREYRSGHS

SEQ ID NO: 895768 - protein, 13 aa, Mycobacterium
APEQGRDEFESED

SEQ ID NO: 895769 - protein, 4 aa, Mycobacterium
APER

SEQ ID NO: 895770 - protein, 6 aa, Mycobacterium
APERFR

SEQ ID NO: 895771 - protein, 5 aa, Mycobacterium
APEVG

SEQ ID NO: 895772 - protein, 6 aa, Mycobacterium
APFDAQ

SEQ ID NO: 895773 - protein, 8 aa, Mycobacterium
APFEGEQD

SEQ ID NO: 895774 - protein, 14 aa, Mycobacterium
APFNKTDAVNDPSL

SEQ ID NO: 895775 - protein, 22 aa, Mycobacterium
APFPPAAPGFDRPADAQPVPAR

SEQ ID NO: 895776 - protein, 4 aa, Mycobacterium
APFT

SEQ ID NO: 895777 - protein, 10 aa, Mycobacterium
APGAAQPASC

SEQ ID NO: 895778 - protein, 6 aa, Mycobacterium
APGADI

SEQ ID NO: 895779 - protein, 10 aa, Mycobacterium
APGAGPARSW

SEQ ID NO: 895780 - protein, 7 aa, Mycobacterium
APGAQSQ

SEQ ID NO: 895781 - protein, 9 aa, Mycobacterium
APGASAPSH

SEQ ID NO: 895782 - protein, 31 aa, Mycobacterium
APGCAPSPSPQANAANPGRQIDTRTPPGIRA

SEQ ID NO: 895783 - protein, 30 aa, Mycobacterium
APGCGHKSAPRPTTAPDTCKNSDGPTSQTV

SEQ ID NO: 895784 - protein, 10 aa, Mycobacterium
APGCPGDGPG

SEQ ID NO: 895785 - protein, 15 aa, Mycobacterium
APGDPRGLPAGTQFQ

SEQ ID NO: 895786 - protein, 11 aa, Mycobacterium
APGDPYDPSPV

SEQ ID NO: 895787 - protein, 18 aa, Mycobacterium
APGDTGQLNDPGPSAART

SEQ ID NO: 895788 - protein, 7 aa, Mycobacterium
APGEAAL

SEQ ID NO: 895789 - protein, 16 aa, Mycobacterium
APGEAPPLVPVPGEGT

SEQ ID NO: 895790 - protein, 9 aa, Mycobacterium
APGEGAEGV

SEQ ID NO: 895791 - protein, 6 aa, Mycobacterium
APGEGG

SEQ ID NO: 895792 - protein, 5 aa, Mycobacterium
APGFT

SEQ ID NO: 895793 - protein, 8 aa, Mycobacterium
APGGGPGQ

SEQ ID NO: 895794 - protein, 11 aa, Mycobacterium
APGGSATGGLR

SEQ ID NO: 895795 - protein, 5 aa, Mycobacterium
APGGV

SEQ ID NO: 895796 - protein, 7 aa, Mycobacterium
APGINGL

SEQ ID NO: 895797 - protein, 9 aa, Mycobacterium
APGKESAAV

SEQ ID NO: 895798 - protein, 15 aa, Mycobacterium
APGLKTAADTLRTNG

SEQ ID NO: 895799 - protein, 6 aa, Mycobacterium
APGLPA

SEQ ID NO: 895800 - protein, 35 aa, Mycobacterium
APGMCNPTDQTPCISGTPSQQQIDHDERGAPERRH

SEQ ID NO: 895801 - protein, 6 aa, Mycobacterium
APGMPG

SEQ ID NO: 895802 - protein, 8 aa, Mycobacterium
APGNPKHI

SEQ ID NO: 895803 - protein, 8 aa, Mycobacterium
APGNPKHV

SEQ ID NO: 895804 - protein, 9 aa, Mycobacterium
APGNPKQIG

SEQ ID NO: 895805 - protein, 9 aa, Mycobacterium
APGNPKRVG

SEQ ID NO: 895806 - protein, 19 aa, Mycobacterium
APGNTGQLHDGGPSAARTA

SEQ ID NO: 895807 - protein, 4 aa, Mycobacterium
APGP

SEQ ID NO: 895808 - protein, 10 aa, Mycobacterium
APGPAHHGRG

SEQ ID NO: 895809 - protein, 7 aa, Mycobacterium
APGPIDT

SEQ ID NO: 895810 - protein, 14 aa, Mycobacterium
APGPLDSNESAKAT

SEQ ID NO: 895811 - protein, 13 aa, Mycobacterium
APGPLGSNQAARA

SEQ ID NO: 895812 - protein, 23 aa, Mycobacterium
APGPPPGAAPPPGPPEPPPPGPR

SEQ ID NO: 895813 - protein, 15 aa, Mycobacterium
APGPQWGAYQASKGA

SEQ ID NO: 895814 - protein, 11 aa, Mycobacterium
APGQKKARVSF

SEQ ID NO: 895815 - protein, 14 aa, Mycobacterium
APGQVRADSASPLS

SEQ ID NO: 895816 - protein, 4 aa, Mycobacterium
APGR

SEQ ID NO: 895817 - protein, 8 aa, Mycobacterium
APGRTGTV

SEQ ID NO: 895818 - protein, 11 aa, Mycobacterium
APGSGLDDRRR

SEQ ID NO: 895819 - protein, 5 aa, Mycobacterium
APGSI

SEQ ID NO: 895820 - protein, 13 aa, Mycobacterium
APGTQGQGNQCAP

SEQ ID NO: 895821 - protein, 5 aa, Mycobacterium
APGTR

SEQ ID NO: 895822 - protein, 8 aa, Mycobacterium
APGTTGRV

SEQ ID NO: 895823 - protein, 8 aa, Mycobacterium
APGTTGTV

SEQ ID NO: 895824 - protein, 8 aa, Mycobacterium
APGTTVTA

SEQ ID NO: 895825 - protein, 5 aa, Mycobacterium
APGTV

SEQ ID NO: 895826 - protein, 9 aa, Mycobacterium
APGVPNDRA

SEQ ID NO: 895827 - protein, 13 aa, Mycobacterium
APGVTPPQIPADA

SEQ ID NO: 895828 - protein, 23 aa, Mycobacterium
APGWSASYADAHNSSYTATEGAR

SEQ ID NO: 895829 - protein, 13 aa, Mycobacterium
APHAAAAGTPIGR

SEQ ID NO: 895830 - protein, 6 aa, Mycobacterium
APHGSG

SEQ ID NO: 895831 - protein, 30 aa, Mycobacterium
APHPGGGELPAEHAPAGPHVPVPPDGPPPV

SEQ ID NO: 895832 - protein, 5 aa, Mycobacterium
APHPT

SEQ ID NO: 895833 - protein, 4 aa, Mycobacterium
APHS

SEQ ID NO: 895834 - protein, 11 aa, Mycobacterium
APIDPKNPNSW

SEQ ID NO: 895835 - protein, 6 aa, Mycobacterium
APIGEA

SEQ ID NO: 895836 - protein, 7 aa, Mycobacterium
APIGSPL

SEQ ID NO: 895837 - protein, 5 aa, Mycobacterium
APIQD

SEQ ID NO: 895838 - protein, 14 aa, Mycobacterium
APIRPGDSGGPMVN

SEQ ID NO: 895839 - protein, 5 aa, Mycobacterium
APISS

SEQ ID NO: 895840 - protein, 6 aa, Mycobacterium
APISSG

SEQ ID NO: 895841 - protein, 5 aa, Mycobacterium
APKDG

SEQ ID NO: 895842 - protein, 11 aa, Mycobacterium
APKQPDASIEP

SEQ ID NO: 895843 - protein, 15 aa, Mycobacterium
APKSLPPTAAPDLSR

SEQ ID NO: 895844 - protein, 54 aa, Mycobacterium
APLAPAAAPAAAAVPGTSSLGVTNQTPGVPAATVPTGTVPTGAVPAAPAAVPQP

SEQ ID NO: 895845 - protein, 6 aa, Mycobacterium
APLATP

SEQ ID NO: 895846 - protein, 4 aa, Mycobacterium
APLD

SEQ ID NO: 895847 - protein, 5 aa, Mycobacterium
APLDE

SEQ ID NO: 895848 - protein, 12 aa, Mycobacterium
APLDKPDQSRPI

SEQ ID NO: 895849 - protein, 14 aa, Mycobacterium
APLDPINGAPGSVT

SEQ ID NO: 895850 - protein, 6 aa, Mycobacterium
APLHET

SEQ ID NO: 895851 - protein, 8 aa, Mycobacterium
APLHPSDQ

SEQ ID NO: 895852 - protein, 9 aa, Mycobacterium
APLNNPEGA

SEQ ID NO: 895853 - protein, 4 aa, Mycobacterium
APLP

SEQ ID NO: 895854 - protein, 10 aa, Mycobacterium
APLPATPGSY

SEQ ID NO: 895855 - protein, 13 aa, Mycobacterium
APLPEAPPDEPAA

SEQ ID NO: 895856 - protein, 8 aa, Mycobacterium
APLPEEEP

SEQ ID NO: 895857 - protein, 10 aa, Mycobacterium
APLPGTSSNA

SEQ ID NO: 895858 - protein, 17 aa, Mycobacterium
APLPPDITERAQSSAGV

SEQ ID NO: 895859 - protein, 10 aa, Mycobacterium
APLPPTVGSR

SEQ ID NO: 895860 - protein, 14 aa, Mycobacterium
APLPQDPPPAQPIA

SEQ ID NO: 895861 - protein, 22 aa, Mycobacterium
APLPQDPPPPPPAPGTLPTAEQ

SEQ ID NO: 895862 - protein, 25 aa, Mycobacterium
APLPQDPPPPPPPPPGAPGQLPTAD

SEQ ID NO: 895863 - protein, 30 aa, Mycobacterium
APLPVAPPATPGPQPGPAPGPAPGPAPGPV

SEQ ID NO: 895864 - protein, 4 aa, Mycobacterium
APLR

SEQ ID NO: 895865 - protein, 7 aa, Mycobacterium
APLRERS

SEQ ID NO: 895866 - protein, 10 aa, Mycobacterium
APLRPGEVGQ

SEQ ID NO: 895867 - protein, 8 aa, Mycobacterium
APLSEPSI

SEQ ID NO: 895868 - protein, 6 aa, Mycobacterium
APLSPE

SEQ ID NO: 895869 - protein, 6 aa, Mycobacterium
APLSTN

SEQ ID NO: 895870 - protein, 7 aa, Mycobacterium
APLTETA

SEQ ID NO: 895871 - protein, 17 aa, Mycobacterium
APLTPAAPAAPAAALPG

SEQ ID NO: 895872 - protein, 11 aa, Mycobacterium
APLTQGPSGEE

SEQ ID NO: 895873 - protein, 8 aa, Mycobacterium
APLTTSSL

SEQ ID NO: 895874 - protein, 6 aa, Mycobacterium
APMGGM

SEQ ID NO: 895875 - protein, 8 aa, Mycobacterium
APMGSGRN

SEQ ID NO: 895876 - protein, 4 aa, Mycobacterium
APMN

SEQ ID NO: 895877 - protein, 12 aa, Mycobacterium
APMPPQPSPASL

SEQ ID NO: 895878 - protein, 8 aa, Mycobacterium
APMPSGAT

SEQ ID NO: 895879 - protein, 10 aa, Mycobacterium
APMTAADPGV

SEQ ID NO: 895880 - protein, 14 aa, Mycobacterium
APMTGPANTGATTT

SEQ ID NO: 895881 - protein, 19 aa, Mycobacterium
APMTGQGTTQATGPAITTD

SEQ ID NO: 895882 - protein, 5 aa, Mycobacterium
APNAA

SEQ ID NO: 895883 - protein, 8 aa, Mycobacterium
APNAAAAD

SEQ ID NO: 895884 - protein, 11 aa, Mycobacterium
APNEFKDPSGK

SEQ ID NO: 895885 - protein, 7 aa, Mycobacterium
APNGGPI

SEQ ID NO: 895886 - protein, 5 aa, Mycobacterium
APNGP

SEQ ID NO: 895887 - protein, 5 aa, Mycobacterium
APNIG

SEQ ID NO: 895888 - protein, 15 aa, Mycobacterium
APNNGNLGCTNEPPL

SEQ ID NO: 895889 - protein, 19 aa, Mycobacterium
APNPNGGGGGAGGTGGAGG

SEQ ID NO: 895890 - protein, 8 aa, Mycobacterium
APNTDVGH

SEQ ID NO: 895891 - protein, 4 aa, Mycobacterium
APPA

SEQ ID NO: 895892 - protein, 5 aa, Mycobacterium
APPAA

SEQ ID NO: 895893 - protein, 12 aa, Mycobacterium
APPAAAEPCTGA

SEQ ID NO: 895894 - protein, 11 aa, Mycobacterium
APPAAAGPQTC

SEQ ID NO: 895895 - protein, 9 aa, Mycobacterium
APPAAAGPT

SEQ ID NO: 895896 - protein, 13 aa, Mycobacterium
APPADGSGTGELV

SEQ ID NO: 895897 - protein, 7 aa, Mycobacterium
APPADLG

SEQ ID NO: 895898 - protein, 14 aa, Mycobacterium
APPAETDPDDVGDG

SEQ ID NO: 895899 - protein, 14 aa, Mycobacterium
APPAGVAPQGKLKN

SEQ ID NO: 895900 - protein, 9 aa, Mycobacterium
APPANAGCQ

SEQ ID NO: 895901 - protein, 26 aa, Mycobacterium
APPAPPVPGAIPPGDIAPPGSPAATT

SEQ ID NO: 895902 - protein, 20 aa, Mycobacterium
APPAPRSEGGFASRHQCGYW

SEQ ID NO: 895903 - protein, 10 aa, Mycobacterium
APPAPSAGQQ

SEQ ID NO: 895904 - protein, 9 aa, Mycobacterium
APPARAANA

SEQ ID NO: 895905 - protein, 9 aa, Mycobacterium
APPATAAPA

SEQ ID NO: 895906 - protein, 6 aa, Mycobacterium
APPAVG

SEQ ID NO: 895907 - protein, 12 aa, Mycobacterium
APPDDDDGAEPQ

SEQ ID NO: 895908 - protein, 6 aa, Mycobacterium
APPDPR

SEQ ID NO: 895909 - protein, 8 aa, Mycobacterium
APPDYAPE

SEQ ID NO: 895910 - protein, 29 aa, Mycobacterium
APPEKDSSGGETESGTNAAQATSAEDFGG

SEQ ID NO: 895911 - protein, 29 aa, Mycobacterium
APPEKESSGGDTESGVKVSEATSAEDFGG

SEQ ID NO: 895912 - protein, 16 aa, Mycobacterium
APPEPPERPERPRGRH

SEQ ID NO: 895913 - protein, 12 aa, Mycobacterium
APPFSATDPVPG

SEQ ID NO: 895914 - protein, 17 aa, Mycobacterium
APPGAAEMPVPTNPTDG

SEQ ID NO: 895915 - protein, 9 aa, Mycobacterium
APPGAPDAL

SEQ ID NO: 895916 - protein, 17 aa, Mycobacterium
APPGGRPRGYRANHAKG

SEQ ID NO: 895917 - protein, 11 aa, Mycobacterium
APPGISDDARD

SEQ ID NO: 895918 - protein, 10 aa, Mycobacterium
APPGISEEDR

SEQ ID NO: 895919 - protein, 5 aa, Mycobacterium
APPGL

SEQ ID NO: 895920 - protein, 11 aa, Mycobacterium
APPHTAVRRGG

SEQ ID NO: 895921 - protein, 4 aa, Mycobacterium
APPI

SEQ ID NO: 895922 - protein, 13 aa, Mycobacterium
APPIESTPGHKPT

SEQ ID NO: 895923 - protein, 21 aa, Mycobacterium
APPKETNTSTGGVTASGISDS

SEQ ID NO: 895924 - protein, 9 aa, Mycobacterium
APPKGYDGP

SEQ ID NO: 895925 - protein, 4 aa, Mycobacterium
APPL

SEQ ID NO: 895926 - protein, 5 aa, Mycobacterium
APPLE

SEQ ID NO: 895927 - protein, 13 aa, Mycobacterium
APPLNATQAGPSV

SEQ ID NO: 895928 - protein, 6 aa, Mycobacterium
APPLNQ

SEQ ID NO: 895929 - protein, 13 aa, Mycobacterium
APPLNQAQAGPSV

SEQ ID NO: 895930 - protein, 5 aa, Mycobacterium
APPMG

SEQ ID NO: 895931 - protein, 4 aa, Mycobacterium
APPP

SEQ ID NO: 895932 - protein, 5 aa, Mycobacterium
APPPC

SEQ ID NO: 895933 - protein, 13 aa, Mycobacterium
APPPDQPPPPAPP

SEQ ID NO: 895934 - protein, 9 aa, Mycobacterium
APPPKREQM

SEQ ID NO: 895935 - protein, 12 aa, Mycobacterium
APPPPAPPGAPP

SEQ ID NO: 895936 - protein, 14 aa, Mycobacterium
APPPPPPAPPPPPP

SEQ ID NO: 895937 - protein, 11 aa, Mycobacterium
APPPPPPTEIR

SEQ ID NO: 895938 - protein, 9 aa, Mycobacterium
APPPPPVTE

SEQ ID NO: 895939 - protein, 8 aa, Mycobacterium
APPPRAEW

SEQ ID NO: 895940 - protein, 5 aa, Mycobacterium
APPQR

SEQ ID NO: 895941 - protein, 12 aa, Mycobacterium
APPRAYDGEPSL

SEQ ID NO: 895942 - protein, 21 aa, Mycobacterium
APPRETNTATGGVTASGISDS

SEQ ID NO: 895943 - protein, 11 aa, Mycobacterium
APPRPAERAGA

SEQ ID NO: 895944 - protein, 16 aa, Mycobacterium
APPSFPESPEESSTPD

SEQ ID NO: 895945 - protein, 9 aa, Mycobacterium
APPSSAAGM

SEQ ID NO: 895946 - protein, 13 aa, Mycobacterium
APPTGAPPRGRLR

SEQ ID NO: 895947 - protein, 7 aa, Mycobacterium
APPTPGL

SEQ ID NO: 895948 - protein, 21 aa, Mycobacterium
APPTSTTSGVVTTQSASCTDA

SEQ ID NO: 895949 - protein, 10 aa, Mycobacterium
APPVEPAPAP

SEQ ID NO: 895950 - protein, 7 aa, Mycobacterium
APPYNRR

SEQ ID NO: 895951 - protein, 46 aa, Mycobacterium
APQAATPLAPPATAGTPGTTAPAAAAPAAAPASAAAPAPVPATSGT

SEQ ID NO: 895952 - protein, 14 aa, Mycobacterium
APQAPQPVPAAPGL

SEQ ID NO: 895953 - protein, 30 aa, Mycobacterium
APQCTNVSPNTTQCQTNGSTQIVTSPPAMN

SEQ ID NO: 895954 - protein, 6 aa, Mycobacterium
APQGPI

SEQ ID NO: 895955 - protein, 9 aa, Mycobacterium
APQPDGSLR

SEQ ID NO: 895956 - protein, 8 aa, Mycobacterium
APQPINPG

SEQ ID NO: 895957 - protein, 30 aa, Mycobacterium
APQPMAPSPPAEAPPPPPPAPPPPAWNGPR

SEQ ID NO: 895958 - protein, 12 aa, Mycobacterium
APQPMNGQPDPA

SEQ ID NO: 895959 - protein, 6 aa, Mycobacterium
APQPTF

SEQ ID NO: 895960 - protein, 5 aa, Mycobacterium
APQQI

SEQ ID NO: 895961 - protein, 29 aa, Mycobacterium
APQQPAPETATANTPQAAPNVAAVVDQQD

SEQ ID NO: 895962 - protein, 12 aa, Mycobacterium
APQQTDYVEPGT

SEQ ID NO: 895963 - protein, 4 aa, Mycobacterium
APQT

SEQ ID NO: 895964 - protein, 6 aa, Mycobacterium
APQTSR

SEQ ID NO: 895965 - protein, 11 aa, Mycobacterium
APQTYTKVTRD

SEQ ID NO: 895966 - protein, 4 aa, Mycobacterium
APQV

SEQ ID NO: 895967 - protein, 5 aa, Mycobacterium
APRAA

SEQ ID NO: 895968 - protein, 6 aa, Mycobacterium
APRAQI

SEQ ID NO: 895969 - protein, 19 aa, Mycobacterium
APRASAAGAGQWSPDRANT

SEQ ID NO: 895970 - protein, 9 aa, Mycobacterium
APRATAGVA

SEQ ID NO: 895971 - protein, 8 aa, Mycobacterium
APRAWAGD

SEQ ID NO: 895972 - protein, 6 aa, Mycobacterium
APRDAP

SEQ ID NO: 895973 - protein, 6 aa, Mycobacterium
APRDGE

SEQ ID NO: 895974 - protein, 6 aa, Mycobacterium
APRDSS

SEQ ID NO: 895975 - protein, 15 aa, Mycobacterium
APRDSSISKVSDLSG

SEQ ID NO: 895976 - protein, 10 aa, Mycobacterium
APRGTRESAI

SEQ ID NO: 895977 - protein, 22 aa, Mycobacterium
APRPGQRADARQPAAPDGWWRL

SEQ ID NO: 895978 - protein, 7 aa, Mycobacterium
APRPQRN

SEQ ID NO: 895979 - protein, 20 aa, Mycobacterium
APRQPDAVTNPISAGAGQYR

SEQ ID NO: 895980 - protein, 17 aa, Mycobacterium
APRRGRRAESVLRSEVR

SEQ ID NO: 895981 - protein, 16 aa, Mycobacterium
APRSDTAPANLASRTD

SEQ ID NO: 895982 - protein, 8 aa, Mycobacterium
APRSGGHS

SEQ ID NO: 895983 - protein, 7 aa, Mycobacterium
APRVPDA

SEQ ID NO: 895984 - protein, 21 aa, Mycobacterium
APRVSEGTEQYRLGADGQPIY

SEQ ID NO: 895985 - protein, 4 aa, Mycobacterium
APSA

SEQ ID NO: 895986 - protein, 28 aa, Mycobacterium
APSAAAAPDCSPAGVNSTVSSVQGSAEQ

SEQ ID NO: 895987 - protein, 8 aa, Mycobacterium
APSAAADD

SEQ ID NO: 895988 - protein, 9 aa, Mycobacterium
APSADERAG

SEQ ID NO: 895989 - protein, 33 aa, Mycobacterium
APSALAQPAPAPAPAPVPPPATATGARTPATAD

SEQ ID NO: 895990 - protein, 12 aa, Mycobacterium
APSAMASPPDTL

SEQ ID NO: 895991 - protein, 8 aa, Mycobacterium
APSAPGAG

SEQ ID NO: 895992 - protein, 33 aa, Mycobacterium
APSDPTTGTGTGTGTTPSPLAQKTTQPDEDPAN

SEQ ID NO: 895993 - protein, 4 aa, Mycobacterium
APSG

SEQ ID NO: 895994 - protein, 7 aa, Mycobacterium
APSGAEL

SEQ ID NO: 895995 - protein, 6 aa, Mycobacterium
APSGAV

SEQ ID NO: 895996 - protein, 17 aa, Mycobacterium
APSGAWGRTRGYGTRER

SEQ ID NO: 895997 - protein, 20 aa, Mycobacterium
APSGDTSASTADQTTDPKTR

SEQ ID NO: 895998 - protein, 6 aa, Mycobacterium
APSGSW

SEQ ID NO: 895999 - protein, 9 aa, Mycobacterium
APSIDGART

SEQ ID NO: 896000 - protein, 47 aa, Mycobacterium
APSINNGLNPLPASQLPPPEVSSGPSSDPLTAPRGGTVTCSGQQPNP

SEQ ID NO: 896001 - protein, 7 aa, Mycobacterium
APSKPIL

SEQ ID NO: 896002 - protein, 7 aa, Mycobacterium
APSKTAK

SEQ ID NO: 896003 - protein, 6 aa, Mycobacterium
APSNAD

SEQ ID NO: 896004 - protein, 7 aa, Mycobacterium
APSNADE

SEQ ID NO: 896005 - protein, 5 aa, Mycobacterium
APSNI

SEQ ID NO: 896006 - protein, 6 aa, Mycobacterium
APSNLT

SEQ ID NO: 896007 - protein, 4 aa, Mycobacterium
APSP

SEQ ID NO: 896008 - protein, 9 aa, Mycobacterium
APSPAATAS

SEQ ID NO: 896009 - protein, 7 aa, Mycobacterium
APSPAID

SEQ ID NO: 896010 - protein, 6 aa, Mycobacterium
APSPLS

SEQ ID NO: 896011 - protein, 14 aa, Mycobacterium
APSPQAAAFSRPGL

SEQ ID NO: 896012 - protein, 7 aa, Mycobacterium
APSPQRT

SEQ ID NO: 896013 - protein, 15 aa, Mycobacterium
APSQPWNGKGSSTRE

SEQ ID NO: 896014 - protein, 22 aa, Mycobacterium
APSRDTNDATGGTTESGISGNT

SEQ ID NO: 896015 - protein, 7 aa, Mycobacterium
APSSAAQ

SEQ ID NO: 896016 - protein, 8 aa, Mycobacterium
APSSARDR

SEQ ID NO: 896017 - protein, 24 aa, Mycobacterium
APSSYADPNDGGPGVPAPAPAPAQ

SEQ ID NO: 896018 - protein, 17 aa, Mycobacterium
APSTDGHHAADGEKPGG

SEQ ID NO: 896019 - protein, 12 aa, Mycobacterium
APSWTADYGSET

SEQ ID NO: 896020 - protein, 5 aa, Mycobacterium
APTAA

SEQ ID NO: 896021 - protein, 24 aa, Mycobacterium
APTAAAAPAADAQGYEDSTARCAS

SEQ ID NO: 896022 - protein, 28 aa, Mycobacterium
APTAAAAPDCSPGGVNATVSSVQGSAEQ

SEQ ID NO: 896023 - protein, 9 aa, Mycobacterium
APTAPGNIM

SEQ ID NO: 896024 - protein, 12 aa, Mycobacterium
APTAQKGQLTAS

SEQ ID NO: 896025 - protein, 17 aa, Mycobacterium
APTASAAPDCSASGVAN

SEQ ID NO: 896026 - protein, 11 aa, Mycobacterium
APTASAGEGWG

SEQ ID NO: 896027 - protein, 10 aa, Mycobacterium
APTASALPDR

SEQ ID NO: 896028 - protein, 30 aa, Mycobacterium
APTDKPAEGRLADGSRIPESHTGRSPTTEE

SEQ ID NO: 896029 - protein, 5 aa, Mycobacterium
APTDQ

SEQ ID NO: 896030 - protein, 4 aa, Mycobacterium
APTE

SEQ ID NO: 896031 - protein, 14 aa, Mycobacterium
APTGCESPAHPRAA

SEQ ID NO: 896032 - protein, 16 aa, Mycobacterium
APTGDVDHKRAESSVY

SEQ ID NO: 896033 - protein, 21 aa, Mycobacterium
APTGGSDMGSRAGLSHPTVSA

SEQ ID NO: 896034 - protein, 11 aa, Mycobacterium
APTGRGAPPTL

SEQ ID NO: 896035 - protein, 7 aa, Mycobacterium
APTIAQA

SEQ ID NO: 896036 - protein, 10 aa, Mycobacterium
APTIPQSDGD

SEQ ID NO: 896037 - protein, 16 aa, Mycobacterium
APTITKQGLDSATKMG

SEQ ID NO: 896038 - protein, 13 aa, Mycobacterium
APTKLATKGYNDS

SEQ ID NO: 896039 - protein, 10 aa, Mycobacterium
APTLRKTGGH

SEQ ID NO: 896040 - protein, 5 aa, Mycobacterium
APTMG

SEQ ID NO: 896041 - protein, 9 aa, Mycobacterium
APTPKDAAS

SEQ ID NO: 896042 - protein, 10 aa, Mycobacterium
APTPNWRPGH

SEQ ID NO: 896043 - protein, 14 aa, Mycobacterium
APTPPRGNQLESPD

SEQ ID NO: 896044 - protein, 5 aa, Mycobacterium
APTPV

SEQ ID NO: 896045 - protein, 12 aa, Mycobacterium
APTQQAPLQQAP

SEQ ID NO: 896046 - protein, 17 aa, Mycobacterium
APTRRSAARRRGGDPVT

SEQ ID NO: 896047 - protein, 11 aa, Mycobacterium
APTTEGARGSD

SEQ ID NO: 896048 - protein, 13 aa, Mycobacterium
APTTGAVTGEPDV

SEQ ID NO: 896049 - protein, 9 aa, Mycobacterium
APTTQADKR

SEQ ID NO: 896050 - protein, 6 aa, Mycobacterium
APTVDP

SEQ ID NO: 896051 - protein, 7 aa, Mycobacterium
APTVDSD

SEQ ID NO: 896052 - protein, 11 aa, Mycobacterium
APTVGGTTAVS

SEQ ID NO: 896053 - protein, 10 aa, Mycobacterium
APTVPQSDGD

SEQ ID NO: 896054 - protein, 12 aa, Mycobacterium
APVAANAAPAVE

SEQ ID NO: 896055 - protein, 33 aa, Mycobacterium
APVADPAAPAAAPVTPAANPAGAPGLGPNAPVT

SEQ ID NO: 896056 - protein, 5 aa, Mycobacterium
APVDG

SEQ ID NO: 896057 - protein, 13 aa, Mycobacterium
APVDSNDEPTPCR

SEQ ID NO: 896058 - protein, 4 aa, Mycobacterium
APVN

SEQ ID NO: 896059 - protein, 63 aa, Mycobacterium
APVNPGDPGDDGPDSDISGPEDTDTDNVAPPAPASGTGAECENAGTACGGDESGTVLTSDNDE

SEQ ID NO: 896060 - protein, 4 aa, Mycobacterium
APVP

SEQ ID NO: 896061 - protein, 6 aa, Mycobacterium
APVPAP

SEQ ID NO: 896062 - protein, 7 aa, Mycobacterium
APVPGLA

SEQ ID NO: 896063 - protein, 7 aa, Mycobacterium
APVPIPA

SEQ ID NO: 896064 - protein, 9 aa, Mycobacterium
APVPPPEQT

SEQ ID NO: 896065 - protein, 18 aa, Mycobacterium
APVPTGPGGAPGCPTGGA

SEQ ID NO: 896066 - protein, 22 aa, Mycobacterium
APVQPQNGASTESAPETSTEYV

SEQ ID NO: 896067 - protein, 13 aa, Mycobacterium
APVSGGIKGATAG

SEQ ID NO: 896068 - protein, 11 aa, Mycobacterium
APVSGGVKGAV

SEQ ID NO: 896069 - protein, 12 aa, Mycobacterium
APVSGGVKGAVA

SEQ ID NO: 896070 - protein, 6 aa, Mycobacterium
APVTAN

SEQ ID NO: 896071 - protein, 29 aa, Mycobacterium
APVTPSNAPTLSGTPTTTTPATTGPATPG

SEQ ID NO: 896072 - protein, 15 aa, Mycobacterium
APVTQPPPTGEPEPV

SEQ ID NO: 896073 - protein, 9 aa, Mycobacterium
APVTSSPHV

SEQ ID NO: 896074 - protein, 4 aa, Mycobacterium
APVV

SEQ ID NO: 896075 - protein, 6 aa, Mycobacterium
APVYEG

SEQ ID NO: 896076 - protein, 6 aa, Mycobacterium
APWEKT

SEQ ID NO: 896077 - protein, 4 aa, Mycobacterium
APWR

SEQ ID NO: 896078 - protein, 13 aa, Mycobacterium
APYDEETVAAGGG

SEQ ID NO: 896079 - protein, 7 aa, Mycobacterium
APYGPFE

SEQ ID NO: 896080 - protein, 6 aa, Mycobacterium
APYKSN

SEQ ID NO: 896081 - protein, 13 aa, Mycobacterium
APYTGKAVDDSPY

SEQ ID NO: 896082 - protein, 6 aa, Mycobacterium
AQAAAD

SEQ ID NO: 896083 - protein, 12 aa, Mycobacterium
AQAAALTSGDVS

SEQ ID NO: 896084 - protein, 10 aa, Mycobacterium
AQAAASAAAY

SEQ ID NO: 896085 - protein, 7 aa, Mycobacterium
AQAAEEA

SEQ ID NO: 896086 - protein, 8 aa, Mycobacterium
AQAAGTTP

SEQ ID NO: 896087 - protein, 8 aa, Mycobacterium
AQAAPRSV

SEQ ID NO: 896088 - protein, 8 aa, Mycobacterium
AQAAPRTV

SEQ ID NO: 896089 - protein, 35 aa, Mycobacterium
AQAAPTGPTCTDQGNSTLCQSNGNAQVTANPPAVD

SEQ ID NO: 896090 - protein, 15 aa, Mycobacterium
AQAATARNAPSGRAA

SEQ ID NO: 896091 - protein, 4 aa, Mycobacterium
AQAD

SEQ ID NO: 896092 - protein, 16 aa, Mycobacterium
AQADAQISVSDHGSYQ

SEQ ID NO: 896093 - protein, 11 aa, Mycobacterium
AQADGALTPDH

SEQ ID NO: 896094 - protein, 9 aa, Mycobacterium
AQAEPPSDV

SEQ ID NO: 896095 - protein, 6 aa, Mycobacterium
AQAGAD

SEQ ID NO: 896096 - protein, 7 aa, Mycobacterium
AQAGGDY

SEQ ID NO: 896097 - protein, 12 aa, Mycobacterium
AQAGPMTGKGDL

SEQ ID NO: 896098 - protein, 5 aa, Mycobacterium
AQAKA

SEQ ID NO: 896099 - protein, 6 aa, Mycobacterium
AQAKHR

SEQ ID NO: 896100 - protein, 6 aa, Mycobacterium
AQALTG

SEQ ID NO: 896101 - protein, 15 aa, Mycobacterium
AQANENDSDPAPADL

SEQ ID NO: 896102 - protein, 7 aa, Mycobacterium
AQANRAR

SEQ ID NO: 896103 - protein, 19 aa, Mycobacterium
AQAPAAHAKNGDTHITGEG

SEQ ID NO: 896104 - protein, 8 aa, Mycobacterium
AQAPGLSA

SEQ ID NO: 896105 - protein, 5 aa, Mycobacterium
AQAPK

SEQ ID NO: 896106 - protein, 10 aa, Mycobacterium
AQAPQGPWGP

SEQ ID NO: 896107 - protein, 5 aa, Mycobacterium
AQAPR

SEQ ID NO: 896108 - protein, 5 aa, Mycobacterium
AQAPT

SEQ ID NO: 896109 - protein, 11 aa, Mycobacterium
AQAQADKDGAQ

SEQ ID NO: 896110 - protein, 5 aa, Mycobacterium
AQAQH

SEQ ID NO: 896111 - protein, 11 aa, Mycobacterium
AQAQPAPPNCT

SEQ ID NO: 896112 - protein, 16 aa, Mycobacterium
AQAQSPAGGASSSVND

SEQ ID NO: 896113 - protein, 7 aa, Mycobacterium
AQAQTLQ

SEQ ID NO: 896114 - protein, 8 aa, Mycobacterium
AQARPNEI

SEQ ID NO: 896115 - protein, 17 aa, Mycobacterium
AQASEKSSADARAAAEH

SEQ ID NO: 896116 - protein, 10 aa, Mycobacterium
AQATTTELGG

SEQ ID NO: 896117 - protein, 8 aa, Mycobacterium
AQAVGGLG

SEQ ID NO: 896118 - protein, 16 aa, Mycobacterium
AQAYGSTEATNASPLE

SEQ ID NO: 896119 - protein, 7 aa, Mycobacterium
AQDAYRQ

SEQ ID NO: 896120 - protein, 9 aa, Mycobacterium
AQDELEKQP

SEQ ID NO: 896121 - protein, 8 aa, Mycobacterium
AQDGITRD

SEQ ID NO: 896122 - protein, 30 aa, Mycobacterium
AQDPASPAGNDARDTVSARDKRDADTPEAL

SEQ ID NO: 896123 - protein, 7 aa, Mycobacterium
AQDPQAF

SEQ ID NO: 896124 - protein, 9 aa, Mycobacterium
AQDPQPYEN

SEQ ID NO: 896125 - protein, 7 aa, Mycobacterium
AQDPRSD

SEQ ID NO: 896126 - protein, 23 aa, Mycobacterium
AQDQRGRNGIPVREDRTRHQLTG

SEQ ID NO: 896127 - protein, 5 aa, Mycobacterium
AQEDF

SEQ ID NO: 896128 - protein, 6 aa, Mycobacterium
AQEDYN

SEQ ID NO: 896129 - protein, 7 aa, Mycobacterium
AQEEAAN

SEQ ID NO: 896130 - protein, 7 aa, Mycobacterium
AQENGSH

SEQ ID NO: 896131 - protein, 11 aa, Mycobacterium
AQEPQPAGPNR

SEQ ID NO: 896132 - protein, 6 aa, Mycobacterium
AQEQGL

SEQ ID NO: 896133 - protein, 10 aa, Mycobacterium
AQERAQREAR

SEQ ID NO: 896134 - protein, 4 aa, Mycobacterium
AQEV

SEQ ID NO: 896135 - protein, 6 aa, Mycobacterium
AQEVNN

SEQ ID NO: 896136 - protein, 6 aa, Mycobacterium
AQFATS

SEQ ID NO: 896137 - protein, 7 aa, Mycobacterium
AQFSATS

SEQ ID NO: 896138 - protein, 4 aa, Mycobacterium
AQGA

SEQ ID NO: 896139 - protein, 10 aa, Mycobacterium
AQGAPSDRSF

SEQ ID NO: 896140 - protein, 8 aa, Mycobacterium
AQGDGSQI

SEQ ID NO: 896141 - protein, 10 aa, Mycobacterium
AQGDNGRPLG

SEQ ID NO: 896142 - protein, 8 aa, Mycobacterium
AQGDRSVT

SEQ ID NO: 896143 - protein, 8 aa, Mycobacterium
AQGDSDDI

SEQ ID NO: 896144 - protein, 7 aa, Mycobacterium
AQGDSNR

SEQ ID NO: 896145 - protein, 7 aa, Mycobacterium
AQGDSST

SEQ ID NO: 896146 - protein, 9 aa, Mycobacterium
AQGDVQDPQ

SEQ ID NO: 896147 - protein, 8 aa, Mycobacterium
AQGEAKAI

SEQ ID NO: 896148 - protein, 6 aa, Mycobacterium
AQGERD

SEQ ID NO: 896149 - protein, 76 aa, Mycobacterium
AQGFESGFGQGYSDGYDAGLNAGQDSGADQGGWDQGSGADQGGGWDQGGGWDSGGSGWDGGGWDGGGGDFGGDFGD

SEQ ID NO: 896150 - protein, 6 aa, Mycobacterium
AQGGER

SEQ ID NO: 896151 - protein, 6 aa, Mycobacterium
AQGGRT

SEQ ID NO: 896152 - protein, 5 aa, Mycobacterium
AQGHL

SEQ ID NO: 896153 - protein, 8 aa, Mycobacterium
AQGHTATG

SEQ ID NO: 896154 - protein, 8 aa, Mycobacterium
AQGHTNTS

SEQ ID NO: 896155 - protein, 6 aa, Mycobacterium
AQGIQD

SEQ ID NO: 896156 - protein, 14 aa, Mycobacterium
AQGKGAWGRPPTPL

SEQ ID NO: 896157 - protein, 4 aa, Mycobacterium
AQGL

SEQ ID NO: 896158 - protein, 54 aa, Mycobacterium
AQGLAEPDDTGTLPPEPAITTGETITETTAPTSPETSVATPSVSATTPSGFAEP

SEQ ID NO: 896159 - protein, 4 aa, Mycobacterium
AQGM

SEQ ID NO: 896160 - protein, 8 aa, Mycobacterium
AQGNGDTL

SEQ ID NO: 896161 - protein, 8 aa, Mycobacterium
AQGNSDSI

SEQ ID NO: 896162 - protein, 8 aa, Mycobacterium
AQGNSDTL

SEQ ID NO: 896163 - protein, 7 aa, Mycobacterium
AQGPGPI

SEQ ID NO: 896164 - protein, 8 aa, Mycobacterium
AQGQAKAI

SEQ ID NO: 896165 - protein, 10 aa, Mycobacterium
AQGRYTNSTD

SEQ ID NO: 896166 - protein, 4 aa, Mycobacterium
AQGT

SEQ ID NO: 896167 - protein, 6 aa, Mycobacterium
AQGTTF

SEQ ID NO: 896168 - protein, 15 aa, Mycobacterium
AQGTTTDPQATAVTP

SEQ ID NO: 896169 - protein, 6 aa, Mycobacterium
AQGVDA

SEQ ID NO: 896170 - protein, 18 aa, Mycobacterium
AQGVNPGTLSQGEKTTGK

SEQ ID NO: 896171 - protein, 6 aa, Mycobacterium
AQHARD

SEQ ID NO: 896172 - protein, 23 aa, Mycobacterium
AQHGPPDGGAQYFGGGNVATSTI

SEQ ID NO: 896173 - protein, 8 aa, Mycobacterium
AQIDARNN

SEQ ID NO: 896174 - protein, 6 aa, Mycobacterium
AQIIPE

SEQ ID NO: 896175 - protein, 10 aa, Mycobacterium
AQKAAGLETE

SEQ ID NO: 896176 - protein, 4 aa, Mycobacterium
AQKP

SEQ ID NO: 896177 - protein, 7 aa, Mycobacterium
AQKPQQP

SEQ ID NO: 896178 - protein, 6 aa, Mycobacterium
AQKYPG

SEQ ID NO: 896179 - protein, 7 aa, Mycobacterium
AQLEGGA

SEQ ID NO: 896180 - protein, 6 aa, Mycobacterium
AQLPGK

SEQ ID NO: 896181 - protein, 18 aa, Mycobacterium
AQLQPTPAPPLPREATPS

SEQ ID NO: 896182 - protein, 14 aa, Mycobacterium
AQLTSQIAERDQAI

SEQ ID NO: 896183 - protein, 8 aa, Mycobacterium
AQMPSSSV

SEQ ID NO: 896184 - protein, 8 aa, Mycobacterium
AQNIDRGR

SEQ ID NO: 896185 - protein, 11 aa, Mycobacterium
AQNPAADPQGA

SEQ ID NO: 896186 - protein, 10 aa, Mycobacterium
AQNPDIETTS

SEQ ID NO: 896187 - protein, 10 aa, Mycobacterium
AQNPGLTADH

SEQ ID NO: 896188 - protein, 6 aa, Mycobacterium
AQNSVR

SEQ ID NO: 896189 - protein, 31 aa, Mycobacterium
AQPAPAPPPPPAPGAAAGAPTPLGTPGRGYA

SEQ ID NO: 896190 - protein, 10 aa, Mycobacterium
AQPDEPLEGG

SEQ ID NO: 896191 - protein, 9 aa, Mycobacterium
AQPGETHAH

SEQ ID NO: 896192 - protein, 9 aa, Mycobacterium
AQPGNPKPR

SEQ ID NO: 896193 - protein, 8 aa, Mycobacterium
AQPGTDRS

SEQ ID NO: 896194 - protein, 12 aa, Mycobacterium
AQPGVEKGRRAG

SEQ ID NO: 896195 - protein, 4 aa, Mycobacterium
AQPL

SEQ ID NO: 896196 - protein, 7 aa, Mycobacterium
AQPLAAD

SEQ ID NO: 896197 - protein, 14 aa, Mycobacterium
AQPNGHAPATQQET

SEQ ID NO: 896198 - protein, 5 aa, Mycobacterium
AQPPA

SEQ ID NO: 896199 - protein, 6 aa, Mycobacterium
AQPPET

SEQ ID NO: 896200 - protein, 11 aa, Mycobacterium
AQPPTSAYPGD

SEQ ID NO: 896201 - protein, 8 aa, Mycobacterium
AQPPYPNA

SEQ ID NO: 896202 - protein, 10 aa, Mycobacterium
AQPQKASNVP

SEQ ID NO: 896203 - protein, 11 aa, Mycobacterium
AQPQKRPRSSW

SEQ ID NO: 896204 - protein, 5 aa, Mycobacterium
AQPQQ

SEQ ID NO: 896205 - protein, 6 aa, Mycobacterium
AQPQQV

SEQ ID NO: 896206 - protein, 10 aa, Mycobacterium
AQPQQVKDAP

SEQ ID NO: 896207 - protein, 7 aa, Mycobacterium
AQPRRVD

SEQ ID NO: 896208 - protein, 6 aa, Mycobacterium
AQPRSA

SEQ ID NO: 896209 - protein, 12 aa, Mycobacterium
AQPSAPFPGRGL

SEQ ID NO: 896210 - protein, 20 aa, Mycobacterium
AQPSPLGPPNRPPAAPPTGK

SEQ ID NO: 896211 - protein, 11 aa, Mycobacterium
AQPTAPQPELT

SEQ ID NO: 896212 - protein, 9 aa, Mycobacterium
AQPVDAPDG

SEQ ID NO: 896213 - protein, 5 aa, Mycobacterium
AQPVR

SEQ ID NO: 896214 - protein, 6 aa, Mycobacterium
AQQAGL

SEQ ID NO: 896215 - protein, 10 aa, Mycobacterium
AQQGDGRQVR

SEQ ID NO: 896216 - protein, 7 aa, Mycobacterium
AQQHYAT

SEQ ID NO: 896217 - protein, 4 aa, Mycobacterium
AQQL

SEQ ID NO: 896218 - protein, 5 aa, Mycobacterium
AQQNP

SEQ ID NO: 896219 - protein, 8 aa, Mycobacterium
AQQPCASG

SEQ ID NO: 896220 - protein, 6 aa, Mycobacterium
AQQPDL

SEQ ID NO: 896221 - protein, 19 aa, Mycobacterium
AQQQRAPSEVDYPPKPPGD

SEQ ID NO: 896222 - protein, 19 aa, Mycobacterium
AQQQRAPTFEDAPDRPRGD

SEQ ID NO: 896223 - protein, 5 aa, Mycobacterium
AQQSV

SEQ ID NO: 896224 - protein, 13 aa, Mycobacterium
AQQSVDRLSAEQG

SEQ ID NO: 896225 - protein, 6 aa, Mycobacterium
AQRDGR

SEQ ID NO: 896226 - protein, 6 aa, Mycobacterium
AQRDGT

SEQ ID NO: 896227 - protein, 29 aa, Mycobacterium
AQREQAPRTSTSTSTTTSQAAPGPQASVE

SEQ ID NO: 896228 - protein, 8 aa, Mycobacterium
AQRGAQAA

SEQ ID NO: 896229 - protein, 16 aa, Mycobacterium
AQRGRGERKRPSSGWE

SEQ ID NO: 896230 - protein, 15 aa, Mycobacterium
AQRGRGERRRAATGW

SEQ ID NO: 896231 - protein, 9 aa, Mycobacterium
AQRLRDGLR

SEQ ID NO: 896232 - protein, 6 aa, Mycobacterium
AQRNSA

SEQ ID NO: 896233 - protein, 17 aa, Mycobacterium
AQRSADDPDGDGPANLR

SEQ ID NO: 896234 - protein, 7 aa, Mycobacterium
AQRSTLT

SEQ ID NO: 896235 - protein, 12 aa, Mycobacterium
AQRSVSANQSAS

SEQ ID NO: 896236 - protein, 17 aa, Mycobacterium
AQSAAGSRFATEGLPDV

SEQ ID NO: 896237 - protein, 14 aa, Mycobacterium
AQSAGELAEAAEKA

SEQ ID NO: 896238 - protein, 7 aa, Mycobacterium
AQSAGTE

SEQ ID NO: 896239 - protein, 9 aa, Mycobacterium
AQSATRTGP

SEQ ID NO: 896240 - protein, 75 aa, Mycobacterium
AQSAVAEQSGVSTGPGVSADTGGAVPAPPAGPSGAVEPPAGAAGTARAARASRTRATDATGTAVADQSRATTPTT

SEQ ID NO: 896241 - protein, 12 aa, Mycobacterium
AQSDKPLGIPGD

SEQ ID NO: 896242 - protein, 7 aa, Mycobacterium
AQSDRAL

SEQ ID NO: 896243 - protein, 8 aa, Mycobacterium
AQSDRALN

SEQ ID NO: 896244 - protein, 17 aa, Mycobacterium
AQSDRPLGIPGEQLPGS

SEQ ID NO: 896245 - protein, 9 aa, Mycobacterium
AQSDSSEIG

SEQ ID NO: 896246 - protein, 9 aa, Mycobacterium
AQSEAPSDV

SEQ ID NO: 896247 - protein, 11 aa, Mycobacterium
AQSEGNASGLI

SEQ ID NO: 896248 - protein, 7 aa, Mycobacterium
AQSEHPG

SEQ ID NO: 896249 - protein, 6 aa, Mycobacterium
AQSELD

SEQ ID NO: 896250 - protein, 27 aa, Mycobacterium
AQSEPFTTEPELRPGPTTTPPPPPPLP

SEQ ID NO: 896251 - protein, 8 aa, Mycobacterium
AQSGLPAE

SEQ ID NO: 896252 - protein, 11 aa, Mycobacterium
AQSGLQPANYI

SEQ ID NO: 896253 - protein, 7 aa, Mycobacterium
AQSGRPD

SEQ ID NO: 896254 - protein, 15 aa, Mycobacterium
AQSGRTVAADAATSL

SEQ ID NO: 896255 - protein, 8 aa, Mycobacterium
AQSITTGE

SEQ ID NO: 896256 - protein, 11 aa, Mycobacterium
AQSPDPSGPIQ

SEQ ID NO: 896257 - protein, 6 aa, Mycobacterium
AQSPGV

SEQ ID NO: 896258 - protein, 6 aa, Mycobacterium
AQSPVY

SEQ ID NO: 896259 - protein, 7 aa, Mycobacterium
AQSPYRT

SEQ ID NO: 896260 - protein, 8 aa, Mycobacterium
AQSQADAE

SEQ ID NO: 896261 - protein, 10 aa, Mycobacterium
AQSQANADGV

SEQ ID NO: 896262 - protein, 6 aa, Mycobacterium
AQSSTF

SEQ ID NO: 896263 - protein, 17 aa, Mycobacterium
AQSTPEAKDTTQPGGVY

SEQ ID NO: 896264 - protein, 11 aa, Mycobacterium
AQSTPNGIDGY

SEQ ID NO: 896265 - protein, 11 aa, Mycobacterium
AQSTPNGLDGY

SEQ ID NO: 896266 - protein, 12 aa, Mycobacterium
AQSTPNGVDGYP

SEQ ID NO: 896267 - protein, 5 aa, Mycobacterium
AQSVQ

SEQ ID NO: 896268 - protein, 4 aa, Mycobacterium
AQTA

SEQ ID NO: 896269 - protein, 6 aa, Mycobacterium
AQTAGV

SEQ ID NO: 896270 - protein, 16 aa, Mycobacterium
AQTASPEAASPRMVDR

SEQ ID NO: 896271 - protein, 13 aa, Mycobacterium
AQTATADPNNDAV

SEQ ID NO: 896272 - protein, 6 aa, Mycobacterium
AQTEGG

SEQ ID NO: 896273 - protein, 7 aa, Mycobacterium
AQTGATL

SEQ ID NO: 896274 - protein, 10 aa, Mycobacterium
AQTGAYAPPA

SEQ ID NO: 896275 - protein, 16 aa, Mycobacterium
AQTGESVPHYPAPDGV

SEQ ID NO: 896276 - protein, 9 aa, Mycobacterium
AQTHGPLDS

SEQ ID NO: 896277 - protein, 4 aa, Mycobacterium
AQTI

SEQ ID NO: 896278 - protein, 9 aa, Mycobacterium
AQTKKTWPR

SEQ ID NO: 896279 - protein, 9 aa, Mycobacterium
AQTKTGSAH

SEQ ID NO: 896280 - protein, 9 aa, Mycobacterium
AQTKTGSPH

SEQ ID NO: 896281 - protein, 4 aa, Mycobacterium
AQTL

SEQ ID NO: 896282 - protein, 6 aa, Mycobacterium
AQTPLS

SEQ ID NO: 896283 - protein, 6 aa, Mycobacterium
AQTPSR

SEQ ID NO: 896284 - protein, 10 aa, Mycobacterium
AQTQTVPESV

SEQ ID NO: 896285 - protein, 6 aa, Mycobacterium
AQTSDG

SEQ ID NO: 896286 - protein, 11 aa, Mycobacterium
AQTSTYSAPAN

SEQ ID NO: 896287 - protein, 6 aa, Mycobacterium
AQVPGI

SEQ ID NO: 896288 - protein, 19 aa, Mycobacterium
AQWGPDGDATYRAADTEYT

SEQ ID NO: 896289 - protein, 17 aa, Mycobacterium
AQYSLNPDGSVRVENSG

SEQ ID NO: 896290 - protein, 6 aa, Mycobacterium
ARAAAD

SEQ ID NO: 896291 - protein, 8 aa, Mycobacterium
ARAAEQAG

SEQ ID NO: 896292 - protein, 11 aa, Mycobacterium
ARAAESGDPVA

SEQ ID NO: 896293 - protein, 9 aa, Mycobacterium
ARAAGAAPL

SEQ ID NO: 896294 - protein, 9 aa, Mycobacterium
ARAAGPGAV

SEQ ID NO: 896295 - protein, 7 aa, Mycobacterium
ARAAGVR

SEQ ID NO: 896296 - protein, 6 aa, Mycobacterium
ARAAKL

SEQ ID NO: 896297 - protein, 9 aa, Mycobacterium
ARAANGDTY

SEQ ID NO: 896298 - protein, 8 aa, Mycobacterium
ARAANGEN

SEQ ID NO: 896299 - protein, 12 aa, Mycobacterium
ARAANGQNYPEL

SEQ ID NO: 896300 - protein, 9 aa, Mycobacterium
ARAARAARA

SEQ ID NO: 896301 - protein, 5 aa, Mycobacterium
ARAAT

SEQ ID NO: 896302 - protein, 10 aa, Mycobacterium
ARAATAADPM

SEQ ID NO: 896303 - protein, 13 aa, Mycobacterium
ARAAVTAAQANAA

SEQ ID NO: 896304 - protein, 10 aa, Mycobacterium
ARADAGVTPG

SEQ ID NO: 896305 - protein, 9 aa, Mycobacterium
ARADDANRL

SEQ ID NO: 896306 - protein, 7 aa, Mycobacterium
ARADDRH

SEQ ID NO: 896307 - protein, 9 aa, Mycobacterium
ARADEDNIN

SEQ ID NO: 896308 - protein, 6 aa, Mycobacterium
ARADEI

SEQ ID NO: 896309 - protein, 8 aa, Mycobacterium
ARADGQLP

SEQ ID NO: 896310 - protein, 8 aa, Mycobacterium
ARADGVPV

SEQ ID NO: 896311 - protein, 9 aa, Mycobacterium
ARADPGPFV

SEQ ID NO: 896312 - protein, 10 aa, Mycobacterium
ARADRPEPVP

SEQ ID NO: 896313 - protein, 11 aa, Mycobacterium
ARADSADEQQA

SEQ ID NO: 896314 - protein, 24 aa, Mycobacterium
ARADSALASEAAGALGPQDATARA

SEQ ID NO: 896315 - protein, 10 aa, Mycobacterium
ARADTASGAG

SEQ ID NO: 896316 - protein, 10 aa, Mycobacterium
ARADVGQQVS

SEQ ID NO: 896317 - protein, 10 aa, Mycobacterium
ARAEESPGCT

SEQ ID NO: 896318 - protein, 7 aa, Mycobacterium
ARAESEE

SEQ ID NO: 896319 - protein, 15 aa, Mycobacterium
ARAFEDAKSRAQQYA

SEQ ID NO: 896320 - protein, 14 aa, Mycobacterium
ARAFNDAKNRAEQY

SEQ ID NO: 896321 - protein, 7 aa, Mycobacterium
ARAGAHS

SEQ ID NO: 896322 - protein, 10 aa, Mycobacterium
ARAGASGDLK

SEQ ID NO: 896323 - protein, 9 aa, Mycobacterium
ARAGGTGAE

SEQ ID NO: 896324 - protein, 12 aa, Mycobacterium
ARAGKGPAGASV

SEQ ID NO: 896325 - protein, 6 aa, Mycobacterium
ARAGKP

SEQ ID NO: 896326 - protein, 12 aa, Mycobacterium
ARAGLAAAETSL

SEQ ID NO: 896327 - protein, 5 aa, Mycobacterium
ARAGP

SEQ ID NO: 896328 - protein, 23 aa, Mycobacterium
ARAGRAASPAGKRPAPPAGPDDA

SEQ ID NO: 896329 - protein, 10 aa, Mycobacterium
ARAGSSTTAT

SEQ ID NO: 896330 - protein, 6 aa, Mycobacterium
ARAGVG

SEQ ID NO: 896331 - protein, 10 aa, Mycobacterium
ARAHADDPPW

SEQ ID NO: 896332 - protein, 10 aa, Mycobacterium
ARAKSETASA

SEQ ID NO: 896333 - protein, 7 aa, Mycobacterium
ARALGES

SEQ ID NO: 896334 - protein, 16 aa, Mycobacterium
ARANLAAEGAASFDEV

SEQ ID NO: 896335 - protein, 5 aa, Mycobacterium
ARAPL

SEQ ID NO: 896336 - protein, 6 aa, Mycobacterium
ARAPLG

SEQ ID NO: 896337 - protein, 8 aa, Mycobacterium
ARAPRPGH

SEQ ID NO: 896338 - protein, 6 aa, Mycobacterium
ARAPRV

SEQ ID NO: 896339 - protein, 5 aa, Mycobacterium
ARAQG

SEQ ID NO: 896340 - protein, 11 aa, Mycobacterium
ARAQQTAAPLA

SEQ ID NO: 896341 - protein, 8 aa, Mycobacterium
ARARSGQT

SEQ ID NO: 896342 - protein, 8 aa, Mycobacterium
ARASADES

SEQ ID NO: 896343 - protein, 9 aa, Mycobacterium
ARASNSFDR

SEQ ID NO: 896344 - protein, 10 aa, Mycobacterium
ARASNSLDRY

SEQ ID NO: 896345 - protein, 13 aa, Mycobacterium
ARATAAPNPTGWE

SEQ ID NO: 896346 - protein, 13 aa, Mycobacterium
ARATLTDDSPTAL

SEQ ID NO: 896347 - protein, 15 aa, Mycobacterium
ARATRSTPAAEPLPS

SEQ ID NO: 896348 - protein, 16 aa, Mycobacterium
ARCRDTQTARAIGRTA

SEQ ID NO: 896349 - protein, 29 aa, Mycobacterium
ARDAAAAAQRELEAGQRGVADANAAIEAA

SEQ ID NO: 896350 - protein, 17 aa, Mycobacterium
ARDALDSGDFEAARTAY

SEQ ID NO: 896351 - protein, 9 aa, Mycobacterium
ARDDRSGWD

SEQ ID NO: 896352 - protein, 8 aa, Mycobacterium
ARDESQVP

SEQ ID NO: 896353 - protein, 9 aa, Mycobacterium
ARDGKRSTI

SEQ ID NO: 896354 - protein, 16 aa, Mycobacterium
ARDGSCDGGGHEGHHQ

SEQ ID NO: 896355 - protein, 9 aa, Mycobacterium
ARDGSGVNS

SEQ ID NO: 896356 - protein, 5 aa, Mycobacterium
ARDHR

SEQ ID NO: 896357 - protein, 9 aa, Mycobacterium
ARDKDNLGR

SEQ ID NO: 896358 - protein, 9 aa, Mycobacterium
ARDNSEARA

SEQ ID NO: 896359 - protein, 4 aa, Mycobacterium
ARDP

SEQ ID NO: 896360 - protein, 10 aa, Mycobacterium
ARDPDDDAVW

SEQ ID NO: 896361 - protein, 7 aa, Mycobacterium
ARDPDSG

SEQ ID NO: 896362 - protein, 10 aa, Mycobacterium
ARDPGPGRPV

SEQ ID NO: 896363 - protein, 20 aa, Mycobacterium
ARDPVSITTTSQPRPGSSAS

SEQ ID NO: 896364 - protein, 4 aa, Mycobacterium
ARDR

SEQ ID NO: 896365 - protein, 84 aa, Mycobacterium
ARDRAGPAGAASTTHTGGAAITAGTTGTAATTGKRARGPHTTITGQPTGPTGTAGPAGTLAAEEADQPARTPGPAGPPGPAGTA

SEQ ID NO: 896366 - protein, 85 aa, Mycobacterium
ARDRAGPARPASTTHTGGAAITAGTTGTTTTTGKRARGPHTTITGQPTSPTGTAGPTSTLAAEQTDQPARTPGAAGPPGPAGTTI

SEQ ID NO: 896367 - protein, 9 aa, Mycobacterium
ARDRGGNDI

SEQ ID NO: 896368 - protein, 9 aa, Mycobacterium
ARDRPTDFT

SEQ ID NO: 896369 - protein, 9 aa, Mycobacterium
ARDRSGGGA

SEQ ID NO: 896370 - protein, 8 aa, Mycobacterium
ARDTGADV

SEQ ID NO: 896371 - protein, 8 aa, Mycobacterium
ARDTGGLD

SEQ ID NO: 896372 - protein, 5 aa, Mycobacterium
AREAA

SEQ ID NO: 896373 - protein, 5 aa, Mycobacterium
AREAG

SEQ ID NO: 896374 - protein, 13 aa, Mycobacterium
AREARLRNGPRAA

SEQ ID NO: 896375 - protein, 8 aa, Mycobacterium
AREDQNGW

SEQ ID NO: 896376 - protein, 20 aa, Mycobacterium
AREHRDADTPAALAGPRRRA

SEQ ID NO: 896377 - protein, 4 aa, Mycobacterium
AREL

SEQ ID NO: 896378 - protein, 12 aa, Mycobacterium
ARELAEETGLQV

SEQ ID NO: 896379 - protein, 6 aa, Mycobacterium
ARERAG

SEQ ID NO: 896380 - protein, 20 aa, Mycobacterium
ARERAGSEAAPLTVAGSGED

SEQ ID NO: 896381 - protein, 11 aa, Mycobacterium
ARERETFGRPL

SEQ ID NO: 896382 - protein, 30 aa, Mycobacterium
ARERGAEIAETAQRRGSQFAETASRRGSEL

SEQ ID NO: 896383 - protein, 9 aa, Mycobacterium
ARERPKDSI

SEQ ID NO: 896384 - protein, 21 aa, Mycobacterium
ARERVGEEAPTPAVGNGHDHE

SEQ ID NO: 896385 - protein, 7 aa, Mycobacterium
ARESASG

SEQ ID NO: 896386 - protein, 10 aa, Mycobacterium
ARETIKDPTY

SEQ ID NO: 896387 - protein, 7 aa, Mycobacterium
ARETMKD

SEQ ID NO: 896388 - protein, 4 aa, Mycobacterium
AREV

SEQ ID NO: 896389 - protein, 6 aa, Mycobacterium
ARFAPA

SEQ ID NO: 896390 - protein, 4 aa, Mycobacterium
ARFE

SEQ ID NO: 896391 - protein, 4 aa, Mycobacterium
ARGA

SEQ ID NO: 896392 - protein, 5 aa, Mycobacterium
ARGAR

SEQ ID NO: 896393 - protein, 11 aa, Mycobacterium
ARGASTSKEVA

SEQ ID NO: 896394 - protein, 4 aa, Mycobacterium
ARGD

SEQ ID NO: 896395 - protein, 21 aa, Mycobacterium
ARGDAAAARKAAETALQQTNP

SEQ ID NO: 896396 - protein, 7 aa, Mycobacterium
ARGDGKT

SEQ ID NO: 896397 - protein, 9 aa, Mycobacterium
ARGDGPLAG

SEQ ID NO: 896398 - protein, 10 aa, Mycobacterium
ARGDSTAPVI

SEQ ID NO: 896399 - protein, 12 aa, Mycobacterium
ARGDTAADPMTN

SEQ ID NO: 896400 - protein, 10 aa, Mycobacterium
ARGDVDRSRE

SEQ ID NO: 896401 - protein, 8 aa, Mycobacterium
ARGEQAAR

SEQ ID NO: 896402 - protein, 9 aa, Mycobacterium
ARGFPRAAQ

SEQ ID NO: 896403 - protein, 4 aa, Mycobacterium
ARGG

SEQ ID NO: 896404 - protein, 7 aa, Mycobacterium
ARGGGHS

SEQ ID NO: 896405 - protein, 16 aa, Mycobacterium
ARGGGHSYTGASTADG

SEQ ID NO: 896406 - protein, 6 aa, Mycobacterium
ARGGIK

SEQ ID NO: 896407 - protein, 13 aa, Mycobacterium
ARGGQVGQGPVPL

SEQ ID NO: 896408 - protein, 6 aa, Mycobacterium
ARGGVP

SEQ ID NO: 896409 - protein, 6 aa, Mycobacterium
ARGGVR

SEQ ID NO: 896410 - protein, 14 aa, Mycobacterium
ARGLATRLRRWYRC

SEQ ID NO: 896411 - protein, 10 aa, Mycobacterium
ARGNDTGLGP

SEQ ID NO: 896412 - protein, 6 aa, Mycobacterium
ARGPHA

SEQ ID NO: 896413 - protein, 8 aa, Mycobacterium
ARGPQQIS

SEQ ID NO: 896414 - protein, 8 aa, Mycobacterium
ARGPRQIS

SEQ ID NO: 896415 - protein, 5 aa, Mycobacterium
ARGPS

SEQ ID NO: 896416 - protein, 5 aa, Mycobacterium
ARGSR

SEQ ID NO: 896417 - protein, 5 aa, Mycobacterium
ARGST

SEQ ID NO: 896418 - protein, 9 aa, Mycobacterium
ARGSVPAPA

SEQ ID NO: 896419 - protein, 12 aa, Mycobacterium
ARGTNDSPGLGD

SEQ ID NO: 896420 - protein, 8 aa, Mycobacterium
ARGTTQGQ

SEQ ID NO: 896421 - protein, 7 aa, Mycobacterium
ARGTTSL

SEQ ID NO: 896422 - protein, 19 aa, Mycobacterium
ARGVENRTVRDDRGNRHES

SEQ ID NO: 896423 - protein, 6 aa, Mycobacterium
ARHGSG

SEQ ID NO: 896424 - protein, 4 aa, Mycobacterium
ARHP

SEQ ID NO: 896425 - protein, 10 aa, Mycobacterium
ARHQQDYADL

SEQ ID NO: 896426 - protein, 13 aa, Mycobacterium
ARHSGAEPAITGS

SEQ ID NO: 896427 - protein, 7 aa, Mycobacterium
ARHSSGL

SEQ ID NO: 896428 - protein, 6 aa, Mycobacterium
ARIDPT

SEQ ID NO: 896429 - protein, 14 aa, Mycobacterium
ARIPGGSGLPGGLD

SEQ ID NO: 896430 - protein, 6 aa, Mycobacterium
ARIPTA

SEQ ID NO: 896431 - protein, 14 aa, Mycobacterium
ARLANDPTAPPPNQ

SEQ ID NO: 896432 - protein, 9 aa, Mycobacterium
ARLSDGTTV

SEQ ID NO: 896433 - protein, 4 aa, Mycobacterium
ARLT

SEQ ID NO: 896434 - protein, 6 aa, Mycobacterium
ARLTQG

SEQ ID NO: 896435 - protein, 5 aa, Mycobacterium
ARMSG

SEQ ID NO: 896436 - protein, 12 aa, Mycobacterium
ARNATAAEGLDA

SEQ ID NO: 896437 - protein, 12 aa, Mycobacterium
ARNATTAEGLDQ

SEQ ID NO: 896438 - protein, 9 aa, Mycobacterium
ARNDGSHPV

SEQ ID NO: 896439 - protein, 4 aa, Mycobacterium
ARNG

SEQ ID NO: 896440 - protein, 6 aa, Mycobacterium
ARNGTR

SEQ ID NO: 896441 - protein, 5 aa, Mycobacterium
ARNVS

SEQ ID NO: 896442 - protein, 8 aa, Mycobacterium
ARPANPVN

SEQ ID NO: 896443 - protein, 9 aa, Mycobacterium
ARPAPGAAA

SEQ ID NO: 896444 - protein, 13 aa, Mycobacterium
ARPAPSSCPQVGN

SEQ ID NO: 896445 - protein, 16 aa, Mycobacterium
ARPARAAARAGPIGEG

SEQ ID NO: 896446 - protein, 8 aa, Mycobacterium
ARPATDTL

SEQ ID NO: 896447 - protein, 12 aa, Mycobacterium
ARPATEASASQL

SEQ ID NO: 896448 - protein, 15 aa, Mycobacterium
ARPATSALADNTAQL

SEQ ID NO: 896449 - protein, 13 aa, Mycobacterium
ARPDAPRPGPQAA

SEQ ID NO: 896450 - protein, 14 aa, Mycobacterium
ARPDASPAGPAAID

SEQ ID NO: 896451 - protein, 5 aa, Mycobacterium
ARPDG

SEQ ID NO: 896452 - protein, 5 aa, Mycobacterium
ARPDI

SEQ ID NO: 896453 - protein, 9 aa, Mycobacterium
ARPDSDGIR

SEQ ID NO: 896454 - protein, 25 aa, Mycobacterium
ARPELTAASGAAVRAANGPGEAAAT

SEQ ID NO: 896455 - protein, 4 aa, Mycobacterium
ARPG

SEQ ID NO: 896456 - protein, 8 aa, Mycobacterium
ARPGKTSW

SEQ ID NO: 896457 - protein, 5 aa, Mycobacterium
ARPGV

SEQ ID NO: 896458 - protein, 9 aa, Mycobacterium
ARPKVAPSG

SEQ ID NO: 896459 - protein, 5 aa, Mycobacterium
ARPLD

SEQ ID NO: 896460 - protein, 6 aa, Mycobacterium
ARPMRG

SEQ ID NO: 896461 - protein, 7 aa, Mycobacterium
ARPNELT

SEQ ID NO: 896462 - protein, 8 aa, Mycobacterium
ARPPADAE

SEQ ID NO: 896463 - protein, 10 aa, Mycobacterium
ARPPADAEAT

SEQ ID NO: 896464 - protein, 6 aa, Mycobacterium
ARPPEC

SEQ ID NO: 896465 - protein, 11 aa, Mycobacterium
ARPQSRGTVTL

SEQ ID NO: 896466 - protein, 14 aa, Mycobacterium
ARPRHAAASQTAGH

SEQ ID NO: 896467 - protein, 24 aa, Mycobacterium
ARPRVEQPSRPAAPARGCEPTRGS

SEQ ID NO: 896468 - protein, 7 aa, Mycobacterium
ARPSGPN

SEQ ID NO: 896469 - protein, 39 aa, Mycobacterium
ARPSSPMQQTAVPEAAGGTAPGATAATGRQNIPTGQPMG

SEQ ID NO: 896470 - protein, 11 aa, Mycobacterium
ARPSSPRTAPS

SEQ ID NO: 896471 - protein, 8 aa, Mycobacterium
ARPSTHAR

SEQ ID NO: 896472 - protein, 9 aa, Mycobacterium
ARPSTHTRR

SEQ ID NO: 896473 - protein, 4 aa, Mycobacterium
ARPT

SEQ ID NO: 896474 - protein, 6 aa, Mycobacterium
ARPTPL

SEQ ID NO: 896475 - protein, 17 aa, Mycobacterium
ARQALQTAGAAVPGGRP

SEQ ID NO: 896476 - protein, 13 aa, Mycobacterium
ARQDTPAAPPGPC

SEQ ID NO: 896477 - protein, 12 aa, Mycobacterium
ARQENGRFAPAS

SEQ ID NO: 896478 - protein, 4 aa, Mycobacterium
ARQH

SEQ ID NO: 896479 - protein, 21 aa, Mycobacterium
ARQLPGPALTARNDGPRHAAP

SEQ ID NO: 896480 - protein, 15 aa, Mycobacterium
ARQPARSAAAAPDTA

SEQ ID NO: 896481 - protein, 9 aa, Mycobacterium
ARQPDAERF

SEQ ID NO: 896482 - protein, 10 aa, Mycobacterium
ARQPDDRADD

SEQ ID NO: 896483 - protein, 6 aa, Mycobacterium
ARQSAR

SEQ ID NO: 896484 - protein, 7 aa, Mycobacterium
ARQVGPA

SEQ ID NO: 896485 - protein, 11 aa, Mycobacterium
ARQVGTKHDAT

SEQ ID NO: 896486 - protein, 6 aa, Mycobacterium
ARRAAA

SEQ ID NO: 896487 - protein, 11 aa, Mycobacterium
ARRAQSRYSGG

SEQ ID NO: 896488 - protein, 6 aa, Mycobacterium
ARRARA

SEQ ID NO: 896489 - protein, 6 aa, Mycobacterium
ARRARP

SEQ ID NO: 896490 - protein, 6 aa, Mycobacterium
ARRASE

SEQ ID NO: 896491 - protein, 14 aa, Mycobacterium
ARRDENGRVTVTVT

SEQ ID NO: 896492 - protein, 11 aa, Mycobacterium
ARRDSDPVGAA

SEQ ID NO: 896493 - protein, 6 aa, Mycobacterium
ARRGEP

SEQ ID NO: 896494 - protein, 5 aa, Mycobacterium
ARRGR

SEQ ID NO: 896495 - protein, 21 aa, Mycobacterium
ARRGSDDVPPRDPKDTEASER

SEQ ID NO: 896496 - protein, 8 aa, Mycobacterium
ARRLDDER

SEQ ID NO: 896497 - protein, 6 aa, Mycobacterium
ARRPND

SEQ ID NO: 896498 - protein, 7 aa, Mycobacterium
ARRQQKA

SEQ ID NO: 896499 - protein, 4 aa, Mycobacterium
ARRR

SEQ ID NO: 896500 - protein, 9 aa, Mycobacterium
ARRRGVPTP

SEQ ID NO: 896501 - protein, 6 aa, Mycobacterium
ARRSGS

SEQ ID NO: 896502 - protein, 20 aa, Mycobacterium
ARRSMTQRARGADDPYADED

SEQ ID NO: 896503 - protein, 6 aa, Mycobacterium
ARRTDI

SEQ ID NO: 896504 - protein, 9 aa, Mycobacterium
ARRTGRAAT

SEQ ID NO: 896505 - protein, 4 aa, Mycobacterium
ARSA

SEQ ID NO: 896506 - protein, 13 aa, Mycobacterium
ARSAAAASGFTAD

SEQ ID NO: 896507 - protein, 6 aa, Mycobacterium
ARSAHE

SEQ ID NO: 896508 - protein, 5 aa, Mycobacterium
ARSAS

SEQ ID NO: 896509 - protein, 8 aa, Mycobacterium
ARSASAAQ

SEQ ID NO: 896510 - protein, 7 aa, Mycobacterium
ARSASSL

SEQ ID NO: 896511 - protein, 12 aa, Mycobacterium
ARSATERLPQRT

SEQ ID NO: 896512 - protein, 12 aa, Mycobacterium
ARSDNGPGGESV

SEQ ID NO: 896513 - protein, 15 aa, Mycobacterium
ARSEEISTAMTETSR

SEQ ID NO: 896514 - protein, 6 aa, Mycobacterium
ARSEQI

SEQ ID NO: 896515 - protein, 7 aa, Mycobacterium
ARSFSDA

SEQ ID NO: 896516 - protein, 15 aa, Mycobacterium
ARSGAVDAATEALET

SEQ ID NO: 896517 - protein, 20 aa, Mycobacterium
ARSGGGAHPASTTAAPAADL

SEQ ID NO: 896518 - protein, 6 aa, Mycobacterium
ARSGGP

SEQ ID NO: 896519 - protein, 16 aa, Mycobacterium
ARSGHAGHQAGTQPVR

SEQ ID NO: 896520 - protein, 8 aa, Mycobacterium
ARSGNQQL

SEQ ID NO: 896521 - protein, 7 aa, Mycobacterium
ARSLGST

SEQ ID NO: 896522 - protein, 8 aa, Mycobacterium
ARSNSKQL

SEQ ID NO: 896523 - protein, 5 aa, Mycobacterium
ARSPA

SEQ ID NO: 896524 - protein, 9 aa, Mycobacterium
ARSQTHRAK

SEQ ID NO: 896525 - protein, 27 aa, Mycobacterium
ARSQTNRPKTRVIGPDDDPEFLRRLGQ

SEQ ID NO: 896526 - protein, 11 aa, Mycobacterium
ARSRDTGGTGL

SEQ ID NO: 896527 - protein, 10 aa, Mycobacterium
ARSRLNPAEG

SEQ ID NO: 896528 - protein, 18 aa, Mycobacterium
ARSSAPAVDAAGNFLRAV

SEQ ID NO: 896529 - protein, 14 aa, Mycobacterium
ARSSQLDSALRDTA

SEQ ID NO: 896530 - protein, 16 aa, Mycobacterium
ARSTALASKSSAEALE

SEQ ID NO: 896531 - protein, 7 aa, Mycobacterium
ARSVTGT

SEQ ID NO: 896532 - protein, 4 aa, Mycobacterium
ARTA

SEQ ID NO: 896533 - protein, 10 aa, Mycobacterium
ARTADGQSYQ

SEQ ID NO: 896534 - protein, 7 aa, Mycobacterium
ARTADGV

SEQ ID NO: 896535 - protein, 6 aa, Mycobacterium
ARTAGA

SEQ ID NO: 896536 - protein, 13 aa, Mycobacterium
ARTARSGDTIEGT

SEQ ID NO: 896537 - protein, 11 aa, Mycobacterium
ARTASGVSNAT

SEQ ID NO: 896538 - protein, 6 aa, Mycobacterium
ARTDPV

SEQ ID NO: 896539 - protein, 7 aa, Mycobacterium
ARTEPGI

SEQ ID NO: 896540 - protein, 35 aa, Mycobacterium
ARTEQVNKESAARLAKQKADDAVKAAETSQQDAVS

SEQ ID NO: 896541 - protein, 5 aa, Mycobacterium
ARTGM

SEQ ID NO: 896542 - protein, 5 aa, Mycobacterium
ARTGQ

SEQ ID NO: 896543 - protein, 6 aa, Mycobacterium
ARTGQL

SEQ ID NO: 896544 - protein, 5 aa, Mycobacterium
ARTPD

SEQ ID NO: 896545 - protein, 9 aa, Mycobacterium
ARTPDTPPQ

SEQ ID NO: 896546 - protein, 14 aa, Mycobacterium
ARTPGPRESTAADM

SEQ ID NO: 896547 - protein, 6 aa, Mycobacterium
ARTPRS

SEQ ID NO: 896548 - protein, 8 aa, Mycobacterium
ARTQARAA

SEQ ID NO: 896549 - protein, 5 aa, Mycobacterium
ARTQR

SEQ ID NO: 896550 - protein, 17 aa, Mycobacterium
ARTRAFNDAKGRAEQYA

SEQ ID NO: 896551 - protein, 33 aa, Mycobacterium
ARTRQVNKESASRLAKQKADKAAEEAKTSQDAA

SEQ ID NO: 896552 - protein, 21 aa, Mycobacterium
ARTSGHGADAESGDRSPSATV

SEQ ID NO: 896553 - protein, 6 aa, Mycobacterium
ARTSSI

SEQ ID NO: 896554 - protein, 8 aa, Mycobacterium
ARTSTGGV

SEQ ID NO: 896555 - protein, 8 aa, Mycobacterium
ARTTEQLA

SEQ ID NO: 896556 - protein, 7 aa, Mycobacterium
ARTTGDN

SEQ ID NO: 896557 - protein, 12 aa, Mycobacterium
ARTTQDGAYGNS

SEQ ID NO: 896558 - protein, 7 aa, Mycobacterium
ARTTQEG

SEQ ID NO: 896559 - protein, 12 aa, Mycobacterium
ARTTRGSQLTPA

SEQ ID NO: 896560 - protein, 13 aa, Mycobacterium
ARTVATSGGATYG

SEQ ID NO: 896561 - protein, 12 aa, Mycobacterium
ARTVESDPVNRN

SEQ ID NO: 896562 - protein, 5 aa, Mycobacterium
ARTVH

SEQ ID NO: 896563 - protein, 5 aa, Mycobacterium
ARVND

SEQ ID NO: 896564 - protein, 7 aa, Mycobacterium
ARVPGNG

SEQ ID NO: 896565 - protein, 4 aa, Mycobacterium
ARVS

SEQ ID NO: 896566 - protein, 9 aa, Mycobacterium
ARWEPPSDV

SEQ ID NO: 896567 - protein, 11 aa, Mycobacterium
ARWRPRRRRRR

SEQ ID NO: 896568 - protein, 5 aa, Mycobacterium
ARWSD

SEQ ID NO: 896569 - protein, 22 aa, Mycobacterium
ARYANQEASAADEMAAVAQLKV

SEQ ID NO: 896570 - protein, 7 aa, Mycobacterium
ARYGRRR

SEQ ID NO: 896571 - protein, 13 aa, Mycobacterium
ARYRDDSAKRGGP

SEQ ID NO: 896572 - protein, 4 aa, Mycobacterium
ASAA

SEQ ID NO: 896573 - protein, 6 aa, Mycobacterium
ASAAAG

SEQ ID NO: 896574 - protein, 11 aa, Mycobacterium
ASAAAKAVTGA

SEQ ID NO: 896575 - protein, 22 aa, Mycobacterium
ASAAASTLTPFEEAPETTHADG

SEQ ID NO: 896576 - protein, 6 aa, Mycobacterium
ASAACP

SEQ ID NO: 896577 - protein, 15 aa, Mycobacterium
ASAADPRGPHAKPED

SEQ ID NO: 896578 - protein, 8 aa, Mycobacterium
ASAADTGM

SEQ ID NO: 896579 - protein, 13 aa, Mycobacterium
ASAAEGQQAWSGV

SEQ ID NO: 896580 - protein, 7 aa, Mycobacterium
ASAAPER

SEQ ID NO: 896581 - protein, 11 aa, Mycobacterium
ASAAQLDVTDP

SEQ ID NO: 896582 - protein, 5 aa, Mycobacterium
ASAAV

SEQ ID NO: 896583 - protein, 15 aa, Mycobacterium
ASADAASQQLQTGTA

SEQ ID NO: 896584 - protein, 12 aa, Mycobacterium
ASADEKKQNEAI

SEQ ID NO: 896585 - protein, 11 aa, Mycobacterium
ASADGTKDPEF

SEQ ID NO: 896586 - protein, 19 aa, Mycobacterium
ASADPDTPNPLDPSGLPNV

SEQ ID NO: 896587 - protein, 8 aa, Mycobacterium
ASADQKLQ

SEQ ID NO: 896588 - protein, 9 aa, Mycobacterium
ASADSASRL

SEQ ID NO: 896589 - protein, 16 aa, Mycobacterium
ASADSATAAAGSLTGY

SEQ ID NO: 896590 - protein, 22 aa, Mycobacterium
ASAEPSTPTVEVPDPQGPDCGP

SEQ ID NO: 896591 - protein, 14 aa, Mycobacterium
ASAESYAGAEAASA

SEQ ID NO: 896592 - protein, 100 aa, Mycobacterium
ASAETSEPSSSSAESSAGPSATERESSKPTVESRSESDADADAESDASEDSDDADAPDESTEGAGDDVDDRASRNTTQPTEVEEPATGTSRAQAEAEEPS

SEQ ID NO: 896593 - protein, 4 aa, Mycobacterium
ASAG

SEQ ID NO: 896594 - protein, 25 aa, Mycobacterium
ASAGEYIDPPKLDRKTRSKWEDTGR

SEQ ID NO: 896595 - protein, 7 aa, Mycobacterium
ASAGGID

SEQ ID NO: 896596 - protein, 9 aa, Mycobacterium
ASAGGSSDL

SEQ ID NO: 896597 - protein, 5 aa, Mycobacterium
ASAGL

SEQ ID NO: 896598 - protein, 10 aa, Mycobacterium
ASAGPKDFGY

SEQ ID NO: 896599 - protein, 8 aa, Mycobacterium
ASAGQLDR

SEQ ID NO: 896600 - protein, 10 aa, Mycobacterium
ASAGRPRRRR

SEQ ID NO: 896601 - protein, 24 aa, Mycobacterium
ASAGTYGATENLNSAAAASPLDGI

SEQ ID NO: 896602 - protein, 67 aa, Mycobacterium
ASAGVAGADPDQTPAPSPSPAASSRGPAPGPPPSSPAPSPAASSAPAPAASPPASPAPGPKTTIDKD

SEQ ID NO: 896603 - protein, 16 aa, Mycobacterium
ASAGVGRAAAREFGKH

SEQ ID NO: 896604 - protein, 4 aa, Mycobacterium
ASAH

SEQ ID NO: 896605 - protein, 5 aa, Mycobacterium
ASAHA

SEQ ID NO: 896606 - protein, 5 aa, Mycobacterium
ASAHP

SEQ ID NO: 896607 - protein, 13 aa, Mycobacterium
ASALNSALAEGSS

SEQ ID NO: 896608 - protein, 16 aa, Mycobacterium
ASALTGGSGSNTVRGP

SEQ ID NO: 896609 - protein, 7 aa, Mycobacterium
ASALTGV

SEQ ID NO: 896610 - protein, 4 aa, Mycobacterium
ASAN

SEQ ID NO: 896611 - protein, 11 aa, Mycobacterium
ASANPDELPVQ

SEQ ID NO: 896612 - protein, 17 aa, Mycobacterium
ASANPGPRIPGPPGPHV

SEQ ID NO: 896613 - protein, 9 aa, Mycobacterium
ASAPAAGTA

SEQ ID NO: 896614 - protein, 8 aa, Mycobacterium
ASAPAGAR

SEQ ID NO: 896615 - protein, 6 aa, Mycobacterium
ASAPIN

SEQ ID NO: 896616 - protein, 12 aa, Mycobacterium
ASAPPESGATSA

SEQ ID NO: 896617 - protein, 7 aa, Mycobacterium
ASAPSAE

SEQ ID NO: 896618 - protein, 19 aa, Mycobacterium
ASAQEAPDEPVRPPFDSDA

SEQ ID NO: 896619 - protein, 12 aa, Mycobacterium
ASAQPALDGARR

SEQ ID NO: 896620 - protein, 14 aa, Mycobacterium
ASAQPDPVSPVAPG

SEQ ID NO: 896621 - protein, 13 aa, Mycobacterium
ASAQPGLDRRRRE

SEQ ID NO: 896622 - protein, 12 aa, Mycobacterium
ASAQPPDPITGE

SEQ ID NO: 896623 - protein, 19 aa, Mycobacterium
ASAQPTTQAEQPPAPRISP

SEQ ID NO: 896624 - protein, 13 aa, Mycobacterium
ASAQRVKDANAAI

SEQ ID NO: 896625 - protein, 7 aa, Mycobacterium
ASAQSFK

SEQ ID NO: 896626 - protein, 16 aa, Mycobacterium
ASARAQALRGLQSHRD

SEQ ID NO: 896627 - protein, 4 aa, Mycobacterium
ASAS

SEQ ID NO: 896628 - protein, 10 aa, Mycobacterium
ASASAAPGVE

SEQ ID NO: 896629 - protein, 12 aa, Mycobacterium
ASASAAPPTIQG

SEQ ID NO: 896630 - protein, 9 aa, Mycobacterium
ASASDDDPV

SEQ ID NO: 896631 - protein, 9 aa, Mycobacterium
ASASDPAIQ

SEQ ID NO: 896632 - protein, 11 aa, Mycobacterium
ASASPADGSVE

SEQ ID NO: 896633 - protein, 29 aa, Mycobacterium
ASASRTGSGEHARRPETVPLDEPAPSDVV

SEQ ID NO: 896634 - protein, 6 aa, Mycobacterium
ASASST

SEQ ID NO: 896635 - protein, 7 aa, Mycobacterium
ASASTKV

SEQ ID NO: 896636 - protein, 7 aa, Mycobacterium
ASATAAG

SEQ ID NO: 896637 - protein, 8 aa, Mycobacterium
ASATEVPR

SEQ ID NO: 896638 - protein, 7 aa, Mycobacterium
ASATLSS

SEQ ID NO: 896639 - protein, 12 aa, Mycobacterium
ASATPSPTCSSD

SEQ ID NO: 896640 - protein, 13 aa, Mycobacterium
ASATQKQSPLPVQ

SEQ ID NO: 896641 - protein, 12 aa, Mycobacterium
ASATSTASQGAL

SEQ ID NO: 896642 - protein, 60 aa, Mycobacterium
ASATTTSSASTTTSVTTSTTTTEVPPPSTSTSTVTVTSTPASTSTLPTTTVTTPPSLPPS

SEQ ID NO: 896643 - protein, 20 aa, Mycobacterium
ASATTTSSTTSVTTSTSTST

SEQ ID NO: 896644 - protein, 10 aa, Mycobacterium
ASAVGPAAPV

SEQ ID NO: 896645 - protein, 12 aa, Mycobacterium
ASCGGGDTTSLK

SEQ ID NO: 896646 - protein, 5 aa, Mycobacterium
ASCPN

SEQ ID NO: 896647 - protein, 5 aa, Mycobacterium
ASCPR

SEQ ID NO: 896648 - protein, 4 aa, Mycobacterium
ASDA

SEQ ID NO: 896649 - protein, 8 aa, Mycobacterium
ASDAASDY

SEQ ID NO: 896650 - protein, 8 aa, Mycobacterium
ASDADRDL

SEQ ID NO: 896651 - protein, 9 aa, Mycobacterium
ASDATKGQI

SEQ ID NO: 896652 - protein, 10 aa, Mycobacterium
ASDCSDATLR

SEQ ID NO: 896653 - protein, 20 aa, Mycobacterium
ASDDDGGALTTTVTSANATV

SEQ ID NO: 896654 - protein, 9 aa, Mycobacterium
ASDDKNNTP

SEQ ID NO: 896655 - protein, 40 aa, Mycobacterium
ASDGAWGKGAGKSFKGGVGEGAKGNDGTSAAIKNTEGSIT

SEQ ID NO: 896656 - protein, 40 aa, Mycobacterium
ASDGAWGKGAGQTFNGGVGEGAAGNDGTSQALKRTDGSIT

SEQ ID NO: 896657 - protein, 7 aa, Mycobacterium
ASDGGIP

SEQ ID NO: 896658 - protein, 6 aa, Mycobacterium
ASDGGS

SEQ ID NO: 896659 - protein, 6 aa, Mycobacterium
ASDGLA

SEQ ID NO: 896660 - protein, 7 aa, Mycobacterium
ASDGSSH

SEQ ID NO: 896661 - protein, 13 aa, Mycobacterium
ASDIAGSTRIPAG

SEQ ID NO: 896662 - protein, 10 aa, Mycobacterium
ASDLDTGTDL

SEQ ID NO: 896663 - protein, 11 aa, Mycobacterium
ASDNEGGGRAA

SEQ ID NO: 896664 - protein, 10 aa, Mycobacterium
ASDPHSPPAL

SEQ ID NO: 896665 - protein, 7 aa, Mycobacterium
ASDQIDR

SEQ ID NO: 896666 - protein, 14 aa, Mycobacterium
ASDQLRQDLGVPAA

SEQ ID NO: 896667 - protein, 4 aa, Mycobacterium
ASDR

SEQ ID NO: 896668 - protein, 19 aa, Mycobacterium
ASDRSNSARTAALDRCDAA

SEQ ID NO: 896669 - protein, 8 aa, Mycobacterium
ASDTAKGG

SEQ ID NO: 896670 - protein, 12 aa, Mycobacterium
ASDTGPRGRKEY

SEQ ID NO: 896671 - protein, 13 aa, Mycobacterium
ASDVNGESVPSGF

SEQ ID NO: 896672 - protein, 4 aa, Mycobacterium
ASEA

SEQ ID NO: 896673 - protein, 9 aa, Mycobacterium
ASEAAANLP

SEQ ID NO: 896674 - protein, 10 aa, Mycobacterium
ASEAAPKAGV

SEQ ID NO: 896675 - protein, 7 aa, Mycobacterium
ASEAAST

SEQ ID NO: 896676 - protein, 5 aa, Mycobacterium
ASEAG

SEQ ID NO: 896677 - protein, 8 aa, Mycobacterium
ASEAPVSV

SEQ ID NO: 896678 - protein, 7 aa, Mycobacterium
ASEDWPE

SEQ ID NO: 896679 - protein, 7 aa, Mycobacterium
ASEEGKD

SEQ ID NO: 896680 - protein, 7 aa, Mycobacterium
ASEEGRD

SEQ ID NO: 896681 - protein, 13 aa, Mycobacterium
ASEEPGIVTTPDG

SEQ ID NO: 896682 - protein, 22 aa, Mycobacterium
ASEESESPLGAFGPTRGVSGDG

SEQ ID NO: 896683 - protein, 9 aa, Mycobacterium
ASEGNYTDA

SEQ ID NO: 896684 - protein, 7 aa, Mycobacterium
ASEGTSF

SEQ ID NO: 896685 - protein, 4 aa, Mycobacterium
ASEI

SEQ ID NO: 896686 - protein, 12 aa, Mycobacterium
ASENPAEVTPGA

SEQ ID NO: 896687 - protein, 5 aa, Mycobacterium
ASEPG

SEQ ID NO: 896688 - protein, 5 aa, Mycobacterium
ASESA

SEQ ID NO: 896689 - protein, 7 aa, Mycobacterium
ASESGYR

SEQ ID NO: 896690 - protein, 7 aa, Mycobacterium
ASESTGQ

SEQ ID NO: 896691 - protein, 7 aa, Mycobacterium
ASESTPQ

SEQ ID NO: 896692 - protein, 15 aa, Mycobacterium
ASETANQAAAAAAAY

SEQ ID NO: 896693 - protein, 12 aa, Mycobacterium
ASEVPPAEVSGP

SEQ ID NO: 896694 - protein, 16 aa, Mycobacterium
ASFGGATAQTAAGDAT

SEQ ID NO: 896695 - protein, 12 aa, Mycobacterium
ASGAAALARTNA

SEQ ID NO: 896696 - protein, 6 aa, Mycobacterium
ASGAAY

SEQ ID NO: 896697 - protein, 8 aa, Mycobacterium
ASGAGQAA

SEQ ID NO: 896698 - protein, 12 aa, Mycobacterium
ASGANSTANAGV

SEQ ID NO: 896699 - protein, 16 aa, Mycobacterium
ASGAVPDNRQAKPIPA

SEQ ID NO: 896700 - protein, 10 aa, Mycobacterium
ASGCAGQTRQ

SEQ ID NO: 896701 - protein, 10 aa, Mycobacterium
ASGDAGGGRR

SEQ ID NO: 896702 - protein, 7 aa, Mycobacterium
ASGDDAG

SEQ ID NO: 896703 - protein, 8 aa, Mycobacterium
ASGDDTSL

SEQ ID NO: 896704 - protein, 7 aa, Mycobacterium
ASGDPTV

SEQ ID NO: 896705 - protein, 172 aa, Mycobacterium
ASGDQGAGGAGGNGGDGGVAGTGGAGGAGDASHPDGGVGGDGGDPGAGGAGGIGGHGSSTGANGSFGSTPTTAAGNGGKGGNGYTPTTPGADGGAGGTGGSGGLYGNGGDGGAGGNGATGAPGVNPTPNPVTSHADPGAAGTTDNGGDGNGGTGSNGTTAGEQGGTGGAGFN

SEQ ID NO: 896706 - protein, 5 aa, Mycobacterium
ASGDR

SEQ ID NO: 896707 - protein, 7 aa, Mycobacterium
ASGDSYG

SEQ ID NO: 896708 - protein, 16 aa, Mycobacterium
ASGDTRGTQFIGYTFC

SEQ ID NO: 896709 - protein, 11 aa, Mycobacterium
ASGEAGGGQRF

SEQ ID NO: 896710 - protein, 23 aa, Mycobacterium
ASGEGGGESSPESTQAASGAKVD

SEQ ID NO: 896711 - protein, 24 aa, Mycobacterium
ASGFGNAPAAPAAVAAPAAPALPA

SEQ ID NO: 896712 - protein, 17 aa, Mycobacterium
ASGGESNFGKIGSPQID

SEQ ID NO: 896713 - protein, 7 aa, Mycobacterium
ASGGGLN

SEQ ID NO: 896714 - protein, 20 aa, Mycobacterium
ASGGGSYAAAETTNAAPLQT

SEQ ID NO: 896715 - protein, 8 aa, Mycobacterium
ASGGPNCR

SEQ ID NO: 896716 - protein, 14 aa, Mycobacterium
ASGGSFSGKAPYIQ

SEQ ID NO: 896717 - protein, 6 aa, Mycobacterium
ASGIGA

SEQ ID NO: 896718 - protein, 7 aa, Mycobacterium
ASGIGRA

SEQ ID NO: 896719 - protein, 9 aa, Mycobacterium
ASGIPPATY

SEQ ID NO: 896720 - protein, 7 aa, Mycobacterium
ASGLDPA

SEQ ID NO: 896721 - protein, 10 aa, Mycobacterium
ASGLGRRHGA

SEQ ID NO: 896722 - protein, 9 aa, Mycobacterium
ASGNDAANT

SEQ ID NO: 896723 - protein, 8 aa, Mycobacterium
ASGNLSGA

SEQ ID NO: 896724 - protein, 13 aa, Mycobacterium
ASGNLSGAVPQLP

SEQ ID NO: 896725 - protein, 10 aa, Mycobacterium
ASGPATRPSD

SEQ ID NO: 896726 - protein, 11 aa, Mycobacterium
ASGPDGGGQRF

SEQ ID NO: 896727 - protein, 7 aa, Mycobacterium
ASGQADY

SEQ ID NO: 896728 - protein, 10 aa, Mycobacterium
ASGQFADPNK

SEQ ID NO: 896729 - protein, 7 aa, Mycobacterium
ASGQHDW

SEQ ID NO: 896730 - protein, 6 aa, Mycobacterium
ASGRAG

SEQ ID NO: 896731 - protein, 7 aa, Mycobacterium
ASGRASN

SEQ ID NO: 896732 - protein, 9 aa, Mycobacterium
ASGRSSVTR

SEQ ID NO: 896733 - protein, 6 aa, Mycobacterium
ASGRVS

SEQ ID NO: 896734 - protein, 27 aa, Mycobacterium
ASGSAGAALASGALGTTGAGSGCAAGS

SEQ ID NO: 896735 - protein, 34 aa, Mycobacterium
ASGSALASGSAGAALAAGTLDTAGAGSGCAAGST

SEQ ID NO: 896736 - protein, 8 aa, Mycobacterium
ASGSEGVA

SEQ ID NO: 896737 - protein, 8 aa, Mycobacterium
ASGSETVG

SEQ ID NO: 896738 - protein, 25 aa, Mycobacterium
ASGSVQTSSSFGGGVAAGAAGTAGA

SEQ ID NO: 896739 - protein, 7 aa, Mycobacterium
ASGTDTA

SEQ ID NO: 896740 - protein, 15 aa, Mycobacterium
ASGTGSTEVRDTTKA

SEQ ID NO: 896741 - protein, 8 aa, Mycobacterium
ASGTLVPK

SEQ ID NO: 896742 - protein, 16 aa, Mycobacterium
ASGTRVQSDYTDPTIQ

SEQ ID NO: 896743 - protein, 8 aa, Mycobacterium
ASGTSDAA

SEQ ID NO: 896744 - protein, 8 aa, Mycobacterium
ASGTYDSR

SEQ ID NO: 896745 - protein, 7 aa, Mycobacterium
ASGVANS

SEQ ID NO: 896746 - protein, 16 aa, Mycobacterium
ASGVGHPVTGKASLEA

SEQ ID NO: 896747 - protein, 9 aa, Mycobacterium
ASGVTGADV

SEQ ID NO: 896748 - protein, 7 aa, Mycobacterium
ASGYAPR

SEQ ID NO: 896749 - protein, 16 aa, Mycobacterium
ASIDKKDHDADPCGQI

SEQ ID NO: 896750 - protein, 22 aa, Mycobacterium
ASIEASSLTSAARESERQATLT

SEQ ID NO: 896751 - protein, 8 aa, Mycobacterium
ASIGTGAS

SEQ ID NO: 896752 - protein, 9 aa, Mycobacterium
ASIGTGASA

SEQ ID NO: 896753 - protein, 13 aa, Mycobacterium
ASIPGSTSGSDFN

SEQ ID NO: 896754 - protein, 9 aa, Mycobacterium
ASKAAGTPL

SEQ ID NO: 896755 - protein, 7 aa, Mycobacterium
ASKDDRD

SEQ ID NO: 896756 - protein, 9 aa, Mycobacterium
ASKDPTADY

SEQ ID NO: 896757 - protein, 8 aa, Mycobacterium
ASKRPAKA

SEQ ID NO: 896758 - protein, 12 aa, Mycobacterium
ASKTADDQIPPL

SEQ ID NO: 896759 - protein, 7 aa, Mycobacterium
ASKTAQE

SEQ ID NO: 896760 - protein, 8 aa, Mycobacterium
ASKTAQEH

SEQ ID NO: 896761 - protein, 10 aa, Mycobacterium
ASKTDSPNAA

SEQ ID NO: 896762 - protein, 8 aa, Mycobacterium
ASKTRRIG

SEQ ID NO: 896763 - protein, 5 aa, Mycobacterium
ASKTT

SEQ ID NO: 896764 - protein, 20 aa, Mycobacterium
ASLAAGPAALAQPAPPATPS

SEQ ID NO: 896765 - protein, 10 aa, Mycobacterium
ASLADRDQAI

SEQ ID NO: 896766 - protein, 6 aa, Mycobacterium
ASLAGG

SEQ ID NO: 896767 - protein, 6 aa, Mycobacterium
ASLAGN

SEQ ID NO: 896768 - protein, 11 aa, Mycobacterium
ASLGGNDAATI

SEQ ID NO: 896769 - protein, 4 aa, Mycobacterium
ASLP

SEQ ID NO: 896770 - protein, 5 aa, Mycobacterium
ASLPA

SEQ ID NO: 896771 - protein, 5 aa, Mycobacterium
ASLPQ

SEQ ID NO: 896772 - protein, 7 aa, Mycobacterium
ASLPTYT

SEQ ID NO: 896773 - protein, 10 aa, Mycobacterium
ASLQSKQSQL

SEQ ID NO: 896774 - protein, 12 aa, Mycobacterium
ASLRAAPVSAAS

SEQ ID NO: 896775 - protein, 6 aa, Mycobacterium
ASLSDQ

SEQ ID NO: 896776 - protein, 20 aa, Mycobacterium
ASLTDGSVPLASSSSAIVPS

SEQ ID NO: 896777 - protein, 9 aa, Mycobacterium
ASLVTTPDG

SEQ ID NO: 896778 - protein, 4 aa, Mycobacterium
ASMA

SEQ ID NO: 896779 - protein, 4 aa, Mycobacterium
ASMS

SEQ ID NO: 896780 - protein, 6 aa, Mycobacterium
ASMSGS

SEQ ID NO: 896781 - protein, 8 aa, Mycobacterium
ASNATRIS

SEQ ID NO: 896782 - protein, 9 aa, Mycobacterium
ASNDEADEL

SEQ ID NO: 896783 - protein, 8 aa, Mycobacterium
ASNDPTSV

SEQ ID NO: 896784 - protein, 9 aa, Mycobacterium
ASNEDADEL

SEQ ID NO: 896785 - protein, 9 aa, Mycobacterium
ASNEEADEL

SEQ ID NO: 896786 - protein, 7 aa, Mycobacterium
ASNEPVR

SEQ ID NO: 896787 - protein, 4 aa, Mycobacterium
ASNG

SEQ ID NO: 896788 - protein, 6 aa, Mycobacterium
ASNGNV

SEQ ID NO: 896789 - protein, 15 aa, Mycobacterium
ASNGRVPNPYEGVRR

SEQ ID NO: 896790 - protein, 12 aa, Mycobacterium
ASNGYASAQAGQ

SEQ ID NO: 896791 - protein, 4 aa, Mycobacterium
ASNK

SEQ ID NO: 896792 - protein, 6 aa, Mycobacterium
ASNNPM

SEQ ID NO: 896793 - protein, 4 aa, Mycobacterium
ASNP

SEQ ID NO: 896794 - protein, 15 aa, Mycobacterium
ASNRASDVVANGSTQ

SEQ ID NO: 896795 - protein, 16 aa, Mycobacterium
ASNRSGRTRIPDPEAA

SEQ ID NO: 896796 - protein, 9 aa, Mycobacterium
ASNRSGVST

SEQ ID NO: 896797 - protein, 10 aa, Mycobacterium
ASNSVDADAD

SEQ ID NO: 896798 - protein, 17 aa, Mycobacterium
ASNYSAAEAASTLGGGA

SEQ ID NO: 896799 - protein, 7 aa, Mycobacterium
ASPAARG

SEQ ID NO: 896800 - protein, 10 aa, Mycobacterium
ASPAEPASTG

SEQ ID NO: 896801 - protein, 19 aa, Mycobacterium
ASPAGAASGTMYGDPAAAA

SEQ ID NO: 896802 - protein, 26 aa, Mycobacterium
ASPAGPGPAPGDHPDGGPALTPTKGD

SEQ ID NO: 896803 - protein, 12 aa, Mycobacterium
ASPAIANGGGQN

SEQ ID NO: 896804 - protein, 10 aa, Mycobacterium
ASPASAAGIP

SEQ ID NO: 896805 - protein, 9 aa, Mycobacterium
ASPASASAA

SEQ ID NO: 896806 - protein, 15 aa, Mycobacterium
ASPASTKDPHAKPED

SEQ ID NO: 896807 - protein, 6 aa, Mycobacterium
ASPAVA

SEQ ID NO: 896808 - protein, 7 aa, Mycobacterium
ASPDGTT

SEQ ID NO: 896809 - protein, 10 aa, Mycobacterium
ASPDPSVPPR

SEQ ID NO: 896810 - protein, 5 aa, Mycobacterium
ASPEP

SEQ ID NO: 896811 - protein, 7 aa, Mycobacterium
ASPGGKT

SEQ ID NO: 896812 - protein, 6 aa, Mycobacterium
ASPGIS

SEQ ID NO: 896813 - protein, 7 aa, Mycobacterium
ASPIAAA

SEQ ID NO: 896814 - protein, 10 aa, Mycobacterium
ASPKAAITTT

SEQ ID NO: 896815 - protein, 6 aa, Mycobacterium
ASPNGF

SEQ ID NO: 896816 - protein, 7 aa, Mycobacterium
ASPNSRL

SEQ ID NO: 896817 - protein, 13 aa, Mycobacterium
ASPPGVPGLRGSE

SEQ ID NO: 896818 - protein, 10 aa, Mycobacterium
ASPPNPSPEL

SEQ ID NO: 896819 - protein, 10 aa, Mycobacterium
ASPPPKRQEM

SEQ ID NO: 896820 - protein, 8 aa, Mycobacterium
ASPQRRPD

SEQ ID NO: 896821 - protein, 4 aa, Mycobacterium
ASPR

SEQ ID NO: 896822 - protein, 6 aa, Mycobacterium
ASPRAS

SEQ ID NO: 896823 - protein, 6 aa, Mycobacterium
ASPRLG

SEQ ID NO: 896824 - protein, 6 aa, Mycobacterium
ASPRRA

SEQ ID NO: 896825 - protein, 9 aa, Mycobacterium
ASPRSGMGT

SEQ ID NO: 896826 - protein, 12 aa, Mycobacterium
ASPSDEGSGDVH

SEQ ID NO: 896827 - protein, 7 aa, Mycobacterium
ASPSNGV

SEQ ID NO: 896828 - protein, 13 aa, Mycobacterium
ASPSPRELARTQT

SEQ ID NO: 896829 - protein, 10 aa, Mycobacterium
ASPSSLPTDL

SEQ ID NO: 896830 - protein, 6 aa, Mycobacterium
ASPSVK

SEQ ID NO: 896831 - protein, 7 aa, Mycobacterium
ASPTLPG

SEQ ID NO: 896832 - protein, 16 aa, Mycobacterium
ASPTQQDTPHAKPEDV

SEQ ID NO: 896833 - protein, 8 aa, Mycobacterium
ASPTSLPG

SEQ ID NO: 896834 - protein, 6 aa, Mycobacterium
ASPTYN

SEQ ID NO: 896835 - protein, 5 aa, Mycobacterium
ASPVT

SEQ ID NO: 896836 - protein, 11 aa, Mycobacterium
ASQAAGSASDI

SEQ ID NO: 896837 - protein, 9 aa, Mycobacterium
ASQADARRD

SEQ ID NO: 896838 - protein, 11 aa, Mycobacterium
ASQADASVGGT

SEQ ID NO: 896839 - protein, 7 aa, Mycobacterium
ASQADYE

SEQ ID NO: 896840 - protein, 5 aa, Mycobacterium
ASQGG

SEQ ID NO: 896841 - protein, 11 aa, Mycobacterium
ASQGKGAWPTC

SEQ ID NO: 896842 - protein, 37 aa, Mycobacterium
ASQINTGLPGFGAGQTLGPLPGPMPAAAPQPVAPPPT

SEQ ID NO: 896843 - protein, 8 aa, Mycobacterium
ASQPLSAA

SEQ ID NO: 896844 - protein, 8 aa, Mycobacterium
ASQPPSRY

SEQ ID NO: 896845 - protein, 5 aa, Mycobacterium
ASQQV

SEQ ID NO: 896846 - protein, 14 aa, Mycobacterium
ASQVGADDTSAQKQ

SEQ ID NO: 896847 - protein, 18 aa, Mycobacterium
ASRARTANPSALRGDPAL

SEQ ID NO: 896848 - protein, 5 aa, Mycobacterium
ASRDA

SEQ ID NO: 896849 - protein, 6 aa, Mycobacterium
ASRDHE

SEQ ID NO: 896850 - protein, 6 aa, Mycobacterium
ASRGEE

SEQ ID NO: 896851 - protein, 9 aa, Mycobacterium
ASRLGAKES

SEQ ID NO: 896852 - protein, 9 aa, Mycobacterium
ASRLGGEQA

SEQ ID NO: 896853 - protein, 9 aa, Mycobacterium
ASRLNSQQA

SEQ ID NO: 896854 - protein, 9 aa, Mycobacterium
ASRNAGPSK

SEQ ID NO: 896855 - protein, 5 aa, Mycobacterium
ASRND

SEQ ID NO: 896856 - protein, 8 aa, Mycobacterium
ASRPEIDG

SEQ ID NO: 896857 - protein, 8 aa, Mycobacterium
ASRQGAPT

SEQ ID NO: 896858 - protein, 6 aa, Mycobacterium
ASRRDR

SEQ ID NO: 896859 - protein, 28 aa, Mycobacterium
ASRRPEIASPVASNPQPPPPAINPQAPP

SEQ ID NO: 896860 - protein, 8 aa, Mycobacterium
ASRRYRED

SEQ ID NO: 896861 - protein, 7 aa, Mycobacterium
ASRSGYA

SEQ ID NO: 896862 - protein, 12 aa, Mycobacterium
ASRTDGATEAFS

SEQ ID NO: 896863 - protein, 7 aa, Mycobacterium
ASRTPTI

SEQ ID NO: 896864 - protein, 9 aa, Mycobacterium
ASRVSPDPQ

SEQ ID NO: 896865 - protein, 7 aa, Mycobacterium
ASRWSPS

SEQ ID NO: 896866 - protein, 4 aa, Mycobacterium
ASSA

SEQ ID NO: 896867 - protein, 42 aa, Mycobacterium
ASSAAAGTLNPLTTPSRIANPAGLAAQAAAVGQAAATGTAQQ

SEQ ID NO: 896868 - protein, 10 aa, Mycobacterium
ASSAAASQLA

SEQ ID NO: 896869 - protein, 9 aa, Mycobacterium
ASSAAATRL

SEQ ID NO: 896870 - protein, 31 aa, Mycobacterium
ASSAPDDSDQPDQPRARDARPNRSQREEELS

SEQ ID NO: 896871 - protein, 8 aa, Mycobacterium
ASSARKEQ

SEQ ID NO: 896872 - protein, 8 aa, Mycobacterium
ASSASQQF

SEQ ID NO: 896873 - protein, 5 aa, Mycobacterium
ASSAT

SEQ ID NO: 896874 - protein, 7 aa, Mycobacterium
ASSDDAQ

SEQ ID NO: 896875 - protein, 9 aa, Mycobacterium
ASSDEADEL

SEQ ID NO: 896876 - protein, 15 aa, Mycobacterium
ASSDGTRFTNDGTGH

SEQ ID NO: 896877 - protein, 5 aa, Mycobacterium
ASSDR

SEQ ID NO: 896878 - protein, 6 aa, Mycobacterium
ASSFNG

SEQ ID NO: 896879 - protein, 7 aa, Mycobacterium
ASSGADK

SEQ ID NO: 896880 - protein, 18 aa, Mycobacterium
ASSGGSDRVASVTPGVDD

SEQ ID NO: 896881 - protein, 8 aa, Mycobacterium
ASSGLGAG

SEQ ID NO: 896882 - protein, 9 aa, Mycobacterium
ASSGRVTTN

SEQ ID NO: 896883 - protein, 7 aa, Mycobacterium
ASSGTSY

SEQ ID NO: 896884 - protein, 7 aa, Mycobacterium
ASSGVGA

SEQ ID NO: 896885 - protein, 7 aa, Mycobacterium
ASSGWFG

SEQ ID NO: 896886 - protein, 4 aa, Mycobacterium
ASSL

SEQ ID NO: 896887 - protein, 4 aa, Mycobacterium
ASSP

SEQ ID NO: 896888 - protein, 9 aa, Mycobacterium
ASSPAVATD

SEQ ID NO: 896889 - protein, 29 aa, Mycobacterium
ASSPDSATPPSSSSESPAASGAQQPPPEG

SEQ ID NO: 896890 - protein, 10 aa, Mycobacterium
ASSPEGGEVD

SEQ ID NO: 896891 - protein, 15 aa, Mycobacterium
ASSPIPAADYVAAHP

SEQ ID NO: 896892 - protein, 14 aa, Mycobacterium
ASSPPEYEPAPGTL

SEQ ID NO: 896893 - protein, 7 aa, Mycobacterium
ASSPQSL

SEQ ID NO: 896894 - protein, 20 aa, Mycobacterium
ASSPRSVASAPVSAGSGQAA

SEQ ID NO: 896895 - protein, 7 aa, Mycobacterium
ASSQSFK

SEQ ID NO: 896896 - protein, 9 aa, Mycobacterium
ASSQTPTLT

SEQ ID NO: 896897 - protein, 9 aa, Mycobacterium
ASSRDGAER

SEQ ID NO: 896898 - protein, 5 aa, Mycobacterium
ASSRL

SEQ ID NO: 896899 - protein, 9 aa, Mycobacterium
ASSSKVGGL

SEQ ID NO: 896900 - protein, 9 aa, Mycobacterium
ASSSRQAKS

SEQ ID NO: 896901 - protein, 9 aa, Mycobacterium
ASSSVVGAD

SEQ ID NO: 896902 - protein, 5 aa, Mycobacterium
ASSTI

SEQ ID NO: 896903 - protein, 7 aa, Mycobacterium
ASSTRGA

SEQ ID NO: 896904 - protein, 6 aa, Mycobacterium
ASSTSV

SEQ ID NO: 896905 - protein, 6 aa, Mycobacterium
ASSTVS

SEQ ID NO: 896906 - protein, 4 aa, Mycobacterium
ASTA

SEQ ID NO: 896907 - protein, 8 aa, Mycobacterium
ASTADTTI

SEQ ID NO: 896908 - protein, 17 aa, Mycobacterium
ASTAGAGVASASPDYGP

SEQ ID NO: 896909 - protein, 9 aa, Mycobacterium
ASTAGAQGP

SEQ ID NO: 896910 - protein, 10 aa, Mycobacterium
ASTAGPDDTT

SEQ ID NO: 896911 - protein, 21 aa, Mycobacterium
ASTASADPIPGPPPNPTNPAA

SEQ ID NO: 896912 - protein, 35 aa, Mycobacterium
ASTASAQPGWTPPPAPPAGPNVGQAPAGAPPKPVD

SEQ ID NO: 896913 - protein, 5 aa, Mycobacterium
ASTAT

SEQ ID NO: 896914 - protein, 7 aa, Mycobacterium
ASTATAA

SEQ ID NO: 896915 - protein, 7 aa, Mycobacterium
ASTDETY

SEQ ID NO: 896916 - protein, 19 aa, Mycobacterium
ASTDLDDTSADKQPSGVRG

SEQ ID NO: 896917 - protein, 6 aa, Mycobacterium
ASTDPV

SEQ ID NO: 896918 - protein, 6 aa, Mycobacterium
ASTGDM

SEQ ID NO: 896919 - protein, 18 aa, Mycobacterium
ASTGGAAGAGSSGSSAID

SEQ ID NO: 896920 - protein, 11 aa, Mycobacterium
ASTGHGGGYQL

SEQ ID NO: 896921 - protein, 7 aa, Mycobacterium
ASTGIGT

SEQ ID NO: 896922 - protein, 10 aa, Mycobacterium
ASTGRQQGTP

SEQ ID NO: 896923 - protein, 8 aa, Mycobacterium
ASTGSLTG

SEQ ID NO: 896924 - protein, 14 aa, Mycobacterium
ASTHRNASEVAQTG

SEQ ID NO: 896925 - protein, 17 aa, Mycobacterium
ASTLRRAQAAANAAAAR

SEQ ID NO: 896926 - protein, 4 aa, Mycobacterium
ASTP

SEQ ID NO: 896927 - protein, 8 aa, Mycobacterium
ASTPGPGM

SEQ ID NO: 896928 - protein, 7 aa, Mycobacterium
ASTPPLG

SEQ ID NO: 896929 - protein, 10 aa, Mycobacterium
ASTPTAPDGM

SEQ ID NO: 896930 - protein, 19 aa, Mycobacterium
ASTQAKTRGLQATAQAAAY

SEQ ID NO: 896931 - protein, 34 aa, Mycobacterium
ASTQLPAATSGSTAVGSSSDINPQDPATLEDGGD

SEQ ID NO: 896932 - protein, 5 aa, Mycobacterium
ASTQQ

SEQ ID NO: 896933 - protein, 7 aa, Mycobacterium
ASTQSFK

SEQ ID NO: 896934 - protein, 4 aa, Mycobacterium
ASTR

SEQ ID NO: 896935 - protein, 41 aa, Mycobacterium
ASTRADDAARAAQSSALAARTATEQASAVSASLQSKQSRLR

SEQ ID NO: 896936 - protein, 8 aa, Mycobacterium
ASTSLTEA

SEQ ID NO: 896937 - protein, 9 aa, Mycobacterium
ASTSQGPAG

SEQ ID NO: 896938 - protein, 9 aa, Mycobacterium
ASTSQHKAE

SEQ ID NO: 896939 - protein, 9 aa, Mycobacterium
ASTTAPDEP

SEQ ID NO: 896940 - protein, 12 aa, Mycobacterium
ASTTASAPAPPV

SEQ ID NO: 896941 - protein, 12 aa, Mycobacterium
ASTTATAAVDTG

SEQ ID NO: 896942 - protein, 20 aa, Mycobacterium
ASTTESGDRDDLKPGVPDRS

SEQ ID NO: 896943 - protein, 10 aa, Mycobacterium
ASTTPPSDGR

SEQ ID NO: 896944 - protein, 8 aa, Mycobacterium
ASTTPPVL

SEQ ID NO: 896945 - protein, 8 aa, Mycobacterium
ASTTRHRA

SEQ ID NO: 896946 - protein, 5 aa, Mycobacterium
ASTTS

SEQ ID NO: 896947 - protein, 4 aa, Mycobacterium
ASTV

SEQ ID NO: 896948 - protein, 5 aa, Mycobacterium
ASTVD

SEQ ID NO: 896949 - protein, 7 aa, Mycobacterium
ASTVNDA

SEQ ID NO: 896950 - protein, 7 aa, Mycobacterium
ASTYGPE

SEQ ID NO: 896951 - protein, 11 aa, Mycobacterium
ASTYPSTEQTL

SEQ ID NO: 896952 - protein, 10 aa, Mycobacterium
ASTYPTTEQT

SEQ ID NO: 896953 - protein, 24 aa, Mycobacterium
ASVAGEPAGPTDPAVAAGAAGSVG

SEQ ID NO: 896954 - protein, 8 aa, Mycobacterium
ASVAPGAT

SEQ ID NO: 896955 - protein, 15 aa, Mycobacterium
ASVGAADPAPSHQAY

SEQ ID NO: 896956 - protein, 6 aa, Mycobacterium
ASVGQT

SEQ ID NO: 896957 - protein, 15 aa, Mycobacterium
ASVNGRDAATEFSGE

SEQ ID NO: 896958 - protein, 7 aa, Mycobacterium
ASVPAGP

SEQ ID NO: 896959 - protein, 10 aa, Mycobacterium
ASVPDNAAGE

SEQ ID NO: 896960 - protein, 10 aa, Mycobacterium
ASVPPGVPAA

SEQ ID NO: 896961 - protein, 24 aa, Mycobacterium
ASVQDGAVGVSAGSPVTVSAEDGV

SEQ ID NO: 896962 - protein, 6 aa, Mycobacterium
ASVQPA

SEQ ID NO: 896963 - protein, 7 aa, Mycobacterium
ASVSGNA

SEQ ID NO: 896964 - protein, 15 aa, Mycobacterium
ASVSGNGGIDPDEAA

SEQ ID NO: 896965 - protein, 44 aa, Mycobacterium
ASVSGNTINVTGTDPSGNTTQTAVTVDDKTKYMKRSSATTDAIA

SEQ ID NO: 896966 - protein, 12 aa, Mycobacterium
ASVTGSEQVDGV

SEQ ID NO: 896967 - protein, 8 aa, Mycobacterium
ASWATPDE

SEQ ID NO: 896968 - protein, 16 aa, Mycobacterium
ASWGTAPGAVEQASTK

SEQ ID NO: 896969 - protein, 21 aa, Mycobacterium
ASWSSAAPALPSGTTALEGSG

SEQ ID NO: 896970 - protein, 20 aa, Mycobacterium
ASYGASGDQSRSVESGKPAD

SEQ ID NO: 896971 - protein, 26 aa, Mycobacterium
ASYGGGLPPTPLPAPPEVRPMPDEPA

SEQ ID NO: 896972 - protein, 15 aa, Mycobacterium
ASYPAPAKSSAPGVT

SEQ ID NO: 896973 - protein, 6 aa, Mycobacterium
ASYPEP

SEQ ID NO: 896974 - protein, 6 aa, Mycobacterium
ASYTTP

SEQ ID NO: 896975 - protein, 13 aa, Mycobacterium
ATAAAEAAGRGRI

SEQ ID NO: 896976 - protein, 9 aa, Mycobacterium
ATAAEGEGN

SEQ ID NO: 896977 - protein, 13 aa, Mycobacterium
ATAALPDGGRDLA

SEQ ID NO: 896978 - protein, 8 aa, Mycobacterium
ATAAPGGD

SEQ ID NO: 896979 - protein, 11 aa, Mycobacterium
ATAAPGNEARA

SEQ ID NO: 896980 - protein, 7 aa, Mycobacterium
ATAAPKE

SEQ ID NO: 896981 - protein, 14 aa, Mycobacterium
ATAAPPPPNPAPYN

SEQ ID NO: 896982 - protein, 9 aa, Mycobacterium
ATAAPVPAA

SEQ ID NO: 896983 - protein, 13 aa, Mycobacterium
ATAAQAEQVATQA

SEQ ID NO: 896984 - protein, 15 aa, Mycobacterium
ATAAQAGQVSAQANG

SEQ ID NO: 896985 - protein, 9 aa, Mycobacterium
ATAASNNPL

SEQ ID NO: 896986 - protein, 12 aa, Mycobacterium
ATAATGTTATTA

SEQ ID NO: 896987 - protein, 19 aa, Mycobacterium
ATAATSYAQAEAANAATVT

SEQ ID NO: 896988 - protein, 15 aa, Mycobacterium
ATACGADDGGEDGAT

SEQ ID NO: 896989 - protein, 19 aa, Mycobacterium
ATACGGRQDAPAADSGGEI

SEQ ID NO: 896990 - protein, 13 aa, Mycobacterium
ATADAFDDEENWA

SEQ ID NO: 896991 - protein, 8 aa, Mycobacterium
ATADDSTK

SEQ ID NO: 896992 - protein, 18 aa, Mycobacterium
ATADGADPSITQTDEGTA

SEQ ID NO: 896993 - protein, 16 aa, Mycobacterium
ATADPAVHADPATAGE

SEQ ID NO: 896994 - protein, 13 aa, Mycobacterium
ATADPPDPHQPDM

SEQ ID NO: 896995 - protein, 8 aa, Mycobacterium
ATAEMSGD

SEQ ID NO: 896996 - protein, 21 aa, Mycobacterium
ATAEPAGRGRPTTTAATAGPP

SEQ ID NO: 896997 - protein, 7 aa, Mycobacterium
ATAGASV

SEQ ID NO: 896998 - protein, 17 aa, Mycobacterium
ATAGCAGAGTLGATDQT

SEQ ID NO: 896999 - protein, 5 aa, Mycobacterium
ATAGE

SEQ ID NO: 897000 - protein, 8 aa, Mycobacterium
ATAGFTGG

SEQ ID NO: 897001 - protein, 5 aa, Mycobacterium
ATAGN

SEQ ID NO: 897002 - protein, 13 aa, Mycobacterium
ATAGPPDPHQPDM

SEQ ID NO: 897003 - protein, 6 aa, Mycobacterium
ATAGPV

SEQ ID NO: 897004 - protein, 25 aa, Mycobacterium
ATAGQRRKENDTMHGNQPGDPAKAA

SEQ ID NO: 897005 - protein, 6 aa, Mycobacterium
ATAGRA

SEQ ID NO: 897006 - protein, 13 aa, Mycobacterium
ATAGSAAFGRRGG

SEQ ID NO: 897007 - protein, 4 aa, Mycobacterium
ATAH

SEQ ID NO: 897008 - protein, 7 aa, Mycobacterium
ATAHAGL

SEQ ID NO: 897009 - protein, 6 aa, Mycobacterium
ATAHTG

SEQ ID NO: 897010 - protein, 4 aa, Mycobacterium
ATAI

SEQ ID NO: 897011 - protein, 12 aa, Mycobacterium
ATALGGNGAKLR

SEQ ID NO: 897012 - protein, 15 aa, Mycobacterium
ATANAAPAPALPSAP

SEQ ID NO: 897013 - protein, 14 aa, Mycobacterium
ATANAEPERPANCT

SEQ ID NO: 897014 - protein, 5 aa, Mycobacterium
ATANL

SEQ ID NO: 897015 - protein, 7 aa, Mycobacterium
ATANPPV

SEQ ID NO: 897016 - protein, 13 aa, Mycobacterium
ATANSETPSIPDP

SEQ ID NO: 897017 - protein, 4 aa, Mycobacterium
ATAP

SEQ ID NO: 897018 - protein, 9 aa, Mycobacterium
ATAPAPAHV

SEQ ID NO: 897019 - protein, 14 aa, Mycobacterium
ATAPASRADSMQPV

SEQ ID NO: 897020 - protein, 13 aa, Mycobacterium
ATAPDAPARGSLS

SEQ ID NO: 897021 - protein, 18 aa, Mycobacterium
ATAPGADPSISRAEEGTA

SEQ ID NO: 897022 - protein, 19 aa, Mycobacterium
ATAPGADPSITQTDENTAR

SEQ ID NO: 897023 - protein, 18 aa, Mycobacterium
ATAPGADPSITRAEAGTA

SEQ ID NO: 897024 - protein, 19 aa, Mycobacterium
ATAPGADPSITRTDEGTAR

SEQ ID NO: 897025 - protein, 8 aa, Mycobacterium
ATAPPSDG

SEQ ID NO: 897026 - protein, 7 aa, Mycobacterium
ATAPTAG

SEQ ID NO: 897027 - protein, 22 aa, Mycobacterium
ATAPTARNAVDNTAAVLRSCGC

SEQ ID NO: 897028 - protein, 9 aa, Mycobacterium
ATAPVQAPT

SEQ ID NO: 897029 - protein, 11 aa, Mycobacterium
ATAQAETPDER

SEQ ID NO: 897030 - protein, 9 aa, Mycobacterium
ATAQAVAAG

SEQ ID NO: 897031 - protein, 15 aa, Mycobacterium
ATAQDKLTGHGPATI

SEQ ID NO: 897032 - protein, 7 aa, Mycobacterium
ATAQGIA

SEQ ID NO: 897033 - protein, 5 aa, Mycobacterium
ATAQR

SEQ ID NO: 897034 - protein, 4 aa, Mycobacterium
ATAR

SEQ ID NO: 897035 - protein, 6 aa, Mycobacterium
ATARAD

SEQ ID NO: 897036 - protein, 5 aa, Mycobacterium
ATARS

SEQ ID NO: 897037 - protein, 6 aa, Mycobacterium
ATARSA

SEQ ID NO: 897038 - protein, 6 aa, Mycobacterium
ATARVA

SEQ ID NO: 897039 - protein, 13 aa, Mycobacterium
ATASAAGCVVTND

SEQ ID NO: 897040 - protein, 81 aa, Mycobacterium
ATASADPAPAPAPSTTAAPPADPNAAPPPADPNAPPPPPADPNAPPPPPADPNAPPPPPADPNAPPPPVVDPNAPEPGRVN

SEQ ID NO: 897041 - protein, 6 aa, Mycobacterium
ATASGL

SEQ ID NO: 897042 - protein, 36 aa, Mycobacterium
ATASTTMQPATGPSAPAAPPSTSSTPPSPQPLPPVE

SEQ ID NO: 897043 - protein, 12 aa, Mycobacterium
ATATAAPPTIES

SEQ ID NO: 897044 - protein, 18 aa, Mycobacterium
ATATAQPAPAPAPAPEVP

SEQ ID NO: 897045 - protein, 15 aa, Mycobacterium
ATATAQPDSDAVPPT

SEQ ID NO: 897046 - protein, 7 aa, Mycobacterium
ATATATT

SEQ ID NO: 897047 - protein, 25 aa, Mycobacterium
ATATGTYTPAPTDLSQMTASGIPCV

SEQ ID NO: 897048 - protein, 34 aa, Mycobacterium
ATATPGQPAPQTPPAPQAPPVPLEPPATAAPTYV

SEQ ID NO: 897049 - protein, 14 aa, Mycobacterium
ATATPGYYKRPDVT

SEQ ID NO: 897050 - protein, 8 aa, Mycobacterium
ATATPPVA

SEQ ID NO: 897051 - protein, 9 aa, Mycobacterium
ATATSYRTA

SEQ ID NO: 897052 - protein, 14 aa, Mycobacterium
ATATVGTPARTVCT

SEQ ID NO: 897053 - protein, 13 aa, Mycobacterium
ATAVDGKSPTAAV

SEQ ID NO: 897054 - protein, 43 aa, Mycobacterium
ATAVPGPATTTSQAPTTTTTTTPPATTTPTPTAPIPAPESGEL

SEQ ID NO: 897055 - protein, 6 aa, Mycobacterium
ATAVSH

SEQ ID NO: 897056 - protein, 15 aa, Mycobacterium
ATAVSSNTRADAGGF

SEQ ID NO: 897057 - protein, 4 aa, Mycobacterium
ATDA

SEQ ID NO: 897058 - protein, 8 aa, Mycobacterium
ATDAAGRP

SEQ ID NO: 897059 - protein, 8 aa, Mycobacterium
ATDAALSE

SEQ ID NO: 897060 - protein, 9 aa, Mycobacterium
ATDAALSET

SEQ ID NO: 897061 - protein, 6 aa, Mycobacterium
ATDADT

SEQ ID NO: 897062 - protein, 10 aa, Mycobacterium
ATDAEAQGHW

SEQ ID NO: 897063 - protein, 7 aa, Mycobacterium
ATDAEST

SEQ ID NO: 897064 - protein, 6 aa, Mycobacterium
ATDAET

SEQ ID NO: 897065 - protein, 5 aa, Mycobacterium
ATDAF

SEQ ID NO: 897066 - protein, 21 aa, Mycobacterium
ATDAGSSGPFRGGPGGPPRAA

SEQ ID NO: 897067 - protein, 16 aa, Mycobacterium
ATDDAKLDAAGYDPIR

SEQ ID NO: 897068 - protein, 7 aa, Mycobacterium
ATDDQAP

SEQ ID NO: 897069 - protein, 9 aa, Mycobacterium
ATDEGKGVA

SEQ ID NO: 897070 - protein, 7 aa, Mycobacterium
ATDEPVD

SEQ ID NO: 897071 - protein, 4 aa, Mycobacterium
ATDG

SEQ ID NO: 897072 - protein, 7 aa, Mycobacterium
ATDGIPE

SEQ ID NO: 897073 - protein, 10 aa, Mycobacterium
ATDGLAGPKQ

SEQ ID NO: 897074 - protein, 8 aa, Mycobacterium
ATDGRGAA

SEQ ID NO: 897075 - protein, 8 aa, Mycobacterium
ATDGRTAA

SEQ ID NO: 897076 - protein, 7 aa, Mycobacterium
ATDGVPR

SEQ ID NO: 897077 - protein, 10 aa, Mycobacterium
ATDKADGPVR

SEQ ID NO: 897078 - protein, 5 aa, Mycobacterium
ATDPA

SEQ ID NO: 897079 - protein, 17 aa, Mycobacterium
ATDPAAAAKLNSSPMAQ

SEQ ID NO: 897080 - protein, 17 aa, Mycobacterium
ATDPAAAQQLNSSPVAQ

SEQ ID NO: 897081 - protein, 10 aa, Mycobacterium
ATDPNKVGQA

SEQ ID NO: 897082 - protein, 9 aa, Mycobacterium
ATDPRQKTQ

SEQ ID NO: 897083 - protein, 32 aa, Mycobacterium
ATDPTITGDPAGHGAIGPAPPATAITAQGAGT

SEQ ID NO: 897084 - protein, 25 aa, Mycobacterium
ATDPTITGDPAGHGAIGPAPSATAI

SEQ ID NO: 897085 - protein, 13 aa, Mycobacterium
ATDPVASGWSTRP

SEQ ID NO: 897086 - protein, 7 aa, Mycobacterium
ATDRQAI

SEQ ID NO: 897087 - protein, 7 aa, Mycobacterium
ATDSASF

SEQ ID NO: 897088 - protein, 5 aa, Mycobacterium
ATDWP

SEQ ID NO: 897089 - protein, 11 aa, Mycobacterium
ATEAAANAPDI

SEQ ID NO: 897090 - protein, 9 aa, Mycobacterium
ATEAGKGIQ

SEQ ID NO: 897091 - protein, 6 aa, Mycobacterium
ATEAMS

SEQ ID NO: 897092 - protein, 12 aa, Mycobacterium
ATEARKAFRSRE

SEQ ID NO: 897093 - protein, 5 aa, Mycobacterium
ATEDA

SEQ ID NO: 897094 - protein, 132 aa, Mycobacterium
ATEDSGSSASAGAESSTARTSSQDRQAASPSKPARDRAGGRDDAEGGGAEDRDAQAQDDATPETGGETGAPDDASVDASGPDTGGTTGDASAEDDDPDEAEERAAWADTGADTDADPDADPDADASAATDVA

SEQ ID NO: 897095 - protein, 4 aa, Mycobacterium
ATEG

SEQ ID NO: 897096 - protein, 16 aa, Mycobacterium
ATEGGVGRGGYVERPG

SEQ ID NO: 897097 - protein, 5 aa, Mycobacterium
ATEGL

SEQ ID NO: 897098 - protein, 5 aa, Mycobacterium
ATEHP

SEQ ID NO: 897099 - protein, 18 aa, Mycobacterium
ATEKEPSRDDASPGPRAI

SEQ ID NO: 897100 - protein, 8 aa, Mycobacterium
ATEKRTGV

SEQ ID NO: 897101 - protein, 4 aa, Mycobacterium
ATEN

SEQ ID NO: 897102 - protein, 8 aa, Mycobacterium
ATENDPSL

SEQ ID NO: 897103 - protein, 7 aa, Mycobacterium
ATEPELR

SEQ ID NO: 897104 - protein, 6 aa, Mycobacterium
ATEPIA

SEQ ID NO: 897105 - protein, 7 aa, Mycobacterium
ATEPPLD

SEQ ID NO: 897106 - protein, 10 aa, Mycobacterium
ATESFSDTRR

SEQ ID NO: 897107 - protein, 26 aa, Mycobacterium
ATESFSNPNRIEGPQLTPESDGTGRV

SEQ ID NO: 897108 - protein, 15 aa, Mycobacterium
ATESGTRFTNDATGR

SEQ ID NO: 897109 - protein, 9 aa, Mycobacterium
ATESKKVPS

SEQ ID NO: 897110 - protein, 9 aa, Mycobacterium
ATESNPTAA

SEQ ID NO: 897111 - protein, 7 aa, Mycobacterium
ATESPAI

SEQ ID NO: 897112 - protein, 7 aa, Mycobacterium
ATESRVR

SEQ ID NO: 897113 - protein, 7 aa, Mycobacterium
ATESTHG

SEQ ID NO: 897114 - protein, 9 aa, Mycobacterium
ATETAGDDV

SEQ ID NO: 897115 - protein, 5 aa, Mycobacterium
ATETL

SEQ ID NO: 897116 - protein, 6 aa, Mycobacterium
ATETPT

SEQ ID NO: 897117 - protein, 7 aa, Mycobacterium
ATEVPGV

SEQ ID NO: 897118 - protein, 6 aa, Mycobacterium
ATFDGG

SEQ ID NO: 897119 - protein, 9 aa, Mycobacterium
ATFKGKGND

SEQ ID NO: 897120 - protein, 8 aa, Mycobacterium
ATFKGQGN

SEQ ID NO: 897121 - protein, 26 aa, Mycobacterium
ATFSTTNATIPAASSSSQTGQDCFSG

SEQ ID NO: 897122 - protein, 5 aa, Mycobacterium
ATGAA

SEQ ID NO: 897123 - protein, 15 aa, Mycobacterium
ATGAALDSASQSVAR

SEQ ID NO: 897124 - protein, 17 aa, Mycobacterium
ATGAGSNDVGYSNPAFD

SEQ ID NO: 897125 - protein, 7 aa, Mycobacterium
ATGAPTL

SEQ ID NO: 897126 - protein, 20 aa, Mycobacterium
ATGAQAEQAASGARAAAAAY

SEQ ID NO: 897127 - protein, 5 aa, Mycobacterium
ATGAR

SEQ ID NO: 897128 - protein, 12 aa, Mycobacterium
ATGCNPGGTEEP

SEQ ID NO: 897129 - protein, 16 aa, Mycobacterium
ATGDARRVVTDPDAQY

SEQ ID NO: 897130 - protein, 6 aa, Mycobacterium
ATGDDK

SEQ ID NO: 897131 - protein, 8 aa, Mycobacterium
ATGDDKAN

SEQ ID NO: 897132 - protein, 7 aa, Mycobacterium
ATGDDKV

SEQ ID NO: 897133 - protein, 15 aa, Mycobacterium
ATGDGPRGALCSLRH

SEQ ID NO: 897134 - protein, 15 aa, Mycobacterium
ATGDGRRVVTDDDAR

SEQ ID NO: 897135 - protein, 14 aa, Mycobacterium
ATGDGRVDAQDLAR

SEQ ID NO: 897136 - protein, 5 aa, Mycobacterium
ATGDI

SEQ ID NO: 897137 - protein, 6 aa, Mycobacterium
ATGDKV

SEQ ID NO: 897138 - protein, 9 aa, Mycobacterium
ATGDPRPDG

SEQ ID NO: 897139 - protein, 8 aa, Mycobacterium
ATGEMTGD

SEQ ID NO: 897140 - protein, 8 aa, Mycobacterium
ATGGEPRQ

SEQ ID NO: 897141 - protein, 14 aa, Mycobacterium
ATGGPAGKARAAGY

SEQ ID NO: 897142 - protein, 6 aa, Mycobacterium
ATGGRE

SEQ ID NO: 897143 - protein, 6 aa, Mycobacterium
ATGGRI

SEQ ID NO: 897144 - protein, 21 aa, Mycobacterium
ATGGSRGLGAATAEALADRGA

SEQ ID NO: 897145 - protein, 10 aa, Mycobacterium
ATGGSTSHAP

SEQ ID NO: 897146 - protein, 10 aa, Mycobacterium
ATGGVGPQPW

SEQ ID NO: 897147 - protein, 19 aa, Mycobacterium
ATGHPSPEVAQSIDTTDNV

SEQ ID NO: 897148 - protein, 5 aa, Mycobacterium
ATGIR

SEQ ID NO: 897149 - protein, 4 aa, Mycobacterium
ATGK

SEQ ID NO: 897150 - protein, 22 aa, Mycobacterium
ATGKGDTREVPVGPNVGTAGGS

SEQ ID NO: 897151 - protein, 6 aa, Mycobacterium
ATGKRR

SEQ ID NO: 897152 - protein, 11 aa, Mycobacterium
ATGLAAPACSG

SEQ ID NO: 897153 - protein, 7 aa, Mycobacterium
ATGLSQA

SEQ ID NO: 897154 - protein, 7 aa, Mycobacterium
ATGMAER

SEQ ID NO: 897155 - protein, 5 aa, Mycobacterium
ATGMM

SEQ ID NO: 897156 - protein, 7 aa, Mycobacterium
ATGMSNG

SEQ ID NO: 897157 - protein, 16 aa, Mycobacterium
ATGNLPGLPQIPGIPG

SEQ ID NO: 897158 - protein, 7 aa, Mycobacterium
ATGNPLQ

SEQ ID NO: 897159 - protein, 7 aa, Mycobacterium
ATGNSTG

SEQ ID NO: 897160 - protein, 7 aa, Mycobacterium
ATGPENL

SEQ ID NO: 897161 - protein, 4 aa, Mycobacterium
ATGQ

SEQ ID NO: 897162 - protein, 6 aa, Mycobacterium
ATGQQV

SEQ ID NO: 897163 - protein, 6 aa, Mycobacterium
ATGQRI

SEQ ID NO: 897164 - protein, 13 aa, Mycobacterium
ATGQRQAKDPAAF

SEQ ID NO: 897165 - protein, 6 aa, Mycobacterium
ATGRDV

SEQ ID NO: 897166 - protein, 8 aa, Mycobacterium
ATGRGSRT

SEQ ID NO: 897167 - protein, 5 aa, Mycobacterium
ATGRI

SEQ ID NO: 897168 - protein, 7 aa, Mycobacterium
ATGRLSG

SEQ ID NO: 897169 - protein, 10 aa, Mycobacterium
ATGRSARTPA

SEQ ID NO: 897170 - protein, 18 aa, Mycobacterium
ATGSAAPIPPLSDAARAA

SEQ ID NO: 897171 - protein, 11 aa, Mycobacterium
ATGSDAVAQGG

SEQ ID NO: 897172 - protein, 15 aa, Mycobacterium
ATGSERKKSGSYYTP

SEQ ID NO: 897173 - protein, 13 aa, Mycobacterium
ATGSQTRKPGNAI

SEQ ID NO: 897174 - protein, 6 aa, Mycobacterium
ATGSSG

SEQ ID NO: 897175 - protein, 13 aa, Mycobacterium
ATGSTGKANAAPY

SEQ ID NO: 897176 - protein, 8 aa, Mycobacterium
ATGTAGSR

SEQ ID NO: 897177 - protein, 5 aa, Mycobacterium
ATGTD

SEQ ID NO: 897178 - protein, 5 aa, Mycobacterium
ATGTE

SEQ ID NO: 897179 - protein, 5 aa, Mycobacterium
ATGTF

SEQ ID NO: 897180 - protein, 10 aa, Mycobacterium
ATGTGKSATT

SEQ ID NO: 897181 - protein, 17 aa, Mycobacterium
ATGTSVGDVAESKAINN

SEQ ID NO: 897182 - protein, 5 aa, Mycobacterium
ATGTT

SEQ ID NO: 897183 - protein, 6 aa, Mycobacterium
ATGTTA

SEQ ID NO: 897184 - protein, 6 aa, Mycobacterium
ATGTTR

SEQ ID NO: 897185 - protein, 5 aa, Mycobacterium
ATGTW

SEQ ID NO: 897186 - protein, 7 aa, Mycobacterium
ATGVEGT

SEQ ID NO: 897187 - protein, 10 aa, Mycobacterium
ATGVRGNATP

SEQ ID NO: 897188 - protein, 7 aa, Mycobacterium
ATGVRTA

SEQ ID NO: 897189 - protein, 6 aa, Mycobacterium
ATGYTP

SEQ ID NO: 897190 - protein, 29 aa, Mycobacterium
ATHAGAQPAVPFDPPPPPPAAAPAQPQTP

SEQ ID NO: 897191 - protein, 12 aa, Mycobacterium
ATHASSASAQAE

SEQ ID NO: 897192 - protein, 6 aa, Mycobacterium
ATHGSG

SEQ ID NO: 897193 - protein, 27 aa, Mycobacterium
ATHQPPAATTSSKSGATSTAPTTMPGT

SEQ ID NO: 897194 - protein, 14 aa, Mycobacterium
ATHSIPGSITGDQF

SEQ ID NO: 897195 - protein, 18 aa, Mycobacterium
ATHTGADEQEQVQRSALT

SEQ ID NO: 897196 - protein, 6 aa, Mycobacterium
ATHTGN

SEQ ID NO: 897197 - protein, 11 aa, Mycobacterium
ATHTTRPPACR

SEQ ID NO: 897198 - protein, 17 aa, Mycobacterium
ATHTTRPPACSQNQQYR

SEQ ID NO: 897199 - protein, 12 aa, Mycobacterium
ATIEAKEGTVTP

SEQ ID NO: 897200 - protein, 6 aa, Mycobacterium
ATIGDP

SEQ ID NO: 897201 - protein, 18 aa, Mycobacterium
ATIGPSDTLTADSARDSI

SEQ ID NO: 897202 - protein, 7 aa, Mycobacterium
ATIGTES

SEQ ID NO: 897203 - protein, 7 aa, Mycobacterium
ATIPDHP

SEQ ID NO: 897204 - protein, 6 aa, Mycobacterium
ATIPRS

SEQ ID NO: 897205 - protein, 13 aa, Mycobacterium
ATISAGAPGDPLA

SEQ ID NO: 897206 - protein, 17 aa, Mycobacterium
ATISNSGLQRGPAEHGW

SEQ ID NO: 897207 - protein, 10 aa, Mycobacterium
ATKAESQMRV

SEQ ID NO: 897208 - protein, 6 aa, Mycobacterium
ATKAGM

SEQ ID NO: 897209 - protein, 6 aa, Mycobacterium
ATKDEL

SEQ ID NO: 897210 - protein, 7 aa, Mycobacterium
ATKGGVG

SEQ ID NO: 897211 - protein, 5 aa, Mycobacterium
ATKPY

SEQ ID NO: 897212 - protein, 6 aa, Mycobacterium
ATKRAE

SEQ ID NO: 897213 - protein, 7 aa, Mycobacterium
ATKSRVR

SEQ ID NO: 897214 - protein, 8 aa, Mycobacterium
ATKSRVRD

SEQ ID NO: 897215 - protein, 10 aa, Mycobacterium
ATKTRAGSIE

SEQ ID NO: 897216 - protein, 4 aa, Mycobacterium
ATLA

SEQ ID NO: 897217 - protein, 12 aa, Mycobacterium
ATLAARAEKTPQ

SEQ ID NO: 897218 - protein, 9 aa, Mycobacterium
ATLAEQGVS

SEQ ID NO: 897219 - protein, 6 aa, Mycobacterium
ATLAPV

SEQ ID NO: 897220 - protein, 10 aa, Mycobacterium
ATLASTGSAV

SEQ ID NO: 897221 - protein, 14 aa, Mycobacterium
ATLDSDPAKTWTPQ

SEQ ID NO: 897222 - protein, 8 aa, Mycobacterium
ATLKGNTA

SEQ ID NO: 897223 - protein, 10 aa, Mycobacterium
ATLPEDRSRE

SEQ ID NO: 897224 - protein, 13 aa, Mycobacterium
ATMPAASTGGGGL

SEQ ID NO: 897225 - protein, 4 aa, Mycobacterium
ATNA

SEQ ID NO: 897226 - protein, 13 aa, Mycobacterium
ATNDAATVAEGGT

SEQ ID NO: 897227 - protein, 4 aa, Mycobacterium
ATNG

SEQ ID NO: 897228 - protein, 19 aa, Mycobacterium
ATNGADGATNDAQERIRHE

SEQ ID NO: 897229 - protein, 5 aa, Mycobacterium
ATNGL

SEQ ID NO: 897230 - protein, 9 aa, Mycobacterium
ATNHGTTLG

SEQ ID NO: 897231 - protein, 12 aa, Mycobacterium
ATNNTAKDKGLF

SEQ ID NO: 897232 - protein, 6 aa, Mycobacterium
ATNPHA

SEQ ID NO: 897233 - protein, 5 aa, Mycobacterium
ATNQR

SEQ ID NO: 897234 - protein, 7 aa, Mycobacterium
ATNSEQA

SEQ ID NO: 897235 - protein, 4 aa, Mycobacterium
ATNT

SEQ ID NO: 897236 - protein, 5 aa, Mycobacterium
ATNVE

SEQ ID NO: 897237 - protein, 5 aa, Mycobacterium
ATPAE

SEQ ID NO: 897238 - protein, 14 aa, Mycobacterium
ATPAHADPSGNPDA

SEQ ID NO: 897239 - protein, 12 aa, Mycobacterium
ATPASADQTDDD

SEQ ID NO: 897240 - protein, 7 aa, Mycobacterium
ATPATLG

SEQ ID NO: 897241 - protein, 14 aa, Mycobacterium
ATPAVSHADPAGHQ

SEQ ID NO: 897242 - protein, 14 aa, Mycobacterium
ATPAVSSADCGDGE

SEQ ID NO: 897243 - protein, 10 aa, Mycobacterium
ATPDDNARHE

SEQ ID NO: 897244 - protein, 6 aa, Mycobacterium
ATPDDP

SEQ ID NO: 897245 - protein, 9 aa, Mycobacterium
ATPDFPIPA

SEQ ID NO: 897246 - protein, 13 aa, Mycobacterium
ATPDGAPGNDDLG

SEQ ID NO: 897247 - protein, 7 aa, Mycobacterium
ATPDNAF

SEQ ID NO: 897248 - protein, 14 aa, Mycobacterium
ATPDVAAGEIDPLS

SEQ ID NO: 897249 - protein, 5 aa, Mycobacterium
ATPFA

SEQ ID NO: 897250 - protein, 6 aa, Mycobacterium
ATPFAS

SEQ ID NO: 897251 - protein, 4 aa, Mycobacterium
ATPG

SEQ ID NO: 897252 - protein, 10 aa, Mycobacterium
ATPGASAGHG

SEQ ID NO: 897253 - protein, 10 aa, Mycobacterium
ATPGATARHA

SEQ ID NO: 897254 - protein, 18 aa, Mycobacterium
ATPGGKPMYTPKCRNVTD

SEQ ID NO: 897255 - protein, 18 aa, Mycobacterium
ATPGNKAQYTPKCRNLAD

SEQ ID NO: 897256 - protein, 18 aa, Mycobacterium
ATPGNVAQHTPRCRNLAN

SEQ ID NO: 897257 - protein, 18 aa, Mycobacterium
ATPGNVAQYTPRCRNMAN

SEQ ID NO: 897258 - protein, 7 aa, Mycobacterium
ATPGPEG

SEQ ID NO: 897259 - protein, 14 aa, Mycobacterium
ATPGPYELSQSGGE

SEQ ID NO: 897260 - protein, 14 aa, Mycobacterium
ATPGQDPGDSPGVR

SEQ ID NO: 897261 - protein, 10 aa, Mycobacterium
ATPGSAVAAG

SEQ ID NO: 897262 - protein, 8 aa, Mycobacterium
ATPGSIRR

SEQ ID NO: 897263 - protein, 4 aa, Mycobacterium
ATPH

SEQ ID NO: 897264 - protein, 12 aa, Mycobacterium
ATPLSAQAEPTV

SEQ ID NO: 897265 - protein, 9 aa, Mycobacterium
ATPNAPITR

SEQ ID NO: 897266 - protein, 14 aa, Mycobacterium
ATPPAPASAAPSTF

SEQ ID NO: 897267 - protein, 16 aa, Mycobacterium
ATPPAPQAPPAAGGGP

SEQ ID NO: 897268 - protein, 15 aa, Mycobacterium
ATPPDGHVHEVVIRP

SEQ ID NO: 897269 - protein, 19 aa, Mycobacterium
ATPPGQARTTTPAPAPREL

SEQ ID NO: 897270 - protein, 13 aa, Mycobacterium
ATPPHAQAGPAPV

SEQ ID NO: 897271 - protein, 24 aa, Mycobacterium
ATPPPVNAEAGAAPLEVPAGDSDA

SEQ ID NO: 897272 - protein, 23 aa, Mycobacterium
ATPPQEPQPPQALPGAGSAPLQA

SEQ ID NO: 897273 - protein, 9 aa, Mycobacterium
ATPPTEGLG

SEQ ID NO: 897274 - protein, 25 aa, Mycobacterium
ATPPTGNPNGQPGVATTFKDEDGSH

SEQ ID NO: 897275 - protein, 9 aa, Mycobacterium
ATPQGRRAA

SEQ ID NO: 897276 - protein, 13 aa, Mycobacterium
ATPQSAPTGGAIT

SEQ ID NO: 897277 - protein, 7 aa, Mycobacterium
ATPQSFR

SEQ ID NO: 897278 - protein, 9 aa, Mycobacterium
ATPQTQGEL

SEQ ID NO: 897279 - protein, 7 aa, Mycobacterium
ATPRADL

SEQ ID NO: 897280 - protein, 6 aa, Mycobacterium
ATPRGD

SEQ ID NO: 897281 - protein, 12 aa, Mycobacterium
ATPRGRFTPTPL

SEQ ID NO: 897282 - protein, 9 aa, Mycobacterium
ATPRRGGRT

SEQ ID NO: 897283 - protein, 13 aa, Mycobacterium
ATPSADQRAKPED

SEQ ID NO: 897284 - protein, 17 aa, Mycobacterium
ATPSAPQAPPSAGPGGP

SEQ ID NO: 897285 - protein, 5 aa, Mycobacterium
ATPSK

SEQ ID NO: 897286 - protein, 7 aa, Mycobacterium
ATPSKLT

SEQ ID NO: 897287 - protein, 8 aa, Mycobacterium
ATPSSDAV

SEQ ID NO: 897288 - protein, 9 aa, Mycobacterium
ATPTGVPET

SEQ ID NO: 897289 - protein, 4 aa, Mycobacterium
ATPV

SEQ ID NO: 897290 - protein, 11 aa, Mycobacterium
ATPVASADDCP

SEQ ID NO: 897291 - protein, 6 aa, Mycobacterium
ATPVDE

SEQ ID NO: 897292 - protein, 4 aa, Mycobacterium
ATQA

SEQ ID NO: 897293 - protein, 5 aa, Mycobacterium
ATQAG

SEQ ID NO: 897294 - protein, 8 aa, Mycobacterium
ATQAGPAL

SEQ ID NO: 897295 - protein, 10 aa, Mycobacterium
ATQAGSGTAL

SEQ ID NO: 897296 - protein, 5 aa, Mycobacterium
ATQDH

SEQ ID NO: 897297 - protein, 9 aa, Mycobacterium
ATQEEADAA

SEQ ID NO: 897298 - protein, 6 aa, Mycobacterium
ATQGDT

SEQ ID NO: 897299 - protein, 16 aa, Mycobacterium
ATQGGVGRGGYVERPG

SEQ ID NO: 897300 - protein, 7 aa, Mycobacterium
ATQPGTE

SEQ ID NO: 897301 - protein, 4 aa, Mycobacterium
ATQS

SEQ ID NO: 897302 - protein, 6 aa, Mycobacterium
ATQSQL

SEQ ID NO: 897303 - protein, 6 aa, Mycobacterium
ATQTGD

SEQ ID NO: 897304 - protein, 5 aa, Mycobacterium
ATRAA

SEQ ID NO: 897305 - protein, 7 aa, Mycobacterium
ATRAEPK

SEQ ID NO: 897306 - protein, 5 aa, Mycobacterium
ATRAG

SEQ ID NO: 897307 - protein, 6 aa, Mycobacterium
ATRAGG

SEQ ID NO: 897308 - protein, 14 aa, Mycobacterium
ATRALGAATQAKAA

SEQ ID NO: 897309 - protein, 12 aa, Mycobacterium
ATRAQSQTATPV

SEQ ID NO: 897310 - protein, 39 aa, Mycobacterium
ATRASAGYSSAARRAGDRAGRQARLGKSPELPGARTALD

SEQ ID NO: 897311 - protein, 10 aa, Mycobacterium
ATRDGYSSSF

SEQ ID NO: 897312 - protein, 7 aa, Mycobacterium
ATRESLE

SEQ ID NO: 897313 - protein, 6 aa, Mycobacterium
ATRGIK

SEQ ID NO: 897314 - protein, 7 aa, Mycobacterium
ATRGPAA

SEQ ID NO: 897315 - protein, 6 aa, Mycobacterium
ATRGPV

SEQ ID NO: 897316 - protein, 9 aa, Mycobacterium
ATRGYTQEK

SEQ ID NO: 897317 - protein, 4 aa, Mycobacterium
ATRI

SEQ ID NO: 897318 - protein, 7 aa, Mycobacterium
ATRIGST

SEQ ID NO: 897319 - protein, 6 aa, Mycobacterium
ATRNEG

SEQ ID NO: 897320 - protein, 6 aa, Mycobacterium
ATRPDK

SEQ ID NO: 897321 - protein, 11 aa, Mycobacterium
ATRPEPGPAPH

SEQ ID NO: 897322 - protein, 7 aa, Mycobacterium
ATRPGTV

SEQ ID NO: 897323 - protein, 8 aa, Mycobacterium
ATRSDDGA

SEQ ID NO: 897324 - protein, 8 aa, Mycobacterium
ATRSGTRQ

SEQ ID NO: 897325 - protein, 11 aa, Mycobacterium
ATRSKASKTPI

SEQ ID NO: 897326 - protein, 8 aa, Mycobacterium
ATRSSPDQ

SEQ ID NO: 897327 - protein, 25 aa, Mycobacterium
ATRTDDQPTESAPPPAQQAPPTPAE

SEQ ID NO: 897328 - protein, 13 aa, Mycobacterium
ATRTGEALSTRSN

SEQ ID NO: 897329 - protein, 19 aa, Mycobacterium
ATRVSNKAFQSKYKAAGGY

SEQ ID NO: 897330 - protein, 13 aa, Mycobacterium
ATRYRDDSAARGG

SEQ ID NO: 897331 - protein, 16 aa, Mycobacterium
ATSAAGSALAAGLGGE

SEQ ID NO: 897332 - protein, 21 aa, Mycobacterium
ATSAARHEAAADDAAPETKQD

SEQ ID NO: 897333 - protein, 10 aa, Mycobacterium
ATSAEPKIKT

SEQ ID NO: 897334 - protein, 8 aa, Mycobacterium
ATSAQVTA

SEQ ID NO: 897335 - protein, 4 aa, Mycobacterium
ATSD

SEQ ID NO: 897336 - protein, 6 aa, Mycobacterium
ATSEDL

SEQ ID NO: 897337 - protein, 16 aa, Mycobacterium
ATSEEVREDLGVARVA

SEQ ID NO: 897338 - protein, 20 aa, Mycobacterium
ATSGAAPGPAQGCESQQQAL

SEQ ID NO: 897339 - protein, 11 aa, Mycobacterium
ATSGAPARADG

SEQ ID NO: 897340 - protein, 7 aa, Mycobacterium
ATSGPDK

SEQ ID NO: 897341 - protein, 10 aa, Mycobacterium
ATSGRGPATP

SEQ ID NO: 897342 - protein, 10 aa, Mycobacterium
ATSGTGTENL

SEQ ID NO: 897343 - protein, 12 aa, Mycobacterium
ATSIRQSASRAG

SEQ ID NO: 897344 - protein, 5 aa, Mycobacterium
ATSKI

SEQ ID NO: 897345 - protein, 14 aa, Mycobacterium
ATSKRNRSYDPVSE

SEQ ID NO: 897346 - protein, 7 aa, Mycobacterium
ATSLAER

SEQ ID NO: 897347 - protein, 9 aa, Mycobacterium
ATSNGEWAR

SEQ ID NO: 897348 - protein, 13 aa, Mycobacterium
ATSNHDLTADPGL

SEQ ID NO: 897349 - protein, 9 aa, Mycobacterium
ATSPAAKSV

SEQ ID NO: 897350 - protein, 6 aa, Mycobacterium
ATSPKV

SEQ ID NO: 897351 - protein, 6 aa, Mycobacterium
ATSPQQ

SEQ ID NO: 897352 - protein, 17 aa, Mycobacterium
ATSPTGTPAGSLGWGDK

SEQ ID NO: 897353 - protein, 5 aa, Mycobacterium
ATSPV

SEQ ID NO: 897354 - protein, 10 aa, Mycobacterium
ATSQAQPVDI

SEQ ID NO: 897355 - protein, 9 aa, Mycobacterium
ATSQPTSAS

SEQ ID NO: 897356 - protein, 5 aa, Mycobacterium
ATSQY

SEQ ID NO: 897357 - protein, 7 aa, Mycobacterium
ATSREPI

SEQ ID NO: 897358 - protein, 5 aa, Mycobacterium
ATSRY

SEQ ID NO: 897359 - protein, 7 aa, Mycobacterium
ATSSDVD

SEQ ID NO: 897360 - protein, 8 aa, Mycobacterium
ATSSEMPP

SEQ ID NO: 897361 - protein, 7 aa, Mycobacterium
ATSSPAH

SEQ ID NO: 897362 - protein, 9 aa, Mycobacterium
ATSSPAPCA

SEQ ID NO: 897363 - protein, 8 aa, Mycobacterium
ATSSPAQL

SEQ ID NO: 897364 - protein, 15 aa, Mycobacterium
ATSTARPVTGPGPGK

SEQ ID NO: 897365 - protein, 16 aa, Mycobacterium
ATSTATPAQVVSATTH

SEQ ID NO: 897366 - protein, 15 aa, Mycobacterium
ATSTPHVASPAAPGK

SEQ ID NO: 897367 - protein, 9 aa, Mycobacterium
ATSTQVTAG

SEQ ID NO: 897368 - protein, 4 aa, Mycobacterium
ATSV

SEQ ID NO: 897369 - protein, 5 aa, Mycobacterium
ATSVD

SEQ ID NO: 897370 - protein, 7 aa, Mycobacterium
ATSVGKT

SEQ ID NO: 897371 - protein, 19 aa, Mycobacterium
ATSYGDNNNVSASTPGVGA

SEQ ID NO: 897372 - protein, 10 aa, Mycobacterium
ATTAAKNRAD

SEQ ID NO: 897373 - protein, 7 aa, Mycobacterium
ATTADAA

SEQ ID NO: 897374 - protein, 8 aa, Mycobacterium
ATTAEGPV

SEQ ID NO: 897375 - protein, 7 aa, Mycobacterium
ATTAGAA

SEQ ID NO: 897376 - protein, 20 aa, Mycobacterium
ATTAGSNNAVGASGVGVGGN

SEQ ID NO: 897377 - protein, 7 aa, Mycobacterium
ATTAPAE

SEQ ID NO: 897378 - protein, 7 aa, Mycobacterium
ATTAPTE

SEQ ID NO: 897379 - protein, 14 aa, Mycobacterium
ATTASATNVTLSEN

SEQ ID NO: 897380 - protein, 5 aa, Mycobacterium
ATTAW

SEQ ID NO: 897381 - protein, 10 aa, Mycobacterium
ATTCGASSAA

SEQ ID NO: 897382 - protein, 11 aa, Mycobacterium
ATTDAPGATAA

SEQ ID NO: 897383 - protein, 10 aa, Mycobacterium
ATTDPQSFAG

SEQ ID NO: 897384 - protein, 10 aa, Mycobacterium
ATTDPSPFDP

SEQ ID NO: 897385 - protein, 16 aa, Mycobacterium
ATTDQHSAGQPPHNTR

SEQ ID NO: 897386 - protein, 19 aa, Mycobacterium
ATTDSGDRDDLKPGVADRS

SEQ ID NO: 897387 - protein, 13 aa, Mycobacterium
ATTDYAKGGLTDA

SEQ ID NO: 897388 - protein, 5 aa, Mycobacterium
ATTEQ

SEQ ID NO: 897389 - protein, 16 aa, Mycobacterium
ATTEQHAAGQPPHNTR

SEQ ID NO: 897390 - protein, 16 aa, Mycobacterium
ATTEQRTSGQPPHNTR

SEQ ID NO: 897391 - protein, 7 aa, Mycobacterium
ATTGIAA

SEQ ID NO: 897392 - protein, 20 aa, Mycobacterium
ATTGPAASAAAALASGPAAA

SEQ ID NO: 897393 - protein, 5 aa, Mycobacterium
ATTGW

SEQ ID NO: 897394 - protein, 10 aa, Mycobacterium
ATTKNRKKFR

SEQ ID NO: 897395 - protein, 6 aa, Mycobacterium
ATTKQL

SEQ ID NO: 897396 - protein, 7 aa, Mycobacterium
ATTNGHV

SEQ ID NO: 897397 - protein, 12 aa, Mycobacterium
ATTNPDGSTGDG

SEQ ID NO: 897398 - protein, 8 aa, Mycobacterium
ATTNRRKR

SEQ ID NO: 897399 - protein, 6 aa, Mycobacterium
ATTPER

SEQ ID NO: 897400 - protein, 6 aa, Mycobacterium
ATTPFS

SEQ ID NO: 897401 - protein, 11 aa, Mycobacterium
ATTPPSVAPDG

SEQ ID NO: 897402 - protein, 5 aa, Mycobacterium
ATTPS

SEQ ID NO: 897403 - protein, 13 aa, Mycobacterium
ATTQTVTDQAGRT

SEQ ID NO: 897404 - protein, 4 aa, Mycobacterium
ATTR

SEQ ID NO: 897405 - protein, 15 aa, Mycobacterium
ATTRKACPQDTDQVE

SEQ ID NO: 897406 - protein, 9 aa, Mycobacterium
ATTRPNELT

SEQ ID NO: 897407 - protein, 24 aa, Mycobacterium
ATTSCTDTIAPGDSAYDNAHAAED

SEQ ID NO: 897408 - protein, 5 aa, Mycobacterium
ATTSG

SEQ ID NO: 897409 - protein, 6 aa, Mycobacterium
ATTSND

SEQ ID NO: 897410 - protein, 16 aa, Mycobacterium
ATTSPTEERRAVPEKV

SEQ ID NO: 897411 - protein, 16 aa, Mycobacterium
ATTTALPQTTTPAPET

SEQ ID NO: 897412 - protein, 7 aa, Mycobacterium
ATTTFEQ

SEQ ID NO: 897413 - protein, 16 aa, Mycobacterium
ATTTGRPLARAADGRE

SEQ ID NO: 897414 - protein, 7 aa, Mycobacterium
ATTTTPI

SEQ ID NO: 897415 - protein, 15 aa, Mycobacterium
ATTVQETDELPARSK

SEQ ID NO: 897416 - protein, 24 aa, Mycobacterium
ATTVQETDELPARSKKCTDAGQPA

SEQ ID NO: 897417 - protein, 17 aa, Mycobacterium
ATVAPTATLAAPESRSL

SEQ ID NO: 897418 - protein, 8 aa, Mycobacterium
ATVARPDQ

SEQ ID NO: 897419 - protein, 12 aa, Mycobacterium
ATVDSTTAAAVA

SEQ ID NO: 897420 - protein, 20 aa, Mycobacterium
ATVEAQGNPARTSASFAPDV

SEQ ID NO: 897421 - protein, 10 aa, Mycobacterium
ATVGGSGAIN

SEQ ID NO: 897422 - protein, 6 aa, Mycobacterium
ATVGQT

SEQ ID NO: 897423 - protein, 6 aa, Mycobacterium
ATVPAE

SEQ ID NO: 897424 - protein, 11 aa, Mycobacterium
ATVSPGPGQTV

SEQ ID NO: 897425 - protein, 8 aa, Mycobacterium
ATVSSQSA

SEQ ID NO: 897426 - protein, 22 aa, Mycobacterium
ATVTAGPAGPTVGTGPTVTPAA

SEQ ID NO: 897427 - protein, 8 aa, Mycobacterium
ATVTEQDG

SEQ ID NO: 897428 - protein, 8 aa, Mycobacterium
ATVTERDG

SEQ ID NO: 897429 - protein, 9 aa, Mycobacterium
ATVTERDGQ

SEQ ID NO: 897430 - protein, 6 aa, Mycobacterium
ATVTVT

SEQ ID NO: 897431 - protein, 5 aa, Mycobacterium
ATYAD

SEQ ID NO: 897432 - protein, 19 aa, Mycobacterium
ATYGDAASAISDSGGTPKI

SEQ ID NO: 897433 - protein, 6 aa, Mycobacterium
ATYGES

SEQ ID NO: 897434 - protein, 5 aa, Mycobacterium
ATYRP

SEQ ID NO: 897435 - protein, 6 aa, Mycobacterium
ATYSTT

SEQ ID NO: 897436 - protein, 11 aa, Mycobacterium
AVAAAAGRSWE

SEQ ID NO: 897437 - protein, 13 aa, Mycobacterium
AVAADTSGPIQTP

SEQ ID NO: 897438 - protein, 15 aa, Mycobacterium
AVAAESAGAAVAGGA

SEQ ID NO: 897439 - protein, 9 aa, Mycobacterium
AVAAPDALS

SEQ ID NO: 897440 - protein, 9 aa, Mycobacterium
AVAARGGNG

SEQ ID NO: 897441 - protein, 15 aa, Mycobacterium
AVAATDPGAADGAAA

SEQ ID NO: 897442 - protein, 12 aa, Mycobacterium
AVADGSAEHPSV

SEQ ID NO: 897443 - protein, 8 aa, Mycobacterium
AVADPAQC

SEQ ID NO: 897444 - protein, 131 aa, Mycobacterium
AVADTGSDTSGSAGASTSDSADRGPRATGDSARESRKPSLSNRTEASGGDGDSGDTSVGDADAADPSEEAGADETADDTGAGTAPEPSDVDVDDTADQLPEGDAETVPDLDTEPSGVDDLPPVSPEPQDAA

SEQ ID NO: 897445 - protein, 23 aa, Mycobacterium
AVAGEKSVDDALATAQAEAEKIQ

SEQ ID NO: 897446 - protein, 10 aa, Mycobacterium
AVAGPGGANI

SEQ ID NO: 897447 - protein, 5 aa, Mycobacterium
AVAGS

SEQ ID NO: 897448 - protein, 5 aa, Mycobacterium
AVAHP

SEQ ID NO: 897449 - protein, 15 aa, Mycobacterium
AVAKSEINPRGLPRQ

SEQ ID NO: 897450 - protein, 8 aa, Mycobacterium
AVAPGENL

SEQ ID NO: 897451 - protein, 22 aa, Mycobacterium
AVAPGLDRGPLSYTTRAPQPAA

SEQ ID NO: 897452 - protein, 6 aa, Mycobacterium
AVAQGR

SEQ ID NO: 897453 - protein, 7 aa, Mycobacterium
AVAQSTD

SEQ ID NO: 897454 - protein, 8 aa, Mycobacterium
AVARTELD

SEQ ID NO: 897455 - protein, 5 aa, Mycobacterium
AVASD

SEQ ID NO: 897456 - protein, 19 aa, Mycobacterium
AVATAGRAGAEPGRWPAER

SEQ ID NO: 897457 - protein, 11 aa, Mycobacterium
AVATGGSAPIT

SEQ ID NO: 897458 - protein, 6 aa, Mycobacterium
AVATNK

SEQ ID NO: 897459 - protein, 10 aa, Mycobacterium
AVDADGDSLT

SEQ ID NO: 897460 - protein, 6 aa, Mycobacterium
AVDEAQ

SEQ ID NO: 897461 - protein, 6 aa, Mycobacterium
AVDGGA

SEQ ID NO: 897462 - protein, 14 aa, Mycobacterium
AVDGPSGMKPGVQV

SEQ ID NO: 897463 - protein, 29 aa, Mycobacterium
AVDGPSGPRSDAPEPTGSVKNTNHGDEDK

SEQ ID NO: 897464 - protein, 7 aa, Mycobacterium
AVDGTLD

SEQ ID NO: 897465 - protein, 10 aa, Mycobacterium
AVDPAQAAAM

SEQ ID NO: 897466 - protein, 17 aa, Mycobacterium
AVDPASARGWTASGPGG

SEQ ID NO: 897467 - protein, 6 aa, Mycobacterium
AVDPRG

SEQ ID NO: 897468 - protein, 10 aa, Mycobacterium
AVDPSRPPAF

SEQ ID NO: 897469 - protein, 10 aa, Mycobacterium
AVDTDPRERA

SEQ ID NO: 897470 - protein, 16 aa, Mycobacterium
AVDTEGKFKEAADSYK

SEQ ID NO: 897471 - protein, 5 aa, Mycobacterium
AVEAY

SEQ ID NO: 897472 - protein, 9 aa, Mycobacterium
AVEEGDDAD

SEQ ID NO: 897473 - protein, 10 aa, Mycobacterium
AVEGGEIGRA

SEQ ID NO: 897474 - protein, 9 aa, Mycobacterium
AVEGGELRD

SEQ ID NO: 897475 - protein, 4 aa, Mycobacterium
AVEP

SEQ ID NO: 897476 - protein, 8 aa, Mycobacterium
AVEPANEA

SEQ ID NO: 897477 - protein, 8 aa, Mycobacterium
AVERADRA

SEQ ID NO: 897478 - protein, 4 aa, Mycobacterium
AVES

SEQ ID NO: 897479 - protein, 11 aa, Mycobacterium
AVESGAGEVPG

SEQ ID NO: 897480 - protein, 13 aa, Mycobacterium
AVETTGPSVDPDT

SEQ ID NO: 897481 - protein, 8 aa, Mycobacterium
AVGAAGDD

SEQ ID NO: 897482 - protein, 10 aa, Mycobacterium
AVGAPTDREP

SEQ ID NO: 897483 - protein, 10 aa, Mycobacterium
AVGDASVAPT

SEQ ID NO: 897484 - protein, 12 aa, Mycobacterium
AVGDVDPSGSAF

SEQ ID NO: 897485 - protein, 4 aa, Mycobacterium
AVGG

SEQ ID NO: 897486 - protein, 5 aa, Mycobacterium
AVGGA

SEQ ID NO: 897487 - protein, 13 aa, Mycobacterium
AVGGGDEDAHYAA

SEQ ID NO: 897488 - protein, 11 aa, Mycobacterium
AVGGPAKGRHA

SEQ ID NO: 897489 - protein, 15 aa, Mycobacterium
AVGGPDDPEFAPPRL

SEQ ID NO: 897490 - protein, 13 aa, Mycobacterium
AVGGPDDPEFHPP

SEQ ID NO: 897491 - protein, 11 aa, Mycobacterium
AVGGTPKDYAE

SEQ ID NO: 897492 - protein, 10 aa, Mycobacterium
AVGHDGKAIP

SEQ ID NO: 897493 - protein, 9 aa, Mycobacterium
AVGKGSSAH

SEQ ID NO: 897494 - protein, 12 aa, Mycobacterium
AVGLDGKAVPVS

SEQ ID NO: 897495 - protein, 4 aa, Mycobacterium
AVGN

SEQ ID NO: 897496 - protein, 5 aa, Mycobacterium
AVGNY

SEQ ID NO: 897497 - protein, 7 aa, Mycobacterium
AVGPAAP

SEQ ID NO: 897498 - protein, 43 aa, Mycobacterium
AVGPDAAVTPSQHVGAEPAADHSMPAEQGVPVSPLSADPPGLS

SEQ ID NO: 897499 - protein, 6 aa, Mycobacterium
AVGPST

SEQ ID NO: 897500 - protein, 10 aa, Mycobacterium
AVGRGEAGVD

SEQ ID NO: 897501 - protein, 9 aa, Mycobacterium
AVGRRSPRI

SEQ ID NO: 897502 - protein, 8 aa, Mycobacterium
AVGSPQRG

SEQ ID NO: 897503 - protein, 6 aa, Mycobacterium
AVGSRQ

SEQ ID NO: 897504 - protein, 14 aa, Mycobacterium
AVGTPTASAAPRCS

SEQ ID NO: 897505 - protein, 28 aa, Mycobacterium
AVGTRTGSGAAVTAGASSGADTAVTTHG

SEQ ID NO: 897506 - protein, 4 aa, Mycobacterium
AVGV

SEQ ID NO: 897507 - protein, 5 aa, Mycobacterium
AVHPD

SEQ ID NO: 897508 - protein, 17 aa, Mycobacterium
AVHQDASDLGLSDTGPT

SEQ ID NO: 897509 - protein, 21 aa, Mycobacterium
AVKDEQSSSGHHAQAFCLVKA

SEQ ID NO: 897510 - protein, 11 aa, Mycobacterium
AVKNRGPHTVT

SEQ ID NO: 897511 - protein, 20 aa, Mycobacterium
AVMPGKGDSAEGPNAEQKYP

SEQ ID NO: 897512 - protein, 8 aa, Mycobacterium
AVNGRGHE

SEQ ID NO: 897513 - protein, 6 aa, Mycobacterium
AVNGTA

SEQ ID NO: 897514 - protein, 7 aa, Mycobacterium
AVNGTPV

SEQ ID NO: 897515 - protein, 20 aa, Mycobacterium
AVNQDGASNGLTAPNGPAQQ

SEQ ID NO: 897516 - protein, 33 aa, Mycobacterium
AVPAAGGAVPAKAGESGAGADTARAAGPTGTGV

SEQ ID NO: 897517 - protein, 9 aa, Mycobacterium
AVPAAPSGE

SEQ ID NO: 897518 - protein, 15 aa, Mycobacterium
AVPADEVAGDRYTAQ

SEQ ID NO: 897519 - protein, 15 aa, Mycobacterium
AVPAEGYLSTGASPR

SEQ ID NO: 897520 - protein, 51 aa, Mycobacterium
AVPAPAPPNPANQAPNATQIAPDAAPIPAPAPPPPPDGSDAGGALGGATTS

SEQ ID NO: 897521 - protein, 6 aa, Mycobacterium
AVPDPR

SEQ ID NO: 897522 - protein, 6 aa, Mycobacterium
AVPDRD

SEQ ID NO: 897523 - protein, 8 aa, Mycobacterium
AVPDWDND

SEQ ID NO: 897524 - protein, 4 aa, Mycobacterium
AVPG

SEQ ID NO: 897525 - protein, 16 aa, Mycobacterium
AVPGDPRDTSTPRALA

SEQ ID NO: 897526 - protein, 9 aa, Mycobacterium
AVPGGQPAN

SEQ ID NO: 897527 - protein, 6 aa, Mycobacterium
AVPGGT

SEQ ID NO: 897528 - protein, 8 aa, Mycobacterium
AVPNQTAA

SEQ ID NO: 897529 - protein, 7 aa, Mycobacterium
AVPPAAG

SEQ ID NO: 897530 - protein, 8 aa, Mycobacterium
AVPPGVPA

SEQ ID NO: 897531 - protein, 17 aa, Mycobacterium
AVPPGVPASAVPPPMPA

SEQ ID NO: 897532 - protein, 14 aa, Mycobacterium
AVPPIASAEPAAGA

SEQ ID NO: 897533 - protein, 6 aa, Mycobacterium
AVPPSR

SEQ ID NO: 897534 - protein, 12 aa, Mycobacterium
AVPRASADPCSD

SEQ ID NO: 897535 - protein, 8 aa, Mycobacterium
AVPRQGAR

SEQ ID NO: 897536 - protein, 5 aa, Mycobacterium
AVPSW

SEQ ID NO: 897537 - protein, 16 aa, Mycobacterium
AVPTAIPSAAATDCPD

SEQ ID NO: 897538 - protein, 4 aa, Mycobacterium
AVPV

SEQ ID NO: 897539 - protein, 15 aa, Mycobacterium
AVQAADGHNLSRPSW

SEQ ID NO: 897540 - protein, 5 aa, Mycobacterium
AVQAV

SEQ ID NO: 897541 - protein, 9 aa, Mycobacterium
AVQDSDGQF

SEQ ID NO: 897542 - protein, 5 aa, Mycobacterium
AVQEA

SEQ ID NO: 897543 - protein, 10 aa, Mycobacterium
AVQGATPEQL

SEQ ID NO: 897544 - protein, 5 aa, Mycobacterium
AVQGV

SEQ ID NO: 897545 - protein, 13 aa, Mycobacterium
AVQKGEDLAETAA

SEQ ID NO: 897546 - protein, 9 aa, Mycobacterium
AVQPDGDQV

SEQ ID NO: 897547 - protein, 7 aa, Mycobacterium
AVQREDG

SEQ ID NO: 897548 - protein, 45 aa, Mycobacterium
AVQSRGAAPVTPVGAAGTTIADQPATVAASTTRTGGSAEPVPAVS

SEQ ID NO: 897549 - protein, 8 aa, Mycobacterium
AVQTDSAA

SEQ ID NO: 897550 - protein, 18 aa, Mycobacterium
AVRASGAAPENRQAKAMP

SEQ ID NO: 897551 - protein, 7 aa, Mycobacterium
AVRDGDT

SEQ ID NO: 897552 - protein, 7 aa, Mycobacterium
AVRGKNT

SEQ ID NO: 897553 - protein, 10 aa, Mycobacterium
AVRGRGGLSH

SEQ ID NO: 897554 - protein, 4 aa, Mycobacterium
AVRP

SEQ ID NO: 897555 - protein, 8 aa, Mycobacterium
AVRPASPY

SEQ ID NO: 897556 - protein, 10 aa, Mycobacterium
AVRPATPAYQ

SEQ ID NO: 897557 - protein, 9 aa, Mycobacterium
AVRPGRDVT

SEQ ID NO: 897558 - protein, 5 aa, Mycobacterium
AVRPR

SEQ ID NO: 897559 - protein, 7 aa, Mycobacterium
AVRRADD

SEQ ID NO: 897560 - protein, 9 aa, Mycobacterium
AVRTPAATY

SEQ ID NO: 897561 - protein, 8 aa, Mycobacterium
AVSAPPPA

SEQ ID NO: 897562 - protein, 15 aa, Mycobacterium
AVSGNNGVDPKEAAQ

SEQ ID NO: 897563 - protein, 15 aa, Mycobacterium
AVSGNSGIDPDEAAR

SEQ ID NO: 897564 - protein, 11 aa, Mycobacterium
AVSGPKLTAPV

SEQ ID NO: 897565 - protein, 12 aa, Mycobacterium
AVSGPKLTSPVT

SEQ ID NO: 897566 - protein, 5 aa, Mycobacterium
AVSGS

SEQ ID NO: 897567 - protein, 4 aa, Mycobacterium
AVSP

SEQ ID NO: 897568 - protein, 23 aa, Mycobacterium
AVSPAPSALSGALGSGALGGNAA

SEQ ID NO: 897569 - protein, 9 aa, Mycobacterium
AVSPDRPVT

SEQ ID NO: 897570 - protein, 6 aa, Mycobacterium
AVSPDT

SEQ ID NO: 897571 - protein, 9 aa, Mycobacterium
AVSPEKAAE

SEQ ID NO: 897572 - protein, 9 aa, Mycobacterium
AVSPEPDTS

SEQ ID NO: 897573 - protein, 13 aa, Mycobacterium
AVSPGREVREPPA

SEQ ID NO: 897574 - protein, 6 aa, Mycobacterium
AVSPQV

SEQ ID NO: 897575 - protein, 7 aa, Mycobacterium
AVSRGAK

SEQ ID NO: 897576 - protein, 8 aa, Mycobacterium
AVSSASGL

SEQ ID NO: 897577 - protein, 5 aa, Mycobacterium
AVSSD

SEQ ID NO: 897578 - protein, 8 aa, Mycobacterium
AVSSRFPG

SEQ ID NO: 897579 - protein, 7 aa, Mycobacterium
AVSTDDS

SEQ ID NO: 897580 - protein, 13 aa, Mycobacterium
AVSTVEDPASSNV

SEQ ID NO: 897581 - protein, 179 aa, Mycobacterium
AVTEKTQAKVTTLTKPRPQAADEAGDEADAEPSEPSESSESEPSGSETPETSDTKKPMTVAKDSGSEDKAVTKPADAKPEPKEKSEDTSAGKRGRHSSGLTAKPSDKESAPKHRAPDSDTASAKPSREKNSAPKHAAAAKDDRQTKPRAAHGAAAKDAGARDKQHKQDKQDKQAASAAK

SEQ ID NO: 897582 - protein, 10 aa, Mycobacterium
AVTGSPATKK

SEQ ID NO: 897583 - protein, 7 aa, Mycobacterium
AVTKGTD

SEQ ID NO: 897584 - protein, 12 aa, Mycobacterium
AVTQTSANDQTH

SEQ ID NO: 897585 - protein, 8 aa, Mycobacterium
AVTRNRAT

SEQ ID NO: 897586 - protein, 4 aa, Mycobacterium
AVTS

SEQ ID NO: 897587 - protein, 4 aa, Mycobacterium
AVYG

SEQ ID NO: 897588 - protein, 10 aa, Mycobacterium
AVYGEGSWQS

SEQ ID NO: 897589 - protein, 5 aa, Mycobacterium
AWAGG

SEQ ID NO: 897590 - protein, 12 aa, Mycobacterium
AWANDSVSCPRS

SEQ ID NO: 897591 - protein, 17 aa, Mycobacterium
AWAQPAGGDINPEDACG

SEQ ID NO: 897592 - protein, 20 aa, Mycobacterium
AWDDDNDAPLGHNGCDTRDD

SEQ ID NO: 897593 - protein, 8 aa, Mycobacterium
AWGGSGSR

SEQ ID NO: 897594 - protein, 7 aa, Mycobacterium
AWGPQGH

SEQ ID NO: 897595 - protein, 23 aa, Mycobacterium
AWGTPRASAGPDVPPVSDAARAA

SEQ ID NO: 897596 - protein, 8 aa, Mycobacterium
AWPAAPGR

SEQ ID NO: 897597 - protein, 5 aa, Mycobacterium
AWPAD

SEQ ID NO: 897598 - protein, 45 aa, Mycobacterium
AWPPQRPRAAAHPCGGHPGRGRSARRDPAGAKAPRRSARDGDHRA

SEQ ID NO: 897599 - protein, 8 aa, Mycobacterium
AWPPSACA

SEQ ID NO: 897600 - protein, 9 aa, Mycobacterium
AWPSDADEL

SEQ ID NO: 897601 - protein, 4 aa, Mycobacterium
AWQA

SEQ ID NO: 897602 - protein, 8 aa, Mycobacterium
AWQGPASK

SEQ ID NO: 897603 - protein, 8 aa, Mycobacterium
AWQGPTAA

SEQ ID NO: 897604 - protein, 7 aa, Mycobacterium
AWRQSGE

SEQ ID NO: 897605 - protein, 6 aa, Mycobacterium
AWRTTD

SEQ ID NO: 897606 - protein, 7 aa, Mycobacterium
AWSGPDD

SEQ ID NO: 897607 - protein, 5 aa, Mycobacterium
AWSPG

SEQ ID NO: 897608 - protein, 10 aa, Mycobacterium
AWSRTYSPAP

SEQ ID NO: 897609 - protein, 5 aa, Mycobacterium
AWSSL

SEQ ID NO: 897610 - protein, 11 aa, Mycobacterium
AWTGGGSDKAI

SEQ ID NO: 897611 - protein, 5 aa, Mycobacterium
AWTPD

SEQ ID NO: 897612 - protein, 13 aa, Mycobacterium
AYAASKAGLSSLG

SEQ ID NO: 897613 - protein, 7 aa, Mycobacterium
AYADDDA

SEQ ID NO: 897614 - protein, 6 aa, Mycobacterium
AYADSG

SEQ ID NO: 897615 - protein, 26 aa, Mycobacterium
AYAGRPAAGWAPGLGERDRWSGTDTP

SEQ ID NO: 897616 - protein, 9 aa, Mycobacterium
AYAQAEAAN

SEQ ID NO: 897617 - protein, 5 aa, Mycobacterium
AYATS

SEQ ID NO: 897618 - protein, 16 aa, Mycobacterium
AYDEPASVAYRGRAEV

SEQ ID NO: 897619 - protein, 8 aa, Mycobacterium
AYDEPESV

SEQ ID NO: 897620 - protein, 10 aa, Mycobacterium
AYDGSDDDDS

SEQ ID NO: 897621 - protein, 10 aa, Mycobacterium
AYDKRGNDIT

SEQ ID NO: 897622 - protein, 10 aa, Mycobacterium
AYDNAGNDIT

SEQ ID NO: 897623 - protein, 9 aa, Mycobacterium
AYDNEGDAL

SEQ ID NO: 897624 - protein, 5 aa, Mycobacterium
AYDNP

SEQ ID NO: 897625 - protein, 4 aa, Mycobacterium
AYDP

SEQ ID NO: 897626 - protein, 9 aa, Mycobacterium
AYDPGPAHN

SEQ ID NO: 897627 - protein, 8 aa, Mycobacterium
AYDPTNNE

SEQ ID NO: 897628 - protein, 10 aa, Mycobacterium
AYDRDGNDIT

SEQ ID NO: 897629 - protein, 7 aa, Mycobacterium
AYESDDG

SEQ ID NO: 897630 - protein, 9 aa, Mycobacterium
AYESDDGQT

SEQ ID NO: 897631 - protein, 10 aa, Mycobacterium
AYGAQKAGID

SEQ ID NO: 897632 - protein, 16 aa, Mycobacterium
AYGGASEGRRLAALAD

SEQ ID NO: 897633 - protein, 8 aa, Mycobacterium
AYGGEADV

SEQ ID NO: 897634 - protein, 6 aa, Mycobacterium
AYGPAK

SEQ ID NO: 897635 - protein, 5 aa, Mycobacterium
AYGQG

SEQ ID NO: 897636 - protein, 7 aa, Mycobacterium
AYGSDGR

SEQ ID NO: 897637 - protein, 11 aa, Mycobacterium
AYGSNAPLTRE

SEQ ID NO: 897638 - protein, 11 aa, Mycobacterium
AYGVGPQGKRL

SEQ ID NO: 897639 - protein, 10 aa, Mycobacterium
AYHDARPELA

SEQ ID NO: 897640 - protein, 9 aa, Mycobacterium
AYNAGELNA

SEQ ID NO: 897641 - protein, 10 aa, Mycobacterium
AYNDPAGDYP

SEQ ID NO: 897642 - protein, 13 aa, Mycobacterium
AYNPTGSGAGREQ

SEQ ID NO: 897643 - protein, 16 aa, Mycobacterium
AYPGKQGLSGGGESWS

SEQ ID NO: 897644 - protein, 6 aa, Mycobacterium
AYPGRV

SEQ ID NO: 897645 - protein, 15 aa, Mycobacterium
AYPPVAQAEPEQLSA

SEQ ID NO: 897646 - protein, 27 aa, Mycobacterium
AYPSDATSYENNVNTDLAANARTALAT

SEQ ID NO: 897647 - protein, 9 aa, Mycobacterium
AYQRDPNTP

SEQ ID NO: 897648 - protein, 13 aa, Mycobacterium
AYQSARRSGSVEN

SEQ ID NO: 897649 - protein, 12 aa, Mycobacterium
AYRDGDGATMAD

SEQ ID NO: 897650 - protein, 9 aa, Mycobacterium
AYRDSGPVM

SEQ ID NO: 897651 - protein, 10 aa, Mycobacterium
AYRRSDGQWG

SEQ ID NO: 897652 - protein, 11 aa, Mycobacterium
AYRSEGPTLPD

SEQ ID NO: 897653 - protein, 9 aa, Mycobacterium
AYRSSGPVM

SEQ ID NO: 897654 - protein, 13 aa, Mycobacterium
AYSASKAGVTSLG

SEQ ID NO: 897655 - protein, 7 aa, Mycobacterium
AYSLGGP

SEQ ID NO: 897656 - protein, 4 aa, Mycobacterium
AYSP

SEQ ID NO: 897657 - protein, 10 aa, Mycobacterium
AYSPNGSAVS

SEQ ID NO: 897658 - protein, 20 aa, Mycobacterium
AYSPNGTDVSISRRKRGGNI

SEQ ID NO: 897659 - protein, 7 aa, Mycobacterium
AYSSMGP

SEQ ID NO: 897660 - protein, 7 aa, Mycobacterium
AYSSPMN

SEQ ID NO: 897661 - protein, 11 aa, Mycobacterium
AYSTDNGENFT

SEQ ID NO: 897662 - protein, 15 aa, Mycobacterium
AYTEGDEMADGTSIG

SEQ ID NO: 897663 - protein, 10 aa, Mycobacterium
AYTPNENFHG

SEQ ID NO: 897664 - protein, 6 aa, Mycobacterium
AYTSGR

SEQ ID NO: 897665 - protein, 8 aa, Mycobacterium
AYTTAGGR

SEQ ID NO: 897666 - protein, 13 aa, Mycobacterium
AYTTDVATLSCCA

SEQ ID NO: 897667 - protein, 5 aa, Mycobacterium
CAANG

SEQ ID NO: 897668 - protein, 5 aa, Mycobacterium
CAAPA

SEQ ID NO: 897669 - protein, 39 aa, Mycobacterium
CAAPPPAYAPPPAPGVPPPPPAGWAPPPPAWAPPPAPAV

SEQ ID NO: 897670 - protein, 12 aa, Mycobacterium
CAASQTDPSRSI

SEQ ID NO: 897671 - protein, 22 aa, Mycobacterium
CADDPAPETLPAVGDGTSTERL

SEQ ID NO: 897672 - protein, 17 aa, Mycobacterium
CADGKSVNVGGSNNTLT

SEQ ID NO: 897673 - protein, 4 aa, Mycobacterium
CAEA

SEQ ID NO: 897674 - protein, 12 aa, Mycobacterium
CAEAKTDGGQGL

SEQ ID NO: 897675 - protein, 16 aa, Mycobacterium
CAENDSCPLGTDPAKA

SEQ ID NO: 897676 - protein, 11 aa, Mycobacterium
CAGGTDNGGTY

SEQ ID NO: 897677 - protein, 8 aa, Mycobacterium
CAGHPEVT

SEQ ID NO: 897678 - protein, 6 aa, Mycobacterium
CAGQTT

SEQ ID NO: 897679 - protein, 6 aa, Mycobacterium
CAGTPS

SEQ ID NO: 897680 - protein, 16 aa, Mycobacterium
CAKQPSCPLGTDPAKA

SEQ ID NO: 897681 - protein, 17 aa, Mycobacterium
CAKSPDCPLGTDPAKAV

SEQ ID NO: 897682 - protein, 19 aa, Mycobacterium
CAKSPSCPLGTDPAQATAR

SEQ ID NO: 897683 - protein, 4 aa, Mycobacterium
CANN

SEQ ID NO: 897684 - protein, 10 aa, Mycobacterium
CANTADGQQY

SEQ ID NO: 897685 - protein, 6 aa, Mycobacterium
CAPDED

SEQ ID NO: 897686 - protein, 10 aa, Mycobacterium
CAPGETGVTN

SEQ ID NO: 897687 - protein, 27 aa, Mycobacterium
CAPGGPAAGGAAAGGTPAAGGGAAAGG

SEQ ID NO: 897688 - protein, 10 aa, Mycobacterium
CAPGPSAGPH

SEQ ID NO: 897689 - protein, 21 aa, Mycobacterium
CAPPATTTSGRITTSNAGCVN

SEQ ID NO: 897690 - protein, 18 aa, Mycobacterium
CAPSPSPQANAANPGRQI

SEQ ID NO: 897691 - protein, 17 aa, Mycobacterium
CAPTTSTTGCGGVIDCV

SEQ ID NO: 897692 - protein, 16 aa, Mycobacterium
CARGAGANATPTASAA

SEQ ID NO: 897693 - protein, 6 aa, Mycobacterium
CASDDD

SEQ ID NO: 897694 - protein, 11 aa, Mycobacterium
CATAPAAPPIA

SEQ ID NO: 897695 - protein, 18 aa, Mycobacterium
CATDGRTNPDGSTGPLLR

SEQ ID NO: 897696 - protein, 13 aa, Mycobacterium
CATDTGGDPRARA

SEQ ID NO: 897697 - protein, 10 aa, Mycobacterium
CATGGTTRRD

SEQ ID NO: 897698 - protein, 18 aa, Mycobacterium
CATGKSLNVAGSDNTLTV

SEQ ID NO: 897699 - protein, 21 aa, Mycobacterium
CATGPDSDTSVTSAASGAEAP

SEQ ID NO: 897700 - protein, 8 aa, Mycobacterium
CATGSQLT

SEQ ID NO: 897701 - protein, 12 aa, Mycobacterium
CATGTPRQYASA

SEQ ID NO: 897702 - protein, 4 aa, Mycobacterium
CATM

SEQ ID NO: 897703 - protein, 5 aa, Mycobacterium
CATNG

SEQ ID NO: 897704 - protein, 8 aa, Mycobacterium
CATSSSGP

SEQ ID NO: 897705 - protein, 4 aa, Mycobacterium
CATY

SEQ ID NO: 897706 - protein, 11 aa, Mycobacterium
CCGRSGREGVD

SEQ ID NO: 897707 - protein, 17 aa, Mycobacterium
CDASSGPVAGSGDPRQV

SEQ ID NO: 897708 - protein, 6 aa, Mycobacterium
CDETAA

SEQ ID NO: 897709 - protein, 11 aa, Mycobacterium
CDGAPDAGPNV

SEQ ID NO: 897710 - protein, 17 aa, Mycobacterium
CDGAPGGAFTYPFTLVR

SEQ ID NO: 897711 - protein, 17 aa, Mycobacterium
CDGAPGGTFTYPFSLVR

SEQ ID NO: 897712 - protein, 4 aa, Mycobacterium
CDGD

SEQ ID NO: 897713 - protein, 11 aa, Mycobacterium
CDGHDGSSWTY

SEQ ID NO: 897714 - protein, 4 aa, Mycobacterium
CDNT

SEQ ID NO: 897715 - protein, 5 aa, Mycobacterium
CDPAG

SEQ ID NO: 897716 - protein, 5 aa, Mycobacterium
CDPDT

SEQ ID NO: 897717 - protein, 8 aa, Mycobacterium
CDPPTEGG

SEQ ID NO: 897718 - protein, 7 aa, Mycobacterium
CDQPNAF

SEQ ID NO: 897719 - protein, 7 aa, Mycobacterium
CDRTGDV

SEQ ID NO: 897720 - protein, 11 aa, Mycobacterium
CDSHDGAEWTY

SEQ ID NO: 897721 - protein, 15 aa, Mycobacterium
CDSPPSAPAPGVNPR

SEQ ID NO: 897722 - protein, 14 aa, Mycobacterium
CDTGASAPIRPPVP

SEQ ID NO: 897723 - protein, 10 aa, Mycobacterium
CDTTQTQGEL

SEQ ID NO: 897724 - protein, 37 aa, Mycobacterium
CEANSAAPGGGATGDFNSAGSVYQAPDHTGFPASGDL

SEQ ID NO: 897725 - protein, 13 aa, Mycobacterium
CEANSAGPTGGPV

SEQ ID NO: 897726 - protein, 12 aa, Mycobacterium
CEAPRQTATGDD

SEQ ID NO: 897727 - protein, 5 aa, Mycobacterium
CEDPR

SEQ ID NO: 897728 - protein, 16 aa, Mycobacterium
CEPNSVAPTGGPPGNF

SEQ ID NO: 897729 - protein, 12 aa, Mycobacterium
CEQDPRARTGEG

SEQ ID NO: 897730 - protein, 7 aa, Mycobacterium
CESGGNW

SEQ ID NO: 897731 - protein, 16 aa, Mycobacterium
CESGGNWGINTGNGYY

SEQ ID NO: 897732 - protein, 18 aa, Mycobacterium
CESGGNWHANTGNGNYGG

SEQ ID NO: 897733 - protein, 8 aa, Mycobacterium
CESGGNWS

SEQ ID NO: 897734 - protein, 18 aa, Mycobacterium
CESGGNWSANTGNGAYGG

SEQ ID NO: 897735 - protein, 15 aa, Mycobacterium
CESGGNWSANTGNGF

SEQ ID NO: 897736 - protein, 17 aa, Mycobacterium
CESGGNWSTNTGNGHYG

SEQ ID NO: 897737 - protein, 8 aa, Mycobacterium
CESPEYDR

SEQ ID NO: 897738 - protein, 10 aa, Mycobacterium
CESQLADADR

SEQ ID NO: 897739 - protein, 16 aa, Mycobacterium
CETGPSDQKRIPPGSE

SEQ ID NO: 897740 - protein, 17 aa, Mycobacterium
CETPQTQGELPVNERDP

SEQ ID NO: 897741 - protein, 7 aa, Mycobacterium
CETSDGL

SEQ ID NO: 897742 - protein, 5 aa, Mycobacterium
CGAAS

SEQ ID NO: 897743 - protein, 9 aa, Mycobacterium
CGAGGDCGR

SEQ ID NO: 897744 - protein, 24 aa, Mycobacterium
CGAGQISQTANQSSAINGGSANLG

SEQ ID NO: 897745 - protein, 24 aa, Mycobacterium
CGAPDRPVTPPSSPAAPGDGFESA

SEQ ID NO: 897746 - protein, 6 aa, Mycobacterium
CGAPGL

SEQ ID NO: 897747 - protein, 7 aa, Mycobacterium
CGAPGYP

SEQ ID NO: 897748 - protein, 9 aa, Mycobacterium
CGAQSGPPT

SEQ ID NO: 897749 - protein, 7 aa, Mycobacterium
CGARGGV

SEQ ID NO: 897750 - protein, 29 aa, Mycobacterium
CGDANQSPSSWHKDGSAANAGQAACGTYQ

SEQ ID NO: 897751 - protein, 52 aa, Mycobacterium
CGDGDTSTPPTSGPTSEETSVTTTTTTAPSSAPPEPAPPAPTEKSIDPTGGN

SEQ ID NO: 897752 - protein, 7 aa, Mycobacterium
CGDGLTP

SEQ ID NO: 897753 - protein, 9 aa, Mycobacterium
CGDGLTPRA

SEQ ID NO: 897754 - protein, 21 aa, Mycobacterium
CGDNNSSSGSSGKQASVDCGG

SEQ ID NO: 897755 - protein, 6 aa, Mycobacterium
CGDPAA

SEQ ID NO: 897756 - protein, 22 aa, Mycobacterium
CGDSGQSPTNWHQGSNSANAGQ

SEQ ID NO: 897757 - protein, 5 aa, Mycobacterium
CGDTD

SEQ ID NO: 897758 - protein, 9 aa, Mycobacterium
CGEATADSV

SEQ ID NO: 897759 - protein, 11 aa, Mycobacterium
CGEPQRAGTDD

SEQ ID NO: 897760 - protein, 9 aa, Mycobacterium
CGEPRYDNK

SEQ ID NO: 897761 - protein, 19 aa, Mycobacterium
CGGAGGDQTVRTAYVPRSI

SEQ ID NO: 897762 - protein, 17 aa, Mycobacterium
CGGAGSQVASEDFPKKG

SEQ ID NO: 897763 - protein, 11 aa, Mycobacterium
CGGDAGNAAPI

SEQ ID NO: 897764 - protein, 7 aa, Mycobacterium
CGGDGTV

SEQ ID NO: 897765 - protein, 10 aa, Mycobacterium
CGGEPSIPFN

SEQ ID NO: 897766 - protein, 4 aa, Mycobacterium
CGGG

SEQ ID NO: 897767 - protein, 19 aa, Mycobacterium
CGGGASDVVGGGGPADAHT

SEQ ID NO: 897768 - protein, 9 aa, Mycobacterium
CGGHPAHPH

SEQ ID NO: 897769 - protein, 28 aa, Mycobacterium
CGGNASEPSKENTSSTKAQAPATAAPAA

SEQ ID NO: 897770 - protein, 7 aa, Mycobacterium
CGGNGTP

SEQ ID NO: 897771 - protein, 6 aa, Mycobacterium
CGGPGA

SEQ ID NO: 897772 - protein, 17 aa, Mycobacterium
CGGPGAPVAAEGAEAKG

SEQ ID NO: 897773 - protein, 18 aa, Mycobacterium
CGGPGAPVAAEGAEDKGV

SEQ ID NO: 897774 - protein, 10 aa, Mycobacterium
CGGQPDGADT

SEQ ID NO: 897775 - protein, 40 aa, Mycobacterium
CGGSEQAQESESTQSSASSSQPAAQPSTPAPAAGDDEQEI

SEQ ID NO: 897776 - protein, 11 aa, Mycobacterium
CGGSGPSESHP

SEQ ID NO: 897777 - protein, 9 aa, Mycobacterium
CGGSGSDGV

SEQ ID NO: 897778 - protein, 23 aa, Mycobacterium
CGGSGTDNAESGSTEAGSGTQAA

SEQ ID NO: 897779 - protein, 52 aa, Mycobacterium
CGGSNSPSADDAASTGSESQAATPASSTEAAAAGKVNTRYDDAQTPDAEQGR

SEQ ID NO: 897780 - protein, 12 aa, Mycobacterium
CGGSTEAPTPQV

SEQ ID NO: 897781 - protein, 54 aa, Mycobacterium
CGGSTNSQAAENSPSGNQSSQASNTATTAEPASAARMNPRYEDAETPEAQQGRQ

SEQ ID NO: 897782 - protein, 17 aa, Mycobacterium
CGGTSAKQAEKKEQPAL

SEQ ID NO: 897783 - protein, 9 aa, Mycobacterium
CGKPANAAQ

SEQ ID NO: 897784 - protein, 42 aa, Mycobacterium
CGNNKSQPSTSKTGSPTSATSAPSGASSAPPSSAGPAQPNDY

SEQ ID NO: 897785 - protein, 6 aa, Mycobacterium
CGNTDS

SEQ ID NO: 897786 - protein, 7 aa, Mycobacterium
CGPAESP

SEQ ID NO: 897787 - protein, 5 aa, Mycobacterium
CGPAL

SEQ ID NO: 897788 - protein, 5 aa, Mycobacterium
CGPGD

SEQ ID NO: 897789 - protein, 6 aa, Mycobacterium
CGPHSV

SEQ ID NO: 897790 - protein, 14 aa, Mycobacterium
CGPPTSTTTGDVTT

SEQ ID NO: 897791 - protein, 8 aa, Mycobacterium
CGPQGSSY

SEQ ID NO: 897792 - protein, 9 aa, Mycobacterium
CGPSGTDNR

SEQ ID NO: 897793 - protein, 14 aa, Mycobacterium
CGQAGPGGSQTGSI

SEQ ID NO: 897794 - protein, 12 aa, Mycobacterium
CGQNPDAAGPAL

SEQ ID NO: 897795 - protein, 8 aa, Mycobacterium
CGRPAAPV

SEQ ID NO: 897796 - protein, 19 aa, Mycobacterium
CGRSAEGGGGGDGDAKGTV

SEQ ID NO: 897797 - protein, 13 aa, Mycobacterium
CGRSDDPDGPIEA

SEQ ID NO: 897798 - protein, 45 aa, Mycobacterium
CGRTDDQAQHTTAASGSSSGATPPGSSTNSAPAGPAPGTAPPAFG

SEQ ID NO: 897799 - protein, 13 aa, Mycobacterium
CGSATEKVEAATG

SEQ ID NO: 897800 - protein, 43 aa, Mycobacterium
CGSDNNAPATGTSGAAPSGSAASAECGGKNSLTAEGSTAQQNA

SEQ ID NO: 897801 - protein, 38 aa, Mycobacterium
CGSDNTTGASSSSAVSASGDCAGKAKLSAEGSSAQKNA

SEQ ID NO: 897802 - protein, 19 aa, Mycobacterium
CGSDSGSNAGSAEGGSGGK

SEQ ID NO: 897803 - protein, 61 aa, Mycobacterium
CGSDTGKNTEEGQPAESSSVSAPASTSAEAAPPTVAPGEVGVSPGGVTTAVGAPAQSTEEE

SEQ ID NO: 897804 - protein, 47 aa, Mycobacterium
CGSEEEAPETTTPTTTTTTTTTSPAETPAPPPPVEPTEKSINPTGGN

SEQ ID NO: 897805 - protein, 16 aa, Mycobacterium
CGSESEPAAESGATTI

SEQ ID NO: 897806 - protein, 21 aa, Mycobacterium
CGSESSDTNTPSATAGSSGVN

SEQ ID NO: 897807 - protein, 11 aa, Mycobacterium
CGSGDDGSGGI

SEQ ID NO: 897808 - protein, 18 aa, Mycobacterium
CGSGGQFAGPGGVPGGTG

SEQ ID NO: 897809 - protein, 18 aa, Mycobacterium
CGSGGQNAGPGGIPGGQG

SEQ ID NO: 897810 - protein, 38 aa, Mycobacterium
CGSGGSDGGGEQTSAAPASPSESTVSPSDMTDQQQAPS

SEQ ID NO: 897811 - protein, 12 aa, Mycobacterium
CGSGSDEADSAD

SEQ ID NO: 897812 - protein, 27 aa, Mycobacterium
CGSHGSSSNAKSESEPTSSSAPAERHT

SEQ ID NO: 897813 - protein, 42 aa, Mycobacterium
CGSKTETKTSTSTSSSTSSTSTTSASSTSATPGAQAKKTISD

SEQ ID NO: 897814 - protein, 27 aa, Mycobacterium
CGSNDSEPTTTTETGGSQSETPTGHGS

SEQ ID NO: 897815 - protein, 8 aa, Mycobacterium
CGSPEEVP

SEQ ID NO: 897816 - protein, 7 aa, Mycobacterium
CGSQTGG

SEQ ID NO: 897817 - protein, 43 aa, Mycobacterium
CGSQTTGDATTAQETPSASETSSTSSTTPAAPTSPSPAAAPGI

SEQ ID NO: 897818 - protein, 19 aa, Mycobacterium
CGSSGGNSALAADAPVSGR

SEQ ID NO: 897819 - protein, 35 aa, Mycobacterium
CGSSNKSSPTTSTSTSTSVVTSTTTSPAPATGEAR

SEQ ID NO: 897820 - protein, 16 aa, Mycobacterium
CGSTAGFSYRSDAARE

SEQ ID NO: 897821 - protein, 8 aa, Mycobacterium
CGSTEPRQ

SEQ ID NO: 897822 - protein, 6 aa, Mycobacterium
CGTDAA

SEQ ID NO: 897823 - protein, 12 aa, Mycobacterium
CGTDAGDHRPRP

SEQ ID NO: 897824 - protein, 6 aa, Mycobacterium
CGTDGF

SEQ ID NO: 897825 - protein, 11 aa, Mycobacterium
CGTDTPAGRPL

SEQ ID NO: 897826 - protein, 16 aa, Mycobacterium
CGTPSRSCASTLDANG

SEQ ID NO: 897827 - protein, 13 aa, Mycobacterium
CGTPSSAPSSTGL

SEQ ID NO: 897828 - protein, 22 aa, Mycobacterium
CGTSQPPAPTTRPGDAGEIGGA

SEQ ID NO: 897829 - protein, 5 aa, Mycobacterium
CGTTD

SEQ ID NO: 897830 - protein, 23 aa, Mycobacterium
CGTTQNQGSPATTVPAVNDDRGA

SEQ ID NO: 897831 - protein, 4 aa, Mycobacterium
CGYG

SEQ ID NO: 897832 - protein, 5 aa, Mycobacterium
CHPGQ

SEQ ID NO: 897833 - protein, 5 aa, Mycobacterium
CIQGD

SEQ ID NO: 897834 - protein, 13 aa, Mycobacterium
CKPVGDAPPGSVA

SEQ ID NO: 897835 - protein, 7 aa, Mycobacterium
CKTGIRG

SEQ ID NO: 897836 - protein, 7 aa, Mycobacterium
CLSDGGN

SEQ ID NO: 897837 - protein, 5 aa, Mycobacterium
CNATG

SEQ ID NO: 897838 - protein, 15 aa, Mycobacterium
CNDGANVTVKQGSSF

SEQ ID NO: 897839 - protein, 5 aa, Mycobacterium
CNEQL

SEQ ID NO: 897840 - protein, 6 aa, Mycobacterium
CNGQTT

SEQ ID NO: 897841 - protein, 6 aa, Mycobacterium
CNGTDD

SEQ ID NO: 897842 - protein, 11 aa, Mycobacterium
CNNGKNPRVEV

SEQ ID NO: 897843 - protein, 31 aa, Mycobacterium
CNPDNQTPCVTDEPTEDAAATDARRPAQRQH

SEQ ID NO: 897844 - protein, 11 aa, Mycobacterium
CNPGGPEEAEL

SEQ ID NO: 897845 - protein, 6 aa, Mycobacterium
CNPSRP

SEQ ID NO: 897846 - protein, 14 aa, Mycobacterium
CNQGSPEEDAAQTN

SEQ ID NO: 897847 - protein, 7 aa, Mycobacterium
CNTGERV

SEQ ID NO: 897848 - protein, 4 aa, Mycobacterium
CPAP

SEQ ID NO: 897849 - protein, 4 aa, Mycobacterium
CPAT

SEQ ID NO: 897850 - protein, 12 aa, Mycobacterium
CPDGSTARGEQS

SEQ ID NO: 897851 - protein, 8 aa, Mycobacterium
CPEDGAVE

SEQ ID NO: 897852 - protein, 14 aa, Mycobacterium
CPFDTDPRSGTENL

SEQ ID NO: 897853 - protein, 13 aa, Mycobacterium
CPGQLEESKGKGG

SEQ ID NO: 897854 - protein, 5 aa, Mycobacterium
CPGQT

SEQ ID NO: 897855 - protein, 11 aa, Mycobacterium
CPNGETEDTFT

SEQ ID NO: 897856 - protein, 5 aa, Mycobacterium
CPRTT

SEQ ID NO: 897857 - protein, 6 aa, Mycobacterium
CPTNQD

SEQ ID NO: 897858 - protein, 4 aa, Mycobacterium
CPVN

SEQ ID NO: 897859 - protein, 5 aa, Mycobacterium
CQGGP

SEQ ID NO: 897860 - protein, 19 aa, Mycobacterium
CQGGPSDIAGGGGPTDAHT

SEQ ID NO: 897861 - protein, 30 aa, Mycobacterium
CQNAQSTSSIGIDGAPDEISGPGGESLAPN

SEQ ID NO: 897862 - protein, 13 aa, Mycobacterium
CQPDPAGSGTGFG

SEQ ID NO: 897863 - protein, 7 aa, Mycobacterium
CQPGNGS

SEQ ID NO: 897864 - protein, 14 aa, Mycobacterium
CQQTPDTKPEEDAL

SEQ ID NO: 897865 - protein, 9 aa, Mycobacterium
CQRGNSGSV

SEQ ID NO: 897866 - protein, 4 aa, Mycobacterium
CQYG

SEQ ID NO: 897867 - protein, 20 aa, Mycobacterium
CQYSSNPNWQYTGPDCQREN

SEQ ID NO: 897868 - protein, 13 aa, Mycobacterium
CRGEGAVSDRDNN

SEQ ID NO: 897869 - protein, 14 aa, Mycobacterium
CRGGEGVVTDRGGA

SEQ ID NO: 897870 - protein, 14 aa, Mycobacterium
CRGGGGVVTDRGGT

SEQ ID NO: 897871 - protein, 5 aa, Mycobacterium
CRGRE

SEQ ID NO: 897872 - protein, 13 aa, Mycobacterium
CRPGSRFACATEG

SEQ ID NO: 897873 - protein, 12 aa, Mycobacterium
CRQSGTARRGIK

SEQ ID NO: 897874 - protein, 13 aa, Mycobacterium
CRSSNPKAKIPAG

SEQ ID NO: 897875 - protein, 8 aa, Mycobacterium
CSAEPATM

SEQ ID NO: 897876 - protein, 8 aa, Mycobacterium
CSAGPESY

SEQ ID NO: 897877 - protein, 6 aa, Mycobacterium
CSAPDR

SEQ ID NO: 897878 - protein, 14 aa, Mycobacterium
CSAPGSSLESAPAV

SEQ ID NO: 897879 - protein, 15 aa, Mycobacterium
CSASRPAAGSGTGMS

SEQ ID NO: 897880 - protein, 26 aa, Mycobacterium
CSDSGGNKPGATASSTPQKGQGNHGP

SEQ ID NO: 897881 - protein, 25 aa, Mycobacterium
CSDSGSNKPGATSSSAPGNAEGRHG

SEQ ID NO: 897882 - protein, 8 aa, Mycobacterium
CSERAAGR

SEQ ID NO: 897883 - protein, 30 aa, Mycobacterium
CSGDGNESAPSSAEKTTVSAEGGAAAMNSS

SEQ ID NO: 897884 - protein, 40 aa, Mycobacterium
CSGDKDKSETKGTTVSNSAGAVATNSSAKVTIDGKEQKIE

SEQ ID NO: 897885 - protein, 10 aa, Mycobacterium
CSGDSADRRD

SEQ ID NO: 897886 - protein, 14 aa, Mycobacterium
CSGEAERSTAEPIA

SEQ ID NO: 897887 - protein, 10 aa, Mycobacterium
CSGEDGGGGN

SEQ ID NO: 897888 - protein, 31 aa, Mycobacterium
CSGGDKSDQPNGTASNATAPQQTKSKGVDGP

SEQ ID NO: 897889 - protein, 20 aa, Mycobacterium
CSGGGDHSGTASASSTGTAC

SEQ ID NO: 897890 - protein, 17 aa, Mycobacterium
CSGSDKPQSTTAEGFPE

SEQ ID NO: 897891 - protein, 8 aa, Mycobacterium
CSGSTAAQ

SEQ ID NO: 897892 - protein, 5 aa, Mycobacterium
CSGSV

SEQ ID NO: 897893 - protein, 15 aa, Mycobacterium
CSHRSGSEQTTGAAE

SEQ ID NO: 897894 - protein, 14 aa, Mycobacterium
CSKTDKADPNLPEA

SEQ ID NO: 897895 - protein, 9 aa, Mycobacterium
CSLESTESH

SEQ ID NO: 897896 - protein, 7 aa, Mycobacterium
CSNNYGP

SEQ ID NO: 897897 - protein, 28 aa, Mycobacterium
CSNQSGEDESSTTTPSSSANAADAQQLK

SEQ ID NO: 897898 - protein, 4 aa, Mycobacterium
CSNT

SEQ ID NO: 897899 - protein, 9 aa, Mycobacterium
CSPAKPPDF

SEQ ID NO: 897900 - protein, 43 aa, Mycobacterium
CSPGDSTVSKTPEQTAPAAAPPAASPPPQSTGPLPGPAPADDP

SEQ ID NO: 897901 - protein, 9 aa, Mycobacterium
CSPGSRLPA

SEQ ID NO: 897902 - protein, 17 aa, Mycobacterium
CSPPGETASSEPGTTPA

SEQ ID NO: 897903 - protein, 14 aa, Mycobacterium
CSPRQEAPKEDAGW

SEQ ID NO: 897904 - protein, 38 aa, Mycobacterium
CSPSPDNAESSTSAVAPAPPAAPSALPVPPAAPLPPPE

SEQ ID NO: 897905 - protein, 6 aa, Mycobacterium
CSPSRV

SEQ ID NO: 897906 - protein, 14 aa, Mycobacterium
CSQISATRESTARF

SEQ ID NO: 897907 - protein, 8 aa, Mycobacterium
CSRGPVQT

SEQ ID NO: 897908 - protein, 15 aa, Mycobacterium
CSRNGNRRPAPDELA

SEQ ID NO: 897909 - protein, 24 aa, Mycobacterium
CSSAPAHETSAHAAATAPALTGSL

SEQ ID NO: 897910 - protein, 23 aa, Mycobacterium
CSSAPGDTSQETDGAKPSGQEIT

SEQ ID NO: 897911 - protein, 12 aa, Mycobacterium
CSSDGPAYPDAD

SEQ ID NO: 897912 - protein, 11 aa, Mycobacterium
CSSGAGDSAKV

SEQ ID NO: 897913 - protein, 12 aa, Mycobacterium
CSSGHDAVAQGG

SEQ ID NO: 897914 - protein, 12 aa, Mycobacterium
CSSGRDAVAQGG

SEQ ID NO: 897915 - protein, 17 aa, Mycobacterium
CSSGSKQSGAPLPDGTT

SEQ ID NO: 897916 - protein, 16 aa, Mycobacterium
CSSGSKQSSAPLPDAT

SEQ ID NO: 897917 - protein, 17 aa, Mycobacterium
CSSGTKDSGGPLPDATP

SEQ ID NO: 897918 - protein, 15 aa, Mycobacterium
CSSHHGEHEGHNAST

SEQ ID NO: 897919 - protein, 26 aa, Mycobacterium
CSSNGGSGGPGTATGTTVTTSSAEAA

SEQ ID NO: 897920 - protein, 33 aa, Mycobacterium
CSSNPVDAPPPTIPAAQPAESPVPTARPAGDVQ

SEQ ID NO: 897921 - protein, 17 aa, Mycobacterium
CSSPQHASTVPGTTPSV

SEQ ID NO: 897922 - protein, 12 aa, Mycobacterium
CSSQGASPTSSA

SEQ ID NO: 897923 - protein, 11 aa, Mycobacterium
CSSSDDTGGYT

SEQ ID NO: 897924 - protein, 24 aa, Mycobacterium
CSSSEDPAASASTGAVTSAETTAF

SEQ ID NO: 897925 - protein, 9 aa, Mycobacterium
CSSSEEEDG

SEQ ID NO: 897926 - protein, 22 aa, Mycobacterium
CSSSEGATPEPTGPAKVSPPAV

SEQ ID NO: 897927 - protein, 38 aa, Mycobacterium
CSSSSDKASPTSSSAPQSTASSAAAAAAPDHPLPDPAA

SEQ ID NO: 897928 - protein, 15 aa, Mycobacterium
CSSSSETSDAPLPDG

SEQ ID NO: 897929 - protein, 11 aa, Mycobacterium
CSSSSPAEPRD

SEQ ID NO: 897930 - protein, 18 aa, Mycobacterium
CSSSSTEDSGKDLPDPTT

SEQ ID NO: 897931 - protein, 22 aa, Mycobacterium
CSSSTTSAEGASTNANGTNNAL

SEQ ID NO: 897932 - protein, 22 aa, Mycobacterium
CSSTGTKGAGGAEIGPTSAQVA

SEQ ID NO: 897933 - protein, 17 aa, Mycobacterium
CSSTRPAPHAATPDLGH

SEQ ID NO: 897934 - protein, 42 aa, Mycobacterium
CSTDANNGTATTSSGPSAKTTAPPVSSLAPGAVGVSPTGVTT

SEQ ID NO: 897935 - protein, 6 aa, Mycobacterium
CSTGGL

SEQ ID NO: 897936 - protein, 6 aa, Mycobacterium
CSTGTL

SEQ ID NO: 897937 - protein, 6 aa, Mycobacterium
CSTGTM

SEQ ID NO: 897938 - protein, 11 aa, Mycobacterium
CSTPENSTPLP

SEQ ID NO: 897939 - protein, 25 aa, Mycobacterium
CSTPEPALGGTTATVSIDGKDTGGA

SEQ ID NO: 897940 - protein, 12 aa, Mycobacterium
CSYPGECTGTVD

SEQ ID NO: 897941 - protein, 5 aa, Mycobacterium
CTAEA

SEQ ID NO: 897942 - protein, 10 aa, Mycobacterium
CTAPPEQDTI

SEQ ID NO: 897943 - protein, 7 aa, Mycobacterium
CTEQAGG

SEQ ID NO: 897944 - protein, 8 aa, Mycobacterium
CTGANTGQ

SEQ ID NO: 897945 - protein, 4 aa, Mycobacterium
CTGK

SEQ ID NO: 897946 - protein, 28 aa, Mycobacterium
CTGNSAPEGSSPAEPAPETSTAAPFPAS

SEQ ID NO: 897947 - protein, 5 aa, Mycobacterium
CTHKG

SEQ ID NO: 897948 - protein, 8 aa, Mycobacterium
CTPGQKKA

SEQ ID NO: 897949 - protein, 7 aa, Mycobacterium
CTPPGLD

SEQ ID NO: 897950 - protein, 13 aa, Mycobacterium
CTPRPDGPGPAAE

SEQ ID NO: 897951 - protein, 9 aa, Mycobacterium
CTPSRGAMT

SEQ ID NO: 897952 - protein, 19 aa, Mycobacterium
CTRDQPTTQVAANTPIPTF

SEQ ID NO: 897953 - protein, 4 aa, Mycobacterium
CTRQ

SEQ ID NO: 897954 - protein, 28 aa, Mycobacterium
CTSDERDIPSAGGTAEVGATNDINPQDV

SEQ ID NO: 897955 - protein, 7 aa, Mycobacterium
CTSGEEV

SEQ ID NO: 897956 - protein, 21 aa, Mycobacterium
CTSTARDSIADQRRKLTSARP

SEQ ID NO: 897957 - protein, 8 aa, Mycobacterium
CTTETPDY

SEQ ID NO: 897958 - protein, 15 aa, Mycobacterium
CTTGRDDKGDAAAPA

SEQ ID NO: 897959 - protein, 9 aa, Mycobacterium
CVDTTGDTV

SEQ ID NO: 897960 - protein, 12 aa, Mycobacterium
CVGGGKSLAAAR

SEQ ID NO: 897961 - protein, 11 aa, Mycobacterium
CVGRPGKRAPT

SEQ ID NO: 897962 - protein, 4 aa, Mycobacterium
DAAA

SEQ ID NO: 897963 - protein, 7 aa, Mycobacterium
DAAAAAG

SEQ ID NO: 897964 - protein, 20 aa, Mycobacterium
DAAAQASTSYHRAGEADRAM

SEQ ID NO: 897965 - protein, 8 aa, Mycobacterium
DAAARLTD

SEQ ID NO: 897966 - protein, 12 aa, Mycobacterium
DAAATAGTALAT

SEQ ID NO: 897967 - protein, 11 aa, Mycobacterium
DAAATLPEELR

SEQ ID NO: 897968 - protein, 8 aa, Mycobacterium
DAADAKAE

SEQ ID NO: 897969 - protein, 12 aa, Mycobacterium
DAADAPAYGGHN

SEQ ID NO: 897970 - protein, 11 aa, Mycobacterium
DAADAPEYGAH

SEQ ID NO: 897971 - protein, 10 aa, Mycobacterium
DAADDQDAIG

SEQ ID NO: 897972 - protein, 7 aa, Mycobacterium
DAADPGW

SEQ ID NO: 897973 - protein, 6 aa, Mycobacterium
DAADQY

SEQ ID NO: 897974 - protein, 7 aa, Mycobacterium
DAADRGG

SEQ ID NO: 897975 - protein, 7 aa, Mycobacterium
DAADTQV

SEQ ID NO: 897976 - protein, 10 aa, Mycobacterium
DAAEAKGANV

SEQ ID NO: 897977 - protein, 18 aa, Mycobacterium
DAAEQAPRHERENAENEL

SEQ ID NO: 897978 - protein, 27 aa, Mycobacterium
DAAGAARSAIDSSSDAKAASARAEAAA

SEQ ID NO: 897979 - protein, 10 aa, Mycobacterium
DAAGAPLTGA

SEQ ID NO: 897980 - protein, 11 aa, Mycobacterium
DAAGGQAARTG

SEQ ID NO: 897981 - protein, 7 aa, Mycobacterium
DAAGGRI

SEQ ID NO: 897982 - protein, 19 aa, Mycobacterium
DAAGKPSPEVAQSVETTDN

SEQ ID NO: 897983 - protein, 8 aa, Mycobacterium
DAAGNQAP

SEQ ID NO: 897984 - protein, 7 aa, Mycobacterium
DAAGTDF

SEQ ID NO: 897985 - protein, 12 aa, Mycobacterium
DAAGTRSSFRTG

SEQ ID NO: 897986 - protein, 8 aa, Mycobacterium
DAAGTTAK

SEQ ID NO: 897987 - protein, 7 aa, Mycobacterium
DAAGTTL

SEQ ID NO: 897988 - protein, 11 aa, Mycobacterium
DAAHGRSSDRA

SEQ ID NO: 897989 - protein, 17 aa, Mycobacterium
DAAHPAGYRQSNTATFT

SEQ ID NO: 897990 - protein, 8 aa, Mycobacterium
DAAKEPGQ

SEQ ID NO: 897991 - protein, 4 aa, Mycobacterium
DAAL

SEQ ID NO: 897992 - protein, 7 aa, Mycobacterium
DAAMNSA

SEQ ID NO: 897993 - protein, 14 aa, Mycobacterium
DAANADTGPTALRD

SEQ ID NO: 897994 - protein, 10 aa, Mycobacterium
DAANEAGGGR

SEQ ID NO: 897995 - protein, 10 aa, Mycobacterium
DAANSAAADG

SEQ ID NO: 897996 - protein, 10 aa, Mycobacterium
DAAPAGTPVR

SEQ ID NO: 897997 - protein, 9 aa, Mycobacterium
DAAPAPTDV

SEQ ID NO: 897998 - protein, 6 aa, Mycobacterium
DAAPHI

SEQ ID NO: 897999 - protein, 16 aa, Mycobacterium
DAAPNQGGSAGAAVNG

SEQ ID NO: 898000 - protein, 9 aa, Mycobacterium
DAAPPGFSQ

SEQ ID NO: 898001 - protein, 7 aa, Mycobacterium
DAAQARI

SEQ ID NO: 898002 - protein, 6 aa, Mycobacterium
DAAQRE

SEQ ID NO: 898003 - protein, 33 aa, Mycobacterium
DAARAGTLKPNDYTHQNSSYATAAGGAISTADD

SEQ ID NO: 898004 - protein, 16 aa, Mycobacterium
DAARGAATLNSQRGEV

SEQ ID NO: 898005 - protein, 8 aa, Mycobacterium
DAARPPDE

SEQ ID NO: 898006 - protein, 12 aa, Mycobacterium
DAASATAAATAN

SEQ ID NO: 898007 - protein, 10 aa, Mycobacterium
DAASNQGPAG

SEQ ID NO: 898008 - protein, 17 aa, Mycobacterium
DAASTGVLRQAAASCPA

SEQ ID NO: 898009 - protein, 30 aa, Mycobacterium
DAATAAERLTESTTAHSKAVEAAKAEAEQV

SEQ ID NO: 898010 - protein, 9 aa, Mycobacterium
DAATDPALT

SEQ ID NO: 898011 - protein, 14 aa, Mycobacterium
DAATGQVTVTPSTG

SEQ ID NO: 898012 - protein, 8 aa, Mycobacterium
DAATVRPG

SEQ ID NO: 898013 - protein, 12 aa, Mycobacterium
DAAYENAKAEFG

SEQ ID NO: 898014 - protein, 7 aa, Mycobacterium
DAAYSRN

SEQ ID NO: 898015 - protein, 8 aa, Mycobacterium
DADAYDRV

SEQ ID NO: 898016 - protein, 7 aa, Mycobacterium
DADDARA

SEQ ID NO: 898017 - protein, 10 aa, Mycobacterium
DADDKSRTDC

SEQ ID NO: 898018 - protein, 18 aa, Mycobacterium
DADEADEVADVEEPQADV

SEQ ID NO: 898019 - protein, 9 aa, Mycobacterium
DADGDEGTW

SEQ ID NO: 898020 - protein, 15 aa, Mycobacterium
DADGGNGGGGGNGGT

SEQ ID NO: 898021 - protein, 5 aa, Mycobacterium
DADGN

SEQ ID NO: 898022 - protein, 7 aa, Mycobacterium
DADGREH

SEQ ID NO: 898023 - protein, 7 aa, Mycobacterium
DADGRSV

SEQ ID NO: 898024 - protein, 5 aa, Mycobacterium
DADGS

SEQ ID NO: 898025 - protein, 12 aa, Mycobacterium
DADGSPKPTEAQ

SEQ ID NO: 898026 - protein, 17 aa, Mycobacterium
DADGSYTYAPNDGYVGE

SEQ ID NO: 898027 - protein, 6 aa, Mycobacterium
DADIQQ

SEQ ID NO: 898028 - protein, 4 aa, Mycobacterium
DADL

SEQ ID NO: 898029 - protein, 10 aa, Mycobacterium
DADMGTAREN

SEQ ID NO: 898030 - protein, 8 aa, Mycobacterium
DADNDRLR

SEQ ID NO: 898031 - protein, 18 aa, Mycobacterium
DADNDRLRAEPQVDYSEA

SEQ ID NO: 898032 - protein, 18 aa, Mycobacterium
DADNDRLRTEPNVDYTPA

SEQ ID NO: 898033 - protein, 7 aa, Mycobacterium
DADPDAI

SEQ ID NO: 898034 - protein, 8 aa, Mycobacterium
DADQDGYT

SEQ ID NO: 898035 - protein, 8 aa, Mycobacterium
DADQRDVE

SEQ ID NO: 898036 - protein, 7 aa, Mycobacterium
DADQTPA

SEQ ID NO: 898037 - protein, 18 aa, Mycobacterium
DADQTYTIRTESGDDHGQ

SEQ ID NO: 898038 - protein, 8 aa, Mycobacterium
DADRAEVE

SEQ ID NO: 898039 - protein, 7 aa, Mycobacterium
DADSQAL

SEQ ID NO: 898040 - protein, 6 aa, Mycobacterium
DADTGT

SEQ ID NO: 898041 - protein, 29 aa, Mycobacterium
DADVTDGDPDGAIGDRSFSGDPQKVAEYA

SEQ ID NO: 898042 - protein, 6 aa, Mycobacterium
DADYDG

SEQ ID NO: 898043 - protein, 7 aa, Mycobacterium
DAEADEV

SEQ ID NO: 898044 - protein, 8 aa, Mycobacterium
DAEAGPTE

SEQ ID NO: 898045 - protein, 22 aa, Mycobacterium
DAEARTASARPPVSGSLSTVTA

SEQ ID NO: 898046 - protein, 5 aa, Mycobacterium
DAEEL

SEQ ID NO: 898047 - protein, 20 aa, Mycobacterium
DAEGERATADAVGQKLGAPV

SEQ ID NO: 898048 - protein, 13 aa, Mycobacterium
DAEGKFKDATDRY

SEQ ID NO: 898049 - protein, 14 aa, Mycobacterium
DAEGQCPPLRTNAA

SEQ ID NO: 898050 - protein, 7 aa, Mycobacterium
DAEHAPA

SEQ ID NO: 898051 - protein, 5 aa, Mycobacterium
DAELA

SEQ ID NO: 898052 - protein, 10 aa, Mycobacterium
DAENRGGQRS

SEQ ID NO: 898053 - protein, 5 aa, Mycobacterium
DAEPH

SEQ ID NO: 898054 - protein, 6 aa, Mycobacterium
DAEPQV

SEQ ID NO: 898055 - protein, 4 aa, Mycobacterium
DAER

SEQ ID NO: 898056 - protein, 7 aa, Mycobacterium
DAERRSM

SEQ ID NO: 898057 - protein, 9 aa, Mycobacterium
DAERSFRAE

SEQ ID NO: 898058 - protein, 6 aa, Mycobacterium
DAESDT

SEQ ID NO: 898059 - protein, 8 aa, Mycobacterium
DAESGPEL

SEQ ID NO: 898060 - protein, 5 aa, Mycobacterium
DAETR

SEQ ID NO: 898061 - protein, 5 aa, Mycobacterium
DAETY

SEQ ID NO: 898062 - protein, 7 aa, Mycobacterium
DAFSEGD

SEQ ID NO: 898063 - protein, 6 aa, Mycobacterium
DAGAAI

SEQ ID NO: 898064 - protein, 10 aa, Mycobacterium
DAGAPPASFR

SEQ ID NO: 898065 - protein, 5 aa, Mycobacterium
DAGAR

SEQ ID NO: 898066 - protein, 31 aa, Mycobacterium
DAGDEIADDDLGADLGADLGDDIGNDGTDVE

SEQ ID NO: 898067 - protein, 9 aa, Mycobacterium
DAGDGDDDY

SEQ ID NO: 898068 - protein, 10 aa, Mycobacterium
DAGDHADQAW

SEQ ID NO: 898069 - protein, 7 aa, Mycobacterium
DAGDSYL

SEQ ID NO: 898070 - protein, 6 aa, Mycobacterium
DAGDVR

SEQ ID NO: 898071 - protein, 14 aa, Mycobacterium
DAGEPDGSGGPPAM

SEQ ID NO: 898072 - protein, 5 aa, Mycobacterium
DAGEQ

SEQ ID NO: 898073 - protein, 14 aa, Mycobacterium
DAGFGGDPGFHGPK

SEQ ID NO: 898074 - protein, 15 aa, Mycobacterium
DAGFKGDVGSHGPKR

SEQ ID NO: 898075 - protein, 6 aa, Mycobacterium
DAGGDL

SEQ ID NO: 898076 - protein, 16 aa, Mycobacterium
DAGGDRAQLRTDDGSA

SEQ ID NO: 898077 - protein, 6 aa, Mycobacterium
DAGGFN

SEQ ID NO: 898078 - protein, 7 aa, Mycobacterium
DAGGFSA

SEQ ID NO: 898079 - protein, 16 aa, Mycobacterium
DAGGHSGTLSPSRPLT

SEQ ID NO: 898080 - protein, 10 aa, Mycobacterium
DAGGSVTGTV

SEQ ID NO: 898081 - protein, 7 aa, Mycobacterium
DAGGYKA

SEQ ID NO: 898082 - protein, 8 aa, Mycobacterium
DAGGYNAE

SEQ ID NO: 898083 - protein, 8 aa, Mycobacterium
DAGGYNAN

SEQ ID NO: 898084 - protein, 8 aa, Mycobacterium
DAGGYNSA

SEQ ID NO: 898085 - protein, 9 aa, Mycobacterium
DAGKSTRAG

SEQ ID NO: 898086 - protein, 5 aa, Mycobacterium
DAGLQ

SEQ ID NO: 898087 - protein, 4 aa, Mycobacterium
DAGN

SEQ ID NO: 898088 - protein, 7 aa, Mycobacterium
DAGNGGK

SEQ ID NO: 898089 - protein, 15 aa, Mycobacterium
DAGNPAMAADPNSLA

SEQ ID NO: 898090 - protein, 9 aa, Mycobacterium
DAGNSDEMS

SEQ ID NO: 898091 - protein, 5 aa, Mycobacterium
DAGPA

SEQ ID NO: 898092 - protein, 6 aa, Mycobacterium
DAGPAL

SEQ ID NO: 898093 - protein, 9 aa, Mycobacterium
DAGPAPSYL

SEQ ID NO: 898094 - protein, 21 aa, Mycobacterium
DAGPNAPRQHTIDGGGHEGGE

SEQ ID NO: 898095 - protein, 9 aa, Mycobacterium
DAGPNGRNA

SEQ ID NO: 898096 - protein, 8 aa, Mycobacterium
DAGPPANL

SEQ ID NO: 898097 - protein, 17 aa, Mycobacterium
DAGQGSTKTVQAVGSDQ

SEQ ID NO: 898098 - protein, 5 aa, Mycobacterium
DAGRL

SEQ ID NO: 898099 - protein, 8 aa, Mycobacterium
DAGSADAV

SEQ ID NO: 898100 - protein, 6 aa, Mycobacterium
DAGSDL

SEQ ID NO: 898101 - protein, 15 aa, Mycobacterium
DAGSPEMAADPNSLA

SEQ ID NO: 898102 - protein, 6 aa, Mycobacterium
DAGTLT

SEQ ID NO: 898103 - protein, 29 aa, Mycobacterium
DAGTQAEIAEQASAASATEAKTAAEQAAA

SEQ ID NO: 898104 - protein, 4 aa, Mycobacterium
DAGV

SEQ ID NO: 898105 - protein, 10 aa, Mycobacterium
DAGVKAPDFT

SEQ ID NO: 898106 - protein, 4 aa, Mycobacterium
DAGY

SEQ ID NO: 898107 - protein, 15 aa, Mycobacterium
DAGYSRNDDPATAPI

SEQ ID NO: 898108 - protein, 29 aa, Mycobacterium
DAHESSRPATPTRTGHQQHDRAAAAHHQN

SEQ ID NO: 898109 - protein, 17 aa, Mycobacterium
DAHGGNRALGSPGYRES

SEQ ID NO: 898110 - protein, 4 aa, Mycobacterium
DAHP

SEQ ID NO: 898111 - protein, 8 aa, Mycobacterium
DAHPADTN

SEQ ID NO: 898112 - protein, 14 aa, Mycobacterium
DAIDGTKAALAQGK

SEQ ID NO: 898113 - protein, 6 aa, Mycobacterium
DAIGPH

SEQ ID NO: 898114 - protein, 8 aa, Mycobacterium
DAISRDAG

SEQ ID NO: 898115 - protein, 14 aa, Mycobacterium
DAKADGRDTIDGQT

SEQ ID NO: 898116 - protein, 8 aa, Mycobacterium
DAKFPENV

SEQ ID NO: 898117 - protein, 8 aa, Mycobacterium
DAKGDLHG

SEQ ID NO: 898118 - protein, 9 aa, Mycobacterium
DAKGKPSLE

SEQ ID NO: 898119 - protein, 6 aa, Mycobacterium
DAKNAD

SEQ ID NO: 898120 - protein, 8 aa, Mycobacterium
DALARTDR

SEQ ID NO: 898121 - protein, 9 aa, Mycobacterium
DALARTDRG

SEQ ID NO: 898122 - protein, 12 aa, Mycobacterium
DALENGGPGSVT

SEQ ID NO: 898123 - protein, 4 aa, Mycobacterium
DALG

SEQ ID NO: 898124 - protein, 6 aa, Mycobacterium
DALGAG

SEQ ID NO: 898125 - protein, 7 aa, Mycobacterium
DALGDLD

SEQ ID NO: 898126 - protein, 12 aa, Mycobacterium
DALGNGNGDKLR

SEQ ID NO: 898127 - protein, 6 aa, Mycobacterium
DALGPE

SEQ ID NO: 898128 - protein, 7 aa, Mycobacterium
DALNSDK

SEQ ID NO: 898129 - protein, 7 aa, Mycobacterium
DALPNRT

SEQ ID NO: 898130 - protein, 5 aa, Mycobacterium
DALTG

SEQ ID NO: 898131 - protein, 6 aa, Mycobacterium
DALTTD

SEQ ID NO: 898132 - protein, 10 aa, Mycobacterium
DAMAGNGQKL

SEQ ID NO: 898133 - protein, 13 aa, Mycobacterium
DAMEGNGEKLRNT

SEQ ID NO: 898134 - protein, 6 aa, Mycobacterium
DAMGTK

SEQ ID NO: 898135 - protein, 4 aa, Mycobacterium
DAMT

SEQ ID NO: 898136 - protein, 7 aa, Mycobacterium
DANFGLP

SEQ ID NO: 898137 - protein, 10 aa, Mycobacterium
DANGEQEKQI

SEQ ID NO: 898138 - protein, 17 aa, Mycobacterium
DANGNPLYPSYTETPGG

SEQ ID NO: 898139 - protein, 9 aa, Mycobacterium
DANGRQTPH

SEQ ID NO: 898140 - protein, 9 aa, Mycobacterium
DANGSGAGV

SEQ ID NO: 898141 - protein, 8 aa, Mycobacterium
DANKPAGQ

SEQ ID NO: 898142 - protein, 16 aa, Mycobacterium
DANNGNRATGTRGYDA

SEQ ID NO: 898143 - protein, 7 aa, Mycobacterium
DANPDAA

SEQ ID NO: 898144 - protein, 9 aa, Mycobacterium
DANPETARR

SEQ ID NO: 898145 - protein, 8 aa, Mycobacterium
DANPPEVK

SEQ ID NO: 898146 - protein, 13 aa, Mycobacterium
DANPQGGTVTLSL

SEQ ID NO: 898147 - protein, 9 aa, Mycobacterium
DANPQTHAD

SEQ ID NO: 898148 - protein, 8 aa, Mycobacterium
DANPSVKA

SEQ ID NO: 898149 - protein, 7 aa, Mycobacterium
DANSPVS

SEQ ID NO: 898150 - protein, 15 aa, Mycobacterium
DANSTCTGTWKRSTK

SEQ ID NO: 898151 - protein, 11 aa, Mycobacterium
DANYAGPTINR

SEQ ID NO: 898152 - protein, 4 aa, Mycobacterium
DAPA

SEQ ID NO: 898153 - protein, 9 aa, Mycobacterium
DAPAAEVPA

SEQ ID NO: 898154 - protein, 5 aa, Mycobacterium
DAPAE

SEQ ID NO: 898155 - protein, 7 aa, Mycobacterium
DAPAGSR

SEQ ID NO: 898156 - protein, 7 aa, Mycobacterium
DAPARAE

SEQ ID NO: 898157 - protein, 7 aa, Mycobacterium
DAPGGGL

SEQ ID NO: 898158 - protein, 9 aa, Mycobacterium
DAPGVAGRI

SEQ ID NO: 898159 - protein, 7 aa, Mycobacterium
DAPLGRA

SEQ ID NO: 898160 - protein, 5 aa, Mycobacterium
DAPNS

SEQ ID NO: 898161 - protein, 9 aa, Mycobacterium
DAPPEDLAP

SEQ ID NO: 898162 - protein, 7 aa, Mycobacterium
DAPPGGK

SEQ ID NO: 898163 - protein, 63 aa, Mycobacterium
DAPPPPAPPATPAPGQPAPNPETPTTVTTPPPAPAPGQPAPPTPPPAPGAPADGGRVNNDQGG

SEQ ID NO: 898164 - protein, 13 aa, Mycobacterium
DAPPPPPQLPAPA

SEQ ID NO: 898165 - protein, 9 aa, Mycobacterium
DAPPSDESL

SEQ ID NO: 898166 - protein, 9 aa, Mycobacterium
DAPPSDIAP

SEQ ID NO: 898167 - protein, 6 aa, Mycobacterium
DAPPSL

SEQ ID NO: 898168 - protein, 6 aa, Mycobacterium
DAPPTQ

SEQ ID NO: 898169 - protein, 4 aa, Mycobacterium
DAPR

SEQ ID NO: 898170 - protein, 18 aa, Mycobacterium
DAPRDANGRFPRDASPDD

SEQ ID NO: 898171 - protein, 7 aa, Mycobacterium
DAPRIPG

SEQ ID NO: 898172 - protein, 6 aa, Mycobacterium
DAPRQA

SEQ ID NO: 898173 - protein, 14 aa, Mycobacterium
DAPRRASVNELGGS

SEQ ID NO: 898174 - protein, 21 aa, Mycobacterium
DAPRRPLGPPPCYGAPICLPG

SEQ ID NO: 898175 - protein, 4 aa, Mycobacterium
DAPS

SEQ ID NO: 898176 - protein, 10 aa, Mycobacterium
DAPSPNWQRG

SEQ ID NO: 898177 - protein, 12 aa, Mycobacterium
DAPSTLTDLTGT

SEQ ID NO: 898178 - protein, 6 aa, Mycobacterium
DAPSVL

SEQ ID NO: 898179 - protein, 17 aa, Mycobacterium
DAPSVPALTRAAETCPT

SEQ ID NO: 898180 - protein, 7 aa, Mycobacterium
DAPTEEP

SEQ ID NO: 898181 - protein, 8 aa, Mycobacterium
DAPTTANP

SEQ ID NO: 898182 - protein, 5 aa, Mycobacterium
DAPVA

SEQ ID NO: 898183 - protein, 20 aa, Mycobacterium
DAPVNATDVTASLGAPTEQV

SEQ ID NO: 898184 - protein, 13 aa, Mycobacterium
DAPVPPDVLENAV

SEQ ID NO: 898185 - protein, 7 aa, Mycobacterium
DAPVRPR

SEQ ID NO: 898186 - protein, 12 aa, Mycobacterium
DAQASPPASYCP

SEQ ID NO: 898187 - protein, 8 aa, Mycobacterium
DAQATAAG

SEQ ID NO: 898188 - protein, 8 aa, Mycobacterium
DAQDPSKV

SEQ ID NO: 898189 - protein, 14 aa, Mycobacterium
DAQGECAPLKPNAA

SEQ ID NO: 898190 - protein, 7 aa, Mycobacterium
DAQGQTT

SEQ ID NO: 898191 - protein, 6 aa, Mycobacterium
DAQGVD

SEQ ID NO: 898192 - protein, 17 aa, Mycobacterium
DAQRDAEGRFPRDAAPD

SEQ ID NO: 898193 - protein, 18 aa, Mycobacterium
DAQRDAHGRFPRDASPDD

SEQ ID NO: 898194 - protein, 18 aa, Mycobacterium
DAQRDAQGRFPRDASPDD

SEQ ID NO: 898195 - protein, 8 aa, Mycobacterium
DAQRNTAL

SEQ ID NO: 898196 - protein, 35 aa, Mycobacterium
DAQSQPFTTNPELRPQPSSTPPPPPPLPPTPFPKE

SEQ ID NO: 898197 - protein, 4 aa, Mycobacterium
DAQT

SEQ ID NO: 898198 - protein, 11 aa, Mycobacterium
DAQTPPGDNAE

SEQ ID NO: 898199 - protein, 5 aa, Mycobacterium
DARAT

SEQ ID NO: 898200 - protein, 9 aa, Mycobacterium
DARATGEPV

SEQ ID NO: 898201 - protein, 18 aa, Mycobacterium
DARERAGKICEPLLQTKG

SEQ ID NO: 898202 - protein, 9 aa, Mycobacterium
DARGGNTNR

SEQ ID NO: 898203 - protein, 15 aa, Mycobacterium
DARIPRAPKASRAKV

SEQ ID NO: 898204 - protein, 6 aa, Mycobacterium
DARLPA

SEQ ID NO: 898205 - protein, 14 aa, Mycobacterium
DARNEPKGPQRPHP

SEQ ID NO: 898206 - protein, 6 aa, Mycobacterium
DARQRY

SEQ ID NO: 898207 - protein, 11 aa, Mycobacterium
DARRAAEERAQ

SEQ ID NO: 898208 - protein, 4 aa, Mycobacterium
DARS

SEQ ID NO: 898209 - protein, 14 aa, Mycobacterium
DARSVAAPAPGAKP

SEQ ID NO: 898210 - protein, 10 aa, Mycobacterium
DASAPHRQRA

SEQ ID NO: 898211 - protein, 11 aa, Mycobacterium
DASASAAAEAG

SEQ ID NO: 898212 - protein, 19 aa, Mycobacterium
DASASADPLRPVSPPLDPG

SEQ ID NO: 898213 - protein, 10 aa, Mycobacterium
DASGNRIAGD

SEQ ID NO: 898214 - protein, 10 aa, Mycobacterium
DASGQPARIP

SEQ ID NO: 898215 - protein, 24 aa, Mycobacterium
DASGTPARIPVDSSAVSSRYPGPI

SEQ ID NO: 898216 - protein, 10 aa, Mycobacterium
DASGTPYSGF

SEQ ID NO: 898217 - protein, 4 aa, Mycobacterium
DASP

SEQ ID NO: 898218 - protein, 8 aa, Mycobacterium
DASPPHDV

SEQ ID NO: 898219 - protein, 8 aa, Mycobacterium
DASPPNQQ

SEQ ID NO: 898220 - protein, 8 aa, Mycobacterium
DASPPQVK

SEQ ID NO: 898221 - protein, 17 aa, Mycobacterium
DASPSDPHAPHAKPEDV

SEQ ID NO: 898222 - protein, 20 aa, Mycobacterium
DASPVDVKTSNWSADPYARG

SEQ ID NO: 898223 - protein, 6 aa, Mycobacterium
DASPVQ

SEQ ID NO: 898224 - protein, 5 aa, Mycobacterium
DASQI

SEQ ID NO: 898225 - protein, 8 aa, Mycobacterium
DASREGVN

SEQ ID NO: 898226 - protein, 5 aa, Mycobacterium
DASSA

SEQ ID NO: 898227 - protein, 10 aa, Mycobacterium
DASSPSVGGP

SEQ ID NO: 898228 - protein, 9 aa, Mycobacterium
DASTADFNG

SEQ ID NO: 898229 - protein, 7 aa, Mycobacterium
DASTPTD

SEQ ID NO: 898230 - protein, 9 aa, Mycobacterium
DASTSTDPR

SEQ ID NO: 898231 - protein, 10 aa, Mycobacterium
DASTTPYNGF

SEQ ID NO: 898232 - protein, 28 aa, Mycobacterium
DASVAGSQQVNGVATTKITGKSSADDIA

SEQ ID NO: 898233 - protein, 34 aa, Mycobacterium
DASYGCSGPLPGAPDGANLVSGSNAPGFATTDRP

SEQ ID NO: 898234 - protein, 35 aa, Mycobacterium
DATAAKATTGTASSTLADLSTTEQGPQTADAKPNL

SEQ ID NO: 898235 - protein, 18 aa, Mycobacterium
DATAGQAAKDSLSGSTEL

SEQ ID NO: 898236 - protein, 9 aa, Mycobacterium
DATARADLE

SEQ ID NO: 898237 - protein, 7 aa, Mycobacterium
DATAYGP

SEQ ID NO: 898238 - protein, 5 aa, Mycobacterium
DATDV

SEQ ID NO: 898239 - protein, 8 aa, Mycobacterium
DATGGANG

SEQ ID NO: 898240 - protein, 7 aa, Mycobacterium
DATGGHV

SEQ ID NO: 898241 - protein, 19 aa, Mycobacterium
DATGKPSPEVAQSIETTDN

SEQ ID NO: 898242 - protein, 14 aa, Mycobacterium
DATGKSLYSTDLAP

SEQ ID NO: 898243 - protein, 15 aa, Mycobacterium
DATNTSDEPAAADST

SEQ ID NO: 898244 - protein, 5 aa, Mycobacterium
DATPW

SEQ ID NO: 898245 - protein, 10 aa, Mycobacterium
DATQDRRSGY

SEQ ID NO: 898246 - protein, 7 aa, Mycobacterium
DATRDEG

SEQ ID NO: 898247 - protein, 6 aa, Mycobacterium
DATRDR

SEQ ID NO: 898248 - protein, 7 aa, Mycobacterium
DATRDTG

SEQ ID NO: 898249 - protein, 7 aa, Mycobacterium
DATRGAG

SEQ ID NO: 898250 - protein, 18 aa, Mycobacterium
DATRGRVAAGPAPARGTQ

SEQ ID NO: 898251 - protein, 7 aa, Mycobacterium
DATSSVE

SEQ ID NO: 898252 - protein, 15 aa, Mycobacterium
DATTDLSTADTPMAR

SEQ ID NO: 898253 - protein, 6 aa, Mycobacterium
DATTGI

SEQ ID NO: 898254 - protein, 9 aa, Mycobacterium
DATTHESGL

SEQ ID NO: 898255 - protein, 12 aa, Mycobacterium
DATTPEAQNGRQ

SEQ ID NO: 898256 - protein, 10 aa, Mycobacterium
DATVPGSHDE

SEQ ID NO: 898257 - protein, 14 aa, Mycobacterium
DAVAAAAGKAWPDL

SEQ ID NO: 898258 - protein, 8 aa, Mycobacterium
DAVGEAAP

SEQ ID NO: 898259 - protein, 8 aa, Mycobacterium
DAVGPAAP

SEQ ID NO: 898260 - protein, 13 aa, Mycobacterium
DAVGTTSDVSASI

SEQ ID NO: 898261 - protein, 6 aa, Mycobacterium
DAVNSY

SEQ ID NO: 898262 - protein, 15 aa, Mycobacterium
DAVPDDDARADDAAA

SEQ ID NO: 898263 - protein, 8 aa, Mycobacterium
DAVRTGAR

SEQ ID NO: 898264 - protein, 7 aa, Mycobacterium
DAVSTDD

SEQ ID NO: 898265 - protein, 20 aa, Mycobacterium
DAWSDDTDAPSGRNGCDTRN

SEQ ID NO: 898266 - protein, 18 aa, Mycobacterium
DCADGKSLTVGGANNTLT

SEQ ID NO: 898267 - protein, 18 aa, Mycobacterium
DCAKDPKCPLGPDPSQAV

SEQ ID NO: 898268 - protein, 6 aa, Mycobacterium
DCDDRT

SEQ ID NO: 898269 - protein, 10 aa, Mycobacterium
DCEPGQKRAR

SEQ ID NO: 898270 - protein, 16 aa, Mycobacterium
DCGSYAAGGFGSAGSY

SEQ ID NO: 898271 - protein, 10 aa, Mycobacterium
DCKPGQKTAR

SEQ ID NO: 898272 - protein, 8 aa, Mycobacterium
DCNGVTDA

SEQ ID NO: 898273 - protein, 10 aa, Mycobacterium
DCRDPSDRQI

SEQ ID NO: 898274 - protein, 7 aa, Mycobacterium
DCRKAER

SEQ ID NO: 898275 - protein, 8 aa, Mycobacterium
DCSEAAEG

SEQ ID NO: 898276 - protein, 18 aa, Mycobacterium
DCTDGFAPYTGRPVAGSP

SEQ ID NO: 898277 - protein, 7 aa, Mycobacterium
DCTEAAE

SEQ ID NO: 898278 - protein, 4 aa, Mycobacterium
DCTP

SEQ ID NO: 898279 - protein, 24 aa, Mycobacterium
DCTTSPCGGSSMSEDNERGAPSQP

SEQ ID NO: 898280 - protein, 4 aa, Mycobacterium
DDAA

SEQ ID NO: 898281 - protein, 11 aa, Mycobacterium
DDAPDTGSLAG

SEQ ID NO: 898282 - protein, 14 aa, Mycobacterium
DDAPETRTDSTPFV

SEQ ID NO: 898283 - protein, 6 aa, Mycobacterium
DDAPVA

SEQ ID NO: 898284 - protein, 7 aa, Mycobacterium
DDAPVTV

SEQ ID NO: 898285 - protein, 11 aa, Mycobacterium
DDARHGETGSV

SEQ ID NO: 898286 - protein, 7 aa, Mycobacterium
DDARLAR

SEQ ID NO: 898287 - protein, 8 aa, Mycobacterium
DDARPDSI

SEQ ID NO: 898288 - protein, 5 aa, Mycobacterium
DDASG

SEQ ID NO: 898289 - protein, 9 aa, Mycobacterium
DDASGKPAI

SEQ ID NO: 898290 - protein, 10 aa, Mycobacterium
DDAVRATKDA

SEQ ID NO: 898291 - protein, 4 aa, Mycobacterium
DDDA

SEQ ID NO: 898292 - protein, 6 aa, Mycobacterium
DDDEQR

SEQ ID NO: 898293 - protein, 30 aa, Mycobacterium
DDDGAHATASAIRADGGAAAALRADATSVA

SEQ ID NO: 898294 - protein, 5 aa, Mycobacterium
DDDGR

SEQ ID NO: 898295 - protein, 10 aa, Mycobacterium
DDDGTIDPES

SEQ ID NO: 898296 - protein, 5 aa, Mycobacterium
DDDIE

SEQ ID NO: 898297 - protein, 9 aa, Mycobacterium
DDDKTWTSK

SEQ ID NO: 898298 - protein, 9 aa, Mycobacterium
DDDLAGSPF

SEQ ID NO: 898299 - protein, 6 aa, Mycobacterium
DDDPMT

SEQ ID NO: 898300 - protein, 9 aa, Mycobacterium
DDDPQGNGW

SEQ ID NO: 898301 - protein, 6 aa, Mycobacterium
DDDPRL

SEQ ID NO: 898302 - protein, 8 aa, Mycobacterium
DDDPSYEQ

SEQ ID NO: 898303 - protein, 6 aa, Mycobacterium
DDDSPV

SEQ ID NO: 898304 - protein, 6 aa, Mycobacterium
DDDTDT

SEQ ID NO: 898305 - protein, 4 aa, Mycobacterium
DDEA

SEQ ID NO: 898306 - protein, 6 aa, Mycobacterium
DDEDGL

SEQ ID NO: 898307 - protein, 8 aa, Mycobacterium
DDEGDANQ

SEQ ID NO: 898308 - protein, 8 aa, Mycobacterium
DDEIPRDR

SEQ ID NO: 898309 - protein, 10 aa, Mycobacterium
DDEPIDAPPE

SEQ ID NO: 898310 - protein, 11 aa, Mycobacterium
DDEQRRLTGAG

SEQ ID NO: 898311 - protein, 7 aa, Mycobacterium
DDEQTSL

SEQ ID NO: 898312 - protein, 34 aa, Mycobacterium
DDERPKQQPQTPAAQDKPEEKPDKPAGPVFDPDA

SEQ ID NO: 898313 - protein, 7 aa, Mycobacterium
DDESIET

SEQ ID NO: 898314 - protein, 8 aa, Mycobacterium
DDFNPDRY

SEQ ID NO: 898315 - protein, 8 aa, Mycobacterium
DDFTGPDG

SEQ ID NO: 898316 - protein, 9 aa, Mycobacterium
DDGAATLAD

SEQ ID NO: 898317 - protein, 28 aa, Mycobacterium
DDGAGMDPETLRAGQGDALADRTDQGAH

SEQ ID NO: 898318 - protein, 5 aa, Mycobacterium
DDGAL

SEQ ID NO: 898319 - protein, 157 aa, Mycobacterium
DDGASSASKPSASATSGGNTADTQSTTTKPDDATQTDDDTADDTATDDSATDTEELGAEDPDVEEPDIDSPQVDTDSPDDEVDGPDDEAEPEPAAESDDRTPAKPAGRAERDTEPEAEVEAGPQQTAQTSERDPSDTTATPRDTEDIPSPQTSTTVT

SEQ ID NO: 898320 - protein, 9 aa, Mycobacterium
DDGATTLAD

SEQ ID NO: 898321 - protein, 13 aa, Mycobacterium
DDGDQSGPPGPGV

SEQ ID NO: 898322 - protein, 26 aa, Mycobacterium
DDGDQSGPPGPGVASADVPEGSAGIE

SEQ ID NO: 898323 - protein, 5 aa, Mycobacterium
DDGFP

SEQ ID NO: 898324 - protein, 6 aa, Mycobacterium
DDGFTE

SEQ ID NO: 898325 - protein, 9 aa, Mycobacterium
DDGGEGLPP

SEQ ID NO: 898326 - protein, 8 aa, Mycobacterium
DDGHNQNV

SEQ ID NO: 898327 - protein, 7 aa, Mycobacterium
DDGLTER

SEQ ID NO: 898328 - protein, 9 aa, Mycobacterium
DDGPDAQRA

SEQ ID NO: 898329 - protein, 7 aa, Mycobacterium
DDGPGSL

SEQ ID NO: 898330 - protein, 8 aa, Mycobacterium
DDGPTDAT

SEQ ID NO: 898331 - protein, 4 aa, Mycobacterium
DDGR

SEQ ID NO: 898332 - protein, 8 aa, Mycobacterium
DDGRPDLR

SEQ ID NO: 898333 - protein, 7 aa, Mycobacterium
DDGSTIG

SEQ ID NO: 898334 - protein, 7 aa, Mycobacterium
DDGTDAN

SEQ ID NO: 898335 - protein, 9 aa, Mycobacterium
DDGTVANKT

SEQ ID NO: 898336 - protein, 4 aa, Mycobacterium
DDGV

SEQ ID NO: 898337 - protein, 9 aa, Mycobacterium
DDHGAGCSA

SEQ ID NO: 898338 - protein, 8 aa, Mycobacterium
DDHGTELA

SEQ ID NO: 898339 - protein, 9 aa, Mycobacterium
DDHNNRHRH

SEQ ID NO: 898340 - protein, 8 aa, Mycobacterium
DDHSTEVA

SEQ ID NO: 898341 - protein, 21 aa, Mycobacterium
DDIDSALGTRGTTSDPPFTNL

SEQ ID NO: 898342 - protein, 11 aa, Mycobacterium
DDIPTEDDSEP

SEQ ID NO: 898343 - protein, 13 aa, Mycobacterium
DDKAKDVNPTAPV

SEQ ID NO: 898344 - protein, 5 aa, Mycobacterium
DDKDD

SEQ ID NO: 898345 - protein, 33 aa, Mycobacterium
DDKPQATPSPAAADVKTGGNTQVKVDGKDLPGL

SEQ ID NO: 898346 - protein, 10 aa, Mycobacterium
DDKPVASASI

SEQ ID NO: 898347 - protein, 8 aa, Mycobacterium
DDKPVAVG

SEQ ID NO: 898348 - protein, 9 aa, Mycobacterium
DDLAEDNAR

SEQ ID NO: 898349 - protein, 6 aa, Mycobacterium
DDLGQV

SEQ ID NO: 898350 - protein, 4 aa, Mycobacterium
DDLK

SEQ ID NO: 898351 - protein, 5 aa, Mycobacterium
DDLNN

SEQ ID NO: 898352 - protein, 4 aa, Mycobacterium
DDLP

SEQ ID NO: 898353 - protein, 6 aa, Mycobacterium
DDLPDA

SEQ ID NO: 898354 - protein, 10 aa, Mycobacterium
DDLTPPGSQR

SEQ ID NO: 898355 - protein, 5 aa, Mycobacterium
DDLYP

SEQ ID NO: 898356 - protein, 6 aa, Mycobacterium
DDMGPE

SEQ ID NO: 898357 - protein, 6 aa, Mycobacterium
DDMNGS

SEQ ID NO: 898358 - protein, 8 aa, Mycobacterium
DDNGPGEI

SEQ ID NO: 898359 - protein, 17 aa, Mycobacterium
DDNNDAPGGHNGCDTRD

SEQ ID NO: 898360 - protein, 8 aa, Mycobacterium
DDNPDRSG

SEQ ID NO: 898361 - protein, 11 aa, Mycobacterium
DDNPRGEDPAA

SEQ ID NO: 898362 - protein, 12 aa, Mycobacterium
DDNPRSEDPATI

SEQ ID NO: 898363 - protein, 9 aa, Mycobacterium
DDNPSYEQY

SEQ ID NO: 898364 - protein, 5 aa, Mycobacterium
DDNRP

SEQ ID NO: 898365 - protein, 8 aa, Mycobacterium
DDNTKTLT

SEQ ID NO: 898366 - protein, 9 aa, Mycobacterium
DDPAAAAKA

SEQ ID NO: 898367 - protein, 5 aa, Mycobacterium
DDPAF

SEQ ID NO: 898368 - protein, 10 aa, Mycobacterium
DDPANNGPVV

SEQ ID NO: 898369 - protein, 8 aa, Mycobacterium
DDPAQSLA

SEQ ID NO: 898370 - protein, 9 aa, Mycobacterium
DDPAQVPTE

SEQ ID NO: 898371 - protein, 5 aa, Mycobacterium
DDPDL

SEQ ID NO: 898372 - protein, 9 aa, Mycobacterium
DDPDNPMTN

SEQ ID NO: 898373 - protein, 4 aa, Mycobacterium
DDPE

SEQ ID NO: 898374 - protein, 35 aa, Mycobacterium
DDPEAATNALNAAKGQQGGVVKDPTTQPSNVGTGG

SEQ ID NO: 898375 - protein, 8 aa, Mycobacterium
DDPGRSGE

SEQ ID NO: 898376 - protein, 6 aa, Mycobacterium
DDPGTQ

SEQ ID NO: 898377 - protein, 5 aa, Mycobacterium
DDPGV

SEQ ID NO: 898378 - protein, 35 aa, Mycobacterium
DDPHPKPAKCGTLADPGNGRDQSAQGVSGSGSGGI

SEQ ID NO: 898379 - protein, 8 aa, Mycobacterium
DDPKMSRD

SEQ ID NO: 898380 - protein, 26 aa, Mycobacterium
DDPNRFTETTPYNPSSPYSATKASAD

SEQ ID NO: 898381 - protein, 8 aa, Mycobacterium
DDPPQRSS

SEQ ID NO: 898382 - protein, 4 aa, Mycobacterium
DDPQ

SEQ ID NO: 898383 - protein, 9 aa, Mycobacterium
DDPQARPQA

SEQ ID NO: 898384 - protein, 25 aa, Mycobacterium
DDPQRFTEATPYNPSSPYSATKAAA

SEQ ID NO: 898385 - protein, 26 aa, Mycobacterium
DDPQRFTESTPYNPSSPYSASKAAGD

SEQ ID NO: 898386 - protein, 4 aa, Mycobacterium
DDPR

SEQ ID NO: 898387 - protein, 5 aa, Mycobacterium
DDPRE

SEQ ID NO: 898388 - protein, 7 aa, Mycobacterium
DDPSPAV

SEQ ID NO: 898389 - protein, 10 aa, Mycobacterium
DDPSTPDIDE

SEQ ID NO: 898390 - protein, 4 aa, Mycobacterium
DDPT

SEQ ID NO: 898391 - protein, 11 aa, Mycobacterium
DDPTALGDAPV

SEQ ID NO: 898392 - protein, 5 aa, Mycobacterium
DDPTD

SEQ ID NO: 898393 - protein, 9 aa, Mycobacterium
DDPTDNIAN

SEQ ID NO: 898394 - protein, 29 aa, Mycobacterium
DDPTDNIANYSTSAPLSPQVTDAIAEFAS

SEQ ID NO: 898395 - protein, 11 aa, Mycobacterium
DDPTSLGTAPV

SEQ ID NO: 898396 - protein, 7 aa, Mycobacterium
DDPYRGE

SEQ ID NO: 898397 - protein, 6 aa, Mycobacterium
DDQGEI

SEQ ID NO: 898398 - protein, 7 aa, Mycobacterium
DDQGPNL

SEQ ID NO: 898399 - protein, 8 aa, Mycobacterium
DDQPVGTT

SEQ ID NO: 898400 - protein, 6 aa, Mycobacterium
DDQQDN

SEQ ID NO: 898401 - protein, 10 aa, Mycobacterium
DDQQFDRPSG

SEQ ID NO: 898402 - protein, 17 aa, Mycobacterium
DDQQHPNGDSAPTEADR

SEQ ID NO: 898403 - protein, 9 aa, Mycobacterium
DDQTGSPTY

SEQ ID NO: 898404 - protein, 4 aa, Mycobacterium
DDRE

SEQ ID NO: 898405 - protein, 7 aa, Mycobacterium
DDRGVPT

SEQ ID NO: 898406 - protein, 6 aa, Mycobacterium
DDRPGN

SEQ ID NO: 898407 - protein, 8 aa, Mycobacterium
DDRPGTDT

SEQ ID NO: 898408 - protein, 8 aa, Mycobacterium
DDRPINSA

SEQ ID NO: 898409 - protein, 12 aa, Mycobacterium
DDRPQLPPEEEA

SEQ ID NO: 898410 - protein, 7 aa, Mycobacterium
DDRRPLA

SEQ ID NO: 898411 - protein, 7 aa, Mycobacterium
DDRTNEI

SEQ ID NO: 898412 - protein, 14 aa, Mycobacterium
DDRTVKAKAAAALA

SEQ ID NO: 898413 - protein, 19 aa, Mycobacterium
DDRVERRARNGSRDRGDIS

SEQ ID NO: 898414 - protein, 8 aa, Mycobacterium
DDSAGEPI

SEQ ID NO: 898415 - protein, 7 aa, Mycobacterium
DDSDLVR

SEQ ID NO: 898416 - protein, 5 aa, Mycobacterium
DDSFE

SEQ ID NO: 898417 - protein, 14 aa, Mycobacterium
DDSGAEQPWDGKSV

SEQ ID NO: 898418 - protein, 6 aa, Mycobacterium
DDSLTT

SEQ ID NO: 898419 - protein, 19 aa, Mycobacterium
DDSPDAAGWASPLRSAGPW

SEQ ID NO: 898420 - protein, 9 aa, Mycobacterium
DDSPGGTGK

SEQ ID NO: 898421 - protein, 27 aa, Mycobacterium
DDSPPGRAAARNQALTDAGIDPPSAQD

SEQ ID NO: 898422 - protein, 5 aa, Mycobacterium
DDSQL

SEQ ID NO: 898423 - protein, 8 aa, Mycobacterium
DDSRSDLD

SEQ ID NO: 898424 - protein, 11 aa, Mycobacterium
DDSSHGDAMTG

SEQ ID NO: 898425 - protein, 4 aa, Mycobacterium
DDST

SEQ ID NO: 898426 - protein, 9 aa, Mycobacterium
DDSTGAGAA

SEQ ID NO: 898427 - protein, 6 aa, Mycobacterium
DDSTHQ

SEQ ID NO: 898428 - protein, 9 aa, Mycobacterium
DDSTNPTDL

SEQ ID NO: 898429 - protein, 8 aa, Mycobacterium
DDSTTPGD

SEQ ID NO: 898430 - protein, 11 aa, Mycobacterium
DDSTVTPGDDD

SEQ ID NO: 898431 - protein, 17 aa, Mycobacterium
DDSYSGADFPAGRQRLD

SEQ ID NO: 898432 - protein, 7 aa, Mycobacterium
DDTADGM

SEQ ID NO: 898433 - protein, 19 aa, Mycobacterium
DDTAKSAAVQEAAAGGNAV

SEQ ID NO: 898434 - protein, 5 aa, Mycobacterium
DDTAS

SEQ ID NO: 898435 - protein, 16 aa, Mycobacterium
DDTAYQYDRNPNAITA

SEQ ID NO: 898436 - protein, 4 aa, Mycobacterium
DDTE

SEQ ID NO: 898437 - protein, 8 aa, Mycobacterium
DDTERGMP

SEQ ID NO: 898438 - protein, 7 aa, Mycobacterium
DDTGDGM

SEQ ID NO: 898439 - protein, 14 aa, Mycobacterium
DDTGLQDNPERRNG

SEQ ID NO: 898440 - protein, 18 aa, Mycobacterium
DDTGVSNTLPGVVAVTVF

SEQ ID NO: 898441 - protein, 4 aa, Mycobacterium
DDTP

SEQ ID NO: 898442 - protein, 4 aa, Mycobacterium
DDTR

SEQ ID NO: 898443 - protein, 6 aa, Mycobacterium
DDTRAI

SEQ ID NO: 898444 - protein, 12 aa, Mycobacterium
DDTSDPYSGADF

SEQ ID NO: 898445 - protein, 13 aa, Mycobacterium
DDTSGQPPSHVEG

SEQ ID NO: 898446 - protein, 21 aa, Mycobacterium
DDTTCPSDSLGNAPTANPQQL

SEQ ID NO: 898447 - protein, 8 aa, Mycobacterium
DDTTDEWP

SEQ ID NO: 898448 - protein, 8 aa, Mycobacterium
DDTVSASD

SEQ ID NO: 898449 - protein, 9 aa, Mycobacterium
DDVDAAPGR

SEQ ID NO: 898450 - protein, 6 aa, Mycobacterium
DDVDDD

SEQ ID NO: 898451 - protein, 58 aa, Mycobacterium
DDVDDDDAEDTQADSPTGDTTPRKDATNHPPRPHGLPASGSSKADGLLTSTSPADGLR

SEQ ID NO: 898452 - protein, 15 aa, Mycobacterium
DDVGGTWRDNSYPGA

SEQ ID NO: 898453 - protein, 14 aa, Mycobacterium
DDVKGQRPTQQGAE

SEQ ID NO: 898454 - protein, 6 aa, Mycobacterium
DDVRGT

SEQ ID NO: 898455 - protein, 10 aa, Mycobacterium
DDVRREQPEL

SEQ ID NO: 898456 - protein, 6 aa, Mycobacterium
DDVTGP

SEQ ID NO: 898457 - protein, 9 aa, Mycobacterium
DDWNDGAEA

SEQ ID NO: 898458 - protein, 11 aa, Mycobacterium
DDWTEDRQDAL

SEQ ID NO: 898459 - protein, 13 aa, Mycobacterium
DDYASGRDSEGLA

SEQ ID NO: 898460 - protein, 5 aa, Mycobacterium
DDYGI

SEQ ID NO: 898461 - protein, 4 aa, Mycobacterium
DDYN

SEQ ID NO: 898462 - protein, 4 aa, Mycobacterium
DDYQ

SEQ ID NO: 898463 - protein, 13 aa, Mycobacterium
DEAAAAGYGAFGG

SEQ ID NO: 898464 - protein, 6 aa, Mycobacterium
DEAALG

SEQ ID NO: 898465 - protein, 20 aa, Mycobacterium
DEAAQKPRLSGALPGSTDLP

SEQ ID NO: 898466 - protein, 7 aa, Mycobacterium
DEAAQYG

SEQ ID NO: 898467 - protein, 5 aa, Mycobacterium
DEAAR

SEQ ID NO: 898468 - protein, 5 aa, Mycobacterium
DEADT

SEQ ID NO: 898469 - protein, 5 aa, Mycobacterium
DEADV

SEQ ID NO: 898470 - protein, 13 aa, Mycobacterium
DEAEASPPAAFAA

SEQ ID NO: 898471 - protein, 7 aa, Mycobacterium
DEAESGL

SEQ ID NO: 898472 - protein, 6 aa, Mycobacterium
DEAFER

SEQ ID NO: 898473 - protein, 7 aa, Mycobacterium
DEAGGSR

SEQ ID NO: 898474 - protein, 4 aa, Mycobacterium
DEAI

SEQ ID NO: 898475 - protein, 6 aa, Mycobacterium
DEAQGA

SEQ ID NO: 898476 - protein, 8 aa, Mycobacterium
DEAQGARA

SEQ ID NO: 898477 - protein, 7 aa, Mycobacterium
DEAQGSR

SEQ ID NO: 898478 - protein, 6 aa, Mycobacterium
DEASEW

SEQ ID NO: 898479 - protein, 8 aa, Mycobacterium
DEASPKVE

SEQ ID NO: 898480 - protein, 13 aa, Mycobacterium
DEATSRPDRGAKR

SEQ ID NO: 898481 - protein, 15 aa, Mycobacterium
DECADGDPACSGGGN

SEQ ID NO: 898482 - protein, 4 aa, Mycobacterium
DEDA

SEQ ID NO: 898483 - protein, 5 aa, Mycobacterium
DEDAD

SEQ ID NO: 898484 - protein, 5 aa, Mycobacterium
DEDDR

SEQ ID NO: 898485 - protein, 6 aa, Mycobacterium
DEDEDA

SEQ ID NO: 898486 - protein, 6 aa, Mycobacterium
DEDLER

SEQ ID NO: 898487 - protein, 13 aa, Mycobacterium
DEDLTDGDGVTRA

SEQ ID NO: 898488 - protein, 9 aa, Mycobacterium
DEDQPVRDR

SEQ ID NO: 898489 - protein, 20 aa, Mycobacterium
DEDSGTWTVETDGGSSYRSR

SEQ ID NO: 898490 - protein, 5 aa, Mycobacterium
DEDSM

SEQ ID NO: 898491 - protein, 9 aa, Mycobacterium
DEDSRSPVD

SEQ ID NO: 898492 - protein, 5 aa, Mycobacterium
DEDTD

SEQ ID NO: 898493 - protein, 5 aa, Mycobacterium
DEDTE

SEQ ID NO: 898494 - protein, 8 aa, Mycobacterium
DEDTPTHT

SEQ ID NO: 898495 - protein, 9 aa, Mycobacterium
DEDVPSPAG

SEQ ID NO: 898496 - protein, 13 aa, Mycobacterium
DEEDALPLPRGRR

SEQ ID NO: 898497 - protein, 17 aa, Mycobacterium
DEEGEVGEEQFAGGHSL

SEQ ID NO: 898498 - protein, 14 aa, Mycobacterium
DEEQMGGTLGPTTE

SEQ ID NO: 898499 - protein, 5 aa, Mycobacterium
DEETH

SEQ ID NO: 898500 - protein, 4 aa, Mycobacterium
DEFR

SEQ ID NO: 898501 - protein, 6 aa, Mycobacterium
DEFRPP

SEQ ID NO: 898502 - protein, 9 aa, Mycobacterium
DEGAAQPHR

SEQ ID NO: 898503 - protein, 6 aa, Mycobacterium
DEGAVD

SEQ ID NO: 898504 - protein, 7 aa, Mycobacterium
DEGERPD

SEQ ID NO: 898505 - protein, 8 aa, Mycobacterium
DEGGAKDA

SEQ ID NO: 898506 - protein, 9 aa, Mycobacterium
DEGGGHRGP

SEQ ID NO: 898507 - protein, 14 aa, Mycobacterium
DEGGYGSSAEAKVG

SEQ ID NO: 898508 - protein, 7 aa, Mycobacterium
DEGHSAK

SEQ ID NO: 898509 - protein, 5 aa, Mycobacterium
DEGIR

SEQ ID NO: 898510 - protein, 15 aa, Mycobacterium
DEGKNEPANAELTGT

SEQ ID NO: 898511 - protein, 5 aa, Mycobacterium
DEGNA

SEQ ID NO: 898512 - protein, 7 aa, Mycobacterium
DEGNPIT

SEQ ID NO: 898513 - protein, 8 aa, Mycobacterium
DEGNSPTT

SEQ ID NO: 898514 - protein, 9 aa, Mycobacterium
DEGPSDGPP

SEQ ID NO: 898515 - protein, 7 aa, Mycobacterium
DEGQNLY

SEQ ID NO: 898516 - protein, 10 aa, Mycobacterium
DEGRRGNLST

SEQ ID NO: 898517 - protein, 7 aa, Mycobacterium
DEGRTGT

SEQ ID NO: 898518 - protein, 11 aa, Mycobacterium
DEGSQFDGEGN

SEQ ID NO: 898519 - protein, 7 aa, Mycobacterium
DEGSTRI

SEQ ID NO: 898520 - protein, 6 aa, Mycobacterium
DEGVRA

SEQ ID NO: 898521 - protein, 10 aa, Mycobacterium
DEHEGQSGSI

SEQ ID NO: 898522 - protein, 7 aa, Mycobacterium
DEHGAAD

SEQ ID NO: 898523 - protein, 7 aa, Mycobacterium
DEHGDPV

SEQ ID NO: 898524 - protein, 7 aa, Mycobacterium
DEHGESN

SEQ ID NO: 898525 - protein, 7 aa, Mycobacterium
DEHSPLS

SEQ ID NO: 898526 - protein, 4 aa, Mycobacterium
DEIS

SEQ ID NO: 898527 - protein, 7 aa, Mycobacterium
DEKQGDF

SEQ ID NO: 898528 - protein, 7 aa, Mycobacterium
DELGDLD

SEQ ID NO: 898529 - protein, 5 aa, Mycobacterium
DELPG

SEQ ID NO: 898530 - protein, 8 aa, Mycobacterium
DELPPNAL

SEQ ID NO: 898531 - protein, 4 aa, Mycobacterium
DELR

SEQ ID NO: 898532 - protein, 6 aa, Mycobacterium
DELRRR

SEQ ID NO: 898533 - protein, 14 aa, Mycobacterium
DEMEDDEDLSAADY

SEQ ID NO: 898534 - protein, 17 aa, Mycobacterium
DEMRDQSQFQTGDDPVA

SEQ ID NO: 898535 - protein, 9 aa, Mycobacterium
DENAPPGTI

SEQ ID NO: 898536 - protein, 8 aa, Mycobacterium
DENGEPTG

SEQ ID NO: 898537 - protein, 13 aa, Mycobacterium
DENGKPALTSDAS

SEQ ID NO: 898538 - protein, 9 aa, Mycobacterium
DENGQPHRV

SEQ ID NO: 898539 - protein, 10 aa, Mycobacterium
DENMSGTHTS

SEQ ID NO: 898540 - protein, 10 aa, Mycobacterium
DENMSGTHTT

SEQ ID NO: 898541 - protein, 19 aa, Mycobacterium
DENQQEPSGLQTTAAKNSA

SEQ ID NO: 898542 - protein, 4 aa, Mycobacterium
DEPA

SEQ ID NO: 898543 - protein, 19 aa, Mycobacterium
DEPAGSAGPGDDSGDPALP

SEQ ID NO: 898544 - protein, 10 aa, Mycobacterium
DEPDAPAAGY

SEQ ID NO: 898545 - protein, 6 aa, Mycobacterium
DEPDEI

SEQ ID NO: 898546 - protein, 8 aa, Mycobacterium
DEPDGRPA

SEQ ID NO: 898547 - protein, 12 aa, Mycobacterium
DEPELAARDAHD

SEQ ID NO: 898548 - protein, 8 aa, Mycobacterium
DEPGPADW

SEQ ID NO: 898549 - protein, 11 aa, Mycobacterium
DEPGTDRRTPS

SEQ ID NO: 898550 - protein, 18 aa, Mycobacterium
DEPGVPDRTPEPLPSGVD

SEQ ID NO: 898551 - protein, 6 aa, Mycobacterium
DEPGYQ

SEQ ID NO: 898552 - protein, 7 aa, Mycobacterium
DEPLEGG

SEQ ID NO: 898553 - protein, 5 aa, Mycobacterium
DEPLG

SEQ ID NO: 898554 - protein, 8 aa, Mycobacterium
DEPPASAK

SEQ ID NO: 898555 - protein, 18 aa, Mycobacterium
DEPPEKDRAKAVEKDRRI

SEQ ID NO: 898556 - protein, 8 aa, Mycobacterium
DEPRADQL

SEQ ID NO: 898557 - protein, 7 aa, Mycobacterium
DEPSAAS

SEQ ID NO: 898558 - protein, 7 aa, Mycobacterium
DEPSLTV

SEQ ID NO: 898559 - protein, 15 aa, Mycobacterium
DEPTANLDSATGKRV

SEQ ID NO: 898560 - protein, 5 aa, Mycobacterium
DEQEN

SEQ ID NO: 898561 - protein, 4 aa, Mycobacterium
DEQF

SEQ ID NO: 898562 - protein, 4 aa, Mycobacterium
DEQL

SEQ ID NO: 898563 - protein, 5 aa, Mycobacterium
DEQPM

SEQ ID NO: 898564 - protein, 4 aa, Mycobacterium
DEQQ

SEQ ID NO: 898565 - protein, 14 aa, Mycobacterium
DEQQMGGTLGPDTD

SEQ ID NO: 898566 - protein, 4 aa, Mycobacterium
DEQR

SEQ ID NO: 898567 - protein, 7 aa, Mycobacterium
DEQRADI

SEQ ID NO: 898568 - protein, 16 aa, Mycobacterium
DEQSANAIRKAAQTCP

SEQ ID NO: 898569 - protein, 10 aa, Mycobacterium
DEQSMGGTLG

SEQ ID NO: 898570 - protein, 5 aa, Mycobacterium
DEQSV

SEQ ID NO: 898571 - protein, 7 aa, Mycobacterium
DEQSVAE

SEQ ID NO: 898572 - protein, 4 aa, Mycobacterium
DEQT

SEQ ID NO: 898573 - protein, 7 aa, Mycobacterium
DERDNLA

SEQ ID NO: 898574 - protein, 6 aa, Mycobacterium
DERGIG

SEQ ID NO: 898575 - protein, 12 aa, Mycobacterium
DERGRLGTPDVR

SEQ ID NO: 898576 - protein, 4 aa, Mycobacterium
DERQ

SEQ ID NO: 898577 - protein, 5 aa, Mycobacterium
DERQQ

SEQ ID NO: 898578 - protein, 5 aa, Mycobacterium
DERQT

SEQ ID NO: 898579 - protein, 5 aa, Mycobacterium
DERSA

SEQ ID NO: 898580 - protein, 18 aa, Mycobacterium
DERTATGVDALTYCFVKS

SEQ ID NO: 898581 - protein, 9 aa, Mycobacterium
DERTDNAGF

SEQ ID NO: 898582 - protein, 4 aa, Mycobacterium
DESA

SEQ ID NO: 898583 - protein, 11 aa, Mycobacterium
DESADAPGKDK

SEQ ID NO: 898584 - protein, 8 aa, Mycobacterium
DESAEQKK

SEQ ID NO: 898585 - protein, 11 aa, Mycobacterium
DESGASATHRA

SEQ ID NO: 898586 - protein, 10 aa, Mycobacterium
DESGRELDEE

SEQ ID NO: 898587 - protein, 23 aa, Mycobacterium
DESGTEAAAVTPGLGGGLGSPER

SEQ ID NO: 898588 - protein, 12 aa, Mycobacterium
DESLGTGSVGRK

SEQ ID NO: 898589 - protein, 6 aa, Mycobacterium
DESPAA

SEQ ID NO: 898590 - protein, 64 aa, Mycobacterium
DESQETSATTTSTGTTGTTGTTGTTGTTGTTENKYNTYYSGGTTSTYPTPDHGMPIDGGGVPCV

SEQ ID NO: 898591 - protein, 20 aa, Mycobacterium
DESRTITGQSIPVDAGGYMQ

SEQ ID NO: 898592 - protein, 6 aa, Mycobacterium
DETADR

SEQ ID NO: 898593 - protein, 6 aa, Mycobacterium
DETAGL

SEQ ID NO: 898594 - protein, 79 aa, Mycobacterium
DETASSSASSEGGPSKPQRPASESSGAESDSSDTDTGASHDTNVDTDADAEDRAADADADADVTEVDPEDSTRATPISV

SEQ ID NO: 898595 - protein, 6 aa, Mycobacterium
DETASV

SEQ ID NO: 898596 - protein, 4 aa, Mycobacterium
DETK

SEQ ID NO: 898597 - protein, 4 aa, Mycobacterium
DETL

SEQ ID NO: 898598 - protein, 5 aa, Mycobacterium
DETLS

SEQ ID NO: 898599 - protein, 7 aa, Mycobacterium
DETRKSF

SEQ ID NO: 898600 - protein, 8 aa, Mycobacterium
DETRSHVT

SEQ ID NO: 898601 - protein, 19 aa, Mycobacterium
DETSQSREEPVPESSSESV

SEQ ID NO: 898602 - protein, 27 aa, Mycobacterium
DETTDGTEETEESGDVSEDPADADTSL

SEQ ID NO: 898603 - protein, 4 aa, Mycobacterium
DEVA

SEQ ID NO: 898604 - protein, 87 aa, Mycobacterium
DEVPAEDSGRSDADDAPAEDTTETEGTDEESGDSADAESSEGGAEPAEGGAEGAEAESGQAAPARTSAKPDSTRSDRTRADAGTSDT

SEQ ID NO: 898605 - protein, 4 aa, Mycobacterium
DEVR

SEQ ID NO: 898606 - protein, 8 aa, Mycobacterium
DEVSSEEF

SEQ ID NO: 898607 - protein, 5 aa, Mycobacterium
DEVST

SEQ ID NO: 898608 - protein, 12 aa, Mycobacterium
DEWTEERREKLE

SEQ ID NO: 898609 - protein, 10 aa, Mycobacterium
DEYGRGAASP

SEQ ID NO: 898610 - protein, 5 aa, Mycobacterium
DEYGY

SEQ ID NO: 898611 - protein, 12 aa, Mycobacterium
DFDGPTKDGTAY

SEQ ID NO: 898612 - protein, 5 aa, Mycobacterium
DFDTQ

SEQ ID NO: 898613 - protein, 6 aa, Mycobacterium
DFERGP

SEQ ID NO: 898614 - protein, 5 aa, Mycobacterium
DFGEE

SEQ ID NO: 898615 - protein, 6 aa, Mycobacterium
DFGSRT

SEQ ID NO: 898616 - protein, 11 aa, Mycobacterium
DFKADSDLSLG

SEQ ID NO: 898617 - protein, 7 aa, Mycobacterium
DFKGANP

SEQ ID NO: 898618 - protein, 15 aa, Mycobacterium
DFNPADVARRGNEDA

SEQ ID NO: 898619 - protein, 8 aa, Mycobacterium
DFPAGAGT

SEQ ID NO: 898620 - protein, 10 aa, Mycobacterium
DFPAGNGTFT

SEQ ID NO: 898621 - protein, 7 aa, Mycobacterium
DFPDDPS

SEQ ID NO: 898622 - protein, 7 aa, Mycobacterium
DFPDRPD

SEQ ID NO: 898623 - protein, 7 aa, Mycobacterium
DFPESKT

SEQ ID NO: 898624 - protein, 17 aa, Mycobacterium
DFPGGKENYQPAKPHDH

SEQ ID NO: 898625 - protein, 6 aa, Mycobacterium
DFPGTD

SEQ ID NO: 898626 - protein, 6 aa, Mycobacterium
DFPHPS

SEQ ID NO: 898627 - protein, 7 aa, Mycobacterium
DFPKPGV

SEQ ID NO: 898628 - protein, 4 aa, Mycobacterium
DFSP

SEQ ID NO: 898629 - protein, 6 aa, Mycobacterium
DFTDTD

SEQ ID NO: 898630 - protein, 15 aa, Mycobacterium
DFTTNTAETDTAAIN

SEQ ID NO: 898631 - protein, 8 aa, Mycobacterium
DFYGDPGD

SEQ ID NO: 898632 - protein, 16 aa, Mycobacterium
DGAAGTATNPNGGAGG

SEQ ID NO: 898633 - protein, 50 aa, Mycobacterium
DGAAPGAEAPSATARDHRDADTPEALAEPRARADLPPCPGPGNGQGPEAL

SEQ ID NO: 898634 - protein, 7 aa, Mycobacterium
DGAARSK

SEQ ID NO: 898635 - protein, 11 aa, Mycobacterium
DGAASQGAAEK

SEQ ID NO: 898636 - protein, 17 aa, Mycobacterium
DGADGAPGTGRDGGPGG

SEQ ID NO: 898637 - protein, 18 aa, Mycobacterium
DGADGQTVNGVGQAGGDG

SEQ ID NO: 898638 - protein, 10 aa, Mycobacterium
DGAENNAPSY

SEQ ID NO: 898639 - protein, 8 aa, Mycobacterium
DGAGAETP

SEQ ID NO: 898640 - protein, 9 aa, Mycobacterium
DGAGDENEV

SEQ ID NO: 898641 - protein, 9 aa, Mycobacterium
DGAGGGSVT

SEQ ID NO: 898642 - protein, 9 aa, Mycobacterium
DGAGSELTV

SEQ ID NO: 898643 - protein, 5 aa, Mycobacterium
DGAGT

SEQ ID NO: 898644 - protein, 15 aa, Mycobacterium
DGAHGTTSVGGASEN

SEQ ID NO: 898645 - protein, 4 aa, Mycobacterium
DGAK

SEQ ID NO: 898646 - protein, 8 aa, Mycobacterium
DGAKGPSW

SEQ ID NO: 898647 - protein, 8 aa, Mycobacterium
DGAKQFGA

SEQ ID NO: 898648 - protein, 10 aa, Mycobacterium
DGALSEPATG

SEQ ID NO: 898649 - protein, 10 aa, Mycobacterium
DGAPAGGPSF

SEQ ID NO: 898650 - protein, 21 aa, Mycobacterium
DGAPAQQLTSTPPKDTGPVRT

SEQ ID NO: 898651 - protein, 15 aa, Mycobacterium
DGAPASLPSQETSLP

SEQ ID NO: 898652 - protein, 34 aa, Mycobacterium
DGAPGGKATATKDGKKYTVTGTATGVDTANPMQP

SEQ ID NO: 898653 - protein, 16 aa, Mycobacterium
DGAPGGSFTYPFFLTR

SEQ ID NO: 898654 - protein, 10 aa, Mycobacterium
DGAPLPPGGI

SEQ ID NO: 898655 - protein, 6 aa, Mycobacterium
DGAPQN

SEQ ID NO: 898656 - protein, 7 aa, Mycobacterium
DGAPTDI

SEQ ID NO: 898657 - protein, 6 aa, Mycobacterium
DGAQPY

SEQ ID NO: 898658 - protein, 7 aa, Mycobacterium
DGAQVDA

SEQ ID NO: 898659 - protein, 16 aa, Mycobacterium
DGASDGAWGKGDSEVF

SEQ ID NO: 898660 - protein, 12 aa, Mycobacterium
DGASDGAWGKGV

SEQ ID NO: 898661 - protein, 12 aa, Mycobacterium
DGATDVDGDPLR

SEQ ID NO: 898662 - protein, 6 aa, Mycobacterium
DGATGQ

SEQ ID NO: 898663 - protein, 8 aa, Mycobacterium
DGATLSPG

SEQ ID NO: 898664 - protein, 7 aa, Mycobacterium
DGATSAL

SEQ ID NO: 898665 - protein, 6 aa, Mycobacterium
DGAWSI

SEQ ID NO: 898666 - protein, 21 aa, Mycobacterium
DGAWSIPKGEYPDGEDPWPAA

SEQ ID NO: 898667 - protein, 10 aa, Mycobacterium
DGAYGAADST

SEQ ID NO: 898668 - protein, 8 aa, Mycobacterium
DGCAGEPS

SEQ ID NO: 898669 - protein, 12 aa, Mycobacterium
DGCAQNPQPGTC

SEQ ID NO: 898670 - protein, 23 aa, Mycobacterium
DGCTTPGTDHATSAGPPPPSGKG

SEQ ID NO: 898671 - protein, 4 aa, Mycobacterium
DGDA

SEQ ID NO: 898672 - protein, 13 aa, Mycobacterium
DGDAAVADGEAPL

SEQ ID NO: 898673 - protein, 7 aa, Mycobacterium
DGDALER

SEQ ID NO: 898674 - protein, 5 aa, Mycobacterium
DGDAN

SEQ ID NO: 898675 - protein, 5 aa, Mycobacterium
DGDAV

SEQ ID NO: 898676 - protein, 6 aa, Mycobacterium
DGDDAR

SEQ ID NO: 898677 - protein, 7 aa, Mycobacterium
DGDDQKI

SEQ ID NO: 898678 - protein, 8 aa, Mycobacterium
DGDFPGEG

SEQ ID NO: 898679 - protein, 8 aa, Mycobacterium
DGDFPSDV

SEQ ID NO: 898680 - protein, 8 aa, Mycobacterium
DGDGESAG

SEQ ID NO: 898681 - protein, 8 aa, Mycobacterium
DGDGPAWL

SEQ ID NO: 898682 - protein, 8 aa, Mycobacterium
DGDGTELT

SEQ ID NO: 898683 - protein, 5 aa, Mycobacterium
DGDGV

SEQ ID NO: 898684 - protein, 28 aa, Mycobacterium
DGDIGSDGSTPQDRANAAGYTGSAAETV

SEQ ID NO: 898685 - protein, 21 aa, Mycobacterium
DGDIGSDGSTPSDRAAAAGFR

SEQ ID NO: 898686 - protein, 5 aa, Mycobacterium
DGDKG

SEQ ID NO: 898687 - protein, 8 aa, Mycobacterium
DGDKQRVA

SEQ ID NO: 898688 - protein, 9 aa, Mycobacterium
DGDLSDTAT

SEQ ID NO: 898689 - protein, 16 aa, Mycobacterium
DGDLTNAPAVAAEGTA

SEQ ID NO: 898690 - protein, 8 aa, Mycobacterium
DGDMANNQ

SEQ ID NO: 898691 - protein, 13 aa, Mycobacterium
DGDQSNEPDPNEI

SEQ ID NO: 898692 - protein, 4 aa, Mycobacterium
DGDS

SEQ ID NO: 898693 - protein, 8 aa, Mycobacterium
DGDSEETL

SEQ ID NO: 898694 - protein, 9 aa, Mycobacterium
DGDSGSPGF

SEQ ID NO: 898695 - protein, 9 aa, Mycobacterium
DGDSPKVTS

SEQ ID NO: 898696 - protein, 7 aa, Mycobacterium
DGDSTPI

SEQ ID NO: 898697 - protein, 8 aa, Mycobacterium
DGDSTTMV

SEQ ID NO: 898698 - protein, 7 aa, Mycobacterium
DGDTIDL

SEQ ID NO: 898699 - protein, 11 aa, Mycobacterium
DGDVGPGPETT

SEQ ID NO: 898700 - protein, 6 aa, Mycobacterium
DGDVPK

SEQ ID NO: 898701 - protein, 15 aa, Mycobacterium
DGDVSNTPQTVATGS

SEQ ID NO: 898702 - protein, 8 aa, Mycobacterium
DGEGRRES

SEQ ID NO: 898703 - protein, 4 aa, Mycobacterium
DGEI

SEQ ID NO: 898704 - protein, 9 aa, Mycobacterium
DGELPPERA

SEQ ID NO: 898705 - protein, 11 aa, Mycobacterium
DGELQASEKLA

SEQ ID NO: 898706 - protein, 9 aa, Mycobacterium
DGELTDTAT

SEQ ID NO: 898707 - protein, 13 aa, Mycobacterium
DGELTRAADTEKA

SEQ ID NO: 898708 - protein, 5 aa, Mycobacterium
DGEPL

SEQ ID NO: 898709 - protein, 19 aa, Mycobacterium
DGEPWTASSPSALAAAPGV

SEQ ID NO: 898710 - protein, 4 aa, Mycobacterium
DGER

SEQ ID NO: 898711 - protein, 4 aa, Mycobacterium
DGET

SEQ ID NO: 898712 - protein, 11 aa, Mycobacterium
DGETKSRTTIG

SEQ ID NO: 898713 - protein, 6 aa, Mycobacterium
DGETTV

SEQ ID NO: 898714 - protein, 8 aa, Mycobacterium
DGEVRESD

SEQ ID NO: 898715 - protein, 7 aa, Mycobacterium
DGFETGD

SEQ ID NO: 898716 - protein, 10 aa, Mycobacterium
DGGAFDDPTR

SEQ ID NO: 898717 - protein, 18 aa, Mycobacterium
DGGAGGAGGKGGTGGQGL

SEQ ID NO: 898718 - protein, 67 aa, Mycobacterium
DGGAGGAGGNGGFGGSGVQNGAGGDAGSGGDSRLIGDGGAAGAGGTGAPPGADGHSGADGLLSAALG

SEQ ID NO: 898719 - protein, 20 aa, Mycobacterium
DGGAGGNGGAGGGQGANGGL

SEQ ID NO: 898720 - protein, 19 aa, Mycobacterium
DGGAGGNGGMGGNGGPGGF

SEQ ID NO: 898721 - protein, 25 aa, Mycobacterium
DGGAGGTGGDSIGGRANGGDGGAAG

SEQ ID NO: 898722 - protein, 16 aa, Mycobacterium
DGGATGAVAAEATASV

SEQ ID NO: 898723 - protein, 32 aa, Mycobacterium
DGGDGGAGGDGGRGLPGGDGGSGGAGGGTGLW

SEQ ID NO: 898724 - protein, 23 aa, Mycobacterium
DGGDGGDGGAGRFSSGSGGAAGT

SEQ ID NO: 898725 - protein, 18 aa, Mycobacterium
DGGDRALAATGGSVAAPI

SEQ ID NO: 898726 - protein, 29 aa, Mycobacterium
DGGDRLSATGGALAAPIGRATIAAALREG

SEQ ID NO: 898727 - protein, 8 aa, Mycobacterium
DGGEIGRA

SEQ ID NO: 898728 - protein, 22 aa, Mycobacterium
DGGESPAAVDPRRFEKAHSQEA

SEQ ID NO: 898729 - protein, 7 aa, Mycobacterium
DGGEVAA

SEQ ID NO: 898730 - protein, 8 aa, Mycobacterium
DGGGPATV

SEQ ID NO: 898731 - protein, 9 aa, Mycobacterium
DGGGPATVQ

SEQ ID NO: 898732 - protein, 8 aa, Mycobacterium
DGGGPGDQ

SEQ ID NO: 898733 - protein, 6 aa, Mycobacterium
DGGGSY

SEQ ID NO: 898734 - protein, 7 aa, Mycobacterium
DGGHEWP

SEQ ID NO: 898735 - protein, 5 aa, Mycobacterium
DGGHN

SEQ ID NO: 898736 - protein, 5 aa, Mycobacterium
DGGHQ

SEQ ID NO: 898737 - protein, 7 aa, Mycobacterium
DGGLSDD

SEQ ID NO: 898738 - protein, 7 aa, Mycobacterium
DGGMPAD

SEQ ID NO: 898739 - protein, 5 aa, Mycobacterium
DGGNG

SEQ ID NO: 898740 - protein, 19 aa, Mycobacterium
DGGNGADAGSPGAGQSSFG

SEQ ID NO: 898741 - protein, 76 aa, Mycobacterium
DGGNGGAGGDGATGGSGATGGNGGAGGITTADQNGYSAVGTQAVGGDGGNGGNGGSGGSGGTGGAAGSGGAGGDGG

SEQ ID NO: 898742 - protein, 53 aa, Mycobacterium
DGGNGGAGTADHPTGGNGGNAGLIGNGGNGGAGYSPAGVTGAAGGAGGVGGRG

SEQ ID NO: 898743 - protein, 10 aa, Mycobacterium
DGGNGGDGVN

SEQ ID NO: 898744 - protein, 5 aa, Mycobacterium
DGGNS

SEQ ID NO: 898745 - protein, 5 aa, Mycobacterium
DGGNT

SEQ ID NO: 898746 - protein, 7 aa, Mycobacterium
DGGPALR

SEQ ID NO: 898747 - protein, 12 aa, Mycobacterium
DGGQLREESGHT

SEQ ID NO: 898748 - protein, 7 aa, Mycobacterium
DGGQQFG

SEQ ID NO: 898749 - protein, 10 aa, Mycobacterium
DGGQSKDEVC

SEQ ID NO: 898750 - protein, 6 aa, Mycobacterium
DGGRQH

SEQ ID NO: 898751 - protein, 7 aa, Mycobacterium
DGGTAAD

SEQ ID NO: 898752 - protein, 29 aa, Mycobacterium
DGGVGGAGGTGGSGADGGDAGTGGAGGRG

SEQ ID NO: 898753 - protein, 9 aa, Mycobacterium
DGGVPQEQV

SEQ ID NO: 898754 - protein, 6 aa, Mycobacterium
DGGVPS

SEQ ID NO: 898755 - protein, 7 aa, Mycobacterium
DGGVSSS

SEQ ID NO: 898756 - protein, 11 aa, Mycobacterium
DGGYTYTPGEG

SEQ ID NO: 898757 - protein, 7 aa, Mycobacterium
DGHAETL

SEQ ID NO: 898758 - protein, 11 aa, Mycobacterium
DGHAPASPPRT

SEQ ID NO: 898759 - protein, 16 aa, Mycobacterium
DGHCNPVAGTNARESL

SEQ ID NO: 898760 - protein, 9 aa, Mycobacterium
DGHEAASSL

SEQ ID NO: 898761 - protein, 8 aa, Mycobacterium
DGHGGTAT

SEQ ID NO: 898762 - protein, 8 aa, Mycobacterium
DGHGGTTT

SEQ ID NO: 898763 - protein, 7 aa, Mycobacterium
DGHGGVT

SEQ ID NO: 898764 - protein, 5 aa, Mycobacterium
DGHTI

SEQ ID NO: 898765 - protein, 6 aa, Mycobacterium
DGHTSA

SEQ ID NO: 898766 - protein, 6 aa, Mycobacterium
DGHTTD

SEQ ID NO: 898767 - protein, 5 aa, Mycobacterium
DGIAG

SEQ ID NO: 898768 - protein, 4 aa, Mycobacterium
DGIE

SEQ ID NO: 898769 - protein, 10 aa, Mycobacterium
DGIGKSPQQL

SEQ ID NO: 898770 - protein, 10 aa, Mycobacterium
DGIGSSPQQL

SEQ ID NO: 898771 - protein, 12 aa, Mycobacterium
DGITPPSAARAI

SEQ ID NO: 898772 - protein, 12 aa, Mycobacterium
DGITPPTAARAI

SEQ ID NO: 898773 - protein, 10 aa, Mycobacterium
DGKDYAPQEY

SEQ ID NO: 898774 - protein, 5 aa, Mycobacterium
DGKEH

SEQ ID NO: 898775 - protein, 6 aa, Mycobacterium
DGKEIA

SEQ ID NO: 898776 - protein, 10 aa, Mycobacterium
DGKGAFRARK

SEQ ID NO: 898777 - protein, 9 aa, Mycobacterium
DGKGMTGPF

SEQ ID NO: 898778 - protein, 5 aa, Mycobacterium
DGKLG

SEQ ID NO: 898779 - protein, 14 aa, Mycobacterium
DGKLKDGERARKRG

SEQ ID NO: 898780 - protein, 12 aa, Mycobacterium
DGKLPDTDTFCP

SEQ ID NO: 898781 - protein, 10 aa, Mycobacterium
DGKPAALQPG

SEQ ID NO: 898782 - protein, 6 aa, Mycobacterium
DGKPAL

SEQ ID NO: 898783 - protein, 20 aa, Mycobacterium
DGKPSSNSEVPAPKDPSGVA

SEQ ID NO: 898784 - protein, 8 aa, Mycobacterium
DGKTVPVA

SEQ ID NO: 898785 - protein, 8 aa, Mycobacterium
DGKVEREI

SEQ ID NO: 898786 - protein, 12 aa, Mycobacterium
DGLAAATTSGLP

SEQ ID NO: 898787 - protein, 16 aa, Mycobacterium
DGLATGDAGWTTAGDL

SEQ ID NO: 898788 - protein, 6 aa, Mycobacterium
DGLDGY

SEQ ID NO: 898789 - protein, 10 aa, Mycobacterium
DGLDRTGDTM

SEQ ID NO: 898790 - protein, 4 aa, Mycobacterium
DGLG

SEQ ID NO: 898791 - protein, 5 aa, Mycobacterium
DGLGA

SEQ ID NO: 898792 - protein, 6 aa, Mycobacterium
DGLHGT

SEQ ID NO: 898793 - protein, 16 aa, Mycobacterium
DGLPNQPIAPGAQATG

SEQ ID NO: 898794 - protein, 9 aa, Mycobacterium
DGLQDTDGQ

SEQ ID NO: 898795 - protein, 4 aa, Mycobacterium
DGLR

SEQ ID NO: 898796 - protein, 7 aa, Mycobacterium
DGLSGAY

SEQ ID NO: 898797 - protein, 8 aa, Mycobacterium
DGLTPAEP

SEQ ID NO: 898798 - protein, 15 aa, Mycobacterium
DGLTRPSASVAATEP

SEQ ID NO: 898799 - protein, 7 aa, Mycobacterium
DGLYGRD

SEQ ID NO: 898800 - protein, 4 aa, Mycobacterium
DGMP

SEQ ID NO: 898801 - protein, 5 aa, Mycobacterium
DGMPA

SEQ ID NO: 898802 - protein, 15 aa, Mycobacterium
DGMPGLSAASRDELA

SEQ ID NO: 898803 - protein, 46 aa, Mycobacterium
DGMSSSAAASAKKKAPEPDSAAAAATAAAREQARRRRRRSAALRGY

SEQ ID NO: 898804 - protein, 5 aa, Mycobacterium
DGNDE

SEQ ID NO: 898805 - protein, 34 aa, Mycobacterium
DGNFGSGNAGSYNFGTGNNGSFNIGSGNNGDSNI

SEQ ID NO: 898806 - protein, 11 aa, Mycobacterium
DGNKGFKAADT

SEQ ID NO: 898807 - protein, 6 aa, Mycobacterium
DGNPSG

SEQ ID NO: 898808 - protein, 14 aa, Mycobacterium
DGNPTGTAAKDGPN

SEQ ID NO: 898809 - protein, 7 aa, Mycobacterium
DGNREGQ

SEQ ID NO: 898810 - protein, 13 aa, Mycobacterium
DGNSVPEAVTRET

SEQ ID NO: 898811 - protein, 4 aa, Mycobacterium
DGNT

SEQ ID NO: 898812 - protein, 5 aa, Mycobacterium
DGNTV

SEQ ID NO: 898813 - protein, 12 aa, Mycobacterium
DGNVSPPNPLGN

SEQ ID NO: 898814 - protein, 7 aa, Mycobacterium
DGNVTGF

SEQ ID NO: 898815 - protein, 10 aa, Mycobacterium
DGPADATRNS

SEQ ID NO: 898816 - protein, 11 aa, Mycobacterium
DGPAGAPPDPA

SEQ ID NO: 898817 - protein, 12 aa, Mycobacterium
DGPAGSAPDGSK

SEQ ID NO: 898818 - protein, 13 aa, Mycobacterium
DGPAGSAPDGSKW

SEQ ID NO: 898819 - protein, 13 aa, Mycobacterium
DGPAGSAPDPAKW

SEQ ID NO: 898820 - protein, 13 aa, Mycobacterium
DGPAGSAPDSSKW

SEQ ID NO: 898821 - protein, 9 aa, Mycobacterium
DGPAGSTVK

SEQ ID NO: 898822 - protein, 10 aa, Mycobacterium
DGPAHGDSGP

SEQ ID NO: 898823 - protein, 16 aa, Mycobacterium
DGPANQDKGDAPPAQW

SEQ ID NO: 898824 - protein, 18 aa, Mycobacterium
DGPANQDKGDSPPGQWMP

SEQ ID NO: 898825 - protein, 14 aa, Mycobacterium
DGPAPTDNPPTKPF

SEQ ID NO: 898826 - protein, 9 aa, Mycobacterium
DGPAQDEVY

SEQ ID NO: 898827 - protein, 13 aa, Mycobacterium
DGPAQDTVYAGSG

SEQ ID NO: 898828 - protein, 7 aa, Mycobacterium
DGPAQEA

SEQ ID NO: 898829 - protein, 5 aa, Mycobacterium
DGPDV

SEQ ID NO: 898830 - protein, 7 aa, Mycobacterium
DGPGPFD

SEQ ID NO: 898831 - protein, 8 aa, Mycobacterium
DGPGPHTD

SEQ ID NO: 898832 - protein, 13 aa, Mycobacterium
DGPGRWKQTPAEE

SEQ ID NO: 898833 - protein, 10 aa, Mycobacterium
DGPGSIPGKT

SEQ ID NO: 898834 - protein, 10 aa, Mycobacterium
DGPHRRATYP

SEQ ID NO: 898835 - protein, 9 aa, Mycobacterium
DGPIQPDGT

SEQ ID NO: 898836 - protein, 13 aa, Mycobacterium
DGPLKGEKGATQR

SEQ ID NO: 898837 - protein, 9 aa, Mycobacterium
DGPPDTLAP

SEQ ID NO: 898838 - protein, 7 aa, Mycobacterium
DGPPRAV

SEQ ID NO: 898839 - protein, 6 aa, Mycobacterium
DGPPVE

SEQ ID NO: 898840 - protein, 4 aa, Mycobacterium
DGPQ

SEQ ID NO: 898841 - protein, 16 aa, Mycobacterium
DGPRGGPGINDDGSGV

SEQ ID NO: 898842 - protein, 7 aa, Mycobacterium
DGPRRQA

SEQ ID NO: 898843 - protein, 8 aa, Mycobacterium
DGPSACSG

SEQ ID NO: 898844 - protein, 7 aa, Mycobacterium
DGPSPFT

SEQ ID NO: 898845 - protein, 9 aa, Mycobacterium
DGPSYGESI

SEQ ID NO: 898846 - protein, 6 aa, Mycobacterium
DGPTAA

SEQ ID NO: 898847 - protein, 11 aa, Mycobacterium
DGPTDTLAPPD

SEQ ID NO: 898848 - protein, 11 aa, Mycobacterium
DGPTPKDSAPW

SEQ ID NO: 898849 - protein, 10 aa, Mycobacterium
DGPVDPYKQA

SEQ ID NO: 898850 - protein, 15 aa, Mycobacterium
DGPVDRLTAPDGAVD

SEQ ID NO: 898851 - protein, 11 aa, Mycobacterium
DGPVGSAPDAS

SEQ ID NO: 898852 - protein, 11 aa, Mycobacterium
DGQATDRTSLP

SEQ ID NO: 898853 - protein, 10 aa, Mycobacterium
DGQATSSAAT

SEQ ID NO: 898854 - protein, 7 aa, Mycobacterium
DGQGRTL

SEQ ID NO: 898855 - protein, 5 aa, Mycobacterium
DGQLD

SEQ ID NO: 898856 - protein, 10 aa, Mycobacterium
DGQPAAKAEL

SEQ ID NO: 898857 - protein, 13 aa, Mycobacterium
DGQPLTGSAQRPG

SEQ ID NO: 898858 - protein, 10 aa, Mycobacterium
DGQPLTGTNS

SEQ ID NO: 898859 - protein, 7 aa, Mycobacterium
DGQPRVS

SEQ ID NO: 898860 - protein, 10 aa, Mycobacterium
DGQPVPASTG

SEQ ID NO: 898861 - protein, 6 aa, Mycobacterium
DGQQVV

SEQ ID NO: 898862 - protein, 11 aa, Mycobacterium
DGQRAPRVPGA

SEQ ID NO: 898863 - protein, 5 aa, Mycobacterium
DGQRG

SEQ ID NO: 898864 - protein, 7 aa, Mycobacterium
DGQSDAK

SEQ ID NO: 898865 - protein, 7 aa, Mycobacterium
DGQSGIR

SEQ ID NO: 898866 - protein, 7 aa, Mycobacterium
DGQSSAE

SEQ ID NO: 898867 - protein, 4 aa, Mycobacterium
DGQT

SEQ ID NO: 898868 - protein, 5 aa, Mycobacterium
DGQTV

SEQ ID NO: 898869 - protein, 14 aa, Mycobacterium
DGRAGGRTRDELAD

SEQ ID NO: 898870 - protein, 16 aa, Mycobacterium
DGRAKAGQSIGQQCVH

SEQ ID NO: 898871 - protein, 11 aa, Mycobacterium
DGRAPTSPPRT

SEQ ID NO: 898872 - protein, 9 aa, Mycobacterium
DGRDADAVT

SEQ ID NO: 898873 - protein, 5 aa, Mycobacterium
DGREH

SEQ ID NO: 898874 - protein, 13 aa, Mycobacterium
DGRETAPAAATEN

SEQ ID NO: 898875 - protein, 5 aa, Mycobacterium
DGRFS

SEQ ID NO: 898876 - protein, 13 aa, Mycobacterium
DGRFSDADRARQR

SEQ ID NO: 898877 - protein, 7 aa, Mycobacterium
DGRGDQI

SEQ ID NO: 898878 - protein, 14 aa, Mycobacterium
DGRIYTGNKAAVES

SEQ ID NO: 898879 - protein, 10 aa, Mycobacterium
DGRPAGSAPA

SEQ ID NO: 898880 - protein, 8 aa, Mycobacterium
DGRPRRAG

SEQ ID NO: 898881 - protein, 8 aa, Mycobacterium
DGRPTDKT

SEQ ID NO: 898882 - protein, 8 aa, Mycobacterium
DGRPYQDS

SEQ ID NO: 898883 - protein, 6 aa, Mycobacterium
DGRQIR

SEQ ID NO: 898884 - protein, 9 aa, Mycobacterium
DGRRKRATR

SEQ ID NO: 898885 - protein, 23 aa, Mycobacterium
DGRRQDGVGQSPGPNPPGQGAEV

SEQ ID NO: 898886 - protein, 7 aa, Mycobacterium
DGRRRFR

SEQ ID NO: 898887 - protein, 12 aa, Mycobacterium
DGRRYSPGKQNG

SEQ ID NO: 898888 - protein, 7 aa, Mycobacterium
DGRSAGR

SEQ ID NO: 898889 - protein, 17 aa, Mycobacterium
DGRSLSDEWAGGAQAYK

SEQ ID NO: 898890 - protein, 4 aa, Mycobacterium
DGRT

SEQ ID NO: 898891 - protein, 6 aa, Mycobacterium
DGRTAP

SEQ ID NO: 898892 - protein, 5 aa, Mycobacterium
DGRTY

SEQ ID NO: 898893 - protein, 6 aa, Mycobacterium
DGRVDP

SEQ ID NO: 898894 - protein, 5 aa, Mycobacterium
DGRVS

SEQ ID NO: 898895 - protein, 4 aa, Mycobacterium
DGRY

SEQ ID NO: 898896 - protein, 12 aa, Mycobacterium
DGSAERRGRPSA

SEQ ID NO: 898897 - protein, 10 aa, Mycobacterium
DGSATGAAAA

SEQ ID NO: 898898 - protein, 18 aa, Mycobacterium
DGSATPADTSGPLPQPPV

SEQ ID NO: 898899 - protein, 6 aa, Mycobacterium
DGSAVA

SEQ ID NO: 898900 - protein, 9 aa, Mycobacterium
DGSDIGGGA

SEQ ID NO: 898901 - protein, 6 aa, Mycobacterium
DGSEDT

SEQ ID NO: 898902 - protein, 5 aa, Mycobacterium
DGSEL

SEQ ID NO: 898903 - protein, 9 aa, Mycobacterium
DGSEVTSDS

SEQ ID NO: 898904 - protein, 7 aa, Mycobacterium
DGSGDGG

SEQ ID NO: 898905 - protein, 5 aa, Mycobacterium
DGSGE

SEQ ID NO: 898906 - protein, 7 aa, Mycobacterium
DGSGELV

SEQ ID NO: 898907 - protein, 7 aa, Mycobacterium
DGSGERV

SEQ ID NO: 898908 - protein, 7 aa, Mycobacterium
DGSGGMG

SEQ ID NO: 898909 - protein, 7 aa, Mycobacterium
DGSGLYK

SEQ ID NO: 898910 - protein, 7 aa, Mycobacterium
DGSGNEL

SEQ ID NO: 898911 - protein, 7 aa, Mycobacterium
DGSGPYH

SEQ ID NO: 898912 - protein, 13 aa, Mycobacterium
DGSGRRPGVHPPE

SEQ ID NO: 898913 - protein, 9 aa, Mycobacterium
DGSGTAGSF

SEQ ID NO: 898914 - protein, 8 aa, Mycobacterium
DGSGTTDN

SEQ ID NO: 898915 - protein, 28 aa, Mycobacterium
DGSGVRQVSKPQRGDYHTSPSWGYAARH

SEQ ID NO: 898916 - protein, 4 aa, Mycobacterium
DGSH

SEQ ID NO: 898917 - protein, 17 aa, Mycobacterium
DGSLDNEYSVAEWAGAK

SEQ ID NO: 898918 - protein, 10 aa, Mycobacterium
DGSNEDPNGI

SEQ ID NO: 898919 - protein, 27 aa, Mycobacterium
DGSNGNLRLPDTDKGVLDGDANQDRAM

SEQ ID NO: 898920 - protein, 4 aa, Mycobacterium
DGSQ

SEQ ID NO: 898921 - protein, 7 aa, Mycobacterium
DGSRGDL

SEQ ID NO: 898922 - protein, 9 aa, Mycobacterium
DGSRSELNS

SEQ ID NO: 898923 - protein, 4 aa, Mycobacterium
DGSS

SEQ ID NO: 898924 - protein, 8 aa, Mycobacterium
DGSSLTNT

SEQ ID NO: 898925 - protein, 8 aa, Mycobacterium
DGSSSPVE

SEQ ID NO: 898926 - protein, 27 aa, Mycobacterium
DGSSTFVNNPTSAMSEQELSGRVAELA

SEQ ID NO: 898927 - protein, 27 aa, Mycobacterium
DGSSTFVNNPTSAMSKQELSDRVAALN

SEQ ID NO: 898928 - protein, 27 aa, Mycobacterium
DGSSTFVNNPTSAMSQQELADRVAALT

SEQ ID NO: 898929 - protein, 27 aa, Mycobacterium
DGSSTFVNNPTSAMSQQELSDRVSALK

SEQ ID NO: 898930 - protein, 56 aa, Mycobacterium
DGSSTPAEAPEAPEVVEEPDAPTPSVETGEATPRAGPATTDRASAATATASEPTES

SEQ ID NO: 898931 - protein, 6 aa, Mycobacterium
DGSSVE

SEQ ID NO: 898932 - protein, 4 aa, Mycobacterium
DGST

SEQ ID NO: 898933 - protein, 6 aa, Mycobacterium
DGSTAT

SEQ ID NO: 898934 - protein, 8 aa, Mycobacterium
DGSTTPMT

SEQ ID NO: 898935 - protein, 6 aa, Mycobacterium
DGSTVA

SEQ ID NO: 898936 - protein, 4 aa, Mycobacterium
DGSV

SEQ ID NO: 898937 - protein, 10 aa, Mycobacterium
DGSVEEAGTR

SEQ ID NO: 898938 - protein, 8 aa, Mycobacterium
DGSVREAS

SEQ ID NO: 898939 - protein, 7 aa, Mycobacterium
DGSVRRA

SEQ ID NO: 898940 - protein, 4 aa, Mycobacterium
DGTA

SEQ ID NO: 898941 - protein, 10 aa, Mycobacterium
DGTAAWGPAD

SEQ ID NO: 898942 - protein, 7 aa, Mycobacterium
DGTADPA

SEQ ID NO: 898943 - protein, 11 aa, Mycobacterium
DGTANPVSDDA

SEQ ID NO: 898944 - protein, 5 aa, Mycobacterium
DGTAR

SEQ ID NO: 898945 - protein, 5 aa, Mycobacterium
DGTAV

SEQ ID NO: 898946 - protein, 6 aa, Mycobacterium
DGTAVA

SEQ ID NO: 898947 - protein, 26 aa, Mycobacterium
DGTAVAPGEGLSSNERGENDKLDPYG

SEQ ID NO: 898948 - protein, 13 aa, Mycobacterium
DGTAVAVGDGQYG

SEQ ID NO: 898949 - protein, 12 aa, Mycobacterium
DGTAVGAGYNTY

SEQ ID NO: 898950 - protein, 7 aa, Mycobacterium
DGTDLDA

SEQ ID NO: 898951 - protein, 4 aa, Mycobacterium
DGTE

SEQ ID NO: 898952 - protein, 6 aa, Mycobacterium
DGTEVG

SEQ ID NO: 898953 - protein, 21 aa, Mycobacterium
DGTFTYRPTEAAREAASRPFA

SEQ ID NO: 898954 - protein, 4 aa, Mycobacterium
DGTG

SEQ ID NO: 898955 - protein, 6 aa, Mycobacterium
DGTGAV

SEQ ID NO: 898956 - protein, 6 aa, Mycobacterium
DGTGGT

SEQ ID NO: 898957 - protein, 10 aa, Mycobacterium
DGTGTDPDRV

SEQ ID NO: 898958 - protein, 7 aa, Mycobacterium
DGTHESL

SEQ ID NO: 898959 - protein, 4 aa, Mycobacterium
DGTI

SEQ ID NO: 898960 - protein, 4 aa, Mycobacterium
DGTK

SEQ ID NO: 898961 - protein, 12 aa, Mycobacterium
DGTKIDYSYAPR

SEQ ID NO: 898962 - protein, 4 aa, Mycobacterium
DGTL

SEQ ID NO: 898963 - protein, 13 aa, Mycobacterium
DGTLDERLGCSSS

SEQ ID NO: 898964 - protein, 8 aa, Mycobacterium
DGTLEHSG

SEQ ID NO: 898965 - protein, 10 aa, Mycobacterium
DGTNNPAPVD

SEQ ID NO: 898966 - protein, 7 aa, Mycobacterium
DGTPCTA

SEQ ID NO: 898967 - protein, 6 aa, Mycobacterium
DGTPIE

SEQ ID NO: 898968 - protein, 14 aa, Mycobacterium
DGTPLAEPDTESRQ

SEQ ID NO: 898969 - protein, 8 aa, Mycobacterium
DGTPTNVT

SEQ ID NO: 898970 - protein, 6 aa, Mycobacterium
DGTPVA

SEQ ID NO: 898971 - protein, 9 aa, Mycobacterium
DGTPYRAGE

SEQ ID NO: 898972 - protein, 4 aa, Mycobacterium
DGTQ

SEQ ID NO: 898973 - protein, 7 aa, Mycobacterium
DGTQEGY

SEQ ID NO: 898974 - protein, 15 aa, Mycobacterium
DGTRNIKAEDTAKVD

SEQ ID NO: 898975 - protein, 6 aa, Mycobacterium
DGTRNL

SEQ ID NO: 898976 - protein, 14 aa, Mycobacterium
DGTSNIKADETDSL

SEQ ID NO: 898977 - protein, 7 aa, Mycobacterium
DGTSPVD

SEQ ID NO: 898978 - protein, 9 aa, Mycobacterium
DGTSSARVD

SEQ ID NO: 898979 - protein, 6 aa, Mycobacterium
DGTTDF

SEQ ID NO: 898980 - protein, 6 aa, Mycobacterium
DGTTES

SEQ ID NO: 898981 - protein, 7 aa, Mycobacterium
DGTTRTA

SEQ ID NO: 898982 - protein, 16 aa, Mycobacterium
DGTTVNTYPLPNASGW

SEQ ID NO: 898983 - protein, 20 aa, Mycobacterium
DGTTYLGGKGVTRSLAEEDA

SEQ ID NO: 898984 - protein, 4 aa, Mycobacterium
DGTV

SEQ ID NO: 898985 - protein, 5 aa, Mycobacterium
DGTVS

SEQ ID NO: 898986 - protein, 11 aa, Mycobacterium
DGTVTPTNEQL

SEQ ID NO: 898987 - protein, 4 aa, Mycobacterium
DGTY

SEQ ID NO: 898988 - protein, 12 aa, Mycobacterium
DGTYTYTPGANF

SEQ ID NO: 898989 - protein, 7 aa, Mycobacterium
DGVAATA

SEQ ID NO: 898990 - protein, 4 aa, Mycobacterium
DGVD

SEQ ID NO: 898991 - protein, 18 aa, Mycobacterium
DGVEAARADGFDATADLD

SEQ ID NO: 898992 - protein, 15 aa, Mycobacterium
DGVGADTPGPRGTDP

SEQ ID NO: 898993 - protein, 31 aa, Mycobacterium
DGVGMDPDALRSGPSDALSAGDAEPEGTGAH

SEQ ID NO: 898994 - protein, 6 aa, Mycobacterium
DGVNSE

SEQ ID NO: 898995 - protein, 5 aa, Mycobacterium
DGVNT

SEQ ID NO: 898996 - protein, 5 aa, Mycobacterium
DGVPA

SEQ ID NO: 898997 - protein, 14 aa, Mycobacterium
DGVPGLTQPEIAPT

SEQ ID NO: 898998 - protein, 7 aa, Mycobacterium
DGVPGVT

SEQ ID NO: 898999 - protein, 14 aa, Mycobacterium
DGVPPPAGDAVPQI

SEQ ID NO: 899000 - protein, 8 aa, Mycobacterium
DGVQGPSV

SEQ ID NO: 899001 - protein, 13 aa, Mycobacterium
DGVRPLEQGEGDS

SEQ ID NO: 899002 - protein, 9 aa, Mycobacterium
DGVRREGTV

SEQ ID NO: 899003 - protein, 8 aa, Mycobacterium
DGVSRGAS

SEQ ID NO: 899004 - protein, 4 aa, Mycobacterium
DGVT

SEQ ID NO: 899005 - protein, 12 aa, Mycobacterium
DGVTEPGARQQL

SEQ ID NO: 899006 - protein, 13 aa, Mycobacterium
DGVTTQKRPHEDA

SEQ ID NO: 899007 - protein, 17 aa, Mycobacterium
DGVTVTPKNGGPAEEYA

SEQ ID NO: 899008 - protein, 9 aa, Mycobacterium
DGYDEGNAE

SEQ ID NO: 899009 - protein, 21 aa, Mycobacterium
DGYGHGATQAARAALAGGAAE

SEQ ID NO: 899010 - protein, 7 aa, Mycobacterium
DGYNGSM

SEQ ID NO: 899011 - protein, 6 aa, Mycobacterium
DGYNGT

SEQ ID NO: 899012 - protein, 7 aa, Mycobacterium
DGYNGTM

SEQ ID NO: 899013 - protein, 22 aa, Mycobacterium
DGYTANEANSAAEMTAVAPVVM

SEQ ID NO: 899014 - protein, 11 aa, Mycobacterium
DGYTLTPRAER

SEQ ID NO: 899015 - protein, 5 aa, Mycobacterium
DHADQ

SEQ ID NO: 899016 - protein, 12 aa, Mycobacterium
DHAETGKATLEG

SEQ ID NO: 899017 - protein, 11 aa, Mycobacterium
DHASGNGGGRV

SEQ ID NO: 899018 - protein, 4 aa, Mycobacterium
DHAT

SEQ ID NO: 899019 - protein, 7 aa, Mycobacterium
DHATKGR

SEQ ID NO: 899020 - protein, 6 aa, Mycobacterium
DHDAAT

SEQ ID NO: 899021 - protein, 6 aa, Mycobacterium
DHDANP

SEQ ID NO: 899022 - protein, 5 aa, Mycobacterium
DHDAV

SEQ ID NO: 899023 - protein, 6 aa, Mycobacterium
DHDGGV

SEQ ID NO: 899024 - protein, 6 aa, Mycobacterium
DHDGSV

SEQ ID NO: 899025 - protein, 7 aa, Mycobacterium
DHDKDQS

SEQ ID NO: 899026 - protein, 4 aa, Mycobacterium
DHDQ

SEQ ID NO: 899027 - protein, 15 aa, Mycobacterium
DHDQSGSVLSSDNDE

SEQ ID NO: 899028 - protein, 4 aa, Mycobacterium
DHDT

SEQ ID NO: 899029 - protein, 4 aa, Mycobacterium
DHEA

SEQ ID NO: 899030 - protein, 37 aa, Mycobacterium
DHESPPPPTVNPSPPPDFGRPGRPGGGGGGGGSIVRP

SEQ ID NO: 899031 - protein, 12 aa, Mycobacterium
DHGADEGDHGGI

SEQ ID NO: 899032 - protein, 6 aa, Mycobacterium
DHGAEV

SEQ ID NO: 899033 - protein, 7 aa, Mycobacterium
DHGETGW

SEQ ID NO: 899034 - protein, 6 aa, Mycobacterium
DHGGSL

SEQ ID NO: 899035 - protein, 9 aa, Mycobacterium
DHGPGSPEI

SEQ ID NO: 899036 - protein, 5 aa, Mycobacterium
DHGQK

SEQ ID NO: 899037 - protein, 8 aa, Mycobacterium
DHGQVTRD

SEQ ID NO: 899038 - protein, 8 aa, Mycobacterium
DHGRPDTF

SEQ ID NO: 899039 - protein, 13 aa, Mycobacterium
DHGTLPKPSQDRI

SEQ ID NO: 899040 - protein, 11 aa, Mycobacterium
DHGYADAQLSE

SEQ ID NO: 899041 - protein, 5 aa, Mycobacterium
DHIGA

SEQ ID NO: 899042 - protein, 34 aa, Mycobacterium
DHKSGGQSSTSTTASTSASTTTASSAAPAAKAKY

SEQ ID NO: 899043 - protein, 6 aa, Mycobacterium
DHNMEG

SEQ ID NO: 899044 - protein, 6 aa, Mycobacterium
DHPDGS

SEQ ID NO: 899045 - protein, 5 aa, Mycobacterium
DHPDV

SEQ ID NO: 899046 - protein, 5 aa, Mycobacterium
DHPGD

SEQ ID NO: 899047 - protein, 9 aa, Mycobacterium
DHPINDSAE

SEQ ID NO: 899048 - protein, 10 aa, Mycobacterium
DHPLTDPAQA

SEQ ID NO: 899049 - protein, 8 aa, Mycobacterium
DHPVGTGP

SEQ ID NO: 899050 - protein, 8 aa, Mycobacterium
DHQTVSGL

SEQ ID NO: 899051 - protein, 5 aa, Mycobacterium
DHRGS

SEQ ID NO: 899052 - protein, 4 aa, Mycobacterium
DHRI

SEQ ID NO: 899053 - protein, 6 aa, Mycobacterium
DHSATF

SEQ ID NO: 899054 - protein, 11 aa, Mycobacterium
DHTGYPASGDL

SEQ ID NO: 899055 - protein, 9 aa, Mycobacterium
DHTPGHTRG

SEQ ID NO: 899056 - protein, 25 aa, Mycobacterium
DHVANPARVSDPDKLRAATSGKTAL

SEQ ID NO: 899057 - protein, 14 aa, Mycobacterium
DIAKGGPIHSQSEG

SEQ ID NO: 899058 - protein, 7 aa, Mycobacterium
DIAPGKP

SEQ ID NO: 899059 - protein, 8 aa, Mycobacterium
DIAPPERV

SEQ ID NO: 899060 - protein, 15 aa, Mycobacterium
DIARGRAAAGPEAPE

SEQ ID NO: 899061 - protein, 20 aa, Mycobacterium
DIATTAADLQPQYGSNGTAI

SEQ ID NO: 899062 - protein, 13 aa, Mycobacterium
DIDDPANSRWEED

SEQ ID NO: 899063 - protein, 5 aa, Mycobacterium
DIDGR

SEQ ID NO: 899064 - protein, 45 aa, Mycobacterium
DIDGRPGLSPTSTPTSIATSSAPSASGKPPAGSAASSAPAAGAPI

SEQ ID NO: 899065 - protein, 13 aa, Mycobacterium
DIDPERTADELTE

SEQ ID NO: 899066 - protein, 9 aa, Mycobacterium
DIESAGGTA

SEQ ID NO: 899067 - protein, 5 aa, Mycobacterium
DIETT

SEQ ID NO: 899068 - protein, 4 aa, Mycobacterium
DIGA

SEQ ID NO: 899069 - protein, 11 aa, Mycobacterium
DIGATTKTLPD

SEQ ID NO: 899070 - protein, 5 aa, Mycobacterium
DIGDP

SEQ ID NO: 899071 - protein, 10 aa, Mycobacterium
DIGEHSNIGA

SEQ ID NO: 899072 - protein, 10 aa, Mycobacterium
DIGGGNTGKR

SEQ ID NO: 899073 - protein, 10 aa, Mycobacterium
DIGGKNPAAG

SEQ ID NO: 899074 - protein, 25 aa, Mycobacterium
DIGGSDSALSEEEAGKAKERCGGNE

SEQ ID NO: 899075 - protein, 7 aa, Mycobacterium
DIGGTGA

SEQ ID NO: 899076 - protein, 7 aa, Mycobacterium
DIGPPDA

SEQ ID NO: 899077 - protein, 11 aa, Mycobacterium
DIGSTSKTLPE

SEQ ID NO: 899078 - protein, 8 aa, Mycobacterium
DIPAGASP

SEQ ID NO: 899079 - protein, 20 aa, Mycobacterium
DIPDLGGKTGTAEFGDNTHS

SEQ ID NO: 899080 - protein, 4 aa, Mycobacterium
DIPG

SEQ ID NO: 899081 - protein, 10 aa, Mycobacterium
DIPPQEKAKI

SEQ ID NO: 899082 - protein, 4 aa, Mycobacterium
DIPR

SEQ ID NO: 899083 - protein, 8 aa, Mycobacterium
DIPSRGPH

SEQ ID NO: 899084 - protein, 11 aa, Mycobacterium
DIPTKQTGGSF

SEQ ID NO: 899085 - protein, 6 aa, Mycobacterium
DIQETP

SEQ ID NO: 899086 - protein, 11 aa, Mycobacterium
DIQEVDGSDAA

SEQ ID NO: 899087 - protein, 14 aa, Mycobacterium
DIQRESGLAPGSGA

SEQ ID NO: 899088 - protein, 9 aa, Mycobacterium
DIRAKDPRK

SEQ ID NO: 899089 - protein, 4 aa, Mycobacterium
DIRN

SEQ ID NO: 899090 - protein, 8 aa, Mycobacterium
DIRPGGQT

SEQ ID NO: 899091 - protein, 10 aa, Mycobacterium
DIRSTSPITE

SEQ ID NO: 899092 - protein, 27 aa, Mycobacterium
DISGTADGFDTDNPSFRTTGNFQIKIA

SEQ ID NO: 899093 - protein, 8 aa, Mycobacterium
DISTPDDV

SEQ ID NO: 899094 - protein, 6 aa, Mycobacterium
DITEQE

SEQ ID NO: 899095 - protein, 7 aa, Mycobacterium
DITGPPF

SEQ ID NO: 899096 - protein, 12 aa, Mycobacterium
DITTGESGACGV

SEQ ID NO: 899097 - protein, 5 aa, Mycobacterium
DKAAE

SEQ ID NO: 899098 - protein, 14 aa, Mycobacterium
DKAPAAASRGSRVP

SEQ ID NO: 899099 - protein, 7 aa, Mycobacterium
DKAQPQR

SEQ ID NO: 899100 - protein, 13 aa, Mycobacterium
DKATNPEQGPASM

SEQ ID NO: 899101 - protein, 5 aa, Mycobacterium
DKAVE

SEQ ID NO: 899102 - protein, 15 aa, Mycobacterium
DKDNGTITKIYKQAT

SEQ ID NO: 899103 - protein, 9 aa, Mycobacterium
DKDVPSAWS

SEQ ID NO: 899104 - protein, 6 aa, Mycobacterium
DKEAQF

SEQ ID NO: 899105 - protein, 14 aa, Mycobacterium
DKFGADKPTSDPME

SEQ ID NO: 899106 - protein, 8 aa, Mycobacterium
DKFPQTRR

SEQ ID NO: 899107 - protein, 9 aa, Mycobacterium
DKGFDVQTP

SEQ ID NO: 899108 - protein, 9 aa, Mycobacterium
DKGGPGQDW

SEQ ID NO: 899109 - protein, 17 aa, Mycobacterium
DKGLDAARTDPNYADQD

SEQ ID NO: 899110 - protein, 6 aa, Mycobacterium
DKGLGN

SEQ ID NO: 899111 - protein, 5 aa, Mycobacterium
DKGLP

SEQ ID NO: 899112 - protein, 11 aa, Mycobacterium
DKGRDAAKDQL

SEQ ID NO: 899113 - protein, 7 aa, Mycobacterium
DKGRRRF

SEQ ID NO: 899114 - protein, 15 aa, Mycobacterium
DKGTGSITKIYMQAT

SEQ ID NO: 899115 - protein, 6 aa, Mycobacterium
DKGTPF

SEQ ID NO: 899116 - protein, 7 aa, Mycobacterium
DKGTPYA

SEQ ID NO: 899117 - protein, 7 aa, Mycobacterium
DKGYRTR

SEQ ID NO: 899118 - protein, 4 aa, Mycobacterium
DKIA

SEQ ID NO: 899119 - protein, 7 aa, Mycobacterium
DKKNGAL

SEQ ID NO: 899120 - protein, 7 aa, Mycobacterium
DKLPARG

SEQ ID NO: 899121 - protein, 8 aa, Mycobacterium
DKLPGVAE

SEQ ID NO: 899122 - protein, 8 aa, Mycobacterium
DKLPPGAQ

SEQ ID NO: 899123 - protein, 16 aa, Mycobacterium
DKNAGIKATADGLGRT

SEQ ID NO: 899124 - protein, 15 aa, Mycobacterium
DKNDGSITKIYKEAT

SEQ ID NO: 899125 - protein, 15 aa, Mycobacterium
DKNGTDPSNAEISAT

SEQ ID NO: 899126 - protein, 7 aa, Mycobacterium
DKNIGIA

SEQ ID NO: 899127 - protein, 8 aa, Mycobacterium
DKPAPTHK

SEQ ID NO: 899128 - protein, 13 aa, Mycobacterium
DKPEVTVGGQPVE

SEQ ID NO: 899129 - protein, 5 aa, Mycobacterium
DKPGV

SEQ ID NO: 899130 - protein, 22 aa, Mycobacterium
DKPKLDQEKTGKSKPEKVDPPG

SEQ ID NO: 899131 - protein, 7 aa, Mycobacterium
DKQNDLD

SEQ ID NO: 899132 - protein, 10 aa, Mycobacterium
DKQQSGQAAS

SEQ ID NO: 899133 - protein, 24 aa, Mycobacterium
DKRALPAPDYADTTRYRAPTTAVE

SEQ ID NO: 899134 - protein, 24 aa, Mycobacterium
DKRALPAPDYRGDAGSFRAPTSDV

SEQ ID NO: 899135 - protein, 8 aa, Mycobacterium
DKSDPTTL

SEQ ID NO: 899136 - protein, 7 aa, Mycobacterium
DKSLGPA

SEQ ID NO: 899137 - protein, 8 aa, Mycobacterium
DKSNGRLT

SEQ ID NO: 899138 - protein, 6 aa, Mycobacterium
DKSNLD

SEQ ID NO: 899139 - protein, 13 aa, Mycobacterium
DKSSTYPSTEQTL

SEQ ID NO: 899140 - protein, 7 aa, Mycobacterium
DKTEHGP

SEQ ID NO: 899141 - protein, 12 aa, Mycobacterium
DKTGGGFKGETN

SEQ ID NO: 899142 - protein, 9 aa, Mycobacterium
DKTNNDSYI

SEQ ID NO: 899143 - protein, 129 aa, Mycobacterium
DKTPAAEDTEQGAETPAGSEEPTQPQDETPAADADDDAGVDAEPVTTPRKPSSTTKSDVDASESADADATTSGTAGTSESSESEKSDTSSDSSASDSSASDSASSSDSSGSGAGSSGSGGSAGSGGGSD

SEQ ID NO: 899144 - protein, 7 aa, Mycobacterium
DKTPEGF

SEQ ID NO: 899145 - protein, 10 aa, Mycobacterium
DKTQSTGDTV

SEQ ID NO: 899146 - protein, 7 aa, Mycobacterium
DKTWTAA

SEQ ID NO: 899147 - protein, 10 aa, Mycobacterium
DKVDTGEVGS

SEQ ID NO: 899148 - protein, 7 aa, Mycobacterium
DKVESDH

SEQ ID NO: 899149 - protein, 4 aa, Mycobacterium
DKVN

SEQ ID NO: 899150 - protein, 6 aa, Mycobacterium
DKVNTI

SEQ ID NO: 899151 - protein, 9 aa, Mycobacterium
DKVSDTTLS

SEQ ID NO: 899152 - protein, 17 aa, Mycobacterium
DKYGSPPDYTAAGCSAA

SEQ ID NO: 899153 - protein, 12 aa, Mycobacterium
DLAAAGASVPTD

SEQ ID NO: 899154 - protein, 5 aa, Mycobacterium
DLAER

SEQ ID NO: 899155 - protein, 7 aa, Mycobacterium
DLAETGS

SEQ ID NO: 899156 - protein, 19 aa, Mycobacterium
DLAGTSTRVRAKRPDGSWG

SEQ ID NO: 899157 - protein, 18 aa, Mycobacterium
DLAGTSTRVRARHPDGSW

SEQ ID NO: 899158 - protein, 14 aa, Mycobacterium
DLAPDPGEALTGPA

SEQ ID NO: 899159 - protein, 10 aa, Mycobacterium
DLASIGSSIN

SEQ ID NO: 899160 - protein, 7 aa, Mycobacterium
DLATREE

SEQ ID NO: 899161 - protein, 9 aa, Mycobacterium
DLDEESWEE

SEQ ID NO: 899162 - protein, 4 aa, Mycobacterium
DLDG

SEQ ID NO: 899163 - protein, 10 aa, Mycobacterium
DLDGDGRPDT

SEQ ID NO: 899164 - protein, 22 aa, Mycobacterium
DLDGDIGSDGSAPSDRASAAGF

SEQ ID NO: 899165 - protein, 19 aa, Mycobacterium
DLDGTSARIRAKKADGSWG

SEQ ID NO: 899166 - protein, 10 aa, Mycobacterium
DLDQAERDAH

SEQ ID NO: 899167 - protein, 13 aa, Mycobacterium
DLDTAPAAASCEA

SEQ ID NO: 899168 - protein, 5 aa, Mycobacterium
DLEAT

SEQ ID NO: 899169 - protein, 10 aa, Mycobacterium
DLEPAPEMSR

SEQ ID NO: 899170 - protein, 5 aa, Mycobacterium
DLGAA

SEQ ID NO: 899171 - protein, 9 aa, Mycobacterium
DLGAPGGGA

SEQ ID NO: 899172 - protein, 7 aa, Mycobacterium
DLGDEDA

SEQ ID NO: 899173 - protein, 9 aa, Mycobacterium
DLGDGAGGA

SEQ ID NO: 899174 - protein, 13 aa, Mycobacterium
DLGPANGVSETSL

SEQ ID NO: 899175 - protein, 5 aa, Mycobacterium
DLGPE

SEQ ID NO: 899176 - protein, 16 aa, Mycobacterium
DLGPGGISGRPVARRS

SEQ ID NO: 899177 - protein, 13 aa, Mycobacterium
DLGPTAELTTGSV

SEQ ID NO: 899178 - protein, 13 aa, Mycobacterium
DLGQYDLRRHVPA

SEQ ID NO: 899179 - protein, 10 aa, Mycobacterium
DLGRGKGAQA

SEQ ID NO: 899180 - protein, 20 aa, Mycobacterium
DLGRKTGRGFYEYDDTRLFG

SEQ ID NO: 899181 - protein, 9 aa, Mycobacterium
DLGSETANH

SEQ ID NO: 899182 - protein, 10 aa, Mycobacterium
DLGSGSTGRK

SEQ ID NO: 899183 - protein, 4 aa, Mycobacterium
DLHS

SEQ ID NO: 899184 - protein, 8 aa, Mycobacterium
DLKDPRAE

SEQ ID NO: 899185 - protein, 5 aa, Mycobacterium
DLKNP

SEQ ID NO: 899186 - protein, 10 aa, Mycobacterium
DLKSARPLTK

SEQ ID NO: 899187 - protein, 9 aa, Mycobacterium
DLNANAGKG

SEQ ID NO: 899188 - protein, 6 aa, Mycobacterium
DLNPSI

SEQ ID NO: 899189 - protein, 8 aa, Mycobacterium
DLPADSAL

SEQ ID NO: 899190 - protein, 13 aa, Mycobacterium
DLPANATATIGQS

SEQ ID NO: 899191 - protein, 13 aa, Mycobacterium
DLPANATATLGQT

SEQ ID NO: 899192 - protein, 12 aa, Mycobacterium
DLPANSTVSLGQ

SEQ ID NO: 899193 - protein, 6 aa, Mycobacterium
DLPDAE

SEQ ID NO: 899194 - protein, 6 aa, Mycobacterium
DLPDDG

SEQ ID NO: 899195 - protein, 10 aa, Mycobacterium
DLPGGGPLSQ

SEQ ID NO: 899196 - protein, 13 aa, Mycobacterium
DLPNQGAGGPAVG

SEQ ID NO: 899197 - protein, 9 aa, Mycobacterium
DLPNSGGLY

SEQ ID NO: 899198 - protein, 28 aa, Mycobacterium
DLPPHGSPIPDVSGQPVPGAAHPGPPPV

SEQ ID NO: 899199 - protein, 5 aa, Mycobacterium
DLPPQ

SEQ ID NO: 899200 - protein, 6 aa, Mycobacterium
DLPPSA

SEQ ID NO: 899201 - protein, 8 aa, Mycobacterium
DLPQDQAT

SEQ ID NO: 899202 - protein, 11 aa, Mycobacterium
DLPRDHSTGRF

SEQ ID NO: 899203 - protein, 5 aa, Mycobacterium
DLPSG

SEQ ID NO: 899204 - protein, 9 aa, Mycobacterium
DLPSPDDVE

SEQ ID NO: 899205 - protein, 8 aa, Mycobacterium
DLPSPEDI

SEQ ID NO: 899206 - protein, 7 aa, Mycobacterium
DLPTEPA

SEQ ID NO: 899207 - protein, 48 aa, Mycobacterium
DLPTSAPPEEPASQPPRTDVPAAYPRTSPAIQAPASSVGALSTPVSQP

SEQ ID NO: 899208 - protein, 16 aa, Mycobacterium
DLQGDPAHKIAPRATQ

SEQ ID NO: 899209 - protein, 23 aa, Mycobacterium
DLQGIGSSVNAANAAAAISTTEL

SEQ ID NO: 899210 - protein, 5 aa, Mycobacterium
DLQPG

SEQ ID NO: 899211 - protein, 8 aa, Mycobacterium
DLQPGEKW

SEQ ID NO: 899212 - protein, 6 aa, Mycobacterium
DLQQGA

SEQ ID NO: 899213 - protein, 6 aa, Mycobacterium
DLRESP

SEQ ID NO: 899214 - protein, 8 aa, Mycobacterium
DLRNSSGT

SEQ ID NO: 899215 - protein, 15 aa, Mycobacterium
DLRPDQSYPPKPPVG

SEQ ID NO: 899216 - protein, 30 aa, Mycobacterium
DLRPGGPGTRSGPTAIAPGDSAYQAQQPTV

SEQ ID NO: 899217 - protein, 37 aa, Mycobacterium
DLRRSQTERANRLSAAKQARLDADAAAAEAQRRQDAA

SEQ ID NO: 899218 - protein, 6 aa, Mycobacterium
DLSARA

SEQ ID NO: 899219 - protein, 7 aa, Mycobacterium
DLSDADI

SEQ ID NO: 899220 - protein, 9 aa, Mycobacterium
DLSDSDIDD

SEQ ID NO: 899221 - protein, 11 aa, Mycobacterium
DLSEGNLGRDT

SEQ ID NO: 899222 - protein, 4 aa, Mycobacterium
DLSG

SEQ ID NO: 899223 - protein, 5 aa, Mycobacterium
DLSGE

SEQ ID NO: 899224 - protein, 9 aa, Mycobacterium
DLSGPEPTI

SEQ ID NO: 899225 - protein, 6 aa, Mycobacterium
DLSGTR

SEQ ID NO: 899226 - protein, 8 aa, Mycobacterium
DLSPGTIL

SEQ ID NO: 899227 - protein, 9 aa, Mycobacterium
DLSPKARDL

SEQ ID NO: 899228 - protein, 6 aa, Mycobacterium
DLSTGD

SEQ ID NO: 899229 - protein, 11 aa, Mycobacterium
DLTAADRGGFT

SEQ ID NO: 899230 - protein, 9 aa, Mycobacterium
DLTDPEGRR

SEQ ID NO: 899231 - protein, 13 aa, Mycobacterium
DLTGSRATAVEGK

SEQ ID NO: 899232 - protein, 9 aa, Mycobacterium
DLTPDQRTR

SEQ ID NO: 899233 - protein, 6 aa, Mycobacterium
DLTPKT

SEQ ID NO: 899234 - protein, 23 aa, Mycobacterium
DLTSLGSTISAANAAAATATTRM

SEQ ID NO: 899235 - protein, 10 aa, Mycobacterium
DLYGGNEPAR

SEQ ID NO: 899236 - protein, 7 aa, Mycobacterium
DLYGRRR

SEQ ID NO: 899237 - protein, 4 aa, Mycobacterium
DLYP

SEQ ID NO: 899238 - protein, 6 aa, Mycobacterium
DLYPAG

SEQ ID NO: 899239 - protein, 8 aa, Mycobacterium
DMAGPASH

SEQ ID NO: 899240 - protein, 7 aa, Mycobacterium
DMAGPGQ

SEQ ID NO: 899241 - protein, 24 aa, Mycobacterium
DMASSTSLASSATYATGGTATLSS

SEQ ID NO: 899242 - protein, 8 aa, Mycobacterium
DMDDNGPI

SEQ ID NO: 899243 - protein, 7 aa, Mycobacterium
DMDDTAG

SEQ ID NO: 899244 - protein, 17 aa, Mycobacterium
DMDGATPATPNIDPSSN

SEQ ID NO: 899245 - protein, 7 aa, Mycobacterium
DMDTERD

SEQ ID NO: 899246 - protein, 16 aa, Mycobacterium
DMDTERTLEQNAGRTL

SEQ ID NO: 899247 - protein, 23 aa, Mycobacterium
DMEPPDASHWDAQEQAYRASATA

SEQ ID NO: 899248 - protein, 8 aa, Mycobacterium
DMGASARP

SEQ ID NO: 899249 - protein, 8 aa, Mycobacterium
DMGSSARP

SEQ ID NO: 899250 - protein, 12 aa, Mycobacterium
DMPGAEQGADTR

SEQ ID NO: 899251 - protein, 25 aa, Mycobacterium
DMPPDPPRNAREPAGDVPAEPPTSD

SEQ ID NO: 899252 - protein, 9 aa, Mycobacterium
DMSGPLNQT

SEQ ID NO: 899253 - protein, 5 aa, Mycobacterium
DMTNP

SEQ ID NO: 899254 - protein, 10 aa, Mycobacterium
DNAARSGPIA

SEQ ID NO: 899255 - protein, 6 aa, Mycobacterium
DNACGT

SEQ ID NO: 899256 - protein, 5 aa, Mycobacterium
DNADG

SEQ ID NO: 899257 - protein, 9 aa, Mycobacterium
DNADPVAQA

SEQ ID NO: 899258 - protein, 6 aa, Mycobacterium
DNADQA

SEQ ID NO: 899259 - protein, 6 aa, Mycobacterium
DNAGAL

SEQ ID NO: 899260 - protein, 8 aa, Mycobacterium
DNALDDPA

SEQ ID NO: 899261 - protein, 6 aa, Mycobacterium
DNAPIA

SEQ ID NO: 899262 - protein, 7 aa, Mycobacterium
DNAPIGA

SEQ ID NO: 899263 - protein, 8 aa, Mycobacterium
DNAPSNGV

SEQ ID NO: 899264 - protein, 14 aa, Mycobacterium
DNARDTDPVPLNRG

SEQ ID NO: 899265 - protein, 10 aa, Mycobacterium
DNASGSNAQN

SEQ ID NO: 899266 - protein, 6 aa, Mycobacterium
DNASGV

SEQ ID NO: 899267 - protein, 22 aa, Mycobacterium
DNATPAHGVAPQAPAAAVDSGA

SEQ ID NO: 899268 - protein, 9 aa, Mycobacterium
DNDDSGHAG

SEQ ID NO: 899269 - protein, 9 aa, Mycobacterium
DNDGGDPTQ

SEQ ID NO: 899270 - protein, 11 aa, Mycobacterium
DNDGLDDTNGE

SEQ ID NO: 899271 - protein, 6 aa, Mycobacterium
DNDKPT

SEQ ID NO: 899272 - protein, 7 aa, Mycobacterium
DNDPDSF

SEQ ID NO: 899273 - protein, 7 aa, Mycobacterium
DNDTSKK

SEQ ID NO: 899274 - protein, 7 aa, Mycobacterium
DNDVENA

SEQ ID NO: 899275 - protein, 5 aa, Mycobacterium
DNEGF

SEQ ID NO: 899276 - protein, 6 aa, Mycobacterium
DNEITK

SEQ ID NO: 899277 - protein, 5 aa, Mycobacterium
DNFAN

SEQ ID NO: 899278 - protein, 4 aa, Mycobacterium
DNGA

SEQ ID NO: 899279 - protein, 9 aa, Mycobacterium
DNGAHARSA

SEQ ID NO: 899280 - protein, 8 aa, Mycobacterium
DNGAVGKT

SEQ ID NO: 899281 - protein, 7 aa, Mycobacterium
DNGAVRT

SEQ ID NO: 899282 - protein, 10 aa, Mycobacterium
DNGETTSNRP

SEQ ID NO: 899283 - protein, 5 aa, Mycobacterium
DNGHG

SEQ ID NO: 899284 - protein, 7 aa, Mycobacterium
DNGPCRG

SEQ ID NO: 899285 - protein, 6 aa, Mycobacterium
DNGRCA

SEQ ID NO: 899286 - protein, 8 aa, Mycobacterium
DNGTPGDL

SEQ ID NO: 899287 - protein, 9 aa, Mycobacterium
DNGTTGPTI

SEQ ID NO: 899288 - protein, 9 aa, Mycobacterium
DNGVETRTA

SEQ ID NO: 899289 - protein, 11 aa, Mycobacterium
DNKGATSNEAT

SEQ ID NO: 899290 - protein, 8 aa, Mycobacterium
DNLAHPKA

SEQ ID NO: 899291 - protein, 4 aa, Mycobacterium
DNLP

SEQ ID NO: 899292 - protein, 10 aa, Mycobacterium
DNLRGEGDNI

SEQ ID NO: 899293 - protein, 11 aa, Mycobacterium
DNLRGQGPDIR

SEQ ID NO: 899294 - protein, 10 aa, Mycobacterium
DNLRGQGSTI

SEQ ID NO: 899295 - protein, 14 aa, Mycobacterium
DNLTGSATGESGKR

SEQ ID NO: 899296 - protein, 6 aa, Mycobacterium
DNNANA

SEQ ID NO: 899297 - protein, 13 aa, Mycobacterium
DNNDITGAASLEN

SEQ ID NO: 899298 - protein, 8 aa, Mycobacterium
DNNGTGAK

SEQ ID NO: 899299 - protein, 4 aa, Mycobacterium
DNNH

SEQ ID NO: 899300 - protein, 13 aa, Mycobacterium
DNNIAGAAATAQR

SEQ ID NO: 899301 - protein, 17 aa, Mycobacterium
DNNIATASATGVGNIPT

SEQ ID NO: 899302 - protein, 11 aa, Mycobacterium
DNNPALTTNGA

SEQ ID NO: 899303 - protein, 12 aa, Mycobacterium
DNNTANVSATGL

SEQ ID NO: 899304 - protein, 10 aa, Mycobacterium
DNPEDPDGDV

SEQ ID NO: 899305 - protein, 29 aa, Mycobacterium
DNPFGGNGGNGGTGGPGTLGGDGGRGGFG

SEQ ID NO: 899306 - protein, 4 aa, Mycobacterium
DNPG

SEQ ID NO: 899307 - protein, 5 aa, Mycobacterium
DNPGA

SEQ ID NO: 899308 - protein, 8 aa, Mycobacterium
DNPGKDTI

SEQ ID NO: 899309 - protein, 7 aa, Mycobacterium
DNPLGAD

SEQ ID NO: 899310 - protein, 7 aa, Mycobacterium
DNPLGTL

SEQ ID NO: 899311 - protein, 4 aa, Mycobacterium
DNPN

SEQ ID NO: 899312 - protein, 9 aa, Mycobacterium
DNPNASNAD

SEQ ID NO: 899313 - protein, 10 aa, Mycobacterium
DNPNSPLQDK

SEQ ID NO: 899314 - protein, 14 aa, Mycobacterium
DNPNTVEHNGGSTW

SEQ ID NO: 899315 - protein, 9 aa, Mycobacterium
DNPPAAAAQ

SEQ ID NO: 899316 - protein, 10 aa, Mycobacterium
DNPPAEADKP

SEQ ID NO: 899317 - protein, 28 aa, Mycobacterium
DNPPKAVYGDGKCSDGSGTAPASYCPKD

SEQ ID NO: 899318 - protein, 6 aa, Mycobacterium
DNPTDV

SEQ ID NO: 899319 - protein, 9 aa, Mycobacterium
DNPTPEQYK

SEQ ID NO: 899320 - protein, 6 aa, Mycobacterium
DNPTRV

SEQ ID NO: 899321 - protein, 42 aa, Mycobacterium
DNPVPPSGTAGQPGATGATGANGQSGQAGLNGGSAGTSGPAI

SEQ ID NO: 899322 - protein, 6 aa, Mycobacterium
DNQAPV

SEQ ID NO: 899323 - protein, 7 aa, Mycobacterium
DNRDGLT

SEQ ID NO: 899324 - protein, 8 aa, Mycobacterium
DNRDTARD

SEQ ID NO: 899325 - protein, 14 aa, Mycobacterium
DNRNRGRSKGEVEA

SEQ ID NO: 899326 - protein, 5 aa, Mycobacterium
DNRRQ

SEQ ID NO: 899327 - protein, 12 aa, Mycobacterium
DNSEQDAEKPTI

SEQ ID NO: 899328 - protein, 5 aa, Mycobacterium
DNSPA

SEQ ID NO: 899329 - protein, 4 aa, Mycobacterium
DNSR

SEQ ID NO: 899330 - protein, 8 aa, Mycobacterium
DNSRAAAQ

SEQ ID NO: 899331 - protein, 7 aa, Mycobacterium
DNSSPAA

SEQ ID NO: 899332 - protein, 5 aa, Mycobacterium
DNSTV

SEQ ID NO: 899333 - protein, 10 aa, Mycobacterium
DNTGAGYGTA

SEQ ID NO: 899334 - protein, 11 aa, Mycobacterium
DNTPPPSAPVD

SEQ ID NO: 899335 - protein, 17 aa, Mycobacterium
DNTPSGSTVATDQSIDD

SEQ ID NO: 899336 - protein, 7 aa, Mycobacterium
DNTTITG

SEQ ID NO: 899337 - protein, 5 aa, Mycobacterium
DNTTP

SEQ ID NO: 899338 - protein, 6 aa, Mycobacterium
DNTYPG

SEQ ID NO: 899339 - protein, 7 aa, Mycobacterium
DNTYPGA

SEQ ID NO: 899340 - protein, 10 aa, Mycobacterium
DNVPQNPAIG

SEQ ID NO: 899341 - protein, 6 aa, Mycobacterium
DPAAAA

SEQ ID NO: 899342 - protein, 12 aa, Mycobacterium
DPAAAAFDEGGA

SEQ ID NO: 899343 - protein, 9 aa, Mycobacterium
DPAAADTDP

SEQ ID NO: 899344 - protein, 11 aa, Mycobacterium
DPAAAEQGFAP

SEQ ID NO: 899345 - protein, 7 aa, Mycobacterium
DPAAERI

SEQ ID NO: 899346 - protein, 7 aa, Mycobacterium
DPAAFTG

SEQ ID NO: 899347 - protein, 11 aa, Mycobacterium
DPAAGELAQSR

SEQ ID NO: 899348 - protein, 9 aa, Mycobacterium
DPAAPPPDQ

SEQ ID NO: 899349 - protein, 10 aa, Mycobacterium
DPAAPPPDSL

SEQ ID NO: 899350 - protein, 16 aa, Mycobacterium
DPAARAALSGGSVTED

SEQ ID NO: 899351 - protein, 8 aa, Mycobacterium
DPAASAET

SEQ ID NO: 899352 - protein, 21 aa, Mycobacterium
DPAAVSRATALGADAAASVRE

SEQ ID NO: 899353 - protein, 6 aa, Mycobacterium
DPADAA

SEQ ID NO: 899354 - protein, 13 aa, Mycobacterium
DPADVARRGNDDA

SEQ ID NO: 899355 - protein, 5 aa, Mycobacterium
DPAEA

SEQ ID NO: 899356 - protein, 5 aa, Mycobacterium
DPAEL

SEQ ID NO: 899357 - protein, 9 aa, Mycobacterium
DPAEPGGYD

SEQ ID NO: 899358 - protein, 7 aa, Mycobacterium
DPAGDGG

SEQ ID NO: 899359 - protein, 7 aa, Mycobacterium
DPAGFES

SEQ ID NO: 899360 - protein, 12 aa, Mycobacterium
DPAGLAQPDRRV

SEQ ID NO: 899361 - protein, 6 aa, Mycobacterium
DPAGRR

SEQ ID NO: 899362 - protein, 17 aa, Mycobacterium
DPAGRRVTARRPDDSTF

SEQ ID NO: 899363 - protein, 27 aa, Mycobacterium
DPAGTPGRKLTDGPADTQPAPSPDGTR

SEQ ID NO: 899364 - protein, 12 aa, Mycobacterium
DPAHAADYRGNA

SEQ ID NO: 899365 - protein, 118 aa, Mycobacterium
DPAHAAGPAPVAAPAGAPPASAPAPAAAAPASAPGTAPAPAAAPGPAPAAPAPAPAAAAPAPAPAPAAPPAAPVAAPAPVPAPAPAAAPAPEAAAPAPAPAPAPAAAPGFGPDAPPTQ

SEQ ID NO: 899366 - protein, 4 aa, Mycobacterium
DPAI

SEQ ID NO: 899367 - protein, 7 aa, Mycobacterium
DPAKAGM

SEQ ID NO: 899368 - protein, 7 aa, Mycobacterium
DPAKDHV

SEQ ID NO: 899369 - protein, 8 aa, Mycobacterium
DPAKLNET

SEQ ID NO: 899370 - protein, 9 aa, Mycobacterium
DPAKLNETL

SEQ ID NO: 899371 - protein, 19 aa, Mycobacterium
DPAKYPQTGRDIAGTSGEL

SEQ ID NO: 899372 - protein, 18 aa, Mycobacterium
DPALAGSINGAGTFVPSD

SEQ ID NO: 899373 - protein, 12 aa, Mycobacterium
DPALPYSKPPLS

SEQ ID NO: 899374 - protein, 5 aa, Mycobacterium
DPALR

SEQ ID NO: 899375 - protein, 12 aa, Mycobacterium
DPANPAGKGTLS

SEQ ID NO: 899376 - protein, 7 aa, Mycobacterium
DPANPVG

SEQ ID NO: 899377 - protein, 4 aa, Mycobacterium
DPAP

SEQ ID NO: 899378 - protein, 15 aa, Mycobacterium
DPAPDAPKTLDPAGI

SEQ ID NO: 899379 - protein, 12 aa, Mycobacterium
DPAPPDSSQLPA

SEQ ID NO: 899380 - protein, 17 aa, Mycobacterium
DPAPTAAAPTNPGGKIP

SEQ ID NO: 899381 - protein, 7 aa, Mycobacterium
DPAPVTA

SEQ ID NO: 899382 - protein, 9 aa, Mycobacterium
DPAQAGTAT

SEQ ID NO: 899383 - protein, 7 aa, Mycobacterium
DPAQGVA

SEQ ID NO: 899384 - protein, 8 aa, Mycobacterium
DPAQPLTS

SEQ ID NO: 899385 - protein, 5 aa, Mycobacterium
DPARE

SEQ ID NO: 899386 - protein, 14 aa, Mycobacterium
DPAREAVSDYTPER

SEQ ID NO: 899387 - protein, 25 aa, Mycobacterium
DPARFTESSPYNPSSPYSSTKAGSD

SEQ ID NO: 899388 - protein, 12 aa, Mycobacterium
DPARPLPPPEER

SEQ ID NO: 899389 - protein, 7 aa, Mycobacterium
DPARRTP

SEQ ID NO: 899390 - protein, 18 aa, Mycobacterium
DPARTGKPVGSDLASRKA

SEQ ID NO: 899391 - protein, 6 aa, Mycobacterium
DPARYG

SEQ ID NO: 899392 - protein, 8 aa, Mycobacterium
DPASAPAE

SEQ ID NO: 899393 - protein, 7 aa, Mycobacterium
DPASPLR

SEQ ID NO: 899394 - protein, 4 aa, Mycobacterium
DPAT

SEQ ID NO: 899395 - protein, 5 aa, Mycobacterium
DPATA

SEQ ID NO: 899396 - protein, 8 aa, Mycobacterium
DPATAAPP

SEQ ID NO: 899397 - protein, 7 aa, Mycobacterium
DPATAYS

SEQ ID NO: 899398 - protein, 5 aa, Mycobacterium
DPATF

SEQ ID NO: 899399 - protein, 8 aa, Mycobacterium
DPATLGPK

SEQ ID NO: 899400 - protein, 10 aa, Mycobacterium
DPATNQPTDI

SEQ ID NO: 899401 - protein, 8 aa, Mycobacterium
DPATPTDL

SEQ ID NO: 899402 - protein, 6 aa, Mycobacterium
DPATTP

SEQ ID NO: 899403 - protein, 4 aa, Mycobacterium
DPAV

SEQ ID NO: 899404 - protein, 5 aa, Mycobacterium
DPAVA

SEQ ID NO: 899405 - protein, 4 aa, Mycobacterium
DPAY

SEQ ID NO: 899406 - protein, 16 aa, Mycobacterium
DPAYGWSTSPPNVPTP

SEQ ID NO: 899407 - protein, 4 aa, Mycobacterium
DPDA

SEQ ID NO: 899408 - protein, 9 aa, Mycobacterium
DPDAAHGGP

SEQ ID NO: 899409 - protein, 9 aa, Mycobacterium
DPDAELERP

SEQ ID NO: 899410 - protein, 22 aa, Mycobacterium
DPDAPAPAPDDAGPIGDPEMVN

SEQ ID NO: 899411 - protein, 5 aa, Mycobacterium
DPDAR

SEQ ID NO: 899412 - protein, 7 aa, Mycobacterium
DPDAVGG

SEQ ID NO: 899413 - protein, 4 aa, Mycobacterium
DPDD

SEQ ID NO: 899414 - protein, 17 aa, Mycobacterium
DPDDCTVPAGADVMHSG

SEQ ID NO: 899415 - protein, 6 aa, Mycobacterium
DPDDDA

SEQ ID NO: 899416 - protein, 5 aa, Mycobacterium
DPDDF

SEQ ID NO: 899417 - protein, 6 aa, Mycobacterium
DPDDQA

SEQ ID NO: 899418 - protein, 9 aa, Mycobacterium
DPDEGADYD

SEQ ID NO: 899419 - protein, 8 aa, Mycobacterium
DPDGDALT

SEQ ID NO: 899420 - protein, 7 aa, Mycobacterium
DPDGGSI

SEQ ID NO: 899421 - protein, 17 aa, Mycobacterium
DPDHAQAYRDNAAAYRT

SEQ ID NO: 899422 - protein, 8 aa, Mycobacterium
DPDHKTDP

SEQ ID NO: 899423 - protein, 4 aa, Mycobacterium
DPDL

SEQ ID NO: 899424 - protein, 16 aa, Mycobacterium
DPDPAADPAHPAQLPQ

SEQ ID NO: 899425 - protein, 8 aa, Mycobacterium
DPDPDALG

SEQ ID NO: 899426 - protein, 7 aa, Mycobacterium
DPDPEVD

SEQ ID NO: 899427 - protein, 6 aa, Mycobacterium
DPDPFN

SEQ ID NO: 899428 - protein, 11 aa, Mycobacterium
DPDPTAAPADV

SEQ ID NO: 899429 - protein, 6 aa, Mycobacterium
DPDQVN

SEQ ID NO: 899430 - protein, 4 aa, Mycobacterium
DPDR

SEQ ID NO: 899431 - protein, 6 aa, Mycobacterium
DPDRAR

SEQ ID NO: 899432 - protein, 9 aa, Mycobacterium
DPDRDATGQ

SEQ ID NO: 899433 - protein, 6 aa, Mycobacterium
DPDRLA

SEQ ID NO: 899434 - protein, 5 aa, Mycobacterium
DPDRV

SEQ ID NO: 899435 - protein, 5 aa, Mycobacterium
DPDTA

SEQ ID NO: 899436 - protein, 8 aa, Mycobacterium
DPDTAKNT

SEQ ID NO: 899437 - protein, 13 aa, Mycobacterium
DPDTGRRGPTYPY

SEQ ID NO: 899438 - protein, 7 aa, Mycobacterium
DPDVPPR

SEQ ID NO: 899439 - protein, 7 aa, Mycobacterium
DPDVQAS

SEQ ID NO: 899440 - protein, 9 aa, Mycobacterium
DPDVQNSVK

SEQ ID NO: 899441 - protein, 4 aa, Mycobacterium
DPEA

SEQ ID NO: 899442 - protein, 15 aa, Mycobacterium
DPEGNEACICTWQGR

SEQ ID NO: 899443 - protein, 5 aa, Mycobacterium
DPEID

SEQ ID NO: 899444 - protein, 9 aa, Mycobacterium
DPEKAKAEL

SEQ ID NO: 899445 - protein, 5 aa, Mycobacterium
DPELR

SEQ ID NO: 899446 - protein, 14 aa, Mycobacterium
DPEMGTVSRAAATE

SEQ ID NO: 899447 - protein, 12 aa, Mycobacterium
DPEPDPGPGPVF

SEQ ID NO: 899448 - protein, 21 aa, Mycobacterium
DPEPSSDAAPAPSAASGQGAG

SEQ ID NO: 899449 - protein, 6 aa, Mycobacterium
DPERNL

SEQ ID NO: 899450 - protein, 6 aa, Mycobacterium
DPERRV

SEQ ID NO: 899451 - protein, 23 aa, Mycobacterium
DPERTADELAAQAQKAIDGKGLL

SEQ ID NO: 899452 - protein, 10 aa, Mycobacterium
DPETGTGEKH

SEQ ID NO: 899453 - protein, 8 aa, Mycobacterium
DPETTDVN

SEQ ID NO: 899454 - protein, 6 aa, Mycobacterium
DPEVPG

SEQ ID NO: 899455 - protein, 7 aa, Mycobacterium
DPFASAT

SEQ ID NO: 899456 - protein, 6 aa, Mycobacterium
DPFRPR

SEQ ID NO: 899457 - protein, 12 aa, Mycobacterium
DPFSDPPNHPGN

SEQ ID NO: 899458 - protein, 19 aa, Mycobacterium
DPGAATDALNKAKGAQGDV

SEQ ID NO: 899459 - protein, 10 aa, Mycobacterium
DPGAESPQET

SEQ ID NO: 899460 - protein, 8 aa, Mycobacterium
DPGGDGPF

SEQ ID NO: 899461 - protein, 7 aa, Mycobacterium
DPGGDGW

SEQ ID NO: 899462 - protein, 8 aa, Mycobacterium
DPGLSPFD

SEQ ID NO: 899463 - protein, 6 aa, Mycobacterium
DPGMDG

SEQ ID NO: 899464 - protein, 4 aa, Mycobacterium
DPGN

SEQ ID NO: 899465 - protein, 5 aa, Mycobacterium
DPGNG

SEQ ID NO: 899466 - protein, 9 aa, Mycobacterium
DPGPDRPWT

SEQ ID NO: 899467 - protein, 22 aa, Mycobacterium
DPGPELPSTAGQSRAGAVSEER

SEQ ID NO: 899468 - protein, 10 aa, Mycobacterium
DPGPQVRPAL

SEQ ID NO: 899469 - protein, 7 aa, Mycobacterium
DPGSGEV

SEQ ID NO: 899470 - protein, 13 aa, Mycobacterium
DPGSPHPGLAPEF

SEQ ID NO: 899471 - protein, 7 aa, Mycobacterium
DPGSRGA

SEQ ID NO: 899472 - protein, 7 aa, Mycobacterium
DPGSTSG

SEQ ID NO: 899473 - protein, 8 aa, Mycobacterium
DPGTLSPP

SEQ ID NO: 899474 - protein, 9 aa, Mycobacterium
DPGVSGGRG

SEQ ID NO: 899475 - protein, 9 aa, Mycobacterium
DPGWDPTLP

SEQ ID NO: 899476 - protein, 6 aa, Mycobacterium
DPGWGN

SEQ ID NO: 899477 - protein, 11 aa, Mycobacterium
DPGWYGDNRDR

SEQ ID NO: 899478 - protein, 4 aa, Mycobacterium
DPGY

SEQ ID NO: 899479 - protein, 5 aa, Mycobacterium
DPHQP

SEQ ID NO: 899480 - protein, 6 aa, Mycobacterium
DPHRGR

SEQ ID NO: 899481 - protein, 5 aa, Mycobacterium
DPHSQ

SEQ ID NO: 899482 - protein, 13 aa, Mycobacterium
DPICSDGRNPFAH

SEQ ID NO: 899483 - protein, 8 aa, Mycobacterium
DPICSGGG

SEQ ID NO: 899484 - protein, 9 aa, Mycobacterium
DPIDGAKQV

SEQ ID NO: 899485 - protein, 7 aa, Mycobacterium
DPIKDPV

SEQ ID NO: 899486 - protein, 5 aa, Mycobacterium
DPIPD

SEQ ID NO: 899487 - protein, 6 aa, Mycobacterium
DPIVGT

SEQ ID NO: 899488 - protein, 13 aa, Mycobacterium
DPIVGTDGVAQTA

SEQ ID NO: 899489 - protein, 8 aa, Mycobacterium
DPKDNVED

SEQ ID NO: 899490 - protein, 11 aa, Mycobacterium
DPKKRENVDEY

SEQ ID NO: 899491 - protein, 10 aa, Mycobacterium
DPKSAASQLQ

SEQ ID NO: 899492 - protein, 8 aa, Mycobacterium
DPKTGQYV

SEQ ID NO: 899493 - protein, 9 aa, Mycobacterium
DPKTGQYVA

SEQ ID NO: 899494 - protein, 4 aa, Mycobacterium
DPLG

SEQ ID NO: 899495 - protein, 16 aa, Mycobacterium
DPLPEGPANRPAVPQG

SEQ ID NO: 899496 - protein, 6 aa, Mycobacterium
DPLPPH

SEQ ID NO: 899497 - protein, 4 aa, Mycobacterium
DPLQ

SEQ ID NO: 899498 - protein, 4 aa, Mycobacterium
DPLR

SEQ ID NO: 899499 - protein, 8 aa, Mycobacterium
DPLSNPKY

SEQ ID NO: 899500 - protein, 6 aa, Mycobacterium
DPMPAE

SEQ ID NO: 899501 - protein, 11 aa, Mycobacterium
DPNADPTQADI

SEQ ID NO: 899502 - protein, 17 aa, Mycobacterium
DPNAPAAPTPLAGWKVH

SEQ ID NO: 899503 - protein, 35 aa, Mycobacterium
DPNATLSGQAVPQLRPGQQPAQASPPPGPAPPPMA

SEQ ID NO: 899504 - protein, 6 aa, Mycobacterium
DPNEPP

SEQ ID NO: 899505 - protein, 4 aa, Mycobacterium
DPNI

SEQ ID NO: 899506 - protein, 8 aa, Mycobacterium
DPNIPGDK

SEQ ID NO: 899507 - protein, 10 aa, Mycobacterium
DPNLPGAEKV

SEQ ID NO: 899508 - protein, 9 aa, Mycobacterium
DPNNPNGGV

SEQ ID NO: 899509 - protein, 51 aa, Mycobacterium
DPNNPPEALTPTVSGTSTTPTTTTETTEPAPAEAPESAETPEAMPAADAPI

SEQ ID NO: 899510 - protein, 4 aa, Mycobacterium
DPNR

SEQ ID NO: 899511 - protein, 12 aa, Mycobacterium
DPNRAKRANGVG

SEQ ID NO: 899512 - protein, 5 aa, Mycobacterium
DPNSR

SEQ ID NO: 899513 - protein, 5 aa, Mycobacterium
DPNVP

SEQ ID NO: 899514 - protein, 6 aa, Mycobacterium
DPNVPG

SEQ ID NO: 899515 - protein, 8 aa, Mycobacterium
DPNVTGDA

SEQ ID NO: 899516 - protein, 8 aa, Mycobacterium
DPPAPVPE

SEQ ID NO: 899517 - protein, 5 aa, Mycobacterium
DPPDV

SEQ ID NO: 899518 - protein, 8 aa, Mycobacterium
DPPGSRDL

SEQ ID NO: 899519 - protein, 8 aa, Mycobacterium
DPPIGGTE

SEQ ID NO: 899520 - protein, 9 aa, Mycobacterium
DPPKLNESL

SEQ ID NO: 899521 - protein, 19 aa, Mycobacterium
DPPPPEGPPFTQIGSDGGL

SEQ ID NO: 899522 - protein, 6 aa, Mycobacterium
DPPQGV

SEQ ID NO: 899523 - protein, 13 aa, Mycobacterium
DPPQSRGRPGTLA

SEQ ID NO: 899524 - protein, 23 aa, Mycobacterium
DPPQSRQTPGPISGPSLLDPTKT

SEQ ID NO: 899525 - protein, 6 aa, Mycobacterium
DPPRHA

SEQ ID NO: 899526 - protein, 6 aa, Mycobacterium
DPPSFE

SEQ ID NO: 899527 - protein, 7 aa, Mycobacterium
DPPSLPT

SEQ ID NO: 899528 - protein, 15 aa, Mycobacterium
DPPSQSAFDADSSKY

SEQ ID NO: 899529 - protein, 17 aa, Mycobacterium
DPPSSRGTIGDLSGPDL

SEQ ID NO: 899530 - protein, 7 aa, Mycobacterium
DPPYPEQ

SEQ ID NO: 899531 - protein, 7 aa, Mycobacterium
DPQAQGA

SEQ ID NO: 899532 - protein, 9 aa, Mycobacterium
DPQASGADP

SEQ ID NO: 899533 - protein, 11 aa, Mycobacterium
DPQCCPTGSGT

SEQ ID NO: 899534 - protein, 5 aa, Mycobacterium
DPQDV

SEQ ID NO: 899535 - protein, 11 aa, Mycobacterium
DPQGNASTALG

SEQ ID NO: 899536 - protein, 6 aa, Mycobacterium
DPQLTI

SEQ ID NO: 899537 - protein, 7 aa, Mycobacterium
DPQPDGS

SEQ ID NO: 899538 - protein, 8 aa, Mycobacterium
DPQPPGGS

SEQ ID NO: 899539 - protein, 6 aa, Mycobacterium
DPQQAG

SEQ ID NO: 899540 - protein, 7 aa, Mycobacterium
DPQRMDP

SEQ ID NO: 899541 - protein, 8 aa, Mycobacterium
DPQSPNHA

SEQ ID NO: 899542 - protein, 7 aa, Mycobacterium
DPQSQKR

SEQ ID NO: 899543 - protein, 9 aa, Mycobacterium
DPQTTAKLD

SEQ ID NO: 899544 - protein, 7 aa, Mycobacterium
DPRDRHS

SEQ ID NO: 899545 - protein, 4 aa, Mycobacterium
DPRE

SEQ ID NO: 899546 - protein, 8 aa, Mycobacterium
DPREFPDG

SEQ ID NO: 899547 - protein, 9 aa, Mycobacterium
DPRERSFGG

SEQ ID NO: 899548 - protein, 34 aa, Mycobacterium
DPRFATDSGAHPQGASTAKPPPSGPPPLAAPKND

SEQ ID NO: 899549 - protein, 6 aa, Mycobacterium
DPRGFE

SEQ ID NO: 899550 - protein, 18 aa, Mycobacterium
DPRNDSFGEEAAAQLAAD

SEQ ID NO: 899551 - protein, 5 aa, Mycobacterium
DPRPF

SEQ ID NO: 899552 - protein, 31 aa, Mycobacterium
DPRRGFDPAEVTAPASQATFGGGSDPISQIT

SEQ ID NO: 899553 - protein, 6 aa, Mycobacterium
DPRRRL

SEQ ID NO: 899554 - protein, 11 aa, Mycobacterium
DPRSDSLPAET

SEQ ID NO: 899555 - protein, 10 aa, Mycobacterium
DPRTDSFGAE

SEQ ID NO: 899556 - protein, 4 aa, Mycobacterium
DPRV

SEQ ID NO: 899557 - protein, 18 aa, Mycobacterium
DPRYNDAQKATGPLTAAA

SEQ ID NO: 899558 - protein, 5 aa, Mycobacterium
DPRYP

SEQ ID NO: 899559 - protein, 21 aa, Mycobacterium
DPSAAAKAIAAENGLTPQEVA

SEQ ID NO: 899560 - protein, 6 aa, Mycobacterium
DPSAAL

SEQ ID NO: 899561 - protein, 7 aa, Mycobacterium
DPSDGSL

SEQ ID NO: 899562 - protein, 9 aa, Mycobacterium
DPSDGYSAR

SEQ ID NO: 899563 - protein, 27 aa, Mycobacterium
DPSESQMGHSSLESRDAARRTLNRPGF

SEQ ID NO: 899564 - protein, 7 aa, Mycobacterium
DPSGDGG

SEQ ID NO: 899565 - protein, 6 aa, Mycobacterium
DPSKIE

SEQ ID NO: 899566 - protein, 9 aa, Mycobacterium
DPSLDAEAF

SEQ ID NO: 899567 - protein, 8 aa, Mycobacterium
DPSNLSAA

SEQ ID NO: 899568 - protein, 8 aa, Mycobacterium
DPSNPQGG

SEQ ID NO: 899569 - protein, 7 aa, Mycobacterium
DPSQARS

SEQ ID NO: 899570 - protein, 5 aa, Mycobacterium
DPSQD

SEQ ID NO: 899571 - protein, 8 aa, Mycobacterium
DPSQPLTS

SEQ ID NO: 899572 - protein, 18 aa, Mycobacterium
DPSRADQVEASPGTGSQL

SEQ ID NO: 899573 - protein, 7 aa, Mycobacterium
DPSRDID

SEQ ID NO: 899574 - protein, 7 aa, Mycobacterium
DPSSAAR

SEQ ID NO: 899575 - protein, 11 aa, Mycobacterium
DPSSKSGRTAR

SEQ ID NO: 899576 - protein, 8 aa, Mycobacterium
DPSSPGAG

SEQ ID NO: 899577 - protein, 5 aa, Mycobacterium
DPSSV

SEQ ID NO: 899578 - protein, 8 aa, Mycobacterium
DPSVDPDQ

SEQ ID NO: 899579 - protein, 8 aa, Mycobacterium
DPSVTPTP

SEQ ID NO: 899580 - protein, 4 aa, Mycobacterium
DPTA

SEQ ID NO: 899581 - protein, 8 aa, Mycobacterium
DPTDQQQR

SEQ ID NO: 899582 - protein, 8 aa, Mycobacterium
DPTEGDYD

SEQ ID NO: 899583 - protein, 5 aa, Mycobacterium
DPTFD

SEQ ID NO: 899584 - protein, 8 aa, Mycobacterium
DPTGGQGL

SEQ ID NO: 899585 - protein, 10 aa, Mycobacterium
DPTGKTVVPD

SEQ ID NO: 899586 - protein, 5 aa, Mycobacterium
DPTGL

SEQ ID NO: 899587 - protein, 8 aa, Mycobacterium
DPTIDPVE

SEQ ID NO: 899588 - protein, 6 aa, Mycobacterium
DPTIPG

SEQ ID NO: 899589 - protein, 6 aa, Mycobacterium
DPTNFA

SEQ ID NO: 899590 - protein, 6 aa, Mycobacterium
DPTNTT

SEQ ID NO: 899591 - protein, 11 aa, Mycobacterium
DPTQDQPFTEV

SEQ ID NO: 899592 - protein, 22 aa, Mycobacterium
DPTRDYQPRGVKPGNSPTNKPQ

SEQ ID NO: 899593 - protein, 8 aa, Mycobacterium
DPTSAPEL

SEQ ID NO: 899594 - protein, 7 aa, Mycobacterium
DPTTTNR

SEQ ID NO: 899595 - protein, 6 aa, Mycobacterium
DPTTTQ

SEQ ID NO: 899596 - protein, 8 aa, Mycobacterium
DPTVGPVD

SEQ ID NO: 899597 - protein, 5 aa, Mycobacterium
DPVAT

SEQ ID NO: 899598 - protein, 31 aa, Mycobacterium
DPVCGSGDSVPAHRAYDGGPANQAAAFVAGL

SEQ ID NO: 899599 - protein, 15 aa, Mycobacterium
DPVCGSGNGNDLAAH

SEQ ID NO: 899600 - protein, 10 aa, Mycobacterium
DPVCSAGDDI

SEQ ID NO: 899601 - protein, 4 aa, Mycobacterium
DPVH

SEQ ID NO: 899602 - protein, 10 aa, Mycobacterium
DPVNGGSGSV

SEQ ID NO: 899603 - protein, 17 aa, Mycobacterium
DPVPPEPSDIGQSLATA

SEQ ID NO: 899604 - protein, 7 aa, Mycobacterium
DPVQPLT

SEQ ID NO: 899605 - protein, 12 aa, Mycobacterium
DPVRAAGGRVTA

SEQ ID NO: 899606 - protein, 9 aa, Mycobacterium
DPVRQWGRG

SEQ ID NO: 899607 - protein, 6 aa, Mycobacterium
DPVRRS

SEQ ID NO: 899608 - protein, 11 aa, Mycobacterium
DPVTGEPKLEK

SEQ ID NO: 899609 - protein, 11 aa, Mycobacterium
DPVTGTPRPVD

SEQ ID NO: 899610 - protein, 8 aa, Mycobacterium
DPVTTSPD

SEQ ID NO: 899611 - protein, 9 aa, Mycobacterium
DPVVRGGGY

SEQ ID NO: 899612 - protein, 5 aa, Mycobacterium
DPWSG

SEQ ID NO: 899613 - protein, 11 aa, Mycobacterium
DPYATHAPAST

SEQ ID NO: 899614 - protein, 4 aa, Mycobacterium
DPYL

SEQ ID NO: 899615 - protein, 6 aa, Mycobacterium
DPYRYP

SEQ ID NO: 899616 - protein, 13 aa, Mycobacterium
DQAARQLPGQPAP

SEQ ID NO: 899617 - protein, 5 aa, Mycobacterium
DQAEP

SEQ ID NO: 899618 - protein, 16 aa, Mycobacterium
DQAKTSELNGTHQGNT

SEQ ID NO: 899619 - protein, 13 aa, Mycobacterium
DQAPPPHDPGTYP

SEQ ID NO: 899620 - protein, 23 aa, Mycobacterium
DQARKDSALAGAAAAAVGNPPQV

SEQ ID NO: 899621 - protein, 4 aa, Mycobacterium
DQAS

SEQ ID NO: 899622 - protein, 4 aa, Mycobacterium
DQDE

SEQ ID NO: 899623 - protein, 7 aa, Mycobacterium
DQDEQAD

SEQ ID NO: 899624 - protein, 6 aa, Mycobacterium
DQDGEI

SEQ ID NO: 899625 - protein, 6 aa, Mycobacterium
DQDGRD

SEQ ID NO: 899626 - protein, 6 aa, Mycobacterium
DQDKRE

SEQ ID NO: 899627 - protein, 15 aa, Mycobacterium
DQDLAQQARGFRPDE

SEQ ID NO: 899628 - protein, 4 aa, Mycobacterium
DQDP

SEQ ID NO: 899629 - protein, 5 aa, Mycobacterium
DQDPA

SEQ ID NO: 899630 - protein, 7 aa, Mycobacterium
DQDSPEL

SEQ ID NO: 899631 - protein, 13 aa, Mycobacterium
DQETAAAQAVANA

SEQ ID NO: 899632 - protein, 11 aa, Mycobacterium
DQFDAGPREPM

SEQ ID NO: 899633 - protein, 5 aa, Mycobacterium
DQFDP

SEQ ID NO: 899634 - protein, 12 aa, Mycobacterium
DQGCPEPKPLSG

SEQ ID NO: 899635 - protein, 7 aa, Mycobacterium
DQGGQLT

SEQ ID NO: 899636 - protein, 12 aa, Mycobacterium
DQGHPGGPRPAM

SEQ ID NO: 899637 - protein, 5 aa, Mycobacterium
DQGHV

SEQ ID NO: 899638 - protein, 18 aa, Mycobacterium
DQGLPATTLAEGQSSSGT

SEQ ID NO: 899639 - protein, 14 aa, Mycobacterium
DQGPTIANKSGREV

SEQ ID NO: 899640 - protein, 4 aa, Mycobacterium
DQGW

SEQ ID NO: 899641 - protein, 5 aa, Mycobacterium
DQHPA

SEQ ID NO: 899642 - protein, 4 aa, Mycobacterium
DQHS

SEQ ID NO: 899643 - protein, 5 aa, Mycobacterium
DQHVT

SEQ ID NO: 899644 - protein, 14 aa, Mycobacterium
DQIAQTNPPTSALQ

SEQ ID NO: 899645 - protein, 17 aa, Mycobacterium
DQISPERLPGPALAGRS

SEQ ID NO: 899646 - protein, 5 aa, Mycobacterium
DQKGD

SEQ ID NO: 899647 - protein, 10 aa, Mycobacterium
DQKSAQFSAS

SEQ ID NO: 899648 - protein, 8 aa, Mycobacterium
DQKSVGTE

SEQ ID NO: 899649 - protein, 10 aa, Mycobacterium
DQLDTKNQTL

SEQ ID NO: 899650 - protein, 4 aa, Mycobacterium
DQLG

SEQ ID NO: 899651 - protein, 5 aa, Mycobacterium
DQLPP

SEQ ID NO: 899652 - protein, 9 aa, Mycobacterium
DQMTTPVTG

SEQ ID NO: 899653 - protein, 6 aa, Mycobacterium
DQNGPV

SEQ ID NO: 899654 - protein, 17 aa, Mycobacterium
DQNNYGPRASAPRTANY

SEQ ID NO: 899655 - protein, 7 aa, Mycobacterium
DQNTAGI

SEQ ID NO: 899656 - protein, 7 aa, Mycobacterium
DQPAARE

SEQ ID NO: 899657 - protein, 7 aa, Mycobacterium
DQPASTV

SEQ ID NO: 899658 - protein, 9 aa, Mycobacterium
DQPDTDGDR

SEQ ID NO: 899659 - protein, 15 aa, Mycobacterium
DQPGLGQKNPDGTMS

SEQ ID NO: 899660 - protein, 5 aa, Mycobacterium
DQPGV

SEQ ID NO: 899661 - protein, 6 aa, Mycobacterium
DQPHKG

SEQ ID NO: 899662 - protein, 8 aa, Mycobacterium
DQPHYEGD

SEQ ID NO: 899663 - protein, 6 aa, Mycobacterium
DQPINP

SEQ ID NO: 899664 - protein, 12 aa, Mycobacterium
DQPNAVNSSARY

SEQ ID NO: 899665 - protein, 11 aa, Mycobacterium
DQPNDSGDTGW

SEQ ID NO: 899666 - protein, 9 aa, Mycobacterium
DQPRHDGAA

SEQ ID NO: 899667 - protein, 12 aa, Mycobacterium
DQPSGTRNMNDY

SEQ ID NO: 899668 - protein, 15 aa, Mycobacterium
DQPSGTRNMNDYSDP

SEQ ID NO: 899669 - protein, 9 aa, Mycobacterium
DQPVDGAQR

SEQ ID NO: 899670 - protein, 17 aa, Mycobacterium
DQPVDKPPAPSPQQMNQ

SEQ ID NO: 899671 - protein, 11 aa, Mycobacterium
DQPVVRSSSHR

SEQ ID NO: 899672 - protein, 7 aa, Mycobacterium
DQQKNLD

SEQ ID NO: 899673 - protein, 8 aa, Mycobacterium
DQQPAELK

SEQ ID NO: 899674 - protein, 18 aa, Mycobacterium
DQQQATNRNAQVSCLDKS

SEQ ID NO: 899675 - protein, 6 aa, Mycobacterium
DQQQDL

SEQ ID NO: 899676 - protein, 6 aa, Mycobacterium
DQQRGN

SEQ ID NO: 899677 - protein, 24 aa, Mycobacterium
DQQVGDAAARRAIQAASDGATAAL

SEQ ID NO: 899678 - protein, 12 aa, Mycobacterium
DQRKRRAYTADE

SEQ ID NO: 899679 - protein, 6 aa, Mycobacterium
DQRNGA

SEQ ID NO: 899680 - protein, 7 aa, Mycobacterium
DQRNGSI

SEQ ID NO: 899681 - protein, 10 aa, Mycobacterium
DQRNRDRNGR

SEQ ID NO: 899682 - protein, 7 aa, Mycobacterium
DQRSAQF

SEQ ID NO: 899683 - protein, 10 aa, Mycobacterium
DQRSAQFSTS

SEQ ID NO: 899684 - protein, 5 aa, Mycobacterium
DQRTA

SEQ ID NO: 899685 - protein, 6 aa, Mycobacterium
DQSEYS

SEQ ID NO: 899686 - protein, 8 aa, Mycobacterium
DQSGTTAN

SEQ ID NO: 899687 - protein, 4 aa, Mycobacterium
DQSI

SEQ ID NO: 899688 - protein, 22 aa, Mycobacterium
DQSLPLDERGQPVVPEGSAGIE

SEQ ID NO: 899689 - protein, 21 aa, Mycobacterium
DQSLPLDSRGQPVVPEGSAGI

SEQ ID NO: 899690 - protein, 22 aa, Mycobacterium
DQSLPMDARGKPVVPEGSAGIE

SEQ ID NO: 899691 - protein, 15 aa, Mycobacterium
DQSPSMQPYQSPPGR

SEQ ID NO: 899692 - protein, 7 aa, Mycobacterium
DQSPVNS

SEQ ID NO: 899693 - protein, 9 aa, Mycobacterium
DQSRSSETT

SEQ ID NO: 899694 - protein, 19 aa, Mycobacterium
DQSTTDDRRLTCSGLVPGA

SEQ ID NO: 899695 - protein, 18 aa, Mycobacterium
DQTAAQKTADAITEQGGK

SEQ ID NO: 899696 - protein, 11 aa, Mycobacterium
DQTAGPRPNGV

SEQ ID NO: 899697 - protein, 8 aa, Mycobacterium
DQTARDQL

SEQ ID NO: 899698 - protein, 5 aa, Mycobacterium
DQTGD

SEQ ID NO: 899699 - protein, 10 aa, Mycobacterium
DQTKRTTNGI

SEQ ID NO: 899700 - protein, 12 aa, Mycobacterium
DQTLADAKRNTA

SEQ ID NO: 899701 - protein, 6 aa, Mycobacterium
DQVPED

SEQ ID NO: 899702 - protein, 8 aa, Mycobacterium
DQVRKSGV

SEQ ID NO: 899703 - protein, 4 aa, Mycobacterium
DQWQ

SEQ ID NO: 899704 - protein, 13 aa, Mycobacterium
DQYAGEKKAKAKG

SEQ ID NO: 899705 - protein, 8 aa, Mycobacterium
DRAAASGY

SEQ ID NO: 899706 - protein, 6 aa, Mycobacterium
DRAARS

SEQ ID NO: 899707 - protein, 8 aa, Mycobacterium
DRAARSHA

SEQ ID NO: 899708 - protein, 7 aa, Mycobacterium
DRADDTS

SEQ ID NO: 899709 - protein, 10 aa, Mycobacterium
DRADQPDGTA

SEQ ID NO: 899710 - protein, 6 aa, Mycobacterium
DRADYS

SEQ ID NO: 899711 - protein, 12 aa, Mycobacterium
DRAGCESSSGLS

SEQ ID NO: 899712 - protein, 10 aa, Mycobacterium
DRAGGAEQTL

SEQ ID NO: 899713 - protein, 17 aa, Mycobacterium
DRAGGTLPSQSALLGSK

SEQ ID NO: 899714 - protein, 11 aa, Mycobacterium
DRAHDTATPQF

SEQ ID NO: 899715 - protein, 9 aa, Mycobacterium
DRAPAGDRL

SEQ ID NO: 899716 - protein, 11 aa, Mycobacterium
DRAPGPGGTAG

SEQ ID NO: 899717 - protein, 6 aa, Mycobacterium
DRAQRR

SEQ ID NO: 899718 - protein, 8 aa, Mycobacterium
DRARNGDC

SEQ ID NO: 899719 - protein, 10 aa, Mycobacterium
DRARSDGDLA

SEQ ID NO: 899720 - protein, 10 aa, Mycobacterium
DRASGGYDAE

SEQ ID NO: 899721 - protein, 17 aa, Mycobacterium
DRASSDVLRQAAATCPT

SEQ ID NO: 899722 - protein, 8 aa, Mycobacterium
DRATEAEA

SEQ ID NO: 899723 - protein, 4 aa, Mycobacterium
DRCG

SEQ ID NO: 899724 - protein, 20 aa, Mycobacterium
DRDAAEAPPRSAPQAGSEEA

SEQ ID NO: 899725 - protein, 8 aa, Mycobacterium
DRDAPAPE

SEQ ID NO: 899726 - protein, 17 aa, Mycobacterium
DRDDVAPAKHDSVRDGD

SEQ ID NO: 899727 - protein, 10 aa, Mycobacterium
DRDGDGLAQT

SEQ ID NO: 899728 - protein, 8 aa, Mycobacterium
DRDGDKID

SEQ ID NO: 899729 - protein, 5 aa, Mycobacterium
DRDGG

SEQ ID NO: 899730 - protein, 5 aa, Mycobacterium
DRDGH

SEQ ID NO: 899731 - protein, 13 aa, Mycobacterium
DRDGNAASLTTTV

SEQ ID NO: 899732 - protein, 23 aa, Mycobacterium
DRDGNELSQDTESTPTGGPIDSP

SEQ ID NO: 899733 - protein, 6 aa, Mycobacterium
DRDGRD

SEQ ID NO: 899734 - protein, 9 aa, Mycobacterium
DRDGTSAGY

SEQ ID NO: 899735 - protein, 10 aa, Mycobacterium
DRDKRSATEV

SEQ ID NO: 899736 - protein, 8 aa, Mycobacterium
DRDMATPN

SEQ ID NO: 899737 - protein, 6 aa, Mycobacterium
DRDPLN

SEQ ID NO: 899738 - protein, 4 aa, Mycobacterium
DRDQ

SEQ ID NO: 899739 - protein, 9 aa, Mycobacterium
DRDRDATRT

SEQ ID NO: 899740 - protein, 11 aa, Mycobacterium
DRDRPADYPEP

SEQ ID NO: 899741 - protein, 45 aa, Mycobacterium
DRDRPDDWRGDDGRWRNNGPGPGDNRGPDRGPDRGPDRGPGNDWH

SEQ ID NO: 899742 - protein, 9 aa, Mycobacterium
DRDSTTAQS

SEQ ID NO: 899743 - protein, 11 aa, Mycobacterium
DRDTGQSETVR

SEQ ID NO: 899744 - protein, 12 aa, Mycobacterium
DRDTLTRLCIAR

SEQ ID NO: 899745 - protein, 6 aa, Mycobacterium
DRDTVT

SEQ ID NO: 899746 - protein, 5 aa, Mycobacterium
DREAM

SEQ ID NO: 899747 - protein, 7 aa, Mycobacterium
DREDPQV

SEQ ID NO: 899748 - protein, 5 aa, Mycobacterium
DREER

SEQ ID NO: 899749 - protein, 12 aa, Mycobacterium
DREESRLPPIYP

SEQ ID NO: 899750 - protein, 4 aa, Mycobacterium
DREP

SEQ ID NO: 899751 - protein, 24 aa, Mycobacterium
DRERDAVERPERPIPSGEVSGGTA

SEQ ID NO: 899752 - protein, 7 aa, Mycobacterium
DRGAGEV

SEQ ID NO: 899753 - protein, 8 aa, Mycobacterium
DRGALDRA

SEQ ID NO: 899754 - protein, 10 aa, Mycobacterium
DRGAPSLTDA

SEQ ID NO: 899755 - protein, 6 aa, Mycobacterium
DRGAQR

SEQ ID NO: 899756 - protein, 8 aa, Mycobacterium
DRGDIGGL

SEQ ID NO: 899757 - protein, 13 aa, Mycobacterium
DRGELGECAPGVG

SEQ ID NO: 899758 - protein, 10 aa, Mycobacterium
DRGGFYGGEG

SEQ ID NO: 899759 - protein, 7 aa, Mycobacterium
DRGLPRR

SEQ ID NO: 899760 - protein, 7 aa, Mycobacterium
DRGNTGL

SEQ ID NO: 899761 - protein, 7 aa, Mycobacterium
DRGPRGE

SEQ ID NO: 899762 - protein, 8 aa, Mycobacterium
DRGSGNSV

SEQ ID NO: 899763 - protein, 6 aa, Mycobacterium
DRGTGE

SEQ ID NO: 899764 - protein, 6 aa, Mycobacterium
DRGTPY

SEQ ID NO: 899765 - protein, 8 aa, Mycobacterium
DRGTSPTQ

SEQ ID NO: 899766 - protein, 12 aa, Mycobacterium
DRGYSRNDPANV

SEQ ID NO: 899767 - protein, 12 aa, Mycobacterium
DRHAAQTVARQG

SEQ ID NO: 899768 - protein, 5 aa, Mycobacterium
DRHGG

SEQ ID NO: 899769 - protein, 4 aa, Mycobacterium
DRHN

SEQ ID NO: 899770 - protein, 7 aa, Mycobacterium
DRHPGAR

SEQ ID NO: 899771 - protein, 6 aa, Mycobacterium
DRIGGR

SEQ ID NO: 899772 - protein, 10 aa, Mycobacterium
DRKDISTTQV

SEQ ID NO: 899773 - protein, 13 aa, Mycobacterium
DRKGNEVAVTTET

SEQ ID NO: 899774 - protein, 7 aa, Mycobacterium
DRKPAKL

SEQ ID NO: 899775 - protein, 9 aa, Mycobacterium
DRKSSTEQK

SEQ ID NO: 899776 - protein, 7 aa, Mycobacterium
DRKTGQH

SEQ ID NO: 899777 - protein, 4 aa, Mycobacterium
DRLA

SEQ ID NO: 899778 - protein, 10 aa, Mycobacterium
DRLDEKNQAI

SEQ ID NO: 899779 - protein, 8 aa, Mycobacterium
DRLDTAAT

SEQ ID NO: 899780 - protein, 7 aa, Mycobacterium
DRLPGKS

SEQ ID NO: 899781 - protein, 9 aa, Mycobacterium
DRLPTDPTI

SEQ ID NO: 899782 - protein, 7 aa, Mycobacterium
DRLQTGN

SEQ ID NO: 899783 - protein, 5 aa, Mycobacterium
DRLRS

SEQ ID NO: 899784 - protein, 6 aa, Mycobacterium
DRLRSG

SEQ ID NO: 899785 - protein, 9 aa, Mycobacterium
DRLSGPVTG

SEQ ID NO: 899786 - protein, 13 aa, Mycobacterium
DRLTTSAAEIGAD

SEQ ID NO: 899787 - protein, 21 aa, Mycobacterium
DRNADGARERASELGSGHRAE

SEQ ID NO: 899788 - protein, 4 aa, Mycobacterium
DRNL

SEQ ID NO: 899789 - protein, 21 aa, Mycobacterium
DRNTPGSQAACAPGTGSDPVT

SEQ ID NO: 899790 - protein, 13 aa, Mycobacterium
DRPALTQSASAAA

SEQ ID NO: 899791 - protein, 43 aa, Mycobacterium
DRPAPSVNGPVATPAEVPTPAPPEIPPVGGGQAPGPAPFDADA

SEQ ID NO: 899792 - protein, 9 aa, Mycobacterium
DRPASQRFT

SEQ ID NO: 899793 - protein, 4 aa, Mycobacterium
DRPD

SEQ ID NO: 899794 - protein, 4 aa, Mycobacterium
DRPI

SEQ ID NO: 899795 - protein, 7 aa, Mycobacterium
DRPINSA

SEQ ID NO: 899796 - protein, 12 aa, Mycobacterium
DRPLAGLGGDGR

SEQ ID NO: 899797 - protein, 8 aa, Mycobacterium
DRPPAAAA

SEQ ID NO: 899798 - protein, 8 aa, Mycobacterium
DRPPGKPE

SEQ ID NO: 899799 - protein, 5 aa, Mycobacterium
DRPPQ

SEQ ID NO: 899800 - protein, 7 aa, Mycobacterium
DRPPSPA

SEQ ID NO: 899801 - protein, 18 aa, Mycobacterium
DRPQPADRGGLAPAGVTT

SEQ ID NO: 899802 - protein, 6 aa, Mycobacterium
DRPRDH

SEQ ID NO: 899803 - protein, 14 aa, Mycobacterium
DRPRRASVNELGGS

SEQ ID NO: 899804 - protein, 5 aa, Mycobacterium
DRPTL

SEQ ID NO: 899805 - protein, 7 aa, Mycobacterium
DRPTRRE

SEQ ID NO: 899806 - protein, 6 aa, Mycobacterium
DRPTSR

SEQ ID NO: 899807 - protein, 20 aa, Mycobacterium
DRQEMRDQSQFQTGDDPVAN

SEQ ID NO: 899808 - protein, 11 aa, Mycobacterium
DRQGRSVTDGV

SEQ ID NO: 899809 - protein, 9 aa, Mycobacterium
DRQLKRGND

SEQ ID NO: 899810 - protein, 6 aa, Mycobacterium
DRRAYS

SEQ ID NO: 899811 - protein, 10 aa, Mycobacterium
DRRGGGMTGP

SEQ ID NO: 899812 - protein, 19 aa, Mycobacterium
DRRGSGTVLTGRSGSANGI

SEQ ID NO: 899813 - protein, 6 aa, Mycobacterium
DRRPGG

SEQ ID NO: 899814 - protein, 7 aa, Mycobacterium
DRRPGGK

SEQ ID NO: 899815 - protein, 7 aa, Mycobacterium
DRRPGGN

SEQ ID NO: 899816 - protein, 7 aa, Mycobacterium
DRRPGGT

SEQ ID NO: 899817 - protein, 10 aa, Mycobacterium
DRRPTRAEVS

SEQ ID NO: 899818 - protein, 5 aa, Mycobacterium
DRRQT

SEQ ID NO: 899819 - protein, 10 aa, Mycobacterium
DRRREEDAAT

SEQ ID NO: 899820 - protein, 17 aa, Mycobacterium
DRRRGAADAVGRTPGAT

SEQ ID NO: 899821 - protein, 5 aa, Mycobacterium
DRRVR

SEQ ID NO: 899822 - protein, 4 aa, Mycobacterium
DRSA

SEQ ID NO: 899823 - protein, 5 aa, Mycobacterium
DRSAQ

SEQ ID NO: 899824 - protein, 4 aa, Mycobacterium
DRSG

SEQ ID NO: 899825 - protein, 8 aa, Mycobacterium
DRSGGDFD

SEQ ID NO: 899826 - protein, 9 aa, Mycobacterium
DRSGGYSPT

SEQ ID NO: 899827 - protein, 10 aa, Mycobacterium
DRSGQPGAEE

SEQ ID NO: 899828 - protein, 15 aa, Mycobacterium
DRSLNPLGTAARAAA

SEQ ID NO: 899829 - protein, 13 aa, Mycobacterium
DRSTELHDHGGSL

SEQ ID NO: 899830 - protein, 5 aa, Mycobacterium
DRSTQ

SEQ ID NO: 899831 - protein, 4 aa, Mycobacterium
DRTA

SEQ ID NO: 899832 - protein, 28 aa, Mycobacterium
DRTAATTHPLRSTGATEAKDASPHSGRA

SEQ ID NO: 899833 - protein, 15 aa, Mycobacterium
DRTARIPGSIDGDEF

SEQ ID NO: 899834 - protein, 8 aa, Mycobacterium
DRTDRPEC

SEQ ID NO: 899835 - protein, 18 aa, Mycobacterium
DRTPKSAGTTLTNPAYAK

SEQ ID NO: 899836 - protein, 21 aa, Mycobacterium
DRTPSTFTAANENETDPSPSD

SEQ ID NO: 899837 - protein, 6 aa, Mycobacterium
DRTRRQ

SEQ ID NO: 899838 - protein, 12 aa, Mycobacterium
DRTRSVTGPPGE

SEQ ID NO: 899839 - protein, 11 aa, Mycobacterium
DRTSGESQTVR

SEQ ID NO: 899840 - protein, 11 aa, Mycobacterium
DRTSKDLYTPN

SEQ ID NO: 899841 - protein, 7 aa, Mycobacterium
DRTTPQL

SEQ ID NO: 899842 - protein, 5 aa, Mycobacterium
DRTTQ

SEQ ID NO: 899843 - protein, 11 aa, Mycobacterium
DRVESGAGAVE

SEQ ID NO: 899844 - protein, 6 aa, Mycobacterium
DRVGGT

SEQ ID NO: 899845 - protein, 7 aa, Mycobacterium
DRVGGTW

SEQ ID NO: 899846 - protein, 7 aa, Mycobacterium
DRVPNSG

SEQ ID NO: 899847 - protein, 12 aa, Mycobacterium
DRVQNGRGPSAD

SEQ ID NO: 899848 - protein, 7 aa, Mycobacterium
DRVSGAR

SEQ ID NO: 899849 - protein, 16 aa, Mycobacterium
DRVTGAGSRTQPRVVT

SEQ ID NO: 899850 - protein, 8 aa, Mycobacterium
DRWESSAD

SEQ ID NO: 899851 - protein, 9 aa, Mycobacterium
DRWGPPPQA

SEQ ID NO: 899852 - protein, 4 aa, Mycobacterium
DRYG

SEQ ID NO: 899853 - protein, 33 aa, Mycobacterium
DRYNQTNGTAGPDQTTLATGDAGKRVACGVIGS

SEQ ID NO: 899854 - protein, 4 aa, Mycobacterium
DSAA

SEQ ID NO: 899855 - protein, 6 aa, Mycobacterium
DSAADA

SEQ ID NO: 899856 - protein, 5 aa, Mycobacterium
DSAAT

SEQ ID NO: 899857 - protein, 13 aa, Mycobacterium
DSAAVDAGGTTTI

SEQ ID NO: 899858 - protein, 11 aa, Mycobacterium
DSADATGVPEL

SEQ ID NO: 899859 - protein, 9 aa, Mycobacterium
DSADGPTRL

SEQ ID NO: 899860 - protein, 4 aa, Mycobacterium
DSAE

SEQ ID NO: 899861 - protein, 7 aa, Mycobacterium
DSAEGYK

SEQ ID NO: 899862 - protein, 5 aa, Mycobacterium
DSAGA

SEQ ID NO: 899863 - protein, 23 aa, Mycobacterium
DSAGEWTTNYSATAVSNDNGQNW

SEQ ID NO: 899864 - protein, 8 aa, Mycobacterium
DSAKAKGV

SEQ ID NO: 899865 - protein, 28 aa, Mycobacterium
DSALGATGSRSKEKNDKLKDDAAKQPWP

SEQ ID NO: 899866 - protein, 17 aa, Mycobacterium
DSAMPTAACPGGEEEDL

SEQ ID NO: 899867 - protein, 10 aa, Mycobacterium
DSANGLDSTL

SEQ ID NO: 899868 - protein, 6 aa, Mycobacterium
DSAPAD

SEQ ID NO: 899869 - protein, 6 aa, Mycobacterium
DSAPDL

SEQ ID NO: 899870 - protein, 10 aa, Mycobacterium
DSAPIPTADG

SEQ ID NO: 899871 - protein, 6 aa, Mycobacterium
DSAPNL

SEQ ID NO: 899872 - protein, 13 aa, Mycobacterium
DSAPPPIGSPVPG

SEQ ID NO: 899873 - protein, 8 aa, Mycobacterium
DSAPTDPE

SEQ ID NO: 899874 - protein, 40 aa, Mycobacterium
DSAQSQPFTTEPQLAPGPTSTPPPPPPLPAKPFPKECPAP

SEQ ID NO: 899875 - protein, 7 aa, Mycobacterium
DSAQTVG

SEQ ID NO: 899876 - protein, 9 aa, Mycobacterium
DSARQTKDT

SEQ ID NO: 899877 - protein, 9 aa, Mycobacterium
DSATDGDTV

SEQ ID NO: 899878 - protein, 11 aa, Mycobacterium
DSATGETQKFD

SEQ ID NO: 899879 - protein, 10 aa, Mycobacterium
DSATGNVTMP

SEQ ID NO: 899880 - protein, 18 aa, Mycobacterium
DSATYPKNKPGASAQAGN

SEQ ID NO: 899881 - protein, 8 aa, Mycobacterium
DSAYGNSS

SEQ ID NO: 899882 - protein, 8 aa, Mycobacterium
DSAYRRKN

SEQ ID NO: 899883 - protein, 16 aa, Mycobacterium
DSDAETADAPDESGYD

SEQ ID NO: 899884 - protein, 8 aa, Mycobacterium
DSDDPASP

SEQ ID NO: 899885 - protein, 5 aa, Mycobacterium
DSDEA

SEQ ID NO: 899886 - protein, 9 aa, Mycobacterium
DSDESNGGL

SEQ ID NO: 899887 - protein, 9 aa, Mycobacterium
DSDGRWSTN

SEQ ID NO: 899888 - protein, 5 aa, Mycobacterium
DSDGY

SEQ ID NO: 899889 - protein, 7 aa, Mycobacterium
DSDIPTA

SEQ ID NO: 899890 - protein, 15 aa, Mycobacterium
DSDRISGGGLSAALS

SEQ ID NO: 899891 - protein, 16 aa, Mycobacterium
DSDRLPGGGLSATLSD

SEQ ID NO: 899892 - protein, 18 aa, Mycobacterium
DSDSGASIQEKAATQGVK

SEQ ID NO: 899893 - protein, 8 aa, Mycobacterium
DSDSQARC

SEQ ID NO: 899894 - protein, 5 aa, Mycobacterium
DSDSS

SEQ ID NO: 899895 - protein, 6 aa, Mycobacterium
DSEATT

SEQ ID NO: 899896 - protein, 8 aa, Mycobacterium
DSEDTDPV

SEQ ID NO: 899897 - protein, 6 aa, Mycobacterium
DSEELG

SEQ ID NO: 899898 - protein, 6 aa, Mycobacterium
DSEHQQ

SEQ ID NO: 899899 - protein, 5 aa, Mycobacterium
DSEHV

SEQ ID NO: 899900 - protein, 7 aa, Mycobacterium
DSEPADV

SEQ ID NO: 899901 - protein, 22 aa, Mycobacterium
DSEPPDSLAEADAALTRAQGQT

SEQ ID NO: 899902 - protein, 6 aa, Mycobacterium
DSERRG

SEQ ID NO: 899903 - protein, 14 aa, Mycobacterium
DSETENDDAHGSAL

SEQ ID NO: 899904 - protein, 7 aa, Mycobacterium
DSETTRQ

SEQ ID NO: 899905 - protein, 6 aa, Mycobacterium
DSEYGQ

SEQ ID NO: 899906 - protein, 7 aa, Mycobacterium
DSGADVN

SEQ ID NO: 899907 - protein, 13 aa, Mycobacterium
DSGAEQPWDGKSV

SEQ ID NO: 899908 - protein, 19 aa, Mycobacterium
DSGAGAVELTDESAAKAID

SEQ ID NO: 899909 - protein, 6 aa, Mycobacterium
DSGAQA

SEQ ID NO: 899910 - protein, 19 aa, Mycobacterium
DSGATAPPLIGTGTPDQVG

SEQ ID NO: 899911 - protein, 28 aa, Mycobacterium
DSGDPAHAVGPPPDGNYTYNEAGVSGAT

SEQ ID NO: 899912 - protein, 6 aa, Mycobacterium
DSGDTA

SEQ ID NO: 899913 - protein, 17 aa, Mycobacterium
DSGEASVFTSGGKGIGN

SEQ ID NO: 899914 - protein, 7 aa, Mycobacterium
DSGERKM

SEQ ID NO: 899915 - protein, 5 aa, Mycobacterium
DSGEV

SEQ ID NO: 899916 - protein, 7 aa, Mycobacterium
DSGGFGA

SEQ ID NO: 899917 - protein, 10 aa, Mycobacterium
DSGGINNGDK

SEQ ID NO: 899918 - protein, 10 aa, Mycobacterium
DSGGSFTSGK

SEQ ID NO: 899919 - protein, 7 aa, Mycobacterium
DSGGYNA

SEQ ID NO: 899920 - protein, 6 aa, Mycobacterium
DSGHNK

SEQ ID NO: 899921 - protein, 4 aa, Mycobacterium
DSGL

SEQ ID NO: 899922 - protein, 12 aa, Mycobacterium
DSGNPDGRDEQI

SEQ ID NO: 899923 - protein, 10 aa, Mycobacterium
DSGPQRPEIS

SEQ ID NO: 899924 - protein, 5 aa, Mycobacterium
DSGQA

SEQ ID NO: 899925 - protein, 10 aa, Mycobacterium
DSGQTPEQVA

SEQ ID NO: 899926 - protein, 22 aa, Mycobacterium
DSGRQKSDVAGDVAASSSLDGY

SEQ ID NO: 899927 - protein, 11 aa, Mycobacterium
DSGSDEGRDEQ

SEQ ID NO: 899928 - protein, 8 aa, Mycobacterium
DSGSITQA

SEQ ID NO: 899929 - protein, 12 aa, Mycobacterium
DSGTKQGRDEQV

SEQ ID NO: 899930 - protein, 16 aa, Mycobacterium
DSGTPGGAQPPLAADP

SEQ ID NO: 899931 - protein, 4 aa, Mycobacterium
DSGV

SEQ ID NO: 899932 - protein, 5 aa, Mycobacterium
DSGVV

SEQ ID NO: 899933 - protein, 9 aa, Mycobacterium
DSHPETNQA

SEQ ID NO: 899934 - protein, 7 aa, Mycobacterium
DSHPGAR

SEQ ID NO: 899935 - protein, 17 aa, Mycobacterium
DSIDDPAAHPAGNGGTH

SEQ ID NO: 899936 - protein, 33 aa, Mycobacterium
DSIEAAGKSWASYEQSMPTPCATTSSGPYSPGE

SEQ ID NO: 899937 - protein, 10 aa, Mycobacterium
DSINGASGTV

SEQ ID NO: 899938 - protein, 4 aa, Mycobacterium
DSIP

SEQ ID NO: 899939 - protein, 10 aa, Mycobacterium
DSIRNGDTQV

SEQ ID NO: 899940 - protein, 12 aa, Mycobacterium
DSITGTSGDAQQ

SEQ ID NO: 899941 - protein, 11 aa, Mycobacterium
DSKATNPHAAR

SEQ ID NO: 899942 - protein, 4 aa, Mycobacterium
DSKD

SEQ ID NO: 899943 - protein, 10 aa, Mycobacterium
DSLESEQGPL

SEQ ID NO: 899944 - protein, 14 aa, Mycobacterium
DSLGGAGDAQTEFN

SEQ ID NO: 899945 - protein, 15 aa, Mycobacterium
DSLGPQVASAKSKGI

SEQ ID NO: 899946 - protein, 11 aa, Mycobacterium
DSLPADGVETT

SEQ ID NO: 899947 - protein, 11 aa, Mycobacterium
DSLVTGDDGKL

SEQ ID NO: 899948 - protein, 13 aa, Mycobacterium
DSMADGDTVRAPH

SEQ ID NO: 899949 - protein, 13 aa, Mycobacterium
DSMTEGDTVRAPH

SEQ ID NO: 899950 - protein, 9 aa, Mycobacterium
DSMTGVPAS

SEQ ID NO: 899951 - protein, 4 aa, Mycobacterium
DSNA

SEQ ID NO: 899952 - protein, 11 aa, Mycobacterium
DSNGNGQEISR

SEQ ID NO: 899953 - protein, 7 aa, Mycobacterium
DSNGTMA

SEQ ID NO: 899954 - protein, 4 aa, Mycobacterium
DSNQ

SEQ ID NO: 899955 - protein, 10 aa, Mycobacterium
DSNQAEIARS

SEQ ID NO: 899956 - protein, 7 aa, Mycobacterium
DSNQPAS

SEQ ID NO: 899957 - protein, 5 aa, Mycobacterium
DSNQQ

SEQ ID NO: 899958 - protein, 6 aa, Mycobacterium
DSNRQA

SEQ ID NO: 899959 - protein, 5 aa, Mycobacterium
DSNSW

SEQ ID NO: 899960 - protein, 4 aa, Mycobacterium
DSNT

SEQ ID NO: 899961 - protein, 12 aa, Mycobacterium
DSNVNTADPTML

SEQ ID NO: 899962 - protein, 7 aa, Mycobacterium
DSPAALT

SEQ ID NO: 899963 - protein, 16 aa, Mycobacterium
DSPAGGPGINDGGSGV

SEQ ID NO: 899964 - protein, 9 aa, Mycobacterium
DSPAGTPGF

SEQ ID NO: 899965 - protein, 7 aa, Mycobacterium
DSPANTT

SEQ ID NO: 899966 - protein, 8 aa, Mycobacterium
DSPAVSPD

SEQ ID NO: 899967 - protein, 14 aa, Mycobacterium
DSPCGGEDFSGGET

SEQ ID NO: 899968 - protein, 6 aa, Mycobacterium
DSPDVT

SEQ ID NO: 899969 - protein, 5 aa, Mycobacterium
DSPFQ

SEQ ID NO: 899970 - protein, 5 aa, Mycobacterium
DSPFR

SEQ ID NO: 899971 - protein, 8 aa, Mycobacterium
DSPGRTDY

SEQ ID NO: 899972 - protein, 4 aa, Mycobacterium
DSPL

SEQ ID NO: 899973 - protein, 16 aa, Mycobacterium
DSPPGSPGINSAGSGV

SEQ ID NO: 899974 - protein, 7 aa, Mycobacterium
DSPQFAS

SEQ ID NO: 899975 - protein, 7 aa, Mycobacterium
DSPQMSE

SEQ ID NO: 899976 - protein, 7 aa, Mycobacterium
DSPRSDL

SEQ ID NO: 899977 - protein, 8 aa, Mycobacterium
DSPSPSGL

SEQ ID NO: 899978 - protein, 7 aa, Mycobacterium
DSPVKSV

SEQ ID NO: 899979 - protein, 14 aa, Mycobacterium
DSPVSGGVHGAEAG

SEQ ID NO: 899980 - protein, 6 aa, Mycobacterium
DSQHAA

SEQ ID NO: 899981 - protein, 13 aa, Mycobacterium
DSQITDPGRGLTY

SEQ ID NO: 899982 - protein, 9 aa, Mycobacterium
DSQRPWKDE

SEQ ID NO: 899983 - protein, 6 aa, Mycobacterium
DSQSAL

SEQ ID NO: 899984 - protein, 8 aa, Mycobacterium
DSQSTRQI

SEQ ID NO: 899985 - protein, 22 aa, Mycobacterium
DSQTDGAAAEAAVEAASSATAT

SEQ ID NO: 899986 - protein, 5 aa, Mycobacterium
DSQYH

SEQ ID NO: 899987 - protein, 7 aa, Mycobacterium
DSRDFSP

SEQ ID NO: 899988 - protein, 26 aa, Mycobacterium
DSREGLTPEQQASLTTGGDLGTGRTD

SEQ ID NO: 899989 - protein, 4 aa, Mycobacterium
DSRG

SEQ ID NO: 899990 - protein, 8 aa, Mycobacterium
DSRKNNDD

SEQ ID NO: 899991 - protein, 5 aa, Mycobacterium
DSRLD

SEQ ID NO: 899992 - protein, 6 aa, Mycobacterium
DSRNNY

SEQ ID NO: 899993 - protein, 26 aa, Mycobacterium
DSRQGLTPDQETQLATGGDIGDGRTD

SEQ ID NO: 899994 - protein, 26 aa, Mycobacterium
DSRQSLSAAQQQDLATGGDIGDGRTD

SEQ ID NO: 899995 - protein, 7 aa, Mycobacterium
DSRRPEL

SEQ ID NO: 899996 - protein, 8 aa, Mycobacterium
DSRRPELV

SEQ ID NO: 899997 - protein, 8 aa, Mycobacterium
DSRSDQIK

SEQ ID NO: 899998 - protein, 4 aa, Mycobacterium
DSRT

SEQ ID NO: 899999 - protein, 9 aa, Mycobacterium
DSSALTPSD

SEQ ID NO: 900000 - protein, 5 aa, Mycobacterium
DSSGG

SEQ ID NO: 900001 - protein, 39 aa, Mycobacterium
DSSGKAVDDSSSLTTMPTSSSATKSPTSTSAKPAAPQAE

SEQ ID NO: 900002 - protein, 7 aa, Mycobacterium
DSSGLSV

SEQ ID NO: 900003 - protein, 12 aa, Mycobacterium
DSSGNPETGEVP

SEQ ID NO: 900004 - protein, 19 aa, Mycobacterium
DSSNTELYSKPTDTRVDGP

SEQ ID NO: 900005 - protein, 7 aa, Mycobacterium
DSSQRFS

SEQ ID NO: 900006 - protein, 9 aa, Mycobacterium
DSSRNLDNT

SEQ ID NO: 900007 - protein, 6 aa, Mycobacterium
DSSRRI

SEQ ID NO: 900008 - protein, 10 aa, Mycobacterium
DSSRSDIADG

SEQ ID NO: 900009 - protein, 8 aa, Mycobacterium
DSSSPPPV

SEQ ID NO: 900010 - protein, 8 aa, Mycobacterium
DSSSPSGL

SEQ ID NO: 900011 - protein, 13 aa, Mycobacterium
DSSTGTVNPLPVL

SEQ ID NO: 900012 - protein, 7 aa, Mycobacterium
DSTAPTE

SEQ ID NO: 900013 - protein, 16 aa, Mycobacterium
DSTASVDISDEGGTVS

SEQ ID NO: 900014 - protein, 8 aa, Mycobacterium
DSTATTPD

SEQ ID NO: 900015 - protein, 4 aa, Mycobacterium
DSTD

SEQ ID NO: 900016 - protein, 6 aa, Mycobacterium
DSTDYG

SEQ ID NO: 900017 - protein, 9 aa, Mycobacterium
DSTDYGSGL

SEQ ID NO: 900018 - protein, 11 aa, Mycobacterium
DSTGADYTSAL

SEQ ID NO: 900019 - protein, 5 aa, Mycobacterium
DSTGH

SEQ ID NO: 900020 - protein, 9 aa, Mycobacterium
DSTGQAGTF

SEQ ID NO: 900021 - protein, 16 aa, Mycobacterium
DSTKITERVNPKPIRE

SEQ ID NO: 900022 - protein, 8 aa, Mycobacterium
DSTNPTDL

SEQ ID NO: 900023 - protein, 11 aa, Mycobacterium
DSTQDRRPGSE

SEQ ID NO: 900024 - protein, 6 aa, Mycobacterium
DSTSAR

SEQ ID NO: 900025 - protein, 8 aa, Mycobacterium
DSTSSRFA

SEQ ID NO: 900026 - protein, 7 aa, Mycobacterium
DSTTDAL

SEQ ID NO: 900027 - protein, 7 aa, Mycobacterium
DSTTPME

SEQ ID NO: 900028 - protein, 8 aa, Mycobacterium
DSTTPTDL

SEQ ID NO: 900029 - protein, 6 aa, Mycobacterium
DSVGCE

SEQ ID NO: 900030 - protein, 8 aa, Mycobacterium
DSVNQTKD

SEQ ID NO: 900031 - protein, 7 aa, Mycobacterium
DSVPPQR

SEQ ID NO: 900032 - protein, 8 aa, Mycobacterium
DSVPPQRV

SEQ ID NO: 900033 - protein, 11 aa, Mycobacterium
DSVRDAGGRVT

SEQ ID NO: 900034 - protein, 9 aa, Mycobacterium
DSVRNGDTQ

SEQ ID NO: 900035 - protein, 10 aa, Mycobacterium
DSVSRGNPQE

SEQ ID NO: 900036 - protein, 28 aa, Mycobacterium
DSVSRLDQEEPELNRDPPGDERDTTTPH

SEQ ID NO: 900037 - protein, 8 aa, Mycobacterium
DSWQRGDR

SEQ ID NO: 900038 - protein, 4 aa, Mycobacterium
DSWR

SEQ ID NO: 900039 - protein, 7 aa, Mycobacterium
DSWTTSA

SEQ ID NO: 900040 - protein, 6 aa, Mycobacterium
DSYGEE

SEQ ID NO: 900041 - protein, 9 aa, Mycobacterium
DSYPAAADA

SEQ ID NO: 900042 - protein, 10 aa, Mycobacterium
DSYPAASGAP

SEQ ID NO: 900043 - protein, 5 aa, Mycobacterium
DSYQG

SEQ ID NO: 900044 - protein, 6 aa, Mycobacterium
DSYTGH

SEQ ID NO: 900045 - protein, 6 aa, Mycobacterium
DTAAGD

SEQ ID NO: 900046 - protein, 12 aa, Mycobacterium
DTAAGKSAPDYY

SEQ ID NO: 900047 - protein, 5 aa, Mycobacterium
DTAAS

SEQ ID NO: 900048 - protein, 9 aa, Mycobacterium
DTADDGEEL

SEQ ID NO: 900049 - protein, 10 aa, Mycobacterium
DTADGAALDG

SEQ ID NO: 900050 - protein, 10 aa, Mycobacterium
DTAETPTPAG

SEQ ID NO: 900051 - protein, 7 aa, Mycobacterium
DTAGEAM

SEQ ID NO: 900052 - protein, 7 aa, Mycobacterium
DTAGHIS

SEQ ID NO: 900053 - protein, 10 aa, Mycobacterium
DTAGPGALRD

SEQ ID NO: 900054 - protein, 7 aa, Mycobacterium
DTAGQRG

SEQ ID NO: 900055 - protein, 5 aa, Mycobacterium
DTAGT

SEQ ID NO: 900056 - protein, 19 aa, Mycobacterium
DTAGVADTAGRCEKAGATA

SEQ ID NO: 900057 - protein, 18 aa, Mycobacterium
DTANGSANYNKQVTGTRV

SEQ ID NO: 900058 - protein, 5 aa, Mycobacterium
DTAPA

SEQ ID NO: 900059 - protein, 13 aa, Mycobacterium
DTAPAAANRGSRV

SEQ ID NO: 900060 - protein, 13 aa, Mycobacterium
DTAPAPGKTASDI

SEQ ID NO: 900061 - protein, 13 aa, Mycobacterium
DTAPATASRGSRV

SEQ ID NO: 900062 - protein, 8 aa, Mycobacterium
DTAPDAPR

SEQ ID NO: 900063 - protein, 9 aa, Mycobacterium
DTAPPPAEG

SEQ ID NO: 900064 - protein, 7 aa, Mycobacterium
DTARGGA

SEQ ID NO: 900065 - protein, 8 aa, Mycobacterium
DTARGGEI

SEQ ID NO: 900066 - protein, 6 aa, Mycobacterium
DTARQR

SEQ ID NO: 900067 - protein, 9 aa, Mycobacterium
DTARRTAAG

SEQ ID NO: 900068 - protein, 21 aa, Mycobacterium
DTASDAIEGTGSFDGKEQPIQ

SEQ ID NO: 900069 - protein, 17 aa, Mycobacterium
DTASIGPDGPPMDYDLP

SEQ ID NO: 900070 - protein, 10 aa, Mycobacterium
DTASNPGPLV

SEQ ID NO: 900071 - protein, 7 aa, Mycobacterium
DTASNRL

SEQ ID NO: 900072 - protein, 7 aa, Mycobacterium
DTATADV

SEQ ID NO: 900073 - protein, 8 aa, Mycobacterium
DTATRAPM

SEQ ID NO: 900074 - protein, 30 aa, Mycobacterium
DTAVDDSDGDLANEESEAEEVATERHPAKV

SEQ ID NO: 900075 - protein, 14 aa, Mycobacterium
DTAVPVQAPARPAL

SEQ ID NO: 900076 - protein, 9 aa, Mycobacterium
DTDAGRAAA

SEQ ID NO: 900077 - protein, 12 aa, Mycobacterium
DTDAQASCETER

SEQ ID NO: 900078 - protein, 11 aa, Mycobacterium
DTDDDGWNPEA

SEQ ID NO: 900079 - protein, 97 aa, Mycobacterium
DTDEPRLESRKPSATRVDDEPTDEPDAEKAESEKAESEKAESDEATADDATDADTAAKDSPGTDDDESGSAPTSKKPDSGSSVSSDSDSDSDSDSDD

SEQ ID NO: 900080 - protein, 14 aa, Mycobacterium
DTDEQNDDEHGSAL

SEQ ID NO: 900081 - protein, 5 aa, Mycobacterium
DTDEW

SEQ ID NO: 900082 - protein, 5 aa, Mycobacterium
DTDGA

SEQ ID NO: 900083 - protein, 7 aa, Mycobacterium
DTDIDAG

SEQ ID NO: 900084 - protein, 21 aa, Mycobacterium
DTDIDAGPKTITGVSQPAKGN

SEQ ID NO: 900085 - protein, 26 aa, Mycobacterium
DTDIDAGPKTITSITQPNSGTTTITA

SEQ ID NO: 900086 - protein, 20 aa, Mycobacterium
DTDIDGGPKTITSITSPAGG

SEQ ID NO: 900087 - protein, 8 aa, Mycobacterium
DTDIDNGP

SEQ ID NO: 900088 - protein, 6 aa, Mycobacterium
DTDING

SEQ ID NO: 900089 - protein, 7 aa, Mycobacterium
DTDNSYA

SEQ ID NO: 900090 - protein, 8 aa, Mycobacterium
DTDPPTWA

SEQ ID NO: 900091 - protein, 8 aa, Mycobacterium
DTDPSGRL

SEQ ID NO: 900092 - protein, 17 aa, Mycobacterium
DTDRKSAATTLGGGKYL

SEQ ID NO: 900093 - protein, 15 aa, Mycobacterium
DTDSGDSEDSEDEEL

SEQ ID NO: 900094 - protein, 9 aa, Mycobacterium
DTDSSVLSG

SEQ ID NO: 900095 - protein, 8 aa, Mycobacterium
DTEGRPGL

SEQ ID NO: 900096 - protein, 6 aa, Mycobacterium
DTEHGH

SEQ ID NO: 900097 - protein, 5 aa, Mycobacterium
DTEPF

SEQ ID NO: 900098 - protein, 9 aa, Mycobacterium
DTEQYNPTY

SEQ ID NO: 900099 - protein, 5 aa, Mycobacterium
DTERQ

SEQ ID NO: 900100 - protein, 4 aa, Mycobacterium
DTET

SEQ ID NO: 900101 - protein, 7 aa, Mycobacterium
DTFAGPS

SEQ ID NO: 900102 - protein, 6 aa, Mycobacterium
DTFGGH

SEQ ID NO: 900103 - protein, 4 aa, Mycobacterium
DTGA

SEQ ID NO: 900104 - protein, 6 aa, Mycobacterium
DTGANT

SEQ ID NO: 900105 - protein, 5 aa, Mycobacterium
DTGAP

SEQ ID NO: 900106 - protein, 6 aa, Mycobacterium
DTGAPI

SEQ ID NO: 900107 - protein, 5 aa, Mycobacterium
DTGAS

SEQ ID NO: 900108 - protein, 7 aa, Mycobacterium
DTGATVD

SEQ ID NO: 900109 - protein, 9 aa, Mycobacterium
DTGDAEQVE

SEQ ID NO: 900110 - protein, 6 aa, Mycobacterium
DTGEFD

SEQ ID NO: 900111 - protein, 7 aa, Mycobacterium
DTGEFDA

SEQ ID NO: 900112 - protein, 8 aa, Mycobacterium
DTGERQTL

SEQ ID NO: 900113 - protein, 7 aa, Mycobacterium
DTGGIGV

SEQ ID NO: 900114 - protein, 7 aa, Mycobacterium
DTGPASF

SEQ ID NO: 900115 - protein, 10 aa, Mycobacterium
DTGPDRGRGY

SEQ ID NO: 900116 - protein, 11 aa, Mycobacterium
DTGPQNYSDDG

SEQ ID NO: 900117 - protein, 11 aa, Mycobacterium
DTGPQNYTDDG

SEQ ID NO: 900118 - protein, 5 aa, Mycobacterium
DTGQL

SEQ ID NO: 900119 - protein, 5 aa, Mycobacterium
DTGRR

SEQ ID NO: 900120 - protein, 4 aa, Mycobacterium
DTGS

SEQ ID NO: 900121 - protein, 12 aa, Mycobacterium
DTGSGDTVGHRA

SEQ ID NO: 900122 - protein, 16 aa, Mycobacterium
DTGSVLSPPQRPAAAD

SEQ ID NO: 900123 - protein, 4 aa, Mycobacterium
DTGT

SEQ ID NO: 900124 - protein, 8 aa, Mycobacterium
DTGTTLQE

SEQ ID NO: 900125 - protein, 4 aa, Mycobacterium
DTGV

SEQ ID NO: 900126 - protein, 7 aa, Mycobacterium
DTGVREE

SEQ ID NO: 900127 - protein, 5 aa, Mycobacterium
DTGYS

SEQ ID NO: 900128 - protein, 5 aa, Mycobacterium
DTGYT

SEQ ID NO: 900129 - protein, 7 aa, Mycobacterium
DTHEYTE

SEQ ID NO: 900130 - protein, 12 aa, Mycobacterium
DTIAGPASPAAN

SEQ ID NO: 900131 - protein, 7 aa, Mycobacterium
DTIDDDR

SEQ ID NO: 900132 - protein, 12 aa, Mycobacterium
DTIDGADKRIKD

SEQ ID NO: 900133 - protein, 10 aa, Mycobacterium
DTIESGAGAV

SEQ ID NO: 900134 - protein, 14 aa, Mycobacterium
DTIGLDSTAAAATV

SEQ ID NO: 900135 - protein, 13 aa, Mycobacterium
DTIGNDATGLNVS

SEQ ID NO: 900136 - protein, 8 aa, Mycobacterium
DTINPEDQ

SEQ ID NO: 900137 - protein, 4 aa, Mycobacterium
DTKA

SEQ ID NO: 900138 - protein, 6 aa, Mycobacterium
DTKPGD

SEQ ID NO: 900139 - protein, 24 aa, Mycobacterium
DTKPPLPGGDPQSSVLNRVEYGNR

SEQ ID NO: 900140 - protein, 24 aa, Mycobacterium
DTKPPLPGGDPSSSVLNRVEYGNR

SEQ ID NO: 900141 - protein, 6 aa, Mycobacterium
DTKPRC

SEQ ID NO: 900142 - protein, 6 aa, Mycobacterium
DTKPTL

SEQ ID NO: 900143 - protein, 12 aa, Mycobacterium
DTKSEKEVLPLA

SEQ ID NO: 900144 - protein, 17 aa, Mycobacterium
DTKSSVRWETKDRPALE

SEQ ID NO: 900145 - protein, 14 aa, Mycobacterium
DTKTPSVTARAPQS

SEQ ID NO: 900146 - protein, 7 aa, Mycobacterium
DTKVDEG

SEQ ID NO: 900147 - protein, 9 aa, Mycobacterium
DTLDDGTTV

SEQ ID NO: 900148 - protein, 9 aa, Mycobacterium
DTLGKRDDE

SEQ ID NO: 900149 - protein, 8 aa, Mycobacterium
DTLPDAPK

SEQ ID NO: 900150 - protein, 4 aa, Mycobacterium
DTLR

SEQ ID NO: 900151 - protein, 13 aa, Mycobacterium
DTLTDDKNRLNQK

SEQ ID NO: 900152 - protein, 18 aa, Mycobacterium
DTMSGPVNVTGPAPVTNA

SEQ ID NO: 900153 - protein, 9 aa, Mycobacterium
DTNANPWQY

SEQ ID NO: 900154 - protein, 8 aa, Mycobacterium
DTNKPNGQ

SEQ ID NO: 900155 - protein, 7 aa, Mycobacterium
DTNPHID

SEQ ID NO: 900156 - protein, 5 aa, Mycobacterium
DTNPQ

SEQ ID NO: 900157 - protein, 7 aa, Mycobacterium
DTNQQIE

SEQ ID NO: 900158 - protein, 11 aa, Mycobacterium
DTNTPPGLRAK

SEQ ID NO: 900159 - protein, 11 aa, Mycobacterium
DTNVAARRDAQ

SEQ ID NO: 900160 - protein, 11 aa, Mycobacterium
DTNVGDRRAAQ

SEQ ID NO: 900161 - protein, 17 aa, Mycobacterium
DTPAAAGVAPGRVRGPQ

SEQ ID NO: 900162 - protein, 7 aa, Mycobacterium
DTPAHRA

SEQ ID NO: 900163 - protein, 14 aa, Mycobacterium
DTPANRAAAERLPA

SEQ ID NO: 900164 - protein, 12 aa, Mycobacterium
DTPANSVRGSRN

SEQ ID NO: 900165 - protein, 27 aa, Mycobacterium
DTPASAAPPAPTYTTGSFPSAARGGAV

SEQ ID NO: 900166 - protein, 7 aa, Mycobacterium
DTPDVGA

SEQ ID NO: 900167 - protein, 6 aa, Mycobacterium
DTPEAD

SEQ ID NO: 900168 - protein, 13 aa, Mycobacterium
DTPETQAKAETPV

SEQ ID NO: 900169 - protein, 7 aa, Mycobacterium
DTPFSEE

SEQ ID NO: 900170 - protein, 32 aa, Mycobacterium
DTPGGGGCDGNGNCGSGGQNQGPGGGPGGQGC

SEQ ID NO: 900171 - protein, 15 aa, Mycobacterium
DTPKPQIRAEAARRG

SEQ ID NO: 900172 - protein, 6 aa, Mycobacterium
DTPLAQ

SEQ ID NO: 900173 - protein, 6 aa, Mycobacterium
DTPNNR

SEQ ID NO: 900174 - protein, 7 aa, Mycobacterium
DTPPPAI

SEQ ID NO: 900175 - protein, 7 aa, Mycobacterium
DTPPSAI

SEQ ID NO: 900176 - protein, 8 aa, Mycobacterium
DTPPTPPP

SEQ ID NO: 900177 - protein, 6 aa, Mycobacterium
DTPQPV

SEQ ID NO: 900178 - protein, 8 aa, Mycobacterium
DTPSGAVD

SEQ ID NO: 900179 - protein, 5 aa, Mycobacterium
DTPSP

SEQ ID NO: 900180 - protein, 6 aa, Mycobacterium
DTPVNP

SEQ ID NO: 900181 - protein, 12 aa, Mycobacterium
DTQDEEGPASDF

SEQ ID NO: 900182 - protein, 4 aa, Mycobacterium
DTQT

SEQ ID NO: 900183 - protein, 4 aa, Mycobacterium
DTRA

SEQ ID NO: 900184 - protein, 8 aa, Mycobacterium
DTRAGQEQ

SEQ ID NO: 900185 - protein, 20 aa, Mycobacterium
DTRDMRDQAQNRAGDDPVAS

SEQ ID NO: 900186 - protein, 6 aa, Mycobacterium
DTRGSM

SEQ ID NO: 900187 - protein, 8 aa, Mycobacterium
DTRPPLAD

SEQ ID NO: 900188 - protein, 6 aa, Mycobacterium
DTRRAQ

SEQ ID NO: 900189 - protein, 5 aa, Mycobacterium
DTRTG

SEQ ID NO: 900190 - protein, 47 aa, Mycobacterium
DTSAGSYGETETANRVTTAASSLSPLAASPTAAADPPPAGSTTLGTG

SEQ ID NO: 900191 - protein, 5 aa, Mycobacterium
DTSAL

SEQ ID NO: 900192 - protein, 8 aa, Mycobacterium
DTSAPPTA

SEQ ID NO: 900193 - protein, 12 aa, Mycobacterium
DTSATQQERQRA

SEQ ID NO: 900194 - protein, 13 aa, Mycobacterium
DTSEVGASDYAGP

SEQ ID NO: 900195 - protein, 11 aa, Mycobacterium
DTSGPQALRDG

SEQ ID NO: 900196 - protein, 33 aa, Mycobacterium
DTSGSRELTPSQSTSSTAATPTRSYPALPPEYR

SEQ ID NO: 900197 - protein, 10 aa, Mycobacterium
DTSPERKRGY

SEQ ID NO: 900198 - protein, 8 aa, Mycobacterium
DTSRPSEH

SEQ ID NO: 900199 - protein, 10 aa, Mycobacterium
DTSSPGPELT

SEQ ID NO: 900200 - protein, 10 aa, Mycobacterium
DTSTPGPPLT

SEQ ID NO: 900201 - protein, 4 aa, Mycobacterium
DTTA

SEQ ID NO: 900202 - protein, 10 aa, Mycobacterium
DTTAAAGGKP

SEQ ID NO: 900203 - protein, 7 aa, Mycobacterium
DTTAARA

SEQ ID NO: 900204 - protein, 9 aa, Mycobacterium
DTTADPAVT

SEQ ID NO: 900205 - protein, 9 aa, Mycobacterium
DTTADPDLT

SEQ ID NO: 900206 - protein, 9 aa, Mycobacterium
DTTAEPDVT

SEQ ID NO: 900207 - protein, 7 aa, Mycobacterium
DTTANAG

SEQ ID NO: 900208 - protein, 7 aa, Mycobacterium
DTTESDW

SEQ ID NO: 900209 - protein, 12 aa, Mycobacterium
DTTGLVSNPATV

SEQ ID NO: 900210 - protein, 6 aa, Mycobacterium
DTTLRP

SEQ ID NO: 900211 - protein, 13 aa, Mycobacterium
DTTNENGPKLMNS

SEQ ID NO: 900212 - protein, 5 aa, Mycobacterium
DTTPG

SEQ ID NO: 900213 - protein, 10 aa, Mycobacterium
DTTQDRRSGY

SEQ ID NO: 900214 - protein, 10 aa, Mycobacterium
DTTQDRRTGY

SEQ ID NO: 900215 - protein, 6 aa, Mycobacterium
DTTQLE

SEQ ID NO: 900216 - protein, 9 aa, Mycobacterium
DTTQTTGDT

SEQ ID NO: 900217 - protein, 22 aa, Mycobacterium
DTTRGNGLPTLRTGETRSAGSL

SEQ ID NO: 900218 - protein, 8 aa, Mycobacterium
DTTRKTLS

SEQ ID NO: 900219 - protein, 6 aa, Mycobacterium
DTTTAQ

SEQ ID NO: 900220 - protein, 7 aa, Mycobacterium
DTTYPGA

SEQ ID NO: 900221 - protein, 8 aa, Mycobacterium
DTTYPGAS

SEQ ID NO: 900222 - protein, 6 aa, Mycobacterium
DTVGHE

SEQ ID NO: 900223 - protein, 6 aa, Mycobacterium
DTVKQS

SEQ ID NO: 900224 - protein, 8 aa, Mycobacterium
DTVNQSQE

SEQ ID NO: 900225 - protein, 7 aa, Mycobacterium
DTVPDGG

SEQ ID NO: 900226 - protein, 11 aa, Mycobacterium
DTVTGTAADAQ

SEQ ID NO: 900227 - protein, 21 aa, Mycobacterium
DTWTDPGSSCTQATRARRRGV

SEQ ID NO: 900228 - protein, 7 aa, Mycobacterium
DTYARSA

SEQ ID NO: 900229 - protein, 8 aa, Mycobacterium
DTYDPRRI

SEQ ID NO: 900230 - protein, 7 aa, Mycobacterium
DTYGAAA

SEQ ID NO: 900231 - protein, 12 aa, Mycobacterium
DTYGSSATITTA

SEQ ID NO: 900232 - protein, 4 aa, Mycobacterium
DTYQ

SEQ ID NO: 900233 - protein, 6 aa, Mycobacterium
DVAAGA

SEQ ID NO: 900234 - protein, 16 aa, Mycobacterium
DVAATDPGVADGAGAG

SEQ ID NO: 900235 - protein, 9 aa, Mycobacterium
DVAATGNAA

SEQ ID NO: 900236 - protein, 5 aa, Mycobacterium
DVAGG

SEQ ID NO: 900237 - protein, 8 aa, Mycobacterium
DVAGGSGD

SEQ ID NO: 900238 - protein, 13 aa, Mycobacterium
DVAGKPGITDIPD

SEQ ID NO: 900239 - protein, 12 aa, Mycobacterium
DVAPAAGREALP

SEQ ID NO: 900240 - protein, 6 aa, Mycobacterium
DVAPAE

SEQ ID NO: 900241 - protein, 10 aa, Mycobacterium
DVAPAHAESD

SEQ ID NO: 900242 - protein, 7 aa, Mycobacterium
DVAPGAT

SEQ ID NO: 900243 - protein, 8 aa, Mycobacterium
DVAQRDDR

SEQ ID NO: 900244 - protein, 10 aa, Mycobacterium
DVARAAGPGM

SEQ ID NO: 900245 - protein, 4 aa, Mycobacterium
DVDD

SEQ ID NO: 900246 - protein, 5 aa, Mycobacterium
DVDEA

SEQ ID NO: 900247 - protein, 8 aa, Mycobacterium
DVDGGPKV

SEQ ID NO: 900248 - protein, 9 aa, Mycobacterium
DVDGRDPSV

SEQ ID NO: 900249 - protein, 7 aa, Mycobacterium
DVDGTTY

SEQ ID NO: 900250 - protein, 7 aa, Mycobacterium
DVDPDAP

SEQ ID NO: 900251 - protein, 8 aa, Mycobacterium
DVDPDTLE

SEQ ID NO: 900252 - protein, 21 aa, Mycobacterium
DVDPKGTVELESAGSSYTTFP

SEQ ID NO: 900253 - protein, 12 aa, Mycobacterium
DVDSAESDEARA

SEQ ID NO: 900254 - protein, 6 aa, Mycobacterium
DVEDDK

SEQ ID NO: 900255 - protein, 6 aa, Mycobacterium
DVEGNK

SEQ ID NO: 900256 - protein, 8 aa, Mycobacterium
DVEPDGPD

SEQ ID NO: 900257 - protein, 13 aa, Mycobacterium
DVEPTPTGAEATM

SEQ ID NO: 900258 - protein, 10 aa, Mycobacterium
DVERCDPQAG

SEQ ID NO: 900259 - protein, 16 aa, Mycobacterium
DVESRGEPAGGPPAIA

SEQ ID NO: 900260 - protein, 6 aa, Mycobacterium
DVGASR

SEQ ID NO: 900261 - protein, 13 aa, Mycobacterium
DVGATQKVGTEDV

SEQ ID NO: 900262 - protein, 6 aa, Mycobacterium
DVGDPG

SEQ ID NO: 900263 - protein, 21 aa, Mycobacterium
DVGGGNGVGPNEAPEVPRPQV

SEQ ID NO: 900264 - protein, 13 aa, Mycobacterium
DVGGTWRDNTYPG

SEQ ID NO: 900265 - protein, 7 aa, Mycobacterium
DVGKAAV

SEQ ID NO: 900266 - protein, 5 aa, Mycobacterium
DVGKG

SEQ ID NO: 900267 - protein, 7 aa, Mycobacterium
DVGPGQP

SEQ ID NO: 900268 - protein, 10 aa, Mycobacterium
DVGPSTVPGV

SEQ ID NO: 900269 - protein, 11 aa, Mycobacterium
DVGSSGTTGGP

SEQ ID NO: 900270 - protein, 43 aa, Mycobacterium
DVGTETAEGTQGQETTSHGDHGDTHDGAHGDTHDGAHNDADAT

SEQ ID NO: 900271 - protein, 12 aa, Mycobacterium
DVGTLDQNSRVQ

SEQ ID NO: 900272 - protein, 11 aa, Mycobacterium
DVGTLEQNSRV

SEQ ID NO: 900273 - protein, 13 aa, Mycobacterium
DVGVSAAPAHGGH

SEQ ID NO: 900274 - protein, 5 aa, Mycobacterium
DVIPA

SEQ ID NO: 900275 - protein, 13 aa, Mycobacterium
DVIPADRTSVPPD

SEQ ID NO: 900276 - protein, 13 aa, Mycobacterium
DVKASDAILALAQ

SEQ ID NO: 900277 - protein, 21 aa, Mycobacterium
DVKDEQSAQGHHAQTFCLVKA

SEQ ID NO: 900278 - protein, 6 aa, Mycobacterium
DVKDER

SEQ ID NO: 900279 - protein, 5 aa, Mycobacterium
DVKPA

SEQ ID NO: 900280 - protein, 8 aa, Mycobacterium
DVKPTGSA

SEQ ID NO: 900281 - protein, 8 aa, Mycobacterium
DVNGDNRH

SEQ ID NO: 900282 - protein, 11 aa, Mycobacterium
DVNGDSVPSGF

SEQ ID NO: 900283 - protein, 10 aa, Mycobacterium
DVNGTRPFGT

SEQ ID NO: 900284 - protein, 6 aa, Mycobacterium
DVNTAM

SEQ ID NO: 900285 - protein, 5 aa, Mycobacterium
DVPAD

SEQ ID NO: 900286 - protein, 5 aa, Mycobacterium
DVPAG

SEQ ID NO: 900287 - protein, 10 aa, Mycobacterium
DVPDGSAGIE

SEQ ID NO: 900288 - protein, 8 aa, Mycobacterium
DVPKGGSF

SEQ ID NO: 900289 - protein, 17 aa, Mycobacterium
DVPKQNTTVTENALGGT

SEQ ID NO: 900290 - protein, 6 aa, Mycobacterium
DVPPGA

SEQ ID NO: 900291 - protein, 8 aa, Mycobacterium
DVPPPSVQ

SEQ ID NO: 900292 - protein, 7 aa, Mycobacterium
DVPPTPI

SEQ ID NO: 900293 - protein, 16 aa, Mycobacterium
DVPSQAVPFDGGAPAL

SEQ ID NO: 900294 - protein, 12 aa, Mycobacterium
DVPSSEDARLSA

SEQ ID NO: 900295 - protein, 8 aa, Mycobacterium
DVPTADQL

SEQ ID NO: 900296 - protein, 9 aa, Mycobacterium
DVPTPESIA

SEQ ID NO: 900297 - protein, 10 aa, Mycobacterium
DVPTVQPGTD

SEQ ID NO: 900298 - protein, 10 aa, Mycobacterium
DVQSRDGGKR

SEQ ID NO: 900299 - protein, 10 aa, Mycobacterium
DVQTQQESIN

SEQ ID NO: 900300 - protein, 9 aa, Mycobacterium
DVRAAAGLP

SEQ ID NO: 900301 - protein, 10 aa, Mycobacterium
DVRGGSTLEQ

SEQ ID NO: 900302 - protein, 9 aa, Mycobacterium
DVRNDGPLD

SEQ ID NO: 900303 - protein, 6 aa, Mycobacterium
DVRPAE

SEQ ID NO: 900304 - protein, 9 aa, Mycobacterium
DVRPTNNAA

SEQ ID NO: 900305 - protein, 7 aa, Mycobacterium
DVRQASP

SEQ ID NO: 900306 - protein, 7 aa, Mycobacterium
DVRTAAQ

SEQ ID NO: 900307 - protein, 9 aa, Mycobacterium
DVSAPDPAT

SEQ ID NO: 900308 - protein, 15 aa, Mycobacterium
DVSKGEGQGNKVDAD

SEQ ID NO: 900309 - protein, 8 aa, Mycobacterium
DVSPDGTQ

SEQ ID NO: 900310 - protein, 8 aa, Mycobacterium
DVSPDRKT

SEQ ID NO: 900311 - protein, 6 aa, Mycobacterium
DVSPDS

SEQ ID NO: 900312 - protein, 5 aa, Mycobacterium
DVSST

SEQ ID NO: 900313 - protein, 9 aa, Mycobacterium
DVSTQASQV

SEQ ID NO: 900314 - protein, 5 aa, Mycobacterium
DVTAG

SEQ ID NO: 900315 - protein, 12 aa, Mycobacterium
DVTDAEQVSSAV

SEQ ID NO: 900316 - protein, 67 aa, Mycobacterium
DVTDDADAAAEEEVGARTVSASTATVEAGAPEPQKTSAKPSASAPRTAAPAPAPGPAAAPQATTQTL

SEQ ID NO: 900317 - protein, 7 aa, Mycobacterium
DVTDEDS

SEQ ID NO: 900318 - protein, 14 aa, Mycobacterium
DVTGAMSQANARQQ

SEQ ID NO: 900319 - protein, 8 aa, Mycobacterium
DVTGDNAE

SEQ ID NO: 900320 - protein, 14 aa, Mycobacterium
DVTNQPEGNGQAVG

SEQ ID NO: 900321 - protein, 5 aa, Mycobacterium
DVTSG

SEQ ID NO: 900322 - protein, 4 aa, Mycobacterium
DVTT

SEQ ID NO: 900323 - protein, 14 aa, Mycobacterium
DVTTAMNQTNDRQQ

SEQ ID NO: 900324 - protein, 8 aa, Mycobacterium
DVTTGVSG

SEQ ID NO: 900325 - protein, 9 aa, Mycobacterium
DVTTTPDAQ

SEQ ID NO: 900326 - protein, 7 aa, Mycobacterium
DWAGPRK

SEQ ID NO: 900327 - protein, 8 aa, Mycobacterium
DWAPDTSV

SEQ ID NO: 900328 - protein, 8 aa, Mycobacterium
DWAPGTTV

SEQ ID NO: 900329 - protein, 8 aa, Mycobacterium
DWGNGQDY

SEQ ID NO: 900330 - protein, 7 aa, Mycobacterium
DWGQTDI

SEQ ID NO: 900331 - protein, 8 aa, Mycobacterium
DWNTQSPM

SEQ ID NO: 900332 - protein, 4 aa, Mycobacterium
DWPA

SEQ ID NO: 900333 - protein, 7 aa, Mycobacterium
DWPSGTT

SEQ ID NO: 900334 - protein, 8 aa, Mycobacterium
DWQGNSAR

SEQ ID NO: 900335 - protein, 10 aa, Mycobacterium
DWTEPRQKAL

SEQ ID NO: 900336 - protein, 9 aa, Mycobacterium
DYADEETPW

SEQ ID NO: 900337 - protein, 7 aa, Mycobacterium
DYADTGN

SEQ ID NO: 900338 - protein, 6 aa, Mycobacterium
DYAGTK

SEQ ID NO: 900339 - protein, 10 aa, Mycobacterium
DYANDRTYQN

SEQ ID NO: 900340 - protein, 21 aa, Mycobacterium
DYANDRTYQNTVTGRVYYVNV

SEQ ID NO: 900341 - protein, 4 aa, Mycobacterium
DYAR

SEQ ID NO: 900342 - protein, 8 aa, Mycobacterium
DYARGTAR

SEQ ID NO: 900343 - protein, 17 aa, Mycobacterium
DYASGATASLREELGPE

SEQ ID NO: 900344 - protein, 10 aa, Mycobacterium
DYATAAEDKP

SEQ ID NO: 900345 - protein, 10 aa, Mycobacterium
DYDPDADEVT

SEQ ID NO: 900346 - protein, 13 aa, Mycobacterium
DYGAGRVSGDLEG

SEQ ID NO: 900347 - protein, 13 aa, Mycobacterium
DYGPNYANVPTPA

SEQ ID NO: 900348 - protein, 4 aa, Mycobacterium
DYLP

SEQ ID NO: 900349 - protein, 11 aa, Mycobacterium
DYNRTIAPGGS

SEQ ID NO: 900350 - protein, 13 aa, Mycobacterium
DYPATGKRTLQDN

SEQ ID NO: 900351 - protein, 7 aa, Mycobacterium
DYPDEQA

SEQ ID NO: 900352 - protein, 8 aa, Mycobacterium
DYPDRPAG

SEQ ID NO: 900353 - protein, 12 aa, Mycobacterium
DYPDRPATGSGT

SEQ ID NO: 900354 - protein, 9 aa, Mycobacterium
DYPEDGAPR

SEQ ID NO: 900355 - protein, 12 aa, Mycobacterium
DYPNATGDLGDG

SEQ ID NO: 900356 - protein, 6 aa, Mycobacterium
DYPTDK

SEQ ID NO: 900357 - protein, 12 aa, Mycobacterium
DYQDDPRYIGIS

SEQ ID NO: 900358 - protein, 16 aa, Mycobacterium
DYRNKSAWDDFWRTSH

SEQ ID NO: 900359 - protein, 8 aa, Mycobacterium
DYRPDGTA

SEQ ID NO: 900360 - protein, 12 aa, Mycobacterium
DYSGPGSGLGGA

SEQ ID NO: 900361 - protein, 14 aa, Mycobacterium
DYSGPGSGLSGTET

SEQ ID NO: 900362 - protein, 15 aa, Mycobacterium
DYSGPGSGLSGTGTV

SEQ ID NO: 900363 - protein, 4 aa, Mycobacterium
DYSP

SEQ ID NO: 900364 - protein, 7 aa, Mycobacterium
DYSQPNV

SEQ ID NO: 900365 - protein, 5 aa, Mycobacterium
DYSTN

SEQ ID NO: 900366 - protein, 14 aa, Mycobacterium
DYTAPGYQAPTTPV

SEQ ID NO: 900367 - protein, 18 aa, Mycobacterium
DYTGAGDSAKVSAAEMST

SEQ ID NO: 900368 - protein, 52 aa, Mycobacterium
DYTGPGSGLGGNVGGNAVAPARASNAGNAGNSDTAPPPSPILTAGSDNPECI

SEQ ID NO: 900369 - protein, 5 aa, Mycobacterium
DYTPG

SEQ ID NO: 900370 - protein, 5 aa, Mycobacterium
DYTPV

SEQ ID NO: 900371 - protein, 8 aa, Mycobacterium
EAAAAGGA

SEQ ID NO: 900372 - protein, 7 aa, Mycobacterium
EAAAEAG

SEQ ID NO: 900373 - protein, 14 aa, Mycobacterium
EAAAEQQVKGQQAA

SEQ ID NO: 900374 - protein, 13 aa, Mycobacterium
EAAAEQQVRGQQA

SEQ ID NO: 900375 - protein, 13 aa, Mycobacterium
EAAAGKGITGGGS

SEQ ID NO: 900376 - protein, 33 aa, Mycobacterium
EAAAQRQGRSPDEVRAASEASIPAGRYGTPDEF

SEQ ID NO: 900377 - protein, 8 aa, Mycobacterium
EAADAAPT

SEQ ID NO: 900378 - protein, 10 aa, Mycobacterium
EAADSAEAKV

SEQ ID NO: 900379 - protein, 6 aa, Mycobacterium
EAAEAG

SEQ ID NO: 900380 - protein, 6 aa, Mycobacterium
EAAEAN

SEQ ID NO: 900381 - protein, 13 aa, Mycobacterium
EAAEPQKSAEPQR

SEQ ID NO: 900382 - protein, 6 aa, Mycobacterium
EAAGGQ

SEQ ID NO: 900383 - protein, 7 aa, Mycobacterium
EAAGGRA

SEQ ID NO: 900384 - protein, 6 aa, Mycobacterium
EAAGGV

SEQ ID NO: 900385 - protein, 8 aa, Mycobacterium
EAAGKTDE

SEQ ID NO: 900386 - protein, 6 aa, Mycobacterium
EAAGSA

SEQ ID NO: 900387 - protein, 5 aa, Mycobacterium
EAAGV

SEQ ID NO: 900388 - protein, 11 aa, Mycobacterium
EAAHRSPGEDI

SEQ ID NO: 900389 - protein, 11 aa, Mycobacterium
EAANAPDGCTA

SEQ ID NO: 900390 - protein, 12 aa, Mycobacterium
EAAPAVPDQAEI

SEQ ID NO: 900391 - protein, 7 aa, Mycobacterium
EAAPDLG

SEQ ID NO: 900392 - protein, 5 aa, Mycobacterium
EAAPP

SEQ ID NO: 900393 - protein, 8 aa, Mycobacterium
EAAPRQET

SEQ ID NO: 900394 - protein, 10 aa, Mycobacterium
EAAPTGDDPA

SEQ ID NO: 900395 - protein, 21 aa, Mycobacterium
EAAQNAEDGADTSPAPTSRTI

SEQ ID NO: 900396 - protein, 15 aa, Mycobacterium
EAAQQTAAPLAGELS

SEQ ID NO: 900397 - protein, 11 aa, Mycobacterium
EAARRGGAAPH

SEQ ID NO: 900398 - protein, 5 aa, Mycobacterium
EAART

SEQ ID NO: 900399 - protein, 10 aa, Mycobacterium
EAASDTPSGL

SEQ ID NO: 900400 - protein, 6 aa, Mycobacterium
EAASRD

SEQ ID NO: 900401 - protein, 14 aa, Mycobacterium
EAAVERNEKLGAMR

SEQ ID NO: 900402 - protein, 9 aa, Mycobacterium
EAAVTDQYA

SEQ ID NO: 900403 - protein, 5 aa, Mycobacterium
EACPS

SEQ ID NO: 900404 - protein, 4 aa, Mycobacterium
EADA

SEQ ID NO: 900405 - protein, 17 aa, Mycobacterium
EADARGLSERRAPGEAE

SEQ ID NO: 900406 - protein, 5 aa, Mycobacterium
EADAV

SEQ ID NO: 900407 - protein, 18 aa, Mycobacterium
EADDGHDHEHGGDPTPID

SEQ ID NO: 900408 - protein, 9 aa, Mycobacterium
EADDKQSRL

SEQ ID NO: 900409 - protein, 34 aa, Mycobacterium
EADDTEAAESVPIGGSGRNSSRGRRAQGEPGRAV

SEQ ID NO: 900410 - protein, 81 aa, Mycobacterium
EADEEDTARSAPRDSGKRSVDTESEESEGAEVADEALSPDPVEEQDTAADEDHAESPDTDTDSTSETAADSDSSDDGADTA

SEQ ID NO: 900411 - protein, 4 aa, Mycobacterium
EADG

SEQ ID NO: 900412 - protein, 5 aa, Mycobacterium
EADGA

SEQ ID NO: 900413 - protein, 6 aa, Mycobacterium
EADGGS

SEQ ID NO: 900414 - protein, 7 aa, Mycobacterium
EADGTPA

SEQ ID NO: 900415 - protein, 7 aa, Mycobacterium
EADGTQT

SEQ ID NO: 900416 - protein, 6 aa, Mycobacterium
EADGTY

SEQ ID NO: 900417 - protein, 17 aa, Mycobacterium
EADIGTSVGPEDGAGDL

SEQ ID NO: 900418 - protein, 11 aa, Mycobacterium
EADMGGDDQWP

SEQ ID NO: 900419 - protein, 9 aa, Mycobacterium
EADNPLDGQ

SEQ ID NO: 900420 - protein, 16 aa, Mycobacterium
EADPATETLAANTAQL

SEQ ID NO: 900421 - protein, 17 aa, Mycobacterium
EADQPFDPNYHKASDTL

SEQ ID NO: 900422 - protein, 9 aa, Mycobacterium
EAEAPPGYP

SEQ ID NO: 900423 - protein, 9 aa, Mycobacterium
EAEARGATV

SEQ ID NO: 900424 - protein, 15 aa, Mycobacterium
EAEDELRTLLLNPQQ

SEQ ID NO: 900425 - protein, 8 aa, Mycobacterium
EAEDPVDI

SEQ ID NO: 900426 - protein, 12 aa, Mycobacterium
EAEGSSSTEVRD

SEQ ID NO: 900427 - protein, 18 aa, Mycobacterium
EAEMTDAGTTTASGDGAA

SEQ ID NO: 900428 - protein, 12 aa, Mycobacterium
EAEQGKSDPNAI

SEQ ID NO: 900429 - protein, 9 aa, Mycobacterium
EAERADETA

SEQ ID NO: 900430 - protein, 14 aa, Mycobacterium
EAERKAGRSAEQAR

SEQ ID NO: 900431 - protein, 7 aa, Mycobacterium
EAERQSR

SEQ ID NO: 900432 - protein, 8 aa, Mycobacterium
EAETEFKE

SEQ ID NO: 900433 - protein, 36 aa, Mycobacterium
EAETRNGSGVAPAGSTPPSGDEVTGSTDDDEATASD

SEQ ID NO: 900434 - protein, 8 aa, Mycobacterium
EAFTEKDR

SEQ ID NO: 900435 - protein, 12 aa, Mycobacterium
EAGCPDPASAGD

SEQ ID NO: 900436 - protein, 14 aa, Mycobacterium
EAGDPESPASSQKL

SEQ ID NO: 900437 - protein, 8 aa, Mycobacterium
EAGEEERM

SEQ ID NO: 900438 - protein, 22 aa, Mycobacterium
EAGELGYAEADPTADVEGYDAA

SEQ ID NO: 900439 - protein, 10 aa, Mycobacterium
EAGEPSDRER

SEQ ID NO: 900440 - protein, 9 aa, Mycobacterium
EAGEQDAER

SEQ ID NO: 900441 - protein, 7 aa, Mycobacterium
EAGERAA

SEQ ID NO: 900442 - protein, 8 aa, Mycobacterium
EAGGDPWA

SEQ ID NO: 900443 - protein, 7 aa, Mycobacterium
EAGGGGF

SEQ ID NO: 900444 - protein, 22 aa, Mycobacterium
EAGGGMSCNSEPSGMRCSNSDG

SEQ ID NO: 900445 - protein, 7 aa, Mycobacterium
EAGGKNG

SEQ ID NO: 900446 - protein, 11 aa, Mycobacterium
EAGGLTAGNEV

SEQ ID NO: 900447 - protein, 17 aa, Mycobacterium
EAGGPGDDPPVEFDDAC

SEQ ID NO: 900448 - protein, 8 aa, Mycobacterium
EAGGPRLD

SEQ ID NO: 900449 - protein, 7 aa, Mycobacterium
EAGGTSV

SEQ ID NO: 900450 - protein, 4 aa, Mycobacterium
EAGH

SEQ ID NO: 900451 - protein, 7 aa, Mycobacterium
EAGKGPW

SEQ ID NO: 900452 - protein, 6 aa, Mycobacterium
EAGKQR

SEQ ID NO: 900453 - protein, 8 aa, Mycobacterium
EAGPADAP

SEQ ID NO: 900454 - protein, 10 aa, Mycobacterium
EAGPGKRPRR

SEQ ID NO: 900455 - protein, 16 aa, Mycobacterium
EAGPKASSFAAASYSS

SEQ ID NO: 900456 - protein, 6 aa, Mycobacterium
EAGPLR

SEQ ID NO: 900457 - protein, 6 aa, Mycobacterium
EAGPTT

SEQ ID NO: 900458 - protein, 5 aa, Mycobacterium
EAGRA

SEQ ID NO: 900459 - protein, 17 aa, Mycobacterium
EAGRDAKPSLNTPPGLK

SEQ ID NO: 900460 - protein, 8 aa, Mycobacterium
EAGRELRE

SEQ ID NO: 900461 - protein, 5 aa, Mycobacterium
EAGTT

SEQ ID NO: 900462 - protein, 4 aa, Mycobacterium
EAGV

SEQ ID NO: 900463 - protein, 8 aa, Mycobacterium
EAGVSPSA

SEQ ID NO: 900464 - protein, 4 aa, Mycobacterium
EAHS

SEQ ID NO: 900465 - protein, 20 aa, Mycobacterium
EAIARQPVDGPPPGAPPRLG

SEQ ID NO: 900466 - protein, 8 aa, Mycobacterium
EAKKQGLA

SEQ ID NO: 900467 - protein, 7 aa, Mycobacterium
EAKNQSL

SEQ ID NO: 900468 - protein, 8 aa, Mycobacterium
EALAPKRE

SEQ ID NO: 900469 - protein, 16 aa, Mycobacterium
EALETGLGATNISSEK

SEQ ID NO: 900470 - protein, 11 aa, Mycobacterium
EALGDSTIDGW

SEQ ID NO: 900471 - protein, 14 aa, Mycobacterium
EALGTTSDKLAGVS

SEQ ID NO: 900472 - protein, 30 aa, Mycobacterium
EALPPAPEALPPAPEAPPAPEALPPAPEAQ

SEQ ID NO: 900473 - protein, 12 aa, Mycobacterium
EALSEATKAAME

SEQ ID NO: 900474 - protein, 13 aa, Mycobacterium
EAMSSSSAEAVGS

SEQ ID NO: 900475 - protein, 5 aa, Mycobacterium
EANAF

SEQ ID NO: 900476 - protein, 5 aa, Mycobacterium
EANMT

SEQ ID NO: 900477 - protein, 5 aa, Mycobacterium
EANPL

SEQ ID NO: 900478 - protein, 15 aa, Mycobacterium
EANSVAPAGGAPGDF

SEQ ID NO: 900479 - protein, 20 aa, Mycobacterium
EANSVAPTGGAPGDFNSAGG

SEQ ID NO: 900480 - protein, 11 aa, Mycobacterium
EANYAGPTINR

SEQ ID NO: 900481 - protein, 14 aa, Mycobacterium
EAPAPAQGRGRPTT

SEQ ID NO: 900482 - protein, 19 aa, Mycobacterium
EAPAPEEAPAPEAPAADDQ

SEQ ID NO: 900483 - protein, 14 aa, Mycobacterium
EAPAQTKACEHTTQ

SEQ ID NO: 900484 - protein, 24 aa, Mycobacterium
EAPEAPAIDEAPAPEEAPAPEAQD

SEQ ID NO: 900485 - protein, 9 aa, Mycobacterium
EAPGIGATG

SEQ ID NO: 900486 - protein, 5 aa, Mycobacterium
EAPGV

SEQ ID NO: 900487 - protein, 7 aa, Mycobacterium
EAPGVSQ

SEQ ID NO: 900488 - protein, 7 aa, Mycobacterium
EAPNTGD

SEQ ID NO: 900489 - protein, 7 aa, Mycobacterium
EAPPQRA

SEQ ID NO: 900490 - protein, 14 aa, Mycobacterium
EAPPRASVHERTGT

SEQ ID NO: 900491 - protein, 4 aa, Mycobacterium
EAPR

SEQ ID NO: 900492 - protein, 9 aa, Mycobacterium
EAPSAQRET

SEQ ID NO: 900493 - protein, 7 aa, Mycobacterium
EAPSVGQ

SEQ ID NO: 900494 - protein, 12 aa, Mycobacterium
EAPTGIAATTDV

SEQ ID NO: 900495 - protein, 33 aa, Mycobacterium
EAPTIANPAASTTQGAAVSAAQATSAASTQSTV

SEQ ID NO: 900496 - protein, 7 aa, Mycobacterium
EAPVATD

SEQ ID NO: 900497 - protein, 4 aa, Mycobacterium
EAQI

SEQ ID NO: 900498 - protein, 9 aa, Mycobacterium
EAQPDPPRF

SEQ ID NO: 900499 - protein, 12 aa, Mycobacterium
EAQPGSQSIQGK

SEQ ID NO: 900500 - protein, 7 aa, Mycobacterium
EAQPHEV

SEQ ID NO: 900501 - protein, 9 aa, Mycobacterium
EAQRAQAGE

SEQ ID NO: 900502 - protein, 8 aa, Mycobacterium
EAQRPQGF

SEQ ID NO: 900503 - protein, 9 aa, Mycobacterium
EAQRTATGR

SEQ ID NO: 900504 - protein, 6 aa, Mycobacterium
EAQSSV

SEQ ID NO: 900505 - protein, 4 aa, Mycobacterium
EAQT

SEQ ID NO: 900506 - protein, 10 aa, Mycobacterium
EAQTGGIPRH

SEQ ID NO: 900507 - protein, 4 aa, Mycobacterium
EAQW

SEQ ID NO: 900508 - protein, 7 aa, Mycobacterium
EARAEIE

SEQ ID NO: 900509 - protein, 10 aa, Mycobacterium
EARASRAAQA

SEQ ID NO: 900510 - protein, 7 aa, Mycobacterium
EARATPP

SEQ ID NO: 900511 - protein, 10 aa, Mycobacterium
EAREQAKTEV

SEQ ID NO: 900512 - protein, 20 aa, Mycobacterium
EAREQARREVTADRGRAPRT

SEQ ID NO: 900513 - protein, 7 aa, Mycobacterium
EARERGE

SEQ ID NO: 900514 - protein, 8 aa, Mycobacterium
EARGGTSR

SEQ ID NO: 900515 - protein, 24 aa, Mycobacterium
EARGNQKLRPGDSLPIGQSTTPYQ

SEQ ID NO: 900516 - protein, 23 aa, Mycobacterium
EARGNQPLRPGGTLPLGQSTTPY

SEQ ID NO: 900517 - protein, 7 aa, Mycobacterium
EARGPLH

SEQ ID NO: 900518 - protein, 4 aa, Mycobacterium
EARK

SEQ ID NO: 900519 - protein, 4 aa, Mycobacterium
EARL

SEQ ID NO: 900520 - protein, 11 aa, Mycobacterium
EARPGSQSLRD

SEQ ID NO: 900521 - protein, 11 aa, Mycobacterium
EARPYTGEDDM

SEQ ID NO: 900522 - protein, 15 aa, Mycobacterium
EARRRDAAAQHQQNG

SEQ ID NO: 900523 - protein, 7 aa, Mycobacterium
EARRRGT

SEQ ID NO: 900524 - protein, 10 aa, Mycobacterium
EASAAASALA

SEQ ID NO: 900525 - protein, 20 aa, Mycobacterium
EASAPPAEPAANPAPPLPDP

SEQ ID NO: 900526 - protein, 9 aa, Mycobacterium
EASDGVDGR

SEQ ID NO: 900527 - protein, 19 aa, Mycobacterium
EASDTSCTLSGTEGKTGAN

SEQ ID NO: 900528 - protein, 7 aa, Mycobacterium
EASETAS

SEQ ID NO: 900529 - protein, 9 aa, Mycobacterium
EASGGVDGR

SEQ ID NO: 900530 - protein, 7 aa, Mycobacterium
EASGPAT

SEQ ID NO: 900531 - protein, 11 aa, Mycobacterium
EASGSAGKVTV

SEQ ID NO: 900532 - protein, 13 aa, Mycobacterium
EASGSAGKVTVSP

SEQ ID NO: 900533 - protein, 28 aa, Mycobacterium
EASGSAGKVTVSPVRKPGMTPFLTRIIE

SEQ ID NO: 900534 - protein, 28 aa, Mycobacterium
EASGSAGKVTVSPVRTGGMTPYAVRIIA

SEQ ID NO: 900535 - protein, 11 aa, Mycobacterium
EASLEPKPGTT

SEQ ID NO: 900536 - protein, 6 aa, Mycobacterium
EASPRI

SEQ ID NO: 900537 - protein, 7 aa, Mycobacterium
EASRAGI

SEQ ID NO: 900538 - protein, 10 aa, Mycobacterium
EASRLKAGQD

SEQ ID NO: 900539 - protein, 7 aa, Mycobacterium
EASRRGV

SEQ ID NO: 900540 - protein, 5 aa, Mycobacterium
EASSH

SEQ ID NO: 900541 - protein, 12 aa, Mycobacterium
EASTAVGGLGPD

SEQ ID NO: 900542 - protein, 9 aa, Mycobacterium
EATAAHSPD

SEQ ID NO: 900543 - protein, 33 aa, Mycobacterium
EATAARVDNTQQHGEVRTEGLPDAAARRSTKTL

SEQ ID NO: 900544 - protein, 5 aa, Mycobacterium
EATAL

SEQ ID NO: 900545 - protein, 7 aa, Mycobacterium
EATAQRR

SEQ ID NO: 900546 - protein, 17 aa, Mycobacterium
EATARGVTGHPAPSEAE

SEQ ID NO: 900547 - protein, 10 aa, Mycobacterium
EATATKPDEV

SEQ ID NO: 900548 - protein, 8 aa, Mycobacterium
EATDGGVQ

SEQ ID NO: 900549 - protein, 17 aa, Mycobacterium
EATEANRASEAGDRRPT

SEQ ID NO: 900550 - protein, 17 aa, Mycobacterium
EATEPPAPGPPAPRAMP

SEQ ID NO: 900551 - protein, 7 aa, Mycobacterium
EATGAST

SEQ ID NO: 900552 - protein, 7 aa, Mycobacterium
EATGESA

SEQ ID NO: 900553 - protein, 8 aa, Mycobacterium
EATGGADQ

SEQ ID NO: 900554 - protein, 13 aa, Mycobacterium
EATGGKGIPTWGS

SEQ ID NO: 900555 - protein, 5 aa, Mycobacterium
EATGH

SEQ ID NO: 900556 - protein, 17 aa, Mycobacterium
EATGNPPPVGTPTPRAM

SEQ ID NO: 900557 - protein, 7 aa, Mycobacterium
EATGQTK

SEQ ID NO: 900558 - protein, 8 aa, Mycobacterium
EATKRGAD

SEQ ID NO: 900559 - protein, 7 aa, Mycobacterium
EATPKVE

SEQ ID NO: 900560 - protein, 7 aa, Mycobacterium
EATPKVT

SEQ ID NO: 900561 - protein, 12 aa, Mycobacterium
EATPPDSPYPTT

SEQ ID NO: 900562 - protein, 7 aa, Mycobacterium
EATPQAT

SEQ ID NO: 900563 - protein, 18 aa, Mycobacterium
EATPYNPSSPYSATKAGA

SEQ ID NO: 900564 - protein, 7 aa, Mycobacterium
EATRGRG

SEQ ID NO: 900565 - protein, 4 aa, Mycobacterium
EAVA

SEQ ID NO: 900566 - protein, 13 aa, Mycobacterium
EAVAAAAGKPWAE

SEQ ID NO: 900567 - protein, 14 aa, Mycobacterium
EAVAAAAGKSWEDL

SEQ ID NO: 900568 - protein, 6 aa, Mycobacterium
EAVAQA

SEQ ID NO: 900569 - protein, 13 aa, Mycobacterium
EAVATGAGKSWED

SEQ ID NO: 900570 - protein, 7 aa, Mycobacterium
EAVEAAD

SEQ ID NO: 900571 - protein, 4 aa, Mycobacterium
EAVG

SEQ ID NO: 900572 - protein, 23 aa, Mycobacterium
EAVNNGTAKVPYSPRIYTTNCTI

SEQ ID NO: 900573 - protein, 4 aa, Mycobacterium
EAVP

SEQ ID NO: 900574 - protein, 11 aa, Mycobacterium
EAVYSDGKPIT

SEQ ID NO: 900575 - protein, 7 aa, Mycobacterium
EAWPGED

SEQ ID NO: 900576 - protein, 21 aa, Mycobacterium
EAYAKESKGTQLSVTKNGQDC

SEQ ID NO: 900577 - protein, 5 aa, Mycobacterium
EAYPQ

SEQ ID NO: 900578 - protein, 5 aa, Mycobacterium
EAYRG

SEQ ID NO: 900579 - protein, 6 aa, Mycobacterium
ECEAAG

SEQ ID NO: 900580 - protein, 6 aa, Mycobacterium
ECGAQG

SEQ ID NO: 900581 - protein, 4 aa, Mycobacterium
ECPD

SEQ ID NO: 900582 - protein, 16 aa, Mycobacterium
ECPETSPGPKKGESLE

SEQ ID NO: 900583 - protein, 17 aa, Mycobacterium
ECQGKPAVAELPEAGDS

SEQ ID NO: 900584 - protein, 12 aa, Mycobacterium
EDAAATAARLGG

SEQ ID NO: 900585 - protein, 18 aa, Mycobacterium
EDAAEGPMAQPRSIISAS

SEQ ID NO: 900586 - protein, 9 aa, Mycobacterium
EDAAPGINS

SEQ ID NO: 900587 - protein, 5 aa, Mycobacterium
EDAAV

SEQ ID NO: 900588 - protein, 5 aa, Mycobacterium
EDADA

SEQ ID NO: 900589 - protein, 10 aa, Mycobacterium
EDAGTPGEQD

SEQ ID NO: 900590 - protein, 8 aa, Mycobacterium
EDANSDSN

SEQ ID NO: 900591 - protein, 9 aa, Mycobacterium
EDAPAAGSE

SEQ ID NO: 900592 - protein, 9 aa, Mycobacterium
EDAPAGAPH

SEQ ID NO: 900593 - protein, 4 aa, Mycobacterium
EDAR

SEQ ID NO: 900594 - protein, 19 aa, Mycobacterium
EDAYTYAQSARGVPSARAE

SEQ ID NO: 900595 - protein, 8 aa, Mycobacterium
EDDAVERA

SEQ ID NO: 900596 - protein, 9 aa, Mycobacterium
EDDGGRRNQ

SEQ ID NO: 900597 - protein, 10 aa, Mycobacterium
EDDKARARTE

SEQ ID NO: 900598 - protein, 4 aa, Mycobacterium
EDDL

SEQ ID NO: 900599 - protein, 9 aa, Mycobacterium
EDDNGSHNQ

SEQ ID NO: 900600 - protein, 12 aa, Mycobacterium
EDDQKPNAADYI

SEQ ID NO: 900601 - protein, 8 aa, Mycobacterium
EDDRPPEV

SEQ ID NO: 900602 - protein, 6 aa, Mycobacterium
EDDSEL

SEQ ID NO: 900603 - protein, 5 aa, Mycobacterium
EDEGR

SEQ ID NO: 900604 - protein, 8 aa, Mycobacterium
EDEGRVQQ

SEQ ID NO: 900605 - protein, 4 aa, Mycobacterium
EDEL

SEQ ID NO: 900606 - protein, 6 aa, Mycobacterium
EDELPD

SEQ ID NO: 900607 - protein, 7 aa, Mycobacterium
EDERPTV

SEQ ID NO: 900608 - protein, 5 aa, Mycobacterium
EDETK

SEQ ID NO: 900609 - protein, 5 aa, Mycobacterium
EDFAS

SEQ ID NO: 900610 - protein, 5 aa, Mycobacterium
EDFDP

SEQ ID NO: 900611 - protein, 6 aa, Mycobacterium
EDFNDN

SEQ ID NO: 900612 - protein, 7 aa, Mycobacterium
EDGASAG

SEQ ID NO: 900613 - protein, 9 aa, Mycobacterium
EDGASEPTI

SEQ ID NO: 900614 - protein, 13 aa, Mycobacterium
EDGDQSGPPAAGV

SEQ ID NO: 900615 - protein, 4 aa, Mycobacterium
EDGG

SEQ ID NO: 900616 - protein, 9 aa, Mycobacterium
EDGGPRGSL

SEQ ID NO: 900617 - protein, 5 aa, Mycobacterium
EDGGQ

SEQ ID NO: 900618 - protein, 6 aa, Mycobacterium
EDGGRK

SEQ ID NO: 900619 - protein, 5 aa, Mycobacterium
EDGIE

SEQ ID NO: 900620 - protein, 8 aa, Mycobacterium
EDGKNTTM

SEQ ID NO: 900621 - protein, 5 aa, Mycobacterium
EDGLN

SEQ ID NO: 900622 - protein, 11 aa, Mycobacterium
EDGLRGSNNYV

SEQ ID NO: 900623 - protein, 5 aa, Mycobacterium
EDGNP

SEQ ID NO: 900624 - protein, 4 aa, Mycobacterium
EDGR

SEQ ID NO: 900625 - protein, 12 aa, Mycobacterium
EDGSVSLQTGDT

SEQ ID NO: 900626 - protein, 14 aa, Mycobacterium
EDGTIDKPAINGAV

SEQ ID NO: 900627 - protein, 9 aa, Mycobacterium
EDGYTDAHR

SEQ ID NO: 900628 - protein, 11 aa, Mycobacterium
EDGYTDANREA

SEQ ID NO: 900629 - protein, 9 aa, Mycobacterium
EDHDPADDL

SEQ ID NO: 900630 - protein, 9 aa, Mycobacterium
EDHTTTEST

SEQ ID NO: 900631 - protein, 36 aa, Mycobacterium
EDIEPVAEKAEEPVGEQDSQKDSEKKDAKKQPRGLK

SEQ ID NO: 900632 - protein, 6 aa, Mycobacterium
EDINNT

SEQ ID NO: 900633 - protein, 7 aa, Mycobacterium
EDKGMRD

SEQ ID NO: 900634 - protein, 8 aa, Mycobacterium
EDKPLGRA

SEQ ID NO: 900635 - protein, 4 aa, Mycobacterium
EDKV

SEQ ID NO: 900636 - protein, 4 aa, Mycobacterium
EDLG

SEQ ID NO: 900637 - protein, 10 aa, Mycobacterium
EDLGDDGPPF

SEQ ID NO: 900638 - protein, 12 aa, Mycobacterium
EDLGSDRPAPGD

SEQ ID NO: 900639 - protein, 12 aa, Mycobacterium
EDLGSGTTGKKI

SEQ ID NO: 900640 - protein, 13 aa, Mycobacterium
EDLNQDKNALNEK

SEQ ID NO: 900641 - protein, 5 aa, Mycobacterium
EDLPE

SEQ ID NO: 900642 - protein, 4 aa, Mycobacterium
EDLS

SEQ ID NO: 900643 - protein, 6 aa, Mycobacterium
EDLSGF

SEQ ID NO: 900644 - protein, 10 aa, Mycobacterium
EDNEQELAPT

SEQ ID NO: 900645 - protein, 5 aa, Mycobacterium
EDNPD

SEQ ID NO: 900646 - protein, 9 aa, Mycobacterium
EDPAAIGGP

SEQ ID NO: 900647 - protein, 10 aa, Mycobacterium
EDPDPHNPKR

SEQ ID NO: 900648 - protein, 7 aa, Mycobacterium
EDPDPKI

SEQ ID NO: 900649 - protein, 7 aa, Mycobacterium
EDPDRVQ

SEQ ID NO: 900650 - protein, 10 aa, Mycobacterium
EDPEAYPAPE

SEQ ID NO: 900651 - protein, 10 aa, Mycobacterium
EDPGAPGTQD

SEQ ID NO: 900652 - protein, 12 aa, Mycobacterium
EDPGPPPPPPVD

SEQ ID NO: 900653 - protein, 6 aa, Mycobacterium
EDPGYA

SEQ ID NO: 900654 - protein, 7 aa, Mycobacterium
EDPSQLT

SEQ ID NO: 900655 - protein, 17 aa, Mycobacterium
EDPTDPERGLAAAGSDY

SEQ ID NO: 900656 - protein, 9 aa, Mycobacterium
EDPTNSTST

SEQ ID NO: 900657 - protein, 9 aa, Mycobacterium
EDPTNTTST

SEQ ID NO: 900658 - protein, 8 aa, Mycobacterium
EDPVTEQT

SEQ ID NO: 900659 - protein, 6 aa, Mycobacterium
EDQGEI

SEQ ID NO: 900660 - protein, 8 aa, Mycobacterium
EDQPGDKR

SEQ ID NO: 900661 - protein, 11 aa, Mycobacterium
EDQTGELPITE

SEQ ID NO: 900662 - protein, 17 aa, Mycobacterium
EDQTGELPVTEDSARSI

SEQ ID NO: 900663 - protein, 10 aa, Mycobacterium
EDRGARADDA

SEQ ID NO: 900664 - protein, 5 aa, Mycobacterium
EDRGT

SEQ ID NO: 900665 - protein, 8 aa, Mycobacterium
EDRPGDRR

SEQ ID NO: 900666 - protein, 10 aa, Mycobacterium
EDRPRLPAGE

SEQ ID NO: 900667 - protein, 8 aa, Mycobacterium
EDRSTAER

SEQ ID NO: 900668 - protein, 13 aa, Mycobacterium
EDRTDASAKSKRG

SEQ ID NO: 900669 - protein, 7 aa, Mycobacterium
EDRVGEK

SEQ ID NO: 900670 - protein, 8 aa, Mycobacterium
EDRVPDQS

SEQ ID NO: 900671 - protein, 5 aa, Mycobacterium
EDRYP

SEQ ID NO: 900672 - protein, 4 aa, Mycobacterium
EDSE

SEQ ID NO: 900673 - protein, 7 aa, Mycobacterium
EDSELQT

SEQ ID NO: 900674 - protein, 5 aa, Mycobacterium
EDSGV

SEQ ID NO: 900675 - protein, 7 aa, Mycobacterium
EDSNPQF

SEQ ID NO: 900676 - protein, 11 aa, Mycobacterium
EDTDANEARHA

SEQ ID NO: 900677 - protein, 4 aa, Mycobacterium
EDTI

SEQ ID NO: 900678 - protein, 4 aa, Mycobacterium
EDTL

SEQ ID NO: 900679 - protein, 8 aa, Mycobacterium
EDVAAQQG

SEQ ID NO: 900680 - protein, 7 aa, Mycobacterium
EDVAAQR

SEQ ID NO: 900681 - protein, 9 aa, Mycobacterium
EEAAVSEEV

SEQ ID NO: 900682 - protein, 8 aa, Mycobacterium
EEAEAARD

SEQ ID NO: 900683 - protein, 19 aa, Mycobacterium
EEAKAVGSSGFDELEPGAT

SEQ ID NO: 900684 - protein, 10 aa, Mycobacterium
EEAKEDAKRI

SEQ ID NO: 900685 - protein, 11 aa, Mycobacterium
EEAKTDATRIT

SEQ ID NO: 900686 - protein, 9 aa, Mycobacterium
EEAQRRHNA

SEQ ID NO: 900687 - protein, 26 aa, Mycobacterium
EEAQSQAPAVTPESSVGSSPTVHGSI

SEQ ID NO: 900688 - protein, 11 aa, Mycobacterium
EEARRGETGSL

SEQ ID NO: 900689 - protein, 5 aa, Mycobacterium
EEATG

SEQ ID NO: 900690 - protein, 7 aa, Mycobacterium
EEAVAAD

SEQ ID NO: 900691 - protein, 10 aa, Mycobacterium
EEDDTGGEVE

SEQ ID NO: 900692 - protein, 7 aa, Mycobacterium
EEDDYGG

SEQ ID NO: 900693 - protein, 19 aa, Mycobacterium
EEDKPGTLASAGSERISTA

SEQ ID NO: 900694 - protein, 7 aa, Mycobacterium
EEDPDLK

SEQ ID NO: 900695 - protein, 5 aa, Mycobacterium
EEDRS

SEQ ID NO: 900696 - protein, 5 aa, Mycobacterium
EEEVG

SEQ ID NO: 900697 - protein, 6 aa, Mycobacterium
EEEVGG

SEQ ID NO: 900698 - protein, 10 aa, Mycobacterium
EEFGGDTTFT

SEQ ID NO: 900699 - protein, 10 aa, Mycobacterium
EEFGGESLES

SEQ ID NO: 900700 - protein, 5 aa, Mycobacterium
EEFPQ

SEQ ID NO: 900701 - protein, 7 aa, Mycobacterium
EEGAAAV

SEQ ID NO: 900702 - protein, 14 aa, Mycobacterium
EEGPRAAPDCATGA

SEQ ID NO: 900703 - protein, 7 aa, Mycobacterium
EEGSPTR

SEQ ID NO: 900704 - protein, 29 aa, Mycobacterium
EEGTPHLASPDNLPPGTSEVPVGPPQGRT

SEQ ID NO: 900705 - protein, 16 aa, Mycobacterium
EEHADKDFSAVIELLR

SEQ ID NO: 900706 - protein, 8 aa, Mycobacterium
EEHDTDRH

SEQ ID NO: 900707 - protein, 17 aa, Mycobacterium
EEIPGGVRTTTESDSAD

SEQ ID NO: 900708 - protein, 8 aa, Mycobacterium
EEKAGAGA

SEQ ID NO: 900709 - protein, 8 aa, Mycobacterium
EEKAGRCK

SEQ ID NO: 900710 - protein, 12 aa, Mycobacterium
EEKPKAPRSEYA

SEQ ID NO: 900711 - protein, 4 aa, Mycobacterium
EELG

SEQ ID NO: 900712 - protein, 9 aa, Mycobacterium
EELPPREDL

SEQ ID NO: 900713 - protein, 4 aa, Mycobacterium
EENG

SEQ ID NO: 900714 - protein, 9 aa, Mycobacterium
EENRGSPRS

SEQ ID NO: 900715 - protein, 4 aa, Mycobacterium
EEPA

SEQ ID NO: 900716 - protein, 6 aa, Mycobacterium
EEPDYD

SEQ ID NO: 900717 - protein, 13 aa, Mycobacterium
EEPHEPYDRPPLS

SEQ ID NO: 900718 - protein, 6 aa, Mycobacterium
EEPNPF

SEQ ID NO: 900719 - protein, 14 aa, Mycobacterium
EEQDPDRRSRAQTE

SEQ ID NO: 900720 - protein, 10 aa, Mycobacterium
EEQKQNDAVS

SEQ ID NO: 900721 - protein, 26 aa, Mycobacterium
EEQQAQGPAAVPRSSVGSSPTVTGHT

SEQ ID NO: 900722 - protein, 7 aa, Mycobacterium
EEQTERQ

SEQ ID NO: 900723 - protein, 9 aa, Mycobacterium
EEQVTDDDG

SEQ ID NO: 900724 - protein, 9 aa, Mycobacterium
EERDYGEYR

SEQ ID NO: 900725 - protein, 6 aa, Mycobacterium
EERNAR

SEQ ID NO: 900726 - protein, 5 aa, Mycobacterium
EERQQ

SEQ ID NO: 900727 - protein, 40 aa, Mycobacterium
EESDAHDGNSASAAPEVDSPSTAVPSDATGVSEAEAPAHE

SEQ ID NO: 900728 - protein, 6 aa, Mycobacterium
EESDGA

SEQ ID NO: 900729 - protein, 9 aa, Mycobacterium
EESGRTRQW

SEQ ID NO: 900730 - protein, 5 aa, Mycobacterium
EETEL

SEQ ID NO: 900731 - protein, 8 aa, Mycobacterium
EETPQSQY

SEQ ID NO: 900732 - protein, 10 aa, Mycobacterium
EETSEGPDDF

SEQ ID NO: 900733 - protein, 8 aa, Mycobacterium
EETTGRPV

SEQ ID NO: 900734 - protein, 13 aa, Mycobacterium
EETTYTNDPGMAS

SEQ ID NO: 900735 - protein, 12 aa, Mycobacterium
EEVGGSGGNAID

SEQ ID NO: 900736 - protein, 5 aa, Mycobacterium
EEVKP

SEQ ID NO: 900737 - protein, 6 aa, Mycobacterium
EEVKSD

SEQ ID NO: 900738 - protein, 8 aa, Mycobacterium
EEVNEGRF

SEQ ID NO: 900739 - protein, 4 aa, Mycobacterium
EEVP

SEQ ID NO: 900740 - protein, 9 aa, Mycobacterium
EEVPAPGDP

SEQ ID NO: 900741 - protein, 10 aa, Mycobacterium
EEVTTPDGDT

SEQ ID NO: 900742 - protein, 16 aa, Mycobacterium
EEWPEPADSLPPPYDN

SEQ ID NO: 900743 - protein, 11 aa, Mycobacterium
EFDPEKRKAAI

SEQ ID NO: 900744 - protein, 8 aa, Mycobacterium
EFEGGSSF

SEQ ID NO: 900745 - protein, 9 aa, Mycobacterium
EFGGDPARV

SEQ ID NO: 900746 - protein, 12 aa, Mycobacterium
EFGGGDKLGTAW

SEQ ID NO: 900747 - protein, 8 aa, Mycobacterium
EFGGTTTF

SEQ ID NO: 900748 - protein, 5 aa, Mycobacterium
EFGHA

SEQ ID NO: 900749 - protein, 13 aa, Mycobacterium
EFGSGASKPTVDR

SEQ ID NO: 900750 - protein, 7 aa, Mycobacterium
EFKRSAN

SEQ ID NO: 900751 - protein, 23 aa, Mycobacterium
EFNQGAPKPKAKEQAQIPGEARA

SEQ ID NO: 900752 - protein, 5 aa, Mycobacterium
EFNTR

SEQ ID NO: 900753 - protein, 17 aa, Mycobacterium
EFPDPDSPAHAYTRERK

SEQ ID NO: 900754 - protein, 5 aa, Mycobacterium
EFPPG

SEQ ID NO: 900755 - protein, 13 aa, Mycobacterium
EFPPGGQPRASIN

SEQ ID NO: 900756 - protein, 7 aa, Mycobacterium
EFRKSAN

SEQ ID NO: 900757 - protein, 5 aa, Mycobacterium
EFSEN

SEQ ID NO: 900758 - protein, 7 aa, Mycobacterium
EFTGNAP

SEQ ID NO: 900759 - protein, 6 aa, Mycobacterium
EFTPAA

SEQ ID NO: 900760 - protein, 15 aa, Mycobacterium
EFTTNTEGTDTAAIN

SEQ ID NO: 900761 - protein, 7 aa, Mycobacterium
EGAAARL

SEQ ID NO: 900762 - protein, 10 aa, Mycobacterium
EGAALSSDEA

SEQ ID NO: 900763 - protein, 19 aa, Mycobacterium
EGAAPGSSSFNLSPDQDRV

SEQ ID NO: 900764 - protein, 8 aa, Mycobacterium
EGADDFEG

SEQ ID NO: 900765 - protein, 9 aa, Mycobacterium
EGAEDTRPV

SEQ ID NO: 900766 - protein, 15 aa, Mycobacterium
EGAEPVGGRTGGPAV

SEQ ID NO: 900767 - protein, 5 aa, Mycobacterium
EGAGG

SEQ ID NO: 900768 - protein, 12 aa, Mycobacterium
EGAGGDLNEDNK

SEQ ID NO: 900769 - protein, 15 aa, Mycobacterium
EGAGGTTKLRPGDAI

SEQ ID NO: 900770 - protein, 5 aa, Mycobacterium
EGAKQ

SEQ ID NO: 900771 - protein, 7 aa, Mycobacterium
EGAKQAS

SEQ ID NO: 900772 - protein, 5 aa, Mycobacterium
EGAQP

SEQ ID NO: 900773 - protein, 14 aa, Mycobacterium
EGATEGKPSTLSGF

SEQ ID NO: 900774 - protein, 8 aa, Mycobacterium
EGATLPAE

SEQ ID NO: 900775 - protein, 10 aa, Mycobacterium
EGATPESAAT

SEQ ID NO: 900776 - protein, 6 aa, Mycobacterium
EGAWSI

SEQ ID NO: 900777 - protein, 8 aa, Mycobacterium
EGDASPAD

SEQ ID NO: 900778 - protein, 4 aa, Mycobacterium
EGDD

SEQ ID NO: 900779 - protein, 11 aa, Mycobacterium
EGDFDSAGSVY

SEQ ID NO: 900780 - protein, 4 aa, Mycobacterium
EGDG

SEQ ID NO: 900781 - protein, 7 aa, Mycobacterium
EGDGAAT

SEQ ID NO: 900782 - protein, 16 aa, Mycobacterium
EGDGDYDRARAKYDAD

SEQ ID NO: 900783 - protein, 8 aa, Mycobacterium
EGDPPKPI

SEQ ID NO: 900784 - protein, 8 aa, Mycobacterium
EGDPRAPL

SEQ ID NO: 900785 - protein, 19 aa, Mycobacterium
EGDPSPANTCNGSPICLPG

SEQ ID NO: 900786 - protein, 13 aa, Mycobacterium
EGDQATPNAASPI

SEQ ID NO: 900787 - protein, 5 aa, Mycobacterium
EGDRD

SEQ ID NO: 900788 - protein, 7 aa, Mycobacterium
EGDSTLD

SEQ ID NO: 900789 - protein, 8 aa, Mycobacterium
EGDYTGGD

SEQ ID NO: 900790 - protein, 12 aa, Mycobacterium
EGEDGATSEPVT

SEQ ID NO: 900791 - protein, 6 aa, Mycobacterium
EGEDGG

SEQ ID NO: 900792 - protein, 10 aa, Mycobacterium
EGEGAGQLPV

SEQ ID NO: 900793 - protein, 10 aa, Mycobacterium
EGEGAGQVPL

SEQ ID NO: 900794 - protein, 9 aa, Mycobacterium
EGELPDPGP

SEQ ID NO: 900795 - protein, 33 aa, Mycobacterium
EGERELTGTCGGGSKAHGHVRAEGSRKATWRDK

SEQ ID NO: 900796 - protein, 6 aa, Mycobacterium
EGESGA

SEQ ID NO: 900797 - protein, 14 aa, Mycobacterium
EGGAQQDRFPAGTQ

SEQ ID NO: 900798 - protein, 6 aa, Mycobacterium
EGGDAT

SEQ ID NO: 900799 - protein, 8 aa, Mycobacterium
EGGEIGRA

SEQ ID NO: 900800 - protein, 9 aa, Mycobacterium
EGGGCTESV

SEQ ID NO: 900801 - protein, 9 aa, Mycobacterium
EGGGDQTEA

SEQ ID NO: 900802 - protein, 6 aa, Mycobacterium
EGGGPH

SEQ ID NO: 900803 - protein, 8 aa, Mycobacterium
EGGGVTGE

SEQ ID NO: 900804 - protein, 5 aa, Mycobacterium
EGGGW

SEQ ID NO: 900805 - protein, 5 aa, Mycobacterium
EGGID

SEQ ID NO: 900806 - protein, 9 aa, Mycobacterium
EGGIGGTEA

SEQ ID NO: 900807 - protein, 9 aa, Mycobacterium
EGGPAGHAP

SEQ ID NO: 900808 - protein, 10 aa, Mycobacterium
EGGPEAQEEL

SEQ ID NO: 900809 - protein, 7 aa, Mycobacterium
EGGPSYW

SEQ ID NO: 900810 - protein, 9 aa, Mycobacterium
EGGQGAGTV

SEQ ID NO: 900811 - protein, 9 aa, Mycobacterium
EGGQGEGTV

SEQ ID NO: 900812 - protein, 9 aa, Mycobacterium
EGGQGQGTV

SEQ ID NO: 900813 - protein, 6 aa, Mycobacterium
EGGRIN

SEQ ID NO: 900814 - protein, 6 aa, Mycobacterium
EGGSAK

SEQ ID NO: 900815 - protein, 16 aa, Mycobacterium
EGGTPQPHPVGTNGTV

SEQ ID NO: 900816 - protein, 9 aa, Mycobacterium
EGHDPAGHM

SEQ ID NO: 900817 - protein, 4 aa, Mycobacterium
EGHG

SEQ ID NO: 900818 - protein, 7 aa, Mycobacterium
EGHLTGP

SEQ ID NO: 900819 - protein, 6 aa, Mycobacterium
EGHVQE

SEQ ID NO: 900820 - protein, 12 aa, Mycobacterium
EGIGQGKVTASP

SEQ ID NO: 900821 - protein, 17 aa, Mycobacterium
EGISDDDAAAAGKVAKQ

SEQ ID NO: 900822 - protein, 16 aa, Mycobacterium
EGITEEDEAAADKTTK

SEQ ID NO: 900823 - protein, 12 aa, Mycobacterium
EGKAALSAEDRQ

SEQ ID NO: 900824 - protein, 6 aa, Mycobacterium
EGKAEV

SEQ ID NO: 900825 - protein, 25 aa, Mycobacterium
EGKAINNALGANRPAVYAPKSALGH

SEQ ID NO: 900826 - protein, 5 aa, Mycobacterium
EGKKG

SEQ ID NO: 900827 - protein, 6 aa, Mycobacterium
EGKNSL

SEQ ID NO: 900828 - protein, 6 aa, Mycobacterium
EGKPVT

SEQ ID NO: 900829 - protein, 7 aa, Mycobacterium
EGKRAAK

SEQ ID NO: 900830 - protein, 9 aa, Mycobacterium
EGKRLNAPN

SEQ ID NO: 900831 - protein, 12 aa, Mycobacterium
EGKTHDEQEAFT

SEQ ID NO: 900832 - protein, 9 aa, Mycobacterium
EGLAATEER

SEQ ID NO: 900833 - protein, 7 aa, Mycobacterium
EGLESSP

SEQ ID NO: 900834 - protein, 6 aa, Mycobacterium
EGLIGS

SEQ ID NO: 900835 - protein, 4 aa, Mycobacterium
EGLN

SEQ ID NO: 900836 - protein, 6 aa, Mycobacterium
EGLPAG

SEQ ID NO: 900837 - protein, 12 aa, Mycobacterium
EGLRGNGDNFGQ

SEQ ID NO: 900838 - protein, 5 aa, Mycobacterium
EGLRN

SEQ ID NO: 900839 - protein, 8 aa, Mycobacterium
EGLTGTNV

SEQ ID NO: 900840 - protein, 7 aa, Mycobacterium
EGNGPSF

SEQ ID NO: 900841 - protein, 8 aa, Mycobacterium
EGNPKNIR

SEQ ID NO: 900842 - protein, 10 aa, Mycobacterium
EGNPPEGQRA

SEQ ID NO: 900843 - protein, 7 aa, Mycobacterium
EGNPVRV

SEQ ID NO: 900844 - protein, 7 aa, Mycobacterium
EGNREGQ

SEQ ID NO: 900845 - protein, 14 aa, Mycobacterium
EGPAASQVAAANPG

SEQ ID NO: 900846 - protein, 8 aa, Mycobacterium
EGPAYSQG

SEQ ID NO: 900847 - protein, 6 aa, Mycobacterium
EGPDGA

SEQ ID NO: 900848 - protein, 5 aa, Mycobacterium
EGPHV

SEQ ID NO: 900849 - protein, 6 aa, Mycobacterium
EGPLDP

SEQ ID NO: 900850 - protein, 7 aa, Mycobacterium
EGPMTPG

SEQ ID NO: 900851 - protein, 27 aa, Mycobacterium
EGPPDKYQTSGRIDSTDWQTGQPKTDN

SEQ ID NO: 900852 - protein, 11 aa, Mycobacterium
EGPPDKYQTTG

SEQ ID NO: 900853 - protein, 12 aa, Mycobacterium
EGPPDKYQTTGV

SEQ ID NO: 900854 - protein, 28 aa, Mycobacterium
EGPPEKYQTNGRIDSTDWQTGQPKTDNN

SEQ ID NO: 900855 - protein, 10 aa, Mycobacterium
EGPPNQADME

SEQ ID NO: 900856 - protein, 8 aa, Mycobacterium
EGPRNPDA

SEQ ID NO: 900857 - protein, 6 aa, Mycobacterium
EGPSPI

SEQ ID NO: 900858 - protein, 8 aa, Mycobacterium
EGPTKLPS

SEQ ID NO: 900859 - protein, 13 aa, Mycobacterium
EGPVPHYPAPDGV

SEQ ID NO: 900860 - protein, 5 aa, Mycobacterium
EGQAP

SEQ ID NO: 900861 - protein, 10 aa, Mycobacterium
EGQLPDPGPI

SEQ ID NO: 900862 - protein, 5 aa, Mycobacterium
EGQNL

SEQ ID NO: 900863 - protein, 7 aa, Mycobacterium
EGQPDPA

SEQ ID NO: 900864 - protein, 10 aa, Mycobacterium
EGQQFPPGLQ

SEQ ID NO: 900865 - protein, 6 aa, Mycobacterium
EGQRTT

SEQ ID NO: 900866 - protein, 12 aa, Mycobacterium
EGQVQGVPDTLT

SEQ ID NO: 900867 - protein, 4 aa, Mycobacterium
EGRA

SEQ ID NO: 900868 - protein, 10 aa, Mycobacterium
EGRDTSAMPR

SEQ ID NO: 900869 - protein, 8 aa, Mycobacterium
EGRNLSTE

SEQ ID NO: 900870 - protein, 10 aa, Mycobacterium
EGRPARRPLT

SEQ ID NO: 900871 - protein, 10 aa, Mycobacterium
EGRPPAEHAE

SEQ ID NO: 900872 - protein, 8 aa, Mycobacterium
EGRPRATD

SEQ ID NO: 900873 - protein, 8 aa, Mycobacterium
EGRPYEPD

SEQ ID NO: 900874 - protein, 6 aa, Mycobacterium
EGRQKY

SEQ ID NO: 900875 - protein, 6 aa, Mycobacterium
EGRRAG

SEQ ID NO: 900876 - protein, 24 aa, Mycobacterium
EGSDNASSSTLASAGSGTISRDPG

SEQ ID NO: 900877 - protein, 10 aa, Mycobacterium
EGSEDGVLPA

SEQ ID NO: 900878 - protein, 4 aa, Mycobacterium
EGSG

SEQ ID NO: 900879 - protein, 9 aa, Mycobacterium
EGSGAPYGG

SEQ ID NO: 900880 - protein, 6 aa, Mycobacterium
EGSGDI

SEQ ID NO: 900881 - protein, 5 aa, Mycobacterium
EGSGN

SEQ ID NO: 900882 - protein, 9 aa, Mycobacterium
EGSPAPSVS

SEQ ID NO: 900883 - protein, 7 aa, Mycobacterium
EGSPEEG

SEQ ID NO: 900884 - protein, 9 aa, Mycobacterium
EGSQSHPIR

SEQ ID NO: 900885 - protein, 10 aa, Mycobacterium
EGSSENEGLG

SEQ ID NO: 900886 - protein, 9 aa, Mycobacterium
EGSTPDTAA

SEQ ID NO: 900887 - protein, 11 aa, Mycobacterium
EGSTTPSRVPD

SEQ ID NO: 900888 - protein, 10 aa, Mycobacterium
EGSVTMDSSS

SEQ ID NO: 900889 - protein, 6 aa, Mycobacterium
EGSVTQ

SEQ ID NO: 900890 - protein, 6 aa, Mycobacterium
EGTARP

SEQ ID NO: 900891 - protein, 5 aa, Mycobacterium
EGTHG

SEQ ID NO: 900892 - protein, 31 aa, Mycobacterium
EGTNWKGDPNATLSGQPVPQPPPDPPPPVPV

SEQ ID NO: 900893 - protein, 7 aa, Mycobacterium
EGTNWNA

SEQ ID NO: 900894 - protein, 33 aa, Mycobacterium
EGTPDHPLPAVPPGSPCSYTPAADALPRPDNPL

SEQ ID NO: 900895 - protein, 20 aa, Mycobacterium
EGTPQANTDPPGSEITEDGS

SEQ ID NO: 900896 - protein, 4 aa, Mycobacterium
EGTQ

SEQ ID NO: 900897 - protein, 10 aa, Mycobacterium
EGTRSPDGRL

SEQ ID NO: 900898 - protein, 7 aa, Mycobacterium
EGTSTIA

SEQ ID NO: 900899 - protein, 6 aa, Mycobacterium
EGTTGV

SEQ ID NO: 900900 - protein, 7 aa, Mycobacterium
EGTYRDG

SEQ ID NO: 900901 - protein, 4 aa, Mycobacterium
EGVA

SEQ ID NO: 900902 - protein, 17 aa, Mycobacterium
EGVAAGDYATAAEDKPA

SEQ ID NO: 900903 - protein, 15 aa, Mycobacterium
EGVAAGDYTTAAEDK

SEQ ID NO: 900904 - protein, 15 aa, Mycobacterium
EGVAPQPPSPPPGEV

SEQ ID NO: 900905 - protein, 6 aa, Mycobacterium
EGVAQT

SEQ ID NO: 900906 - protein, 9 aa, Mycobacterium
EGVDEPTKS

SEQ ID NO: 900907 - protein, 14 aa, Mycobacterium
EGVDGSRPFCTGGG

SEQ ID NO: 900908 - protein, 18 aa, Mycobacterium
EGVEDQASEIVDQIVANI

SEQ ID NO: 900909 - protein, 5 aa, Mycobacterium
EGVEK

SEQ ID NO: 900910 - protein, 27 aa, Mycobacterium
EGVGETDTLAAGGATVESVHGSADVTE

SEQ ID NO: 900911 - protein, 19 aa, Mycobacterium
EGVGTRPSPGEMNTPAPRT

SEQ ID NO: 900912 - protein, 10 aa, Mycobacterium
EGVPAPGDPE

SEQ ID NO: 900913 - protein, 13 aa, Mycobacterium
EGVRRTGGNTARP

SEQ ID NO: 900914 - protein, 13 aa, Mycobacterium
EGVSPDQQANRAR

SEQ ID NO: 900915 - protein, 12 aa, Mycobacterium
EGVSPESIDTAD

SEQ ID NO: 900916 - protein, 10 aa, Mycobacterium
EGYVRSSEAT

SEQ ID NO: 900917 - protein, 5 aa, Mycobacterium
EHAAE

SEQ ID NO: 900918 - protein, 5 aa, Mycobacterium
EHADE

SEQ ID NO: 900919 - protein, 10 aa, Mycobacterium
EHAPQRPAAE

SEQ ID NO: 900920 - protein, 5 aa, Mycobacterium
EHDGE

SEQ ID NO: 900921 - protein, 8 aa, Mycobacterium
EHENPGEA

SEQ ID NO: 900922 - protein, 6 aa, Mycobacterium
EHEPSD

SEQ ID NO: 900923 - protein, 4 aa, Mycobacterium
EHEQ

SEQ ID NO: 900924 - protein, 4 aa, Mycobacterium
EHGD

SEQ ID NO: 900925 - protein, 8 aa, Mycobacterium
EHGEEGPL

SEQ ID NO: 900926 - protein, 7 aa, Mycobacterium
EHGPPLT

SEQ ID NO: 900927 - protein, 13 aa, Mycobacterium
EHPAHRRERFTVA

SEQ ID NO: 900928 - protein, 6 aa, Mycobacterium
EHPAPG

SEQ ID NO: 900929 - protein, 18 aa, Mycobacterium
EHPHTGGTCHGHGGVQRY

SEQ ID NO: 900930 - protein, 5 aa, Mycobacterium
EHPIE

SEQ ID NO: 900931 - protein, 7 aa, Mycobacterium
EHPLPQR

SEQ ID NO: 900932 - protein, 4 aa, Mycobacterium
EHQT

SEQ ID NO: 900933 - protein, 8 aa, Mycobacterium
EHRPGGEQ

SEQ ID NO: 900934 - protein, 20 aa, Mycobacterium
EHRPSYAESRQQDTKPFNPK

SEQ ID NO: 900935 - protein, 25 aa, Mycobacterium
EHRSGAPGQLDDQSASALVSGSREV

SEQ ID NO: 900936 - protein, 4 aa, Mycobacterium
EHRT

SEQ ID NO: 900937 - protein, 5 aa, Mycobacterium
EHTNP

SEQ ID NO: 900938 - protein, 4 aa, Mycobacterium
EHYG

SEQ ID NO: 900939 - protein, 4 aa, Mycobacterium
EIAD

SEQ ID NO: 900940 - protein, 10 aa, Mycobacterium
EIAKTGARYS

SEQ ID NO: 900941 - protein, 42 aa, Mycobacterium
EIATGTPVADPAAATESTTAPKTRASATTTAPVPDQSAPVGS

SEQ ID NO: 900942 - protein, 18 aa, Mycobacterium
EIATQNDHPYSPRCQLGN

SEQ ID NO: 900943 - protein, 13 aa, Mycobacterium
EIDAERVAKGGAV

SEQ ID NO: 900944 - protein, 11 aa, Mycobacterium
EIEAKGYAEDV

SEQ ID NO: 900945 - protein, 11 aa, Mycobacterium
EIEQRRGDLPN

SEQ ID NO: 900946 - protein, 7 aa, Mycobacterium
EIGQDRT

SEQ ID NO: 900947 - protein, 4 aa, Mycobacterium
EIGV

SEQ ID NO: 900948 - protein, 5 aa, Mycobacterium
EIGYG

SEQ ID NO: 900949 - protein, 20 aa, Mycobacterium
EIKSAPNEKDLPAPASGAIG

SEQ ID NO: 900950 - protein, 6 aa, Mycobacterium
EINGDD

SEQ ID NO: 900951 - protein, 5 aa, Mycobacterium
EIPAA

SEQ ID NO: 900952 - protein, 17 aa, Mycobacterium
EIPGGVRTTTQSAAPDL

SEQ ID NO: 900953 - protein, 6 aa, Mycobacterium
EIPPQP

SEQ ID NO: 900954 - protein, 10 aa, Mycobacterium
EIQTEQESVN

SEQ ID NO: 900955 - protein, 7 aa, Mycobacterium
EISDTAS

SEQ ID NO: 900956 - protein, 5 aa, Mycobacterium
EISGG

SEQ ID NO: 900957 - protein, 6 aa, Mycobacterium
EISPKS

SEQ ID NO: 900958 - protein, 7 aa, Mycobacterium
EITAGKD

SEQ ID NO: 900959 - protein, 6 aa, Mycobacterium
EITGDD

SEQ ID NO: 900960 - protein, 12 aa, Mycobacterium
EITTADGRATGL

SEQ ID NO: 900961 - protein, 18 aa, Mycobacterium
EITTGGGRASGLKLGDGS

SEQ ID NO: 900962 - protein, 13 aa, Mycobacterium
EITTTGGKATGLK

SEQ ID NO: 900963 - protein, 10 aa, Mycobacterium
EKAEPPRAPM

SEQ ID NO: 900964 - protein, 4 aa, Mycobacterium
EKAG

SEQ ID NO: 900965 - protein, 8 aa, Mycobacterium
EKAGAAQT

SEQ ID NO: 900966 - protein, 5 aa, Mycobacterium
EKAGL

SEQ ID NO: 900967 - protein, 9 aa, Mycobacterium
EKAKEAGHD

SEQ ID NO: 900968 - protein, 4 aa, Mycobacterium
EKAN

SEQ ID NO: 900969 - protein, 10 aa, Mycobacterium
EKAQSPASLR

SEQ ID NO: 900970 - protein, 16 aa, Mycobacterium
EKDAKPGCVYTLTVTV

SEQ ID NO: 900971 - protein, 5 aa, Mycobacterium
EKDGS

SEQ ID NO: 900972 - protein, 7 aa, Mycobacterium
EKDNGRI

SEQ ID NO: 900973 - protein, 11 aa, Mycobacterium
EKDPTLTAEDR

SEQ ID NO: 900974 - protein, 9 aa, Mycobacterium
EKDSSINDD

SEQ ID NO: 900975 - protein, 10 aa, Mycobacterium
EKDSTEASQV

SEQ ID NO: 900976 - protein, 12 aa, Mycobacterium
EKEGKSIDKHYR

SEQ ID NO: 900977 - protein, 7 aa, Mycobacterium
EKEKGRA

SEQ ID NO: 900978 - protein, 8 aa, Mycobacterium
EKEKGRAV

SEQ ID NO: 900979 - protein, 54 aa, Mycobacterium
EKEPASDSDDATDAADAQGDTESPGSGADSGEGDSDSGGGQARQSAKPGSSGSD

SEQ ID NO: 900980 - protein, 8 aa, Mycobacterium
EKEPGRAA

SEQ ID NO: 900981 - protein, 5 aa, Mycobacterium
EKGAD

SEQ ID NO: 900982 - protein, 10 aa, Mycobacterium
EKGGDPRAQI

SEQ ID NO: 900983 - protein, 21 aa, Mycobacterium
EKGHAQLDAPVSGGVKGATAG

SEQ ID NO: 900984 - protein, 8 aa, Mycobacterium
EKGSVDVG

SEQ ID NO: 900985 - protein, 7 aa, Mycobacterium
EKGTARE

SEQ ID NO: 900986 - protein, 6 aa, Mycobacterium
EKGTQG

SEQ ID NO: 900987 - protein, 8 aa, Mycobacterium
EKHNDDGS

SEQ ID NO: 900988 - protein, 19 aa, Mycobacterium
EKHTAAALSTNPATQANDR

SEQ ID NO: 900989 - protein, 10 aa, Mycobacterium
EKIGSEDAKA

SEQ ID NO: 900990 - protein, 6 aa, Mycobacterium
EKKAEI

SEQ ID NO: 900991 - protein, 9 aa, Mycobacterium
EKLDPARCG

SEQ ID NO: 900992 - protein, 8 aa, Mycobacterium
EKLGSQDA

SEQ ID NO: 900993 - protein, 4 aa, Mycobacterium
EKLH

SEQ ID NO: 900994 - protein, 9 aa, Mycobacterium
EKLQSADAD

SEQ ID NO: 900995 - protein, 9 aa, Mycobacterium
EKNPKVASD

SEQ ID NO: 900996 - protein, 5 aa, Mycobacterium
EKNRP

SEQ ID NO: 900997 - protein, 7 aa, Mycobacterium
EKPEAVS

SEQ ID NO: 900998 - protein, 10 aa, Mycobacterium
EKPIPDPTAQ

SEQ ID NO: 900999 - protein, 17 aa, Mycobacterium
EKRAESGTYGLRPDPSL

SEQ ID NO: 901000 - protein, 26 aa, Mycobacterium
EKRCPEDTTPSRYSAPPRTYCLALPT

SEQ ID NO: 901001 - protein, 16 aa, Mycobacterium
EKRGELDRSSQRPVGA

SEQ ID NO: 901002 - protein, 18 aa, Mycobacterium
EKRGTIPNTAGRVEGSRN

SEQ ID NO: 901003 - protein, 20 aa, Mycobacterium
EKRPSYADTKAADSKPFDPK

SEQ ID NO: 901004 - protein, 21 aa, Mycobacterium
EKRPSYADTNVSDAKSFDPKK

SEQ ID NO: 901005 - protein, 7 aa, Mycobacterium
EKSDPEI

SEQ ID NO: 901006 - protein, 9 aa, Mycobacterium
EKTAPPTAY

SEQ ID NO: 901007 - protein, 6 aa, Mycobacterium
EKTGEV

SEQ ID NO: 901008 - protein, 5 aa, Mycobacterium
EKTPD

SEQ ID NO: 901009 - protein, 10 aa, Mycobacterium
EKTSNSTDPL

SEQ ID NO: 901010 - protein, 17 aa, Mycobacterium
EKVERPPLSPPVPPAEP

SEQ ID NO: 901011 - protein, 10 aa, Mycobacterium
EKVGDKTQRQ

SEQ ID NO: 901012 - protein, 18 aa, Mycobacterium
EKVGSEEAQALRGQAGVA

SEQ ID NO: 901013 - protein, 5 aa, Mycobacterium
EKYPD

SEQ ID NO: 901014 - protein, 11 aa, Mycobacterium
ELAAGTRRWSG

SEQ ID NO: 901015 - protein, 10 aa, Mycobacterium
ELADKKEQLA

SEQ ID NO: 901016 - protein, 4 aa, Mycobacterium
ELAE

SEQ ID NO: 901017 - protein, 11 aa, Mycobacterium
ELAGAGGLAPE

SEQ ID NO: 901018 - protein, 9 aa, Mycobacterium
ELAGGTGKH

SEQ ID NO: 901019 - protein, 6 aa, Mycobacterium
ELAPQS

SEQ ID NO: 901020 - protein, 17 aa, Mycobacterium
ELAPSPPLTTRTSDEIA

SEQ ID NO: 901021 - protein, 8 aa, Mycobacterium
ELAQAAEK

SEQ ID NO: 901022 - protein, 6 aa, Mycobacterium
ELAQDV

SEQ ID NO: 901023 - protein, 6 aa, Mycobacterium
ELDEET

SEQ ID NO: 901024 - protein, 7 aa, Mycobacterium
ELDEPGA

SEQ ID NO: 901025 - protein, 15 aa, Mycobacterium
ELDGGPSWSSETPEM

SEQ ID NO: 901026 - protein, 5 aa, Mycobacterium
ELDGR

SEQ ID NO: 901027 - protein, 13 aa, Mycobacterium
ELDPAKARTSANE

SEQ ID NO: 901028 - protein, 10 aa, Mycobacterium
ELDPDRARAL

SEQ ID NO: 901029 - protein, 12 aa, Mycobacterium
ELDPEKARTMAN

SEQ ID NO: 901030 - protein, 8 aa, Mycobacterium
ELDPQGLP

SEQ ID NO: 901031 - protein, 4 aa, Mycobacterium
ELDY

SEQ ID NO: 901032 - protein, 5 aa, Mycobacterium
ELEPH

SEQ ID NO: 901033 - protein, 13 aa, Mycobacterium
ELETTGRKTGQLR

SEQ ID NO: 901034 - protein, 10 aa, Mycobacterium
ELGADSTAHI

SEQ ID NO: 901035 - protein, 11 aa, Mycobacterium
ELGGAEAALGA

SEQ ID NO: 901036 - protein, 10 aa, Mycobacterium
ELGPAPGEVR

SEQ ID NO: 901037 - protein, 13 aa, Mycobacterium
ELGPQAGASGTSI

SEQ ID NO: 901038 - protein, 12 aa, Mycobacterium
ELGPRSGVDGTS

SEQ ID NO: 901039 - protein, 12 aa, Mycobacterium
ELGPSGGVSETS

SEQ ID NO: 901040 - protein, 12 aa, Mycobacterium
ELGPVSRAAATE

SEQ ID NO: 901041 - protein, 6 aa, Mycobacterium
ELGQAQ

SEQ ID NO: 901042 - protein, 14 aa, Mycobacterium
ELNANRPEGNSPLT

SEQ ID NO: 901043 - protein, 8 aa, Mycobacterium
ELNPAELR

SEQ ID NO: 901044 - protein, 9 aa, Mycobacterium
ELNQQREEI

SEQ ID NO: 901045 - protein, 12 aa, Mycobacterium
ELNTSTADFGGF

SEQ ID NO: 901046 - protein, 13 aa, Mycobacterium
ELPANATATLGQT

SEQ ID NO: 901047 - protein, 10 aa, Mycobacterium
ELPASGGLYP

SEQ ID NO: 901048 - protein, 9 aa, Mycobacterium
ELPASPGQV

SEQ ID NO: 901049 - protein, 9 aa, Mycobacterium
ELPEGTDPG

SEQ ID NO: 901050 - protein, 6 aa, Mycobacterium
ELPESW

SEQ ID NO: 901051 - protein, 7 aa, Mycobacterium
ELPGDGV

SEQ ID NO: 901052 - protein, 5 aa, Mycobacterium
ELPGQ

SEQ ID NO: 901053 - protein, 15 aa, Mycobacterium
ELPPDTTEVTPEQRR

SEQ ID NO: 901054 - protein, 7 aa, Mycobacterium
ELPPGYE

SEQ ID NO: 901055 - protein, 18 aa, Mycobacterium
ELPQTDPSNRRTDEHQSL

SEQ ID NO: 901056 - protein, 4 aa, Mycobacterium
ELPR

SEQ ID NO: 901057 - protein, 20 aa, Mycobacterium
ELPRDPRSGQGWNPEPLAGN

SEQ ID NO: 901058 - protein, 20 aa, Mycobacterium
ELPRDPRSNQAWSPEPIAGN

SEQ ID NO: 901059 - protein, 19 aa, Mycobacterium
ELPSRREYSPSPPKNAPSQ

SEQ ID NO: 901060 - protein, 11 aa, Mycobacterium
ELQAPNGPNVG

SEQ ID NO: 901061 - protein, 26 aa, Mycobacterium
ELQNEGNAAKASDTPQAVEQPQVPPT

SEQ ID NO: 901062 - protein, 5 aa, Mycobacterium
ELQPG

SEQ ID NO: 901063 - protein, 12 aa, Mycobacterium
ELQPNGDALPPI

SEQ ID NO: 901064 - protein, 9 aa, Mycobacterium
ELQPPTPDL

SEQ ID NO: 901065 - protein, 9 aa, Mycobacterium
ELQPPTPGL

SEQ ID NO: 901066 - protein, 13 aa, Mycobacterium
ELQPTEPGGVSPL

SEQ ID NO: 901067 - protein, 11 aa, Mycobacterium
ELRATDPAHAK

SEQ ID NO: 901068 - protein, 8 aa, Mycobacterium
ELRDAPDV

SEQ ID NO: 901069 - protein, 6 aa, Mycobacterium
ELRDAS

SEQ ID NO: 901070 - protein, 9 aa, Mycobacterium
ELRDPTPYL

SEQ ID NO: 901071 - protein, 12 aa, Mycobacterium
ELRESTRGNTEE

SEQ ID NO: 901072 - protein, 8 aa, Mycobacterium
ELRGDGTA

SEQ ID NO: 901073 - protein, 16 aa, Mycobacterium
ELRPDDHTFQEQDTQP

SEQ ID NO: 901074 - protein, 24 aa, Mycobacterium
ELSAPTATSALPTAASATAEPSLA

SEQ ID NO: 901075 - protein, 13 aa, Mycobacterium
ELSGAAGSFGSVT

SEQ ID NO: 901076 - protein, 8 aa, Mycobacterium
ELSGGQRQ

SEQ ID NO: 901077 - protein, 9 aa, Mycobacterium
ELSGPPADL

SEQ ID NO: 901078 - protein, 5 aa, Mycobacterium
ELSGT

SEQ ID NO: 901079 - protein, 6 aa, Mycobacterium
ELSKPR

SEQ ID NO: 901080 - protein, 12 aa, Mycobacterium
ELSNTDDAGRPV

SEQ ID NO: 901081 - protein, 6 aa, Mycobacterium
ELSQRY

SEQ ID NO: 901082 - protein, 7 aa, Mycobacterium
ELSQRYP

SEQ ID NO: 901083 - protein, 6 aa, Mycobacterium
ELSRDG

SEQ ID NO: 901084 - protein, 18 aa, Mycobacterium
ELSRQAEATSEAANTAKI

SEQ ID NO: 901085 - protein, 9 aa, Mycobacterium
ELSSSAASF

SEQ ID NO: 901086 - protein, 13 aa, Mycobacterium
ELTDTPGTPGTER

SEQ ID NO: 901087 - protein, 8 aa, Mycobacterium
ELTEDRGD

SEQ ID NO: 901088 - protein, 9 aa, Mycobacterium
ELTGGSGHD

SEQ ID NO: 901089 - protein, 23 aa, Mycobacterium
ELTNSDNDQYYTPPKWGQTGTKD

SEQ ID NO: 901090 - protein, 4 aa, Mycobacterium
ELTP

SEQ ID NO: 901091 - protein, 23 aa, Mycobacterium
ELTPEARRNLSGRRQTKRRPPDE

SEQ ID NO: 901092 - protein, 5 aa, Mycobacterium
ELTPS

SEQ ID NO: 901093 - protein, 11 aa, Mycobacterium
ELTSANSSISY

SEQ ID NO: 901094 - protein, 7 aa, Mycobacterium
ELTSTST

SEQ ID NO: 901095 - protein, 13 aa, Mycobacterium
EMAAPGPARDEAY

SEQ ID NO: 901096 - protein, 13 aa, Mycobacterium
EMADPAAAQRSTG

SEQ ID NO: 901097 - protein, 7 aa, Mycobacterium
EMQPADG

SEQ ID NO: 901098 - protein, 13 aa, Mycobacterium
EMSDHSADVSDPD

SEQ ID NO: 901099 - protein, 6 aa, Mycobacterium
EMTGTT

SEQ ID NO: 901100 - protein, 23 aa, Mycobacterium
EMTTGGSKGAPDATTGAPLDPAD

SEQ ID NO: 901101 - protein, 8 aa, Mycobacterium
ENAAALKG

SEQ ID NO: 901102 - protein, 10 aa, Mycobacterium
ENADGRGYQG

SEQ ID NO: 901103 - protein, 10 aa, Mycobacterium
ENAEAADAVT

SEQ ID NO: 901104 - protein, 9 aa, Mycobacterium
ENAPPGTIS

SEQ ID NO: 901105 - protein, 11 aa, Mycobacterium
ENAPTEIPTSA

SEQ ID NO: 901106 - protein, 29 aa, Mycobacterium
ENAQVDVNSDEYAGEDTTTGPSGSCGRNQ

SEQ ID NO: 901107 - protein, 7 aa, Mycobacterium
ENATALP

SEQ ID NO: 901108 - protein, 11 aa, Mycobacterium
ENATSEESAKA

SEQ ID NO: 901109 - protein, 7 aa, Mycobacterium
ENDPRRS

SEQ ID NO: 901110 - protein, 12 aa, Mycobacterium
ENDSPAASPDGW

SEQ ID NO: 901111 - protein, 7 aa, Mycobacterium
ENDTRAT

SEQ ID NO: 901112 - protein, 6 aa, Mycobacterium
ENERTT

SEQ ID NO: 901113 - protein, 11 aa, Mycobacterium
ENETDPAPADL

SEQ ID NO: 901114 - protein, 8 aa, Mycobacterium
ENETYRRD

SEQ ID NO: 901115 - protein, 10 aa, Mycobacterium
ENEVKQRRGD

SEQ ID NO: 901116 - protein, 10 aa, Mycobacterium
ENFARSEGPS

SEQ ID NO: 901117 - protein, 11 aa, Mycobacterium
ENFGSGNTGRQ

SEQ ID NO: 901118 - protein, 13 aa, Mycobacterium
ENGAEVPHDGETI

SEQ ID NO: 901119 - protein, 4 aa, Mycobacterium
ENGG

SEQ ID NO: 901120 - protein, 14 aa, Mycobacterium
ENGKSISGQLSPDG

SEQ ID NO: 901121 - protein, 5 aa, Mycobacterium
ENGLG

SEQ ID NO: 901122 - protein, 15 aa, Mycobacterium
ENGRSISGKLSPDGL

SEQ ID NO: 901123 - protein, 6 aa, Mycobacterium
ENHDQT

SEQ ID NO: 901124 - protein, 8 aa, Mycobacterium
ENHSAGGG

SEQ ID NO: 901125 - protein, 9 aa, Mycobacterium
ENHTTTEST

SEQ ID NO: 901126 - protein, 8 aa, Mycobacterium
ENKDPIAG

SEQ ID NO: 901127 - protein, 10 aa, Mycobacterium
ENNDGTLDNS

SEQ ID NO: 901128 - protein, 13 aa, Mycobacterium
ENNIGGDGADIPQ

SEQ ID NO: 901129 - protein, 8 aa, Mycobacterium
ENPDDQKA

SEQ ID NO: 901130 - protein, 9 aa, Mycobacterium
ENPGPPKGL

SEQ ID NO: 901131 - protein, 9 aa, Mycobacterium
ENPGQPKGL

SEQ ID NO: 901132 - protein, 19 aa, Mycobacterium
ENPLRAKPPLEAAKDQYRA

SEQ ID NO: 901133 - protein, 17 aa, Mycobacterium
ENPLRAKPSLEAAREEY

SEQ ID NO: 901134 - protein, 9 aa, Mycobacterium
ENPNGGDFA

SEQ ID NO: 901135 - protein, 4 aa, Mycobacterium
ENPS

SEQ ID NO: 901136 - protein, 9 aa, Mycobacterium
ENPTSGPAI

SEQ ID NO: 901137 - protein, 17 aa, Mycobacterium
ENQARAKITASTAMGGG

SEQ ID NO: 901138 - protein, 4 aa, Mycobacterium
ENQG

SEQ ID NO: 901139 - protein, 7 aa, Mycobacterium
ENQQVSS

SEQ ID NO: 901140 - protein, 13 aa, Mycobacterium
ENRADFSNVTTDE

SEQ ID NO: 901141 - protein, 10 aa, Mycobacterium
ENRSENGIIG

SEQ ID NO: 901142 - protein, 10 aa, Mycobacterium
ENRSESGIIG

SEQ ID NO: 901143 - protein, 9 aa, Mycobacterium
ENSANVGGQ

SEQ ID NO: 901144 - protein, 9 aa, Mycobacterium
ENSDGVDGR

SEQ ID NO: 901145 - protein, 7 aa, Mycobacterium
ENSPDRT

SEQ ID NO: 901146 - protein, 8 aa, Mycobacterium
ENTGGQTL

SEQ ID NO: 901147 - protein, 7 aa, Mycobacterium
ENTNRIS

SEQ ID NO: 901148 - protein, 4 aa, Mycobacterium
ENTY

SEQ ID NO: 901149 - protein, 5 aa, Mycobacterium
ENTYP

SEQ ID NO: 901150 - protein, 6 aa, Mycobacterium
ENVYPR

SEQ ID NO: 901151 - protein, 4 aa, Mycobacterium
ENWR

SEQ ID NO: 901152 - protein, 19 aa, Mycobacterium
ENYPGADDELSMRDNNTSA

SEQ ID NO: 901153 - protein, 5 aa, Mycobacterium
EPAAA

SEQ ID NO: 901154 - protein, 8 aa, Mycobacterium
EPAAAGAY

SEQ ID NO: 901155 - protein, 4 aa, Mycobacterium
EPAD

SEQ ID NO: 901156 - protein, 12 aa, Mycobacterium
EPADHGHGGHGS

SEQ ID NO: 901157 - protein, 5 aa, Mycobacterium
EPAEG

SEQ ID NO: 901158 - protein, 83 aa, Mycobacterium
EPAEGAEAAEASEAPKAPESLESPEKPETKTPDAPAAEFSAPAGTTENTASGVTENAENTEVVEDTTTPTKADTSTKAPVKPV

SEQ ID NO: 901159 - protein, 15 aa, Mycobacterium
EPAEPGEPAVSKEQR

SEQ ID NO: 901160 - protein, 13 aa, Mycobacterium
EPAETSDPRGLSY

SEQ ID NO: 901161 - protein, 8 aa, Mycobacterium
EPAGIRAE

SEQ ID NO: 901162 - protein, 7 aa, Mycobacterium
EPAINGN

SEQ ID NO: 901163 - protein, 8 aa, Mycobacterium
EPAINGNK

SEQ ID NO: 901164 - protein, 5 aa, Mycobacterium
EPAME

SEQ ID NO: 901165 - protein, 9 aa, Mycobacterium
EPANGSLTG

SEQ ID NO: 901166 - protein, 14 aa, Mycobacterium
EPAPPAPPAAGGGG

SEQ ID NO: 901167 - protein, 8 aa, Mycobacterium
EPAPTPEQ

SEQ ID NO: 901168 - protein, 5 aa, Mycobacterium
EPAQR

SEQ ID NO: 901169 - protein, 8 aa, Mycobacterium
EPAQRSAT

SEQ ID NO: 901170 - protein, 4 aa, Mycobacterium
EPAR

SEQ ID NO: 901171 - protein, 5 aa, Mycobacterium
EPARP

SEQ ID NO: 901172 - protein, 5 aa, Mycobacterium
EPARR

SEQ ID NO: 901173 - protein, 11 aa, Mycobacterium
EPASGQPARIP

SEQ ID NO: 901174 - protein, 10 aa, Mycobacterium
EPATGQPARI

SEQ ID NO: 901175 - protein, 11 aa, Mycobacterium
EPATSGRPVGL

SEQ ID NO: 901176 - protein, 6 aa, Mycobacterium
EPAVPS

SEQ ID NO: 901177 - protein, 9 aa, Mycobacterium
EPCGSPTSN

SEQ ID NO: 901178 - protein, 9 aa, Mycobacterium
EPCGSTPAP

SEQ ID NO: 901179 - protein, 4 aa, Mycobacterium
EPCP

SEQ ID NO: 901180 - protein, 4 aa, Mycobacterium
EPCT

SEQ ID NO: 901181 - protein, 4 aa, Mycobacterium
EPDF

SEQ ID NO: 901182 - protein, 16 aa, Mycobacterium
EPDGPAAPTEPGAEEH

SEQ ID NO: 901183 - protein, 7 aa, Mycobacterium
EPDGQIQ

SEQ ID NO: 901184 - protein, 5 aa, Mycobacterium
EPDLP

SEQ ID NO: 901185 - protein, 8 aa, Mycobacterium
EPDNPADV

SEQ ID NO: 901186 - protein, 8 aa, Mycobacterium
EPDNPAKV

SEQ ID NO: 901187 - protein, 10 aa, Mycobacterium
EPDNPARPYR

SEQ ID NO: 901188 - protein, 20 aa, Mycobacterium
EPDNPARQYKNAERSDKDQL

SEQ ID NO: 901189 - protein, 19 aa, Mycobacterium
EPDNPARQYRKVERSDKLD

SEQ ID NO: 901190 - protein, 8 aa, Mycobacterium
EPDNPARV

SEQ ID NO: 901191 - protein, 5 aa, Mycobacterium
EPDQI

SEQ ID NO: 901192 - protein, 11 aa, Mycobacterium
EPDSATEPTAD

SEQ ID NO: 901193 - protein, 9 aa, Mycobacterium
EPDSEFPPS

SEQ ID NO: 901194 - protein, 11 aa, Mycobacterium
EPDVDCPSTNL

SEQ ID NO: 901195 - protein, 6 aa, Mycobacterium
EPEGQV

SEQ ID NO: 901196 - protein, 14 aa, Mycobacterium
EPEIAEGEIDPLSP

SEQ ID NO: 901197 - protein, 6 aa, Mycobacterium
EPELGS

SEQ ID NO: 901198 - protein, 9 aa, Mycobacterium
EPELPSEAV

SEQ ID NO: 901199 - protein, 6 aa, Mycobacterium
EPEPPA

SEQ ID NO: 901200 - protein, 4 aa, Mycobacterium
EPET

SEQ ID NO: 901201 - protein, 8 aa, Mycobacterium
EPFGDGQS

SEQ ID NO: 901202 - protein, 5 aa, Mycobacterium
EPFKS

SEQ ID NO: 901203 - protein, 4 aa, Mycobacterium
EPGA

SEQ ID NO: 901204 - protein, 8 aa, Mycobacterium
EPGARADR

SEQ ID NO: 901205 - protein, 5 aa, Mycobacterium
EPGDQ

SEQ ID NO: 901206 - protein, 13 aa, Mycobacterium
EPGEENADLTKTE

SEQ ID NO: 901207 - protein, 5 aa, Mycobacterium
EPGEV

SEQ ID NO: 901208 - protein, 4 aa, Mycobacterium
EPGF

SEQ ID NO: 901209 - protein, 11 aa, Mycobacterium
EPGGSFNSAAS

SEQ ID NO: 901210 - protein, 10 aa, Mycobacterium
EPGQNAANVA

SEQ ID NO: 901211 - protein, 7 aa, Mycobacterium
EPGRGPR

SEQ ID NO: 901212 - protein, 9 aa, Mycobacterium
EPGRGPRRY

SEQ ID NO: 901213 - protein, 18 aa, Mycobacterium
EPGRGPRRYTAGGHRVPA

SEQ ID NO: 901214 - protein, 11 aa, Mycobacterium
EPGSEGPGTSY

SEQ ID NO: 901215 - protein, 5 aa, Mycobacterium
EPGSF

SEQ ID NO: 901216 - protein, 11 aa, Mycobacterium
EPGSGAPDSCD

SEQ ID NO: 901217 - protein, 4 aa, Mycobacterium
EPGT

SEQ ID NO: 901218 - protein, 5 aa, Mycobacterium
EPGTP

SEQ ID NO: 901219 - protein, 9 aa, Mycobacterium
EPGTPVGSV

SEQ ID NO: 901220 - protein, 6 aa, Mycobacterium
EPGTSV

SEQ ID NO: 901221 - protein, 7 aa, Mycobacterium
EPGTYQT

SEQ ID NO: 901222 - protein, 4 aa, Mycobacterium
EPGV

SEQ ID NO: 901223 - protein, 8 aa, Mycobacterium
EPHPSREQ

SEQ ID NO: 901224 - protein, 7 aa, Mycobacterium
EPHSGIR

SEQ ID NO: 901225 - protein, 6 aa, Mycobacterium
EPIDPA

SEQ ID NO: 901226 - protein, 4 aa, Mycobacterium
EPIG

SEQ ID NO: 901227 - protein, 5 aa, Mycobacterium
EPIPE

SEQ ID NO: 901228 - protein, 5 aa, Mycobacterium
EPIPS

SEQ ID NO: 901229 - protein, 6 aa, Mycobacterium
EPISDP

SEQ ID NO: 901230 - protein, 8 aa, Mycobacterium
EPITSPEA

SEQ ID NO: 901231 - protein, 5 aa, Mycobacterium
EPKGD

SEQ ID NO: 901232 - protein, 5 aa, Mycobacterium
EPKGG

SEQ ID NO: 901233 - protein, 12 aa, Mycobacterium
EPKGSGRIGPSG

SEQ ID NO: 901234 - protein, 4 aa, Mycobacterium
EPKL

SEQ ID NO: 901235 - protein, 5 aa, Mycobacterium
EPKLG

SEQ ID NO: 901236 - protein, 7 aa, Mycobacterium
EPKLGQP

SEQ ID NO: 901237 - protein, 8 aa, Mycobacterium
EPLAGARN

SEQ ID NO: 901238 - protein, 5 aa, Mycobacterium
EPLGY

SEQ ID NO: 901239 - protein, 8 aa, Mycobacterium
EPLPGPNT

SEQ ID NO: 901240 - protein, 7 aa, Mycobacterium
EPLPRPH

SEQ ID NO: 901241 - protein, 10 aa, Mycobacterium
EPLSRKQDIG

SEQ ID NO: 901242 - protein, 15 aa, Mycobacterium
EPLTPSASPARHEIP

SEQ ID NO: 901243 - protein, 14 aa, Mycobacterium
EPMPESAAARVKTH

SEQ ID NO: 901244 - protein, 6 aa, Mycobacterium
EPMSPE

SEQ ID NO: 901245 - protein, 4 aa, Mycobacterium
EPNA

SEQ ID NO: 901246 - protein, 8 aa, Mycobacterium
EPNEPGDY

SEQ ID NO: 901247 - protein, 15 aa, Mycobacterium
EPNPDWSRAYSGSSE

SEQ ID NO: 901248 - protein, 26 aa, Mycobacterium
EPNSPAPDGGPVGDFNSAGDHFQGEG

SEQ ID NO: 901249 - protein, 9 aa, Mycobacterium
EPNTAPARY

SEQ ID NO: 901250 - protein, 8 aa, Mycobacterium
EPPAAEGD

SEQ ID NO: 901251 - protein, 8 aa, Mycobacterium
EPPAPADE

SEQ ID NO: 901252 - protein, 20 aa, Mycobacterium
EPPAPAPPPPPAPPAEQVPA

SEQ ID NO: 901253 - protein, 14 aa, Mycobacterium
EPPAPDVAPPPAPK

SEQ ID NO: 901254 - protein, 4 aa, Mycobacterium
EPPF

SEQ ID NO: 901255 - protein, 9 aa, Mycobacterium
EPPRSPAQM

SEQ ID NO: 901256 - protein, 5 aa, Mycobacterium
EPQGE

SEQ ID NO: 901257 - protein, 6 aa, Mycobacterium
EPQPTQ

SEQ ID NO: 901258 - protein, 5 aa, Mycobacterium
EPRAG

SEQ ID NO: 901259 - protein, 14 aa, Mycobacterium
EPREHGHGGHGHDS

SEQ ID NO: 901260 - protein, 5 aa, Mycobacterium
EPRGV

SEQ ID NO: 901261 - protein, 14 aa, Mycobacterium
EPRLQPPPGFKDTT

SEQ ID NO: 901262 - protein, 30 aa, Mycobacterium
EPRPHRDALDDTGAARQLRSEAARGRLDGD

SEQ ID NO: 901263 - protein, 4 aa, Mycobacterium
EPSA

SEQ ID NO: 901264 - protein, 8 aa, Mycobacterium
EPSAPKSD

SEQ ID NO: 901265 - protein, 15 aa, Mycobacterium
EPSDAVRGAPSSRNV

SEQ ID NO: 901266 - protein, 10 aa, Mycobacterium
EPSEPDAGRQ

SEQ ID NO: 901267 - protein, 15 aa, Mycobacterium
EPSGSGARYGRQGSE

SEQ ID NO: 901268 - protein, 4 aa, Mycobacterium
EPSI

SEQ ID NO: 901269 - protein, 10 aa, Mycobacterium
EPSIEGRTEL

SEQ ID NO: 901270 - protein, 8 aa, Mycobacterium
EPSPGNSV

SEQ ID NO: 901271 - protein, 19 aa, Mycobacterium
EPSPVDTSTERPEDDSDEV

SEQ ID NO: 901272 - protein, 11 aa, Mycobacterium
EPSREAFERQT

SEQ ID NO: 901273 - protein, 13 aa, Mycobacterium
EPSRGPRRYTAGG

SEQ ID NO: 901274 - protein, 6 aa, Mycobacterium
EPSTAL

SEQ ID NO: 901275 - protein, 8 aa, Mycobacterium
EPSTCDYP

SEQ ID NO: 901276 - protein, 26 aa, Mycobacterium
EPSVGQHHDKRDEEAQWRDMWESRSG

SEQ ID NO: 901277 - protein, 5 aa, Mycobacterium
EPSVT

SEQ ID NO: 901278 - protein, 4 aa, Mycobacterium
EPTA

SEQ ID NO: 901279 - protein, 13 aa, Mycobacterium
EPTATGATDPCAA

SEQ ID NO: 901280 - protein, 6 aa, Mycobacterium
EPTGVA

SEQ ID NO: 901281 - protein, 12 aa, Mycobacterium
EPTGVPAGMATP

SEQ ID NO: 901282 - protein, 29 aa, Mycobacterium
EPTHEGANPRTPLGTNPHVPYGTNTTTVL

SEQ ID NO: 901283 - protein, 4 aa, Mycobacterium
EPTI

SEQ ID NO: 901284 - protein, 13 aa, Mycobacterium
EPTPARPQETSAE

SEQ ID NO: 901285 - protein, 6 aa, Mycobacterium
EPTPIA

SEQ ID NO: 901286 - protein, 16 aa, Mycobacterium
EPTPQDKSFAEQPPID

SEQ ID NO: 901287 - protein, 7 aa, Mycobacterium
EPTPRGY

SEQ ID NO: 901288 - protein, 11 aa, Mycobacterium
EPTRQGSPPTL

SEQ ID NO: 901289 - protein, 6 aa, Mycobacterium
EPTSAL

SEQ ID NO: 901290 - protein, 7 aa, Mycobacterium
EPTTQTV

SEQ ID NO: 901291 - protein, 7 aa, Mycobacterium
EPTWPAT

SEQ ID NO: 901292 - protein, 5 aa, Mycobacterium
EPTYG

SEQ ID NO: 901293 - protein, 7 aa, Mycobacterium
EPVPAGG

SEQ ID NO: 901294 - protein, 11 aa, Mycobacterium
EPVPEPDPVPV

SEQ ID NO: 901295 - protein, 15 aa, Mycobacterium
EPWTEPDDWQQPRPT

SEQ ID NO: 901296 - protein, 26 aa, Mycobacterium
EQAAADDRHRADRAALDAANAELDPL

SEQ ID NO: 901297 - protein, 13 aa, Mycobacterium
EQADSIARSVQLL

SEQ ID NO: 901298 - protein, 23 aa, Mycobacterium
EQAPPAASSAPRPTSARGPVDPA

SEQ ID NO: 901299 - protein, 16 aa, Mycobacterium
EQARQTAAQARAAATA

SEQ ID NO: 901300 - protein, 23 aa, Mycobacterium
EQARRDSALASAAAAAIGNPPQI

SEQ ID NO: 901301 - protein, 7 aa, Mycobacterium
EQARTHG

SEQ ID NO: 901302 - protein, 10 aa, Mycobacterium
EQASSATQPV

SEQ ID NO: 901303 - protein, 10 aa, Mycobacterium
EQASSTPHPV

SEQ ID NO: 901304 - protein, 8 aa, Mycobacterium
EQATAGGL

SEQ ID NO: 901305 - protein, 6 aa, Mycobacterium
EQAVDG

SEQ ID NO: 901306 - protein, 4 aa, Mycobacterium
EQCT

SEQ ID NO: 901307 - protein, 6 aa, Mycobacterium
EQDDAG

SEQ ID NO: 901308 - protein, 28 aa, Mycobacterium
EQDEGKTEQLAYTPAKTTADVANDTDIN

SEQ ID NO: 901309 - protein, 15 aa, Mycobacterium
EQDKKPVVTGIDPST

SEQ ID NO: 901310 - protein, 12 aa, Mycobacterium
EQEAVEKANDSL

SEQ ID NO: 901311 - protein, 6 aa, Mycobacterium
EQEDGR

SEQ ID NO: 901312 - protein, 21 aa, Mycobacterium
EQEEGKTEEIAYTPAKTTASV

SEQ ID NO: 901313 - protein, 5 aa, Mycobacterium
EQEGV

SEQ ID NO: 901314 - protein, 21 aa, Mycobacterium
EQEQGKTEEVAYTPAKTTASV

SEQ ID NO: 901315 - protein, 9 aa, Mycobacterium
EQESRSQDF

SEQ ID NO: 901316 - protein, 5 aa, Mycobacterium
EQFPD

SEQ ID NO: 901317 - protein, 17 aa, Mycobacterium
EQFPGLGADGPSVGESV

SEQ ID NO: 901318 - protein, 5 aa, Mycobacterium
EQFPQ

SEQ ID NO: 901319 - protein, 6 aa, Mycobacterium
EQGHGK

SEQ ID NO: 901320 - protein, 5 aa, Mycobacterium
EQGNL

SEQ ID NO: 901321 - protein, 8 aa, Mycobacterium
EQHNPAPA

SEQ ID NO: 901322 - protein, 18 aa, Mycobacterium
EQHSSNGHNAQTFCLVKS

SEQ ID NO: 901323 - protein, 5 aa, Mycobacterium
EQLER

SEQ ID NO: 901324 - protein, 4 aa, Mycobacterium
EQLG

SEQ ID NO: 901325 - protein, 18 aa, Mycobacterium
EQLPAPPAGEFGPGAHEG

SEQ ID NO: 901326 - protein, 4 aa, Mycobacterium
EQLR

SEQ ID NO: 901327 - protein, 11 aa, Mycobacterium
EQLTASGARYS

SEQ ID NO: 901328 - protein, 5 aa, Mycobacterium
EQNDF

SEQ ID NO: 901329 - protein, 10 aa, Mycobacterium
EQNEGKTAEL

SEQ ID NO: 901330 - protein, 6 aa, Mycobacterium
EQNSGN

SEQ ID NO: 901331 - protein, 6 aa, Mycobacterium
EQNTGN

SEQ ID NO: 901332 - protein, 20 aa, Mycobacterium
EQPAAALNSAAEAADSALAG

SEQ ID NO: 901333 - protein, 14 aa, Mycobacterium
EQPAWPGPAVSSER

SEQ ID NO: 901334 - protein, 6 aa, Mycobacterium
EQPDTG

SEQ ID NO: 901335 - protein, 15 aa, Mycobacterium
EQPDYGQKLDAQEKA

SEQ ID NO: 901336 - protein, 32 aa, Mycobacterium
EQPGGSGCDSNGNCGSGGVNGGPGGGPGGQGC

SEQ ID NO: 901337 - protein, 5 aa, Mycobacterium
EQPLA

SEQ ID NO: 901338 - protein, 8 aa, Mycobacterium
EQPPAVPA

SEQ ID NO: 901339 - protein, 7 aa, Mycobacterium
EQPPRQP

SEQ ID NO: 901340 - protein, 5 aa, Mycobacterium
EQPTV

SEQ ID NO: 901341 - protein, 9 aa, Mycobacterium
EQQATPQQI

SEQ ID NO: 901342 - protein, 9 aa, Mycobacterium
EQQDPVTDA

SEQ ID NO: 901343 - protein, 12 aa, Mycobacterium
EQQEAQKRGLGA

SEQ ID NO: 901344 - protein, 4 aa, Mycobacterium
EQQP

SEQ ID NO: 901345 - protein, 5 aa, Mycobacterium
EQQPE

SEQ ID NO: 901346 - protein, 12 aa, Mycobacterium
EQQTSVPRARNE

SEQ ID NO: 901347 - protein, 6 aa, Mycobacterium
EQRAPA

SEQ ID NO: 901348 - protein, 5 aa, Mycobacterium
EQRET

SEQ ID NO: 901349 - protein, 6 aa, Mycobacterium
EQRKAA

SEQ ID NO: 901350 - protein, 6 aa, Mycobacterium
EQRSAT

SEQ ID NO: 901351 - protein, 12 aa, Mycobacterium
EQRTAQTGALPG

SEQ ID NO: 901352 - protein, 9 aa, Mycobacterium
EQSAELDPG

SEQ ID NO: 901353 - protein, 9 aa, Mycobacterium
EQSANAIRT

SEQ ID NO: 901354 - protein, 21 aa, Mycobacterium
EQSDGHSGRYGLGPGATSITV

SEQ ID NO: 901355 - protein, 9 aa, Mycobacterium
EQSGSGYEL

SEQ ID NO: 901356 - protein, 15 aa, Mycobacterium
EQSPAAAQQVNANPI

SEQ ID NO: 901357 - protein, 4 aa, Mycobacterium
EQSQ

SEQ ID NO: 901358 - protein, 5 aa, Mycobacterium
EQTAG

SEQ ID NO: 901359 - protein, 9 aa, Mycobacterium
EQTGRAAPY

SEQ ID NO: 901360 - protein, 8 aa, Mycobacterium
EQTPGGGY

SEQ ID NO: 901361 - protein, 6 aa, Mycobacterium
EQTQDG

SEQ ID NO: 901362 - protein, 5 aa, Mycobacterium
EQVRD

SEQ ID NO: 901363 - protein, 29 aa, Mycobacterium
EQVSSTALPGRAATQPPYVSEQSAYEKRV

SEQ ID NO: 901364 - protein, 5 aa, Mycobacterium
EQVTK

SEQ ID NO: 901365 - protein, 18 aa, Mycobacterium
EQYDAEKPRTVEDAVRSA

SEQ ID NO: 901366 - protein, 13 aa, Mycobacterium
EQYDAGEPGGVEQ

SEQ ID NO: 901367 - protein, 16 aa, Mycobacterium
EQYDAGQPDSVEQAVR

SEQ ID NO: 901368 - protein, 12 aa, Mycobacterium
EQYDAGQPGSVE

SEQ ID NO: 901369 - protein, 14 aa, Mycobacterium
EQYDAGQPGSVERA

SEQ ID NO: 901370 - protein, 12 aa, Mycobacterium
EQYPPDDMSVWN

SEQ ID NO: 901371 - protein, 10 aa, Mycobacterium
ERAAAQAELD

SEQ ID NO: 901372 - protein, 5 aa, Mycobacterium
ERAAG

SEQ ID NO: 901373 - protein, 5 aa, Mycobacterium
ERADD

SEQ ID NO: 901374 - protein, 9 aa, Mycobacterium
ERADKQERV

SEQ ID NO: 901375 - protein, 19 aa, Mycobacterium
ERAEETRVETRTRVEERRA

SEQ ID NO: 901376 - protein, 9 aa, Mycobacterium
ERAGGDHRR

SEQ ID NO: 901377 - protein, 4 aa, Mycobacterium
ERAP

SEQ ID NO: 901378 - protein, 12 aa, Mycobacterium
ERAPGDTRANAV

SEQ ID NO: 901379 - protein, 9 aa, Mycobacterium
ERARGRAAE

SEQ ID NO: 901380 - protein, 9 aa, Mycobacterium
ERARGRAGA

SEQ ID NO: 901381 - protein, 14 aa, Mycobacterium
ERARPGDSRRPGAV

SEQ ID NO: 901382 - protein, 4 aa, Mycobacterium
ERCG

SEQ ID NO: 901383 - protein, 9 aa, Mycobacterium
ERDADGNLL

SEQ ID NO: 901384 - protein, 25 aa, Mycobacterium
ERDGGAATAVEADVSDRAQADAAVA

SEQ ID NO: 901385 - protein, 12 aa, Mycobacterium
ERDGRADPFGTE

SEQ ID NO: 901386 - protein, 12 aa, Mycobacterium
ERDGRTDPFGQE

SEQ ID NO: 901387 - protein, 8 aa, Mycobacterium
ERDMATPN

SEQ ID NO: 901388 - protein, 9 aa, Mycobacterium
ERDPDLGKR

SEQ ID NO: 901389 - protein, 13 aa, Mycobacterium
ERDQNVAHPPAST

SEQ ID NO: 901390 - protein, 16 aa, Mycobacterium
ERDRKPVVTRPDRSAG

SEQ ID NO: 901391 - protein, 5 aa, Mycobacterium
ERDSA

SEQ ID NO: 901392 - protein, 16 aa, Mycobacterium
ERDSTTEPSPGHPDPL

SEQ ID NO: 901393 - protein, 8 aa, Mycobacterium
ERDYPDDK

SEQ ID NO: 901394 - protein, 5 aa, Mycobacterium
ERENL

SEQ ID NO: 901395 - protein, 6 aa, Mycobacterium
EREPGR

SEQ ID NO: 901396 - protein, 5 aa, Mycobacterium
ERFNG

SEQ ID NO: 901397 - protein, 4 aa, Mycobacterium
ERGA

SEQ ID NO: 901398 - protein, 6 aa, Mycobacterium
ERGARV

SEQ ID NO: 901399 - protein, 7 aa, Mycobacterium
ERGATTE

SEQ ID NO: 901400 - protein, 9 aa, Mycobacterium
ERGGAIRTT

SEQ ID NO: 901401 - protein, 7 aa, Mycobacterium
ERGGYDA

SEQ ID NO: 901402 - protein, 14 aa, Mycobacterium
ERGGYDANGHGNSV

SEQ ID NO: 901403 - protein, 9 aa, Mycobacterium
ERGKPTQGA

SEQ ID NO: 901404 - protein, 5 aa, Mycobacterium
ERGNG

SEQ ID NO: 901405 - protein, 5 aa, Mycobacterium
ERGNN

SEQ ID NO: 901406 - protein, 7 aa, Mycobacterium
ERGRRDL

SEQ ID NO: 901407 - protein, 7 aa, Mycobacterium
ERGRRSE

SEQ ID NO: 901408 - protein, 4 aa, Mycobacterium
ERGS

SEQ ID NO: 901409 - protein, 4 aa, Mycobacterium
ERGT

SEQ ID NO: 901410 - protein, 7 aa, Mycobacterium
ERGTDAE

SEQ ID NO: 901411 - protein, 12 aa, Mycobacterium
ERGTRTAETRYG

SEQ ID NO: 901412 - protein, 5 aa, Mycobacterium
ERGVR

SEQ ID NO: 901413 - protein, 6 aa, Mycobacterium
ERGVRA

SEQ ID NO: 901414 - protein, 10 aa, Mycobacterium
ERGVSPRDRN

SEQ ID NO: 901415 - protein, 17 aa, Mycobacterium
ERIDPGVKDHAPERTPR

SEQ ID NO: 901416 - protein, 10 aa, Mycobacterium
ERIGEQVPRP

SEQ ID NO: 901417 - protein, 7 aa, Mycobacterium
ERIPGKG

SEQ ID NO: 901418 - protein, 6 aa, Mycobacterium
ERKDDV

SEQ ID NO: 901419 - protein, 8 aa, Mycobacterium
ERKQYTAQ

SEQ ID NO: 901420 - protein, 10 aa, Mycobacterium
ERLAGEQPRC

SEQ ID NO: 901421 - protein, 5 aa, Mycobacterium
ERLPK

SEQ ID NO: 901422 - protein, 6 aa, Mycobacterium
ERLRSG

SEQ ID NO: 901423 - protein, 5 aa, Mycobacterium
ERNGP

SEQ ID NO: 901424 - protein, 11 aa, Mycobacterium
ERNGQTDPFGA

SEQ ID NO: 901425 - protein, 6 aa, Mycobacterium
ERNGRL

SEQ ID NO: 901426 - protein, 5 aa, Mycobacterium
ERNVT

SEQ ID NO: 901427 - protein, 4 aa, Mycobacterium
ERPA

SEQ ID NO: 901428 - protein, 15 aa, Mycobacterium
ERPAPSNLPKPIPGM

SEQ ID NO: 901429 - protein, 4 aa, Mycobacterium
ERPD

SEQ ID NO: 901430 - protein, 7 aa, Mycobacterium
ERPDLAE

SEQ ID NO: 901431 - protein, 17 aa, Mycobacterium
ERPEAQSDVGSLSRRTS

SEQ ID NO: 901432 - protein, 6 aa, Mycobacterium
ERPGSD

SEQ ID NO: 901433 - protein, 20 aa, Mycobacterium
ERPGSGDFARQYDDSVNGES

SEQ ID NO: 901434 - protein, 6 aa, Mycobacterium
ERPGTD

SEQ ID NO: 901435 - protein, 7 aa, Mycobacterium
ERPRPDI

SEQ ID NO: 901436 - protein, 8 aa, Mycobacterium
ERPVQPAG

SEQ ID NO: 901437 - protein, 11 aa, Mycobacterium
ERPWRGPGSRP

SEQ ID NO: 901438 - protein, 8 aa, Mycobacterium
ERQANENY

SEQ ID NO: 901439 - protein, 15 aa, Mycobacterium
ERQATSKAAAAGADI

SEQ ID NO: 901440 - protein, 16 aa, Mycobacterium
ERQSAQWARDNGGSAV

SEQ ID NO: 901441 - protein, 6 aa, Mycobacterium
ERQTPF

SEQ ID NO: 901442 - protein, 6 aa, Mycobacterium
ERQTPL

SEQ ID NO: 901443 - protein, 12 aa, Mycobacterium
ERRDALNRTDRG

SEQ ID NO: 901444 - protein, 6 aa, Mycobacterium
ERRDKV

SEQ ID NO: 901445 - protein, 23 aa, Mycobacterium
ERREATTDLSLPDNDLRRSPSRQ

SEQ ID NO: 901446 - protein, 7 aa, Mycobacterium
ERRNNAS

SEQ ID NO: 901447 - protein, 19 aa, Mycobacterium
ERRPEYATADREEKRPHDP

SEQ ID NO: 901448 - protein, 12 aa, Mycobacterium
ERRPGPALAGRS

SEQ ID NO: 901449 - protein, 13 aa, Mycobacterium
ERRQRRSAEQSGI

SEQ ID NO: 901450 - protein, 6 aa, Mycobacterium
ERRRYR

SEQ ID NO: 901451 - protein, 6 aa, Mycobacterium
ERRTDI

SEQ ID NO: 901452 - protein, 12 aa, Mycobacterium
ERRVDNKPLDPK

SEQ ID NO: 901453 - protein, 14 aa, Mycobacterium
ERSAGANPALTPTR

SEQ ID NO: 901454 - protein, 5 aa, Mycobacterium
ERSAQ

SEQ ID NO: 901455 - protein, 5 aa, Mycobacterium
ERSDK

SEQ ID NO: 901456 - protein, 5 aa, Mycobacterium
ERSEQ

SEQ ID NO: 901457 - protein, 5 aa, Mycobacterium
ERSGE

SEQ ID NO: 901458 - protein, 7 aa, Mycobacterium
ERSGGPR

SEQ ID NO: 901459 - protein, 6 aa, Mycobacterium
ERSGGR

SEQ ID NO: 901460 - protein, 4 aa, Mycobacterium
ERSL

SEQ ID NO: 901461 - protein, 7 aa, Mycobacterium
ERSLTAE

SEQ ID NO: 901462 - protein, 4 aa, Mycobacterium
ERSP

SEQ ID NO: 901463 - protein, 10 aa, Mycobacterium
ERSPAGKADY

SEQ ID NO: 901464 - protein, 8 aa, Mycobacterium
ERSSLPSA

SEQ ID NO: 901465 - protein, 4 aa, Mycobacterium
ERTA

SEQ ID NO: 901466 - protein, 7 aa, Mycobacterium
ERTARTA

SEQ ID NO: 901467 - protein, 6 aa, Mycobacterium
ERTGGR

SEQ ID NO: 901468 - protein, 5 aa, Mycobacterium
ERTKG

SEQ ID NO: 901469 - protein, 13 aa, Mycobacterium
ERTLRDPATPDPA

SEQ ID NO: 901470 - protein, 7 aa, Mycobacterium
ERTPTDK

SEQ ID NO: 901471 - protein, 5 aa, Mycobacterium
ERTRP

SEQ ID NO: 901472 - protein, 4 aa, Mycobacterium
ERTV

SEQ ID NO: 901473 - protein, 13 aa, Mycobacterium
ERTYGAADARRAL

SEQ ID NO: 901474 - protein, 7 aa, Mycobacterium
ERVAAER

SEQ ID NO: 901475 - protein, 9 aa, Mycobacterium
ERVEDQPPR

SEQ ID NO: 901476 - protein, 4 aa, Mycobacterium
ERVG

SEQ ID NO: 901477 - protein, 13 aa, Mycobacterium
ERVQRGEKASGSW

SEQ ID NO: 901478 - protein, 27 aa, Mycobacterium
ERVTPARVPADAVTGSGSSLDPDITPE

SEQ ID NO: 901479 - protein, 6 aa, Mycobacterium
ERWSAN

SEQ ID NO: 901480 - protein, 5 aa, Mycobacterium
ERWSG

SEQ ID NO: 901481 - protein, 13 aa, Mycobacterium
ERYQKQPSTRGTW

SEQ ID NO: 901482 - protein, 15 aa, Mycobacterium
ESAAHAGSQATASAA

SEQ ID NO: 901483 - protein, 12 aa, Mycobacterium
ESAATTKTQTST

SEQ ID NO: 901484 - protein, 8 aa, Mycobacterium
ESADISDK

SEQ ID NO: 901485 - protein, 9 aa, Mycobacterium
ESAEGRQKY

SEQ ID NO: 901486 - protein, 8 aa, Mycobacterium
ESAGKAID

SEQ ID NO: 901487 - protein, 5 aa, Mycobacterium
ESAPW

SEQ ID NO: 901488 - protein, 29 aa, Mycobacterium
ESARDNAAAAQHDLEASQQAVKDANAAIA

SEQ ID NO: 901489 - protein, 8 aa, Mycobacterium
ESARGDEE

SEQ ID NO: 901490 - protein, 49 aa, Mycobacterium
ESARPNEVTYSEDRLRPDYVPPSPDAPETTAAPAGQPAPAHTAPPSPAE

SEQ ID NO: 901491 - protein, 5 aa, Mycobacterium
ESASR

SEQ ID NO: 901492 - protein, 11 aa, Mycobacterium
ESASSAWDDAG

SEQ ID NO: 901493 - protein, 11 aa, Mycobacterium
ESASSTWDDAG

SEQ ID NO: 901494 - protein, 8 aa, Mycobacterium
ESATGGSS

SEQ ID NO: 901495 - protein, 7 aa, Mycobacterium
ESCGTIE

SEQ ID NO: 901496 - protein, 37 aa, Mycobacterium
ESCTSAPDLAPATATAPTPTTAPASAPPPPSADDAAA

SEQ ID NO: 901497 - protein, 8 aa, Mycobacterium
ESDEEQAS

SEQ ID NO: 901498 - protein, 6 aa, Mycobacterium
ESDEQI

SEQ ID NO: 901499 - protein, 5 aa, Mycobacterium
ESDIP

SEQ ID NO: 901500 - protein, 4 aa, Mycobacterium
ESDN

SEQ ID NO: 901501 - protein, 7 aa, Mycobacterium
ESDPGVA

SEQ ID NO: 901502 - protein, 8 aa, Mycobacterium
ESDRPASG

SEQ ID NO: 901503 - protein, 4 aa, Mycobacterium
ESDY

SEQ ID NO: 901504 - protein, 6 aa, Mycobacterium
ESEAER

SEQ ID NO: 901505 - protein, 7 aa, Mycobacterium
ESEAERL

SEQ ID NO: 901506 - protein, 9 aa, Mycobacterium
ESEAHAKDR

SEQ ID NO: 901507 - protein, 9 aa, Mycobacterium
ESEANANGV

SEQ ID NO: 901508 - protein, 6 aa, Mycobacterium
ESEDES

SEQ ID NO: 901509 - protein, 10 aa, Mycobacterium
ESEGGAQTTR

SEQ ID NO: 901510 - protein, 7 aa, Mycobacterium
ESEPGAV

SEQ ID NO: 901511 - protein, 6 aa, Mycobacterium
ESEPLG

SEQ ID NO: 901512 - protein, 6 aa, Mycobacterium
ESEPSM

SEQ ID NO: 901513 - protein, 21 aa, Mycobacterium
ESEPSPYAASYDNPEIRETYE

SEQ ID NO: 901514 - protein, 22 aa, Mycobacterium
ESERGHAGYTTEGTTGLPAGGE

SEQ ID NO: 901515 - protein, 17 aa, Mycobacterium
ESESPAHALGPPPDGAY

SEQ ID NO: 901516 - protein, 4 aa, Mycobacterium
ESFD

SEQ ID NO: 901517 - protein, 27 aa, Mycobacterium
ESFKATPGKHALDANNPVKKSVQETVE

SEQ ID NO: 901518 - protein, 7 aa, Mycobacterium
ESFPRSD

SEQ ID NO: 901519 - protein, 9 aa, Mycobacterium
ESFRANKGT

SEQ ID NO: 901520 - protein, 14 aa, Mycobacterium
ESFTPSHADSNQQL

SEQ ID NO: 901521 - protein, 5 aa, Mycobacterium
ESGDV

SEQ ID NO: 901522 - protein, 7 aa, Mycobacterium
ESGEPPG

SEQ ID NO: 901523 - protein, 11 aa, Mycobacterium
ESGGAPPPVPM

SEQ ID NO: 901524 - protein, 9 aa, Mycobacterium
ESGGPNSPA

SEQ ID NO: 901525 - protein, 12 aa, Mycobacterium
ESGGTDRNGDNV

SEQ ID NO: 901526 - protein, 14 aa, Mycobacterium
ESGITEQLNNSYSS

SEQ ID NO: 901527 - protein, 21 aa, Mycobacterium
ESGKPFGPNNFTSNPPVLAPD

SEQ ID NO: 901528 - protein, 14 aa, Mycobacterium
ESGKSISGKLSSDG

SEQ ID NO: 901529 - protein, 6 aa, Mycobacterium
ESGLPQ

SEQ ID NO: 901530 - protein, 9 aa, Mycobacterium
ESGNDAANT

SEQ ID NO: 901531 - protein, 16 aa, Mycobacterium
ESGPTDRNGDNKVVGP

SEQ ID NO: 901532 - protein, 6 aa, Mycobacterium
ESGRAA

SEQ ID NO: 901533 - protein, 9 aa, Mycobacterium
ESGRGDSGF

SEQ ID NO: 901534 - protein, 6 aa, Mycobacterium
ESGRYA

SEQ ID NO: 901535 - protein, 6 aa, Mycobacterium
ESGSCA

SEQ ID NO: 901536 - protein, 13 aa, Mycobacterium
ESGSGRGETPESA

SEQ ID NO: 901537 - protein, 6 aa, Mycobacterium
ESGTRD

SEQ ID NO: 901538 - protein, 6 aa, Mycobacterium
ESGVAN

SEQ ID NO: 901539 - protein, 8 aa, Mycobacterium
ESGVDSTR

SEQ ID NO: 901540 - protein, 22 aa, Mycobacterium
ESHGSVPPPPPPMGKRAPMQAD

SEQ ID NO: 901541 - protein, 4 aa, Mycobacterium
ESHI

SEQ ID NO: 901542 - protein, 12 aa, Mycobacterium
ESHNDNSLDRPE

SEQ ID NO: 901543 - protein, 22 aa, Mycobacterium
ESHNGTYRGATIAPNGDVTPPI

SEQ ID NO: 901544 - protein, 6 aa, Mycobacterium
ESHPDW

SEQ ID NO: 901545 - protein, 6 aa, Mycobacterium
ESLHTT

SEQ ID NO: 901546 - protein, 8 aa, Mycobacterium
ESLPDGRA

SEQ ID NO: 901547 - protein, 7 aa, Mycobacterium
ESLPPDA

SEQ ID NO: 901548 - protein, 6 aa, Mycobacterium
ESLPQT

SEQ ID NO: 901549 - protein, 20 aa, Mycobacterium
ESLRGEADRAERDGDLAKAA

SEQ ID NO: 901550 - protein, 6 aa, Mycobacterium
ESLTPR

SEQ ID NO: 901551 - protein, 9 aa, Mycobacterium
ESLTQNTGF

SEQ ID NO: 901552 - protein, 4 aa, Mycobacterium
ESME

SEQ ID NO: 901553 - protein, 7 aa, Mycobacterium
ESMPGEV

SEQ ID NO: 901554 - protein, 5 aa, Mycobacterium
ESNDS

SEQ ID NO: 901555 - protein, 4 aa, Mycobacterium
ESNG

SEQ ID NO: 901556 - protein, 11 aa, Mycobacterium
ESNMAPDTHSR

SEQ ID NO: 901557 - protein, 6 aa, Mycobacterium
ESPAPP

SEQ ID NO: 901558 - protein, 4 aa, Mycobacterium
ESPC

SEQ ID NO: 901559 - protein, 9 aa, Mycobacterium
ESPEGRQKY

SEQ ID NO: 901560 - protein, 7 aa, Mycobacterium
ESPEPPG

SEQ ID NO: 901561 - protein, 20 aa, Mycobacterium
ESPFPKERTADGSFRVTPQS

SEQ ID NO: 901562 - protein, 13 aa, Mycobacterium
ESPGTGPGKADPG

SEQ ID NO: 901563 - protein, 9 aa, Mycobacterium
ESPKGPDAF

SEQ ID NO: 901564 - protein, 12 aa, Mycobacterium
ESPQIDDARTVG

SEQ ID NO: 901565 - protein, 14 aa, Mycobacterium
ESPRAGAALSQKTK

SEQ ID NO: 901566 - protein, 13 aa, Mycobacterium
ESPRRPDGTRAGN

SEQ ID NO: 901567 - protein, 19 aa, Mycobacterium
ESPTLSRPTAELPATVPSG

SEQ ID NO: 901568 - protein, 4 aa, Mycobacterium
ESPY

SEQ ID NO: 901569 - protein, 4 aa, Mycobacterium
ESQA

SEQ ID NO: 901570 - protein, 7 aa, Mycobacterium
ESQGKLA

SEQ ID NO: 901571 - protein, 35 aa, Mycobacterium
ESQTLQASSFDRSGGDFDISTGNRNGTGGCLAPGG

SEQ ID NO: 901572 - protein, 8 aa, Mycobacterium
ESRGAPWR

SEQ ID NO: 901573 - protein, 5 aa, Mycobacterium
ESRGE

SEQ ID NO: 901574 - protein, 7 aa, Mycobacterium
ESRGEME

SEQ ID NO: 901575 - protein, 11 aa, Mycobacterium
ESRGGQDGQAG

SEQ ID NO: 901576 - protein, 7 aa, Mycobacterium
ESRGPAH

SEQ ID NO: 901577 - protein, 7 aa, Mycobacterium
ESRSEAA

SEQ ID NO: 901578 - protein, 12 aa, Mycobacterium
ESRVPNKKNLRE

SEQ ID NO: 901579 - protein, 6 aa, Mycobacterium
ESSAKF

SEQ ID NO: 901580 - protein, 9 aa, Mycobacterium
ESSDDPETV

SEQ ID NO: 901581 - protein, 12 aa, Mycobacterium
ESSGAKAPLGTH

SEQ ID NO: 901582 - protein, 9 aa, Mycobacterium
ESSGDHPDN

SEQ ID NO: 901583 - protein, 6 aa, Mycobacterium
ESSGPT

SEQ ID NO: 901584 - protein, 7 aa, Mycobacterium
ESSIGDT

SEQ ID NO: 901585 - protein, 7 aa, Mycobacterium
ESSLTNE

SEQ ID NO: 901586 - protein, 9 aa, Mycobacterium
ESSNPDNIP

SEQ ID NO: 901587 - protein, 7 aa, Mycobacterium
ESSPGKP

SEQ ID NO: 901588 - protein, 8 aa, Mycobacterium
ESSPHGKR

SEQ ID NO: 901589 - protein, 12 aa, Mycobacterium
ESSREAFEKQTS

SEQ ID NO: 901590 - protein, 8 aa, Mycobacterium
ESSRSDWD

SEQ ID NO: 901591 - protein, 14 aa, Mycobacterium
ESSRTDDPLNPTEF

SEQ ID NO: 901592 - protein, 7 aa, Mycobacterium
ESSYITG

SEQ ID NO: 901593 - protein, 6 aa, Mycobacterium
ESTADR

SEQ ID NO: 901594 - protein, 9 aa, Mycobacterium
ESTALNERI

SEQ ID NO: 901595 - protein, 5 aa, Mycobacterium
ESTAT

SEQ ID NO: 901596 - protein, 9 aa, Mycobacterium
ESTDSSTWS

SEQ ID NO: 901597 - protein, 16 aa, Mycobacterium
ESTDVSSAIPAGDQSV

SEQ ID NO: 901598 - protein, 23 aa, Mycobacterium
ESTEPAASSTPAPGPLSDVPPPL

SEQ ID NO: 901599 - protein, 6 aa, Mycobacterium
ESTGGS

SEQ ID NO: 901600 - protein, 19 aa, Mycobacterium
ESTGHHGPNLAEGSGITAN

SEQ ID NO: 901601 - protein, 12 aa, Mycobacterium
ESTGLSSKGAKT

SEQ ID NO: 901602 - protein, 14 aa, Mycobacterium
ESTGSSYTTVPGGA

SEQ ID NO: 901603 - protein, 8 aa, Mycobacterium
ESTGTTLP

SEQ ID NO: 901604 - protein, 8 aa, Mycobacterium
ESTHAGTT

SEQ ID NO: 901605 - protein, 8 aa, Mycobacterium
ESTPSSMH

SEQ ID NO: 901606 - protein, 18 aa, Mycobacterium
ESTRPDEFNTEPFPPRGV

SEQ ID NO: 901607 - protein, 7 aa, Mycobacterium
ESTSSVT

SEQ ID NO: 901608 - protein, 7 aa, Mycobacterium
ESTTGPI

SEQ ID NO: 901609 - protein, 8 aa, Mycobacterium
ESVAPGTQ

SEQ ID NO: 901610 - protein, 6 aa, Mycobacterium
ESVGRT

SEQ ID NO: 901611 - protein, 7 aa, Mycobacterium
ESVGYGG

SEQ ID NO: 901612 - protein, 6 aa, Mycobacterium
ESVPKE

SEQ ID NO: 901613 - protein, 4 aa, Mycobacterium
ESVQ

SEQ ID NO: 901614 - protein, 6 aa, Mycobacterium
ESVSAG

SEQ ID NO: 901615 - protein, 7 aa, Mycobacterium
ESVSSGP

SEQ ID NO: 901616 - protein, 5 aa, Mycobacterium
ESVTS

SEQ ID NO: 901617 - protein, 13 aa, Mycobacterium
ESYNSTIAPGNSV

SEQ ID NO: 901618 - protein, 13 aa, Mycobacterium
ESYNTTIAPGSSV

SEQ ID NO: 901619 - protein, 8 aa, Mycobacterium
ESYPAVSG

SEQ ID NO: 901620 - protein, 24 aa, Mycobacterium
ETAAPDAPGPDPADAGAGPRSTDP

SEQ ID NO: 901621 - protein, 26 aa, Mycobacterium
ETAAPDEQGAGAPATAGTSERPRSTE

SEQ ID NO: 901622 - protein, 8 aa, Mycobacterium
ETAAQRDP

SEQ ID NO: 901623 - protein, 5 aa, Mycobacterium
ETAAT

SEQ ID NO: 901624 - protein, 7 aa, Mycobacterium
ETADDGM

SEQ ID NO: 901625 - protein, 6 aa, Mycobacterium
ETAGNT

SEQ ID NO: 901626 - protein, 10 aa, Mycobacterium
ETANTASLQT

SEQ ID NO: 901627 - protein, 34 aa, Mycobacterium
ETAPAPPGPRDEPRHRPPPAPPPQPEPSSWEPVA

SEQ ID NO: 901628 - protein, 10 aa, Mycobacterium
ETAPSSNGEC

SEQ ID NO: 901629 - protein, 26 aa, Mycobacterium
ETAPTDSAAPASAEAAPTEESSATPR

SEQ ID NO: 901630 - protein, 8 aa, Mycobacterium
ETAPTPAA

SEQ ID NO: 901631 - protein, 5 aa, Mycobacterium
ETARR

SEQ ID NO: 901632 - protein, 9 aa, Mycobacterium
ETASATTEV

SEQ ID NO: 901633 - protein, 11 aa, Mycobacterium
ETASGQPARIP

SEQ ID NO: 901634 - protein, 15 aa, Mycobacterium
ETASRERPEAAVTAS

SEQ ID NO: 901635 - protein, 7 aa, Mycobacterium
ETATAEP

SEQ ID NO: 901636 - protein, 13 aa, Mycobacterium
ETAVTGAQQQIPQ

SEQ ID NO: 901637 - protein, 8 aa, Mycobacterium
ETCGTVQS

SEQ ID NO: 901638 - protein, 8 aa, Mycobacterium
ETCPSSDG

SEQ ID NO: 901639 - protein, 8 aa, Mycobacterium
ETDDEARS

SEQ ID NO: 901640 - protein, 7 aa, Mycobacterium
ETDDTEV

SEQ ID NO: 901641 - protein, 7 aa, Mycobacterium
ETDHPGT

SEQ ID NO: 901642 - protein, 4 aa, Mycobacterium
ETDP

SEQ ID NO: 901643 - protein, 9 aa, Mycobacterium
ETDPGGTAH

SEQ ID NO: 901644 - protein, 8 aa, Mycobacterium
ETDPPNWA

SEQ ID NO: 901645 - protein, 7 aa, Mycobacterium
ETDTSVE

SEQ ID NO: 901646 - protein, 12 aa, Mycobacterium
ETEGEQEAAEEV

SEQ ID NO: 901647 - protein, 7 aa, Mycobacterium
ETEGTNW

SEQ ID NO: 901648 - protein, 5 aa, Mycobacterium
ETENE

SEQ ID NO: 901649 - protein, 7 aa, Mycobacterium
ETFSRQG

SEQ ID NO: 901650 - protein, 4 aa, Mycobacterium
ETFT

SEQ ID NO: 901651 - protein, 6 aa, Mycobacterium
ETGEEC

SEQ ID NO: 901652 - protein, 4 aa, Mycobacterium
ETGF

SEQ ID NO: 901653 - protein, 9 aa, Mycobacterium
ETGGDATRI

SEQ ID NO: 901654 - protein, 9 aa, Mycobacterium
ETGKSVQGV

SEQ ID NO: 901655 - protein, 5 aa, Mycobacterium
ETGQD

SEQ ID NO: 901656 - protein, 14 aa, Mycobacterium
ETGRRILDQSGFAK

SEQ ID NO: 901657 - protein, 12 aa, Mycobacterium
ETGRRLAAEALD

SEQ ID NO: 901658 - protein, 6 aa, Mycobacterium
ETGSPY

SEQ ID NO: 901659 - protein, 9 aa, Mycobacterium
ETGSTTDQA

SEQ ID NO: 901660 - protein, 16 aa, Mycobacterium
ETGVTGFGSAADAVAG

SEQ ID NO: 901661 - protein, 5 aa, Mycobacterium
ETHPD

SEQ ID NO: 901662 - protein, 8 aa, Mycobacterium
ETHPSEPN

SEQ ID NO: 901663 - protein, 6 aa, Mycobacterium
ETIGSA

SEQ ID NO: 901664 - protein, 6 aa, Mycobacterium
ETIKNP

SEQ ID NO: 901665 - protein, 5 aa, Mycobacterium
ETIRQ

SEQ ID NO: 901666 - protein, 7 aa, Mycobacterium
ETKDRTA

SEQ ID NO: 901667 - protein, 6 aa, Mycobacterium
ETKNAG

SEQ ID NO: 901668 - protein, 7 aa, Mycobacterium
ETKPGDK

SEQ ID NO: 901669 - protein, 8 aa, Mycobacterium
ETKTGAQI

SEQ ID NO: 901670 - protein, 6 aa, Mycobacterium
ETLAGG

SEQ ID NO: 901671 - protein, 4 aa, Mycobacterium
ETLG

SEQ ID NO: 901672 - protein, 7 aa, Mycobacterium
ETLPDGA

SEQ ID NO: 901673 - protein, 8 aa, Mycobacterium
ETLRQTDG

SEQ ID NO: 901674 - protein, 4 aa, Mycobacterium
ETMK

SEQ ID NO: 901675 - protein, 8 aa, Mycobacterium
ETMSGTHT

SEQ ID NO: 901676 - protein, 9 aa, Mycobacterium
ETMSGTHTT

SEQ ID NO: 901677 - protein, 8 aa, Mycobacterium
ETNASRVQ

SEQ ID NO: 901678 - protein, 6 aa, Mycobacterium
ETNKQH

SEQ ID NO: 901679 - protein, 21 aa, Mycobacterium
ETNKTSPGTAPLRTFTAKVTV

SEQ ID NO: 901680 - protein, 4 aa, Mycobacterium
ETNQ

SEQ ID NO: 901681 - protein, 30 aa, Mycobacterium
ETPAATPTSATAAAAPPPSPPHTASPAEVE

SEQ ID NO: 901682 - protein, 13 aa, Mycobacterium
ETPATAQSLTTKA

SEQ ID NO: 901683 - protein, 17 aa, Mycobacterium
ETPDGFGQDGFDEGNAE

SEQ ID NO: 901684 - protein, 7 aa, Mycobacterium
ETPETPW

SEQ ID NO: 901685 - protein, 15 aa, Mycobacterium
ETPGAGESTATRLRD

SEQ ID NO: 901686 - protein, 12 aa, Mycobacterium
ETPNYTSSNPAS

SEQ ID NO: 901687 - protein, 8 aa, Mycobacterium
ETPPSGEL

SEQ ID NO: 901688 - protein, 6 aa, Mycobacterium
ETPQWA

SEQ ID NO: 901689 - protein, 8 aa, Mycobacterium
ETPREPDA

SEQ ID NO: 901690 - protein, 9 aa, Mycobacterium
ETQERQNDV

SEQ ID NO: 901691 - protein, 21 aa, Mycobacterium
ETQGDLAARSADISRAEQRYN

SEQ ID NO: 901692 - protein, 9 aa, Mycobacterium
ETQPPSVSS

SEQ ID NO: 901693 - protein, 4 aa, Mycobacterium
ETQS

SEQ ID NO: 901694 - protein, 9 aa, Mycobacterium
ETQSSVNRL

SEQ ID NO: 901695 - protein, 10 aa, Mycobacterium
ETRDQTSEQV

SEQ ID NO: 901696 - protein, 12 aa, Mycobacterium
ETRSGEGESSKS

SEQ ID NO: 901697 - protein, 5 aa, Mycobacterium
ETSAF

SEQ ID NO: 901698 - protein, 8 aa, Mycobacterium
ETSELPGA

SEQ ID NO: 901699 - protein, 5 aa, Mycobacterium
ETSRQ

SEQ ID NO: 901700 - protein, 5 aa, Mycobacterium
ETSTP

SEQ ID NO: 901701 - protein, 4 aa, Mycobacterium
ETTA

SEQ ID NO: 901702 - protein, 5 aa, Mycobacterium
ETTAN

SEQ ID NO: 901703 - protein, 9 aa, Mycobacterium
ETTDDSRSC

SEQ ID NO: 901704 - protein, 7 aa, Mycobacterium
ETTGERI

SEQ ID NO: 901705 - protein, 6 aa, Mycobacterium
ETTGSD

SEQ ID NO: 901706 - protein, 5 aa, Mycobacterium
ETTQF

SEQ ID NO: 901707 - protein, 7 aa, Mycobacterium
ETTQTRL

SEQ ID NO: 901708 - protein, 6 aa, Mycobacterium
ETTRNT

SEQ ID NO: 901709 - protein, 7 aa, Mycobacterium
ETTRTTL

SEQ ID NO: 901710 - protein, 19 aa, Mycobacterium
ETTTAEKIAARSDPWDPSS

SEQ ID NO: 901711 - protein, 9 aa, Mycobacterium
ETTTPGRLT

SEQ ID NO: 901712 - protein, 4 aa, Mycobacterium
ETTV

SEQ ID NO: 901713 - protein, 18 aa, Mycobacterium
ETTVKTPELVPASDGDQV

SEQ ID NO: 901714 - protein, 10 aa, Mycobacterium
ETTVPENPSR

SEQ ID NO: 901715 - protein, 14 aa, Mycobacterium
ETVDADQQAQLRRR

SEQ ID NO: 901716 - protein, 6 aa, Mycobacterium
ETVHQS

SEQ ID NO: 901717 - protein, 10 aa, Mycobacterium
ETVPPPEQRG

SEQ ID NO: 901718 - protein, 6 aa, Mycobacterium
ETYGDK

SEQ ID NO: 901719 - protein, 8 aa, Mycobacterium
ETYRPPAD

SEQ ID NO: 901720 - protein, 13 aa, Mycobacterium
EVAAGDAKRTTMS

SEQ ID NO: 901721 - protein, 8 aa, Mycobacterium
EVADTQDA

SEQ ID NO: 901722 - protein, 25 aa, Mycobacterium
EVAKTNKRDKPFTATDSDDASCNVT

SEQ ID NO: 901723 - protein, 16 aa, Mycobacterium
EVAPAPAVTSRQASTN

SEQ ID NO: 901724 - protein, 21 aa, Mycobacterium
EVAPSRDDQPVSPESPQAAEA

SEQ ID NO: 901725 - protein, 7 aa, Mycobacterium
EVAQAPD

SEQ ID NO: 901726 - protein, 10 aa, Mycobacterium
EVATGARGTL

SEQ ID NO: 901727 - protein, 12 aa, Mycobacterium
EVATSDADRALR

SEQ ID NO: 901728 - protein, 16 aa, Mycobacterium
EVATTDADRAQKTPWN

SEQ ID NO: 901729 - protein, 5 aa, Mycobacterium
EVDGK

SEQ ID NO: 901730 - protein, 8 aa, Mycobacterium
EVDGRGTA

SEQ ID NO: 901731 - protein, 8 aa, Mycobacterium
EVDGSDAA

SEQ ID NO: 901732 - protein, 6 aa, Mycobacterium
EVDPEQ

SEQ ID NO: 901733 - protein, 13 aa, Mycobacterium
EVDRRGRAAEGQN

SEQ ID NO: 901734 - protein, 5 aa, Mycobacterium
EVEAD

SEQ ID NO: 901735 - protein, 10 aa, Mycobacterium
EVENTSPAEG

SEQ ID NO: 901736 - protein, 13 aa, Mycobacterium
EVEQSEIGGSPRH

SEQ ID NO: 901737 - protein, 8 aa, Mycobacterium
EVEVGPGA

SEQ ID NO: 901738 - protein, 8 aa, Mycobacterium
EVGEAPGA

SEQ ID NO: 901739 - protein, 9 aa, Mycobacterium
EVGEGPGRY

SEQ ID NO: 901740 - protein, 5 aa, Mycobacterium
EVGER

SEQ ID NO: 901741 - protein, 16 aa, Mycobacterium
EVGGPGDPVPGDLQDA

SEQ ID NO: 901742 - protein, 12 aa, Mycobacterium
EVGGTWRDNTYP

SEQ ID NO: 901743 - protein, 10 aa, Mycobacterium
EVGKGERLAQ

SEQ ID NO: 901744 - protein, 13 aa, Mycobacterium
EVGSTSDHGAQSD

SEQ ID NO: 901745 - protein, 5 aa, Mycobacterium
EVGVS

SEQ ID NO: 901746 - protein, 8 aa, Mycobacterium
EVKDENLT

SEQ ID NO: 901747 - protein, 9 aa, Mycobacterium
EVKEGKGDT

SEQ ID NO: 901748 - protein, 4 aa, Mycobacterium
EVNP

SEQ ID NO: 901749 - protein, 11 aa, Mycobacterium
EVNQDKGDKEP

SEQ ID NO: 901750 - protein, 22 aa, Mycobacterium
EVPAAAEQASVAAPPTAPATVG

SEQ ID NO: 901751 - protein, 5 aa, Mycobacterium
EVPED

SEQ ID NO: 901752 - protein, 8 aa, Mycobacterium
EVPEGIRK

SEQ ID NO: 901753 - protein, 12 aa, Mycobacterium
EVPGSDGVDPRA

SEQ ID NO: 901754 - protein, 8 aa, Mycobacterium
EVPKDSAV

SEQ ID NO: 901755 - protein, 10 aa, Mycobacterium
EVPLQTPPCE

SEQ ID NO: 901756 - protein, 6 aa, Mycobacterium
EVPPGW

SEQ ID NO: 901757 - protein, 11 aa, Mycobacterium
EVPPPPPPRPW

SEQ ID NO: 901758 - protein, 5 aa, Mycobacterium
EVREE

SEQ ID NO: 901759 - protein, 4 aa, Mycobacterium
EVRN

SEQ ID NO: 901760 - protein, 8 aa, Mycobacterium
EVRNGEQL

SEQ ID NO: 901761 - protein, 14 aa, Mycobacterium
EVRNTRKLGPAGPI

SEQ ID NO: 901762 - protein, 7 aa, Mycobacterium
EVRTDGP

SEQ ID NO: 901763 - protein, 9 aa, Mycobacterium
EVSAPSAAT

SEQ ID NO: 901764 - protein, 10 aa, Mycobacterium
EVSGGADPQR

SEQ ID NO: 901765 - protein, 8 aa, Mycobacterium
EVSGSGAA

SEQ ID NO: 901766 - protein, 4 aa, Mycobacterium
EVSR

SEQ ID NO: 901767 - protein, 8 aa, Mycobacterium
EVSTPNTS

SEQ ID NO: 901768 - protein, 5 aa, Mycobacterium
EVTAD

SEQ ID NO: 901769 - protein, 11 aa, Mycobacterium
EVTDGSGQQLT

SEQ ID NO: 901770 - protein, 4 aa, Mycobacterium
EVTF

SEQ ID NO: 901771 - protein, 5 aa, Mycobacterium
EVTGS

SEQ ID NO: 901772 - protein, 5 aa, Mycobacterium
EVTGT

SEQ ID NO: 901773 - protein, 7 aa, Mycobacterium
EVTHGDD

SEQ ID NO: 901774 - protein, 4 aa, Mycobacterium
EVTR

SEQ ID NO: 901775 - protein, 7 aa, Mycobacterium
EVTRGGR

SEQ ID NO: 901776 - protein, 4 aa, Mycobacterium
EVTS

SEQ ID NO: 901777 - protein, 8 aa, Mycobacterium
EVVANGSA

SEQ ID NO: 901778 - protein, 9 aa, Mycobacterium
EVVGGNRQA

SEQ ID NO: 901779 - protein, 17 aa, Mycobacterium
EVYDDPPGLSPLPEEEP

SEQ ID NO: 901780 - protein, 8 aa, Mycobacterium
EWAPGTDF

SEQ ID NO: 901781 - protein, 11 aa, Mycobacterium
EWDATTRPRIP

SEQ ID NO: 901782 - protein, 14 aa, Mycobacterium
EWPEPAESLPPPFD

SEQ ID NO: 901783 - protein, 15 aa, Mycobacterium
EWPEPAESLPPPYDN

SEQ ID NO: 901784 - protein, 16 aa, Mycobacterium
EWPEPRDRQAADSAAI

SEQ ID NO: 901785 - protein, 6 aa, Mycobacterium
EWTDQE

SEQ ID NO: 901786 - protein, 10 aa, Mycobacterium
EYAEQNPDNV

SEQ ID NO: 901787 - protein, 6 aa, Mycobacterium
EYAGSG

SEQ ID NO: 901788 - protein, 19 aa, Mycobacterium
EYDPANGTYVGPDGRVYTQ

SEQ ID NO: 901789 - protein, 13 aa, Mycobacterium
EYDPATGTYVGPD

SEQ ID NO: 901790 - protein, 30 aa, Mycobacterium
EYDPSTGSYIGPDGKQYRQADLGQNAAGQH

SEQ ID NO: 901791 - protein, 6 aa, Mycobacterium
EYETES

SEQ ID NO: 901792 - protein, 12 aa, Mycobacterium
EYGEPGASAAGF

SEQ ID NO: 901793 - protein, 10 aa, Mycobacterium
EYGGAGGSLD

SEQ ID NO: 901794 - protein, 5 aa, Mycobacterium
EYGIT

SEQ ID NO: 901795 - protein, 7 aa, Mycobacterium
EYGNTGV

SEQ ID NO: 901796 - protein, 13 aa, Mycobacterium
EYLPPGTSRAVNA

SEQ ID NO: 901797 - protein, 6 aa, Mycobacterium
EYNGSI

SEQ ID NO: 901798 - protein, 12 aa, Mycobacterium
EYNSEGDPRKAY

SEQ ID NO: 901799 - protein, 17 aa, Mycobacterium
EYPDPESHSDEREDQRE

SEQ ID NO: 901800 - protein, 13 aa, Mycobacterium
EYPEDLAHALDVL

SEQ ID NO: 901801 - protein, 6 aa, Mycobacterium
EYPETV

SEQ ID NO: 901802 - protein, 5 aa, Mycobacterium
EYPSY

SEQ ID NO: 901803 - protein, 14 aa, Mycobacterium
EYPTDQYPAGDPAL

SEQ ID NO: 901804 - protein, 11 aa, Mycobacterium
EYQPGEPRGTD

SEQ ID NO: 901805 - protein, 11 aa, Mycobacterium
EYSGDARLADG

SEQ ID NO: 901806 - protein, 7 aa, Mycobacterium
EYSPARA

SEQ ID NO: 901807 - protein, 12 aa, Mycobacterium
EYSTGTSGGQVS

SEQ ID NO: 901808 - protein, 8 aa, Mycobacterium
EYSYEGSG

SEQ ID NO: 901809 - protein, 5 aa, Mycobacterium
FAADG

SEQ ID NO: 901810 - protein, 4 aa, Mycobacterium
FADD

SEQ ID NO: 901811 - protein, 6 aa, Mycobacterium
FADGTS

SEQ ID NO: 901812 - protein, 7 aa, Mycobacterium
FADQGGM

SEQ ID NO: 901813 - protein, 8 aa, Mycobacterium
FADQQSDL

SEQ ID NO: 901814 - protein, 20 aa, Mycobacterium
FAGANTVDGGTSTAVVPPEL

SEQ ID NO: 901815 - protein, 4 aa, Mycobacterium
FAGE

SEQ ID NO: 901816 - protein, 15 aa, Mycobacterium
FAGGDEEYAPGAHHH

SEQ ID NO: 901817 - protein, 12 aa, Mycobacterium
FAGPSQGADPAK

SEQ ID NO: 901818 - protein, 6 aa, Mycobacterium
FAGQGV

SEQ ID NO: 901819 - protein, 7 aa, Mycobacterium
FAGQGVG

SEQ ID NO: 901820 - protein, 8 aa, Mycobacterium
FAGQRDAI

SEQ ID NO: 901821 - protein, 4 aa, Mycobacterium
FAGR

SEQ ID NO: 901822 - protein, 9 aa, Mycobacterium
FAGRGSGSI

SEQ ID NO: 901823 - protein, 14 aa, Mycobacterium
FAGSGGFGGAGGDA

SEQ ID NO: 901824 - protein, 6 aa, Mycobacterium
FANDPA

SEQ ID NO: 901825 - protein, 7 aa, Mycobacterium
FANDRDR

SEQ ID NO: 901826 - protein, 7 aa, Mycobacterium
FAPGGTW

SEQ ID NO: 901827 - protein, 17 aa, Mycobacterium
FAPGSDGLGGTDPNDPF

SEQ ID NO: 901828 - protein, 20 aa, Mycobacterium
FAPKPKNPANYLTKPGRRIH

SEQ ID NO: 901829 - protein, 11 aa, Mycobacterium
FAPPLEPGQQT

SEQ ID NO: 901830 - protein, 18 aa, Mycobacterium
FAPPPDTTSVNAAGGQSA

SEQ ID NO: 901831 - protein, 7 aa, Mycobacterium
FAPVTGA

SEQ ID NO: 901832 - protein, 13 aa, Mycobacterium
FAQRPTVRTPHPG

SEQ ID NO: 901833 - protein, 15 aa, Mycobacterium
FASADAGLVPRGALV

SEQ ID NO: 901834 - protein, 18 aa, Mycobacterium
FATASDGNRMTAVGDFAG

SEQ ID NO: 901835 - protein, 4 aa, Mycobacterium
FATD

SEQ ID NO: 901836 - protein, 4 aa, Mycobacterium
FATP

SEQ ID NO: 901837 - protein, 4 aa, Mycobacterium
FDAE

SEQ ID NO: 901838 - protein, 11 aa, Mycobacterium
FDAPSPDWHPG

SEQ ID NO: 901839 - protein, 15 aa, Mycobacterium
FDDHHDADVTCRVKS

SEQ ID NO: 901840 - protein, 16 aa, Mycobacterium
FDDKEGRARQRLSDAG

SEQ ID NO: 901841 - protein, 7 aa, Mycobacterium
FDDNSDT

SEQ ID NO: 901842 - protein, 4 aa, Mycobacterium
FDDT

SEQ ID NO: 901843 - protein, 11 aa, Mycobacterium
FDDTAGRSRRA

SEQ ID NO: 901844 - protein, 29 aa, Mycobacterium
FDEDGDIRTVSPTRHIDPGYANGYANSKW

SEQ ID NO: 901845 - protein, 10 aa, Mycobacterium
FDEQVPSAWS

SEQ ID NO: 901846 - protein, 10 aa, Mycobacterium
FDGDNEGQVT

SEQ ID NO: 901847 - protein, 13 aa, Mycobacterium
FDGPAGSAPSAAK

SEQ ID NO: 901848 - protein, 46 aa, Mycobacterium
FDGPFGKGGVNQSGAFNQGVGNSGFDSGDNIKGGTVSSSGFENHGN

SEQ ID NO: 901849 - protein, 8 aa, Mycobacterium
FDKDGEGL

SEQ ID NO: 901850 - protein, 10 aa, Mycobacterium
FDKDGTGLDT

SEQ ID NO: 901851 - protein, 8 aa, Mycobacterium
FDKNGRGL

SEQ ID NO: 901852 - protein, 4 aa, Mycobacterium
FDPA

SEQ ID NO: 901853 - protein, 5 aa, Mycobacterium
FDPAA

SEQ ID NO: 901854 - protein, 9 aa, Mycobacterium
FDPARAQTP

SEQ ID NO: 901855 - protein, 8 aa, Mycobacterium
FDPDRPTA

SEQ ID NO: 901856 - protein, 5 aa, Mycobacterium
FDPEP

SEQ ID NO: 901857 - protein, 6 aa, Mycobacterium
FDPKEA

SEQ ID NO: 901858 - protein, 5 aa, Mycobacterium
FDPRR

SEQ ID NO: 901859 - protein, 5 aa, Mycobacterium
FDPSG

SEQ ID NO: 901860 - protein, 21 aa, Mycobacterium
FDPTTTTESVTAQLNSTTDDR

SEQ ID NO: 901861 - protein, 4 aa, Mycobacterium
FDRS

SEQ ID NO: 901862 - protein, 9 aa, Mycobacterium
FDSSGNTLA

SEQ ID NO: 901863 - protein, 9 aa, Mycobacterium
FDSSTAPQW

SEQ ID NO: 901864 - protein, 10 aa, Mycobacterium
FDSYESSSFD

SEQ ID NO: 901865 - protein, 15 aa, Mycobacterium
FDTEGDPQKASAIAP

SEQ ID NO: 901866 - protein, 4 aa, Mycobacterium
FDTG

SEQ ID NO: 901867 - protein, 11 aa, Mycobacterium
FDTGANPENYK

SEQ ID NO: 901868 - protein, 17 aa, Mycobacterium
FDTPDADAYRAAHDAEA

SEQ ID NO: 901869 - protein, 6 aa, Mycobacterium
FDYPDD

SEQ ID NO: 901870 - protein, 7 aa, Mycobacterium
FEAGNDD

SEQ ID NO: 901871 - protein, 11 aa, Mycobacterium
FEAPGVGDTGQ

SEQ ID NO: 901872 - protein, 9 aa, Mycobacterium
FEDANPGAT

SEQ ID NO: 901873 - protein, 10 aa, Mycobacterium
FEGHPDNAAA

SEQ ID NO: 901874 - protein, 12 aa, Mycobacterium
FEGHPDNAAASV

SEQ ID NO: 901875 - protein, 6 aa, Mycobacterium
FEGPGL

SEQ ID NO: 901876 - protein, 53 aa, Mycobacterium
FENGYGDGFQDGLDQGQLDGGGDWGGDAGGGDWDSGGDWGGGDFGGGDFGGFD

SEQ ID NO: 901877 - protein, 20 aa, Mycobacterium
FEPADADNCADARPSPPASF

SEQ ID NO: 901878 - protein, 14 aa, Mycobacterium
FESDAQQKVIPEAR

SEQ ID NO: 901879 - protein, 5 aa, Mycobacterium
FESDD

SEQ ID NO: 901880 - protein, 6 aa, Mycobacterium
FESDDG

SEQ ID NO: 901881 - protein, 10 aa, Mycobacterium
FESNPDLAKG

SEQ ID NO: 901882 - protein, 8 aa, Mycobacterium
FESPGPGV

SEQ ID NO: 901883 - protein, 11 aa, Mycobacterium
FESTTNLGQGF

SEQ ID NO: 901884 - protein, 5 aa, Mycobacterium
FEVSD

SEQ ID NO: 901885 - protein, 6 aa, Mycobacterium
FEYPDD

SEQ ID NO: 901886 - protein, 4 aa, Mycobacterium
FGAD

SEQ ID NO: 901887 - protein, 15 aa, Mycobacterium
FGAGPAPAYLSEDGG

SEQ ID NO: 901888 - protein, 8 aa, Mycobacterium
FGASRVAP

SEQ ID NO: 901889 - protein, 22 aa, Mycobacterium
FGDDPNRYTDAKSRKNYAATSQ

SEQ ID NO: 901890 - protein, 6 aa, Mycobacterium
FGDEGT

SEQ ID NO: 901891 - protein, 10 aa, Mycobacterium
FGDGALKGKP

SEQ ID NO: 901892 - protein, 7 aa, Mycobacterium
FGDGSKL

SEQ ID NO: 901893 - protein, 14 aa, Mycobacterium
FGDPQADTKAKSTL

SEQ ID NO: 901894 - protein, 10 aa, Mycobacterium
FGDPQPAHDL

SEQ ID NO: 901895 - protein, 9 aa, Mycobacterium
FGDQTSDET

SEQ ID NO: 901896 - protein, 4 aa, Mycobacterium
FGEE

SEQ ID NO: 901897 - protein, 7 aa, Mycobacterium
FGEPGNA

SEQ ID NO: 901898 - protein, 9 aa, Mycobacterium
FGEPGNAMS

SEQ ID NO: 901899 - protein, 20 aa, Mycobacterium
FGGAGTQTQVKPNQFRKEGG

SEQ ID NO: 901900 - protein, 11 aa, Mycobacterium
FGGDGGAGGNS

SEQ ID NO: 901901 - protein, 9 aa, Mycobacterium
FGGDPQRVT

SEQ ID NO: 901902 - protein, 4 aa, Mycobacterium
FGGN

SEQ ID NO: 901903 - protein, 8 aa, Mycobacterium
FGGNEPAR

SEQ ID NO: 901904 - protein, 6 aa, Mycobacterium
FGGNGH

SEQ ID NO: 901905 - protein, 7 aa, Mycobacterium
FGGPENN

SEQ ID NO: 901906 - protein, 21 aa, Mycobacterium
FGGPSMAPGWDPADIEGGDVA

SEQ ID NO: 901907 - protein, 6 aa, Mycobacterium
FGGSGR

SEQ ID NO: 901908 - protein, 10 aa, Mycobacterium
FGGSPEASYV

SEQ ID NO: 901909 - protein, 10 aa, Mycobacterium
FGGTPEASYV

SEQ ID NO: 901910 - protein, 9 aa, Mycobacterium
FGKPAADLP

SEQ ID NO: 901911 - protein, 11 aa, Mycobacterium
FGLPKNSRLGY

SEQ ID NO: 901912 - protein, 8 aa, Mycobacterium
FGNDNSVT

SEQ ID NO: 901913 - protein, 41 aa, Mycobacterium
FGNGGNGGTGGGSLDGNGGSGGAGGAGGFLGSGGKGGVGGV

SEQ ID NO: 901914 - protein, 9 aa, Mycobacterium
FGNNGSNNI

SEQ ID NO: 901915 - protein, 19 aa, Mycobacterium
FGNNNSVAATATGVGGNLG

SEQ ID NO: 901916 - protein, 17 aa, Mycobacterium
FGNNSPNVAASALGAGN

SEQ ID NO: 901917 - protein, 18 aa, Mycobacterium
FGNPTPTDTCEHSDGTHC

SEQ ID NO: 901918 - protein, 4 aa, Mycobacterium
FGPE

SEQ ID NO: 901919 - protein, 4 aa, Mycobacterium
FGPG

SEQ ID NO: 901920 - protein, 14 aa, Mycobacterium
FGPGGTTAGAGGAW

SEQ ID NO: 901921 - protein, 8 aa, Mycobacterium
FGPNPLDP

SEQ ID NO: 901922 - protein, 6 aa, Mycobacterium
FGPPPH

SEQ ID NO: 901923 - protein, 10 aa, Mycobacterium
FGPTPGPAQV

SEQ ID NO: 901924 - protein, 6 aa, Mycobacterium
FGQDDN

SEQ ID NO: 901925 - protein, 11 aa, Mycobacterium
FGQDGFDEGNA

SEQ ID NO: 901926 - protein, 20 aa, Mycobacterium
FGQGDNQVAAESGAGGGNIA

SEQ ID NO: 901927 - protein, 4 aa, Mycobacterium
FGRA

SEQ ID NO: 901928 - protein, 9 aa, Mycobacterium
FGRDGDQGV

SEQ ID NO: 901929 - protein, 8 aa, Mycobacterium
FGRGSNRE

SEQ ID NO: 901930 - protein, 10 aa, Mycobacterium
FGRIGQPREV

SEQ ID NO: 901931 - protein, 8 aa, Mycobacterium
FGRPAPDL

SEQ ID NO: 901932 - protein, 77 aa, Mycobacterium
FGSGGAGGDGGAGAGGTSPGGQSAGAGGNGGSGGATGLCGTGGAGGSGGVGGKGGSSGATASLGGIGGSGGAGGDGG

SEQ ID NO: 901933 - protein, 23 aa, Mycobacterium
FGSGGAGGSGGAGAAGGAGGSGG

SEQ ID NO: 901934 - protein, 6 aa, Mycobacterium
FGSIPP

SEQ ID NO: 901935 - protein, 8 aa, Mycobacterium
FGSNGSGD

SEQ ID NO: 901936 - protein, 9 aa, Mycobacterium
FGSTAGSAA

SEQ ID NO: 901937 - protein, 15 aa, Mycobacterium
FGTAPNPGGGLPYTQ

SEQ ID NO: 901938 - protein, 15 aa, Mycobacterium
FGTAPNPGSGLPYTQ

SEQ ID NO: 901939 - protein, 12 aa, Mycobacterium
FGTAPNPGTGLP

SEQ ID NO: 901940 - protein, 10 aa, Mycobacterium
FGTDAEPFYG

SEQ ID NO: 901941 - protein, 14 aa, Mycobacterium
FGTKTELPARFGGP

SEQ ID NO: 901942 - protein, 6 aa, Mycobacterium
FGTPAE

SEQ ID NO: 901943 - protein, 6 aa, Mycobacterium
FGTPET

SEQ ID NO: 901944 - protein, 6 aa, Mycobacterium
FGTPSK

SEQ ID NO: 901945 - protein, 13 aa, Mycobacterium
FGTQEQLNDSDGA

SEQ ID NO: 901946 - protein, 11 aa, Mycobacterium
FGTREQAASMD

SEQ ID NO: 901947 - protein, 5 aa, Mycobacterium
FGTTG

SEQ ID NO: 901948 - protein, 6 aa, Mycobacterium
FHDDGS

SEQ ID NO: 901949 - protein, 9 aa, Mycobacterium
FHGTSPADP

SEQ ID NO: 901950 - protein, 7 aa, Mycobacterium
FHPSAPA

SEQ ID NO: 901951 - protein, 8 aa, Mycobacterium
FKDPDGTW

SEQ ID NO: 901952 - protein, 19 aa, Mycobacterium
FKDRGDSRKAITGQSTEDI

SEQ ID NO: 901953 - protein, 6 aa, Mycobacterium
FKGDPE

SEQ ID NO: 901954 - protein, 10 aa, Mycobacterium
FKGNPDGERV

SEQ ID NO: 901955 - protein, 9 aa, Mycobacterium
FKKSEESAE

SEQ ID NO: 901956 - protein, 11 aa, Mycobacterium
FKNAYTAAGGH

SEQ ID NO: 901957 - protein, 8 aa, Mycobacterium
FKPGKGVH

SEQ ID NO: 901958 - protein, 8 aa, Mycobacterium
FKPPSGFQ

SEQ ID NO: 901959 - protein, 10 aa, Mycobacterium
FKPPTGGPSY

SEQ ID NO: 901960 - protein, 6 aa, Mycobacterium
FKQRYE

SEQ ID NO: 901961 - protein, 13 aa, Mycobacterium
FNDPSKSLHYDEP

SEQ ID NO: 901962 - protein, 11 aa, Mycobacterium
FNDSSAAMDDP

SEQ ID NO: 901963 - protein, 8 aa, Mycobacterium
FNDTGAES

SEQ ID NO: 901964 - protein, 10 aa, Mycobacterium
FNETSGTRRI

SEQ ID NO: 901965 - protein, 4 aa, Mycobacterium
FNGQ

SEQ ID NO: 901966 - protein, 10 aa, Mycobacterium
FNGTDLTGEV

SEQ ID NO: 901967 - protein, 6 aa, Mycobacterium
FNNQGG

SEQ ID NO: 901968 - protein, 11 aa, Mycobacterium
FNPASDPQRAQ

SEQ ID NO: 901969 - protein, 6 aa, Mycobacterium
FNPDRY

SEQ ID NO: 901970 - protein, 11 aa, Mycobacterium
FNPDRYRDTYQ

SEQ ID NO: 901971 - protein, 12 aa, Mycobacterium
FNPDRYRDTYQE

SEQ ID NO: 901972 - protein, 6 aa, Mycobacterium
FNPERA

SEQ ID NO: 901973 - protein, 44 aa, Mycobacterium
FNPGPPYGADGQAGAMGATGQDGVAGMTPGTGTAGNGGNGGPGV

SEQ ID NO: 901974 - protein, 6 aa, Mycobacterium
FNPGRA

SEQ ID NO: 901975 - protein, 5 aa, Mycobacterium
FNPQR

SEQ ID NO: 901976 - protein, 11 aa, Mycobacterium
FNPTNDPRRDQ

SEQ ID NO: 901977 - protein, 13 aa, Mycobacterium
FNQEPGTYSAEGY

SEQ ID NO: 901978 - protein, 16 aa, Mycobacterium
FNQPPTTSNPGGMATQ

SEQ ID NO: 901979 - protein, 12 aa, Mycobacterium
FNSGEPGDTSLT

SEQ ID NO: 901980 - protein, 12 aa, Mycobacterium
FNTGAGNSSGGA

SEQ ID NO: 901981 - protein, 9 aa, Mycobacterium
FPAAPPPTF

SEQ ID NO: 901982 - protein, 12 aa, Mycobacterium
FPDGSNSQPSYL

SEQ ID NO: 901983 - protein, 7 aa, Mycobacterium
FPDPNAQ

SEQ ID NO: 901984 - protein, 8 aa, Mycobacterium
FPDQNSDL

SEQ ID NO: 901985 - protein, 14 aa, Mycobacterium
FPDQTRNASANEVA

SEQ ID NO: 901986 - protein, 8 aa, Mycobacterium
FPDSNPTV

SEQ ID NO: 901987 - protein, 6 aa, Mycobacterium
FPEPKV

SEQ ID NO: 901988 - protein, 9 aa, Mycobacterium
FPFPGSDGK

SEQ ID NO: 901989 - protein, 7 aa, Mycobacterium
FPGAPRD

SEQ ID NO: 901990 - protein, 11 aa, Mycobacterium
FPGDNGDQPIV

SEQ ID NO: 901991 - protein, 10 aa, Mycobacterium
FPGDNGDRLI

SEQ ID NO: 901992 - protein, 10 aa, Mycobacterium
FPGEDGEHPI

SEQ ID NO: 901993 - protein, 8 aa, Mycobacterium
FPGEPRAV

SEQ ID NO: 901994 - protein, 4 aa, Mycobacterium
FPGP

SEQ ID NO: 901995 - protein, 4 aa, Mycobacterium
FPGR

SEQ ID NO: 901996 - protein, 5 aa, Mycobacterium
FPNDL

SEQ ID NO: 901997 - protein, 8 aa, Mycobacterium
FPNNETTA

SEQ ID NO: 901998 - protein, 5 aa, Mycobacterium
FPPAG

SEQ ID NO: 901999 - protein, 7 aa, Mycobacterium
FPPDHGE

SEQ ID NO: 902000 - protein, 8 aa, Mycobacterium
FPPDPVAD

SEQ ID NO: 902001 - protein, 5 aa, Mycobacterium
FPPGS

SEQ ID NO: 902002 - protein, 6 aa, Mycobacterium
FPPGTL

SEQ ID NO: 902003 - protein, 24 aa, Mycobacterium
FPPIGSRSISGPNAVSGYAPRTAP

SEQ ID NO: 902004 - protein, 28 aa, Mycobacterium
FPPPAAPAAVGPADPATPGATATDPDAQ

SEQ ID NO: 902005 - protein, 7 aa, Mycobacterium
FPPPQTQ

SEQ ID NO: 902006 - protein, 4 aa, Mycobacterium
FPPT

SEQ ID NO: 902007 - protein, 11 aa, Mycobacterium
FPQDGNGGYRV

SEQ ID NO: 902008 - protein, 8 aa, Mycobacterium
FPQDKYKP

SEQ ID NO: 902009 - protein, 5 aa, Mycobacterium
FPQGV

SEQ ID NO: 902010 - protein, 4 aa, Mycobacterium
FPQR

SEQ ID NO: 902011 - protein, 5 aa, Mycobacterium
FPRDA

SEQ ID NO: 902012 - protein, 5 aa, Mycobacterium
FPRGA

SEQ ID NO: 902013 - protein, 7 aa, Mycobacterium
FPRPDDP

SEQ ID NO: 902014 - protein, 15 aa, Mycobacterium
FPRPGRQRPPRPGVH

SEQ ID NO: 902015 - protein, 6 aa, Mycobacterium
FPSAGD

SEQ ID NO: 902016 - protein, 4 aa, Mycobacterium
FPSG

SEQ ID NO: 902017 - protein, 6 aa, Mycobacterium
FPSGMT

SEQ ID NO: 902018 - protein, 5 aa, Mycobacterium
FPSQD

SEQ ID NO: 902019 - protein, 8 aa, Mycobacterium
FPSSGPYR

SEQ ID NO: 902020 - protein, 6 aa, Mycobacterium
FPTGAI

SEQ ID NO: 902021 - protein, 12 aa, Mycobacterium
FPTGDRISTTTT

SEQ ID NO: 902022 - protein, 6 aa, Mycobacterium
FPTKSG

SEQ ID NO: 902023 - protein, 7 aa, Mycobacterium
FPTRDGQ

SEQ ID NO: 902024 - protein, 15 aa, Mycobacterium
FQAEGGPGSPVDTGS

SEQ ID NO: 902025 - protein, 10 aa, Mycobacterium
FQAGDDPVAN

SEQ ID NO: 902026 - protein, 9 aa, Mycobacterium
FQDAANPAF

SEQ ID NO: 902027 - protein, 9 aa, Mycobacterium
FQDPPDGAL

SEQ ID NO: 902028 - protein, 7 aa, Mycobacterium
FQERDTQ

SEQ ID NO: 902029 - protein, 11 aa, Mycobacterium
FQGAASTDVPG

SEQ ID NO: 902030 - protein, 4 aa, Mycobacterium
FQGT

SEQ ID NO: 902031 - protein, 11 aa, Mycobacterium
FQKSANTQIIP

SEQ ID NO: 902032 - protein, 6 aa, Mycobacterium
FQPGGA

SEQ ID NO: 902033 - protein, 7 aa, Mycobacterium
FQPGGAK

SEQ ID NO: 902034 - protein, 13 aa, Mycobacterium
FQPPGASRADQLG

SEQ ID NO: 902035 - protein, 14 aa, Mycobacterium
FQPTTDPKAELDSG

SEQ ID NO: 902036 - protein, 4 aa, Mycobacterium
FQPV

SEQ ID NO: 902037 - protein, 10 aa, Mycobacterium
FQSGDDPVAN

SEQ ID NO: 902038 - protein, 28 aa, Mycobacterium
FQSGPAPEEPAPAPEPAPVDEAQAPAPE

SEQ ID NO: 902039 - protein, 8 aa, Mycobacterium
FQSSSPAY

SEQ ID NO: 902040 - protein, 7 aa, Mycobacterium
FRADGAA

SEQ ID NO: 902041 - protein, 4 aa, Mycobacterium
FRDA

SEQ ID NO: 902042 - protein, 15 aa, Mycobacterium
FRDAADSRGFDEAHR

SEQ ID NO: 902043 - protein, 7 aa, Mycobacterium
FREKDGH

SEQ ID NO: 902044 - protein, 9 aa, Mycobacterium
FREKDGKRL

SEQ ID NO: 902045 - protein, 8 aa, Mycobacterium
FREKDGRP

SEQ ID NO: 902046 - protein, 7 aa, Mycobacterium
FREKNGR

SEQ ID NO: 902047 - protein, 17 aa, Mycobacterium
FREPPQTANVTGQTAQS

SEQ ID NO: 902048 - protein, 12 aa, Mycobacterium
FRGGTNGGADVS

SEQ ID NO: 902049 - protein, 10 aa, Mycobacterium
FRPAGPADDY

SEQ ID NO: 902050 - protein, 25 aa, Mycobacterium
FRPNNAAPGDAPLPLGSANDSQIRD

SEQ ID NO: 902051 - protein, 6 aa, Mycobacterium
FRPPDA

SEQ ID NO: 902052 - protein, 9 aa, Mycobacterium
FRTNEEPPF

SEQ ID NO: 902053 - protein, 14 aa, Mycobacterium
FRTPRPEDPSGGTM

SEQ ID NO: 902054 - protein, 17 aa, Mycobacterium
FRTPSGAYCTSSSHRGM

SEQ ID NO: 902055 - protein, 6 aa, Mycobacterium
FRTSDY

SEQ ID NO: 902056 - protein, 16 aa, Mycobacterium
FRTSPTPGSNGTTHRA

SEQ ID NO: 902057 - protein, 5 aa, Mycobacterium
FRTTD

SEQ ID NO: 902058 - protein, 10 aa, Mycobacterium
FSAAGKNGFI

SEQ ID NO: 902059 - protein, 13 aa, Mycobacterium
FSAAKDAHPEFSG

SEQ ID NO: 902060 - protein, 8 aa, Mycobacterium
FSADGRAR

SEQ ID NO: 902061 - protein, 10 aa, Mycobacterium
FSAGKSALDD

SEQ ID NO: 902062 - protein, 11 aa, Mycobacterium
FSANTGQDAAG

SEQ ID NO: 902063 - protein, 8 aa, Mycobacterium
FSDGRTAP

SEQ ID NO: 902064 - protein, 9 aa, Mycobacterium
FSDGSVSAA

SEQ ID NO: 902065 - protein, 8 aa, Mycobacterium
FSDGTPLD

SEQ ID NO: 902066 - protein, 9 aa, Mycobacterium
FSDGTPLTA

SEQ ID NO: 902067 - protein, 7 aa, Mycobacterium
FSDTATQ

SEQ ID NO: 902068 - protein, 9 aa, Mycobacterium
FSDTPPDLK

SEQ ID NO: 902069 - protein, 8 aa, Mycobacterium
FSEARSEG

SEQ ID NO: 902070 - protein, 5 aa, Mycobacterium
FSEER

SEQ ID NO: 902071 - protein, 29 aa, Mycobacterium
FSEGGAQAAPLPTVGDDAEIPRDAPRRTI

SEQ ID NO: 902072 - protein, 17 aa, Mycobacterium
FSEGPGAAGMTTAGEGA

SEQ ID NO: 902073 - protein, 9 aa, Mycobacterium
FSGAGEALQ

SEQ ID NO: 902074 - protein, 10 aa, Mycobacterium
FSGASNREIT

SEQ ID NO: 902075 - protein, 13 aa, Mycobacterium
FSGDGYTLTYTDI

SEQ ID NO: 902076 - protein, 11 aa, Mycobacterium
FSGETKSTGQI

SEQ ID NO: 902077 - protein, 13 aa, Mycobacterium
FSGGAPAAPSQPP

SEQ ID NO: 902078 - protein, 23 aa, Mycobacterium
FSGGTFPSPNGMPNQGLQKDPGI

SEQ ID NO: 902079 - protein, 20 aa, Mycobacterium
FSGNAKGHGRHVKQSGGHGQ

SEQ ID NO: 902080 - protein, 12 aa, Mycobacterium
FSGRGPQLGQSL

SEQ ID NO: 902081 - protein, 18 aa, Mycobacterium
FSKANDAITAATGHTPTL

SEQ ID NO: 902082 - protein, 10 aa, Mycobacterium
FSKEDTRDGS

SEQ ID NO: 902083 - protein, 5 aa, Mycobacterium
FSPDG

SEQ ID NO: 902084 - protein, 7 aa, Mycobacterium
FSPDGKT

SEQ ID NO: 902085 - protein, 9 aa, Mycobacterium
FSPDGTQIA

SEQ ID NO: 902086 - protein, 14 aa, Mycobacterium
FSPEAQRDAAQAVD

SEQ ID NO: 902087 - protein, 5 aa, Mycobacterium
FSREG

SEQ ID NO: 902088 - protein, 9 aa, Mycobacterium
FSRNDDATR

SEQ ID NO: 902089 - protein, 9 aa, Mycobacterium
FSRTPDGSD

SEQ ID NO: 902090 - protein, 9 aa, Mycobacterium
FSSAGSSTE

SEQ ID NO: 902091 - protein, 5 aa, Mycobacterium
FSSGD

SEQ ID NO: 902092 - protein, 15 aa, Mycobacterium
FSSGFRNTGPEGINP

SEQ ID NO: 902093 - protein, 21 aa, Mycobacterium
FSSTSGPTPTPNDPANCDGAH

SEQ ID NO: 902094 - protein, 22 aa, Mycobacterium
FSTSNVDPAGMPRTATLPDGST

SEQ ID NO: 902095 - protein, 9 aa, Mycobacterium
FTAATGTAR

SEQ ID NO: 902096 - protein, 29 aa, Mycobacterium
FTAPGRPPVPGAQPHAKPPRPTDGKPGWP

SEQ ID NO: 902097 - protein, 13 aa, Mycobacterium
FTAPSEPANPSVW

SEQ ID NO: 902098 - protein, 4 aa, Mycobacterium
FTDE

SEQ ID NO: 902099 - protein, 12 aa, Mycobacterium
FTDEQRARREAE

SEQ ID NO: 902100 - protein, 9 aa, Mycobacterium
FTDGSDGFG

SEQ ID NO: 902101 - protein, 9 aa, Mycobacterium
FTDGTDGFG

SEQ ID NO: 902102 - protein, 10 aa, Mycobacterium
FTDPGGNPLP

SEQ ID NO: 902103 - protein, 10 aa, Mycobacterium
FTDSKEREEQ

SEQ ID NO: 902104 - protein, 10 aa, Mycobacterium
FTDTGEPAGI

SEQ ID NO: 902105 - protein, 10 aa, Mycobacterium
FTDTKEREQS

SEQ ID NO: 902106 - protein, 15 aa, Mycobacterium
FTEETGKPVPAGPPI

SEQ ID NO: 902107 - protein, 17 aa, Mycobacterium
FTEGQIGDAEALEPATT

SEQ ID NO: 902108 - protein, 4 aa, Mycobacterium
FTEH

SEQ ID NO: 902109 - protein, 31 aa, Mycobacterium
FTEPPRTTDSSAVARQSAAIAQSAASDIPSE

SEQ ID NO: 902110 - protein, 4 aa, Mycobacterium
FTEQ

SEQ ID NO: 902111 - protein, 6 aa, Mycobacterium
FTGDGP

SEQ ID NO: 902112 - protein, 16 aa, Mycobacterium
FTGNQTDFAGSDSPLA

SEQ ID NO: 902113 - protein, 9 aa, Mycobacterium
FTGRDRKDC

SEQ ID NO: 902114 - protein, 7 aa, Mycobacterium
FTGREND

SEQ ID NO: 902115 - protein, 13 aa, Mycobacterium
FTGSPPPTPPTLG

SEQ ID NO: 902116 - protein, 4 aa, Mycobacterium
FTGT

SEQ ID NO: 902117 - protein, 7 aa, Mycobacterium
FTKDGQI

SEQ ID NO: 902118 - protein, 6 aa, Mycobacterium
FTNPRK

SEQ ID NO: 902119 - protein, 13 aa, Mycobacterium
FTNSPIKDGEHAN

SEQ ID NO: 902120 - protein, 21 aa, Mycobacterium
FTNSPLQDGEHANGVSVTTGG

SEQ ID NO: 902121 - protein, 9 aa, Mycobacterium
FTPGNENFQ

SEQ ID NO: 902122 - protein, 20 aa, Mycobacterium
FTPGSPSGGSGGSPGGPGGS

SEQ ID NO: 902123 - protein, 20 aa, Mycobacterium
FTPGSPSGGSGGSPGGPGGT

SEQ ID NO: 902124 - protein, 10 aa, Mycobacterium
FTPNGAHAGI

SEQ ID NO: 902125 - protein, 19 aa, Mycobacterium
FTPPDATRLAGANSKKLRA

SEQ ID NO: 902126 - protein, 12 aa, Mycobacterium
FTPPDGAGGDRA

SEQ ID NO: 902127 - protein, 6 aa, Mycobacterium
FTPPGF

SEQ ID NO: 902128 - protein, 18 aa, Mycobacterium
FTPPPAGLGGGAASAGLA

SEQ ID NO: 902129 - protein, 5 aa, Mycobacterium
FTPQE

SEQ ID NO: 902130 - protein, 4 aa, Mycobacterium
FTRR

SEQ ID NO: 902131 - protein, 19 aa, Mycobacterium
FTSGAAAASAAKPPVDASI

SEQ ID NO: 902132 - protein, 17 aa, Mycobacterium
FTTESTGRSWFYDTWLN

SEQ ID NO: 902133 - protein, 6 aa, Mycobacterium
FTTGDT

SEQ ID NO: 902134 - protein, 6 aa, Mycobacterium
FTTGPE

SEQ ID NO: 902135 - protein, 14 aa, Mycobacterium
FTTPAGQDTPETGW

SEQ ID NO: 902136 - protein, 23 aa, Mycobacterium
FTTSDTVPSSVPAAAAPTPLPPE

SEQ ID NO: 902137 - protein, 14 aa, Mycobacterium
FTTSPGEANPANGL

SEQ ID NO: 902138 - protein, 27 aa, Mycobacterium
FTYTPAEAARHAAAAAEATAADKQDTF

SEQ ID NO: 902139 - protein, 26 aa, Mycobacterium
FTYTPTAAARHAAANANATEADKQDT

SEQ ID NO: 902140 - protein, 9 aa, Mycobacterium
FYRPTKAGA

SEQ ID NO: 902141 - protein, 6 aa, Mycobacterium
GAAAAA

SEQ ID NO: 902142 - protein, 68 aa, Mycobacterium
GAAAADDDTGSSQSQSSQSANPATQESDPTSAANAAGDSSNESTDADSATASSDDDTETEETAATDTV

SEQ ID NO: 902143 - protein, 11 aa, Mycobacterium
GAAAADPNQDD

SEQ ID NO: 902144 - protein, 95 aa, Mycobacterium
GAAAADSEAGDAGGSVSASSSARSADSDADSDADSDSAGARSSAKPKTRPKADRADRDPQRDDDSAAERESQAVTATRDEPVRRSSAVPNNAPTV

SEQ ID NO: 902145 - protein, 11 aa, Mycobacterium
GAAAADSNQDD

SEQ ID NO: 902146 - protein, 14 aa, Mycobacterium
GAAAAGRDPANLGK

SEQ ID NO: 902147 - protein, 5 aa, Mycobacterium
GAAAG

SEQ ID NO: 902148 - protein, 6 aa, Mycobacterium
GAAAGA

SEQ ID NO: 902149 - protein, 21 aa, Mycobacterium
GAAAGRAAALADGKQPIATKG

SEQ ID NO: 902150 - protein, 9 aa, Mycobacterium
GAAAKGHRD

SEQ ID NO: 902151 - protein, 29 aa, Mycobacterium
GAAAPPEDAPAPEPAPAAQAPAPLPAEAP

SEQ ID NO: 902152 - protein, 11 aa, Mycobacterium
GAAAPQTLGDR

SEQ ID NO: 902153 - protein, 7 aa, Mycobacterium
GAAAQSA

SEQ ID NO: 902154 - protein, 7 aa, Mycobacterium
GAAASIS

SEQ ID NO: 902155 - protein, 7 aa, Mycobacterium
GAAATAL

SEQ ID NO: 902156 - protein, 7 aa, Mycobacterium
GAAATMP

SEQ ID NO: 902157 - protein, 13 aa, Mycobacterium
GAAAYRDVDTARR

SEQ ID NO: 902158 - protein, 12 aa, Mycobacterium
GAADAAPSKCTA

SEQ ID NO: 902159 - protein, 10 aa, Mycobacterium
GAADARTAAA

SEQ ID NO: 902160 - protein, 11 aa, Mycobacterium
GAADGTGFSEG

SEQ ID NO: 902161 - protein, 6 aa, Mycobacterium
GAAEAG

SEQ ID NO: 902162 - protein, 35 aa, Mycobacterium
GAAEQNPGSATPSGSTAPAAKAESDTDDVPDEGDM

SEQ ID NO: 902163 - protein, 8 aa, Mycobacterium
GAAGAAGA

SEQ ID NO: 902164 - protein, 11 aa, Mycobacterium
GAAGAIDGGAV

SEQ ID NO: 902165 - protein, 9 aa, Mycobacterium
GAAGDTAAE

SEQ ID NO: 902166 - protein, 9 aa, Mycobacterium
GAAGDTAAQ

SEQ ID NO: 902167 - protein, 11 aa, Mycobacterium
GAAGEAPGAQI

SEQ ID NO: 902168 - protein, 5 aa, Mycobacterium
GAAGG

SEQ ID NO: 902169 - protein, 35 aa, Mycobacterium
GAAGGDGGIGGDGASGGNDGGNGGVGGLGGVGGPG

SEQ ID NO: 902170 - protein, 30 aa, Mycobacterium
GAAGGRLAGSCEADQGRRQATGCHRRNTES

SEQ ID NO: 902171 - protein, 7 aa, Mycobacterium
GAAGPAW

SEQ ID NO: 902172 - protein, 8 aa, Mycobacterium
GAAGQPVY

SEQ ID NO: 902173 - protein, 10 aa, Mycobacterium
GAAGQTVTGR

SEQ ID NO: 902174 - protein, 9 aa, Mycobacterium
GAAGSAAAA

SEQ ID NO: 902175 - protein, 12 aa, Mycobacterium
GAAGSAPDSSKW

SEQ ID NO: 902176 - protein, 11 aa, Mycobacterium
GAAGTGTPLPA

SEQ ID NO: 902177 - protein, 6 aa, Mycobacterium
GAAGTV

SEQ ID NO: 902178 - protein, 7 aa, Mycobacterium
GAAKGIA

SEQ ID NO: 902179 - protein, 30 aa, Mycobacterium
GAALASGSAGAALAAGTLDAAGAGSGCTAG

SEQ ID NO: 902180 - protein, 5 aa, Mycobacterium
GAALD

SEQ ID NO: 902181 - protein, 21 aa, Mycobacterium
GAALPAAADPQKNPYPDTSKY

SEQ ID NO: 902182 - protein, 8 aa, Mycobacterium
GAALSTEE

SEQ ID NO: 902183 - protein, 7 aa, Mycobacterium
GAAMGDS

SEQ ID NO: 902184 - protein, 8 aa, Mycobacterium
GAAMGDSR

SEQ ID NO: 902185 - protein, 16 aa, Mycobacterium
GAANAEPAPVPPAPMP

SEQ ID NO: 902186 - protein, 9 aa, Mycobacterium
GAANPDVAG

SEQ ID NO: 902187 - protein, 15 aa, Mycobacterium
GAAPAGAAPFNPEEQ

SEQ ID NO: 902188 - protein, 7 aa, Mycobacterium
GAAPAYD

SEQ ID NO: 902189 - protein, 7 aa, Mycobacterium
GAAPGGF

SEQ ID NO: 902190 - protein, 24 aa, Mycobacterium
GAAPGSPAAPAGPVAPPAPPPAGA

SEQ ID NO: 902191 - protein, 8 aa, Mycobacterium
GAAPNLGS

SEQ ID NO: 902192 - protein, 9 aa, Mycobacterium
GAAPNRDTP

SEQ ID NO: 902193 - protein, 9 aa, Mycobacterium
GAAPPECGQ

SEQ ID NO: 902194 - protein, 8 aa, Mycobacterium
GAAPRTAR

SEQ ID NO: 902195 - protein, 8 aa, Mycobacterium
GAAPSGPV

SEQ ID NO: 902196 - protein, 13 aa, Mycobacterium
GAAQDAGRDPDAL

SEQ ID NO: 902197 - protein, 8 aa, Mycobacterium
GAAQRGNR

SEQ ID NO: 902198 - protein, 8 aa, Mycobacterium
GAARADES

SEQ ID NO: 902199 - protein, 5 aa, Mycobacterium
GAARR

SEQ ID NO: 902200 - protein, 14 aa, Mycobacterium
GAASAAPSHQPDYG

SEQ ID NO: 902201 - protein, 9 aa, Mycobacterium
GAASAGAQA

SEQ ID NO: 902202 - protein, 14 aa, Mycobacterium
GAASDPHSYQASPV

SEQ ID NO: 902203 - protein, 8 aa, Mycobacterium
GAASGGTS

SEQ ID NO: 902204 - protein, 6 aa, Mycobacterium
GAASGL

SEQ ID NO: 902205 - protein, 5 aa, Mycobacterium
GAASQ

SEQ ID NO: 902206 - protein, 13 aa, Mycobacterium
GAATAGVSKETGV

SEQ ID NO: 902207 - protein, 21 aa, Mycobacterium
GAATAHGGPDVPPVSDAARAA

SEQ ID NO: 902208 - protein, 8 aa, Mycobacterium
GAATDQTY

SEQ ID NO: 902209 - protein, 12 aa, Mycobacterium
GAATEKVEKATG

SEQ ID NO: 902210 - protein, 13 aa, Mycobacterium
GAATTAPATTVAP

SEQ ID NO: 902211 - protein, 16 aa, Mycobacterium
GAATTYAQAEAANAAA

SEQ ID NO: 902212 - protein, 7 aa, Mycobacterium
GAATVES

SEQ ID NO: 902213 - protein, 8 aa, Mycobacterium
GAAVAQTG

SEQ ID NO: 902214 - protein, 16 aa, Mycobacterium
GAAVASAPAAEPAPEI

SEQ ID NO: 902215 - protein, 13 aa, Mycobacterium
GAAVTEYDENHEK

SEQ ID NO: 902216 - protein, 7 aa, Mycobacterium
GAAYGGN

SEQ ID NO: 902217 - protein, 32 aa, Mycobacterium
GACSSSAAQQPQAQPSAPPTPSFQPNQRYPDP

SEQ ID NO: 902218 - protein, 6 aa, Mycobacterium
GADAAD

SEQ ID NO: 902219 - protein, 26 aa, Mycobacterium
GADAAGVTERGVQAGRALGDDPAAEV

SEQ ID NO: 902220 - protein, 8 aa, Mycobacterium
GADAARRD

SEQ ID NO: 902221 - protein, 8 aa, Mycobacterium
GADADAVG

SEQ ID NO: 902222 - protein, 12 aa, Mycobacterium
GADAGGPQGGSI

SEQ ID NO: 902223 - protein, 7 aa, Mycobacterium
GADAPAV

SEQ ID NO: 902224 - protein, 8 aa, Mycobacterium
GADARTRA

SEQ ID NO: 902225 - protein, 7 aa, Mycobacterium
GADATGA

SEQ ID NO: 902226 - protein, 8 aa, Mycobacterium
GADDPHGL

SEQ ID NO: 902227 - protein, 7 aa, Mycobacterium
GADDSDV

SEQ ID NO: 902228 - protein, 6 aa, Mycobacterium
GADEIS

SEQ ID NO: 902229 - protein, 16 aa, Mycobacterium
GADESLQATLDGRADL

SEQ ID NO: 902230 - protein, 5 aa, Mycobacterium
GADEV

SEQ ID NO: 902231 - protein, 6 aa, Mycobacterium
GADEVS

SEQ ID NO: 902232 - protein, 7 aa, Mycobacterium
GADEVSE

SEQ ID NO: 902233 - protein, 7 aa, Mycobacterium
GADEVSS

SEQ ID NO: 902234 - protein, 4 aa, Mycobacterium
GADG

SEQ ID NO: 902235 - protein, 11 aa, Mycobacterium
GADGGAHTREQ

SEQ ID NO: 902236 - protein, 9 aa, Mycobacterium
GADGGRVTA

SEQ ID NO: 902237 - protein, 5 aa, Mycobacterium
GADGH

SEQ ID NO: 902238 - protein, 10 aa, Mycobacterium
GADGKPYPNG

SEQ ID NO: 902239 - protein, 7 aa, Mycobacterium
GADGPAP

SEQ ID NO: 902240 - protein, 9 aa, Mycobacterium
GADGRITEG

SEQ ID NO: 902241 - protein, 9 aa, Mycobacterium
GADGRRITN

SEQ ID NO: 902242 - protein, 6 aa, Mycobacterium
GADGTF

SEQ ID NO: 902243 - protein, 10 aa, Mycobacterium
GADGTPYPNG

SEQ ID NO: 902244 - protein, 5 aa, Mycobacterium
GADGV

SEQ ID NO: 902245 - protein, 4 aa, Mycobacterium
GADI

SEQ ID NO: 902246 - protein, 5 aa, Mycobacterium
GADIG

SEQ ID NO: 902247 - protein, 7 aa, Mycobacterium
GADIGEV

SEQ ID NO: 902248 - protein, 16 aa, Mycobacterium
GADNTADERYSPGERY

SEQ ID NO: 902249 - protein, 4 aa, Mycobacterium
GADP

SEQ ID NO: 902250 - protein, 7 aa, Mycobacterium
GADPAAA

SEQ ID NO: 902251 - protein, 21 aa, Mycobacterium
GADPADPSVPADTPFDIAVTC

SEQ ID NO: 902252 - protein, 8 aa, Mycobacterium
GADPARAV

SEQ ID NO: 902253 - protein, 7 aa, Mycobacterium
GADPAVA

SEQ ID NO: 902254 - protein, 10 aa, Mycobacterium
GADPDTGASL

SEQ ID NO: 902255 - protein, 9 aa, Mycobacterium
GADPETVRQ

SEQ ID NO: 902256 - protein, 9 aa, Mycobacterium
GADPPPSRW

SEQ ID NO: 902257 - protein, 11 aa, Mycobacterium
GADPPTSTAST

SEQ ID NO: 902258 - protein, 8 aa, Mycobacterium
GADPRGRM

SEQ ID NO: 902259 - protein, 10 aa, Mycobacterium
GADPTAPLGM

SEQ ID NO: 902260 - protein, 7 aa, Mycobacterium
GADPTLA

SEQ ID NO: 902261 - protein, 4 aa, Mycobacterium
GADR

SEQ ID NO: 902262 - protein, 9 aa, Mycobacterium
GADRDGDTL

SEQ ID NO: 902263 - protein, 10 aa, Mycobacterium
GADRSSAQTV

SEQ ID NO: 902264 - protein, 5 aa, Mycobacterium
GADRV

SEQ ID NO: 902265 - protein, 15 aa, Mycobacterium
GADRYASAEAANAGQ

SEQ ID NO: 902266 - protein, 6 aa, Mycobacterium
GADSER

SEQ ID NO: 902267 - protein, 23 aa, Mycobacterium
GADSPLAADQIGPAAARCDGNPA

SEQ ID NO: 902268 - protein, 4 aa, Mycobacterium
GADT

SEQ ID NO: 902269 - protein, 7 aa, Mycobacterium
GADTETV

SEQ ID NO: 902270 - protein, 6 aa, Mycobacterium
GADTRT

SEQ ID NO: 902271 - protein, 7 aa, Mycobacterium
GADTYAP

SEQ ID NO: 902272 - protein, 4 aa, Mycobacterium
GADV

SEQ ID NO: 902273 - protein, 5 aa, Mycobacterium
GADWN

SEQ ID NO: 902274 - protein, 10 aa, Mycobacterium
GADYANATEQ

SEQ ID NO: 902275 - protein, 11 aa, Mycobacterium
GAEAAAQKDNV

SEQ ID NO: 902276 - protein, 6 aa, Mycobacterium
GAEAGL

SEQ ID NO: 902277 - protein, 6 aa, Mycobacterium
GAEAPW

SEQ ID NO: 902278 - protein, 44 aa, Mycobacterium
GAEAVEEAAAGAAEAAASELGAATGGVGGAVSAGVGNAATIGPL

SEQ ID NO: 902279 - protein, 7 aa, Mycobacterium
GAECSAD

SEQ ID NO: 902280 - protein, 7 aa, Mycobacterium
GAEDDKA

SEQ ID NO: 902281 - protein, 36 aa, Mycobacterium
GAEDKMSDEEAKQWGGKAGQPFDPNYHQAGDTLANV

SEQ ID NO: 902282 - protein, 7 aa, Mycobacterium
GAEDPRV

SEQ ID NO: 902283 - protein, 10 aa, Mycobacterium
GAEGKMSADQ

SEQ ID NO: 902284 - protein, 6 aa, Mycobacterium
GAEKLP

SEQ ID NO: 902285 - protein, 10 aa, Mycobacterium
GAEPDNNKAA

SEQ ID NO: 902286 - protein, 14 aa, Mycobacterium
GAEPDNQKAARRLA

SEQ ID NO: 902287 - protein, 5 aa, Mycobacterium
GAEPG

SEQ ID NO: 902288 - protein, 6 aa, Mycobacterium
GAEPLP

SEQ ID NO: 902289 - protein, 9 aa, Mycobacterium
GAEPTAERR

SEQ ID NO: 902290 - protein, 4 aa, Mycobacterium
GAEQ

SEQ ID NO: 902291 - protein, 8 aa, Mycobacterium
GAERGELS

SEQ ID NO: 902292 - protein, 11 aa, Mycobacterium
GAERGQHDPWT

SEQ ID NO: 902293 - protein, 7 aa, Mycobacterium
GAERTGH

SEQ ID NO: 902294 - protein, 5 aa, Mycobacterium
GAERW

SEQ ID NO: 902295 - protein, 9 aa, Mycobacterium
GAESANANQ

SEQ ID NO: 902296 - protein, 22 aa, Mycobacterium
GAESGWRTANTESIKSAAEEAG

SEQ ID NO: 902297 - protein, 7 aa, Mycobacterium
GAETPDY

SEQ ID NO: 902298 - protein, 13 aa, Mycobacterium
GAEVGDPSLSGYS

SEQ ID NO: 902299 - protein, 7 aa, Mycobacterium
GAEVSDT

SEQ ID NO: 902300 - protein, 14 aa, Mycobacterium
GAEVTNMTNTPGSF

SEQ ID NO: 902301 - protein, 4 aa, Mycobacterium
GAFA

SEQ ID NO: 902302 - protein, 13 aa, Mycobacterium
GAGAAASYLASKG

SEQ ID NO: 902303 - protein, 19 aa, Mycobacterium
GAGAADTARASGSAGAALA

SEQ ID NO: 902304 - protein, 42 aa, Mycobacterium
GAGAADTARASGSAGAALASGALDATGAGSGCTARSAGSACA

SEQ ID NO: 902305 - protein, 16 aa, Mycobacterium
GAGAAPAPTVTPPQLS

SEQ ID NO: 902306 - protein, 17 aa, Mycobacterium
GAGAASAQTGVPLGGGS

SEQ ID NO: 902307 - protein, 18 aa, Mycobacterium
GAGAGAGPAYADSTADST

SEQ ID NO: 902308 - protein, 9 aa, Mycobacterium
GAGAGDEGI

SEQ ID NO: 902309 - protein, 9 aa, Mycobacterium
GAGAGEQRD

SEQ ID NO: 902310 - protein, 6 aa, Mycobacterium
GAGAGG

SEQ ID NO: 902311 - protein, 25 aa, Mycobacterium
GAGAGGATPPPTTSTGGGGRKGLPP

SEQ ID NO: 902312 - protein, 7 aa, Mycobacterium
GAGANMP

SEQ ID NO: 902313 - protein, 11 aa, Mycobacterium
GAGAPESELTA

SEQ ID NO: 902314 - protein, 8 aa, Mycobacterium
GAGDARRA

SEQ ID NO: 902315 - protein, 9 aa, Mycobacterium
GAGDDNTVT

SEQ ID NO: 902316 - protein, 14 aa, Mycobacterium
GAGDPAANSDTTRI

SEQ ID NO: 902317 - protein, 14 aa, Mycobacterium
GAGDTAANSDTKRI

SEQ ID NO: 902318 - protein, 9 aa, Mycobacterium
GAGDTATGV

SEQ ID NO: 902319 - protein, 8 aa, Mycobacterium
GAGELSEV

SEQ ID NO: 902320 - protein, 5 aa, Mycobacterium
GAGEV

SEQ ID NO: 902321 - protein, 22 aa, Mycobacterium
GAGFATGTALASPDPAQQPDIS

SEQ ID NO: 902322 - protein, 20 aa, Mycobacterium
GAGGAAALSGAGNGGTGGAG

SEQ ID NO: 902323 - protein, 8 aa, Mycobacterium
GAGGAAPL

SEQ ID NO: 902324 - protein, 39 aa, Mycobacterium
GAGGAGAGAKGAAGAARAAEVGGEAADAAAAVGRGGRLA

SEQ ID NO: 902325 - protein, 29 aa, Mycobacterium
GAGGAGGAGGAGSSLGGAGGTGGAGGRGG

SEQ ID NO: 902326 - protein, 21 aa, Mycobacterium
GAGGAGGDASTGGGGLGGNGG

SEQ ID NO: 902327 - protein, 84 aa, Mycobacterium
GAGGAGGDGGQADDAIGGTGGTGGSGGTLYGSGGLGGNGGNGGHQGGLGGAGGSGGLFGDGGSGGDGGTGGTNGAAGGAGGRGG

SEQ ID NO: 902328 - protein, 24 aa, Mycobacterium
GAGGAGGNTSAGNGGAGGAGGSGG

SEQ ID NO: 902329 - protein, 10 aa, Mycobacterium
GAGGAGGVGG

SEQ ID NO: 902330 - protein, 9 aa, Mycobacterium
GAGGAGKTR

SEQ ID NO: 902331 - protein, 10 aa, Mycobacterium
GAGGAGKTRL

SEQ ID NO: 902332 - protein, 7 aa, Mycobacterium
GAGGATQ

SEQ ID NO: 902333 - protein, 18 aa, Mycobacterium
GAGGAYAAAEAANVSPLQ

SEQ ID NO: 902334 - protein, 19 aa, Mycobacterium
GAGGDGGVSGNGGAGGKAG

SEQ ID NO: 902335 - protein, 7 aa, Mycobacterium
GAGGGLG

SEQ ID NO: 902336 - protein, 6 aa, Mycobacterium
GAGGGS

SEQ ID NO: 902337 - protein, 72 aa, Mycobacterium
GAGGGTGGSGGDGTTEAGRGGDGGHGGSAGLIGNGGAGAVAGGGGTGPISRGPGDPGAGGSGGLLFGRPGPS

SEQ ID NO: 902338 - protein, 24 aa, Mycobacterium
GAGGHGGAGATGGAGGGGGSAYSG

SEQ ID NO: 902339 - protein, 23 aa, Mycobacterium
GAGGHGGDATTGIGGAGGAGGMA

SEQ ID NO: 902340 - protein, 24 aa, Mycobacterium
GAGGIGGKGGAASSGGAGGTGGAG

SEQ ID NO: 902341 - protein, 8 aa, Mycobacterium
GAGGLTAA

SEQ ID NO: 902342 - protein, 20 aa, Mycobacterium
GAGGNAPVFGGGSGGTGGRA

SEQ ID NO: 902343 - protein, 25 aa, Mycobacterium
GAGGNGGDGGAAGLHGGQGGGGGNA

SEQ ID NO: 902344 - protein, 28 aa, Mycobacterium
GAGGNGGDGGVGHDNGGAGGAGGRAGPL

SEQ ID NO: 902345 - protein, 30 aa, Mycobacterium
GAGGPGGQGGDNQNTNTGPGGVGGAGGDAG

SEQ ID NO: 902346 - protein, 7 aa, Mycobacterium
GAGGSSI

SEQ ID NO: 902347 - protein, 10 aa, Mycobacterium
GAGGTGGSGI

SEQ ID NO: 902348 - protein, 32 aa, Mycobacterium
GAGGTGGTGGLSDTTTETIGGYGGMGGLGGQS

SEQ ID NO: 902349 - protein, 9 aa, Mycobacterium
GAGHPRDYS

SEQ ID NO: 902350 - protein, 5 aa, Mycobacterium
GAGHT

SEQ ID NO: 902351 - protein, 12 aa, Mycobacterium
GAGKATGDQGRA

SEQ ID NO: 902352 - protein, 5 aa, Mycobacterium
GAGKS

SEQ ID NO: 902353 - protein, 13 aa, Mycobacterium
GAGLASADPVTDE

SEQ ID NO: 902354 - protein, 9 aa, Mycobacterium
GAGLGENTA

SEQ ID NO: 902355 - protein, 12 aa, Mycobacterium
GAGLSAQASAAL

SEQ ID NO: 902356 - protein, 4 aa, Mycobacterium
GAGM

SEQ ID NO: 902357 - protein, 4 aa, Mycobacterium
GAGN

SEQ ID NO: 902358 - protein, 7 aa, Mycobacterium
GAGPCSG

SEQ ID NO: 902359 - protein, 8 aa, Mycobacterium
GAGPCSGQ

SEQ ID NO: 902360 - protein, 6 aa, Mycobacterium
GAGPGT

SEQ ID NO: 902361 - protein, 6 aa, Mycobacterium
GAGPNP

SEQ ID NO: 902362 - protein, 8 aa, Mycobacterium
GAGPTGVE

SEQ ID NO: 902363 - protein, 8 aa, Mycobacterium
GAGQEGEL

SEQ ID NO: 902364 - protein, 21 aa, Mycobacterium
GAGRAAADPVPPPPPLPPPPP

SEQ ID NO: 902365 - protein, 13 aa, Mycobacterium
GAGRAIPSGTCPT

SEQ ID NO: 902366 - protein, 26 aa, Mycobacterium
GAGRGFSSGAGISADDVSDGGGVPPD

SEQ ID NO: 902367 - protein, 15 aa, Mycobacterium
GAGRKVSAGMASYSA

SEQ ID NO: 902368 - protein, 8 aa, Mycobacterium
GAGRNVSA

SEQ ID NO: 902369 - protein, 4 aa, Mycobacterium
GAGS

SEQ ID NO: 902370 - protein, 15 aa, Mycobacterium
GAGSAAAQPCTGPST

SEQ ID NO: 902371 - protein, 11 aa, Mycobacterium
GAGSAAETNLR

SEQ ID NO: 902372 - protein, 9 aa, Mycobacterium
GAGSAPTLA

SEQ ID NO: 902373 - protein, 135 aa, Mycobacterium
GAGSAYADDDGGSGTKDAPTSSATSTGESTASSSDTRTPSKPQVTGGERTAGTTPSGPSGDDEDASAADDAPERGSANKRGEAADEATEATDAGAADEADTAAGEAVDADEPAASEAPDVPTADVPAAEPVPAEV

SEQ ID NO: 902374 - protein, 10 aa, Mycobacterium
GAGSDNTVTL

SEQ ID NO: 902375 - protein, 7 aa, Mycobacterium
GAGSGIG

SEQ ID NO: 902376 - protein, 8 aa, Mycobacterium
GAGSGIGR

SEQ ID NO: 902377 - protein, 7 aa, Mycobacterium
GAGSLGD

SEQ ID NO: 902378 - protein, 8 aa, Mycobacterium
GAGSPAEI

SEQ ID NO: 902379 - protein, 11 aa, Mycobacterium
GAGSPRGSCDT

SEQ ID NO: 902380 - protein, 4 aa, Mycobacterium
GAGT

SEQ ID NO: 902381 - protein, 10 aa, Mycobacterium
GAGTASADPH

SEQ ID NO: 902382 - protein, 6 aa, Mycobacterium
GAGTDR

SEQ ID NO: 902383 - protein, 6 aa, Mycobacterium
GAGTPI

SEQ ID NO: 902384 - protein, 12 aa, Mycobacterium
GAGTPKGSCDTR

SEQ ID NO: 902385 - protein, 6 aa, Mycobacterium
GAGTRW

SEQ ID NO: 902386 - protein, 13 aa, Mycobacterium
GAGVDRKDIRTTD

SEQ ID NO: 902387 - protein, 6 aa, Mycobacterium
GAGVTG

SEQ ID NO: 902388 - protein, 5 aa, Mycobacterium
GAGWP

SEQ ID NO: 902389 - protein, 18 aa, Mycobacterium
GAHGGNAAVYAPKAALGH

SEQ ID NO: 902390 - protein, 8 aa, Mycobacterium
GAHPAPAP

SEQ ID NO: 902391 - protein, 6 aa, Mycobacterium
GAHPTK

SEQ ID NO: 902392 - protein, 5 aa, Mycobacterium
GAHQP

SEQ ID NO: 902393 - protein, 4 aa, Mycobacterium
GAHS

SEQ ID NO: 902394 - protein, 11 aa, Mycobacterium
GAHSAAGADAA

SEQ ID NO: 902395 - protein, 8 aa, Mycobacterium
GAHSRRSG

SEQ ID NO: 902396 - protein, 13 aa, Mycobacterium
GAIGGKTGFTDAA

SEQ ID NO: 902397 - protein, 13 aa, Mycobacterium
GAIGGKTGYTNAA

SEQ ID NO: 902398 - protein, 7 aa, Mycobacterium
GAIKPDQ

SEQ ID NO: 902399 - protein, 32 aa, Mycobacterium
GAIPGLPAAAPAPAAPAPGAPAGPPQTLLAAL

SEQ ID NO: 902400 - protein, 18 aa, Mycobacterium
GAIPPADAPPPADAPPPA

SEQ ID NO: 902401 - protein, 8 aa, Mycobacterium
GAIQTTPS

SEQ ID NO: 902402 - protein, 7 aa, Mycobacterium
GAITGVD

SEQ ID NO: 902403 - protein, 13 aa, Mycobacterium
GAKAKATKQTINT

SEQ ID NO: 902404 - protein, 7 aa, Mycobacterium
GAKARAY

SEQ ID NO: 902405 - protein, 4 aa, Mycobacterium
GAKG

SEQ ID NO: 902406 - protein, 7 aa, Mycobacterium
GAKINEV

SEQ ID NO: 902407 - protein, 11 aa, Mycobacterium
GAKLGDSAIGQ

SEQ ID NO: 902408 - protein, 6 aa, Mycobacterium
GAKMTP

SEQ ID NO: 902409 - protein, 9 aa, Mycobacterium
GAKPPPTFG

SEQ ID NO: 902410 - protein, 9 aa, Mycobacterium
GAKQSDCAG

SEQ ID NO: 902411 - protein, 7 aa, Mycobacterium
GAKVTYN

SEQ ID NO: 902412 - protein, 5 aa, Mycobacterium
GALAA

SEQ ID NO: 902413 - protein, 6 aa, Mycobacterium
GALAAS

SEQ ID NO: 902414 - protein, 8 aa, Mycobacterium
GALAGDAA

SEQ ID NO: 902415 - protein, 16 aa, Mycobacterium
GALDPAANRPDGTDAD

SEQ ID NO: 902416 - protein, 4 aa, Mycobacterium
GALG

SEQ ID NO: 902417 - protein, 7 aa, Mycobacterium
GALGARP

SEQ ID NO: 902418 - protein, 7 aa, Mycobacterium
GALGDLD

SEQ ID NO: 902419 - protein, 13 aa, Mycobacterium
GALGEDAGNRGAT

SEQ ID NO: 902420 - protein, 10 aa, Mycobacterium
GALNSPKSVV

SEQ ID NO: 902421 - protein, 12 aa, Mycobacterium
GALSNARTAVTA

SEQ ID NO: 902422 - protein, 5 aa, Mycobacterium
GALSS

SEQ ID NO: 902423 - protein, 12 aa, Mycobacterium
GALSTPKLPDVP

SEQ ID NO: 902424 - protein, 7 aa, Mycobacterium
GALTGSS

SEQ ID NO: 902425 - protein, 11 aa, Mycobacterium
GAMPKARNLQA

SEQ ID NO: 902426 - protein, 9 aa, Mycobacterium
GANDASRRI

SEQ ID NO: 902427 - protein, 9 aa, Mycobacterium
GANGGSQAV

SEQ ID NO: 902428 - protein, 7 aa, Mycobacterium
GANGPQD

SEQ ID NO: 902429 - protein, 8 aa, Mycobacterium
GANNEDTV

SEQ ID NO: 902430 - protein, 10 aa, Mycobacterium
GANPAQYGNS

SEQ ID NO: 902431 - protein, 15 aa, Mycobacterium
GANPETVTYTSGDED

SEQ ID NO: 902432 - protein, 5 aa, Mycobacterium
GANPG

SEQ ID NO: 902433 - protein, 9 aa, Mycobacterium
GANPTGVSY

SEQ ID NO: 902434 - protein, 5 aa, Mycobacterium
GANPV

SEQ ID NO: 902435 - protein, 4 aa, Mycobacterium
GANS

SEQ ID NO: 902436 - protein, 8 aa, Mycobacterium
GANSGLGI

SEQ ID NO: 902437 - protein, 6 aa, Mycobacterium
GANSIT

SEQ ID NO: 902438 - protein, 21 aa, Mycobacterium
GANTLTPAAPGGHDPGNAEAQ

SEQ ID NO: 902439 - protein, 8 aa, Mycobacterium
GANTPPSI

SEQ ID NO: 902440 - protein, 16 aa, Mycobacterium
GANYGWPEAEGRGGIE

SEQ ID NO: 902441 - protein, 16 aa, Mycobacterium
GAPAAAAAPDCSPEGV

SEQ ID NO: 902442 - protein, 7 aa, Mycobacterium
GAPAAAQ

SEQ ID NO: 902443 - protein, 9 aa, Mycobacterium
GAPAAGAAP

SEQ ID NO: 902444 - protein, 9 aa, Mycobacterium
GAPAAVEAA

SEQ ID NO: 902445 - protein, 5 aa, Mycobacterium
GAPAL

SEQ ID NO: 902446 - protein, 6 aa, Mycobacterium
GAPAPA

SEQ ID NO: 902447 - protein, 12 aa, Mycobacterium
GAPAVQAAPGCR

SEQ ID NO: 902448 - protein, 10 aa, Mycobacterium
GAPCGPGPTV

SEQ ID NO: 902449 - protein, 5 aa, Mycobacterium
GAPDA

SEQ ID NO: 902450 - protein, 24 aa, Mycobacterium
GAPDALGAHPASIAAATAGSPNCR

SEQ ID NO: 902451 - protein, 7 aa, Mycobacterium
GAPDDVH

SEQ ID NO: 902452 - protein, 10 aa, Mycobacterium
GAPDGSDGRR

SEQ ID NO: 902453 - protein, 5 aa, Mycobacterium
GAPDM

SEQ ID NO: 902454 - protein, 6 aa, Mycobacterium
GAPDTW

SEQ ID NO: 902455 - protein, 12 aa, Mycobacterium
GAPDTWTPRRSD

SEQ ID NO: 902456 - protein, 8 aa, Mycobacterium
GAPEAPGQ

SEQ ID NO: 902457 - protein, 5 aa, Mycobacterium
GAPEQ

SEQ ID NO: 902458 - protein, 5 aa, Mycobacterium
GAPGA

SEQ ID NO: 902459 - protein, 11 aa, Mycobacterium
GAPGACNPDGD

SEQ ID NO: 902460 - protein, 14 aa, Mycobacterium
GAPGAGVAPPQPGI

SEQ ID NO: 902461 - protein, 6 aa, Mycobacterium
GAPGAV

SEQ ID NO: 902462 - protein, 7 aa, Mycobacterium
GAPGDDG

SEQ ID NO: 902463 - protein, 9 aa, Mycobacterium
GAPGPGEFG

SEQ ID NO: 902464 - protein, 8 aa, Mycobacterium
GAPGPVVT

SEQ ID NO: 902465 - protein, 13 aa, Mycobacterium
GAPGQPPDNAGPR

SEQ ID NO: 902466 - protein, 7 aa, Mycobacterium
GAPGQWS

SEQ ID NO: 902467 - protein, 12 aa, Mycobacterium
GAPGRASADPGI

SEQ ID NO: 902468 - protein, 6 aa, Mycobacterium
GAPGSI

SEQ ID NO: 902469 - protein, 6 aa, Mycobacterium
GAPHAN

SEQ ID NO: 902470 - protein, 11 aa, Mycobacterium
GAPINSATAMS

SEQ ID NO: 902471 - protein, 9 aa, Mycobacterium
GAPIPGPPN

SEQ ID NO: 902472 - protein, 6 aa, Mycobacterium
GAPIRG

SEQ ID NO: 902473 - protein, 7 aa, Mycobacterium
GAPKGTI

SEQ ID NO: 902474 - protein, 16 aa, Mycobacterium
GAPKQSPSVTDDEPTR

SEQ ID NO: 902475 - protein, 6 aa, Mycobacterium
GAPLDD

SEQ ID NO: 902476 - protein, 5 aa, Mycobacterium
GAPLL

SEQ ID NO: 902477 - protein, 7 aa, Mycobacterium
GAPLPGL

SEQ ID NO: 902478 - protein, 5 aa, Mycobacterium
GAPMT

SEQ ID NO: 902479 - protein, 20 aa, Mycobacterium
GAPNGLNPAPIPQGSESTGT

SEQ ID NO: 902480 - protein, 8 aa, Mycobacterium
GAPNHGGT

SEQ ID NO: 902481 - protein, 4 aa, Mycobacterium
GAPP

SEQ ID NO: 902482 - protein, 14 aa, Mycobacterium
GAPPAAADNCSGPL

SEQ ID NO: 902483 - protein, 26 aa, Mycobacterium
GAPPAAADPCSVPTPNASARGLTPSM

SEQ ID NO: 902484 - protein, 7 aa, Mycobacterium
GAPPAGV

SEQ ID NO: 902485 - protein, 7 aa, Mycobacterium
GAPPAKQ

SEQ ID NO: 902486 - protein, 7 aa, Mycobacterium
GAPPAQL

SEQ ID NO: 902487 - protein, 6 aa, Mycobacterium
GAPPDA

SEQ ID NO: 902488 - protein, 7 aa, Mycobacterium
GAPPEPR

SEQ ID NO: 902489 - protein, 5 aa, Mycobacterium
GAPPF

SEQ ID NO: 902490 - protein, 16 aa, Mycobacterium
GAPPGHASTDCSQEGI

SEQ ID NO: 902491 - protein, 11 aa, Mycobacterium
GAPPLNPRQQA

SEQ ID NO: 902492 - protein, 8 aa, Mycobacterium
GAPPPPGE

SEQ ID NO: 902493 - protein, 7 aa, Mycobacterium
GAPPTSQ

SEQ ID NO: 902494 - protein, 8 aa, Mycobacterium
GAPPVKPD

SEQ ID NO: 902495 - protein, 10 aa, Mycobacterium
GAPPVQAAPG

SEQ ID NO: 902496 - protein, 11 aa, Mycobacterium
GAPQDDLPAAV

SEQ ID NO: 902497 - protein, 7 aa, Mycobacterium
GAPQPTF

SEQ ID NO: 902498 - protein, 7 aa, Mycobacterium
GAPRAMA

SEQ ID NO: 902499 - protein, 7 aa, Mycobacterium
GAPRDPE

SEQ ID NO: 902500 - protein, 7 aa, Mycobacterium
GAPRGRR

SEQ ID NO: 902501 - protein, 5 aa, Mycobacterium
GAPRL

SEQ ID NO: 902502 - protein, 40 aa, Mycobacterium
GAPSAPTPPAGTDAPAAPPEDGAAGDSAVQPLDRDEVGAT

SEQ ID NO: 902503 - protein, 11 aa, Mycobacterium
GAPTAAADPCS

SEQ ID NO: 902504 - protein, 14 aa, Mycobacterium
GAPTAPEDSAAGDA

SEQ ID NO: 902505 - protein, 17 aa, Mycobacterium
GAPTSPEADGADGARYA

SEQ ID NO: 902506 - protein, 14 aa, Mycobacterium
GAPTSPEAEAAGAA

SEQ ID NO: 902507 - protein, 5 aa, Mycobacterium
GAPTT

SEQ ID NO: 902508 - protein, 9 aa, Mycobacterium
GAPTTPKIV

SEQ ID NO: 902509 - protein, 5 aa, Mycobacterium
GAPTV

SEQ ID NO: 902510 - protein, 22 aa, Mycobacterium
GAPVGDSKYRQQFTADRKAVPA

SEQ ID NO: 902511 - protein, 12 aa, Mycobacterium
GAPVGSPTMDPR

SEQ ID NO: 902512 - protein, 6 aa, Mycobacterium
GAPVKA

SEQ ID NO: 902513 - protein, 16 aa, Mycobacterium
GAPVPPATSPPPASTL

SEQ ID NO: 902514 - protein, 4 aa, Mycobacterium
GAPY

SEQ ID NO: 902515 - protein, 7 aa, Mycobacterium
GAPYGIP

SEQ ID NO: 902516 - protein, 5 aa, Mycobacterium
GAQAG

SEQ ID NO: 902517 - protein, 9 aa, Mycobacterium
GAQDAIQSV

SEQ ID NO: 902518 - protein, 7 aa, Mycobacterium
GAQDSEA

SEQ ID NO: 902519 - protein, 5 aa, Mycobacterium
GAQDY

SEQ ID NO: 902520 - protein, 7 aa, Mycobacterium
GAQEKQI

SEQ ID NO: 902521 - protein, 9 aa, Mycobacterium
GAQESSPTA

SEQ ID NO: 902522 - protein, 12 aa, Mycobacterium
GAQFREKDGKRL

SEQ ID NO: 902523 - protein, 8 aa, Mycobacterium
GAQGADRE

SEQ ID NO: 902524 - protein, 5 aa, Mycobacterium
GAQGF

SEQ ID NO: 902525 - protein, 48 aa, Mycobacterium
GAQGVANADPITPPPPPPIPQAPPIPDGNGVPPVPQAPPIPQIPAIPQ

SEQ ID NO: 902526 - protein, 4 aa, Mycobacterium
GAQP

SEQ ID NO: 902527 - protein, 6 aa, Mycobacterium
GAQPDG

SEQ ID NO: 902528 - protein, 6 aa, Mycobacterium
GAQPLT

SEQ ID NO: 902529 - protein, 9 aa, Mycobacterium
GAQPTADRR

SEQ ID NO: 902530 - protein, 5 aa, Mycobacterium
GAQRG

SEQ ID NO: 902531 - protein, 8 aa, Mycobacterium
GAQRPTRV

SEQ ID NO: 902532 - protein, 6 aa, Mycobacterium
GAQRPV

SEQ ID NO: 902533 - protein, 6 aa, Mycobacterium
GAQRQE

SEQ ID NO: 902534 - protein, 18 aa, Mycobacterium
GAQSDKPLNIPGEDLPGS

SEQ ID NO: 902535 - protein, 7 aa, Mycobacterium
GAQSSTF

SEQ ID NO: 902536 - protein, 7 aa, Mycobacterium
GAQSTTE

SEQ ID NO: 902537 - protein, 10 aa, Mycobacterium
GARAAPTNVT

SEQ ID NO: 902538 - protein, 8 aa, Mycobacterium
GARADRGL

SEQ ID NO: 902539 - protein, 16 aa, Mycobacterium
GARANLAAEGGASFDD

SEQ ID NO: 902540 - protein, 15 aa, Mycobacterium
GARANLAAEGGRSFD

SEQ ID NO: 902541 - protein, 6 aa, Mycobacterium
GARATA

SEQ ID NO: 902542 - protein, 8 aa, Mycobacterium
GARDIAGK

SEQ ID NO: 902543 - protein, 9 aa, Mycobacterium
GARERPRSA

SEQ ID NO: 902544 - protein, 8 aa, Mycobacterium
GARGIGAA

SEQ ID NO: 902545 - protein, 7 aa, Mycobacterium
GARGRKE

SEQ ID NO: 902546 - protein, 11 aa, Mycobacterium
GARGSGRDVPG

SEQ ID NO: 902547 - protein, 29 aa, Mycobacterium
GARGSRVSADVAAEGRAGYAAPGDHGSTF

SEQ ID NO: 902548 - protein, 4 aa, Mycobacterium
GARM

SEQ ID NO: 902549 - protein, 6 aa, Mycobacterium
GARNAL

SEQ ID NO: 902550 - protein, 7 aa, Mycobacterium
GARPEQF

SEQ ID NO: 902551 - protein, 7 aa, Mycobacterium
GARPGWH

SEQ ID NO: 902552 - protein, 24 aa, Mycobacterium
GARPPGPTTSVSKPAAAPAPPACG

SEQ ID NO: 902553 - protein, 6 aa, Mycobacterium
GARPSP

SEQ ID NO: 902554 - protein, 7 aa, Mycobacterium
GARQRGV

SEQ ID NO: 902555 - protein, 9 aa, Mycobacterium
GARRRGDPW

SEQ ID NO: 902556 - protein, 8 aa, Mycobacterium
GARSSLGR

SEQ ID NO: 902557 - protein, 7 aa, Mycobacterium
GARSTLG

SEQ ID NO: 902558 - protein, 8 aa, Mycobacterium
GARSTLGR

SEQ ID NO: 902559 - protein, 5 aa, Mycobacterium
GARTA

SEQ ID NO: 902560 - protein, 11 aa, Mycobacterium
GARTALPRQQT

SEQ ID NO: 902561 - protein, 11 aa, Mycobacterium
GARTAVRRQQT

SEQ ID NO: 902562 - protein, 9 aa, Mycobacterium
GARTGPTTH

SEQ ID NO: 902563 - protein, 8 aa, Mycobacterium
GARTGSAT

SEQ ID NO: 902564 - protein, 4 aa, Mycobacterium
GARV

SEQ ID NO: 902565 - protein, 10 aa, Mycobacterium
GASAAATTLT

SEQ ID NO: 902566 - protein, 17 aa, Mycobacterium
GASAAEAAAAGTEAGRE

SEQ ID NO: 902567 - protein, 5 aa, Mycobacterium
GASAD

SEQ ID NO: 902568 - protein, 17 aa, Mycobacterium
GASADQSRGVADGKPAD

SEQ ID NO: 902569 - protein, 18 aa, Mycobacterium
GASADSLPTGLAAGSDGR

SEQ ID NO: 902570 - protein, 17 aa, Mycobacterium
GASAPEGATKTRPGRAA

SEQ ID NO: 902571 - protein, 17 aa, Mycobacterium
GASAPPHHGSSDAAVTP

SEQ ID NO: 902572 - protein, 12 aa, Mycobacterium
GASAPTHTPTRD

SEQ ID NO: 902573 - protein, 5 aa, Mycobacterium
GASAV

SEQ ID NO: 902574 - protein, 7 aa, Mycobacterium
GASAVPS

SEQ ID NO: 902575 - protein, 17 aa, Mycobacterium
GASAYTGAEAANASPLQ

SEQ ID NO: 902576 - protein, 16 aa, Mycobacterium
GASCPGPNSAAQTEDG

SEQ ID NO: 902577 - protein, 5 aa, Mycobacterium
GASEV

SEQ ID NO: 902578 - protein, 14 aa, Mycobacterium
GASFPYRKDPNDTN

SEQ ID NO: 902579 - protein, 7 aa, Mycobacterium
GASGIGA

SEQ ID NO: 902580 - protein, 13 aa, Mycobacterium
GASGPAGPAPRQV

SEQ ID NO: 902581 - protein, 12 aa, Mycobacterium
GASKAAVKAMTT

SEQ ID NO: 902582 - protein, 49 aa, Mycobacterium
GASKARGTWQASRASAGYSSAARRAGDRAGKRARLGNSPELPGARSALS

SEQ ID NO: 902583 - protein, 10 aa, Mycobacterium
GASLAGNSRA

SEQ ID NO: 902584 - protein, 12 aa, Mycobacterium
GASLAGNSRATI

SEQ ID NO: 902585 - protein, 12 aa, Mycobacterium
GASLAGNSRSTI

SEQ ID NO: 902586 - protein, 9 aa, Mycobacterium
GASPAPATA

SEQ ID NO: 902587 - protein, 6 aa, Mycobacterium
GASPQQ

SEQ ID NO: 902588 - protein, 7 aa, Mycobacterium
GASPQQL

SEQ ID NO: 902589 - protein, 8 aa, Mycobacterium
GASPTGRD

SEQ ID NO: 902590 - protein, 11 aa, Mycobacterium
GASQGGQATWA

SEQ ID NO: 902591 - protein, 9 aa, Mycobacterium
GASRARGTW

SEQ ID NO: 902592 - protein, 10 aa, Mycobacterium
GASRGAGRGI

SEQ ID NO: 902593 - protein, 25 aa, Mycobacterium
GASRGDPGPFVNGNGPELAEGDSLS

SEQ ID NO: 902594 - protein, 7 aa, Mycobacterium
GASRNGR

SEQ ID NO: 902595 - protein, 9 aa, Mycobacterium
GASRRPPAA

SEQ ID NO: 902596 - protein, 7 aa, Mycobacterium
GASSDSV

SEQ ID NO: 902597 - protein, 7 aa, Mycobacterium
GASSGIG

SEQ ID NO: 902598 - protein, 10 aa, Mycobacterium
GASSGIGAAT

SEQ ID NO: 902599 - protein, 11 aa, Mycobacterium
GASSGIGAATA

SEQ ID NO: 902600 - protein, 6 aa, Mycobacterium
GASTAN

SEQ ID NO: 902601 - protein, 7 aa, Mycobacterium
GASTANG

SEQ ID NO: 902602 - protein, 8 aa, Mycobacterium
GASTANGT

SEQ ID NO: 902603 - protein, 8 aa, Mycobacterium
GASTGLGP

SEQ ID NO: 902604 - protein, 7 aa, Mycobacterium
GASTRGI

SEQ ID NO: 902605 - protein, 20 aa, Mycobacterium
GASVDPDRLADPETPLAELV

SEQ ID NO: 902606 - protein, 15 aa, Mycobacterium
GASVTNMTNTPGSFG

SEQ ID NO: 902607 - protein, 11 aa, Mycobacterium
GASYESSNYLS

SEQ ID NO: 902608 - protein, 7 aa, Mycobacterium
GASYGGG

SEQ ID NO: 902609 - protein, 6 aa, Mycobacterium
GATAAA

SEQ ID NO: 902610 - protein, 7 aa, Mycobacterium
GATAMDD

SEQ ID NO: 902611 - protein, 14 aa, Mycobacterium
GATAPASYGKTPAV

SEQ ID NO: 902612 - protein, 14 aa, Mycobacterium
GATARPTRRVVAVW

SEQ ID NO: 902613 - protein, 8 aa, Mycobacterium
GATATPAR

SEQ ID NO: 902614 - protein, 7 aa, Mycobacterium
GATDRGR

SEQ ID NO: 902615 - protein, 8 aa, Mycobacterium
GATDTPVE

SEQ ID NO: 902616 - protein, 5 aa, Mycobacterium
GATET

SEQ ID NO: 902617 - protein, 9 aa, Mycobacterium
GATFKGQGN

SEQ ID NO: 902618 - protein, 16 aa, Mycobacterium
GATGAGRGVGSGPRYG

SEQ ID NO: 902619 - protein, 5 aa, Mycobacterium
GATGD

SEQ ID NO: 902620 - protein, 5 aa, Mycobacterium
GATGE

SEQ ID NO: 902621 - protein, 8 aa, Mycobacterium
GATGFGET

SEQ ID NO: 902622 - protein, 18 aa, Mycobacterium
GATGIGAATAERLATEGA

SEQ ID NO: 902623 - protein, 5 aa, Mycobacterium
GATGK

SEQ ID NO: 902624 - protein, 6 aa, Mycobacterium
GATGLP

SEQ ID NO: 902625 - protein, 11 aa, Mycobacterium
GATGLTDKQIR

SEQ ID NO: 902626 - protein, 6 aa, Mycobacterium
GATGRL

SEQ ID NO: 902627 - protein, 8 aa, Mycobacterium
GATGSSPD

SEQ ID NO: 902628 - protein, 7 aa, Mycobacterium
GATIATG

SEQ ID NO: 902629 - protein, 4 aa, Mycobacterium
GATK

SEQ ID NO: 902630 - protein, 6 aa, Mycobacterium
GATKAS

SEQ ID NO: 902631 - protein, 9 aa, Mycobacterium
GATKGGAGL

SEQ ID NO: 902632 - protein, 10 aa, Mycobacterium
GATLGGGTDV

SEQ ID NO: 902633 - protein, 8 aa, Mycobacterium
GATLPSAP

SEQ ID NO: 902634 - protein, 23 aa, Mycobacterium
GATPEPGAGQTPAPKPSAALPQT

SEQ ID NO: 902635 - protein, 11 aa, Mycobacterium
GATPESAGTLD

SEQ ID NO: 902636 - protein, 21 aa, Mycobacterium
GATPGAGPATASAAGNGTGQG

SEQ ID NO: 902637 - protein, 14 aa, Mycobacterium
GATPGGGGNGTTQG

SEQ ID NO: 902638 - protein, 15 aa, Mycobacterium
GATPNNGVDGAPGDL

SEQ ID NO: 902639 - protein, 11 aa, Mycobacterium
GATPPNSPYAT

SEQ ID NO: 902640 - protein, 5 aa, Mycobacterium
GATPR

SEQ ID NO: 902641 - protein, 8 aa, Mycobacterium
GATPSGEL

SEQ ID NO: 902642 - protein, 16 aa, Mycobacterium
GATQAQVPRNAIPPLA

SEQ ID NO: 902643 - protein, 7 aa, Mycobacterium
GATSPAL

SEQ ID NO: 902644 - protein, 17 aa, Mycobacterium
GATSQQVREDLGARDNA

SEQ ID NO: 902645 - protein, 14 aa, Mycobacterium
GATTDGGGTAPPMS

SEQ ID NO: 902646 - protein, 10 aa, Mycobacterium
GATTDRSGRI

SEQ ID NO: 902647 - protein, 20 aa, Mycobacterium
GATTFAGQAAADPPPPNLDG

SEQ ID NO: 902648 - protein, 10 aa, Mycobacterium
GATTGGPGNE

SEQ ID NO: 902649 - protein, 6 aa, Mycobacterium
GATTRQ

SEQ ID NO: 902650 - protein, 4 aa, Mycobacterium
GATV

SEQ ID NO: 902651 - protein, 12 aa, Mycobacterium
GATVQSEPSWAT

SEQ ID NO: 902652 - protein, 15 aa, Mycobacterium
GAVAGGTADGVRQAT

SEQ ID NO: 902653 - protein, 8 aa, Mycobacterium
GAVDAVTT

SEQ ID NO: 902654 - protein, 10 aa, Mycobacterium
GAVGRGPGAS

SEQ ID NO: 902655 - protein, 68 aa, Mycobacterium
GAVPGGPGGVAGPGGAAGAIPGGPAGAAGPGGASGAIPGGPSGAAGPGGATGAIPGGPSGTAGPGGAA

SEQ ID NO: 902656 - protein, 8 aa, Mycobacterium
GAVPGGTV

SEQ ID NO: 902657 - protein, 7 aa, Mycobacterium
GAVRTTD

SEQ ID NO: 902658 - protein, 5 aa, Mycobacterium
GAVSN

SEQ ID NO: 902659 - protein, 9 aa, Mycobacterium
GAWGGRDDG

SEQ ID NO: 902660 - protein, 4 aa, Mycobacterium
GAYG

SEQ ID NO: 902661 - protein, 9 aa, Mycobacterium
GAYGDAAPD

SEQ ID NO: 902662 - protein, 5 aa, Mycobacterium
GAYHS

SEQ ID NO: 902663 - protein, 4 aa, Mycobacterium
GAYQ

SEQ ID NO: 902664 - protein, 7 aa, Mycobacterium
GAYSPPA

SEQ ID NO: 902665 - protein, 18 aa, Mycobacterium
GCAASGNRPQSTTTQTMP

SEQ ID NO: 902666 - protein, 28 aa, Mycobacterium
GCAGGDDTADAQRSAQPSQTFADEPPPL

SEQ ID NO: 902667 - protein, 7 aa, Mycobacterium
GCAPDDD

SEQ ID NO: 902668 - protein, 23 aa, Mycobacterium
GCAPVKSDALDEQAVSAADTATV

SEQ ID NO: 902669 - protein, 7 aa, Mycobacterium
GCARSDD

SEQ ID NO: 902670 - protein, 12 aa, Mycobacterium
GCASGSSGAALA

SEQ ID NO: 902671 - protein, 7 aa, Mycobacterium
GCCDGSS

SEQ ID NO: 902672 - protein, 12 aa, Mycobacterium
GCCGRSARDGVD

SEQ ID NO: 902673 - protein, 7 aa, Mycobacterium
GCDGPCR

SEQ ID NO: 902674 - protein, 4 aa, Mycobacterium
GCEP

SEQ ID NO: 902675 - protein, 4 aa, Mycobacterium
GCFP

SEQ ID NO: 902676 - protein, 14 aa, Mycobacterium
GCGADQAPTAASRS

SEQ ID NO: 902677 - protein, 36 aa, Mycobacterium
GCGEDKNSTAPSGPAASSSAAVSSSAPSSPGAPANY

SEQ ID NO: 902678 - protein, 22 aa, Mycobacterium
GCGGGGDEASGDGSTGPQIPES

SEQ ID NO: 902679 - protein, 8 aa, Mycobacterium
GCGGPPCK

SEQ ID NO: 902680 - protein, 12 aa, Mycobacterium
GCGGQSGTPPIR

SEQ ID NO: 902681 - protein, 37 aa, Mycobacterium
GCGGSDKSETTGETSSAAAAEGKSTVTIDGADQEVTG

SEQ ID NO: 902682 - protein, 24 aa, Mycobacterium
GCGPPSASTSGVLTTETAGCPDGR

SEQ ID NO: 902683 - protein, 21 aa, Mycobacterium
GCGRPGTDHATPDAPPPPAAK

SEQ ID NO: 902684 - protein, 42 aa, Mycobacterium
GCGSDNNATGGSGATSGSSSGNVACGGKKTLKASGSTAQANA

SEQ ID NO: 902685 - protein, 41 aa, Mycobacterium
GCGSDNNGSGASGPTGSSSGKVNCGGKKALKASGSTAQANA

SEQ ID NO: 902686 - protein, 46 aa, Mycobacterium
GCGSGDSTVAKTPQATTTTETPSITAPAQPSGAAAPPGSVAAPADP

SEQ ID NO: 902687 - protein, 23 aa, Mycobacterium
GCGSGKPGAKSATPSLVTPTTQI

SEQ ID NO: 902688 - protein, 115 aa, Mycobacterium
GCGTNNDGGPTSTSTTTTTTTTTTTTITPAPSGAPEGTPAPGPTGGGGPDGGSGAIPGGPTGGGGPEGGSGSIPGGPTGGGGPEGGGGHIPGVGGGHGGPGGGGGCVDNVGCVSI

SEQ ID NO: 902689 - protein, 12 aa, Mycobacterium
GCGTPPPPPDLD

SEQ ID NO: 902690 - protein, 9 aa, Mycobacterium
GCGTTDSGA

SEQ ID NO: 902691 - protein, 7 aa, Mycobacterium
GCNGPCK

SEQ ID NO: 902692 - protein, 7 aa, Mycobacterium
GCPAGPD

SEQ ID NO: 902693 - protein, 4 aa, Mycobacterium
GCPD

SEQ ID NO: 902694 - protein, 9 aa, Mycobacterium
GCPLGTDPA

SEQ ID NO: 902695 - protein, 9 aa, Mycobacterium
GCQGDPTMD

SEQ ID NO: 902696 - protein, 16 aa, Mycobacterium
GCRTNKESLMSEGPPW

SEQ ID NO: 902697 - protein, 7 aa, Mycobacterium
GCSGDDS

SEQ ID NO: 902698 - protein, 40 aa, Mycobacterium
GCSGDNNVAGKSAAPGTTSAQVTCGGKRTLAASGSTAQEN

SEQ ID NO: 902699 - protein, 20 aa, Mycobacterium
GCSGKGGQPASTTSSTPVSV

SEQ ID NO: 902700 - protein, 17 aa, Mycobacterium
GCSGTEKGETSSAPSSR

SEQ ID NO: 902701 - protein, 27 aa, Mycobacterium
GCSNSGANQPGATISSTPGNAAGKHGP

SEQ ID NO: 902702 - protein, 26 aa, Mycobacterium
GCSNSGDNNPGATASSTPGSSEGRHG

SEQ ID NO: 902703 - protein, 19 aa, Mycobacterium
GCSPDQQASTTPGTTPPVW

SEQ ID NO: 902704 - protein, 8 aa, Mycobacterium
GCSRTTEG

SEQ ID NO: 902705 - protein, 46 aa, Mycobacterium
GCSSDDKSAEASEASPTANATVDSTASPGTSVAAGDATATTGTGTA

SEQ ID NO: 902706 - protein, 13 aa, Mycobacterium
GCSSGDDAVAQGG

SEQ ID NO: 902707 - protein, 11 aa, Mycobacterium
GCSSGSDDGRT

SEQ ID NO: 902708 - protein, 31 aa, Mycobacterium
GCSSQDSNDAGQSPATESDGPAATPVEADQG

SEQ ID NO: 902709 - protein, 18 aa, Mycobacterium
GCSSSPTPSANAANPQRR

SEQ ID NO: 902710 - protein, 24 aa, Mycobacterium
GCSSSSESPSDEGSPTAVAPAEKV

SEQ ID NO: 902711 - protein, 20 aa, Mycobacterium
GCSTDRPTSPASGDHGSGCR

SEQ ID NO: 902712 - protein, 13 aa, Mycobacterium
GCSTGDDAVAQGG

SEQ ID NO: 902713 - protein, 7 aa, Mycobacterium
GCSTNGL

SEQ ID NO: 902714 - protein, 20 aa, Mycobacterium
GCSTQRESPVEPVVPTYPEE

SEQ ID NO: 902715 - protein, 7 aa, Mycobacterium
GCTDPGR

SEQ ID NO: 902716 - protein, 7 aa, Mycobacterium
GCTHPGC

SEQ ID NO: 902717 - protein, 19 aa, Mycobacterium
GCTPKEPAQGGAAGGGQEI

SEQ ID NO: 902718 - protein, 9 aa, Mycobacterium
GCTPTMPPH

SEQ ID NO: 902719 - protein, 11 aa, Mycobacterium
GCTRPGCTANG

SEQ ID NO: 902720 - protein, 49 aa, Mycobacterium
GCTSQQGTTETSATPTTTTRSVNPPAPSLPDSGPAGLTGWPGQDKITEE

SEQ ID NO: 902721 - protein, 19 aa, Mycobacterium
GCTSTSASDAGQAAAPGFP

SEQ ID NO: 902722 - protein, 5 aa, Mycobacterium
GDAAA

SEQ ID NO: 902723 - protein, 5 aa, Mycobacterium
GDAAP

SEQ ID NO: 902724 - protein, 12 aa, Mycobacterium
GDAARAAQVDPN

SEQ ID NO: 902725 - protein, 18 aa, Mycobacterium
GDAATAAATAAATTPQPF

SEQ ID NO: 902726 - protein, 9 aa, Mycobacterium
GDAEDRLDT

SEQ ID NO: 902727 - protein, 16 aa, Mycobacterium
GDAEPFTSGRTAAPQQ

SEQ ID NO: 902728 - protein, 39 aa, Mycobacterium
GDAEVSSDGGSFTISGTADGAFDDTPSEAVSAKFRIEAD

SEQ ID NO: 902729 - protein, 4 aa, Mycobacterium
GDAG

SEQ ID NO: 902730 - protein, 9 aa, Mycobacterium
GDAGDRQFG

SEQ ID NO: 902731 - protein, 8 aa, Mycobacterium
GDAGGYDA

SEQ ID NO: 902732 - protein, 9 aa, Mycobacterium
GDAGGYKAD

SEQ ID NO: 902733 - protein, 10 aa, Mycobacterium
GDAGTSSRAR

SEQ ID NO: 902734 - protein, 15 aa, Mycobacterium
GDAHADVTNDAYTIT

SEQ ID NO: 902735 - protein, 11 aa, Mycobacterium
GDAKPPPPGVS

SEQ ID NO: 902736 - protein, 9 aa, Mycobacterium
GDANSSPPL

SEQ ID NO: 902737 - protein, 4 aa, Mycobacterium
GDAP

SEQ ID NO: 902738 - protein, 7 aa, Mycobacterium
GDAPDSV

SEQ ID NO: 902739 - protein, 6 aa, Mycobacterium
GDAPIW

SEQ ID NO: 902740 - protein, 6 aa, Mycobacterium
GDAQDW

SEQ ID NO: 902741 - protein, 6 aa, Mycobacterium
GDAQRE

SEQ ID NO: 902742 - protein, 5 aa, Mycobacterium
GDARV

SEQ ID NO: 902743 - protein, 8 aa, Mycobacterium
GDASGPNF

SEQ ID NO: 902744 - protein, 15 aa, Mycobacterium
GDASRSILAESGFAK

SEQ ID NO: 902745 - protein, 13 aa, Mycobacterium
GDATDLDATRNGF

SEQ ID NO: 902746 - protein, 13 aa, Mycobacterium
GDATDLDKDRNGL

SEQ ID NO: 902747 - protein, 6 aa, Mycobacterium
GDATIT

SEQ ID NO: 902748 - protein, 7 aa, Mycobacterium
GDATKSD

SEQ ID NO: 902749 - protein, 8 aa, Mycobacterium
GDAVGEDT

SEQ ID NO: 902750 - protein, 5 aa, Mycobacterium
GDAVR

SEQ ID NO: 902751 - protein, 4 aa, Mycobacterium
GDCD

SEQ ID NO: 902752 - protein, 6 aa, Mycobacterium
GDCPNY

SEQ ID NO: 902753 - protein, 6 aa, Mycobacterium
GDDDGA

SEQ ID NO: 902754 - protein, 7 aa, Mycobacterium
GDDGAEQ

SEQ ID NO: 902755 - protein, 6 aa, Mycobacterium
GDDGAR

SEQ ID NO: 902756 - protein, 6 aa, Mycobacterium
GDDGEL

SEQ ID NO: 902757 - protein, 5 aa, Mycobacterium
GDDGI

SEQ ID NO: 902758 - protein, 10 aa, Mycobacterium
GDDGKPGNLA

SEQ ID NO: 902759 - protein, 6 aa, Mycobacterium
GDDGPV

SEQ ID NO: 902760 - protein, 9 aa, Mycobacterium
GDDGTHSAE

SEQ ID NO: 902761 - protein, 6 aa, Mycobacterium
GDDNKI

SEQ ID NO: 902762 - protein, 6 aa, Mycobacterium
GDDPAW

SEQ ID NO: 902763 - protein, 5 aa, Mycobacterium
GDDPL

SEQ ID NO: 902764 - protein, 4 aa, Mycobacterium
GDDS

SEQ ID NO: 902765 - protein, 10 aa, Mycobacterium
GDDSATTLAG

SEQ ID NO: 902766 - protein, 14 aa, Mycobacterium
GDDSTGGPESSRNV

SEQ ID NO: 902767 - protein, 8 aa, Mycobacterium
GDDSTSAL

SEQ ID NO: 902768 - protein, 10 aa, Mycobacterium
GDDYTGNGKR

SEQ ID NO: 902769 - protein, 4 aa, Mycobacterium
GDEA

SEQ ID NO: 902770 - protein, 10 aa, Mycobacterium
GDEDGRSGLE

SEQ ID NO: 902771 - protein, 5 aa, Mycobacterium
GDEDI

SEQ ID NO: 902772 - protein, 8 aa, Mycobacterium
GDEGGGAW

SEQ ID NO: 902773 - protein, 6 aa, Mycobacterium
GDEGVE

SEQ ID NO: 902774 - protein, 8 aa, Mycobacterium
GDELTDEP

SEQ ID NO: 902775 - protein, 15 aa, Mycobacterium
GDEPLPGPPPPGGCD

SEQ ID NO: 902776 - protein, 27 aa, Mycobacterium
GDEPLPGPPPPGGCDGAIPPADAPPPA

SEQ ID NO: 902777 - protein, 8 aa, Mycobacterium
GDETVGGY

SEQ ID NO: 902778 - protein, 8 aa, Mycobacterium
GDEVPSDK

SEQ ID NO: 902779 - protein, 5 aa, Mycobacterium
GDEVS

SEQ ID NO: 902780 - protein, 6 aa, Mycobacterium
GDFQGT

SEQ ID NO: 902781 - protein, 6 aa, Mycobacterium
GDGADI

SEQ ID NO: 902782 - protein, 5 aa, Mycobacterium
GDGAG

SEQ ID NO: 902783 - protein, 7 aa, Mycobacterium
GDGANDM

SEQ ID NO: 902784 - protein, 46 aa, Mycobacterium
GDGAPVSGRAGRTRAAGPTVAAGATGSAVAPVAGQGTTQATGPAIA

SEQ ID NO: 902785 - protein, 9 aa, Mycobacterium
GDGAQAQRD

SEQ ID NO: 902786 - protein, 10 aa, Mycobacterium
GDGAYTGAGT

SEQ ID NO: 902787 - protein, 14 aa, Mycobacterium
GDGDLYGGTEPART

SEQ ID NO: 902788 - protein, 10 aa, Mycobacterium
GDGEPAWTAG

SEQ ID NO: 902789 - protein, 24 aa, Mycobacterium
GDGGDGAHGGDGTPDGASGTGGSG

SEQ ID NO: 902790 - protein, 263 aa, Mycobacterium
GDGGHGGTGGTGGTGGAGGSGVGSGLAGGAGGDGGAGGAAGRGGAAGAGGPLVTPGHAGNTGTGGTGGTGGTGGNGDLHTNGGNGGTGGSGGAGIAGVGGGNGGTGGDGGKGGTGANGAPLGASGGTGGDGGKGGGGGNATDGGHGGNGGTGGTAGDGGNGQSGDLNANGGGGGRGGTGGAGGIGGTTTGGGDAGAGGGGGAGGTGGSGGEGGAGGFGGDGGAGGTGGKAGAGGDGGNATDGGNAGAGGDGGTGGAGGTGGGI

SEQ ID NO: 902791 - protein, 10 aa, Mycobacterium
GDGGPASGRG

SEQ ID NO: 902792 - protein, 8 aa, Mycobacterium
GDGGPATA

SEQ ID NO: 902793 - protein, 59 aa, Mycobacterium
GDGGRGGDGGLGGTGGTGGVGGDGALADSAGGRGGDAGNGGVGGVGGAGGRGGSGGHGG

SEQ ID NO: 902794 - protein, 7 aa, Mycobacterium
GDGGRTL

SEQ ID NO: 902795 - protein, 9 aa, Mycobacterium
GDGGRYEMN

SEQ ID NO: 902796 - protein, 6 aa, Mycobacterium
GDGGSL

SEQ ID NO: 902797 - protein, 6 aa, Mycobacterium
GDGGTV

SEQ ID NO: 902798 - protein, 16 aa, Mycobacterium
GDGGVAGAGGDGGRGG

SEQ ID NO: 902799 - protein, 5 aa, Mycobacterium
GDGNF

SEQ ID NO: 902800 - protein, 6 aa, Mycobacterium
GDGNFG

SEQ ID NO: 902801 - protein, 13 aa, Mycobacterium
GDGNLYGGNEPAR

SEQ ID NO: 902802 - protein, 16 aa, Mycobacterium
GDGNSALGDSAVAAGY

SEQ ID NO: 902803 - protein, 18 aa, Mycobacterium
GDGNTTVSATATGSGNIA

SEQ ID NO: 902804 - protein, 16 aa, Mycobacterium
GDGNTVAASATGAHTL

SEQ ID NO: 902805 - protein, 6 aa, Mycobacterium
GDGPAH

SEQ ID NO: 902806 - protein, 9 aa, Mycobacterium
GDGPVVPTT

SEQ ID NO: 902807 - protein, 5 aa, Mycobacterium
GDGQI

SEQ ID NO: 902808 - protein, 5 aa, Mycobacterium
GDGQV

SEQ ID NO: 902809 - protein, 9 aa, Mycobacterium
GDGSFSGER

SEQ ID NO: 902810 - protein, 18 aa, Mycobacterium
GDGSNGAPGTGQAGGNGG

SEQ ID NO: 902811 - protein, 8 aa, Mycobacterium
GDGSQNAV

SEQ ID NO: 902812 - protein, 7 aa, Mycobacterium
GDGSTIA

SEQ ID NO: 902813 - protein, 8 aa, Mycobacterium
GDGTAGHA

SEQ ID NO: 902814 - protein, 8 aa, Mycobacterium
GDGTQGGY

SEQ ID NO: 902815 - protein, 7 aa, Mycobacterium
GDGTQVT

SEQ ID NO: 902816 - protein, 8 aa, Mycobacterium
GDGTVGTP

SEQ ID NO: 902817 - protein, 13 aa, Mycobacterium
GDGVAAGNGDRIK

SEQ ID NO: 902818 - protein, 6 aa, Mycobacterium
GDGVDG

SEQ ID NO: 902819 - protein, 10 aa, Mycobacterium
GDGVPDDGGV

SEQ ID NO: 902820 - protein, 11 aa, Mycobacterium
GDGVQVKNPDV

SEQ ID NO: 902821 - protein, 43 aa, Mycobacterium
GDHATATNPGASVASPAGREAKAAADEAAAEEQEGLEEVSTPD

SEQ ID NO: 902822 - protein, 43 aa, Mycobacterium
GDHATATNPGASVASPLGREAKAAADEASAAEESAIEQVSTPD

SEQ ID NO: 902823 - protein, 43 aa, Mycobacterium
GDHATATNPGASVASTLGREAKEAADEAATSEESELAEVSTPD

SEQ ID NO: 902824 - protein, 17 aa, Mycobacterium
GDHATSGPAAVNQSLDT

SEQ ID NO: 902825 - protein, 9 aa, Mycobacterium
GDHHGDATA

SEQ ID NO: 902826 - protein, 10 aa, Mycobacterium
GDHHRTTREA

SEQ ID NO: 902827 - protein, 7 aa, Mycobacterium
GDHNPIH

SEQ ID NO: 902828 - protein, 8 aa, Mycobacterium
GDHPDRTA

SEQ ID NO: 902829 - protein, 7 aa, Mycobacterium
GDHRDGC

SEQ ID NO: 902830 - protein, 4 aa, Mycobacterium
GDHV

SEQ ID NO: 902831 - protein, 9 aa, Mycobacterium
GDIDEDEYR

SEQ ID NO: 902832 - protein, 13 aa, Mycobacterium
GDIKSEQAAQEAL

SEQ ID NO: 902833 - protein, 6 aa, Mycobacterium
GDIPDA

SEQ ID NO: 902834 - protein, 5 aa, Mycobacterium
GDIPK

SEQ ID NO: 902835 - protein, 8 aa, Mycobacterium
GDIRPDDA

SEQ ID NO: 902836 - protein, 14 aa, Mycobacterium
GDISNSPQTVATGS

SEQ ID NO: 902837 - protein, 8 aa, Mycobacterium
GDKDTKSF

SEQ ID NO: 902838 - protein, 27 aa, Mycobacterium
GDKGPEGDKRGTKAEVVRSRPKVVPRT

SEQ ID NO: 902839 - protein, 13 aa, Mycobacterium
GDKGVRGGSTLEQ

SEQ ID NO: 902840 - protein, 15 aa, Mycobacterium
GDKNSASASALGAGN

SEQ ID NO: 902841 - protein, 21 aa, Mycobacterium
GDKPDGLPNQPLTAGSQTTGR

SEQ ID NO: 902842 - protein, 7 aa, Mycobacterium
GDKPTLK

SEQ ID NO: 902843 - protein, 8 aa, Mycobacterium
GDKRKQAS

SEQ ID NO: 902844 - protein, 9 aa, Mycobacterium
GDKSAAALG

SEQ ID NO: 902845 - protein, 10 aa, Mycobacterium
GDKVTSGPAA

SEQ ID NO: 902846 - protein, 12 aa, Mycobacterium
GDLAASDGKPVT

SEQ ID NO: 902847 - protein, 10 aa, Mycobacterium
GDLADEPGHD

SEQ ID NO: 902848 - protein, 31 aa, Mycobacterium
GDLAPDGADRETDARTPSPAARDASRSQGRG

SEQ ID NO: 902849 - protein, 17 aa, Mycobacterium
GDLAPRVDSPLRGPEVS

SEQ ID NO: 902850 - protein, 4 aa, Mycobacterium
GDLD

SEQ ID NO: 902851 - protein, 6 aa, Mycobacterium
GDLDAQ

SEQ ID NO: 902852 - protein, 6 aa, Mycobacterium
GDLDEA

SEQ ID NO: 902853 - protein, 8 aa, Mycobacterium
GDLKPGQL

SEQ ID NO: 902854 - protein, 4 aa, Mycobacterium
GDLP

SEQ ID NO: 902855 - protein, 14 aa, Mycobacterium
GDLPEDRAGNCEEE

SEQ ID NO: 902856 - protein, 14 aa, Mycobacterium
GDLPGSSGSSRPER

SEQ ID NO: 902857 - protein, 6 aa, Mycobacterium
GDLPTG

SEQ ID NO: 902858 - protein, 5 aa, Mycobacterium
GDLSG

SEQ ID NO: 902859 - protein, 14 aa, Mycobacterium
GDLTQTPAVAAKGT

SEQ ID NO: 902860 - protein, 24 aa, Mycobacterium
GDLTTAPATAAKGNATITLGGSDI

SEQ ID NO: 902861 - protein, 24 aa, Mycobacterium
GDLTTAPATAASGNATITLGGSDI

SEQ ID NO: 902862 - protein, 4 aa, Mycobacterium
GDMA

SEQ ID NO: 902863 - protein, 5 aa, Mycobacterium
GDMSG

SEQ ID NO: 902864 - protein, 6 aa, Mycobacterium
GDNAGR

SEQ ID NO: 902865 - protein, 11 aa, Mycobacterium
GDNATSGPAAI

SEQ ID NO: 902866 - protein, 7 aa, Mycobacterium
GDNDDMT

SEQ ID NO: 902867 - protein, 7 aa, Mycobacterium
GDNGLSR

SEQ ID NO: 902868 - protein, 9 aa, Mycobacterium
GDNLAHPKA

SEQ ID NO: 902869 - protein, 9 aa, Mycobacterium
GDNLSHPKA

SEQ ID NO: 902870 - protein, 14 aa, Mycobacterium
GDNNGVAASAPGIG

SEQ ID NO: 902871 - protein, 7 aa, Mycobacterium
GDNNTAD

SEQ ID NO: 902872 - protein, 9 aa, Mycobacterium
GDNNTGGVV

SEQ ID NO: 902873 - protein, 12 aa, Mycobacterium
GDNPALRARSRD

SEQ ID NO: 902874 - protein, 6 aa, Mycobacterium
GDNPYD

SEQ ID NO: 902875 - protein, 4 aa, Mycobacterium
GDNQ

SEQ ID NO: 902876 - protein, 5 aa, Mycobacterium
GDNSA

SEQ ID NO: 902877 - protein, 16 aa, Mycobacterium
GDNTPLGPASSTRVGE

SEQ ID NO: 902878 - protein, 23 aa, Mycobacterium
GDNVAGGGDAAVAAGAAGASQAT

SEQ ID NO: 902879 - protein, 7 aa, Mycobacterium
GDPAFAA

SEQ ID NO: 902880 - protein, 26 aa, Mycobacterium
GDPAKFTESTPYNPSSPYSSTKAASD

SEQ ID NO: 902881 - protein, 9 aa, Mycobacterium
GDPALQGSI

SEQ ID NO: 902882 - protein, 6 aa, Mycobacterium
GDPANH

SEQ ID NO: 902883 - protein, 9 aa, Mycobacterium
GDPAPPGSQ

SEQ ID NO: 902884 - protein, 5 aa, Mycobacterium
GDPAR

SEQ ID NO: 902885 - protein, 15 aa, Mycobacterium
GDPAYGYSTSPPNVA

SEQ ID NO: 902886 - protein, 7 aa, Mycobacterium
GDPDALA

SEQ ID NO: 902887 - protein, 9 aa, Mycobacterium
GDPDEGPIV

SEQ ID NO: 902888 - protein, 5 aa, Mycobacterium
GDPGA

SEQ ID NO: 902889 - protein, 6 aa, Mycobacterium
GDPGAM

SEQ ID NO: 902890 - protein, 8 aa, Mycobacterium
GDPGAPGQ

SEQ ID NO: 902891 - protein, 6 aa, Mycobacterium
GDPGHV

SEQ ID NO: 902892 - protein, 8 aa, Mycobacterium
GDPGSPTI

SEQ ID NO: 902893 - protein, 6 aa, Mycobacterium
GDPHSD

SEQ ID NO: 902894 - protein, 9 aa, Mycobacterium
GDPICSDGD

SEQ ID NO: 902895 - protein, 4 aa, Mycobacterium
GDPN

SEQ ID NO: 902896 - protein, 9 aa, Mycobacterium
GDPPADDAR

SEQ ID NO: 902897 - protein, 6 aa, Mycobacterium
GDPPTL

SEQ ID NO: 902898 - protein, 9 aa, Mycobacterium
GDPQDPDSM

SEQ ID NO: 902899 - protein, 20 aa, Mycobacterium
GDPQTHRHTQARVGSEAAQA

SEQ ID NO: 902900 - protein, 15 aa, Mycobacterium
GDPRLPNVPPSPEQI

SEQ ID NO: 902901 - protein, 8 aa, Mycobacterium
GDPSAARR

SEQ ID NO: 902902 - protein, 4 aa, Mycobacterium
GDPT

SEQ ID NO: 902903 - protein, 8 aa, Mycobacterium
GDPTGPNG

SEQ ID NO: 902904 - protein, 13 aa, Mycobacterium
GDPTLSAAPPGVD

SEQ ID NO: 902905 - protein, 13 aa, Mycobacterium
GDPTLSAAPPGVE

SEQ ID NO: 902906 - protein, 5 aa, Mycobacterium
GDPTM

SEQ ID NO: 902907 - protein, 13 aa, Mycobacterium
GDPVCSGGNDAAA

SEQ ID NO: 902908 - protein, 23 aa, Mycobacterium
GDPVDAEKYRTIDQGGTPGRLAE

SEQ ID NO: 902909 - protein, 5 aa, Mycobacterium
GDPVS

SEQ ID NO: 902910 - protein, 5 aa, Mycobacterium
GDPYD

SEQ ID NO: 902911 - protein, 9 aa, Mycobacterium
GDPYKANAD

SEQ ID NO: 902912 - protein, 7 aa, Mycobacterium
GDQAEID

SEQ ID NO: 902913 - protein, 9 aa, Mycobacterium
GDQKGGTEA

SEQ ID NO: 902914 - protein, 9 aa, Mycobacterium
GDQKGGTES

SEQ ID NO: 902915 - protein, 12 aa, Mycobacterium
GDQLSITGLELL

SEQ ID NO: 902916 - protein, 23 aa, Mycobacterium
GDQSLPADVRGQPVVPEGSAGIE

SEQ ID NO: 902917 - protein, 17 aa, Mycobacterium
GDQYNAGRHIPPNEARR

SEQ ID NO: 902918 - protein, 13 aa, Mycobacterium
GDRADATEDSGTD

SEQ ID NO: 902919 - protein, 6 aa, Mycobacterium
GDRALG

SEQ ID NO: 902920 - protein, 9 aa, Mycobacterium
GDRAPRVAG

SEQ ID NO: 902921 - protein, 10 aa, Mycobacterium
GDRDAATQRA

SEQ ID NO: 902922 - protein, 8 aa, Mycobacterium
GDREGARQ

SEQ ID NO: 902923 - protein, 5 aa, Mycobacterium
GDREI

SEQ ID NO: 902924 - protein, 5 aa, Mycobacterium
GDRFG

SEQ ID NO: 902925 - protein, 4 aa, Mycobacterium
GDRG

SEQ ID NO: 902926 - protein, 13 aa, Mycobacterium
GDRGDPMDDSGTD

SEQ ID NO: 902927 - protein, 8 aa, Mycobacterium
GDRGDQGV

SEQ ID NO: 902928 - protein, 6 aa, Mycobacterium
GDRGHR

SEQ ID NO: 902929 - protein, 13 aa, Mycobacterium
GDRGRAVESAAAD

SEQ ID NO: 902930 - protein, 4 aa, Mycobacterium
GDRL

SEQ ID NO: 902931 - protein, 7 aa, Mycobacterium
GDRLDPS

SEQ ID NO: 902932 - protein, 5 aa, Mycobacterium
GDRLP

SEQ ID NO: 902933 - protein, 5 aa, Mycobacterium
GDRPG

SEQ ID NO: 902934 - protein, 31 aa, Mycobacterium
GDRPTDLVPPESKPESAPTTVSPATLPASPG

SEQ ID NO: 902935 - protein, 8 aa, Mycobacterium
GDRQQINP

SEQ ID NO: 902936 - protein, 7 aa, Mycobacterium
GDRSDQV

SEQ ID NO: 902937 - protein, 11 aa, Mycobacterium
GDRTTDDSGTD

SEQ ID NO: 902938 - protein, 7 aa, Mycobacterium
GDSADIA

SEQ ID NO: 902939 - protein, 9 aa, Mycobacterium
GDSATGDIT

SEQ ID NO: 902940 - protein, 5 aa, Mycobacterium
GDSDE

SEQ ID NO: 902941 - protein, 10 aa, Mycobacterium
GDSDSRETVA

SEQ ID NO: 902942 - protein, 4 aa, Mycobacterium
GDSP

SEQ ID NO: 902943 - protein, 7 aa, Mycobacterium
GDSPEYL

SEQ ID NO: 902944 - protein, 7 aa, Mycobacterium
GDSPGDV

SEQ ID NO: 902945 - protein, 15 aa, Mycobacterium
GDSPKPDIRAEAEQR

SEQ ID NO: 902946 - protein, 7 aa, Mycobacterium
GDSPRFT

SEQ ID NO: 902947 - protein, 8 aa, Mycobacterium
GDSPTPLV

SEQ ID NO: 902948 - protein, 26 aa, Mycobacterium
GDSSAGDTAASSSTTTTASPKTPLAK

SEQ ID NO: 902949 - protein, 8 aa, Mycobacterium
GDSSAPAV

SEQ ID NO: 902950 - protein, 7 aa, Mycobacterium
GDSTNPA

SEQ ID NO: 902951 - protein, 4 aa, Mycobacterium
GDTA

SEQ ID NO: 902952 - protein, 19 aa, Mycobacterium
GDTATAAQLSDNPNEAREA

SEQ ID NO: 902953 - protein, 19 aa, Mycobacterium
GDTATAAQLTDSPNDAREA

SEQ ID NO: 902954 - protein, 4 aa, Mycobacterium
GDTD

SEQ ID NO: 902955 - protein, 5 aa, Mycobacterium
GDTEL

SEQ ID NO: 902956 - protein, 7 aa, Mycobacterium
GDTGQLT

SEQ ID NO: 902957 - protein, 17 aa, Mycobacterium
GDTGSTPVDETAGPGQN

SEQ ID NO: 902958 - protein, 5 aa, Mycobacterium
GDTGY

SEQ ID NO: 902959 - protein, 8 aa, Mycobacterium
GDTGYTKS

SEQ ID NO: 902960 - protein, 13 aa, Mycobacterium
GDTIEGKPRSRSV

SEQ ID NO: 902961 - protein, 14 aa, Mycobacterium
GDTIGLDETTAAAT

SEQ ID NO: 902962 - protein, 14 aa, Mycobacterium
GDTIGLDSTTAAAT

SEQ ID NO: 902963 - protein, 15 aa, Mycobacterium
GDTIPIDQTGAAATV

SEQ ID NO: 902964 - protein, 8 aa, Mycobacterium
GDTIPLAQ

SEQ ID NO: 902965 - protein, 18 aa, Mycobacterium
GDTIPLKNSSAYPNTEQT

SEQ ID NO: 902966 - protein, 18 aa, Mycobacterium
GDTIPLKNSSAYPTTEQT

SEQ ID NO: 902967 - protein, 18 aa, Mycobacterium
GDTIPLKNSSSYPTTEQT

SEQ ID NO: 902968 - protein, 6 aa, Mycobacterium
GDTLAR

SEQ ID NO: 902969 - protein, 8 aa, Mycobacterium
GDTLPTRT

SEQ ID NO: 902970 - protein, 9 aa, Mycobacterium
GDTLTRSPL

SEQ ID NO: 902971 - protein, 29 aa, Mycobacterium
GDTNPVSASVAAEKEPVAAPAPPPVEEQA

SEQ ID NO: 902972 - protein, 16 aa, Mycobacterium
GDTPKPQIRAEAAERG

SEQ ID NO: 902973 - protein, 5 aa, Mycobacterium
GDTPL

SEQ ID NO: 902974 - protein, 7 aa, Mycobacterium
GDTPPAD

SEQ ID NO: 902975 - protein, 6 aa, Mycobacterium
GDTPPI

SEQ ID NO: 902976 - protein, 11 aa, Mycobacterium
GDTPVRGRAED

SEQ ID NO: 902977 - protein, 5 aa, Mycobacterium
GDTQA

SEQ ID NO: 902978 - protein, 8 aa, Mycobacterium
GDTSAAGR

SEQ ID NO: 902979 - protein, 6 aa, Mycobacterium
GDTSVY

SEQ ID NO: 902980 - protein, 9 aa, Mycobacterium
GDTTGKPLA

SEQ ID NO: 902981 - protein, 12 aa, Mycobacterium
GDTTKTDAERTE

SEQ ID NO: 902982 - protein, 13 aa, Mycobacterium
GDTVSGTASDAQQ

SEQ ID NO: 902983 - protein, 9 aa, Mycobacterium
GDTYADAAP

SEQ ID NO: 902984 - protein, 6 aa, Mycobacterium
GDTYPT

SEQ ID NO: 902985 - protein, 6 aa, Mycobacterium
GDVDEA

SEQ ID NO: 902986 - protein, 8 aa, Mycobacterium
GDVDGTPI

SEQ ID NO: 902987 - protein, 11 aa, Mycobacterium
GDVDPVPRRRA

SEQ ID NO: 902988 - protein, 8 aa, Mycobacterium
GDVDRNDL

SEQ ID NO: 902989 - protein, 5 aa, Mycobacterium
GDVPK

SEQ ID NO: 902990 - protein, 6 aa, Mycobacterium
GDVPKP

SEQ ID NO: 902991 - protein, 16 aa, Mycobacterium
GDVRGGGSTTSSTPYV

SEQ ID NO: 902992 - protein, 9 aa, Mycobacterium
GDVRGRGGV

SEQ ID NO: 902993 - protein, 20 aa, Mycobacterium
GDVRGTNSGTGPVGSSGPYV

SEQ ID NO: 902994 - protein, 6 aa, Mycobacterium
GDVSEE

SEQ ID NO: 902995 - protein, 4 aa, Mycobacterium
GDWD

SEQ ID NO: 902996 - protein, 14 aa, Mycobacterium
GDWYSSDTYPAAQD

SEQ ID NO: 902997 - protein, 7 aa, Mycobacterium
GDYPRIS

SEQ ID NO: 902998 - protein, 5 aa, Mycobacterium
GDYQA

SEQ ID NO: 902999 - protein, 5 aa, Mycobacterium
GDYTI

SEQ ID NO: 903000 - protein, 8 aa, Mycobacterium
GEAATSVD

SEQ ID NO: 903001 - protein, 13 aa, Mycobacterium
GEAAVEGAGDGSE

SEQ ID NO: 903002 - protein, 5 aa, Mycobacterium
GEADA

SEQ ID NO: 903003 - protein, 9 aa, Mycobacterium
GEADSPWAT

SEQ ID NO: 903004 - protein, 5 aa, Mycobacterium
GEAFG

SEQ ID NO: 903005 - protein, 6 aa, Mycobacterium
GEAFGR

SEQ ID NO: 903006 - protein, 13 aa, Mycobacterium
GEAGQRQLPDPHT

SEQ ID NO: 903007 - protein, 5 aa, Mycobacterium
GEAPA

SEQ ID NO: 903008 - protein, 7 aa, Mycobacterium
GEAPDSV

SEQ ID NO: 903009 - protein, 8 aa, Mycobacterium
GEAPNKWT

SEQ ID NO: 903010 - protein, 6 aa, Mycobacterium
GEAPTT

SEQ ID NO: 903011 - protein, 10 aa, Mycobacterium
GEASWSTSQH

SEQ ID NO: 903012 - protein, 4 aa, Mycobacterium
GEAT

SEQ ID NO: 903013 - protein, 8 aa, Mycobacterium
GEATPTLA

SEQ ID NO: 903014 - protein, 17 aa, Mycobacterium
GEAVQSADGHNLSRPSW

SEQ ID NO: 903015 - protein, 17 aa, Mycobacterium
GEAVQSADGHSLSRPSW

SEQ ID NO: 903016 - protein, 4 aa, Mycobacterium
GECD

SEQ ID NO: 903017 - protein, 23 aa, Mycobacterium
GECGGGAKLSGTVRADGTRQATW

SEQ ID NO: 903018 - protein, 8 aa, Mycobacterium
GEDIDTGA

SEQ ID NO: 903019 - protein, 4 aa, Mycobacterium
GEDP

SEQ ID NO: 903020 - protein, 19 aa, Mycobacterium
GEDPKTTSTSRDDTGGRDV

SEQ ID NO: 903021 - protein, 6 aa, Mycobacterium
GEDRGG

SEQ ID NO: 903022 - protein, 16 aa, Mycobacterium
GEDSGVLEKDESGVTR

SEQ ID NO: 903023 - protein, 8 aa, Mycobacterium
GEDVKTDP

SEQ ID NO: 903024 - protein, 10 aa, Mycobacterium
GEDYTPLGST

SEQ ID NO: 903025 - protein, 4 aa, Mycobacterium
GEEF

SEQ ID NO: 903026 - protein, 10 aa, Mycobacterium
GEEGGGQVNG

SEQ ID NO: 903027 - protein, 7 aa, Mycobacterium
GEEGPEN

SEQ ID NO: 903028 - protein, 7 aa, Mycobacterium
GEEGPGN

SEQ ID NO: 903029 - protein, 4 aa, Mycobacterium
GEEI

SEQ ID NO: 903030 - protein, 8 aa, Mycobacterium
GEEITGDP

SEQ ID NO: 903031 - protein, 6 aa, Mycobacterium
GEELAS

SEQ ID NO: 903032 - protein, 15 aa, Mycobacterium
GEERVEGVDAPTLKE

SEQ ID NO: 903033 - protein, 11 aa, Mycobacterium
GEEYGGTTTLR

SEQ ID NO: 903034 - protein, 7 aa, Mycobacterium
GEFDPDA

SEQ ID NO: 903035 - protein, 6 aa, Mycobacterium
GEFSAP

SEQ ID NO: 903036 - protein, 6 aa, Mycobacterium
GEGADE

SEQ ID NO: 903037 - protein, 10 aa, Mycobacterium
GEGADQVPLG

SEQ ID NO: 903038 - protein, 11 aa, Mycobacterium
GEGALPDPGPI

SEQ ID NO: 903039 - protein, 5 aa, Mycobacterium
GEGDL

SEQ ID NO: 903040 - protein, 11 aa, Mycobacterium
GEGDLDRNVTR

SEQ ID NO: 903041 - protein, 13 aa, Mycobacterium
GEGGLSDHHRQGG

SEQ ID NO: 903042 - protein, 7 aa, Mycobacterium
GEGKTIG

SEQ ID NO: 903043 - protein, 7 aa, Mycobacterium
GEGPVPT

SEQ ID NO: 903044 - protein, 20 aa, Mycobacterium
GEGQQDGTIPIDRTTSPYQL

SEQ ID NO: 903045 - protein, 4 aa, Mycobacterium
GEGR

SEQ ID NO: 903046 - protein, 5 aa, Mycobacterium
GEGRL

SEQ ID NO: 903047 - protein, 6 aa, Mycobacterium
GEGSGD

SEQ ID NO: 903048 - protein, 7 aa, Mycobacterium
GEGSGNI

SEQ ID NO: 903049 - protein, 9 aa, Mycobacterium
GEGSGQVPL

SEQ ID NO: 903050 - protein, 19 aa, Mycobacterium
GEGTAPAEVPGPAAGAQLQ

SEQ ID NO: 903051 - protein, 7 aa, Mycobacterium
GEGTGAA

SEQ ID NO: 903052 - protein, 20 aa, Mycobacterium
GEGVKGNDGAAAAVGRTEGS

SEQ ID NO: 903053 - protein, 16 aa, Mycobacterium
GEHDSVDDAGQKYRNA

SEQ ID NO: 903054 - protein, 12 aa, Mycobacterium
GEHSRRPAFGDD

SEQ ID NO: 903055 - protein, 4 aa, Mycobacterium
GEHV

SEQ ID NO: 903056 - protein, 6 aa, Mycobacterium
GEIAGG

SEQ ID NO: 903057 - protein, 6 aa, Mycobacterium
GEIASP

SEQ ID NO: 903058 - protein, 9 aa, Mycobacterium
GEIESAGGT

SEQ ID NO: 903059 - protein, 5 aa, Mycobacterium
GEIRS

SEQ ID NO: 903060 - protein, 4 aa, Mycobacterium
GEKR

SEQ ID NO: 903061 - protein, 5 aa, Mycobacterium
GEKTG

SEQ ID NO: 903062 - protein, 17 aa, Mycobacterium
GEKTTADTPSVPLPPNI

SEQ ID NO: 903063 - protein, 7 aa, Mycobacterium
GELAERD

SEQ ID NO: 903064 - protein, 10 aa, Mycobacterium
GELAGPDYGS

SEQ ID NO: 903065 - protein, 9 aa, Mycobacterium
GELDDDDRR

SEQ ID NO: 903066 - protein, 10 aa, Mycobacterium
GELDDTTSPI

SEQ ID NO: 903067 - protein, 5 aa, Mycobacterium
GELGD

SEQ ID NO: 903068 - protein, 5 aa, Mycobacterium
GELGP

SEQ ID NO: 903069 - protein, 32 aa, Mycobacterium
GELGPQAADLETDARTPAPAARDASRSQGRGL

SEQ ID NO: 903070 - protein, 9 aa, Mycobacterium
GELKDERTI

SEQ ID NO: 903071 - protein, 6 aa, Mycobacterium
GELPRG

SEQ ID NO: 903072 - protein, 4 aa, Mycobacterium
GELS

SEQ ID NO: 903073 - protein, 10 aa, Mycobacterium
GELTGGEGSY

SEQ ID NO: 903074 - protein, 6 aa, Mycobacterium
GELTTG

SEQ ID NO: 903075 - protein, 18 aa, Mycobacterium
GEMIDPSDSGWLSRLVGA

SEQ ID NO: 903076 - protein, 5 aa, Mycobacterium
GEMTV

SEQ ID NO: 903077 - protein, 4 aa, Mycobacterium
GENA

SEQ ID NO: 903078 - protein, 4 aa, Mycobacterium
GEND

SEQ ID NO: 903079 - protein, 16 aa, Mycobacterium
GENGAPVRRSAGAEAA

SEQ ID NO: 903080 - protein, 14 aa, Mycobacterium
GENHQAAEPGWTDT

SEQ ID NO: 903081 - protein, 5 aa, Mycobacterium
GENLT

SEQ ID NO: 903082 - protein, 19 aa, Mycobacterium
GENPDAGPPWTHVRRQRPG

SEQ ID NO: 903083 - protein, 11 aa, Mycobacterium
GEPADASPRLR

SEQ ID NO: 903084 - protein, 12 aa, Mycobacterium
GEPAENHSKGCG

SEQ ID NO: 903085 - protein, 5 aa, Mycobacterium
GEPAH

SEQ ID NO: 903086 - protein, 5 aa, Mycobacterium
GEPAL

SEQ ID NO: 903087 - protein, 7 aa, Mycobacterium
GEPDPRH

SEQ ID NO: 903088 - protein, 9 aa, Mycobacterium
GEPDPRSVN

SEQ ID NO: 903089 - protein, 12 aa, Mycobacterium
GEPDQLDPHKTT

SEQ ID NO: 903090 - protein, 13 aa, Mycobacterium
GEPDQLDPQKTSA

SEQ ID NO: 903091 - protein, 5 aa, Mycobacterium
GEPDV

SEQ ID NO: 903092 - protein, 6 aa, Mycobacterium
GEPGAA

SEQ ID NO: 903093 - protein, 10 aa, Mycobacterium
GEPGPRSAKE

SEQ ID NO: 903094 - protein, 5 aa, Mycobacterium
GEPIP

SEQ ID NO: 903095 - protein, 14 aa, Mycobacterium
GEPISGTHGAAGEY

SEQ ID NO: 903096 - protein, 10 aa, Mycobacterium
GEPKARAAAP

SEQ ID NO: 903097 - protein, 47 aa, Mycobacterium
GEPPAAPPPPPAAQKPIRCTGGGTVPAGQTCPPKPPPAAVEQAPTNA

SEQ ID NO: 903098 - protein, 8 aa, Mycobacterium
GEPRQGDY

SEQ ID NO: 903099 - protein, 8 aa, Mycobacterium
GEPRSGTT

SEQ ID NO: 903100 - protein, 8 aa, Mycobacterium
GEPSAEDT

SEQ ID NO: 903101 - protein, 7 aa, Mycobacterium
GEPSNIP

SEQ ID NO: 903102 - protein, 7 aa, Mycobacterium
GEPSSGF

SEQ ID NO: 903103 - protein, 14 aa, Mycobacterium
GEPTTEPPPPSSNT

SEQ ID NO: 903104 - protein, 7 aa, Mycobacterium
GEPVTAQ

SEQ ID NO: 903105 - protein, 19 aa, Mycobacterium
GEQAGSGPDCGAPYADPAP

SEQ ID NO: 903106 - protein, 7 aa, Mycobacterium
GEQDRLR

SEQ ID NO: 903107 - protein, 8 aa, Mycobacterium
GEQGKPGH

SEQ ID NO: 903108 - protein, 10 aa, Mycobacterium
GEQIPGGGPL

SEQ ID NO: 903109 - protein, 6 aa, Mycobacterium
GEQPCC

SEQ ID NO: 903110 - protein, 17 aa, Mycobacterium
GEQRVSAARSRDQAGTL

SEQ ID NO: 903111 - protein, 6 aa, Mycobacterium
GEQSHQ

SEQ ID NO: 903112 - protein, 16 aa, Mycobacterium
GEQTWRESGLDAPTDI

SEQ ID NO: 903113 - protein, 4 aa, Mycobacterium
GEQV

SEQ ID NO: 903114 - protein, 4 aa, Mycobacterium
GEQY

SEQ ID NO: 903115 - protein, 5 aa, Mycobacterium
GERAA

SEQ ID NO: 903116 - protein, 11 aa, Mycobacterium
GERADGAAVAE

SEQ ID NO: 903117 - protein, 9 aa, Mycobacterium
GERAEPRAV

SEQ ID NO: 903118 - protein, 6 aa, Mycobacterium
GERATG

SEQ ID NO: 903119 - protein, 6 aa, Mycobacterium
GERERG

SEQ ID NO: 903120 - protein, 7 aa, Mycobacterium
GERERGV

SEQ ID NO: 903121 - protein, 7 aa, Mycobacterium
GERHENR

SEQ ID NO: 903122 - protein, 5 aa, Mycobacterium
GERIS

SEQ ID NO: 903123 - protein, 4 aa, Mycobacterium
GERL

SEQ ID NO: 903124 - protein, 19 aa, Mycobacterium
GERLNEQAATNTFGSYRER

SEQ ID NO: 903125 - protein, 10 aa, Mycobacterium
GERPDDAEGL

SEQ ID NO: 903126 - protein, 6 aa, Mycobacterium
GERRPG

SEQ ID NO: 903127 - protein, 17 aa, Mycobacterium
GESAAAAVSGGFSGGLT

SEQ ID NO: 903128 - protein, 8 aa, Mycobacterium
GESAAANR

SEQ ID NO: 903129 - protein, 9 aa, Mycobacterium
GESADAVNT

SEQ ID NO: 903130 - protein, 15 aa, Mycobacterium
GESCGDGPAPTASVR

SEQ ID NO: 903131 - protein, 4 aa, Mycobacterium
GESG

SEQ ID NO: 903132 - protein, 17 aa, Mycobacterium
GESGGGGGLGGTGGTGG

SEQ ID NO: 903133 - protein, 12 aa, Mycobacterium
GESGSGKSTAAA

SEQ ID NO: 903134 - protein, 10 aa, Mycobacterium
GESGSGKSTV

SEQ ID NO: 903135 - protein, 13 aa, Mycobacterium
GESNFGKIGSPQI

SEQ ID NO: 903136 - protein, 10 aa, Mycobacterium
GESPPKPPAV

SEQ ID NO: 903137 - protein, 7 aa, Mycobacterium
GESTADR

SEQ ID NO: 903138 - protein, 11 aa, Mycobacterium
GESTDGTLGVA

SEQ ID NO: 903139 - protein, 10 aa, Mycobacterium
GESTPKPPAV

SEQ ID NO: 903140 - protein, 14 aa, Mycobacterium
GESWSGSASAAMGS

SEQ ID NO: 903141 - protein, 8 aa, Mycobacterium
GETAPTVL

SEQ ID NO: 903142 - protein, 9 aa, Mycobacterium
GETCGTVDS

SEQ ID NO: 903143 - protein, 6 aa, Mycobacterium
GETDPR

SEQ ID NO: 903144 - protein, 4 aa, Mycobacterium
GETF

SEQ ID NO: 903145 - protein, 4 aa, Mycobacterium
GETG

SEQ ID NO: 903146 - protein, 5 aa, Mycobacterium
GETLA

SEQ ID NO: 903147 - protein, 7 aa, Mycobacterium
GETMRPQ

SEQ ID NO: 903148 - protein, 9 aa, Mycobacterium
GETRHGSET

SEQ ID NO: 903149 - protein, 5 aa, Mycobacterium
GETST

SEQ ID NO: 903150 - protein, 7 aa, Mycobacterium
GETTSDR

SEQ ID NO: 903151 - protein, 5 aa, Mycobacterium
GETVA

SEQ ID NO: 903152 - protein, 5 aa, Mycobacterium
GETYP

SEQ ID NO: 903153 - protein, 12 aa, Mycobacterium
GEVAGANPGVRS

SEQ ID NO: 903154 - protein, 10 aa, Mycobacterium
GEVAPGITQN

SEQ ID NO: 903155 - protein, 22 aa, Mycobacterium
GEVEDERTAEGVNAATYCLVKA

SEQ ID NO: 903156 - protein, 8 aa, Mycobacterium
GEVEVKGK

SEQ ID NO: 903157 - protein, 15 aa, Mycobacterium
GEVGGTWRDNSYPGA

SEQ ID NO: 903158 - protein, 5 aa, Mycobacterium
GEVKD

SEQ ID NO: 903159 - protein, 22 aa, Mycobacterium
GEVKDEQNASNHNAQVFCMVKS

SEQ ID NO: 903160 - protein, 22 aa, Mycobacterium
GEVKDERSSAGRNAQTSCLVKA

SEQ ID NO: 903161 - protein, 9 aa, Mycobacterium
GEVKDQRTV

SEQ ID NO: 903162 - protein, 6 aa, Mycobacterium
GEVPDD

SEQ ID NO: 903163 - protein, 10 aa, Mycobacterium
GEVQGTPDTL

SEQ ID NO: 903164 - protein, 6 aa, Mycobacterium
GEVRDS

SEQ ID NO: 903165 - protein, 7 aa, Mycobacterium
GEVRTEN

SEQ ID NO: 903166 - protein, 7 aa, Mycobacterium
GEVSADA

SEQ ID NO: 903167 - protein, 4 aa, Mycobacterium
GEVV

SEQ ID NO: 903168 - protein, 5 aa, Mycobacterium
GEYEK

SEQ ID NO: 903169 - protein, 5 aa, Mycobacterium
GEYKS

SEQ ID NO: 903170 - protein, 7 aa, Mycobacterium
GEYNGQQ

SEQ ID NO: 903171 - protein, 4 aa, Mycobacterium
GEYP

SEQ ID NO: 903172 - protein, 6 aa, Mycobacterium
GEYRPQ

SEQ ID NO: 903173 - protein, 17 aa, Mycobacterium
GFAGPSDFSDLHADRGQ

SEQ ID NO: 903174 - protein, 8 aa, Mycobacterium
GFAPGRTP

SEQ ID NO: 903175 - protein, 37 aa, Mycobacterium
GFATGTVGNNDGGHVKASQVRAAKSDDMGAKEVSKEL

SEQ ID NO: 903176 - protein, 4 aa, Mycobacterium
GFDD

SEQ ID NO: 903177 - protein, 27 aa, Mycobacterium
GFDDPDGSPAPLRQPDGSIVADQPDRV

SEQ ID NO: 903178 - protein, 12 aa, Mycobacterium
GFDDPTAVTLST

SEQ ID NO: 903179 - protein, 9 aa, Mycobacterium
GFDDTTDPA

SEQ ID NO: 903180 - protein, 10 aa, Mycobacterium
GFDGDEDGGA

SEQ ID NO: 903181 - protein, 5 aa, Mycobacterium
GFDPA

SEQ ID NO: 903182 - protein, 11 aa, Mycobacterium
GFDPEAAKREL

SEQ ID NO: 903183 - protein, 8 aa, Mycobacterium
GFDPSRPS

SEQ ID NO: 903184 - protein, 7 aa, Mycobacterium
GFDPTER

SEQ ID NO: 903185 - protein, 7 aa, Mycobacterium
GFDPTRP

SEQ ID NO: 903186 - protein, 8 aa, Mycobacterium
GFDRPEDH

SEQ ID NO: 903187 - protein, 25 aa, Mycobacterium
GFDTPSPSFQQKGWNPQTQSIDPAG

SEQ ID NO: 903188 - protein, 11 aa, Mycobacterium
GFDTPSSAFQQ

SEQ ID NO: 903189 - protein, 6 aa, Mycobacterium
GFDTPT

SEQ ID NO: 903190 - protein, 37 aa, Mycobacterium
GFGAGTVGNNDGGHVKGSQVRAAKTDDLGAQEVSKEL

SEQ ID NO: 903191 - protein, 33 aa, Mycobacterium
GFGGHGGSGATNNLGNGEFGGFGGSGGDGGNGG

SEQ ID NO: 903192 - protein, 9 aa, Mycobacterium
GFGGTATQT

SEQ ID NO: 903193 - protein, 10 aa, Mycobacterium
GFGNNGNNNI

SEQ ID NO: 903194 - protein, 7 aa, Mycobacterium
GFGNTGA

SEQ ID NO: 903195 - protein, 5 aa, Mycobacterium
GFGPE

SEQ ID NO: 903196 - protein, 5 aa, Mycobacterium
GFGRT

SEQ ID NO: 903197 - protein, 5 aa, Mycobacterium
GFGSG

SEQ ID NO: 903198 - protein, 10 aa, Mycobacterium
GFGSGTSGQQ

SEQ ID NO: 903199 - protein, 11 aa, Mycobacterium
GFGSPRRDVQG

SEQ ID NO: 903200 - protein, 27 aa, Mycobacterium
GFNEPDGGQAPLRQADGTVLPDQQDRV

SEQ ID NO: 903201 - protein, 11 aa, Mycobacterium
GFNGGAGGSGG

SEQ ID NO: 903202 - protein, 5 aa, Mycobacterium
GFNGS

SEQ ID NO: 903203 - protein, 13 aa, Mycobacterium
GFPEARKPVRHPH

SEQ ID NO: 903204 - protein, 10 aa, Mycobacterium
GFPGAPSPSL

SEQ ID NO: 903205 - protein, 12 aa, Mycobacterium
GFPPCDNPAGIT

SEQ ID NO: 903206 - protein, 7 aa, Mycobacterium
GFPRDKA

SEQ ID NO: 903207 - protein, 15 aa, Mycobacterium
GFPRDKACGDGLTPR

SEQ ID NO: 903208 - protein, 9 aa, Mycobacterium
GFQQGTAPN

SEQ ID NO: 903209 - protein, 5 aa, Mycobacterium
GFRGP

SEQ ID NO: 903210 - protein, 5 aa, Mycobacterium
GFRTG

SEQ ID NO: 903211 - protein, 11 aa, Mycobacterium
GFSDPSPAFQQ

SEQ ID NO: 903212 - protein, 4 aa, Mycobacterium
GFSG

SEQ ID NO: 903213 - protein, 7 aa, Mycobacterium
GFSPDEK

SEQ ID NO: 903214 - protein, 9 aa, Mycobacterium
GFTAPEELS

SEQ ID NO: 903215 - protein, 20 aa, Mycobacterium
GFTGSYNQGLGGEATVSMTG

SEQ ID NO: 903216 - protein, 7 aa, Mycobacterium
GFTPENV

SEQ ID NO: 903217 - protein, 10 aa, Mycobacterium
GFTYNDPGQV

SEQ ID NO: 903218 - protein, 8 aa, Mycobacterium
GGAAAAAA

SEQ ID NO: 903219 - protein, 10 aa, Mycobacterium
GGAAAAAGVP

SEQ ID NO: 903220 - protein, 8 aa, Mycobacterium
GGAAAAYR

SEQ ID NO: 903221 - protein, 7 aa, Mycobacterium
GGAAAGV

SEQ ID NO: 903222 - protein, 10 aa, Mycobacterium
GGAAATAGLP

SEQ ID NO: 903223 - protein, 7 aa, Mycobacterium
GGAAGLS

SEQ ID NO: 903224 - protein, 43 aa, Mycobacterium
GGAAGSPGSQGGAGAGSDTAGANAGGDASSSVVAGGGAGGAGL

SEQ ID NO: 903225 - protein, 13 aa, Mycobacterium
GGAAQAYSAAVTD

SEQ ID NO: 903226 - protein, 18 aa, Mycobacterium
GGAARPAPDLAPRSVHGQ

SEQ ID NO: 903227 - protein, 6 aa, Mycobacterium
GGAATV

SEQ ID NO: 903228 - protein, 6 aa, Mycobacterium
GGAAVG

SEQ ID NO: 903229 - protein, 4 aa, Mycobacterium
GGAD

SEQ ID NO: 903230 - protein, 8 aa, Mycobacterium
GGADPAEG

SEQ ID NO: 903231 - protein, 19 aa, Mycobacterium
GGADPRREGAVMGDGDAPV

SEQ ID NO: 903232 - protein, 9 aa, Mycobacterium
GGADRTGHA

SEQ ID NO: 903233 - protein, 18 aa, Mycobacterium
GGADVAVGGTGVGGTGVG

SEQ ID NO: 903234 - protein, 10 aa, Mycobacterium
GGAGAGAASH

SEQ ID NO: 903235 - protein, 6 aa, Mycobacterium
GGAGAP

SEQ ID NO: 903236 - protein, 17 aa, Mycobacterium
GGAGAPAAGSGCSAVRP

SEQ ID NO: 903237 - protein, 7 aa, Mycobacterium
GGAGAQC

SEQ ID NO: 903238 - protein, 71 aa, Mycobacterium
GGAGENTLSSRAPAAPPVPTSSNPAPPAPPPVPGGTYGGGGSAGSGADGGGAAGGAGGGGGAGGGGAGGGG

SEQ ID NO: 903239 - protein, 28 aa, Mycobacterium
GGAGGAGGATPGIGGGGGAGGAGGIGGA

SEQ ID NO: 903240 - protein, 19 aa, Mycobacterium
GGAGGAGGTGGVAPPTGVG

SEQ ID NO: 903241 - protein, 14 aa, Mycobacterium
GGAGGAYGAAERAG

SEQ ID NO: 903242 - protein, 23 aa, Mycobacterium
GGAGGDGGTATTGTAGSGGNGGF

SEQ ID NO: 903243 - protein, 24 aa, Mycobacterium
GGAGGHGGAAPTGNGGSGGAGAGG

SEQ ID NO: 903244 - protein, 22 aa, Mycobacterium
GGAGGHGGSGTSGADGGAGGVS

SEQ ID NO: 903245 - protein, 26 aa, Mycobacterium
GGAGGLGGAASGAGNGGAGGAGGAGG

SEQ ID NO: 903246 - protein, 20 aa, Mycobacterium
GGAGGNGAPGGTGVGGTGGS

SEQ ID NO: 903247 - protein, 26 aa, Mycobacterium
GGAGGNGAPNVGGGSPGAGGNGGDAG

SEQ ID NO: 903248 - protein, 38 aa, Mycobacterium
GGAGGNGGAGASGISGPPHATAGPGGDGGNGGAGGAAG

SEQ ID NO: 903249 - protein, 17 aa, Mycobacterium
GGAGGNGGLGGSGGTGV

SEQ ID NO: 903250 - protein, 12 aa, Mycobacterium
GGAGGNGGSGGS

SEQ ID NO: 903251 - protein, 22 aa, Mycobacterium
GGAGGSSSVFAGGDGGAGGAGG

SEQ ID NO: 903252 - protein, 32 aa, Mycobacterium
GGAGGVGGAGGVGGVDSAGGTGGTGGTGGANG

SEQ ID NO: 903253 - protein, 13 aa, Mycobacterium
GGAGNQTPIPDSA

SEQ ID NO: 903254 - protein, 16 aa, Mycobacterium
GGAGVSAGLGEAASVG

SEQ ID NO: 903255 - protein, 6 aa, Mycobacterium
GGAGYT

SEQ ID NO: 903256 - protein, 6 aa, Mycobacterium
GGAHPQ

SEQ ID NO: 903257 - protein, 4 aa, Mycobacterium
GGAI

SEQ ID NO: 903258 - protein, 6 aa, Mycobacterium
GGANDN

SEQ ID NO: 903259 - protein, 6 aa, Mycobacterium
GGANGE

SEQ ID NO: 903260 - protein, 9 aa, Mycobacterium
GGANITPAI

SEQ ID NO: 903261 - protein, 6 aa, Mycobacterium
GGANMT

SEQ ID NO: 903262 - protein, 8 aa, Mycobacterium
GGANQTAA

SEQ ID NO: 903263 - protein, 4 aa, Mycobacterium
GGAP

SEQ ID NO: 903264 - protein, 18 aa, Mycobacterium
GGAPAALADSIRNGDTQV

SEQ ID NO: 903265 - protein, 7 aa, Mycobacterium
GGAPEVA

SEQ ID NO: 903266 - protein, 14 aa, Mycobacterium
GGAPFNGASLQGKP

SEQ ID NO: 903267 - protein, 8 aa, Mycobacterium
GGAPIAEP

SEQ ID NO: 903268 - protein, 10 aa, Mycobacterium
GGAPPPSPAQ

SEQ ID NO: 903269 - protein, 14 aa, Mycobacterium
GGAPTAGAFSRPGL

SEQ ID NO: 903270 - protein, 11 aa, Mycobacterium
GGAPTGFPGDT

SEQ ID NO: 903271 - protein, 8 aa, Mycobacterium
GGARTTRA

SEQ ID NO: 903272 - protein, 10 aa, Mycobacterium
GGASASAATT

SEQ ID NO: 903273 - protein, 27 aa, Mycobacterium
GGASGGGDAPPPPPTTGGGKSSLPPRF

SEQ ID NO: 903274 - protein, 9 aa, Mycobacterium
GGASGIGRA

SEQ ID NO: 903275 - protein, 7 aa, Mycobacterium
GGASRST

SEQ ID NO: 903276 - protein, 12 aa, Mycobacterium
GGATAGAESGTT

SEQ ID NO: 903277 - protein, 13 aa, Mycobacterium
GGATAGAYSRPGL

SEQ ID NO: 903278 - protein, 7 aa, Mycobacterium
GGATATV

SEQ ID NO: 903279 - protein, 16 aa, Mycobacterium
GGATGLGAAAATRLAE

SEQ ID NO: 903280 - protein, 15 aa, Mycobacterium
GGATPLDDGADPNLA

SEQ ID NO: 903281 - protein, 8 aa, Mycobacterium
GGATPYSI

SEQ ID NO: 903282 - protein, 4 aa, Mycobacterium
GGAV

SEQ ID NO: 903283 - protein, 8 aa, Mycobacterium
GGAVTSPG

SEQ ID NO: 903284 - protein, 11 aa, Mycobacterium
GGAWEGPSAER

SEQ ID NO: 903285 - protein, 10 aa, Mycobacterium
GGAYPSTEQT

SEQ ID NO: 903286 - protein, 6 aa, Mycobacterium
GGCGRD

SEQ ID NO: 903287 - protein, 6 aa, Mycobacterium
GGCQGI

SEQ ID NO: 903288 - protein, 6 aa, Mycobacterium
GGDAAG

SEQ ID NO: 903289 - protein, 6 aa, Mycobacterium
GGDADL

SEQ ID NO: 903290 - protein, 9 aa, Mycobacterium
GGDATGAEV

SEQ ID NO: 903291 - protein, 7 aa, Mycobacterium
GGDGAND

SEQ ID NO: 903292 - protein, 24 aa, Mycobacterium
GGDGGGAGTGVGSNGGDGGGGGGA

SEQ ID NO: 903293 - protein, 14 aa, Mycobacterium
GGDGSSSDNNNGQA

SEQ ID NO: 903294 - protein, 15 aa, Mycobacterium
GGDIDSARDASTKAW

SEQ ID NO: 903295 - protein, 5 aa, Mycobacterium
GGDLA

SEQ ID NO: 903296 - protein, 14 aa, Mycobacterium
GGDLPKADPPVGGR

SEQ ID NO: 903297 - protein, 9 aa, Mycobacterium
GGDLSTTDG

SEQ ID NO: 903298 - protein, 19 aa, Mycobacterium
GGDPAPSAATPSNPGGKIP

SEQ ID NO: 903299 - protein, 6 aa, Mycobacterium
GGDPIV

SEQ ID NO: 903300 - protein, 10 aa, Mycobacterium
GGDPVSTGTG

SEQ ID NO: 903301 - protein, 6 aa, Mycobacterium
GGDQPT

SEQ ID NO: 903302 - protein, 13 aa, Mycobacterium
GGDRDPGKREPMG

SEQ ID NO: 903303 - protein, 10 aa, Mycobacterium
GGDREPTTQQ

SEQ ID NO: 903304 - protein, 16 aa, Mycobacterium
GGDRYESLKGDGARVQ

SEQ ID NO: 903305 - protein, 9 aa, Mycobacterium
GGDSGYTKS

SEQ ID NO: 903306 - protein, 39 aa, Mycobacterium
GGDSTVSKTPGPTASQPATAAPETTVAAPAPTSAEPDPC

SEQ ID NO: 903307 - protein, 6 aa, Mycobacterium
GGDTAG

SEQ ID NO: 903308 - protein, 16 aa, Mycobacterium
GGDTGGGGGGGASDTF

SEQ ID NO: 903309 - protein, 8 aa, Mycobacterium
GGDTGKDI

SEQ ID NO: 903310 - protein, 8 aa, Mycobacterium
GGDTGYTK

SEQ ID NO: 903311 - protein, 4 aa, Mycobacterium
GGDV

SEQ ID NO: 903312 - protein, 23 aa, Mycobacterium
GGDVERDRTSADGMGQKTADITI

SEQ ID NO: 903313 - protein, 58 aa, Mycobacterium
GGDVNGPTRGVPREIPPAAAVPTGAYPGLAPAATPEALTPGLNTPAVTPGLSAPAITP

SEQ ID NO: 903314 - protein, 10 aa, Mycobacterium
GGEAAPWSAT

SEQ ID NO: 903315 - protein, 12 aa, Mycobacterium
GGEAISAEASLA

SEQ ID NO: 903316 - protein, 4 aa, Mycobacterium
GGEG

SEQ ID NO: 903317 - protein, 9 aa, Mycobacterium
GGEGGTGAA

SEQ ID NO: 903318 - protein, 5 aa, Mycobacterium
GGELR

SEQ ID NO: 903319 - protein, 10 aa, Mycobacterium
GGENVSSREV

SEQ ID NO: 903320 - protein, 20 aa, Mycobacterium
GGEPPNPLIPTGTNDSNGGR

SEQ ID NO: 903321 - protein, 20 aa, Mycobacterium
GGEPPNPLIPTGTNDSQGGR

SEQ ID NO: 903322 - protein, 19 aa, Mycobacterium
GGEPPNPLIPTGTNDSYGG

SEQ ID NO: 903323 - protein, 10 aa, Mycobacterium
GGEPSIPFNE

SEQ ID NO: 903324 - protein, 16 aa, Mycobacterium
GGERDPGKRAPMGATA

SEQ ID NO: 903325 - protein, 6 aa, Mycobacterium
GGERRA

SEQ ID NO: 903326 - protein, 7 aa, Mycobacterium
GGERRAA

SEQ ID NO: 903327 - protein, 5 aa, Mycobacterium
GGERY

SEQ ID NO: 903328 - protein, 4 aa, Mycobacterium
GGES

SEQ ID NO: 903329 - protein, 7 aa, Mycobacterium
GGESGRK

SEQ ID NO: 903330 - protein, 5 aa, Mycobacterium
GGETA

SEQ ID NO: 903331 - protein, 15 aa, Mycobacterium
GGETIGLPATRAAAT

SEQ ID NO: 903332 - protein, 13 aa, Mycobacterium
GGETVTASADDHP

SEQ ID NO: 903333 - protein, 16 aa, Mycobacterium
GGEVTPTNEQLQGKVG

SEQ ID NO: 903334 - protein, 5 aa, Mycobacterium
GGFEG

SEQ ID NO: 903335 - protein, 10 aa, Mycobacterium
GGFGGTGSPA

SEQ ID NO: 903336 - protein, 5 aa, Mycobacterium
GGFGK

SEQ ID NO: 903337 - protein, 6 aa, Mycobacterium
GGFTDK

SEQ ID NO: 903338 - protein, 8 aa, Mycobacterium
GGGANRQA

SEQ ID NO: 903339 - protein, 21 aa, Mycobacterium
GGGASDVAGDDGGADANAETT

SEQ ID NO: 903340 - protein, 20 aa, Mycobacterium
GGGASDVAGDSGGSGSAETT

SEQ ID NO: 903341 - protein, 9 aa, Mycobacterium
GGGDRRGAA

SEQ ID NO: 903342 - protein, 17 aa, Mycobacterium
GGGDTTLSAAPKGTDTW

SEQ ID NO: 903343 - protein, 5 aa, Mycobacterium
GGGEL

SEQ ID NO: 903344 - protein, 15 aa, Mycobacterium
GGGGASGPSKGTVAL

SEQ ID NO: 903345 - protein, 16 aa, Mycobacterium
GGGGDSGGGGGAGGDT

SEQ ID NO: 903346 - protein, 17 aa, Mycobacterium
GGGGPPPRSSQRWACSS

SEQ ID NO: 903347 - protein, 30 aa, Mycobacterium
GGGGRAASSSSSPAKSSAPSPTAPSSLPPG

SEQ ID NO: 903348 - protein, 13 aa, Mycobacterium
GGGGTGAGQQSLS

SEQ ID NO: 903349 - protein, 8 aa, Mycobacterium
GGGGTGIA

SEQ ID NO: 903350 - protein, 13 aa, Mycobacterium
GGGGTGNAQRGLT

SEQ ID NO: 903351 - protein, 9 aa, Mycobacterium
GGGGTQARN

SEQ ID NO: 903352 - protein, 24 aa, Mycobacterium
GGGHGNNTKHDRSDTPEHRDSAGR

SEQ ID NO: 903353 - protein, 4 aa, Mycobacterium
GGGI

SEQ ID NO: 903354 - protein, 11 aa, Mycobacterium
GGGIDPENACG

SEQ ID NO: 903355 - protein, 19 aa, Mycobacterium
GGGKPNGPSRGIDSGANTV

SEQ ID NO: 903356 - protein, 4 aa, Mycobacterium
GGGL

SEQ ID NO: 903357 - protein, 12 aa, Mycobacterium
GGGMGADSRHAG

SEQ ID NO: 903358 - protein, 19 aa, Mycobacterium
GGGNAAGPSKGIDSGAGIT

SEQ ID NO: 903359 - protein, 19 aa, Mycobacterium
GGGNAAGPSRGIDSGAGIT

SEQ ID NO: 903360 - protein, 19 aa, Mycobacterium
GGGNAAGPSRGIDSGAGTV

SEQ ID NO: 903361 - protein, 19 aa, Mycobacterium
GGGNANGPSRGIDQGANTV

SEQ ID NO: 903362 - protein, 14 aa, Mycobacterium
GGGNSATASASGLE

SEQ ID NO: 903363 - protein, 4 aa, Mycobacterium
GGGP

SEQ ID NO: 903364 - protein, 23 aa, Mycobacterium
GGGPAAGAANTSPSRIPRANGRQ

SEQ ID NO: 903365 - protein, 7 aa, Mycobacterium
GGGPDTR

SEQ ID NO: 903366 - protein, 6 aa, Mycobacterium
GGGPGI

SEQ ID NO: 903367 - protein, 7 aa, Mycobacterium
GGGPGSR

SEQ ID NO: 903368 - protein, 5 aa, Mycobacterium
GGGPH

SEQ ID NO: 903369 - protein, 6 aa, Mycobacterium
GGGPQI

SEQ ID NO: 903370 - protein, 8 aa, Mycobacterium
GGGPTGVE

SEQ ID NO: 903371 - protein, 4 aa, Mycobacterium
GGGQ

SEQ ID NO: 903372 - protein, 10 aa, Mycobacterium
GGGQDGDRFT

SEQ ID NO: 903373 - protein, 17 aa, Mycobacterium
GGGQGGQQPPPPPPAPH

SEQ ID NO: 903374 - protein, 39 aa, Mycobacterium
GGGQKGPASSGPSATSGASGPSAASTTSTVDPISPDTAN

SEQ ID NO: 903375 - protein, 15 aa, Mycobacterium
GGGRASRLIDRRPPF

SEQ ID NO: 903376 - protein, 16 aa, Mycobacterium
GGGREGKSVESGGWTT

SEQ ID NO: 903377 - protein, 6 aa, Mycobacterium
GGGRPM

SEQ ID NO: 903378 - protein, 9 aa, Mycobacterium
GGGRQKTHY

SEQ ID NO: 903379 - protein, 5 aa, Mycobacterium
GGGSF

SEQ ID NO: 903380 - protein, 17 aa, Mycobacterium
GGGSGGDAGNAGDDASL

SEQ ID NO: 903381 - protein, 18 aa, Mycobacterium
GGGSIVNTSSGAALGSDP

SEQ ID NO: 903382 - protein, 9 aa, Mycobacterium
GGGSPQARS

SEQ ID NO: 903383 - protein, 12 aa, Mycobacterium
GGGSSGAGQQRL

SEQ ID NO: 903384 - protein, 10 aa, Mycobacterium
GGGSSSSGPV

SEQ ID NO: 903385 - protein, 9 aa, Mycobacterium
GGGSVKPPN

SEQ ID NO: 903386 - protein, 5 aa, Mycobacterium
GGGSY

SEQ ID NO: 903387 - protein, 17 aa, Mycobacterium
GGGTDGDRYVNSSEDGA

SEQ ID NO: 903388 - protein, 10 aa, Mycobacterium
GGGTGDDGAR

SEQ ID NO: 903389 - protein, 11 aa, Mycobacterium
GGGTGGTGGAG

SEQ ID NO: 903390 - protein, 8 aa, Mycobacterium
GGGTGLYD

SEQ ID NO: 903391 - protein, 8 aa, Mycobacterium
GGGTPERF

SEQ ID NO: 903392 - protein, 6 aa, Mycobacterium
GGGTSV

SEQ ID NO: 903393 - protein, 4 aa, Mycobacterium
GGGV

SEQ ID NO: 903394 - protein, 5 aa, Mycobacterium
GGGVS

SEQ ID NO: 903395 - protein, 4 aa, Mycobacterium
GGHA

SEQ ID NO: 903396 - protein, 19 aa, Mycobacterium
GGHAGQYGTGHGATSITVP

SEQ ID NO: 903397 - protein, 5 aa, Mycobacterium
GGHAN

SEQ ID NO: 903398 - protein, 9 aa, Mycobacterium
GGHDDPDPL

SEQ ID NO: 903399 - protein, 13 aa, Mycobacterium
GGHDVPETKVRER

SEQ ID NO: 903400 - protein, 14 aa, Mycobacterium
GGHGGNGGRGGVDP

SEQ ID NO: 903401 - protein, 5 aa, Mycobacterium
GGHGI

SEQ ID NO: 903402 - protein, 6 aa, Mycobacterium
GGHGRS

SEQ ID NO: 903403 - protein, 19 aa, Mycobacterium
GGHPGQYGTGHGATSVTVA

SEQ ID NO: 903404 - protein, 6 aa, Mycobacterium
GGHPRL

SEQ ID NO: 903405 - protein, 20 aa, Mycobacterium
GGHSGTDSVRRERKIVEYQP

SEQ ID NO: 903406 - protein, 17 aa, Mycobacterium
GGHSSNTSSSTGSSTPL

SEQ ID NO: 903407 - protein, 8 aa, Mycobacterium
GGHSTATV

SEQ ID NO: 903408 - protein, 4 aa, Mycobacterium
GGHT

SEQ ID NO: 903409 - protein, 8 aa, Mycobacterium
GGHTWPGA

SEQ ID NO: 903410 - protein, 9 aa, Mycobacterium
GGHTWPGGR

SEQ ID NO: 903411 - protein, 8 aa, Mycobacterium
GGHTWPGS

SEQ ID NO: 903412 - protein, 6 aa, Mycobacterium
GGHYPT

SEQ ID NO: 903413 - protein, 10 aa, Mycobacterium
GGIASADPDV

SEQ ID NO: 903414 - protein, 4 aa, Mycobacterium
GGIE

SEQ ID NO: 903415 - protein, 6 aa, Mycobacterium
GGIGGN

SEQ ID NO: 903416 - protein, 7 aa, Mycobacterium
GGIGGNH

SEQ ID NO: 903417 - protein, 8 aa, Mycobacterium
GGIGPDTR

SEQ ID NO: 903418 - protein, 13 aa, Mycobacterium
GGIGPFGGPGFPA

SEQ ID NO: 903419 - protein, 18 aa, Mycobacterium
GGINGPTRGTGTGANTVG

SEQ ID NO: 903420 - protein, 15 aa, Mycobacterium
GGINGPTRGTGTGIN

SEQ ID NO: 903421 - protein, 6 aa, Mycobacterium
GGIPES

SEQ ID NO: 903422 - protein, 23 aa, Mycobacterium
GGISASGAAPSMPAASVPGGSVE

SEQ ID NO: 903423 - protein, 5 aa, Mycobacterium
GGISE

SEQ ID NO: 903424 - protein, 5 aa, Mycobacterium
GGITD

SEQ ID NO: 903425 - protein, 13 aa, Mycobacterium
GGITGPSRGKGTG

SEQ ID NO: 903426 - protein, 26 aa, Mycobacterium
GGKAPTPPQAKPDTCKASDGPTADTV

SEQ ID NO: 903427 - protein, 6 aa, Mycobacterium
GGKFPT

SEQ ID NO: 903428 - protein, 10 aa, Mycobacterium
GGKGEPTAID

SEQ ID NO: 903429 - protein, 5 aa, Mycobacterium
GGKGR

SEQ ID NO: 903430 - protein, 20 aa, Mycobacterium
GGKGWKPFADPPAGEGPRHS

SEQ ID NO: 903431 - protein, 17 aa, Mycobacterium
GGKIPQGDYTVTDVFEE

SEQ ID NO: 903432 - protein, 8 aa, Mycobacterium
GGKLPPPV

SEQ ID NO: 903433 - protein, 14 aa, Mycobacterium
GGKPCPPPPPPAEQ

SEQ ID NO: 903434 - protein, 10 aa, Mycobacterium
GGKQEHKSDA

SEQ ID NO: 903435 - protein, 4 aa, Mycobacterium
GGKR

SEQ ID NO: 903436 - protein, 9 aa, Mycobacterium
GGKRARAQV

SEQ ID NO: 903437 - protein, 4 aa, Mycobacterium
GGKS

SEQ ID NO: 903438 - protein, 8 aa, Mycobacterium
GGKSSSQR

SEQ ID NO: 903439 - protein, 7 aa, Mycobacterium
GGKVTKM

SEQ ID NO: 903440 - protein, 15 aa, Mycobacterium
GGKYAPRADLATREE

SEQ ID NO: 903441 - protein, 4 aa, Mycobacterium
GGLA

SEQ ID NO: 903442 - protein, 9 aa, Mycobacterium
GGLAAGNEV

SEQ ID NO: 903443 - protein, 6 aa, Mycobacterium
GGLAGS

SEQ ID NO: 903444 - protein, 9 aa, Mycobacterium
GGLDPERGA

SEQ ID NO: 903445 - protein, 9 aa, Mycobacterium
GGLEEGKLK

SEQ ID NO: 903446 - protein, 6 aa, Mycobacterium
GGLETD

SEQ ID NO: 903447 - protein, 11 aa, Mycobacterium
GGLGGNGGAAG

SEQ ID NO: 903448 - protein, 5 aa, Mycobacterium
GGLGP

SEQ ID NO: 903449 - protein, 17 aa, Mycobacterium
GGLGPDAACTQSVDEDD

SEQ ID NO: 903450 - protein, 5 aa, Mycobacterium
GGLGQ

SEQ ID NO: 903451 - protein, 6 aa, Mycobacterium
GGLGQV

SEQ ID NO: 903452 - protein, 5 aa, Mycobacterium
GGLMS

SEQ ID NO: 903453 - protein, 7 aa, Mycobacterium
GGLNKGT

SEQ ID NO: 903454 - protein, 9 aa, Mycobacterium
GGLNPRSDI

SEQ ID NO: 903455 - protein, 9 aa, Mycobacterium
GGLNVPPEA

SEQ ID NO: 903456 - protein, 14 aa, Mycobacterium
GGLPADAGNQGASV

SEQ ID NO: 903457 - protein, 8 aa, Mycobacterium
GGLPALPA

SEQ ID NO: 903458 - protein, 14 aa, Mycobacterium
GGLPDDAGNKGSTV

SEQ ID NO: 903459 - protein, 5 aa, Mycobacterium
GGLPL

SEQ ID NO: 903460 - protein, 8 aa, Mycobacterium
GGLPPEQT

SEQ ID NO: 903461 - protein, 4 aa, Mycobacterium
GGLR

SEQ ID NO: 903462 - protein, 10 aa, Mycobacterium
GGLRKEGRER

SEQ ID NO: 903463 - protein, 4 aa, Mycobacterium
GGLT

SEQ ID NO: 903464 - protein, 54 aa, Mycobacterium
GGLTPTAATPAAAAPAAAAPVAAAAADAGPVSAGANSGSTAGAGLRSPAAGYSG

SEQ ID NO: 903465 - protein, 14 aa, Mycobacterium
GGLTSGASQPKTTV

SEQ ID NO: 903466 - protein, 7 aa, Mycobacterium
GGLTTAD

SEQ ID NO: 903467 - protein, 6 aa, Mycobacterium
GGMQDD

SEQ ID NO: 903468 - protein, 12 aa, Mycobacterium
GGMTAQNYASKR

SEQ ID NO: 903469 - protein, 6 aa, Mycobacterium
GGMTDA

SEQ ID NO: 903470 - protein, 18 aa, Mycobacterium
GGNAAGPSKGIDSGAGIT

SEQ ID NO: 903471 - protein, 6 aa, Mycobacterium
GGNAAQ

SEQ ID NO: 903472 - protein, 14 aa, Mycobacterium
GGNATSPFTTPEQA

SEQ ID NO: 903473 - protein, 8 aa, Mycobacterium
GGNDAGFE

SEQ ID NO: 903474 - protein, 5 aa, Mycobacterium
GGNDV

SEQ ID NO: 903475 - protein, 26 aa, Mycobacterium
GGNGGNGGDGQLGGPGTGGTGGTGGT

SEQ ID NO: 903476 - protein, 19 aa, Mycobacterium
GGNGGNGGNGGNGGAGGDA

SEQ ID NO: 903477 - protein, 5 aa, Mycobacterium
GGNPI

SEQ ID NO: 903478 - protein, 9 aa, Mycobacterium
GGNPLNDPP

SEQ ID NO: 903479 - protein, 8 aa, Mycobacterium
GGNPPAGA

SEQ ID NO: 903480 - protein, 10 aa, Mycobacterium
GGNPQRGVTE

SEQ ID NO: 903481 - protein, 6 aa, Mycobacterium
GGNVEG

SEQ ID NO: 903482 - protein, 5 aa, Mycobacterium
GGNVR

SEQ ID NO: 903483 - protein, 5 aa, Mycobacterium
GGPAE

SEQ ID NO: 903484 - protein, 9 aa, Mycobacterium
GGPAEAAGL

SEQ ID NO: 903485 - protein, 10 aa, Mycobacterium
GGPAGPADAD

SEQ ID NO: 903486 - protein, 21 aa, Mycobacterium
GGPAGPADENWTKQEAGTDRR

SEQ ID NO: 903487 - protein, 17 aa, Mycobacterium
GGPAQAQVPRNAIPPLA

SEQ ID NO: 903488 - protein, 23 aa, Mycobacterium
GGPAWGPNNPMQRDGNNIFPMPG

SEQ ID NO: 903489 - protein, 46 aa, Mycobacterium
GGPDTTPPPSRFQTPPGPPNAYSNMGPPPPGPPPAADAASVATGSG

SEQ ID NO: 903490 - protein, 6 aa, Mycobacterium
GGPEAA

SEQ ID NO: 903491 - protein, 5 aa, Mycobacterium
GGPEK

SEQ ID NO: 903492 - protein, 13 aa, Mycobacterium
GGPELKAGGEAAW

SEQ ID NO: 903493 - protein, 14 aa, Mycobacterium
GGPESDGSGGPGYQ

SEQ ID NO: 903494 - protein, 30 aa, Mycobacterium
GGPFGRQTPVANAPYPNAPGAWGPGSMGPG

SEQ ID NO: 903495 - protein, 8 aa, Mycobacterium
GGPGAGPL

SEQ ID NO: 903496 - protein, 12 aa, Mycobacterium
GGPGDSGGPVTV

SEQ ID NO: 903497 - protein, 12 aa, Mycobacterium
GGPGGAATLSAP

SEQ ID NO: 903498 - protein, 14 aa, Mycobacterium
GGPGNFTQQEARST

SEQ ID NO: 903499 - protein, 7 aa, Mycobacterium
GGPGPGA

SEQ ID NO: 903500 - protein, 9 aa, Mycobacterium
GGPGSYAEQ

SEQ ID NO: 903501 - protein, 8 aa, Mycobacterium
GGPKETEK

SEQ ID NO: 903502 - protein, 14 aa, Mycobacterium
GGPKSAKLAGQHGD

SEQ ID NO: 903503 - protein, 6 aa, Mycobacterium
GGPKYT

SEQ ID NO: 903504 - protein, 4 aa, Mycobacterium
GGPL

SEQ ID NO: 903505 - protein, 14 aa, Mycobacterium
GGPPDPSKGRCSEN

SEQ ID NO: 903506 - protein, 21 aa, Mycobacterium
GGPPGPADASWTKQEAGTDRR

SEQ ID NO: 903507 - protein, 21 aa, Mycobacterium
GGPPTATDSAWTKQEAGTDRR

SEQ ID NO: 903508 - protein, 5 aa, Mycobacterium
GGPQT

SEQ ID NO: 903509 - protein, 8 aa, Mycobacterium
GGPRTGEL

SEQ ID NO: 903510 - protein, 6 aa, Mycobacterium
GGPSAV

SEQ ID NO: 903511 - protein, 6 aa, Mycobacterium
GGPTYW

SEQ ID NO: 903512 - protein, 4 aa, Mycobacterium
GGPV

SEQ ID NO: 903513 - protein, 5 aa, Mycobacterium
GGPVL

SEQ ID NO: 903514 - protein, 8 aa, Mycobacterium
GGPVSDHK

SEQ ID NO: 903515 - protein, 10 aa, Mycobacterium
GGPVVGPPPF

SEQ ID NO: 903516 - protein, 8 aa, Mycobacterium
GGPYPPGM

SEQ ID NO: 903517 - protein, 25 aa, Mycobacterium
GGQAPALSKLGGSDWANTKTKARRA

SEQ ID NO: 903518 - protein, 14 aa, Mycobacterium
GGQAVTASNASNPD

SEQ ID NO: 903519 - protein, 22 aa, Mycobacterium
GGQFTSLDGTPGPHGGSAVASN

SEQ ID NO: 903520 - protein, 25 aa, Mycobacterium
GGQGGSPSITTTTTTAPTTSTSGGF

SEQ ID NO: 903521 - protein, 8 aa, Mycobacterium
GGQGQGTV

SEQ ID NO: 903522 - protein, 15 aa, Mycobacterium
GGQGRQGLLDAPLTG

SEQ ID NO: 903523 - protein, 7 aa, Mycobacterium
GGQLGPI

SEQ ID NO: 903524 - protein, 14 aa, Mycobacterium
GGQPDPSKGRCAFA

SEQ ID NO: 903525 - protein, 9 aa, Mycobacterium
GGQPGMTKK

SEQ ID NO: 903526 - protein, 4 aa, Mycobacterium
GGQR

SEQ ID NO: 903527 - protein, 9 aa, Mycobacterium
GGQSSNYTD

SEQ ID NO: 903528 - protein, 4 aa, Mycobacterium
GGQT

SEQ ID NO: 903529 - protein, 16 aa, Mycobacterium
GGQTNTAGLSSMPGNA

SEQ ID NO: 903530 - protein, 13 aa, Mycobacterium
GGQVLSEDGRRVT

SEQ ID NO: 903531 - protein, 4 aa, Mycobacterium
GGQW

SEQ ID NO: 903532 - protein, 16 aa, Mycobacterium
GGRARGVRARRPDGTA

SEQ ID NO: 903533 - protein, 6 aa, Mycobacterium
GGRASG

SEQ ID NO: 903534 - protein, 8 aa, Mycobacterium
GGRGDHSD

SEQ ID NO: 903535 - protein, 16 aa, Mycobacterium
GGRGPSARELARTDTV

SEQ ID NO: 903536 - protein, 15 aa, Mycobacterium
GGRHDTSDLSERAGG

SEQ ID NO: 903537 - protein, 4 aa, Mycobacterium
GGRI

SEQ ID NO: 903538 - protein, 9 aa, Mycobacterium
GGRISPRQV

SEQ ID NO: 903539 - protein, 7 aa, Mycobacterium
GGRKAVA

SEQ ID NO: 903540 - protein, 20 aa, Mycobacterium
GGRLTSLDGAPGPHGGSAVA

SEQ ID NO: 903541 - protein, 13 aa, Mycobacterium
GGRMGPGGMGGGG

SEQ ID NO: 903542 - protein, 19 aa, Mycobacterium
GGRPAHYGTGHGATSVTVP

SEQ ID NO: 903543 - protein, 8 aa, Mycobacterium
GGRPAVPE

SEQ ID NO: 903544 - protein, 5 aa, Mycobacterium
GGRPM

SEQ ID NO: 903545 - protein, 58 aa, Mycobacterium
GGRPVASPGAGAGEPSFPTPRSTPSPPSATAAPAPTAPAAPTGPTNPAGAIPLPPDQN

SEQ ID NO: 903546 - protein, 4 aa, Mycobacterium
GGRQ

SEQ ID NO: 903547 - protein, 9 aa, Mycobacterium
GGRQAAADR

SEQ ID NO: 903548 - protein, 28 aa, Mycobacterium
GGRRDVSGGVEDMPDGLATESDATPHDC

SEQ ID NO: 903549 - protein, 4 aa, Mycobacterium
GGRS

SEQ ID NO: 903550 - protein, 25 aa, Mycobacterium
GGRSGNTSSSTGSSTPSVPVDCGGK

SEQ ID NO: 903551 - protein, 6 aa, Mycobacterium
GGRSTS

SEQ ID NO: 903552 - protein, 8 aa, Mycobacterium
GGRTAQGR

SEQ ID NO: 903553 - protein, 7 aa, Mycobacterium
GGRTGSL

SEQ ID NO: 903554 - protein, 6 aa, Mycobacterium
GGRTNG

SEQ ID NO: 903555 - protein, 24 aa, Mycobacterium
GGRTQPTTVESRRSKSPALDAGKA

SEQ ID NO: 903556 - protein, 4 aa, Mycobacterium
GGSA

SEQ ID NO: 903557 - protein, 17 aa, Mycobacterium
GGSAADIAQQIAAKVAG

SEQ ID NO: 903558 - protein, 15 aa, Mycobacterium
GGSAAPADTHGPLTQ

SEQ ID NO: 903559 - protein, 8 aa, Mycobacterium
GGSAESLA

SEQ ID NO: 903560 - protein, 27 aa, Mycobacterium
GGSAGAGLSRASGLSATAANTSSIGTN

SEQ ID NO: 903561 - protein, 18 aa, Mycobacterium
GGSAPSVPAANMPPGSVE

SEQ ID NO: 903562 - protein, 14 aa, Mycobacterium
GGSASAGAFSRPGL

SEQ ID NO: 903563 - protein, 14 aa, Mycobacterium
GGSATAGAWSRPGL

SEQ ID NO: 903564 - protein, 5 aa, Mycobacterium
GGSAV

SEQ ID NO: 903565 - protein, 15 aa, Mycobacterium
GGSDGYGRSKAAVEA

SEQ ID NO: 903566 - protein, 11 aa, Mycobacterium
GGSDGYGTSKA

SEQ ID NO: 903567 - protein, 15 aa, Mycobacterium
GGSDPHVADDPSLAR

SEQ ID NO: 903568 - protein, 6 aa, Mycobacterium
GGSFDA

SEQ ID NO: 903569 - protein, 5 aa, Mycobacterium
GGSGF

SEQ ID NO: 903570 - protein, 44 aa, Mycobacterium
GGSGGAGGDGGAGSVGATGGAGQDGTTGATGGAGGTGGAGGRGG

SEQ ID NO: 903571 - protein, 24 aa, Mycobacterium
GGSGGGDPAAGTYPQEMLVDWVRV

SEQ ID NO: 903572 - protein, 15 aa, Mycobacterium
GGSGGREPAAGTYPA

SEQ ID NO: 903573 - protein, 14 aa, Mycobacterium
GGSGGREPAGGTYP

SEQ ID NO: 903574 - protein, 13 aa, Mycobacterium
GGSGMARPGALSR

SEQ ID NO: 903575 - protein, 20 aa, Mycobacterium
GGSGNTGAGDEASAGDCPAA

SEQ ID NO: 903576 - protein, 7 aa, Mycobacterium
GGSGTLG

SEQ ID NO: 903577 - protein, 10 aa, Mycobacterium
GGSHAGLSDV

SEQ ID NO: 903578 - protein, 6 aa, Mycobacterium
GGSKAK

SEQ ID NO: 903579 - protein, 17 aa, Mycobacterium
GGSLPDRVGQGLAAIAV

SEQ ID NO: 903580 - protein, 18 aa, Mycobacterium
GGSLQGPSKGVDSGANTV

SEQ ID NO: 903581 - protein, 22 aa, Mycobacterium
GGSNGGTPGSSTTTSTPPPVAQ

SEQ ID NO: 903582 - protein, 16 aa, Mycobacterium
GGSNVTTPPACAQTKF

SEQ ID NO: 903583 - protein, 4 aa, Mycobacterium
GGSP

SEQ ID NO: 903584 - protein, 15 aa, Mycobacterium
GGSPAPSAANTGANR

SEQ ID NO: 903585 - protein, 7 aa, Mycobacterium
GGSPRGR

SEQ ID NO: 903586 - protein, 5 aa, Mycobacterium
GGSPT

SEQ ID NO: 903587 - protein, 8 aa, Mycobacterium
GGSPTPMN

SEQ ID NO: 903588 - protein, 13 aa, Mycobacterium
GGSPYDRPPLSKD

SEQ ID NO: 903589 - protein, 6 aa, Mycobacterium
GGSRED

SEQ ID NO: 903590 - protein, 11 aa, Mycobacterium
GGSSATPTATK

SEQ ID NO: 903591 - protein, 6 aa, Mycobacterium
GGSSEY

SEQ ID NO: 903592 - protein, 10 aa, Mycobacterium
GGSSHTSTTV

SEQ ID NO: 903593 - protein, 12 aa, Mycobacterium
GGSSLSTDARKN

SEQ ID NO: 903594 - protein, 8 aa, Mycobacterium
GGSTDATL

SEQ ID NO: 903595 - protein, 11 aa, Mycobacterium
GGSTDKSPAAP

SEQ ID NO: 903596 - protein, 9 aa, Mycobacterium
GGSTGSVLP

SEQ ID NO: 903597 - protein, 15 aa, Mycobacterium
GGSTPIDDNTDAGVA

SEQ ID NO: 903598 - protein, 6 aa, Mycobacterium
GGSTVQ

SEQ ID NO: 903599 - protein, 9 aa, Mycobacterium
GGSVAGGTV

SEQ ID NO: 903600 - protein, 10 aa, Mycobacterium
GGSVAGVGES

SEQ ID NO: 903601 - protein, 5 aa, Mycobacterium
GGSVG

SEQ ID NO: 903602 - protein, 9 aa, Mycobacterium
GGSVGAPDL

SEQ ID NO: 903603 - protein, 7 aa, Mycobacterium
GGSVPAA

SEQ ID NO: 903604 - protein, 8 aa, Mycobacterium
GGSVTCGD

SEQ ID NO: 903605 - protein, 5 aa, Mycobacterium
GGSYN

SEQ ID NO: 903606 - protein, 19 aa, Mycobacterium
GGTADEPFDPNYHQKSDTI

SEQ ID NO: 903607 - protein, 19 aa, Mycobacterium
GGTADQPFDPNYHQKGDTL

SEQ ID NO: 903608 - protein, 19 aa, Mycobacterium
GGTADQPFDPNYHQKTDTL

SEQ ID NO: 903609 - protein, 11 aa, Mycobacterium
GGTANANSTFG

SEQ ID NO: 903610 - protein, 19 aa, Mycobacterium
GGTANEPFDPNYHQKGDTL

SEQ ID NO: 903611 - protein, 27 aa, Mycobacterium
GGTASTLTSATGPGLAGMGGAASEVEA

SEQ ID NO: 903612 - protein, 10 aa, Mycobacterium
GGTATAHADS

SEQ ID NO: 903613 - protein, 6 aa, Mycobacterium
GGTATV

SEQ ID NO: 903614 - protein, 5 aa, Mycobacterium
GGTDE

SEQ ID NO: 903615 - protein, 10 aa, Mycobacterium
GGTDPAGPLT

SEQ ID NO: 903616 - protein, 10 aa, Mycobacterium
GGTDTDGAEL

SEQ ID NO: 903617 - protein, 11 aa, Mycobacterium
GGTDVDTADRL

SEQ ID NO: 903618 - protein, 15 aa, Mycobacterium
GGTEIVDGNGAKIKG

SEQ ID NO: 903619 - protein, 6 aa, Mycobacterium
GGTERI

SEQ ID NO: 903620 - protein, 8 aa, Mycobacterium
GGTESGRL

SEQ ID NO: 903621 - protein, 18 aa, Mycobacterium
GGTETQSRADTFAAESEH

SEQ ID NO: 903622 - protein, 9 aa, Mycobacterium
GGTETRSHA

SEQ ID NO: 903623 - protein, 24 aa, Mycobacterium
GGTGGDGGAGSTVAGAGGHGGTAG

SEQ ID NO: 903624 - protein, 17 aa, Mycobacterium
GGTGGSGGGIGAGETAA

SEQ ID NO: 903625 - protein, 12 aa, Mycobacterium
GGTGGTGGAGGV

SEQ ID NO: 903626 - protein, 11 aa, Mycobacterium
GGTGGTGGDAL

SEQ ID NO: 903627 - protein, 6 aa, Mycobacterium
GGTGTS

SEQ ID NO: 903628 - protein, 18 aa, Mycobacterium
GGTGVAHADPDPVLPPAP

SEQ ID NO: 903629 - protein, 15 aa, Mycobacterium
GGTHGRLPDSDEDTP

SEQ ID NO: 903630 - protein, 6 aa, Mycobacterium
GGTKAV

SEQ ID NO: 903631 - protein, 18 aa, Mycobacterium
GGTLEGPSKGVDSGAGTV

SEQ ID NO: 903632 - protein, 13 aa, Mycobacterium
GGTLGPGGVADRN

SEQ ID NO: 903633 - protein, 10 aa, Mycobacterium
GGTLPGTEGL

SEQ ID NO: 903634 - protein, 11 aa, Mycobacterium
GGTLSGTDGLG

SEQ ID NO: 903635 - protein, 6 aa, Mycobacterium
GGTMTG

SEQ ID NO: 903636 - protein, 5 aa, Mycobacterium
GGTNE

SEQ ID NO: 903637 - protein, 8 aa, Mycobacterium
GGTPEEFA

SEQ ID NO: 903638 - protein, 15 aa, Mycobacterium
GGTPFPSDACSEETA

SEQ ID NO: 903639 - protein, 17 aa, Mycobacterium
GGTPPDLGIGEPPADSA

SEQ ID NO: 903640 - protein, 5 aa, Mycobacterium
GGTQM

SEQ ID NO: 903641 - protein, 10 aa, Mycobacterium
GGTRLGPGGA

SEQ ID NO: 903642 - protein, 7 aa, Mycobacterium
GGTRSST

SEQ ID NO: 903643 - protein, 11 aa, Mycobacterium
GGTSAPGSRMY

SEQ ID NO: 903644 - protein, 5 aa, Mycobacterium
GGTSF

SEQ ID NO: 903645 - protein, 7 aa, Mycobacterium
GGTSGFT

SEQ ID NO: 903646 - protein, 6 aa, Mycobacterium
GGTSTD

SEQ ID NO: 903647 - protein, 8 aa, Mycobacterium
GGTTAAST

SEQ ID NO: 903648 - protein, 17 aa, Mycobacterium
GGTTAKQAEKKEQPAPQ

SEQ ID NO: 903649 - protein, 10 aa, Mycobacterium
GGTTKGTVTS

SEQ ID NO: 903650 - protein, 8 aa, Mycobacterium
GGTTSGYG

SEQ ID NO: 903651 - protein, 5 aa, Mycobacterium
GGTTV

SEQ ID NO: 903652 - protein, 22 aa, Mycobacterium
GGTVNSGINNSGNTNAGIGNLG

SEQ ID NO: 903653 - protein, 20 aa, Mycobacterium
GGTVRGPSGGVDYDSGKVGY

SEQ ID NO: 903654 - protein, 7 aa, Mycobacterium
GGTVTAA

SEQ ID NO: 903655 - protein, 12 aa, Mycobacterium
GGTVTGEYPEYG

SEQ ID NO: 903656 - protein, 6 aa, Mycobacterium
GGTYDP

SEQ ID NO: 903657 - protein, 9 aa, Mycobacterium
GGVAGSAGV

SEQ ID NO: 903658 - protein, 17 aa, Mycobacterium
GGVGGDGGAAGANPASF

SEQ ID NO: 903659 - protein, 14 aa, Mycobacterium
GGVGGTGGAGGGGA

SEQ ID NO: 903660 - protein, 15 aa, Mycobacterium
GGVGNPAEASREEQI

SEQ ID NO: 903661 - protein, 14 aa, Mycobacterium
GGVGNPASASKQQQ

SEQ ID NO: 903662 - protein, 15 aa, Mycobacterium
GGVGQGASGNNGTSA

SEQ ID NO: 903663 - protein, 6 aa, Mycobacterium
GGVGQV

SEQ ID NO: 903664 - protein, 95 aa, Mycobacterium
GGVPDEEGDPVGTGNGKGGNGGAGGNGGVAVGNGGNGGIGGDGYNETGGTKTPVAGKGGPGGAGGAIGSDGDAGADGETETSSGSSGSAGSADSD

SEQ ID NO: 903665 - protein, 11 aa, Mycobacterium
GGVPGEVPQDS

SEQ ID NO: 903666 - protein, 11 aa, Mycobacterium
GGVPGSGSTGS

SEQ ID NO: 903667 - protein, 10 aa, Mycobacterium
GGVPPPPTSW

SEQ ID NO: 903668 - protein, 4 aa, Mycobacterium
GGVQ

SEQ ID NO: 903669 - protein, 10 aa, Mycobacterium
GGVRTGAATY

SEQ ID NO: 903670 - protein, 7 aa, Mycobacterium
GGVSAGA

SEQ ID NO: 903671 - protein, 11 aa, Mycobacterium
GGVSGAETQMP

SEQ ID NO: 903672 - protein, 9 aa, Mycobacterium
GGVSLTEAG

SEQ ID NO: 903673 - protein, 15 aa, Mycobacterium
GGVTGNADACYSRYP

SEQ ID NO: 903674 - protein, 14 aa, Mycobacterium
GGVTGPTRGKGSGI

SEQ ID NO: 903675 - protein, 5 aa, Mycobacterium
GGVTT

SEQ ID NO: 903676 - protein, 14 aa, Mycobacterium
GGVTVDGNRVRAEA

SEQ ID NO: 903677 - protein, 4 aa, Mycobacterium
GGYA

SEQ ID NO: 903678 - protein, 5 aa, Mycobacterium
GGYDG

SEQ ID NO: 903679 - protein, 5 aa, Mycobacterium
GGYDP

SEQ ID NO: 903680 - protein, 4 aa, Mycobacterium
GGYR

SEQ ID NO: 903681 - protein, 6 aa, Mycobacterium
GGYRIG

SEQ ID NO: 903682 - protein, 31 aa, Mycobacterium
GGYTVTGTASDAGITVTPTAGQFSSDGSAGI

SEQ ID NO: 903683 - protein, 9 aa, Mycobacterium
GHAAYANTA

SEQ ID NO: 903684 - protein, 4 aa, Mycobacterium
GHAG

SEQ ID NO: 903685 - protein, 15 aa, Mycobacterium
GHAPQPGKFTVTGDQ

SEQ ID NO: 903686 - protein, 4 aa, Mycobacterium
GHAT

SEQ ID NO: 903687 - protein, 6 aa, Mycobacterium
GHDDST

SEQ ID NO: 903688 - protein, 7 aa, Mycobacterium
GHDGKGN

SEQ ID NO: 903689 - protein, 9 aa, Mycobacterium
GHDGSNGKA

SEQ ID NO: 903690 - protein, 7 aa, Mycobacterium
GHDKNGD

SEQ ID NO: 903691 - protein, 6 aa, Mycobacterium
GHDRIT

SEQ ID NO: 903692 - protein, 10 aa, Mycobacterium
GHDSPIQYGQ

SEQ ID NO: 903693 - protein, 6 aa, Mycobacterium
GHDSSA

SEQ ID NO: 903694 - protein, 11 aa, Mycobacterium
GHDTTDPDTGA

SEQ ID NO: 903695 - protein, 13 aa, Mycobacterium
GHDTTGTATWPGA

SEQ ID NO: 903696 - protein, 4 aa, Mycobacterium
GHEI

SEQ ID NO: 903697 - protein, 16 aa, Mycobacterium
GHEPGAARDTPAEPTV

SEQ ID NO: 903698 - protein, 17 aa, Mycobacterium
GHGGGRCDSPPAPDGSF

SEQ ID NO: 903699 - protein, 5 aa, Mycobacterium
GHGGL

SEQ ID NO: 903700 - protein, 16 aa, Mycobacterium
GHGGTGGNGGAAGNGG

SEQ ID NO: 903701 - protein, 14 aa, Mycobacterium
GHGHASGDSHTNGV

SEQ ID NO: 903702 - protein, 14 aa, Mycobacterium
GHGHGSGDSHTGGV

SEQ ID NO: 903703 - protein, 15 aa, Mycobacterium
GHGHGSGDSHTGGVV

SEQ ID NO: 903704 - protein, 48 aa, Mycobacterium
GHGNKRSSAAPPSTSTSVSQPKNSAQNATDCTPNVSGGEMPRGDSITA

SEQ ID NO: 903705 - protein, 5 aa, Mycobacterium
GHGNS

SEQ ID NO: 903706 - protein, 23 aa, Mycobacterium
GHGNVGPSTAPPQSGPPAIDKPK

SEQ ID NO: 903707 - protein, 13 aa, Mycobacterium
GHGQSGDAPPETY

SEQ ID NO: 903708 - protein, 14 aa, Mycobacterium
GHGRASGDSHTGGV

SEQ ID NO: 903709 - protein, 8 aa, Mycobacterium
GHGRDEEL

SEQ ID NO: 903710 - protein, 4 aa, Mycobacterium
GHGS

SEQ ID NO: 903711 - protein, 9 aa, Mycobacterium
GHGSAFGTG

SEQ ID NO: 903712 - protein, 11 aa, Mycobacterium
GHGSGSGDSHV

SEQ ID NO: 903713 - protein, 5 aa, Mycobacterium
GHGTA

SEQ ID NO: 903714 - protein, 12 aa, Mycobacterium
GHGTGTTLGDPI

SEQ ID NO: 903715 - protein, 6 aa, Mycobacterium
GHGTGV

SEQ ID NO: 903716 - protein, 7 aa, Mycobacterium
GHGTSSA

SEQ ID NO: 903717 - protein, 7 aa, Mycobacterium
GHGTTTE

SEQ ID NO: 903718 - protein, 8 aa, Mycobacterium
GHHDPASM

SEQ ID NO: 903719 - protein, 5 aa, Mycobacterium
GHHPG

SEQ ID NO: 903720 - protein, 6 aa, Mycobacterium
GHKPLD

SEQ ID NO: 903721 - protein, 6 aa, Mycobacterium
GHLTTA

SEQ ID NO: 903722 - protein, 37 aa, Mycobacterium
GHNGANDASIGRQVPTGRGGTKDCQASGTSSNSGYPE

SEQ ID NO: 903723 - protein, 38 aa, Mycobacterium
GHNGANDASIGRQVPTGRGGTKNCQESGTATDDGYPEH

SEQ ID NO: 903724 - protein, 9 aa, Mycobacterium
GHNGDIPGY

SEQ ID NO: 903725 - protein, 36 aa, Mycobacterium
GHNGSNDASISRQVPTGRGGTKDCQASGTASAAGYQ

SEQ ID NO: 903726 - protein, 9 aa, Mycobacterium
GHNSENSSF

SEQ ID NO: 903727 - protein, 60 aa, Mycobacterium
GHPAYTQDHPNRPHGDDDDDWGGHDGRHNNGNWRGDDSRRDRDRDWRDDGRWQDDRREWR

SEQ ID NO: 903728 - protein, 14 aa, Mycobacterium
GHPDGHPETKRKVV

SEQ ID NO: 903729 - protein, 13 aa, Mycobacterium
GHPDPSSGTIDAP

SEQ ID NO: 903730 - protein, 22 aa, Mycobacterium
GHPDTGAKSSSATATATSGEAA

SEQ ID NO: 903731 - protein, 10 aa, Mycobacterium
GHPESAGPGL

SEQ ID NO: 903732 - protein, 7 aa, Mycobacterium
GHPHQEN

SEQ ID NO: 903733 - protein, 6 aa, Mycobacterium
GHPHSG

SEQ ID NO: 903734 - protein, 7 aa, Mycobacterium
GHPNTDA

SEQ ID NO: 903735 - protein, 18 aa, Mycobacterium
GHPRIGARADNASSAREQ

SEQ ID NO: 903736 - protein, 8 aa, Mycobacterium
GHPTGSLS

SEQ ID NO: 903737 - protein, 4 aa, Mycobacterium
GHPV

SEQ ID NO: 903738 - protein, 4 aa, Mycobacterium
GHQA

SEQ ID NO: 903739 - protein, 11 aa, Mycobacterium
GHQDDQPTSVA

SEQ ID NO: 903740 - protein, 7 aa, Mycobacterium
GHQDTSH

SEQ ID NO: 903741 - protein, 7 aa, Mycobacterium
GHQGSME

SEQ ID NO: 903742 - protein, 6 aa, Mycobacterium
GHQPGA

SEQ ID NO: 903743 - protein, 5 aa, Mycobacterium
GHQPQ

SEQ ID NO: 903744 - protein, 5 aa, Mycobacterium
GHQVA

SEQ ID NO: 903745 - protein, 14 aa, Mycobacterium
GHQWPGGEPSPLAE

SEQ ID NO: 903746 - protein, 11 aa, Mycobacterium
GHQWPGSTRGP

SEQ ID NO: 903747 - protein, 8 aa, Mycobacterium
GHRAPSAI

SEQ ID NO: 903748 - protein, 8 aa, Mycobacterium
GHRQGSPT

SEQ ID NO: 903749 - protein, 11 aa, Mycobacterium
GHRSQVARDRY

SEQ ID NO: 903750 - protein, 10 aa, Mycobacterium
GHSAGEPSCA

SEQ ID NO: 903751 - protein, 7 aa, Mycobacterium
GHSAQNA

SEQ ID NO: 903752 - protein, 6 aa, Mycobacterium
GHSDQF

SEQ ID NO: 903753 - protein, 5 aa, Mycobacterium
GHSEA

SEQ ID NO: 903754 - protein, 11 aa, Mycobacterium
GHSGESLSDEG

SEQ ID NO: 903755 - protein, 12 aa, Mycobacterium
GHSGHPASGDLS

SEQ ID NO: 903756 - protein, 6 aa, Mycobacterium
GHSQGG

SEQ ID NO: 903757 - protein, 6 aa, Mycobacterium
GHSRAA

SEQ ID NO: 903758 - protein, 29 aa, Mycobacterium
GHTDNAATKIECGGKKELQDAGSTAQQNA

SEQ ID NO: 903759 - protein, 4 aa, Mycobacterium
GHTE

SEQ ID NO: 903760 - protein, 5 aa, Mycobacterium
GHTEA

SEQ ID NO: 903761 - protein, 6 aa, Mycobacterium
GHTEGR

SEQ ID NO: 903762 - protein, 11 aa, Mycobacterium
GHTPADHDGYP

SEQ ID NO: 903763 - protein, 11 aa, Mycobacterium
GHTPPDSDGYP

SEQ ID NO: 903764 - protein, 5 aa, Mycobacterium
GHTPT

SEQ ID NO: 903765 - protein, 6 aa, Mycobacterium
GHTPTL

SEQ ID NO: 903766 - protein, 4 aa, Mycobacterium
GHTR

SEQ ID NO: 903767 - protein, 14 aa, Mycobacterium
GHTVGREKSPSEAL

SEQ ID NO: 903768 - protein, 14 aa, Mycobacterium
GHTVGREKSPSKAL

SEQ ID NO: 903769 - protein, 16 aa, Mycobacterium
GHTVGRRSHPSDDVDE

SEQ ID NO: 903770 - protein, 5 aa, Mycobacterium
GHTYT

SEQ ID NO: 903771 - protein, 10 aa, Mycobacterium
GHVAGTPGFE

SEQ ID NO: 903772 - protein, 13 aa, Mycobacterium
GHVGGTPGFDPGR

SEQ ID NO: 903773 - protein, 18 aa, Mycobacterium
GHYNAPGHTGKPESGDLT

SEQ ID NO: 903774 - protein, 6 aa, Mycobacterium
GIAAGS

SEQ ID NO: 903775 - protein, 5 aa, Mycobacterium
GIAAT

SEQ ID NO: 903776 - protein, 38 aa, Mycobacterium
GIAGAGGHGGTAGSGGQSSGNADGGDGGTGGAGGTSGR

SEQ ID NO: 903777 - protein, 5 aa, Mycobacterium
GIAGP

SEQ ID NO: 903778 - protein, 13 aa, Mycobacterium
GIAGPGADGRPRY

SEQ ID NO: 903779 - protein, 13 aa, Mycobacterium
GIAGPGPDGRPRY

SEQ ID NO: 903780 - protein, 12 aa, Mycobacterium
GIAGSAAALRSP

SEQ ID NO: 903781 - protein, 11 aa, Mycobacterium
GIANSGSDSSG

SEQ ID NO: 903782 - protein, 8 aa, Mycobacterium
GIAPPTAD

SEQ ID NO: 903783 - protein, 7 aa, Mycobacterium
GIAPQQV

SEQ ID NO: 903784 - protein, 5 aa, Mycobacterium
GIAPT

SEQ ID NO: 903785 - protein, 7 aa, Mycobacterium
GIASENR

SEQ ID NO: 903786 - protein, 7 aa, Mycobacterium
GIASRDG

SEQ ID NO: 903787 - protein, 12 aa, Mycobacterium
GICDPNGGGLGP

SEQ ID NO: 903788 - protein, 21 aa, Mycobacterium
GIDGEPTAERGAGPSGPIQPA

SEQ ID NO: 903789 - protein, 6 aa, Mycobacterium
GIDPRV

SEQ ID NO: 903790 - protein, 6 aa, Mycobacterium
GIDRQT

SEQ ID NO: 903791 - protein, 5 aa, Mycobacterium
GIDST

SEQ ID NO: 903792 - protein, 7 aa, Mycobacterium
GIDTPQD

SEQ ID NO: 903793 - protein, 17 aa, Mycobacterium
GIDTSGAKLVDSSGLSV

SEQ ID NO: 903794 - protein, 12 aa, Mycobacterium
GIEGSPERLPEG

SEQ ID NO: 903795 - protein, 10 aa, Mycobacterium
GIENETAPRW

SEQ ID NO: 903796 - protein, 16 aa, Mycobacterium
GIEPPQVAEPHTQPTI

SEQ ID NO: 903797 - protein, 10 aa, Mycobacterium
GIEPSEDPML

SEQ ID NO: 903798 - protein, 9 aa, Mycobacterium
GIETSDRQL

SEQ ID NO: 903799 - protein, 6 aa, Mycobacterium
GIGDER

SEQ ID NO: 903800 - protein, 5 aa, Mycobacterium
GIGGA

SEQ ID NO: 903801 - protein, 8 aa, Mycobacterium
GIGGAAAT

SEQ ID NO: 903802 - protein, 6 aa, Mycobacterium
GIGGAS

SEQ ID NO: 903803 - protein, 19 aa, Mycobacterium
GIGGDGGGGGDGGAGGNGG

SEQ ID NO: 903804 - protein, 9 aa, Mycobacterium
GIGNNGSGN

SEQ ID NO: 903805 - protein, 5 aa, Mycobacterium
GIGPG

SEQ ID NO: 903806 - protein, 10 aa, Mycobacterium
GIGPNGGPIG

SEQ ID NO: 903807 - protein, 8 aa, Mycobacterium
GIHPTDAG

SEQ ID NO: 903808 - protein, 7 aa, Mycobacterium
GIIPGSR

SEQ ID NO: 903809 - protein, 13 aa, Mycobacterium
GILNSSKKKEDAQ

SEQ ID NO: 903810 - protein, 10 aa, Mycobacterium
GINAHPGIGS

SEQ ID NO: 903811 - protein, 16 aa, Mycobacterium
GINAPGPDPAHTPSPI

SEQ ID NO: 903812 - protein, 7 aa, Mycobacterium
GINFESP

SEQ ID NO: 903813 - protein, 5 aa, Mycobacterium
GINPA

SEQ ID NO: 903814 - protein, 7 aa, Mycobacterium
GINPSPE

SEQ ID NO: 903815 - protein, 20 aa, Mycobacterium
GINSSNPDKVVTTEFKIVAE

SEQ ID NO: 903816 - protein, 12 aa, Mycobacterium
GINYESPETAIR

SEQ ID NO: 903817 - protein, 13 aa, Mycobacterium
GIPDGDEKPTAGA

SEQ ID NO: 903818 - protein, 16 aa, Mycobacterium
GIPEGDASAYWGSTLF

SEQ ID NO: 903819 - protein, 7 aa, Mycobacterium
GIPFSTA

SEQ ID NO: 903820 - protein, 12 aa, Mycobacterium
GIPGKDSTSDVL

SEQ ID NO: 903821 - protein, 13 aa, Mycobacterium
GIPGSAGATPIQN

SEQ ID NO: 903822 - protein, 13 aa, Mycobacterium
GIPGSAGATPVQN

SEQ ID NO: 903823 - protein, 7 aa, Mycobacterium
GIPGSDS

SEQ ID NO: 903824 - protein, 5 aa, Mycobacterium
GIPMP

SEQ ID NO: 903825 - protein, 19 aa, Mycobacterium
GIPPAPPPPPEGAPPPVGS

SEQ ID NO: 903826 - protein, 18 aa, Mycobacterium
GIPPAPPPPPEGAPVPVG

SEQ ID NO: 903827 - protein, 20 aa, Mycobacterium
GIPPAPPPPPEGEPPPPVGS

SEQ ID NO: 903828 - protein, 13 aa, Mycobacterium
GIPPGDVAPPPAA

SEQ ID NO: 903829 - protein, 12 aa, Mycobacterium
GIPSSSSPQAIG

SEQ ID NO: 903830 - protein, 5 aa, Mycobacterium
GIQGG

SEQ ID NO: 903831 - protein, 8 aa, Mycobacterium
GIQNGTVD

SEQ ID NO: 903832 - protein, 11 aa, Mycobacterium
GIQPAEISDPD

SEQ ID NO: 903833 - protein, 12 aa, Mycobacterium
GIQPTDEPALAQ

SEQ ID NO: 903834 - protein, 15 aa, Mycobacterium
GIRATPEAEEALSGA

SEQ ID NO: 903835 - protein, 9 aa, Mycobacterium
GIRDENSSC

SEQ ID NO: 903836 - protein, 11 aa, Mycobacterium
GIRDNSAATPI

SEQ ID NO: 903837 - protein, 10 aa, Mycobacterium
GIRDSGGAAP

SEQ ID NO: 903838 - protein, 5 aa, Mycobacterium
GIREG

SEQ ID NO: 903839 - protein, 6 aa, Mycobacterium
GIRPET

SEQ ID NO: 903840 - protein, 17 aa, Mycobacterium
GISDEDAAAAGKTAKQN

SEQ ID NO: 903841 - protein, 4 aa, Mycobacterium
GISG

SEQ ID NO: 903842 - protein, 16 aa, Mycobacterium
GISGPTALPVEFDARP

SEQ ID NO: 903843 - protein, 11 aa, Mycobacterium
GISGTFDPDLT

SEQ ID NO: 903844 - protein, 9 aa, Mycobacterium
GISKEQLAR

SEQ ID NO: 903845 - protein, 10 aa, Mycobacterium
GISKGQAAGL

SEQ ID NO: 903846 - protein, 7 aa, Mycobacterium
GISPAAN

SEQ ID NO: 903847 - protein, 9 aa, Mycobacterium
GISPDEVAR

SEQ ID NO: 903848 - protein, 21 aa, Mycobacterium
GISPETGDAYEPQRTDEPDDL

SEQ ID NO: 903849 - protein, 13 aa, Mycobacterium
GISPNPRLPAVPG

SEQ ID NO: 903850 - protein, 8 aa, Mycobacterium
GISSEEWN

SEQ ID NO: 903851 - protein, 11 aa, Mycobacterium
GISSTSPRKEQ

SEQ ID NO: 903852 - protein, 5 aa, Mycobacterium
GITDS

SEQ ID NO: 903853 - protein, 9 aa, Mycobacterium
GITGPMPPA

SEQ ID NO: 903854 - protein, 7 aa, Mycobacterium
GITPEGG

SEQ ID NO: 903855 - protein, 19 aa, Mycobacterium
GITTSNALAGESGSVGDTE

SEQ ID NO: 903856 - protein, 13 aa, Mycobacterium
GITYESPATAVGV

SEQ ID NO: 903857 - protein, 12 aa, Mycobacterium
GITYQDAGNAIT

SEQ ID NO: 903858 - protein, 7 aa, Mycobacterium
GIYPGDD

SEQ ID NO: 903859 - protein, 10 aa, Mycobacterium
GKAAGNDGEV

SEQ ID NO: 903860 - protein, 6 aa, Mycobacterium
GKAGCT

SEQ ID NO: 903861 - protein, 8 aa, Mycobacterium
GKAGLDDP

SEQ ID NO: 903862 - protein, 15 aa, Mycobacterium
GKAGSETTYGSPRDA

SEQ ID NO: 903863 - protein, 7 aa, Mycobacterium
GKAGVAN

SEQ ID NO: 903864 - protein, 8 aa, Mycobacterium
GKAIAGGL

SEQ ID NO: 903865 - protein, 12 aa, Mycobacterium
GKALGKEAEAKE

SEQ ID NO: 903866 - protein, 8 aa, Mycobacterium
GKAQPGQV

SEQ ID NO: 903867 - protein, 19 aa, Mycobacterium
GKASAEPLYPQPPLPAPVP

SEQ ID NO: 903868 - protein, 11 aa, Mycobacterium
GKATGDQGQAF

SEQ ID NO: 903869 - protein, 5 aa, Mycobacterium
GKATL

SEQ ID NO: 903870 - protein, 18 aa, Mycobacterium
GKCEPNSVAPSGGAPGDF

SEQ ID NO: 903871 - protein, 7 aa, Mycobacterium
GKCPPPV

SEQ ID NO: 903872 - protein, 16 aa, Mycobacterium
GKDHTGGTATGAAGSV

SEQ ID NO: 903873 - protein, 16 aa, Mycobacterium
GKDHTGGTATGAASSV

SEQ ID NO: 903874 - protein, 9 aa, Mycobacterium
GKDIESKVT

SEQ ID NO: 903875 - protein, 10 aa, Mycobacterium
GKDMPSVEST

SEQ ID NO: 903876 - protein, 16 aa, Mycobacterium
GKDPKPACTYTATITV

SEQ ID NO: 903877 - protein, 8 aa, Mycobacterium
GKDQNVSG

SEQ ID NO: 903878 - protein, 13 aa, Mycobacterium
GKDTAQALAEADG

SEQ ID NO: 903879 - protein, 15 aa, Mycobacterium
GKDVPAGEPLPTSSN

SEQ ID NO: 903880 - protein, 12 aa, Mycobacterium
GKEGMDAYAKDN

SEQ ID NO: 903881 - protein, 14 aa, Mycobacterium
GKEGVAGRTADQLK

SEQ ID NO: 903882 - protein, 9 aa, Mycobacterium
GKESMNKAV

SEQ ID NO: 903883 - protein, 8 aa, Mycobacterium
GKEVPTTV

SEQ ID NO: 903884 - protein, 9 aa, Mycobacterium
GKGAPLGSG

SEQ ID NO: 903885 - protein, 8 aa, Mycobacterium
GKGFPGRG

SEQ ID NO: 903886 - protein, 14 aa, Mycobacterium
GKGLGSGGAKGCPK

SEQ ID NO: 903887 - protein, 5 aa, Mycobacterium
GKGLV

SEQ ID NO: 903888 - protein, 10 aa, Mycobacterium
GKGPDAPAIP

SEQ ID NO: 903889 - protein, 7 aa, Mycobacterium
GKGPGVP

SEQ ID NO: 903890 - protein, 8 aa, Mycobacterium
GKGQDAAG

SEQ ID NO: 903891 - protein, 9 aa, Mycobacterium
GKGQTAAGV

SEQ ID NO: 903892 - protein, 8 aa, Mycobacterium
GKGSDAAT

SEQ ID NO: 903893 - protein, 8 aa, Mycobacterium
GKGSTSDW

SEQ ID NO: 903894 - protein, 9 aa, Mycobacterium
GKGSTSDWL

SEQ ID NO: 903895 - protein, 9 aa, Mycobacterium
GKGYPGDPH

SEQ ID NO: 903896 - protein, 25 aa, Mycobacterium
GKHAGPPAAAPDKCKDSDGPTPETV

SEQ ID NO: 903897 - protein, 8 aa, Mycobacterium
GKHGKKDI

SEQ ID NO: 903898 - protein, 5 aa, Mycobacterium
GKHPV

SEQ ID NO: 903899 - protein, 23 aa, Mycobacterium
GKHSDAAEAVPPAPPPATADPGV

SEQ ID NO: 903900 - protein, 15 aa, Mycobacterium
GKIDEARRNNPEFEG

SEQ ID NO: 903901 - protein, 14 aa, Mycobacterium
GKINIGSGSAGGQQ

SEQ ID NO: 903902 - protein, 18 aa, Mycobacterium
GKIPDKAVSYDKGDTGSQ

SEQ ID NO: 903903 - protein, 16 aa, Mycobacterium
GKKALKSSGSTAQANA

SEQ ID NO: 903904 - protein, 10 aa, Mycobacterium
GKKLGAPVEP

SEQ ID NO: 903905 - protein, 15 aa, Mycobacterium
GKKPPAVPAPARPLP

SEQ ID NO: 903906 - protein, 37 aa, Mycobacterium
GKKQPTPSPSKPPTSSSATASPGAAPTSSAPAQSSEY

SEQ ID NO: 903907 - protein, 18 aa, Mycobacterium
GKKVGTSYLEPADRTEMG

SEQ ID NO: 903908 - protein, 4 aa, Mycobacterium
GKLE

SEQ ID NO: 903909 - protein, 10 aa, Mycobacterium
GKLGVDSAEP

SEQ ID NO: 903910 - protein, 4 aa, Mycobacterium
GKLP

SEQ ID NO: 903911 - protein, 7 aa, Mycobacterium
GKLPSEE

SEQ ID NO: 903912 - protein, 7 aa, Mycobacterium
GKLPSER

SEQ ID NO: 903913 - protein, 22 aa, Mycobacterium
GKLTGGATIPLSRTGKYPSTEE

SEQ ID NO: 903914 - protein, 13 aa, Mycobacterium
GKNDGKHETKNGT

SEQ ID NO: 903915 - protein, 8 aa, Mycobacterium
GKNGDRDY

SEQ ID NO: 903916 - protein, 5 aa, Mycobacterium
GKNPV

SEQ ID NO: 903917 - protein, 10 aa, Mycobacterium
GKNSTPTNNG

SEQ ID NO: 903918 - protein, 6 aa, Mycobacterium
GKPAAM

SEQ ID NO: 903919 - protein, 15 aa, Mycobacterium
GKPAEVNGNVAGNNL

SEQ ID NO: 903920 - protein, 7 aa, Mycobacterium
GKPAWPG

SEQ ID NO: 903921 - protein, 5 aa, Mycobacterium
GKPCG

SEQ ID NO: 903922 - protein, 6 aa, Mycobacterium
GKPEDI

SEQ ID NO: 903923 - protein, 10 aa, Mycobacterium
GKPFSNPNSG

SEQ ID NO: 903924 - protein, 7 aa, Mycobacterium
GKPGEDG

SEQ ID NO: 903925 - protein, 9 aa, Mycobacterium
GKPGLGTES

SEQ ID NO: 903926 - protein, 27 aa, Mycobacterium
GKPGWPDPSDSTRGYDGGVADARTAQR

SEQ ID NO: 903927 - protein, 11 aa, Mycobacterium
GKPGYDTKNGT

SEQ ID NO: 903928 - protein, 5 aa, Mycobacterium
GKPHA

SEQ ID NO: 903929 - protein, 6 aa, Mycobacterium
GKPHAR

SEQ ID NO: 903930 - protein, 13 aa, Mycobacterium
GKPLDGAANLKRA

SEQ ID NO: 903931 - protein, 15 aa, Mycobacterium
GKPLPSTGKPDPDAM

SEQ ID NO: 903932 - protein, 40 aa, Mycobacterium
GKPRPGAGPSAAPATAPSNPPTTTSTAPAGPCGPDEATAV

SEQ ID NO: 903933 - protein, 9 aa, Mycobacterium
GKPRPGNYE

SEQ ID NO: 903934 - protein, 11 aa, Mycobacterium
GKPSDLGGDNL

SEQ ID NO: 903935 - protein, 12 aa, Mycobacterium
GKPSDLGGDNLP

SEQ ID NO: 903936 - protein, 26 aa, Mycobacterium
GKPTSVNPATDPIGAAEAARPHTGRT

SEQ ID NO: 903937 - protein, 6 aa, Mycobacterium
GKPVPE

SEQ ID NO: 903938 - protein, 9 aa, Mycobacterium
GKPYSDTEP

SEQ ID NO: 903939 - protein, 7 aa, Mycobacterium
GKQDDYD

SEQ ID NO: 903940 - protein, 12 aa, Mycobacterium
GKQDSTIKEAPH

SEQ ID NO: 903941 - protein, 15 aa, Mycobacterium
GKQPPPNPAPAKPLR

SEQ ID NO: 903942 - protein, 17 aa, Mycobacterium
GKQPPVNPEPARPPSDY

SEQ ID NO: 903943 - protein, 5 aa, Mycobacterium
GKQQL

SEQ ID NO: 903944 - protein, 27 aa, Mycobacterium
GKRAATPRECRDPKPYVPAGTNPWYGD

SEQ ID NO: 903945 - protein, 5 aa, Mycobacterium
GKRGW

SEQ ID NO: 903946 - protein, 5 aa, Mycobacterium
GKRKG

SEQ ID NO: 903947 - protein, 7 aa, Mycobacterium
GKRPADM

SEQ ID NO: 903948 - protein, 8 aa, Mycobacterium
GKRPADMP

SEQ ID NO: 903949 - protein, 9 aa, Mycobacterium
GKRPADMPL

SEQ ID NO: 903950 - protein, 10 aa, Mycobacterium
GKRPADMPLN

SEQ ID NO: 903951 - protein, 13 aa, Mycobacterium
GKRTTGTGPQTYA

SEQ ID NO: 903952 - protein, 10 aa, Mycobacterium
GKRVGTPFAS

SEQ ID NO: 903953 - protein, 14 aa, Mycobacterium
GKRVSTGSPGSGTE

SEQ ID NO: 903954 - protein, 9 aa, Mycobacterium
GKSDPGPLS

SEQ ID NO: 903955 - protein, 8 aa, Mycobacterium
GKSGPATI

SEQ ID NO: 903956 - protein, 8 aa, Mycobacterium
GKSGPTTV

SEQ ID NO: 903957 - protein, 6 aa, Mycobacterium
GKSGPY

SEQ ID NO: 903958 - protein, 6 aa, Mycobacterium
GKSPRF

SEQ ID NO: 903959 - protein, 8 aa, Mycobacterium
GKSRSEIR

SEQ ID NO: 903960 - protein, 6 aa, Mycobacterium
GKSVVT

SEQ ID NO: 903961 - protein, 17 aa, Mycobacterium
GKTAQDTAFDGRSDYDG

SEQ ID NO: 903962 - protein, 11 aa, Mycobacterium
GKTDLTPDDER

SEQ ID NO: 903963 - protein, 9 aa, Mycobacterium
GKTGDTNVL

SEQ ID NO: 903964 - protein, 7 aa, Mycobacterium
GKTGFTD

SEQ ID NO: 903965 - protein, 13 aa, Mycobacterium
GKTGSTDRLKPGS

SEQ ID NO: 903966 - protein, 8 aa, Mycobacterium
GKTGTAEY

SEQ ID NO: 903967 - protein, 13 aa, Mycobacterium
GKTIAGATIKGEG

SEQ ID NO: 903968 - protein, 21 aa, Mycobacterium
GKTPEAGTISYGDYSGTPQAV

SEQ ID NO: 903969 - protein, 6 aa, Mycobacterium
GKTTAV

SEQ ID NO: 903970 - protein, 15 aa, Mycobacterium
GKVDENWNAGPNKGI

SEQ ID NO: 903971 - protein, 9 aa, Mycobacterium
GKVGGRSVG

SEQ ID NO: 903972 - protein, 8 aa, Mycobacterium
GKVRSASD

SEQ ID NO: 903973 - protein, 9 aa, Mycobacterium
GKVRSDGAS

SEQ ID NO: 903974 - protein, 15 aa, Mycobacterium
GKVSKDWNADATKGI

SEQ ID NO: 903975 - protein, 13 aa, Mycobacterium
GKVSSFDATEGYR

SEQ ID NO: 903976 - protein, 14 aa, Mycobacterium
GKVTPPESDESALA

SEQ ID NO: 903977 - protein, 5 aa, Mycobacterium
GKVTT

SEQ ID NO: 903978 - protein, 4 aa, Mycobacterium
GKVV

SEQ ID NO: 903979 - protein, 6 aa, Mycobacterium
GKWKNC

SEQ ID NO: 903980 - protein, 8 aa, Mycobacterium
GKYGRTDL

SEQ ID NO: 903981 - protein, 5 aa, Mycobacterium
GLAAD

SEQ ID NO: 903982 - protein, 11 aa, Mycobacterium
GLAAGNTDTAL

SEQ ID NO: 903983 - protein, 23 aa, Mycobacterium
GLAAGTTAATEAARQAAMLLSSI

SEQ ID NO: 903984 - protein, 9 aa, Mycobacterium
GLAARPDGG

SEQ ID NO: 903985 - protein, 18 aa, Mycobacterium
GLADPGQPLPTGSSTGCA

SEQ ID NO: 903986 - protein, 13 aa, Mycobacterium
GLADTGSLTSTTA

SEQ ID NO: 903987 - protein, 7 aa, Mycobacterium
GLAGASQ

SEQ ID NO: 903988 - protein, 19 aa, Mycobacterium
GLAGGAGAGSGFAGGSGMV

SEQ ID NO: 903989 - protein, 10 aa, Mycobacterium
GLAGGAPITA

SEQ ID NO: 903990 - protein, 11 aa, Mycobacterium
GLAGGDDSGLD

SEQ ID NO: 903991 - protein, 13 aa, Mycobacterium
GLAGKGKEINSTL

SEQ ID NO: 903992 - protein, 10 aa, Mycobacterium
GLAGREDDAR

SEQ ID NO: 903993 - protein, 5 aa, Mycobacterium
GLAGS

SEQ ID NO: 903994 - protein, 6 aa, Mycobacterium
GLAGTT

SEQ ID NO: 903995 - protein, 4 aa, Mycobacterium
GLAP

SEQ ID NO: 903996 - protein, 43 aa, Mycobacterium
GLAPAATNTAASAATAAAPALTAPAASAPSAVAPLAPLLTAGL

SEQ ID NO: 903997 - protein, 7 aa, Mycobacterium
GLAPEQT

SEQ ID NO: 903998 - protein, 8 aa, Mycobacterium
GLAPGSGA

SEQ ID NO: 903999 - protein, 9 aa, Mycobacterium
GLAPPGDYA

SEQ ID NO: 904000 - protein, 7 aa, Mycobacterium
GLATERG

SEQ ID NO: 904001 - protein, 6 aa, Mycobacterium
GLDADT

SEQ ID NO: 904002 - protein, 10 aa, Mycobacterium
GLDATTAAAT

SEQ ID NO: 904003 - protein, 5 aa, Mycobacterium
GLDEA

SEQ ID NO: 904004 - protein, 9 aa, Mycobacterium
GLDNDGLST

SEQ ID NO: 904005 - protein, 12 aa, Mycobacterium
GLDNGDLDRTHR

SEQ ID NO: 904006 - protein, 6 aa, Mycobacterium
GLDPAP

SEQ ID NO: 904007 - protein, 6 aa, Mycobacterium
GLDPEV

SEQ ID NO: 904008 - protein, 6 aa, Mycobacterium
GLDPGV

SEQ ID NO: 904009 - protein, 12 aa, Mycobacterium
GLDPTGRVRPDS

SEQ ID NO: 904010 - protein, 8 aa, Mycobacterium
GLDSRGRD

SEQ ID NO: 904011 - protein, 4 aa, Mycobacterium
GLDT

SEQ ID NO: 904012 - protein, 12 aa, Mycobacterium
GLDTDSAQTAAP

SEQ ID NO: 904013 - protein, 5 aa, Mycobacterium
GLDTS

SEQ ID NO: 904014 - protein, 50 aa, Mycobacterium
GLGAPGGPLSAEGPLLSPTGPLSANGPLTASGGPLSADGPVLSPTSPVSP

SEQ ID NO: 904015 - protein, 7 aa, Mycobacterium
GLGASPT

SEQ ID NO: 904016 - protein, 12 aa, Mycobacterium
GLGDSTEPGCPP

SEQ ID NO: 904017 - protein, 5 aa, Mycobacterium
GLGEH

SEQ ID NO: 904018 - protein, 7 aa, Mycobacterium
GLGGEQT

SEQ ID NO: 904019 - protein, 14 aa, Mycobacterium
GLGGLTKAAKKLGL

SEQ ID NO: 904020 - protein, 13 aa, Mycobacterium
GLGGPDSAIPSNE

SEQ ID NO: 904021 - protein, 53 aa, Mycobacterium
GLGGQGGSGGTSGTGGPGGPGGSAQGIGDGGNGGSGGSGVDPGAGGAAGNGGR

SEQ ID NO: 904022 - protein, 10 aa, Mycobacterium
GLGGQTPVAD

SEQ ID NO: 904023 - protein, 12 aa, Mycobacterium
GLGGTTAPSNGR

SEQ ID NO: 904024 - protein, 5 aa, Mycobacterium
GLGGV

SEQ ID NO: 904025 - protein, 15 aa, Mycobacterium
GLGIPGPGPDGRPRY

SEQ ID NO: 904026 - protein, 9 aa, Mycobacterium
GLGLPGSTA

SEQ ID NO: 904027 - protein, 10 aa, Mycobacterium
GLGNNGSNNI

SEQ ID NO: 904028 - protein, 5 aa, Mycobacterium
GLGPS

SEQ ID NO: 904029 - protein, 4 aa, Mycobacterium
GLGQ

SEQ ID NO: 904030 - protein, 5 aa, Mycobacterium
GLGSA

SEQ ID NO: 904031 - protein, 16 aa, Mycobacterium
GLGSAARNSAGFGAPR

SEQ ID NO: 904032 - protein, 8 aa, Mycobacterium
GLGSAETV

SEQ ID NO: 904033 - protein, 5 aa, Mycobacterium
GLGSC

SEQ ID NO: 904034 - protein, 16 aa, Mycobacterium
GLGSDVPAATVPAGAT

SEQ ID NO: 904035 - protein, 17 aa, Mycobacterium
GLGTAGSARADGDEPQY

SEQ ID NO: 904036 - protein, 8 aa, Mycobacterium
GLGTPGTH

SEQ ID NO: 904037 - protein, 5 aa, Mycobacterium
GLGTT

SEQ ID NO: 904038 - protein, 4 aa, Mycobacterium
GLIP

SEQ ID NO: 904039 - protein, 4 aa, Mycobacterium
GLKE

SEQ ID NO: 904040 - protein, 29 aa, Mycobacterium
GLNDETLTSCGESQSPTTWHQGTSGTAGQ

SEQ ID NO: 904041 - protein, 8 aa, Mycobacterium
GLNDQKNV

SEQ ID NO: 904042 - protein, 12 aa, Mycobacterium
GLNDQRNALNEK

SEQ ID NO: 904043 - protein, 5 aa, Mycobacterium
GLNHP

SEQ ID NO: 904044 - protein, 16 aa, Mycobacterium
GLNNPNVQEVDGSDAA

SEQ ID NO: 904045 - protein, 8 aa, Mycobacterium
GLNPQTDV

SEQ ID NO: 904046 - protein, 6 aa, Mycobacterium
GLPAET

SEQ ID NO: 904047 - protein, 13 aa, Mycobacterium
GLPAGRPGNPDDD

SEQ ID NO: 904048 - protein, 31 aa, Mycobacterium
GLPANPSGALYPGAPVPPGVPSPPPAAGPAG

SEQ ID NO: 904049 - protein, 11 aa, Mycobacterium
GLPAYDSPNGA

SEQ ID NO: 904050 - protein, 9 aa, Mycobacterium
GLPDEQRRA

SEQ ID NO: 904051 - protein, 9 aa, Mycobacterium
GLPDGTTVG

SEQ ID NO: 904052 - protein, 10 aa, Mycobacterium
GLPDHAGDQL

SEQ ID NO: 904053 - protein, 12 aa, Mycobacterium
GLPDHAGDQLED

SEQ ID NO: 904054 - protein, 10 aa, Mycobacterium
GLPDRGPNSW

SEQ ID NO: 904055 - protein, 7 aa, Mycobacterium
GLPEDER

SEQ ID NO: 904056 - protein, 7 aa, Mycobacterium
GLPENRP

SEQ ID NO: 904057 - protein, 6 aa, Mycobacterium
GLPEPT

SEQ ID NO: 904058 - protein, 14 aa, Mycobacterium
GLPGASAGPAQPTL

SEQ ID NO: 904059 - protein, 8 aa, Mycobacterium
GLPGDGNA

SEQ ID NO: 904060 - protein, 5 aa, Mycobacterium
GLPGG

SEQ ID NO: 904061 - protein, 11 aa, Mycobacterium
GLPGGADVPPT

SEQ ID NO: 904062 - protein, 10 aa, Mycobacterium
GLPGPSTPAT

SEQ ID NO: 904063 - protein, 13 aa, Mycobacterium
GLPHGRDRAAGPL

SEQ ID NO: 904064 - protein, 12 aa, Mycobacterium
GLPPAARSAPLS

SEQ ID NO: 904065 - protein, 23 aa, Mycobacterium
GLPPAPPPGAPREPGPPPPGSEP

SEQ ID NO: 904066 - protein, 7 aa, Mycobacterium
GLPPDDP

SEQ ID NO: 904067 - protein, 5 aa, Mycobacterium
GLPPL

SEQ ID NO: 904068 - protein, 5 aa, Mycobacterium
GLPPN

SEQ ID NO: 904069 - protein, 6 aa, Mycobacterium
GLPPVR

SEQ ID NO: 904070 - protein, 8 aa, Mycobacterium
GLPQRTGQ

SEQ ID NO: 904071 - protein, 15 aa, Mycobacterium
GLPRGTTEDDAIPAG

SEQ ID NO: 904072 - protein, 10 aa, Mycobacterium
GLPRTKTPVE

SEQ ID NO: 904073 - protein, 12 aa, Mycobacterium
GLPSGPVASAPL

SEQ ID NO: 904074 - protein, 4 aa, Mycobacterium
GLPT

SEQ ID NO: 904075 - protein, 7 aa, Mycobacterium
GLPTSAE

SEQ ID NO: 904076 - protein, 7 aa, Mycobacterium
GLPTSGE

SEQ ID NO: 904077 - protein, 5 aa, Mycobacterium
GLPVP

SEQ ID NO: 904078 - protein, 9 aa, Mycobacterium
GLQDGGAPV

SEQ ID NO: 904079 - protein, 4 aa, Mycobacterium
GLQG

SEQ ID NO: 904080 - protein, 4 aa, Mycobacterium
GLQP

SEQ ID NO: 904081 - protein, 8 aa, Mycobacterium
GLQPPLAN

SEQ ID NO: 904082 - protein, 10 aa, Mycobacterium
GLQPSHNPQV

SEQ ID NO: 904083 - protein, 6 aa, Mycobacterium
GLQTED

SEQ ID NO: 904084 - protein, 9 aa, Mycobacterium
GLRADPRNQ

SEQ ID NO: 904085 - protein, 4 aa, Mycobacterium
GLRD

SEQ ID NO: 904086 - protein, 9 aa, Mycobacterium
GLREPEARD

SEQ ID NO: 904087 - protein, 11 aa, Mycobacterium
GLRERGIPPSA

SEQ ID NO: 904088 - protein, 7 aa, Mycobacterium
GLRGEPV

SEQ ID NO: 904089 - protein, 8 aa, Mycobacterium
GLRGHGDD

SEQ ID NO: 904090 - protein, 4 aa, Mycobacterium
GLRP

SEQ ID NO: 904091 - protein, 9 aa, Mycobacterium
GLRSDPRNQ

SEQ ID NO: 904092 - protein, 19 aa, Mycobacterium
GLRSPGRETLEALAQISAR

SEQ ID NO: 904093 - protein, 30 aa, Mycobacterium
GLSAPRAVAAPGCPPGGTPAPADVNERRVG

SEQ ID NO: 904094 - protein, 10 aa, Mycobacterium
GLSGATPRNV

SEQ ID NO: 904095 - protein, 11 aa, Mycobacterium
GLSGGDRQRNL

SEQ ID NO: 904096 - protein, 10 aa, Mycobacterium
GLSGRDTPTL

SEQ ID NO: 904097 - protein, 17 aa, Mycobacterium
GLSGSTPRTAPAANITP

SEQ ID NO: 904098 - protein, 8 aa, Mycobacterium
GLSKTGNA

SEQ ID NO: 904099 - protein, 6 aa, Mycobacterium
GLSNKD

SEQ ID NO: 904100 - protein, 6 aa, Mycobacterium
GLSNPD

SEQ ID NO: 904101 - protein, 8 aa, Mycobacterium
GLSPAGEQ

SEQ ID NO: 904102 - protein, 9 aa, Mycobacterium
GLSPDDAAD

SEQ ID NO: 904103 - protein, 6 aa, Mycobacterium
GLSPTA

SEQ ID NO: 904104 - protein, 8 aa, Mycobacterium
GLSPTDAG

SEQ ID NO: 904105 - protein, 4 aa, Mycobacterium
GLSR

SEQ ID NO: 904106 - protein, 7 aa, Mycobacterium
GLSSGQI

SEQ ID NO: 904107 - protein, 6 aa, Mycobacterium
GLSSGV

SEQ ID NO: 904108 - protein, 11 aa, Mycobacterium
GLTAPGDVSDP

SEQ ID NO: 904109 - protein, 5 aa, Mycobacterium
GLTDA

SEQ ID NO: 904110 - protein, 6 aa, Mycobacterium
GLTEQD

SEQ ID NO: 904111 - protein, 13 aa, Mycobacterium
GLTGDDPASLSGA

SEQ ID NO: 904112 - protein, 12 aa, Mycobacterium
GLTGDEPASLSA

SEQ ID NO: 904113 - protein, 13 aa, Mycobacterium
GLTGDEPASLSKN

SEQ ID NO: 904114 - protein, 13 aa, Mycobacterium
GLTGDVPASLSPE

SEQ ID NO: 904115 - protein, 6 aa, Mycobacterium
GLTGGG

SEQ ID NO: 904116 - protein, 8 aa, Mycobacterium
GLTGPFRD

SEQ ID NO: 904117 - protein, 14 aa, Mycobacterium
GLTGSDPASLSPQA

SEQ ID NO: 904118 - protein, 12 aa, Mycobacterium
GLTIPGAAPVLP

SEQ ID NO: 904119 - protein, 40 aa, Mycobacterium
GLTKTKAPAADERQSEPKPVEEQSAPQRDDDTTEAPSAAV

SEQ ID NO: 904120 - protein, 6 aa, Mycobacterium
GLTPDD

SEQ ID NO: 904121 - protein, 8 aa, Mycobacterium
GLTPKSDC

SEQ ID NO: 904122 - protein, 5 aa, Mycobacterium
GLTPQ

SEQ ID NO: 904123 - protein, 6 aa, Mycobacterium
GLTPQD

SEQ ID NO: 904124 - protein, 18 aa, Mycobacterium
GLTPRGRTQWERILATPE

SEQ ID NO: 904125 - protein, 7 aa, Mycobacterium
GLTPSNP

SEQ ID NO: 904126 - protein, 5 aa, Mycobacterium
GLTQT

SEQ ID NO: 904127 - protein, 5 aa, Mycobacterium
GLTSG

SEQ ID NO: 904128 - protein, 8 aa, Mycobacterium
GLTSNTAT

SEQ ID NO: 904129 - protein, 12 aa, Mycobacterium
GLTSTKPPNDGR

SEQ ID NO: 904130 - protein, 5 aa, Mycobacterium
GLTTG

SEQ ID NO: 904131 - protein, 13 aa, Mycobacterium
GLTTGASQTKTTV

SEQ ID NO: 904132 - protein, 13 aa, Mycobacterium
GLTTGSSQTKTTV

SEQ ID NO: 904133 - protein, 5 aa, Mycobacterium
GLYEG

SEQ ID NO: 904134 - protein, 4 aa, Mycobacterium
GLYP

SEQ ID NO: 904135 - protein, 6 aa, Mycobacterium
GLYPGS

SEQ ID NO: 904136 - protein, 17 aa, Mycobacterium
GLYPSGNVTYRGTEVGR

SEQ ID NO: 904137 - protein, 4 aa, Mycobacterium
GMAP

SEQ ID NO: 904138 - protein, 13 aa, Mycobacterium
GMAPQTHDGEMKT

SEQ ID NO: 904139 - protein, 7 aa, Mycobacterium
GMASGTP

SEQ ID NO: 904140 - protein, 5 aa, Mycobacterium
GMDES

SEQ ID NO: 904141 - protein, 11 aa, Mycobacterium
GMDFGSPDKAI

SEQ ID NO: 904142 - protein, 10 aa, Mycobacterium
GMDQDTARAR

SEQ ID NO: 904143 - protein, 5 aa, Mycobacterium
GMGAG

SEQ ID NO: 904144 - protein, 6 aa, Mycobacterium
GMGDSE

SEQ ID NO: 904145 - protein, 4 aa, Mycobacterium
GMGR

SEQ ID NO: 904146 - protein, 13 aa, Mycobacterium
GMPDPDKHAQRYP

SEQ ID NO: 904147 - protein, 5 aa, Mycobacterium
GMPPF

SEQ ID NO: 904148 - protein, 6 aa, Mycobacterium
GMPPPL

SEQ ID NO: 904149 - protein, 4 aa, Mycobacterium
GMPQ

SEQ ID NO: 904150 - protein, 9 aa, Mycobacterium
GMPSISDPG

SEQ ID NO: 904151 - protein, 6 aa, Mycobacterium
GMPTKD

SEQ ID NO: 904152 - protein, 16 aa, Mycobacterium
GMRTPDPGKVEATPEP

SEQ ID NO: 904153 - protein, 6 aa, Mycobacterium
GMTPRA

SEQ ID NO: 904154 - protein, 17 aa, Mycobacterium
GMTPTPDIPPGPPLPSP

SEQ ID NO: 904155 - protein, 30 aa, Mycobacterium
GMTRGRNPRPINGSAHPQQCGIRGNAGLDY

SEQ ID NO: 904156 - protein, 7 aa, Mycobacterium
GMTTQAA

SEQ ID NO: 904157 - protein, 14 aa, Mycobacterium
GMTTSEQTGPISTT

SEQ ID NO: 904158 - protein, 7 aa, Mycobacterium
GNAAPAV

SEQ ID NO: 904159 - protein, 24 aa, Mycobacterium
GNADGYNTDKPAEPTTAAFRISVN

SEQ ID NO: 904160 - protein, 13 aa, Mycobacterium
GNADVQEGDGADA

SEQ ID NO: 904161 - protein, 8 aa, Mycobacterium
GNAEAARA

SEQ ID NO: 904162 - protein, 7 aa, Mycobacterium
GNAGDNN

SEQ ID NO: 904163 - protein, 9 aa, Mycobacterium
GNAGDRNMG

SEQ ID NO: 904164 - protein, 15 aa, Mycobacterium
GNAGRSDIEGAATAA

SEQ ID NO: 904165 - protein, 9 aa, Mycobacterium
GNAGSSNLG

SEQ ID NO: 904166 - protein, 7 aa, Mycobacterium
GNAMTDD

SEQ ID NO: 904167 - protein, 6 aa, Mycobacterium
GNAPLD

SEQ ID NO: 904168 - protein, 7 aa, Mycobacterium
GNAPQGA

SEQ ID NO: 904169 - protein, 8 aa, Mycobacterium
GNAPQGSI

SEQ ID NO: 904170 - protein, 5 aa, Mycobacterium
GNAQR

SEQ ID NO: 904171 - protein, 36 aa, Mycobacterium
GNARKPDESCAREAAATDPGPPTRQAHNAAGVNPDV

SEQ ID NO: 904172 - protein, 13 aa, Mycobacterium
GNARTTDVRGRDR

SEQ ID NO: 904173 - protein, 4 aa, Mycobacterium
GNAT

SEQ ID NO: 904174 - protein, 10 aa, Mycobacterium
GNATGDQGQA

SEQ ID NO: 904175 - protein, 6 aa, Mycobacterium
GNDAGL

SEQ ID NO: 904176 - protein, 5 aa, Mycobacterium
GNDAK

SEQ ID NO: 904177 - protein, 9 aa, Mycobacterium
GNDAPLGKI

SEQ ID NO: 904178 - protein, 12 aa, Mycobacterium
GNDDPDPQRRAV

SEQ ID NO: 904179 - protein, 10 aa, Mycobacterium
GNDGDDGYDT

SEQ ID NO: 904180 - protein, 5 aa, Mycobacterium
GNDGI

SEQ ID NO: 904181 - protein, 5 aa, Mycobacterium
GNDGL

SEQ ID NO: 904182 - protein, 11 aa, Mycobacterium
GNDLPPHSPPM

SEQ ID NO: 904183 - protein, 12 aa, Mycobacterium
GNDNSKIREAPH

SEQ ID NO: 904184 - protein, 7 aa, Mycobacterium
GNDPAQY

SEQ ID NO: 904185 - protein, 21 aa, Mycobacterium
GNDPDHPERSLADEHAMDQVV

SEQ ID NO: 904186 - protein, 35 aa, Mycobacterium
GNDRHPDESCAREAAAADPGPKTRQAHNAAGVTPD

SEQ ID NO: 904187 - protein, 35 aa, Mycobacterium
GNDRKADESCAREAAAPDPGPATRPAHNAAGVTPD

SEQ ID NO: 904188 - protein, 10 aa, Mycobacterium
GNDTAGQPDW

SEQ ID NO: 904189 - protein, 12 aa, Mycobacterium
GNDYADDLASGN

SEQ ID NO: 904190 - protein, 7 aa, Mycobacterium
GNEASLG

SEQ ID NO: 904191 - protein, 5 aa, Mycobacterium
GNEGN

SEQ ID NO: 904192 - protein, 12 aa, Mycobacterium
GNEKSKIKEAPH

SEQ ID NO: 904193 - protein, 6 aa, Mycobacterium
GNEQYD

SEQ ID NO: 904194 - protein, 6 aa, Mycobacterium
GNFGGG

SEQ ID NO: 904195 - protein, 11 aa, Mycobacterium
GNFGSAPPLPS

SEQ ID NO: 904196 - protein, 7 aa, Mycobacterium
GNFTSPT

SEQ ID NO: 904197 - protein, 18 aa, Mycobacterium
GNGADGAAGTGQNGGDGG

SEQ ID NO: 904198 - protein, 18 aa, Mycobacterium
GNGANGAPGNGANGADGG

SEQ ID NO: 904199 - protein, 15 aa, Mycobacterium
GNGGAGGAGGDSTVA

SEQ ID NO: 904200 - protein, 10 aa, Mycobacterium
GNGGAGGAGY

SEQ ID NO: 904201 - protein, 23 aa, Mycobacterium
GNGGAGGDGGAGGQGAGGAGGSG

SEQ ID NO: 904202 - protein, 28 aa, Mycobacterium
GNGGAGGTGADADVSATNGGAGGAGGNA

SEQ ID NO: 904203 - protein, 14 aa, Mycobacterium
GNGGAGGVGGDGGL

SEQ ID NO: 904204 - protein, 25 aa, Mycobacterium
GNGGDGYSFTSGTTSEAGGAGGAAG

SEQ ID NO: 904205 - protein, 11 aa, Mycobacterium
GNGGGGNTGFY

SEQ ID NO: 904206 - protein, 20 aa, Mycobacterium
GNGGMGGAGLRGGDGGTGGL

SEQ ID NO: 904207 - protein, 27 aa, Mycobacterium
GNGGNGGAGGITSVAGGTGGDGGKGGD

SEQ ID NO: 904208 - protein, 27 aa, Mycobacterium
GNGGNGGAGVDGTSGSAGGAGGLGGNG

SEQ ID NO: 904209 - protein, 14 aa, Mycobacterium
GNGGQSDLEAAGKL

SEQ ID NO: 904210 - protein, 7 aa, Mycobacterium
GNGGYGG

SEQ ID NO: 904211 - protein, 32 aa, Mycobacterium
GNGNMGIGNSGSLNSGLGNSGSMSTGFGTASM

SEQ ID NO: 904212 - protein, 13 aa, Mycobacterium
GNGNTAKVDTFGA

SEQ ID NO: 904213 - protein, 11 aa, Mycobacterium
GNGPELASGDS

SEQ ID NO: 904214 - protein, 10 aa, Mycobacterium
GNGPFKADGD

SEQ ID NO: 904215 - protein, 5 aa, Mycobacterium
GNGPV

SEQ ID NO: 904216 - protein, 10 aa, Mycobacterium
GNGQTGLEEN

SEQ ID NO: 904217 - protein, 18 aa, Mycobacterium
GNGSDAASGSGANGGAGG

SEQ ID NO: 904218 - protein, 17 aa, Mycobacterium
GNGSNATAPGGSGGDGG

SEQ ID NO: 904219 - protein, 18 aa, Mycobacterium
GNGTNGAPGSGDAGGPGG

SEQ ID NO: 904220 - protein, 18 aa, Mycobacterium
GNGTNGAPGTGQDGGPGG

SEQ ID NO: 904221 - protein, 18 aa, Mycobacterium
GNGTPSAELGGDKPGASL

SEQ ID NO: 904222 - protein, 16 aa, Mycobacterium
GNGTPSEIGQGSIPGQ

SEQ ID NO: 904223 - protein, 6 aa, Mycobacterium
GNGVET

SEQ ID NO: 904224 - protein, 10 aa, Mycobacterium
GNGYSQNSHT

SEQ ID NO: 904225 - protein, 8 aa, Mycobacterium
GNHAAAPA

SEQ ID NO: 904226 - protein, 9 aa, Mycobacterium
GNLAQQNAS

SEQ ID NO: 904227 - protein, 4 aa, Mycobacterium
GNLG

SEQ ID NO: 904228 - protein, 5 aa, Mycobacterium
GNLQN

SEQ ID NO: 904229 - protein, 14 aa, Mycobacterium
GNMGSTAIRSTAAF

SEQ ID NO: 904230 - protein, 12 aa, Mycobacterium
GNNADITNISVN

SEQ ID NO: 904231 - protein, 8 aa, Mycobacterium
GNNGSNNI

SEQ ID NO: 904232 - protein, 16 aa, Mycobacterium
GNNGYETLAPAEKDLT

SEQ ID NO: 904233 - protein, 40 aa, Mycobacterium
GNNNLGSGNTGSANLGGGNIGNGNLGSGNTGNVNLGNGNN

SEQ ID NO: 904234 - protein, 8 aa, Mycobacterium
GNNNTAAV

SEQ ID NO: 904235 - protein, 5 aa, Mycobacterium
GNNSS

SEQ ID NO: 904236 - protein, 16 aa, Mycobacterium
GNPAAPANVLGPGQSA

SEQ ID NO: 904237 - protein, 23 aa, Mycobacterium
GNPAPSAPVPAVTPAATPGRANG

SEQ ID NO: 904238 - protein, 6 aa, Mycobacterium
GNPATG

SEQ ID NO: 904239 - protein, 7 aa, Mycobacterium
GNPDGNI

SEQ ID NO: 904240 - protein, 5 aa, Mycobacterium
GNPDN

SEQ ID NO: 904241 - protein, 12 aa, Mycobacterium
GNPDRDADRQAI

SEQ ID NO: 904242 - protein, 6 aa, Mycobacterium
GNPEGA

SEQ ID NO: 904243 - protein, 12 aa, Mycobacterium
GNPENITGPDSL

SEQ ID NO: 904244 - protein, 6 aa, Mycobacterium
GNPGAR

SEQ ID NO: 904245 - protein, 5 aa, Mycobacterium
GNPID

SEQ ID NO: 904246 - protein, 7 aa, Mycobacterium
GNPITVQ

SEQ ID NO: 904247 - protein, 7 aa, Mycobacterium
GNPKNIK

SEQ ID NO: 904248 - protein, 5 aa, Mycobacterium
GNPNL

SEQ ID NO: 904249 - protein, 15 aa, Mycobacterium
GNPPMGDHEGMGDHG

SEQ ID NO: 904250 - protein, 6 aa, Mycobacterium
GNPPVT

SEQ ID NO: 904251 - protein, 7 aa, Mycobacterium
GNPQAHA

SEQ ID NO: 904252 - protein, 7 aa, Mycobacterium
GNPREGS

SEQ ID NO: 904253 - protein, 8 aa, Mycobacterium
GNPSAKLG

SEQ ID NO: 904254 - protein, 6 aa, Mycobacterium
GNPTTK

SEQ ID NO: 904255 - protein, 4 aa, Mycobacterium
GNPV

SEQ ID NO: 904256 - protein, 8 aa, Mycobacterium
GNPVPRPA

SEQ ID NO: 904257 - protein, 8 aa, Mycobacterium
GNQAGDAA

SEQ ID NO: 904258 - protein, 15 aa, Mycobacterium
GNQDTWKSHTSYPPA

SEQ ID NO: 904259 - protein, 5 aa, Mycobacterium
GNQLG

SEQ ID NO: 904260 - protein, 11 aa, Mycobacterium
GNQSTAPDPRI

SEQ ID NO: 904261 - protein, 4 aa, Mycobacterium
GNRD

SEQ ID NO: 904262 - protein, 5 aa, Mycobacterium
GNRGT

SEQ ID NO: 904263 - protein, 35 aa, Mycobacterium
GNRHPCPPKPAITTRRRSAPMPSLPSTSMSDNTAN

SEQ ID NO: 904264 - protein, 4 aa, Mycobacterium
GNRP

SEQ ID NO: 904265 - protein, 30 aa, Mycobacterium
GNRSPGVPPAGRYNGKTAEGDSQEDPTSEA

SEQ ID NO: 904266 - protein, 9 aa, Mycobacterium
GNRSRGVGG

SEQ ID NO: 904267 - protein, 12 aa, Mycobacterium
GNSAAADPNQDD

SEQ ID NO: 904268 - protein, 6 aa, Mycobacterium
GNSAEV

SEQ ID NO: 904269 - protein, 7 aa, Mycobacterium
GNSAEVS

SEQ ID NO: 904270 - protein, 5 aa, Mycobacterium
GNSAT

SEQ ID NO: 904271 - protein, 6 aa, Mycobacterium
GNSAVA

SEQ ID NO: 904272 - protein, 7 aa, Mycobacterium
GNSDQLL

SEQ ID NO: 904273 - protein, 15 aa, Mycobacterium
GNSDVPALYQWWRTN

SEQ ID NO: 904274 - protein, 54 aa, Mycobacterium
GNSGAGSSAGNANVGNGNLGSQNFGNGNNGSQNVGSGNNGNVNTGYGNTGDRNW

SEQ ID NO: 904275 - protein, 6 aa, Mycobacterium
GNSGGL

SEQ ID NO: 904276 - protein, 49 aa, Mycobacterium
GNSGTGNVGNNNVGNNNWGSGNTGSSNVGTGNTGSSNIGSGNTGNSNVG

SEQ ID NO: 904277 - protein, 5 aa, Mycobacterium
GNSHT

SEQ ID NO: 904278 - protein, 7 aa, Mycobacterium
GNSIEGP

SEQ ID NO: 904279 - protein, 5 aa, Mycobacterium
GNSNT

SEQ ID NO: 904280 - protein, 5 aa, Mycobacterium
GNSPH

SEQ ID NO: 904281 - protein, 7 aa, Mycobacterium
GNSPQVH

SEQ ID NO: 904282 - protein, 7 aa, Mycobacterium
GNSPQVR

SEQ ID NO: 904283 - protein, 7 aa, Mycobacterium
GNSPRFT

SEQ ID NO: 904284 - protein, 7 aa, Mycobacterium
GNSQGAG

SEQ ID NO: 904285 - protein, 4 aa, Mycobacterium
GNST

SEQ ID NO: 904286 - protein, 16 aa, Mycobacterium
GNSTAVAGDPAGGLAG

SEQ ID NO: 904287 - protein, 23 aa, Mycobacterium
GNSVEVTKQNGNATVSFGQSTKV

SEQ ID NO: 904288 - protein, 9 aa, Mycobacterium
GNTASAEPV

SEQ ID NO: 904289 - protein, 11 aa, Mycobacterium
GNTASPAGDRD

SEQ ID NO: 904290 - protein, 11 aa, Mycobacterium
GNTASPSGDRD

SEQ ID NO: 904291 - protein, 10 aa, Mycobacterium
GNTDCPGNAA

SEQ ID NO: 904292 - protein, 10 aa, Mycobacterium
GNTDCPGNAG

SEQ ID NO: 904293 - protein, 7 aa, Mycobacterium
GNTDGTN

SEQ ID NO: 904294 - protein, 8 aa, Mycobacterium
GNTECPGA

SEQ ID NO: 904295 - protein, 8 aa, Mycobacterium
GNTECPGE

SEQ ID NO: 904296 - protein, 14 aa, Mycobacterium
GNTGGQGGTPRAVP

SEQ ID NO: 904297 - protein, 12 aa, Mycobacterium
GNTIRDSGICDG

SEQ ID NO: 904298 - protein, 6 aa, Mycobacterium
GNTNVS

SEQ ID NO: 904299 - protein, 8 aa, Mycobacterium
GNVESGQI

SEQ ID NO: 904300 - protein, 7 aa, Mycobacterium
GNVSADA

SEQ ID NO: 904301 - protein, 8 aa, Mycobacterium
GNWPSATT

SEQ ID NO: 904302 - protein, 12 aa, Mycobacterium
GNYPDGDKVTTQ

SEQ ID NO: 904303 - protein, 24 aa, Mycobacterium
GNYPHQPRPALGPVADEATGRRVE

SEQ ID NO: 904304 - protein, 6 aa, Mycobacterium
GNYRGT

SEQ ID NO: 904305 - protein, 11 aa, Mycobacterium
GPAAAARGPEN

SEQ ID NO: 904306 - protein, 12 aa, Mycobacterium
GPAAAPRSTAST

SEQ ID NO: 904307 - protein, 13 aa, Mycobacterium
GPAAAVAPPADGT

SEQ ID NO: 904308 - protein, 5 aa, Mycobacterium
GPAAD

SEQ ID NO: 904309 - protein, 10 aa, Mycobacterium
GPAADGRPRY

SEQ ID NO: 904310 - protein, 9 aa, Mycobacterium
GPAAGATDA

SEQ ID NO: 904311 - protein, 6 aa, Mycobacterium
GPAAGV

SEQ ID NO: 904312 - protein, 6 aa, Mycobacterium
GPAANL

SEQ ID NO: 904313 - protein, 23 aa, Mycobacterium
GPAANPSATPAGVSAGAEPATAS

SEQ ID NO: 904314 - protein, 7 aa, Mycobacterium
GPAARTT

SEQ ID NO: 904315 - protein, 5 aa, Mycobacterium
GPAAT

SEQ ID NO: 904316 - protein, 13 aa, Mycobacterium
GPAATASAADNAC

SEQ ID NO: 904317 - protein, 8 aa, Mycobacterium
GPAAVSGP

SEQ ID NO: 904318 - protein, 7 aa, Mycobacterium
GPADAPG

SEQ ID NO: 904319 - protein, 6 aa, Mycobacterium
GPADGG

SEQ ID NO: 904320 - protein, 5 aa, Mycobacterium
GPADH

SEQ ID NO: 904321 - protein, 13 aa, Mycobacterium
GPADKGSADINTS

SEQ ID NO: 904322 - protein, 21 aa, Mycobacterium
GPADTAGPASATVRTEAHAGA

SEQ ID NO: 904323 - protein, 8 aa, Mycobacterium
GPAEPGKL

SEQ ID NO: 904324 - protein, 26 aa, Mycobacterium
GPAETAAEATAATPAAAGPAAQAEQP

SEQ ID NO: 904325 - protein, 9 aa, Mycobacterium
GPAETDPAW

SEQ ID NO: 904326 - protein, 6 aa, Mycobacterium
GPAGDL

SEQ ID NO: 904327 - protein, 5 aa, Mycobacterium
GPAGI

SEQ ID NO: 904328 - protein, 34 aa, Mycobacterium
GPAGPAIPAGPATATLKTHTGGARTARAAGPTVP

SEQ ID NO: 904329 - protein, 7 aa, Mycobacterium
GPAGPIG

SEQ ID NO: 904330 - protein, 22 aa, Mycobacterium
GPAGPVTATAARAAGGGQVEVA

SEQ ID NO: 904331 - protein, 10 aa, Mycobacterium
GPAGSANAFG

SEQ ID NO: 904332 - protein, 8 aa, Mycobacterium
GPAGSTAN

SEQ ID NO: 904333 - protein, 5 aa, Mycobacterium
GPAGT

SEQ ID NO: 904334 - protein, 8 aa, Mycobacterium
GPAGVSAA

SEQ ID NO: 904335 - protein, 14 aa, Mycobacterium
GPANADPTAPLPAP

SEQ ID NO: 904336 - protein, 12 aa, Mycobacterium
GPAPAPPSAKYR

SEQ ID NO: 904337 - protein, 12 aa, Mycobacterium
GPAPAPQPSQDI

SEQ ID NO: 904338 - protein, 7 aa, Mycobacterium
GPAPGAP

SEQ ID NO: 904339 - protein, 8 aa, Mycobacterium
GPAPGGLR

SEQ ID NO: 904340 - protein, 6 aa, Mycobacterium
GPAPGT

SEQ ID NO: 904341 - protein, 5 aa, Mycobacterium
GPAPK

SEQ ID NO: 904342 - protein, 7 aa, Mycobacterium
GPAPLGG

SEQ ID NO: 904343 - protein, 5 aa, Mycobacterium
GPAPQ

SEQ ID NO: 904344 - protein, 18 aa, Mycobacterium
GPAPRGPESVEGWDSLTR

SEQ ID NO: 904345 - protein, 6 aa, Mycobacterium
GPAPSA

SEQ ID NO: 904346 - protein, 18 aa, Mycobacterium
GPAPSARELAATQTPEQV

SEQ ID NO: 904347 - protein, 5 aa, Mycobacterium
GPAPT

SEQ ID NO: 904348 - protein, 20 aa, Mycobacterium
GPAPTATDAAWTKQEADTDR

SEQ ID NO: 904349 - protein, 18 aa, Mycobacterium
GPAPVAAADPGAWDPTLP

SEQ ID NO: 904350 - protein, 4 aa, Mycobacterium
GPAQ

SEQ ID NO: 904351 - protein, 6 aa, Mycobacterium
GPAQQA

SEQ ID NO: 904352 - protein, 8 aa, Mycobacterium
GPARADQA

SEQ ID NO: 904353 - protein, 12 aa, Mycobacterium
GPARASARAGPV

SEQ ID NO: 904354 - protein, 6 aa, Mycobacterium
GPARMS

SEQ ID NO: 904355 - protein, 10 aa, Mycobacterium
GPASNSFAKD

SEQ ID NO: 904356 - protein, 8 aa, Mycobacterium
GPATDGYP

SEQ ID NO: 904357 - protein, 6 aa, Mycobacterium
GPATGA

SEQ ID NO: 904358 - protein, 11 aa, Mycobacterium
GPATGSSCGTI

SEQ ID NO: 904359 - protein, 6 aa, Mycobacterium
GPATNV

SEQ ID NO: 904360 - protein, 4 aa, Mycobacterium
GPAV

SEQ ID NO: 904361 - protein, 11 aa, Mycobacterium
GPAVGNGGTHN

SEQ ID NO: 904362 - protein, 26 aa, Mycobacterium
GPAVTAGTAGPTVRAGPAVTATTTVG

SEQ ID NO: 904363 - protein, 21 aa, Mycobacterium
GPAYNTGGPWGYSPKGATGVP

SEQ ID NO: 904364 - protein, 7 aa, Mycobacterium
GPAYSSY

SEQ ID NO: 904365 - protein, 8 aa, Mycobacterium
GPCGPTTL

SEQ ID NO: 904366 - protein, 9 aa, Mycobacterium
GPDAATAWE

SEQ ID NO: 904367 - protein, 13 aa, Mycobacterium
GPDAGDPDAPPTV

SEQ ID NO: 904368 - protein, 5 aa, Mycobacterium
GPDAV

SEQ ID NO: 904369 - protein, 6 aa, Mycobacterium
GPDDFE

SEQ ID NO: 904370 - protein, 8 aa, Mycobacterium
GPDEALRA

SEQ ID NO: 904371 - protein, 8 aa, Mycobacterium
GPDERDTL

SEQ ID NO: 904372 - protein, 25 aa, Mycobacterium
GPDEVSGVGQAARPSSVHDTSGVEP

SEQ ID NO: 904373 - protein, 4 aa, Mycobacterium
GPDG

SEQ ID NO: 904374 - protein, 11 aa, Mycobacterium
GPDGARGTGVD

SEQ ID NO: 904375 - protein, 22 aa, Mycobacterium
GPDGDFDADKLSPETREAIEDG

SEQ ID NO: 904376 - protein, 14 aa, Mycobacterium
GPDGKLEALGPIPH

SEQ ID NO: 904377 - protein, 14 aa, Mycobacterium
GPDGKLQTVGKVPN

SEQ ID NO: 904378 - protein, 6 aa, Mycobacterium
GPDGTA

SEQ ID NO: 904379 - protein, 14 aa, Mycobacterium
GPDKANLGCTTEPA

SEQ ID NO: 904380 - protein, 4 aa, Mycobacterium
GPDM

SEQ ID NO: 904381 - protein, 22 aa, Mycobacterium
GPDNRLAEKGWTTRKNARGDTE

SEQ ID NO: 904382 - protein, 4 aa, Mycobacterium
GPDP

SEQ ID NO: 904383 - protein, 6 aa, Mycobacterium
GPDPAF

SEQ ID NO: 904384 - protein, 13 aa, Mycobacterium
GPDPKADPKNKVP

SEQ ID NO: 904385 - protein, 9 aa, Mycobacterium
GPDPKGAVS

SEQ ID NO: 904386 - protein, 13 aa, Mycobacterium
GPDQGGKITLNDD

SEQ ID NO: 904387 - protein, 18 aa, Mycobacterium
GPDQRPSDLAFADPPSHI

SEQ ID NO: 904388 - protein, 8 aa, Mycobacterium
GPDSKTAL

SEQ ID NO: 904389 - protein, 9 aa, Mycobacterium
GPDTADAVD

SEQ ID NO: 904390 - protein, 7 aa, Mycobacterium
GPEAPEQ

SEQ ID NO: 904391 - protein, 6 aa, Mycobacterium
GPEATV

SEQ ID NO: 904392 - protein, 4 aa, Mycobacterium
GPEE

SEQ ID NO: 904393 - protein, 10 aa, Mycobacterium
GPEGPTRQEL

SEQ ID NO: 904394 - protein, 9 aa, Mycobacterium
GPEHDPAEL

SEQ ID NO: 904395 - protein, 7 aa, Mycobacterium
GPEKQGM

SEQ ID NO: 904396 - protein, 7 aa, Mycobacterium
GPEPRVS

SEQ ID NO: 904397 - protein, 4 aa, Mycobacterium
GPER

SEQ ID NO: 904398 - protein, 7 aa, Mycobacterium
GPERRGP

SEQ ID NO: 904399 - protein, 10 aa, Mycobacterium
GPESPNDTAR

SEQ ID NO: 904400 - protein, 5 aa, Mycobacterium
GPEST

SEQ ID NO: 904401 - protein, 5 aa, Mycobacterium
GPEVG

SEQ ID NO: 904402 - protein, 12 aa, Mycobacterium
GPFAPGEWTDDT

SEQ ID NO: 904403 - protein, 10 aa, Mycobacterium
GPGAATARAD

SEQ ID NO: 904404 - protein, 5 aa, Mycobacterium
GPGAE

SEQ ID NO: 904405 - protein, 5 aa, Mycobacterium
GPGAG

SEQ ID NO: 904406 - protein, 15 aa, Mycobacterium
GPGAGEGRPFLNAPV

SEQ ID NO: 904407 - protein, 15 aa, Mycobacterium
GPGAGTDLPILDVPV

SEQ ID NO: 904408 - protein, 15 aa, Mycobacterium
GPGAGVDLPILNVPV

SEQ ID NO: 904409 - protein, 11 aa, Mycobacterium
GPGAPAPLGQV

SEQ ID NO: 904410 - protein, 13 aa, Mycobacterium
GPGDQGNGNINTT

SEQ ID NO: 904411 - protein, 7 aa, Mycobacterium
GPGDRIT

SEQ ID NO: 904412 - protein, 26 aa, Mycobacterium
GPGEVTDVEDPPPPLPDPPPPPPPDG

SEQ ID NO: 904413 - protein, 4 aa, Mycobacterium
GPGF

SEQ ID NO: 904414 - protein, 9 aa, Mycobacterium
GPGGGLSSA

SEQ ID NO: 904415 - protein, 14 aa, Mycobacterium
GPGGGWNKPPTPLW

SEQ ID NO: 904416 - protein, 8 aa, Mycobacterium
GPGGRGMT

SEQ ID NO: 904417 - protein, 10 aa, Mycobacterium
GPGGTSFDTT

SEQ ID NO: 904418 - protein, 24 aa, Mycobacterium
GPGHATGAPEPTTIPTGQSSQSIR

SEQ ID NO: 904419 - protein, 6 aa, Mycobacterium
GPGIGF

SEQ ID NO: 904420 - protein, 7 aa, Mycobacterium
GPGKTHL

SEQ ID NO: 904421 - protein, 7 aa, Mycobacterium
GPGLAPD

SEQ ID NO: 904422 - protein, 18 aa, Mycobacterium
GPGPKPGAAADLDAEDID

SEQ ID NO: 904423 - protein, 8 aa, Mycobacterium
GPGPRAGE

SEQ ID NO: 904424 - protein, 8 aa, Mycobacterium
GPGPRRGE

SEQ ID NO: 904425 - protein, 8 aa, Mycobacterium
GPGPVPGQ

SEQ ID NO: 904426 - protein, 8 aa, Mycobacterium
GPGQAERT

SEQ ID NO: 904427 - protein, 9 aa, Mycobacterium
GPGQEGLDQ

SEQ ID NO: 904428 - protein, 7 aa, Mycobacterium
GPGQMDP

SEQ ID NO: 904429 - protein, 26 aa, Mycobacterium
GPGQMGPGGMGPGQPSPTSPAPTPPH

SEQ ID NO: 904430 - protein, 6 aa, Mycobacterium
GPGRCA

SEQ ID NO: 904431 - protein, 19 aa, Mycobacterium
GPGRGGGGLNLDPPRELPP

SEQ ID NO: 904432 - protein, 11 aa, Mycobacterium
GPGRTDVAEGD

SEQ ID NO: 904433 - protein, 7 aa, Mycobacterium
GPGSSSM

SEQ ID NO: 904434 - protein, 4 aa, Mycobacterium
GPGT

SEQ ID NO: 904435 - protein, 6 aa, Mycobacterium
GPGTVD

SEQ ID NO: 904436 - protein, 6 aa, Mycobacterium
GPGTVE

SEQ ID NO: 904437 - protein, 4 aa, Mycobacterium
GPGV

SEQ ID NO: 904438 - protein, 31 aa, Mycobacterium
GPGYANATPTLGPVKTSSITVDGTKAVRADA

SEQ ID NO: 904439 - protein, 6 aa, Mycobacterium
GPGYSA

SEQ ID NO: 904440 - protein, 18 aa, Mycobacterium
GPHGADPHHGYSDRELQA

SEQ ID NO: 904441 - protein, 4 aa, Mycobacterium
GPIA

SEQ ID NO: 904442 - protein, 4 aa, Mycobacterium
GPIP

SEQ ID NO: 904443 - protein, 7 aa, Mycobacterium
GPISAAP

SEQ ID NO: 904444 - protein, 5 aa, Mycobacterium
GPISV

SEQ ID NO: 904445 - protein, 8 aa, Mycobacterium
GPITAGEI

SEQ ID NO: 904446 - protein, 4 aa, Mycobacterium
GPKE

SEQ ID NO: 904447 - protein, 8 aa, Mycobacterium
GPKGRVSV

SEQ ID NO: 904448 - protein, 26 aa, Mycobacterium
GPKPAPPPPTGAVPTYTAAETAAAQQ

SEQ ID NO: 904449 - protein, 11 aa, Mycobacterium
GPLANASLPDI

SEQ ID NO: 904450 - protein, 4 aa, Mycobacterium
GPLG

SEQ ID NO: 904451 - protein, 14 aa, Mycobacterium
GPLGEDAGNQGSTV

SEQ ID NO: 904452 - protein, 8 aa, Mycobacterium
GPLGPIPA

SEQ ID NO: 904453 - protein, 9 aa, Mycobacterium
GPLHGGAPA

SEQ ID NO: 904454 - protein, 5 aa, Mycobacterium
GPLNG

SEQ ID NO: 904455 - protein, 9 aa, Mycobacterium
GPLQPATGS

SEQ ID NO: 904456 - protein, 7 aa, Mycobacterium
GPLRSER

SEQ ID NO: 904457 - protein, 4 aa, Mycobacterium
GPLT

SEQ ID NO: 904458 - protein, 7 aa, Mycobacterium
GPLTADS

SEQ ID NO: 904459 - protein, 6 aa, Mycobacterium
GPLTGS

SEQ ID NO: 904460 - protein, 11 aa, Mycobacterium
GPLTSDRLEES

SEQ ID NO: 904461 - protein, 7 aa, Mycobacterium
GPLTSER

SEQ ID NO: 904462 - protein, 7 aa, Mycobacterium
GPMGTGE

SEQ ID NO: 904463 - protein, 4 aa, Mycobacterium
GPMR

SEQ ID NO: 904464 - protein, 8 aa, Mycobacterium
GPMTDQGY

SEQ ID NO: 904465 - protein, 7 aa, Mycobacterium
GPNARQL

SEQ ID NO: 904466 - protein, 11 aa, Mycobacterium
GPNGAGQTVKA

SEQ ID NO: 904467 - protein, 21 aa, Mycobacterium
GPNGVNGRSWNNRTRAQAESS

SEQ ID NO: 904468 - protein, 5 aa, Mycobacterium
GPNLA

SEQ ID NO: 904469 - protein, 15 aa, Mycobacterium
GPNMPGASWAPSSLR

SEQ ID NO: 904470 - protein, 6 aa, Mycobacterium
GPNPDN

SEQ ID NO: 904471 - protein, 6 aa, Mycobacterium
GPNQLE

SEQ ID NO: 904472 - protein, 7 aa, Mycobacterium
GPNQLET

SEQ ID NO: 904473 - protein, 18 aa, Mycobacterium
GPNSTPADLDQADAFTQQ

SEQ ID NO: 904474 - protein, 5 aa, Mycobacterium
GPNYR

SEQ ID NO: 904475 - protein, 7 aa, Mycobacterium
GPPAADQ

SEQ ID NO: 904476 - protein, 6 aa, Mycobacterium
GPPADV

SEQ ID NO: 904477 - protein, 17 aa, Mycobacterium
GPPAGDQFGEAADGVEA

SEQ ID NO: 904478 - protein, 5 aa, Mycobacterium
GPPAV

SEQ ID NO: 904479 - protein, 7 aa, Mycobacterium
GPPEAPD

SEQ ID NO: 904480 - protein, 13 aa, Mycobacterium
GPPGLEQQLDAAA

SEQ ID NO: 904481 - protein, 6 aa, Mycobacterium
GPPGLT

SEQ ID NO: 904482 - protein, 8 aa, Mycobacterium
GPPGRRTD

SEQ ID NO: 904483 - protein, 8 aa, Mycobacterium
GPPGSTAQ

SEQ ID NO: 904484 - protein, 12 aa, Mycobacterium
GPPGTGKTSVAR

SEQ ID NO: 904485 - protein, 6 aa, Mycobacterium
GPPGTL

SEQ ID NO: 904486 - protein, 7 aa, Mycobacterium
GPPGTTG

SEQ ID NO: 904487 - protein, 7 aa, Mycobacterium
GPPGVGK

SEQ ID NO: 904488 - protein, 9 aa, Mycobacterium
GPPHEGGPG

SEQ ID NO: 904489 - protein, 9 aa, Mycobacterium
GPPIEGGPY

SEQ ID NO: 904490 - protein, 16 aa, Mycobacterium
GPPLSGAANVTEAQDH

SEQ ID NO: 904491 - protein, 14 aa, Mycobacterium
GPPPARPHLASLLR

SEQ ID NO: 904492 - protein, 5 aa, Mycobacterium
GPPPD

SEQ ID NO: 904493 - protein, 6 aa, Mycobacterium
GPPPQL

SEQ ID NO: 904494 - protein, 8 aa, Mycobacterium
GPPSFDPE

SEQ ID NO: 904495 - protein, 4 aa, Mycobacterium
GPPT

SEQ ID NO: 904496 - protein, 5 aa, Mycobacterium
GPPTA

SEQ ID NO: 904497 - protein, 18 aa, Mycobacterium
GPPTDPAWAANDPTANAA

SEQ ID NO: 904498 - protein, 9 aa, Mycobacterium
GPPVPGGVR

SEQ ID NO: 904499 - protein, 6 aa, Mycobacterium
GPPVPN

SEQ ID NO: 904500 - protein, 13 aa, Mycobacterium
GPPVTPPGSNVTV

SEQ ID NO: 904501 - protein, 10 aa, Mycobacterium
GPQAPDSFTQ

SEQ ID NO: 904502 - protein, 9 aa, Mycobacterium
GPQDDKQVA

SEQ ID NO: 904503 - protein, 15 aa, Mycobacterium
GPQGRDVLAAAGFGR

SEQ ID NO: 904504 - protein, 8 aa, Mycobacterium
GPQKTTEW

SEQ ID NO: 904505 - protein, 5 aa, Mycobacterium
GPQLR

SEQ ID NO: 904506 - protein, 4 aa, Mycobacterium
GPQN

SEQ ID NO: 904507 - protein, 9 aa, Mycobacterium
GPQPDTNAI

SEQ ID NO: 904508 - protein, 5 aa, Mycobacterium
GPQPL

SEQ ID NO: 904509 - protein, 5 aa, Mycobacterium
GPQPP

SEQ ID NO: 904510 - protein, 10 aa, Mycobacterium
GPQQPDGSYH

SEQ ID NO: 904511 - protein, 6 aa, Mycobacterium
GPQSPQ

SEQ ID NO: 904512 - protein, 4 aa, Mycobacterium
GPRA

SEQ ID NO: 904513 - protein, 20 aa, Mycobacterium
GPRAPGSSYGGRENGPPVNG

SEQ ID NO: 904514 - protein, 8 aa, Mycobacterium
GPRDARGN

SEQ ID NO: 904515 - protein, 18 aa, Mycobacterium
GPREPGTSYGSRENGPPV

SEQ ID NO: 904516 - protein, 6 aa, Mycobacterium
GPREVT

SEQ ID NO: 904517 - protein, 6 aa, Mycobacterium
GPRGRD

SEQ ID NO: 904518 - protein, 4 aa, Mycobacterium
GPRH

SEQ ID NO: 904519 - protein, 4 aa, Mycobacterium
GPRI

SEQ ID NO: 904520 - protein, 17 aa, Mycobacterium
GPRPDGEPGNDDLGAQS

SEQ ID NO: 904521 - protein, 7 aa, Mycobacterium
GPRPELA

SEQ ID NO: 904522 - protein, 6 aa, Mycobacterium
GPRPEM

SEQ ID NO: 904523 - protein, 8 aa, Mycobacterium
GPRPEMER

SEQ ID NO: 904524 - protein, 6 aa, Mycobacterium
GPRQGS

SEQ ID NO: 904525 - protein, 7 aa, Mycobacterium
GPRQLGP

SEQ ID NO: 904526 - protein, 8 aa, Mycobacterium
GPRQLGPG

SEQ ID NO: 904527 - protein, 10 aa, Mycobacterium
GPRVGAPSDV

SEQ ID NO: 904528 - protein, 6 aa, Mycobacterium
GPSAVT

SEQ ID NO: 904529 - protein, 8 aa, Mycobacterium
GPSDLDGV

SEQ ID NO: 904530 - protein, 42 aa, Mycobacterium
GPSFGTAAAAPGAAPTAASAPPAAPTPAATPTPPAPPAAGVA

SEQ ID NO: 904531 - protein, 9 aa, Mycobacterium
GPSFPAHSS

SEQ ID NO: 904532 - protein, 8 aa, Mycobacterium
GPSFPAYS

SEQ ID NO: 904533 - protein, 4 aa, Mycobacterium
GPSG

SEQ ID NO: 904534 - protein, 8 aa, Mycobacterium
GPSGLTAA

SEQ ID NO: 904535 - protein, 7 aa, Mycobacterium
GPSGQAE

SEQ ID NO: 904536 - protein, 6 aa, Mycobacterium
GPSIAA

SEQ ID NO: 904537 - protein, 14 aa, Mycobacterium
GPSITPAHAAPPVR

SEQ ID NO: 904538 - protein, 8 aa, Mycobacterium
GPSPNKPT

SEQ ID NO: 904539 - protein, 6 aa, Mycobacterium
GPSPWT

SEQ ID NO: 904540 - protein, 7 aa, Mycobacterium
GPSQSAI

SEQ ID NO: 904541 - protein, 9 aa, Mycobacterium
GPSRGPRFS

SEQ ID NO: 904542 - protein, 4 aa, Mycobacterium
GPSS

SEQ ID NO: 904543 - protein, 40 aa, Mycobacterium
GPSSGPGPGPAASAPKSTTPTTPLPPPLPAEVGGSAAKAS

SEQ ID NO: 904544 - protein, 14 aa, Mycobacterium
GPSSSYLTASDPTD

SEQ ID NO: 904545 - protein, 101 aa, Mycobacterium
GPSTGTAAADSPTDTTSASPRASSSADNDESSSTTDAAPDSTDTGEGADDDDADDSASAKGSNSRRDTADTDTDTETETESDAAEIDTAAEGVQDRAEKPN

SEQ ID NO: 904546 - protein, 15 aa, Mycobacterium
GPTAGTGTPTGDYGI

SEQ ID NO: 904547 - protein, 4 aa, Mycobacterium
GPTD

SEQ ID NO: 904548 - protein, 5 aa, Mycobacterium
GPTEW

SEQ ID NO: 904549 - protein, 8 aa, Mycobacterium
GPTGAEEA

SEQ ID NO: 904550 - protein, 13 aa, Mycobacterium
GPTGLTSEVPAPD

SEQ ID NO: 904551 - protein, 17 aa, Mycobacterium
GPTGVIGTNKKDSQETV

SEQ ID NO: 904552 - protein, 7 aa, Mycobacterium
GPTGVTA

SEQ ID NO: 904553 - protein, 28 aa, Mycobacterium
GPTPPPGCYAGKSSVNNPQGSCVTPGGV

SEQ ID NO: 904554 - protein, 4 aa, Mycobacterium
GPTQ

SEQ ID NO: 904555 - protein, 22 aa, Mycobacterium
GPTREDAEAQALERAPGGTIQA

SEQ ID NO: 904556 - protein, 7 aa, Mycobacterium
GPTRYSP

SEQ ID NO: 904557 - protein, 6 aa, Mycobacterium
GPTSPN

SEQ ID NO: 904558 - protein, 12 aa, Mycobacterium
GPTSTHEADDAC

SEQ ID NO: 904559 - protein, 10 aa, Mycobacterium
GPTTRAFDGS

SEQ ID NO: 904560 - protein, 11 aa, Mycobacterium
GPTTRALDGSE

SEQ ID NO: 904561 - protein, 4 aa, Mycobacterium
GPTV

SEQ ID NO: 904562 - protein, 5 aa, Mycobacterium
GPTVN

SEQ ID NO: 904563 - protein, 9 aa, Mycobacterium
GPTVPGDPP

SEQ ID NO: 904564 - protein, 23 aa, Mycobacterium
GPTVTTTTAGPTVGAGPTVTPAA

SEQ ID NO: 904565 - protein, 12 aa, Mycobacterium
GPVAGQDPTPFV

SEQ ID NO: 904566 - protein, 9 aa, Mycobacterium
GPVAPGSPD

SEQ ID NO: 904567 - protein, 13 aa, Mycobacterium
GPVATNAEGANMD

SEQ ID NO: 904568 - protein, 4 aa, Mycobacterium
GPVD

SEQ ID NO: 904569 - protein, 13 aa, Mycobacterium
GPVEADASDIAAP

SEQ ID NO: 904570 - protein, 14 aa, Mycobacterium
GPVETANDEPTAYA

SEQ ID NO: 904571 - protein, 6 aa, Mycobacterium
GPVGET

SEQ ID NO: 904572 - protein, 26 aa, Mycobacterium
GPVGPGPVGPGPVGPGPMGPGPMGPG

SEQ ID NO: 904573 - protein, 26 aa, Mycobacterium
GPVPIPAPAPVPAGAPVPLPAGAPVP

SEQ ID NO: 904574 - protein, 34 aa, Mycobacterium
GPVPQAPGPAPQAPGPADGVPGSVVGAPGSMVQV

SEQ ID NO: 904575 - protein, 34 aa, Mycobacterium
GPVPRAPGPAPQAPGPATASPGTPVGATGTLVGA

SEQ ID NO: 904576 - protein, 4 aa, Mycobacterium
GPVR

SEQ ID NO: 904577 - protein, 14 aa, Mycobacterium
GPVRTDLPDDAERS

SEQ ID NO: 904578 - protein, 20 aa, Mycobacterium
GPVTRADGGKTGVGRGYGGA

SEQ ID NO: 904579 - protein, 6 aa, Mycobacterium
GPVTSG

SEQ ID NO: 904580 - protein, 6 aa, Mycobacterium
GPYDYE

SEQ ID NO: 904581 - protein, 13 aa, Mycobacterium
GPYGEADRAESIA

SEQ ID NO: 904582 - protein, 62 aa, Mycobacterium
GPYGPNSMSNPANPASPLNPNNPANPASPLNPNNPANPASPMNPNNPANPASPLNPMNHPGQ

SEQ ID NO: 904583 - protein, 7 aa, Mycobacterium
GPYGSAP

SEQ ID NO: 904584 - protein, 14 aa, Mycobacterium
GPYPSPPPPWGPGT

SEQ ID NO: 904585 - protein, 5 aa, Mycobacterium
GPYRY

SEQ ID NO: 904586 - protein, 11 aa, Mycobacterium
GQAAAATDGEW

SEQ ID NO: 904587 - protein, 13 aa, Mycobacterium
GQAAGNGGAGGHG

SEQ ID NO: 904588 - protein, 8 aa, Mycobacterium
GQAAPDQV

SEQ ID NO: 904589 - protein, 15 aa, Mycobacterium
GQAAQRSVGRGAEFG

SEQ ID NO: 904590 - protein, 4 aa, Mycobacterium
GQAD

SEQ ID NO: 904591 - protein, 16 aa, Mycobacterium
GQAEHAATQAQSAAAA

SEQ ID NO: 904592 - protein, 10 aa, Mycobacterium
GQAGGSVTGT

SEQ ID NO: 904593 - protein, 9 aa, Mycobacterium
GQAGTKGLR

SEQ ID NO: 904594 - protein, 6 aa, Mycobacterium
GQAGVA

SEQ ID NO: 904595 - protein, 15 aa, Mycobacterium
GQAHADLSRGTYTIT

SEQ ID NO: 904596 - protein, 12 aa, Mycobacterium
GQANQDKGDKEP

SEQ ID NO: 904597 - protein, 15 aa, Mycobacterium
GQANQDKGDSPPAQW

SEQ ID NO: 904598 - protein, 12 aa, Mycobacterium
GQANYGAAKAGI

SEQ ID NO: 904599 - protein, 17 aa, Mycobacterium
GQAPGNGRGRIARDGEP

SEQ ID NO: 904600 - protein, 6 aa, Mycobacterium
GQAPPI

SEQ ID NO: 904601 - protein, 10 aa, Mycobacterium
GQAQTTPRKA

SEQ ID NO: 904602 - protein, 5 aa, Mycobacterium
GQARE

SEQ ID NO: 904603 - protein, 6 aa, Mycobacterium
GQAREY

SEQ ID NO: 904604 - protein, 8 aa, Mycobacterium
GQARPADQ

SEQ ID NO: 904605 - protein, 6 aa, Mycobacterium
GQASAV

SEQ ID NO: 904606 - protein, 4 aa, Mycobacterium
GQDA

SEQ ID NO: 904607 - protein, 7 aa, Mycobacterium
GQDAATN

SEQ ID NO: 904608 - protein, 5 aa, Mycobacterium
GQDEV

SEQ ID NO: 904609 - protein, 10 aa, Mycobacterium
GQDGATIAEP

SEQ ID NO: 904610 - protein, 14 aa, Mycobacterium
GQDGRIAGQGVGDR

SEQ ID NO: 904611 - protein, 9 aa, Mycobacterium
GQDIPEGAQ

SEQ ID NO: 904612 - protein, 14 aa, Mycobacterium
GQDKPGTVAGDGSV

SEQ ID NO: 904613 - protein, 14 aa, Mycobacterium
GQDRDAMSANTQNY

SEQ ID NO: 904614 - protein, 6 aa, Mycobacterium
GQDYQA

SEQ ID NO: 904615 - protein, 7 aa, Mycobacterium
GQELDSA

SEQ ID NO: 904616 - protein, 8 aa, Mycobacterium
GQEQSRER

SEQ ID NO: 904617 - protein, 10 aa, Mycobacterium
GQFEGQPEVN

SEQ ID NO: 904618 - protein, 4 aa, Mycobacterium
GQGA

SEQ ID NO: 904619 - protein, 6 aa, Mycobacterium
GQGATI

SEQ ID NO: 904620 - protein, 5 aa, Mycobacterium
GQGGA

SEQ ID NO: 904621 - protein, 7 aa, Mycobacterium
GQGGGSA

SEQ ID NO: 904622 - protein, 6 aa, Mycobacterium
GQGGTL

SEQ ID NO: 904623 - protein, 6 aa, Mycobacterium
GQGGVA

SEQ ID NO: 904624 - protein, 11 aa, Mycobacterium
GQGNEWSGHTD

SEQ ID NO: 904625 - protein, 9 aa, Mycobacterium
GQGPAAWPK

SEQ ID NO: 904626 - protein, 7 aa, Mycobacterium
GQGPGVP

SEQ ID NO: 904627 - protein, 26 aa, Mycobacterium
GQGPNPPAPAPAPQPEPAPAPEPGPG

SEQ ID NO: 904628 - protein, 6 aa, Mycobacterium
GQGPTI

SEQ ID NO: 904629 - protein, 12 aa, Mycobacterium
GQGRAGYTETDV

SEQ ID NO: 904630 - protein, 6 aa, Mycobacterium
GQGRQY

SEQ ID NO: 904631 - protein, 6 aa, Mycobacterium
GQGRRT

SEQ ID NO: 904632 - protein, 7 aa, Mycobacterium
GQGSQRL

SEQ ID NO: 904633 - protein, 9 aa, Mycobacterium
GQGSSRPPR

SEQ ID NO: 904634 - protein, 7 aa, Mycobacterium
GQGTQMP

SEQ ID NO: 904635 - protein, 111 aa, Mycobacterium
GQGVATADTDDSSGSGESSATARGKQAAVADRPSASEQSESPSSPDSDNDGVGTDDETTDDTDTDTGAESPDVEVDEQDQDPQPDTVEEPDEDTSEVTVDESDGSRTHQKP

SEQ ID NO: 904636 - protein, 10 aa, Mycobacterium
GQHAAQRNSE

SEQ ID NO: 904637 - protein, 11 aa, Mycobacterium
GQHGDSGGPVY

SEQ ID NO: 904638 - protein, 7 aa, Mycobacterium
GQHPDGQ

SEQ ID NO: 904639 - protein, 9 aa, Mycobacterium
GQHRTNTYH

SEQ ID NO: 904640 - protein, 29 aa, Mycobacterium
GQHTAVSSSTTTTTTATSAANSSAKVRSQ

SEQ ID NO: 904641 - protein, 5 aa, Mycobacterium
GQHTS

SEQ ID NO: 904642 - protein, 9 aa, Mycobacterium
GQIKSAPRF

SEQ ID NO: 904643 - protein, 6 aa, Mycobacterium
GQIPGM

SEQ ID NO: 904644 - protein, 7 aa, Mycobacterium
GQIPGMG

SEQ ID NO: 904645 - protein, 6 aa, Mycobacterium
GQITGE

SEQ ID NO: 904646 - protein, 15 aa, Mycobacterium
GQKGGSWRTTGCSSP

SEQ ID NO: 904647 - protein, 16 aa, Mycobacterium
GQKGGTWKSTGCTSPL

SEQ ID NO: 904648 - protein, 13 aa, Mycobacterium
GQKQDEAIKKGLG

SEQ ID NO: 904649 - protein, 4 aa, Mycobacterium
GQKV

SEQ ID NO: 904650 - protein, 4 aa, Mycobacterium
GQLN

SEQ ID NO: 904651 - protein, 6 aa, Mycobacterium
GQLPDG

SEQ ID NO: 904652 - protein, 5 aa, Mycobacterium
GQLPP

SEQ ID NO: 904653 - protein, 10 aa, Mycobacterium
GQLQSQDAAV

SEQ ID NO: 904654 - protein, 19 aa, Mycobacterium
GQLSKASDAIEAATGQRPK

SEQ ID NO: 904655 - protein, 9 aa, Mycobacterium
GQLSPDGVS

SEQ ID NO: 904656 - protein, 30 aa, Mycobacterium
GQMPGAGSGLPNAGGLPTASNAGGASPLSA

SEQ ID NO: 904657 - protein, 18 aa, Mycobacterium
GQMPGQTGAALSRSGQEV

SEQ ID NO: 904658 - protein, 8 aa, Mycobacterium
GQNASSQL

SEQ ID NO: 904659 - protein, 8 aa, Mycobacterium
GQNGNDAL

SEQ ID NO: 904660 - protein, 14 aa, Mycobacterium
GQNTAAIADTEAQY

SEQ ID NO: 904661 - protein, 6 aa, Mycobacterium
GQPARV

SEQ ID NO: 904662 - protein, 6 aa, Mycobacterium
GQPAVI

SEQ ID NO: 904663 - protein, 13 aa, Mycobacterium
GQPEQTPGVTPSG

SEQ ID NO: 904664 - protein, 7 aa, Mycobacterium
GQPGTRT

SEQ ID NO: 904665 - protein, 4 aa, Mycobacterium
GQPL

SEQ ID NO: 904666 - protein, 22 aa, Mycobacterium
GQPPGLRLPPNTGVCPPLAWMC

SEQ ID NO: 904667 - protein, 7 aa, Mycobacterium
GQPPNGV

SEQ ID NO: 904668 - protein, 6 aa, Mycobacterium
GQPPRD

SEQ ID NO: 904669 - protein, 9 aa, Mycobacterium
GQPQAWPTV

SEQ ID NO: 904670 - protein, 5 aa, Mycobacterium
GQPQV

SEQ ID NO: 904671 - protein, 10 aa, Mycobacterium
GQPRGEAASN

SEQ ID NO: 904672 - protein, 7 aa, Mycobacterium
GQPRTGE

SEQ ID NO: 904673 - protein, 7 aa, Mycobacterium
GQPTLTD

SEQ ID NO: 904674 - protein, 6 aa, Mycobacterium
GQPTTL

SEQ ID NO: 904675 - protein, 4 aa, Mycobacterium
GQPV

SEQ ID NO: 904676 - protein, 5 aa, Mycobacterium
GQPVT

SEQ ID NO: 904677 - protein, 8 aa, Mycobacterium
GQPVTPAA

SEQ ID NO: 904678 - protein, 7 aa, Mycobacterium
GQQGGSW

SEQ ID NO: 904679 - protein, 11 aa, Mycobacterium
GQQRAPRPGVH

SEQ ID NO: 904680 - protein, 12 aa, Mycobacterium
GQRKPTIGRDGG

SEQ ID NO: 904681 - protein, 6 aa, Mycobacterium
GQRPCS

SEQ ID NO: 904682 - protein, 8 aa, Mycobacterium
GQRPETES

SEQ ID NO: 904683 - protein, 11 aa, Mycobacterium
GQRPQPATRKS

SEQ ID NO: 904684 - protein, 7 aa, Mycobacterium
GQRQGAD

SEQ ID NO: 904685 - protein, 4 aa, Mycobacterium
GQRS

SEQ ID NO: 904686 - protein, 9 aa, Mycobacterium
GQRSPTPPA

SEQ ID NO: 904687 - protein, 5 aa, Mycobacterium
GQSAA

SEQ ID NO: 904688 - protein, 9 aa, Mycobacterium
GQSAGGGFA

SEQ ID NO: 904689 - protein, 13 aa, Mycobacterium
GQSAPSPFDPGGI

SEQ ID NO: 904690 - protein, 33 aa, Mycobacterium
GQSATTSNPTSPPHANATTQATAATLTTVDGKT

SEQ ID NO: 904691 - protein, 6 aa, Mycobacterium
GQSGKT

SEQ ID NO: 904692 - protein, 9 aa, Mycobacterium
GQSGRWSTN

SEQ ID NO: 904693 - protein, 13 aa, Mycobacterium
GQSHTPRTITGPH

SEQ ID NO: 904694 - protein, 5 aa, Mycobacterium
GQSLA

SEQ ID NO: 904695 - protein, 7 aa, Mycobacterium
GQSNREI

SEQ ID NO: 904696 - protein, 12 aa, Mycobacterium
GQSPDPKGPAQA

SEQ ID NO: 904697 - protein, 7 aa, Mycobacterium
GQTGANR

SEQ ID NO: 904698 - protein, 8 aa, Mycobacterium
GQTGLDAA

SEQ ID NO: 904699 - protein, 5 aa, Mycobacterium
GQTHR

SEQ ID NO: 904700 - protein, 4 aa, Mycobacterium
GQTI

SEQ ID NO: 904701 - protein, 6 aa, Mycobacterium
GQTIPL

SEQ ID NO: 904702 - protein, 13 aa, Mycobacterium
GQTLGRDGHKIAR

SEQ ID NO: 904703 - protein, 4 aa, Mycobacterium
GQTN

SEQ ID NO: 904704 - protein, 15 aa, Mycobacterium
GQTNTTNLPSMPGNA

SEQ ID NO: 904705 - protein, 5 aa, Mycobacterium
GQTQA

SEQ ID NO: 904706 - protein, 11 aa, Mycobacterium
GQTRDDRSTHD

SEQ ID NO: 904707 - protein, 9 aa, Mycobacterium
GQTRETKRA

SEQ ID NO: 904708 - protein, 4 aa, Mycobacterium
GQTS

SEQ ID NO: 904709 - protein, 10 aa, Mycobacterium
GQTSTAEPSV

SEQ ID NO: 904710 - protein, 31 aa, Mycobacterium
GQTSVTTIGADGRARQALRAGEGATTLAADP

SEQ ID NO: 904711 - protein, 16 aa, Mycobacterium
GQTSVTTLNSDGTGAA

SEQ ID NO: 904712 - protein, 20 aa, Mycobacterium
GQTTTGRPAFAGSDARRLEG

SEQ ID NO: 904713 - protein, 4 aa, Mycobacterium
GQTV

SEQ ID NO: 904714 - protein, 6 aa, Mycobacterium
GQVAPG

SEQ ID NO: 904715 - protein, 19 aa, Mycobacterium
GQVEQTGPEEELQDVDTPD

SEQ ID NO: 904716 - protein, 10 aa, Mycobacterium
GQVGDGREAA

SEQ ID NO: 904717 - protein, 6 aa, Mycobacterium
GQVGNQ

SEQ ID NO: 904718 - protein, 7 aa, Mycobacterium
GQVPTRA

SEQ ID NO: 904719 - protein, 12 aa, Mycobacterium
GQVRDDRSSADK

SEQ ID NO: 904720 - protein, 12 aa, Mycobacterium
GQVRDSRASTDA

SEQ ID NO: 904721 - protein, 7 aa, Mycobacterium
GQVSPAT

SEQ ID NO: 904722 - protein, 13 aa, Mycobacterium
GQYDGVSASGDAT

SEQ ID NO: 904723 - protein, 4 aa, Mycobacterium
GQYP

SEQ ID NO: 904724 - protein, 12 aa, Mycobacterium
GQYPPDDPSVWN

SEQ ID NO: 904725 - protein, 7 aa, Mycobacterium
GQYRSGD

SEQ ID NO: 904726 - protein, 5 aa, Mycobacterium
GQYTT

SEQ ID NO: 904727 - protein, 9 aa, Mycobacterium
GRAAAENRL

SEQ ID NO: 904728 - protein, 12 aa, Mycobacterium
GRAAGRGAAADI

SEQ ID NO: 904729 - protein, 12 aa, Mycobacterium
GRAAGRHAAVAV

SEQ ID NO: 904730 - protein, 7 aa, Mycobacterium
GRAAPDD

SEQ ID NO: 904731 - protein, 5 aa, Mycobacterium
GRAAV

SEQ ID NO: 904732 - protein, 5 aa, Mycobacterium
GRAFS

SEQ ID NO: 904733 - protein, 4 aa, Mycobacterium
GRAG

SEQ ID NO: 904734 - protein, 9 aa, Mycobacterium
GRAGIRGEK

SEQ ID NO: 904735 - protein, 9 aa, Mycobacterium
GRAGSRLTG

SEQ ID NO: 904736 - protein, 8 aa, Mycobacterium
GRAKKSNV

SEQ ID NO: 904737 - protein, 7 aa, Mycobacterium
GRAKPSR

SEQ ID NO: 904738 - protein, 18 aa, Mycobacterium
GRALGTPPTTATASPNAD

SEQ ID NO: 904739 - protein, 28 aa, Mycobacterium
GRAMPGQAGKAGTRTDTTGPSGPTGPGV

SEQ ID NO: 904740 - protein, 28 aa, Mycobacterium
GRAMPGQAGQAVARAGAAGPAGPTGPGV

SEQ ID NO: 904741 - protein, 5 aa, Mycobacterium
GRANG

SEQ ID NO: 904742 - protein, 12 aa, Mycobacterium
GRAPASAAGPDL

SEQ ID NO: 904743 - protein, 7 aa, Mycobacterium
GRAPLEN

SEQ ID NO: 904744 - protein, 15 aa, Mycobacterium
GRARGVRARRPDGTA

SEQ ID NO: 904745 - protein, 4 aa, Mycobacterium
GRAS

SEQ ID NO: 904746 - protein, 14 aa, Mycobacterium
GRASDDGYRIPARG

SEQ ID NO: 904747 - protein, 5 aa, Mycobacterium
GRASP

SEQ ID NO: 904748 - protein, 7 aa, Mycobacterium
GRATVRP

SEQ ID NO: 904749 - protein, 16 aa, Mycobacterium
GRCDEGSTVTDSKENV

SEQ ID NO: 904750 - protein, 15 aa, Mycobacterium
GRCGGRGGGGHHTGL

SEQ ID NO: 904751 - protein, 15 aa, Mycobacterium
GRDADAAEAAAKRIS

SEQ ID NO: 904752 - protein, 13 aa, Mycobacterium
GRDARDRNDLRTT

SEQ ID NO: 904753 - protein, 9 aa, Mycobacterium
GRDEARGRE

SEQ ID NO: 904754 - protein, 9 aa, Mycobacterium
GRDGLPGVA

SEQ ID NO: 904755 - protein, 5 aa, Mycobacterium
GRDGQ

SEQ ID NO: 904756 - protein, 6 aa, Mycobacterium
GRDGSV

SEQ ID NO: 904757 - protein, 15 aa, Mycobacterium
GRDGTSETIDMPVTA

SEQ ID NO: 904758 - protein, 6 aa, Mycobacterium
GRDLPE

SEQ ID NO: 904759 - protein, 6 aa, Mycobacterium
GRDPDE

SEQ ID NO: 904760 - protein, 18 aa, Mycobacterium
GRDPRGANVDTTIKPRVQ

SEQ ID NO: 904761 - protein, 18 aa, Mycobacterium
GRDPRGGNVDTTIKPQVQ

SEQ ID NO: 904762 - protein, 15 aa, Mycobacterium
GRDPRGGNVDTTINP

SEQ ID NO: 904763 - protein, 18 aa, Mycobacterium
GRDPRGGNVDTTINPRVQ

SEQ ID NO: 904764 - protein, 15 aa, Mycobacterium
GRDPRGGNVDTTIRP

SEQ ID NO: 904765 - protein, 18 aa, Mycobacterium
GRDPRGGNVSTTINPDVQ

SEQ ID NO: 904766 - protein, 9 aa, Mycobacterium
GRDPRGGSV

SEQ ID NO: 904767 - protein, 12 aa, Mycobacterium
GRDQNVTHPPAS

SEQ ID NO: 904768 - protein, 14 aa, Mycobacterium
GRDQVSPQAGRDAA

SEQ ID NO: 904769 - protein, 27 aa, Mycobacterium
GREDDAIRDTKAALGQLQSTRDGYANS

SEQ ID NO: 904770 - protein, 7 aa, Mycobacterium
GREDPKV

SEQ ID NO: 904771 - protein, 16 aa, Mycobacterium
GREKTTGPSGACGNNA

SEQ ID NO: 904772 - protein, 4 aa, Mycobacterium
GREL

SEQ ID NO: 904773 - protein, 15 aa, Mycobacterium
GREPDRNFSATGLMA

SEQ ID NO: 904774 - protein, 11 aa, Mycobacterium
GREQAETAAQK

SEQ ID NO: 904775 - protein, 6 aa, Mycobacterium
GRERDI

SEQ ID NO: 904776 - protein, 9 aa, Mycobacterium
GRERPDDSI

SEQ ID NO: 904777 - protein, 12 aa, Mycobacterium
GRESAGDPCAEA

SEQ ID NO: 904778 - protein, 20 aa, Mycobacterium
GRETAPAPQPQPDPTPAGEF

SEQ ID NO: 904779 - protein, 15 aa, Mycobacterium
GRETAPEPVITGPST

SEQ ID NO: 904780 - protein, 7 aa, Mycobacterium
GREYDPG

SEQ ID NO: 904781 - protein, 13 aa, Mycobacterium
GRFAENGSATTRV

SEQ ID NO: 904782 - protein, 5 aa, Mycobacterium
GRFDP

SEQ ID NO: 904783 - protein, 9 aa, Mycobacterium
GRGAGRVAT

SEQ ID NO: 904784 - protein, 12 aa, Mycobacterium
GRGAVGGPTHGT

SEQ ID NO: 904785 - protein, 15 aa, Mycobacterium
GRGEDSAEQSGWTDE

SEQ ID NO: 904786 - protein, 33 aa, Mycobacterium
GRGEVPSETAAPESADATTTSAPAVTADPGVQA

SEQ ID NO: 904787 - protein, 4 aa, Mycobacterium
GRGG

SEQ ID NO: 904788 - protein, 14 aa, Mycobacterium
GRGGMMGPGGMMGP

SEQ ID NO: 904789 - protein, 16 aa, Mycobacterium
GRGGPGGGGSAGDAVK

SEQ ID NO: 904790 - protein, 8 aa, Mycobacterium
GRGGRTPA

SEQ ID NO: 904791 - protein, 13 aa, Mycobacterium
GRGIPTGTCPTVG

SEQ ID NO: 904792 - protein, 10 aa, Mycobacterium
GRGPDSPQVP

SEQ ID NO: 904793 - protein, 8 aa, Mycobacterium
GRGPGGEA

SEQ ID NO: 904794 - protein, 7 aa, Mycobacterium
GRGPGGV

SEQ ID NO: 904795 - protein, 9 aa, Mycobacterium
GRGPGSPQL

SEQ ID NO: 904796 - protein, 38 aa, Mycobacterium
GRGPQTPMGQTPWTPSGPPLPPAPGGEAPPDPINPEPP

SEQ ID NO: 904797 - protein, 4 aa, Mycobacterium
GRGR

SEQ ID NO: 904798 - protein, 4 aa, Mycobacterium
GRGS

SEQ ID NO: 904799 - protein, 5 aa, Mycobacterium
GRGSN

SEQ ID NO: 904800 - protein, 15 aa, Mycobacterium
GRGSNEGEARQDAQR

SEQ ID NO: 904801 - protein, 11 aa, Mycobacterium
GRGSTLPKRAQ

SEQ ID NO: 904802 - protein, 7 aa, Mycobacterium
GRGSVGE

SEQ ID NO: 904803 - protein, 4 aa, Mycobacterium
GRGT

SEQ ID NO: 904804 - protein, 16 aa, Mycobacterium
GRGTGYRTGPDDGGTR

SEQ ID NO: 904805 - protein, 20 aa, Mycobacterium
GRGTQHNGTLRDSAAAHDAP

SEQ ID NO: 904806 - protein, 6 aa, Mycobacterium
GRGTTM

SEQ ID NO: 904807 - protein, 5 aa, Mycobacterium
GRGVE

SEQ ID NO: 904808 - protein, 8 aa, Mycobacterium
GRHAEQRC

SEQ ID NO: 904809 - protein, 6 aa, Mycobacterium
GRHDGN

SEQ ID NO: 904810 - protein, 4 aa, Mycobacterium
GRHG

SEQ ID NO: 904811 - protein, 14 aa, Mycobacterium
GRHGASSKAPGPAQ

SEQ ID NO: 904812 - protein, 7 aa, Mycobacterium
GRHGRDL

SEQ ID NO: 904813 - protein, 6 aa, Mycobacterium
GRHLPR

SEQ ID NO: 904814 - protein, 22 aa, Mycobacterium
GRHPADHASWGPANQSPLRTGG

SEQ ID NO: 904815 - protein, 7 aa, Mycobacterium
GRHQPSA

SEQ ID NO: 904816 - protein, 11 aa, Mycobacterium
GRHRKPSTSNI

SEQ ID NO: 904817 - protein, 5 aa, Mycobacterium
GRHTE

SEQ ID NO: 904818 - protein, 12 aa, Mycobacterium
GRIEASDADGDR

SEQ ID NO: 904819 - protein, 7 aa, Mycobacterium
GRIESAA

SEQ ID NO: 904820 - protein, 10 aa, Mycobacterium
GRIGQYRNDR

SEQ ID NO: 904821 - protein, 8 aa, Mycobacterium
GRIQGRDN

SEQ ID NO: 904822 - protein, 7 aa, Mycobacterium
GRKLPEG

SEQ ID NO: 904823 - protein, 7 aa, Mycobacterium
GRKPDNL

SEQ ID NO: 904824 - protein, 22 aa, Mycobacterium
GRKRRPLPSGLGGPSADPYADL

SEQ ID NO: 904825 - protein, 9 aa, Mycobacterium
GRKSGDSIT

SEQ ID NO: 904826 - protein, 9 aa, Mycobacterium
GRLAGDDTV

SEQ ID NO: 904827 - protein, 7 aa, Mycobacterium
GRLGDKS

SEQ ID NO: 904828 - protein, 8 aa, Mycobacterium
GRLGDSRN

SEQ ID NO: 904829 - protein, 8 aa, Mycobacterium
GRLGEESD

SEQ ID NO: 904830 - protein, 35 aa, Mycobacterium
GRLPDTRTTTPPPPPASNTPAPPSREDSVRAPSNL

SEQ ID NO: 904831 - protein, 11 aa, Mycobacterium
GRLPINPDGGL

SEQ ID NO: 904832 - protein, 4 aa, Mycobacterium
GRLR

SEQ ID NO: 904833 - protein, 10 aa, Mycobacterium
GRLTDGHGRT

SEQ ID NO: 904834 - protein, 9 aa, Mycobacterium
GRLTTSGVA

SEQ ID NO: 904835 - protein, 16 aa, Mycobacterium
GRMPDFDTASTAGYAD

SEQ ID NO: 904836 - protein, 11 aa, Mycobacterium
GRMPGNTDEER

SEQ ID NO: 904837 - protein, 10 aa, Mycobacterium
GRNESPGPGV

SEQ ID NO: 904838 - protein, 35 aa, Mycobacterium
GRNPLPQGVPPPAGDPVPDIATPPAHIQGRPADQL

SEQ ID NO: 904839 - protein, 4 aa, Mycobacterium
GRNV

SEQ ID NO: 904840 - protein, 8 aa, Mycobacterium
GRPADPGH

SEQ ID NO: 904841 - protein, 9 aa, Mycobacterium
GRPADPTRY

SEQ ID NO: 904842 - protein, 8 aa, Mycobacterium
GRPAPDLP

SEQ ID NO: 904843 - protein, 8 aa, Mycobacterium
GRPAPPHR

SEQ ID NO: 904844 - protein, 8 aa, Mycobacterium
GRPAPTHD

SEQ ID NO: 904845 - protein, 9 aa, Mycobacterium
GRPAPTHGR

SEQ ID NO: 904846 - protein, 8 aa, Mycobacterium
GRPAPTHR

SEQ ID NO: 904847 - protein, 8 aa, Mycobacterium
GRPDAAAA

SEQ ID NO: 904848 - protein, 5 aa, Mycobacterium
GRPED

SEQ ID NO: 904849 - protein, 14 aa, Mycobacterium
GRPLAEPPAEESAR

SEQ ID NO: 904850 - protein, 15 aa, Mycobacterium
GRPLTSFTGPQPADQ

SEQ ID NO: 904851 - protein, 6 aa, Mycobacterium
GRPMAD

SEQ ID NO: 904852 - protein, 5 aa, Mycobacterium
GRPPR

SEQ ID NO: 904853 - protein, 6 aa, Mycobacterium
GRPPRT

SEQ ID NO: 904854 - protein, 10 aa, Mycobacterium
GRPSELEHQS

SEQ ID NO: 904855 - protein, 8 aa, Mycobacterium
GRPSERWG

SEQ ID NO: 904856 - protein, 8 aa, Mycobacterium
GRPSSQLD

SEQ ID NO: 904857 - protein, 7 aa, Mycobacterium
GRPSTFP

SEQ ID NO: 904858 - protein, 6 aa, Mycobacterium
GRPTDR

SEQ ID NO: 904859 - protein, 13 aa, Mycobacterium
GRPTSPEASGLGA

SEQ ID NO: 904860 - protein, 17 aa, Mycobacterium
GRPTTVQGGAQRPIPPG

SEQ ID NO: 904861 - protein, 5 aa, Mycobacterium
GRPVA

SEQ ID NO: 904862 - protein, 13 aa, Mycobacterium
GRPVPGQSSGDLT

SEQ ID NO: 904863 - protein, 15 aa, Mycobacterium
GRPYDGNSDWMSRLP

SEQ ID NO: 904864 - protein, 7 aa, Mycobacterium
GRQARAQ

SEQ ID NO: 904865 - protein, 6 aa, Mycobacterium
GRQAVA

SEQ ID NO: 904866 - protein, 5 aa, Mycobacterium
GRQAY

SEQ ID NO: 904867 - protein, 7 aa, Mycobacterium
GRQDGDQ

SEQ ID NO: 904868 - protein, 4 aa, Mycobacterium
GRQG

SEQ ID NO: 904869 - protein, 15 aa, Mycobacterium
GRQKGSGAPNGLQDE

SEQ ID NO: 904870 - protein, 21 aa, Mycobacterium
GRQPATSLAGLSRSVDEVLRS

SEQ ID NO: 904871 - protein, 11 aa, Mycobacterium
GRQRYRTAGVP

SEQ ID NO: 904872 - protein, 24 aa, Mycobacterium
GRQRYRTAGVPKAADLRQALQPLL

SEQ ID NO: 904873 - protein, 9 aa, Mycobacterium
GRQSEEGSG

SEQ ID NO: 904874 - protein, 5 aa, Mycobacterium
GRRAD

SEQ ID NO: 904875 - protein, 11 aa, Mycobacterium
GRRDDPTDQPH

SEQ ID NO: 904876 - protein, 5 aa, Mycobacterium
GRRGG

SEQ ID NO: 904877 - protein, 11 aa, Mycobacterium
GRRHTPAGGGC

SEQ ID NO: 904878 - protein, 13 aa, Mycobacterium
GRRKAKDPRAFEA

SEQ ID NO: 904879 - protein, 8 aa, Mycobacterium
GRRNSNEV

SEQ ID NO: 904880 - protein, 21 aa, Mycobacterium
GRRPSPGTGAYGAAKAGLESL

SEQ ID NO: 904881 - protein, 21 aa, Mycobacterium
GRRQPGVGNDIPPSPPGEGAE

SEQ ID NO: 904882 - protein, 41 aa, Mycobacterium
GRRQTDQQAGPDRDAASQTAAQAEAPIAATPVPGDASASPI

SEQ ID NO: 904883 - protein, 11 aa, Mycobacterium
GRRQYSENTAT

SEQ ID NO: 904884 - protein, 12 aa, Mycobacterium
GRRQYSENTATD

SEQ ID NO: 904885 - protein, 6 aa, Mycobacterium
GRRRAE

SEQ ID NO: 904886 - protein, 12 aa, Mycobacterium
GRRSAFACEPPG

SEQ ID NO: 904887 - protein, 9 aa, Mycobacterium
GRRSEPSSH

SEQ ID NO: 904888 - protein, 9 aa, Mycobacterium
GRRSGRTFE

SEQ ID NO: 904889 - protein, 17 aa, Mycobacterium
GRRSPGADEGGVVSGPP

SEQ ID NO: 904890 - protein, 5 aa, Mycobacterium
GRRTP

SEQ ID NO: 904891 - protein, 5 aa, Mycobacterium
GRRTV

SEQ ID NO: 904892 - protein, 8 aa, Mycobacterium
GRRYRTTA

SEQ ID NO: 904893 - protein, 5 aa, Mycobacterium
GRSAE

SEQ ID NO: 904894 - protein, 27 aa, Mycobacterium
GRSAQIQNSLDKTSQLASTLSAREKTI

SEQ ID NO: 904895 - protein, 7 aa, Mycobacterium
GRSARTP

SEQ ID NO: 904896 - protein, 8 aa, Mycobacterium
GRSDAAAV

SEQ ID NO: 904897 - protein, 4 aa, Mycobacterium
GRSE

SEQ ID NO: 904898 - protein, 5 aa, Mycobacterium
GRSEE

SEQ ID NO: 904899 - protein, 5 aa, Mycobacterium
GRSGA

SEQ ID NO: 904900 - protein, 8 aa, Mycobacterium
GRSGDQVG

SEQ ID NO: 904901 - protein, 9 aa, Mycobacterium
GRSGTPGKA

SEQ ID NO: 904902 - protein, 10 aa, Mycobacterium
GRSGVKAFAG

SEQ ID NO: 904903 - protein, 25 aa, Mycobacterium
GRSHQAAGHDAKARLGGGWVLTSAC

SEQ ID NO: 904904 - protein, 7 aa, Mycobacterium
GRSITRN

SEQ ID NO: 904905 - protein, 10 aa, Mycobacterium
GRSKSAVARD

SEQ ID NO: 904906 - protein, 4 aa, Mycobacterium
GRSL

SEQ ID NO: 904907 - protein, 8 aa, Mycobacterium
GRSLSGPA

SEQ ID NO: 904908 - protein, 9 aa, Mycobacterium
GRSLTQSTT

SEQ ID NO: 904909 - protein, 25 aa, Mycobacterium
GRSPAAPTDMSNASEEQARANFQSD

SEQ ID NO: 904910 - protein, 11 aa, Mycobacterium
GRSPAGNTAAA

SEQ ID NO: 904911 - protein, 6 aa, Mycobacterium
GRSTAD

SEQ ID NO: 904912 - protein, 6 aa, Mycobacterium
GRSTAE

SEQ ID NO: 904913 - protein, 7 aa, Mycobacterium
GRSTDVR

SEQ ID NO: 904914 - protein, 6 aa, Mycobacterium
GRSTGY

SEQ ID NO: 904915 - protein, 6 aa, Mycobacterium
GRSTWP

SEQ ID NO: 904916 - protein, 15 aa, Mycobacterium
GRSYAAAEAANATAA

SEQ ID NO: 904917 - protein, 8 aa, Mycobacterium
GRSYPKDE

SEQ ID NO: 904918 - protein, 4 aa, Mycobacterium
GRTA

SEQ ID NO: 904919 - protein, 9 aa, Mycobacterium
GRTASRETA

SEQ ID NO: 904920 - protein, 10 aa, Mycobacterium
GRTDESFDQF

SEQ ID NO: 904921 - protein, 13 aa, Mycobacterium
GRTEDPNSAWKRN

SEQ ID NO: 904922 - protein, 8 aa, Mycobacterium
GRTGERQG

SEQ ID NO: 904923 - protein, 5 aa, Mycobacterium
GRTGF

SEQ ID NO: 904924 - protein, 6 aa, Mycobacterium
GRTGNL

SEQ ID NO: 904925 - protein, 5 aa, Mycobacterium
GRTGQ

SEQ ID NO: 904926 - protein, 9 aa, Mycobacterium
GRTLSRPSW

SEQ ID NO: 904927 - protein, 10 aa, Mycobacterium
GRTNDEQVTA

SEQ ID NO: 904928 - protein, 7 aa, Mycobacterium
GRTPAYP

SEQ ID NO: 904929 - protein, 6 aa, Mycobacterium
GRTPRV

SEQ ID NO: 904930 - protein, 6 aa, Mycobacterium
GRTPTA

SEQ ID NO: 904931 - protein, 7 aa, Mycobacterium
GRTQACQ

SEQ ID NO: 904932 - protein, 22 aa, Mycobacterium
GRTQPTDYDSRRSTTPALDAGR

SEQ ID NO: 904933 - protein, 5 aa, Mycobacterium
GRTQT

SEQ ID NO: 904934 - protein, 21 aa, Mycobacterium
GRTSAGRVGVDPTASDPGGWP

SEQ ID NO: 904935 - protein, 6 aa, Mycobacterium
GRTSGD

SEQ ID NO: 904936 - protein, 13 aa, Mycobacterium
GRTSSTSRSQVTP

SEQ ID NO: 904937 - protein, 15 aa, Mycobacterium
GRTSSTTRDQATPRN

SEQ ID NO: 904938 - protein, 8 aa, Mycobacterium
GRTTGNSC

SEQ ID NO: 904939 - protein, 8 aa, Mycobacterium
GRTTITTV

SEQ ID NO: 904940 - protein, 13 aa, Mycobacterium
GRTVRGGASQPVR

SEQ ID NO: 904941 - protein, 9 aa, Mycobacterium
GRTYDAPDA

SEQ ID NO: 904942 - protein, 19 aa, Mycobacterium
GRVAAEPMPLPAGAPHPGP

SEQ ID NO: 904943 - protein, 10 aa, Mycobacterium
GRVDDKGPYE

SEQ ID NO: 904944 - protein, 9 aa, Mycobacterium
GRVGGRSVG

SEQ ID NO: 904945 - protein, 25 aa, Mycobacterium
GRVGGSNAALTPGTVSTGDGSLTGR

SEQ ID NO: 904946 - protein, 4 aa, Mycobacterium
GRVP

SEQ ID NO: 904947 - protein, 10 aa, Mycobacterium
GRVPDPALPV

SEQ ID NO: 904948 - protein, 7 aa, Mycobacterium
GRVPGQE

SEQ ID NO: 904949 - protein, 11 aa, Mycobacterium
GRVTKGDGSPY

SEQ ID NO: 904950 - protein, 17 aa, Mycobacterium
GRVTPSTADIDKDASRV

SEQ ID NO: 904951 - protein, 4 aa, Mycobacterium
GRYA

SEQ ID NO: 904952 - protein, 7 aa, Mycobacterium
GRYKPNA

SEQ ID NO: 904953 - protein, 12 aa, Mycobacterium
GSAAAERSHGRP

SEQ ID NO: 904954 - protein, 8 aa, Mycobacterium
GSAAEDPS

SEQ ID NO: 904955 - protein, 9 aa, Mycobacterium
GSAAEEVAE

SEQ ID NO: 904956 - protein, 11 aa, Mycobacterium
GSAAEPGTVGR

SEQ ID NO: 904957 - protein, 12 aa, Mycobacterium
GSAAGNSPIPYN

SEQ ID NO: 904958 - protein, 21 aa, Mycobacterium
GSAAGRAAALADPEARVGTRG

SEQ ID NO: 904959 - protein, 6 aa, Mycobacterium
GSAALA

SEQ ID NO: 904960 - protein, 7 aa, Mycobacterium
GSAAPPG

SEQ ID NO: 904961 - protein, 19 aa, Mycobacterium
GSAAPRPAKLGEGSGITAN

SEQ ID NO: 904962 - protein, 8 aa, Mycobacterium
GSAASNAA

SEQ ID NO: 904963 - protein, 8 aa, Mycobacterium
GSAATRRG

SEQ ID NO: 904964 - protein, 13 aa, Mycobacterium
GSADEIAAAVGNP

SEQ ID NO: 904965 - protein, 20 aa, Mycobacterium
GSADPETPTPTPASETNSRT

SEQ ID NO: 904966 - protein, 7 aa, Mycobacterium
GSADYPG

SEQ ID NO: 904967 - protein, 4 aa, Mycobacterium
GSAE

SEQ ID NO: 904968 - protein, 14 aa, Mycobacterium
GSAEATAVADPLAP

SEQ ID NO: 904969 - protein, 11 aa, Mycobacterium
GSAERGPGAAG

SEQ ID NO: 904970 - protein, 5 aa, Mycobacterium
GSAES

SEQ ID NO: 904971 - protein, 19 aa, Mycobacterium
GSAESDLGAPTSVEQQAVG

SEQ ID NO: 904972 - protein, 13 aa, Mycobacterium
GSAGAAPIQAPIP

SEQ ID NO: 904973 - protein, 12 aa, Mycobacterium
GSAGAASANSVD

SEQ ID NO: 904974 - protein, 33 aa, Mycobacterium
GSAGDGGGGGDGGLSVGPHSGRGAGGGGGGGGS

SEQ ID NO: 904975 - protein, 13 aa, Mycobacterium
GSAGFTPSINDQR

SEQ ID NO: 904976 - protein, 8 aa, Mycobacterium
GSAGGLTK

SEQ ID NO: 904977 - protein, 9 aa, Mycobacterium
GSAGGLTKP

SEQ ID NO: 904978 - protein, 7 aa, Mycobacterium
GSAGSGL

SEQ ID NO: 904979 - protein, 6 aa, Mycobacterium
GSAGSV

SEQ ID NO: 904980 - protein, 8 aa, Mycobacterium
GSAGTRGL

SEQ ID NO: 904981 - protein, 7 aa, Mycobacterium
GSAGTVV

SEQ ID NO: 904982 - protein, 30 aa, Mycobacterium
GSAGVAAADPQPAPPSAPKTTIDHDGTYTV

SEQ ID NO: 904983 - protein, 9 aa, Mycobacterium
GSAGVSPGI

SEQ ID NO: 904984 - protein, 6 aa, Mycobacterium
GSAGWD

SEQ ID NO: 904985 - protein, 7 aa, Mycobacterium
GSAHTGE

SEQ ID NO: 904986 - protein, 12 aa, Mycobacterium
GSAHVDRNPDGR

SEQ ID NO: 904987 - protein, 9 aa, Mycobacterium
GSAISGRAG

SEQ ID NO: 904988 - protein, 4 aa, Mycobacterium
GSAL

SEQ ID NO: 904989 - protein, 30 aa, Mycobacterium
GSAMGTPYSWGGGSYNGPTRGIDSGAGTVG

SEQ ID NO: 904990 - protein, 8 aa, Mycobacterium
GSANGQTY

SEQ ID NO: 904991 - protein, 17 aa, Mycobacterium
GSANSYTAAEAANTNPL

SEQ ID NO: 904992 - protein, 4 aa, Mycobacterium
GSAP

SEQ ID NO: 904993 - protein, 7 aa, Mycobacterium
GSAPEVI

SEQ ID NO: 904994 - protein, 6 aa, Mycobacterium
GSAPGF

SEQ ID NO: 904995 - protein, 5 aa, Mycobacterium
GSAPL

SEQ ID NO: 904996 - protein, 5 aa, Mycobacterium
GSAPM

SEQ ID NO: 904997 - protein, 7 aa, Mycobacterium
GSAPSAW

SEQ ID NO: 904998 - protein, 11 aa, Mycobacterium
GSAPTAKEMSS

SEQ ID NO: 904999 - protein, 9 aa, Mycobacterium
GSAPTRVAG

SEQ ID NO: 905000 - protein, 21 aa, Mycobacterium
GSAQPTAGAPSTLSDVPPNQV

SEQ ID NO: 905001 - protein, 17 aa, Mycobacterium
GSARHGGVGRTRQMAED

SEQ ID NO: 905002 - protein, 10 aa, Mycobacterium
GSARQAERSY

SEQ ID NO: 905003 - protein, 8 aa, Mycobacterium
GSARTGEL

SEQ ID NO: 905004 - protein, 15 aa, Mycobacterium
GSARVTSADPEATYQ

SEQ ID NO: 905005 - protein, 4 aa, Mycobacterium
GSAS

SEQ ID NO: 905006 - protein, 8 aa, Mycobacterium
GSASARSP

SEQ ID NO: 905007 - protein, 15 aa, Mycobacterium
GSASASARAGPADGS

SEQ ID NO: 905008 - protein, 7 aa, Mycobacterium
GSASVPE

SEQ ID NO: 905009 - protein, 12 aa, Mycobacterium
GSATASAFSRPG

SEQ ID NO: 905010 - protein, 10 aa, Mycobacterium
GSATASATGL

SEQ ID NO: 905011 - protein, 8 aa, Mycobacterium
GSATENRS

SEQ ID NO: 905012 - protein, 8 aa, Mycobacterium
GSATEPEQ

SEQ ID NO: 905013 - protein, 9 aa, Mycobacterium
GSATNWNAD

SEQ ID NO: 905014 - protein, 10 aa, Mycobacterium
GSATSSPRSF

SEQ ID NO: 905015 - protein, 14 aa, Mycobacterium
GSATTTLANAGTIS

SEQ ID NO: 905016 - protein, 7 aa, Mycobacterium
GSATTVV

SEQ ID NO: 905017 - protein, 12 aa, Mycobacterium
GSATVSPEYTGN

SEQ ID NO: 905018 - protein, 13 aa, Mycobacterium
GSAVHGVESIFGF

SEQ ID NO: 905019 - protein, 5 aa, Mycobacterium
GSAVP

SEQ ID NO: 905020 - protein, 12 aa, Mycobacterium
GSAYRRKSKQVS

SEQ ID NO: 905021 - protein, 5 aa, Mycobacterium
GSCPT

SEQ ID NO: 905022 - protein, 6 aa, Mycobacterium
GSCTGV

SEQ ID NO: 905023 - protein, 30 aa, Mycobacterium
GSCVREHPKEQQSTSPAPTSGKRPEHEGIR

SEQ ID NO: 905024 - protein, 5 aa, Mycobacterium
GSDAL

SEQ ID NO: 905025 - protein, 20 aa, Mycobacterium
GSDAQRNRADSGAWSQPENA

SEQ ID NO: 905026 - protein, 40 aa, Mycobacterium
GSDDASKQALADASERYTAASSQIDQATTARQAELAKESA

SEQ ID NO: 905027 - protein, 4 aa, Mycobacterium
GSDE

SEQ ID NO: 905028 - protein, 8 aa, Mycobacterium
GSDEGRQA

SEQ ID NO: 905029 - protein, 7 aa, Mycobacterium
GSDEVST

SEQ ID NO: 905030 - protein, 4 aa, Mycobacterium
GSDG

SEQ ID NO: 905031 - protein, 20 aa, Mycobacterium
GSDGQPINGYREAPAQGNVT

SEQ ID NO: 905032 - protein, 5 aa, Mycobacterium
GSDKY

SEQ ID NO: 905033 - protein, 7 aa, Mycobacterium
GSDLPSS

SEQ ID NO: 905034 - protein, 12 aa, Mycobacterium
GSDNGVATESPR

SEQ ID NO: 905035 - protein, 9 aa, Mycobacterium
GSDNKAGDV

SEQ ID NO: 905036 - protein, 38 aa, Mycobacterium
GSDNNASGGSSPAGQSSNVSCGGKKTLKASGSTAQANA

SEQ ID NO: 905037 - protein, 39 aa, Mycobacterium
GSDNNASGSSGSGSGDPAGVSCGGKKSLKASGSTAQANA

SEQ ID NO: 905038 - protein, 39 aa, Mycobacterium
GSDNNTSSSGSGDGGSEPAGDCGGKESLKASGSSAQANA

SEQ ID NO: 905039 - protein, 16 aa, Mycobacterium
GSDNTPTCTFTAKVTV

SEQ ID NO: 905040 - protein, 13 aa, Mycobacterium
GSDPDTGRSRVPS

SEQ ID NO: 905041 - protein, 10 aa, Mycobacterium
GSDPDTPELE

SEQ ID NO: 905042 - protein, 8 aa, Mycobacterium
GSDPKGAV

SEQ ID NO: 905043 - protein, 36 aa, Mycobacterium
GSDSTKSGPTTPTQSTASGASSTTTAQASGGECPAA

SEQ ID NO: 905044 - protein, 29 aa, Mycobacterium
GSDTTAEQAQTTSAAAAPSTTQQGRPHND

SEQ ID NO: 905045 - protein, 4 aa, Mycobacterium
GSDV

SEQ ID NO: 905046 - protein, 9 aa, Mycobacterium
GSDVGGGQR

SEQ ID NO: 905047 - protein, 8 aa, Mycobacterium
GSDVPSSV

SEQ ID NO: 905048 - protein, 42 aa, Mycobacterium
GSDVTAGQATTGDQTISATSTAAQTSAKAAPEPIAEGTSGPH

SEQ ID NO: 905049 - protein, 5 aa, Mycobacterium
GSEAH

SEQ ID NO: 905050 - protein, 12 aa, Mycobacterium
GSEDLNANAGAG

SEQ ID NO: 905051 - protein, 6 aa, Mycobacterium
GSEEEV

SEQ ID NO: 905052 - protein, 8 aa, Mycobacterium
GSEERADV

SEQ ID NO: 905053 - protein, 8 aa, Mycobacterium
GSEHPSQC

SEQ ID NO: 905054 - protein, 4 aa, Mycobacterium
GSEP

SEQ ID NO: 905055 - protein, 18 aa, Mycobacterium
GSFAGRGLGSSDTPGCPK

SEQ ID NO: 905056 - protein, 8 aa, Mycobacterium
GSFDPSND

SEQ ID NO: 905057 - protein, 19 aa, Mycobacterium
GSFNSGNFNTGDFNSGSMN

SEQ ID NO: 905058 - protein, 12 aa, Mycobacterium
GSFPGAPAGTNQ

SEQ ID NO: 905059 - protein, 15 aa, Mycobacterium
GSFRDGTRVAGSAPD

SEQ ID NO: 905060 - protein, 18 aa, Mycobacterium
GSFTSASRELGLSQPAVS

SEQ ID NO: 905061 - protein, 5 aa, Mycobacterium
GSFTY

SEQ ID NO: 905062 - protein, 16 aa, Mycobacterium
GSFTYTPTTGYSGTDT

SEQ ID NO: 905063 - protein, 4 aa, Mycobacterium
GSGA

SEQ ID NO: 905064 - protein, 7 aa, Mycobacterium
GSGAAMA

SEQ ID NO: 905065 - protein, 32 aa, Mycobacterium
GSGAAPAFAQPAPPPAPVGEQPPAWAPPKPAE

SEQ ID NO: 905066 - protein, 9 aa, Mycobacterium
GSGAGGAMA

SEQ ID NO: 905067 - protein, 8 aa, Mycobacterium
GSGAGVGR

SEQ ID NO: 905068 - protein, 15 aa, Mycobacterium
GSGAGVQVIEHAAGI

SEQ ID NO: 905069 - protein, 5 aa, Mycobacterium
GSGAL

SEQ ID NO: 905070 - protein, 8 aa, Mycobacterium
GSGALASA

SEQ ID NO: 905071 - protein, 16 aa, Mycobacterium
GSGAQAAGRDVATLGK

SEQ ID NO: 905072 - protein, 9 aa, Mycobacterium
GSGARYGRQ

SEQ ID NO: 905073 - protein, 7 aa, Mycobacterium
GSGAVNG

SEQ ID NO: 905074 - protein, 4 aa, Mycobacterium
GSGD

SEQ ID NO: 905075 - protein, 19 aa, Mycobacterium
GSGDGDNPTVTAGTSGAQV

SEQ ID NO: 905076 - protein, 11 aa, Mycobacterium
GSGDLYGGTEP

SEQ ID NO: 905077 - protein, 5 aa, Mycobacterium
GSGDP

SEQ ID NO: 905078 - protein, 16 aa, Mycobacterium
GSGDQTRVPAESARGT

SEQ ID NO: 905079 - protein, 8 aa, Mycobacterium
GSGEATCG

SEQ ID NO: 905080 - protein, 7 aa, Mycobacterium
GSGEKRT

SEQ ID NO: 905081 - protein, 10 aa, Mycobacterium
GSGEPPGIGG

SEQ ID NO: 905082 - protein, 11 aa, Mycobacterium
GSGEPPGIGGI

SEQ ID NO: 905083 - protein, 13 aa, Mycobacterium
GSGERDNPTLNGG

SEQ ID NO: 905084 - protein, 25 aa, Mycobacterium
GSGGAGGQGGTGGTGLNGNAPFADG

SEQ ID NO: 905085 - protein, 28 aa, Mycobacterium
GSGGDGGDGGNGQPADGGAGGAGGAGGL

SEQ ID NO: 905086 - protein, 224 aa, Mycobacterium
GSGGDGGRGGDGDGEGPETAGSHGADGGNGGAGGVFGNGGRGGDGGDANNGTVGTRNGNAAAGKGGNGGSTGIGTGGAGGNGGKATGTNAAYGGNGGNGGSGLAGGGNGGDGGDAQSSSNRARPGQGGQAGRGGFGRDGKTGNPGNATDRSATRENVSNRVTGRSTPTRSADKAGSRTSSSSESNSESNSESSSKTSSKAGGTKSSDTKSGGGAAGTGSDSKDS

SEQ ID NO: 905087 - protein, 6 aa, Mycobacterium
GSGGGL

SEQ ID NO: 905088 - protein, 7 aa, Mycobacterium
GSGGLYG

SEQ ID NO: 905089 - protein, 25 aa, Mycobacterium
GSGGNGGSEATSAAPDDGSPASGTL

SEQ ID NO: 905090 - protein, 16 aa, Mycobacterium
GSGGQFSGPGGVPGGQ

SEQ ID NO: 905091 - protein, 8 aa, Mycobacterium
GSGGRQVG

SEQ ID NO: 905092 - protein, 5 aa, Mycobacterium
GSGGT

SEQ ID NO: 905093 - protein, 7 aa, Mycobacterium
GSGGTAN

SEQ ID NO: 905094 - protein, 4 aa, Mycobacterium
GSGI

SEQ ID NO: 905095 - protein, 9 aa, Mycobacterium
GSGKSTIGR

SEQ ID NO: 905096 - protein, 37 aa, Mycobacterium
GSGLGVGGARDHSESGRGEAAGEESAGDDAGKGVGDR

SEQ ID NO: 905097 - protein, 12 aa, Mycobacterium
GSGLPGGAAGAR

SEQ ID NO: 905098 - protein, 7 aa, Mycobacterium
GSGLQAN

SEQ ID NO: 905099 - protein, 9 aa, Mycobacterium
GSGLTPEDL

SEQ ID NO: 905100 - protein, 8 aa, Mycobacterium
GSGNAGRE

SEQ ID NO: 905101 - protein, 9 aa, Mycobacterium
GSGNAGSAV

SEQ ID NO: 905102 - protein, 5 aa, Mycobacterium
GSGNE

SEQ ID NO: 905103 - protein, 6 aa, Mycobacterium
GSGNFG

SEQ ID NO: 905104 - protein, 15 aa, Mycobacterium
GSGNGNSGNGDSTTP

SEQ ID NO: 905105 - protein, 9 aa, Mycobacterium
GSGNHGDAN

SEQ ID NO: 905106 - protein, 59 aa, Mycobacterium
GSGNIGSHNFGSGNSGSANLGSGNTGNSNFGLGNTGSTNLGSGNTGSANFGSGNLGDAN

SEQ ID NO: 905107 - protein, 14 aa, Mycobacterium
GSGNLGDANLGSGN

SEQ ID NO: 905108 - protein, 30 aa, Mycobacterium
GSGNNGSTNFGSGNTGSLNLGSGNAGDSNV

SEQ ID NO: 905109 - protein, 8 aa, Mycobacterium
GSGNPIPS

SEQ ID NO: 905110 - protein, 6 aa, Mycobacterium
GSGNRL

SEQ ID NO: 905111 - protein, 8 aa, Mycobacterium
GSGNTAKV

SEQ ID NO: 905112 - protein, 5 aa, Mycobacterium
GSGPH

SEQ ID NO: 905113 - protein, 6 aa, Mycobacterium
GSGPLP

SEQ ID NO: 905114 - protein, 6 aa, Mycobacterium
GSGPMA

SEQ ID NO: 905115 - protein, 24 aa, Mycobacterium
GSGPNGTGAERGGKANPDSPYPDY

SEQ ID NO: 905116 - protein, 11 aa, Mycobacterium
GSGPQTQSPTP

SEQ ID NO: 905117 - protein, 7 aa, Mycobacterium
GSGPSGF

SEQ ID NO: 905118 - protein, 7 aa, Mycobacterium
GSGQATT

SEQ ID NO: 905119 - protein, 8 aa, Mycobacterium
GSGRATSL

SEQ ID NO: 905120 - protein, 7 aa, Mycobacterium
GSGREVN

SEQ ID NO: 905121 - protein, 6 aa, Mycobacterium
GSGRKV

SEQ ID NO: 905122 - protein, 27 aa, Mycobacterium
GSGRVSHPAAHGSSSAQETTTAPELSA

SEQ ID NO: 905123 - protein, 7 aa, Mycobacterium
GSGSGSI

SEQ ID NO: 905124 - protein, 11 aa, Mycobacterium
GSGSTAEATGG

SEQ ID NO: 905125 - protein, 8 aa, Mycobacterium
GSGTGQAA

SEQ ID NO: 905126 - protein, 5 aa, Mycobacterium
GSGTP

SEQ ID NO: 905127 - protein, 38 aa, Mycobacterium
GSGTTSDNKTSTSTSTSTSTSTSTTTSATSPTPGAQAN

SEQ ID NO: 905128 - protein, 6 aa, Mycobacterium
GSGTVR

SEQ ID NO: 905129 - protein, 8 aa, Mycobacterium
GSGTYDTA

SEQ ID NO: 905130 - protein, 4 aa, Mycobacterium
GSGV

SEQ ID NO: 905131 - protein, 9 aa, Mycobacterium
GSGVTSLTT

SEQ ID NO: 905132 - protein, 7 aa, Mycobacterium
GSHADQL

SEQ ID NO: 905133 - protein, 9 aa, Mycobacterium
GSHADRPGV

SEQ ID NO: 905134 - protein, 5 aa, Mycobacterium
GSHPC

SEQ ID NO: 905135 - protein, 6 aa, Mycobacterium
GSHPNK

SEQ ID NO: 905136 - protein, 8 aa, Mycobacterium
GSHTIGPD

SEQ ID NO: 905137 - protein, 6 aa, Mycobacterium
GSIPGY

SEQ ID NO: 905138 - protein, 12 aa, Mycobacterium
GSISGLASQVSN

SEQ ID NO: 905139 - protein, 13 aa, Mycobacterium
GSISGMASQVSSA

SEQ ID NO: 905140 - protein, 14 aa, Mycobacterium
GSKAAARRAGRPGL

SEQ ID NO: 905141 - protein, 24 aa, Mycobacterium
GSKASETDAANAESCVDTSGPTIK

SEQ ID NO: 905142 - protein, 24 aa, Mycobacterium
GSKASETDSANAESCVDTSGSSIK

SEQ ID NO: 905143 - protein, 9 aa, Mycobacterium
GSKDSLGRT

SEQ ID NO: 905144 - protein, 8 aa, Mycobacterium
GSKDTSPL

SEQ ID NO: 905145 - protein, 6 aa, Mycobacterium
GSKEFD

SEQ ID NO: 905146 - protein, 7 aa, Mycobacterium
GSKEYTE

SEQ ID NO: 905147 - protein, 9 aa, Mycobacterium
GSKPAAGAK

SEQ ID NO: 905148 - protein, 9 aa, Mycobacterium
GSKPQPERL

SEQ ID NO: 905149 - protein, 6 aa, Mycobacterium
GSKVTY

SEQ ID NO: 905150 - protein, 12 aa, Mycobacterium
GSLAAGPALSGR

SEQ ID NO: 905151 - protein, 9 aa, Mycobacterium
GSLASQSAE

SEQ ID NO: 905152 - protein, 11 aa, Mycobacterium
GSLEPTDEAAA

SEQ ID NO: 905153 - protein, 77 aa, Mycobacterium
GSLGAASRADGPSPVVAPPPSAVPPPPTPVPERPTAPPPPRLAAPPPPEPAARHRSPEPEPAVGAHGSDAQTGGQSV

SEQ ID NO: 905154 - protein, 15 aa, Mycobacterium
GSLGPSRASVPESAK

SEQ ID NO: 905155 - protein, 12 aa, Mycobacterium
GSLPAPPRSADD

SEQ ID NO: 905156 - protein, 6 aa, Mycobacterium
GSLPDI

SEQ ID NO: 905157 - protein, 12 aa, Mycobacterium
GSLPQDAGNRGV

SEQ ID NO: 905158 - protein, 16 aa, Mycobacterium
GSLQSPFDVREWAGAT

SEQ ID NO: 905159 - protein, 14 aa, Mycobacterium
GSLRGDGKGNGPIA

SEQ ID NO: 905160 - protein, 17 aa, Mycobacterium
GSLRNGPQSAGATPGPA

SEQ ID NO: 905161 - protein, 5 aa, Mycobacterium
GSLSR

SEQ ID NO: 905162 - protein, 5 aa, Mycobacterium
GSLTG

SEQ ID NO: 905163 - protein, 7 aa, Mycobacterium
GSLTTPD

SEQ ID NO: 905164 - protein, 5 aa, Mycobacterium
GSMDE

SEQ ID NO: 905165 - protein, 6 aa, Mycobacterium
GSMGPK

SEQ ID NO: 905166 - protein, 45 aa, Mycobacterium
GSMGPPAAAIPPPAATVPAGTVGSTNTAPAAPTSAAAGAAAGPTL

SEQ ID NO: 905167 - protein, 7 aa, Mycobacterium
GSMGSPD

SEQ ID NO: 905168 - protein, 8 aa, Mycobacterium
GSMGTTTN

SEQ ID NO: 905169 - protein, 4 aa, Mycobacterium
GSMQ

SEQ ID NO: 905170 - protein, 6 aa, Mycobacterium
GSNAYG

SEQ ID NO: 905171 - protein, 18 aa, Mycobacterium
GSNDNAAGEDVGAAASPV

SEQ ID NO: 905172 - protein, 8 aa, Mycobacterium
GSNGSNNV

SEQ ID NO: 905173 - protein, 11 aa, Mycobacterium
GSNKANEGVRS

SEQ ID NO: 905174 - protein, 18 aa, Mycobacterium
GSNPAPFRNAAGNEYTLD

SEQ ID NO: 905175 - protein, 7 aa, Mycobacterium
GSNPTGI

SEQ ID NO: 905176 - protein, 6 aa, Mycobacterium
GSNQIG

SEQ ID NO: 905177 - protein, 20 aa, Mycobacterium
GSNQPATKASRSVTTPTTQI

SEQ ID NO: 905178 - protein, 16 aa, Mycobacterium
GSNTDAAALYQWWRAN

SEQ ID NO: 905179 - protein, 8 aa, Mycobacterium
GSNTDEAL

SEQ ID NO: 905180 - protein, 4 aa, Mycobacterium
GSPA

SEQ ID NO: 905181 - protein, 11 aa, Mycobacterium
GSPAATPVADA

SEQ ID NO: 905182 - protein, 6 aa, Mycobacterium
GSPADL

SEQ ID NO: 905183 - protein, 13 aa, Mycobacterium
GSPALNGQRGESL

SEQ ID NO: 905184 - protein, 8 aa, Mycobacterium
GSPDDNNA

SEQ ID NO: 905185 - protein, 7 aa, Mycobacterium
GSPEADL

SEQ ID NO: 905186 - protein, 7 aa, Mycobacterium
GSPFSAG

SEQ ID NO: 905187 - protein, 12 aa, Mycobacterium
GSPGATVSGSPV

SEQ ID NO: 905188 - protein, 13 aa, Mycobacterium
GSPGIAAAAPKTY

SEQ ID NO: 905189 - protein, 8 aa, Mycobacterium
GSPGQGGK

SEQ ID NO: 905190 - protein, 10 aa, Mycobacterium
GSPGQGNYAA

SEQ ID NO: 905191 - protein, 13 aa, Mycobacterium
GSPGVSGGDAKMA

SEQ ID NO: 905192 - protein, 9 aa, Mycobacterium
GSPKGFTHP

SEQ ID NO: 905193 - protein, 9 aa, Mycobacterium
GSPKGYTHP

SEQ ID NO: 905194 - protein, 9 aa, Mycobacterium
GSPKQVANT

SEQ ID NO: 905195 - protein, 10 aa, Mycobacterium
GSPLPGTDGL

SEQ ID NO: 905196 - protein, 10 aa, Mycobacterium
GSPLSGAPDR

SEQ ID NO: 905197 - protein, 5 aa, Mycobacterium
GSPMS

SEQ ID NO: 905198 - protein, 5 aa, Mycobacterium
GSPNA

SEQ ID NO: 905199 - protein, 7 aa, Mycobacterium
GSPNPGY

SEQ ID NO: 905200 - protein, 6 aa, Mycobacterium
GSPPKM

SEQ ID NO: 905201 - protein, 15 aa, Mycobacterium
GSPRAFADPRPSGWE

SEQ ID NO: 905202 - protein, 13 aa, Mycobacterium
GSPRNRPGSSNAD

SEQ ID NO: 905203 - protein, 13 aa, Mycobacterium
GSPRWRAQGSPWR

SEQ ID NO: 905204 - protein, 4 aa, Mycobacterium
GSPS

SEQ ID NO: 905205 - protein, 11 aa, Mycobacterium
GSPSRPADGAR

SEQ ID NO: 905206 - protein, 9 aa, Mycobacterium
GSPTDNNAT

SEQ ID NO: 905207 - protein, 4 aa, Mycobacterium
GSPV

SEQ ID NO: 905208 - protein, 10 aa, Mycobacterium
GSPVAQSASE

SEQ ID NO: 905209 - protein, 12 aa, Mycobacterium
GSPVDAARPNFS

SEQ ID NO: 905210 - protein, 6 aa, Mycobacterium
GSPVSE

SEQ ID NO: 905211 - protein, 5 aa, Mycobacterium
GSPWQ

SEQ ID NO: 905212 - protein, 14 aa, Mycobacterium
GSQASPQPAPDPAV

SEQ ID NO: 905213 - protein, 6 aa, Mycobacterium
GSQIGQ

SEQ ID NO: 905214 - protein, 10 aa, Mycobacterium
GSQPAGEDAD

SEQ ID NO: 905215 - protein, 7 aa, Mycobacterium
GSQPHAS

SEQ ID NO: 905216 - protein, 9 aa, Mycobacterium
GSQPLAEDA

SEQ ID NO: 905217 - protein, 13 aa, Mycobacterium
GSQSQAAAAVSPV

SEQ ID NO: 905218 - protein, 11 aa, Mycobacterium
GSQVAKPDLPG

SEQ ID NO: 905219 - protein, 15 aa, Mycobacterium
GSRAGDEAAAPAAES

SEQ ID NO: 905220 - protein, 4 aa, Mycobacterium
GSRE

SEQ ID NO: 905221 - protein, 6 aa, Mycobacterium
GSRERT

SEQ ID NO: 905222 - protein, 6 aa, Mycobacterium
GSRETY

SEQ ID NO: 905223 - protein, 10 aa, Mycobacterium
GSRGAQRTGN

SEQ ID NO: 905224 - protein, 9 aa, Mycobacterium
GSRGPTRAA

SEQ ID NO: 905225 - protein, 6 aa, Mycobacterium
GSRLGG

SEQ ID NO: 905226 - protein, 8 aa, Mycobacterium
GSRMGYQE

SEQ ID NO: 905227 - protein, 6 aa, Mycobacterium
GSRMYR

SEQ ID NO: 905228 - protein, 5 aa, Mycobacterium
GSRNA

SEQ ID NO: 905229 - protein, 10 aa, Mycobacterium
GSRNQTSEQI

SEQ ID NO: 905230 - protein, 7 aa, Mycobacterium
GSRPAAL

SEQ ID NO: 905231 - protein, 7 aa, Mycobacterium
GSRPATS

SEQ ID NO: 905232 - protein, 10 aa, Mycobacterium
GSRPATSLAG

SEQ ID NO: 905233 - protein, 10 aa, Mycobacterium
GSRPATSLTG

SEQ ID NO: 905234 - protein, 20 aa, Mycobacterium
GSRPDSATCTGDLEGRPGNT

SEQ ID NO: 905235 - protein, 11 aa, Mycobacterium
GSRPLAEDAEE

SEQ ID NO: 905236 - protein, 18 aa, Mycobacterium
GSRSGVAGYTDSVRVLRV

SEQ ID NO: 905237 - protein, 10 aa, Mycobacterium
GSRSPARDFT

SEQ ID NO: 905238 - protein, 10 aa, Mycobacterium
GSRSQTAEQV

SEQ ID NO: 905239 - protein, 12 aa, Mycobacterium
GSRSTREAQLSG

SEQ ID NO: 905240 - protein, 11 aa, Mycobacterium
GSRTTGNGGGR

SEQ ID NO: 905241 - protein, 4 aa, Mycobacterium
GSSA

SEQ ID NO: 905242 - protein, 23 aa, Mycobacterium
GSSAGDADRGRIEATQAAREGTA

SEQ ID NO: 905243 - protein, 24 aa, Mycobacterium
GSSAGSYAKTEAANRTAAGSTSLS

SEQ ID NO: 905244 - protein, 6 aa, Mycobacterium
GSSALA

SEQ ID NO: 905245 - protein, 16 aa, Mycobacterium
GSSDLATQLTQGAPAD

SEQ ID NO: 905246 - protein, 10 aa, Mycobacterium
GSSDPFGTTG

SEQ ID NO: 905247 - protein, 14 aa, Mycobacterium
GSSELATQLTQGAT

SEQ ID NO: 905248 - protein, 8 aa, Mycobacterium
GSSGAGEH

SEQ ID NO: 905249 - protein, 14 aa, Mycobacterium
GSSGESAQTADGKT

SEQ ID NO: 905250 - protein, 6 aa, Mycobacterium
GSSGLR

SEQ ID NO: 905251 - protein, 9 aa, Mycobacterium
GSSGRGREF

SEQ ID NO: 905252 - protein, 23 aa, Mycobacterium
GSSGSGGLGRGGEQEGPLSPEKV

SEQ ID NO: 905253 - protein, 7 aa, Mycobacterium
GSSGVYD

SEQ ID NO: 905254 - protein, 5 aa, Mycobacterium
GSSHT

SEQ ID NO: 905255 - protein, 41 aa, Mycobacterium
GSSHTVSKSDVAGQITSTMTDAAGNKPDSVNCPNDLPAKVG

SEQ ID NO: 905256 - protein, 17 aa, Mycobacterium
GSSISTASATAASPTAM

SEQ ID NO: 905257 - protein, 4 aa, Mycobacterium
GSSM

SEQ ID NO: 905258 - protein, 14 aa, Mycobacterium
GSSNPLGGGEISGD

SEQ ID NO: 905259 - protein, 7 aa, Mycobacterium
GSSPFAR

SEQ ID NO: 905260 - protein, 7 aa, Mycobacterium
GSSPPVH

SEQ ID NO: 905261 - protein, 8 aa, Mycobacterium
GSSPVARG

SEQ ID NO: 905262 - protein, 10 aa, Mycobacterium
GSSPVARGLS

SEQ ID NO: 905263 - protein, 5 aa, Mycobacterium
GSSQL

SEQ ID NO: 905264 - protein, 13 aa, Mycobacterium
GSSRPVAASVPEA

SEQ ID NO: 905265 - protein, 9 aa, Mycobacterium
GSSRRLGTP

SEQ ID NO: 905266 - protein, 9 aa, Mycobacterium
GSSSPELAK

SEQ ID NO: 905267 - protein, 16 aa, Mycobacterium
GSSTENSAYGPTRNPW

SEQ ID NO: 905268 - protein, 14 aa, Mycobacterium
GSSVDGDGASISAA

SEQ ID NO: 905269 - protein, 16 aa, Mycobacterium
GSSVDPHDFEPAPSDA

SEQ ID NO: 905270 - protein, 4 aa, Mycobacterium
GSSY

SEQ ID NO: 905271 - protein, 20 aa, Mycobacterium
GSTACDARSTAPAPGTDSRQ

SEQ ID NO: 905272 - protein, 6 aa, Mycobacterium
GSTARE

SEQ ID NO: 905273 - protein, 7 aa, Mycobacterium
GSTDPSL

SEQ ID NO: 905274 - protein, 7 aa, Mycobacterium
GSTGVPK

SEQ ID NO: 905275 - protein, 7 aa, Mycobacterium
GSTIGSA

SEQ ID NO: 905276 - protein, 8 aa, Mycobacterium
GSTNGTYL

SEQ ID NO: 905277 - protein, 15 aa, Mycobacterium
GSTNTGFGNAGSADF

SEQ ID NO: 905278 - protein, 7 aa, Mycobacterium
GSTPISD

SEQ ID NO: 905279 - protein, 14 aa, Mycobacterium
GSTPPPAQSPQASG

SEQ ID NO: 905280 - protein, 6 aa, Mycobacterium
GSTSVY

SEQ ID NO: 905281 - protein, 16 aa, Mycobacterium
GSTVSTGVPSDPAAPT

SEQ ID NO: 905282 - protein, 4 aa, Mycobacterium
GSTY

SEQ ID NO: 905283 - protein, 6 aa, Mycobacterium
GSTYTG

SEQ ID NO: 905284 - protein, 4 aa, Mycobacterium
GSVE

SEQ ID NO: 905285 - protein, 12 aa, Mycobacterium
GSVEPGEVPRDE

SEQ ID NO: 905286 - protein, 36 aa, Mycobacterium
GSVGGAGGNGGLFGTGGAGGSGGQDGYNYGGNGGAG

SEQ ID NO: 905287 - protein, 6 aa, Mycobacterium
GSVGGG

SEQ ID NO: 905288 - protein, 9 aa, Mycobacterium
GSVGGSTGV

SEQ ID NO: 905289 - protein, 6 aa, Mycobacterium
GSVKTD

SEQ ID NO: 905290 - protein, 4 aa, Mycobacterium
GSVP

SEQ ID NO: 905291 - protein, 6 aa, Mycobacterium
GSVPDE

SEQ ID NO: 905292 - protein, 4 aa, Mycobacterium
GSVR

SEQ ID NO: 905293 - protein, 4 aa, Mycobacterium
GSVS

SEQ ID NO: 905294 - protein, 7 aa, Mycobacterium
GSVTAAE

SEQ ID NO: 905295 - protein, 12 aa, Mycobacterium
GSVVGAGQNNYG

SEQ ID NO: 905296 - protein, 15 aa, Mycobacterium
GSVVPDQKDTVFSTG

SEQ ID NO: 905297 - protein, 19 aa, Mycobacterium
GSWPSATTVHAKSNGGEWK

SEQ ID NO: 905298 - protein, 17 aa, Mycobacterium
GSWPSGTTVHANPDGTA

SEQ ID NO: 905299 - protein, 13 aa, Mycobacterium
GSWSNDSVSCPRS

SEQ ID NO: 905300 - protein, 4 aa, Mycobacterium
GSYA

SEQ ID NO: 905301 - protein, 7 aa, Mycobacterium
GSYAQSI

SEQ ID NO: 905302 - protein, 6 aa, Mycobacterium
GSYGGG

SEQ ID NO: 905303 - protein, 4 aa, Mycobacterium
GSYS

SEQ ID NO: 905304 - protein, 9 aa, Mycobacterium
GSYTEGSQV

SEQ ID NO: 905305 - protein, 13 aa, Mycobacterium
GSYTKNGKQRAVA

SEQ ID NO: 905306 - protein, 7 aa, Mycobacterium
GSYTPDN

SEQ ID NO: 905307 - protein, 8 aa, Mycobacterium
GSYTPDNL

SEQ ID NO: 905308 - protein, 7 aa, Mycobacterium
GSYTPDQ

SEQ ID NO: 905309 - protein, 9 aa, Mycobacterium
GTAAAAPDV

SEQ ID NO: 905310 - protein, 17 aa, Mycobacterium
GTAAAAPSGPVSAQETI

SEQ ID NO: 905311 - protein, 128 aa, Mycobacterium
GTAAADGTGDTSSAQSSSSAGDSPSGKPAGGADREAGATTSGSASADDSDSEAGTASRSRRDVRPADDEDAAEHDDIDTGDIDTGEAEDTEAAPQGATKPRAARLSGAAAEPAEEEQEQQQPAPPVKA

SEQ ID NO: 905312 - protein, 27 aa, Mycobacterium
GTAAASTSTGGGNAGDTVTNLQKQGYS

SEQ ID NO: 905313 - protein, 13 aa, Mycobacterium
GTAADNPASAQSM

SEQ ID NO: 905314 - protein, 10 aa, Mycobacterium
GTAARTGTGV

SEQ ID NO: 905315 - protein, 6 aa, Mycobacterium
GTAASA

SEQ ID NO: 905316 - protein, 12 aa, Mycobacterium
GTAASGPTPPTI

SEQ ID NO: 905317 - protein, 26 aa, Mycobacterium
GTAATGSSSRCPPGSPAGGSARVTAP

SEQ ID NO: 905318 - protein, 13 aa, Mycobacterium
GTAATGTANAAYP

SEQ ID NO: 905319 - protein, 5 aa, Mycobacterium
GTADP

SEQ ID NO: 905320 - protein, 8 aa, Mycobacterium
GTAEPHGS

SEQ ID NO: 905321 - protein, 10 aa, Mycobacterium
GTAEPPGVGG

SEQ ID NO: 905322 - protein, 11 aa, Mycobacterium
GTAESPGVGGV

SEQ ID NO: 905323 - protein, 11 aa, Mycobacterium
GTAGAAGELDG

SEQ ID NO: 905324 - protein, 25 aa, Mycobacterium
GTAGAGGAGGAASAGTGGAGGLGGT

SEQ ID NO: 905325 - protein, 78 aa, Mycobacterium
GTAGPGGAAGAIPGGPAGEAGPGGASGAIPGGPAGEAGPGGASGAIPGGPAGEAGPGGVSGSTNPGGVSGAAGPDGVS

SEQ ID NO: 905326 - protein, 7 aa, Mycobacterium
GTAGPGL

SEQ ID NO: 905327 - protein, 8 aa, Mycobacterium
GTAGTRGL

SEQ ID NO: 905328 - protein, 20 aa, Mycobacterium
GTAHAGPGAHGPVPQAPRGP

SEQ ID NO: 905329 - protein, 8 aa, Mycobacterium
GTAHPAAN

SEQ ID NO: 905330 - protein, 5 aa, Mycobacterium
GTAIG

SEQ ID NO: 905331 - protein, 9 aa, Mycobacterium
GTALGADGK

SEQ ID NO: 905332 - protein, 5 aa, Mycobacterium
GTALP

SEQ ID NO: 905333 - protein, 10 aa, Mycobacterium
GTALRGHGAG

SEQ ID NO: 905334 - protein, 28 aa, Mycobacterium
GTANAACSTNNGAHQPPECGPPEGPPGC

SEQ ID NO: 905335 - protein, 9 aa, Mycobacterium
GTANGFDPA

SEQ ID NO: 905336 - protein, 4 aa, Mycobacterium
GTAP

SEQ ID NO: 905337 - protein, 12 aa, Mycobacterium
GTAPAHASVEDD

SEQ ID NO: 905338 - protein, 10 aa, Mycobacterium
GTAPDGVSGP

SEQ ID NO: 905339 - protein, 5 aa, Mycobacterium
GTAPM

SEQ ID NO: 905340 - protein, 11 aa, Mycobacterium
GTAPSGQTVPG

SEQ ID NO: 905341 - protein, 9 aa, Mycobacterium
GTAPSPYGP

SEQ ID NO: 905342 - protein, 18 aa, Mycobacterium
GTAPSSAPPSFGAGSSAV

SEQ ID NO: 905343 - protein, 20 aa, Mycobacterium
GTAPVAGADNGRYEGDVPGM

SEQ ID NO: 905344 - protein, 18 aa, Mycobacterium
GTAQADGPSYQGGNCPPG

SEQ ID NO: 905345 - protein, 5 aa, Mycobacterium
GTAQH

SEQ ID NO: 905346 - protein, 9 aa, Mycobacterium
GTARSIGRR

SEQ ID NO: 905347 - protein, 9 aa, Mycobacterium
GTASADPVN

SEQ ID NO: 905348 - protein, 31 aa, Mycobacterium
GTASADRIAPDRTVNSGQGTVSKDATFGDVR

SEQ ID NO: 905349 - protein, 7 aa, Mycobacterium
GTASETV

SEQ ID NO: 905350 - protein, 7 aa, Mycobacterium
GTASLAA

SEQ ID NO: 905351 - protein, 8 aa, Mycobacterium
GTASTGHQ

SEQ ID NO: 905352 - protein, 12 aa, Mycobacterium
GTASTSESRTEI

SEQ ID NO: 905353 - protein, 7 aa, Mycobacterium
GTATAAR

SEQ ID NO: 905354 - protein, 6 aa, Mycobacterium
GTATFG

SEQ ID NO: 905355 - protein, 16 aa, Mycobacterium
GTATRDPAAPPPGAAV

SEQ ID NO: 905356 - protein, 48 aa, Mycobacterium
GTATRTPDSSFTEPEFPTPRPSRPTTAPPSTSAPTPTPTRPRPPGGEV

SEQ ID NO: 905357 - protein, 5 aa, Mycobacterium
GTAVT

SEQ ID NO: 905358 - protein, 12 aa, Mycobacterium
GTAVVSGNGEKI

SEQ ID NO: 905359 - protein, 15 aa, Mycobacterium
GTAWTGPPDESTGSE

SEQ ID NO: 905360 - protein, 9 aa, Mycobacterium
GTDAANSAA

SEQ ID NO: 905361 - protein, 6 aa, Mycobacterium
GTDAPV

SEQ ID NO: 905362 - protein, 8 aa, Mycobacterium
GTDARTRA

SEQ ID NO: 905363 - protein, 13 aa, Mycobacterium
GTDATAAVEHRGD

SEQ ID NO: 905364 - protein, 9 aa, Mycobacterium
GTDEPAGLG

SEQ ID NO: 905365 - protein, 9 aa, Mycobacterium
GTDEPPGLG

SEQ ID NO: 905366 - protein, 10 aa, Mycobacterium
GTDEPPGLGR

SEQ ID NO: 905367 - protein, 10 aa, Mycobacterium
GTDESPGIGR

SEQ ID NO: 905368 - protein, 7 aa, Mycobacterium
GTDEVSG

SEQ ID NO: 905369 - protein, 7 aa, Mycobacterium
GTDGRTH

SEQ ID NO: 905370 - protein, 8 aa, Mycobacterium
GTDGSPLG

SEQ ID NO: 905371 - protein, 10 aa, Mycobacterium
GTDHDAHPGA

SEQ ID NO: 905372 - protein, 15 aa, Mycobacterium
GTDLPSALTTPEAPA

SEQ ID NO: 905373 - protein, 7 aa, Mycobacterium
GTDNRGD

SEQ ID NO: 905374 - protein, 9 aa, Mycobacterium
GTDNTTITG

SEQ ID NO: 905375 - protein, 7 aa, Mycobacterium
GTDPAPH

SEQ ID NO: 905376 - protein, 8 aa, Mycobacterium
GTDPGKVL

SEQ ID NO: 905377 - protein, 9 aa, Mycobacterium
GTDPQPQGV

SEQ ID NO: 905378 - protein, 9 aa, Mycobacterium
GTDPQRVRP

SEQ ID NO: 905379 - protein, 17 aa, Mycobacterium
GTDPSAPVLGPDGTAHV

SEQ ID NO: 905380 - protein, 8 aa, Mycobacterium
GTDPSTHI

SEQ ID NO: 905381 - protein, 8 aa, Mycobacterium
GTDQVDGG

SEQ ID NO: 905382 - protein, 22 aa, Mycobacterium
GTDRSDDSAIPERLSTSAADLD

SEQ ID NO: 905383 - protein, 11 aa, Mycobacterium
GTDSNGSTEPV

SEQ ID NO: 905384 - protein, 12 aa, Mycobacterium
GTDTGGSIRQPA

SEQ ID NO: 905385 - protein, 4 aa, Mycobacterium
GTEA

SEQ ID NO: 905386 - protein, 13 aa, Mycobacterium
GTEAGRAAAEAGV

SEQ ID NO: 905387 - protein, 5 aa, Mycobacterium
GTEDV

SEQ ID NO: 905388 - protein, 14 aa, Mycobacterium
GTEKSESGPDDRNE

SEQ ID NO: 905389 - protein, 6 aa, Mycobacterium
GTENVA

SEQ ID NO: 905390 - protein, 9 aa, Mycobacterium
GTEPTNTDA

SEQ ID NO: 905391 - protein, 5 aa, Mycobacterium
GTETR

SEQ ID NO: 905392 - protein, 4 aa, Mycobacterium
GTEV

SEQ ID NO: 905393 - protein, 12 aa, Mycobacterium
GTFGGKTGYTDL

SEQ ID NO: 905394 - protein, 9 aa, Mycobacterium
GTFSPTDEQ

SEQ ID NO: 905395 - protein, 4 aa, Mycobacterium
GTFT

SEQ ID NO: 905396 - protein, 14 aa, Mycobacterium
GTGAAAAEPQVSTD

SEQ ID NO: 905397 - protein, 13 aa, Mycobacterium
GTGAADATFGPDQ

SEQ ID NO: 905398 - protein, 106 aa, Mycobacterium
GTGADSAARAATAGSGTGATAASAESAGWSAGSGLSSATGAAVAGATATGATATDATATGAAVTGTTATGATATGTTATGATATGATATGTTATGATATGTTGGSA

SEQ ID NO: 905399 - protein, 16 aa, Mycobacterium
GTGAGSNDVGYSNQEF

SEQ ID NO: 905400 - protein, 8 aa, Mycobacterium
GTGAPAGL

SEQ ID NO: 905401 - protein, 17 aa, Mycobacterium
GTGATGLGPYETKPTQV

SEQ ID NO: 905402 - protein, 6 aa, Mycobacterium
GTGDGL

SEQ ID NO: 905403 - protein, 7 aa, Mycobacterium
GTGEARA

SEQ ID NO: 905404 - protein, 11 aa, Mycobacterium
GTGEPPGIGGI

SEQ ID NO: 905405 - protein, 10 aa, Mycobacterium
GTGEPPGIGS

SEQ ID NO: 905406 - protein, 10 aa, Mycobacterium
GTGEPPGLGR

SEQ ID NO: 905407 - protein, 7 aa, Mycobacterium
GTGEQVA

SEQ ID NO: 905408 - protein, 5 aa, Mycobacterium
GTGFT

SEQ ID NO: 905409 - protein, 10 aa, Mycobacterium
GTGGGAETKV

SEQ ID NO: 905410 - protein, 11 aa, Mycobacterium
GTGGKTARPTV

SEQ ID NO: 905411 - protein, 14 aa, Mycobacterium
GTGGNGGATSTNGA

SEQ ID NO: 905412 - protein, 7 aa, Mycobacterium
GTGGQQF

SEQ ID NO: 905413 - protein, 7 aa, Mycobacterium
GTGGRRL

SEQ ID NO: 905414 - protein, 11 aa, Mycobacterium
GTGKDGNPRST

SEQ ID NO: 905415 - protein, 10 aa, Mycobacterium
GTGKDGRPRE

SEQ ID NO: 905416 - protein, 9 aa, Mycobacterium
GTGKTTTVG

SEQ ID NO: 905417 - protein, 5 aa, Mycobacterium
GTGMA

SEQ ID NO: 905418 - protein, 6 aa, Mycobacterium
GTGMPQ

SEQ ID NO: 905419 - protein, 11 aa, Mycobacterium
GTGNPDPDPKY

SEQ ID NO: 905420 - protein, 11 aa, Mycobacterium
GTGQASGVGQV

SEQ ID NO: 905421 - protein, 18 aa, Mycobacterium
GTGQISQTANQEPAVNGN

SEQ ID NO: 905422 - protein, 9 aa, Mycobacterium
GTGQQAERS

SEQ ID NO: 905423 - protein, 4 aa, Mycobacterium
GTGR

SEQ ID NO: 905424 - protein, 6 aa, Mycobacterium
GTGRRR

SEQ ID NO: 905425 - protein, 8 aa, Mycobacterium
GTGSGGEI

SEQ ID NO: 905426 - protein, 15 aa, Mycobacterium
GTGSHSVSKSDVAEQ

SEQ ID NO: 905427 - protein, 8 aa, Mycobacterium
GTGSSAVQ

SEQ ID NO: 905428 - protein, 7 aa, Mycobacterium
GTGSSGI

SEQ ID NO: 905429 - protein, 8 aa, Mycobacterium
GTGSSGIQ

SEQ ID NO: 905430 - protein, 6 aa, Mycobacterium
GTGSTG

SEQ ID NO: 905431 - protein, 10 aa, Mycobacterium
GTGTGGATVG

SEQ ID NO: 905432 - protein, 8 aa, Mycobacterium
GTGTGGEI

SEQ ID NO: 905433 - protein, 15 aa, Mycobacterium
GTGTISADGKVGQIG

SEQ ID NO: 905434 - protein, 15 aa, Mycobacterium
GTGTISGDGKVGSIG

SEQ ID NO: 905435 - protein, 8 aa, Mycobacterium
GTGTPNPA

SEQ ID NO: 905436 - protein, 11 aa, Mycobacterium
GTGTTGSAQIE

SEQ ID NO: 905437 - protein, 8 aa, Mycobacterium
GTGTVEQY

SEQ ID NO: 905438 - protein, 6 aa, Mycobacterium
GTGVPE

SEQ ID NO: 905439 - protein, 10 aa, Mycobacterium
GTGYGGPPFD

SEQ ID NO: 905440 - protein, 10 aa, Mycobacterium
GTHAGTSEFN

SEQ ID NO: 905441 - protein, 5 aa, Mycobacterium
GTHDG

SEQ ID NO: 905442 - protein, 11 aa, Mycobacterium
GTHDGRRIAAP

SEQ ID NO: 905443 - protein, 33 aa, Mycobacterium
GTHGDTNAASTRSSAPTTSSSAPHGEHNEKGHV

SEQ ID NO: 905444 - protein, 4 aa, Mycobacterium
GTHP

SEQ ID NO: 905445 - protein, 5 aa, Mycobacterium
GTIED

SEQ ID NO: 905446 - protein, 7 aa, Mycobacterium
GTIPENL

SEQ ID NO: 905447 - protein, 12 aa, Mycobacterium
GTIPGAPGGANQ

SEQ ID NO: 905448 - protein, 4 aa, Mycobacterium
GTIR

SEQ ID NO: 905449 - protein, 8 aa, Mycobacterium
GTKGKTAI

SEQ ID NO: 905450 - protein, 14 aa, Mycobacterium
GTKPGTDVPPVSDG

SEQ ID NO: 905451 - protein, 13 aa, Mycobacterium
GTKPGTDVPPVSN

SEQ ID NO: 905452 - protein, 8 aa, Mycobacterium
GTKPGTEV

SEQ ID NO: 905453 - protein, 14 aa, Mycobacterium
GTKPGTEVPPISDG

SEQ ID NO: 905454 - protein, 8 aa, Mycobacterium
GTKTAGAY

SEQ ID NO: 905455 - protein, 8 aa, Mycobacterium
GTKVDPVS

SEQ ID NO: 905456 - protein, 4 aa, Mycobacterium
GTLA

SEQ ID NO: 905457 - protein, 16 aa, Mycobacterium
GTLDATGAGSGCAAGS

SEQ ID NO: 905458 - protein, 10 aa, Mycobacterium
GTLDKDRTTF

SEQ ID NO: 905459 - protein, 6 aa, Mycobacterium
GTLDPA

SEQ ID NO: 905460 - protein, 7 aa, Mycobacterium
GTLEPNS

SEQ ID NO: 905461 - protein, 4 aa, Mycobacterium
GTLG

SEQ ID NO: 905462 - protein, 11 aa, Mycobacterium
GTLGGKTGFTD

SEQ ID NO: 905463 - protein, 8 aa, Mycobacterium
GTLGRGDD

SEQ ID NO: 905464 - protein, 12 aa, Mycobacterium
GTLGRTYTTEGN

SEQ ID NO: 905465 - protein, 11 aa, Mycobacterium
GTLNGRSEEIK

SEQ ID NO: 905466 - protein, 9 aa, Mycobacterium
GTLPDGARG

SEQ ID NO: 905467 - protein, 5 aa, Mycobacterium
GTLPG

SEQ ID NO: 905468 - protein, 6 aa, Mycobacterium
GTLPPR

SEQ ID NO: 905469 - protein, 7 aa, Mycobacterium
GTLTDPT

SEQ ID NO: 905470 - protein, 15 aa, Mycobacterium
GTLTTVGGGEGRGVG

SEQ ID NO: 905471 - protein, 6 aa, Mycobacterium
GTMGSG

SEQ ID NO: 905472 - protein, 6 aa, Mycobacterium
GTNAGD

SEQ ID NO: 905473 - protein, 10 aa, Mycobacterium
GTNEPAGLGR

SEQ ID NO: 905474 - protein, 10 aa, Mycobacterium
GTNEPPGLGR

SEQ ID NO: 905475 - protein, 11 aa, Mycobacterium
GTNGKSTTTRM

SEQ ID NO: 905476 - protein, 12 aa, Mycobacterium
GTNGKSTTTRMT

SEQ ID NO: 905477 - protein, 10 aa, Mycobacterium
GTNGKTTTTS

SEQ ID NO: 905478 - protein, 5 aa, Mycobacterium
GTNGN

SEQ ID NO: 905479 - protein, 8 aa, Mycobacterium
GTNKDRDY

SEQ ID NO: 905480 - protein, 11 aa, Mycobacterium
GTNKSDSQETV

SEQ ID NO: 905481 - protein, 4 aa, Mycobacterium
GTNL

SEQ ID NO: 905482 - protein, 7 aa, Mycobacterium
GTNPPYA

SEQ ID NO: 905483 - protein, 18 aa, Mycobacterium
GTNSSGALNSGDDQSGFN

SEQ ID NO: 905484 - protein, 8 aa, Mycobacterium
GTNSSVRG

SEQ ID NO: 905485 - protein, 8 aa, Mycobacterium
GTNSTGQL

SEQ ID NO: 905486 - protein, 6 aa, Mycobacterium
GTNTDL

SEQ ID NO: 905487 - protein, 18 aa, Mycobacterium
GTNTSESASTADPDSLYG

SEQ ID NO: 905488 - protein, 8 aa, Mycobacterium
GTPAGANR

SEQ ID NO: 905489 - protein, 14 aa, Mycobacterium
GTPAGSTPNEGPPQ

SEQ ID NO: 905490 - protein, 8 aa, Mycobacterium
GTPDKAGF

SEQ ID NO: 905491 - protein, 4 aa, Mycobacterium
GTPE

SEQ ID NO: 905492 - protein, 5 aa, Mycobacterium
GTPED

SEQ ID NO: 905493 - protein, 9 aa, Mycobacterium
GTPEPPRGD

SEQ ID NO: 905494 - protein, 11 aa, Mycobacterium
GTPEQRQTGPV

SEQ ID NO: 905495 - protein, 6 aa, Mycobacterium
GTPERP

SEQ ID NO: 905496 - protein, 9 aa, Mycobacterium
GTPETAERF

SEQ ID NO: 905497 - protein, 4 aa, Mycobacterium
GTPF

SEQ ID NO: 905498 - protein, 7 aa, Mycobacterium
GTPGADN

SEQ ID NO: 905499 - protein, 6 aa, Mycobacterium
GTPGED

SEQ ID NO: 905500 - protein, 7 aa, Mycobacterium
GTPGEDG

SEQ ID NO: 905501 - protein, 6 aa, Mycobacterium
GTPGEY

SEQ ID NO: 905502 - protein, 8 aa, Mycobacterium
GTPGGTVD

SEQ ID NO: 905503 - protein, 10 aa, Mycobacterium
GTPGPAAEQK

SEQ ID NO: 905504 - protein, 11 aa, Mycobacterium
GTPGPAAEQKL

SEQ ID NO: 905505 - protein, 8 aa, Mycobacterium
GTPGPAEV

SEQ ID NO: 905506 - protein, 6 aa, Mycobacterium
GTPGQD

SEQ ID NO: 905507 - protein, 10 aa, Mycobacterium
GTPGQHGPYL

SEQ ID NO: 905508 - protein, 6 aa, Mycobacterium
GTPGQR

SEQ ID NO: 905509 - protein, 7 aa, Mycobacterium
GTPHSAN

SEQ ID NO: 905510 - protein, 5 aa, Mycobacterium
GTPIG

SEQ ID NO: 905511 - protein, 10 aa, Mycobacterium
GTPKASGLDK

SEQ ID NO: 905512 - protein, 9 aa, Mycobacterium
GTPKSADFD

SEQ ID NO: 905513 - protein, 9 aa, Mycobacterium
GTPKSSGFD

SEQ ID NO: 905514 - protein, 8 aa, Mycobacterium
GTPKTGEF

SEQ ID NO: 905515 - protein, 5 aa, Mycobacterium
GTPLA

SEQ ID NO: 905516 - protein, 10 aa, Mycobacterium
GTPLRGDSSR

SEQ ID NO: 905517 - protein, 6 aa, Mycobacterium
GTPLTA

SEQ ID NO: 905518 - protein, 5 aa, Mycobacterium
GTPNR

SEQ ID NO: 905519 - protein, 9 aa, Mycobacterium
GTPPDGVSG

SEQ ID NO: 905520 - protein, 10 aa, Mycobacterium
GTPPGGVSGP

SEQ ID NO: 905521 - protein, 10 aa, Mycobacterium
GTPPGRGGSA

SEQ ID NO: 905522 - protein, 5 aa, Mycobacterium
GTPPI

SEQ ID NO: 905523 - protein, 7 aa, Mycobacterium
GTPPRRI

SEQ ID NO: 905524 - protein, 19 aa, Mycobacterium
GTPQPIPEGTPAGQNPNPF

SEQ ID NO: 905525 - protein, 5 aa, Mycobacterium
GTPQS

SEQ ID NO: 905526 - protein, 14 aa, Mycobacterium
GTPRHPPSAADYPE

SEQ ID NO: 905527 - protein, 16 aa, Mycobacterium
GTPRRNSSSGSDGNKP

SEQ ID NO: 905528 - protein, 8 aa, Mycobacterium
GTPRSDEE

SEQ ID NO: 905529 - protein, 16 aa, Mycobacterium
GTPRVPPSSADFPEPP

SEQ ID NO: 905530 - protein, 8 aa, Mycobacterium
GTPRVTTD

SEQ ID NO: 905531 - protein, 11 aa, Mycobacterium
GTPSELGGANV

SEQ ID NO: 905532 - protein, 5 aa, Mycobacterium
GTPSQ

SEQ ID NO: 905533 - protein, 8 aa, Mycobacterium
GTPTAGVR

SEQ ID NO: 905534 - protein, 4 aa, Mycobacterium
GTPV

SEQ ID NO: 905535 - protein, 11 aa, Mycobacterium
GTPVAAPVDDE

SEQ ID NO: 905536 - protein, 4 aa, Mycobacterium
GTPW

SEQ ID NO: 905537 - protein, 11 aa, Mycobacterium
GTQPLADDAEE

SEQ ID NO: 905538 - protein, 8 aa, Mycobacterium
GTQPLATK

SEQ ID NO: 905539 - protein, 48 aa, Mycobacterium
GTQSGGIKPIPVGATETSAAADKGADAAIASPKSSAPPVTTSLEPPAP

SEQ ID NO: 905540 - protein, 9 aa, Mycobacterium
GTQTHPTSG

SEQ ID NO: 905541 - protein, 9 aa, Mycobacterium
GTQTHPTTG

SEQ ID NO: 905542 - protein, 20 aa, Mycobacterium
GTQTVEQSLEQAQASWDSAS

SEQ ID NO: 905543 - protein, 10 aa, Mycobacterium
GTRDQTAEQI

SEQ ID NO: 905544 - protein, 4 aa, Mycobacterium
GTRF

SEQ ID NO: 905545 - protein, 10 aa, Mycobacterium
GTRFTNDQTK

SEQ ID NO: 905546 - protein, 15 aa, Mycobacterium
GTRLSPKAAHRRQRV

SEQ ID NO: 905547 - protein, 7 aa, Mycobacterium
GTRNPHR

SEQ ID NO: 905548 - protein, 9 aa, Mycobacterium
GTRPTMKHE

SEQ ID NO: 905549 - protein, 9 aa, Mycobacterium
GTRSAARDF

SEQ ID NO: 905550 - protein, 9 aa, Mycobacterium
GTRSPARDF

SEQ ID NO: 905551 - protein, 20 aa, Mycobacterium
GTRTGSGGGSASPSTGAGDP

SEQ ID NO: 905552 - protein, 9 aa, Mycobacterium
GTRTPPAGA

SEQ ID NO: 905553 - protein, 8 aa, Mycobacterium
GTRTSYNN

SEQ ID NO: 905554 - protein, 4 aa, Mycobacterium
GTRV

SEQ ID NO: 905555 - protein, 11 aa, Mycobacterium
GTRVGADGNKA

SEQ ID NO: 905556 - protein, 8 aa, Mycobacterium
GTRVGPGG

SEQ ID NO: 905557 - protein, 10 aa, Mycobacterium
GTSAGSTVAA

SEQ ID NO: 905558 - protein, 10 aa, Mycobacterium
GTSANTAMDP

SEQ ID NO: 905559 - protein, 10 aa, Mycobacterium
GTSDDDRAKV

SEQ ID NO: 905560 - protein, 11 aa, Mycobacterium
GTSEAPGVGGV

SEQ ID NO: 905561 - protein, 6 aa, Mycobacterium
GTSEIQ

SEQ ID NO: 905562 - protein, 10 aa, Mycobacterium
GTSEPAGIGR

SEQ ID NO: 905563 - protein, 9 aa, Mycobacterium
GTSEPPGIG

SEQ ID NO: 905564 - protein, 10 aa, Mycobacterium
GTSEPPGIGR

SEQ ID NO: 905565 - protein, 10 aa, Mycobacterium
GTSEPPGVGR

SEQ ID NO: 905566 - protein, 5 aa, Mycobacterium
GTSEQ

SEQ ID NO: 905567 - protein, 4 aa, Mycobacterium
GTSF

SEQ ID NO: 905568 - protein, 12 aa, Mycobacterium
GTSFATNPHPVD

SEQ ID NO: 905569 - protein, 17 aa, Mycobacterium
GTSFGGTGSAVRRTELD

SEQ ID NO: 905570 - protein, 13 aa, Mycobacterium
GTSGGNGGNGGGA

SEQ ID NO: 905571 - protein, 36 aa, Mycobacterium
GTSGSSDDDSASPVPSATATASATSTSNKPAATQAE

SEQ ID NO: 905572 - protein, 9 aa, Mycobacterium
GTSISGSAG

SEQ ID NO: 905573 - protein, 4 aa, Mycobacterium
GTSL

SEQ ID NO: 905574 - protein, 27 aa, Mycobacterium
GTSLAGTGTPKEAPPADAPSPQAPAPT

SEQ ID NO: 905575 - protein, 15 aa, Mycobacterium
GTSPPARELAQTQTV

SEQ ID NO: 905576 - protein, 10 aa, Mycobacterium
GTSPSGQTIP

SEQ ID NO: 905577 - protein, 11 aa, Mycobacterium
GTSPSGTTIPG

SEQ ID NO: 905578 - protein, 9 aa, Mycobacterium
GTSSDAGKS

SEQ ID NO: 905579 - protein, 8 aa, Mycobacterium
GTSTPPAR

SEQ ID NO: 905580 - protein, 5 aa, Mycobacterium
GTTAS

SEQ ID NO: 905581 - protein, 16 aa, Mycobacterium
GTTCQQRSIETTLGGL

SEQ ID NO: 905582 - protein, 5 aa, Mycobacterium
GTTFD

SEQ ID NO: 905583 - protein, 24 aa, Mycobacterium
GTTGADPAIDRKTGFAEGISKNPN

SEQ ID NO: 905584 - protein, 6 aa, Mycobacterium
GTTGEN

SEQ ID NO: 905585 - protein, 13 aa, Mycobacterium
GTTGESPVTSDAE

SEQ ID NO: 905586 - protein, 10 aa, Mycobacterium
GTTGLPKGVP

SEQ ID NO: 905587 - protein, 6 aa, Mycobacterium
GTTGMP

SEQ ID NO: 905588 - protein, 19 aa, Mycobacterium
GTTGVPKGVPRKPKVSSGI

SEQ ID NO: 905589 - protein, 18 aa, Mycobacterium
GTTGYADTCAPSAATADG

SEQ ID NO: 905590 - protein, 23 aa, Mycobacterium
GTTITDGNAVSATADGAGNTATV

SEQ ID NO: 905591 - protein, 11 aa, Mycobacterium
GTTKGESSSVL

SEQ ID NO: 905592 - protein, 6 aa, Mycobacterium
GTTKQE

SEQ ID NO: 905593 - protein, 18 aa, Mycobacterium
GTTLSGASFDGSSLAGKP

SEQ ID NO: 905594 - protein, 5 aa, Mycobacterium
GTTLT

SEQ ID NO: 905595 - protein, 7 aa, Mycobacterium
GTTNTAM

SEQ ID NO: 905596 - protein, 4 aa, Mycobacterium
GTTP

SEQ ID NO: 905597 - protein, 10 aa, Mycobacterium
GTTPGGFPST

SEQ ID NO: 905598 - protein, 7 aa, Mycobacterium
GTTPLSD

SEQ ID NO: 905599 - protein, 9 aa, Mycobacterium
GTTPPPGSH

SEQ ID NO: 905600 - protein, 9 aa, Mycobacterium
GTTQTSTGK

SEQ ID NO: 905601 - protein, 6 aa, Mycobacterium
GTTSLE

SEQ ID NO: 905602 - protein, 6 aa, Mycobacterium
GTTTCT

SEQ ID NO: 905603 - protein, 12 aa, Mycobacterium
GTTTPDFYPGGS

SEQ ID NO: 905604 - protein, 17 aa, Mycobacterium
GTTVSGAPFNGASLKGK

SEQ ID NO: 905605 - protein, 6 aa, Mycobacterium
GTTWNS

SEQ ID NO: 905606 - protein, 7 aa, Mycobacterium
GTVASTL

SEQ ID NO: 905607 - protein, 5 aa, Mycobacterium
GTVDT

SEQ ID NO: 905608 - protein, 10 aa, Mycobacterium
GTVNPTAPEL

SEQ ID NO: 905609 - protein, 12 aa, Mycobacterium
GTVNRGNATQAV

SEQ ID NO: 905610 - protein, 13 aa, Mycobacterium
GTVRGSDSQGADG

SEQ ID NO: 905611 - protein, 9 aa, Mycobacterium
GTVRGTGEF

SEQ ID NO: 905612 - protein, 6 aa, Mycobacterium
GTVSDG

SEQ ID NO: 905613 - protein, 6 aa, Mycobacterium
GTVTGN

SEQ ID NO: 905614 - protein, 7 aa, Mycobacterium
GTVTSTL

SEQ ID NO: 905615 - protein, 6 aa, Mycobacterium
GTWAND

SEQ ID NO: 905616 - protein, 8 aa, Mycobacterium
GTWEANGG

SEQ ID NO: 905617 - protein, 6 aa, Mycobacterium
GTWSGR

SEQ ID NO: 905618 - protein, 7 aa, Mycobacterium
GTWTSPG

SEQ ID NO: 905619 - protein, 10 aa, Mycobacterium
GTYDSRRIDG

SEQ ID NO: 905620 - protein, 26 aa, Mycobacterium
GTYEPGYNSDSTRTYSIGEPNPEVAE

SEQ ID NO: 905621 - protein, 12 aa, Mycobacterium
GTYNGQQITSPE

SEQ ID NO: 905622 - protein, 6 aa, Mycobacterium
GTYNQD

SEQ ID NO: 905623 - protein, 4 aa, Mycobacterium
GTYP

SEQ ID NO: 905624 - protein, 4 aa, Mycobacterium
GTYQ

SEQ ID NO: 905625 - protein, 10 aa, Mycobacterium
GTYQRDGKTR

SEQ ID NO: 905626 - protein, 13 aa, Mycobacterium
GTYTSGTTGAPKA

SEQ ID NO: 905627 - protein, 11 aa, Mycobacterium
GTYTYTPGAEF

SEQ ID NO: 905628 - protein, 136 aa, Mycobacterium
GVAAADSDTADAADTSSQSAETRTAADQPAAREPDEPEARETEAEAEETDADAAAESEGEGADTDDTADVTAEEDAAVESASARKPRAERREAVAEAASETEPASEQAPEPAQTPAAPTQAVASAPTGVKTGRAPL

SEQ ID NO: 905629 - protein, 9 aa, Mycobacterium
GVAAGAAGY

SEQ ID NO: 905630 - protein, 6 aa, Mycobacterium
GVAASE

SEQ ID NO: 905631 - protein, 7 aa, Mycobacterium
GVAATPA

SEQ ID NO: 905632 - protein, 13 aa, Mycobacterium
GVAESGADYAARD

SEQ ID NO: 905633 - protein, 4 aa, Mycobacterium
GVAG

SEQ ID NO: 905634 - protein, 14 aa, Mycobacterium
GVAGAAPSRSCSSD

SEQ ID NO: 905635 - protein, 12 aa, Mycobacterium
GVAGRTADQLKE

SEQ ID NO: 905636 - protein, 11 aa, Mycobacterium
GVAGSGGIRGP

SEQ ID NO: 905637 - protein, 5 aa, Mycobacterium
GVAPG

SEQ ID NO: 905638 - protein, 9 aa, Mycobacterium
GVAPGHPAK

SEQ ID NO: 905639 - protein, 6 aa, Mycobacterium
GVAPGQ

SEQ ID NO: 905640 - protein, 9 aa, Mycobacterium
GVAPRGEGG

SEQ ID NO: 905641 - protein, 14 aa, Mycobacterium
GVAPSSVSNKTMSR

SEQ ID NO: 905642 - protein, 12 aa, Mycobacterium
GVAQAAPAETAR

SEQ ID NO: 905643 - protein, 9 aa, Mycobacterium
GVASASPLD

SEQ ID NO: 905644 - protein, 10 aa, Mycobacterium
GVASATTAAD

SEQ ID NO: 905645 - protein, 7 aa, Mycobacterium
GVASEDR

SEQ ID NO: 905646 - protein, 18 aa, Mycobacterium
GVATNTNVTPPGGSGDIT

SEQ ID NO: 905647 - protein, 5 aa, Mycobacterium
GVDDP

SEQ ID NO: 905648 - protein, 6 aa, Mycobacterium
GVDDRE

SEQ ID NO: 905649 - protein, 9 aa, Mycobacterium
GVDGDAYKS

SEQ ID NO: 905650 - protein, 6 aa, Mycobacterium
GVDPAE

SEQ ID NO: 905651 - protein, 7 aa, Mycobacterium
GVDPAQL

SEQ ID NO: 905652 - protein, 17 aa, Mycobacterium
GVDPKGTVQLESAGSHY

SEQ ID NO: 905653 - protein, 5 aa, Mycobacterium
GVDPL

SEQ ID NO: 905654 - protein, 7 aa, Mycobacterium
GVDPQRA

SEQ ID NO: 905655 - protein, 9 aa, Mycobacterium
GVDPQRGWG

SEQ ID NO: 905656 - protein, 5 aa, Mycobacterium
GVDPR

SEQ ID NO: 905657 - protein, 13 aa, Mycobacterium
GVDPTAADPAGWP

SEQ ID NO: 905658 - protein, 8 aa, Mycobacterium
GVDQTNAE

SEQ ID NO: 905659 - protein, 9 aa, Mycobacterium
GVDSDGPSR

SEQ ID NO: 905660 - protein, 9 aa, Mycobacterium
GVDSGAGGP

SEQ ID NO: 905661 - protein, 6 aa, Mycobacterium
GVDSPV

SEQ ID NO: 905662 - protein, 8 aa, Mycobacterium
GVEGSPGQ

SEQ ID NO: 905663 - protein, 24 aa, Mycobacterium
GVEGTGSVKMGKASGATVDTTESV

SEQ ID NO: 905664 - protein, 15 aa, Mycobacterium
GVEHPPACTRETNPL

SEQ ID NO: 905665 - protein, 12 aa, Mycobacterium
GVENMGHGNAGS

SEQ ID NO: 905666 - protein, 6 aa, Mycobacterium
GVENNA

SEQ ID NO: 905667 - protein, 35 aa, Mycobacterium
GVEPGAQSHLPTGIDPAHAAGPGRVAAPPAGAEPA

SEQ ID NO: 905668 - protein, 8 aa, Mycobacterium
GVEPGGPI

SEQ ID NO: 905669 - protein, 15 aa, Mycobacterium
GVERGKDVVSPSRHT

SEQ ID NO: 905670 - protein, 19 aa, Mycobacterium
GVESSPPNPNGLPPTPGIP

SEQ ID NO: 905671 - protein, 6 aa, Mycobacterium
GVETER

SEQ ID NO: 905672 - protein, 6 aa, Mycobacterium
GVETGR

SEQ ID NO: 905673 - protein, 7 aa, Mycobacterium
GVETGRL

SEQ ID NO: 905674 - protein, 8 aa, Mycobacterium
GVETSDRQ

SEQ ID NO: 905675 - protein, 4 aa, Mycobacterium
GVFT

SEQ ID NO: 905676 - protein, 15 aa, Mycobacterium
GVGADTPSPGGIRGT

SEQ ID NO: 905677 - protein, 14 aa, Mycobacterium
GVGAGGAAIGDAPL

SEQ ID NO: 905678 - protein, 11 aa, Mycobacterium
GVGAGGAPIGE

SEQ ID NO: 905679 - protein, 14 aa, Mycobacterium
GVGDGAAGNNGTSA

SEQ ID NO: 905680 - protein, 32 aa, Mycobacterium
GVGGAGGTGADGGGMSTTGGHGGTGGTGGSAR

SEQ ID NO: 905681 - protein, 11 aa, Mycobacterium
GVGGQAPPADV

SEQ ID NO: 905682 - protein, 16 aa, Mycobacterium
GVGGQGGTGGNGSDGG

SEQ ID NO: 905683 - protein, 13 aa, Mycobacterium
GVGKGSAEPHKTK

SEQ ID NO: 905684 - protein, 6 aa, Mycobacterium
GVGKTE

SEQ ID NO: 905685 - protein, 4 aa, Mycobacterium
GVGN

SEQ ID NO: 905686 - protein, 13 aa, Mycobacterium
GVGNPAAASREQQ

SEQ ID NO: 905687 - protein, 4 aa, Mycobacterium
GVGP

SEQ ID NO: 905688 - protein, 5 aa, Mycobacterium
GVGPG

SEQ ID NO: 905689 - protein, 14 aa, Mycobacterium
GVGPNGDNWPINPD

SEQ ID NO: 905690 - protein, 15 aa, Mycobacterium
GVGSDRGTDANPRPR

SEQ ID NO: 905691 - protein, 6 aa, Mycobacterium
GVGSGG

SEQ ID NO: 905692 - protein, 7 aa, Mycobacterium
GVGSGQV

SEQ ID NO: 905693 - protein, 4 aa, Mycobacterium
GVGT

SEQ ID NO: 905694 - protein, 15 aa, Mycobacterium
GVGTPHATADDASPL

SEQ ID NO: 905695 - protein, 10 aa, Mycobacterium
GVGYADPDAA

SEQ ID NO: 905696 - protein, 11 aa, Mycobacterium
GVHEPANAGPW

SEQ ID NO: 905697 - protein, 6 aa, Mycobacterium
GVHPAR

SEQ ID NO: 905698 - protein, 10 aa, Mycobacterium
GVHPNDAGHQ

SEQ ID NO: 905699 - protein, 9 aa, Mycobacterium
GVHPTDAGH

SEQ ID NO: 905700 - protein, 9 aa, Mycobacterium
GVKNPDYSD

SEQ ID NO: 905701 - protein, 5 aa, Mycobacterium
GVKPG

SEQ ID NO: 905702 - protein, 16 aa, Mycobacterium
GVLTPKPGETRTQLTS

SEQ ID NO: 905703 - protein, 13 aa, Mycobacterium
GVNPAAPASTTGV

SEQ ID NO: 905704 - protein, 6 aa, Mycobacterium
GVNPHP

SEQ ID NO: 905705 - protein, 6 aa, Mycobacterium
GVNQDQ

SEQ ID NO: 905706 - protein, 10 aa, Mycobacterium
GVNSDAPSRN

SEQ ID NO: 905707 - protein, 8 aa, Mycobacterium
GVNSDLND

SEQ ID NO: 905708 - protein, 5 aa, Mycobacterium
GVNSQ

SEQ ID NO: 905709 - protein, 5 aa, Mycobacterium
GVNTA

SEQ ID NO: 905710 - protein, 13 aa, Mycobacterium
GVNYGDAGGAEAL

SEQ ID NO: 905711 - protein, 11 aa, Mycobacterium
GVNYGDPASAV

SEQ ID NO: 905712 - protein, 18 aa, Mycobacterium
GVPAAPASPAVALPATRP

SEQ ID NO: 905713 - protein, 13 aa, Mycobacterium
GVPAAQADNRRLN

SEQ ID NO: 905714 - protein, 6 aa, Mycobacterium
GVPANP

SEQ ID NO: 905715 - protein, 9 aa, Mycobacterium
GVPAPPTTW

SEQ ID NO: 905716 - protein, 5 aa, Mycobacterium
GVPDT

SEQ ID NO: 905717 - protein, 10 aa, Mycobacterium
GVPEARQRGL

SEQ ID NO: 905718 - protein, 17 aa, Mycobacterium
GVPEGQNPEPFTGQPPF

SEQ ID NO: 905719 - protein, 7 aa, Mycobacterium
GVPFTDP

SEQ ID NO: 905720 - protein, 8 aa, Mycobacterium
GVPGAAPQ

SEQ ID NO: 905721 - protein, 13 aa, Mycobacterium
GVPGASKTDDIDE

SEQ ID NO: 905722 - protein, 8 aa, Mycobacterium
GVPGPHPY

SEQ ID NO: 905723 - protein, 6 aa, Mycobacterium
GVPGRG

SEQ ID NO: 905724 - protein, 7 aa, Mycobacterium
GVPIPAD

SEQ ID NO: 905725 - protein, 16 aa, Mycobacterium
GVPKAADLRAALQPLL

SEQ ID NO: 905726 - protein, 18 aa, Mycobacterium
GVPKATDLRTALQGMTQP

SEQ ID NO: 905727 - protein, 7 aa, Mycobacterium
GVPLPDT

SEQ ID NO: 905728 - protein, 7 aa, Mycobacterium
GVPNTPY

SEQ ID NO: 905729 - protein, 4 aa, Mycobacterium
GVPP

SEQ ID NO: 905730 - protein, 8 aa, Mycobacterium
GVPPEEVG

SEQ ID NO: 905731 - protein, 6 aa, Mycobacterium
GVPPEV

SEQ ID NO: 905732 - protein, 24 aa, Mycobacterium
GVPPPAGAPVPPVDTHASGRPADQ

SEQ ID NO: 905733 - protein, 24 aa, Mycobacterium
GVPPPAGDPVPPVDTHASGRPAEQ

SEQ ID NO: 905734 - protein, 25 aa, Mycobacterium
GVPPPPGDPVPPVDTYASGRPADQL

SEQ ID NO: 905735 - protein, 8 aa, Mycobacterium
GVPPSGPR

SEQ ID NO: 905736 - protein, 10 aa, Mycobacterium
GVPPSHQPDR

SEQ ID NO: 905737 - protein, 5 aa, Mycobacterium
GVPQG

SEQ ID NO: 905738 - protein, 6 aa, Mycobacterium
GVPSGD

SEQ ID NO: 905739 - protein, 12 aa, Mycobacterium
GVPSSSSPQAIG

SEQ ID NO: 905740 - protein, 9 aa, Mycobacterium
GVPTPESIK

SEQ ID NO: 905741 - protein, 12 aa, Mycobacterium
GVPTSSSPQAIG

SEQ ID NO: 905742 - protein, 8 aa, Mycobacterium
GVPTTTSN

SEQ ID NO: 905743 - protein, 27 aa, Mycobacterium
GVPVPGGVKPGVGTGDGTLESPTGAPT

SEQ ID NO: 905744 - protein, 5 aa, Mycobacterium
GVQHA

SEQ ID NO: 905745 - protein, 18 aa, Mycobacterium
GVQNTTGGGSGGTYPSGT

SEQ ID NO: 905746 - protein, 13 aa, Mycobacterium
GVQPLAAAAPPKL

SEQ ID NO: 905747 - protein, 10 aa, Mycobacterium
GVQPTGTENH

SEQ ID NO: 905748 - protein, 8 aa, Mycobacterium
GVQPTGVE

SEQ ID NO: 905749 - protein, 23 aa, Mycobacterium
GVQPTTTVPAPAPTTAPVSHGPA

SEQ ID NO: 905750 - protein, 6 aa, Mycobacterium
GVQTAN

SEQ ID NO: 905751 - protein, 11 aa, Mycobacterium
GVQTTGTSTSI

SEQ ID NO: 905752 - protein, 4 aa, Mycobacterium
GVRG

SEQ ID NO: 905753 - protein, 14 aa, Mycobacterium
GVRGQGDRIGEAIT

SEQ ID NO: 905754 - protein, 4 aa, Mycobacterium
GVRP

SEQ ID NO: 905755 - protein, 13 aa, Mycobacterium
GVRPASAPSTTGV

SEQ ID NO: 905756 - protein, 7 aa, Mycobacterium
GVRPGDP

SEQ ID NO: 905757 - protein, 16 aa, Mycobacterium
GVRSRRRHAGRPRRQL

SEQ ID NO: 905758 - protein, 4 aa, Mycobacterium
GVRT

SEQ ID NO: 905759 - protein, 10 aa, Mycobacterium
GVRTADGATV

SEQ ID NO: 905760 - protein, 7 aa, Mycobacterium
GVRTESA

SEQ ID NO: 905761 - protein, 5 aa, Mycobacterium
GVRTP

SEQ ID NO: 905762 - protein, 16 aa, Mycobacterium
GVRVSGPAVDAPADVS

SEQ ID NO: 905763 - protein, 14 aa, Mycobacterium
GVSATAGAFSKPGL

SEQ ID NO: 905764 - protein, 4 aa, Mycobacterium
GVSD

SEQ ID NO: 905765 - protein, 14 aa, Mycobacterium
GVSGGAEIRRSDAP

SEQ ID NO: 905766 - protein, 9 aa, Mycobacterium
GVSLPGSTT

SEQ ID NO: 905767 - protein, 7 aa, Mycobacterium
GVSPSDV

SEQ ID NO: 905768 - protein, 4 aa, Mycobacterium
GVSQ

SEQ ID NO: 905769 - protein, 37 aa, Mycobacterium
GVSQQSGVQNVQPGRNMRNQPTTVPTAGQKVAYVTLA

SEQ ID NO: 905770 - protein, 8 aa, Mycobacterium
GVSQSAQR

SEQ ID NO: 905771 - protein, 6 aa, Mycobacterium
GVSRNA

SEQ ID NO: 905772 - protein, 10 aa, Mycobacterium
GVSRPPAPIP

SEQ ID NO: 905773 - protein, 16 aa, Mycobacterium
GVTAPGSSAESGPLDT

SEQ ID NO: 905774 - protein, 14 aa, Mycobacterium
GVTDADIDKAVGSG

SEQ ID NO: 905775 - protein, 5 aa, Mycobacterium
GVTGT

SEQ ID NO: 905776 - protein, 16 aa, Mycobacterium
GVTNPAVSNEPGPLDT

SEQ ID NO: 905777 - protein, 4 aa, Mycobacterium
GVTP

SEQ ID NO: 905778 - protein, 13 aa, Mycobacterium
GVTPHDKRHRARV

SEQ ID NO: 905779 - protein, 9 aa, Mycobacterium
GVTPPAHGT

SEQ ID NO: 905780 - protein, 9 aa, Mycobacterium
GVTPRSGHG

SEQ ID NO: 905781 - protein, 11 aa, Mycobacterium
GVTQGTSGTVT

SEQ ID NO: 905782 - protein, 14 aa, Mycobacterium
GVTRQSEKKPPAAP

SEQ ID NO: 905783 - protein, 6 aa, Mycobacterium
GVTSDG

SEQ ID NO: 905784 - protein, 19 aa, Mycobacterium
GVTSQRELETRGREAGRAA

SEQ ID NO: 905785 - protein, 6 aa, Mycobacterium
GVTTGE

SEQ ID NO: 905786 - protein, 8 aa, Mycobacterium
GVTTGSQA

SEQ ID NO: 905787 - protein, 15 aa, Mycobacterium
GVTTSTLTTTARPVP

SEQ ID NO: 905788 - protein, 8 aa, Mycobacterium
GVTVGGNG

SEQ ID NO: 905789 - protein, 8 aa, Mycobacterium
GVVPNSGA

SEQ ID NO: 905790 - protein, 32 aa, Mycobacterium
GVVPSSDAQPPAPAASACPTALPDSDAAPEWT

SEQ ID NO: 905791 - protein, 7 aa, Mycobacterium
GVYANSK

SEQ ID NO: 905792 - protein, 8 aa, Mycobacterium
GWAGADPG

SEQ ID NO: 905793 - protein, 8 aa, Mycobacterium
GWAGPTAD

SEQ ID NO: 905794 - protein, 7 aa, Mycobacterium
GWDADAP

SEQ ID NO: 905795 - protein, 10 aa, Mycobacterium
GWDPAPHAGF

SEQ ID NO: 905796 - protein, 15 aa, Mycobacterium
GWDPRTQSIDPAGIT

SEQ ID NO: 905797 - protein, 7 aa, Mycobacterium
GWDSEAP

SEQ ID NO: 905798 - protein, 20 aa, Mycobacterium
GWETSDVAATDPGAAPGAAA

SEQ ID NO: 905799 - protein, 25 aa, Mycobacterium
GWGGVGGAGDGTGDGGDGGSGGDGG

SEQ ID NO: 905800 - protein, 6 aa, Mycobacterium
GWGVPG

SEQ ID NO: 905801 - protein, 10 aa, Mycobacterium
GWKPGPDGIR

SEQ ID NO: 905802 - protein, 13 aa, Mycobacterium
GWNGPNGPGQTGY

SEQ ID NO: 905803 - protein, 15 aa, Mycobacterium
GWNPRTQALDPAGTT

SEQ ID NO: 905804 - protein, 21 aa, Mycobacterium
GWNTSDVAATDPGVADGAGAG

SEQ ID NO: 905805 - protein, 14 aa, Mycobacterium
GWPGATAYAASKSG

SEQ ID NO: 905806 - protein, 8 aa, Mycobacterium
GWPGPAGQ

SEQ ID NO: 905807 - protein, 18 aa, Mycobacterium
GWPLGEGKPWANKATLET

SEQ ID NO: 905808 - protein, 11 aa, Mycobacterium
GWQSASHTAKE

SEQ ID NO: 905809 - protein, 18 aa, Mycobacterium
GWRPGAGQIREKDGARAS

SEQ ID NO: 905810 - protein, 11 aa, Mycobacterium
GWSEQHDGAEY

SEQ ID NO: 905811 - protein, 7 aa, Mycobacterium
GWSPEQS

SEQ ID NO: 905812 - protein, 15 aa, Mycobacterium
GWSTPNTYESRRGET

SEQ ID NO: 905813 - protein, 6 aa, Mycobacterium
GWTDGQ

SEQ ID NO: 905814 - protein, 4 aa, Mycobacterium
GWTG

SEQ ID NO: 905815 - protein, 4 aa, Mycobacterium
GWTT

SEQ ID NO: 905816 - protein, 21 aa, Mycobacterium
GWTTSDVAATDPGVADGAGAG

SEQ ID NO: 905817 - protein, 12 aa, Mycobacterium
GYAAATGKSVDL

SEQ ID NO: 905818 - protein, 6 aa, Mycobacterium
GYAATS

SEQ ID NO: 905819 - protein, 9 aa, Mycobacterium
GYAPADQTA

SEQ ID NO: 905820 - protein, 5 aa, Mycobacterium
GYAPD

SEQ ID NO: 905821 - protein, 9 aa, Mycobacterium
GYAPQTNEF

SEQ ID NO: 905822 - protein, 17 aa, Mycobacterium
GYASGDLDTRGGSTIEQ

SEQ ID NO: 905823 - protein, 9 aa, Mycobacterium
GYDADTAAA

SEQ ID NO: 905824 - protein, 8 aa, Mycobacterium
GYDAGAAT

SEQ ID NO: 905825 - protein, 5 aa, Mycobacterium
GYDGQ

SEQ ID NO: 905826 - protein, 4 aa, Mycobacterium
GYDN

SEQ ID NO: 905827 - protein, 14 aa, Mycobacterium
GYDRTNYGRPTPAG

SEQ ID NO: 905828 - protein, 13 aa, Mycobacterium
GYDRTSSPGEPKP

SEQ ID NO: 905829 - protein, 4 aa, Mycobacterium
GYDS

SEQ ID NO: 905830 - protein, 10 aa, Mycobacterium
GYDTCNTPGS

SEQ ID NO: 905831 - protein, 5 aa, Mycobacterium
GYEAV

SEQ ID NO: 905832 - protein, 30 aa, Mycobacterium
GYEIDSNTSASTAPPGPGSTTPVSTGPPEV

SEQ ID NO: 905833 - protein, 13 aa, Mycobacterium
GYEPTGAPSTVPS

SEQ ID NO: 905834 - protein, 4 aa, Mycobacterium
GYFE

SEQ ID NO: 905835 - protein, 12 aa, Mycobacterium
GYGLPGGDPTMC

SEQ ID NO: 905836 - protein, 10 aa, Mycobacterium
GYGPGGPISH

SEQ ID NO: 905837 - protein, 5 aa, Mycobacterium
GYGPQ

SEQ ID NO: 905838 - protein, 8 aa, Mycobacterium
GYGPTETT

SEQ ID NO: 905839 - protein, 9 aa, Mycobacterium
GYGRDSNNP

SEQ ID NO: 905840 - protein, 5 aa, Mycobacterium
GYGYR

SEQ ID NO: 905841 - protein, 9 aa, Mycobacterium
GYHDSQGDE

SEQ ID NO: 905842 - protein, 9 aa, Mycobacterium
GYHPSAPAY

SEQ ID NO: 905843 - protein, 9 aa, Mycobacterium
GYKDADVAS

SEQ ID NO: 905844 - protein, 9 aa, Mycobacterium
GYKGPPFTG

SEQ ID NO: 905845 - protein, 7 aa, Mycobacterium
GYKSATD

SEQ ID NO: 905846 - protein, 5 aa, Mycobacterium
GYKTS

SEQ ID NO: 905847 - protein, 7 aa, Mycobacterium
GYNPKGA

SEQ ID NO: 905848 - protein, 10 aa, Mycobacterium
GYPAGLDDTP

SEQ ID NO: 905849 - protein, 12 aa, Mycobacterium
GYPERPAAGRGT

SEQ ID NO: 905850 - protein, 13 aa, Mycobacterium
GYPGMPAKPGPAV

SEQ ID NO: 905851 - protein, 5 aa, Mycobacterium
GYPIP

SEQ ID NO: 905852 - protein, 9 aa, Mycobacterium
GYPKPDHSH

SEQ ID NO: 905853 - protein, 9 aa, Mycobacterium
GYPKSPGNT

SEQ ID NO: 905854 - protein, 14 aa, Mycobacterium
GYPRGGRVDAGNEL

SEQ ID NO: 905855 - protein, 9 aa, Mycobacterium
GYQEARDRA

SEQ ID NO: 905856 - protein, 6 aa, Mycobacterium
GYQPRY

SEQ ID NO: 905857 - protein, 20 aa, Mycobacterium
GYRDATAEPTSDILRRLASG

SEQ ID NO: 905858 - protein, 6 aa, Mycobacterium
GYRPRD

SEQ ID NO: 905859 - protein, 4 aa, Mycobacterium
GYSE

SEQ ID NO: 905860 - protein, 10 aa, Mycobacterium
GYSEAGARQA

SEQ ID NO: 905861 - protein, 14 aa, Mycobacterium
GYSGVTDDIDPGGK

SEQ ID NO: 905862 - protein, 13 aa, Mycobacterium
GYSPDGLPSGSPL

SEQ ID NO: 905863 - protein, 10 aa, Mycobacterium
GYSPPQDSRV

SEQ ID NO: 905864 - protein, 6 aa, Mycobacterium
GYSQGA

SEQ ID NO: 905865 - protein, 32 aa, Mycobacterium
GYSQGAAVAGYTTSATVPPGVPADKVPPPMPP

SEQ ID NO: 905866 - protein, 7 aa, Mycobacterium
GYSRDSG

SEQ ID NO: 905867 - protein, 13 aa, Mycobacterium
GYSRNDDPATAPI

SEQ ID NO: 905868 - protein, 13 aa, Mycobacterium
GYSRNDDPQTAPI

SEQ ID NO: 905869 - protein, 11 aa, Mycobacterium
GYSVGDRDDLY

SEQ ID NO: 905870 - protein, 4 aa, Mycobacterium
GYSY

SEQ ID NO: 905871 - protein, 5 aa, Mycobacterium
GYTEL

SEQ ID NO: 905872 - protein, 4 aa, Mycobacterium
GYTG

SEQ ID NO: 905873 - protein, 10 aa, Mycobacterium
GYTNDASGDQ

SEQ ID NO: 905874 - protein, 17 aa, Mycobacterium
GYTSCGEATTFDPDAGA

SEQ ID NO: 905875 - protein, 20 aa, Mycobacterium
GYYGNTKDRVVDENDRAGKG

SEQ ID NO: 905876 - protein, 7 aa, Mycobacterium
HAADGRE

SEQ ID NO: 905877 - protein, 11 aa, Mycobacterium
HAAEKRDDRKY

SEQ ID NO: 905878 - protein, 4 aa, Mycobacterium
HAAG

SEQ ID NO: 905879 - protein, 9 aa, Mycobacterium
HAAPNREAV

SEQ ID NO: 905880 - protein, 26 aa, Mycobacterium
HAAPTPSTAAASTTTTSAASVPDPTV

SEQ ID NO: 905881 - protein, 6 aa, Mycobacterium
HAAPTV

SEQ ID NO: 905882 - protein, 5 aa, Mycobacterium
HAARN

SEQ ID NO: 905883 - protein, 11 aa, Mycobacterium
HAARTRYDSFP

SEQ ID NO: 905884 - protein, 17 aa, Mycobacterium
HAASNGKTWEGKSIPGL

SEQ ID NO: 905885 - protein, 14 aa, Mycobacterium
HAASNGKTWEGRSI

SEQ ID NO: 905886 - protein, 15 aa, Mycobacterium
HAASRSPAQAPTQRT

SEQ ID NO: 905887 - protein, 18 aa, Mycobacterium
HAATPSGLDGPGGSGWST

SEQ ID NO: 905888 - protein, 25 aa, Mycobacterium
HACPTTAGPAGGLSQSAAGSPATSC

SEQ ID NO: 905889 - protein, 10 aa, Mycobacterium
HADDQPTSVA

SEQ ID NO: 905890 - protein, 6 aa, Mycobacterium
HADPAP

SEQ ID NO: 905891 - protein, 14 aa, Mycobacterium
HADPAPDPNDPGNI

SEQ ID NO: 905892 - protein, 14 aa, Mycobacterium
HADPATPDPRPAPV

SEQ ID NO: 905893 - protein, 14 aa, Mycobacterium
HADPEPPPPPPGNT

SEQ ID NO: 905894 - protein, 9 aa, Mycobacterium
HADPGPLPI

SEQ ID NO: 905895 - protein, 13 aa, Mycobacterium
HADPVDGVDGTDE

SEQ ID NO: 905896 - protein, 8 aa, Mycobacterium
HADVNNDQ

SEQ ID NO: 905897 - protein, 6 aa, Mycobacterium
HAEARN

SEQ ID NO: 905898 - protein, 7 aa, Mycobacterium
HAEDAYG

SEQ ID NO: 905899 - protein, 8 aa, Mycobacterium
HAEDPTPY

SEQ ID NO: 905900 - protein, 60 aa, Mycobacterium
HAEPPANPGNSNGNGNGPGNGNGNGNGPGGPNGNNGPDRPDVVTGPGVNAGDPGTPLPPG

SEQ ID NO: 905901 - protein, 9 aa, Mycobacterium
HAETDKNTV

SEQ ID NO: 905902 - protein, 8 aa, Mycobacterium
HAFQDGKG

SEQ ID NO: 905903 - protein, 11 aa, Mycobacterium
HAGCRASGAGG

SEQ ID NO: 905904 - protein, 12 aa, Mycobacterium
HAGGPTDTTGQF

SEQ ID NO: 905905 - protein, 8 aa, Mycobacterium
HAGGTDAA

SEQ ID NO: 905906 - protein, 9 aa, Mycobacterium
HAGPQGYGD

SEQ ID NO: 905907 - protein, 7 aa, Mycobacterium
HAGPTIQ

SEQ ID NO: 905908 - protein, 11 aa, Mycobacterium
HAGSPADPAVA

SEQ ID NO: 905909 - protein, 11 aa, Mycobacterium
HAHPDEGGGDD

SEQ ID NO: 905910 - protein, 7 aa, Mycobacterium
HALGGGL

SEQ ID NO: 905911 - protein, 13 aa, Mycobacterium
HALGGGLGANSRH

SEQ ID NO: 905912 - protein, 13 aa, Mycobacterium
HALGGGLGAQSRH

SEQ ID NO: 905913 - protein, 18 aa, Mycobacterium
HANGGSGSAASASREEQI

SEQ ID NO: 905914 - protein, 13 aa, Mycobacterium
HANPAREPGPPPL

SEQ ID NO: 905915 - protein, 15 aa, Mycobacterium
HANQDKGDSPPAGWM

SEQ ID NO: 905916 - protein, 12 aa, Mycobacterium
HANTDAETSENF

SEQ ID NO: 905917 - protein, 4 aa, Mycobacterium
HAPD

SEQ ID NO: 905918 - protein, 13 aa, Mycobacterium
HAPNQGTCTAGQQ

SEQ ID NO: 905919 - protein, 7 aa, Mycobacterium
HAPQGAQ

SEQ ID NO: 905920 - protein, 5 aa, Mycobacterium
HAPSY

SEQ ID NO: 905921 - protein, 4 aa, Mycobacterium
HAPT

SEQ ID NO: 905922 - protein, 14 aa, Mycobacterium
HAPTDVDLNGGRPS

SEQ ID NO: 905923 - protein, 11 aa, Mycobacterium
HAPTTTTRAAP

SEQ ID NO: 905924 - protein, 9 aa, Mycobacterium
HAQARAATR

SEQ ID NO: 905925 - protein, 4 aa, Mycobacterium
HARA

SEQ ID NO: 905926 - protein, 7 aa, Mycobacterium
HARDGER

SEQ ID NO: 905927 - protein, 6 aa, Mycobacterium
HARGAD

SEQ ID NO: 905928 - protein, 4 aa, Mycobacterium
HART

SEQ ID NO: 905929 - protein, 4 aa, Mycobacterium
HASG

SEQ ID NO: 905930 - protein, 7 aa, Mycobacterium
HASGDTG

SEQ ID NO: 905931 - protein, 6 aa, Mycobacterium
HASGSE

SEQ ID NO: 905932 - protein, 8 aa, Mycobacterium
HASPEGIE

SEQ ID NO: 905933 - protein, 7 aa, Mycobacterium
HASPPFS

SEQ ID NO: 905934 - protein, 27 aa, Mycobacterium
HASRGLDAGTAAASSVTGLAPAGADEI

SEQ ID NO: 905935 - protein, 8 aa, Mycobacterium
HATEAAKA

SEQ ID NO: 905936 - protein, 11 aa, Mycobacterium
HATEPASGDLT

SEQ ID NO: 905937 - protein, 5 aa, Mycobacterium
HATEY

SEQ ID NO: 905938 - protein, 36 aa, Mycobacterium
HATGTNVGDVAESKAINNAMGGHKPAVYAPKGALGH

SEQ ID NO: 905939 - protein, 9 aa, Mycobacterium
HATGTQIGD

SEQ ID NO: 905940 - protein, 5 aa, Mycobacterium
HATPT

SEQ ID NO: 905941 - protein, 26 aa, Mycobacterium
HATRGAPSTGPAAGSVATAPATSTIE

SEQ ID NO: 905942 - protein, 9 aa, Mycobacterium
HATSGADKN

SEQ ID NO: 905943 - protein, 9 aa, Mycobacterium
HATSGADNR

SEQ ID NO: 905944 - protein, 9 aa, Mycobacterium
HATSGKDKA

SEQ ID NO: 905945 - protein, 72 aa, Mycobacterium
HAVGPAEALPPAAEPLAAPAPAPAPEAAPAPAPEAAPAPAPEAAAPAPEAPAPAPAPAAAAAPGFGPDAPVT

SEQ ID NO: 905946 - protein, 8 aa, Mycobacterium
HAYGGGSQ

SEQ ID NO: 905947 - protein, 6 aa, Mycobacterium
HAYRGD

SEQ ID NO: 905948 - protein, 10 aa, Mycobacterium
HCGGNGPVFT

SEQ ID NO: 905949 - protein, 7 aa, Mycobacterium
HCNKGSD

SEQ ID NO: 905950 - protein, 7 aa, Mycobacterium
HDAESAD

SEQ ID NO: 905951 - protein, 6 aa, Mycobacterium
HDAHQS

SEQ ID NO: 905952 - protein, 7 aa, Mycobacterium
HDANDAD

SEQ ID NO: 905953 - protein, 5 aa, Mycobacterium
HDASF

SEQ ID NO: 905954 - protein, 8 aa, Mycobacterium
HDASPGRI

SEQ ID NO: 905955 - protein, 8 aa, Mycobacterium
HDDAPAEL

SEQ ID NO: 905956 - protein, 8 aa, Mycobacterium
HDDGVGAD

SEQ ID NO: 905957 - protein, 9 aa, Mycobacterium
HDDTEQGVP

SEQ ID NO: 905958 - protein, 9 aa, Mycobacterium
HDDTEVGVP

SEQ ID NO: 905959 - protein, 12 aa, Mycobacterium
HDEEAKSATPRL

SEQ ID NO: 905960 - protein, 8 aa, Mycobacterium
HDEGGRTH

SEQ ID NO: 905961 - protein, 6 aa, Mycobacterium
HDEPDE

SEQ ID NO: 905962 - protein, 8 aa, Mycobacterium
HDERYDRA

SEQ ID NO: 905963 - protein, 8 aa, Mycobacterium
HDESPRRR

SEQ ID NO: 905964 - protein, 4 aa, Mycobacterium
HDET

SEQ ID NO: 905965 - protein, 11 aa, Mycobacterium
HDGADLTPKEQ

SEQ ID NO: 905966 - protein, 19 aa, Mycobacterium
HDGAKYHGGYGYNRSAAEA

SEQ ID NO: 905967 - protein, 12 aa, Mycobacterium
HDGDSDSTGSIA

SEQ ID NO: 905968 - protein, 11 aa, Mycobacterium
HDGGPSAARTA

SEQ ID NO: 905969 - protein, 9 aa, Mycobacterium
HDGKPGPAA

SEQ ID NO: 905970 - protein, 9 aa, Mycobacterium
HDGPDRDPD

SEQ ID NO: 905971 - protein, 8 aa, Mycobacterium
HDGRGPAT

SEQ ID NO: 905972 - protein, 4 aa, Mycobacterium
HDGS

SEQ ID NO: 905973 - protein, 9 aa, Mycobacterium
HDGSETGRR

SEQ ID NO: 905974 - protein, 8 aa, Mycobacterium
HDGTEVGV

SEQ ID NO: 905975 - protein, 9 aa, Mycobacterium
HDGTPGRID

SEQ ID NO: 905976 - protein, 8 aa, Mycobacterium
HDGTPLDA

SEQ ID NO: 905977 - protein, 11 aa, Mycobacterium
HDGTTIEQQVG

SEQ ID NO: 905978 - protein, 17 aa, Mycobacterium
HDHDRGGDWRGHDRDWR

SEQ ID NO: 905979 - protein, 12 aa, Mycobacterium
HDKKHETKNGTY

SEQ ID NO: 905980 - protein, 6 aa, Mycobacterium
HDKNGD

SEQ ID NO: 905981 - protein, 10 aa, Mycobacterium
HDNTTANSGL

SEQ ID NO: 905982 - protein, 6 aa, Mycobacterium
HDPAAR

SEQ ID NO: 905983 - protein, 12 aa, Mycobacterium
HDPADPPEVADR

SEQ ID NO: 905984 - protein, 11 aa, Mycobacterium
HDPAGDQPAAI

SEQ ID NO: 905985 - protein, 7 aa, Mycobacterium
HDPDAGD

SEQ ID NO: 905986 - protein, 8 aa, Mycobacterium
HDPEAQAE

SEQ ID NO: 905987 - protein, 8 aa, Mycobacterium
HDPGDPNA

SEQ ID NO: 905988 - protein, 12 aa, Mycobacterium
HDPISGSEGVSA

SEQ ID NO: 905989 - protein, 14 aa, Mycobacterium
HDPRDSTSVDEPVP

SEQ ID NO: 905990 - protein, 10 aa, Mycobacterium
HDPTAPPPGR

SEQ ID NO: 905991 - protein, 12 aa, Mycobacterium
HDPTDPAEVADR

SEQ ID NO: 905992 - protein, 8 aa, Mycobacterium
HDQPEKAF

SEQ ID NO: 905993 - protein, 8 aa, Mycobacterium
HDRGNPGL

SEQ ID NO: 905994 - protein, 5 aa, Mycobacterium
HDRIS

SEQ ID NO: 905995 - protein, 8 aa, Mycobacterium
HDRPLPDD

SEQ ID NO: 905996 - protein, 10 aa, Mycobacterium
HDRYGGTRLG

SEQ ID NO: 905997 - protein, 8 aa, Mycobacterium
HDSDDSSF

SEQ ID NO: 905998 - protein, 7 aa, Mycobacterium
HDSGAER

SEQ ID NO: 905999 - protein, 7 aa, Mycobacterium
HDSHREA

SEQ ID NO: 906000 - protein, 6 aa, Mycobacterium
HDSPRR

SEQ ID NO: 906001 - protein, 7 aa, Mycobacterium
HDTDPGD

SEQ ID NO: 906002 - protein, 7 aa, Mycobacterium
HDYEPEE

SEQ ID NO: 906003 - protein, 16 aa, Mycobacterium
HEADPEAKVTTNEAYI

SEQ ID NO: 906004 - protein, 7 aa, Mycobacterium
HEEARRS

SEQ ID NO: 906005 - protein, 5 aa, Mycobacterium
HEGAG

SEQ ID NO: 906006 - protein, 6 aa, Mycobacterium
HEGEDK

SEQ ID NO: 906007 - protein, 11 aa, Mycobacterium
HEGESEETEPL

SEQ ID NO: 906008 - protein, 6 aa, Mycobacterium
HEGPRM

SEQ ID NO: 906009 - protein, 7 aa, Mycobacterium
HEGPRMS

SEQ ID NO: 906010 - protein, 18 aa, Mycobacterium
HEHAQKTLDAAKAELPEG

SEQ ID NO: 906011 - protein, 5 aa, Mycobacterium
HEIPP

SEQ ID NO: 906012 - protein, 7 aa, Mycobacterium
HEIPPGA

SEQ ID NO: 906013 - protein, 5 aa, Mycobacterium
HEPAA

SEQ ID NO: 906014 - protein, 13 aa, Mycobacterium
HERATGEPQGRPR

SEQ ID NO: 906015 - protein, 4 aa, Mycobacterium
HERD

SEQ ID NO: 906016 - protein, 9 aa, Mycobacterium
HERKHGEPL

SEQ ID NO: 906017 - protein, 13 aa, Mycobacterium
HERTGHTAGNGSL

SEQ ID NO: 906018 - protein, 8 aa, Mycobacterium
HESDKTLP

SEQ ID NO: 906019 - protein, 7 aa, Mycobacterium
HESGRCT

SEQ ID NO: 906020 - protein, 9 aa, Mycobacterium
HESGRSAND

SEQ ID NO: 906021 - protein, 4 aa, Mycobacterium
HESL

SEQ ID NO: 906022 - protein, 8 aa, Mycobacterium
HETDKTIQ

SEQ ID NO: 906023 - protein, 8 aa, Mycobacterium
HETDRTAT

SEQ ID NO: 906024 - protein, 12 aa, Mycobacterium
HEVSNQGSEEAE

SEQ ID NO: 906025 - protein, 4 aa, Mycobacterium
HEVT

SEQ ID NO: 906026 - protein, 19 aa, Mycobacterium
HFSDPLNGQPDQRTATGGC

SEQ ID NO: 906027 - protein, 8 aa, Mycobacterium
HFTNTAKS

SEQ ID NO: 906028 - protein, 24 aa, Mycobacterium
HGAAPTTTSTTPTPAPVTTTSATP

SEQ ID NO: 906029 - protein, 6 aa, Mycobacterium
HGAGEV

SEQ ID NO: 906030 - protein, 37 aa, Mycobacterium
HGAPGGETASSSARPAGIPAGAAPPGAVGRSPAGVTT

SEQ ID NO: 906031 - protein, 8 aa, Mycobacterium
HGARGNSG

SEQ ID NO: 906032 - protein, 9 aa, Mycobacterium
HGASPSMTA

SEQ ID NO: 906033 - protein, 7 aa, Mycobacterium
HGAYGSS

SEQ ID NO: 906034 - protein, 10 aa, Mycobacterium
HGDALKADGL

SEQ ID NO: 906035 - protein, 9 aa, Mycobacterium
HGDPAADSL

SEQ ID NO: 906036 - protein, 7 aa, Mycobacterium
HGDPGPF

SEQ ID NO: 906037 - protein, 9 aa, Mycobacterium
HGDPGPNVD

SEQ ID NO: 906038 - protein, 9 aa, Mycobacterium
HGDPGSPNI

SEQ ID NO: 906039 - protein, 6 aa, Mycobacterium
HGDRGD

SEQ ID NO: 906040 - protein, 13 aa, Mycobacterium
HGDSRQVRTDPNA

SEQ ID NO: 906041 - protein, 18 aa, Mycobacterium
HGEIKGDTVTGTASAAQE

SEQ ID NO: 906042 - protein, 20 aa, Mycobacterium
HGEITGNTIAGTAASSQETF

SEQ ID NO: 906043 - protein, 7 aa, Mycobacterium
HGEPETC

SEQ ID NO: 906044 - protein, 7 aa, Mycobacterium
HGETAPA

SEQ ID NO: 906045 - protein, 19 aa, Mycobacterium
HGEYAGSHGLRGKGATAYE

SEQ ID NO: 906046 - protein, 5 aa, Mycobacterium
HGFGD

SEQ ID NO: 906047 - protein, 26 aa, Mycobacterium
HGGAGGTGGAATGVGATAGAAGSGGL

SEQ ID NO: 906048 - protein, 6 aa, Mycobacterium
HGGATT

SEQ ID NO: 906049 - protein, 33 aa, Mycobacterium
HGGDGGAGGDAGHGGTGGDGGDGGLSGAGGRGG

SEQ ID NO: 906050 - protein, 30 aa, Mycobacterium
HGGDGGSGGAASGAGGIGGAGGNGGSGTTP

SEQ ID NO: 906051 - protein, 11 aa, Mycobacterium
HGGDRPIELPP

SEQ ID NO: 906052 - protein, 231 aa, Mycobacterium
HGGGGGNGGNGGVGGTATAGGDAGSGGTGGVGGDGSVGGDASDAVAGGDGGTGGRGGSGGAGGIATGGGSAGHGGVGGGGGNGGHGTDGTAGVAGHGGGAGGAGGDAGDGGKGGDALDGGTAGAGGAGGKAGNGGGAGSGGKGTFDGGAGGAGGDGGKAGNGGAGGIDSNGQVADGGDGGDGGNGGDGGNGGDGSPVGAGGTGGIGTAGGAGGGGGAVSGRPGQNGSEGQP

SEQ ID NO: 906053 - protein, 6 aa, Mycobacterium
HGGNGV

SEQ ID NO: 906054 - protein, 4 aa, Mycobacterium
HGGP

SEQ ID NO: 906055 - protein, 8 aa, Mycobacterium
HGGPAGDR

SEQ ID NO: 906056 - protein, 8 aa, Mycobacterium
HGGPEAEN

SEQ ID NO: 906057 - protein, 18 aa, Mycobacterium
HGGPSDVVGGGGPTGAHT

SEQ ID NO: 906058 - protein, 5 aa, Mycobacterium
HGGQT

SEQ ID NO: 906059 - protein, 10 aa, Mycobacterium
HGGSPGAAAA

SEQ ID NO: 906060 - protein, 11 aa, Mycobacterium
HGGTEGVPTAE

SEQ ID NO: 906061 - protein, 28 aa, Mycobacterium
HGGTRTGSSSTTTSAGASPSATSSTPMA

SEQ ID NO: 906062 - protein, 15 aa, Mycobacterium
HGGVGSPATASREQQ

SEQ ID NO: 906063 - protein, 6 aa, Mycobacterium
HGHSSQ

SEQ ID NO: 906064 - protein, 10 aa, Mycobacterium
HGHYTNATDA

SEQ ID NO: 906065 - protein, 10 aa, Mycobacterium
HGKSTAGERV

SEQ ID NO: 906066 - protein, 20 aa, Mycobacterium
HGLGGTTSTSATFETHSPEN

SEQ ID NO: 906067 - protein, 12 aa, Mycobacterium
HGMGRANQAVTG

SEQ ID NO: 906068 - protein, 5 aa, Mycobacterium
HGMNA

SEQ ID NO: 906069 - protein, 4 aa, Mycobacterium
HGNA

SEQ ID NO: 906070 - protein, 9 aa, Mycobacterium
HGNATTIGA

SEQ ID NO: 906071 - protein, 6 aa, Mycobacterium
HGNEAI

SEQ ID NO: 906072 - protein, 5 aa, Mycobacterium
HGNNA

SEQ ID NO: 906073 - protein, 10 aa, Mycobacterium
HGNSKISSIQ

SEQ ID NO: 906074 - protein, 5 aa, Mycobacterium
HGPDG

SEQ ID NO: 906075 - protein, 12 aa, Mycobacterium
HGPDGELTGEVR

SEQ ID NO: 906076 - protein, 6 aa, Mycobacterium
HGPEGQ

SEQ ID NO: 906077 - protein, 17 aa, Mycobacterium
HGPGSPEGEAANASLPK

SEQ ID NO: 906078 - protein, 7 aa, Mycobacterium
HGQPRTN

SEQ ID NO: 906079 - protein, 12 aa, Mycobacterium
HGQTDGETRPPE

SEQ ID NO: 906080 - protein, 13 aa, Mycobacterium
HGRELSDEWSQGA

SEQ ID NO: 906081 - protein, 6 aa, Mycobacterium
HGRGGF

SEQ ID NO: 906082 - protein, 8 aa, Mycobacterium
HGRGRPAK

SEQ ID NO: 906083 - protein, 22 aa, Mycobacterium
HGRGTDSDGSPRYGKPVKVLRR

SEQ ID NO: 906084 - protein, 6 aa, Mycobacterium
HGRSLT

SEQ ID NO: 906085 - protein, 5 aa, Mycobacterium
HGRTP

SEQ ID NO: 906086 - protein, 5 aa, Mycobacterium
HGSAF

SEQ ID NO: 906087 - protein, 7 aa, Mycobacterium
HGSEGPI

SEQ ID NO: 906088 - protein, 7 aa, Mycobacterium
HGSPEGI

SEQ ID NO: 906089 - protein, 12 aa, Mycobacterium
HGSYADDDIAAP

SEQ ID NO: 906090 - protein, 6 aa, Mycobacterium
HGTADP

SEQ ID NO: 906091 - protein, 12 aa, Mycobacterium
HGTDDASGNLQA

SEQ ID NO: 906092 - protein, 7 aa, Mycobacterium
HGTEEQR

SEQ ID NO: 906093 - protein, 9 aa, Mycobacterium
HGTSSQIGA

SEQ ID NO: 906094 - protein, 8 aa, Mycobacterium
HGTTGLDD

SEQ ID NO: 906095 - protein, 8 aa, Mycobacterium
HGTVTGAA

SEQ ID NO: 906096 - protein, 16 aa, Mycobacterium
HGVSGGAEIRGSDAPR

SEQ ID NO: 906097 - protein, 16 aa, Mycobacterium
HGVSGGDEIRRSDSPR

SEQ ID NO: 906098 - protein, 33 aa, Mycobacterium
HGYTAGQVRDRQAGDPSTSTIKYGTGTQTDAQN

SEQ ID NO: 906099 - protein, 7 aa, Mycobacterium
HHDSSRK

SEQ ID NO: 906100 - protein, 23 aa, Mycobacterium
HHEEQAAAEPAPAPEPPAEGDEQ

SEQ ID NO: 906101 - protein, 6 aa, Mycobacterium
HHGPGV

SEQ ID NO: 906102 - protein, 11 aa, Mycobacterium
HHGTDDGHLPA

SEQ ID NO: 906103 - protein, 5 aa, Mycobacterium
HHPDE

SEQ ID NO: 906104 - protein, 4 aa, Mycobacterium
HHPG

SEQ ID NO: 906105 - protein, 57 aa, Mycobacterium
HHTDTAASKPDNTTHRTKGASTSAEHSSSGESSRAGQSSAGSAHERTARHSKAARSS

SEQ ID NO: 906106 - protein, 6 aa, Mycobacterium
HIDGAP

SEQ ID NO: 906107 - protein, 17 aa, Mycobacterium
HIDTTGAALADSSGLSV

SEQ ID NO: 906108 - protein, 16 aa, Mycobacterium
HIGGNAYSEAEPQTGI

SEQ ID NO: 906109 - protein, 15 aa, Mycobacterium
HIGGNAYSEPEPQTG

SEQ ID NO: 906110 - protein, 5 aa, Mycobacterium
HIPGN

SEQ ID NO: 906111 - protein, 8 aa, Mycobacterium
HIPSSDTA

SEQ ID NO: 906112 - protein, 5 aa, Mycobacterium
HITET

SEQ ID NO: 906113 - protein, 5 aa, Mycobacterium
HKDDI

SEQ ID NO: 906114 - protein, 8 aa, Mycobacterium
HKLSPGGD

SEQ ID NO: 906115 - protein, 6 aa, Mycobacterium
HKPAAS

SEQ ID NO: 906116 - protein, 28 aa, Mycobacterium
HKPAPPSPPTTSTSAPSAAPPAPPAPAP

SEQ ID NO: 906117 - protein, 5 aa, Mycobacterium
HKPGA

SEQ ID NO: 906118 - protein, 6 aa, Mycobacterium
HKPGAL

SEQ ID NO: 906119 - protein, 6 aa, Mycobacterium
HKPGAS

SEQ ID NO: 906120 - protein, 7 aa, Mycobacterium
HKQESVN

SEQ ID NO: 906121 - protein, 6 aa, Mycobacterium
HKRPRE

SEQ ID NO: 906122 - protein, 35 aa, Mycobacterium
HKSATSTSQTSGASGSSATTSASGSSGAPSPEAQQ

SEQ ID NO: 906123 - protein, 7 aa, Mycobacterium
HKTVQGA

SEQ ID NO: 906124 - protein, 15 aa, Mycobacterium
HKVAPNASEVQSMST

SEQ ID NO: 906125 - protein, 18 aa, Mycobacterium
HKVAPTASELQSTATPEL

SEQ ID NO: 906126 - protein, 9 aa, Mycobacterium
HLAATAGSA

SEQ ID NO: 906127 - protein, 7 aa, Mycobacterium
HLDTTRA

SEQ ID NO: 906128 - protein, 4 aa, Mycobacterium
HLPQ

SEQ ID NO: 906129 - protein, 12 aa, Mycobacterium
HLTDEGYPEVGD

SEQ ID NO: 906130 - protein, 8 aa, Mycobacterium
HLTGSGET

SEQ ID NO: 906131 - protein, 9 aa, Mycobacterium
HMGPGGSMG

SEQ ID NO: 906132 - protein, 14 aa, Mycobacterium
HMQPGNPASSNEQL

SEQ ID NO: 906133 - protein, 9 aa, Mycobacterium
HMTGTTPGY

SEQ ID NO: 906134 - protein, 8 aa, Mycobacterium
HNAANPGC

SEQ ID NO: 906135 - protein, 28 aa, Mycobacterium
HNAATSAAQALSTTSAVSGVAPSAPGPT

SEQ ID NO: 906136 - protein, 5 aa, Mycobacterium
HNAEA

SEQ ID NO: 906137 - protein, 17 aa, Mycobacterium
HNAEPARQFSPDAETTT

SEQ ID NO: 906138 - protein, 4 aa, Mycobacterium
HNAQ

SEQ ID NO: 906139 - protein, 8 aa, Mycobacterium
HNATKDKG

SEQ ID NO: 906140 - protein, 36 aa, Mycobacterium
HNAVNDASINQQVPNGRGGTKPCQTSGAAAGDGYPE

SEQ ID NO: 906141 - protein, 8 aa, Mycobacterium
HNDADRVH

SEQ ID NO: 906142 - protein, 8 aa, Mycobacterium
HNDAVDPI

SEQ ID NO: 906143 - protein, 26 aa, Mycobacterium
HNDGGGTASSSTTATTASPKGPLTKD

SEQ ID NO: 906144 - protein, 8 aa, Mycobacterium
HNEANPGC

SEQ ID NO: 906145 - protein, 11 aa, Mycobacterium
HNNASGANGIS

SEQ ID NO: 906146 - protein, 9 aa, Mycobacterium
HNNGSTEAR

SEQ ID NO: 906147 - protein, 7 aa, Mycobacterium
HNPTPPV

SEQ ID NO: 906148 - protein, 6 aa, Mycobacterium
HNQEQP

SEQ ID NO: 906149 - protein, 13 aa, Mycobacterium
HNRADAASVESAG

SEQ ID NO: 906150 - protein, 14 aa, Mycobacterium
HNRAGHKRTGPRDS

SEQ ID NO: 906151 - protein, 4 aa, Mycobacterium
HNSD

SEQ ID NO: 906152 - protein, 7 aa, Mycobacterium
HNSEAGI

SEQ ID NO: 906153 - protein, 7 aa, Mycobacterium
HNSGGAM

SEQ ID NO: 906154 - protein, 10 aa, Mycobacterium
HNTRGRPTLG

SEQ ID NO: 906155 - protein, 6 aa, Mycobacterium
HPAATR

SEQ ID NO: 906156 - protein, 22 aa, Mycobacterium
HPADPGRYHTAARDGVATPLGS

SEQ ID NO: 906157 - protein, 13 aa, Mycobacterium
HPAKTKDGRGLSH

SEQ ID NO: 906158 - protein, 8 aa, Mycobacterium
HPAMPNAG

SEQ ID NO: 906159 - protein, 5 aa, Mycobacterium
HPDDR

SEQ ID NO: 906160 - protein, 6 aa, Mycobacterium
HPDKTA

SEQ ID NO: 906161 - protein, 4 aa, Mycobacterium
HPDR

SEQ ID NO: 906162 - protein, 9 aa, Mycobacterium
HPDRPLTGT

SEQ ID NO: 906163 - protein, 16 aa, Mycobacterium
HPDRTGPSDEGQSIAA

SEQ ID NO: 906164 - protein, 5 aa, Mycobacterium
HPDVP

SEQ ID NO: 906165 - protein, 7 aa, Mycobacterium
HPEADRA

SEQ ID NO: 906166 - protein, 9 aa, Mycobacterium
HPEDARLGP

SEQ ID NO: 906167 - protein, 11 aa, Mycobacterium
HPEDPDSTQLT

SEQ ID NO: 906168 - protein, 5 aa, Mycobacterium
HPEGG

SEQ ID NO: 906169 - protein, 9 aa, Mycobacterium
HPEGLGPNL

SEQ ID NO: 906170 - protein, 6 aa, Mycobacterium
HPEGTR

SEQ ID NO: 906171 - protein, 6 aa, Mycobacterium
HPEGTT

SEQ ID NO: 906172 - protein, 8 aa, Mycobacterium
HPESGGAI

SEQ ID NO: 906173 - protein, 33 aa, Mycobacterium
HPESPRAPHSVPEAAQATSRAPETASAPAPTEA

SEQ ID NO: 906174 - protein, 6 aa, Mycobacterium
HPETKA

SEQ ID NO: 906175 - protein, 6 aa, Mycobacterium
HPGANQ

SEQ ID NO: 906176 - protein, 5 aa, Mycobacterium
HPGAP

SEQ ID NO: 906177 - protein, 5 aa, Mycobacterium
HPGCP

SEQ ID NO: 906178 - protein, 6 aa, Mycobacterium
HPGCTG

SEQ ID NO: 906179 - protein, 4 aa, Mycobacterium
HPGG

SEQ ID NO: 906180 - protein, 32 aa, Mycobacterium
HPGGPTAPSGWGPWGPPPAWAPPQPPQPAWAP

SEQ ID NO: 906181 - protein, 12 aa, Mycobacterium
HPGGSRTSYEPV

SEQ ID NO: 906182 - protein, 7 aa, Mycobacterium
HPGITSA

SEQ ID NO: 906183 - protein, 5 aa, Mycobacterium
HPGLP

SEQ ID NO: 906184 - protein, 6 aa, Mycobacterium
HPGNPP

SEQ ID NO: 906185 - protein, 7 aa, Mycobacterium
HPGPDPL

SEQ ID NO: 906186 - protein, 10 aa, Mycobacterium
HPGPPGPRRA

SEQ ID NO: 906187 - protein, 4 aa, Mycobacterium
HPGQ

SEQ ID NO: 906188 - protein, 8 aa, Mycobacterium
HPGQSSGV

SEQ ID NO: 906189 - protein, 20 aa, Mycobacterium
HPGSEEPLYRGPKVSADEVA

SEQ ID NO: 906190 - protein, 5 aa, Mycobacterium
HPGTQ

SEQ ID NO: 906191 - protein, 6 aa, Mycobacterium
HPHDES

SEQ ID NO: 906192 - protein, 18 aa, Mycobacterium
HPHQSPSRRAELTGDQDP

SEQ ID NO: 906193 - protein, 9 aa, Mycobacterium
HPIGNGPYQ

SEQ ID NO: 906194 - protein, 5 aa, Mycobacterium
HPIGT

SEQ ID NO: 906195 - protein, 5 aa, Mycobacterium
HPKVP

SEQ ID NO: 906196 - protein, 4 aa, Mycobacterium
HPMT

SEQ ID NO: 906197 - protein, 15 aa, Mycobacterium
HPMTGTAYSGWSAGD

SEQ ID NO: 906198 - protein, 5 aa, Mycobacterium
HPNAP

SEQ ID NO: 906199 - protein, 15 aa, Mycobacterium
HPPASVTSETPERTD

SEQ ID NO: 906200 - protein, 9 aa, Mycobacterium
HPPGQPETA

SEQ ID NO: 906201 - protein, 18 aa, Mycobacterium
HPPLPGDARTAGTTGTAV

SEQ ID NO: 906202 - protein, 18 aa, Mycobacterium
HPPLPGDPGTAGTAGTAV

SEQ ID NO: 906203 - protein, 4 aa, Mycobacterium
HPPP

SEQ ID NO: 906204 - protein, 21 aa, Mycobacterium
HPPQQSSAPTGPDGKGTKADA

SEQ ID NO: 906205 - protein, 6 aa, Mycobacterium
HPQPGE

SEQ ID NO: 906206 - protein, 8 aa, Mycobacterium
HPQPGSDL

SEQ ID NO: 906207 - protein, 7 aa, Mycobacterium
HPQQDRE

SEQ ID NO: 906208 - protein, 4 aa, Mycobacterium
HPQR

SEQ ID NO: 906209 - protein, 5 aa, Mycobacterium
HPRAG

SEQ ID NO: 906210 - protein, 4 aa, Mycobacterium
HPRH

SEQ ID NO: 906211 - protein, 9 aa, Mycobacterium
HPRNAPADR

SEQ ID NO: 906212 - protein, 11 aa, Mycobacterium
HPRPASGPSHR

SEQ ID NO: 906213 - protein, 6 aa, Mycobacterium
HPSLGT

SEQ ID NO: 906214 - protein, 4 aa, Mycobacterium
HPST

SEQ ID NO: 906215 - protein, 4 aa, Mycobacterium
HPVD

SEQ ID NO: 906216 - protein, 4 aa, Mycobacterium
HPVG

SEQ ID NO: 906217 - protein, 6 aa, Mycobacterium
HPVGTG

SEQ ID NO: 906218 - protein, 10 aa, Mycobacterium
HPVSAGELAQ

SEQ ID NO: 906219 - protein, 9 aa, Mycobacterium
HQAESESGV

SEQ ID NO: 906220 - protein, 4 aa, Mycobacterium
HQAT

SEQ ID NO: 906221 - protein, 11 aa, Mycobacterium
HQDSHGGGGLI

SEQ ID NO: 906222 - protein, 8 aa, Mycobacterium
HQEERPEI

SEQ ID NO: 906223 - protein, 10 aa, Mycobacterium
HQFPPTGGLG

SEQ ID NO: 906224 - protein, 19 aa, Mycobacterium
HQGDQARCENNPGARTGEG

SEQ ID NO: 906225 - protein, 15 aa, Mycobacterium
HQGGSSRDNSGEDKT

SEQ ID NO: 906226 - protein, 6 aa, Mycobacterium
HQGVRS

SEQ ID NO: 906227 - protein, 14 aa, Mycobacterium
HQLASTTGGGQADT

SEQ ID NO: 906228 - protein, 16 aa, Mycobacterium
HQNGDHPINGSAEVQR

SEQ ID NO: 906229 - protein, 25 aa, Mycobacterium
HQPAPKPPAVPAKSPPSNTAAVNPA

SEQ ID NO: 906230 - protein, 5 aa, Mycobacterium
HQPAS

SEQ ID NO: 906231 - protein, 10 aa, Mycobacterium
HQPDPQNPDG

SEQ ID NO: 906232 - protein, 8 aa, Mycobacterium
HQPGTSRD

SEQ ID NO: 906233 - protein, 12 aa, Mycobacterium
HQPQRAAAMPAS

SEQ ID NO: 906234 - protein, 9 aa, Mycobacterium
HQPTYGGAN

SEQ ID NO: 906235 - protein, 10 aa, Mycobacterium
HQRLSDADGA

SEQ ID NO: 906236 - protein, 9 aa, Mycobacterium
HQRSPGSSV

SEQ ID NO: 906237 - protein, 23 aa, Mycobacterium
HQRYRTSGVPRAADLRTAVEPLL

SEQ ID NO: 906238 - protein, 6 aa, Mycobacterium
HQSGAI

SEQ ID NO: 906239 - protein, 6 aa, Mycobacterium
HQSSLN

SEQ ID NO: 906240 - protein, 20 aa, Mycobacterium
HQSTTAKPSTTTSTPPSGAD

SEQ ID NO: 906241 - protein, 8 aa, Mycobacterium
HQTGHNSN

SEQ ID NO: 906242 - protein, 6 aa, Mycobacterium
HQTSPR

SEQ ID NO: 906243 - protein, 10 aa, Mycobacterium
HQVAPTASEL

SEQ ID NO: 906244 - protein, 11 aa, Mycobacterium
HQWPGSRSKPV

SEQ ID NO: 906245 - protein, 7 aa, Mycobacterium
HRDDTAT

SEQ ID NO: 906246 - protein, 5 aa, Mycobacterium
HRDHR

SEQ ID NO: 906247 - protein, 5 aa, Mycobacterium
HRDPQ

SEQ ID NO: 906248 - protein, 4 aa, Mycobacterium
HREH

SEQ ID NO: 906249 - protein, 12 aa, Mycobacterium
HREHADPATVRS

SEQ ID NO: 906250 - protein, 6 aa, Mycobacterium
HREQAA

SEQ ID NO: 906251 - protein, 10 aa, Mycobacterium
HRESRNPPAV

SEQ ID NO: 906252 - protein, 8 aa, Mycobacterium
HRGADGRV

SEQ ID NO: 906253 - protein, 12 aa, Mycobacterium
HRGAPPPAGFAE

SEQ ID NO: 906254 - protein, 19 aa, Mycobacterium
HRGDQARCENNPGARTGEG

SEQ ID NO: 906255 - protein, 11 aa, Mycobacterium
HRGDTEPQDPV

SEQ ID NO: 906256 - protein, 13 aa, Mycobacterium
HRGGRGETTEESL

SEQ ID NO: 906257 - protein, 10 aa, Mycobacterium
HRKSSTLEGL

SEQ ID NO: 906258 - protein, 13 aa, Mycobacterium
HRLGTSPEKDVGF

SEQ ID NO: 906259 - protein, 6 aa, Mycobacterium
HRNAAR

SEQ ID NO: 906260 - protein, 21 aa, Mycobacterium
HRPAPVEDRRSLPPRTTEQSQ

SEQ ID NO: 906261 - protein, 5 aa, Mycobacterium
HRPET

SEQ ID NO: 906262 - protein, 8 aa, Mycobacterium
HRPNRTDP

SEQ ID NO: 906263 - protein, 11 aa, Mycobacterium
HRPPRNPADRH

SEQ ID NO: 906264 - protein, 14 aa, Mycobacterium
HRPSRAEPYSTRTV

SEQ ID NO: 906265 - protein, 9 aa, Mycobacterium
HRPSRTEPY

SEQ ID NO: 906266 - protein, 9 aa, Mycobacterium
HRQAQGDDI

SEQ ID NO: 906267 - protein, 11 aa, Mycobacterium
HRQLADDSSAV

SEQ ID NO: 906268 - protein, 15 aa, Mycobacterium
HRRRRGSAGGRPPAF

SEQ ID NO: 906269 - protein, 22 aa, Mycobacterium
HRSPSPQPPPEGPPPGPGPQPG

SEQ ID NO: 906270 - protein, 8 aa, Mycobacterium
HRSQAAAD

SEQ ID NO: 906271 - protein, 8 aa, Mycobacterium
HRSSPKGL

SEQ ID NO: 906272 - protein, 8 aa, Mycobacterium
HRSTEPGH

SEQ ID NO: 906273 - protein, 11 aa, Mycobacterium
HRTGAQPPEGC

SEQ ID NO: 906274 - protein, 9 aa, Mycobacterium
HRTGASDHS

SEQ ID NO: 906275 - protein, 19 aa, Mycobacterium
HRTGRQHHRRTPTGPHTYT

SEQ ID NO: 906276 - protein, 6 aa, Mycobacterium
HRTPIR

SEQ ID NO: 906277 - protein, 5 aa, Mycobacterium
HRTQL

SEQ ID NO: 906278 - protein, 7 aa, Mycobacterium
HRTVTTQ

SEQ ID NO: 906279 - protein, 15 aa, Mycobacterium
HRVAPNASETQSMST

SEQ ID NO: 906280 - protein, 9 aa, Mycobacterium
HRVEDSTGV

SEQ ID NO: 906281 - protein, 8 aa, Mycobacterium
HSAASALP

SEQ ID NO: 906282 - protein, 10 aa, Mycobacterium
HSADAASATV

SEQ ID NO: 906283 - protein, 15 aa, Mycobacterium
HSAHRSAASAPTQRT

SEQ ID NO: 906284 - protein, 5 aa, Mycobacterium
HSAQR

SEQ ID NO: 906285 - protein, 9 aa, Mycobacterium
HSDHPLATS

SEQ ID NO: 906286 - protein, 10 aa, Mycobacterium
HSDKSSPVAM

SEQ ID NO: 906287 - protein, 5 aa, Mycobacterium
HSEDI

SEQ ID NO: 906288 - protein, 4 aa, Mycobacterium
HSES

SEQ ID NO: 906289 - protein, 8 aa, Mycobacterium
HSGAQGLG

SEQ ID NO: 906290 - protein, 18 aa, Mycobacterium
HSGIDQEPLGVGSPAVAP

SEQ ID NO: 906291 - protein, 12 aa, Mycobacterium
HSGNGNNLPRYA

SEQ ID NO: 906292 - protein, 15 aa, Mycobacterium
HSGNGNNLSGYANPQ

SEQ ID NO: 906293 - protein, 18 aa, Mycobacterium
HSGNGNNLSGYANPQIDS

SEQ ID NO: 906294 - protein, 13 aa, Mycobacterium
HSGPGNDWNGHTD

SEQ ID NO: 906295 - protein, 19 aa, Mycobacterium
HSGYQSRCERDPRARTSEG

SEQ ID NO: 906296 - protein, 27 aa, Mycobacterium
HSHVGSDGSSPQARMTDAGYRGDASTG

SEQ ID NO: 906297 - protein, 8 aa, Mycobacterium
HSKATREL

SEQ ID NO: 906298 - protein, 5 aa, Mycobacterium
HSKGG

SEQ ID NO: 906299 - protein, 29 aa, Mycobacterium
HSKKRSGLRAQSGRLRDSGDAVSSPRWEP

SEQ ID NO: 906300 - protein, 10 aa, Mycobacterium
HSKSTAGERV

SEQ ID NO: 906301 - protein, 9 aa, Mycobacterium
HSLPGTSTY

SEQ ID NO: 906302 - protein, 5 aa, Mycobacterium
HSNAL

SEQ ID NO: 906303 - protein, 16 aa, Mycobacterium
HSNGTSNAQKFSDPEV

SEQ ID NO: 906304 - protein, 9 aa, Mycobacterium
HSPDKPDCL

SEQ ID NO: 906305 - protein, 6 aa, Mycobacterium
HSPGTY

SEQ ID NO: 906306 - protein, 4 aa, Mycobacterium
HSPI

SEQ ID NO: 906307 - protein, 7 aa, Mycobacterium
HSPNLTA

SEQ ID NO: 906308 - protein, 4 aa, Mycobacterium
HSPS

SEQ ID NO: 906309 - protein, 5 aa, Mycobacterium
HSPSD

SEQ ID NO: 906310 - protein, 4 aa, Mycobacterium
HSPV

SEQ ID NO: 906311 - protein, 6 aa, Mycobacterium
HSPVTA

SEQ ID NO: 906312 - protein, 8 aa, Mycobacterium
HSQDPASG

SEQ ID NO: 906313 - protein, 9 aa, Mycobacterium
HSQRAPGNT

SEQ ID NO: 906314 - protein, 6 aa, Mycobacterium
HSQSHY

SEQ ID NO: 906315 - protein, 8 aa, Mycobacterium
HSQSHYAA

SEQ ID NO: 906316 - protein, 6 aa, Mycobacterium
HSRTDG

SEQ ID NO: 906317 - protein, 7 aa, Mycobacterium
HSSASGS

SEQ ID NO: 906318 - protein, 16 aa, Mycobacterium
HSSHDDAERIWHKYPG

SEQ ID NO: 906319 - protein, 6 aa, Mycobacterium
HSSNGV

SEQ ID NO: 906320 - protein, 8 aa, Mycobacterium
HSSQPAVS

SEQ ID NO: 906321 - protein, 4 aa, Mycobacterium
HSTG

SEQ ID NO: 906322 - protein, 5 aa, Mycobacterium
HSTGL

SEQ ID NO: 906323 - protein, 8 aa, Mycobacterium
HSTGNGGL

SEQ ID NO: 906324 - protein, 13 aa, Mycobacterium
HSTITGSATTGGF

SEQ ID NO: 906325 - protein, 15 aa, Mycobacterium
HSTQRQSTRLPAYTA

SEQ ID NO: 906326 - protein, 6 aa, Mycobacterium
HSTTAG

SEQ ID NO: 906327 - protein, 7 aa, Mycobacterium
HSTVEGA

SEQ ID NO: 906328 - protein, 7 aa, Mycobacterium
HTAATRA

SEQ ID NO: 906329 - protein, 13 aa, Mycobacterium
HTADASTAGAALA

SEQ ID NO: 906330 - protein, 5 aa, Mycobacterium
HTAYN

SEQ ID NO: 906331 - protein, 8 aa, Mycobacterium
HTDGDSEA

SEQ ID NO: 906332 - protein, 15 aa, Mycobacterium
HTDGTSNAQKFSNPE

SEQ ID NO: 906333 - protein, 4 aa, Mycobacterium
HTDP

SEQ ID NO: 906334 - protein, 8 aa, Mycobacterium
HTDPNDGR

SEQ ID NO: 906335 - protein, 7 aa, Mycobacterium
HTDSPNL

SEQ ID NO: 906336 - protein, 8 aa, Mycobacterium
HTDSPNLR

SEQ ID NO: 906337 - protein, 5 aa, Mycobacterium
HTEPD

SEQ ID NO: 906338 - protein, 12 aa, Mycobacterium
HTERDGLAGHEV

SEQ ID NO: 906339 - protein, 6 aa, Mycobacterium
HTETTT

SEQ ID NO: 906340 - protein, 7 aa, Mycobacterium
HTETTTL

SEQ ID NO: 906341 - protein, 19 aa, Mycobacterium
HTGDQARCEHNAGARTNEG

SEQ ID NO: 906342 - protein, 19 aa, Mycobacterium
HTGDQARCERNPGARTSEG

SEQ ID NO: 906343 - protein, 8 aa, Mycobacterium
HTGGLNPA

SEQ ID NO: 906344 - protein, 8 aa, Mycobacterium
HTGGSGSA

SEQ ID NO: 906345 - protein, 10 aa, Mycobacterium
HTGPRPGGQA

SEQ ID NO: 906346 - protein, 5 aa, Mycobacterium
HTGSF

SEQ ID NO: 906347 - protein, 7 aa, Mycobacterium
HTLPGSG

SEQ ID NO: 906348 - protein, 17 aa, Mycobacterium
HTLSPSAPGGYRPESVA

SEQ ID NO: 906349 - protein, 4 aa, Mycobacterium
HTMP

SEQ ID NO: 906350 - protein, 5 aa, Mycobacterium
HTMPP

SEQ ID NO: 906351 - protein, 4 aa, Mycobacterium
HTMT

SEQ ID NO: 906352 - protein, 5 aa, Mycobacterium
HTNTG

SEQ ID NO: 906353 - protein, 16 aa, Mycobacterium
HTPESARRYLPSDPQT

SEQ ID NO: 906354 - protein, 8 aa, Mycobacterium
HTPGHTRG

SEQ ID NO: 906355 - protein, 6 aa, Mycobacterium
HTPGTY

SEQ ID NO: 906356 - protein, 4 aa, Mycobacterium
HTPP

SEQ ID NO: 906357 - protein, 8 aa, Mycobacterium
HTPQSPVE

SEQ ID NO: 906358 - protein, 22 aa, Mycobacterium
HTRGSQLARAQTAAVKAAGGVP

SEQ ID NO: 906359 - protein, 6 aa, Mycobacterium
HTRPQD

SEQ ID NO: 906360 - protein, 5 aa, Mycobacterium
HTRTS

SEQ ID NO: 906361 - protein, 11 aa, Mycobacterium
HTSPAPDERAV

SEQ ID NO: 906362 - protein, 17 aa, Mycobacterium
HTSPPWTADELHQMISG

SEQ ID NO: 906363 - protein, 32 aa, Mycobacterium
HTSSGGSIYGTPPQYPTSERVPTDPASPYAAG

SEQ ID NO: 906364 - protein, 5 aa, Mycobacterium
HTSSR

SEQ ID NO: 906365 - protein, 6 aa, Mycobacterium
HTSTAT

SEQ ID NO: 906366 - protein, 6 aa, Mycobacterium
HTSTDY

SEQ ID NO: 906367 - protein, 4 aa, Mycobacterium
HTTE

SEQ ID NO: 906368 - protein, 14 aa, Mycobacterium
HTVKGYNRSPHRTA

SEQ ID NO: 906369 - protein, 11 aa, Mycobacterium
HTVSSPESAEM

SEQ ID NO: 906370 - protein, 17 aa, Mycobacterium
HTWRDSGRSNGTSGALG

SEQ ID NO: 906371 - protein, 6 aa, Mycobacterium
HVDTAG

SEQ ID NO: 906372 - protein, 9 aa, Mycobacterium
HVDTDNGSV

SEQ ID NO: 906373 - protein, 5 aa, Mycobacterium
HVETG

SEQ ID NO: 906374 - protein, 8 aa, Mycobacterium
HVNGQSHK

SEQ ID NO: 906375 - protein, 15 aa, Mycobacterium
HVPSAAARSAGLGES

SEQ ID NO: 906376 - protein, 7 aa, Mycobacterium
HVTAGSA

SEQ ID NO: 906377 - protein, 18 aa, Mycobacterium
HYADQKDRIADAGRDPAA

SEQ ID NO: 906378 - protein, 6 aa, Mycobacterium
HYDGSP

SEQ ID NO: 906379 - protein, 7 aa, Mycobacterium
HYPGAEQ

SEQ ID NO: 906380 - protein, 7 aa, Mycobacterium
HYPSPSR

SEQ ID NO: 906381 - protein, 4 aa, Mycobacterium
HYSD

SEQ ID NO: 906382 - protein, 10 aa, Mycobacterium
IAAADANDDA

SEQ ID NO: 906383 - protein, 14 aa, Mycobacterium
IAAAGNAASRHPDA

SEQ ID NO: 906384 - protein, 15 aa, Mycobacterium
IAAAGNAATKHPGAV

SEQ ID NO: 906385 - protein, 14 aa, Mycobacterium
IAAAGNAATRHPEA

SEQ ID NO: 906386 - protein, 14 aa, Mycobacterium
IAAAGNSATKHPDA

SEQ ID NO: 906387 - protein, 8 aa, Mycobacterium
IAADGGCA

SEQ ID NO: 906388 - protein, 5 aa, Mycobacterium
IAAER

SEQ ID NO: 906389 - protein, 16 aa, Mycobacterium
IAAGGGGIHCATQQEP

SEQ ID NO: 906390 - protein, 18 aa, Mycobacterium
IAAGGPLAAAQPPPKFPN

SEQ ID NO: 906391 - protein, 8 aa, Mycobacterium
IAAGTTGL

SEQ ID NO: 906392 - protein, 8 aa, Mycobacterium
IAANPNVR

SEQ ID NO: 906393 - protein, 10 aa, Mycobacterium
IAAPDGSLPG

SEQ ID NO: 906394 - protein, 10 aa, Mycobacterium
IAAPGGQGFG

SEQ ID NO: 906395 - protein, 11 aa, Mycobacterium
IAARAAAANRP

SEQ ID NO: 906396 - protein, 8 aa, Mycobacterium
IAARGGNG

SEQ ID NO: 906397 - protein, 7 aa, Mycobacterium
IAATEAD

SEQ ID NO: 906398 - protein, 7 aa, Mycobacterium
IAATEAE

SEQ ID NO: 906399 - protein, 88 aa, Mycobacterium
IAATPPPKQSPPPPQQPPPPQQPPLPPPPQQPPPPQELAPPGVAPQPGGTAGGGSGGNDGGGSGGNSGGGPAESSPEQPMPPGLIRLA

SEQ ID NO: 906400 - protein, 12 aa, Mycobacterium
IADAGDAKRPPY

SEQ ID NO: 906401 - protein, 11 aa, Mycobacterium
IADDNTKQVSV

SEQ ID NO: 906402 - protein, 18 aa, Mycobacterium
IADGGWAAQTRDNRGPAV

SEQ ID NO: 906403 - protein, 20 aa, Mycobacterium
IADPGASGPTAGLSTKYGRD

SEQ ID NO: 906404 - protein, 12 aa, Mycobacterium
IADPTRNVKGDS

SEQ ID NO: 906405 - protein, 4 aa, Mycobacterium
IADQ

SEQ ID NO: 906406 - protein, 8 aa, Mycobacterium
IADTGSGS

SEQ ID NO: 906407 - protein, 8 aa, Mycobacterium
IAEAEGAA

SEQ ID NO: 906408 - protein, 11 aa, Mycobacterium
IAEPDKDGGAL

SEQ ID NO: 906409 - protein, 11 aa, Mycobacterium
IAGADTSGRSV

SEQ ID NO: 906410 - protein, 11 aa, Mycobacterium
IAGDATAPVKA

SEQ ID NO: 906411 - protein, 12 aa, Mycobacterium
IAGPPAGTDPYR

SEQ ID NO: 906412 - protein, 14 aa, Mycobacterium
IAGPPRNPAQIGQQ

SEQ ID NO: 906413 - protein, 14 aa, Mycobacterium
IAGPPRNSAQIGQP

SEQ ID NO: 906414 - protein, 7 aa, Mycobacterium
IAGPPVP

SEQ ID NO: 906415 - protein, 10 aa, Mycobacterium
IAGPSGAERV

SEQ ID NO: 906416 - protein, 16 aa, Mycobacterium
IAGQKSVDEALEQAQK

SEQ ID NO: 906417 - protein, 14 aa, Mycobacterium
IAGSDSALSGDQVA

SEQ ID NO: 906418 - protein, 7 aa, Mycobacterium
IAGTAGW

SEQ ID NO: 906419 - protein, 11 aa, Mycobacterium
IAGTDTSGRSV

SEQ ID NO: 906420 - protein, 14 aa, Mycobacterium
IAHTPGNRTQGESV

SEQ ID NO: 906421 - protein, 8 aa, Mycobacterium
IAKDDQER

SEQ ID NO: 906422 - protein, 8 aa, Mycobacterium
IAKSPFSE

SEQ ID NO: 906423 - protein, 13 aa, Mycobacterium
IANADPEDATPPI

SEQ ID NO: 906424 - protein, 5 aa, Mycobacterium
IANGG

SEQ ID NO: 906425 - protein, 10 aa, Mycobacterium
IANGNKSIQT

SEQ ID NO: 906426 - protein, 5 aa, Mycobacterium
IANNG

SEQ ID NO: 906427 - protein, 14 aa, Mycobacterium
IANPPLAQDRTSLA

SEQ ID NO: 906428 - protein, 9 aa, Mycobacterium
IANSATNGL

SEQ ID NO: 906429 - protein, 10 aa, Mycobacterium
IANSDNAATE

SEQ ID NO: 906430 - protein, 9 aa, Mycobacterium
IANSGQVDT

SEQ ID NO: 906431 - protein, 6 aa, Mycobacterium
IANTPQ

SEQ ID NO: 906432 - protein, 7 aa, Mycobacterium
IAPADQE

SEQ ID NO: 906433 - protein, 24 aa, Mycobacterium
IAPAPPPPPAGAPPPGGPPPPAGE

SEQ ID NO: 906434 - protein, 7 aa, Mycobacterium
IAPDDPA

SEQ ID NO: 906435 - protein, 6 aa, Mycobacterium
IAPDDQ

SEQ ID NO: 906436 - protein, 6 aa, Mycobacterium
IAPDEA

SEQ ID NO: 906437 - protein, 11 aa, Mycobacterium
IAPDEIKGAGY

SEQ ID NO: 906438 - protein, 7 aa, Mycobacterium
IAPDGPM

SEQ ID NO: 906439 - protein, 6 aa, Mycobacterium
IAPDRP

SEQ ID NO: 906440 - protein, 7 aa, Mycobacterium
IAPEYTG

SEQ ID NO: 906441 - protein, 15 aa, Mycobacterium
IAPGAPGAAVAAAAA

SEQ ID NO: 906442 - protein, 17 aa, Mycobacterium
IAPGASAYDNGHAASDI

SEQ ID NO: 906443 - protein, 10 aa, Mycobacterium
IAPGDSGGPI

SEQ ID NO: 906444 - protein, 8 aa, Mycobacterium
IAPGPGAR

SEQ ID NO: 906445 - protein, 15 aa, Mycobacterium
IAPGTYSSAGPVGNG

SEQ ID NO: 906446 - protein, 15 aa, Mycobacterium
IAPGTYTSAGPVGDG

SEQ ID NO: 906447 - protein, 9 aa, Mycobacterium
IAPNPPDTI

SEQ ID NO: 906448 - protein, 11 aa, Mycobacterium
IAPPAPAFGGA

SEQ ID NO: 906449 - protein, 13 aa, Mycobacterium
IAPPTPPAPQEPQ

SEQ ID NO: 906450 - protein, 10 aa, Mycobacterium
IAPRGGGHSY

SEQ ID NO: 906451 - protein, 12 aa, Mycobacterium
IAPTTAVPDPGR

SEQ ID NO: 906452 - protein, 14 aa, Mycobacterium
IAQDTSFDGRSDYD

SEQ ID NO: 906453 - protein, 8 aa, Mycobacterium
IAQGATNL

SEQ ID NO: 906454 - protein, 5 aa, Mycobacterium
IAQGT

SEQ ID NO: 906455 - protein, 10 aa, Mycobacterium
IARAAAAAAT

SEQ ID NO: 906456 - protein, 11 aa, Mycobacterium
IARESGRGAGE

SEQ ID NO: 906457 - protein, 13 aa, Mycobacterium
IARQPAEGPGELT

SEQ ID NO: 906458 - protein, 8 aa, Mycobacterium
IASAQPDF

SEQ ID NO: 906459 - protein, 4 aa, Mycobacterium
IASG

SEQ ID NO: 906460 - protein, 7 aa, Mycobacterium
IASGSRL

SEQ ID NO: 906461 - protein, 51 aa, Mycobacterium
IASPDTASSTSETSETSDTSGSERVSEKPADPRGEKADETPDETEAPDSVE

SEQ ID NO: 906462 - protein, 7 aa, Mycobacterium
IASSPHE

SEQ ID NO: 906463 - protein, 10 aa, Mycobacterium
IASWTDPKGG

SEQ ID NO: 906464 - protein, 7 aa, Mycobacterium
IATAPQA

SEQ ID NO: 906465 - protein, 9 aa, Mycobacterium
IATERQGKA

SEQ ID NO: 906466 - protein, 9 aa, Mycobacterium
IATERQGKR

SEQ ID NO: 906467 - protein, 12 aa, Mycobacterium
IATRSGDSLDDD

SEQ ID NO: 906468 - protein, 11 aa, Mycobacterium
IATTPGAGDAL

SEQ ID NO: 906469 - protein, 4 aa, Mycobacterium
IAVT

SEQ ID NO: 906470 - protein, 10 aa, Mycobacterium
ICNPADPNTW

SEQ ID NO: 906471 - protein, 11 aa, Mycobacterium
ICNPADPNTWK

SEQ ID NO: 906472 - protein, 10 aa, Mycobacterium
ICSPADPNTW

SEQ ID NO: 906473 - protein, 7 aa, Mycobacterium
IDAGADG

SEQ ID NO: 906474 - protein, 5 aa, Mycobacterium
IDAGT

SEQ ID NO: 906475 - protein, 14 aa, Mycobacterium
IDASSDSAQSNPAL

SEQ ID NO: 906476 - protein, 7 aa, Mycobacterium
IDATAEP

SEQ ID NO: 906477 - protein, 7 aa, Mycobacterium
IDATGIG

SEQ ID NO: 906478 - protein, 5 aa, Mycobacterium
IDDGA

SEQ ID NO: 906479 - protein, 17 aa, Mycobacterium
IDDPDARLGASSIEQSA

SEQ ID NO: 906480 - protein, 4 aa, Mycobacterium
IDDT

SEQ ID NO: 906481 - protein, 11 aa, Mycobacterium
IDEASTATDHV

SEQ ID NO: 906482 - protein, 9 aa, Mycobacterium
IDEEGGRVS

SEQ ID NO: 906483 - protein, 29 aa, Mycobacterium
IDEGGAEVAASTGAAPADPAGDGNATCPP

SEQ ID NO: 906484 - protein, 15 aa, Mycobacterium
IDEGSQQAINSSKAT

SEQ ID NO: 906485 - protein, 6 aa, Mycobacterium
IDEQAQ

SEQ ID NO: 906486 - protein, 10 aa, Mycobacterium
IDETERRRAK

SEQ ID NO: 906487 - protein, 39 aa, Mycobacterium
IDETPSTDGDIDETAVQSTTQRRTVANTAADRTAETAEV

SEQ ID NO: 906488 - protein, 15 aa, Mycobacterium
IDGAAPATPDIPAGQ

SEQ ID NO: 906489 - protein, 14 aa, Mycobacterium
IDGADFAGSSLAGK

SEQ ID NO: 906490 - protein, 5 aa, Mycobacterium
IDGAQ

SEQ ID NO: 906491 - protein, 8 aa, Mycobacterium
IDGGSGDL

SEQ ID NO: 906492 - protein, 14 aa, Mycobacterium
IDGPPRNGGQIGHP

SEQ ID NO: 906493 - protein, 14 aa, Mycobacterium
IDGPPRNSAQIGQP

SEQ ID NO: 906494 - protein, 13 aa, Mycobacterium
IDGSPTSLAVGPD

SEQ ID NO: 906495 - protein, 4 aa, Mycobacterium
IDHD

SEQ ID NO: 906496 - protein, 6 aa, Mycobacterium
IDIPSD

SEQ ID NO: 906497 - protein, 4 aa, Mycobacterium
IDNS

SEQ ID NO: 906498 - protein, 9 aa, Mycobacterium
IDPAGPGGV

SEQ ID NO: 906499 - protein, 5 aa, Mycobacterium
IDPAN

SEQ ID NO: 906500 - protein, 23 aa, Mycobacterium
IDPATTYQATANSTSLTAEQADA

SEQ ID NO: 906501 - protein, 10 aa, Mycobacterium
IDPDGANGGP

SEQ ID NO: 906502 - protein, 7 aa, Mycobacterium
IDPDGDR

SEQ ID NO: 906503 - protein, 7 aa, Mycobacterium
IDPERTA

SEQ ID NO: 906504 - protein, 24 aa, Mycobacterium
IDPERTADELSAEVQKAIDGKGLL

SEQ ID NO: 906505 - protein, 9 aa, Mycobacterium
IDPERTADK

SEQ ID NO: 906506 - protein, 6 aa, Mycobacterium
IDPIPG

SEQ ID NO: 906507 - protein, 8 aa, Mycobacterium
IDPLPNGQ

SEQ ID NO: 906508 - protein, 11 aa, Mycobacterium
IDPMPRSRADL

SEQ ID NO: 906509 - protein, 11 aa, Mycobacterium
IDPNADPLEAD

SEQ ID NO: 906510 - protein, 12 aa, Mycobacterium
IDPNADPVEESI

SEQ ID NO: 906511 - protein, 8 aa, Mycobacterium
IDPPPSIQ

SEQ ID NO: 906512 - protein, 12 aa, Mycobacterium
IDPPPSVQESME

SEQ ID NO: 906513 - protein, 16 aa, Mycobacterium
IDPRDGLREFAFARLR

SEQ ID NO: 906514 - protein, 9 aa, Mycobacterium
IDQGAGTLS

SEQ ID NO: 906515 - protein, 14 aa, Mycobacterium
IDQPALPAAATGAA

SEQ ID NO: 906516 - protein, 30 aa, Mycobacterium
IDRPAKGGSNPKKATTDAKDTKAASDAKDA

SEQ ID NO: 906517 - protein, 4 aa, Mycobacterium
IDRQ

SEQ ID NO: 906518 - protein, 25 aa, Mycobacterium
IDRQKHGSTMPRSTYPTRRRWESTN

SEQ ID NO: 906519 - protein, 5 aa, Mycobacterium
IDRQT

SEQ ID NO: 906520 - protein, 21 aa, Mycobacterium
IDRRAGAPQPVLPRRQPFSAA

SEQ ID NO: 906521 - protein, 23 aa, Mycobacterium
IDRSRGVTATQDSGNTTIRSGEN

SEQ ID NO: 906522 - protein, 4 aa, Mycobacterium
IDSE

SEQ ID NO: 906523 - protein, 9 aa, Mycobacterium
IDSTPDYDA

SEQ ID NO: 906524 - protein, 9 aa, Mycobacterium
IDTAESPVL

SEQ ID NO: 906525 - protein, 12 aa, Mycobacterium
IDTAHGRSSDAA

SEQ ID NO: 906526 - protein, 15 aa, Mycobacterium
IDTEGKFKEAADSYK

SEQ ID NO: 906527 - protein, 10 aa, Mycobacterium
IDTGGAPPDF

SEQ ID NO: 906528 - protein, 7 aa, Mycobacterium
IDTPENK

SEQ ID NO: 906529 - protein, 8 aa, Mycobacterium
IDTPTDMA

SEQ ID NO: 906530 - protein, 39 aa, Mycobacterium
IDTTATSGSTTSMPTKPTALASTPETDRTLAPAKASSSL

SEQ ID NO: 906531 - protein, 6 aa, Mycobacterium
IDTTDN

SEQ ID NO: 906532 - protein, 8 aa, Mycobacterium
IDVGPDGS

SEQ ID NO: 906533 - protein, 13 aa, Mycobacterium
IDYGPGADAAAHS

SEQ ID NO: 906534 - protein, 9 aa, Mycobacterium
IDYSGDQAR

SEQ ID NO: 906535 - protein, 4 aa, Mycobacterium
IEAA

SEQ ID NO: 906536 - protein, 5 aa, Mycobacterium
IEAAD

SEQ ID NO: 906537 - protein, 15 aa, Mycobacterium
IEAAEGAAAATAGLA

SEQ ID NO: 906538 - protein, 11 aa, Mycobacterium
IEAEPSGSHRV

SEQ ID NO: 906539 - protein, 27 aa, Mycobacterium
IEASPQPSGRTPNYYPGGTVAGRPVPA

SEQ ID NO: 906540 - protein, 7 aa, Mycobacterium
IEATEAE

SEQ ID NO: 906541 - protein, 6 aa, Mycobacterium
IEDADD

SEQ ID NO: 906542 - protein, 6 aa, Mycobacterium
IEDDSQ

SEQ ID NO: 906543 - protein, 9 aa, Mycobacterium
IEDGGGTPH

SEQ ID NO: 906544 - protein, 21 aa, Mycobacterium
IEDTALTAESVASSIDEIDDS

SEQ ID NO: 906545 - protein, 15 aa, Mycobacterium
IEGADPAKPTVQPVP

SEQ ID NO: 906546 - protein, 16 aa, Mycobacterium
IEGGHANNALPQRATA

SEQ ID NO: 906547 - protein, 13 aa, Mycobacterium
IEGPDATVHPTSG

SEQ ID NO: 906548 - protein, 9 aa, Mycobacterium
IEGPPGAAL

SEQ ID NO: 906549 - protein, 5 aa, Mycobacterium
IEGPS

SEQ ID NO: 906550 - protein, 13 aa, Mycobacterium
IEGYSQETEEVRE

SEQ ID NO: 906551 - protein, 12 aa, Mycobacterium
IEHDPSGDASVR

SEQ ID NO: 906552 - protein, 13 aa, Mycobacterium
IENKDSDGNPRSD

SEQ ID NO: 906553 - protein, 13 aa, Mycobacterium
IENKGSDGQPRAD

SEQ ID NO: 906554 - protein, 5 aa, Mycobacterium
IEPED

SEQ ID NO: 906555 - protein, 5 aa, Mycobacterium
IEPEE

SEQ ID NO: 906556 - protein, 9 aa, Mycobacterium
IEPEGTQTK

SEQ ID NO: 906557 - protein, 7 aa, Mycobacterium
IEPEPER

SEQ ID NO: 906558 - protein, 4 aa, Mycobacterium
IEPG

SEQ ID NO: 906559 - protein, 17 aa, Mycobacterium
IEPGKPFDTDKLGTQTV

SEQ ID NO: 906560 - protein, 7 aa, Mycobacterium
IEPGQNG

SEQ ID NO: 906561 - protein, 7 aa, Mycobacterium
IEPLPER

SEQ ID NO: 906562 - protein, 8 aa, Mycobacterium
IEPQGTRA

SEQ ID NO: 906563 - protein, 7 aa, Mycobacterium
IEPQPQR

SEQ ID NO: 906564 - protein, 7 aa, Mycobacterium
IEPRPAD

SEQ ID NO: 906565 - protein, 7 aa, Mycobacterium
IEPRPSD

SEQ ID NO: 906566 - protein, 8 aa, Mycobacterium
IEPRSGQQ

SEQ ID NO: 906567 - protein, 13 aa, Mycobacterium
IEQGTRAAEARHG

SEQ ID NO: 906568 - protein, 7 aa, Mycobacterium
IESPGAG

SEQ ID NO: 906569 - protein, 6 aa, Mycobacterium
IETADD

SEQ ID NO: 906570 - protein, 10 aa, Mycobacterium
IETAQQPEID

SEQ ID NO: 906571 - protein, 4 aa, Mycobacterium
IETE

SEQ ID NO: 906572 - protein, 13 aa, Mycobacterium
IETGTRAAGERHG

SEQ ID NO: 906573 - protein, 6 aa, Mycobacterium
IETNPN

SEQ ID NO: 906574 - protein, 4 aa, Mycobacterium
IGAA

SEQ ID NO: 906575 - protein, 6 aa, Mycobacterium
IGADNK

SEQ ID NO: 906576 - protein, 6 aa, Mycobacterium
IGAEPA

SEQ ID NO: 906577 - protein, 5 aa, Mycobacterium
IGAGQ

SEQ ID NO: 906578 - protein, 10 aa, Mycobacterium
IGAGQNGLAD

SEQ ID NO: 906579 - protein, 11 aa, Mycobacterium
IGAGQNGLADN

SEQ ID NO: 906580 - protein, 11 aa, Mycobacterium
IGAGQSGLADN

SEQ ID NO: 906581 - protein, 8 aa, Mycobacterium
IGAGSAAS

SEQ ID NO: 906582 - protein, 6 aa, Mycobacterium
IGAPGT

SEQ ID NO: 906583 - protein, 7 aa, Mycobacterium
IGDDRTR

SEQ ID NO: 906584 - protein, 19 aa, Mycobacterium
IGDGNSQVSASAGGGGGNI

SEQ ID NO: 906585 - protein, 20 aa, Mycobacterium
IGDGNSQVSASAGGGGGNVA

SEQ ID NO: 906586 - protein, 16 aa, Mycobacterium
IGDNNGISAGAPGLGA

SEQ ID NO: 906587 - protein, 15 aa, Mycobacterium
IGDNNGVAASTPGIG

SEQ ID NO: 906588 - protein, 11 aa, Mycobacterium
IGDQDGSVRPS

SEQ ID NO: 906589 - protein, 7 aa, Mycobacterium
IGDQRTR

SEQ ID NO: 906590 - protein, 11 aa, Mycobacterium
IGDSGDGSAMG

SEQ ID NO: 906591 - protein, 17 aa, Mycobacterium
IGDTPKAQIRAEAARRG

SEQ ID NO: 906592 - protein, 8 aa, Mycobacterium
IGDTQRTC

SEQ ID NO: 906593 - protein, 4 aa, Mycobacterium
IGEI

SEQ ID NO: 906594 - protein, 5 aa, Mycobacterium
IGEIR

SEQ ID NO: 906595 - protein, 4 aa, Mycobacterium
IGEP

SEQ ID NO: 906596 - protein, 6 aa, Mycobacterium
IGEPNL

SEQ ID NO: 906597 - protein, 7 aa, Mycobacterium
IGERDEA

SEQ ID NO: 906598 - protein, 7 aa, Mycobacterium
IGERGID

SEQ ID NO: 906599 - protein, 9 aa, Mycobacterium
IGESAERLA

SEQ ID NO: 906600 - protein, 7 aa, Mycobacterium
IGETERQ

SEQ ID NO: 906601 - protein, 23 aa, Mycobacterium
IGETPKPRFPQQDPSDTSVPSPL

SEQ ID NO: 906602 - protein, 9 aa, Mycobacterium
IGGAGGNGG

SEQ ID NO: 906603 - protein, 15 aa, Mycobacterium
IGGAGGSAGRSVGTI

SEQ ID NO: 906604 - protein, 15 aa, Mycobacterium
IGGAVDSSIRDAPTG

SEQ ID NO: 906605 - protein, 6 aa, Mycobacterium
IGGDEA

SEQ ID NO: 906606 - protein, 10 aa, Mycobacterium
IGGGERQQLT

SEQ ID NO: 906607 - protein, 7 aa, Mycobacterium
IGGGRSV

SEQ ID NO: 906608 - protein, 10 aa, Mycobacterium
IGGIPTDQQY

SEQ ID NO: 906609 - protein, 7 aa, Mycobacterium
IGGNRQA

SEQ ID NO: 906610 - protein, 13 aa, Mycobacterium
IGGNSASAGAGRP

SEQ ID NO: 906611 - protein, 21 aa, Mycobacterium
IGGPATAQARAATISPGDEID

SEQ ID NO: 906612 - protein, 10 aa, Mycobacterium
IGGSGTGAQH

SEQ ID NO: 906613 - protein, 10 aa, Mycobacterium
IGGTDTSGRS

SEQ ID NO: 906614 - protein, 12 aa, Mycobacterium
IGHAPRPLAPGA

SEQ ID NO: 906615 - protein, 6 aa, Mycobacterium
IGKQQV

SEQ ID NO: 906616 - protein, 11 aa, Mycobacterium
IGLESTTAAAT

SEQ ID NO: 906617 - protein, 16 aa, Mycobacterium
IGNGNSQVSAAAGGIG

SEQ ID NO: 906618 - protein, 10 aa, Mycobacterium
IGNSSSPGHR

SEQ ID NO: 906619 - protein, 4 aa, Mycobacterium
IGPA

SEQ ID NO: 906620 - protein, 5 aa, Mycobacterium
IGPAR

SEQ ID NO: 906621 - protein, 4 aa, Mycobacterium
IGPD

SEQ ID NO: 906622 - protein, 15 aa, Mycobacterium
IGPDGDYDADALTPE

SEQ ID NO: 906623 - protein, 6 aa, Mycobacterium
IGPDGH

SEQ ID NO: 906624 - protein, 15 aa, Mycobacterium
IGPDGKLKTLGKIPN

SEQ ID NO: 906625 - protein, 14 aa, Mycobacterium
IGPDGVHPNDAGHQ

SEQ ID NO: 906626 - protein, 9 aa, Mycobacterium
IGPDPQPGD

SEQ ID NO: 906627 - protein, 7 aa, Mycobacterium
IGPDTTL

SEQ ID NO: 906628 - protein, 5 aa, Mycobacterium
IGPGF

SEQ ID NO: 906629 - protein, 6 aa, Mycobacterium
IGPGQA

SEQ ID NO: 906630 - protein, 10 aa, Mycobacterium
IGPGQDGLEQ

SEQ ID NO: 906631 - protein, 11 aa, Mycobacterium
IGPLASARTGI

SEQ ID NO: 906632 - protein, 7 aa, Mycobacterium
IGPPYAA

SEQ ID NO: 906633 - protein, 7 aa, Mycobacterium
IGPQPSA

SEQ ID NO: 906634 - protein, 8 aa, Mycobacterium
IGPSAERL

SEQ ID NO: 906635 - protein, 11 aa, Mycobacterium
IGPSRSGEPHS

SEQ ID NO: 906636 - protein, 7 aa, Mycobacterium
IGPTDVP

SEQ ID NO: 906637 - protein, 19 aa, Mycobacterium
IGQGNTQVSASAGGGGGNI

SEQ ID NO: 906638 - protein, 6 aa, Mycobacterium
IGQNGL

SEQ ID NO: 906639 - protein, 6 aa, Mycobacterium
IGQRRG

SEQ ID NO: 906640 - protein, 8 aa, Mycobacterium
IGRDPKEI

SEQ ID NO: 906641 - protein, 10 aa, Mycobacterium
IGRQSEEGSG

SEQ ID NO: 906642 - protein, 6 aa, Mycobacterium
IGRRSD

SEQ ID NO: 906643 - protein, 17 aa, Mycobacterium
IGRRSPDGEGGVVSGPP

SEQ ID NO: 906644 - protein, 9 aa, Mycobacterium
IGRSGTPGR

SEQ ID NO: 906645 - protein, 17 aa, Mycobacterium
IGRSSKEFADHPLQQEN

SEQ ID NO: 906646 - protein, 13 aa, Mycobacterium
IGSANAATVASTT

SEQ ID NO: 906647 - protein, 7 aa, Mycobacterium
IGSATAR

SEQ ID NO: 906648 - protein, 6 aa, Mycobacterium
IGSDMG

SEQ ID NO: 906649 - protein, 10 aa, Mycobacterium
IGSEPAFPSF

SEQ ID NO: 906650 - protein, 7 aa, Mycobacterium
IGSGHQD

SEQ ID NO: 906651 - protein, 5 aa, Mycobacterium
IGSGI

SEQ ID NO: 906652 - protein, 5 aa, Mycobacterium
IGSGS

SEQ ID NO: 906653 - protein, 21 aa, Mycobacterium
IGSHKTASNADANSALTKPFN

SEQ ID NO: 906654 - protein, 15 aa, Mycobacterium
IGSPYSWGGSGPGAF

SEQ ID NO: 906655 - protein, 10 aa, Mycobacterium
IGSRDPSSTY

SEQ ID NO: 906656 - protein, 16 aa, Mycobacterium
IGSSSHSVSKSEVANQ

SEQ ID NO: 906657 - protein, 7 aa, Mycobacterium
IGSTRGS

SEQ ID NO: 906658 - protein, 17 aa, Mycobacterium
IGSTVSAANAAAAIPTT

SEQ ID NO: 906659 - protein, 14 aa, Mycobacterium
IGSYTGQSVDSGAY

SEQ ID NO: 906660 - protein, 22 aa, Mycobacterium
IGTGAPAATTTTPAAKPDPSTV

SEQ ID NO: 906661 - protein, 25 aa, Mycobacterium
IGTGGGGGAGAAGGTGGAGGAGGAG

SEQ ID NO: 906662 - protein, 48 aa, Mycobacterium
IGTPTTRSLPSPSATPTSTAVATASASALVSSADAQSVASTAPEAASC

SEQ ID NO: 906663 - protein, 6 aa, Mycobacterium
IGTSPF

SEQ ID NO: 906664 - protein, 6 aa, Mycobacterium
IGTSPY

SEQ ID NO: 906665 - protein, 22 aa, Mycobacterium
IGTTSTAATATTTPAKPSPSTV

SEQ ID NO: 906666 - protein, 4 aa, Mycobacterium
IGVT

SEQ ID NO: 906667 - protein, 4 aa, Mycobacterium
IGYG

SEQ ID NO: 906668 - protein, 4 aa, Mycobacterium
IGYP

SEQ ID NO: 906669 - protein, 13 aa, Mycobacterium
IGYQGDPGFHGPK

SEQ ID NO: 906670 - protein, 9 aa, Mycobacterium
IHESGPAFD

SEQ ID NO: 906671 - protein, 4 aa, Mycobacterium
IIPE

SEQ ID NO: 906672 - protein, 4 aa, Mycobacterium
IIPT

SEQ ID NO: 906673 - protein, 5 aa, Mycobacterium
IITPT

SEQ ID NO: 906674 - protein, 9 aa, Mycobacterium
IKDDSKNII

SEQ ID NO: 906675 - protein, 11 aa, Mycobacterium
IKDENSDCTRY

SEQ ID NO: 906676 - protein, 10 aa, Mycobacterium
IKDENSSCTD

SEQ ID NO: 906677 - protein, 15 aa, Mycobacterium
IKDGPDQHLANNADD

SEQ ID NO: 906678 - protein, 7 aa, Mycobacterium
IKEGTLS

SEQ ID NO: 906679 - protein, 16 aa, Mycobacterium
IKETRRRNGAGDRRPT

SEQ ID NO: 906680 - protein, 8 aa, Mycobacterium
IKGAAPDS

SEQ ID NO: 906681 - protein, 7 aa, Mycobacterium
IKGNDKV

SEQ ID NO: 906682 - protein, 11 aa, Mycobacterium
IKKGASEPSSI

SEQ ID NO: 906683 - protein, 23 aa, Mycobacterium
IKNGGKGDDDGSGDAVRIPETAA

SEQ ID NO: 906684 - protein, 4 aa, Mycobacterium
IKPA

SEQ ID NO: 906685 - protein, 6 aa, Mycobacterium
IKPDAT

SEQ ID NO: 906686 - protein, 7 aa, Mycobacterium
IKPGEAQ

SEQ ID NO: 906687 - protein, 10 aa, Mycobacterium
IKQAEGQKQA

SEQ ID NO: 906688 - protein, 7 aa, Mycobacterium
IKRPGGD

SEQ ID NO: 906689 - protein, 8 aa, Mycobacterium
IKSGPGPI

SEQ ID NO: 906690 - protein, 9 aa, Mycobacterium
IKSGTASWD

SEQ ID NO: 906691 - protein, 22 aa, Mycobacterium
IKTAADLKGKTVADPALGGTQD

SEQ ID NO: 906692 - protein, 11 aa, Mycobacterium
IKTDGSHNSLA

SEQ ID NO: 906693 - protein, 13 aa, Mycobacterium
IKTGSSQGTIPAR

SEQ ID NO: 906694 - protein, 21 aa, Mycobacterium
IKTPDGQSSTDHAFAQLVVER

SEQ ID NO: 906695 - protein, 6 aa, Mycobacterium
IKTPEE

SEQ ID NO: 906696 - protein, 30 aa, Mycobacterium
IKTTSVDGFSADGAQLAPTALGEPEAFSGN

SEQ ID NO: 906697 - protein, 13 aa, Mycobacterium
ILDTQTETSDSIQ

SEQ ID NO: 906698 - protein, 7 aa, Mycobacterium
ILNGSDE

SEQ ID NO: 906699 - protein, 16 aa, Mycobacterium
ILTPDNEKAAFNSEAG

SEQ ID NO: 906700 - protein, 13 aa, Mycobacterium
IMNSGTDEGPAPR

SEQ ID NO: 906701 - protein, 9 aa, Mycobacterium
INATSGKDE

SEQ ID NO: 906702 - protein, 11 aa, Mycobacterium
INDGTFGKTET

SEQ ID NO: 906703 - protein, 11 aa, Mycobacterium
INGPMPAATAS

SEQ ID NO: 906704 - protein, 9 aa, Mycobacterium
INGSGGNVS

SEQ ID NO: 906705 - protein, 5 aa, Mycobacterium
INGTY

SEQ ID NO: 906706 - protein, 5 aa, Mycobacterium
INKSE

SEQ ID NO: 906707 - protein, 6 aa, Mycobacterium
INPDST

SEQ ID NO: 906708 - protein, 10 aa, Mycobacterium
INPDTSAALE

SEQ ID NO: 906709 - protein, 6 aa, Mycobacterium
INPPAE

SEQ ID NO: 906710 - protein, 8 aa, Mycobacterium
INPPGQKT

SEQ ID NO: 906711 - protein, 10 aa, Mycobacterium
INPRGPRGER

SEQ ID NO: 906712 - protein, 7 aa, Mycobacterium
INPRRSP

SEQ ID NO: 906713 - protein, 5 aa, Mycobacterium
INRDT

SEQ ID NO: 906714 - protein, 25 aa, Mycobacterium
INTGGDTKCKDFTSQDEKKQNDEVS

SEQ ID NO: 906715 - protein, 25 aa, Mycobacterium
INTGGDTKCKDFTTQDEKKQNDEVS

SEQ ID NO: 906716 - protein, 8 aa, Mycobacterium
INTGNGYY

SEQ ID NO: 906717 - protein, 7 aa, Mycobacterium
INTTKGS

SEQ ID NO: 906718 - protein, 4 aa, Mycobacterium
INYE

SEQ ID NO: 906719 - protein, 4 aa, Mycobacterium
IPAA

SEQ ID NO: 906720 - protein, 10 aa, Mycobacterium
IPAAPSPSIP

SEQ ID NO: 906721 - protein, 15 aa, Mycobacterium
IPAAPTTLTARPGQR

SEQ ID NO: 906722 - protein, 6 aa, Mycobacterium
IPADAQ

SEQ ID NO: 906723 - protein, 20 aa, Mycobacterium
IPAGDIPTLPNTPSPKPMPN

SEQ ID NO: 906724 - protein, 8 aa, Mycobacterium
IPAGRTDE

SEQ ID NO: 906725 - protein, 18 aa, Mycobacterium
IPANTPAATTGSMPSAVP

SEQ ID NO: 906726 - protein, 8 aa, Mycobacterium
IPAPGDPY

SEQ ID NO: 906727 - protein, 19 aa, Mycobacterium
IPAPPSEEQTPAPMPAPTA

SEQ ID NO: 906728 - protein, 11 aa, Mycobacterium
IPAPSTALDAT

SEQ ID NO: 906729 - protein, 28 aa, Mycobacterium
IPAPTAGAAPTPPAAPEPAPAAPAAGAG

SEQ ID NO: 906730 - protein, 10 aa, Mycobacterium
IPASKAAPVY

SEQ ID NO: 906731 - protein, 9 aa, Mycobacterium
IPASRPGGL

SEQ ID NO: 906732 - protein, 18 aa, Mycobacterium
IPATGQMPAAGQVPAAGQ

SEQ ID NO: 906733 - protein, 18 aa, Mycobacterium
IPDEPDNHAIGRSRGGLT

SEQ ID NO: 906734 - protein, 5 aa, Mycobacterium
IPDGR

SEQ ID NO: 906735 - protein, 10 aa, Mycobacterium
IPDHGKDKVN

SEQ ID NO: 906736 - protein, 20 aa, Mycobacterium
IPDPAIGHSPKPPVIGKPRD

SEQ ID NO: 906737 - protein, 7 aa, Mycobacterium
IPDPASL

SEQ ID NO: 906738 - protein, 6 aa, Mycobacterium
IPDPQP

SEQ ID NO: 906739 - protein, 4 aa, Mycobacterium
IPDR

SEQ ID NO: 906740 - protein, 5 aa, Mycobacterium
IPDSS

SEQ ID NO: 906741 - protein, 4 aa, Mycobacterium
IPDT

SEQ ID NO: 906742 - protein, 11 aa, Mycobacterium
IPENGSNKLNA

SEQ ID NO: 906743 - protein, 6 aa, Mycobacterium
IPEPGL

SEQ ID NO: 906744 - protein, 10 aa, Mycobacterium
IPEPRTDHAE

SEQ ID NO: 906745 - protein, 4 aa, Mycobacterium
IPES

SEQ ID NO: 906746 - protein, 4 aa, Mycobacterium
IPFP

SEQ ID NO: 906747 - protein, 16 aa, Mycobacterium
IPFPDGTSDMCSKPGS

SEQ ID NO: 906748 - protein, 12 aa, Mycobacterium
IPGAPGTGKGSY

SEQ ID NO: 906749 - protein, 11 aa, Mycobacterium
IPGAQRAADGL

SEQ ID NO: 906750 - protein, 11 aa, Mycobacterium
IPGDQSSDARV

SEQ ID NO: 906751 - protein, 10 aa, Mycobacterium
IPGDRARQLD

SEQ ID NO: 906752 - protein, 9 aa, Mycobacterium
IPGEELPGS

SEQ ID NO: 906753 - protein, 9 aa, Mycobacterium
IPGEELQGS

SEQ ID NO: 906754 - protein, 8 aa, Mycobacterium
IPGEPEAA

SEQ ID NO: 906755 - protein, 5 aa, Mycobacterium
IPGGA

SEQ ID NO: 906756 - protein, 10 aa, Mycobacterium
IPGGEPIPEE

SEQ ID NO: 906757 - protein, 11 aa, Mycobacterium
IPGGPGSGSGA

SEQ ID NO: 906758 - protein, 4 aa, Mycobacterium
IPGL

SEQ ID NO: 906759 - protein, 4 aa, Mycobacterium
IPGN

SEQ ID NO: 906760 - protein, 13 aa, Mycobacterium
IPGNKNGWSQEQG

SEQ ID NO: 906761 - protein, 13 aa, Mycobacterium
IPGNPRRAAATPN

SEQ ID NO: 906762 - protein, 61 aa, Mycobacterium
IPGPAVRAGPAETTGAAGPAVPAGPTGAGLGAPGPAGAARATAAAGESLRAGSARGGGVDP

SEQ ID NO: 906763 - protein, 8 aa, Mycobacterium
IPGPGHGP

SEQ ID NO: 906764 - protein, 12 aa, Mycobacterium
IPGQNSGGPNNG

SEQ ID NO: 906765 - protein, 4 aa, Mycobacterium
IPGR

SEQ ID NO: 906766 - protein, 12 aa, Mycobacterium
IPGSAGATPVQN

SEQ ID NO: 906767 - protein, 5 aa, Mycobacterium
IPGSS

SEQ ID NO: 906768 - protein, 14 aa, Mycobacterium
IPGTATARASAPSF

SEQ ID NO: 906769 - protein, 10 aa, Mycobacterium
IPGYTPKGTL

SEQ ID NO: 906770 - protein, 12 aa, Mycobacterium
IPHSRGLGSSAA

SEQ ID NO: 906771 - protein, 5 aa, Mycobacterium
IPIDN

SEQ ID NO: 906772 - protein, 10 aa, Mycobacterium
IPKGATGNTG

SEQ ID NO: 906773 - protein, 11 aa, Mycobacterium
IPKGPTGNAGS

SEQ ID NO: 906774 - protein, 10 aa, Mycobacterium
IPKGPTGNTG

SEQ ID NO: 906775 - protein, 6 aa, Mycobacterium
IPKRTT

SEQ ID NO: 906776 - protein, 24 aa, Mycobacterium
IPLPDSTATLENYGGAPCDSGQTV

SEQ ID NO: 906777 - protein, 24 aa, Mycobacterium
IPLPGSTATLENYGGTTCGAEPTV

SEQ ID NO: 906778 - protein, 9 aa, Mycobacterium
IPNDPPNQA

SEQ ID NO: 906779 - protein, 13 aa, Mycobacterium
IPNGAQPNTGSDG

SEQ ID NO: 906780 - protein, 8 aa, Mycobacterium
IPNPVPGN

SEQ ID NO: 906781 - protein, 30 aa, Mycobacterium
IPNTGRNLGGDPGKIGEHPKLDGADNPLNP

SEQ ID NO: 906782 - protein, 7 aa, Mycobacterium
IPPAPPP

SEQ ID NO: 906783 - protein, 25 aa, Mycobacterium
IPPGARASAAASASSRVGPQPPKYR

SEQ ID NO: 906784 - protein, 28 aa, Mycobacterium
IPPGGPAPAPAAGVPTGDPAGLPPGQGP

SEQ ID NO: 906785 - protein, 6 aa, Mycobacterium
IPPGRI

SEQ ID NO: 906786 - protein, 5 aa, Mycobacterium
IPPPA

SEQ ID NO: 906787 - protein, 8 aa, Mycobacterium
IPPPGRGA

SEQ ID NO: 906788 - protein, 5 aa, Mycobacterium
IPPRA

SEQ ID NO: 906789 - protein, 16 aa, Mycobacterium
IPPRADGVYSPGGGPV

SEQ ID NO: 906790 - protein, 17 aa, Mycobacterium
IPPRADGVYSPGGGPVE

SEQ ID NO: 906791 - protein, 18 aa, Mycobacterium
IPPRADGVYTPGGGPAER

SEQ ID NO: 906792 - protein, 17 aa, Mycobacterium
IPPRADGVYTRGGGPVE

SEQ ID NO: 906793 - protein, 5 aa, Mycobacterium
IPPSA

SEQ ID NO: 906794 - protein, 23 aa, Mycobacterium
IPPSAMPPGLGDPETTTESSRAA

SEQ ID NO: 906795 - protein, 12 aa, Mycobacterium
IPPSATSVSHEE

SEQ ID NO: 906796 - protein, 11 aa, Mycobacterium
IPPSTGHDPTH

SEQ ID NO: 906797 - protein, 26 aa, Mycobacterium
IPPSVKDQYDPETGKYIGDPVDGLTD

SEQ ID NO: 906798 - protein, 5 aa, Mycobacterium
IPPTR

SEQ ID NO: 906799 - protein, 5 aa, Mycobacterium
IPPVP

SEQ ID NO: 906800 - protein, 10 aa, Mycobacterium
IPQPPPGVTY

SEQ ID NO: 906801 - protein, 10 aa, Mycobacterium
IPRDGGVGAA

SEQ ID NO: 906802 - protein, 7 aa, Mycobacterium
IPRERAG

SEQ ID NO: 906803 - protein, 5 aa, Mycobacterium
IPSDG

SEQ ID NO: 906804 - protein, 11 aa, Mycobacterium
IPSGDTSWQTE

SEQ ID NO: 906805 - protein, 8 aa, Mycobacterium
IPSSGPAI

SEQ ID NO: 906806 - protein, 6 aa, Mycobacterium
IPSSPM

SEQ ID NO: 906807 - protein, 4 aa, Mycobacterium
IPSV

SEQ ID NO: 906808 - protein, 5 aa, Mycobacterium
IPTAP

SEQ ID NO: 906809 - protein, 4 aa, Mycobacterium
IPTG

SEQ ID NO: 906810 - protein, 5 aa, Mycobacterium
IPTKM

SEQ ID NO: 906811 - protein, 7 aa, Mycobacterium
IPTKTGN

SEQ ID NO: 906812 - protein, 4 aa, Mycobacterium
IPTP

SEQ ID NO: 906813 - protein, 15 aa, Mycobacterium
IPTPPGGPTLPIEPP

SEQ ID NO: 906814 - protein, 17 aa, Mycobacterium
IPTPPGWSPYEGPKINP

SEQ ID NO: 906815 - protein, 18 aa, Mycobacterium
IPTPPGWSPYSGPKISPE

SEQ ID NO: 906816 - protein, 5 aa, Mycobacterium
IPTPV

SEQ ID NO: 906817 - protein, 15 aa, Mycobacterium
IPTPYGGPALPIEPP

SEQ ID NO: 906818 - protein, 7 aa, Mycobacterium
IPTSQMR

SEQ ID NO: 906819 - protein, 9 aa, Mycobacterium
IPTSTPDTI

SEQ ID NO: 906820 - protein, 13 aa, Mycobacterium
IPTTKISGTVPTD

SEQ ID NO: 906821 - protein, 11 aa, Mycobacterium
IPVDPSGDGGL

SEQ ID NO: 906822 - protein, 13 aa, Mycobacterium
IPVEEDSEFNPER

SEQ ID NO: 906823 - protein, 6 aa, Mycobacterium
IPVPPT

SEQ ID NO: 906824 - protein, 10 aa, Mycobacterium
IPVPTTDGRT

SEQ ID NO: 906825 - protein, 16 aa, Mycobacterium
IPVSTADTGRRDDQLP

SEQ ID NO: 906826 - protein, 6 aa, Mycobacterium
IPYGKA

SEQ ID NO: 906827 - protein, 15 aa, Mycobacterium
IQATNQLGPNGTRPL

SEQ ID NO: 906828 - protein, 4 aa, Mycobacterium
IQDV

SEQ ID NO: 906829 - protein, 9 aa, Mycobacterium
IQERVNEGS

SEQ ID NO: 906830 - protein, 13 aa, Mycobacterium
IQLPDSTATLENY

SEQ ID NO: 906831 - protein, 18 aa, Mycobacterium
IQNPDGTLGVSPGERADS

SEQ ID NO: 906832 - protein, 23 aa, Mycobacterium
IQPEQTYPPGGPTRITGYNATNS

SEQ ID NO: 906833 - protein, 5 aa, Mycobacterium
IQPQA

SEQ ID NO: 906834 - protein, 8 aa, Mycobacterium
IQPQGTQA

SEQ ID NO: 906835 - protein, 25 aa, Mycobacterium
IQPTAAGSATADVSVSGPKLTSPVT

SEQ ID NO: 906836 - protein, 13 aa, Mycobacterium
IQPTTGGGRGMTV

SEQ ID NO: 906837 - protein, 21 aa, Mycobacterium
IQPTTVNSRRSRTPALDAGRE

SEQ ID NO: 906838 - protein, 15 aa, Mycobacterium
IQQATDEAAAKGATL

SEQ ID NO: 906839 - protein, 4 aa, Mycobacterium
IQSG

SEQ ID NO: 906840 - protein, 19 aa, Mycobacterium
IQSGAQAAPAAAPAPVPPP

SEQ ID NO: 906841 - protein, 7 aa, Mycobacterium
IQSKSKS

SEQ ID NO: 906842 - protein, 19 aa, Mycobacterium
IRAPSDPGYEPTAPPAMTT

SEQ ID NO: 906843 - protein, 20 aa, Mycobacterium
IRAPSDPGYEPTAPPAMTTP

SEQ ID NO: 906844 - protein, 9 aa, Mycobacterium
IRASGQPRA

SEQ ID NO: 906845 - protein, 7 aa, Mycobacterium
IRDEGTR

SEQ ID NO: 906846 - protein, 9 aa, Mycobacterium
IRDGGTYNV

SEQ ID NO: 906847 - protein, 9 aa, Mycobacterium
IRDGTASWD

SEQ ID NO: 906848 - protein, 4 aa, Mycobacterium
IREG

SEQ ID NO: 906849 - protein, 12 aa, Mycobacterium
IRESLQRTARSN

SEQ ID NO: 906850 - protein, 13 aa, Mycobacterium
IRGQRTKTAFSDG

SEQ ID NO: 906851 - protein, 19 aa, Mycobacterium
IRNCPAPGARCDQPVDPGR

SEQ ID NO: 906852 - protein, 8 aa, Mycobacterium
IRNGDTQV

SEQ ID NO: 906853 - protein, 6 aa, Mycobacterium
IRNRNG

SEQ ID NO: 906854 - protein, 7 aa, Mycobacterium
IRPAGTE

SEQ ID NO: 906855 - protein, 13 aa, Mycobacterium
IRPEGTEDQPAPS

SEQ ID NO: 906856 - protein, 14 aa, Mycobacterium
IRPEGTGAQTSSSV

SEQ ID NO: 906857 - protein, 14 aa, Mycobacterium
IRPEGTGEQQTPSV

SEQ ID NO: 906858 - protein, 6 aa, Mycobacterium
IRPEQD

SEQ ID NO: 906859 - protein, 13 aa, Mycobacterium
IRPGDSGGPIVNS

SEQ ID NO: 906860 - protein, 6 aa, Mycobacterium
IRPKGG

SEQ ID NO: 906861 - protein, 6 aa, Mycobacterium
IRPNPG

SEQ ID NO: 906862 - protein, 9 aa, Mycobacterium
IRPPPTGWE

SEQ ID NO: 906863 - protein, 9 aa, Mycobacterium
IRPQNRTAL

SEQ ID NO: 906864 - protein, 15 aa, Mycobacterium
IRPRRVDPDQLDGIK

SEQ ID NO: 906865 - protein, 6 aa, Mycobacterium
IRPSMA

SEQ ID NO: 906866 - protein, 4 aa, Mycobacterium
IRQQ

SEQ ID NO: 906867 - protein, 7 aa, Mycobacterium
IRSGERQ

SEQ ID NO: 906868 - protein, 6 aa, Mycobacterium
IRTSDG

SEQ ID NO: 906869 - protein, 11 aa, Mycobacterium
IRTSSSSDVQA

SEQ ID NO: 906870 - protein, 4 aa, Mycobacterium
IRTT

SEQ ID NO: 906871 - protein, 9 aa, Mycobacterium
IRTTDGPIS

SEQ ID NO: 906872 - protein, 9 aa, Mycobacterium
ISAGTSGLG

SEQ ID NO: 906873 - protein, 9 aa, Mycobacterium
ISAKAGPLP

SEQ ID NO: 906874 - protein, 4 aa, Mycobacterium
ISAN

SEQ ID NO: 906875 - protein, 11 aa, Mycobacterium
ISAPGASAPGR

SEQ ID NO: 906876 - protein, 10 aa, Mycobacterium
ISAPGASGPH

SEQ ID NO: 906877 - protein, 8 aa, Mycobacterium
ISAQPGRD

SEQ ID NO: 906878 - protein, 5 aa, Mycobacterium
ISARR

SEQ ID NO: 906879 - protein, 8 aa, Mycobacterium
ISATPRTV

SEQ ID NO: 906880 - protein, 8 aa, Mycobacterium
ISDAAGSL

SEQ ID NO: 906881 - protein, 5 aa, Mycobacterium
ISDGP

SEQ ID NO: 906882 - protein, 10 aa, Mycobacterium
ISDGPGDPLN

SEQ ID NO: 906883 - protein, 4 aa, Mycobacterium
ISDK

SEQ ID NO: 906884 - protein, 9 aa, Mycobacterium
ISDKASVER

SEQ ID NO: 906885 - protein, 8 aa, Mycobacterium
ISDNTAKW

SEQ ID NO: 906886 - protein, 13 aa, Mycobacterium
ISDQPPGVIVLVT

SEQ ID NO: 906887 - protein, 5 aa, Mycobacterium
ISDQT

SEQ ID NO: 906888 - protein, 13 aa, Mycobacterium
ISEGETSPGFAGW

SEQ ID NO: 906889 - protein, 11 aa, Mycobacterium
ISEGRLADSGE

SEQ ID NO: 906890 - protein, 33 aa, Mycobacterium
ISEGSGSTAPTRTAPPAPPRAATPVPIEPGQQT

SEQ ID NO: 906891 - protein, 7 aa, Mycobacterium
ISERGID

SEQ ID NO: 906892 - protein, 63 aa, Mycobacterium
ISERSTAADDDTGATPLTPDAGDTESSTSDGASESAGSDVGDSTTRTSTKPSSDGAARSSSSA

SEQ ID NO: 906893 - protein, 26 aa, Mycobacterium
ISGATASADTEMQPAGSVPIPDGPAQ

SEQ ID NO: 906894 - protein, 12 aa, Mycobacterium
ISGLNTNQLSGS

SEQ ID NO: 906895 - protein, 10 aa, Mycobacterium
ISGPKFAGPV

SEQ ID NO: 906896 - protein, 8 aa, Mycobacterium
ISGSGSYA

SEQ ID NO: 906897 - protein, 28 aa, Mycobacterium
ISGTGSTFSQRRKDVTAPDTLMGSGESQ

SEQ ID NO: 906898 - protein, 9 aa, Mycobacterium
ISKATGVQE

SEQ ID NO: 906899 - protein, 7 aa, Mycobacterium
ISKDGQQ

SEQ ID NO: 906900 - protein, 8 aa, Mycobacterium
ISKDGQQL

SEQ ID NO: 906901 - protein, 7 aa, Mycobacterium
ISKDGRQ

SEQ ID NO: 906902 - protein, 9 aa, Mycobacterium
ISKDQVAKG

SEQ ID NO: 906903 - protein, 10 aa, Mycobacterium
ISNEATTDCT

SEQ ID NO: 906904 - protein, 7 aa, Mycobacterium
ISNSTDI

SEQ ID NO: 906905 - protein, 7 aa, Mycobacterium
ISNSTDV

SEQ ID NO: 906906 - protein, 5 aa, Mycobacterium
ISPAN

SEQ ID NO: 906907 - protein, 5 aa, Mycobacterium
ISPAR

SEQ ID NO: 906908 - protein, 16 aa, Mycobacterium
ISPDAVSSFEDKYQTK

SEQ ID NO: 906909 - protein, 8 aa, Mycobacterium
ISPDGSTI

SEQ ID NO: 906910 - protein, 8 aa, Mycobacterium
ISPEGLPA

SEQ ID NO: 906911 - protein, 7 aa, Mycobacterium
ISPEQAS

SEQ ID NO: 906912 - protein, 24 aa, Mycobacterium
ISPGAGKTGPNIQRSSCTTDPSYT

SEQ ID NO: 906913 - protein, 5 aa, Mycobacterium
ISPGL

SEQ ID NO: 906914 - protein, 7 aa, Mycobacterium
ISPGSTL

SEQ ID NO: 906915 - protein, 10 aa, Mycobacterium
ISPPSTALDA

SEQ ID NO: 906916 - protein, 6 aa, Mycobacterium
ISPRSA

SEQ ID NO: 906917 - protein, 40 aa, Mycobacterium
ISPSVNGACPAKPAGQAPSSTTPAPPPGSPAPAPKPAAIR

SEQ ID NO: 906918 - protein, 5 aa, Mycobacterium
ISPWG

SEQ ID NO: 906919 - protein, 5 aa, Mycobacterium
ISPWS

SEQ ID NO: 906920 - protein, 10 aa, Mycobacterium
ISQAESAALS

SEQ ID NO: 906921 - protein, 5 aa, Mycobacterium
ISQPS

SEQ ID NO: 906922 - protein, 8 aa, Mycobacterium
ISQRATAD

SEQ ID NO: 906923 - protein, 9 aa, Mycobacterium
ISQRATADE

SEQ ID NO: 906924 - protein, 6 aa, Mycobacterium
ISQRRG

SEQ ID NO: 906925 - protein, 7 aa, Mycobacterium
ISRPGAG

SEQ ID NO: 906926 - protein, 4 aa, Mycobacterium
ISSA

SEQ ID NO: 906927 - protein, 9 aa, Mycobacterium
ISSAGAATV

SEQ ID NO: 906928 - protein, 20 aa, Mycobacterium
ISSDSVGKTISGAKISGQGN

SEQ ID NO: 906929 - protein, 4 aa, Mycobacterium
ISSG

SEQ ID NO: 906930 - protein, 9 aa, Mycobacterium
ISSGNPLAA

SEQ ID NO: 906931 - protein, 17 aa, Mycobacterium
ISSGSYAATEAANAAAA

SEQ ID NO: 906932 - protein, 10 aa, Mycobacterium
ISSKEARRRC

SEQ ID NO: 906933 - protein, 10 aa, Mycobacterium
ISSSQGCDQA

SEQ ID NO: 906934 - protein, 12 aa, Mycobacterium
ISSTTTTTASST

SEQ ID NO: 906935 - protein, 8 aa, Mycobacterium
ISSYRADN

SEQ ID NO: 906936 - protein, 6 aa, Mycobacterium
ISTGAA

SEQ ID NO: 906937 - protein, 11 aa, Mycobacterium
ISTGGGGTQSW

SEQ ID NO: 906938 - protein, 37 aa, Mycobacterium
ISTNADPAATAAGLPGSKLGNAAHPPNIQTSSSTRYG

SEQ ID NO: 906939 - protein, 4 aa, Mycobacterium
ISTP

SEQ ID NO: 906940 - protein, 8 aa, Mycobacterium
ISTPDPHT

SEQ ID NO: 906941 - protein, 12 aa, Mycobacterium
ISTSQAPARPTE

SEQ ID NO: 906942 - protein, 17 aa, Mycobacterium
ISTTAPYQQRRAVSPQV

SEQ ID NO: 906943 - protein, 17 aa, Mycobacterium
ISTTTPEQERRAVSPQV

SEQ ID NO: 906944 - protein, 17 aa, Mycobacterium
ISTTTPHQQRRAVSPQV

SEQ ID NO: 906945 - protein, 4 aa, Mycobacterium
ISVD

SEQ ID NO: 906946 - protein, 5 aa, Mycobacterium
ISVND

SEQ ID NO: 906947 - protein, 8 aa, Mycobacterium
ITAGGTKL

SEQ ID NO: 906948 - protein, 13 aa, Mycobacterium
ITAPPPAAGANQV

SEQ ID NO: 906949 - protein, 7 aa, Mycobacterium
ITARGGY

SEQ ID NO: 906950 - protein, 8 aa, Mycobacterium
ITARGHDA

SEQ ID NO: 906951 - protein, 13 aa, Mycobacterium
ITATPAPQSNEPT

SEQ ID NO: 906952 - protein, 5 aa, Mycobacterium
ITATQ

SEQ ID NO: 906953 - protein, 6 aa, Mycobacterium
ITDAGR

SEQ ID NO: 906954 - protein, 4 aa, Mycobacterium
ITDD

SEQ ID NO: 906955 - protein, 4 aa, Mycobacterium
ITDE

SEQ ID NO: 906956 - protein, 12 aa, Mycobacterium
ITDEGGRRPPSH

SEQ ID NO: 906957 - protein, 8 aa, Mycobacterium
ITDGNGKK

SEQ ID NO: 906958 - protein, 10 aa, Mycobacterium
ITDKASAERR

SEQ ID NO: 906959 - protein, 6 aa, Mycobacterium
ITDKAT

SEQ ID NO: 906960 - protein, 5 aa, Mycobacterium
ITDPD

SEQ ID NO: 906961 - protein, 7 aa, Mycobacterium
ITDRASV

SEQ ID NO: 906962 - protein, 9 aa, Mycobacterium
ITDSRKEKV

SEQ ID NO: 906963 - protein, 10 aa, Mycobacterium
ITDSRKEKVD

SEQ ID NO: 906964 - protein, 5 aa, Mycobacterium
ITDTG

SEQ ID NO: 906965 - protein, 12 aa, Mycobacterium
ITEAAARNDAKV

SEQ ID NO: 906966 - protein, 6 aa, Mycobacterium
ITEEHG

SEQ ID NO: 906967 - protein, 15 aa, Mycobacterium
ITEGYPEKPGPVAPR

SEQ ID NO: 906968 - protein, 7 aa, Mycobacterium
ITEHEDG

SEQ ID NO: 906969 - protein, 9 aa, Mycobacterium
ITESSGGGR

SEQ ID NO: 906970 - protein, 7 aa, Mycobacterium
ITGAAGA

SEQ ID NO: 906971 - protein, 18 aa, Mycobacterium
ITGAPDVTVDGEATAPNA

SEQ ID NO: 906972 - protein, 8 aa, Mycobacterium
ITGDGAYG

SEQ ID NO: 906973 - protein, 5 aa, Mycobacterium
ITGEG

SEQ ID NO: 906974 - protein, 5 aa, Mycobacterium
ITGGE

SEQ ID NO: 906975 - protein, 4 aa, Mycobacterium
ITGH

SEQ ID NO: 906976 - protein, 5 aa, Mycobacterium
ITGHG

SEQ ID NO: 906977 - protein, 67 aa, Mycobacterium
ITGKPGDPRYPYRPPLPQPPPGGPPPGPPAGYEPAPDRPSAPVPRPSSGGPTGGPSPVPVGPPGEAG

SEQ ID NO: 906978 - protein, 10 aa, Mycobacterium
ITGNPAGYNA

SEQ ID NO: 906979 - protein, 23 aa, Mycobacterium
ITGNPGDAGCGPPGIPLPGPTGC

SEQ ID NO: 906980 - protein, 53 aa, Mycobacterium
ITGNPGDPRYPYREPPPAPPPGGPPPGPPAVAPPGLASTPGPVQVPAPQPGGP

SEQ ID NO: 906981 - protein, 21 aa, Mycobacterium
ITGPGWKGTLPQGVQEYKSPT

SEQ ID NO: 906982 - protein, 10 aa, Mycobacterium
ITGPKFAGPV

SEQ ID NO: 906983 - protein, 8 aa, Mycobacterium
ITGPMPDD

SEQ ID NO: 906984 - protein, 23 aa, Mycobacterium
ITGPTVNQATRAEQRGAQRFPVR

SEQ ID NO: 906985 - protein, 6 aa, Mycobacterium
ITGRTG

SEQ ID NO: 906986 - protein, 14 aa, Mycobacterium
ITGTKPAADPACGA

SEQ ID NO: 906987 - protein, 9 aa, Mycobacterium
ITGYGDKNV

SEQ ID NO: 906988 - protein, 10 aa, Mycobacterium
ITKDARGTAY

SEQ ID NO: 906989 - protein, 12 aa, Mycobacterium
ITKDGKALGSAG

SEQ ID NO: 906990 - protein, 7 aa, Mycobacterium
ITKDSQV

SEQ ID NO: 906991 - protein, 11 aa, Mycobacterium
ITKGTAAAAHR

SEQ ID NO: 906992 - protein, 7 aa, Mycobacterium
ITKPGAE

SEQ ID NO: 906993 - protein, 14 aa, Mycobacterium
ITKPNGIGPSARRL

SEQ ID NO: 906994 - protein, 16 aa, Mycobacterium
ITKPNGIGPSARRLGA

SEQ ID NO: 906995 - protein, 7 aa, Mycobacterium
ITKQDQK

SEQ ID NO: 906996 - protein, 7 aa, Mycobacterium
ITKTSDV

SEQ ID NO: 906997 - protein, 4 aa, Mycobacterium
ITNG

SEQ ID NO: 906998 - protein, 23 aa, Mycobacterium
ITNGSSSPVGNPQAAPTTGPAAP

SEQ ID NO: 906999 - protein, 9 aa, Mycobacterium
ITPEGTQTR

SEQ ID NO: 907000 - protein, 10 aa, Mycobacterium
ITPEYNPISD

SEQ ID NO: 907001 - protein, 4 aa, Mycobacterium
ITPG

SEQ ID NO: 907002 - protein, 11 aa, Mycobacterium
ITPGPDARDVD

SEQ ID NO: 907003 - protein, 9 aa, Mycobacterium
ITPHTDARA

SEQ ID NO: 907004 - protein, 12 aa, Mycobacterium
ITPKNNAEDVEP

SEQ ID NO: 907005 - protein, 5 aa, Mycobacterium
ITPPP

SEQ ID NO: 907006 - protein, 8 aa, Mycobacterium
ITPQPPDT

SEQ ID NO: 907007 - protein, 6 aa, Mycobacterium
ITPRGG

SEQ ID NO: 907008 - protein, 13 aa, Mycobacterium
ITPTRQPAAQTTT

SEQ ID NO: 907009 - protein, 7 aa, Mycobacterium
ITQPAAN

SEQ ID NO: 907010 - protein, 6 aa, Mycobacterium
ITQRGD

SEQ ID NO: 907011 - protein, 11 aa, Mycobacterium
ITQTSATDQTH

SEQ ID NO: 907012 - protein, 16 aa, Mycobacterium
ITRATTAQAQLTGTFG

SEQ ID NO: 907013 - protein, 7 aa, Mycobacterium
ITRATTK

SEQ ID NO: 907014 - protein, 5 aa, Mycobacterium
ITRDA

SEQ ID NO: 907015 - protein, 7 aa, Mycobacterium
ITRESGT

SEQ ID NO: 907016 - protein, 5 aa, Mycobacterium
ITRPG

SEQ ID NO: 907017 - protein, 8 aa, Mycobacterium
ITRPGRDE

SEQ ID NO: 907018 - protein, 5 aa, Mycobacterium
ITSAD

SEQ ID NO: 907019 - protein, 8 aa, Mycobacterium
ITSPADPE

SEQ ID NO: 907020 - protein, 12 aa, Mycobacterium
ITSPSTCAQTTF

SEQ ID NO: 907021 - protein, 8 aa, Mycobacterium
ITSSNPYA

SEQ ID NO: 907022 - protein, 11 aa, Mycobacterium
ITTADGLDPAK

SEQ ID NO: 907023 - protein, 6 aa, Mycobacterium
ITTANG

SEQ ID NO: 907024 - protein, 147 aa, Mycobacterium
ITTGTAGTTVTARRSRGAVAAGATLTSSPAQGTVTTDTTGTGTAVQPEQSARTATATGTAGATVTARTTGTADTAGAAGTARRDRIATNTTDSTGRTRAAGAAEATDATGTTDAEQPSAVTPATTAAPAAPGTAGGTDTAVTPTETI

SEQ ID NO: 907025 - protein, 8 aa, Mycobacterium
ITTNPPVE

SEQ ID NO: 907026 - protein, 17 aa, Mycobacterium
ITVRTTGGATKQGEASQ

SEQ ID NO: 907027 - protein, 15 aa, Mycobacterium
ITVSPKDGSPDADVA

SEQ ID NO: 907028 - protein, 9 aa, Mycobacterium
ITYKTPDAA

SEQ ID NO: 907029 - protein, 13 aa, Mycobacterium
ITYPSPAAAIGSA

SEQ ID NO: 907030 - protein, 5 aa, Mycobacterium
ITYQN

SEQ ID NO: 907031 - protein, 11 aa, Mycobacterium
ITYQNGDNAIT

SEQ ID NO: 907032 - protein, 12 aa, Mycobacterium
ITYSNPDQAIGS

SEQ ID NO: 907033 - protein, 10 aa, Mycobacterium
ITYSTPDGAV

SEQ ID NO: 907034 - protein, 10 aa, Mycobacterium
IVDGNGQQMK

SEQ ID NO: 907035 - protein, 26 aa, Mycobacterium
IVNTGGDTKCKDFTTQDEKKQSEEVG

SEQ ID NO: 907036 - protein, 7 aa, Mycobacterium
IVPGSAT

SEQ ID NO: 907037 - protein, 4 aa, Mycobacterium
IYDA

SEQ ID NO: 907038 - protein, 7 aa, Mycobacterium
IYGGTRS

SEQ ID NO: 907039 - protein, 13 aa, Mycobacterium
KAAADPGDAPQPP

SEQ ID NO: 907040 - protein, 30 aa, Mycobacterium
KAAALGAGSTHAATPSGLDGPGGSGASTAH

SEQ ID NO: 907041 - protein, 22 aa, Mycobacterium
KAAALGATSTHTDSPSGLDAPG

SEQ ID NO: 907042 - protein, 6 aa, Mycobacterium
KAAAPL

SEQ ID NO: 907043 - protein, 4 aa, Mycobacterium
KAAE

SEQ ID NO: 907044 - protein, 7 aa, Mycobacterium
KAAEAKG

SEQ ID NO: 907045 - protein, 7 aa, Mycobacterium
KAAGEPV

SEQ ID NO: 907046 - protein, 6 aa, Mycobacterium
KAAGRE

SEQ ID NO: 907047 - protein, 8 aa, Mycobacterium
KAAHGTET

SEQ ID NO: 907048 - protein, 7 aa, Mycobacterium
KAANTYT

SEQ ID NO: 907049 - protein, 7 aa, Mycobacterium
KAAPAAD

SEQ ID NO: 907050 - protein, 8 aa, Mycobacterium
KAAQDAGH

SEQ ID NO: 907051 - protein, 8 aa, Mycobacterium
KAAQGPEI

SEQ ID NO: 907052 - protein, 9 aa, Mycobacterium
KAASATPAV

SEQ ID NO: 907053 - protein, 8 aa, Mycobacterium
KAASDQHM

SEQ ID NO: 907054 - protein, 5 aa, Mycobacterium
KAATA

SEQ ID NO: 907055 - protein, 8 aa, Mycobacterium
KAAVNSVS

SEQ ID NO: 907056 - protein, 8 aa, Mycobacterium
KADGARVQ

SEQ ID NO: 907057 - protein, 8 aa, Mycobacterium
KADGDKKW

SEQ ID NO: 907058 - protein, 8 aa, Mycobacterium
KADPGLAP

SEQ ID NO: 907059 - protein, 19 aa, Mycobacterium
KADPSKVSIGGGSSPGGPD

SEQ ID NO: 907060 - protein, 44 aa, Mycobacterium
KAEAEARAPVPGALDGPKQYPPLSQQVQPTATDYAQQPRHGSPD

SEQ ID NO: 907061 - protein, 50 aa, Mycobacterium
KAEAEARTSTPTLGSSPATPPLGGTTPNPSINVPQTQEWPGGGAHHAQPE

SEQ ID NO: 907062 - protein, 7 aa, Mycobacterium
KAEAELR

SEQ ID NO: 907063 - protein, 8 aa, Mycobacterium
KAEAEQTV

SEQ ID NO: 907064 - protein, 6 aa, Mycobacterium
KAEFDG

SEQ ID NO: 907065 - protein, 7 aa, Mycobacterium
KAETTKP

SEQ ID NO: 907066 - protein, 5 aa, Mycobacterium
KAGAA

SEQ ID NO: 907067 - protein, 6 aa, Mycobacterium
KAGATV

SEQ ID NO: 907068 - protein, 6 aa, Mycobacterium
KAGCST

SEQ ID NO: 907069 - protein, 6 aa, Mycobacterium
KAGEKQ

SEQ ID NO: 907070 - protein, 7 aa, Mycobacterium
KAGENAY

SEQ ID NO: 907071 - protein, 6 aa, Mycobacterium
KAGETF

SEQ ID NO: 907072 - protein, 11 aa, Mycobacterium
KAGGANSAIQS

SEQ ID NO: 907073 - protein, 10 aa, Mycobacterium
KAGGANTAIQ

SEQ ID NO: 907074 - protein, 12 aa, Mycobacterium
KAGGANTAIQSA

SEQ ID NO: 907075 - protein, 4 aa, Mycobacterium
KAGI

SEQ ID NO: 907076 - protein, 6 aa, Mycobacterium
KAGIDA

SEQ ID NO: 907077 - protein, 6 aa, Mycobacterium
KAGKIG

SEQ ID NO: 907078 - protein, 7 aa, Mycobacterium
KAGLKPD

SEQ ID NO: 907079 - protein, 7 aa, Mycobacterium
KAGPGAR

SEQ ID NO: 907080 - protein, 7 aa, Mycobacterium
KAGPGSA

SEQ ID NO: 907081 - protein, 8 aa, Mycobacterium
KAGPTSWT

SEQ ID NO: 907082 - protein, 5 aa, Mycobacterium
KAGQA

SEQ ID NO: 907083 - protein, 7 aa, Mycobacterium
KAGQEVL

SEQ ID NO: 907084 - protein, 6 aa, Mycobacterium
KAGQGS

SEQ ID NO: 907085 - protein, 6 aa, Mycobacterium
KAGQGT

SEQ ID NO: 907086 - protein, 6 aa, Mycobacterium
KAGQKQ

SEQ ID NO: 907087 - protein, 5 aa, Mycobacterium
KAGTL

SEQ ID NO: 907088 - protein, 6 aa, Mycobacterium
KAGYLT

SEQ ID NO: 907089 - protein, 4 aa, Mycobacterium
KAHP

SEQ ID NO: 907090 - protein, 8 aa, Mycobacterium
KAHPAAIT

SEQ ID NO: 907091 - protein, 10 aa, Mycobacterium
KAIDGAGAKE

SEQ ID NO: 907092 - protein, 7 aa, Mycobacterium
KAKAASL

SEQ ID NO: 907093 - protein, 10 aa, Mycobacterium
KAKAPSVIAG

SEQ ID NO: 907094 - protein, 10 aa, Mycobacterium
KAKAQTDELR

SEQ ID NO: 907095 - protein, 9 aa, Mycobacterium
KAKEARNRV

SEQ ID NO: 907096 - protein, 7 aa, Mycobacterium
KAKGGHN

SEQ ID NO: 907097 - protein, 6 aa, Mycobacterium
KAKPAE

SEQ ID NO: 907098 - protein, 9 aa, Mycobacterium
KALDENNVT

SEQ ID NO: 907099 - protein, 5 aa, Mycobacterium
KALGH

SEQ ID NO: 907100 - protein, 12 aa, Mycobacterium
KALPLNDPGKDC

SEQ ID NO: 907101 - protein, 8 aa, Mycobacterium
KALPPQAA

SEQ ID NO: 907102 - protein, 41 aa, Mycobacterium
KALTPKATRPAKTSKPSTGTESGGASTGQSDSGDAKSGDSE

SEQ ID NO: 907103 - protein, 9 aa, Mycobacterium
KANIGGADN

SEQ ID NO: 907104 - protein, 21 aa, Mycobacterium
KANSGGRGGIENGRTDPANGQ

SEQ ID NO: 907105 - protein, 7 aa, Mycobacterium
KAPDGTQ

SEQ ID NO: 907106 - protein, 6 aa, Mycobacterium
KAPETV

SEQ ID NO: 907107 - protein, 9 aa, Mycobacterium
KAPGTPVPG

SEQ ID NO: 907108 - protein, 16 aa, Mycobacterium
KAPPAPTEPPGVHRHK

SEQ ID NO: 907109 - protein, 6 aa, Mycobacterium
KAPPFG

SEQ ID NO: 907110 - protein, 7 aa, Mycobacterium
KAPPPDF

SEQ ID NO: 907111 - protein, 31 aa, Mycobacterium
KAPVTPKPTELAPFPPTVDGAGDAAPAAEGG

SEQ ID NO: 907112 - protein, 7 aa, Mycobacterium
KAPYGRI

SEQ ID NO: 907113 - protein, 28 aa, Mycobacterium
KAQRAADKKHDDAQAAVDAAKARLASYQ

SEQ ID NO: 907114 - protein, 12 aa, Mycobacterium
KAQSKSVGTITE

SEQ ID NO: 907115 - protein, 5 aa, Mycobacterium
KARDA

SEQ ID NO: 907116 - protein, 8 aa, Mycobacterium
KAREAGHD

SEQ ID NO: 907117 - protein, 9 aa, Mycobacterium
KAREAGQDL

SEQ ID NO: 907118 - protein, 29 aa, Mycobacterium
KAREAVTAAQRDADARQAEQAAAEERHRV

SEQ ID NO: 907119 - protein, 8 aa, Mycobacterium
KAREGGHD

SEQ ID NO: 907120 - protein, 6 aa, Mycobacterium
KARGFS

SEQ ID NO: 907121 - protein, 22 aa, Mycobacterium
KARKGAQRVTDTPKSKRSNRTV

SEQ ID NO: 907122 - protein, 13 aa, Mycobacterium
KARNNSEREANAE

SEQ ID NO: 907123 - protein, 10 aa, Mycobacterium
KASATQPPWP

SEQ ID NO: 907124 - protein, 7 aa, Mycobacterium
KASEAGI

SEQ ID NO: 907125 - protein, 5 aa, Mycobacterium
KASEV

SEQ ID NO: 907126 - protein, 13 aa, Mycobacterium
KASGNQLGNPVKA

SEQ ID NO: 907127 - protein, 7 aa, Mycobacterium
KASGSTI

SEQ ID NO: 907128 - protein, 8 aa, Mycobacterium
KASPEGRA

SEQ ID NO: 907129 - protein, 7 aa, Mycobacterium
KATDDDG

SEQ ID NO: 907130 - protein, 7 aa, Mycobacterium
KATDFRS

SEQ ID NO: 907131 - protein, 7 aa, Mycobacterium
KATGQDM

SEQ ID NO: 907132 - protein, 8 aa, Mycobacterium
KATPEAAA

SEQ ID NO: 907133 - protein, 18 aa, Mycobacterium
KAVEDTKKATDKRVRPRP

SEQ ID NO: 907134 - protein, 6 aa, Mycobacterium
KAVGDG

SEQ ID NO: 907135 - protein, 10 aa, Mycobacterium
KAVPADPGRG

SEQ ID NO: 907136 - protein, 23 aa, Mycobacterium
KAVPGDKAKGYLGSYPVGPPLGD

SEQ ID NO: 907137 - protein, 23 aa, Mycobacterium
KAVQGSKSRPFRGGFPSGPSIGE

SEQ ID NO: 907138 - protein, 9 aa, Mycobacterium
KAVSTSGNA

SEQ ID NO: 907139 - protein, 12 aa, Mycobacterium
KAVTEPAPTPIV

SEQ ID NO: 907140 - protein, 6 aa, Mycobacterium
KAYQKA

SEQ ID NO: 907141 - protein, 5 aa, Mycobacterium
KAYTE

SEQ ID NO: 907142 - protein, 17 aa, Mycobacterium
KCEPNSVAPNGGAPGDF

SEQ ID NO: 907143 - protein, 7 aa, Mycobacterium
KCSDGSW

SEQ ID NO: 907144 - protein, 9 aa, Mycobacterium
KCVDEGKPA

SEQ ID NO: 907145 - protein, 12 aa, Mycobacterium
KCVDGSGDGCTA

SEQ ID NO: 907146 - protein, 5 aa, Mycobacterium
KDAGA

SEQ ID NO: 907147 - protein, 6 aa, Mycobacterium
KDAGVD

SEQ ID NO: 907148 - protein, 5 aa, Mycobacterium
KDANS

SEQ ID NO: 907149 - protein, 6 aa, Mycobacterium
KDANSS

SEQ ID NO: 907150 - protein, 7 aa, Mycobacterium
KDANSSL

SEQ ID NO: 907151 - protein, 7 aa, Mycobacterium
KDANSSM

SEQ ID NO: 907152 - protein, 7 aa, Mycobacterium
KDANSTL

SEQ ID NO: 907153 - protein, 8 aa, Mycobacterium
KDAPHPAA

SEQ ID NO: 907154 - protein, 16 aa, Mycobacterium
KDAQPKEEGDTDLTND

SEQ ID NO: 907155 - protein, 9 aa, Mycobacterium
KDARAYASA

SEQ ID NO: 907156 - protein, 6 aa, Mycobacterium
KDASEV

SEQ ID NO: 907157 - protein, 15 aa, Mycobacterium
KDASKTDGPDNRVDA

SEQ ID NO: 907158 - protein, 8 aa, Mycobacterium
KDATSPSE

SEQ ID NO: 907159 - protein, 17 aa, Mycobacterium
KDAVGGGTASGSAGAAG

SEQ ID NO: 907160 - protein, 4 aa, Mycobacterium
KDCA

SEQ ID NO: 907161 - protein, 22 aa, Mycobacterium
KDCTDPEKRAQTSGNPLLTSLL

SEQ ID NO: 907162 - protein, 8 aa, Mycobacterium
KDDAELRT

SEQ ID NO: 907163 - protein, 20 aa, Mycobacterium
KDDPATTTATPDKPELNGHG

SEQ ID NO: 907164 - protein, 10 aa, Mycobacterium
KDDPDAAAKA

SEQ ID NO: 907165 - protein, 8 aa, Mycobacterium
KDDTELRN

SEQ ID NO: 907166 - protein, 16 aa, Mycobacterium
KDDVDPSMGWLIPPPI

SEQ ID NO: 907167 - protein, 11 aa, Mycobacterium
KDEGGAPGYQS

SEQ ID NO: 907168 - protein, 10 aa, Mycobacterium
KDEKGTDAAQ

SEQ ID NO: 907169 - protein, 9 aa, Mycobacterium
KDENGDAAA

SEQ ID NO: 907170 - protein, 11 aa, Mycobacterium
KDEQDGPAPVI

SEQ ID NO: 907171 - protein, 11 aa, Mycobacterium
KDERGRDASNL

SEQ ID NO: 907172 - protein, 19 aa, Mycobacterium
KDERSSQGMNAQTFCIVKS

SEQ ID NO: 907173 - protein, 7 aa, Mycobacterium
KDERTVN

SEQ ID NO: 907174 - protein, 5 aa, Mycobacterium
KDFGG

SEQ ID NO: 907175 - protein, 10 aa, Mycobacterium
KDFGTATDTE

SEQ ID NO: 907176 - protein, 5 aa, Mycobacterium
KDGCR

SEQ ID NO: 907177 - protein, 8 aa, Mycobacterium
KDGDTYYS

SEQ ID NO: 907178 - protein, 16 aa, Mycobacterium
KDGESATLTKDGKHYT

SEQ ID NO: 907179 - protein, 12 aa, Mycobacterium
KDGGEKLRADEI

SEQ ID NO: 907180 - protein, 17 aa, Mycobacterium
KDGGTLDLDNTSSAATV

SEQ ID NO: 907181 - protein, 7 aa, Mycobacterium
KDGGTYY

SEQ ID NO: 907182 - protein, 4 aa, Mycobacterium
KDGK

SEQ ID NO: 907183 - protein, 6 aa, Mycobacterium
KDGNHA

SEQ ID NO: 907184 - protein, 13 aa, Mycobacterium
KDGPRGVLCSLRN

SEQ ID NO: 907185 - protein, 5 aa, Mycobacterium
KDGRD

SEQ ID NO: 907186 - protein, 7 aa, Mycobacterium
KDGRRQS

SEQ ID NO: 907187 - protein, 4 aa, Mycobacterium
KDGS

SEQ ID NO: 907188 - protein, 9 aa, Mycobacterium
KDGSETGRR

SEQ ID NO: 907189 - protein, 14 aa, Mycobacterium
KDGSHRNVYEVPVN

SEQ ID NO: 907190 - protein, 11 aa, Mycobacterium
KDGTDHTECPA

SEQ ID NO: 907191 - protein, 7 aa, Mycobacterium
KDGYGED

SEQ ID NO: 907192 - protein, 7 aa, Mycobacterium
KDHGSWK

SEQ ID NO: 907193 - protein, 9 aa, Mycobacterium
KDHPDRPDH

SEQ ID NO: 907194 - protein, 13 aa, Mycobacterium
KDIASAKAQYPTS

SEQ ID NO: 907195 - protein, 7 aa, Mycobacterium
KDINNGV

SEQ ID NO: 907196 - protein, 7 aa, Mycobacterium
KDISTTE

SEQ ID NO: 907197 - protein, 6 aa, Mycobacterium
KDITEN

SEQ ID NO: 907198 - protein, 8 aa, Mycobacterium
KDKASASF

SEQ ID NO: 907199 - protein, 5 aa, Mycobacterium
KDKDA

SEQ ID NO: 907200 - protein, 12 aa, Mycobacterium
KDKSGADPSNVE

SEQ ID NO: 907201 - protein, 11 aa, Mycobacterium
KDKSGKDPTNL

SEQ ID NO: 907202 - protein, 10 aa, Mycobacterium
KDKSGTSENF

SEQ ID NO: 907203 - protein, 10 aa, Mycobacterium
KDKVETGEVT

SEQ ID NO: 907204 - protein, 8 aa, Mycobacterium
KDLEPQSS

SEQ ID NO: 907205 - protein, 9 aa, Mycobacterium
KDLEPQSSR

SEQ ID NO: 907206 - protein, 8 aa, Mycobacterium
KDLGGTSD

SEQ ID NO: 907207 - protein, 14 aa, Mycobacterium
KDNGTITKIYKQAT

SEQ ID NO: 907208 - protein, 18 aa, Mycobacterium
KDNGVACPGGGTAPSTET

SEQ ID NO: 907209 - protein, 7 aa, Mycobacterium
KDPATGV

SEQ ID NO: 907210 - protein, 8 aa, Mycobacterium
KDPDARGL

SEQ ID NO: 907211 - protein, 7 aa, Mycobacterium
KDPDTTA

SEQ ID NO: 907212 - protein, 4 aa, Mycobacterium
KDPG

SEQ ID NO: 907213 - protein, 7 aa, Mycobacterium
KDPGESF

SEQ ID NO: 907214 - protein, 10 aa, Mycobacterium
KDPGQAVAAG

SEQ ID NO: 907215 - protein, 12 aa, Mycobacterium
KDPKKPTSDPME

SEQ ID NO: 907216 - protein, 7 aa, Mycobacterium
KDPLKTA

SEQ ID NO: 907217 - protein, 110 aa, Mycobacterium
KDPPATSASPSPTTSPSPPPPEGGGGNGGDGQGGGNGGDGQGGGNDHNDGQRGGDQNGQPNSLPGEPTQEGPSPGQPTQAPTPVGPDRIPTSGANGANELHPDQGDPADV

SEQ ID NO: 907218 - protein, 14 aa, Mycobacterium
KDPRATPVGDAERD

SEQ ID NO: 907219 - protein, 10 aa, Mycobacterium
KDQETRNATR

SEQ ID NO: 907220 - protein, 8 aa, Mycobacterium
KDQNPGMT

SEQ ID NO: 907221 - protein, 5 aa, Mycobacterium
KDQQR

SEQ ID NO: 907222 - protein, 18 aa, Mycobacterium
KDQRPIPTGTALGPQGKQ

SEQ ID NO: 907223 - protein, 5 aa, Mycobacterium
KDRAA

SEQ ID NO: 907224 - protein, 6 aa, Mycobacterium
KDRPEV

SEQ ID NO: 907225 - protein, 8 aa, Mycobacterium
KDRQDRFN

SEQ ID NO: 907226 - protein, 9 aa, Mycobacterium
KDRRSDQAL

SEQ ID NO: 907227 - protein, 14 aa, Mycobacterium
KDRVVDENDRAGSG

SEQ ID NO: 907228 - protein, 9 aa, Mycobacterium
KDSGAKGEI

SEQ ID NO: 907229 - protein, 9 aa, Mycobacterium
KDSGDIETA

SEQ ID NO: 907230 - protein, 10 aa, Mycobacterium
KDSGERNDVA

SEQ ID NO: 907231 - protein, 9 aa, Mycobacterium
KDSGGQHTW

SEQ ID NO: 907232 - protein, 9 aa, Mycobacterium
KDSGIEDGK

SEQ ID NO: 907233 - protein, 8 aa, Mycobacterium
KDSHGEPT

SEQ ID NO: 907234 - protein, 5 aa, Mycobacterium
KDSKG

SEQ ID NO: 907235 - protein, 6 aa, Mycobacterium
KDSRTV

SEQ ID NO: 907236 - protein, 7 aa, Mycobacterium
KDSSAAT

SEQ ID NO: 907237 - protein, 7 aa, Mycobacterium
KDTAAGP

SEQ ID NO: 907238 - protein, 11 aa, Mycobacterium
KDTAGAAAGLA

SEQ ID NO: 907239 - protein, 6 aa, Mycobacterium
KDTLNK

SEQ ID NO: 907240 - protein, 5 aa, Mycobacterium
KDTQD

SEQ ID NO: 907241 - protein, 9 aa, Mycobacterium
KDVIKSGGE

SEQ ID NO: 907242 - protein, 11 aa, Mycobacterium
KDWDADATRGI

SEQ ID NO: 907243 - protein, 8 aa, Mycobacterium
KEAALQPD

SEQ ID NO: 907244 - protein, 9 aa, Mycobacterium
KEAEGQKQA

SEQ ID NO: 907245 - protein, 8 aa, Mycobacterium
KEAGRTGV

SEQ ID NO: 907246 - protein, 14 aa, Mycobacterium
KEAPDLQKAATAHS

SEQ ID NO: 907247 - protein, 7 aa, Mycobacterium
KEDAVAE

SEQ ID NO: 907248 - protein, 15 aa, Mycobacterium
KEDGSAPTNGAPLSY

SEQ ID NO: 907249 - protein, 8 aa, Mycobacterium
KEDGTTFG

SEQ ID NO: 907250 - protein, 8 aa, Mycobacterium
KEDLKSTV

SEQ ID NO: 907251 - protein, 9 aa, Mycobacterium
KEDPEYKGG

SEQ ID NO: 907252 - protein, 8 aa, Mycobacterium
KEDPYAGE

SEQ ID NO: 907253 - protein, 9 aa, Mycobacterium
KEDRQNSYH

SEQ ID NO: 907254 - protein, 9 aa, Mycobacterium
KEDSITGYR

SEQ ID NO: 907255 - protein, 11 aa, Mycobacterium
KEEDAASKDRL

SEQ ID NO: 907256 - protein, 11 aa, Mycobacterium
KEEDDASKDRL

SEQ ID NO: 907257 - protein, 11 aa, Mycobacterium
KEEDEASKERL

SEQ ID NO: 907258 - protein, 7 aa, Mycobacterium
KEGDGEG

SEQ ID NO: 907259 - protein, 14 aa, Mycobacterium
KEGGKRVRVITQWR

SEQ ID NO: 907260 - protein, 7 aa, Mycobacterium
KEGKPPF

SEQ ID NO: 907261 - protein, 16 aa, Mycobacterium
KEHAGKDFSAIIEALR

SEQ ID NO: 907262 - protein, 6 aa, Mycobacterium
KEHGRA

SEQ ID NO: 907263 - protein, 8 aa, Mycobacterium
KEKANPQA

SEQ ID NO: 907264 - protein, 6 aa, Mycobacterium
KEKPKT

SEQ ID NO: 907265 - protein, 6 aa, Mycobacterium
KEPPKR

SEQ ID NO: 907266 - protein, 7 aa, Mycobacterium
KEPPKRV

SEQ ID NO: 907267 - protein, 7 aa, Mycobacterium
KEPPTRV

SEQ ID NO: 907268 - protein, 8 aa, Mycobacterium
KEPSLQAA

SEQ ID NO: 907269 - protein, 7 aa, Mycobacterium
KEPVSVG

SEQ ID NO: 907270 - protein, 6 aa, Mycobacterium
KEQAGA

SEQ ID NO: 907271 - protein, 6 aa, Mycobacterium
KEQHGH

SEQ ID NO: 907272 - protein, 4 aa, Mycobacterium
KEQL

SEQ ID NO: 907273 - protein, 11 aa, Mycobacterium
KEQVAEQLTRN

SEQ ID NO: 907274 - protein, 4 aa, Mycobacterium
KERL

SEQ ID NO: 907275 - protein, 5 aa, Mycobacterium
KERLQ

SEQ ID NO: 907276 - protein, 4 aa, Mycobacterium
KESI

SEQ ID NO: 907277 - protein, 6 aa, Mycobacterium
KESLGR

SEQ ID NO: 907278 - protein, 8 aa, Mycobacterium
KESRIDPN

SEQ ID NO: 907279 - protein, 5 aa, Mycobacterium
KETFG

SEQ ID NO: 907280 - protein, 4 aa, Mycobacterium
KETG

SEQ ID NO: 907281 - protein, 7 aa, Mycobacterium
KETPPSI

SEQ ID NO: 907282 - protein, 9 aa, Mycobacterium
KETQPEQAS

SEQ ID NO: 907283 - protein, 12 aa, Mycobacterium
KEVSEVQGVIAG

SEQ ID NO: 907284 - protein, 12 aa, Mycobacterium
KEVSQVQGVIAP

SEQ ID NO: 907285 - protein, 9 aa, Mycobacterium
KEYGDPGQV

SEQ ID NO: 907286 - protein, 8 aa, Mycobacterium
KFAGEGND

SEQ ID NO: 907287 - protein, 10 aa, Mycobacterium
KFEPQRSQGF

SEQ ID NO: 907288 - protein, 10 aa, Mycobacterium
KFGTGATGRT

SEQ ID NO: 907289 - protein, 7 aa, Mycobacterium
KFGTGSD

SEQ ID NO: 907290 - protein, 17 aa, Mycobacterium
KFNEQNSLTPMEQPGPE

SEQ ID NO: 907291 - protein, 14 aa, Mycobacterium
KFNQEPGTYSTEGY

SEQ ID NO: 907292 - protein, 17 aa, Mycobacterium
KFPSSGPYKLDGYNDDG

SEQ ID NO: 907293 - protein, 4 aa, Mycobacterium
KFRT

SEQ ID NO: 907294 - protein, 8 aa, Mycobacterium
KGADAVTA

SEQ ID NO: 907295 - protein, 7 aa, Mycobacterium
KGAGYAD

SEQ ID NO: 907296 - protein, 8 aa, Mycobacterium
KGANTGQA

SEQ ID NO: 907297 - protein, 5 aa, Mycobacterium
KGASM

SEQ ID NO: 907298 - protein, 9 aa, Mycobacterium
KGASWPPGE

SEQ ID NO: 907299 - protein, 10 aa, Mycobacterium
KGDAAKTAAT

SEQ ID NO: 907300 - protein, 4 aa, Mycobacterium
KGDD

SEQ ID NO: 907301 - protein, 6 aa, Mycobacterium
KGDGRV

SEQ ID NO: 907302 - protein, 9 aa, Mycobacterium
KGDQATAEL

SEQ ID NO: 907303 - protein, 5 aa, Mycobacterium
KGEGN

SEQ ID NO: 907304 - protein, 5 aa, Mycobacterium
KGEGR

SEQ ID NO: 907305 - protein, 10 aa, Mycobacterium
KGEVKGAPDV

SEQ ID NO: 907306 - protein, 11 aa, Mycobacterium
KGEYADGDDPW

SEQ ID NO: 907307 - protein, 10 aa, Mycobacterium
KGEYTQDEDP

SEQ ID NO: 907308 - protein, 33 aa, Mycobacterium
KGFGTGSVGNNDGGHVKSSQVRAAKTDDLGAQQ

SEQ ID NO: 907309 - protein, 14 aa, Mycobacterium
KGFTTGSVGNNEAG

SEQ ID NO: 907310 - protein, 26 aa, Mycobacterium
KGGAGGAGGVGGLGQAGGTGGNGGAG

SEQ ID NO: 907311 - protein, 12 aa, Mycobacterium
KGGDHQVPNARK

SEQ ID NO: 907312 - protein, 8 aa, Mycobacterium
KGGDSCAA

SEQ ID NO: 907313 - protein, 6 aa, Mycobacterium
KGGDYD

SEQ ID NO: 907314 - protein, 14 aa, Mycobacterium
KGGFTTTVTQTGTI

SEQ ID NO: 907315 - protein, 8 aa, Mycobacterium
KGGNLPGD

SEQ ID NO: 907316 - protein, 8 aa, Mycobacterium
KGGPATIG

SEQ ID NO: 907317 - protein, 8 aa, Mycobacterium
KGGPTDIE

SEQ ID NO: 907318 - protein, 6 aa, Mycobacterium
KGGTAK

SEQ ID NO: 907319 - protein, 9 aa, Mycobacterium
KGHAEALTP

SEQ ID NO: 907320 - protein, 21 aa, Mycobacterium
KGHESGQTVGDHTRPFDDRDE

SEQ ID NO: 907321 - protein, 15 aa, Mycobacterium
KGHETGQRAAGEVRP

SEQ ID NO: 907322 - protein, 5 aa, Mycobacterium
KGIDR

SEQ ID NO: 907323 - protein, 10 aa, Mycobacterium
KGIRAGSSFR

SEQ ID NO: 907324 - protein, 9 aa, Mycobacterium
KGISPSGNA

SEQ ID NO: 907325 - protein, 8 aa, Mycobacterium
KGISQTGN

SEQ ID NO: 907326 - protein, 6 aa, Mycobacterium
KGKTGL

SEQ ID NO: 907327 - protein, 8 aa, Mycobacterium
KGLAPDGH

SEQ ID NO: 907328 - protein, 8 aa, Mycobacterium
KGLAPGGH

SEQ ID NO: 907329 - protein, 19 aa, Mycobacterium
KGLAPGGHAAVGASQGGYA

SEQ ID NO: 907330 - protein, 4 aa, Mycobacterium
KGLC

SEQ ID NO: 907331 - protein, 15 aa, Mycobacterium
KGLGSSDGSKGCPKD

SEQ ID NO: 907332 - protein, 29 aa, Mycobacterium
KGLKGPRAKQKKVKNENETQSESASESDS

SEQ ID NO: 907333 - protein, 5 aa, Mycobacterium
KGLNK

SEQ ID NO: 907334 - protein, 5 aa, Mycobacterium
KGMPP

SEQ ID NO: 907335 - protein, 10 aa, Mycobacterium
KGNENADTGA

SEQ ID NO: 907336 - protein, 8 aa, Mycobacterium
KGNPDGER

SEQ ID NO: 907337 - protein, 8 aa, Mycobacterium
KGNPKHVK

SEQ ID NO: 907338 - protein, 8 aa, Mycobacterium
KGNPKNIR

SEQ ID NO: 907339 - protein, 7 aa, Mycobacterium
KGNPQKT

SEQ ID NO: 907340 - protein, 7 aa, Mycobacterium
KGNPTGG

SEQ ID NO: 907341 - protein, 6 aa, Mycobacterium
KGNQGI

SEQ ID NO: 907342 - protein, 6 aa, Mycobacterium
KGNRLP

SEQ ID NO: 907343 - protein, 5 aa, Mycobacterium
KGPDL

SEQ ID NO: 907344 - protein, 24 aa, Mycobacterium
KGPDLTTISTTAPYEQRRAVSPQV

SEQ ID NO: 907345 - protein, 5 aa, Mycobacterium
KGPDV

SEQ ID NO: 907346 - protein, 6 aa, Mycobacterium
KGPGYQ

SEQ ID NO: 907347 - protein, 7 aa, Mycobacterium
KGPHPAT

SEQ ID NO: 907348 - protein, 8 aa, Mycobacterium
KGPHPDTY

SEQ ID NO: 907349 - protein, 8 aa, Mycobacterium
KGPIEPDP

SEQ ID NO: 907350 - protein, 6 aa, Mycobacterium
KGPLAD

SEQ ID NO: 907351 - protein, 7 aa, Mycobacterium
KGPLPGD

SEQ ID NO: 907352 - protein, 7 aa, Mycobacterium
KGPPRRY

SEQ ID NO: 907353 - protein, 13 aa, Mycobacterium
KGPTSPPEERGSL

SEQ ID NO: 907354 - protein, 5 aa, Mycobacterium
KGQED

SEQ ID NO: 907355 - protein, 9 aa, Mycobacterium
KGQPRSDMR

SEQ ID NO: 907356 - protein, 6 aa, Mycobacterium
KGRQDY

SEQ ID NO: 907357 - protein, 5 aa, Mycobacterium
KGSAI

SEQ ID NO: 907358 - protein, 4 aa, Mycobacterium
KGSD

SEQ ID NO: 907359 - protein, 11 aa, Mycobacterium
KGSDSDTSSAI

SEQ ID NO: 907360 - protein, 8 aa, Mycobacterium
KGSEEPHG

SEQ ID NO: 907361 - protein, 14 aa, Mycobacterium
KGSLAAQAALGSGN

SEQ ID NO: 907362 - protein, 12 aa, Mycobacterium
KGSLSAASRECG

SEQ ID NO: 907363 - protein, 7 aa, Mycobacterium
KGSPLAQ

SEQ ID NO: 907364 - protein, 8 aa, Mycobacterium
KGSPLAQS

SEQ ID NO: 907365 - protein, 10 aa, Mycobacterium
KGSRPDPSEY

SEQ ID NO: 907366 - protein, 4 aa, Mycobacterium
KGSV

SEQ ID NO: 907367 - protein, 6 aa, Mycobacterium
KGSVTV

SEQ ID NO: 907368 - protein, 28 aa, Mycobacterium
KGTATGVDMSNPQQPQQVTKSFELDVTC

SEQ ID NO: 907369 - protein, 5 aa, Mycobacterium
KGTGC

SEQ ID NO: 907370 - protein, 14 aa, Mycobacterium
KGTGSITNIYMQAT

SEQ ID NO: 907371 - protein, 10 aa, Mycobacterium
KGTGYGAPAY

SEQ ID NO: 907372 - protein, 7 aa, Mycobacterium
KGTKNPV

SEQ ID NO: 907373 - protein, 6 aa, Mycobacterium
KGTPNV

SEQ ID NO: 907374 - protein, 8 aa, Mycobacterium
KGTPQEVR

SEQ ID NO: 907375 - protein, 5 aa, Mycobacterium
KGTTP

SEQ ID NO: 907376 - protein, 7 aa, Mycobacterium
KGTTTGE

SEQ ID NO: 907377 - protein, 7 aa, Mycobacterium
KGTTTGQ

SEQ ID NO: 907378 - protein, 10 aa, Mycobacterium
KGVDGDPYKS

SEQ ID NO: 907379 - protein, 9 aa, Mycobacterium
KGVDPNRNA

SEQ ID NO: 907380 - protein, 6 aa, Mycobacterium
KGVEGA

SEQ ID NO: 907381 - protein, 9 aa, Mycobacterium
KGVKPTGSG

SEQ ID NO: 907382 - protein, 4 aa, Mycobacterium
KGVR

SEQ ID NO: 907383 - protein, 10 aa, Mycobacterium
KGVSPTGNAA

SEQ ID NO: 907384 - protein, 8 aa, Mycobacterium
KGVSPVGN

SEQ ID NO: 907385 - protein, 5 aa, Mycobacterium
KGVSQ

SEQ ID NO: 907386 - protein, 14 aa, Mycobacterium
KGWNPQTQSIDPAG

SEQ ID NO: 907387 - protein, 6 aa, Mycobacterium
KGYADD

SEQ ID NO: 907388 - protein, 14 aa, Mycobacterium
KGYPEPGPGGREAP

SEQ ID NO: 907389 - protein, 7 aa, Mycobacterium
KGYPLGG

SEQ ID NO: 907390 - protein, 11 aa, Mycobacterium
KGYQQGDPYGN

SEQ ID NO: 907391 - protein, 6 aa, Mycobacterium
KGYSQS

SEQ ID NO: 907392 - protein, 13 aa, Mycobacterium
KHAPPPPDQNAAR

SEQ ID NO: 907393 - protein, 6 aa, Mycobacterium
KHDAMK

SEQ ID NO: 907394 - protein, 8 aa, Mycobacterium
KHGDDKPV

SEQ ID NO: 907395 - protein, 10 aa, Mycobacterium
KHNDAEKAKG

SEQ ID NO: 907396 - protein, 7 aa, Mycobacterium
KHTDLEE

SEQ ID NO: 907397 - protein, 5 aa, Mycobacterium
KHVTG

SEQ ID NO: 907398 - protein, 10 aa, Mycobacterium
KIADNGRKQI

SEQ ID NO: 907399 - protein, 7 aa, Mycobacterium
KIAGGAQ

SEQ ID NO: 907400 - protein, 25 aa, Mycobacterium
KIDPERTADDITAQVQKAVDGKGLL

SEQ ID NO: 907401 - protein, 14 aa, Mycobacterium
KIDTSLSGKLGGDM

SEQ ID NO: 907402 - protein, 15 aa, Mycobacterium
KIEKPGTIRRPEGAD

SEQ ID NO: 907403 - protein, 8 aa, Mycobacterium
KIEPEPDR

SEQ ID NO: 907404 - protein, 8 aa, Mycobacterium
KIEPQPER

SEQ ID NO: 907405 - protein, 7 aa, Mycobacterium
KIETGTD

SEQ ID NO: 907406 - protein, 6 aa, Mycobacterium
KIGSDE

SEQ ID NO: 907407 - protein, 19 aa, Mycobacterium
KIPDYKGIDPTSITTTPDG

SEQ ID NO: 907408 - protein, 5 aa, Mycobacterium
KIPRD

SEQ ID NO: 907409 - protein, 8 aa, Mycobacterium
KIPSSQMR

SEQ ID NO: 907410 - protein, 8 aa, Mycobacterium
KIPTSQMR

SEQ ID NO: 907411 - protein, 6 aa, Mycobacterium
KIRGGN

SEQ ID NO: 907412 - protein, 5 aa, Mycobacterium
KISGS

SEQ ID NO: 907413 - protein, 7 aa, Mycobacterium
KISRPPV

SEQ ID NO: 907414 - protein, 36 aa, Mycobacterium
KISSAGTESVTGIDTAEDGGVEQTGSITDTPREPDA

SEQ ID NO: 907415 - protein, 6 aa, Mycobacterium
KISSGA

SEQ ID NO: 907416 - protein, 6 aa, Mycobacterium
KITGEE

SEQ ID NO: 907417 - protein, 7 aa, Mycobacterium
KITPEGG

SEQ ID NO: 907418 - protein, 7 aa, Mycobacterium
KKAGTTG

SEQ ID NO: 907419 - protein, 29 aa, Mycobacterium
KKANERAKASAEKARERTQKAVKDAQDRV

SEQ ID NO: 907420 - protein, 7 aa, Mycobacterium
KKAVQAV

SEQ ID NO: 907421 - protein, 11 aa, Mycobacterium
KKDGSNESQDA

SEQ ID NO: 907422 - protein, 6 aa, Mycobacterium
KKDNGL

SEQ ID NO: 907423 - protein, 4 aa, Mycobacterium
KKEP

SEQ ID NO: 907424 - protein, 8 aa, Mycobacterium
KKEQDPAR

SEQ ID NO: 907425 - protein, 9 aa, Mycobacterium
KKGDKDFSA

SEQ ID NO: 907426 - protein, 5 aa, Mycobacterium
KKGFR

SEQ ID NO: 907427 - protein, 8 aa, Mycobacterium
KKGPVPVD

SEQ ID NO: 907428 - protein, 9 aa, Mycobacterium
KKGQDDRGK

SEQ ID NO: 907429 - protein, 27 aa, Mycobacterium
KKITGKDKTKSTSSSSTDSDKDKGGSE

SEQ ID NO: 907430 - protein, 11 aa, Mycobacterium
KKKYKGKEARV

SEQ ID NO: 907431 - protein, 9 aa, Mycobacterium
KKLEAQRGV

SEQ ID NO: 907432 - protein, 8 aa, Mycobacterium
KKLSAPVG

SEQ ID NO: 907433 - protein, 9 aa, Mycobacterium
KKMPASNTQ

SEQ ID NO: 907434 - protein, 17 aa, Mycobacterium
KKPDAPPAPDLPIGDTA

SEQ ID NO: 907435 - protein, 11 aa, Mycobacterium
KKPEPLNDPAA

SEQ ID NO: 907436 - protein, 18 aa, Mycobacterium
KKQVPAGQINANNATANV

SEQ ID NO: 907437 - protein, 8 aa, Mycobacterium
KKRLPNST

SEQ ID NO: 907438 - protein, 7 aa, Mycobacterium
KKRRNPS

SEQ ID NO: 907439 - protein, 9 aa, Mycobacterium
KKSDVPATM

SEQ ID NO: 907440 - protein, 9 aa, Mycobacterium
KKSIGPDKI

SEQ ID NO: 907441 - protein, 7 aa, Mycobacterium
KKTGPKW

SEQ ID NO: 907442 - protein, 41 aa, Mycobacterium
KKTRVTVPKAEPSTKAKPATKPDNDNDDTSDTTDKTAEKDA

SEQ ID NO: 907443 - protein, 6 aa, Mycobacterium
KLADTQ

SEQ ID NO: 907444 - protein, 12 aa, Mycobacterium
KLAEEWSNGAYA

SEQ ID NO: 907445 - protein, 14 aa, Mycobacterium
KLAGGDAAVPTADN

SEQ ID NO: 907446 - protein, 11 aa, Mycobacterium
KLAKRSKQAKR

SEQ ID NO: 907447 - protein, 19 aa, Mycobacterium
KLAPGGAGPGDPPEIPPTV

SEQ ID NO: 907448 - protein, 7 aa, Mycobacterium
KLAQSGT

SEQ ID NO: 907449 - protein, 23 aa, Mycobacterium
KLATESAATSVKSVADSGDVKDV

SEQ ID NO: 907450 - protein, 5 aa, Mycobacterium
KLDSE

SEQ ID NO: 907451 - protein, 10 aa, Mycobacterium
KLEAQKPQNF

SEQ ID NO: 907452 - protein, 5 aa, Mycobacterium
KLGAA

SEQ ID NO: 907453 - protein, 6 aa, Mycobacterium
KLGAAQ

SEQ ID NO: 907454 - protein, 15 aa, Mycobacterium
KLGAPNGRIKASHCS

SEQ ID NO: 907455 - protein, 16 aa, Mycobacterium
KLGESPSLSEDARGKL

SEQ ID NO: 907456 - protein, 9 aa, Mycobacterium
KLGGPTQTH

SEQ ID NO: 907457 - protein, 4 aa, Mycobacterium
KLGK

SEQ ID NO: 907458 - protein, 11 aa, Mycobacterium
KLGNTGNSNAP

SEQ ID NO: 907459 - protein, 8 aa, Mycobacterium
KLGPSRTA

SEQ ID NO: 907460 - protein, 5 aa, Mycobacterium
KLGRA

SEQ ID NO: 907461 - protein, 4 aa, Mycobacterium
KLGT

SEQ ID NO: 907462 - protein, 8 aa, Mycobacterium
KLNGPDAH

SEQ ID NO: 907463 - protein, 8 aa, Mycobacterium
KLNGPDAR

SEQ ID NO: 907464 - protein, 8 aa, Mycobacterium
KLNPDNTV

SEQ ID NO: 907465 - protein, 4 aa, Mycobacterium
KLPD

SEQ ID NO: 907466 - protein, 21 aa, Mycobacterium
KLPDAPVSDDEDTEEAVDPAL

SEQ ID NO: 907467 - protein, 22 aa, Mycobacterium
KLPETPAPTQEQLAEGQKEVGQ

SEQ ID NO: 907468 - protein, 16 aa, Mycobacterium
KLPPGATINSQHTQPA

SEQ ID NO: 907469 - protein, 16 aa, Mycobacterium
KLPPGGTINAQHTQPA

SEQ ID NO: 907470 - protein, 9 aa, Mycobacterium
KLPPPNSTL

SEQ ID NO: 907471 - protein, 7 aa, Mycobacterium
KLPRSSG

SEQ ID NO: 907472 - protein, 7 aa, Mycobacterium
KLPVGDG

SEQ ID NO: 907473 - protein, 10 aa, Mycobacterium
KLPYERPPLS

SEQ ID NO: 907474 - protein, 4 aa, Mycobacterium
KLRP

SEQ ID NO: 907475 - protein, 9 aa, Mycobacterium
KLSDERKRN

SEQ ID NO: 907476 - protein, 8 aa, Mycobacterium
KLSKRDSV

SEQ ID NO: 907477 - protein, 7 aa, Mycobacterium
KLSLDDP

SEQ ID NO: 907478 - protein, 12 aa, Mycobacterium
KLSQPVTTPDGN

SEQ ID NO: 907479 - protein, 6 aa, Mycobacterium
KLTDER

SEQ ID NO: 907480 - protein, 7 aa, Mycobacterium
KLTDGST

SEQ ID NO: 907481 - protein, 7 aa, Mycobacterium
KLTEAQL

SEQ ID NO: 907482 - protein, 8 aa, Mycobacterium
KLTKDGKI

SEQ ID NO: 907483 - protein, 5 aa, Mycobacterium
KLTKG

SEQ ID NO: 907484 - protein, 8 aa, Mycobacterium
KLTPKDQP

SEQ ID NO: 907485 - protein, 7 aa, Mycobacterium
KLTTEGV

SEQ ID NO: 907486 - protein, 8 aa, Mycobacterium
KLTTSGVA

SEQ ID NO: 907487 - protein, 13 aa, Mycobacterium
KMAEGNGMSYETA

SEQ ID NO: 907488 - protein, 8 aa, Mycobacterium
KMEDSGAW

SEQ ID NO: 907489 - protein, 9 aa, Mycobacterium
KMESSGAWK

SEQ ID NO: 907490 - protein, 9 aa, Mycobacterium
KMPKKYGVK

SEQ ID NO: 907491 - protein, 12 aa, Mycobacterium
KMPRSSGEQYKV

SEQ ID NO: 907492 - protein, 8 aa, Mycobacterium
KMPSAPLY

SEQ ID NO: 907493 - protein, 12 aa, Mycobacterium
KMRGDQGSGRPA

SEQ ID NO: 907494 - protein, 4 aa, Mycobacterium
KMSA

SEQ ID NO: 907495 - protein, 7 aa, Mycobacterium
KMSPSNV

SEQ ID NO: 907496 - protein, 5 aa, Mycobacterium
KMTPR

SEQ ID NO: 907497 - protein, 7 aa, Mycobacterium
KNAAPDA

SEQ ID NO: 907498 - protein, 4 aa, Mycobacterium
KNAD

SEQ ID NO: 907499 - protein, 18 aa, Mycobacterium
KNADDAARMQSPDGRANY

SEQ ID NO: 907500 - protein, 9 aa, Mycobacterium
KNAEPEEAD

SEQ ID NO: 907501 - protein, 18 aa, Mycobacterium
KNAGDAARMESADGRAAY

SEQ ID NO: 907502 - protein, 7 aa, Mycobacterium
KNAKDSL

SEQ ID NO: 907503 - protein, 9 aa, Mycobacterium
KNAPPGEAT

SEQ ID NO: 907504 - protein, 31 aa, Mycobacterium
KNAPRPAGDDTAGPPPGADLGKKTDPTPKGR

SEQ ID NO: 907505 - protein, 4 aa, Mycobacterium
KNAQ

SEQ ID NO: 907506 - protein, 17 aa, Mycobacterium
KNAQAAASKYNDAAGEK

SEQ ID NO: 907507 - protein, 9 aa, Mycobacterium
KNAQPEQAD

SEQ ID NO: 907508 - protein, 4 aa, Mycobacterium
KNAR

SEQ ID NO: 907509 - protein, 8 aa, Mycobacterium
KNASREDR

SEQ ID NO: 907510 - protein, 9 aa, Mycobacterium
KNATGLKNG

SEQ ID NO: 907511 - protein, 7 aa, Mycobacterium
KNEAPGV

SEQ ID NO: 907512 - protein, 4 aa, Mycobacterium
KNEF

SEQ ID NO: 907513 - protein, 4 aa, Mycobacterium
KNEL

SEQ ID NO: 907514 - protein, 8 aa, Mycobacterium
KNELGQTP

SEQ ID NO: 907515 - protein, 7 aa, Mycobacterium
KNEPAGV

SEQ ID NO: 907516 - protein, 9 aa, Mycobacterium
KNGAKAAAQ

SEQ ID NO: 907517 - protein, 11 aa, Mycobacterium
KNGDPDPVDSA

SEQ ID NO: 907518 - protein, 7 aa, Mycobacterium
KNGDTHI

SEQ ID NO: 907519 - protein, 4 aa, Mycobacterium
KNGQ

SEQ ID NO: 907520 - protein, 6 aa, Mycobacterium
KNGTGE

SEQ ID NO: 907521 - protein, 6 aa, Mycobacterium
KNGTVS

SEQ ID NO: 907522 - protein, 4 aa, Mycobacterium
KNIG

SEQ ID NO: 907523 - protein, 11 aa, Mycobacterium
KNKPPHVQQAA

SEQ ID NO: 907524 - protein, 18 aa, Mycobacterium
KNLGPAGIQAPQPPAVDR

SEQ ID NO: 907525 - protein, 7 aa, Mycobacterium
KNNAAGR

SEQ ID NO: 907526 - protein, 7 aa, Mycobacterium
KNNPGAN

SEQ ID NO: 907527 - protein, 16 aa, Mycobacterium
KNPAPAPAEPVYPNYA

SEQ ID NO: 907528 - protein, 8 aa, Mycobacterium
KNPDGKRT

SEQ ID NO: 907529 - protein, 7 aa, Mycobacterium
KNPDRPT

SEQ ID NO: 907530 - protein, 24 aa, Mycobacterium
KNPLGEAVAPPPGVMGPDRLPTGG

SEQ ID NO: 907531 - protein, 23 aa, Mycobacterium
KNPTINDGITNAAKGAPEGQRRE

SEQ ID NO: 907532 - protein, 5 aa, Mycobacterium
KNPVD

SEQ ID NO: 907533 - protein, 33 aa, Mycobacterium
KNQTAVEPLPPMPTPSSTLKPPTTRTMTPTPSI

SEQ ID NO: 907534 - protein, 7 aa, Mycobacterium
KNREAAA

SEQ ID NO: 907535 - protein, 7 aa, Mycobacterium
KNRRSQA

SEQ ID NO: 907536 - protein, 12 aa, Mycobacterium
KNSALSEGKANQ

SEQ ID NO: 907537 - protein, 9 aa, Mycobacterium
KNSDTSTAM

SEQ ID NO: 907538 - protein, 9 aa, Mycobacterium
KNSGGDMTR

SEQ ID NO: 907539 - protein, 9 aa, Mycobacterium
KNSGGELTR

SEQ ID NO: 907540 - protein, 9 aa, Mycobacterium
KNSGGQMTR

SEQ ID NO: 907541 - protein, 6 aa, Mycobacterium
KNSTAA

SEQ ID NO: 907542 - protein, 9 aa, Mycobacterium
KNSTPTNNG

SEQ ID NO: 907543 - protein, 17 aa, Mycobacterium
KNTKLPKNATAKIGQTS

SEQ ID NO: 907544 - protein, 12 aa, Mycobacterium
KNVAEDLDGDPG

SEQ ID NO: 907545 - protein, 5 aa, Mycobacterium
KNVPD

SEQ ID NO: 907546 - protein, 5 aa, Mycobacterium
KNVPE

SEQ ID NO: 907547 - protein, 4 aa, Mycobacterium
KNVR

SEQ ID NO: 907548 - protein, 6 aa, Mycobacterium
KPAAPF

SEQ ID NO: 907549 - protein, 9 aa, Mycobacterium
KPAAPGQGQ

SEQ ID NO: 907550 - protein, 11 aa, Mycobacterium
KPADEQLSTEI

SEQ ID NO: 907551 - protein, 7 aa, Mycobacterium
KPAGGTD

SEQ ID NO: 907552 - protein, 6 aa, Mycobacterium
KPAGMD

SEQ ID NO: 907553 - protein, 6 aa, Mycobacterium
KPAGVA

SEQ ID NO: 907554 - protein, 14 aa, Mycobacterium
KPAIKDKATVVEQD

SEQ ID NO: 907555 - protein, 12 aa, Mycobacterium
KPAKTNDPRGLS

SEQ ID NO: 907556 - protein, 7 aa, Mycobacterium
KPALVSG

SEQ ID NO: 907557 - protein, 7 aa, Mycobacterium
KPAPPEV

SEQ ID NO: 907558 - protein, 15 aa, Mycobacterium
KPAQAPAPEISRTTA

SEQ ID NO: 907559 - protein, 6 aa, Mycobacterium
KPASNM

SEQ ID NO: 907560 - protein, 12 aa, Mycobacterium
KPATDPVDAETV

SEQ ID NO: 907561 - protein, 6 aa, Mycobacterium
KPDAMQ

SEQ ID NO: 907562 - protein, 6 aa, Mycobacterium
KPDGTM

SEQ ID NO: 907563 - protein, 15 aa, Mycobacterium
KPDLQGTLGASPGGG

SEQ ID NO: 907564 - protein, 5 aa, Mycobacterium
KPDLR

SEQ ID NO: 907565 - protein, 9 aa, Mycobacterium
KPDQGAKRI

SEQ ID NO: 907566 - protein, 8 aa, Mycobacterium
KPDRAYTD

SEQ ID NO: 907567 - protein, 5 aa, Mycobacterium
KPDRT

SEQ ID NO: 907568 - protein, 8 aa, Mycobacterium
KPDTFTDR

SEQ ID NO: 907569 - protein, 7 aa, Mycobacterium
KPDTVQK

SEQ ID NO: 907570 - protein, 5 aa, Mycobacterium
KPDVP

SEQ ID NO: 907571 - protein, 6 aa, Mycobacterium
KPEDAV

SEQ ID NO: 907572 - protein, 13 aa, Mycobacterium
KPELTVGGRPVEA

SEQ ID NO: 907573 - protein, 19 aa, Mycobacterium
KPELYTDGSSDDATPFNPK

SEQ ID NO: 907574 - protein, 6 aa, Mycobacterium
KPEYQG

SEQ ID NO: 907575 - protein, 5 aa, Mycobacterium
KPFGN

SEQ ID NO: 907576 - protein, 5 aa, Mycobacterium
KPFNP

SEQ ID NO: 907577 - protein, 15 aa, Mycobacterium
KPGAGAGKRVRTGGH

SEQ ID NO: 907578 - protein, 8 aa, Mycobacterium
KPGAPAPV

SEQ ID NO: 907579 - protein, 12 aa, Mycobacterium
KPGDKVKKGQEI

SEQ ID NO: 907580 - protein, 11 aa, Mycobacterium
KPGGLTGAERE

SEQ ID NO: 907581 - protein, 9 aa, Mycobacterium
KPGIDGAAG

SEQ ID NO: 907582 - protein, 8 aa, Mycobacterium
KPGKDSHP

SEQ ID NO: 907583 - protein, 7 aa, Mycobacterium
KPGPGDP

SEQ ID NO: 907584 - protein, 9 aa, Mycobacterium
KPGQPYTTR

SEQ ID NO: 907585 - protein, 15 aa, Mycobacterium
KPGQYARSHEAGRSV

SEQ ID NO: 907586 - protein, 6 aa, Mycobacterium
KPGSEP

SEQ ID NO: 907587 - protein, 7 aa, Mycobacterium
KPGSPAW

SEQ ID NO: 907588 - protein, 39 aa, Mycobacterium
KPGSSNPTPGTWTPPSTSTSTSTSPSASTPTSAKVNIGD

SEQ ID NO: 907589 - protein, 8 aa, Mycobacterium
KPGTTTIT

SEQ ID NO: 907590 - protein, 4 aa, Mycobacterium
KPGV

SEQ ID NO: 907591 - protein, 4 aa, Mycobacterium
KPGW

SEQ ID NO: 907592 - protein, 23 aa, Mycobacterium
KPGWPTPSDFTRGYDGGVADAQT

SEQ ID NO: 907593 - protein, 6 aa, Mycobacterium
KPGYDP

SEQ ID NO: 907594 - protein, 8 aa, Mycobacterium
KPHEAGPL

SEQ ID NO: 907595 - protein, 7 aa, Mycobacterium
KPHPLTG

SEQ ID NO: 907596 - protein, 4 aa, Mycobacterium
KPIA

SEQ ID NO: 907597 - protein, 4 aa, Mycobacterium
KPIG

SEQ ID NO: 907598 - protein, 13 aa, Mycobacterium
KPIPDTREQYEAV

SEQ ID NO: 907599 - protein, 4 aa, Mycobacterium
KPIR

SEQ ID NO: 907600 - protein, 4 aa, Mycobacterium
KPIT

SEQ ID NO: 907601 - protein, 6 aa, Mycobacterium
KPITRE

SEQ ID NO: 907602 - protein, 10 aa, Mycobacterium
KPKAQAADGD

SEQ ID NO: 907603 - protein, 11 aa, Mycobacterium
KPKFPTPTGSF

SEQ ID NO: 907604 - protein, 35 aa, Mycobacterium
KPKKPATKPSKKAEPAKKAEPSKQSASESSSSDSD

SEQ ID NO: 907605 - protein, 8 aa, Mycobacterium
KPKQAGSY

SEQ ID NO: 907606 - protein, 4 aa, Mycobacterium
KPLA

SEQ ID NO: 907607 - protein, 5 aa, Mycobacterium
KPLAT

SEQ ID NO: 907608 - protein, 4 aa, Mycobacterium
KPLQ

SEQ ID NO: 907609 - protein, 6 aa, Mycobacterium
KPLSSQ

SEQ ID NO: 907610 - protein, 19 aa, Mycobacterium
KPMPGLESKDTAWGEQNCW

SEQ ID NO: 907611 - protein, 4 aa, Mycobacterium
KPNA

SEQ ID NO: 907612 - protein, 23 aa, Mycobacterium
KPNDVVRTEKGGAAIRKSTLQNP

SEQ ID NO: 907613 - protein, 16 aa, Mycobacterium
KPNPDYRGNRKPHNKG

SEQ ID NO: 907614 - protein, 6 aa, Mycobacterium
KPNQHG

SEQ ID NO: 907615 - protein, 12 aa, Mycobacterium
KPPPAGGPPAAR

SEQ ID NO: 907616 - protein, 13 aa, Mycobacterium
KPPPSAGQGTPLL

SEQ ID NO: 907617 - protein, 10 aa, Mycobacterium
KPQELTESGE

SEQ ID NO: 907618 - protein, 10 aa, Mycobacterium
KPQELTETGE

SEQ ID NO: 907619 - protein, 9 aa, Mycobacterium
KPRPEWPAD

SEQ ID NO: 907620 - protein, 6 aa, Mycobacterium
KPSAVD

SEQ ID NO: 907621 - protein, 5 aa, Mycobacterium
KPSLE

SEQ ID NO: 907622 - protein, 5 aa, Mycobacterium
KPSLT

SEQ ID NO: 907623 - protein, 6 aa, Mycobacterium
KPSNGF

SEQ ID NO: 907624 - protein, 8 aa, Mycobacterium
KPSPKGQH

SEQ ID NO: 907625 - protein, 24 aa, Mycobacterium
KPSSDNGSDGAGSAEFASASTAVT

SEQ ID NO: 907626 - protein, 13 aa, Mycobacterium
KPSSYAAGTQDVD

SEQ ID NO: 907627 - protein, 6 aa, Mycobacterium
KPTATT

SEQ ID NO: 907628 - protein, 5 aa, Mycobacterium
KPTDI

SEQ ID NO: 907629 - protein, 11 aa, Mycobacterium
KPTDTRSERDT

SEQ ID NO: 907630 - protein, 9 aa, Mycobacterium
KPTEPGGVS

SEQ ID NO: 907631 - protein, 15 aa, Mycobacterium
KPTEYNSDLPPRGTQ

SEQ ID NO: 907632 - protein, 8 aa, Mycobacterium
KPTHSDFT

SEQ ID NO: 907633 - protein, 7 aa, Mycobacterium
KPTKGQI

SEQ ID NO: 907634 - protein, 8 aa, Mycobacterium
KPTQPGSY

SEQ ID NO: 907635 - protein, 36 aa, Mycobacterium
KPVQTASTPEEAKDTAVAPNTAARAAAEPAASTATT

SEQ ID NO: 907636 - protein, 5 aa, Mycobacterium
KPVTD

SEQ ID NO: 907637 - protein, 6 aa, Mycobacterium
KPWNSV

SEQ ID NO: 907638 - protein, 4 aa, Mycobacterium
KPYA

SEQ ID NO: 907639 - protein, 6 aa, Mycobacterium
KPYEDT

SEQ ID NO: 907640 - protein, 14 aa, Mycobacterium
KPYKPGTPVATPRI

SEQ ID NO: 907641 - protein, 5 aa, Mycobacterium
KPYTK

SEQ ID NO: 907642 - protein, 14 aa, Mycobacterium
KQAAAQAAESGAEL

SEQ ID NO: 907643 - protein, 6 aa, Mycobacterium
KQAADH

SEQ ID NO: 907644 - protein, 10 aa, Mycobacterium
KQAEGQKQSQ

SEQ ID NO: 907645 - protein, 6 aa, Mycobacterium
KQAGAA

SEQ ID NO: 907646 - protein, 9 aa, Mycobacterium
KQALSGGDE

SEQ ID NO: 907647 - protein, 8 aa, Mycobacterium
KQAPQNSL

SEQ ID NO: 907648 - protein, 14 aa, Mycobacterium
KQARAGTLTVGERS

SEQ ID NO: 907649 - protein, 7 aa, Mycobacterium
KQATENA

SEQ ID NO: 907650 - protein, 12 aa, Mycobacterium
KQDAAVKAGLPA

SEQ ID NO: 907651 - protein, 15 aa, Mycobacterium
KQDPDGWGRSPGFGT

SEQ ID NO: 907652 - protein, 6 aa, Mycobacterium
KQEAAR

SEQ ID NO: 907653 - protein, 10 aa, Mycobacterium
KQFEKTAEDP

SEQ ID NO: 907654 - protein, 10 aa, Mycobacterium
KQFEKTAQDP

SEQ ID NO: 907655 - protein, 4 aa, Mycobacterium
KQGG

SEQ ID NO: 907656 - protein, 10 aa, Mycobacterium
KQGRSTGNSC

SEQ ID NO: 907657 - protein, 8 aa, Mycobacterium
KQIAPSDL

SEQ ID NO: 907658 - protein, 7 aa, Mycobacterium
KQIPAAA

SEQ ID NO: 907659 - protein, 10 aa, Mycobacterium
KQIPEAAPLG

SEQ ID NO: 907660 - protein, 9 aa, Mycobacterium
KQISATGNG

SEQ ID NO: 907661 - protein, 9 aa, Mycobacterium
KQMRADREK

SEQ ID NO: 907662 - protein, 8 aa, Mycobacterium
KQNSALAK

SEQ ID NO: 907663 - protein, 9 aa, Mycobacterium
KQNSAVARG

SEQ ID NO: 907664 - protein, 9 aa, Mycobacterium
KQPGQYADP

SEQ ID NO: 907665 - protein, 4 aa, Mycobacterium
KQPI

SEQ ID NO: 907666 - protein, 13 aa, Mycobacterium
KQPPVSPAPARPL

SEQ ID NO: 907667 - protein, 6 aa, Mycobacterium
KQPSGK

SEQ ID NO: 907668 - protein, 5 aa, Mycobacterium
KQQAR

SEQ ID NO: 907669 - protein, 12 aa, Mycobacterium
KQQAVDKPPVAE

SEQ ID NO: 907670 - protein, 7 aa, Mycobacterium
KQQLPSG

SEQ ID NO: 907671 - protein, 8 aa, Mycobacterium
KQQRPATK

SEQ ID NO: 907672 - protein, 18 aa, Mycobacterium
KQRAQEPASGEPSAGGEW

SEQ ID NO: 907673 - protein, 8 aa, Mycobacterium
KQRPEDAI

SEQ ID NO: 907674 - protein, 7 aa, Mycobacterium
KQSESNA

SEQ ID NO: 907675 - protein, 4 aa, Mycobacterium
KQSP

SEQ ID NO: 907676 - protein, 6 aa, Mycobacterium
KQTDGT

SEQ ID NO: 907677 - protein, 7 aa, Mycobacterium
KQTGSKV

SEQ ID NO: 907678 - protein, 10 aa, Mycobacterium
KQTPMSAKQS

SEQ ID NO: 907679 - protein, 12 aa, Mycobacterium
KQTTFARLPIPT

SEQ ID NO: 907680 - protein, 6 aa, Mycobacterium
KQVDNL

SEQ ID NO: 907681 - protein, 10 aa, Mycobacterium
KQVGENVQNR

SEQ ID NO: 907682 - protein, 9 aa, Mycobacterium
KQVKPTGSA

SEQ ID NO: 907683 - protein, 13 aa, Mycobacterium
KQVNDDLGKQDPL

SEQ ID NO: 907684 - protein, 10 aa, Mycobacterium
KQVSPTGNAA

SEQ ID NO: 907685 - protein, 6 aa, Mycobacterium
KQVTQD

SEQ ID NO: 907686 - protein, 11 aa, Mycobacterium
KQWQTDPAELP

SEQ ID NO: 907687 - protein, 13 aa, Mycobacterium
KQWQTDPKELPAA

SEQ ID NO: 907688 - protein, 14 aa, Mycobacterium
KQWQTDPKELPASN

SEQ ID NO: 907689 - protein, 13 aa, Mycobacterium
KQWQTDPKQLPAA

SEQ ID NO: 907690 - protein, 7 aa, Mycobacterium
KRAEPGI

SEQ ID NO: 907691 - protein, 6 aa, Mycobacterium
KRAGVP

SEQ ID NO: 907692 - protein, 9 aa, Mycobacterium
KRANVSRQT

SEQ ID NO: 907693 - protein, 13 aa, Mycobacterium
KRASALTDAPPTL

SEQ ID NO: 907694 - protein, 17 aa, Mycobacterium
KRDEDGHYSHAQDAQTA

SEQ ID NO: 907695 - protein, 7 aa, Mycobacterium
KREDWKR

SEQ ID NO: 907696 - protein, 23 aa, Mycobacterium
KRGDSDQILPPGSTIPVERTEPA

SEQ ID NO: 907697 - protein, 9 aa, Mycobacterium
KRGGAGGFE

SEQ ID NO: 907698 - protein, 23 aa, Mycobacterium
KRGGRRSGAPSGGPSPDEGASRT

SEQ ID NO: 907699 - protein, 7 aa, Mycobacterium
KRGIDPE

SEQ ID NO: 907700 - protein, 7 aa, Mycobacterium
KRGLSPE

SEQ ID NO: 907701 - protein, 51 aa, Mycobacterium
KRIPGAAATVRSTPSTTTAPVAPPSADQVKNQLKDSARAATDLAAKQSGYR

SEQ ID NO: 907702 - protein, 32 aa, Mycobacterium
KRITKTQNSLAKAQVRAGKVTEKLQKGDIKGA

SEQ ID NO: 907703 - protein, 32 aa, Mycobacterium
KRNAPTSTDQKSFKTAGIKRDRPPTWSRGAPP

SEQ ID NO: 907704 - protein, 37 aa, Mycobacterium
KRPGSKAAAAAEAAAADGDTAAADRAAATAKPAPATG

SEQ ID NO: 907705 - protein, 6 aa, Mycobacterium
KRPLAE

SEQ ID NO: 907706 - protein, 7 aa, Mycobacterium
KRPSGYL

SEQ ID NO: 907707 - protein, 20 aa, Mycobacterium
KRPSITNPSITNPSITGPSI

SEQ ID NO: 907708 - protein, 10 aa, Mycobacterium
KRPWRGPGAR

SEQ ID NO: 907709 - protein, 6 aa, Mycobacterium
KRRDDA

SEQ ID NO: 907710 - protein, 4 aa, Mycobacterium
KRRN

SEQ ID NO: 907711 - protein, 6 aa, Mycobacterium
KRRPGV

SEQ ID NO: 907712 - protein, 8 aa, Mycobacterium
KRSDDRDD

SEQ ID NO: 907713 - protein, 7 aa, Mycobacterium
KRSSDRA

SEQ ID NO: 907714 - protein, 8 aa, Mycobacterium
KRSTSQAG

SEQ ID NO: 907715 - protein, 8 aa, Mycobacterium
KRTDPDHL

SEQ ID NO: 907716 - protein, 9 aa, Mycobacterium
KRTRQQIDT

SEQ ID NO: 907717 - protein, 10 aa, Mycobacterium
KRTSSERPSA

SEQ ID NO: 907718 - protein, 7 aa, Mycobacterium
KRVPTDA

SEQ ID NO: 907719 - protein, 8 aa, Mycobacterium
KRWPDQPG

SEQ ID NO: 907720 - protein, 10 aa, Mycobacterium
KRWPEERTTW

SEQ ID NO: 907721 - protein, 4 aa, Mycobacterium
KRWS

SEQ ID NO: 907722 - protein, 5 aa, Mycobacterium
KRWSG

SEQ ID NO: 907723 - protein, 5 aa, Mycobacterium
KRYAG

SEQ ID NO: 907724 - protein, 7 aa, Mycobacterium
KSAAKTC

SEQ ID NO: 907725 - protein, 10 aa, Mycobacterium
KSADEIRPDM

SEQ ID NO: 907726 - protein, 6 aa, Mycobacterium
KSAGID

SEQ ID NO: 907727 - protein, 6 aa, Mycobacterium
KSALAA

SEQ ID NO: 907728 - protein, 15 aa, Mycobacterium
KSANGSMAADSYGEE

SEQ ID NO: 907729 - protein, 5 aa, Mycobacterium
KSANK

SEQ ID NO: 907730 - protein, 7 aa, Mycobacterium
KSAPDAD

SEQ ID NO: 907731 - protein, 7 aa, Mycobacterium
KSATANV

SEQ ID NO: 907732 - protein, 8 aa, Mycobacterium
KSATPSLD

SEQ ID NO: 907733 - protein, 7 aa, Mycobacterium
KSATSNL

SEQ ID NO: 907734 - protein, 14 aa, Mycobacterium
KSATTQAATVGTGG

SEQ ID NO: 907735 - protein, 10 aa, Mycobacterium
KSAYKNYPGR

SEQ ID NO: 907736 - protein, 16 aa, Mycobacterium
KSDGESNFGKIGSPQI

SEQ ID NO: 907737 - protein, 6 aa, Mycobacterium
KSDGIG

SEQ ID NO: 907738 - protein, 11 aa, Mycobacterium
KSDGSADKAAD

SEQ ID NO: 907739 - protein, 20 aa, Mycobacterium
KSDGVSCPGGGTAPSTDTYA

SEQ ID NO: 907740 - protein, 19 aa, Mycobacterium
KSDPGTGADAASRLATEEG

SEQ ID NO: 907741 - protein, 11 aa, Mycobacterium
KSDQADVTAAK

SEQ ID NO: 907742 - protein, 9 aa, Mycobacterium
KSDTPFSYS

SEQ ID NO: 907743 - protein, 8 aa, Mycobacterium
KSEAAVAA

SEQ ID NO: 907744 - protein, 9 aa, Mycobacterium
KSFPGSAVN

SEQ ID NO: 907745 - protein, 11 aa, Mycobacterium
KSFPGSSVNRA

SEQ ID NO: 907746 - protein, 11 aa, Mycobacterium
KSFSKDPITRH

SEQ ID NO: 907747 - protein, 11 aa, Mycobacterium
KSGAANPSPKL

SEQ ID NO: 907748 - protein, 7 aa, Mycobacterium
KSGAKWP

SEQ ID NO: 907749 - protein, 8 aa, Mycobacterium
KSGARTGL

SEQ ID NO: 907750 - protein, 7 aa, Mycobacterium
KSGATLG

SEQ ID NO: 907751 - protein, 4 aa, Mycobacterium
KSGD

SEQ ID NO: 907752 - protein, 5 aa, Mycobacterium
KSGDI

SEQ ID NO: 907753 - protein, 17 aa, Mycobacterium
KSGELTETTFTASEPGH

SEQ ID NO: 907754 - protein, 7 aa, Mycobacterium
KSGEPAI

SEQ ID NO: 907755 - protein, 5 aa, Mycobacterium
KSGGL

SEQ ID NO: 907756 - protein, 9 aa, Mycobacterium
KSGISKDQV

SEQ ID NO: 907757 - protein, 8 aa, Mycobacterium
KSGKPTPE

SEQ ID NO: 907758 - protein, 8 aa, Mycobacterium
KSGKTRCQ

SEQ ID NO: 907759 - protein, 8 aa, Mycobacterium
KSGNWDKD

SEQ ID NO: 907760 - protein, 20 aa, Mycobacterium
KSGQAEETAITSQSLQNAAT

SEQ ID NO: 907761 - protein, 8 aa, Mycobacterium
KSGQTRCQ

SEQ ID NO: 907762 - protein, 7 aa, Mycobacterium
KSGQTTF

SEQ ID NO: 907763 - protein, 8 aa, Mycobacterium
KSGRTRCQ

SEQ ID NO: 907764 - protein, 5 aa, Mycobacterium
KSGSG

SEQ ID NO: 907765 - protein, 10 aa, Mycobacterium
KSGTDDLRES

SEQ ID NO: 907766 - protein, 15 aa, Mycobacterium
KSGTSMAAGQAEPTF

SEQ ID NO: 907767 - protein, 17 aa, Mycobacterium
KSHPTTPATKCPDMGPN

SEQ ID NO: 907768 - protein, 10 aa, Mycobacterium
KSHTSAEQVG

SEQ ID NO: 907769 - protein, 7 aa, Mycobacterium
KSIQAAA

SEQ ID NO: 907770 - protein, 6 aa, Mycobacterium
KSITKD

SEQ ID NO: 907771 - protein, 16 aa, Mycobacterium
KSKATPAGEAVDDYRA

SEQ ID NO: 907772 - protein, 16 aa, Mycobacterium
KSKAVGSSGLELPPGA

SEQ ID NO: 907773 - protein, 8 aa, Mycobacterium
KSKPELGI

SEQ ID NO: 907774 - protein, 6 aa, Mycobacterium
KSLDEF

SEQ ID NO: 907775 - protein, 6 aa, Mycobacterium
KSLDNA

SEQ ID NO: 907776 - protein, 13 aa, Mycobacterium
KSLEGDGRGGGPI

SEQ ID NO: 907777 - protein, 7 aa, Mycobacterium
KSLGAQS

SEQ ID NO: 907778 - protein, 15 aa, Mycobacterium
KSLGKASKPLPEGMR

SEQ ID NO: 907779 - protein, 10 aa, Mycobacterium
KSLNSRNESL

SEQ ID NO: 907780 - protein, 25 aa, Mycobacterium
KSLPRSSQALAAGGQPVATTAVQPG

SEQ ID NO: 907781 - protein, 13 aa, Mycobacterium
KSLQGDGHGGGPV

SEQ ID NO: 907782 - protein, 25 aa, Mycobacterium
KSPAAPAPAPQPEPAPGPGPTPGPP

SEQ ID NO: 907783 - protein, 35 aa, Mycobacterium
KSPAAPSSGAPASPPEPAPPPPPPAPEPGPSQNPP

SEQ ID NO: 907784 - protein, 9 aa, Mycobacterium
KSPEGRQKY

SEQ ID NO: 907785 - protein, 10 aa, Mycobacterium
KSPEGRQKYA

SEQ ID NO: 907786 - protein, 15 aa, Mycobacterium
KSPGAAPVDDSQRDT

SEQ ID NO: 907787 - protein, 4 aa, Mycobacterium
KSPI

SEQ ID NO: 907788 - protein, 6 aa, Mycobacterium
KSPRFT

SEQ ID NO: 907789 - protein, 17 aa, Mycobacterium
KSPRVDYQPNSATGDEM

SEQ ID NO: 907790 - protein, 6 aa, Mycobacterium
KSPTYN

SEQ ID NO: 907791 - protein, 5 aa, Mycobacterium
KSPVD

SEQ ID NO: 907792 - protein, 5 aa, Mycobacterium
KSQGD

SEQ ID NO: 907793 - protein, 11 aa, Mycobacterium
KSQNPGLTDDH

SEQ ID NO: 907794 - protein, 23 aa, Mycobacterium
KSQPASPQKCPAVDPNRPVAPTD

SEQ ID NO: 907795 - protein, 9 aa, Mycobacterium
KSSAPRDAP

SEQ ID NO: 907796 - protein, 8 aa, Mycobacterium
KSSDDFDH

SEQ ID NO: 907797 - protein, 8 aa, Mycobacterium
KSSDFPAS

SEQ ID NO: 907798 - protein, 23 aa, Mycobacterium
KSSTPQPEGATTTVTVRTGDGKV

SEQ ID NO: 907799 - protein, 9 aa, Mycobacterium
KSSTSDPEV

SEQ ID NO: 907800 - protein, 11 aa, Mycobacterium
KSSVESGTEID

SEQ ID NO: 907801 - protein, 8 aa, Mycobacterium
KSTDGGTT

SEQ ID NO: 907802 - protein, 5 aa, Mycobacterium
KSTFT

SEQ ID NO: 907803 - protein, 14 aa, Mycobacterium
KSTGSITKIYMRAT

SEQ ID NO: 907804 - protein, 16 aa, Mycobacterium
KSTGVQLRGQPGPTTI

SEQ ID NO: 907805 - protein, 14 aa, Mycobacterium
KSTLEKDLNGQSDL

SEQ ID NO: 907806 - protein, 10 aa, Mycobacterium
KSVEASSQTV

SEQ ID NO: 907807 - protein, 12 aa, Mycobacterium
KSVEVEGDSIVL

SEQ ID NO: 907808 - protein, 6 aa, Mycobacterium
KSVGAD

SEQ ID NO: 907809 - protein, 9 aa, Mycobacterium
KSYDPRHAD

SEQ ID NO: 907810 - protein, 8 aa, Mycobacterium
KTADGIPV

SEQ ID NO: 907811 - protein, 10 aa, Mycobacterium
KTADGTSVAT

SEQ ID NO: 907812 - protein, 7 aa, Mycobacterium
KTANPGV

SEQ ID NO: 907813 - protein, 10 aa, Mycobacterium
KTAPAEVDSF

SEQ ID NO: 907814 - protein, 8 aa, Mycobacterium
KTDAERRA

SEQ ID NO: 907815 - protein, 5 aa, Mycobacterium
KTDAP

SEQ ID NO: 907816 - protein, 13 aa, Mycobacterium
KTDGRWLASKVEL

SEQ ID NO: 907817 - protein, 9 aa, Mycobacterium
KTDPEYKGG

SEQ ID NO: 907818 - protein, 15 aa, Mycobacterium
KTDSGPKGALCSIRA

SEQ ID NO: 907819 - protein, 6 aa, Mycobacterium
KTDSNP

SEQ ID NO: 907820 - protein, 8 aa, Mycobacterium
KTDWGRRY

SEQ ID NO: 907821 - protein, 4 aa, Mycobacterium
KTEA

SEQ ID NO: 907822 - protein, 4 aa, Mycobacterium
KTEL

SEQ ID NO: 907823 - protein, 6 aa, Mycobacterium
KTFAGR

SEQ ID NO: 907824 - protein, 11 aa, Mycobacterium
KTFEGSNPRVT

SEQ ID NO: 907825 - protein, 10 aa, Mycobacterium
KTFEKTAEDP

SEQ ID NO: 907826 - protein, 29 aa, Mycobacterium
KTFNGGVGEGAKGNDGTSAAVKATEGSIT

SEQ ID NO: 907827 - protein, 5 aa, Mycobacterium
KTFTG

SEQ ID NO: 907828 - protein, 8 aa, Mycobacterium
KTGAGDLT

SEQ ID NO: 907829 - protein, 7 aa, Mycobacterium
KTGARYS

SEQ ID NO: 907830 - protein, 8 aa, Mycobacterium
KTGNKPMP

SEQ ID NO: 907831 - protein, 8 aa, Mycobacterium
KTGQATPV

SEQ ID NO: 907832 - protein, 8 aa, Mycobacterium
KTGQYGTD

SEQ ID NO: 907833 - protein, 11 aa, Mycobacterium
KTGSGDYGRAN

SEQ ID NO: 907834 - protein, 11 aa, Mycobacterium
KTGSGEYGRAN

SEQ ID NO: 907835 - protein, 51 aa, Mycobacterium
KTGSKALNQCTASSVRPGQTTVRSDYGLPSNKRPGVFTTTTTTKTMYVDIT

SEQ ID NO: 907836 - protein, 8 aa, Mycobacterium
KTGSTDGF

SEQ ID NO: 907837 - protein, 6 aa, Mycobacterium
KTHEEI

SEQ ID NO: 907838 - protein, 9 aa, Mycobacterium
KTIDPGSGT

SEQ ID NO: 907839 - protein, 5 aa, Mycobacterium
KTINL

SEQ ID NO: 907840 - protein, 4 aa, Mycobacterium
KTKA

SEQ ID NO: 907841 - protein, 14 aa, Mycobacterium
KTKAVADGKPLHAE

SEQ ID NO: 907842 - protein, 7 aa, Mycobacterium
KTKTDFA

SEQ ID NO: 907843 - protein, 8 aa, Mycobacterium
KTLGPIDT

SEQ ID NO: 907844 - protein, 9 aa, Mycobacterium
KTLSSPATL

SEQ ID NO: 907845 - protein, 9 aa, Mycobacterium
KTLSSPTTL

SEQ ID NO: 907846 - protein, 9 aa, Mycobacterium
KTLSSPTTV

SEQ ID NO: 907847 - protein, 4 aa, Mycobacterium
KTMP

SEQ ID NO: 907848 - protein, 20 aa, Mycobacterium
KTNIQGGGDVSVKPTNPESA

SEQ ID NO: 907849 - protein, 7 aa, Mycobacterium
KTPAGCT

SEQ ID NO: 907850 - protein, 7 aa, Mycobacterium
KTPDGEL

SEQ ID NO: 907851 - protein, 5 aa, Mycobacterium
KTPRC

SEQ ID NO: 907852 - protein, 14 aa, Mycobacterium
KTPTISHNPADDTV

SEQ ID NO: 907853 - protein, 6 aa, Mycobacterium
KTQRTV

SEQ ID NO: 907854 - protein, 5 aa, Mycobacterium
KTRGD

SEQ ID NO: 907855 - protein, 12 aa, Mycobacterium
KTRLGQDTTAHI

SEQ ID NO: 907856 - protein, 11 aa, Mycobacterium
KTRLSTGPEYE

SEQ ID NO: 907857 - protein, 7 aa, Mycobacterium
KTRNPGM

SEQ ID NO: 907858 - protein, 11 aa, Mycobacterium
KTRPGSGREAT

SEQ ID NO: 907859 - protein, 5 aa, Mycobacterium
KTRQP

SEQ ID NO: 907860 - protein, 7 aa, Mycobacterium
KTSSEWD

SEQ ID NO: 907861 - protein, 10 aa, Mycobacterium
KTSVVTKDRP

SEQ ID NO: 907862 - protein, 12 aa, Mycobacterium
KTSYQNPPRGGL

SEQ ID NO: 907863 - protein, 12 aa, Mycobacterium
KTTALDRCDAAY

SEQ ID NO: 907864 - protein, 5 aa, Mycobacterium
KTTAV

SEQ ID NO: 907865 - protein, 7 aa, Mycobacterium
KTTPEVE

SEQ ID NO: 907866 - protein, 7 aa, Mycobacterium
KTTPPVE

SEQ ID NO: 907867 - protein, 11 aa, Mycobacterium
KTTQNGKLTPG

SEQ ID NO: 907868 - protein, 7 aa, Mycobacterium
KTTRYKA

SEQ ID NO: 907869 - protein, 6 aa, Mycobacterium
KTTSAD

SEQ ID NO: 907870 - protein, 6 aa, Mycobacterium
KTTSAE

SEQ ID NO: 907871 - protein, 6 aa, Mycobacterium
KTTWNS

SEQ ID NO: 907872 - protein, 10 aa, Mycobacterium
KTVDDKAVAE

SEQ ID NO: 907873 - protein, 26 aa, Mycobacterium
KTVGAADQGELAAGGAEAAAPVTSTG

SEQ ID NO: 907874 - protein, 8 aa, Mycobacterium
KTWNEPNP

SEQ ID NO: 907875 - protein, 15 aa, Mycobacterium
KTYDPRDGLPVREGQ

SEQ ID NO: 907876 - protein, 9 aa, Mycobacterium
KVAAKGGPH

SEQ ID NO: 907877 - protein, 12 aa, Mycobacterium
KVAAKGGPQCTD

SEQ ID NO: 907878 - protein, 15 aa, Mycobacterium
KVAEDWNAGATKGIP

SEQ ID NO: 907879 - protein, 5 aa, Mycobacterium
KVAGQ

SEQ ID NO: 907880 - protein, 15 aa, Mycobacterium
KVAKEWNADATKGIP

SEQ ID NO: 907881 - protein, 14 aa, Mycobacterium
KVAKQAEQKAPEAP

SEQ ID NO: 907882 - protein, 7 aa, Mycobacterium
KVAQGQP

SEQ ID NO: 907883 - protein, 26 aa, Mycobacterium
KVAQGRKAKVAQGRKSAGALPTRSDV

SEQ ID NO: 907884 - protein, 6 aa, Mycobacterium
KVAQPS

SEQ ID NO: 907885 - protein, 10 aa, Mycobacterium
KVDPGRKYTA

SEQ ID NO: 907886 - protein, 6 aa, Mycobacterium
KVDTSK

SEQ ID NO: 907887 - protein, 4 aa, Mycobacterium
KVEA

SEQ ID NO: 907888 - protein, 16 aa, Mycobacterium
KVEDTTTGHASTATCH

SEQ ID NO: 907889 - protein, 15 aa, Mycobacterium
KVEPPGGDPLARAAS

SEQ ID NO: 907890 - protein, 8 aa, Mycobacterium
KVEPSGDK

SEQ ID NO: 907891 - protein, 8 aa, Mycobacterium
KVGANPAD

SEQ ID NO: 907892 - protein, 8 aa, Mycobacterium
KVGELQGQ

SEQ ID NO: 907893 - protein, 8 aa, Mycobacterium
KVGGRSVG

SEQ ID NO: 907894 - protein, 5 aa, Mycobacterium
KVGGV

SEQ ID NO: 907895 - protein, 5 aa, Mycobacterium
KVGNA

SEQ ID NO: 907896 - protein, 5 aa, Mycobacterium
KVNKT

SEQ ID NO: 907897 - protein, 27 aa, Mycobacterium
KVNTSGPGRPRTRPTKVRGDKAYSSRA

SEQ ID NO: 907898 - protein, 5 aa, Mycobacterium
KVPAD

SEQ ID NO: 907899 - protein, 8 aa, Mycobacterium
KVPADAQA

SEQ ID NO: 907900 - protein, 5 aa, Mycobacterium
KVPAN

SEQ ID NO: 907901 - protein, 7 aa, Mycobacterium
KVPGAPE

SEQ ID NO: 907902 - protein, 8 aa, Mycobacterium
KVPNGNKI

SEQ ID NO: 907903 - protein, 14 aa, Mycobacterium
KVPPKRAASRVRKD

SEQ ID NO: 907904 - protein, 6 aa, Mycobacterium
KVPPVT

SEQ ID NO: 907905 - protein, 9 aa, Mycobacterium
KVPTEIKEA

SEQ ID NO: 907906 - protein, 7 aa, Mycobacterium
KVPTGDL

SEQ ID NO: 907907 - protein, 21 aa, Mycobacterium
KVRDEQVATASGGIASCKVQV

SEQ ID NO: 907908 - protein, 9 aa, Mycobacterium
KVRGRGGLS

SEQ ID NO: 907909 - protein, 13 aa, Mycobacterium
KVRGRGGTSQAIS

SEQ ID NO: 907910 - protein, 15 aa, Mycobacterium
KVRQPAGGSWSTTSA

SEQ ID NO: 907911 - protein, 6 aa, Mycobacterium
KVRTRA

SEQ ID NO: 907912 - protein, 7 aa, Mycobacterium
KVSADWD

SEQ ID NO: 907913 - protein, 8 aa, Mycobacterium
KVSAPDDH

SEQ ID NO: 907914 - protein, 62 aa, Mycobacterium
KVSATGNAAPAAAPAAAPAPAAAPAPVPNSAPAPVPGAQPNPQAAAGNWDRAPSGPASSGQN

SEQ ID NO: 907915 - protein, 12 aa, Mycobacterium
KVSGEQQPIDVG

SEQ ID NO: 907916 - protein, 16 aa, Mycobacterium
KVTDTDDAPQTGIPTG

SEQ ID NO: 907917 - protein, 8 aa, Mycobacterium
KVTDTGVE

SEQ ID NO: 907918 - protein, 5 aa, Mycobacterium
KVTGD

SEQ ID NO: 907919 - protein, 13 aa, Mycobacterium
KVTGKGGDIEVND

SEQ ID NO: 907920 - protein, 14 aa, Mycobacterium
KVTPPQPPPGPQPV

SEQ ID NO: 907921 - protein, 5 aa, Mycobacterium
KVTPV

SEQ ID NO: 907922 - protein, 11 aa, Mycobacterium
KVTQQKGAIPG

SEQ ID NO: 907923 - protein, 8 aa, Mycobacterium
KVTSGQAD

SEQ ID NO: 907924 - protein, 12 aa, Mycobacterium
KVVAGGSGMSPE

SEQ ID NO: 907925 - protein, 6 aa, Mycobacterium
KVYSGG

SEQ ID NO: 907926 - protein, 6 aa, Mycobacterium
KWDGDP

SEQ ID NO: 907927 - protein, 6 aa, Mycobacterium
KWESSE

SEQ ID NO: 907928 - protein, 6 aa, Mycobacterium
KWGRRG

SEQ ID NO: 907929 - protein, 10 aa, Mycobacterium
KWRDTDPAEL

SEQ ID NO: 907930 - protein, 7 aa, Mycobacterium
KYAEDQG

SEQ ID NO: 907931 - protein, 9 aa, Mycobacterium
KYAEDTGSI

SEQ ID NO: 907932 - protein, 6 aa, Mycobacterium
KYGPTV

SEQ ID NO: 907933 - protein, 26 aa, Mycobacterium
KYKPRSEASRKRSGGTAVSDPESKAQ

SEQ ID NO: 907934 - protein, 6 aa, Mycobacterium
KYPVPS

SEQ ID NO: 907935 - protein, 4 aa, Mycobacterium
KYQE

SEQ ID NO: 907936 - protein, 14 aa, Mycobacterium
KYRDATAQGGPPIP

SEQ ID NO: 907937 - protein, 7 aa, Mycobacterium
KYRGEFE

SEQ ID NO: 907938 - protein, 10 aa, Mycobacterium
LAAAAAPTLP

SEQ ID NO: 907939 - protein, 16 aa, Mycobacterium
LAAANSQLAPHQAAAD

SEQ ID NO: 907940 - protein, 12 aa, Mycobacterium
LAAAPKPTRTNI

SEQ ID NO: 907941 - protein, 18 aa, Mycobacterium
LAAAQPPPPPPPPPAPDI

SEQ ID NO: 907942 - protein, 20 aa, Mycobacterium
LAAATTGTSVAQRSAAERQL

SEQ ID NO: 907943 - protein, 5 aa, Mycobacterium
LAADA

SEQ ID NO: 907944 - protein, 9 aa, Mycobacterium
LAADGKPTL

SEQ ID NO: 907945 - protein, 6 aa, Mycobacterium
LAADPQ

SEQ ID NO: 907946 - protein, 6 aa, Mycobacterium
LAADSN

SEQ ID NO: 907947 - protein, 10 aa, Mycobacterium
LAAETDKTVA

SEQ ID NO: 907948 - protein, 10 aa, Mycobacterium
LAAGGAAAPG

SEQ ID NO: 907949 - protein, 11 aa, Mycobacterium
LAAPAEADSVD

SEQ ID NO: 907950 - protein, 10 aa, Mycobacterium
LAAPAEAGTI

SEQ ID NO: 907951 - protein, 11 aa, Mycobacterium
LAAPAGLEETA

SEQ ID NO: 907952 - protein, 6 aa, Mycobacterium
LAAPAY

SEQ ID NO: 907953 - protein, 18 aa, Mycobacterium
LAAPGGKERTWQTMLLPP

SEQ ID NO: 907954 - protein, 13 aa, Mycobacterium
LAAPGQPLPTGSE

SEQ ID NO: 907955 - protein, 7 aa, Mycobacterium
LAAPGSH

SEQ ID NO: 907956 - protein, 9 aa, Mycobacterium
LAAPGSVSR

SEQ ID NO: 907957 - protein, 18 aa, Mycobacterium
LAAPSPPVPPGPPPGYDG

SEQ ID NO: 907958 - protein, 5 aa, Mycobacterium
LAAQG

SEQ ID NO: 907959 - protein, 13 aa, Mycobacterium
LAARGDDADARTV

SEQ ID NO: 907960 - protein, 12 aa, Mycobacterium
LAARGDSAAAAR

SEQ ID NO: 907961 - protein, 8 aa, Mycobacterium
LAARTDGR

SEQ ID NO: 907962 - protein, 13 aa, Mycobacterium
LAASGSARRGVPP

SEQ ID NO: 907963 - protein, 5 aa, Mycobacterium
LAASP

SEQ ID NO: 907964 - protein, 10 aa, Mycobacterium
LAASPNPRLD

SEQ ID NO: 907965 - protein, 12 aa, Mycobacterium
LAASQPPPPNCS

SEQ ID NO: 907966 - protein, 18 aa, Mycobacterium
LADASGEDMRNTVVPQSI

SEQ ID NO: 907967 - protein, 17 aa, Mycobacterium
LADDGDAPAPPTPQSPV

SEQ ID NO: 907968 - protein, 10 aa, Mycobacterium
LADETADDFE

SEQ ID NO: 907969 - protein, 14 aa, Mycobacterium
LADGKTVNTEVTAS

SEQ ID NO: 907970 - protein, 9 aa, Mycobacterium
LADGTGNVI

SEQ ID NO: 907971 - protein, 9 aa, Mycobacterium
LADKKEELA

SEQ ID NO: 907972 - protein, 8 aa, Mycobacterium
LADPAPTR

SEQ ID NO: 907973 - protein, 5 aa, Mycobacterium
LADPE

SEQ ID NO: 907974 - protein, 13 aa, Mycobacterium
LADPELPAPSPVA

SEQ ID NO: 907975 - protein, 7 aa, Mycobacterium
LADPENR

SEQ ID NO: 907976 - protein, 23 aa, Mycobacterium
LADPGDPPDPGIEEPGPPPPPPL

SEQ ID NO: 907977 - protein, 5 aa, Mycobacterium
LADPN

SEQ ID NO: 907978 - protein, 4 aa, Mycobacterium
LADQ

SEQ ID NO: 907979 - protein, 9 aa, Mycobacterium
LADQKEKLA

SEQ ID NO: 907980 - protein, 10 aa, Mycobacterium
LADRAGAPRL

SEQ ID NO: 907981 - protein, 31 aa, Mycobacterium
LADSAAAADRLTESTAAHSKAVEAATAEAER

SEQ ID NO: 907982 - protein, 5 aa, Mycobacterium
LADSG

SEQ ID NO: 907983 - protein, 9 aa, Mycobacterium
LADSGHKDL

SEQ ID NO: 907984 - protein, 12 aa, Mycobacterium
LADTGSLTSTTA

SEQ ID NO: 907985 - protein, 10 aa, Mycobacterium
LAEAGPPAEA

SEQ ID NO: 907986 - protein, 10 aa, Mycobacterium
LAEESGKRIR

SEQ ID NO: 907987 - protein, 9 aa, Mycobacterium
LAEGATEEQ

SEQ ID NO: 907988 - protein, 10 aa, Mycobacterium
LAEGPDGPAW

SEQ ID NO: 907989 - protein, 6 aa, Mycobacterium
LAEPGA

SEQ ID NO: 907990 - protein, 7 aa, Mycobacterium
LAEPQAA

SEQ ID NO: 907991 - protein, 9 aa, Mycobacterium
LAEPVRPGA

SEQ ID NO: 907992 - protein, 8 aa, Mycobacterium
LAEQAAEA

SEQ ID NO: 907993 - protein, 77 aa, Mycobacterium
LAEQEEPVKEEATKDDEVTKVADEADKATPVKESTSVEKTDQAVKPDDTDKTVTTAEKVEKADEAEKVEKTKPNVRK

SEQ ID NO: 907994 - protein, 5 aa, Mycobacterium
LAERT

SEQ ID NO: 907995 - protein, 10 aa, Mycobacterium
LAESAARGDA

SEQ ID NO: 907996 - protein, 9 aa, Mycobacterium
LAESGADEA

SEQ ID NO: 907997 - protein, 7 aa, Mycobacterium
LAETADA

SEQ ID NO: 907998 - protein, 16 aa, Mycobacterium
LAGAGRAIPTGSCPTV

SEQ ID NO: 907999 - protein, 19 aa, Mycobacterium
LAGAGRTLGDIGKTGRGLT

SEQ ID NO: 908000 - protein, 13 aa, Mycobacterium
LAGATQPVAPCCN

SEQ ID NO: 908001 - protein, 8 aa, Mycobacterium
LAGDEGRE

SEQ ID NO: 908002 - protein, 6 aa, Mycobacterium
LAGDYA

SEQ ID NO: 908003 - protein, 12 aa, Mycobacterium
LAGEAGMNPVHG

SEQ ID NO: 908004 - protein, 6 aa, Mycobacterium
LAGEPT

SEQ ID NO: 908005 - protein, 10 aa, Mycobacterium
LAGGPAAASV

SEQ ID NO: 908006 - protein, 21 aa, Mycobacterium
LAGIGSTLEAANRAAAASTSR

SEQ ID NO: 908007 - protein, 4 aa, Mycobacterium
LAGK

SEQ ID NO: 908008 - protein, 11 aa, Mycobacterium
LAGKSKDEVNA

SEQ ID NO: 908009 - protein, 7 aa, Mycobacterium
LAGNGLP

SEQ ID NO: 908010 - protein, 12 aa, Mycobacterium
LAGPAGSGDANA

SEQ ID NO: 908011 - protein, 8 aa, Mycobacterium
LAGPDVPE

SEQ ID NO: 908012 - protein, 4 aa, Mycobacterium
LAGQ

SEQ ID NO: 908013 - protein, 8 aa, Mycobacterium
LAGQGGGT

SEQ ID NO: 908014 - protein, 13 aa, Mycobacterium
LAGQKSAGAVTED

SEQ ID NO: 908015 - protein, 7 aa, Mycobacterium
LAGRAGR

SEQ ID NO: 908016 - protein, 5 aa, Mycobacterium
LAGRD

SEQ ID NO: 908017 - protein, 5 aa, Mycobacterium
LAGRG

SEQ ID NO: 908018 - protein, 4 aa, Mycobacterium
LAGS

SEQ ID NO: 908019 - protein, 18 aa, Mycobacterium
LAGSGGRGKPGPSVAGGA

SEQ ID NO: 908020 - protein, 6 aa, Mycobacterium
LAGSPR

SEQ ID NO: 908021 - protein, 6 aa, Mycobacterium
LAGTHT

SEQ ID NO: 908022 - protein, 7 aa, Mycobacterium
LAHDTDK

SEQ ID NO: 908023 - protein, 16 aa, Mycobacterium
LAKAAEGDVDADSVRS

SEQ ID NO: 908024 - protein, 4 aa, Mycobacterium
LAKD

SEQ ID NO: 908025 - protein, 9 aa, Mycobacterium
LAKGSSAHG

SEQ ID NO: 908026 - protein, 8 aa, Mycobacterium
LAKPGSVS

SEQ ID NO: 908027 - protein, 8 aa, Mycobacterium
LAKSPNTA

SEQ ID NO: 908028 - protein, 15 aa, Mycobacterium
LANAANPTVPDTERY

SEQ ID NO: 908029 - protein, 12 aa, Mycobacterium
LANDPTAPPPDK

SEQ ID NO: 908030 - protein, 7 aa, Mycobacterium
LANGRAA

SEQ ID NO: 908031 - protein, 5 aa, Mycobacterium
LANPD

SEQ ID NO: 908032 - protein, 10 aa, Mycobacterium
LANRNTKQDY

SEQ ID NO: 908033 - protein, 24 aa, Mycobacterium
LANSAGDGFADVPAERGALPGQPN

SEQ ID NO: 908034 - protein, 8 aa, Mycobacterium
LANTTPQR

SEQ ID NO: 908035 - protein, 7 aa, Mycobacterium
LAPEDVA

SEQ ID NO: 908036 - protein, 4 aa, Mycobacterium
LAPG

SEQ ID NO: 908037 - protein, 17 aa, Mycobacterium
LAPGAAGSAVAAQAATA

SEQ ID NO: 908038 - protein, 8 aa, Mycobacterium
LAPGATAR

SEQ ID NO: 908039 - protein, 5 aa, Mycobacterium
LAPGG

SEQ ID NO: 908040 - protein, 19 aa, Mycobacterium
LAPGGAGPKPGPPELPPAV

SEQ ID NO: 908041 - protein, 19 aa, Mycobacterium
LAPGGEGPKPIAPELPPAV

SEQ ID NO: 908042 - protein, 9 aa, Mycobacterium
LAPGGTLGL

SEQ ID NO: 908043 - protein, 6 aa, Mycobacterium
LAPGQL

SEQ ID NO: 908044 - protein, 8 aa, Mycobacterium
LAPGQPGP

SEQ ID NO: 908045 - protein, 13 aa, Mycobacterium
LAPGRAPQRRHRR

SEQ ID NO: 908046 - protein, 8 aa, Mycobacterium
LAPGSPGP

SEQ ID NO: 908047 - protein, 5 aa, Mycobacterium
LAPGV

SEQ ID NO: 908048 - protein, 7 aa, Mycobacterium
LAPHGSG

SEQ ID NO: 908049 - protein, 4 aa, Mycobacterium
LAPL

SEQ ID NO: 908050 - protein, 11 aa, Mycobacterium
LAPPAKAEPTC

SEQ ID NO: 908051 - protein, 8 aa, Mycobacterium
LAPPDAAR

SEQ ID NO: 908052 - protein, 6 aa, Mycobacterium
LAPPDV

SEQ ID NO: 908053 - protein, 8 aa, Mycobacterium
LAPPGATV

SEQ ID NO: 908054 - protein, 6 aa, Mycobacterium
LAPPGC

SEQ ID NO: 908055 - protein, 32 aa, Mycobacterium
LAPPPPPPPPPPPPPGAPPPPPPPPPPPPPPV

SEQ ID NO: 908056 - protein, 40 aa, Mycobacterium
LAPPPVATPTPTTTSGQPTTTTSTTTTSTTPPPPPPPLPF

SEQ ID NO: 908057 - protein, 9 aa, Mycobacterium
LAPPTPAGL

SEQ ID NO: 908058 - protein, 9 aa, Mycobacterium
LAPPTPAGM

SEQ ID NO: 908059 - protein, 9 aa, Mycobacterium
LAPQDPRPR

SEQ ID NO: 908060 - protein, 4 aa, Mycobacterium
LAPR

SEQ ID NO: 908061 - protein, 9 aa, Mycobacterium
LAPSGDAVQ

SEQ ID NO: 908062 - protein, 8 aa, Mycobacterium
LAPSPLGR

SEQ ID NO: 908063 - protein, 9 aa, Mycobacterium
LAPSTDDGD

SEQ ID NO: 908064 - protein, 12 aa, Mycobacterium
LAPTALQRGKPV

SEQ ID NO: 908065 - protein, 7 aa, Mycobacterium
LAPTASG

SEQ ID NO: 908066 - protein, 12 aa, Mycobacterium
LAPYTGQSVDAG

SEQ ID NO: 908067 - protein, 10 aa, Mycobacterium
LAQAGPPAEA

SEQ ID NO: 908068 - protein, 10 aa, Mycobacterium
LAQAKNGDTH

SEQ ID NO: 908069 - protein, 22 aa, Mycobacterium
LAQGADLQAPEPTLGSYGPTDR

SEQ ID NO: 908070 - protein, 5 aa, Mycobacterium
LAQGR

SEQ ID NO: 908071 - protein, 6 aa, Mycobacterium
LAQKHP

SEQ ID NO: 908072 - protein, 13 aa, Mycobacterium
LAQPHEQATAPAR

SEQ ID NO: 908073 - protein, 15 aa, Mycobacterium
LAQPYGGYIGPDSTL

SEQ ID NO: 908074 - protein, 5 aa, Mycobacterium
LAQSG

SEQ ID NO: 908075 - protein, 8 aa, Mycobacterium
LAQSPNTA

SEQ ID NO: 908076 - protein, 5 aa, Mycobacterium
LAQSR

SEQ ID NO: 908077 - protein, 7 aa, Mycobacterium
LAQTEEQ

SEQ ID NO: 908078 - protein, 9 aa, Mycobacterium
LAQTSAPDA

SEQ ID NO: 908079 - protein, 19 aa, Mycobacterium
LARAPRASAEEAGRWPADR

SEQ ID NO: 908080 - protein, 20 aa, Mycobacterium
LAREQAPRQVRSTARGAASA

SEQ ID NO: 908081 - protein, 10 aa, Mycobacterium
LARGEPRGYE

SEQ ID NO: 908082 - protein, 19 aa, Mycobacterium
LARPGADQAALTAAQNTWA

SEQ ID NO: 908083 - protein, 11 aa, Mycobacterium
LARPGGSFNSA

SEQ ID NO: 908084 - protein, 9 aa, Mycobacterium
LARPTPDRV

SEQ ID NO: 908085 - protein, 7 aa, Mycobacterium
LARRPGL

SEQ ID NO: 908086 - protein, 27 aa, Mycobacterium
LARSDHAGRDQCRAGGRARCGRRGRRR

SEQ ID NO: 908087 - protein, 5 aa, Mycobacterium
LARSG

SEQ ID NO: 908088 - protein, 9 aa, Mycobacterium
LARSTGDED

SEQ ID NO: 908089 - protein, 9 aa, Mycobacterium
LARTETRGC

SEQ ID NO: 908090 - protein, 51 aa, Mycobacterium
LARTPGATAIAGTTATPGPAVADQPRRTTGPAGTAGATTADLTTHPAGTTV

SEQ ID NO: 908091 - protein, 9 aa, Mycobacterium
LASAAEKLR

SEQ ID NO: 908092 - protein, 8 aa, Mycobacterium
LASAAQSF

SEQ ID NO: 908093 - protein, 15 aa, Mycobacterium
LASADVPRSPVDRQQ

SEQ ID NO: 908094 - protein, 9 aa, Mycobacterium
LASAESDLT

SEQ ID NO: 908095 - protein, 7 aa, Mycobacterium
LASAGAT

SEQ ID NO: 908096 - protein, 7 aa, Mycobacterium
LASAGTL

SEQ ID NO: 908097 - protein, 13 aa, Mycobacterium
LASEADMDPAHGP

SEQ ID NO: 908098 - protein, 13 aa, Mycobacterium
LASEGGPFTTVPG

SEQ ID NO: 908099 - protein, 18 aa, Mycobacterium
LASGAPLGKGMPTVDPED

SEQ ID NO: 908100 - protein, 12 aa, Mycobacterium
LASGDAAALASL

SEQ ID NO: 908101 - protein, 11 aa, Mycobacterium
LASGPTRWPDA

SEQ ID NO: 908102 - protein, 8 aa, Mycobacterium
LASLPSST

SEQ ID NO: 908103 - protein, 12 aa, Mycobacterium
LASLSGTVTDSL

SEQ ID NO: 908104 - protein, 5 aa, Mycobacterium
LASPA

SEQ ID NO: 908105 - protein, 7 aa, Mycobacterium
LASPAVS

SEQ ID NO: 908106 - protein, 10 aa, Mycobacterium
LASPRADDPW

SEQ ID NO: 908107 - protein, 9 aa, Mycobacterium
LASPSGTQS

SEQ ID NO: 908108 - protein, 12 aa, Mycobacterium
LASPTGASTAGA

SEQ ID NO: 908109 - protein, 13 aa, Mycobacterium
LASRGSDYSPVPC

SEQ ID NO: 908110 - protein, 9 aa, Mycobacterium
LASSQNAVG

SEQ ID NO: 908111 - protein, 7 aa, Mycobacterium
LASTASG

SEQ ID NO: 908112 - protein, 6 aa, Mycobacterium
LASTVD

SEQ ID NO: 908113 - protein, 17 aa, Mycobacterium
LATAGHGSEPDGETETV

SEQ ID NO: 908114 - protein, 6 aa, Mycobacterium
LATAGL

SEQ ID NO: 908115 - protein, 18 aa, Mycobacterium
LATASSAVAARNAAAAAV

SEQ ID NO: 908116 - protein, 5 aa, Mycobacterium
LATAT

SEQ ID NO: 908117 - protein, 11 aa, Mycobacterium
LATDPAGQRAL

SEQ ID NO: 908118 - protein, 12 aa, Mycobacterium
LATDPTAPEPES

SEQ ID NO: 908119 - protein, 5 aa, Mycobacterium
LATGD

SEQ ID NO: 908120 - protein, 19 aa, Mycobacterium
LATGGAGLSSSSGATIGTP

SEQ ID NO: 908121 - protein, 15 aa, Mycobacterium
LATGPAPVASAEPCS

SEQ ID NO: 908122 - protein, 28 aa, Mycobacterium
LATGPSNGQVTVNSDGSYTYTPNDGYIG

SEQ ID NO: 908123 - protein, 7 aa, Mycobacterium
LATGTSR

SEQ ID NO: 908124 - protein, 7 aa, Mycobacterium
LATKPTI

SEQ ID NO: 908125 - protein, 8 aa, Mycobacterium
LATPGQIG

SEQ ID NO: 908126 - protein, 17 aa, Mycobacterium
LATQADGETAVTCSLRQ

SEQ ID NO: 908127 - protein, 6 aa, Mycobacterium
LATREE

SEQ ID NO: 908128 - protein, 7 aa, Mycobacterium
LATREEQ

SEQ ID NO: 908129 - protein, 11 aa, Mycobacterium
LATSATTGDNT

SEQ ID NO: 908130 - protein, 9 aa, Mycobacterium
LATSQDGGT

SEQ ID NO: 908131 - protein, 17 aa, Mycobacterium
LAYPGKQGLSGGGESWS

SEQ ID NO: 908132 - protein, 12 aa, Mycobacterium
LDAAGAGSGCAA

SEQ ID NO: 908133 - protein, 6 aa, Mycobacterium
LDAGAD

SEQ ID NO: 908134 - protein, 8 aa, Mycobacterium
LDAGDQAG

SEQ ID NO: 908135 - protein, 6 aa, Mycobacterium
LDAGGG

SEQ ID NO: 908136 - protein, 32 aa, Mycobacterium
LDAKATQPPPASPTEAKDLGYKPASREQPFGQ

SEQ ID NO: 908137 - protein, 8 aa, Mycobacterium
LDAKNQAV

SEQ ID NO: 908138 - protein, 5 aa, Mycobacterium
LDAPD

SEQ ID NO: 908139 - protein, 12 aa, Mycobacterium
LDAPSGVLTIVD

SEQ ID NO: 908140 - protein, 4 aa, Mycobacterium
LDAT

SEQ ID NO: 908141 - protein, 6 aa, Mycobacterium
LDATPI

SEQ ID NO: 908142 - protein, 20 aa, Mycobacterium
LDCAGGKSLNIGGSKNTLTV

SEQ ID NO: 908143 - protein, 14 aa, Mycobacterium
LDDDDIDDSDNPDL

SEQ ID NO: 908144 - protein, 21 aa, Mycobacterium
LDDEPDETDDRDDAATEADLD

SEQ ID NO: 908145 - protein, 8 aa, Mycobacterium
LDDGAVSD

SEQ ID NO: 908146 - protein, 6 aa, Mycobacterium
LDDGRT

SEQ ID NO: 908147 - protein, 12 aa, Mycobacterium
LDDNRAGRGRRR

SEQ ID NO: 908148 - protein, 6 aa, Mycobacterium
LDDPVT

SEQ ID NO: 908149 - protein, 11 aa, Mycobacterium
LDDRESAAQYR

SEQ ID NO: 908150 - protein, 4 aa, Mycobacterium
LDEA

SEQ ID NO: 908151 - protein, 12 aa, Mycobacterium
LDEADAAVSGGE

SEQ ID NO: 908152 - protein, 12 aa, Mycobacterium
LDEADDAVSGGE

SEQ ID NO: 908153 - protein, 13 aa, Mycobacterium
LDEADSAVQDAAG

SEQ ID NO: 908154 - protein, 11 aa, Mycobacterium
LDEAEATGAGE

SEQ ID NO: 908155 - protein, 5 aa, Mycobacterium
LDEDP

SEQ ID NO: 908156 - protein, 4 aa, Mycobacterium
LDER

SEQ ID NO: 908157 - protein, 13 aa, Mycobacterium
LDESGETDEVRTR

SEQ ID NO: 908158 - protein, 11 aa, Mycobacterium
LDESGPSGDWG

SEQ ID NO: 908159 - protein, 6 aa, Mycobacterium
LDETER

SEQ ID NO: 908160 - protein, 5 aa, Mycobacterium
LDGEA

SEQ ID NO: 908161 - protein, 8 aa, Mycobacterium
LDGEGTKQ

SEQ ID NO: 908162 - protein, 8 aa, Mycobacterium
LDGGDGAA

SEQ ID NO: 908163 - protein, 8 aa, Mycobacterium
LDGGSSSA

SEQ ID NO: 908164 - protein, 7 aa, Mycobacterium
LDGKEHD

SEQ ID NO: 908165 - protein, 14 aa, Mycobacterium
LDGPPRNTAQIGMP

SEQ ID NO: 908166 - protein, 14 aa, Mycobacterium
LDGPPRNTAQIGQP

SEQ ID NO: 908167 - protein, 14 aa, Mycobacterium
LDGPPRNTMQIGQP

SEQ ID NO: 908168 - protein, 10 aa, Mycobacterium
LDGPSYGESI

SEQ ID NO: 908169 - protein, 6 aa, Mycobacterium
LDGPTA

SEQ ID NO: 908170 - protein, 7 aa, Mycobacterium
LDGPTAA

SEQ ID NO: 908171 - protein, 7 aa, Mycobacterium
LDGPTTA

SEQ ID NO: 908172 - protein, 5 aa, Mycobacterium
LDGQA

SEQ ID NO: 908173 - protein, 4 aa, Mycobacterium
LDGR

SEQ ID NO: 908174 - protein, 6 aa, Mycobacterium
LDGRDV

SEQ ID NO: 908175 - protein, 5 aa, Mycobacterium
LDGRR

SEQ ID NO: 908176 - protein, 15 aa, Mycobacterium
LDGSGYPNGVRGEDL

SEQ ID NO: 908177 - protein, 9 aa, Mycobacterium
LDGSPEPTG

SEQ ID NO: 908178 - protein, 8 aa, Mycobacterium
LDGSQNAV

SEQ ID NO: 908179 - protein, 17 aa, Mycobacterium
LDGSRAGPGINDDGSGV

SEQ ID NO: 908180 - protein, 4 aa, Mycobacterium
LDGT

SEQ ID NO: 908181 - protein, 16 aa, Mycobacterium
LDGTAGPHHGSAVATN

SEQ ID NO: 908182 - protein, 7 aa, Mycobacterium
LDGTAKG

SEQ ID NO: 908183 - protein, 7 aa, Mycobacterium
LDGTDDI

SEQ ID NO: 908184 - protein, 12 aa, Mycobacterium
LDHDAGDDALHP

SEQ ID NO: 908185 - protein, 4 aa, Mycobacterium
LDHP

SEQ ID NO: 908186 - protein, 9 aa, Mycobacterium
LDKDAYQST

SEQ ID NO: 908187 - protein, 22 aa, Mycobacterium
LDKPGKTGEKEDGPGKDEPGTG

SEQ ID NO: 908188 - protein, 8 aa, Mycobacterium
LDKRPSQM

SEQ ID NO: 908189 - protein, 10 aa, Mycobacterium
LDNDPETERR

SEQ ID NO: 908190 - protein, 8 aa, Mycobacterium
LDNDQNWR

SEQ ID NO: 908191 - protein, 11 aa, Mycobacterium
LDNGDLDRTHR

SEQ ID NO: 908192 - protein, 7 aa, Mycobacterium
LDPAEPL

SEQ ID NO: 908193 - protein, 9 aa, Mycobacterium
LDPAGEKAQ

SEQ ID NO: 908194 - protein, 11 aa, Mycobacterium
LDPAKARELAN

SEQ ID NO: 908195 - protein, 6 aa, Mycobacterium
LDPARS

SEQ ID NO: 908196 - protein, 9 aa, Mycobacterium
LDPATGTVS

SEQ ID NO: 908197 - protein, 11 aa, Mycobacterium
LDPDAEPAGTL

SEQ ID NO: 908198 - protein, 29 aa, Mycobacterium
LDPDEDLTKEASKEASKGTELADDSSVKA

SEQ ID NO: 908199 - protein, 7 aa, Mycobacterium
LDPDEVE

SEQ ID NO: 908200 - protein, 6 aa, Mycobacterium
LDPDQR

SEQ ID NO: 908201 - protein, 15 aa, Mycobacterium
LDPELGGETLGPGTQ

SEQ ID NO: 908202 - protein, 12 aa, Mycobacterium
LDPELSGETMGA

SEQ ID NO: 908203 - protein, 6 aa, Mycobacterium
LDPEPT

SEQ ID NO: 908204 - protein, 8 aa, Mycobacterium
LDPEQKSH

SEQ ID NO: 908205 - protein, 8 aa, Mycobacterium
LDPEREIG

SEQ ID NO: 908206 - protein, 4 aa, Mycobacterium
LDPG

SEQ ID NO: 908207 - protein, 8 aa, Mycobacterium
LDPGEQVA

SEQ ID NO: 908208 - protein, 8 aa, Mycobacterium
LDPGGDGW

SEQ ID NO: 908209 - protein, 43 aa, Mycobacterium
LDPGRPGIGGPGGPGGPGIGAPGGPGRPGGGFGGGGGRGGGGR

SEQ ID NO: 908210 - protein, 11 aa, Mycobacterium
LDPLNGGSGSI

SEQ ID NO: 908211 - protein, 5 aa, Mycobacterium
LDPQG

SEQ ID NO: 908212 - protein, 5 aa, Mycobacterium
LDPQR

SEQ ID NO: 908213 - protein, 10 aa, Mycobacterium
LDPRDSERGL

SEQ ID NO: 908214 - protein, 6 aa, Mycobacterium
LDPRNV

SEQ ID NO: 908215 - protein, 15 aa, Mycobacterium
LDPRQPVALPSESAA

SEQ ID NO: 908216 - protein, 13 aa, Mycobacterium
LDPSGEAAARQNM

SEQ ID NO: 908217 - protein, 6 aa, Mycobacterium
LDPSLG

SEQ ID NO: 908218 - protein, 11 aa, Mycobacterium
LDPVNGGTGTV

SEQ ID NO: 908219 - protein, 13 aa, Mycobacterium
LDQAKATVAQERG

SEQ ID NO: 908220 - protein, 5 aa, Mycobacterium
LDQCD

SEQ ID NO: 908221 - protein, 11 aa, Mycobacterium
LDQHGNPLPED

SEQ ID NO: 908222 - protein, 4 aa, Mycobacterium
LDQR

SEQ ID NO: 908223 - protein, 11 aa, Mycobacterium
LDQTPPAPEEG

SEQ ID NO: 908224 - protein, 9 aa, Mycobacterium
LDRESKELT

SEQ ID NO: 908225 - protein, 9 aa, Mycobacterium
LDRGSGNSV

SEQ ID NO: 908226 - protein, 9 aa, Mycobacterium
LDRNANDSV

SEQ ID NO: 908227 - protein, 10 aa, Mycobacterium
LDRPGTDKAA

SEQ ID NO: 908228 - protein, 8 aa, Mycobacterium
LDRRNDSF

SEQ ID NO: 908229 - protein, 14 aa, Mycobacterium
LDRSSRDVSAQRSS

SEQ ID NO: 908230 - protein, 6 aa, Mycobacterium
LDSGAT

SEQ ID NO: 908231 - protein, 7 aa, Mycobacterium
LDSGGTL

SEQ ID NO: 908232 - protein, 20 aa, Mycobacterium
LDSKDIAGNVQPDDVAAGAQ

SEQ ID NO: 908233 - protein, 8 aa, Mycobacterium
LDSPSRFE

SEQ ID NO: 908234 - protein, 7 aa, Mycobacterium
LDSSGEL

SEQ ID NO: 908235 - protein, 6 aa, Mycobacterium
LDSTPS

SEQ ID NO: 908236 - protein, 12 aa, Mycobacterium
LDTAAAADTARR

SEQ ID NO: 908237 - protein, 7 aa, Mycobacterium
LDTAGNH

SEQ ID NO: 908238 - protein, 12 aa, Mycobacterium
LDTAPADSNHPE

SEQ ID NO: 908239 - protein, 7 aa, Mycobacterium
LDTASQT

SEQ ID NO: 908240 - protein, 22 aa, Mycobacterium
LDTDGAGSGNTTVQDSIRPGTT

SEQ ID NO: 908241 - protein, 12 aa, Mycobacterium
LDTGASGSEDIT

SEQ ID NO: 908242 - protein, 6 aa, Mycobacterium
LDTGPT

SEQ ID NO: 908243 - protein, 4 aa, Mycobacterium
LDTR

SEQ ID NO: 908244 - protein, 9 aa, Mycobacterium
LDTSPDPIP

SEQ ID NO: 908245 - protein, 14 aa, Mycobacterium
LDVPGGGHHDGRHR

SEQ ID NO: 908246 - protein, 20 aa, Mycobacterium
LDYEGKASNPSSATVEGKES

SEQ ID NO: 908247 - protein, 5 aa, Mycobacterium
LEADA

SEQ ID NO: 908248 - protein, 11 aa, Mycobacterium
LEADPRRQYST

SEQ ID NO: 908249 - protein, 11 aa, Mycobacterium
LEAEKATANSL

SEQ ID NO: 908250 - protein, 12 aa, Mycobacterium
LEAGATPQTQLT

SEQ ID NO: 908251 - protein, 9 aa, Mycobacterium
LEAPGEVGN

SEQ ID NO: 908252 - protein, 6 aa, Mycobacterium
LEAQGN

SEQ ID NO: 908253 - protein, 11 aa, Mycobacterium
LEARGSGDYGG

SEQ ID NO: 908254 - protein, 9 aa, Mycobacterium
LEATAQATQ

SEQ ID NO: 908255 - protein, 9 aa, Mycobacterium
LEDDGNGRL

SEQ ID NO: 908256 - protein, 19 aa, Mycobacterium
LEDPGDPERGLASATSPYV

SEQ ID NO: 908257 - protein, 17 aa, Mycobacterium
LEDPSPTGNPPDRPMPG

SEQ ID NO: 908258 - protein, 9 aa, Mycobacterium
LEDSGSTFD

SEQ ID NO: 908259 - protein, 7 aa, Mycobacterium
LEEASAY

SEQ ID NO: 908260 - protein, 8 aa, Mycobacterium
LEENPQVK

SEQ ID NO: 908261 - protein, 5 aa, Mycobacterium
LEEQG

SEQ ID NO: 908262 - protein, 6 aa, Mycobacterium
LEGGEA

SEQ ID NO: 908263 - protein, 22 aa, Mycobacterium
LEGGEAFTAEEQPAELDETEDV

SEQ ID NO: 908264 - protein, 22 aa, Mycobacterium
LEGGEAFTTEEQPKELDETEDV

SEQ ID NO: 908265 - protein, 23 aa, Mycobacterium
LEGGEAFTTEEQPQELDESEDVS

SEQ ID NO: 908266 - protein, 22 aa, Mycobacterium
LEGGEAFTTEEQPTELDETEDV

SEQ ID NO: 908267 - protein, 8 aa, Mycobacterium
LEGPDQST

SEQ ID NO: 908268 - protein, 6 aa, Mycobacterium
LEGVGD

SEQ ID NO: 908269 - protein, 19 aa, Mycobacterium
LEGVSDEDAAAAGKTAKQN

SEQ ID NO: 908270 - protein, 39 aa, Mycobacterium
LEKAAKDAKAKAKAKASASKDSDKKSGGADSEASDDKAA

SEQ ID NO: 908271 - protein, 10 aa, Mycobacterium
LEKGEPPKVF

SEQ ID NO: 908272 - protein, 9 aa, Mycobacterium
LEKGEPPRV

SEQ ID NO: 908273 - protein, 17 aa, Mycobacterium
LEKPPAAEGKPPVAATP

SEQ ID NO: 908274 - protein, 11 aa, Mycobacterium
LEKSSGNSAEV

SEQ ID NO: 908275 - protein, 7 aa, Mycobacterium
LEKTPKQ

SEQ ID NO: 908276 - protein, 27 aa, Mycobacterium
LENNGGFASARGPQDPDLGRRAAGATA

SEQ ID NO: 908277 - protein, 10 aa, Mycobacterium
LEPANGDMNQ

SEQ ID NO: 908278 - protein, 6 aa, Mycobacterium
LEPARQ

SEQ ID NO: 908279 - protein, 16 aa, Mycobacterium
LEPCPAPGEGQGPAPL

SEQ ID NO: 908280 - protein, 8 aa, Mycobacterium
LEPGAYSR

SEQ ID NO: 908281 - protein, 6 aa, Mycobacterium
LEPGGT

SEQ ID NO: 908282 - protein, 22 aa, Mycobacterium
LEPGKAPELPKGSVRVNPKDPL

SEQ ID NO: 908283 - protein, 6 aa, Mycobacterium
LEPGQQ

SEQ ID NO: 908284 - protein, 6 aa, Mycobacterium
LEPGQT

SEQ ID NO: 908285 - protein, 15 aa, Mycobacterium
LEPPERPGDTTTTDR

SEQ ID NO: 908286 - protein, 9 aa, Mycobacterium
LEPPGEEMS

SEQ ID NO: 908287 - protein, 13 aa, Mycobacterium
LEPPGLATSEAAG

SEQ ID NO: 908288 - protein, 7 aa, Mycobacterium
LEPRRGE

SEQ ID NO: 908289 - protein, 6 aa, Mycobacterium
LEPRSE

SEQ ID NO: 908290 - protein, 8 aa, Mycobacterium
LEPSGHND

SEQ ID NO: 908291 - protein, 14 aa, Mycobacterium
LEPSGQLGSYVGTG

SEQ ID NO: 908292 - protein, 15 aa, Mycobacterium
LEPSNAPRGVASSRK

SEQ ID NO: 908293 - protein, 9 aa, Mycobacterium
LEPTPGNSV

SEQ ID NO: 908294 - protein, 8 aa, Mycobacterium
LEQDGAGV

SEQ ID NO: 908295 - protein, 15 aa, Mycobacterium
LEQGAVDAIAVIPPS

SEQ ID NO: 908296 - protein, 4 aa, Mycobacterium
LEQP

SEQ ID NO: 908297 - protein, 24 aa, Mycobacterium
LEQSTGRGEGPAGLPTPLPDLQQG

SEQ ID NO: 908298 - protein, 6 aa, Mycobacterium
LEQTAQ

SEQ ID NO: 908299 - protein, 7 aa, Mycobacterium
LERDGQK

SEQ ID NO: 908300 - protein, 6 aa, Mycobacterium
LEREGA

SEQ ID NO: 908301 - protein, 7 aa, Mycobacterium
LEREPAP

SEQ ID NO: 908302 - protein, 4 aa, Mycobacterium
LERG

SEQ ID NO: 908303 - protein, 9 aa, Mycobacterium
LERGEPPRV

SEQ ID NO: 908304 - protein, 4 aa, Mycobacterium
LERK

SEQ ID NO: 908305 - protein, 11 aa, Mycobacterium
LERKEGLGPGL

SEQ ID NO: 908306 - protein, 19 aa, Mycobacterium
LESGEPAHAVAPPPDGAYS

SEQ ID NO: 908307 - protein, 9 aa, Mycobacterium
LESGGTADK

SEQ ID NO: 908308 - protein, 17 aa, Mycobacterium
LESGSYARIRPGAAPEV

SEQ ID NO: 908309 - protein, 6 aa, Mycobacterium
LESNSP

SEQ ID NO: 908310 - protein, 18 aa, Mycobacterium
LESRSASTLPDGAQSDVG

SEQ ID NO: 908311 - protein, 10 aa, Mycobacterium
LESRTGEGTS

SEQ ID NO: 908312 - protein, 5 aa, Mycobacterium
LESTA

SEQ ID NO: 908313 - protein, 5 aa, Mycobacterium
LETAA

SEQ ID NO: 908314 - protein, 9 aa, Mycobacterium
LETDQPDAA

SEQ ID NO: 908315 - protein, 5 aa, Mycobacterium
LETGD

SEQ ID NO: 908316 - protein, 10 aa, Mycobacterium
LETGSDEGQR

SEQ ID NO: 908317 - protein, 20 aa, Mycobacterium
LETPDLAGNVQPDDVAAGAQ

SEQ ID NO: 908318 - protein, 7 aa, Mycobacterium
LETPTGR

SEQ ID NO: 908319 - protein, 15 aa, Mycobacterium
LETSGSSDQAAIENA

SEQ ID NO: 908320 - protein, 4 aa, Mycobacterium
LETT

SEQ ID NO: 908321 - protein, 9 aa, Mycobacterium
LETTDGSIT

SEQ ID NO: 908322 - protein, 6 aa, Mycobacterium
LFPPGS

SEQ ID NO: 908323 - protein, 4 aa, Mycobacterium
LGAA

SEQ ID NO: 908324 - protein, 22 aa, Mycobacterium
LGAADPTPQQSPFPTGKSGTTI

SEQ ID NO: 908325 - protein, 10 aa, Mycobacterium
LGAAGSPSLL

SEQ ID NO: 908326 - protein, 11 aa, Mycobacterium
LGADGRPTAAA

SEQ ID NO: 908327 - protein, 13 aa, Mycobacterium
LGADSGDAQSGSI

SEQ ID NO: 908328 - protein, 4 aa, Mycobacterium
LGAG

SEQ ID NO: 908329 - protein, 5 aa, Mycobacterium
LGAGD

SEQ ID NO: 908330 - protein, 6 aa, Mycobacterium
LGAGGF

SEQ ID NO: 908331 - protein, 12 aa, Mycobacterium
LGAGGISGPPVA

SEQ ID NO: 908332 - protein, 9 aa, Mycobacterium
LGAGGSEEQ

SEQ ID NO: 908333 - protein, 8 aa, Mycobacterium
LGAGPGSR

SEQ ID NO: 908334 - protein, 8 aa, Mycobacterium
LGAGPQTR

SEQ ID NO: 908335 - protein, 8 aa, Mycobacterium
LGAGPSTR

SEQ ID NO: 908336 - protein, 6 aa, Mycobacterium
LGAGRT

SEQ ID NO: 908337 - protein, 7 aa, Mycobacterium
LGAGRTA

SEQ ID NO: 908338 - protein, 26 aa, Mycobacterium
LGAHGGSGAAATGCAAGTAGAALAAG

SEQ ID NO: 908339 - protein, 11 aa, Mycobacterium
LGAHGGSGAAL

SEQ ID NO: 908340 - protein, 7 aa, Mycobacterium
LGANAES

SEQ ID NO: 908341 - protein, 4 aa, Mycobacterium
LGAP

SEQ ID NO: 908342 - protein, 6 aa, Mycobacterium
LGAPGA

SEQ ID NO: 908343 - protein, 12 aa, Mycobacterium
LGAPGPAPEQSI

SEQ ID NO: 908344 - protein, 8 aa, Mycobacterium
LGAQGTPP

SEQ ID NO: 908345 - protein, 18 aa, Mycobacterium
LGARAQLADGSSLGGDGL

SEQ ID NO: 908346 - protein, 8 aa, Mycobacterium
LGASAAAG

SEQ ID NO: 908347 - protein, 12 aa, Mycobacterium
LGATPNTGDTQG

SEQ ID NO: 908348 - protein, 19 aa, Mycobacterium
LGATPPVPKAPEPALAAPG

SEQ ID NO: 908349 - protein, 8 aa, Mycobacterium
LGATSNEA

SEQ ID NO: 908350 - protein, 11 aa, Mycobacterium
LGDAATAAEFQ

SEQ ID NO: 908351 - protein, 14 aa, Mycobacterium
LGDAATAAEFQNRS

SEQ ID NO: 908352 - protein, 12 aa, Mycobacterium
LGDDAVAARIDR

SEQ ID NO: 908353 - protein, 10 aa, Mycobacterium
LGDDKTAAEF

SEQ ID NO: 908354 - protein, 4 aa, Mycobacterium
LGDG

SEQ ID NO: 908355 - protein, 6 aa, Mycobacterium
LGDGST

SEQ ID NO: 908356 - protein, 5 aa, Mycobacterium
LGDHS

SEQ ID NO: 908357 - protein, 9 aa, Mycobacterium
LGDNPDRDY

SEQ ID NO: 908358 - protein, 10 aa, Mycobacterium
LGDPALGTHN

SEQ ID NO: 908359 - protein, 9 aa, Mycobacterium
LGDPGAFTG

SEQ ID NO: 908360 - protein, 8 aa, Mycobacterium
LGDPGSPI

SEQ ID NO: 908361 - protein, 5 aa, Mycobacterium
LGDRP

SEQ ID NO: 908362 - protein, 7 aa, Mycobacterium
LGDRSTD

SEQ ID NO: 908363 - protein, 10 aa, Mycobacterium
LGDRTEAAIK

SEQ ID NO: 908364 - protein, 14 aa, Mycobacterium
LGDRTEAAVKTKSV

SEQ ID NO: 908365 - protein, 17 aa, Mycobacterium
LGDSGAPVYARQPDGTV

SEQ ID NO: 908366 - protein, 4 aa, Mycobacterium
LGDT

SEQ ID NO: 908367 - protein, 11 aa, Mycobacterium
LGDTATAAEFQ

SEQ ID NO: 908368 - protein, 12 aa, Mycobacterium
LGDTTQAAPAIE

SEQ ID NO: 908369 - protein, 4 aa, Mycobacterium
LGEA

SEQ ID NO: 908370 - protein, 9 aa, Mycobacterium
LGEATRERI

SEQ ID NO: 908371 - protein, 9 aa, Mycobacterium
LGEGPDDLA

SEQ ID NO: 908372 - protein, 6 aa, Mycobacterium
LGENTA

SEQ ID NO: 908373 - protein, 6 aa, Mycobacterium
LGEPAA

SEQ ID NO: 908374 - protein, 14 aa, Mycobacterium
LGEPGENLGANRSR

SEQ ID NO: 908375 - protein, 7 aa, Mycobacterium
LGEPIPG

SEQ ID NO: 908376 - protein, 9 aa, Mycobacterium
LGERTEAAI

SEQ ID NO: 908377 - protein, 5 aa, Mycobacterium
LGETS

SEQ ID NO: 908378 - protein, 4 aa, Mycobacterium
LGGA

SEQ ID NO: 908379 - protein, 16 aa, Mycobacterium
LGGADIGEVDSMSTAN

SEQ ID NO: 908380 - protein, 7 aa, Mycobacterium
LGGAEGQ

SEQ ID NO: 908381 - protein, 11 aa, Mycobacterium
LGGAPAATAVT

SEQ ID NO: 908382 - protein, 7 aa, Mycobacterium
LGGATPE

SEQ ID NO: 908383 - protein, 10 aa, Mycobacterium
LGGATRDGQI

SEQ ID NO: 908384 - protein, 5 aa, Mycobacterium
LGGDA

SEQ ID NO: 908385 - protein, 6 aa, Mycobacterium
LGGDTK

SEQ ID NO: 908386 - protein, 14 aa, Mycobacterium
LGGEDSNGEEADGS

SEQ ID NO: 908387 - protein, 6 aa, Mycobacterium
LGGLQT

SEQ ID NO: 908388 - protein, 15 aa, Mycobacterium
LGGLTASARARSVGR

SEQ ID NO: 908389 - protein, 4 aa, Mycobacterium
LGGN

SEQ ID NO: 908390 - protein, 12 aa, Mycobacterium
LGGNAASGPVAV

SEQ ID NO: 908391 - protein, 6 aa, Mycobacterium
LGGNGK

SEQ ID NO: 908392 - protein, 25 aa, Mycobacterium
LGGPGERRRDGTAADWSAAPAPDVD

SEQ ID NO: 908393 - protein, 9 aa, Mycobacterium
LGGPSRAND

SEQ ID NO: 908394 - protein, 7 aa, Mycobacterium
LGGQGLE

SEQ ID NO: 908395 - protein, 8 aa, Mycobacterium
LGGQPDSI

SEQ ID NO: 908396 - protein, 15 aa, Mycobacterium
LGGQPDSIAISPDGT

SEQ ID NO: 908397 - protein, 9 aa, Mycobacterium
LGGQSDRLD

SEQ ID NO: 908398 - protein, 7 aa, Mycobacterium
LGGRPGS

SEQ ID NO: 908399 - protein, 4 aa, Mycobacterium
LGGS

SEQ ID NO: 908400 - protein, 9 aa, Mycobacterium
LGGSDAAAK

SEQ ID NO: 908401 - protein, 6 aa, Mycobacterium
LGGSDV

SEQ ID NO: 908402 - protein, 10 aa, Mycobacterium
LGGSERGGQL

SEQ ID NO: 908403 - protein, 9 aa, Mycobacterium
LGGSERRGQ

SEQ ID NO: 908404 - protein, 9 aa, Mycobacterium
LGGSEVAGA

SEQ ID NO: 908405 - protein, 10 aa, Mycobacterium
LGGTDTSGRS

SEQ ID NO: 908406 - protein, 7 aa, Mycobacterium
LGGTPGQ

SEQ ID NO: 908407 - protein, 4 aa, Mycobacterium
LGGV

SEQ ID NO: 908408 - protein, 4 aa, Mycobacterium
LGGY

SEQ ID NO: 908409 - protein, 10 aa, Mycobacterium
LGHPGTEGGI

SEQ ID NO: 908410 - protein, 6 aa, Mycobacterium
LGKDTR

SEQ ID NO: 908411 - protein, 8 aa, Mycobacterium
LGKGGGTL

SEQ ID NO: 908412 - protein, 13 aa, Mycobacterium
LGKPDTKISEAPH

SEQ ID NO: 908413 - protein, 9 aa, Mycobacterium
LGKPGSAQD

SEQ ID NO: 908414 - protein, 29 aa, Mycobacterium
LGKRGQPDSPARDNHPPVNYVPPQRICEK

SEQ ID NO: 908415 - protein, 12 aa, Mycobacterium
LGKSSGGNGSNG

SEQ ID NO: 908416 - protein, 5 aa, Mycobacterium
LGLPA

SEQ ID NO: 908417 - protein, 6 aa, Mycobacterium
LGNEEA

SEQ ID NO: 908418 - protein, 6 aa, Mycobacterium
LGNKEI

SEQ ID NO: 908419 - protein, 19 aa, Mycobacterium
LGNSGNNNIGFGNTGNGNI

SEQ ID NO: 908420 - protein, 4 aa, Mycobacterium
LGNT

SEQ ID NO: 908421 - protein, 5 aa, Mycobacterium
LGNTD

SEQ ID NO: 908422 - protein, 10 aa, Mycobacterium
LGNTGNSNAP

SEQ ID NO: 908423 - protein, 7 aa, Mycobacterium
LGNTPPQ

SEQ ID NO: 908424 - protein, 4 aa, Mycobacterium
LGPA

SEQ ID NO: 908425 - protein, 14 aa, Mycobacterium
LGPAAGAAQADRAL

SEQ ID NO: 908426 - protein, 13 aa, Mycobacterium
LGPADGTGIYGTP

SEQ ID NO: 908427 - protein, 16 aa, Mycobacterium
LGPADPAGLPDGYGNG

SEQ ID NO: 908428 - protein, 5 aa, Mycobacterium
LGPAE

SEQ ID NO: 908429 - protein, 11 aa, Mycobacterium
LGPAHGDGIDE

SEQ ID NO: 908430 - protein, 6 aa, Mycobacterium
LGPASG

SEQ ID NO: 908431 - protein, 9 aa, Mycobacterium
LGPDGDQIG

SEQ ID NO: 908432 - protein, 8 aa, Mycobacterium
LGPDISTG

SEQ ID NO: 908433 - protein, 5 aa, Mycobacterium
LGPDS

SEQ ID NO: 908434 - protein, 8 aa, Mycobacterium
LGPGAAAR

SEQ ID NO: 908435 - protein, 10 aa, Mycobacterium
LGPGANSPVN

SEQ ID NO: 908436 - protein, 12 aa, Mycobacterium
LGPKSGVSGTSV

SEQ ID NO: 908437 - protein, 4 aa, Mycobacterium
LGPL

SEQ ID NO: 908438 - protein, 8 aa, Mycobacterium
LGPNGRAA

SEQ ID NO: 908439 - protein, 12 aa, Mycobacterium
LGPNSKVSSPSI

SEQ ID NO: 908440 - protein, 12 aa, Mycobacterium
LGPNSKVSTPSV

SEQ ID NO: 908441 - protein, 12 aa, Mycobacterium
LGPNSQVSSSSV

SEQ ID NO: 908442 - protein, 9 aa, Mycobacterium
LGPPAVASA

SEQ ID NO: 908443 - protein, 6 aa, Mycobacterium
LGPRDP

SEQ ID NO: 908444 - protein, 9 aa, Mycobacterium
LGPRGHAPC

SEQ ID NO: 908445 - protein, 6 aa, Mycobacterium
LGPRPG

SEQ ID NO: 908446 - protein, 9 aa, Mycobacterium
LGPSPDVKN

SEQ ID NO: 908447 - protein, 10 aa, Mycobacterium
LGPTAASDWE

SEQ ID NO: 908448 - protein, 5 aa, Mycobacterium
LGPTL

SEQ ID NO: 908449 - protein, 13 aa, Mycobacterium
LGPTPEQPKGPFG

SEQ ID NO: 908450 - protein, 14 aa, Mycobacterium
LGPTPSGGGSGVNG

SEQ ID NO: 908451 - protein, 14 aa, Mycobacterium
LGPVATNAEGANMD

SEQ ID NO: 908452 - protein, 8 aa, Mycobacterium
LGQGNTAV

SEQ ID NO: 908453 - protein, 4 aa, Mycobacterium
LGQN

SEQ ID NO: 908454 - protein, 9 aa, Mycobacterium
LGQPADAGL

SEQ ID NO: 908455 - protein, 11 aa, Mycobacterium
LGQPGTYTDFG

SEQ ID NO: 908456 - protein, 6 aa, Mycobacterium
LGQPGV

SEQ ID NO: 908457 - protein, 8 aa, Mycobacterium
LGQQQAQD

SEQ ID NO: 908458 - protein, 5 aa, Mycobacterium
LGQRE

SEQ ID NO: 908459 - protein, 4 aa, Mycobacterium
LGQS

SEQ ID NO: 908460 - protein, 10 aa, Mycobacterium
LGRERPGESI

SEQ ID NO: 908461 - protein, 4 aa, Mycobacterium
LGRG

SEQ ID NO: 908462 - protein, 5 aa, Mycobacterium
LGRGS

SEQ ID NO: 908463 - protein, 21 aa, Mycobacterium
LGRKDAAAAAAQTSDPAAAEA

SEQ ID NO: 908464 - protein, 7 aa, Mycobacterium
LGRPLGP

SEQ ID NO: 908465 - protein, 8 aa, Mycobacterium
LGRPQSFE

SEQ ID NO: 908466 - protein, 5 aa, Mycobacterium
LGRPT

SEQ ID NO: 908467 - protein, 4 aa, Mycobacterium
LGRQ

SEQ ID NO: 908468 - protein, 8 aa, Mycobacterium
LGRQTDED

SEQ ID NO: 908469 - protein, 7 aa, Mycobacterium
LGRSGAG

SEQ ID NO: 908470 - protein, 7 aa, Mycobacterium
LGRSGAK

SEQ ID NO: 908471 - protein, 10 aa, Mycobacterium
LGRSGVGVGE

SEQ ID NO: 908472 - protein, 4 aa, Mycobacterium
LGSA

SEQ ID NO: 908473 - protein, 4 aa, Mycobacterium
LGSC

SEQ ID NO: 908474 - protein, 11 aa, Mycobacterium
LGSCENAKTGV

SEQ ID NO: 908475 - protein, 36 aa, Mycobacterium
LGSDDDSSDQPAVASATTTTPTKTSEKAEPEPPARA

SEQ ID NO: 908476 - protein, 11 aa, Mycobacterium
LGSDGKPGNIA

SEQ ID NO: 908477 - protein, 4 aa, Mycobacterium
LGSG

SEQ ID NO: 908478 - protein, 9 aa, Mycobacterium
LGSGGTEEQ

SEQ ID NO: 908479 - protein, 9 aa, Mycobacterium
LGSGGTPDQ

SEQ ID NO: 908480 - protein, 11 aa, Mycobacterium
LGSGNTGAGNL

SEQ ID NO: 908481 - protein, 10 aa, Mycobacterium
LGSGNTGDAN

SEQ ID NO: 908482 - protein, 10 aa, Mycobacterium
LGSGNTGSFN

SEQ ID NO: 908483 - protein, 7 aa, Mycobacterium
LGSGSAV

SEQ ID NO: 908484 - protein, 7 aa, Mycobacterium
LGSHPRL

SEQ ID NO: 908485 - protein, 5 aa, Mycobacterium
LGSMD

SEQ ID NO: 908486 - protein, 10 aa, Mycobacterium
LGSNKDRDYG

SEQ ID NO: 908487 - protein, 8 aa, Mycobacterium
LGSNPGDL

SEQ ID NO: 908488 - protein, 8 aa, Mycobacterium
LGSPEAKA

SEQ ID NO: 908489 - protein, 8 aa, Mycobacterium
LGSPGEHD

SEQ ID NO: 908490 - protein, 6 aa, Mycobacterium
LGSPGI

SEQ ID NO: 908491 - protein, 7 aa, Mycobacterium
LGSPNAG

SEQ ID NO: 908492 - protein, 7 aa, Mycobacterium
LGSRRRR

SEQ ID NO: 908493 - protein, 10 aa, Mycobacterium
LGSSAARHAE

SEQ ID NO: 908494 - protein, 36 aa, Mycobacterium
LGSSGKSDDDSSPVTSMTTTTAPTSTSTKTPANQAE

SEQ ID NO: 908495 - protein, 38 aa, Mycobacterium
LGSSGSSDDDSASAASPATTTSASATPTSTKPAANQAE

SEQ ID NO: 908496 - protein, 13 aa, Mycobacterium
LGSSPARAETGVN

SEQ ID NO: 908497 - protein, 8 aa, Mycobacterium
LGSSTPAT

SEQ ID NO: 908498 - protein, 5 aa, Mycobacterium
LGSSV

SEQ ID NO: 908499 - protein, 4 aa, Mycobacterium
LGST

SEQ ID NO: 908500 - protein, 5 aa, Mycobacterium
LGSTG

SEQ ID NO: 908501 - protein, 11 aa, Mycobacterium
LGSTPEEAGDY

SEQ ID NO: 908502 - protein, 8 aa, Mycobacterium
LGSTTWNS

SEQ ID NO: 908503 - protein, 7 aa, Mycobacterium
LGTADTR

SEQ ID NO: 908504 - protein, 7 aa, Mycobacterium
LGTDDTR

SEQ ID NO: 908505 - protein, 4 aa, Mycobacterium
LGTG

SEQ ID NO: 908506 - protein, 5 aa, Mycobacterium
LGTGP

SEQ ID NO: 908507 - protein, 7 aa, Mycobacterium
LGTGSSA

SEQ ID NO: 908508 - protein, 4 aa, Mycobacterium
LGTL

SEQ ID NO: 908509 - protein, 19 aa, Mycobacterium
LGTNAEAAAEQQVKGQQAA

SEQ ID NO: 908510 - protein, 9 aa, Mycobacterium
LGTNKDRDY

SEQ ID NO: 908511 - protein, 5 aa, Mycobacterium
LGTPA

SEQ ID NO: 908512 - protein, 6 aa, Mycobacterium
LGTPEE

SEQ ID NO: 908513 - protein, 23 aa, Mycobacterium
LGTPGAQSIPVGQSTQGIESGGI

SEQ ID NO: 908514 - protein, 7 aa, Mycobacterium
LGTPGEY

SEQ ID NO: 908515 - protein, 21 aa, Mycobacterium
LGTPGGGVTFNGSTPTDTQYS

SEQ ID NO: 908516 - protein, 9 aa, Mycobacterium
LGTPPDGVT

SEQ ID NO: 908517 - protein, 15 aa, Mycobacterium
LGTPTGSGAVTYGNS

SEQ ID NO: 908518 - protein, 6 aa, Mycobacterium
LGTQRL

SEQ ID NO: 908519 - protein, 9 aa, Mycobacterium
LGTRDGANL

SEQ ID NO: 908520 - protein, 10 aa, Mycobacterium
LGTRDGSNLE

SEQ ID NO: 908521 - protein, 15 aa, Mycobacterium
LGTSATVPAVSAPTR

SEQ ID NO: 908522 - protein, 8 aa, Mycobacterium
LGTSGKVS

SEQ ID NO: 908523 - protein, 6 aa, Mycobacterium
LGWEGT

SEQ ID NO: 908524 - protein, 5 aa, Mycobacterium
LGYEQ

SEQ ID NO: 908525 - protein, 10 aa, Mycobacterium
LGYPGPDPVA

SEQ ID NO: 908526 - protein, 6 aa, Mycobacterium
LGYSED

SEQ ID NO: 908527 - protein, 8 aa, Mycobacterium
LGYSRDGK

SEQ ID NO: 908528 - protein, 7 aa, Mycobacterium
LHGASTA

SEQ ID NO: 908529 - protein, 11 aa, Mycobacterium
LHGASTAARFP

SEQ ID NO: 908530 - protein, 6 aa, Mycobacterium
LHGPDG

SEQ ID NO: 908531 - protein, 5 aa, Mycobacterium
LHPNS

SEQ ID NO: 908532 - protein, 12 aa, Mycobacterium
LHPSNDPIPYQP

SEQ ID NO: 908533 - protein, 10 aa, Mycobacterium
LHSKPDPNVI

SEQ ID NO: 908534 - protein, 4 aa, Mycobacterium
LHSP

SEQ ID NO: 908535 - protein, 13 aa, Mycobacterium
LIEPGKRTGSYRV

SEQ ID NO: 908536 - protein, 5 aa, Mycobacterium
LITTE

SEQ ID NO: 908537 - protein, 10 aa, Mycobacterium
LKAGAAAAAS

SEQ ID NO: 908538 - protein, 6 aa, Mycobacterium
LKAGQK

SEQ ID NO: 908539 - protein, 7 aa, Mycobacterium
LKAQGNK

SEQ ID NO: 908540 - protein, 15 aa, Mycobacterium
LKATFGGSRGSALPQ

SEQ ID NO: 908541 - protein, 9 aa, Mycobacterium
LKATGGSRR

SEQ ID NO: 908542 - protein, 20 aa, Mycobacterium
LKDERTTDGLNAQTFCFVKS

SEQ ID NO: 908543 - protein, 7 aa, Mycobacterium
LKDPART

SEQ ID NO: 908544 - protein, 12 aa, Mycobacterium
LKDSGSTAQQNA

SEQ ID NO: 908545 - protein, 9 aa, Mycobacterium
LKESGRTGV

SEQ ID NO: 908546 - protein, 9 aa, Mycobacterium
LKGNPSPEL

SEQ ID NO: 908547 - protein, 20 aa, Mycobacterium
LKGPDLSNLSTTTPDDIGQA

SEQ ID NO: 908548 - protein, 10 aa, Mycobacterium
LKGTNTGKTC

SEQ ID NO: 908549 - protein, 9 aa, Mycobacterium
LKKATAGLR

SEQ ID NO: 908550 - protein, 7 aa, Mycobacterium
LKKGDGN

SEQ ID NO: 908551 - protein, 8 aa, Mycobacterium
LKKNTDAV

SEQ ID NO: 908552 - protein, 6 aa, Mycobacterium
LKKRGG

SEQ ID NO: 908553 - protein, 14 aa, Mycobacterium
LKNTPGDGGAKHEA

SEQ ID NO: 908554 - protein, 19 aa, Mycobacterium
LKPDPVPGAPWTPPAPSLA

SEQ ID NO: 908555 - protein, 7 aa, Mycobacterium
LKPRGDA

SEQ ID NO: 908556 - protein, 8 aa, Mycobacterium
LKPSDAEL

SEQ ID NO: 908557 - protein, 9 aa, Mycobacterium
LKPSDRGEL

SEQ ID NO: 908558 - protein, 9 aa, Mycobacterium
LKPSSDPIP

SEQ ID NO: 908559 - protein, 10 aa, Mycobacterium
LKPSSDTIPY

SEQ ID NO: 908560 - protein, 7 aa, Mycobacterium
LKPSSDV

SEQ ID NO: 908561 - protein, 9 aa, Mycobacterium
LKQPDGTLT

SEQ ID NO: 908562 - protein, 23 aa, Mycobacterium
LKRGEHVSGPAADEYKARVGRAN

SEQ ID NO: 908563 - protein, 15 aa, Mycobacterium
LKSATSDGTADHERG

SEQ ID NO: 908564 - protein, 4 aa, Mycobacterium
LKSD

SEQ ID NO: 908565 - protein, 8 aa, Mycobacterium
LKSDPTGV

SEQ ID NO: 908566 - protein, 7 aa, Mycobacterium
LKSGEKV

SEQ ID NO: 908567 - protein, 6 aa, Mycobacterium
LKSGQK

SEQ ID NO: 908568 - protein, 9 aa, Mycobacterium
LKSSGRQGV

SEQ ID NO: 908569 - protein, 8 aa, Mycobacterium
LKSSSDVI

SEQ ID NO: 908570 - protein, 9 aa, Mycobacterium
LKTDNAQGE

SEQ ID NO: 908571 - protein, 14 aa, Mycobacterium
LKTGERRGDRSPAT

SEQ ID NO: 908572 - protein, 21 aa, Mycobacterium
LKTTGVEDLGAGGVSGPPVAA

SEQ ID NO: 908573 - protein, 14 aa, Mycobacterium
LKVKPGDQLSTGQA

SEQ ID NO: 908574 - protein, 9 aa, Mycobacterium
LLGSDSGDV

SEQ ID NO: 908575 - protein, 16 aa, Mycobacterium
LNAGAFPQSPLDGTFG

SEQ ID NO: 908576 - protein, 8 aa, Mycobacterium
LNANAGAG

SEQ ID NO: 908577 - protein, 7 aa, Mycobacterium
LNARDAQ

SEQ ID NO: 908578 - protein, 9 aa, Mycobacterium
LNASGEQVY

SEQ ID NO: 908579 - protein, 11 aa, Mycobacterium
LNATDSDGDPI

SEQ ID NO: 908580 - protein, 4 aa, Mycobacterium
LNDE

SEQ ID NO: 908581 - protein, 5 aa, Mycobacterium
LNDGR

SEQ ID NO: 908582 - protein, 7 aa, Mycobacterium
LNDNRKN

SEQ ID NO: 908583 - protein, 4 aa, Mycobacterium
LNDP

SEQ ID NO: 908584 - protein, 14 aa, Mycobacterium
LNDPAGASGERAGQ

SEQ ID NO: 908585 - protein, 13 aa, Mycobacterium
LNDPGPAAARTAL

SEQ ID NO: 908586 - protein, 6 aa, Mycobacterium
LNDPTQ

SEQ ID NO: 908587 - protein, 10 aa, Mycobacterium
LNDSEDAWSA

SEQ ID NO: 908588 - protein, 10 aa, Mycobacterium
LNEGTSLPDA

SEQ ID NO: 908589 - protein, 6 aa, Mycobacterium
LNEPGQ

SEQ ID NO: 908590 - protein, 12 aa, Mycobacterium
LNEPGSGPAAGK

SEQ ID NO: 908591 - protein, 6 aa, Mycobacterium
LNETEQ

SEQ ID NO: 908592 - protein, 6 aa, Mycobacterium
LNGDGA

SEQ ID NO: 908593 - protein, 11 aa, Mycobacterium
LNGDPTQAGAA

SEQ ID NO: 908594 - protein, 12 aa, Mycobacterium
LNGDPTQAGAGF

SEQ ID NO: 908595 - protein, 5 aa, Mycobacterium
LNGDS

SEQ ID NO: 908596 - protein, 21 aa, Mycobacterium
LNGKETSPFDLPAPAAPQGGG

SEQ ID NO: 908597 - protein, 7 aa, Mycobacterium
LNGPDAA

SEQ ID NO: 908598 - protein, 9 aa, Mycobacterium
LNGQSNNGL

SEQ ID NO: 908599 - protein, 8 aa, Mycobacterium
LNGRNQTL

SEQ ID NO: 908600 - protein, 9 aa, Mycobacterium
LNGRQPAAG

SEQ ID NO: 908601 - protein, 6 aa, Mycobacterium
LNGSRY

SEQ ID NO: 908602 - protein, 6 aa, Mycobacterium
LNGTKN

SEQ ID NO: 908603 - protein, 9 aa, Mycobacterium
LNPDGSFTY

SEQ ID NO: 908604 - protein, 6 aa, Mycobacterium
LNPDTG

SEQ ID NO: 908605 - protein, 15 aa, Mycobacterium
LNPEQLANKFRMAWS

SEQ ID NO: 908606 - protein, 10 aa, Mycobacterium
LNPGASLPAE

SEQ ID NO: 908607 - protein, 12 aa, Mycobacterium
LNPPEDPSSELL

SEQ ID NO: 908608 - protein, 14 aa, Mycobacterium
LNPSVSRCNIPQPS

SEQ ID NO: 908609 - protein, 12 aa, Mycobacterium
LNPTGGQYDPTL

SEQ ID NO: 908610 - protein, 7 aa, Mycobacterium
LNQGSTE

SEQ ID NO: 908611 - protein, 7 aa, Mycobacterium
LNQQRDD

SEQ ID NO: 908612 - protein, 19 aa, Mycobacterium
LNQRSAPSITNFSSDDAEL

SEQ ID NO: 908613 - protein, 10 aa, Mycobacterium
LNRATAKTTY

SEQ ID NO: 908614 - protein, 4 aa, Mycobacterium
LNRG

SEQ ID NO: 908615 - protein, 5 aa, Mycobacterium
LNRPT

SEQ ID NO: 908616 - protein, 8 aa, Mycobacterium
LNRPTPDR

SEQ ID NO: 908617 - protein, 13 aa, Mycobacterium
LNSDGYSGGGGKA

SEQ ID NO: 908618 - protein, 10 aa, Mycobacterium
LNSRSDAAIE

SEQ ID NO: 908619 - protein, 7 aa, Mycobacterium
LNSTAQG

SEQ ID NO: 908620 - protein, 9 aa, Mycobacterium
LNSVDQAPA

SEQ ID NO: 908621 - protein, 13 aa, Mycobacterium
LNTFTGGTTLTAD

SEQ ID NO: 908622 - protein, 28 aa, Mycobacterium
LNTGLGSSADQPGPSSGFGNSGAGSSGF

SEQ ID NO: 908623 - protein, 34 aa, Mycobacterium
LNTGMGSPEDQSVANSGFRNAGSGNSGFNNTGSF

SEQ ID NO: 908624 - protein, 4 aa, Mycobacterium
LNTK

SEQ ID NO: 908625 - protein, 4 aa, Mycobacterium
LNTS

SEQ ID NO: 908626 - protein, 15 aa, Mycobacterium
LPAAGGSDGYGQSKA

SEQ ID NO: 908627 - protein, 6 aa, Mycobacterium
LPAAQT

SEQ ID NO: 908628 - protein, 8 aa, Mycobacterium
LPAATGYP

SEQ ID NO: 908629 - protein, 11 aa, Mycobacterium
LPADDPGPFTY

SEQ ID NO: 908630 - protein, 5 aa, Mycobacterium
LPADK

SEQ ID NO: 908631 - protein, 7 aa, Mycobacterium
LPADPTG

SEQ ID NO: 908632 - protein, 6 aa, Mycobacterium
LPADSE

SEQ ID NO: 908633 - protein, 8 aa, Mycobacterium
LPAEASGT

SEQ ID NO: 908634 - protein, 7 aa, Mycobacterium
LPAEGTS

SEQ ID NO: 908635 - protein, 10 aa, Mycobacterium
LPAGADFPSD

SEQ ID NO: 908636 - protein, 27 aa, Mycobacterium
LPAGNDGAAATGSYTQIGSRGKAGRTP

SEQ ID NO: 908637 - protein, 8 aa, Mycobacterium
LPAGTGDD

SEQ ID NO: 908638 - protein, 21 aa, Mycobacterium
LPAGYTSADKTGSGDYGSTND

SEQ ID NO: 908639 - protein, 4 aa, Mycobacterium
LPAN

SEQ ID NO: 908640 - protein, 14 aa, Mycobacterium
LPANATAKVAQTSL

SEQ ID NO: 908641 - protein, 12 aa, Mycobacterium
LPANATARIGTT

SEQ ID NO: 908642 - protein, 12 aa, Mycobacterium
LPANATATLGQT

SEQ ID NO: 908643 - protein, 12 aa, Mycobacterium
LPANGVQLSASG

SEQ ID NO: 908644 - protein, 6 aa, Mycobacterium
LPANVP

SEQ ID NO: 908645 - protein, 18 aa, Mycobacterium
LPAPAPPKISPPKISPPR

SEQ ID NO: 908646 - protein, 6 aa, Mycobacterium
LPAPAQ

SEQ ID NO: 908647 - protein, 9 aa, Mycobacterium
LPAPGIGGG

SEQ ID NO: 908648 - protein, 10 aa, Mycobacterium
LPAPGLGAGG

SEQ ID NO: 908649 - protein, 11 aa, Mycobacterium
LPAPGMTGGSY

SEQ ID NO: 908650 - protein, 11 aa, Mycobacterium
LPAPGVGSGGY

SEQ ID NO: 908651 - protein, 10 aa, Mycobacterium
LPAPGVGTGG

SEQ ID NO: 908652 - protein, 8 aa, Mycobacterium
LPAPHGGS

SEQ ID NO: 908653 - protein, 8 aa, Mycobacterium
LPAPKGPF

SEQ ID NO: 908654 - protein, 32 aa, Mycobacterium
LPAPKTWASPAGRDEPAGRIPAPAAPSGQSGT

SEQ ID NO: 908655 - protein, 11 aa, Mycobacterium
LPAPNMGSQSY

SEQ ID NO: 908656 - protein, 8 aa, Mycobacterium
LPAPPAPR

SEQ ID NO: 908657 - protein, 16 aa, Mycobacterium
LPAPPLPTPPNSTAAP

SEQ ID NO: 908658 - protein, 8 aa, Mycobacterium
LPAPPRTW

SEQ ID NO: 908659 - protein, 31 aa, Mycobacterium
LPAPQAGAHPSGRDRSAGRPPAPAAPSGQTG

SEQ ID NO: 908660 - protein, 12 aa, Mycobacterium
LPAPSARTPATQ

SEQ ID NO: 908661 - protein, 21 aa, Mycobacterium
LPAPSEPAQFTAPGAPGTLGS

SEQ ID NO: 908662 - protein, 11 aa, Mycobacterium
LPAPTLGSGGY

SEQ ID NO: 908663 - protein, 7 aa, Mycobacterium
LPAPTVR

SEQ ID NO: 908664 - protein, 10 aa, Mycobacterium
LPAQGGKQPQ

SEQ ID NO: 908665 - protein, 7 aa, Mycobacterium
LPAQQAP

SEQ ID NO: 908666 - protein, 8 aa, Mycobacterium
LPARQQLP

SEQ ID NO: 908667 - protein, 21 aa, Mycobacterium
LPATNGPSGPRPDGPAATGTV

SEQ ID NO: 908668 - protein, 21 aa, Mycobacterium
LPATNGPSGPRPDGPPPTGTV

SEQ ID NO: 908669 - protein, 11 aa, Mycobacterium
LPATSGEETSR

SEQ ID NO: 908670 - protein, 6 aa, Mycobacterium
LPDATG

SEQ ID NO: 908671 - protein, 6 aa, Mycobacterium
LPDDPR

SEQ ID NO: 908672 - protein, 5 aa, Mycobacterium
LPDGA

SEQ ID NO: 908673 - protein, 8 aa, Mycobacterium
LPDGGPLV

SEQ ID NO: 908674 - protein, 18 aa, Mycobacterium
LPDGPAPDAAPPAPEPVD

SEQ ID NO: 908675 - protein, 14 aa, Mycobacterium
LPDGTDQRRGVPQG

SEQ ID NO: 908676 - protein, 8 aa, Mycobacterium
LPDGTTVR

SEQ ID NO: 908677 - protein, 4 aa, Mycobacterium
LPDN

SEQ ID NO: 908678 - protein, 8 aa, Mycobacterium
LPDPAQAG

SEQ ID NO: 908679 - protein, 14 aa, Mycobacterium
LPDPARPGAAPPFG

SEQ ID NO: 908680 - protein, 9 aa, Mycobacterium
LPDPDNTGR

SEQ ID NO: 908681 - protein, 7 aa, Mycobacterium
LPDPGHP

SEQ ID NO: 908682 - protein, 6 aa, Mycobacterium
LPDPGV

SEQ ID NO: 908683 - protein, 15 aa, Mycobacterium
LPDPIGSSIPSNAET

SEQ ID NO: 908684 - protein, 8 aa, Mycobacterium
LPDPQQAG

SEQ ID NO: 908685 - protein, 14 aa, Mycobacterium
LPDPSARTAALRSG

SEQ ID NO: 908686 - protein, 4 aa, Mycobacterium
LPDR

SEQ ID NO: 908687 - protein, 15 aa, Mycobacterium
LPDRRRRIRGRLRGS

SEQ ID NO: 908688 - protein, 5 aa, Mycobacterium
LPDSA

SEQ ID NO: 908689 - protein, 6 aa, Mycobacterium
LPDSGY

SEQ ID NO: 908690 - protein, 7 aa, Mycobacterium
LPDTVTG

SEQ ID NO: 908691 - protein, 12 aa, Mycobacterium
LPEAPPDEPPAA

SEQ ID NO: 908692 - protein, 5 aa, Mycobacterium
LPEAQ

SEQ ID NO: 908693 - protein, 15 aa, Mycobacterium
LPEDETTAPPPPPPP

SEQ ID NO: 908694 - protein, 8 aa, Mycobacterium
LPEDQPAP

SEQ ID NO: 908695 - protein, 12 aa, Mycobacterium
LPEGASTTAAEN

SEQ ID NO: 908696 - protein, 8 aa, Mycobacterium
LPEGDPAI

SEQ ID NO: 908697 - protein, 15 aa, Mycobacterium
LPEGSTAELRSATPL

SEQ ID NO: 908698 - protein, 4 aa, Mycobacterium
LPEP

SEQ ID NO: 908699 - protein, 52 aa, Mycobacterium
LPEPAAEPEPVEVSEPAETAEAAEAAVPGETVAEAAPEPEPEPEPAPKPEPV

SEQ ID NO: 908700 - protein, 13 aa, Mycobacterium
LPEPSAMSVIANL

SEQ ID NO: 908701 - protein, 8 aa, Mycobacterium
LPEPSPRG

SEQ ID NO: 908702 - protein, 10 aa, Mycobacterium
LPEPSTALDA

SEQ ID NO: 908703 - protein, 4 aa, Mycobacterium
LPER

SEQ ID NO: 908704 - protein, 7 aa, Mycobacterium
LPERQRQ

SEQ ID NO: 908705 - protein, 21 aa, Mycobacterium
LPESAGPVQASVPRSAIDSML

SEQ ID NO: 908706 - protein, 6 aa, Mycobacterium
LPESAR

SEQ ID NO: 908707 - protein, 11 aa, Mycobacterium
LPESARTGVRA

SEQ ID NO: 908708 - protein, 6 aa, Mycobacterium
LPESGF

SEQ ID NO: 908709 - protein, 5 aa, Mycobacterium
LPETT

SEQ ID NO: 908710 - protein, 6 aa, Mycobacterium
LPGAAV

SEQ ID NO: 908711 - protein, 5 aa, Mycobacterium
LPGAD

SEQ ID NO: 908712 - protein, 10 aa, Mycobacterium
LPGAPSSPPL

SEQ ID NO: 908713 - protein, 8 aa, Mycobacterium
LPGATGKV

SEQ ID NO: 908714 - protein, 8 aa, Mycobacterium
LPGATTVT

SEQ ID NO: 908715 - protein, 20 aa, Mycobacterium
LPGDANYDAATGQVTVTPAT

SEQ ID NO: 908716 - protein, 17 aa, Mycobacterium
LPGGAGGNGGAGGAGGL

SEQ ID NO: 908717 - protein, 27 aa, Mycobacterium
LPGGAKTAVAPSVASDALSAGLPAPVA

SEQ ID NO: 908718 - protein, 12 aa, Mycobacterium
LPGGANFDGNTV

SEQ ID NO: 908719 - protein, 17 aa, Mycobacterium
LPGGGGSIPCTGNNTGQ

SEQ ID NO: 908720 - protein, 18 aa, Mycobacterium
LPGGRQLTSRPGVVAQPG

SEQ ID NO: 908721 - protein, 4 aa, Mycobacterium
LPGI

SEQ ID NO: 908722 - protein, 8 aa, Mycobacterium
LPGIPGTR

SEQ ID NO: 908723 - protein, 6 aa, Mycobacterium
LPGLAS

SEQ ID NO: 908724 - protein, 15 aa, Mycobacterium
LPGLPSSGPRPEARA

SEQ ID NO: 908725 - protein, 9 aa, Mycobacterium
LPGLTGGAI

SEQ ID NO: 908726 - protein, 5 aa, Mycobacterium
LPGNP

SEQ ID NO: 908727 - protein, 6 aa, Mycobacterium
LPGPAE

SEQ ID NO: 908728 - protein, 6 aa, Mycobacterium
LPGPAQ

SEQ ID NO: 908729 - protein, 8 aa, Mycobacterium
LPGPLSTA

SEQ ID NO: 908730 - protein, 7 aa, Mycobacterium
LPGPSRD

SEQ ID NO: 908731 - protein, 19 aa, Mycobacterium
LPGQRVDPAGPLRSNPWWR

SEQ ID NO: 908732 - protein, 5 aa, Mycobacterium
LPGQT

SEQ ID NO: 908733 - protein, 24 aa, Mycobacterium
LPGRRPARRSSSRPVRSQRVVDAD

SEQ ID NO: 908734 - protein, 22 aa, Mycobacterium
LPGRRPRSSSRSVRSQRIIDSE

SEQ ID NO: 908735 - protein, 12 aa, Mycobacterium
LPGTAGRGPGSF

SEQ ID NO: 908736 - protein, 16 aa, Mycobacterium
LPGTARDYDPESNESL

SEQ ID NO: 908737 - protein, 8 aa, Mycobacterium
LPGTDGLG

SEQ ID NO: 908738 - protein, 16 aa, Mycobacterium
LPGTGLSSDGKDQAQQ

SEQ ID NO: 908739 - protein, 12 aa, Mycobacterium
LPGTKGGGPGAY

SEQ ID NO: 908740 - protein, 19 aa, Mycobacterium
LPGTTGSVAVTGSTDTAAP

SEQ ID NO: 908741 - protein, 14 aa, Mycobacterium
LPGTTLPPTPGAAV

SEQ ID NO: 908742 - protein, 14 aa, Mycobacterium
LPGVEQTSQSLGAK

SEQ ID NO: 908743 - protein, 11 aa, Mycobacterium
LPGVPRAHGSA

SEQ ID NO: 908744 - protein, 16 aa, Mycobacterium
LPGYEGSNNGSASTLS

SEQ ID NO: 908745 - protein, 4 aa, Mycobacterium
LPHE

SEQ ID NO: 908746 - protein, 7 aa, Mycobacterium
LPHNDKP

SEQ ID NO: 908747 - protein, 4 aa, Mycobacterium
LPHR

SEQ ID NO: 908748 - protein, 9 aa, Mycobacterium
LPKDGNGPF

SEQ ID NO: 908749 - protein, 11 aa, Mycobacterium
LPKDQVRQRAQ

SEQ ID NO: 908750 - protein, 6 aa, Mycobacterium
LPKGDR

SEQ ID NO: 908751 - protein, 15 aa, Mycobacterium
LPKGSTAELRSATPL

SEQ ID NO: 908752 - protein, 7 aa, Mycobacterium
LPKPVTG

SEQ ID NO: 908753 - protein, 22 aa, Mycobacterium
LPKYSGDQYNAGQKVPVAQAKR

SEQ ID NO: 908754 - protein, 8 aa, Mycobacterium
LPLGTGKI

SEQ ID NO: 908755 - protein, 6 aa, Mycobacterium
LPLPAA

SEQ ID NO: 908756 - protein, 16 aa, Mycobacterium
LPLPGTVGRGDGATAY

SEQ ID NO: 908757 - protein, 7 aa, Mycobacterium
LPNDEGL

SEQ ID NO: 908758 - protein, 15 aa, Mycobacterium
LPNQPGGANYQGTNP

SEQ ID NO: 908759 - protein, 4 aa, Mycobacterium
LPNR

SEQ ID NO: 908760 - protein, 8 aa, Mycobacterium
LPNSRRRR

SEQ ID NO: 908761 - protein, 5 aa, Mycobacterium
LPPAD

SEQ ID NO: 908762 - protein, 9 aa, Mycobacterium
LPPADGSRV

SEQ ID NO: 908763 - protein, 6 aa, Mycobacterium
LPPADL

SEQ ID NO: 908764 - protein, 16 aa, Mycobacterium
LPPADPNFADPPGHID

SEQ ID NO: 908765 - protein, 6 aa, Mycobacterium
LPPAIA

SEQ ID NO: 908766 - protein, 9 aa, Mycobacterium
LPPDGLTKA

SEQ ID NO: 908767 - protein, 17 aa, Mycobacterium
LPPDPSPQRLESGDTIT

SEQ ID NO: 908768 - protein, 7 aa, Mycobacterium
LPPDRQP

SEQ ID NO: 908769 - protein, 4 aa, Mycobacterium
LPPE

SEQ ID NO: 908770 - protein, 9 aa, Mycobacterium
LPPEERRAK

SEQ ID NO: 908771 - protein, 17 aa, Mycobacterium
LPPEGSPPDAQPPNDTS

SEQ ID NO: 908772 - protein, 17 aa, Mycobacterium
LPPEPPLPPDDPSQGCD

SEQ ID NO: 908773 - protein, 7 aa, Mycobacterium
LPPEQAR

SEQ ID NO: 908774 - protein, 5 aa, Mycobacterium
LPPET

SEQ ID NO: 908775 - protein, 15 aa, Mycobacterium
LPPGADEDAIKAGYD

SEQ ID NO: 908776 - protein, 7 aa, Mycobacterium
LPPGAGV

SEQ ID NO: 908777 - protein, 15 aa, Mycobacterium
LPPGGEDASAAAAAG

SEQ ID NO: 908778 - protein, 5 aa, Mycobacterium
LPPGL

SEQ ID NO: 908779 - protein, 7 aa, Mycobacterium
LPPGSHT

SEQ ID NO: 908780 - protein, 17 aa, Mycobacterium
LPPGTPGAAPSTDAANC

SEQ ID NO: 908781 - protein, 7 aa, Mycobacterium
LPPGTQL

SEQ ID NO: 908782 - protein, 6 aa, Mycobacterium
LPPHTT

SEQ ID NO: 908783 - protein, 4 aa, Mycobacterium
LPPN

SEQ ID NO: 908784 - protein, 6 aa, Mycobacterium
LPPNGS

SEQ ID NO: 908785 - protein, 11 aa, Mycobacterium
LPPPARRIEDP

SEQ ID NO: 908786 - protein, 6 aa, Mycobacterium
LPPPDL

SEQ ID NO: 908787 - protein, 43 aa, Mycobacterium
LPPPGAPLPPPIPQRPVPPLPPGPGAPPGPPEPAPGPPAMDGS

SEQ ID NO: 908788 - protein, 6 aa, Mycobacterium
LPPPGH

SEQ ID NO: 908789 - protein, 11 aa, Mycobacterium
LPPPGHGGPMP

SEQ ID NO: 908790 - protein, 7 aa, Mycobacterium
LPPPHAS

SEQ ID NO: 908791 - protein, 6 aa, Mycobacterium
LPPPLQ

SEQ ID NO: 908792 - protein, 6 aa, Mycobacterium
LPPPPL

SEQ ID NO: 908793 - protein, 13 aa, Mycobacterium
LPPPTAHAPATQI

SEQ ID NO: 908794 - protein, 13 aa, Mycobacterium
LPPPTAHPPSTQI

SEQ ID NO: 908795 - protein, 6 aa, Mycobacterium
LPPPTI

SEQ ID NO: 908796 - protein, 16 aa, Mycobacterium
LPPQPPLPPDGPNQDC

SEQ ID NO: 908797 - protein, 9 aa, Mycobacterium
LPPRAGGSR

SEQ ID NO: 908798 - protein, 12 aa, Mycobacterium
LPPRTGRPQGWP

SEQ ID NO: 908799 - protein, 13 aa, Mycobacterium
LPPSAKAAGRVNR

SEQ ID NO: 908800 - protein, 9 aa, Mycobacterium
LPPSPAGAV

SEQ ID NO: 908801 - protein, 5 aa, Mycobacterium
LPPSQ

SEQ ID NO: 908802 - protein, 5 aa, Mycobacterium
LPPSV

SEQ ID NO: 908803 - protein, 4 aa, Mycobacterium
LPPT

SEQ ID NO: 908804 - protein, 19 aa, Mycobacterium
LPPTDPRYVDGAPGSRVPS

SEQ ID NO: 908805 - protein, 21 aa, Mycobacterium
LPPTDPRYVEGAPGSKVPSVA

SEQ ID NO: 908806 - protein, 8 aa, Mycobacterium
LPPTGAKG

SEQ ID NO: 908807 - protein, 14 aa, Mycobacterium
LPPTGGLGALAGSG

SEQ ID NO: 908808 - protein, 6 aa, Mycobacterium
LPPTPR

SEQ ID NO: 908809 - protein, 5 aa, Mycobacterium
LPPTQ

SEQ ID NO: 908810 - protein, 4 aa, Mycobacterium
LPPV

SEQ ID NO: 908811 - protein, 24 aa, Mycobacterium
LPPVSGPAPAGGDAATGGAEQPAV

SEQ ID NO: 908812 - protein, 33 aa, Mycobacterium
LPPVSGPAPATAVADNADAATGGPAEGESDQAV

SEQ ID NO: 908813 - protein, 7 aa, Mycobacterium
LPQAGPR

SEQ ID NO: 908814 - protein, 19 aa, Mycobacterium
LPQDEEPAAPTASDQGAAN

SEQ ID NO: 908815 - protein, 18 aa, Mycobacterium
LPQDPAPAPATDVPTAAE

SEQ ID NO: 908816 - protein, 5 aa, Mycobacterium
LPQET

SEQ ID NO: 908817 - protein, 5 aa, Mycobacterium
LPQEV

SEQ ID NO: 908818 - protein, 4 aa, Mycobacterium
LPQI

SEQ ID NO: 908819 - protein, 5 aa, Mycobacterium
LPQNS

SEQ ID NO: 908820 - protein, 7 aa, Mycobacterium
LPQPALA

SEQ ID NO: 908821 - protein, 38 aa, Mycobacterium
LPQPQPQPQPQPQPAPQPQVQAQPAPAPAPPPAPPGTT

SEQ ID NO: 908822 - protein, 7 aa, Mycobacterium
LPQPTPA

SEQ ID NO: 908823 - protein, 6 aa, Mycobacterium
LPQPVP

SEQ ID NO: 908824 - protein, 6 aa, Mycobacterium
LPQQAH

SEQ ID NO: 908825 - protein, 6 aa, Mycobacterium
LPQQAR

SEQ ID NO: 908826 - protein, 7 aa, Mycobacterium
LPQQARK

SEQ ID NO: 908827 - protein, 9 aa, Mycobacterium
LPQQPAPEL

SEQ ID NO: 908828 - protein, 14 aa, Mycobacterium
LPRDARVHQIVVRQ

SEQ ID NO: 908829 - protein, 19 aa, Mycobacterium
LPRDPRSEQPWNPEPLAGN

SEQ ID NO: 908830 - protein, 19 aa, Mycobacterium
LPRDPRSQQPWSPEPLAGN

SEQ ID NO: 908831 - protein, 5 aa, Mycobacterium
LPRDT

SEQ ID NO: 908832 - protein, 14 aa, Mycobacterium
LPRGSTAELRTATP

SEQ ID NO: 908833 - protein, 16 aa, Mycobacterium
LPRGSTGKILRNELRG

SEQ ID NO: 908834 - protein, 9 aa, Mycobacterium
LPRLNPADR

SEQ ID NO: 908835 - protein, 6 aa, Mycobacterium
LPRPER

SEQ ID NO: 908836 - protein, 11 aa, Mycobacterium
LPRPGTRGRAL

SEQ ID NO: 908837 - protein, 6 aa, Mycobacterium
LPRPQQ

SEQ ID NO: 908838 - protein, 13 aa, Mycobacterium
LPRPTSRPPGTQI

SEQ ID NO: 908839 - protein, 4 aa, Mycobacterium
LPRR

SEQ ID NO: 908840 - protein, 16 aa, Mycobacterium
LPRREGSAPGPAGQDP

SEQ ID NO: 908841 - protein, 5 aa, Mycobacterium
LPRRP

SEQ ID NO: 908842 - protein, 11 aa, Mycobacterium
LPRRSGDQYNV

SEQ ID NO: 908843 - protein, 7 aa, Mycobacterium
LPRSSGA

SEQ ID NO: 908844 - protein, 22 aa, Mycobacterium
LPRTASGKLQRGQLRTQPAAQP

SEQ ID NO: 908845 - protein, 5 aa, Mycobacterium
LPSAD

SEQ ID NO: 908846 - protein, 16 aa, Mycobacterium
LPSAGGLSAPAGPDIG

SEQ ID NO: 908847 - protein, 17 aa, Mycobacterium
LPSAGLTAAPTDLGGAP

SEQ ID NO: 908848 - protein, 14 aa, Mycobacterium
LPSAPHGRATVPQD

SEQ ID NO: 908849 - protein, 6 aa, Mycobacterium
LPSATA

SEQ ID NO: 908850 - protein, 16 aa, Mycobacterium
LPSDSDLDTAGPRRSL

SEQ ID NO: 908851 - protein, 7 aa, Mycobacterium
LPSEPRG

SEQ ID NO: 908852 - protein, 4 aa, Mycobacterium
LPSG

SEQ ID NO: 908853 - protein, 13 aa, Mycobacterium
LPSGLQPRSALST

SEQ ID NO: 908854 - protein, 6 aa, Mycobacterium
LPSGSG

SEQ ID NO: 908855 - protein, 7 aa, Mycobacterium
LPSGTPV

SEQ ID NO: 908856 - protein, 13 aa, Mycobacterium
LPSNDQGPQRAET

SEQ ID NO: 908857 - protein, 15 aa, Mycobacterium
LPSPCTGGGPYNPGN

SEQ ID NO: 908858 - protein, 8 aa, Mycobacterium
LPSPEGMT

SEQ ID NO: 908859 - protein, 15 aa, Mycobacterium
LPSPGRDGTGSAEQL

SEQ ID NO: 908860 - protein, 8 aa, Mycobacterium
LPSPYTAR

SEQ ID NO: 908861 - protein, 11 aa, Mycobacterium
LPSQRRRTAGR

SEQ ID NO: 908862 - protein, 4 aa, Mycobacterium
LPST

SEQ ID NO: 908863 - protein, 10 aa, Mycobacterium
LPSTATAQRE

SEQ ID NO: 908864 - protein, 7 aa, Mycobacterium
LPTAADA

SEQ ID NO: 908865 - protein, 8 aa, Mycobacterium
LPTAEQRS

SEQ ID NO: 908866 - protein, 7 aa, Mycobacterium
LPTDAAA

SEQ ID NO: 908867 - protein, 6 aa, Mycobacterium
LPTDRG

SEQ ID NO: 908868 - protein, 7 aa, Mycobacterium
LPTEDQN

SEQ ID NO: 908869 - protein, 6 aa, Mycobacterium
LPTEPD

SEQ ID NO: 908870 - protein, 12 aa, Mycobacterium
LPTEVSEDTPFG

SEQ ID NO: 908871 - protein, 12 aa, Mycobacterium
LPTGGAIGPGDV

SEQ ID NO: 908872 - protein, 18 aa, Mycobacterium
LPTGRQLRSAPGLRAQPG

SEQ ID NO: 908873 - protein, 5 aa, Mycobacterium
LPTHP

SEQ ID NO: 908874 - protein, 6 aa, Mycobacterium
LPTLPQ

SEQ ID NO: 908875 - protein, 13 aa, Mycobacterium
LPTPDEAGRRGED

SEQ ID NO: 908876 - protein, 8 aa, Mycobacterium
LPTPDPAL

SEQ ID NO: 908877 - protein, 6 aa, Mycobacterium
LPTPGI

SEQ ID NO: 908878 - protein, 19 aa, Mycobacterium
LPTPQVSNSVAEEVAGGSR

SEQ ID NO: 908879 - protein, 6 aa, Mycobacterium
LPTPRE

SEQ ID NO: 908880 - protein, 13 aa, Mycobacterium
LPTQQSPVQQAPT

SEQ ID NO: 908881 - protein, 17 aa, Mycobacterium
LPTRNTDVPEVPAPANS

SEQ ID NO: 908882 - protein, 10 aa, Mycobacterium
LPTSGGAGAD

SEQ ID NO: 908883 - protein, 8 aa, Mycobacterium
LPTSPPSA

SEQ ID NO: 908884 - protein, 5 aa, Mycobacterium
LPTTS

SEQ ID NO: 908885 - protein, 5 aa, Mycobacterium
LPTVG

SEQ ID NO: 908886 - protein, 5 aa, Mycobacterium
LPTYA

SEQ ID NO: 908887 - protein, 21 aa, Mycobacterium
LPTYADSTPAGNVSSSGPKRV

SEQ ID NO: 908888 - protein, 9 aa, Mycobacterium
LPYERPPLS

SEQ ID NO: 908889 - protein, 28 aa, Mycobacterium
LQAGARPQTQLTSAPRTPLPDSTATLEN

SEQ ID NO: 908890 - protein, 41 aa, Mycobacterium
LQAGASDTEQLTAAPSIPLPNSTATLENYGGQSCGNEPTVS

SEQ ID NO: 908891 - protein, 14 aa, Mycobacterium
LQAGATDAEQLTAA

SEQ ID NO: 908892 - protein, 12 aa, Mycobacterium
LQAGATDTEQLT

SEQ ID NO: 908893 - protein, 8 aa, Mycobacterium
LQAGDSEA

SEQ ID NO: 908894 - protein, 11 aa, Mycobacterium
LQAGESAPTIL

SEQ ID NO: 908895 - protein, 10 aa, Mycobacterium
LQAGETAPTI

SEQ ID NO: 908896 - protein, 6 aa, Mycobacterium
LQAGSP

SEQ ID NO: 908897 - protein, 10 aa, Mycobacterium
LQAGSPGQIS

SEQ ID NO: 908898 - protein, 10 aa, Mycobacterium
LQAGSPSQIA

SEQ ID NO: 908899 - protein, 7 aa, Mycobacterium
LQAPRSS

SEQ ID NO: 908900 - protein, 6 aa, Mycobacterium
LQAPTG

SEQ ID NO: 908901 - protein, 12 aa, Mycobacterium
LQATAQATQTTL

SEQ ID NO: 908902 - protein, 4 aa, Mycobacterium
LQDG

SEQ ID NO: 908903 - protein, 7 aa, Mycobacterium
LQDGRRK

SEQ ID NO: 908904 - protein, 30 aa, Mycobacterium
LQDTNGQPVDYSGTPFAEAAANGGKSKRYD

SEQ ID NO: 908905 - protein, 8 aa, Mycobacterium
LQEPEPEA

SEQ ID NO: 908906 - protein, 5 aa, Mycobacterium
LQEPI

SEQ ID NO: 908907 - protein, 19 aa, Mycobacterium
LQESNDATGGTTESGISGS

SEQ ID NO: 908908 - protein, 6 aa, Mycobacterium
LQGDNA

SEQ ID NO: 908909 - protein, 8 aa, Mycobacterium
LQGDQASI

SEQ ID NO: 908910 - protein, 21 aa, Mycobacterium
LQGDSESAAQAAESTHPRRGG

SEQ ID NO: 908911 - protein, 8 aa, Mycobacterium
LQGKRRKN

SEQ ID NO: 908912 - protein, 5 aa, Mycobacterium
LQGPQ

SEQ ID NO: 908913 - protein, 8 aa, Mycobacterium
LQGSQTAV

SEQ ID NO: 908914 - protein, 5 aa, Mycobacterium
LQGTM

SEQ ID NO: 908915 - protein, 10 aa, Mycobacterium
LQKSSGNSVQ

SEQ ID NO: 908916 - protein, 12 aa, Mycobacterium
LQLSGGDGAKDA

SEQ ID NO: 908917 - protein, 8 aa, Mycobacterium
LQNFSGRA

SEQ ID NO: 908918 - protein, 11 aa, Mycobacterium
LQPAPEDVSTE

SEQ ID NO: 908919 - protein, 4 aa, Mycobacterium
LQPG

SEQ ID NO: 908920 - protein, 13 aa, Mycobacterium
LQPGASARSDKSV

SEQ ID NO: 908921 - protein, 16 aa, Mycobacterium
LQPGTAVTTARWSDSR

SEQ ID NO: 908922 - protein, 7 aa, Mycobacterium
LQPLPTG

SEQ ID NO: 908923 - protein, 6 aa, Mycobacterium
LQPPAV

SEQ ID NO: 908924 - protein, 19 aa, Mycobacterium
LQPQYSSAEPGGTATITSY

SEQ ID NO: 908925 - protein, 8 aa, Mycobacterium
LQPSGHND

SEQ ID NO: 908926 - protein, 15 aa, Mycobacterium
LQPSNDVTPGYTPTG

SEQ ID NO: 908927 - protein, 6 aa, Mycobacterium
LQPSNV

SEQ ID NO: 908928 - protein, 6 aa, Mycobacterium
LQQDPS

SEQ ID NO: 908929 - protein, 12 aa, Mycobacterium
LQRERDLATARG

SEQ ID NO: 908930 - protein, 9 aa, Mycobacterium
LQRGDDAPK

SEQ ID NO: 908931 - protein, 6 aa, Mycobacterium
LQRGRG

SEQ ID NO: 908932 - protein, 4 aa, Mycobacterium
LQRR

SEQ ID NO: 908933 - protein, 5 aa, Mycobacterium
LQSAA

SEQ ID NO: 908934 - protein, 7 aa, Mycobacterium
LQSAGAR

SEQ ID NO: 908935 - protein, 9 aa, Mycobacterium
LQSAGEVGA

SEQ ID NO: 908936 - protein, 8 aa, Mycobacterium
LQSASGAV

SEQ ID NO: 908937 - protein, 8 aa, Mycobacterium
LQSQGSEV

SEQ ID NO: 908938 - protein, 15 aa, Mycobacterium
LQTGEDANGEEADGE

SEQ ID NO: 908939 - protein, 17 aa, Mycobacterium
LQTGPATSHAQCPPGQT

SEQ ID NO: 908940 - protein, 14 aa, Mycobacterium
LQTGRDVNGAKTDG

SEQ ID NO: 908941 - protein, 10 aa, Mycobacterium
LQTGRPSEIS

SEQ ID NO: 908942 - protein, 12 aa, Mycobacterium
LRAAPASAGSLG

SEQ ID NO: 908943 - protein, 4 aa, Mycobacterium
LRAD

SEQ ID NO: 908944 - protein, 8 aa, Mycobacterium
LRADEPSL

SEQ ID NO: 908945 - protein, 8 aa, Mycobacterium
LRADEPTL

SEQ ID NO: 908946 - protein, 9 aa, Mycobacterium
LRADSPDAP

SEQ ID NO: 908947 - protein, 7 aa, Mycobacterium
LRAEGAT

SEQ ID NO: 908948 - protein, 9 aa, Mycobacterium
LRAEYDKGP

SEQ ID NO: 908949 - protein, 5 aa, Mycobacterium
LRAGE

SEQ ID NO: 908950 - protein, 92 aa, Mycobacterium
LRAGSGRSVPGYGTVPEYGPGYGPGYGSGNGQGYGPLYGPATPGYDPESPTHGPPPGYVPAPPGYVPETPGYELPGPSAAEPSAEVGLVSAV

SEQ ID NO: 908951 - protein, 5 aa, Mycobacterium
LRAHP

SEQ ID NO: 908952 - protein, 10 aa, Mycobacterium
LRAPDGTEVA

SEQ ID NO: 908953 - protein, 9 aa, Mycobacterium
LRASPGART

SEQ ID NO: 908954 - protein, 6 aa, Mycobacterium
LRDDES

SEQ ID NO: 908955 - protein, 10 aa, Mycobacterium
LRDDKRDLQN

SEQ ID NO: 908956 - protein, 9 aa, Mycobacterium
LRDDPQSPL

SEQ ID NO: 908957 - protein, 11 aa, Mycobacterium
LRDDSNYVGPT

SEQ ID NO: 908958 - protein, 10 aa, Mycobacterium
LRDNQPQHRV

SEQ ID NO: 908959 - protein, 48 aa, Mycobacterium
LRDPRDDERPDVRTQASTPESAAHAGAKSDPPGDSPSDNSGADAERGD

SEQ ID NO: 908960 - protein, 7 aa, Mycobacterium
LRDRTAT

SEQ ID NO: 908961 - protein, 10 aa, Mycobacterium
LRDSRIGPTE

SEQ ID NO: 908962 - protein, 9 aa, Mycobacterium
LREESPSAP

SEQ ID NO: 908963 - protein, 14 aa, Mycobacterium
LREGSGPAGHTGAP

SEQ ID NO: 908964 - protein, 4 aa, Mycobacterium
LREH

SEQ ID NO: 908965 - protein, 4 aa, Mycobacterium
LRET

SEQ ID NO: 908966 - protein, 11 aa, Mycobacterium
LRGDGEGGGPV

SEQ ID NO: 908967 - protein, 12 aa, Mycobacterium
LRGECGPRQVPD

SEQ ID NO: 908968 - protein, 17 aa, Mycobacterium
LRGESERAERDGDLAKA

SEQ ID NO: 908969 - protein, 14 aa, Mycobacterium
LRGKGSGSSSIPER

SEQ ID NO: 908970 - protein, 11 aa, Mycobacterium
LRGKTRAQPDC

SEQ ID NO: 908971 - protein, 8 aa, Mycobacterium
LRGPEAAA

SEQ ID NO: 908972 - protein, 10 aa, Mycobacterium
LRGPNGIEGF

SEQ ID NO: 908973 - protein, 17 aa, Mycobacterium
LRGSGWGGAATGSGASR

SEQ ID NO: 908974 - protein, 14 aa, Mycobacterium
LRGSPGQPVYAPGD

SEQ ID NO: 908975 - protein, 8 aa, Mycobacterium
LRGSSDRP

SEQ ID NO: 908976 - protein, 4 aa, Mycobacterium
LRGT

SEQ ID NO: 908977 - protein, 15 aa, Mycobacterium
LRGTRKAEEAAESAR

SEQ ID NO: 908978 - protein, 12 aa, Mycobacterium
LRHSGGKSTPDL

SEQ ID NO: 908979 - protein, 8 aa, Mycobacterium
LRNKTGRD

SEQ ID NO: 908980 - protein, 49 aa, Mycobacterium
LRNPATGTHPTATTAQSAHRRRTAAERRRRRRPRRRSHPRLSDRTRRRE

SEQ ID NO: 908981 - protein, 4 aa, Mycobacterium
LRPD

SEQ ID NO: 908982 - protein, 10 aa, Mycobacterium
LRPDDGPQFA

SEQ ID NO: 908983 - protein, 9 aa, Mycobacterium
LRPDRPSVR

SEQ ID NO: 908984 - protein, 6 aa, Mycobacterium
LRPEAG

SEQ ID NO: 908985 - protein, 11 aa, Mycobacterium
LRPGAALTPAD

SEQ ID NO: 908986 - protein, 9 aa, Mycobacterium
LRPGEAGEV

SEQ ID NO: 908987 - protein, 11 aa, Mycobacterium
LRPGEPPWTDG

SEQ ID NO: 908988 - protein, 7 aa, Mycobacterium
LRPGNAL

SEQ ID NO: 908989 - protein, 6 aa, Mycobacterium
LRPGNP

SEQ ID NO: 908990 - protein, 6 aa, Mycobacterium
LRPGQS

SEQ ID NO: 908991 - protein, 7 aa, Mycobacterium
LRPMTPD

SEQ ID NO: 908992 - protein, 5 aa, Mycobacterium
LRPNN

SEQ ID NO: 908993 - protein, 4 aa, Mycobacterium
LRPQ

SEQ ID NO: 908994 - protein, 15 aa, Mycobacterium
LRPRGANERAPLPKL

SEQ ID NO: 908995 - protein, 5 aa, Mycobacterium
LRPTE

SEQ ID NO: 908996 - protein, 8 aa, Mycobacterium
LRPTPQAR

SEQ ID NO: 908997 - protein, 5 aa, Mycobacterium
LRQGG

SEQ ID NO: 908998 - protein, 26 aa, Mycobacterium
LRQNPRIDQATKDNFARSLSDEDSVT

SEQ ID NO: 908999 - protein, 4 aa, Mycobacterium
LRRP

SEQ ID NO: 909000 - protein, 7 aa, Mycobacterium
LRRPDGQ

SEQ ID NO: 909001 - protein, 4 aa, Mycobacterium
LRRQ

SEQ ID NO: 909002 - protein, 10 aa, Mycobacterium
LRRRESQARC

SEQ ID NO: 909003 - protein, 10 aa, Mycobacterium
LRRSTDTDRT

SEQ ID NO: 909004 - protein, 8 aa, Mycobacterium
LRSAEPRW

SEQ ID NO: 909005 - protein, 5 aa, Mycobacterium
LRSAG

SEQ ID NO: 909006 - protein, 9 aa, Mycobacterium
LRSARTPQE

SEQ ID NO: 909007 - protein, 11 aa, Mycobacterium
LRSGASKDDAI

SEQ ID NO: 909008 - protein, 10 aa, Mycobacterium
LRSGDRVDRN

SEQ ID NO: 909009 - protein, 16 aa, Mycobacterium
LRSNPRVDQASKDNFA

SEQ ID NO: 909010 - protein, 6 aa, Mycobacterium
LRSRDT

SEQ ID NO: 909011 - protein, 6 aa, Mycobacterium
LRSSDA

SEQ ID NO: 909012 - protein, 7 aa, Mycobacterium
LRSSSGS

SEQ ID NO: 909013 - protein, 11 aa, Mycobacterium
LRTAKADAAVE

SEQ ID NO: 909014 - protein, 7 aa, Mycobacterium
LRTDEPT

SEQ ID NO: 909015 - protein, 10 aa, Mycobacterium
LRTDGYDPAS

SEQ ID NO: 909016 - protein, 6 aa, Mycobacterium
LRTERT

SEQ ID NO: 909017 - protein, 7 aa, Mycobacterium
LRTGNTV

SEQ ID NO: 909018 - protein, 9 aa, Mycobacterium
LRTPAQRNH

SEQ ID NO: 909019 - protein, 11 aa, Mycobacterium
LRTPDGVTGFP

SEQ ID NO: 909020 - protein, 11 aa, Mycobacterium
LRTPEGPTGFP

SEQ ID NO: 909021 - protein, 22 aa, Mycobacterium
LRTSETPSIPPEVQVDKVEEVA

SEQ ID NO: 909022 - protein, 22 aa, Mycobacterium
LRTTTPRRERAASGTDDPLAAA

SEQ ID NO: 909023 - protein, 4 aa, Mycobacterium
LRVR

SEQ ID NO: 909024 - protein, 4 aa, Mycobacterium
LSAA

SEQ ID NO: 909025 - protein, 11 aa, Mycobacterium
LSAAASSFGSV

SEQ ID NO: 909026 - protein, 9 aa, Mycobacterium
LSAAGPRKL

SEQ ID NO: 909027 - protein, 13 aa, Mycobacterium
LSAANAAVAGPTT

SEQ ID NO: 909028 - protein, 10 aa, Mycobacterium
LSAATRESME

SEQ ID NO: 909029 - protein, 11 aa, Mycobacterium
LSADPADENRL

SEQ ID NO: 909030 - protein, 12 aa, Mycobacterium
LSADPKNPDRLY

SEQ ID NO: 909031 - protein, 9 aa, Mycobacterium
LSAESPQTT

SEQ ID NO: 909032 - protein, 8 aa, Mycobacterium
LSAGSQAA

SEQ ID NO: 909033 - protein, 8 aa, Mycobacterium
LSAGTASL

SEQ ID NO: 909034 - protein, 7 aa, Mycobacterium
LSANRDN

SEQ ID NO: 909035 - protein, 12 aa, Mycobacterium
LSAPGPAPDDSV

SEQ ID NO: 909036 - protein, 10 aa, Mycobacterium
LSAPGTEADS

SEQ ID NO: 909037 - protein, 13 aa, Mycobacterium
LSAPPAHADPATD

SEQ ID NO: 909038 - protein, 20 aa, Mycobacterium
LSAPSGPVVSPKGAPKLPSF

SEQ ID NO: 909039 - protein, 17 aa, Mycobacterium
LSDADATGASSEDTAAH

SEQ ID NO: 909040 - protein, 5 aa, Mycobacterium
LSDAG

SEQ ID NO: 909041 - protein, 5 aa, Mycobacterium
LSDAT

SEQ ID NO: 909042 - protein, 7 aa, Mycobacterium
LSDATGD

SEQ ID NO: 909043 - protein, 5 aa, Mycobacterium
LSDCD

SEQ ID NO: 909044 - protein, 9 aa, Mycobacterium
LSDDGTRVT

SEQ ID NO: 909045 - protein, 8 aa, Mycobacterium
LSDEEVGR

SEQ ID NO: 909046 - protein, 5 aa, Mycobacterium
LSDGQ

SEQ ID NO: 909047 - protein, 6 aa, Mycobacterium
LSDGVR

SEQ ID NO: 909048 - protein, 21 aa, Mycobacterium
LSDHSVAGRGRHPLPSGTDLR

SEQ ID NO: 909049 - protein, 4 aa, Mycobacterium
LSDP

SEQ ID NO: 909050 - protein, 8 aa, Mycobacterium
LSDPLTSE

SEQ ID NO: 909051 - protein, 7 aa, Mycobacterium
LSDSSTL

SEQ ID NO: 909052 - protein, 5 aa, Mycobacterium
LSDST

SEQ ID NO: 909053 - protein, 6 aa, Mycobacterium
LSDSTL

SEQ ID NO: 909054 - protein, 23 aa, Mycobacterium
LSDTESKLRQRTQGRLDRSRDPA

SEQ ID NO: 909055 - protein, 12 aa, Mycobacterium
LSDWGEDTANLT

SEQ ID NO: 909056 - protein, 4 aa, Mycobacterium
LSEA

SEQ ID NO: 909057 - protein, 9 aa, Mycobacterium
LSEARGPLH

SEQ ID NO: 909058 - protein, 9 aa, Mycobacterium
LSENGATVS

SEQ ID NO: 909059 - protein, 8 aa, Mycobacterium
LSESDVEP

SEQ ID NO: 909060 - protein, 6 aa, Mycobacterium
LSESGA

SEQ ID NO: 909061 - protein, 11 aa, Mycobacterium
LSETGLPPGPI

SEQ ID NO: 909062 - protein, 6 aa, Mycobacterium
LSETGS

SEQ ID NO: 909063 - protein, 18 aa, Mycobacterium
LSGADRRVTPQSARSGAR

SEQ ID NO: 909064 - protein, 9 aa, Mycobacterium
LSGAPRTFA

SEQ ID NO: 909065 - protein, 5 aa, Mycobacterium
LSGAT

SEQ ID NO: 909066 - protein, 10 aa, Mycobacterium
LSGDDGAGPF

SEQ ID NO: 909067 - protein, 6 aa, Mycobacterium
LSGDGL

SEQ ID NO: 909068 - protein, 14 aa, Mycobacterium
LSGDGSTVLSQGET

SEQ ID NO: 909069 - protein, 7 aa, Mycobacterium
LSGDKDR

SEQ ID NO: 909070 - protein, 7 aa, Mycobacterium
LSGDPIP

SEQ ID NO: 909071 - protein, 10 aa, Mycobacterium
LSGDRGREAL

SEQ ID NO: 909072 - protein, 10 aa, Mycobacterium
LSGDSDIPAT

SEQ ID NO: 909073 - protein, 13 aa, Mycobacterium
LSGEPPGVIVLVA

SEQ ID NO: 909074 - protein, 14 aa, Mycobacterium
LSGEPSLASASREE

SEQ ID NO: 909075 - protein, 8 aa, Mycobacterium
LSGGGSQV

SEQ ID NO: 909076 - protein, 4 aa, Mycobacterium
LSGK

SEQ ID NO: 909077 - protein, 7 aa, Mycobacterium
LSGKLNP

SEQ ID NO: 909078 - protein, 8 aa, Mycobacterium
LSGKLNPN

SEQ ID NO: 909079 - protein, 6 aa, Mycobacterium
LSGKVT

SEQ ID NO: 909080 - protein, 12 aa, Mycobacterium
LSGLADGSGPDD

SEQ ID NO: 909081 - protein, 5 aa, Mycobacterium
LSGMG

SEQ ID NO: 909082 - protein, 17 aa, Mycobacterium
LSGPAALAAAAPADEQQ

SEQ ID NO: 909083 - protein, 9 aa, Mycobacterium
LSGPASVAE

SEQ ID NO: 909084 - protein, 6 aa, Mycobacterium
LSGPGY

SEQ ID NO: 909085 - protein, 17 aa, Mycobacterium
LSGQAADPFKIPAGTAS

SEQ ID NO: 909086 - protein, 22 aa, Mycobacterium
LSGQAADPFKIPPGTATQHEGA

SEQ ID NO: 909087 - protein, 13 aa, Mycobacterium
LSGQEQNPDLTGR

SEQ ID NO: 909088 - protein, 7 aa, Mycobacterium
LSGRAAD

SEQ ID NO: 909089 - protein, 8 aa, Mycobacterium
LSGRGGAV

SEQ ID NO: 909090 - protein, 9 aa, Mycobacterium
LSGRGGKAH

SEQ ID NO: 909091 - protein, 6 aa, Mycobacterium
LSGRGY

SEQ ID NO: 909092 - protein, 16 aa, Mycobacterium
LSGSDDDQSSTASTTV

SEQ ID NO: 909093 - protein, 9 aa, Mycobacterium
LSGSDQRAK

SEQ ID NO: 909094 - protein, 6 aa, Mycobacterium
LSGSTL

SEQ ID NO: 909095 - protein, 10 aa, Mycobacterium
LSGTSGRAIG

SEQ ID NO: 909096 - protein, 8 aa, Mycobacterium
LSISPSTL

SEQ ID NO: 909097 - protein, 18 aa, Mycobacterium
LSKDDQPGGTAAGSAGSV

SEQ ID NO: 909098 - protein, 4 aa, Mycobacterium
LSKG

SEQ ID NO: 909099 - protein, 6 aa, Mycobacterium
LSKKPQ

SEQ ID NO: 909100 - protein, 6 aa, Mycobacterium
LSKPRG

SEQ ID NO: 909101 - protein, 8 aa, Mycobacterium
LSKQSEEQ

SEQ ID NO: 909102 - protein, 10 aa, Mycobacterium
LSKSEIAQQL

SEQ ID NO: 909103 - protein, 6 aa, Mycobacterium
LSLAPG

SEQ ID NO: 909104 - protein, 16 aa, Mycobacterium
LSMPSSEATVPPLRPG

SEQ ID NO: 909105 - protein, 4 aa, Mycobacterium
LSNP

SEQ ID NO: 909106 - protein, 9 aa, Mycobacterium
LSNTTAGAG

SEQ ID NO: 909107 - protein, 14 aa, Mycobacterium
LSPAEQAAQLETTR

SEQ ID NO: 909108 - protein, 7 aa, Mycobacterium
LSPAGEQ

SEQ ID NO: 909109 - protein, 6 aa, Mycobacterium
LSPDAL

SEQ ID NO: 909110 - protein, 7 aa, Mycobacterium
LSPDGAQ

SEQ ID NO: 909111 - protein, 10 aa, Mycobacterium
LSPDNKTTAN

SEQ ID NO: 909112 - protein, 10 aa, Mycobacterium
LSPEDVAGQL

SEQ ID NO: 909113 - protein, 12 aa, Mycobacterium
LSPEELASDEDY

SEQ ID NO: 909114 - protein, 5 aa, Mycobacterium
LSPEP

SEQ ID NO: 909115 - protein, 9 aa, Mycobacterium
LSPEPAAQY

SEQ ID NO: 909116 - protein, 5 aa, Mycobacterium
LSPGE

SEQ ID NO: 909117 - protein, 14 aa, Mycobacterium
LSPGKSGGPAGDTV

SEQ ID NO: 909118 - protein, 7 aa, Mycobacterium
LSPGQQS

SEQ ID NO: 909119 - protein, 5 aa, Mycobacterium
LSPGR

SEQ ID NO: 909120 - protein, 8 aa, Mycobacterium
LSPGTDGG

SEQ ID NO: 909121 - protein, 9 aa, Mycobacterium
LSPPFDPDG

SEQ ID NO: 909122 - protein, 17 aa, Mycobacterium
LSPPYRGGPELRDGDTI

SEQ ID NO: 909123 - protein, 6 aa, Mycobacterium
LSPQAI

SEQ ID NO: 909124 - protein, 7 aa, Mycobacterium
LSPQPGR

SEQ ID NO: 909125 - protein, 29 aa, Mycobacterium
LSPQQRTALAEPGPVPAGLPVPGAPAPEA

SEQ ID NO: 909126 - protein, 5 aa, Mycobacterium
LSPSD

SEQ ID NO: 909127 - protein, 5 aa, Mycobacterium
LSPSG

SEQ ID NO: 909128 - protein, 9 aa, Mycobacterium
LSPSSPAAA

SEQ ID NO: 909129 - protein, 18 aa, Mycobacterium
LSPTASAAPGTSAEPYTA

SEQ ID NO: 909130 - protein, 6 aa, Mycobacterium
LSPTGP

SEQ ID NO: 909131 - protein, 17 aa, Mycobacterium
LSPTTVTVRSSDGFTQS

SEQ ID NO: 909132 - protein, 4 aa, Mycobacterium
LSPV

SEQ ID NO: 909133 - protein, 12 aa, Mycobacterium
LSQAAADNDATL

SEQ ID NO: 909134 - protein, 10 aa, Mycobacterium
LSQADATSTM

SEQ ID NO: 909135 - protein, 20 aa, Mycobacterium
LSQEQSDKCTAAGKPPVDIN

SEQ ID NO: 909136 - protein, 7 aa, Mycobacterium
LSQGQAD

SEQ ID NO: 909137 - protein, 5 aa, Mycobacterium
LSQGS

SEQ ID NO: 909138 - protein, 4 aa, Mycobacterium
LSQP

SEQ ID NO: 909139 - protein, 6 aa, Mycobacterium
LSQPAM

SEQ ID NO: 909140 - protein, 4 aa, Mycobacterium
LSQQ

SEQ ID NO: 909141 - protein, 5 aa, Mycobacterium
LSQRG

SEQ ID NO: 909142 - protein, 8 aa, Mycobacterium
LSQSQGRT

SEQ ID NO: 909143 - protein, 16 aa, Mycobacterium
LSQSTGKPAHVDVCQP

SEQ ID NO: 909144 - protein, 12 aa, Mycobacterium
LSRADSSQPIGS

SEQ ID NO: 909145 - protein, 8 aa, Mycobacterium
LSRASASG

SEQ ID NO: 909146 - protein, 11 aa, Mycobacterium
LSRDGDGGVGP

SEQ ID NO: 909147 - protein, 7 aa, Mycobacterium
LSRDQTR

SEQ ID NO: 909148 - protein, 5 aa, Mycobacterium
LSRGD

SEQ ID NO: 909149 - protein, 23 aa, Mycobacterium
LSRGDAAAAAALTTDPAAATDTL

SEQ ID NO: 909150 - protein, 7 aa, Mycobacterium
LSRGGPT

SEQ ID NO: 909151 - protein, 9 aa, Mycobacterium
LSRGNDNAL

SEQ ID NO: 909152 - protein, 7 aa, Mycobacterium
LSRPALP

SEQ ID NO: 909153 - protein, 12 aa, Mycobacterium
LSRQAEQTTEAM

SEQ ID NO: 909154 - protein, 24 aa, Mycobacterium
LSRQRESSSDPAEFAADDSREIGN

SEQ ID NO: 909155 - protein, 4 aa, Mycobacterium
LSRR

SEQ ID NO: 909156 - protein, 14 aa, Mycobacterium
LSRTGAIDANGDEH

SEQ ID NO: 909157 - protein, 6 aa, Mycobacterium
LSRTRG

SEQ ID NO: 909158 - protein, 8 aa, Mycobacterium
LSRTRTPV

SEQ ID NO: 909159 - protein, 12 aa, Mycobacterium
LSSAAPAGPIGL

SEQ ID NO: 909160 - protein, 9 aa, Mycobacterium
LSSAASGYS

SEQ ID NO: 909161 - protein, 30 aa, Mycobacterium
LSSADRTDDIPSSAPVTPSGAPQPAGARPG

SEQ ID NO: 909162 - protein, 5 aa, Mycobacterium
LSSDA

SEQ ID NO: 909163 - protein, 6 aa, Mycobacterium
LSSDAF

SEQ ID NO: 909164 - protein, 12 aa, Mycobacterium
LSSDGGATTREQ

SEQ ID NO: 909165 - protein, 8 aa, Mycobacterium
LSSDGIGP

SEQ ID NO: 909166 - protein, 6 aa, Mycobacterium
LSSDPR

SEQ ID NO: 909167 - protein, 12 aa, Mycobacterium
LSSERGVTTREQ

SEQ ID NO: 909168 - protein, 4 aa, Mycobacterium
LSSG

SEQ ID NO: 909169 - protein, 11 aa, Mycobacterium
LSSNANITKQQ

SEQ ID NO: 909170 - protein, 5 aa, Mycobacterium
LSSNR

SEQ ID NO: 909171 - protein, 15 aa, Mycobacterium
LSSPLSQGLGGSGLG

SEQ ID NO: 909172 - protein, 83 aa, Mycobacterium
LSSPNKPAPPSAPVSTTTPPTTSTTTTTTTTSETSTTSETSTTSSTETSTTPTSQTSSSSPTAAASGLATGRSDLLGGDAGEI

SEQ ID NO: 909173 - protein, 7 aa, Mycobacterium
LSSPQQF

SEQ ID NO: 909174 - protein, 8 aa, Mycobacterium
LSSSEGFR

SEQ ID NO: 909175 - protein, 8 aa, Mycobacterium
LSSSSLDS

SEQ ID NO: 909176 - protein, 11 aa, Mycobacterium
LSSSSLGQAAN

SEQ ID NO: 909177 - protein, 10 aa, Mycobacterium
LSTGEGADDL

SEQ ID NO: 909178 - protein, 12 aa, Mycobacterium
LSTGNHNGTGGC

SEQ ID NO: 909179 - protein, 6 aa, Mycobacterium
LSTGQL

SEQ ID NO: 909180 - protein, 11 aa, Mycobacterium
LSTGTAAAAEE

SEQ ID NO: 909181 - protein, 7 aa, Mycobacterium
LSTNGQL

SEQ ID NO: 909182 - protein, 11 aa, Mycobacterium
LSTSSQAAGNV

SEQ ID NO: 909183 - protein, 9 aa, Mycobacterium
LSTTKRPAD

SEQ ID NO: 909184 - protein, 9 aa, Mycobacterium
LSTTKRPAE

SEQ ID NO: 909185 - protein, 5 aa, Mycobacterium
LSVET

SEQ ID NO: 909186 - protein, 9 aa, Mycobacterium
LSVSEDKEF

SEQ ID NO: 909187 - protein, 14 aa, Mycobacterium
LSYNPTGSGAGREQ

SEQ ID NO: 909188 - protein, 6 aa, Mycobacterium
LTAAES

SEQ ID NO: 909189 - protein, 11 aa, Mycobacterium
LTADATGKPLA

SEQ ID NO: 909190 - protein, 29 aa, Mycobacterium
LTADPATGKAPAASSSAATSSPQAKASDY

SEQ ID NO: 909191 - protein, 21 aa, Mycobacterium
LTAGRPAVADTEPELATRPAR

SEQ ID NO: 909192 - protein, 13 aa, Mycobacterium
LTAKSSSDAFTEA

SEQ ID NO: 909193 - protein, 23 aa, Mycobacterium
LTAPATAHAEVKTADVSTPVDDA

SEQ ID NO: 909194 - protein, 36 aa, Mycobacterium
LTAPQTGPAQGAAEQPGGGAAEQPGGGPALARRRAR

SEQ ID NO: 909195 - protein, 27 aa, Mycobacterium
LTASTTTHKSGQYEEGHPRERSHLVRP

SEQ ID NO: 909196 - protein, 15 aa, Mycobacterium
LTATPEHIPAAGAGL

SEQ ID NO: 909197 - protein, 9 aa, Mycobacterium
LTATTRTGV

SEQ ID NO: 909198 - protein, 5 aa, Mycobacterium
LTCSD

SEQ ID NO: 909199 - protein, 7 aa, Mycobacterium
LTDDDGV

SEQ ID NO: 909200 - protein, 4 aa, Mycobacterium
LTDE

SEQ ID NO: 909201 - protein, 12 aa, Mycobacterium
LTDIDTQAAGEP

SEQ ID NO: 909202 - protein, 18 aa, Mycobacterium
LTDNRNALNEKLSAADDF

SEQ ID NO: 909203 - protein, 11 aa, Mycobacterium
LTDPESSAQID

SEQ ID NO: 909204 - protein, 11 aa, Mycobacterium
LTDPGDGRDQF

SEQ ID NO: 909205 - protein, 14 aa, Mycobacterium
LTDPGSAATSPASL

SEQ ID NO: 909206 - protein, 15 aa, Mycobacterium
LTDPPTGQPGTPPLP

SEQ ID NO: 909207 - protein, 9 aa, Mycobacterium
LTDPSKTIS

SEQ ID NO: 909208 - protein, 4 aa, Mycobacterium
LTDS

SEQ ID NO: 909209 - protein, 9 aa, Mycobacterium
LTDSQSAKE

SEQ ID NO: 909210 - protein, 10 aa, Mycobacterium
LTDTDGASID

SEQ ID NO: 909211 - protein, 15 aa, Mycobacterium
LTDTQRKFDEQREEV

SEQ ID NO: 909212 - protein, 15 aa, Mycobacterium
LTDTQRKFDQQREEV

SEQ ID NO: 909213 - protein, 9 aa, Mycobacterium
LTDTTPETL

SEQ ID NO: 909214 - protein, 9 aa, Mycobacterium
LTEDATADR

SEQ ID NO: 909215 - protein, 14 aa, Mycobacterium
LTEDVRGDYGSSLG

SEQ ID NO: 909216 - protein, 7 aa, Mycobacterium
LTEEPRR

SEQ ID NO: 909217 - protein, 10 aa, Mycobacterium
LTEETAEGFE

SEQ ID NO: 909218 - protein, 15 aa, Mycobacterium
LTEPGTADQAVPDDQ

SEQ ID NO: 909219 - protein, 6 aa, Mycobacterium
LTERTP

SEQ ID NO: 909220 - protein, 8 aa, Mycobacterium
LTESVSEQ

SEQ ID NO: 909221 - protein, 13 aa, Mycobacterium
LTGADGYGLVLRA

SEQ ID NO: 909222 - protein, 7 aa, Mycobacterium
LTGADQA

SEQ ID NO: 909223 - protein, 19 aa, Mycobacterium
LTGCGSSSGSQLASTASMT

SEQ ID NO: 909224 - protein, 12 aa, Mycobacterium
LTGDGTPTATTM

SEQ ID NO: 909225 - protein, 5 aa, Mycobacterium
LTGEG

SEQ ID NO: 909226 - protein, 4 aa, Mycobacterium
LTGG

SEQ ID NO: 909227 - protein, 17 aa, Mycobacterium
LTGGTPQVNDTETYDNG

SEQ ID NO: 909228 - protein, 7 aa, Mycobacterium
LTGNDKS

SEQ ID NO: 909229 - protein, 6 aa, Mycobacterium
LTGNDR

SEQ ID NO: 909230 - protein, 21 aa, Mycobacterium
LTGNGKIAKDRVRDIARTALT

SEQ ID NO: 909231 - protein, 9 aa, Mycobacterium
LTGNPGEET

SEQ ID NO: 909232 - protein, 10 aa, Mycobacterium
LTGNPNPVPA

SEQ ID NO: 909233 - protein, 14 aa, Mycobacterium
LTGPDTADQTVPAD

SEQ ID NO: 909234 - protein, 15 aa, Mycobacterium
LTGPNTADEQVPDDK

SEQ ID NO: 909235 - protein, 10 aa, Mycobacterium
LTGPPTAGMG

SEQ ID NO: 909236 - protein, 6 aa, Mycobacterium
LTGPRN

SEQ ID NO: 909237 - protein, 14 aa, Mycobacterium
LTGQPPVERYGSTE

SEQ ID NO: 909238 - protein, 6 aa, Mycobacterium
LTGRNG

SEQ ID NO: 909239 - protein, 20 aa, Mycobacterium
LTGRNGVPPIEDRTRHVLVK

SEQ ID NO: 909240 - protein, 11 aa, Mycobacterium
LTGRSPGNIDD

SEQ ID NO: 909241 - protein, 9 aa, Mycobacterium
LTGSPAAKT

SEQ ID NO: 909242 - protein, 16 aa, Mycobacterium
LTGTDPGLGADPAVDG

SEQ ID NO: 909243 - protein, 12 aa, Mycobacterium
LTHQGASESEIA

SEQ ID NO: 909244 - protein, 9 aa, Mycobacterium
LTKEGPRKL

SEQ ID NO: 909245 - protein, 7 aa, Mycobacterium
LTKPGDE

SEQ ID NO: 909246 - protein, 10 aa, Mycobacterium
LTKRDGAGRV

SEQ ID NO: 909247 - protein, 12 aa, Mycobacterium
LTKRDTSGRAAQ

SEQ ID NO: 909248 - protein, 32 aa, Mycobacterium; identical to SEQ ID NO: 526082

SEQ ID NO: 909249 - protein, 6 aa, Mycobacterium
LTNGHA

SEQ ID NO: 909250 - protein, 16 aa, Mycobacterium
LTNNDKYAQPMNEYWT

SEQ ID NO: 909251 - protein, 12 aa, Mycobacterium
LTNPPRLVVDLP

SEQ ID NO: 909252 - protein, 6 aa, Mycobacterium
LTPAER

SEQ ID NO: 909253 - protein, 5 aa, Mycobacterium
LTPAR

SEQ ID NO: 909254 - protein, 7 aa, Mycobacterium
LTPDETA

SEQ ID NO: 909255 - protein, 5 aa, Mycobacterium
LTPDG

SEQ ID NO: 909256 - protein, 10 aa, Mycobacterium
LTPDQQRTSP

SEQ ID NO: 909257 - protein, 6 aa, Mycobacterium
LTPDSV

SEQ ID NO: 909258 - protein, 5 aa, Mycobacterium
LTPDT

SEQ ID NO: 909259 - protein, 8 aa, Mycobacterium
LTPDYPAG

SEQ ID NO: 909260 - protein, 9 aa, Mycobacterium
LTPEDIEGQ

SEQ ID NO: 909261 - protein, 6 aa, Mycobacterium
LTPEPI

SEQ ID NO: 909262 - protein, 5 aa, Mycobacterium
LTPEQ

SEQ ID NO: 909263 - protein, 12 aa, Mycobacterium
LTPETAAASVET

SEQ ID NO: 909264 - protein, 7 aa, Mycobacterium
LTPEYKE

SEQ ID NO: 909265 - protein, 6 aa, Mycobacterium
LTPGDI

SEQ ID NO: 909266 - protein, 8 aa, Mycobacterium
LTPGPAAE

SEQ ID NO: 909267 - protein, 12 aa, Mycobacterium
LTPGSLYGSRER

SEQ ID NO: 909268 - protein, 19 aa, Mycobacterium
LTPGTSGLRRRDRASTNEV

SEQ ID NO: 909269 - protein, 6 aa, Mycobacterium
LTPGTV

SEQ ID NO: 909270 - protein, 12 aa, Mycobacterium
LTPITAQRTEDQ

SEQ ID NO: 909271 - protein, 10 aa, Mycobacterium
LTPKGRARYD

SEQ ID NO: 909272 - protein, 13 aa, Mycobacterium
LTPPDDDTAAPEV

SEQ ID NO: 909273 - protein, 18 aa, Mycobacterium
LTPPPPRGQAPADKPKVL

SEQ ID NO: 909274 - protein, 28 aa, Mycobacterium
LTPPSLPSKVPTAPSAPPAPPSTSVVQT

SEQ ID NO: 909275 - protein, 8 aa, Mycobacterium
LTPPSNFT

SEQ ID NO: 909276 - protein, 9 aa, Mycobacterium
LTPPYRSGP

SEQ ID NO: 909277 - protein, 5 aa, Mycobacterium
LTPQS

SEQ ID NO: 909278 - protein, 4 aa, Mycobacterium
LTPR

SEQ ID NO: 909279 - protein, 6 aa, Mycobacterium
LTPTQH

SEQ ID NO: 909280 - protein, 12 aa, Mycobacterium
LTQAGEQPDLSS

SEQ ID NO: 909281 - protein, 5 aa, Mycobacterium
LTQET

SEQ ID NO: 909282 - protein, 7 aa, Mycobacterium
LTQGEAV

SEQ ID NO: 909283 - protein, 9 aa, Mycobacterium
LTQGETVSS

SEQ ID NO: 909284 - protein, 9 aa, Mycobacterium
LTQSPGDVA

SEQ ID NO: 909285 - protein, 8 aa, Mycobacterium
LTRASDAG

SEQ ID NO: 909286 - protein, 5 aa, Mycobacterium
LTRPG

SEQ ID NO: 909287 - protein, 15 aa, Mycobacterium
LTRPSETTNPGGIAR

SEQ ID NO: 909288 - protein, 12 aa, Mycobacterium
LTRQANPKLPAL

SEQ ID NO: 909289 - protein, 6 aa, Mycobacterium
LTRREP

SEQ ID NO: 909290 - protein, 28 aa, Mycobacterium
LTRSDKNTGITEGATPTDRSGGYTAGST

SEQ ID NO: 909291 - protein, 53 aa, Mycobacterium
LTRTPGTTAITGTTTTPITATTDQPRRTTSPAGTADTTTTDLTTHPTGTPIPA

SEQ ID NO: 909292 - protein, 10 aa, Mycobacterium
LTSARQEAEE

SEQ ID NO: 909293 - protein, 10 aa, Mycobacterium
LTSATAGDAL

SEQ ID NO: 909294 - protein, 12 aa, Mycobacterium
LTSGHGDAIENG

SEQ ID NO: 909295 - protein, 5 aa, Mycobacterium
LTSGQ

SEQ ID NO: 909296 - protein, 10 aa, Mycobacterium
LTSKATQNYP

SEQ ID NO: 909297 - protein, 6 aa, Mycobacterium
LTSPEV

SEQ ID NO: 909298 - protein, 12 aa, Mycobacterium
LTSPSTCAQTNF

SEQ ID NO: 909299 - protein, 9 aa, Mycobacterium
LTSRDQING

SEQ ID NO: 909300 - protein, 9 aa, Mycobacterium
LTSSDPGLA

SEQ ID NO: 909301 - protein, 26 aa, Mycobacterium
LTSTGKFDKKKLRSQHADGDLAVETL

SEQ ID NO: 909302 - protein, 10 aa, Mycobacterium
LTSTRRPTDG

SEQ ID NO: 909303 - protein, 11 aa, Mycobacterium
LTSTTPPSDGR

SEQ ID NO: 909304 - protein, 7 aa, Mycobacterium
LTTAGAT

SEQ ID NO: 909305 - protein, 8 aa, Mycobacterium
LTTDRPDC

SEQ ID NO: 909306 - protein, 5 aa, Mycobacterium
LTTEF

SEQ ID NO: 909307 - protein, 10 aa, Mycobacterium
LTTEPSAIGA

SEQ ID NO: 909308 - protein, 10 aa, Mycobacterium
LTTERADDPW

SEQ ID NO: 909309 - protein, 4 aa, Mycobacterium
LTTG

SEQ ID NO: 909310 - protein, 6 aa, Mycobacterium
LTTGRS

SEQ ID NO: 909311 - protein, 6 aa, Mycobacterium
LTTGSQ

SEQ ID NO: 909312 - protein, 4 aa, Mycobacterium
LTTP

SEQ ID NO: 909313 - protein, 6 aa, Mycobacterium
LTTPHE

SEQ ID NO: 909314 - protein, 13 aa, Mycobacterium
LTTPKNPSPQKLN

SEQ ID NO: 909315 - protein, 8 aa, Mycobacterium
LTTSDPLT

SEQ ID NO: 909316 - protein, 7 aa, Mycobacterium
LTTSTAS

SEQ ID NO: 909317 - protein, 7 aa, Mycobacterium
LTVDQDD

SEQ ID NO: 909318 - protein, 4 aa, Mycobacterium
LTVP

SEQ ID NO: 909319 - protein, 7 aa, Mycobacterium
LTVPAGQ

SEQ ID NO: 909320 - protein, 11 aa, Mycobacterium
LTVSTENGLTS

SEQ ID NO: 909321 - protein, 19 aa, Mycobacterium
LTYERKSSSPSDSLASGKC

SEQ ID NO: 909322 - protein, 9 aa, Mycobacterium
LTYSGPDSL

SEQ ID NO: 909323 - protein, 9 aa, Mycobacterium
LVPAPGDPW

SEQ ID NO: 909324 - protein, 13 aa, Mycobacterium
LVPGDDVRPADPV

SEQ ID NO: 909325 - protein, 13 aa, Mycobacterium
LVPGRKGNPDDDD

SEQ ID NO: 909326 - protein, 5 aa, Mycobacterium
LVPQT

SEQ ID NO: 909327 - protein, 6 aa, Mycobacterium
LVSDSG

SEQ ID NO: 909328 - protein, 17 aa, Mycobacterium
LYAGGSDAVGASAQMSA

SEQ ID NO: 909329 - protein, 4 aa, Mycobacterium
LYEG

SEQ ID NO: 909330 - protein, 9 aa, Mycobacterium
LYGGNEPAR

SEQ ID NO: 909331 - protein, 5 aa, Mycobacterium
LYGPD

SEQ ID NO: 909332 - protein, 6 aa, Mycobacterium
LYGQDN

SEQ ID NO: 909333 - protein, 5 aa, Mycobacterium
LYPGG

SEQ ID NO: 909334 - protein, 10 aa, Mycobacterium
LYTTGGSESP

SEQ ID NO: 909335 - protein, 42 aa, Mycobacterium
MAAGGGQSGPVNAGPPVRETAPAAPEPEAAAPAPEEAEAPVP

SEQ ID NO: 909336 - protein, 11 aa, Mycobacterium
MAAPPPEGPAQ

SEQ ID NO: 909337 - protein, 14 aa, Mycobacterium
MAASGCNPGGPEER

SEQ ID NO: 909338 - protein, 7 aa, Mycobacterium
MADGQRG

SEQ ID NO: 909339 - protein, 8 aa, Mycobacterium
MADPAEDA

SEQ ID NO: 909340 - protein, 5 aa, Mycobacterium
MAEAG

SEQ ID NO: 909341 - protein, 6 aa, Mycobacterium
MAEGEA

SEQ ID NO: 909342 - protein, 9 aa, Mycobacterium
MAGGPTTPA

SEQ ID NO: 909343 - protein, 16 aa, Mycobacterium
MAGPSTSYLTATNPDD

SEQ ID NO: 909344 - protein, 4 aa, Mycobacterium
MAGS

SEQ ID NO: 909345 - protein, 9 aa, Mycobacterium
MAGTAHSGW

SEQ ID NO: 909346 - protein, 9 aa, Mycobacterium
MAPSAAAEE

SEQ ID NO: 909347 - protein, 8 aa, Mycobacterium
MASESGIS

SEQ ID NO: 909348 - protein, 6 aa, Mycobacterium
MASYSA

SEQ ID NO: 909349 - protein, 34 aa, Mycobacterium
MATGAAKSYLDTHPGANQAVSTALTQPRDQAAAT

SEQ ID NO: 909350 - protein, 15 aa, Mycobacterium
MATQNAAAAAPTTGL

SEQ ID NO: 909351 - protein, 13 aa, Mycobacterium
MDDSVDDSKRRKH

SEQ ID NO: 909352 - protein, 8 aa, Mycobacterium
MDERKDDI

SEQ ID NO: 909353 - protein, 23 aa, Mycobacterium
MDPGPELESLTGQKSAGTVTEDR

SEQ ID NO: 909354 - protein, 9 aa, Mycobacterium
MDPGPELET

SEQ ID NO: 909355 - protein, 6 aa, Mycobacterium
MDPMRG

SEQ ID NO: 909356 - protein, 10 aa, Mycobacterium
MDSAGALQAT

SEQ ID NO: 909357 - protein, 27 aa, Mycobacterium
MEATESEEEDPATREQKAREAGRKAEI

SEQ ID NO: 909358 - protein, 32 aa, Mycobacterium
MEGGSASGTINSPAPGAPNSPAPGAPPAPAPS

SEQ ID NO: 909359 - protein, 5 aa, Mycobacterium
MEKPI

SEQ ID NO: 909360 - protein, 4 aa, Mycobacterium
MEPT

SEQ ID NO: 909361 - protein, 6 aa, Mycobacterium
MEQESV

SEQ ID NO: 909362 - protein, 9 aa, Mycobacterium
METPGPGAL

SEQ ID NO: 909363 - protein, 10 aa, Mycobacterium
MGADGDPRGV

SEQ ID NO: 909364 - protein, 10 aa, Mycobacterium
MGAPADEQSG

SEQ ID NO: 909365 - protein, 5 aa, Mycobacterium
MGAPG

SEQ ID NO: 909366 - protein, 9 aa, Mycobacterium
MGDAERRTM

SEQ ID NO: 909367 - protein, 8 aa, Mycobacterium
MGDGKPLT

SEQ ID NO: 909368 - protein, 16 aa, Mycobacterium
MGDQTGAALSRSGREV

SEQ ID NO: 909369 - protein, 14 aa, Mycobacterium
MGDQTGAALSRTGR

SEQ ID NO: 909370 - protein, 6 aa, Mycobacterium
MGDTTA

SEQ ID NO: 909371 - protein, 4 aa, Mycobacterium
MGDV

SEQ ID NO: 909372 - protein, 6 aa, Mycobacterium
MGESAQ

SEQ ID NO: 909373 - protein, 14 aa, Mycobacterium
MGESTMPSGGIADP

SEQ ID NO: 909374 - protein, 4 aa, Mycobacterium
MGGA

SEQ ID NO: 909375 - protein, 10 aa, Mycobacterium
MGGATPAVSA

SEQ ID NO: 909376 - protein, 7 aa, Mycobacterium
MGGDLTQ

SEQ ID NO: 909377 - protein, 6 aa, Mycobacterium
MGGNTN

SEQ ID NO: 909378 - protein, 30 aa, Mycobacterium
MGGSADQPSVASGGAMKVGETSTVTYTPGT

SEQ ID NO: 909379 - protein, 10 aa, Mycobacterium
MGGTENVGGK

SEQ ID NO: 909380 - protein, 8 aa, Mycobacterium
MGGTETVN

SEQ ID NO: 909381 - protein, 6 aa, Mycobacterium
MGGTGA

SEQ ID NO: 909382 - protein, 6 aa, Mycobacterium
MGNEPA

SEQ ID NO: 909383 - protein, 9 aa, Mycobacterium
MGNGEYGPQ

SEQ ID NO: 909384 - protein, 7 aa, Mycobacterium
MGPGGKG

SEQ ID NO: 909385 - protein, 5 aa, Mycobacterium
MGREV

SEQ ID NO: 909386 - protein, 11 aa, Mycobacterium
MGRPEYPTPVG

SEQ ID NO: 909387 - protein, 8 aa, Mycobacterium
MGSAPERP

SEQ ID NO: 909388 - protein, 8 aa, Mycobacterium
MGSDPDSA

SEQ ID NO: 909389 - protein, 10 aa, Mycobacterium
MGSGNTGDFN

SEQ ID NO: 909390 - protein, 13 aa, Mycobacterium
MGTKGGPRTDRDG

SEQ ID NO: 909391 - protein, 10 aa, Mycobacterium
MGTPSSDPRV

SEQ ID NO: 909392 - protein, 20 aa, Mycobacterium
MGTQADPDDGTALAAGDNTA

SEQ ID NO: 909393 - protein, 6 aa, Mycobacterium
MGTSPF

SEQ ID NO: 909394 - protein, 10 aa, Mycobacterium
MGVDADPTAV

SEQ ID NO: 909395 - protein, 10 aa, Mycobacterium
MGVDGDPRAV

SEQ ID NO: 909396 - protein, 9 aa, Mycobacterium
MHGPRDDGN

SEQ ID NO: 909397 - protein, 5 aa, Mycobacterium
MHSGE

SEQ ID NO: 909398 - protein, 7 aa, Mycobacterium
MKDGGYE

SEQ ID NO: 909399 - protein, 8 aa, Mycobacterium
MKHTGGGS

SEQ ID NO: 909400 - protein, 9 aa, Mycobacterium
MLNGSDPRL

SEQ ID NO: 909401 - protein, 8 aa, Mycobacterium
MMEGPGGA

SEQ ID NO: 909402 - protein, 10 aa, Mycobacterium
MNADAPPLAP

SEQ ID NO: 909403 - protein, 6 aa, Mycobacterium
MNEEPY

SEQ ID NO: 909404 - protein, 17 aa, Mycobacterium
MNGPSDGYLTAKSPDDI

SEQ ID NO: 909405 - protein, 16 aa, Mycobacterium
MNGPSDSYLTATSPDE

SEQ ID NO: 909406 - protein, 17 aa, Mycobacterium
MNGPSRSYLTATDPADI

SEQ ID NO: 909407 - protein, 17 aa, Mycobacterium
MNGPSSSYLTAASPDDI

SEQ ID NO: 909408 - protein, 6 aa, Mycobacterium
MNPVHG

SEQ ID NO: 909409 - protein, 9 aa, Mycobacterium
MNQTNDRQQ

SEQ ID NO: 909410 - protein, 7 aa, Mycobacterium
MNTLGGK

SEQ ID NO: 909411 - protein, 8 aa, Mycobacterium
MNTLSGKG

SEQ ID NO: 909412 - protein, 16 aa, Mycobacterium
MPAGGGQVAPGINEGQ

SEQ ID NO: 909413 - protein, 25 aa, Mycobacterium
MPAKAGESGGRADTAFTSDPAGAGV

SEQ ID NO: 909414 - protein, 47 aa, Mycobacterium
MPAPDDSDDDTTTYPKPNAYYNGGDDSSSYPAPDHGQPIDGGGVPCV

SEQ ID NO: 909415 - protein, 74 aa, Mycobacterium
MPAPEGLPPAPEALPPAPEALPPAPEAPAPAPEALPPAPEALPPAPEALPPAPEAPAPAPEALPPAPEAPAPVA

SEQ ID NO: 909416 - protein, 16 aa, Mycobacterium
MPAQETTPARGIPSGL

SEQ ID NO: 909417 - protein, 7 aa, Mycobacterium
MPASGGR

SEQ ID NO: 909418 - protein, 4 aa, Mycobacterium
MPAT

SEQ ID NO: 909419 - protein, 31 aa, Mycobacterium
MPATDGPSGLRPDAAAPTREVTDSDGGKIDE

SEQ ID NO: 909420 - protein, 31 aa, Mycobacterium
MPATDGPTGLRPDAESPARDVTGTDGGDIDN

SEQ ID NO: 909421 - protein, 9 aa, Mycobacterium
MPATSEPGL

SEQ ID NO: 909422 - protein, 8 aa, Mycobacterium
MPDAKPSA

SEQ ID NO: 909423 - protein, 11 aa, Mycobacterium
MPDSDDSPSEL

SEQ ID NO: 909424 - protein, 5 aa, Mycobacterium
MPEER

SEQ ID NO: 909425 - protein, 4 aa, Mycobacterium
MPGA

SEQ ID NO: 909426 - protein, 5 aa, Mycobacterium
MPGAS

SEQ ID NO: 909427 - protein, 15 aa, Mycobacterium
MPGQSAGEYDLPPGM

SEQ ID NO: 909428 - protein, 10 aa, Mycobacterium
MPGRDDGTDL

SEQ ID NO: 909429 - protein, 12 aa, Mycobacterium
MPGTAGHGSGAY

SEQ ID NO: 909430 - protein, 12 aa, Mycobacterium
MPGTAGHGSGSF

SEQ ID NO: 909431 - protein, 9 aa, Mycobacterium
MPKAAAKDF

SEQ ID NO: 909432 - protein, 9 aa, Mycobacterium
MPKRTTSAV

SEQ ID NO: 909433 - protein, 8 aa, Mycobacterium
MPNAKPSA

SEQ ID NO: 909434 - protein, 6 aa, Mycobacterium
MPNGAA

SEQ ID NO: 909435 - protein, 13 aa, Mycobacterium
MPPANPKDYAAND

SEQ ID NO: 909436 - protein, 13 aa, Mycobacterium
MPPDAAPEAPRRR

SEQ ID NO: 909437 - protein, 6 aa, Mycobacterium
MPPEYQ

SEQ ID NO: 909438 - protein, 9 aa, Mycobacterium
MPPPSSGGI

SEQ ID NO: 909439 - protein, 11 aa, Mycobacterium
MPPPYESQYDT

SEQ ID NO: 909440 - protein, 12 aa, Mycobacterium
MPPQSAAQIEQD

SEQ ID NO: 909441 - protein, 17 aa, Mycobacterium
MPPRADGVYTRGGGPVQ

SEQ ID NO: 909442 - protein, 30 aa, Mycobacterium
MPPYDDRDVSPAGPLPPSAEPAGTKHSAER

SEQ ID NO: 909443 - protein, 15 aa, Mycobacterium
MPQDPATAANLPTAA

SEQ ID NO: 909444 - protein, 9 aa, Mycobacterium
MPQDTTSAV

SEQ ID NO: 909445 - protein, 6 aa, Mycobacterium
MPRTPT

SEQ ID NO: 909446 - protein, 10 aa, Mycobacterium
MPSAGPYAGP

SEQ ID NO: 909447 - protein, 147 aa, Mycobacterium
MPSLTGGAATPSLASPTLTSPGLASPGLTSPGLTPGLTPGLTTPSLTDPGLTNPALTNPALTSPDGLTSPGLTTPSLTSPGLTTPDASLGATPSLTDPGLTNPALTTPSLTTPGLATPSTGLTTPGLDPSLTPISNAAGLPAPGEVP

SEQ ID NO: 909448 - protein, 6 aa, Mycobacterium
MPSPYT

SEQ ID NO: 909449 - protein, 12 aa, Mycobacterium
MPSTAAFDPAGT

SEQ ID NO: 909450 - protein, 4 aa, Mycobacterium
MPTD

SEQ ID NO: 909451 - protein, 12 aa, Mycobacterium
MPTDSADAPAPC

SEQ ID NO: 909452 - protein, 20 aa, Mycobacterium
MPTPKGWEPYRNSNLSPGTR

SEQ ID NO: 909453 - protein, 8 aa, Mycobacterium
MPTPPGWH

SEQ ID NO: 909454 - protein, 5 aa, Mycobacterium
MPTTC

SEQ ID NO: 909455 - protein, 17 aa, Mycobacterium
MQAPPHDMAPGKTDDDY

SEQ ID NO: 909456 - protein, 9 aa, Mycobacterium
MQPAAPPVQ

SEQ ID NO: 909457 - protein, 5 aa, Mycobacterium
MQPQR

SEQ ID NO: 909458 - protein, 9 aa, Mycobacterium
MQPSGTENH

SEQ ID NO: 909459 - protein, 6 aa, Mycobacterium
MQQAPP

SEQ ID NO: 909460 - protein, 7 aa, Mycobacterium
MQTGTTT

SEQ ID NO: 909461 - protein, 13 aa, Mycobacterium
MQTSRGSADPAWR

SEQ ID NO: 909462 - protein, 7 aa, Mycobacterium
MRADREK

SEQ ID NO: 909463 - protein, 4 aa, Mycobacterium
MRDA

SEQ ID NO: 909464 - protein, 15 aa, Mycobacterium
MRESSIKEAEGAKQA

SEQ ID NO: 909465 - protein, 7 aa, Mycobacterium
MRGGTTI

SEQ ID NO: 909466 - protein, 6 aa, Mycobacterium
MRGRRR

SEQ ID NO: 909467 - protein, 10 aa, Mycobacterium
MRGSPPRRRS

SEQ ID NO: 909468 - protein, 13 aa, Mycobacterium
MRPSHDPATAKAG

SEQ ID NO: 909469 - protein, 21 aa, Mycobacterium
MRSNGTDEGDPPPSPSARPFG

SEQ ID NO: 909470 - protein, 4 aa, Mycobacterium
MSAD

SEQ ID NO: 909471 - protein, 7 aa, Mycobacterium
MSADSPV

SEQ ID NO: 909472 - protein, 7 aa, Mycobacterium
MSDEPYG

SEQ ID NO: 909473 - protein, 9 aa, Mycobacterium
MSGDGRRVS

SEQ ID NO: 909474 - protein, 9 aa, Mycobacterium
MSGGPTTPA

SEQ ID NO: 909475 - protein, 9 aa, Mycobacterium
MSGKTPDAI

SEQ ID NO: 909476 - protein, 4 aa, Mycobacterium
MSGN

SEQ ID NO: 909477 - protein, 4 aa, Mycobacterium
MSGS

SEQ ID NO: 909478 - protein, 14 aa, Mycobacterium
MSGTATSTTRYHNS

SEQ ID NO: 909479 - protein, 18 aa, Mycobacterium
MSKDDTGAGTAAGAAGSV

SEQ ID NO: 909480 - protein, 6 aa, Mycobacterium
MSKKPQ

SEQ ID NO: 909481 - protein, 7 aa, Mycobacterium
MSNDGET

SEQ ID NO: 909482 - protein, 13 aa, Mycobacterium
MSNPRRPRSLELL

SEQ ID NO: 909483 - protein, 5 aa, Mycobacterium
MSPWS

SEQ ID NO: 909484 - protein, 4 aa, Mycobacterium
MSQT

SEQ ID NO: 909485 - protein, 13 aa, Mycobacterium
MSRGDDTGPGPCV

SEQ ID NO: 909486 - protein, 10 aa, Mycobacterium
MSSAGAQFSR

SEQ ID NO: 909487 - protein, 16 aa, Mycobacterium
MSSGRRAAEELMRRVR

SEQ ID NO: 909488 - protein, 46 aa, Mycobacterium
MSSQPPPRKKPRRARPELAAESSHGASKGGRQRNDDRVSVDKREGV

SEQ ID NO: 909489 - protein, 9 aa, Mycobacterium
MSSQTAQEL

SEQ ID NO: 909490 - protein, 7 aa, Mycobacterium
MSTGATD

SEQ ID NO: 909491 - protein, 7 aa, Mycobacterium
MTAKANS

SEQ ID NO: 909492 - protein, 7 aa, Mycobacterium
MTAKSGS

SEQ ID NO: 909493 - protein, 7 aa, Mycobacterium
MTAKSQS

SEQ ID NO: 909494 - protein, 22 aa, Mycobacterium
MTATPEAFNKGQLDGPGPSAGP

SEQ ID NO: 909495 - protein, 7 aa, Mycobacterium
MTATSQG

SEQ ID NO: 909496 - protein, 15 aa, Mycobacterium
MTDAAGNKPESVNCP

SEQ ID NO: 909497 - protein, 15 aa, Mycobacterium
MTDASGNKPESVTCP

SEQ ID NO: 909498 - protein, 19 aa, Mycobacterium
MTDESGSPVAGTLSPDGLT

SEQ ID NO: 909499 - protein, 19 aa, Mycobacterium
MTDRGNALAAQAGLTPLRG

SEQ ID NO: 909500 - protein, 4 aa, Mycobacterium
MTEE

SEQ ID NO: 909501 - protein, 7 aa, Mycobacterium
MTETGGN

SEQ ID NO: 909502 - protein, 42 aa, Mycobacterium
MTGEAPPSASPAESSSASSAPTSLAPGASATPSATPSAPTAD

SEQ ID NO: 909503 - protein, 12 aa, Mycobacterium
MTGQGADFAAHH

SEQ ID NO: 909504 - protein, 8 aa, Mycobacterium
MTGQPTQR

SEQ ID NO: 909505 - protein, 7 aa, Mycobacterium
MTKDSKI

SEQ ID NO: 909506 - protein, 28 aa, Mycobacterium
MTKGEETEPDGAVGGNPYSPPTDTGEAL

SEQ ID NO: 909507 - protein, 7 aa, Mycobacterium
MTNGTAA

SEQ ID NO: 909508 - protein, 9 aa, Mycobacterium
MTNSANDRT

SEQ ID NO: 909509 - protein, 8 aa, Mycobacterium
MTPAKDTL

SEQ ID NO: 909510 - protein, 16 aa, Mycobacterium
MTPNGAMNDPKSTTLV

SEQ ID NO: 909511 - protein, 8 aa, Mycobacterium
MTPPPGWQ

SEQ ID NO: 909512 - protein, 4 aa, Mycobacterium
MTPR

SEQ ID NO: 909513 - protein, 6 aa, Mycobacterium
MTPRGE

SEQ ID NO: 909514 - protein, 10 aa, Mycobacterium
MTPSSGNGPT

SEQ ID NO: 909515 - protein, 8 aa, Mycobacterium
MTQDPDAF

SEQ ID NO: 909516 - protein, 27 aa, Mycobacterium
MTRGEETTSGGAVDGNPYSPPTDTGEA

SEQ ID NO: 909517 - protein, 14 aa, Mycobacterium
MTRTQQTAAPLAAE

SEQ ID NO: 909518 - protein, 5 aa, Mycobacterium
MTSGK

SEQ ID NO: 909519 - protein, 12 aa, Mycobacterium
MTTGASQTKTTV

SEQ ID NO: 909520 - protein, 27 aa, Mycobacterium
MTTPPPDAPPPCYTPSGEPYWTPPGQP

SEQ ID NO: 909521 - protein, 12 aa, Mycobacterium
MTTQGADFAARH

SEQ ID NO: 909522 - protein, 10 aa, Mycobacterium
MTVPAQSKAI

SEQ ID NO: 909523 - protein, 5 aa, Mycobacterium
MVPPQ

SEQ ID NO: 909524 - protein, 8 aa, Mycobacterium
MVTPTTQI

SEQ ID NO: 909525 - protein, 12 aa, Mycobacterium
MWGPKDDPAWAR

SEQ ID NO: 909526 - protein, 17 aa, Mycobacterium
MWGPKDDPAWQRNDPTL

SEQ ID NO: 909527 - protein, 15 aa, Mycobacterium
MWGPSSDPAWQRNDP

SEQ ID NO: 909528 - protein, 17 aa, Mycobacterium
MWGPSSDPAWQRNDPTI

SEQ ID NO: 909529 - protein, 18 aa, Mycobacterium
MYTKDDAGKYTSMGPAEK

SEQ ID NO: 909530 - protein, 9 aa, Mycobacterium
NAAAAAPTT

SEQ ID NO: 909531 - protein, 10 aa, Mycobacterium
NAAADREGPL

SEQ ID NO: 909532 - protein, 7 aa, Mycobacterium
NAAAGSV

SEQ ID NO: 909533 - protein, 10 aa, Mycobacterium
NAADNPDAYY

SEQ ID NO: 909534 - protein, 8 aa, Mycobacterium
NAADPDHR

SEQ ID NO: 909535 - protein, 6 aa, Mycobacterium
NAAEPD

SEQ ID NO: 909536 - protein, 7 aa, Mycobacterium
NAAEPLE

SEQ ID NO: 909537 - protein, 8 aa, Mycobacterium
NAAGPGFR

SEQ ID NO: 909538 - protein, 10 aa, Mycobacterium
NAANAAAAEG

SEQ ID NO: 909539 - protein, 7 aa, Mycobacterium
NAANIGG

SEQ ID NO: 909540 - protein, 8 aa, Mycobacterium
NAANTAAL

SEQ ID NO: 909541 - protein, 10 aa, Mycobacterium
NAAPAEDFSK

SEQ ID NO: 909542 - protein, 9 aa, Mycobacterium
NAAPRGASA

SEQ ID NO: 909543 - protein, 8 aa, Mycobacterium
NAAPTGMP

SEQ ID NO: 909544 - protein, 6 aa, Mycobacterium
NAAPVG

SEQ ID NO: 909545 - protein, 4 aa, Mycobacterium
NAAQ

SEQ ID NO: 909546 - protein, 8 aa, Mycobacterium
NAAQPLTS

SEQ ID NO: 909547 - protein, 10 aa, Mycobacterium
NAARAAQASG

SEQ ID NO: 909548 - protein, 11 aa, Mycobacterium
NAARGPDSGAL

SEQ ID NO: 909549 - protein, 7 aa, Mycobacterium
NAARQSG

SEQ ID NO: 909550 - protein, 11 aa, Mycobacterium
NAARSGSPCGP

SEQ ID NO: 909551 - protein, 9 aa, Mycobacterium
NAARTDRDV

SEQ ID NO: 909552 - protein, 6 aa, Mycobacterium
NAASNF

SEQ ID NO: 909553 - protein, 8 aa, Mycobacterium
NAATDRPI

SEQ ID NO: 909554 - protein, 7 aa, Mycobacterium
NADDARA

SEQ ID NO: 909555 - protein, 8 aa, Mycobacterium
NADDARSV

SEQ ID NO: 909556 - protein, 6 aa, Mycobacterium
NADGDL

SEQ ID NO: 909557 - protein, 7 aa, Mycobacterium
NADGGVL

SEQ ID NO: 909558 - protein, 8 aa, Mycobacterium
NADMSSAA

SEQ ID NO: 909559 - protein, 8 aa, Mycobacterium
NADPHSYG

SEQ ID NO: 909560 - protein, 9 aa, Mycobacterium
NADPRAGAP

SEQ ID NO: 909561 - protein, 6 aa, Mycobacterium
NADRVQ

SEQ ID NO: 909562 - protein, 8 aa, Mycobacterium
NADSGHQE

SEQ ID NO: 909563 - protein, 7 aa, Mycobacterium
NADTGTI

SEQ ID NO: 909564 - protein, 32 aa, Mycobacterium
NADTIQTEGNYPTRQACQDAGPGVKASTPGNW

SEQ ID NO: 909565 - protein, 7 aa, Mycobacterium
NADTSAQ

SEQ ID NO: 909566 - protein, 5 aa, Mycobacterium
NAEAL

SEQ ID NO: 909567 - protein, 4 aa, Mycobacterium
NAEQ

SEQ ID NO: 909568 - protein, 12 aa, Mycobacterium
NAERAAPPRPDR

SEQ ID NO: 909569 - protein, 7 aa, Mycobacterium
NAEREEL

SEQ ID NO: 909570 - protein, 6 aa, Mycobacterium
NAESSI

SEQ ID NO: 909571 - protein, 4 aa, Mycobacterium
NAEV

SEQ ID NO: 909572 - protein, 13 aa, Mycobacterium
NAGADADGLPATT

SEQ ID NO: 909573 - protein, 9 aa, Mycobacterium
NAGDEQSGF

SEQ ID NO: 909574 - protein, 6 aa, Mycobacterium
NAGGGV

SEQ ID NO: 909575 - protein, 14 aa, Mycobacterium
NAGGQGGTPSAVSG

SEQ ID NO: 909576 - protein, 13 aa, Mycobacterium
NAGGQGGTPSAVT

SEQ ID NO: 909577 - protein, 7 aa, Mycobacterium
NAGGSPY

SEQ ID NO: 909578 - protein, 17 aa, Mycobacterium
NAGGSQSVGINNTGSFN

SEQ ID NO: 909579 - protein, 5 aa, Mycobacterium
NAGGT

SEQ ID NO: 909580 - protein, 6 aa, Mycobacterium
NAGPDV

SEQ ID NO: 909581 - protein, 7 aa, Mycobacterium
NAGPGFP

SEQ ID NO: 909582 - protein, 7 aa, Mycobacterium
NAGPGGT

SEQ ID NO: 909583 - protein, 8 aa, Mycobacterium
NAGPITNA

SEQ ID NO: 909584 - protein, 6 aa, Mycobacterium
NAGPNR

SEQ ID NO: 909585 - protein, 12 aa, Mycobacterium
NAGQAGADGPVQ

SEQ ID NO: 909586 - protein, 14 aa, Mycobacterium
NAGQPPDNAGPRAE

SEQ ID NO: 909587 - protein, 24 aa, Mycobacterium
NAGQPPDNAGPRAEFPFPNNGIPG

SEQ ID NO: 909588 - protein, 5 aa, Mycobacterium
NAGSA

SEQ ID NO: 909589 - protein, 9 aa, Mycobacterium
NAGSPEVDA

SEQ ID NO: 909590 - protein, 9 aa, Mycobacterium
NAGSPEVDS

SEQ ID NO: 909591 - protein, 8 aa, Mycobacterium
NAGSTNTG

SEQ ID NO: 909592 - protein, 6 aa, Mycobacterium
NAGVTD

SEQ ID NO: 909593 - protein, 4 aa, Mycobacterium
NAGY

SEQ ID NO: 909594 - protein, 9 aa, Mycobacterium
NAHAQSPAE

SEQ ID NO: 909595 - protein, 30 aa, Mycobacterium
NAHPDARAAANEVTAANNDDGVARVLERWW

SEQ ID NO: 909596 - protein, 16 aa, Mycobacterium
NAKAEGRDTINGQSTI

SEQ ID NO: 909597 - protein, 11 aa, Mycobacterium
NAKKARPAVEQ

SEQ ID NO: 909598 - protein, 14 aa, Mycobacterium
NAKNRPGSDFVPIG

SEQ ID NO: 909599 - protein, 14 aa, Mycobacterium
NAKNRTAGVGFTPV

SEQ ID NO: 909600 - protein, 7 aa, Mycobacterium
NAKPLPK

SEQ ID NO: 909601 - protein, 6 aa, Mycobacterium
NAKSHL

SEQ ID NO: 909602 - protein, 13 aa, Mycobacterium
NALDGNGDKLRQT

SEQ ID NO: 909603 - protein, 7 aa, Mycobacterium
NALEGPE

SEQ ID NO: 909604 - protein, 12 aa, Mycobacterium
NALGGNGDKLRQ

SEQ ID NO: 909605 - protein, 29 aa, Mycobacterium
NALGGNGGDGGIGGPGTIGGNGGHGGPGV

SEQ ID NO: 909606 - protein, 6 aa, Mycobacterium
NALPGL

SEQ ID NO: 909607 - protein, 4 aa, Mycobacterium
NALR

SEQ ID NO: 909608 - protein, 14 aa, Mycobacterium
NALTSTIERQRGQV

SEQ ID NO: 909609 - protein, 12 aa, Mycobacterium
NAMAGNGDKLRT

SEQ ID NO: 909610 - protein, 19 aa, Mycobacterium
NAMGGATGRAYGGAGGTLG

SEQ ID NO: 909611 - protein, 6 aa, Mycobacterium
NANAGQ

SEQ ID NO: 909612 - protein, 12 aa, Mycobacterium
NANDSTLSAEAA

SEQ ID NO: 909613 - protein, 6 aa, Mycobacterium
NANEAT

SEQ ID NO: 909614 - protein, 17 aa, Mycobacterium
NANGGGCCGRSAREGVD

SEQ ID NO: 909615 - protein, 5 aa, Mycobacterium
NANGS

SEQ ID NO: 909616 - protein, 9 aa, Mycobacterium
NANGSGAGV

SEQ ID NO: 909617 - protein, 6 aa, Mycobacterium
NANGTT

SEQ ID NO: 909618 - protein, 14 aa, Mycobacterium
NANSSMAADSYGEE

SEQ ID NO: 909619 - protein, 7 aa, Mycobacterium
NANTGKV

SEQ ID NO: 909620 - protein, 7 aa, Mycobacterium
NANTHQV

SEQ ID NO: 909621 - protein, 14 aa, Mycobacterium
NAPAADGGDQAAAE

SEQ ID NO: 909622 - protein, 5 aa, Mycobacterium
NAPAD

SEQ ID NO: 909623 - protein, 6 aa, Mycobacterium
NAPAIA

SEQ ID NO: 909624 - protein, 12 aa, Mycobacterium
NAPAIAAAESSY

SEQ ID NO: 909625 - protein, 8 aa, Mycobacterium
NAPAIAAT

SEQ ID NO: 909626 - protein, 12 aa, Mycobacterium
NAPAIAATESTY

SEQ ID NO: 909627 - protein, 10 aa, Mycobacterium
NAPDKVAPAT

SEQ ID NO: 909628 - protein, 7 aa, Mycobacterium
NAPDRSK

SEQ ID NO: 909629 - protein, 5 aa, Mycobacterium
NAPDT

SEQ ID NO: 909630 - protein, 6 aa, Mycobacterium
NAPEIA

SEQ ID NO: 909631 - protein, 7 aa, Mycobacterium
NAPEMSS

SEQ ID NO: 909632 - protein, 23 aa, Mycobacterium
NAPNTSGEVTGSVTVTDPEGRPL

SEQ ID NO: 909633 - protein, 15 aa, Mycobacterium
NAPPEADGVQPPDGD

SEQ ID NO: 909634 - protein, 9 aa, Mycobacterium
NAPPGATVN

SEQ ID NO: 909635 - protein, 10 aa, Mycobacterium
NAPPGTPRAR

SEQ ID NO: 909636 - protein, 7 aa, Mycobacterium
NAPQPGL

SEQ ID NO: 909637 - protein, 7 aa, Mycobacterium
NAPQPTL

SEQ ID NO: 909638 - protein, 5 aa, Mycobacterium
NAPRD

SEQ ID NO: 909639 - protein, 17 aa, Mycobacterium
NAPRGDQTRPRAASRSK

SEQ ID NO: 909640 - protein, 9 aa, Mycobacterium
NAPSQALTG

SEQ ID NO: 909641 - protein, 7 aa, Mycobacterium
NAPTGFV

SEQ ID NO: 909642 - protein, 4 aa, Mycobacterium
NAPV

SEQ ID NO: 909643 - protein, 8 aa, Mycobacterium
NAQGESTT

SEQ ID NO: 909644 - protein, 92 aa, Mycobacterium
NAQPAPTPTPAPPPPAVGAPQAPAPDAPAAPAPAPPADPNAPAPAAPPATPPADPNAPVPPPADPNAPAPAGPEAPAAPAPEPGRVDNAAGG

SEQ ID NO: 909645 - protein, 8 aa, Mycobacterium
NAQPRDGQ

SEQ ID NO: 909646 - protein, 10 aa, Mycobacterium
NAQPRPPGLP

SEQ ID NO: 909647 - protein, 6 aa, Mycobacterium
NAQRDD

SEQ ID NO: 909648 - protein, 15 aa, Mycobacterium
NAREATMKEVCADGG

SEQ ID NO: 909649 - protein, 9 aa, Mycobacterium
NARQAERSY

SEQ ID NO: 909650 - protein, 8 aa, Mycobacterium
NARQPAAG

SEQ ID NO: 909651 - protein, 10 aa, Mycobacterium
NARSASGQNY

SEQ ID NO: 909652 - protein, 8 aa, Mycobacterium
NARSFSDD

SEQ ID NO: 909653 - protein, 7 aa, Mycobacterium
NARSGQL

SEQ ID NO: 909654 - protein, 6 aa, Mycobacterium
NARTQI

SEQ ID NO: 909655 - protein, 11 aa, Mycobacterium
NASDDAKANLE

SEQ ID NO: 909656 - protein, 6 aa, Mycobacterium
NASFSK

SEQ ID NO: 909657 - protein, 6 aa, Mycobacterium
NASGGV

SEQ ID NO: 909658 - protein, 6 aa, Mycobacterium
NASGIT

SEQ ID NO: 909659 - protein, 9 aa, Mycobacterium
NASPGIEKE

SEQ ID NO: 909660 - protein, 8 aa, Mycobacterium
NASPGSIT

SEQ ID NO: 909661 - protein, 5 aa, Mycobacterium
NASPI

SEQ ID NO: 909662 - protein, 5 aa, Mycobacterium
NASPV

SEQ ID NO: 909663 - protein, 6 aa, Mycobacterium
NASQHE

SEQ ID NO: 909664 - protein, 4 aa, Mycobacterium
NAST

SEQ ID NO: 909665 - protein, 9 aa, Mycobacterium
NATAQPAPC

SEQ ID NO: 909666 - protein, 5 aa, Mycobacterium
NATEA

SEQ ID NO: 909667 - protein, 8 aa, Mycobacterium
NATEPVPG

SEQ ID NO: 909668 - protein, 8 aa, Mycobacterium
NATETRKL

SEQ ID NO: 909669 - protein, 7 aa, Mycobacterium
NATGAKA

SEQ ID NO: 909670 - protein, 9 aa, Mycobacterium
NATGAPAAL

SEQ ID NO: 909671 - protein, 10 aa, Mycobacterium
NATGGPASLT

SEQ ID NO: 909672 - protein, 6 aa, Mycobacterium
NATGYG

SEQ ID NO: 909673 - protein, 11 aa, Mycobacterium
NATHRTGGPLS

SEQ ID NO: 909674 - protein, 9 aa, Mycobacterium
NATIGTGTK

SEQ ID NO: 909675 - protein, 7 aa, Mycobacterium
NATRGEV

SEQ ID NO: 909676 - protein, 13 aa, Mycobacterium
NATSNASSQPHQL

SEQ ID NO: 909677 - protein, 6 aa, Mycobacterium
NATVTL

SEQ ID NO: 909678 - protein, 149 aa, Mycobacterium
NAVASAKPAADGSDTRASVSQASETSGAADTSEPTTAADTDTRDSDIPADDAPDSDDDAADPDGAAEPDREDADGDIGLPAANEDAGDAESDDRPATSSRKPDTSDGDASTQVTSPASATSPTSDDDAPAETPDDAGAAAPTTSPVRQE

SEQ ID NO: 909679 - protein, 11 aa, Mycobacterium
NAVDTDPEERA

SEQ ID NO: 909680 - protein, 6 aa, Mycobacterium
NAVGAG

SEQ ID NO: 909681 - protein, 7 aa, Mycobacterium
NAVGAGT

SEQ ID NO: 909682 - protein, 35 aa, Mycobacterium
NAVNDASINRQVRNGRGGTKACQTSGTATDDGYPE

SEQ ID NO: 909683 - protein, 5 aa, Mycobacterium
NAVYP

SEQ ID NO: 909684 - protein, 13 aa, Mycobacterium
NAYADASQDLVTT

SEQ ID NO: 909685 - protein, 11 aa, Mycobacterium
NAYDTLAPAEQ

SEQ ID NO: 909686 - protein, 10 aa, Mycobacterium
NAYPPANPKD

SEQ ID NO: 909687 - protein, 5 aa, Mycobacterium
NCAEG

SEQ ID NO: 909688 - protein, 27 aa, Mycobacterium
NCAPEQAGPQDSEPSQEPSNQSVSDRK

SEQ ID NO: 909689 - protein, 9 aa, Mycobacterium
NCPDGTDAE

SEQ ID NO: 909690 - protein, 6 aa, Mycobacterium
NCPGTR

SEQ ID NO: 909691 - protein, 12 aa, Mycobacterium
NCTEARSAPRDG

SEQ ID NO: 909692 - protein, 4 aa, Mycobacterium
NDAA

SEQ ID NO: 909693 - protein, 7 aa, Mycobacterium
NDAAAST

SEQ ID NO: 909694 - protein, 5 aa, Mycobacterium
NDADG

SEQ ID NO: 909695 - protein, 9 aa, Mycobacterium
NDAEQSGAF

SEQ ID NO: 909696 - protein, 9 aa, Mycobacterium
NDAEQSGAL

SEQ ID NO: 909697 - protein, 10 aa, Mycobacterium
NDAEQSGSLP

SEQ ID NO: 909698 - protein, 10 aa, Mycobacterium
NDAEQSGSYP

SEQ ID NO: 909699 - protein, 10 aa, Mycobacterium
NDAERPFSRD

SEQ ID NO: 909700 - protein, 6 aa, Mycobacterium
NDAGDD

SEQ ID NO: 909701 - protein, 9 aa, Mycobacterium
NDAGPNGRN

SEQ ID NO: 909702 - protein, 11 aa, Mycobacterium
NDAGPNGRNAM

SEQ ID NO: 909703 - protein, 17 aa, Mycobacterium
NDAGSADAGPLPGPGAR

SEQ ID NO: 909704 - protein, 7 aa, Mycobacterium
NDAGSDL

SEQ ID NO: 909705 - protein, 5 aa, Mycobacterium
NDAPV

SEQ ID NO: 909706 - protein, 8 aa, Mycobacterium
NDAPVAPD

SEQ ID NO: 909707 - protein, 4 aa, Mycobacterium
NDAQ

SEQ ID NO: 909708 - protein, 10 aa, Mycobacterium
NDAQQSGSLP

SEQ ID NO: 909709 - protein, 33 aa, Mycobacterium
NDAQSQPFTTAPELKPQPSSTPPPPPPLPPTPF

SEQ ID NO: 909710 - protein, 14 aa, Mycobacterium
NDAQTAATQISELC

SEQ ID NO: 909711 - protein, 9 aa, Mycobacterium
NDARGNPVA

SEQ ID NO: 909712 - protein, 6 aa, Mycobacterium
NDATHP

SEQ ID NO: 909713 - protein, 6 aa, Mycobacterium
NDAVRA

SEQ ID NO: 909714 - protein, 8 aa, Mycobacterium
NDDCNRTA

SEQ ID NO: 909715 - protein, 5 aa, Mycobacterium
NDDLG

SEQ ID NO: 909716 - protein, 38 aa, Mycobacterium
NDDSANSAAPTTPTRARVPGRPGSNPGPTDQATGTVPP

SEQ ID NO: 909717 - protein, 19 aa, Mycobacterium
NDENPYPTPEDKGDPDKAK

SEQ ID NO: 909718 - protein, 7 aa, Mycobacterium
NDEYAGP

SEQ ID NO: 909719 - protein, 15 aa, Mycobacterium
NDFPDEYTKSTRDGV

SEQ ID NO: 909720 - protein, 7 aa, Mycobacterium
NDGAGYI

SEQ ID NO: 909721 - protein, 18 aa, Mycobacterium
NDGAPVGAEDAVIPQGGT

SEQ ID NO: 909722 - protein, 6 aa, Mycobacterium
NDGDEK

SEQ ID NO: 909723 - protein, 167 aa, Mycobacterium
NDGGAGGNGGAGGGTGGNGGNGGYSTQRGHNGTGGTGGTGGIGATGGDGSNGGAGGAGGTGGLYGNGGNGGTGGTGGNGGTGATGGTGGTGGNGQTYYNGDSSSPGTGGDGGTGGTGGTGGNGGDGGAAGAGGTYGQSGSNGTGGDAGTGGSGGDGGAPGDGGATVD

SEQ ID NO: 909724 - protein, 4 aa, Mycobacterium
NDGI

SEQ ID NO: 909725 - protein, 5 aa, Mycobacterium
NDGIT

SEQ ID NO: 909726 - protein, 10 aa, Mycobacterium
NDGLDDANGE

SEQ ID NO: 909727 - protein, 13 aa, Mycobacterium
NDGNASAAAFNSG

SEQ ID NO: 909728 - protein, 8 aa, Mycobacterium
NDGQPRNE

SEQ ID NO: 909729 - protein, 6 aa, Mycobacterium
NDGQVE

SEQ ID NO: 909730 - protein, 4 aa, Mycobacterium
NDGR

SEQ ID NO: 909731 - protein, 6 aa, Mycobacterium
NDGSAA

SEQ ID NO: 909732 - protein, 6 aa, Mycobacterium
NDGTSV

SEQ ID NO: 909733 - protein, 16 aa, Mycobacterium
NDGTVDSAIATVTLNV

SEQ ID NO: 909734 - protein, 9 aa, Mycobacterium
NDGVQGPAV

SEQ ID NO: 909735 - protein, 9 aa, Mycobacterium
NDIDKGVGS

SEQ ID NO: 909736 - protein, 25 aa, Mycobacterium
NDIGGADPDTPLGTDPDVPYGTWAQ

SEQ ID NO: 909737 - protein, 8 aa, Mycobacterium
NDKYTEKR

SEQ ID NO: 909738 - protein, 12 aa, Mycobacterium
NDLAKGGNLDGY

SEQ ID NO: 909739 - protein, 4 aa, Mycobacterium
NDLP

SEQ ID NO: 909740 - protein, 5 aa, Mycobacterium
NDLQP

SEQ ID NO: 909741 - protein, 4 aa, Mycobacterium
NDMD

SEQ ID NO: 909742 - protein, 116 aa, Mycobacterium
NDNANAGTGGNGGNGGTGAIGSIGGNGGAGGAGGTGGLYGNGGTGGSGGSGGSGGTGATGGIGGAGGNGGDSFDNPNAPGNGGTGGTGGTGGTGGTGGNGGTGGAAGAGGTYGQSG

SEQ ID NO: 909743 - protein, 11 aa, Mycobacterium
NDNNMHDGSIA

SEQ ID NO: 909744 - protein, 13 aa, Mycobacterium
NDNNMHDGSIAQA

SEQ ID NO: 909745 - protein, 5 aa, Mycobacterium
NDNPN

SEQ ID NO: 909746 - protein, 6 aa, Mycobacterium
NDNRKD

SEQ ID NO: 909747 - protein, 6 aa, Mycobacterium
NDNRKE

SEQ ID NO: 909748 - protein, 4 aa, Mycobacterium
NDPA

SEQ ID NO: 909749 - protein, 6 aa, Mycobacterium
NDPAPL

SEQ ID NO: 909750 - protein, 9 aa, Mycobacterium
NDPDAGDIE

SEQ ID NO: 909751 - protein, 7 aa, Mycobacterium
NDPDEVA

SEQ ID NO: 909752 - protein, 6 aa, Mycobacterium
NDPDHG

SEQ ID NO: 909753 - protein, 6 aa, Mycobacterium
NDPEGY

SEQ ID NO: 909754 - protein, 5 aa, Mycobacterium
NDPEH

SEQ ID NO: 909755 - protein, 8 aa, Mycobacterium
NDPEPYDP

SEQ ID NO: 909756 - protein, 5 aa, Mycobacterium
NDPGY

SEQ ID NO: 909757 - protein, 33 aa, Mycobacterium
NDPHMSSAPDPDNKAPLATIPATKTRPTVIQPG

SEQ ID NO: 909758 - protein, 6 aa, Mycobacterium
NDPKIT

SEQ ID NO: 909759 - protein, 10 aa, Mycobacterium
NDPKLTGDDG

SEQ ID NO: 909760 - protein, 8 aa, Mycobacterium
NDPNEVAG

SEQ ID NO: 909761 - protein, 9 aa, Mycobacterium
NDPPGPEQL

SEQ ID NO: 909762 - protein, 4 aa, Mycobacterium
NDPQ

SEQ ID NO: 909763 - protein, 9 aa, Mycobacterium
NDPQNRINR

SEQ ID NO: 909764 - protein, 4 aa, Mycobacterium
NDPR

SEQ ID NO: 909765 - protein, 11 aa, Mycobacterium
NDPRAQNKKRV

SEQ ID NO: 909766 - protein, 9 aa, Mycobacterium
NDQPGCAQA

SEQ ID NO: 909767 - protein, 8 aa, Mycobacterium
NDQRNALN

SEQ ID NO: 909768 - protein, 10 aa, Mycobacterium
NDQTTCASAG

SEQ ID NO: 909769 - protein, 9 aa, Mycobacterium
NDRAEREAR

SEQ ID NO: 909770 - protein, 6 aa, Mycobacterium
NDRAQE

SEQ ID NO: 909771 - protein, 9 aa, Mycobacterium
NDREEFDKR

SEQ ID NO: 909772 - protein, 7 aa, Mycobacterium
NDRMTYE

SEQ ID NO: 909773 - protein, 8 aa, Mycobacterium
NDRPTTAA

SEQ ID NO: 909774 - protein, 17 aa, Mycobacterium
NDRTGHGAIVSAAKVQT

SEQ ID NO: 909775 - protein, 9 aa, Mycobacterium
NDSATTVAN

SEQ ID NO: 909776 - protein, 34 aa, Mycobacterium
NDSGPNNPDSDISGPYDSDKTNIAPKAPSSGTGM

SEQ ID NO: 909777 - protein, 9 aa, Mycobacterium
NDSKSDLDA

SEQ ID NO: 909778 - protein, 4 aa, Mycobacterium
NDSL

SEQ ID NO: 909779 - protein, 9 aa, Mycobacterium
NDSNTAATR

SEQ ID NO: 909780 - protein, 9 aa, Mycobacterium
NDSNTDATR

SEQ ID NO: 909781 - protein, 5 aa, Mycobacterium
NDSRE

SEQ ID NO: 909782 - protein, 9 aa, Mycobacterium
NDSRSDLDA

SEQ ID NO: 909783 - protein, 17 aa, Mycobacterium
NDSTEGSNKLKSITSDV

SEQ ID NO: 909784 - protein, 11 aa, Mycobacterium
NDTDADGDIDT

SEQ ID NO: 909785 - protein, 11 aa, Mycobacterium
NDTDADGTIDT

SEQ ID NO: 909786 - protein, 10 aa, Mycobacterium
NDTDANGDAL

SEQ ID NO: 909787 - protein, 5 aa, Mycobacterium
NDTDG

SEQ ID NO: 909788 - protein, 9 aa, Mycobacterium
NDTDPDTEV

SEQ ID NO: 909789 - protein, 7 aa, Mycobacterium
NDTDPNI

SEQ ID NO: 909790 - protein, 5 aa, Mycobacterium
NDTEG

SEQ ID NO: 909791 - protein, 9 aa, Mycobacterium
NDTKERQQQ

SEQ ID NO: 909792 - protein, 7 aa, Mycobacterium
NDTPIGE

SEQ ID NO: 909793 - protein, 6 aa, Mycobacterium
NDTRIS

SEQ ID NO: 909794 - protein, 10 aa, Mycobacterium
NDTSSDNTNI

SEQ ID NO: 909795 - protein, 9 aa, Mycobacterium
NDVDTNKIG

SEQ ID NO: 909796 - protein, 8 aa, Mycobacterium
NDVRASGA

SEQ ID NO: 909797 - protein, 16 aa, Mycobacterium
NDWDSNAARGTPSKGA

SEQ ID NO: 909798 - protein, 8 aa, Mycobacterium
NDWPSGTT

SEQ ID NO: 909799 - protein, 11 aa, Mycobacterium
NDYDPDVGNVR

SEQ ID NO: 909800 - protein, 7 aa, Mycobacterium
NDYEPDM

SEQ ID NO: 909801 - protein, 8 aa, Mycobacterium
NDYTGTGK

SEQ ID NO: 909802 - protein, 14 aa, Mycobacterium
NEAAGTRTHPSRVS

SEQ ID NO: 909803 - protein, 7 aa, Mycobacterium
NEADTRV

SEQ ID NO: 909804 - protein, 7 aa, Mycobacterium
NEAGVDG

SEQ ID NO: 909805 - protein, 11 aa, Mycobacterium
NEANGIDPQPL

SEQ ID NO: 909806 - protein, 5 aa, Mycobacterium
NEASG

SEQ ID NO: 909807 - protein, 6 aa, Mycobacterium
NEASRI

SEQ ID NO: 909808 - protein, 5 aa, Mycobacterium
NECPN

SEQ ID NO: 909809 - protein, 23 aa, Mycobacterium
NECPPGVTGAECQPSTGNEAGPV

SEQ ID NO: 909810 - protein, 8 aa, Mycobacterium
NEDGAHKT

SEQ ID NO: 909811 - protein, 17 aa, Mycobacterium
NEDGDEFGGGTLGGDTD

SEQ ID NO: 909812 - protein, 6 aa, Mycobacterium
NEDVTT

SEQ ID NO: 909813 - protein, 6 aa, Mycobacterium
NEEDAA

SEQ ID NO: 909814 - protein, 9 aa, Mycobacterium
NEGAPGRGP

SEQ ID NO: 909815 - protein, 12 aa, Mycobacterium
NEGAPGRGPYLA

SEQ ID NO: 909816 - protein, 13 aa, Mycobacterium
NEGAPGRGPYLAP

SEQ ID NO: 909817 - protein, 15 aa, Mycobacterium
NEGDPDAGYDEHGSA

SEQ ID NO: 909818 - protein, 8 aa, Mycobacterium
NEGGFNPQ

SEQ ID NO: 909819 - protein, 10 aa, Mycobacterium
NEGGGITSGR

SEQ ID NO: 909820 - protein, 4 aa, Mycobacterium
NEGN

SEQ ID NO: 909821 - protein, 11 aa, Mycobacterium
NEGSPGRGPLL

SEQ ID NO: 909822 - protein, 14 aa, Mycobacterium
NEGSPGRGPQLAPG

SEQ ID NO: 909823 - protein, 4 aa, Mycobacterium
NEIT

SEQ ID NO: 909824 - protein, 8 aa, Mycobacterium
NEKAYPYA

SEQ ID NO: 909825 - protein, 5 aa, Mycobacterium
NEKPV

SEQ ID NO: 909826 - protein, 9 aa, Mycobacterium
NEKTRSGAA

SEQ ID NO: 909827 - protein, 5 aa, Mycobacterium
NELAG

SEQ ID NO: 909828 - protein, 6 aa, Mycobacterium
NELGPV

SEQ ID NO: 909829 - protein, 16 aa, Mycobacterium
NENGELTSTLIWVYKV

SEQ ID NO: 909830 - protein, 14 aa, Mycobacterium
NENGKAVEGELTED

SEQ ID NO: 909831 - protein, 7 aa, Mycobacterium
NEPEPKI

SEQ ID NO: 909832 - protein, 10 aa, Mycobacterium
NEPKLSDTQV

SEQ ID NO: 909833 - protein, 14 aa, Mycobacterium
NEPPSKSAYDTESS

SEQ ID NO: 909834 - protein, 5 aa, Mycobacterium
NEPRD

SEQ ID NO: 909835 - protein, 5 aa, Mycobacterium
NEPSF

SEQ ID NO: 909836 - protein, 7 aa, Mycobacterium
NEPSLGD

SEQ ID NO: 909837 - protein, 9 aa, Mycobacterium
NEPTEVGDA

SEQ ID NO: 909838 - protein, 7 aa, Mycobacterium
NEPTLGD

SEQ ID NO: 909839 - protein, 6 aa, Mycobacterium
NEQFQN

SEQ ID NO: 909840 - protein, 5 aa, Mycobacterium
NEQVD

SEQ ID NO: 909841 - protein, 11 aa, Mycobacterium
NERTPGDTRAN

SEQ ID NO: 909842 - protein, 9 aa, Mycobacterium
NERYRSEHA

SEQ ID NO: 909843 - protein, 13 aa, Mycobacterium
NESDDMKWVSNPA

SEQ ID NO: 909844 - protein, 9 aa, Mycobacterium
NESKLADAQ

SEQ ID NO: 909845 - protein, 8 aa, Mycobacterium
NESKLAPT

SEQ ID NO: 909846 - protein, 6 aa, Mycobacterium
NESTPQ

SEQ ID NO: 909847 - protein, 8 aa, Mycobacterium
NETAGQAV

SEQ ID NO: 909848 - protein, 6 aa, Mycobacterium
NETASV

SEQ ID NO: 909849 - protein, 5 aa, Mycobacterium
NETER

SEQ ID NO: 909850 - protein, 8 aa, Mycobacterium
NETGLQPA

SEQ ID NO: 909851 - protein, 30 aa, Mycobacterium
NETSSLRAGLPDGWTSADKTGSGDYGSTND

SEQ ID NO: 909852 - protein, 5 aa, Mycobacterium
NFASP

SEQ ID NO: 909853 - protein, 11 aa, Mycobacterium
NFEPGTATESY

SEQ ID NO: 909854 - protein, 10 aa, Mycobacterium
NFGGDPARVT

SEQ ID NO: 909855 - protein, 14 aa, Mycobacterium
NFGPPGFGPGGMPG

SEQ ID NO: 909856 - protein, 34 aa, Mycobacterium
NFGSFNGGSTNTGDWNSGSINTGYANSGGTNTGI

SEQ ID NO: 909857 - protein, 11 aa, Mycobacterium
NFGTGTTGKKL

SEQ ID NO: 909858 - protein, 9 aa, Mycobacterium
NFPGDTAQK

SEQ ID NO: 909859 - protein, 6 aa, Mycobacterium
NFPNAA

SEQ ID NO: 909860 - protein, 37 aa, Mycobacterium
NFPTPRPTRSSPAPSSTVAAPPSAKPPTGATPLQPQN

SEQ ID NO: 909861 - protein, 6 aa, Mycobacterium
NFSGRA

SEQ ID NO: 909862 - protein, 6 aa, Mycobacterium
NFSTPA

SEQ ID NO: 909863 - protein, 13 aa, Mycobacterium
NFYTGDQTRNESY

SEQ ID NO: 909864 - protein, 4 aa, Mycobacterium
NGAA

SEQ ID NO: 909865 - protein, 25 aa, Mycobacterium
NGAAGGLGGQSTDGDGGSGGSGGRA

SEQ ID NO: 909866 - protein, 15 aa, Mycobacterium
NGADGAPGQAGGDGG

SEQ ID NO: 909867 - protein, 17 aa, Mycobacterium
NGADGAPGTGQSGGNGG

SEQ ID NO: 909868 - protein, 15 aa, Mycobacterium
NGADGGPGQKGGNGG

SEQ ID NO: 909869 - protein, 19 aa, Mycobacterium
NGADGYTNAQGIGTPGGAG

SEQ ID NO: 909870 - protein, 8 aa, Mycobacterium
NGAEARRP

SEQ ID NO: 909871 - protein, 5 aa, Mycobacterium
NGAEQ

SEQ ID NO: 909872 - protein, 8 aa, Mycobacterium
NGAEVSAD

SEQ ID NO: 909873 - protein, 4 aa, Mycobacterium
NGAG

SEQ ID NO: 909874 - protein, 7 aa, Mycobacterium
NGAGAQC

SEQ ID NO: 909875 - protein, 8 aa, Mycobacterium
NGAGTGPQ

SEQ ID NO: 909876 - protein, 6 aa, Mycobacterium
NGALTG

SEQ ID NO: 909877 - protein, 6 aa, Mycobacterium
NGANDT

SEQ ID NO: 909878 - protein, 14 aa, Mycobacterium
NGANGAPGQNGADG

SEQ ID NO: 909879 - protein, 16 aa, Mycobacterium
NGANGAPGTGANGEAG

SEQ ID NO: 909880 - protein, 16 aa, Mycobacterium
NGANGAPGTGPTARPA

SEQ ID NO: 909881 - protein, 18 aa, Mycobacterium
NGANGSEAVGGKTLTRPS

SEQ ID NO: 909882 - protein, 15 aa, Mycobacterium
NGANGTAADPNGEAG

SEQ ID NO: 909883 - protein, 8 aa, Mycobacterium
NGAPHVEN

SEQ ID NO: 909884 - protein, 9 aa, Mycobacterium
NGAPPRPLS

SEQ ID NO: 909885 - protein, 13 aa, Mycobacterium
NGAPSDLDAAGDF

SEQ ID NO: 909886 - protein, 6 aa, Mycobacterium
NGAPVD

SEQ ID NO: 909887 - protein, 5 aa, Mycobacterium
NGAQL

SEQ ID NO: 909888 - protein, 23 aa, Mycobacterium
NGAQNAGEGDYTTSSDRKDPNTF

SEQ ID NO: 909889 - protein, 41 aa, Mycobacterium
NGASEGAWAKGAGKAFNGGVGEGAKGNEGTSAAIKNTPGAI

SEQ ID NO: 909890 - protein, 21 aa, Mycobacterium
NGASGRHRARRSTAAEIASSA

SEQ ID NO: 909891 - protein, 9 aa, Mycobacterium
NGATAEHAV

SEQ ID NO: 909892 - protein, 14 aa, Mycobacterium
NGATTQTSATDQTH

SEQ ID NO: 909893 - protein, 6 aa, Mycobacterium
NGATTT

SEQ ID NO: 909894 - protein, 12 aa, Mycobacterium
NGDAPDQAWGSV

SEQ ID NO: 909895 - protein, 8 aa, Mycobacterium
NGDGTNVT

SEQ ID NO: 909896 - protein, 16 aa, Mycobacterium
NGDIGSDGSTPQVRAN

SEQ ID NO: 909897 - protein, 4 aa, Mycobacterium
NGDS

SEQ ID NO: 909898 - protein, 18 aa, Mycobacterium
NGDSGSPGFVKNPDGTVS

SEQ ID NO: 909899 - protein, 4 aa, Mycobacterium
NGDY

SEQ ID NO: 909900 - protein, 8 aa, Mycobacterium
NGEAARSV

SEQ ID NO: 909901 - protein, 5 aa, Mycobacterium
NGEAG

SEQ ID NO: 909902 - protein, 6 aa, Mycobacterium
NGEDTV

SEQ ID NO: 909903 - protein, 4 aa, Mycobacterium
NGEG

SEQ ID NO: 909904 - protein, 23 aa, Mycobacterium
NGEGGYGDGVETTTRLARILLAS

SEQ ID NO: 909905 - protein, 10 aa, Mycobacterium
NGEGKPCPTY

SEQ ID NO: 909906 - protein, 6 aa, Mycobacterium
NGEPAQ

SEQ ID NO: 909907 - protein, 10 aa, Mycobacterium
NGEPESRANS

SEQ ID NO: 909908 - protein, 6 aa, Mycobacterium
NGEPGL

SEQ ID NO: 909909 - protein, 5 aa, Mycobacterium
NGETR

SEQ ID NO: 909910 - protein, 7 aa, Mycobacterium
NGFAPVG

SEQ ID NO: 909911 - protein, 17 aa, Mycobacterium
NGGAEADEDDGGRPQEE

SEQ ID NO: 909912 - protein, 24 aa, Mycobacterium
NGGAGFNNGATAGAAGGNGGNAGL

SEQ ID NO: 909913 - protein, 22 aa, Mycobacterium
NGGAGGAGGADGNAATGGMGGN

SEQ ID NO: 909914 - protein, 44 aa, Mycobacterium
NGGAGGAGGDGGDSGNGGNATGGGNGGNGGTAGTGGAGGLGGGG

SEQ ID NO: 909915 - protein, 31 aa, Mycobacterium
NGGAGGAGGHGGTHAGLGSTGGIGGAGGAAG

SEQ ID NO: 909916 - protein, 16 aa, Mycobacterium
NGGAGGAGGNGGGAPL

SEQ ID NO: 909917 - protein, 26 aa, Mycobacterium
NGGAGGAGGVGALGQASGTGGNGGAG

SEQ ID NO: 909918 - protein, 21 aa, Mycobacterium
NGGAGGSGAIGGGNGGAGGAG

SEQ ID NO: 909919 - protein, 50 aa, Mycobacterium
NGGAGGSGAPGHAGGRGGNAGLIGTGGAGGSGGSSTSGAGGAGGAGGSGG

SEQ ID NO: 909920 - protein, 20 aa, Mycobacterium
NGGAGGSGAPGQRGGAGGAG

SEQ ID NO: 909921 - protein, 11 aa, Mycobacterium
NGGAGGTGGWG

SEQ ID NO: 909922 - protein, 8 aa, Mycobacterium
NGGAQLTP

SEQ ID NO: 909923 - protein, 5 aa, Mycobacterium
NGGAV

SEQ ID NO: 909924 - protein, 5 aa, Mycobacterium
NGGDE

SEQ ID NO: 909925 - protein, 21 aa, Mycobacterium
NGGDGGDGTGGAAGGAGGSGG

SEQ ID NO: 909926 - protein, 12 aa, Mycobacterium
NGGDGGNGGDGF

SEQ ID NO: 909927 - protein, 51 aa, Mycobacterium
NGGDGGSGAAGQVGGNGGNAGLIGTGGAGGQGGSGVSTTSAQAGGRGGSGG

SEQ ID NO: 909928 - protein, 29 aa, Mycobacterium
NGGDRLGATGGALAAPIGRATIAAALRGA

SEQ ID NO: 909929 - protein, 20 aa, Mycobacterium
NGGEPPNPLIPTATNDSLGG

SEQ ID NO: 909930 - protein, 7 aa, Mycobacterium
NGGEQAE

SEQ ID NO: 909931 - protein, 11 aa, Mycobacterium
NGGGWGSSGGS

SEQ ID NO: 909932 - protein, 14 aa, Mycobacterium
NGGIAATARNLRGT

SEQ ID NO: 909933 - protein, 24 aa, Mycobacterium
NGGNGAEGGTSSATGGAGGNGGDA

SEQ ID NO: 909934 - protein, 9 aa, Mycobacterium
NGGNGGAAA

SEQ ID NO: 909935 - protein, 33 aa, Mycobacterium
NGGNGGAGGTGLPDGTGGNGGTGGLLFGTPGMH

SEQ ID NO: 909936 - protein, 23 aa, Mycobacterium
NGGNGGDSTSAGVAGGAGGSAGL

SEQ ID NO: 909937 - protein, 27 aa, Mycobacterium
NGGNGGIGGAGDSGNPAGGQGGNGGGA

SEQ ID NO: 909938 - protein, 40 aa, Mycobacterium
NGGNGGLGGMGGGGGNGLPSTGVGGDGGDGGNGGTAGNGG

SEQ ID NO: 909939 - protein, 22 aa, Mycobacterium
NGGNGGSGANNQGGGNGGSAGL

SEQ ID NO: 909940 - protein, 33 aa, Mycobacterium
NGGNGGSGGTGTQPGGPGVGGSGGSLIGQHGLN

SEQ ID NO: 909941 - protein, 44 aa, Mycobacterium
NGGNGGSGSAGMAGGAGGSAGLIGNGGAGGAGGADAAGGPGGAG

SEQ ID NO: 909942 - protein, 45 aa, Mycobacterium
NGGNGGTSTTAGVAGGAGGSAGLIGNGGAGGGGGAGAVGGNGGAG

SEQ ID NO: 909943 - protein, 11 aa, Mycobacterium
NGGPAGAAGIA

SEQ ID NO: 909944 - protein, 9 aa, Mycobacterium
NGGPEQTET

SEQ ID NO: 909945 - protein, 13 aa, Mycobacterium
NGGPSGAAGGQPL

SEQ ID NO: 909946 - protein, 4 aa, Mycobacterium
NGGQ

SEQ ID NO: 909947 - protein, 64 aa, Mycobacterium
NGGRGGDGLAGVNGGRAGDGGNAGLLGNGGDGGNSVGGVEGANGGNAGLIGNGGKGGDGSPNVI

SEQ ID NO: 909948 - protein, 6 aa, Mycobacterium
NGGRRR

SEQ ID NO: 909949 - protein, 22 aa, Mycobacterium
NGGSGAAGDAAHPAGGAGGAAG

SEQ ID NO: 909950 - protein, 41 aa, Mycobacterium
NGGSGGAGGTGGSGLADGTGGAGGNGGSGGLIGSDGASGTP

SEQ ID NO: 909951 - protein, 23 aa, Mycobacterium
NGGSGGNSTHAGVAGGAGGNAGL

SEQ ID NO: 909952 - protein, 11 aa, Mycobacterium
NGGSGGSAAHV

SEQ ID NO: 909953 - protein, 21 aa, Mycobacterium
NGGSGGSGAAGTNGGNGGAAG

SEQ ID NO: 909954 - protein, 6 aa, Mycobacterium
NGGSST

SEQ ID NO: 909955 - protein, 19 aa, Mycobacterium
NGGSVARAEQCAEASNGAY

SEQ ID NO: 909956 - protein, 23 aa, Mycobacterium
NGGTGDNGAYAGQAGGNGGDGYA

SEQ ID NO: 909957 - protein, 46 aa, Mycobacterium
NGGTGGAGGNGGAGGLPVRTGAGGDGGIGGDGATGGRGGFLTGNGG

SEQ ID NO: 909958 - protein, 25 aa, Mycobacterium
NGGTGGNGGAGGGTSVGAGGQGGAA

SEQ ID NO: 909959 - protein, 89 aa, Mycobacterium
NGGTGGQGGAGFAGGTGADNVSAGRPGGAGGTGGIGAGGGNAGLIGTGGSGGNGGMGGHGGDSGYGDQTGGQGGNGGMGGAGGAAGNGG

SEQ ID NO: 909960 - protein, 56 aa, Mycobacterium
NGGTGGTGDATHPAGGNGGNAGLIGNGGAGGTGYSPASPSGANGGAGGIGGRGGSL

SEQ ID NO: 909961 - protein, 34 aa, Mycobacterium
NGGTGGTGGIGGQGGIGGQGGVGGNGAVGGNAHS

SEQ ID NO: 909962 - protein, 8 aa, Mycobacterium
NGGTSAEV

SEQ ID NO: 909963 - protein, 4 aa, Mycobacterium
NGGV

SEQ ID NO: 909964 - protein, 11 aa, Mycobacterium
NGHGNPLPPGQ

SEQ ID NO: 909965 - protein, 4 aa, Mycobacterium
NGIP

SEQ ID NO: 909966 - protein, 6 aa, Mycobacterium
NGIPAL

SEQ ID NO: 909967 - protein, 9 aa, Mycobacterium
NGISPDEGH

SEQ ID NO: 909968 - protein, 8 aa, Mycobacterium
NGITGSAS

SEQ ID NO: 909969 - protein, 17 aa, Mycobacterium
NGITSTPVAKGEPGAPT

SEQ ID NO: 909970 - protein, 6 aa, Mycobacterium
NGIYEG

SEQ ID NO: 909971 - protein, 9 aa, Mycobacterium
NGKAGQDKG

SEQ ID NO: 909972 - protein, 8 aa, Mycobacterium
NGKGGQPV

SEQ ID NO: 909973 - protein, 9 aa, Mycobacterium
NGKPDSMAD

SEQ ID NO: 909974 - protein, 9 aa, Mycobacterium
NGKPESMAK

SEQ ID NO: 909975 - protein, 12 aa, Mycobacterium
NGKPGELGGTDL

SEQ ID NO: 909976 - protein, 5 aa, Mycobacterium
NGKTS

SEQ ID NO: 909977 - protein, 7 aa, Mycobacterium
NGLDPSH

SEQ ID NO: 909978 - protein, 7 aa, Mycobacterium
NGLDPTH

SEQ ID NO: 909979 - protein, 8 aa, Mycobacterium
NGLGPADP

SEQ ID NO: 909980 - protein, 4 aa, Mycobacterium
NGLP

SEQ ID NO: 909981 - protein, 4 aa, Mycobacterium
NGLT

SEQ ID NO: 909982 - protein, 4 aa, Mycobacterium
NGMG

SEQ ID NO: 909983 - protein, 19 aa, Mycobacterium
NGMKNSDSVARIGNADPKW

SEQ ID NO: 909984 - protein, 4 aa, Mycobacterium
NGMT

SEQ ID NO: 909985 - protein, 6 aa, Mycobacterium
NGNDAG

SEQ ID NO: 909986 - protein, 5 aa, Mycobacterium
NGNEG

SEQ ID NO: 909987 - protein, 7 aa, Mycobacterium
NGNGAPI

SEQ ID NO: 909988 - protein, 14 aa, Mycobacterium
NGNGPELANGDSLS

SEQ ID NO: 909989 - protein, 6 aa, Mycobacterium
NGNGQH

SEQ ID NO: 909990 - protein, 44 aa, Mycobacterium
NGNIGSGNHGAGNFGSGNTGSRNLGSGNAGSTNFGSGNHGNSNV

SEQ ID NO: 909991 - protein, 5 aa, Mycobacterium
NGNKV

SEQ ID NO: 909992 - protein, 12 aa, Mycobacterium
NGNNLPNYNNER

SEQ ID NO: 909993 - protein, 8 aa, Mycobacterium
NGNRPNGG

SEQ ID NO: 909994 - protein, 12 aa, Mycobacterium
NGNTAVTTTVDH

SEQ ID NO: 909995 - protein, 4 aa, Mycobacterium
NGPA

SEQ ID NO: 909996 - protein, 6 aa, Mycobacterium
NGPAGS

SEQ ID NO: 909997 - protein, 10 aa, Mycobacterium
NGPAGSPPDP

SEQ ID NO: 909998 - protein, 5 aa, Mycobacterium
NGPEY

SEQ ID NO: 909999 - protein, 17 aa, Mycobacterium
NGPGLGSAGDIDPTSET

SEQ ID NO: 910000 - protein, 10 aa, Mycobacterium
NGPGPSAGPF

SEQ ID NO: 910001 - protein, 5 aa, Mycobacterium
NGPGQ

SEQ ID NO: 910002 - protein, 4 aa, Mycobacterium
NGPL

SEQ ID NO: 910003 - protein, 6 aa, Mycobacterium
NGPPAG

SEQ ID NO: 910004 - protein, 15 aa, Mycobacterium
NGPPGSQFWTFKLQR

SEQ ID NO: 910005 - protein, 8 aa, Mycobacterium
NGPQAPEQ

SEQ ID NO: 910006 - protein, 12 aa, Mycobacterium
NGPQAPEQFNPK

SEQ ID NO: 910007 - protein, 7 aa, Mycobacterium
NGPQSSI

SEQ ID NO: 910008 - protein, 6 aa, Mycobacterium
NGPSVN

SEQ ID NO: 910009 - protein, 6 aa, Mycobacterium
NGPTIN

SEQ ID NO: 910010 - protein, 11 aa, Mycobacterium
NGQAAQARRTI

SEQ ID NO: 910011 - protein, 14 aa, Mycobacterium
NGQAVTASAASNPD

SEQ ID NO: 910012 - protein, 13 aa, Mycobacterium
NGQPNELGGGDLP

SEQ ID NO: 910013 - protein, 11 aa, Mycobacterium
NGQTDTGPGDF

SEQ ID NO: 910014 - protein, 10 aa, Mycobacterium
NGQTPSPPVG

SEQ ID NO: 910015 - protein, 6 aa, Mycobacterium
NGQYRG

SEQ ID NO: 910016 - protein, 9 aa, Mycobacterium
NGRETGRMP

SEQ ID NO: 910017 - protein, 21 aa, Mycobacterium
NGRGGPQGLPFGPSSAGGDTI

SEQ ID NO: 910018 - protein, 21 aa, Mycobacterium
NGRGGPQGLPLGPSSAGGDTI

SEQ ID NO: 910019 - protein, 9 aa, Mycobacterium
NGRGGTSTV

SEQ ID NO: 910020 - protein, 6 aa, Mycobacterium
NGRHTA

SEQ ID NO: 910021 - protein, 10 aa, Mycobacterium
NGRPQDFDTR

SEQ ID NO: 910022 - protein, 14 aa, Mycobacterium
NGRPSLALDGSTAA

SEQ ID NO: 910023 - protein, 8 aa, Mycobacterium
NGRPVGPR

SEQ ID NO: 910024 - protein, 5 aa, Mycobacterium
NGRRM

SEQ ID NO: 910025 - protein, 6 aa, Mycobacterium
NGRSTN

SEQ ID NO: 910026 - protein, 9 aa, Mycobacterium
NGRTPGNVD

SEQ ID NO: 910027 - protein, 25 aa, Mycobacterium
NGSAKDLAGSGDVRGKTGEAEFAGG

SEQ ID NO: 910028 - protein, 15 aa, Mycobacterium
NGSATSDPAGEPQEE

SEQ ID NO: 910029 - protein, 13 aa, Mycobacterium
NGSDADAALPPGV

SEQ ID NO: 910030 - protein, 17 aa, Mycobacterium
NGSDRVASVTRGADDRQ

SEQ ID NO: 910031 - protein, 16 aa, Mycobacterium
NGSDRVASVTRGVDDR

SEQ ID NO: 910032 - protein, 10 aa, Mycobacterium
NGSGSPSVST

SEQ ID NO: 910033 - protein, 9 aa, Mycobacterium
NGSIAGAAK

SEQ ID NO: 910034 - protein, 7 aa, Mycobacterium
NGSNPAA

SEQ ID NO: 910035 - protein, 12 aa, Mycobacterium
NGSTARASDATA

SEQ ID NO: 910036 - protein, 13 aa, Mycobacterium
NGSTASEPEDVPQ

SEQ ID NO: 910037 - protein, 5 aa, Mycobacterium
NGSTQ

SEQ ID NO: 910038 - protein, 7 aa, Mycobacterium
NGTAKEI

SEQ ID NO: 910039 - protein, 8 aa, Mycobacterium
NGTAKEIA

SEQ ID NO: 910040 - protein, 10 aa, Mycobacterium
NGTAKPAPNL

SEQ ID NO: 910041 - protein, 6 aa, Mycobacterium
NGTDTL

SEQ ID NO: 910042 - protein, 7 aa, Mycobacterium
NGTEVTA

SEQ ID NO: 910043 - protein, 5 aa, Mycobacterium
NGTGL

SEQ ID NO: 910044 - protein, 13 aa, Mycobacterium
NGTGRAAGQDGQA

SEQ ID NO: 910045 - protein, 4 aa, Mycobacterium
NGTH

SEQ ID NO: 910046 - protein, 5 aa, Mycobacterium
NGTHS

SEQ ID NO: 910047 - protein, 10 aa, Mycobacterium
NGTPAGIPET

SEQ ID NO: 910048 - protein, 13 aa, Mycobacterium
NGTPNELGGGDLP

SEQ ID NO: 910049 - protein, 11 aa, Mycobacterium
NGTPSELGGAN

SEQ ID NO: 910050 - protein, 26 aa, Mycobacterium
NGTPVSSDGGRSDDTAPETATGYRSD

SEQ ID NO: 910051 - protein, 21 aa, Mycobacterium
NGTRCETAPGASDADRIEEAR

SEQ ID NO: 910052 - protein, 26 aa, Mycobacterium
NGTSDFVNNPTSSMSEQELSDRVKAL

SEQ ID NO: 910053 - protein, 15 aa, Mycobacterium
NGTSGAPLKDGETYG

SEQ ID NO: 910054 - protein, 8 aa, Mycobacterium
NGTSPISS

SEQ ID NO: 910055 - protein, 7 aa, Mycobacterium
NGVETGR

SEQ ID NO: 910056 - protein, 9 aa, Mycobacterium
NGVETPWSQ

SEQ ID NO: 910057 - protein, 6 aa, Mycobacterium
NGVGQS

SEQ ID NO: 910058 - protein, 12 aa, Mycobacterium
NGVNYQGRVSPQ

SEQ ID NO: 910059 - protein, 12 aa, Mycobacterium
NGVPTSSNCSEL

SEQ ID NO: 910060 - protein, 8 aa, Mycobacterium
NGVSQNEG

SEQ ID NO: 910061 - protein, 9 aa, Mycobacterium
NGVSQSAQR

SEQ ID NO: 910062 - protein, 14 aa, Mycobacterium
NGVTPHDKRHRAPV

SEQ ID NO: 910063 - protein, 14 aa, Mycobacterium
NGVYGQTREAKRAS

SEQ ID NO: 910064 - protein, 14 aa, Mycobacterium
NGVYGQTRETKRAG

SEQ ID NO: 910065 - protein, 10 aa, Mycobacterium
NGYAESGVSP

SEQ ID NO: 910066 - protein, 16 aa, Mycobacterium
NGYASQQTDQPNTQDA

SEQ ID NO: 910067 - protein, 25 aa, Mycobacterium
NGYDPAEVTAPATQAAFGGGADPVS

SEQ ID NO: 910068 - protein, 10 aa, Mycobacterium
NGYETLAPAE

SEQ ID NO: 910069 - protein, 14 aa, Mycobacterium
NGYNDYEPDTGTIR

SEQ ID NO: 910070 - protein, 10 aa, Mycobacterium
NGYSDGLRNS

SEQ ID NO: 910071 - protein, 6 aa, Mycobacterium
NHDRIS

SEQ ID NO: 910072 - protein, 14 aa, Mycobacterium
NHGSGTADLSDGRI

SEQ ID NO: 910073 - protein, 5 aa, Mycobacterium
NHNGS

SEQ ID NO: 910074 - protein, 5 aa, Mycobacterium
NHNGT

SEQ ID NO: 910075 - protein, 9 aa, Mycobacterium
NHPNPFGEA

SEQ ID NO: 910076 - protein, 7 aa, Mycobacterium
NHQEQAE

SEQ ID NO: 910077 - protein, 61 aa, Mycobacterium
NHQQPNTNHHPDTERGDARNSGATGHNQDHSRKNGDRNSGDASKGNNGNADGDDGESDCHP

SEQ ID NO: 910078 - protein, 10 aa, Mycobacterium
NHSEPSPADL

SEQ ID NO: 910079 - protein, 8 aa, Mycobacterium
NIAPSAYD

SEQ ID NO: 910080 - protein, 7 aa, Mycobacterium
NIEPNSR

SEQ ID NO: 910081 - protein, 9 aa, Mycobacterium
NIGGSDNKI

SEQ ID NO: 910082 - protein, 9 aa, Mycobacterium
NIGGTNNKI

SEQ ID NO: 910083 - protein, 9 aa, Mycobacterium
NIGQYRDDR

SEQ ID NO: 910084 - protein, 5 aa, Mycobacterium
NIGRA

SEQ ID NO: 910085 - protein, 4 aa, Mycobacterium
NIKT

SEQ ID NO: 910086 - protein, 4 aa, Mycobacterium
NIPA

SEQ ID NO: 910087 - protein, 6 aa, Mycobacterium
NIPAAQ

SEQ ID NO: 910088 - protein, 12 aa, Mycobacterium
NIPGGEPIPQEE

SEQ ID NO: 910089 - protein, 5 aa, Mycobacterium
NIPYE

SEQ ID NO: 910090 - protein, 7 aa, Mycobacterium
NIQPNSR

SEQ ID NO: 910091 - protein, 8 aa, Mycobacterium
NIRNGQDV

SEQ ID NO: 910092 - protein, 5 aa, Mycobacterium
NISGQ

SEQ ID NO: 910093 - protein, 6 aa, Mycobacterium
NISPGL

SEQ ID NO: 910094 - protein, 26 aa, Mycobacterium
NISRSGSLEPGPGRRTLDDILRRLER

SEQ ID NO: 910095 - protein, 7 aa, Mycobacterium
NITTSPA

SEQ ID NO: 910096 - protein, 7 aa, Mycobacterium
NKAFQQA

SEQ ID NO: 910097 - protein, 9 aa, Mycobacterium
NKAGGKTTT

SEQ ID NO: 910098 - protein, 7 aa, Mycobacterium
NKAPQVE

SEQ ID NO: 910099 - protein, 5 aa, Mycobacterium
NKDAG

SEQ ID NO: 910100 - protein, 10 aa, Mycobacterium
NKDEAGNPVS

SEQ ID NO: 910101 - protein, 29 aa, Mycobacterium
NKDGKPNYVTDSAASATGWTTGTKTYNGA

SEQ ID NO: 910102 - protein, 6 aa, Mycobacterium
NKEHPD

SEQ ID NO: 910103 - protein, 14 aa, Mycobacterium
NKFSSAASAHTGFK

SEQ ID NO: 910104 - protein, 4 aa, Mycobacterium
NKGL

SEQ ID NO: 910105 - protein, 12 aa, Mycobacterium
NKGLSEDSPQIS

SEQ ID NO: 910106 - protein, 6 aa, Mycobacterium
NKGTPF

SEQ ID NO: 910107 - protein, 9 aa, Mycobacterium
NKIDPQTQR

SEQ ID NO: 910108 - protein, 5 aa, Mycobacterium
NKNLT

SEQ ID NO: 910109 - protein, 5 aa, Mycobacterium
NKPAE

SEQ ID NO: 910110 - protein, 6 aa, Mycobacterium
NKPDSH

SEQ ID NO: 910111 - protein, 8 aa, Mycobacterium
NKPERTAP

SEQ ID NO: 910112 - protein, 6 aa, Mycobacterium
NKQCPD

SEQ ID NO: 910113 - protein, 6 aa, Mycobacterium
NKQEDA

SEQ ID NO: 910114 - protein, 22 aa, Mycobacterium
NKQWGSGPSSAPPSFGAGGSAV

SEQ ID NO: 910115 - protein, 17 aa, Mycobacterium
NKRAGQVPVTGQDATVE

SEQ ID NO: 910116 - protein, 9 aa, Mycobacterium
NKSNKSASF

SEQ ID NO: 910117 - protein, 11 aa, Mycobacterium
NKSVKPTGSAA

SEQ ID NO: 910118 - protein, 9 aa, Mycobacterium
NKTPDTRPG

SEQ ID NO: 910119 - protein, 17 aa, Mycobacterium
NKTPPLRSGSVTNGQTA

SEQ ID NO: 910120 - protein, 7 aa, Mycobacterium
NKVPGGG

SEQ ID NO: 910121 - protein, 10 aa, Mycobacterium
NLAEASNSRE

SEQ ID NO: 910122 - protein, 4 aa, Mycobacterium
NLAR

SEQ ID NO: 910123 - protein, 7 aa, Mycobacterium
NLDGDDA

SEQ ID NO: 910124 - protein, 14 aa, Mycobacterium
NLDGEGGAAAYKSS

SEQ ID NO: 910125 - protein, 9 aa, Mycobacterium
NLDNPDNAD

SEQ ID NO: 910126 - protein, 6 aa, Mycobacterium
NLDPQR

SEQ ID NO: 910127 - protein, 5 aa, Mycobacterium
NLDPS

SEQ ID NO: 910128 - protein, 12 aa, Mycobacterium
NLDTRGGSTIEQ

SEQ ID NO: 910129 - protein, 4 aa, Mycobacterium
NLEG

SEQ ID NO: 910130 - protein, 5 aa, Mycobacterium
NLERG

SEQ ID NO: 910131 - protein, 10 aa, Mycobacterium
NLGASDPAAM

SEQ ID NO: 910132 - protein, 26 aa, Mycobacterium
NLGDTNFGSGNSGNLNLGSGNRFGSG

SEQ ID NO: 910133 - protein, 13 aa, Mycobacterium
NLGGGPTAESNKR

SEQ ID NO: 910134 - protein, 16 aa, Mycobacterium
NLGPAGITAPAPPPLD

SEQ ID NO: 910135 - protein, 9 aa, Mycobacterium
NLGPGEEAT

SEQ ID NO: 910136 - protein, 9 aa, Mycobacterium
NLGRPQPGL

SEQ ID NO: 910137 - protein, 16 aa, Mycobacterium
NLGSGNVGFGNTGNGD

SEQ ID NO: 910138 - protein, 6 aa, Mycobacterium
NLNSEP

SEQ ID NO: 910139 - protein, 5 aa, Mycobacterium
NLNTG

SEQ ID NO: 910140 - protein, 7 aa, Mycobacterium
NLPAPTS

SEQ ID NO: 910141 - protein, 14 aa, Mycobacterium
NLPGGGGAIPCTGH

SEQ ID NO: 910142 - protein, 12 aa, Mycobacterium
NLPGGSWEERAE

SEQ ID NO: 910143 - protein, 8 aa, Mycobacterium
NLPGGTAQ

SEQ ID NO: 910144 - protein, 5 aa, Mycobacterium
NLPGS

SEQ ID NO: 910145 - protein, 13 aa, Mycobacterium
NLPGTAGHGSRSY

SEQ ID NO: 910146 - protein, 18 aa, Mycobacterium
NLPGYDGEGSEGTADELS

SEQ ID NO: 910147 - protein, 17 aa, Mycobacterium
NLPGYQGSGNGSASTLS

SEQ ID NO: 910148 - protein, 10 aa, Mycobacterium
NLPKGADDQR

SEQ ID NO: 910149 - protein, 16 aa, Mycobacterium
NLPPCPAGGAGPGPAR

SEQ ID NO: 910150 - protein, 18 aa, Mycobacterium
NLQPSNATIPGYTPKGTL

SEQ ID NO: 910151 - protein, 7 aa, Mycobacterium
NLQPSNV

SEQ ID NO: 910152 - protein, 5 aa, Mycobacterium
NLRRQ

SEQ ID NO: 910153 - protein, 9 aa, Mycobacterium
NLSNTPGSF

SEQ ID NO: 910154 - protein, 7 aa, Mycobacterium
NLSPAAD

SEQ ID NO: 910155 - protein, 5 aa, Mycobacterium
NLSPQ

SEQ ID NO: 910156 - protein, 7 aa, Mycobacterium
NLSQQTN

SEQ ID NO: 910157 - protein, 19 aa, Mycobacterium
NLTGTVNGLGRATGTNGQA

SEQ ID NO: 910158 - protein, 4 aa, Mycobacterium
NLTN

SEQ ID NO: 910159 - protein, 12 aa, Mycobacterium
NLTQSGSGTDTD

SEQ ID NO: 910160 - protein, 10 aa, Mycobacterium
NLYGGNEPAR

SEQ ID NO: 910161 - protein, 20 aa, Mycobacterium
NMAPPPAPDVPPPPPAPRAY

SEQ ID NO: 910162 - protein, 5 aa, Mycobacterium
NMGDG

SEQ ID NO: 910163 - protein, 9 aa, Mycobacterium
NMGEYRDSR

SEQ ID NO: 910164 - protein, 9 aa, Mycobacterium
NMGHTQAAA

SEQ ID NO: 910165 - protein, 8 aa, Mycobacterium
NMPQPPLA

SEQ ID NO: 910166 - protein, 13 aa, Mycobacterium
NMPSATAQRPGDV

SEQ ID NO: 910167 - protein, 8 aa, Mycobacterium
NMTPKDDQ

SEQ ID NO: 910168 - protein, 6 aa, Mycobacterium
NNADKG

SEQ ID NO: 910169 - protein, 10 aa, Mycobacterium
NNAGPTGRTA

SEQ ID NO: 910170 - protein, 5 aa, Mycobacterium
NNARQ

SEQ ID NO: 910171 - protein, 7 aa, Mycobacterium
NNDFPLP

SEQ ID NO: 910172 - protein, 14 aa, Mycobacterium
NNDITGAASLENNK

SEQ ID NO: 910173 - protein, 26 aa, Mycobacterium
NNDKKDESAGTSASSSAATSTAAAST

SEQ ID NO: 910174 - protein, 7 aa, Mycobacterium
NNDNGRQ

SEQ ID NO: 910175 - protein, 11 aa, Mycobacterium
NNDVSTQASQV

SEQ ID NO: 910176 - protein, 8 aa, Mycobacterium
NNEGAGAL

SEQ ID NO: 910177 - protein, 5 aa, Mycobacterium
NNFSQ

SEQ ID NO: 910178 - protein, 7 aa, Mycobacterium
NNGANDN

SEQ ID NO: 910179 - protein, 7 aa, Mycobacterium
NNGGNDN

SEQ ID NO: 910180 - protein, 6 aa, Mycobacterium
NNGQID

SEQ ID NO: 910181 - protein, 9 aa, Mycobacterium
NNGRSATAI

SEQ ID NO: 910182 - protein, 6 aa, Mycobacterium
NNGSKV

SEQ ID NO: 910183 - protein, 4 aa, Mycobacterium
NNGT

SEQ ID NO: 910184 - protein, 5 aa, Mycobacterium
NNGTH

SEQ ID NO: 910185 - protein, 4 aa, Mycobacterium
NNGV

SEQ ID NO: 910186 - protein, 6 aa, Mycobacterium
NNIDAP

SEQ ID NO: 910187 - protein, 7 aa, Mycobacterium
NNKDAIA

SEQ ID NO: 910188 - protein, 9 aa, Mycobacterium
NNKGDRHGK

SEQ ID NO: 910189 - protein, 8 aa, Mycobacterium
NNKPPGRF

SEQ ID NO: 910190 - protein, 5 aa, Mycobacterium
NNLGN

SEQ ID NO: 910191 - protein, 4 aa, Mycobacterium
NNNQ

SEQ ID NO: 910192 - protein, 7 aa, Mycobacterium
NNNTDVS

SEQ ID NO: 910193 - protein, 10 aa, Mycobacterium
NNNTVRANSI

SEQ ID NO: 910194 - protein, 10 aa, Mycobacterium
NNPDPQGAQA

SEQ ID NO: 910195 - protein, 7 aa, Mycobacterium
NNPFNTG

SEQ ID NO: 910196 - protein, 5 aa, Mycobacterium
NNPGH

SEQ ID NO: 910197 - protein, 9 aa, Mycobacterium
NNRAPGRFD

SEQ ID NO: 910198 - protein, 17 aa, Mycobacterium
NNRDNLKQAVRNGDTVA

SEQ ID NO: 910199 - protein, 4 aa, Mycobacterium
NNRL

SEQ ID NO: 910200 - protein, 9 aa, Mycobacterium
NNSGLSRIP

SEQ ID NO: 910201 - protein, 15 aa, Mycobacterium
NNSPADVARTAGPAV

SEQ ID NO: 910202 - protein, 17 aa, Mycobacterium
NNTATITDPADARLQDP

SEQ ID NO: 910203 - protein, 11 aa, Mycobacterium
NNTGKSVEGPF

SEQ ID NO: 910204 - protein, 8 aa, Mycobacterium
NNTLSASS

SEQ ID NO: 910205 - protein, 5 aa, Mycobacterium
NNTPL

SEQ ID NO: 910206 - protein, 22 aa, Mycobacterium
NNTPSAPGTSPDTQRAPNTNAL

SEQ ID NO: 910207 - protein, 13 aa, Mycobacterium
NNTVSASGLGAGN

SEQ ID NO: 910208 - protein, 9 aa, Mycobacterium
NNVGDPEPD

SEQ ID NO: 910209 - protein, 19 aa, Mycobacterium
NNVGPSSSTGKLQPKVSNG

SEQ ID NO: 910210 - protein, 7 aa, Mycobacterium
NNVTETP

SEQ ID NO: 910211 - protein, 4 aa, Mycobacterium
NPAA

SEQ ID NO: 910212 - protein, 9 aa, Mycobacterium
NPAAALAPG

SEQ ID NO: 910213 - protein, 14 aa, Mycobacterium
NPAAASAAPTAARI

SEQ ID NO: 910214 - protein, 8 aa, Mycobacterium
NPAAPNGS

SEQ ID NO: 910215 - protein, 14 aa, Mycobacterium
NPAAPTESRNVASS

SEQ ID NO: 910216 - protein, 4 aa, Mycobacterium
NPAD

SEQ ID NO: 910217 - protein, 6 aa, Mycobacterium
NPAGDD

SEQ ID NO: 910218 - protein, 4 aa, Mycobacterium
NPAK

SEQ ID NO: 910219 - protein, 17 aa, Mycobacterium
NPAKTRDGRGLSYSDAT

SEQ ID NO: 910220 - protein, 35 aa, Mycobacterium
NPALTNPALTSPTGLAPGLTSPTGLDPSLGGTNEI

SEQ ID NO: 910221 - protein, 23 aa, Mycobacterium
NPANTAMRGGGGADGAIHRAGGP

SEQ ID NO: 910222 - protein, 5 aa, Mycobacterium
NPAPL

SEQ ID NO: 910223 - protein, 24 aa, Mycobacterium
NPARFNETTPYNPSSPYSSTKAAA

SEQ ID NO: 910224 - protein, 15 aa, Mycobacterium
NPASAGAQGNSNVTN

SEQ ID NO: 910225 - protein, 10 aa, Mycobacterium
NPASEESSVT

SEQ ID NO: 910226 - protein, 9 aa, Mycobacterium
NPASGYKTM

SEQ ID NO: 910227 - protein, 18 aa, Mycobacterium
NPATKFGNPVSARGSFAG

SEQ ID NO: 910228 - protein, 8 aa, Mycobacterium
NPATPNGG

SEQ ID NO: 910229 - protein, 7 aa, Mycobacterium
NPATYAP

SEQ ID NO: 910230 - protein, 49 aa, Mycobacterium
NPAVPNPTVPIPTGPVPGPQAPTLQASPQNPLTGTETSVQPAEEPAPTL

SEQ ID NO: 910231 - protein, 7 aa, Mycobacterium
NPAYSGL

SEQ ID NO: 910232 - protein, 13 aa, Mycobacterium
NPDAARQALGNTP

SEQ ID NO: 910233 - protein, 7 aa, Mycobacterium
NPDEADA

SEQ ID NO: 910234 - protein, 7 aa, Mycobacterium
NPDERDA

SEQ ID NO: 910235 - protein, 7 aa, Mycobacterium
NPDEREA

SEQ ID NO: 910236 - protein, 8 aa, Mycobacterium
NPDEVTQT

SEQ ID NO: 910237 - protein, 10 aa, Mycobacterium
NPDGDHSAPD

SEQ ID NO: 910238 - protein, 16 aa, Mycobacterium
NPDGSVPADNPFPGSP

SEQ ID NO: 910239 - protein, 4 aa, Mycobacterium
NPDH

SEQ ID NO: 910240 - protein, 11 aa, Mycobacterium
NPDHIDPEAVP

SEQ ID NO: 910241 - protein, 25 aa, Mycobacterium
NPDIRTGPGGDEPRDQSVPGTVDDA

SEQ ID NO: 910242 - protein, 5 aa, Mycobacterium
NPDLD

SEQ ID NO: 910243 - protein, 5 aa, Mycobacterium
NPDNL

SEQ ID NO: 910244 - protein, 8 aa, Mycobacterium
NPDSGSPV

SEQ ID NO: 910245 - protein, 5 aa, Mycobacterium
NPDTG

SEQ ID NO: 910246 - protein, 11 aa, Mycobacterium
NPDTGETQLGS

SEQ ID NO: 910247 - protein, 10 aa, Mycobacterium
NPDTGGPRGS

SEQ ID NO: 910248 - protein, 11 aa, Mycobacterium
NPDTGGPRGSF

SEQ ID NO: 910249 - protein, 7 aa, Mycobacterium
NPDVKAD

SEQ ID NO: 910250 - protein, 14 aa, Mycobacterium
NPDYHGNRQPRNKG

SEQ ID NO: 910251 - protein, 14 aa, Mycobacterium
NPDYRGNRKPRNKG

SEQ ID NO: 910252 - protein, 7 aa, Mycobacterium
NPEEADA

SEQ ID NO: 910253 - protein, 5 aa, Mycobacterium
NPEHN

SEQ ID NO: 910254 - protein, 5 aa, Mycobacterium
NPELR

SEQ ID NO: 910255 - protein, 8 aa, Mycobacterium
NPERGGEI

SEQ ID NO: 910256 - protein, 5 aa, Mycobacterium
NPEYQ

SEQ ID NO: 910257 - protein, 4 aa, Mycobacterium
NPFA

SEQ ID NO: 910258 - protein, 9 aa, Mycobacterium
NPFKNDPAA

SEQ ID NO: 910259 - protein, 32 aa, Mycobacterium
NPGADIRSTVQDHANDRTYQNTITGKVYYVNI

SEQ ID NO: 910260 - protein, 9 aa, Mycobacterium
NPGADLPTE

SEQ ID NO: 910261 - protein, 7 aa, Mycobacterium
NPGATLP

SEQ ID NO: 910262 - protein, 11 aa, Mycobacterium
NPGATLPDTKV

SEQ ID NO: 910263 - protein, 6 aa, Mycobacterium
NPGDGE

SEQ ID NO: 910264 - protein, 36 aa, Mycobacterium
NPGDPVCQEGGRSWTAHTSYEQTNLPAQAASFVAGK

SEQ ID NO: 910265 - protein, 4 aa, Mycobacterium
NPGF

SEQ ID NO: 910266 - protein, 8 aa, Mycobacterium
NPGGGHGI

SEQ ID NO: 910267 - protein, 11 aa, Mycobacterium
NPGGPGESGVE

SEQ ID NO: 910268 - protein, 9 aa, Mycobacterium
NPGGPGGSA

SEQ ID NO: 910269 - protein, 10 aa, Mycobacterium
NPGGPGGSGV

SEQ ID NO: 910270 - protein, 12 aa, Mycobacterium
NPGGPGKSGVEA

SEQ ID NO: 910271 - protein, 16 aa, Mycobacterium
NPGGTGGSGAAGGGSQ

SEQ ID NO: 910272 - protein, 6 aa, Mycobacterium
NPGHDL

SEQ ID NO: 910273 - protein, 6 aa, Mycobacterium
NPGHDV

SEQ ID NO: 910274 - protein, 7 aa, Mycobacterium
NPGNPEK

SEQ ID NO: 910275 - protein, 6 aa, Mycobacterium
NPGPTF

SEQ ID NO: 910276 - protein, 5 aa, Mycobacterium
NPGRA

SEQ ID NO: 910277 - protein, 8 aa, Mycobacterium
NPGRANGG

SEQ ID NO: 910278 - protein, 8 aa, Mycobacterium
NPGRPNGG

SEQ ID NO: 910279 - protein, 10 aa, Mycobacterium
NPGRRPVRGQ

SEQ ID NO: 910280 - protein, 8 aa, Mycobacterium
NPGSAEGI

SEQ ID NO: 910281 - protein, 5 aa, Mycobacterium
NPGSS

SEQ ID NO: 910282 - protein, 6 aa, Mycobacterium
NPGTIT

SEQ ID NO: 910283 - protein, 4 aa, Mycobacterium
NPHI

SEQ ID NO: 910284 - protein, 6 aa, Mycobacterium
NPHVPY

SEQ ID NO: 910285 - protein, 5 aa, Mycobacterium
NPIDG

SEQ ID NO: 910286 - protein, 4 aa, Mycobacterium
NPIE

SEQ ID NO: 910287 - protein, 6 aa, Mycobacterium
NPIGTA

SEQ ID NO: 910288 - protein, 10 aa, Mycobacterium
NPIKGAKQQW

SEQ ID NO: 910289 - protein, 12 aa, Mycobacterium
NPIPADTTGGAC

SEQ ID NO: 910290 - protein, 15 aa, Mycobacterium
NPKPAAEAAQPTVSG

SEQ ID NO: 910291 - protein, 13 aa, Mycobacterium
NPKRQRRNGDPFS

SEQ ID NO: 910292 - protein, 5 aa, Mycobacterium
NPKSR

SEQ ID NO: 910293 - protein, 5 aa, Mycobacterium
NPKTN

SEQ ID NO: 910294 - protein, 7 aa, Mycobacterium
NPLDPRC

SEQ ID NO: 910295 - protein, 7 aa, Mycobacterium
NPLGDND

SEQ ID NO: 910296 - protein, 8 aa, Mycobacterium
NPLGTGGQ

SEQ ID NO: 910297 - protein, 10 aa, Mycobacterium
NPLPVDPESY

SEQ ID NO: 910298 - protein, 17 aa, Mycobacterium
NPLRAKPSLEAAKDQYR

SEQ ID NO: 910299 - protein, 6 aa, Mycobacterium
NPMGEK

SEQ ID NO: 910300 - protein, 27 aa, Mycobacterium
NPMITPTDEEVSEAVGAPDQKEPSFGP

SEQ ID NO: 910301 - protein, 24 aa, Mycobacterium
NPNAGNVPAAPLAASPKKANVAGS

SEQ ID NO: 910302 - protein, 14 aa, Mycobacterium
NPNENAGGGALDPY

SEQ ID NO: 910303 - protein, 13 aa, Mycobacterium
NPNRMRESANPYE

SEQ ID NO: 910304 - protein, 11 aa, Mycobacterium
NPNRSGKPVDS

SEQ ID NO: 910305 - protein, 10 aa, Mycobacterium
NPNSGLTTGK

SEQ ID NO: 910306 - protein, 14 aa, Mycobacterium
NPNSGTVIPPSRYD

SEQ ID NO: 910307 - protein, 6 aa, Mycobacterium
NPNTGT

SEQ ID NO: 910308 - protein, 8 aa, Mycobacterium
NPNTPDGG

SEQ ID NO: 910309 - protein, 5 aa, Mycobacterium
NPPDT

SEQ ID NO: 910310 - protein, 8 aa, Mycobacterium
NPPEPGTH

SEQ ID NO: 910311 - protein, 7 aa, Mycobacterium
NPPGTTN

SEQ ID NO: 910312 - protein, 9 aa, Mycobacterium
NPPKPGDHV

SEQ ID NO: 910313 - protein, 6 aa, Mycobacterium
NPPLDV

SEQ ID NO: 910314 - protein, 12 aa, Mycobacterium
NPPPAPATAYGE

SEQ ID NO: 910315 - protein, 16 aa, Mycobacterium
NPPPGKQGEGKLQPAA

SEQ ID NO: 910316 - protein, 19 aa, Mycobacterium
NPPPGQPGRGRLQPGASIP

SEQ ID NO: 910317 - protein, 7 aa, Mycobacterium
NPPRSGL

SEQ ID NO: 910318 - protein, 19 aa, Mycobacterium
NPPVDEAGRARYRSDPAAL

SEQ ID NO: 910319 - protein, 4 aa, Mycobacterium
NPPW

SEQ ID NO: 910320 - protein, 7 aa, Mycobacterium
NPQAYAP

SEQ ID NO: 910321 - protein, 11 aa, Mycobacterium
NPQDDPPERSA

SEQ ID NO: 910322 - protein, 7 aa, Mycobacterium
NPQDPAA

SEQ ID NO: 910323 - protein, 6 aa, Mycobacterium
NPQMPQ

SEQ ID NO: 910324 - protein, 8 aa, Mycobacterium
NPQPPRRE

SEQ ID NO: 910325 - protein, 12 aa, Mycobacterium
NPQPSESPTCPA

SEQ ID NO: 910326 - protein, 14 aa, Mycobacterium
NPQSAGAQGNSNVT

SEQ ID NO: 910327 - protein, 9 aa, Mycobacterium
NPQTSAAAI

SEQ ID NO: 910328 - protein, 6 aa, Mycobacterium
NPQVAS

SEQ ID NO: 910329 - protein, 7 aa, Mycobacterium
NPQVTQD

SEQ ID NO: 910330 - protein, 4 aa, Mycobacterium
NPRA

SEQ ID NO: 910331 - protein, 33 aa, Mycobacterium
NPRFATNSGARPQGAATSKPAPSGPPPITAPKN

SEQ ID NO: 910332 - protein, 6 aa, Mycobacterium
NPRHGT

SEQ ID NO: 910333 - protein, 6 aa, Mycobacterium
NPRRRS

SEQ ID NO: 910334 - protein, 11 aa, Mycobacterium
NPRTGDTDNQR

SEQ ID NO: 910335 - protein, 4 aa, Mycobacterium
NPRY

SEQ ID NO: 910336 - protein, 5 aa, Mycobacterium
NPRYT

SEQ ID NO: 910337 - protein, 5 aa, Mycobacterium
NPSAK

SEQ ID NO: 910338 - protein, 8 aa, Mycobacterium
NPSARIGR

SEQ ID NO: 910339 - protein, 10 aa, Mycobacterium
NPSETAPAAS

SEQ ID NO: 910340 - protein, 6 aa, Mycobacterium
NPSGKV

SEQ ID NO: 910341 - protein, 8 aa, Mycobacterium
NPSGRAGG

SEQ ID NO: 910342 - protein, 9 aa, Mycobacterium
NPSHRVRGE

SEQ ID NO: 910343 - protein, 6 aa, Mycobacterium
NPSKTM

SEQ ID NO: 910344 - protein, 10 aa, Mycobacterium
NPSLAPREAE

SEQ ID NO: 910345 - protein, 8 aa, Mycobacterium
NPSRPNGG

SEQ ID NO: 910346 - protein, 11 aa, Mycobacterium
NPSRRLGSNPD

SEQ ID NO: 910347 - protein, 9 aa, Mycobacterium
NPSSPAGIA

SEQ ID NO: 910348 - protein, 8 aa, Mycobacterium
NPSSPEGI

SEQ ID NO: 910349 - protein, 5 aa, Mycobacterium
NPSTI

SEQ ID NO: 910350 - protein, 5 aa, Mycobacterium
NPSWN

SEQ ID NO: 910351 - protein, 5 aa, Mycobacterium
NPTDR

SEQ ID NO: 910352 - protein, 4 aa, Mycobacterium
NPTF

SEQ ID NO: 910353 - protein, 5 aa, Mycobacterium
NPTFT

SEQ ID NO: 910354 - protein, 6 aa, Mycobacterium
NPTGVT

SEQ ID NO: 910355 - protein, 5 aa, Mycobacterium
NPTLG

SEQ ID NO: 910356 - protein, 12 aa, Mycobacterium
NPTNSGAAGSPY

SEQ ID NO: 910357 - protein, 5 aa, Mycobacterium
NPTPA

SEQ ID NO: 910358 - protein, 6 aa, Mycobacterium
NPTPDA

SEQ ID NO: 910359 - protein, 5 aa, Mycobacterium
NPTRS

SEQ ID NO: 910360 - protein, 5 aa, Mycobacterium
NPTRW

SEQ ID NO: 910361 - protein, 9 aa, Mycobacterium
NPTSPLANS

SEQ ID NO: 910362 - protein, 8 aa, Mycobacterium
NPTSQAGI

SEQ ID NO: 910363 - protein, 5 aa, Mycobacterium
NPTWG

SEQ ID NO: 910364 - protein, 6 aa, Mycobacterium
NPTYND

SEQ ID NO: 910365 - protein, 6 aa, Mycobacterium
NPTYQK

SEQ ID NO: 910366 - protein, 5 aa, Mycobacterium
NPVAA

SEQ ID NO: 910367 - protein, 9 aa, Mycobacterium
NPVPVDPRR

SEQ ID NO: 910368 - protein, 8 aa, Mycobacterium
NPVRRTSS

SEQ ID NO: 910369 - protein, 11 aa, Mycobacterium
NPVSASPDRMS

SEQ ID NO: 910370 - protein, 8 aa, Mycobacterium
NPVSPERK

SEQ ID NO: 910371 - protein, 5 aa, Mycobacterium
NPVTR

SEQ ID NO: 910372 - protein, 6 aa, Mycobacterium
NPWDPS

SEQ ID NO: 910373 - protein, 9 aa, Mycobacterium
NPWYGDPDQ

SEQ ID NO: 910374 - protein, 7 aa, Mycobacterium
NPYDDGP

SEQ ID NO: 910375 - protein, 7 aa, Mycobacterium
NPYNNGP

SEQ ID NO: 910376 - protein, 5 aa, Mycobacterium
NPYQF

SEQ ID NO: 910377 - protein, 10 aa, Mycobacterium
NQAAAESTDI

SEQ ID NO: 910378 - protein, 9 aa, Mycobacterium
NQAADAGAD

SEQ ID NO: 910379 - protein, 8 aa, Mycobacterium
NQAELADA

SEQ ID NO: 910380 - protein, 12 aa, Mycobacterium
NQAKPAAYEPLT

SEQ ID NO: 910381 - protein, 10 aa, Mycobacterium
NQAKPVISEP

SEQ ID NO: 910382 - protein, 33 aa, Mycobacterium
NQAPTDGKYTAGQPNPSSGKVSGTVTAADPERD

SEQ ID NO: 910383 - protein, 5 aa, Mycobacterium
NQASR

SEQ ID NO: 910384 - protein, 8 aa, Mycobacterium
NQDEPAYQ

SEQ ID NO: 910385 - protein, 16 aa, Mycobacterium
NQEPEGSAGPSDDELA

SEQ ID NO: 910386 - protein, 55 aa, Mycobacterium
NQGAAATAGMGGGIPPAPPPAPASPSPAPSAGGHAAPAAAAPGGGVSPAAAQPGV

SEQ ID NO: 910387 - protein, 8 aa, Mycobacterium
NQGGDTTC

SEQ ID NO: 910388 - protein, 4 aa, Mycobacterium
NQGH

SEQ ID NO: 910389 - protein, 7 aa, Mycobacterium
NQGPGFP

SEQ ID NO: 910390 - protein, 11 aa, Mycobacterium
NQGRSTEEGSG

SEQ ID NO: 910391 - protein, 6 aa, Mycobacterium
NQGTQS

SEQ ID NO: 910392 - protein, 4 aa, Mycobacterium
NQGV

SEQ ID NO: 910393 - protein, 27 aa, Mycobacterium
NQHPVGTAKCPAAPTADDQAPPADQPG

SEQ ID NO: 910394 - protein, 12 aa, Mycobacterium
NQIGNGEGPVDQ

SEQ ID NO: 910395 - protein, 5 aa, Mycobacterium
NQKFE

SEQ ID NO: 910396 - protein, 6 aa, Mycobacterium
NQKSTA

SEQ ID NO: 910397 - protein, 9 aa, Mycobacterium
NQLGGRTVG

SEQ ID NO: 910398 - protein, 17 aa, Mycobacterium
NQMSYNDSRKEGTDRAV

SEQ ID NO: 910399 - protein, 13 aa, Mycobacterium
NQPALPTTTTSTT

SEQ ID NO: 910400 - protein, 7 aa, Mycobacterium
NQPAYGR

SEQ ID NO: 910401 - protein, 17 aa, Mycobacterium
NQPGNYRRGDSEKAAQN

SEQ ID NO: 910402 - protein, 8 aa, Mycobacterium
NQPKLAEA

SEQ ID NO: 910403 - protein, 10 aa, Mycobacterium
NQPPGPEELA

SEQ ID NO: 910404 - protein, 9 aa, Mycobacterium
NQPPQSDPG

SEQ ID NO: 910405 - protein, 10 aa, Mycobacterium
NQPRPEAEAN

SEQ ID NO: 910406 - protein, 4 aa, Mycobacterium
NQQF

SEQ ID NO: 910407 - protein, 14 aa, Mycobacterium
NQQPEIDTMQGLLK

SEQ ID NO: 910408 - protein, 9 aa, Mycobacterium
NQQPLSPQA

SEQ ID NO: 910409 - protein, 7 aa, Mycobacterium
NQQRDDI

SEQ ID NO: 910410 - protein, 34 aa, Mycobacterium
NQQSPVSNVASARDMRNRPTSVPVSTKVAHVTLA

SEQ ID NO: 910411 - protein, 23 aa, Mycobacterium
NQRDEEFTPPGAEEGDLPQPPTG

SEQ ID NO: 910412 - protein, 23 aa, Mycobacterium
NQRDEEFTPPGGEEGDLPQPPTG

SEQ ID NO: 910413 - protein, 7 aa, Mycobacterium
NQRYTSI

SEQ ID NO: 910414 - protein, 10 aa, Mycobacterium
NQSAAVDQIS

SEQ ID NO: 910415 - protein, 9 aa, Mycobacterium
NQSPDTPDR

SEQ ID NO: 910416 - protein, 8 aa, Mycobacterium
NQSSALDS

SEQ ID NO: 910417 - protein, 4 aa, Mycobacterium
NQVE

SEQ ID NO: 910418 - protein, 9 aa, Mycobacterium
NQVGGRTVS

SEQ ID NO: 910419 - protein, 7 aa, Mycobacterium
NQVTSRM

SEQ ID NO: 910420 - protein, 4 aa, Mycobacterium
NRAA

SEQ ID NO: 910421 - protein, 6 aa, Mycobacterium
NRAARQ

SEQ ID NO: 910422 - protein, 8 aa, Mycobacterium
NRADPIAT

SEQ ID NO: 910423 - protein, 7 aa, Mycobacterium
NRAGDTT

SEQ ID NO: 910424 - protein, 9 aa, Mycobacterium
NRAGGPSKV

SEQ ID NO: 910425 - protein, 6 aa, Mycobacterium
NRAGSA

SEQ ID NO: 910426 - protein, 7 aa, Mycobacterium
NRAPAKV

SEQ ID NO: 910427 - protein, 6 aa, Mycobacterium
NRATIG

SEQ ID NO: 910428 - protein, 8 aa, Mycobacterium
NRDDPPYQ

SEQ ID NO: 910429 - protein, 25 aa, Mycobacterium
NRDEEPHTVAASDGSFHSPGMGTGA

SEQ ID NO: 910430 - protein, 11 aa, Mycobacterium
NRDGAATATFA

SEQ ID NO: 910431 - protein, 5 aa, Mycobacterium
NRDNL

SEQ ID NO: 910432 - protein, 8 aa, Mycobacterium
NRDTMKPA

SEQ ID NO: 910433 - protein, 6 aa, Mycobacterium
NREAEL

SEQ ID NO: 910434 - protein, 15 aa, Mycobacterium
NRESLGTTSDKLAGV

SEQ ID NO: 910435 - protein, 10 aa, Mycobacterium
NRETPDPVPG

SEQ ID NO: 910436 - protein, 5 aa, Mycobacterium
NRGAI

SEQ ID NO: 910437 - protein, 5 aa, Mycobacterium
NRGFQ

SEQ ID NO: 910438 - protein, 8 aa, Mycobacterium
NRGGARAD

SEQ ID NO: 910439 - protein, 7 aa, Mycobacterium
NRGGATA

SEQ ID NO: 910440 - protein, 9 aa, Mycobacterium
NRGGATADD

SEQ ID NO: 910441 - protein, 13 aa, Mycobacterium
NRGGSRPRGPIPL

SEQ ID NO: 910442 - protein, 5 aa, Mycobacterium
NRGKL

SEQ ID NO: 910443 - protein, 9 aa, Mycobacterium
NRGLQSVPR

SEQ ID NO: 910444 - protein, 4 aa, Mycobacterium
NRGN

SEQ ID NO: 910445 - protein, 5 aa, Mycobacterium
NRGPN

SEQ ID NO: 910446 - protein, 8 aa, Mycobacterium
NRHGGEEH

SEQ ID NO: 910447 - protein, 4 aa, Mycobacterium
NRIA

SEQ ID NO: 910448 - protein, 8 aa, Mycobacterium
NRLDPQSR

SEQ ID NO: 910449 - protein, 9 aa, Mycobacterium
NRLPPHSPA

SEQ ID NO: 910450 - protein, 15 aa, Mycobacterium
NRNPPGDVRDTTTPH

SEQ ID NO: 910451 - protein, 7 aa, Mycobacterium
NRPEEYD

SEQ ID NO: 910452 - protein, 8 aa, Mycobacterium
NRPEPSAD

SEQ ID NO: 910453 - protein, 4 aa, Mycobacterium
NRPF

SEQ ID NO: 910454 - protein, 8 aa, Mycobacterium
NRPGALTP

SEQ ID NO: 910455 - protein, 8 aa, Mycobacterium
NRPGPTTI

SEQ ID NO: 910456 - protein, 8 aa, Mycobacterium
NRPQSFTG

SEQ ID NO: 910457 - protein, 4 aa, Mycobacterium
NRPR

SEQ ID NO: 910458 - protein, 7 aa, Mycobacterium
NRPRSFS

SEQ ID NO: 910459 - protein, 15 aa, Mycobacterium
NRPRTRTIGPDDDPE

SEQ ID NO: 910460 - protein, 6 aa, Mycobacterium
NRPTPL

SEQ ID NO: 910461 - protein, 6 aa, Mycobacterium
NRQAIT

SEQ ID NO: 910462 - protein, 14 aa, Mycobacterium
NRQDTVPADGTHPE

SEQ ID NO: 910463 - protein, 11 aa, Mycobacterium
NRQPDPSDRRS

SEQ ID NO: 910464 - protein, 8 aa, Mycobacterium
NRRAPLTK

SEQ ID NO: 910465 - protein, 9 aa, Mycobacterium
NRRCGDKDD

SEQ ID NO: 910466 - protein, 11 aa, Mycobacterium
NRSGDGELTPA

SEQ ID NO: 910467 - protein, 7 aa, Mycobacterium
NRSPQKV

SEQ ID NO: 910468 - protein, 11 aa, Mycobacterium
NRSSDVDGDTL

SEQ ID NO: 910469 - protein, 9 aa, Mycobacterium
NRSSGKQGY

SEQ ID NO: 910470 - protein, 4 aa, Mycobacterium
NRSY

SEQ ID NO: 910471 - protein, 6 aa, Mycobacterium
NRSYWE

SEQ ID NO: 910472 - protein, 10 aa, Mycobacterium
NRTAGDAEKL

SEQ ID NO: 910473 - protein, 8 aa, Mycobacterium
NRTHRNDN

SEQ ID NO: 910474 - protein, 8 aa, Mycobacterium
NRTKTPVE

SEQ ID NO: 910475 - protein, 7 aa, Mycobacterium
NRTPPSF

SEQ ID NO: 910476 - protein, 8 aa, Mycobacterium
NRTTPAYQ

SEQ ID NO: 910477 - protein, 5 aa, Mycobacterium
NRTYG

SEQ ID NO: 910478 - protein, 10 aa, Mycobacterium
NRVNQEDQSF

SEQ ID NO: 910479 - protein, 8 aa, Mycobacterium
NRVSPDSG

SEQ ID NO: 910480 - protein, 14 aa, Mycobacterium
NRWRTGTAQFRPDD

SEQ ID NO: 910481 - protein, 4 aa, Mycobacterium
NSAA

SEQ ID NO: 910482 - protein, 18 aa, Mycobacterium
NSAAMRAAQGAGSPELTS

SEQ ID NO: 910483 - protein, 4 aa, Mycobacterium
NSAE

SEQ ID NO: 910484 - protein, 5 aa, Mycobacterium
NSAEE

SEQ ID NO: 910485 - protein, 6 aa, Mycobacterium
NSAEGY

SEQ ID NO: 910486 - protein, 6 aa, Mycobacterium
NSAEKL

SEQ ID NO: 910487 - protein, 4 aa, Mycobacterium
NSAG

SEQ ID NO: 910488 - protein, 5 aa, Mycobacterium
NSAGF

SEQ ID NO: 910489 - protein, 25 aa, Mycobacterium
NSAGKAVAGKFNSDRTVYTTTEPLG

SEQ ID NO: 910490 - protein, 14 aa, Mycobacterium
NSAIHRRDPDAARA

SEQ ID NO: 910491 - protein, 4 aa, Mycobacterium
NSAN

SEQ ID NO: 910492 - protein, 68 aa, Mycobacterium
NSANQSATTPAVTKNPAPAPPAHTATAQPPPPTAEAPPPSTADTHPPATTETPSSSAPSAKPQHAPPL

SEQ ID NO: 910493 - protein, 28 aa, Mycobacterium
NSANSDAGARSVATREAPANAGAGIPRS

SEQ ID NO: 910494 - protein, 7 aa, Mycobacterium
NSAQGYK

SEQ ID NO: 910495 - protein, 28 aa, Mycobacterium
NSAQPDASSQDEINAANQQKGKSSAPDV

SEQ ID NO: 910496 - protein, 27 aa, Mycobacterium
NSAQPDASSQDEINAANQQKGRSTAPD

SEQ ID NO: 910497 - protein, 8 aa, Mycobacterium
NSASDYGG

SEQ ID NO: 910498 - protein, 8 aa, Mycobacterium
NSAVAKGA

SEQ ID NO: 910499 - protein, 18 aa, Mycobacterium
NSCGADTDDAAPAAPAGL

SEQ ID NO: 910500 - protein, 7 aa, Mycobacterium
NSCSTPI

SEQ ID NO: 910501 - protein, 24 aa, Mycobacterium
NSDGSKGPVRDAAGNPIADQVDSI

SEQ ID NO: 910502 - protein, 16 aa, Mycobacterium
NSDPPSQAAFNSNSSQ

SEQ ID NO: 910503 - protein, 13 aa, Mycobacterium
NSDPVKQRAGQKA

SEQ ID NO: 910504 - protein, 5 aa, Mycobacterium
NSEDV

SEQ ID NO: 910505 - protein, 6 aa, Mycobacterium
NSEGFA

SEQ ID NO: 910506 - protein, 8 aa, Mycobacterium
NSEGGTTT

SEQ ID NO: 910507 - protein, 6 aa, Mycobacterium
NSESLQ

SEQ ID NO: 910508 - protein, 5 aa, Mycobacterium
NSETM

SEQ ID NO: 910509 - protein, 7 aa, Mycobacterium
NSFGAEN

SEQ ID NO: 910510 - protein, 7 aa, Mycobacterium
NSGAATA

SEQ ID NO: 910511 - protein, 16 aa, Mycobacterium
NSGAGNLGFGNSGTNN

SEQ ID NO: 910512 - protein, 16 aa, Mycobacterium
NSGAGNLGFGNTGDNN

SEQ ID NO: 910513 - protein, 45 aa, Mycobacterium
NSGDGNSGFQNSNTGVSANGHSGVRNSGDATNVGFSNSGSNNTGI

SEQ ID NO: 910514 - protein, 7 aa, Mycobacterium
NSGDRER

SEQ ID NO: 910515 - protein, 32 aa, Mycobacterium
NSGDTGSNSGLHNTGGNSSGGFNTGTGQSGFF

SEQ ID NO: 910516 - protein, 8 aa, Mycobacterium
NSGDTNTG

SEQ ID NO: 910517 - protein, 19 aa, Mycobacterium
NSGDTNTGIANSGSGAFGG

SEQ ID NO: 910518 - protein, 9 aa, Mycobacterium
NSGDTNTGL

SEQ ID NO: 910519 - protein, 9 aa, Mycobacterium
NSGDTSTGL

SEQ ID NO: 910520 - protein, 11 aa, Mycobacterium
NSGERGEPRAV

SEQ ID NO: 910521 - protein, 8 aa, Mycobacterium
NSGETSVE

SEQ ID NO: 910522 - protein, 20 aa, Mycobacterium
NSGGGQYAPSAHLATKEQQI

SEQ ID NO: 910523 - protein, 9 aa, Mycobacterium
NSGGSETSR

SEQ ID NO: 910524 - protein, 14 aa, Mycobacterium
NSGITYSSSSQVIT

SEQ ID NO: 910525 - protein, 10 aa, Mycobacterium
NSGNGSSGVF

SEQ ID NO: 910526 - protein, 5 aa, Mycobacterium
NSGPI

SEQ ID NO: 910527 - protein, 8 aa, Mycobacterium
NSGPQRPE

SEQ ID NO: 910528 - protein, 7 aa, Mycobacterium
NSGSAQL

SEQ ID NO: 910529 - protein, 16 aa, Mycobacterium
NSGSGNVGIGNSGTGN

SEQ ID NO: 910530 - protein, 104 aa, Mycobacterium
NSGSPQAPQQVPGQQAGQQPQQAQQPAHGTQIPDYQTATPYTQGPGKPNPDYQAPQQNSPQQPQQGQQPQQQQPNQQQPQNKQDDTTQQLDQQQQQRQQQCQSA

SEQ ID NO: 910531 - protein, 30 aa, Mycobacterium
NSGSRPRNRADGPDHQENGYSGASHGPGSG

SEQ ID NO: 910532 - protein, 9 aa, Mycobacterium
NSGTSLPDT

SEQ ID NO: 910533 - protein, 9 aa, Mycobacterium
NSGTSLPST

SEQ ID NO: 910534 - protein, 62 aa, Mycobacterium
NSGTYNTGFSNAGETNTGWENSGNVNTGGYNSGGLNTGIGSPDTQAGPNSGFGHSGSGNSGF

SEQ ID NO: 910535 - protein, 4 aa, Mycobacterium
NSGV

SEQ ID NO: 910536 - protein, 24 aa, Mycobacterium
NSGVGSSGTLNTGWGNSGSTNTGY

SEQ ID NO: 910537 - protein, 5 aa, Mycobacterium
NSIAP

SEQ ID NO: 910538 - protein, 7 aa, Mycobacterium
NSIPGAP

SEQ ID NO: 910539 - protein, 14 aa, Mycobacterium
NSIQVTKQDNSTAA

SEQ ID NO: 910540 - protein, 11 aa, Mycobacterium
NSISASPANRV

SEQ ID NO: 910541 - protein, 7 aa, Mycobacterium
NSKAMRA

SEQ ID NO: 910542 - protein, 5 aa, Mycobacterium
NSLSG

SEQ ID NO: 910543 - protein, 7 aa, Mycobacterium
NSLSPDP

SEQ ID NO: 910544 - protein, 8 aa, Mycobacterium
NSLTGQLP

SEQ ID NO: 910545 - protein, 17 aa, Mycobacterium
NSNDDPEGACKPFDKDR

SEQ ID NO: 910546 - protein, 6 aa, Mycobacterium
NSNTPL

SEQ ID NO: 910547 - protein, 10 aa, Mycobacterium
NSPAADETIS

SEQ ID NO: 910548 - protein, 5 aa, Mycobacterium
NSPAM

SEQ ID NO: 910549 - protein, 7 aa, Mycobacterium
NSPAPVA

SEQ ID NO: 910550 - protein, 12 aa, Mycobacterium
NSPDAPSLQATK

SEQ ID NO: 910551 - protein, 9 aa, Mycobacterium
NSPDKKGEL

SEQ ID NO: 910552 - protein, 8 aa, Mycobacterium
NSPDKSKG

SEQ ID NO: 910553 - protein, 8 aa, Mycobacterium
NSPEPLRF

SEQ ID NO: 910554 - protein, 16 aa, Mycobacterium
NSPGAFSGIPGNPDLP

SEQ ID NO: 910555 - protein, 6 aa, Mycobacterium
NSPGFE

SEQ ID NO: 910556 - protein, 18 aa, Mycobacterium
NSPGGPYKDYDGYDDWQR

SEQ ID NO: 910557 - protein, 12 aa, Mycobacterium
NSPITETHAGGE

SEQ ID NO: 910558 - protein, 16 aa, Mycobacterium
NSPLAQTSGAFDPKTN

SEQ ID NO: 910559 - protein, 8 aa, Mycobacterium
NSPNNGDV

SEQ ID NO: 910560 - protein, 9 aa, Mycobacterium
NSPSNPSPL

SEQ ID NO: 910561 - protein, 8 aa, Mycobacterium
NSPSPKMG

SEQ ID NO: 910562 - protein, 13 aa, Mycobacterium
NSPTASSTAVTTD

SEQ ID NO: 910563 - protein, 16 aa, Mycobacterium
NSPTVNSSVTTGADNL

SEQ ID NO: 910564 - protein, 12 aa, Mycobacterium
NSQQRPADRSRQ

SEQ ID NO: 910565 - protein, 6 aa, Mycobacterium
NSQRDD

SEQ ID NO: 910566 - protein, 7 aa, Mycobacterium
NSQTGAV

SEQ ID NO: 910567 - protein, 4 aa, Mycobacterium
NSRA

SEQ ID NO: 910568 - protein, 8 aa, Mycobacterium
NSRATGVD

SEQ ID NO: 910569 - protein, 46 aa, Mycobacterium
NSRGSQTATPEPSPGPAPNPEPAPVEPAPEESPPATGSVAPSSGPP

SEQ ID NO: 910570 - protein, 9 aa, Mycobacterium
NSRQAAPRR

SEQ ID NO: 910571 - protein, 14 aa, Mycobacterium
NSRSTESSLRPGRL

SEQ ID NO: 910572 - protein, 9 aa, Mycobacterium
NSSATMSRP

SEQ ID NO: 910573 - protein, 9 aa, Mycobacterium
NSSATNAEY

SEQ ID NO: 910574 - protein, 12 aa, Mycobacterium
NSSAYPNTEQTL

SEQ ID NO: 910575 - protein, 5 aa, Mycobacterium
NSSDG

SEQ ID NO: 910576 - protein, 8 aa, Mycobacterium
NSSPDMQT

SEQ ID NO: 910577 - protein, 4 aa, Mycobacterium
NSSW

SEQ ID NO: 910578 - protein, 5 aa, Mycobacterium
NSTFQ

SEQ ID NO: 910579 - protein, 13 aa, Mycobacterium
NSTPDEVDNPLPY

SEQ ID NO: 910580 - protein, 8 aa, Mycobacterium
NSTPPCPE

SEQ ID NO: 910581 - protein, 12 aa, Mycobacterium
NSTTADADLSGT

SEQ ID NO: 910582 - protein, 4 aa, Mycobacterium
NSVE

SEQ ID NO: 910583 - protein, 13 aa, Mycobacterium
NSVEDPTTEGVQK

SEQ ID NO: 910584 - protein, 4 aa, Mycobacterium
NSVV

SEQ ID NO: 910585 - protein, 6 aa, Mycobacterium
NTAADQ

SEQ ID NO: 910586 - protein, 11 aa, Mycobacterium
NTAADQLRNAG

SEQ ID NO: 910587 - protein, 9 aa, Mycobacterium
NTAAPANSL

SEQ ID NO: 910588 - protein, 5 aa, Mycobacterium
NTANS

SEQ ID NO: 910589 - protein, 6 aa, Mycobacterium
NTAPPQ

SEQ ID NO: 910590 - protein, 8 aa, Mycobacterium
NTAQPANA

SEQ ID NO: 910591 - protein, 6 aa, Mycobacterium
NTASFD

SEQ ID NO: 910592 - protein, 9 aa, Mycobacterium
NTASNPGPL

SEQ ID NO: 910593 - protein, 5 aa, Mycobacterium
NTATD

SEQ ID NO: 910594 - protein, 9 aa, Mycobacterium
NTATRAPLR

SEQ ID NO: 910595 - protein, 13 aa, Mycobacterium
NTCRPPVSSTPLN

SEQ ID NO: 910596 - protein, 8 aa, Mycobacterium
NTDEAADA

SEQ ID NO: 910597 - protein, 18 aa, Mycobacterium
NTDGGLYTQPDGASDWQM

SEQ ID NO: 910598 - protein, 7 aa, Mycobacterium
NTDNGPI

SEQ ID NO: 910599 - protein, 13 aa, Mycobacterium
NTDPGSYDLRPVA

SEQ ID NO: 910600 - protein, 13 aa, Mycobacterium
NTDPNPDRRRIRN

SEQ ID NO: 910601 - protein, 9 aa, Mycobacterium
NTDSRDHAP

SEQ ID NO: 910602 - protein, 5 aa, Mycobacterium
NTEIA

SEQ ID NO: 910603 - protein, 11 aa, Mycobacterium
NTEKANEEQGY

SEQ ID NO: 910604 - protein, 18 aa, Mycobacterium
NTEKQDPETMADALGRLW

SEQ ID NO: 910605 - protein, 6 aa, Mycobacterium
NTELGA

SEQ ID NO: 910606 - protein, 9 aa, Mycobacterium
NTEVTEGGF

SEQ ID NO: 910607 - protein, 11 aa, Mycobacterium
NTFTPNPDGSV

SEQ ID NO: 910608 - protein, 9 aa, Mycobacterium
NTGAPKTTF

SEQ ID NO: 910609 - protein, 9 aa, Mycobacterium
NTGERQRAH

SEQ ID NO: 910610 - protein, 15 aa, Mycobacterium
NTGGEPLKPDNNGDW

SEQ ID NO: 910611 - protein, 13 aa, Mycobacterium
NTGGQGGTPRAVP

SEQ ID NO: 910612 - protein, 9 aa, Mycobacterium
NTGKPGAVT

SEQ ID NO: 910613 - protein, 8 aa, Mycobacterium
NTGNEEAA

SEQ ID NO: 910614 - protein, 8 aa, Mycobacterium
NTGNGYHG

SEQ ID NO: 910615 - protein, 9 aa, Mycobacterium
NTGNGYQGG

SEQ ID NO: 910616 - protein, 8 aa, Mycobacterium
NTGPVEPV

SEQ ID NO: 910617 - protein, 14 aa, Mycobacterium
NTGSFRGTDETETV

SEQ ID NO: 910618 - protein, 9 aa, Mycobacterium
NTGTPTEVR

SEQ ID NO: 910619 - protein, 6 aa, Mycobacterium
NTGVPG

SEQ ID NO: 910620 - protein, 11 aa, Mycobacterium
NTGVPGGKAAY

SEQ ID NO: 910621 - protein, 7 aa, Mycobacterium
NTGVPGV

SEQ ID NO: 910622 - protein, 10 aa, Mycobacterium
NTIDATGVGT

SEQ ID NO: 910623 - protein, 6 aa, Mycobacterium
NTINAT

SEQ ID NO: 910624 - protein, 8 aa, Mycobacterium
NTKPGQSV

SEQ ID NO: 910625 - protein, 8 aa, Mycobacterium
NTKPGQTV

SEQ ID NO: 910626 - protein, 6 aa, Mycobacterium
NTKTHG

SEQ ID NO: 910627 - protein, 5 aa, Mycobacterium
NTKTM

SEQ ID NO: 910628 - protein, 6 aa, Mycobacterium
NTLANK

SEQ ID NO: 910629 - protein, 11 aa, Mycobacterium
NTLGGGPEGAR

SEQ ID NO: 910630 - protein, 6 aa, Mycobacterium
NTLGGK

SEQ ID NO: 910631 - protein, 12 aa, Mycobacterium
NTLPEDIKSSGK

SEQ ID NO: 910632 - protein, 10 aa, Mycobacterium
NTNAANPTTR

SEQ ID NO: 910633 - protein, 10 aa, Mycobacterium
NTNAENPNTR

SEQ ID NO: 910634 - protein, 12 aa, Mycobacterium
NTNDPVCSRGTD

SEQ ID NO: 910635 - protein, 10 aa, Mycobacterium
NTNGDNPTTR

SEQ ID NO: 910636 - protein, 14 aa, Mycobacterium
NTNGRGRANQAVTG

SEQ ID NO: 910637 - protein, 6 aa, Mycobacterium
NTNLGH

SEQ ID NO: 910638 - protein, 6 aa, Mycobacterium
NTNLGS

SEQ ID NO: 910639 - protein, 8 aa, Mycobacterium
NTNLTPKQ

SEQ ID NO: 910640 - protein, 9 aa, Mycobacterium
NTNQPNPNT

SEQ ID NO: 910641 - protein, 4 aa, Mycobacterium
NTNS

SEQ ID NO: 910642 - protein, 22 aa, Mycobacterium
NTNSWVPRDPGAATPVIPGPVG

SEQ ID NO: 910643 - protein, 4 aa, Mycobacterium
NTNT

SEQ ID NO: 910644 - protein, 8 aa, Mycobacterium
NTPAIAAT

SEQ ID NO: 910645 - protein, 4 aa, Mycobacterium
NTPG

SEQ ID NO: 910646 - protein, 5 aa, Mycobacterium
NTPPS

SEQ ID NO: 910647 - protein, 9 aa, Mycobacterium
NTPQGLRAK

SEQ ID NO: 910648 - protein, 9 aa, Mycobacterium
NTQPPENEA

SEQ ID NO: 910649 - protein, 8 aa, Mycobacterium
NTQYDGKP

SEQ ID NO: 910650 - protein, 12 aa, Mycobacterium
NTSADPDTTGRA

SEQ ID NO: 910651 - protein, 10 aa, Mycobacterium
NTSAGQIDSV

SEQ ID NO: 910652 - protein, 6 aa, Mycobacterium
NTSAPW

SEQ ID NO: 910653 - protein, 5 aa, Mycobacterium
NTSET

SEQ ID NO: 910654 - protein, 5 aa, Mycobacterium
NTSGY

SEQ ID NO: 910655 - protein, 5 aa, Mycobacterium
NTSPM

SEQ ID NO: 910656 - protein, 4 aa, Mycobacterium
NTSR

SEQ ID NO: 910657 - protein, 8 aa, Mycobacterium
NTSTITNG

SEQ ID NO: 910658 - protein, 8 aa, Mycobacterium
NTTAPETA

SEQ ID NO: 910659 - protein, 22 aa, Mycobacterium
NTTAQPAQPAPPAAPAAPAQPA

SEQ ID NO: 910660 - protein, 19 aa, Mycobacterium
NTTAQPAQPAQPAQPAQPA

SEQ ID NO: 910661 - protein, 7 aa, Mycobacterium
NTTATGQ

SEQ ID NO: 910662 - protein, 6 aa, Mycobacterium
NTTGAG

SEQ ID NO: 910663 - protein, 8 aa, Mycobacterium
NTTGAKRI

SEQ ID NO: 910664 - protein, 5 aa, Mycobacterium
NTTIS

SEQ ID NO: 910665 - protein, 13 aa, Mycobacterium
NTTLQTVSDQQRD

SEQ ID NO: 910666 - protein, 6 aa, Mycobacterium
NTTSAL

SEQ ID NO: 910667 - protein, 10 aa, Mycobacterium
NTTSEPDEAV

SEQ ID NO: 910668 - protein, 12 aa, Mycobacterium
NTTSGPQDIQSV

SEQ ID NO: 910669 - protein, 13 aa, Mycobacterium
NTTSPSTCAQTTF

SEQ ID NO: 910670 - protein, 6 aa, Mycobacterium
NTTTGN

SEQ ID NO: 910671 - protein, 7 aa, Mycobacterium
NTTVSRD

SEQ ID NO: 910672 - protein, 16 aa, Mycobacterium
NTTVSRDGLATPGVDE

SEQ ID NO: 910673 - protein, 5 aa, Mycobacterium
NTVAG

SEQ ID NO: 910674 - protein, 8 aa, Mycobacterium
NTVGARGS

SEQ ID NO: 910675 - protein, 12 aa, Mycobacterium
NTVPESIKSTGT

SEQ ID NO: 910676 - protein, 9 aa, Mycobacterium
NTVQDSDGQ

SEQ ID NO: 910677 - protein, 6 aa, Mycobacterium
NTVSGD

SEQ ID NO: 910678 - protein, 9 aa, Mycobacterium
NTVTPTGVG

SEQ ID NO: 910679 - protein, 8 aa, Mycobacterium
NTWERNGG

SEQ ID NO: 910680 - protein, 6 aa, Mycobacterium
NTYPGA

SEQ ID NO: 910681 - protein, 5 aa, Mycobacterium
NVAGD

SEQ ID NO: 910682 - protein, 19 aa, Mycobacterium
NVAGQGGTYIGAGPQGSSY

SEQ ID NO: 910683 - protein, 5 aa, Mycobacterium
NVAPD

SEQ ID NO: 910684 - protein, 15 aa, Mycobacterium
NVARTGDRQAGPGRA

SEQ ID NO: 910685 - protein, 8 aa, Mycobacterium
NVDREAAG

SEQ ID NO: 910686 - protein, 6 aa, Mycobacterium
NVESGR

SEQ ID NO: 910687 - protein, 66 aa, Mycobacterium
NVETPQEVETPEADVAGGVETTDVDTTSTETKDVGTHNAVDGDSKLGIKESDTKGVTTNDTKNDAK

SEQ ID NO: 910688 - protein, 7 aa, Mycobacterium
NVGDGPQ

SEQ ID NO: 910689 - protein, 4 aa, Mycobacterium
NVGQ

SEQ ID NO: 910690 - protein, 9 aa, Mycobacterium
NVGQYRDDR

SEQ ID NO: 910691 - protein, 5 aa, Mycobacterium
NVGTE

SEQ ID NO: 910692 - protein, 10 aa, Mycobacterium
NVKSQVESGL

SEQ ID NO: 910693 - protein, 5 aa, Mycobacterium
NVPAR

SEQ ID NO: 910694 - protein, 5 aa, Mycobacterium
NVPGA

SEQ ID NO: 910695 - protein, 8 aa, Mycobacterium
NVPPADSL

SEQ ID NO: 910696 - protein, 9 aa, Mycobacterium
NVPPPAAPD

SEQ ID NO: 910697 - protein, 8 aa, Mycobacterium
NVPPTASV

SEQ ID NO: 910698 - protein, 19 aa, Mycobacterium
NVPQEAPQEFANAIIAAHA

SEQ ID NO: 910699 - protein, 9 aa, Mycobacterium
NVPTDPTQT

SEQ ID NO: 910700 - protein, 9 aa, Mycobacterium
NVRVTGRTK

SEQ ID NO: 910701 - protein, 6 aa, Mycobacterium
NVSADA

SEQ ID NO: 910702 - protein, 11 aa, Mycobacterium
NVSLSSGEQLA

SEQ ID NO: 910703 - protein, 12 aa, Mycobacterium
NVSSTNGGYPDG

SEQ ID NO: 910704 - protein, 4 aa, Mycobacterium
NVSV

SEQ ID NO: 910705 - protein, 4 aa, Mycobacterium
NVTA

SEQ ID NO: 910706 - protein, 4 aa, Mycobacterium
NVTD

SEQ ID NO: 910707 - protein, 6 aa, Mycobacterium
NVTGAP

SEQ ID NO: 910708 - protein, 11 aa, Mycobacterium
NVTGPAPVTNA

SEQ ID NO: 910709 - protein, 6 aa, Mycobacterium
NWDPTT

SEQ ID NO: 910710 - protein, 15 aa, Mycobacterium
NWTGGGSAAAAAAAQ

SEQ ID NO: 910711 - protein, 8 aa, Mycobacterium
NYNGSTPA

SEQ ID NO: 910712 - protein, 19 aa, Mycobacterium
NYNGSTPAAVVTPTSAADV

SEQ ID NO: 910713 - protein, 6 aa, Mycobacterium
NYPIPS

SEQ ID NO: 910714 - protein, 5 aa, Mycobacterium
NYRGS

SEQ ID NO: 910715 - protein, 6 aa, Mycobacterium
NYRSPM

SEQ ID NO: 910716 - protein, 5 aa, Mycobacterium
NYSRA

SEQ ID NO: 910717 - protein, 14 aa, Mycobacterium
NYSSPQWPSQEHPQ

SEQ ID NO: 910718 - protein, 8 aa, Mycobacterium
NYSTQQHG

SEQ ID NO: 910719 - protein, 45 aa, Mycobacterium
NYTGNGSGAGISEFNGNQTDFGGSDSPLSNDEAATAEQRCGGSPA

SEQ ID NO: 910720 - protein, 18 aa, Mycobacterium
NYTGREARTQTDNQYPNQ

SEQ ID NO: 910721 - protein, 11 aa, Mycobacterium
NYTPNGSGAGI

SEQ ID NO: 910722 - protein, 5 aa, Mycobacterium
NYTTP

SEQ ID NO: 910723 - protein, 5 aa, Mycobacterium
PAAAA

SEQ ID NO: 910724 - protein, 8 aa, Mycobacterium
PAAAAAAA

SEQ ID NO: 910725 - protein, 33 aa, Mycobacterium
PAAAAAPAAGLPAAAAATPGAGLVPSAPMFAAL

SEQ ID NO: 910726 - protein, 7 aa, Mycobacterium
PAAAAEI

SEQ ID NO: 910727 - protein, 22 aa, Mycobacterium
PAAAAPAGGDATDTTAALEAQG

SEQ ID NO: 910728 - protein, 6 aa, Mycobacterium
PAAAAV

SEQ ID NO: 910729 - protein, 12 aa, Mycobacterium
PAAADCTTAGAT

SEQ ID NO: 910730 - protein, 8 aa, Mycobacterium
PAAADDDR

SEQ ID NO: 910731 - protein, 10 aa, Mycobacterium
PAAADNPEWG

SEQ ID NO: 910732 - protein, 11 aa, Mycobacterium
PAAAEQGLAPA

SEQ ID NO: 910733 - protein, 7 aa, Mycobacterium
PAAAEVN

SEQ ID NO: 910734 - protein, 19 aa, Mycobacterium
PAAAGEPGAALPDAAPVPH

SEQ ID NO: 910735 - protein, 15 aa, Mycobacterium
PAAALPPPPPPGGEC

SEQ ID NO: 910736 - protein, 18 aa, Mycobacterium
PAAAPGTDCPCCGPTPAG

SEQ ID NO: 910737 - protein, 23 aa, Mycobacterium
PAAAPQAPGAPAVAPPPQLLGLQ

SEQ ID NO: 910738 - protein, 19 aa, Mycobacterium
PAAAPSSAPDLSESRQKID

SEQ ID NO: 910739 - protein, 11 aa, Mycobacterium
PAAARPSDPGV

SEQ ID NO: 910740 - protein, 12 aa, Mycobacterium
PAAASAAAPPPA

SEQ ID NO: 910741 - protein, 16 aa, Mycobacterium
PAAASPFTQPRAPLDP

SEQ ID NO: 910742 - protein, 4 aa, Mycobacterium
PAAD

SEQ ID NO: 910743 - protein, 8 aa, Mycobacterium
PAADPVSV

SEQ ID NO: 910744 - protein, 10 aa, Mycobacterium
PAADSPPWTA

SEQ ID NO: 910745 - protein, 8 aa, Mycobacterium
PAAEAAPH

SEQ ID NO: 910746 - protein, 4 aa, Mycobacterium
PAAG

SEQ ID NO: 910747 - protein, 5 aa, Mycobacterium
PAAGA

SEQ ID NO: 910748 - protein, 22 aa, Mycobacterium
PAAGATATYNPASGEVVGPGGV

SEQ ID NO: 910749 - protein, 8 aa, Mycobacterium
PAAGNGGV

SEQ ID NO: 910750 - protein, 24 aa, Mycobacterium
PAAGPGNGGPELPAPPTPAAVSAA

SEQ ID NO: 910751 - protein, 6 aa, Mycobacterium
PAAGSA

SEQ ID NO: 910752 - protein, 5 aa, Mycobacterium
PAAGY

SEQ ID NO: 910753 - protein, 11 aa, Mycobacterium
PAAHAKNGDTH

SEQ ID NO: 910754 - protein, 13 aa, Mycobacterium
PAAKGGDDCCADK

SEQ ID NO: 910755 - protein, 4 aa, Mycobacterium
PAAL

SEQ ID NO: 910756 - protein, 12 aa, Mycobacterium
PAAMPGGRGSES

SEQ ID NO: 910757 - protein, 6 aa, Mycobacterium
PAAMPK

SEQ ID NO: 910758 - protein, 7 aa, Mycobacterium
PAANADT

SEQ ID NO: 910759 - protein, 5 aa, Mycobacterium
PAANS

SEQ ID NO: 910760 - protein, 7 aa, Mycobacterium
PAAPAKA

SEQ ID NO: 910761 - protein, 17 aa, Mycobacterium
PAAPAPAPGPVPAGPLG

SEQ ID NO: 910762 - protein, 7 aa, Mycobacterium
PAAPKTA

SEQ ID NO: 910763 - protein, 6 aa, Mycobacterium
PAAPTG

SEQ ID NO: 910764 - protein, 12 aa, Mycobacterium
PAAPVTAPAPAP

SEQ ID NO: 910765 - protein, 14 aa, Mycobacterium
PAAQLPAASAEPCP

SEQ ID NO: 910766 - protein, 5 aa, Mycobacterium
PAAQQ

SEQ ID NO: 910767 - protein, 12 aa, Mycobacterium
PAARADNKRLND

SEQ ID NO: 910768 - protein, 9 aa, Mycobacterium
PAARDRGVK

SEQ ID NO: 910769 - protein, 4 aa, Mycobacterium
PAAS

SEQ ID NO: 910770 - protein, 17 aa, Mycobacterium
PAASADTVQITPANERR

SEQ ID NO: 910771 - protein, 156 aa, Mycobacterium
PAASATAPSGTGQSRPATASSPATAAPTAAAEAESEAATDAETEATPAPAAASTAEGGTEATPAGAGSRATDLPAATAAEAETEATATDAETTPVTEETPAAPAPEGTTPVSLGTPAAEGTPAVEGAPAGASAGNVATAVPPAAPAEGAPAEVADP

SEQ ID NO: 910772 - protein, 9 aa, Mycobacterium
PAASEWPNY

SEQ ID NO: 910773 - protein, 5 aa, Mycobacterium
PAATA

SEQ ID NO: 910774 - protein, 11 aa, Mycobacterium
PAATSDPRGLG

SEQ ID NO: 910775 - protein, 5 aa, Mycobacterium
PAAVP

SEQ ID NO: 910776 - protein, 4 aa, Mycobacterium
PACG

SEQ ID NO: 910777 - protein, 22 aa, Mycobacterium
PACSGKESDPASPPSSTPALTS

SEQ ID NO: 910778 - protein, 5 aa, Mycobacterium
PACTA

SEQ ID NO: 910779 - protein, 6 aa, Mycobacterium
PADAAD

SEQ ID NO: 910780 - protein, 6 aa, Mycobacterium
PADAAG

SEQ ID NO: 910781 - protein, 6 aa, Mycobacterium
PADAAQ

SEQ ID NO: 910782 - protein, 25 aa, Mycobacterium
PADADPGGWDPTLPATASAGAPGDA

SEQ ID NO: 910783 - protein, 8 aa, Mycobacterium
PADAGWAE

SEQ ID NO: 910784 - protein, 11 aa, Mycobacterium
PADAPPGTNQT

SEQ ID NO: 910785 - protein, 8 aa, Mycobacterium
PADAPTAA

SEQ ID NO: 910786 - protein, 5 aa, Mycobacterium
PADAT

SEQ ID NO: 910787 - protein, 7 aa, Mycobacterium
PADATAN

SEQ ID NO: 910788 - protein, 11 aa, Mycobacterium
PADDPVDAETV

SEQ ID NO: 910789 - protein, 4 aa, Mycobacterium
PADF

SEQ ID NO: 910790 - protein, 5 aa, Mycobacterium
PADGE

SEQ ID NO: 910791 - protein, 6 aa, Mycobacterium
PADGRL

SEQ ID NO: 910792 - protein, 11 aa, Mycobacterium
PADHGDSGSPV

SEQ ID NO: 910793 - protein, 11 aa, Mycobacterium
PADLDKAAEGV

SEQ ID NO: 910794 - protein, 17 aa, Mycobacterium
PADPEAELRQALTAILC

SEQ ID NO: 910795 - protein, 13 aa, Mycobacterium
PADPSNPNSGMGT

SEQ ID NO: 910796 - protein, 6 aa, Mycobacterium
PADPTG

SEQ ID NO: 910797 - protein, 7 aa, Mycobacterium
PADPTNI

SEQ ID NO: 910798 - protein, 15 aa, Mycobacterium
PADSAYDNGHAASDL

SEQ ID NO: 910799 - protein, 12 aa, Mycobacterium
PADTEVAQGAND

SEQ ID NO: 910800 - protein, 14 aa, Mycobacterium
PADTEVAQGANDMS

SEQ ID NO: 910801 - protein, 7 aa, Mycobacterium
PADTEVD

SEQ ID NO: 910802 - protein, 7 aa, Mycobacterium
PADTYAA

SEQ ID NO: 910803 - protein, 16 aa, Mycobacterium
PADVRAGTNPGDRAED

SEQ ID NO: 910804 - protein, 4 aa, Mycobacterium
PAEA

SEQ ID NO: 910805 - protein, 50 aa, Mycobacterium
PAEAPAPIAPTSTSTTETTTTGSAEASTSATAPAETTEPAAPSPAAEAPA

SEQ ID NO: 910806 - protein, 9 aa, Mycobacterium
PAEATPNTQ

SEQ ID NO: 910807 - protein, 15 aa, Mycobacterium
PAEDPAWAQNDPTVN

SEQ ID NO: 910808 - protein, 10 aa, Mycobacterium
PAEDTDGVSL

SEQ ID NO: 910809 - protein, 4 aa, Mycobacterium
PAEE

SEQ ID NO: 910810 - protein, 10 aa, Mycobacterium
PAEEAAEADV

SEQ ID NO: 910811 - protein, 157 aa, Mycobacterium
PAEGQAGGPGTGNGAIGGGLHGGAGGFGDVGQPTANAAPVGPAGATAAAGTGGSPAQATVHSGPAAGNGDAASVGTGVQHGGAGGGSGDGMASSHVSDGGAARAGGAANSAGGTDAAASSSGAGGGGSAGQGVASTGGDHGAGATSSASGHSPGHGV

SEQ ID NO: 910812 - protein, 11 aa, Mycobacterium
PAEHGDSGSAV

SEQ ID NO: 910813 - protein, 9 aa, Mycobacterium
PAEHTASAP

SEQ ID NO: 910814 - protein, 13 aa, Mycobacterium
PAEIAARKPTEHA

SEQ ID NO: 910815 - protein, 5 aa, Mycobacterium
PAEIP

SEQ ID NO: 910816 - protein, 4 aa, Mycobacterium
PAEL

SEQ ID NO: 910817 - protein, 13 aa, Mycobacterium
PAENSSDLKASYD

SEQ ID NO: 910818 - protein, 4 aa, Mycobacterium
PAEP

SEQ ID NO: 910819 - protein, 11 aa, Mycobacterium
PAEPATPAQAA

SEQ ID NO: 910820 - protein, 25 aa, Mycobacterium
PAERSESTPTDPVPDTDIDTTAPGA

SEQ ID NO: 910821 - protein, 10 aa, Mycobacterium
PAESGRPLDD

SEQ ID NO: 910822 - protein, 7 aa, Mycobacterium
PAESNGF

SEQ ID NO: 910823 - protein, 7 aa, Mycobacterium
PAETRPL

SEQ ID NO: 910824 - protein, 4 aa, Mycobacterium
PAEV

SEQ ID NO: 910825 - protein, 21 aa, Mycobacterium
PAEVTAPANQATFGGDADPLS

SEQ ID NO: 910826 - protein, 10 aa, Mycobacterium
PAFGARETDG

SEQ ID NO: 910827 - protein, 7 aa, Mycobacterium
PAFPRDT

SEQ ID NO: 910828 - protein, 7 aa, Mycobacterium
PAGAADA

SEQ ID NO: 910829 - protein, 26 aa, Mycobacterium
PAGAAGAAGPAVGARAPRSNRGQPAC

SEQ ID NO: 910830 - protein, 14 aa, Mycobacterium
PAGAAPEDGQWDPT

SEQ ID NO: 910831 - protein, 11 aa, Mycobacterium
PAGAASAETAI

SEQ ID NO: 910832 - protein, 12 aa, Mycobacterium
PAGAEPVNPIPG

SEQ ID NO: 910833 - protein, 6 aa, Mycobacterium
PAGALG

SEQ ID NO: 910834 - protein, 18 aa, Mycobacterium
PAGAPRESADLSASRRAI

SEQ ID NO: 910835 - protein, 14 aa, Mycobacterium
PAGATINSQHTQPA

SEQ ID NO: 910836 - protein, 8 aa, Mycobacterium
PAGDDSDI

SEQ ID NO: 910837 - protein, 8 aa, Mycobacterium
PAGEAQQL

SEQ ID NO: 910838 - protein, 5 aa, Mycobacterium
PAGEL

SEQ ID NO: 910839 - protein, 8 aa, Mycobacterium
PAGEQSSL

SEQ ID NO: 910840 - protein, 9 aa, Mycobacterium
PAGETAARR

SEQ ID NO: 910841 - protein, 6 aa, Mycobacterium
PAGETV

SEQ ID NO: 910842 - protein, 4 aa, Mycobacterium
PAGG

SEQ ID NO: 910843 - protein, 10 aa, Mycobacterium
PAGGDLATSL

SEQ ID NO: 910844 - protein, 7 aa, Mycobacterium
PAGGLSD

SEQ ID NO: 910845 - protein, 8 aa, Mycobacterium
PAGIEGSA

SEQ ID NO: 910846 - protein, 11 aa, Mycobacterium
PAGLGAGGLGS

SEQ ID NO: 910847 - protein, 9 aa, Mycobacterium
PAGLPAPKV

SEQ ID NO: 910848 - protein, 10 aa, Mycobacterium
PAGLTTPAGV

SEQ ID NO: 910849 - protein, 15 aa, Mycobacterium
PAGMPREDKGANHDN

SEQ ID NO: 910850 - protein, 10 aa, Mycobacterium
PAGMPTTGYA

SEQ ID NO: 910851 - protein, 6 aa, Mycobacterium
PAGNPL

SEQ ID NO: 910852 - protein, 8 aa, Mycobacterium
PAGPEEAL

SEQ ID NO: 910853 - protein, 8 aa, Mycobacterium
PAGPGSSV

SEQ ID NO: 910854 - protein, 7 aa, Mycobacterium
PAGPPSV

SEQ ID NO: 910855 - protein, 7 aa, Mycobacterium
PAGPTAG

SEQ ID NO: 910856 - protein, 4 aa, Mycobacterium
PAGQ

SEQ ID NO: 910857 - protein, 6 aa, Mycobacterium
PAGQQL

SEQ ID NO: 910858 - protein, 4 aa, Mycobacterium
PAGR

SEQ ID NO: 910859 - protein, 5 aa, Mycobacterium
PAGRD

SEQ ID NO: 910860 - protein, 6 aa, Mycobacterium
PAGRHL

SEQ ID NO: 910861 - protein, 9 aa, Mycobacterium
PAGRRGTAY

SEQ ID NO: 910862 - protein, 9 aa, Mycobacterium
PAGRTVVPD

SEQ ID NO: 910863 - protein, 18 aa, Mycobacterium
PAGRVAPRDPVTTGPAGA

SEQ ID NO: 910864 - protein, 14 aa, Mycobacterium
PAGSDYRNTAPKVS

SEQ ID NO: 910865 - protein, 9 aa, Mycobacterium
PAGSGGAVA

SEQ ID NO: 910866 - protein, 10 aa, Mycobacterium
PAGSGPAVAN

SEQ ID NO: 910867 - protein, 10 aa, Mycobacterium
PAGSGSAVAD

SEQ ID NO: 910868 - protein, 8 aa, Mycobacterium
PAGSNFGD

SEQ ID NO: 910869 - protein, 10 aa, Mycobacterium
PAGSRHDGGR

SEQ ID NO: 910870 - protein, 4 aa, Mycobacterium
PAGT

SEQ ID NO: 910871 - protein, 8 aa, Mycobacterium
PAGTAGSV

SEQ ID NO: 910872 - protein, 18 aa, Mycobacterium
PAGTEQTIADASGPGSIS

SEQ ID NO: 910873 - protein, 9 aa, Mycobacterium
PAGTKGEVN

SEQ ID NO: 910874 - protein, 19 aa, Mycobacterium
PAGTNGGPLVETSSTAPIG

SEQ ID NO: 910875 - protein, 6 aa, Mycobacterium
PAGTQL

SEQ ID NO: 910876 - protein, 19 aa, Mycobacterium
PAGTQLRTDAVDQGSQAGD

SEQ ID NO: 910877 - protein, 11 aa, Mycobacterium
PAGTSAGRPAV

SEQ ID NO: 910878 - protein, 5 aa, Mycobacterium
PAGTV

SEQ ID NO: 910879 - protein, 7 aa, Mycobacterium
PAGTVRT

SEQ ID NO: 910880 - protein, 9 aa, Mycobacterium
PAGVAPERG

SEQ ID NO: 910881 - protein, 9 aa, Mycobacterium
PAGVPAAGA

SEQ ID NO: 910882 - protein, 8 aa, Mycobacterium
PAGVQQAV

SEQ ID NO: 910883 - protein, 12 aa, Mycobacterium
PAGWSATKYGAA

SEQ ID NO: 910884 - protein, 13 aa, Mycobacterium
PAHADPAGNSAAD

SEQ ID NO: 910885 - protein, 16 aa, Mycobacterium
PAHADPGPEPGADDGG

SEQ ID NO: 910886 - protein, 15 aa, Mycobacterium
PAHADPQGPSGGDDA

SEQ ID NO: 910887 - protein, 7 aa, Mycobacterium
PAHAESA

SEQ ID NO: 910888 - protein, 6 aa, Mycobacterium
PAHARA

SEQ ID NO: 910889 - protein, 19 aa, Mycobacterium
PAHASNPGYSDTAPPPSPI

SEQ ID NO: 910890 - protein, 20 aa, Mycobacterium
PAHATPGEDEAPADDNNGSF

SEQ ID NO: 910891 - protein, 6 aa, Mycobacterium
PAHEDS

SEQ ID NO: 910892 - protein, 12 aa, Mycobacterium
PAHGDPDGGVDE

SEQ ID NO: 910893 - protein, 8 aa, Mycobacterium
PAHSGGEP

SEQ ID NO: 910894 - protein, 36 aa, Mycobacterium
PAHTADPTASASQAAQVAGGADASAAAGPAASIGPE

SEQ ID NO: 910895 - protein, 4 aa, Mycobacterium
PAIA

SEQ ID NO: 910896 - protein, 11 aa, Mycobacterium
PAIDGARTAGM

SEQ ID NO: 910897 - protein, 7 aa, Mycobacterium
PAIPPNV

SEQ ID NO: 910898 - protein, 6 aa, Mycobacterium
PAITDR

SEQ ID NO: 910899 - protein, 7 aa, Mycobacterium
PAKGNKI

SEQ ID NO: 910900 - protein, 4 aa, Mycobacterium
PAKL

SEQ ID NO: 910901 - protein, 12 aa, Mycobacterium
PAKRAAGRSGLS

SEQ ID NO: 910902 - protein, 6 aa, Mycobacterium
PAKTGD

SEQ ID NO: 910903 - protein, 5 aa, Mycobacterium
PAKVG

SEQ ID NO: 910904 - protein, 14 aa, Mycobacterium
PALADPADPAVPGI

SEQ ID NO: 910905 - protein, 10 aa, Mycobacterium
PALADPEDLD

SEQ ID NO: 910906 - protein, 11 aa, Mycobacterium
PALANPSDPGV

SEQ ID NO: 910907 - protein, 6 aa, Mycobacterium
PALAPH

SEQ ID NO: 910908 - protein, 15 aa, Mycobacterium
PALASPPPSNDGDVS

SEQ ID NO: 910909 - protein, 13 aa, Mycobacterium
PALGDAGQQISQS

SEQ ID NO: 910910 - protein, 5 aa, Mycobacterium
PALGG

SEQ ID NO: 910911 - protein, 9 aa, Mycobacterium
PALGTEEFA

SEQ ID NO: 910912 - protein, 12 aa, Mycobacterium
PALKADGPVPGT

SEQ ID NO: 910913 - protein, 4 aa, Mycobacterium
PALN

SEQ ID NO: 910914 - protein, 5 aa, Mycobacterium
PALPT

SEQ ID NO: 910915 - protein, 9 aa, Mycobacterium
PALRKTGGH

SEQ ID NO: 910916 - protein, 10 aa, Mycobacterium
PALRPSRGTQ

SEQ ID NO: 910917 - protein, 4 aa, Mycobacterium
PALS

SEQ ID NO: 910918 - protein, 20 aa, Mycobacterium
PALTPNDLAGRNIRSGGLTS

SEQ ID NO: 910919 - protein, 9 aa, Mycobacterium
PAMPDAGGA

SEQ ID NO: 910920 - protein, 26 aa, Mycobacterium
PANARPTGKATVGQVNPATGTATGRV

SEQ ID NO: 910921 - protein, 7 aa, Mycobacterium
PANATPF

SEQ ID NO: 910922 - protein, 20 aa, Mycobacterium
PANCPDAKPTPPASYCPGTN

SEQ ID NO: 910923 - protein, 21 aa, Mycobacterium
PANDDYHNSANAGADDAATHI

SEQ ID NO: 910924 - protein, 21 aa, Mycobacterium
PANDDYHTSASLGSDDASAHI

SEQ ID NO: 910925 - protein, 7 aa, Mycobacterium
PANEEAT

SEQ ID NO: 910926 - protein, 7 aa, Mycobacterium
PANPEMT

SEQ ID NO: 910927 - protein, 7 aa, Mycobacterium
PANPPVV

SEQ ID NO: 910928 - protein, 6 aa, Mycobacterium
PANTAL

SEQ ID NO: 910929 - protein, 6 aa, Mycobacterium
PANYTG

SEQ ID NO: 910930 - protein, 4 aa, Mycobacterium
PAPA

SEQ ID NO: 910931 - protein, 10 aa, Mycobacterium
PAPAAAKPGV

SEQ ID NO: 910932 - protein, 13 aa, Mycobacterium
PAPAAGAASNTAT

SEQ ID NO: 910933 - protein, 10 aa, Mycobacterium
PAPADAAYGA

SEQ ID NO: 910934 - protein, 15 aa, Mycobacterium
PAPAGRPRAPCPAGT

SEQ ID NO: 910935 - protein, 10 aa, Mycobacterium
PAPALAAPSN

SEQ ID NO: 910936 - protein, 44 aa, Mycobacterium
PAPAPAPAPAPAPGAPAAVAAPAPDPLAPAPNADVAPTPPEGVP

SEQ ID NO: 910937 - protein, 5 aa, Mycobacterium
PAPAR

SEQ ID NO: 910938 - protein, 19 aa, Mycobacterium
PAPATDTDTVTVTSQTANA

SEQ ID NO: 910939 - protein, 11 aa, Mycobacterium
PAPDERRAPTF

SEQ ID NO: 910940 - protein, 12 aa, Mycobacterium
PAPDLGSADPVD

SEQ ID NO: 910941 - protein, 8 aa, Mycobacterium
PAPEAVPQ

SEQ ID NO: 910942 - protein, 7 aa, Mycobacterium
PAPFDSD

SEQ ID NO: 910943 - protein, 15 aa, Mycobacterium
PAPGPAPSSCPEVGS

SEQ ID NO: 910944 - protein, 7 aa, Mycobacterium
PAPIEPD

SEQ ID NO: 910945 - protein, 8 aa, Mycobacterium
PAPIEPDP

SEQ ID NO: 910946 - protein, 6 aa, Mycobacterium
PAPKGP

SEQ ID NO: 910947 - protein, 21 aa, Mycobacterium
PAPLASPEQRRERLDRTRHHS

SEQ ID NO: 910948 - protein, 7 aa, Mycobacterium
PAPNSSV

SEQ ID NO: 910949 - protein, 13 aa, Mycobacterium
PAPPAGAGDAPIG

SEQ ID NO: 910950 - protein, 51 aa, Mycobacterium
PAPPAGFGPPPGHPDGPPPPPPGGTPPGGPPGDGQAPPPPPGVEQADWDDA

SEQ ID NO: 910951 - protein, 86 aa, Mycobacterium
PAPPPADPNAPAPAPAPAPAPAPAPAPALAPAPAPGAPAPAPAPAPAPADPNAPAPAPADPNAPAPAPAEEPPAPEPGRVDNAAGG

SEQ ID NO: 910952 - protein, 7 aa, Mycobacterium
PAPPTTW

SEQ ID NO: 910953 - protein, 12 aa, Mycobacterium
PAPQPAPGNTTD

SEQ ID NO: 910954 - protein, 8 aa, Mycobacterium
PAPQRTPP

SEQ ID NO: 910955 - protein, 13 aa, Mycobacterium
PAPQSQAASNTAT

SEQ ID NO: 910956 - protein, 4 aa, Mycobacterium
PAPR

SEQ ID NO: 910957 - protein, 9 aa, Mycobacterium
PAPRAAAGV

SEQ ID NO: 910958 - protein, 16 aa, Mycobacterium
PAPRAGRQRAPRPGVH

SEQ ID NO: 910959 - protein, 6 aa, Mycobacterium
PAPRDI

SEQ ID NO: 910960 - protein, 6 aa, Mycobacterium
PAPRPY

SEQ ID NO: 910961 - protein, 4 aa, Mycobacterium
PAPS

SEQ ID NO: 910962 - protein, 9 aa, Mycobacterium
PAPSPDARA

SEQ ID NO: 910963 - protein, 5 aa, Mycobacterium
PAPTG

SEQ ID NO: 910964 - protein, 9 aa, Mycobacterium
PAPTGSIGD

SEQ ID NO: 910965 - protein, 16 aa, Mycobacterium
PAPTTPHPRKPRPAFQ

SEQ ID NO: 910966 - protein, 9 aa, Mycobacterium
PAQAGSAKL

SEQ ID NO: 910967 - protein, 6 aa, Mycobacterium
PAQDPK

SEQ ID NO: 910968 - protein, 4 aa, Mycobacterium
PAQG

SEQ ID NO: 910969 - protein, 6 aa, Mycobacterium
PAQGTL

SEQ ID NO: 910970 - protein, 11 aa, Mycobacterium
PAQGTLSGAPA

SEQ ID NO: 910971 - protein, 12 aa, Mycobacterium
PAQGTLSGAPAL

SEQ ID NO: 910972 - protein, 7 aa, Mycobacterium
PAQGTLT

SEQ ID NO: 910973 - protein, 7 aa, Mycobacterium
PAQGTVG

SEQ ID NO: 910974 - protein, 10 aa, Mycobacterium
PAQPADARRA

SEQ ID NO: 910975 - protein, 50 aa, Mycobacterium
PAQPGFPSTPDPEIEEPQEGSAISAATVQSAAARTTASGAASARAVEQAP

SEQ ID NO: 910976 - protein, 16 aa, Mycobacterium
PAQPSAQRLHSGQTLQ

SEQ ID NO: 910977 - protein, 4 aa, Mycobacterium
PAQQ

SEQ ID NO: 910978 - protein, 22 aa, Mycobacterium
PAQRAAQLTERATGFARRFGSP

SEQ ID NO: 910979 - protein, 4 aa, Mycobacterium
PAQS

SEQ ID NO: 910980 - protein, 4 aa, Mycobacterium
PAQV

SEQ ID NO: 910981 - protein, 4 aa, Mycobacterium
PAQY

SEQ ID NO: 910982 - protein, 6 aa, Mycobacterium
PAQYAP

SEQ ID NO: 910983 - protein, 4 aa, Mycobacterium
PARA

SEQ ID NO: 910984 - protein, 5 aa, Mycobacterium
PARAA

SEQ ID NO: 910985 - protein, 23 aa, Mycobacterium
PARAAPTGGDAQATISSLEAQGN

SEQ ID NO: 910986 - protein, 7 aa, Mycobacterium
PARARAS

SEQ ID NO: 910987 - protein, 10 aa, Mycobacterium
PARKYGGSGT

SEQ ID NO: 910988 - protein, 15 aa, Mycobacterium
PARKYSGSDKVRGPD

SEQ ID NO: 910989 - protein, 17 aa, Mycobacterium
PARNERNTNKNGNPYGV

SEQ ID NO: 910990 - protein, 9 aa, Mycobacterium
PARNNNATL

SEQ ID NO: 910991 - protein, 6 aa, Mycobacterium
PARQGC

SEQ ID NO: 910992 - protein, 6 aa, Mycobacterium
PARSPA

SEQ ID NO: 910993 - protein, 4 aa, Mycobacterium
PARV

SEQ ID NO: 910994 - protein, 6 aa, Mycobacterium
PASAAE

SEQ ID NO: 910995 - protein, 7 aa, Mycobacterium
PASAGPA

SEQ ID NO: 910996 - protein, 13 aa, Mycobacterium
PASASMAAAAAPY

SEQ ID NO: 910997 - protein, 11 aa, Mycobacterium
PASATVPADGA

SEQ ID NO: 910998 - protein, 11 aa, Mycobacterium
PASDDTPSERE

SEQ ID NO: 910999 - protein, 10 aa, Mycobacterium
PASEAGTFSA

SEQ ID NO: 911000 - protein, 19 aa, Mycobacterium
PASEGNPEPLTEGASTTGK

SEQ ID NO: 911001 - protein, 18 aa, Mycobacterium
PASEIPPLPNTPSPLPAT

SEQ ID NO: 911002 - protein, 9 aa, Mycobacterium
PASETKMDR

SEQ ID NO: 911003 - protein, 4 aa, Mycobacterium
PASG

SEQ ID NO: 911004 - protein, 8 aa, Mycobacterium
PASGDTVK

SEQ ID NO: 911005 - protein, 19 aa, Mycobacterium
PASGELREAPHAEWSVRLV

SEQ ID NO: 911006 - protein, 22 aa, Mycobacterium
PASGRLTGADSGPGRLPEAEEI

SEQ ID NO: 911007 - protein, 23 aa, Mycobacterium
PASLEPFADTAAKVAGTPAELAA

SEQ ID NO: 911008 - protein, 14 aa, Mycobacterium
PASLGSQGNSNVTN

SEQ ID NO: 911009 - protein, 7 aa, Mycobacterium
PASMERG

SEQ ID NO: 911010 - protein, 5 aa, Mycobacterium
PASMG

SEQ ID NO: 911011 - protein, 11 aa, Mycobacterium
PASPASAQPCP

SEQ ID NO: 911012 - protein, 7 aa, Mycobacterium
PASPGIN

SEQ ID NO: 911013 - protein, 15 aa, Mycobacterium
PASQATFGGGADPFS

SEQ ID NO: 911014 - protein, 7 aa, Mycobacterium
PASRADY

SEQ ID NO: 911015 - protein, 8 aa, Mycobacterium
PASRADYV

SEQ ID NO: 911016 - protein, 12 aa, Mycobacterium
PASRETAGFDDP

SEQ ID NO: 911017 - protein, 11 aa, Mycobacterium
PASSAAGSCQP

SEQ ID NO: 911018 - protein, 12 aa, Mycobacterium
PASSDFSSSDFP

SEQ ID NO: 911019 - protein, 11 aa, Mycobacterium
PASSGHEGHDM

SEQ ID NO: 911020 - protein, 19 aa, Mycobacterium
PASSPAPPPPEPPPPPVRQ

SEQ ID NO: 911021 - protein, 5 aa, Mycobacterium
PASTA

SEQ ID NO: 911022 - protein, 10 aa, Mycobacterium
PASTAVDPGA

SEQ ID NO: 911023 - protein, 5 aa, Mycobacterium
PASTD

SEQ ID NO: 911024 - protein, 13 aa, Mycobacterium
PASTDFDNPAFPG

SEQ ID NO: 911025 - protein, 13 aa, Mycobacterium
PASTDFSNPNFPS

SEQ ID NO: 911026 - protein, 20 aa, Mycobacterium
PASTETSVSTSTSTSTVTTT

SEQ ID NO: 911027 - protein, 7 aa, Mycobacterium
PASTNKV

SEQ ID NO: 911028 - protein, 13 aa, Mycobacterium
PATAAADPGITNG

SEQ ID NO: 911029 - protein, 11 aa, Mycobacterium
PATAAADPTVT

SEQ ID NO: 911030 - protein, 9 aa, Mycobacterium
PATAAADSV

SEQ ID NO: 911031 - protein, 5 aa, Mycobacterium
PATAL

SEQ ID NO: 911032 - protein, 10 aa, Mycobacterium
PATAMGGAAP

SEQ ID NO: 911033 - protein, 20 aa, Mycobacterium
PATAQPSLPEAGNETPGATI

SEQ ID NO: 911034 - protein, 16 aa, Mycobacterium
PATATADPSSNVPPAA

SEQ ID NO: 911035 - protein, 7 aa, Mycobacterium
PATATSS

SEQ ID NO: 911036 - protein, 8 aa, Mycobacterium
PATDGATF

SEQ ID NO: 911037 - protein, 5 aa, Mycobacterium
PATDR

SEQ ID NO: 911038 - protein, 21 aa, Mycobacterium
PATEDWPPSASAGATDASTHV

SEQ ID NO: 911039 - protein, 7 aa, Mycobacterium
PATGAVP

SEQ ID NO: 911040 - protein, 12 aa, Mycobacterium
PATGGPPKGQVQ

SEQ ID NO: 911041 - protein, 6 aa, Mycobacterium
PATGKR

SEQ ID NO: 911042 - protein, 6 aa, Mycobacterium
PATGPR

SEQ ID NO: 911043 - protein, 10 aa, Mycobacterium
PATHGEPTKA

SEQ ID NO: 911044 - protein, 13 aa, Mycobacterium
PATHNTARAEAAH

SEQ ID NO: 911045 - protein, 5 aa, Mycobacterium
PATIR

SEQ ID NO: 911046 - protein, 8 aa, Mycobacterium
PATIRAET

SEQ ID NO: 911047 - protein, 7 aa, Mycobacterium
PATIRTE

SEQ ID NO: 911048 - protein, 9 aa, Mycobacterium
PATLPKTGS

SEQ ID NO: 911049 - protein, 16 aa, Mycobacterium
PATNGPGCAPSDYGNL

SEQ ID NO: 911050 - protein, 20 aa, Mycobacterium
PATNGPSGIRSNAPSPTGKV

SEQ ID NO: 911051 - protein, 8 aa, Mycobacterium
PATPGTPI

SEQ ID NO: 911052 - protein, 13 aa, Mycobacterium
PATPPYAVADRRR

SEQ ID NO: 911053 - protein, 7 aa, Mycobacterium
PATPTTA

SEQ ID NO: 911054 - protein, 6 aa, Mycobacterium
PATQQL

SEQ ID NO: 911055 - protein, 6 aa, Mycobacterium
PATQSQ

SEQ ID NO: 911056 - protein, 9 aa, Mycobacterium
PATRPPVLT

SEQ ID NO: 911057 - protein, 6 aa, Mycobacterium
PATSGT

SEQ ID NO: 911058 - protein, 7 aa, Mycobacterium
PATSGTL

SEQ ID NO: 911059 - protein, 8 aa, Mycobacterium
PATSPQPA

SEQ ID NO: 911060 - protein, 8 aa, Mycobacterium
PATSSDHS

SEQ ID NO: 911061 - protein, 10 aa, Mycobacterium
PATSTAWGGS

SEQ ID NO: 911062 - protein, 4 aa, Mycobacterium
PATT

SEQ ID NO: 911063 - protein, 18 aa, Mycobacterium
PATTAFATSAQAGSDDTV

SEQ ID NO: 911064 - protein, 5 aa, Mycobacterium
PATTY

SEQ ID NO: 911065 - protein, 12 aa, Mycobacterium
PATVETLKTDSN

SEQ ID NO: 911066 - protein, 18 aa, Mycobacterium
PATVTAAGQSDLQLTTSS

SEQ ID NO: 911067 - protein, 5 aa, Mycobacterium
PAVAG

SEQ ID NO: 911068 - protein, 14 aa, Mycobacterium
PAVAGPTPNESQGE

SEQ ID NO: 911069 - protein, 5 aa, Mycobacterium
PAVAS

SEQ ID NO: 911070 - protein, 5 aa, Mycobacterium
PAVEA

SEQ ID NO: 911071 - protein, 18 aa, Mycobacterium
PAVGAGTRTPLPAPDSDE

SEQ ID NO: 911072 - protein, 7 aa, Mycobacterium
PAVGSPV

SEQ ID NO: 911073 - protein, 11 aa, Mycobacterium
PAVNPSNLDAQ

SEQ ID NO: 911074 - protein, 20 aa, Mycobacterium
PAVPAAPAAPEAPAAPVAPA

SEQ ID NO: 911075 - protein, 14 aa, Mycobacterium
PAVPASAWTDEQRR

SEQ ID NO: 911076 - protein, 19 aa, Mycobacterium
PAVPGAQGLPAAPAYPVAP

SEQ ID NO: 911077 - protein, 11 aa, Mycobacterium
PAVPGTAPAAP

SEQ ID NO: 911078 - protein, 12 aa, Mycobacterium
PAVPPAEEAQRD

SEQ ID NO: 911079 - protein, 52 aa, Mycobacterium
PAVPPNTASETTPTTPPPTTDSPTPTTTVTTETTAPTETVKTTTTAPVPAPN

SEQ ID NO: 911080 - protein, 4 aa, Mycobacterium
PAVS

SEQ ID NO: 911081 - protein, 7 aa, Mycobacterium
PAVSSAQ

SEQ ID NO: 911082 - protein, 6 aa, Mycobacterium
PAVTDG

SEQ ID NO: 911083 - protein, 10 aa, Mycobacterium
PAVTGGDTTC

SEQ ID NO: 911084 - protein, 22 aa, Mycobacterium
PAVTSGPAGPAGDIDRTPPAVS

SEQ ID NO: 911085 - protein, 15 aa, Mycobacterium
PAVTTGTADPAGDID

SEQ ID NO: 911086 - protein, 9 aa, Mycobacterium
PAWQPTNAS

SEQ ID NO: 911087 - protein, 5 aa, Mycobacterium
PAWRR

SEQ ID NO: 911088 - protein, 34 aa, Mycobacterium
PAWTATSSLGAAASALPSNAAATAPGITGATPSM

SEQ ID NO: 911089 - protein, 11 aa, Mycobacterium
PAYPSGADKQV

SEQ ID NO: 911090 - protein, 9 aa, Mycobacterium
PAYRGGPTL

SEQ ID NO: 911091 - protein, 11 aa, Mycobacterium
PAYRSSGATMR

SEQ ID NO: 911092 - protein, 12 aa, Mycobacterium
PAYRSSGPTMPD

SEQ ID NO: 911093 - protein, 12 aa, Mycobacterium
PAYTERSLDAPD

SEQ ID NO: 911094 - protein, 9 aa, Mycobacterium
PAYTGGPAL

SEQ ID NO: 911095 - protein, 11 aa, Mycobacterium
PAYTGGPAMSD

SEQ ID NO: 911096 - protein, 9 aa, Mycobacterium
PAYTGGPQL

SEQ ID NO: 911097 - protein, 10 aa, Mycobacterium
PAYTGGPQLP

SEQ ID NO: 911098 - protein, 4 aa, Mycobacterium
PAYV

SEQ ID NO: 911099 - protein, 43 aa, Mycobacterium
PCAGPAAGLQPPTPVPDDGIPGQAPPIGRRPAGANDKAPLPEL

SEQ ID NO: 911100 - protein, 7 aa, Mycobacterium
PCAREGD

SEQ ID NO: 911101 - protein, 5 aa, Mycobacterium
PCGNP

SEQ ID NO: 911102 - protein, 13 aa, Mycobacterium
PCGSATRRVEDRT

SEQ ID NO: 911103 - protein, 42 aa, Mycobacterium
PCPAPPPPPPGQPYPSPPPAPPAWPPCGTGGECFPGGLPPGW

SEQ ID NO: 911104 - protein, 5 aa, Mycobacterium
PCPEG

SEQ ID NO: 911105 - protein, 19 aa, Mycobacterium
PCQAQAPVSSAVRDSTAYA

SEQ ID NO: 911106 - protein, 4 aa, Mycobacterium
PCQG

SEQ ID NO: 911107 - protein, 6 aa, Mycobacterium
PCRSPH

SEQ ID NO: 911108 - protein, 15 aa, Mycobacterium
PCSGDAANAPPPANA

SEQ ID NO: 911109 - protein, 5 aa, Mycobacterium
PDAAA

SEQ ID NO: 911110 - protein, 21 aa, Mycobacterium
PDAAADAGAGDASAAQPVHSP

SEQ ID NO: 911111 - protein, 9 aa, Mycobacterium
PDAADGDVE

SEQ ID NO: 911112 - protein, 9 aa, Mycobacterium
PDAADTTLK

SEQ ID NO: 911113 - protein, 8 aa, Mycobacterium
PDAANPSA

SEQ ID NO: 911114 - protein, 4 aa, Mycobacterium
PDAD

SEQ ID NO: 911115 - protein, 5 aa, Mycobacterium
PDADI

SEQ ID NO: 911116 - protein, 11 aa, Mycobacterium
PDADPSAPSGI

SEQ ID NO: 911117 - protein, 8 aa, Mycobacterium
PDADTPGM

SEQ ID NO: 911118 - protein, 16 aa, Mycobacterium
PDAEGDEVLGSAVITR

SEQ ID NO: 911119 - protein, 7 aa, Mycobacterium
PDAGNSD

SEQ ID NO: 911120 - protein, 8 aa, Mycobacterium
PDAHDDDV

SEQ ID NO: 911121 - protein, 8 aa, Mycobacterium
PDAKDDDV

SEQ ID NO: 911122 - protein, 16 aa, Mycobacterium
PDAKTGPGVPYRTTDP

SEQ ID NO: 911123 - protein, 15 aa, Mycobacterium
PDALNGTWQAPKPEK

SEQ ID NO: 911124 - protein, 15 aa, Mycobacterium
PDALNGTWTAPAPEK

SEQ ID NO: 911125 - protein, 19 aa, Mycobacterium
PDAPAELSGLAGSDPDRGV

SEQ ID NO: 911126 - protein, 8 aa, Mycobacterium
PDAQTPGM

SEQ ID NO: 911127 - protein, 4 aa, Mycobacterium
PDAR

SEQ ID NO: 911128 - protein, 9 aa, Mycobacterium
PDASDDDVA

SEQ ID NO: 911129 - protein, 15 aa, Mycobacterium
PDATAAMNQTNERQQ

SEQ ID NO: 911130 - protein, 16 aa, Mycobacterium
PDATPPPQAPPAGVAG

SEQ ID NO: 911131 - protein, 9 aa, Mycobacterium
PDATREQKL

SEQ ID NO: 911132 - protein, 4 aa, Mycobacterium
PDAV

SEQ ID NO: 911133 - protein, 8 aa, Mycobacterium
PDCQPSPG

SEQ ID NO: 911134 - protein, 15 aa, Mycobacterium
PDDANGACGVASDAA

SEQ ID NO: 911135 - protein, 15 aa, Mycobacterium
PDDAPGQQRRYSNPS

SEQ ID NO: 911136 - protein, 9 aa, Mycobacterium
PDDGKIPAR

SEQ ID NO: 911137 - protein, 13 aa, Mycobacterium
PDDGSADPATGWT

SEQ ID NO: 911138 - protein, 7 aa, Mycobacterium
PDDHDTW

SEQ ID NO: 911139 - protein, 12 aa, Mycobacterium
PDDHRAGAAGHP

SEQ ID NO: 911140 - protein, 4 aa, Mycobacterium
PDDL

SEQ ID NO: 911141 - protein, 7 aa, Mycobacterium
PDDLPDS

SEQ ID NO: 911142 - protein, 5 aa, Mycobacterium
PDDPG

SEQ ID NO: 911143 - protein, 14 aa, Mycobacterium
PDDPHEDPADPSVI

SEQ ID NO: 911144 - protein, 10 aa, Mycobacterium
PDDPNGACGV

SEQ ID NO: 911145 - protein, 8 aa, Mycobacterium
PDDPQGAI

SEQ ID NO: 911146 - protein, 15 aa, Mycobacterium
PDDPRSAGQRPHASR

SEQ ID NO: 911147 - protein, 9 aa, Mycobacterium
PDDTEVSAA

SEQ ID NO: 911148 - protein, 18 aa, Mycobacterium
PDDTGITNASPGATAGRI

SEQ ID NO: 911149 - protein, 28 aa, Mycobacterium
PDDVKGQRPTQEGTEVEVTGSGGDIQVN

SEQ ID NO: 911150 - protein, 4 aa, Mycobacterium
PDEA

SEQ ID NO: 911151 - protein, 7 aa, Mycobacterium
PDEASSV

SEQ ID NO: 911152 - protein, 6 aa, Mycobacterium
PDEENG

SEQ ID NO: 911153 - protein, 4 aa, Mycobacterium
PDEN

SEQ ID NO: 911154 - protein, 7 aa, Mycobacterium
PDENYAS

SEQ ID NO: 911155 - protein, 18 aa, Mycobacterium
PDEPGLNGSPAPAEPMTD

SEQ ID NO: 911156 - protein, 18 aa, Mycobacterium
PDEPRAGAGECTLQDRDG

SEQ ID NO: 911157 - protein, 10 aa, Mycobacterium
PDEPRPTAGS

SEQ ID NO: 911158 - protein, 13 aa, Mycobacterium
PDEVGTPRDDRDT

SEQ ID NO: 911159 - protein, 8 aa, Mycobacterium
PDEYRRAT

SEQ ID NO: 911160 - protein, 7 aa, Mycobacterium
PDFEDNG

SEQ ID NO: 911161 - protein, 5 aa, Mycobacterium
PDFTR

SEQ ID NO: 911162 - protein, 11 aa, Mycobacterium
PDGAAAGPGVE

SEQ ID NO: 911163 - protein, 9 aa, Mycobacterium
PDGANGGPL

SEQ ID NO: 911164 - protein, 9 aa, Mycobacterium
PDGDEPPQR

SEQ ID NO: 911165 - protein, 12 aa, Mycobacterium
PDGDLDTSTPQQ

SEQ ID NO: 911166 - protein, 8 aa, Mycobacterium
PDGEEVKA

SEQ ID NO: 911167 - protein, 15 aa, Mycobacterium
PDGEGVTSAGEAPRV

SEQ ID NO: 911168 - protein, 8 aa, Mycobacterium
PDGEYDAG

SEQ ID NO: 911169 - protein, 4 aa, Mycobacterium
PDGG

SEQ ID NO: 911170 - protein, 7 aa, Mycobacterium
PDGGASA

SEQ ID NO: 911171 - protein, 4 aa, Mycobacterium
PDGL

SEQ ID NO: 911172 - protein, 4 aa, Mycobacterium
PDGN

SEQ ID NO: 911173 - protein, 5 aa, Mycobacterium
PDGNG

SEQ ID NO: 911174 - protein, 7 aa, Mycobacterium
PDGNRPC

SEQ ID NO: 911175 - protein, 10 aa, Mycobacterium
PDGPAAGNGA

SEQ ID NO: 911176 - protein, 30 aa, Mycobacterium
PDGPAPEDAPPAPDAFAPPAPEDVPPAPEP

SEQ ID NO: 911177 - protein, 7 aa, Mycobacterium
PDGPTPT

SEQ ID NO: 911178 - protein, 7 aa, Mycobacterium
PDGPVTV

SEQ ID NO: 911179 - protein, 5 aa, Mycobacterium
PDGQL

SEQ ID NO: 911180 - protein, 17 aa, Mycobacterium
PDGRPADDQGDAPGAGL

SEQ ID NO: 911181 - protein, 21 aa, Mycobacterium
PDGRPFQDTEALTTRKLAGSQ

SEQ ID NO: 911182 - protein, 11 aa, Mycobacterium
PDGRPLSPFES

SEQ ID NO: 911183 - protein, 20 aa, Mycobacterium
PDGRPYKDSEYATLRKLTAR

SEQ ID NO: 911184 - protein, 9 aa, Mycobacterium
PDGRPYRES

SEQ ID NO: 911185 - protein, 9 aa, Mycobacterium
PDGRSGLAQ

SEQ ID NO: 911186 - protein, 5 aa, Mycobacterium
PDGRT

SEQ ID NO: 911187 - protein, 8 aa, Mycobacterium
PDGSATGV

SEQ ID NO: 911188 - protein, 8 aa, Mycobacterium
PDGSRMAS

SEQ ID NO: 911189 - protein, 8 aa, Mycobacterium
PDGSRSLG

SEQ ID NO: 911190 - protein, 12 aa, Mycobacterium
PDGSTAPSTETY

SEQ ID NO: 911191 - protein, 8 aa, Mycobacterium
PDGSTTVD

SEQ ID NO: 911192 - protein, 6 aa, Mycobacterium
PDGSYP

SEQ ID NO: 911193 - protein, 8 aa, Mycobacterium
PDGTAAPG

SEQ ID NO: 911194 - protein, 9 aa, Mycobacterium
PDGTFAGAG

SEQ ID NO: 911195 - protein, 9 aa, Mycobacterium
PDGTNGGPL

SEQ ID NO: 911196 - protein, 10 aa, Mycobacterium
PDGTPGPRKD

SEQ ID NO: 911197 - protein, 9 aa, Mycobacterium
PDGTQRPST

SEQ ID NO: 911198 - protein, 6 aa, Mycobacterium
PDGTQS

SEQ ID NO: 911199 - protein, 5 aa, Mycobacterium
PDGTR

SEQ ID NO: 911200 - protein, 8 aa, Mycobacterium
PDGTSAPG

SEQ ID NO: 911201 - protein, 7 aa, Mycobacterium
PDGTSFT

SEQ ID NO: 911202 - protein, 11 aa, Mycobacterium
PDGTTAAPGVE

SEQ ID NO: 911203 - protein, 7 aa, Mycobacterium
PDGVAGG

SEQ ID NO: 911204 - protein, 7 aa, Mycobacterium
PDHPPAD

SEQ ID NO: 911205 - protein, 5 aa, Mycobacterium
PDHPR

SEQ ID NO: 911206 - protein, 6 aa, Mycobacterium
PDHPRS

SEQ ID NO: 911207 - protein, 7 aa, Mycobacterium
PDIDPRV

SEQ ID NO: 911208 - protein, 5 aa, Mycobacterium
PDIPG

SEQ ID NO: 911209 - protein, 9 aa, Mycobacterium
PDIPGQESF

SEQ ID NO: 911210 - protein, 12 aa, Mycobacterium
PDIPTKQTGGSF

SEQ ID NO: 911211 - protein, 5 aa, Mycobacterium
PDKAE

SEQ ID NO: 911212 - protein, 5 aa, Mycobacterium
PDKGL

SEQ ID NO: 911213 - protein, 7 aa, Mycobacterium
PDKNRDF

SEQ ID NO: 911214 - protein, 23 aa, Mycobacterium
PDKRWGTSEADAPPSFGAGSSAL

SEQ ID NO: 911215 - protein, 23 aa, Mycobacterium
PDKRWGTSESSAPPSFGTGSSAV

SEQ ID NO: 911216 - protein, 6 aa, Mycobacterium
PDKVNT

SEQ ID NO: 911217 - protein, 18 aa, Mycobacterium
PDLADDPRFATNPGRCAN

SEQ ID NO: 911218 - protein, 11 aa, Mycobacterium
PDLAERAAESL

SEQ ID NO: 911219 - protein, 5 aa, Mycobacterium
PDLAR

SEQ ID NO: 911220 - protein, 7 aa, Mycobacterium
PDLEGRD

SEQ ID NO: 911221 - protein, 5 aa, Mycobacterium
PDLGS

SEQ ID NO: 911222 - protein, 13 aa, Mycobacterium
PDLLPDKAAPISV

SEQ ID NO: 911223 - protein, 6 aa, Mycobacterium
PDLPRT

SEQ ID NO: 911224 - protein, 10 aa, Mycobacterium
PDLSDSDIDE

SEQ ID NO: 911225 - protein, 18 aa, Mycobacterium
PDLSGPVNMTGPAPVTNA

SEQ ID NO: 911226 - protein, 6 aa, Mycobacterium
PDLSGS

SEQ ID NO: 911227 - protein, 9 aa, Mycobacterium
PDLTATGGS

SEQ ID NO: 911228 - protein, 5 aa, Mycobacterium
PDLVT

SEQ ID NO: 911229 - protein, 5 aa, Mycobacterium
PDNDA

SEQ ID NO: 911230 - protein, 9 aa, Mycobacterium
PDNPPLPRY

SEQ ID NO: 911231 - protein, 12 aa, Mycobacterium
PDNPWPGSGPRP

SEQ ID NO: 911232 - protein, 6 aa, Mycobacterium
PDNYTQ

SEQ ID NO: 911233 - protein, 10 aa, Mycobacterium
PDPAAKAHKR

SEQ ID NO: 911234 - protein, 5 aa, Mycobacterium
PDPAG

SEQ ID NO: 911235 - protein, 10 aa, Mycobacterium
PDPAGRATNG

SEQ ID NO: 911236 - protein, 7 aa, Mycobacterium
PDPDGAY

SEQ ID NO: 911237 - protein, 16 aa, Mycobacterium
PDPDGDEVIASATITR

SEQ ID NO: 911238 - protein, 18 aa, Mycobacterium
PDPDGDEVLGSATIAGTA

SEQ ID NO: 911239 - protein, 6 aa, Mycobacterium
PDPEQV

SEQ ID NO: 911240 - protein, 18 aa, Mycobacterium
PDPESGYPSRDAVRNDEG

SEQ ID NO: 911241 - protein, 4 aa, Mycobacterium
PDPF

SEQ ID NO: 911242 - protein, 4 aa, Mycobacterium
PDPL

SEQ ID NO: 911243 - protein, 7 aa, Mycobacterium
PDPLAAD

SEQ ID NO: 911244 - protein, 8 aa, Mycobacterium
PDPLPAGG

SEQ ID NO: 911245 - protein, 10 aa, Mycobacterium
PDPNGEQAGY

SEQ ID NO: 911246 - protein, 8 aa, Mycobacterium
PDPNGLRA

SEQ ID NO: 911247 - protein, 19 aa, Mycobacterium
PDPNGTRFPNGAPPPGPRV

SEQ ID NO: 911248 - protein, 58 aa, Mycobacterium
PDPNGTRLPNGAPPPAPPVLEGTPEHPGPAVPPGSPCSYTPANPGGNVTVGDEGLPRP

SEQ ID NO: 911249 - protein, 21 aa, Mycobacterium
PDPNNLPPGTTDVAPGDSRGV

SEQ ID NO: 911250 - protein, 7 aa, Mycobacterium
PDPRTGE

SEQ ID NO: 911251 - protein, 11 aa, Mycobacterium
PDPSGNRAGHA

SEQ ID NO: 911252 - protein, 12 aa, Mycobacterium
PDPTAHPRAGAD

SEQ ID NO: 911253 - protein, 11 aa, Mycobacterium
PDPVMPEPAGG

SEQ ID NO: 911254 - protein, 5 aa, Mycobacterium
PDQAQ

SEQ ID NO: 911255 - protein, 4 aa, Mycobacterium
PDQD

SEQ ID NO: 911256 - protein, 4 aa, Mycobacterium
PDQL

SEQ ID NO: 911257 - protein, 5 aa, Mycobacterium
PDQLR

SEQ ID NO: 911258 - protein, 50 aa, Mycobacterium
PDQRTALADPGQVPAGLPGAPGPAPEGTPPGGPPPAGAPVPGEAPPPGGV

SEQ ID NO: 911259 - protein, 4 aa, Mycobacterium
PDRA

SEQ ID NO: 911260 - protein, 5 aa, Mycobacterium
PDRAR

SEQ ID NO: 911261 - protein, 4 aa, Mycobacterium
PDRE

SEQ ID NO: 911262 - protein, 7 aa, Mycobacterium
PDRGAYD

SEQ ID NO: 911263 - protein, 5 aa, Mycobacterium
PDRPD

SEQ ID NO: 911264 - protein, 7 aa, Mycobacterium
PDRPSTV

SEQ ID NO: 911265 - protein, 8 aa, Mycobacterium
PDRTPDAA

SEQ ID NO: 911266 - protein, 4 aa, Mycobacterium
PDSA

SEQ ID NO: 911267 - protein, 9 aa, Mycobacterium
PDSADDDVD

SEQ ID NO: 911268 - protein, 20 aa, Mycobacterium
PDSARADGGFESEGDQSQYD

SEQ ID NO: 911269 - protein, 7 aa, Mycobacterium
PDSASST

SEQ ID NO: 911270 - protein, 4 aa, Mycobacterium
PDSD

SEQ ID NO: 911271 - protein, 8 aa, Mycobacterium
PDSGEFDP

SEQ ID NO: 911272 - protein, 7 aa, Mycobacterium
PDSGLGN

SEQ ID NO: 911273 - protein, 10 aa, Mycobacterium
PDSGLTTAPD

SEQ ID NO: 911274 - protein, 8 aa, Mycobacterium
PDSKSSKS

SEQ ID NO: 911275 - protein, 12 aa, Mycobacterium
PDSPLSHGNHEP

SEQ ID NO: 911276 - protein, 8 aa, Mycobacterium
PDSQQQRL

SEQ ID NO: 911277 - protein, 5 aa, Mycobacterium
PDSQR

SEQ ID NO: 911278 - protein, 4 aa, Mycobacterium
PDSR

SEQ ID NO: 911279 - protein, 26 aa, Mycobacterium
PDSRAKGLADLAGTKVSASVGSAGHG

SEQ ID NO: 911280 - protein, 33 aa, Mycobacterium
PDSRQINGQPQNIGGARNSNGIGKSCNNPGVRC

SEQ ID NO: 911281 - protein, 6 aa, Mycobacterium
PDSRRF

SEQ ID NO: 911282 - protein, 9 aa, Mycobacterium
PDSVADTTD

SEQ ID NO: 911283 - protein, 11 aa, Mycobacterium
PDTDPTGGLTA

SEQ ID NO: 911284 - protein, 6 aa, Mycobacterium
PDTGAT

SEQ ID NO: 911285 - protein, 12 aa, Mycobacterium
PDTGAVTGEPEV

SEQ ID NO: 911286 - protein, 6 aa, Mycobacterium
PDTGLG

SEQ ID NO: 911287 - protein, 4 aa, Mycobacterium
PDTI

SEQ ID NO: 911288 - protein, 7 aa, Mycobacterium
PDTKIGD

SEQ ID NO: 911289 - protein, 14 aa, Mycobacterium
PDTRAPGMPKGGYE

SEQ ID NO: 911290 - protein, 5 aa, Mycobacterium
PDTSL

SEQ ID NO: 911291 - protein, 13 aa, Mycobacterium
PDTTRIGQSVANG

SEQ ID NO: 911292 - protein, 7 aa, Mycobacterium
PDTTVTA

SEQ ID NO: 911293 - protein, 17 aa, Mycobacterium
PDTVERDLGAARDRLTG

SEQ ID NO: 911294 - protein, 5 aa, Mycobacterium
PDTYV

SEQ ID NO: 911295 - protein, 9 aa, Mycobacterium
PDVETTDIR

SEQ ID NO: 911296 - protein, 4 aa, Mycobacterium
PDVG

SEQ ID NO: 911297 - protein, 9 aa, Mycobacterium
PDVRAPGGA

SEQ ID NO: 911298 - protein, 9 aa, Mycobacterium
PDVSGQTAN

SEQ ID NO: 911299 - protein, 6 aa, Mycobacterium
PDYAWP

SEQ ID NO: 911300 - protein, 4 aa, Mycobacterium
PEAA

SEQ ID NO: 911301 - protein, 11 aa, Mycobacterium
PEAAAQDTEDV

SEQ ID NO: 911302 - protein, 6 aa, Mycobacterium
PEAAGA

SEQ ID NO: 911303 - protein, 5 aa, Mycobacterium
PEAAR

SEQ ID NO: 911304 - protein, 8 aa, Mycobacterium
PEADTPGM

SEQ ID NO: 911305 - protein, 13 aa, Mycobacterium
PEAFDDEGNYPNQ

SEQ ID NO: 911306 - protein, 7 aa, Mycobacterium
PEAFTDR

SEQ ID NO: 911307 - protein, 15 aa, Mycobacterium
PEAGEPVEQPTDSVS

SEQ ID NO: 911308 - protein, 7 aa, Mycobacterium
PEAGTRV

SEQ ID NO: 911309 - protein, 11 aa, Mycobacterium
PEAHAAAATAT

SEQ ID NO: 911310 - protein, 4 aa, Mycobacterium
PEAN

SEQ ID NO: 911311 - protein, 22 aa, Mycobacterium
PEAPAPEEAPPAPQDAPPAPEA

SEQ ID NO: 911312 - protein, 4 aa, Mycobacterium
PEAQ

SEQ ID NO: 911313 - protein, 13 aa, Mycobacterium
PEAQWTDNAPIAA

SEQ ID NO: 911314 - protein, 4 aa, Mycobacterium
PEAT

SEQ ID NO: 911315 - protein, 5 aa, Mycobacterium
PEATA

SEQ ID NO: 911316 - protein, 7 aa, Mycobacterium
PEAVGAS

SEQ ID NO: 911317 - protein, 7 aa, Mycobacterium
PECEGSN

SEQ ID NO: 911318 - protein, 5 aa, Mycobacterium
PECGL

SEQ ID NO: 911319 - protein, 8 aa, Mycobacterium
PECQPSPG

SEQ ID NO: 911320 - protein, 7 aa, Mycobacterium
PEDDKTE

SEQ ID NO: 911321 - protein, 4 aa, Mycobacterium
PEDE

SEQ ID NO: 911322 - protein, 5 aa, Mycobacterium
PEDGR

SEQ ID NO: 911323 - protein, 4 aa, Mycobacterium
PEDI

SEQ ID NO: 911324 - protein, 14 aa, Mycobacterium
PEDPDNPDGGQSYG

SEQ ID NO: 911325 - protein, 25 aa, Mycobacterium
PEDPTSTKGKPTIAAATRIVLRAFG

SEQ ID NO: 911326 - protein, 4 aa, Mycobacterium
PEEQ

SEQ ID NO: 911327 - protein, 9 aa, Mycobacterium
PEEQSSTAH

SEQ ID NO: 911328 - protein, 12 aa, Mycobacterium
PEERGGPTSTEF

SEQ ID NO: 911329 - protein, 10 aa, Mycobacterium
PEERSSTAET

SEQ ID NO: 911330 - protein, 5 aa, Mycobacterium
PEERT

SEQ ID NO: 911331 - protein, 4 aa, Mycobacterium
PEES

SEQ ID NO: 911332 - protein, 4 aa, Mycobacterium
PEEV

SEQ ID NO: 911333 - protein, 4 aa, Mycobacterium
PEFE

SEQ ID NO: 911334 - protein, 5 aa, Mycobacterium
PEGAE

SEQ ID NO: 911335 - protein, 8 aa, Mycobacterium
PEGATGGS

SEQ ID NO: 911336 - protein, 7 aa, Mycobacterium
PEGGNPT

SEQ ID NO: 911337 - protein, 11 aa, Mycobacterium
PEGHDTTPADD

SEQ ID NO: 911338 - protein, 10 aa, Mycobacterium
PEGIKTPTLQ

SEQ ID NO: 911339 - protein, 8 aa, Mycobacterium
PEGKSTKS

SEQ ID NO: 911340 - protein, 4 aa, Mycobacterium
PEGN

SEQ ID NO: 911341 - protein, 5 aa, Mycobacterium
PEGPV

SEQ ID NO: 911342 - protein, 14 aa, Mycobacterium
PEGQEVLSEAGFVA

SEQ ID NO: 911343 - protein, 10 aa, Mycobacterium
PEGSAGIERT

SEQ ID NO: 911344 - protein, 19 aa, Mycobacterium
PEGTGHQDGHQDGHQDGHS

SEQ ID NO: 911345 - protein, 5 aa, Mycobacterium
PEGTM

SEQ ID NO: 911346 - protein, 10 aa, Mycobacterium
PEGTSPRSYY

SEQ ID NO: 911347 - protein, 19 aa, Mycobacterium
PEGVAAGDYTTSAQDKPAL

SEQ ID NO: 911348 - protein, 5 aa, Mycobacterium
PEHRN

SEQ ID NO: 911349 - protein, 5 aa, Mycobacterium
PEHRS

SEQ ID NO: 911350 - protein, 9 aa, Mycobacterium
PEHTEAGPL

SEQ ID NO: 911351 - protein, 6 aa, Mycobacterium
PEIADS

SEQ ID NO: 911352 - protein, 9 aa, Mycobacterium
PEIKPSATH

SEQ ID NO: 911353 - protein, 4 aa, Mycobacterium
PEKR

SEQ ID NO: 911354 - protein, 9 aa, Mycobacterium
PEKVQPVST

SEQ ID NO: 911355 - protein, 4 aa, Mycobacterium
PELD

SEQ ID NO: 911356 - protein, 5 aa, Mycobacterium
PELPA

SEQ ID NO: 911357 - protein, 7 aa, Mycobacterium
PELPPGP

SEQ ID NO: 911358 - protein, 34 aa, Mycobacterium
PELQSTLGATPGAGPATAAAADASNGASNGTGQG

SEQ ID NO: 911359 - protein, 12 aa, Mycobacterium
PELSAAYNEFMA

SEQ ID NO: 911360 - protein, 14 aa, Mycobacterium
PEMAPVSQAAATEA

SEQ ID NO: 911361 - protein, 10 aa, Mycobacterium
PEMVPTDPTF

SEQ ID NO: 911362 - protein, 15 aa, Mycobacterium
PENGAASAGSASPAQ

SEQ ID NO: 911363 - protein, 51 aa, Mycobacterium
PENPPYATDEESEENGAENGAEDGGEDVAEDEAEPARPPVAAPTALSPRRT

SEQ ID NO: 911364 - protein, 7 aa, Mycobacterium
PENTPPE

SEQ ID NO: 911365 - protein, 5 aa, Mycobacterium
PEPET

SEQ ID NO: 911366 - protein, 5 aa, Mycobacterium
PEPFD

SEQ ID NO: 911367 - protein, 7 aa, Mycobacterium
PEPFGET

SEQ ID NO: 911368 - protein, 4 aa, Mycobacterium
PEPG

SEQ ID NO: 911369 - protein, 9 aa, Mycobacterium
PEPGKWDEK

SEQ ID NO: 911370 - protein, 5 aa, Mycobacterium
PEPGW

SEQ ID NO: 911371 - protein, 22 aa, Mycobacterium
PEPGWSKAAPAFSATEEGEGVE

SEQ ID NO: 911372 - protein, 6 aa, Mycobacterium
PEPIAT

SEQ ID NO: 911373 - protein, 10 aa, Mycobacterium
PEPKAPPENR

SEQ ID NO: 911374 - protein, 19 aa, Mycobacterium
PEPPLPPDTASQDCNPTAS

SEQ ID NO: 911375 - protein, 6 aa, Mycobacterium
PEPTDQ

SEQ ID NO: 911376 - protein, 8 aa, Mycobacterium
PEPTGLDA

SEQ ID NO: 911377 - protein, 4 aa, Mycobacterium
PEQA

SEQ ID NO: 911378 - protein, 8 aa, Mycobacterium
PEQEDDPR

SEQ ID NO: 911379 - protein, 4 aa, Mycobacterium
PEQN

SEQ ID NO: 911380 - protein, 4 aa, Mycobacterium
PERA

SEQ ID NO: 911381 - protein, 4 aa, Mycobacterium
PERE

SEQ ID NO: 911382 - protein, 9 aa, Mycobacterium
PEREPVHRD

SEQ ID NO: 911383 - protein, 4 aa, Mycobacterium
PERG

SEQ ID NO: 911384 - protein, 17 aa, Mycobacterium
PERPRRRRPRPGRVTAC

SEQ ID NO: 911385 - protein, 14 aa, Mycobacterium
PERRPGPALAGQSV

SEQ ID NO: 911386 - protein, 8 aa, Mycobacterium
PERSGRGP

SEQ ID NO: 911387 - protein, 7 aa, Mycobacterium
PERSIPP

SEQ ID NO: 911388 - protein, 7 aa, Mycobacterium
PERSLDD

SEQ ID NO: 911389 - protein, 11 aa, Mycobacterium
PESDDTPGARD

SEQ ID NO: 911390 - protein, 8 aa, Mycobacterium
PESEQSRA

SEQ ID NO: 911391 - protein, 4 aa, Mycobacterium
PESG

SEQ ID NO: 911392 - protein, 6 aa, Mycobacterium
PESGEF

SEQ ID NO: 911393 - protein, 15 aa, Mycobacterium
PESIRATSDAADALT

SEQ ID NO: 911394 - protein, 5 aa, Mycobacterium
PESYG

SEQ ID NO: 911395 - protein, 10 aa, Mycobacterium
PETGAEPVTG

SEQ ID NO: 911396 - protein, 10 aa, Mycobacterium
PETGAQPVTG

SEQ ID NO: 911397 - protein, 12 aa, Mycobacterium
PETGAVTGDPEV

SEQ ID NO: 911398 - protein, 7 aa, Mycobacterium
PETGGLY

SEQ ID NO: 911399 - protein, 10 aa, Mycobacterium
PETGPQPVTG

SEQ ID NO: 911400 - protein, 28 aa, Mycobacterium
PETGQNARIGTSSDINPRDPATLRDGGD

SEQ ID NO: 911401 - protein, 31 aa, Mycobacterium; identical to SEQ ID NO: 41048

SEQ ID NO: 911402 - protein, 5 aa, Mycobacterium
PETNV

SEQ ID NO: 911403 - protein, 19 aa, Mycobacterium
PEVAEDPRFASNTQRVANR

SEQ ID NO: 911404 - protein, 15 aa, Mycobacterium
PEVESGSTPGYQPYP

SEQ ID NO: 911405 - protein, 14 aa, Mycobacterium
PEVGPGVSAETREL

SEQ ID NO: 911406 - protein, 11 aa, Mycobacterium
PEVNNGPGKGF

SEQ ID NO: 911407 - protein, 8 aa, Mycobacterium
PEVSPEEM

SEQ ID NO: 911408 - protein, 8 aa, Mycobacterium
PEVSSENG

SEQ ID NO: 911409 - protein, 13 aa, Mycobacterium
PEWADASDSHYVR

SEQ ID NO: 911410 - protein, 5 aa, Mycobacterium
PEWKG

SEQ ID NO: 911411 - protein, 5 aa, Mycobacterium
PEYQG

SEQ ID NO: 911412 - protein, 5 aa, Mycobacterium
PFESE

SEQ ID NO: 911413 - protein, 5 aa, Mycobacterium
PFGPS

SEQ ID NO: 911414 - protein, 13 aa, Mycobacterium
PFGPTADTSPDDF

SEQ ID NO: 911415 - protein, 5 aa, Mycobacterium
PFGQR

SEQ ID NO: 911416 - protein, 11 aa, Mycobacterium
PFKPLPPGSRL

SEQ ID NO: 911417 - protein, 13 aa, Mycobacterium
PFNATDSVSDPTL

SEQ ID NO: 911418 - protein, 7 aa, Mycobacterium
PFPGTDG

SEQ ID NO: 911419 - protein, 6 aa, Mycobacterium
PFPPNA

SEQ ID NO: 911420 - protein, 11 aa, Mycobacterium
PFPTKAEADAA

SEQ ID NO: 911421 - protein, 11 aa, Mycobacterium
PFPTKAQADAA

SEQ ID NO: 911422 - protein, 7 aa, Mycobacterium
PFPYPRN

SEQ ID NO: 911423 - protein, 12 aa, Mycobacterium
PFRSRADAADTA

SEQ ID NO: 911424 - protein, 4 aa, Mycobacterium
PFSE

SEQ ID NO: 911425 - protein, 5 aa, Mycobacterium
PFSEE

SEQ ID NO: 911426 - protein, 16 aa, Mycobacterium
PFSPGGPTAAVPPGAW

SEQ ID NO: 911427 - protein, 8 aa, Mycobacterium
PFSRGTEE

SEQ ID NO: 911428 - protein, 9 aa, Mycobacterium
PFTAQSPSR

SEQ ID NO: 911429 - protein, 9 aa, Mycobacterium
PFTGRRGGE

SEQ ID NO: 911430 - protein, 11 aa, Mycobacterium
PFTPATPVARA

SEQ ID NO: 911431 - protein, 13 aa, Mycobacterium
PFTPEQRARREAE

SEQ ID NO: 911432 - protein, 13 aa, Mycobacterium
PFVPPGSLGYWRA

SEQ ID NO: 911433 - protein, 21 aa, Mycobacterium
PGAAENTVAADVSDADAVSRA

SEQ ID NO: 911434 - protein, 4 aa, Mycobacterium
PGAD

SEQ ID NO: 911435 - protein, 6 aa, Mycobacterium
PGADKP

SEQ ID NO: 911436 - protein, 7 aa, Mycobacterium
PGADPNC

SEQ ID NO: 911437 - protein, 14 aa, Mycobacterium
PGADVDRPVLNVPV

SEQ ID NO: 911438 - protein, 9 aa, Mycobacterium
PGAEGPDGS

SEQ ID NO: 911439 - protein, 11 aa, Mycobacterium
PGAGPGGGRRW

SEQ ID NO: 911440 - protein, 7 aa, Mycobacterium
PGAGSGW

SEQ ID NO: 911441 - protein, 8 aa, Mycobacterium
PGAGTARA

SEQ ID NO: 911442 - protein, 14 aa, Mycobacterium
PGAGVDRPIPEVPV

SEQ ID NO: 911443 - protein, 6 aa, Mycobacterium
PGAIGG

SEQ ID NO: 911444 - protein, 6 aa, Mycobacterium
PGAISG

SEQ ID NO: 911445 - protein, 7 aa, Mycobacterium
PGAPAAG

SEQ ID NO: 911446 - protein, 6 aa, Mycobacterium
PGAPDM

SEQ ID NO: 911447 - protein, 11 aa, Mycobacterium
PGAPKVSPSNI

SEQ ID NO: 911448 - protein, 10 aa, Mycobacterium
PGAPNNANLV

SEQ ID NO: 911449 - protein, 9 aa, Mycobacterium
PGAPPGEMT

SEQ ID NO: 911450 - protein, 15 aa, Mycobacterium
PGAPPIVPPNVPSSV

SEQ ID NO: 911451 - protein, 20 aa, Mycobacterium
PGAPPPPPPPPPPPPPPGTP

SEQ ID NO: 911452 - protein, 22 aa, Mycobacterium
PGAPTPPVLEDPHGQPPAPAET

SEQ ID NO: 911453 - protein, 12 aa, Mycobacterium
PGAPTVTSPAAL

SEQ ID NO: 911454 - protein, 4 aa, Mycobacterium
PGAR

SEQ ID NO: 911455 - protein, 10 aa, Mycobacterium
PGARPGNGRR

SEQ ID NO: 911456 - protein, 12 aa, Mycobacterium
PGARRSAPVQQQ

SEQ ID NO: 911457 - protein, 4 aa, Mycobacterium
PGAS

SEQ ID NO: 911458 - protein, 5 aa, Mycobacterium
PGASA

SEQ ID NO: 911459 - protein, 9 aa, Mycobacterium
PGASAHGAR

SEQ ID NO: 911460 - protein, 11 aa, Mycobacterium
PGASARADEQV

SEQ ID NO: 911461 - protein, 10 aa, Mycobacterium
PGASLSENEL

SEQ ID NO: 911462 - protein, 5 aa, Mycobacterium
PGASP

SEQ ID NO: 911463 - protein, 5 aa, Mycobacterium
PGAST

SEQ ID NO: 911464 - protein, 36 aa, Mycobacterium
PGATALGNGNVTTVPAGNTTTVPQTAPAAPASPLTG

SEQ ID NO: 911465 - protein, 14 aa, Mycobacterium
PGATNRGNVPSYDA

SEQ ID NO: 911466 - protein, 23 aa, Mycobacterium
PGATSRAGPAETTITAGPAGTTI

SEQ ID NO: 911467 - protein, 6 aa, Mycobacterium
PGAVPD

SEQ ID NO: 911468 - protein, 9 aa, Mycobacterium
PGCPAGPEE

SEQ ID NO: 911469 - protein, 4 aa, Mycobacterium
PGDA

SEQ ID NO: 911470 - protein, 7 aa, Mycobacterium
PGDCGRD

SEQ ID NO: 911471 - protein, 17 aa, Mycobacterium
PGDDYRDGEGTDTRNYG

SEQ ID NO: 911472 - protein, 13 aa, Mycobacterium
PGDIGGKTGYTNL

SEQ ID NO: 911473 - protein, 11 aa, Mycobacterium
PGDKVTKGQQI

SEQ ID NO: 911474 - protein, 8 aa, Mycobacterium
PGDSSAQR

SEQ ID NO: 911475 - protein, 7 aa, Mycobacterium
PGDTAEK

SEQ ID NO: 911476 - protein, 20 aa, Mycobacterium
PGDYGGRRSRSRHSTEYRDH

SEQ ID NO: 911477 - protein, 7 aa, Mycobacterium
PGEASTD

SEQ ID NO: 911478 - protein, 9 aa, Mycobacterium
PGEAVNRAE

SEQ ID NO: 911479 - protein, 4 aa, Mycobacterium
PGEG

SEQ ID NO: 911480 - protein, 10 aa, Mycobacterium
PGEGETAEQF

SEQ ID NO: 911481 - protein, 7 aa, Mycobacterium
PGEPTTI

SEQ ID NO: 911482 - protein, 16 aa, Mycobacterium
PGEQDPDLRARGESAM

SEQ ID NO: 911483 - protein, 17 aa, Mycobacterium
PGEQGLTVGPATESLLT

SEQ ID NO: 911484 - protein, 10 aa, Mycobacterium
PGETAADYDT

SEQ ID NO: 911485 - protein, 4 aa, Mycobacterium
PGEV

SEQ ID NO: 911486 - protein, 10 aa, Mycobacterium
PGFDPNIPGN

SEQ ID NO: 911487 - protein, 6 aa, Mycobacterium
PGFHGQ

SEQ ID NO: 911488 - protein, 7 aa, Mycobacterium
PGFPPTA

SEQ ID NO: 911489 - protein, 4 aa, Mycobacterium
PGFT

SEQ ID NO: 911490 - protein, 8 aa, Mycobacterium
PGFTATDT

SEQ ID NO: 911491 - protein, 11 aa, Mycobacterium
PGGAASTAGVP

SEQ ID NO: 911492 - protein, 8 aa, Mycobacterium
PGGAPIPQ

SEQ ID NO: 911493 - protein, 6 aa, Mycobacterium
PGGDPT

SEQ ID NO: 911494 - protein, 4 aa, Mycobacterium
PGGE

SEQ ID NO: 911495 - protein, 5 aa, Mycobacterium
PGGEI

SEQ ID NO: 911496 - protein, 6 aa, Mycobacterium
PGGEQW

SEQ ID NO: 911497 - protein, 5 aa, Mycobacterium
PGGFA

SEQ ID NO: 911498 - protein, 5 aa, Mycobacterium
PGGFG

SEQ ID NO: 911499 - protein, 11 aa, Mycobacterium
PGGGGGGDRAT

SEQ ID NO: 911500 - protein, 12 aa, Mycobacterium
PGGGTAPSTDTY

SEQ ID NO: 911501 - protein, 4 aa, Mycobacterium
PGGI

SEQ ID NO: 911502 - protein, 5 aa, Mycobacterium
PGGLN

SEQ ID NO: 911503 - protein, 6 aa, Mycobacterium
PGGLPA

SEQ ID NO: 911504 - protein, 5 aa, Mycobacterium
PGGLR

SEQ ID NO: 911505 - protein, 10 aa, Mycobacterium
PGGLRTSYEP

SEQ ID NO: 911506 - protein, 9 aa, Mycobacterium
PGGLRTTYE

SEQ ID NO: 911507 - protein, 10 aa, Mycobacterium
PGGLRTTYEP

SEQ ID NO: 911508 - protein, 4 aa, Mycobacterium
PGGM

SEQ ID NO: 911509 - protein, 17 aa, Mycobacterium
PGGNFAAAASSVSGRGM

SEQ ID NO: 911510 - protein, 8 aa, Mycobacterium
PGGNNDDL

SEQ ID NO: 911511 - protein, 10 aa, Mycobacterium
PGGNPQEGPF

SEQ ID NO: 911512 - protein, 22 aa, Mycobacterium
PGGNWSSYPAHKHDENTDVETQ

SEQ ID NO: 911513 - protein, 10 aa, Mycobacterium
PGGPGESGIE

SEQ ID NO: 911514 - protein, 11 aa, Mycobacterium
PGGPGQSGIEA

SEQ ID NO: 911515 - protein, 5 aa, Mycobacterium
PGGQT

SEQ ID NO: 911516 - protein, 6 aa, Mycobacterium
PGGQTQ

SEQ ID NO: 911517 - protein, 4 aa, Mycobacterium
PGGS

SEQ ID NO: 911518 - protein, 9 aa, Mycobacterium
PGGSATGGF

SEQ ID NO: 911519 - protein, 20 aa, Mycobacterium
PGGSFAGAASSISGRGMSPQ

SEQ ID NO: 911520 - protein, 11 aa, Mycobacterium
PGGSGEPTAQD

SEQ ID NO: 911521 - protein, 8 aa, Mycobacterium
PGGSPDTL

SEQ ID NO: 911522 - protein, 10 aa, Mycobacterium
PGGTIAGATQ

SEQ ID NO: 911523 - protein, 5 aa, Mycobacterium
PGGTP

SEQ ID NO: 911524 - protein, 10 aa, Mycobacterium
PGGTPIPQQS

SEQ ID NO: 911525 - protein, 4 aa, Mycobacterium
PGGV

SEQ ID NO: 911526 - protein, 12 aa, Mycobacterium
PGGVDYDAGTGH

SEQ ID NO: 911527 - protein, 8 aa, Mycobacterium
PGGVESAG

SEQ ID NO: 911528 - protein, 16 aa, Mycobacterium
PGGVNTELGSHNSSAI

SEQ ID NO: 911529 - protein, 8 aa, Mycobacterium
PGGWPGFP

SEQ ID NO: 911530 - protein, 7 aa, Mycobacterium
PGHDGPM

SEQ ID NO: 911531 - protein, 23 aa, Mycobacterium
PGHGPKTTIGHERRTNPFLEGLT

SEQ ID NO: 911532 - protein, 4 aa, Mycobacterium
PGHP

SEQ ID NO: 911533 - protein, 5 aa, Mycobacterium
PGHSV

SEQ ID NO: 911534 - protein, 7 aa, Mycobacterium
PGHTDVP

SEQ ID NO: 911535 - protein, 7 aa, Mycobacterium
PGIDPAK

SEQ ID NO: 911536 - protein, 4 aa, Mycobacterium
PGIG

SEQ ID NO: 911537 - protein, 14 aa, Mycobacterium
PGISTTDARTKGFE

SEQ ID NO: 911538 - protein, 4 aa, Mycobacterium
PGIT

SEQ ID NO: 911539 - protein, 4 aa, Mycobacterium
PGIY

SEQ ID NO: 911540 - protein, 6 aa, Mycobacterium
PGKESH

SEQ ID NO: 911541 - protein, 10 aa, Mycobacterium
PGKIEGNKLS

SEQ ID NO: 911542 - protein, 7 aa, Mycobacterium
PGKLKTS

SEQ ID NO: 911543 - protein, 5 aa, Mycobacterium
PGKPE

SEQ ID NO: 911544 - protein, 9 aa, Mycobacterium
PGKRAPSAA

SEQ ID NO: 911545 - protein, 5 aa, Mycobacterium
PGKTA

SEQ ID NO: 911546 - protein, 45 aa, Mycobacterium
PGKTEATAKKAQKAVGKAPAKKAPAKKAPAKKAPAKKAAAKKVTQ

SEQ ID NO: 911547 - protein, 5 aa, Mycobacterium
PGLAA

SEQ ID NO: 911548 - protein, 13 aa, Mycobacterium
PGLAPASPGTDPI

SEQ ID NO: 911549 - protein, 20 aa, Mycobacterium
PGLAPGGGGTPPAPAEIPPA

SEQ ID NO: 911550 - protein, 56 aa, Mycobacterium
PGLAPGGGGTPSAPAELPPAVSAYTGAGDVPPPAGWADPPQPPGAYTPNGLPAERH

SEQ ID NO: 911551 - protein, 152 aa, Mycobacterium
PGLGGGGLGSLGGANPALTSPGGLTTPGGLTSPSSSLTNPALTNPGLTSPSGSTTPSLTDPALTNPGLTNPAAPASTPGLTPAAGTGATGVNPALTDPAAGLTSPGGEVPITPNPALGTGLTNPALADPSLAGLGTPTGLGGGSGLGGGSSL

SEQ ID NO: 911552 - protein, 14 aa, Mycobacterium
PGLGPKEYWGQALF

SEQ ID NO: 911553 - protein, 5 aa, Mycobacterium
PGLNT

SEQ ID NO: 911554 - protein, 12 aa, Mycobacterium
PGLPANSQLRPG

SEQ ID NO: 911555 - protein, 7 aa, Mycobacterium
PGLPPRS

SEQ ID NO: 911556 - protein, 24 aa, Mycobacterium
PGLPVPGAAPAAPANQPQTLLAAL

SEQ ID NO: 911557 - protein, 4 aa, Mycobacterium
PGLR

SEQ ID NO: 911558 - protein, 8 aa, Mycobacterium
PGLSGGIG

SEQ ID NO: 911559 - protein, 5 aa, Mycobacterium
PGLTG

SEQ ID NO: 911560 - protein, 5 aa, Mycobacterium
PGLTP

SEQ ID NO: 911561 - protein, 13 aa, Mycobacterium
PGLVGDRDAAGKT

SEQ ID NO: 911562 - protein, 12 aa, Mycobacterium
PGMATADTADDA

SEQ ID NO: 911563 - protein, 7 aa, Mycobacterium
PGMDKPS

SEQ ID NO: 911564 - protein, 5 aa, Mycobacterium
PGMPA

SEQ ID NO: 911565 - protein, 7 aa, Mycobacterium
PGMPQGV

SEQ ID NO: 911566 - protein, 9 aa, Mycobacterium
PGMRPDPSQ

SEQ ID NO: 911567 - protein, 4 aa, Mycobacterium
PGMS

SEQ ID NO: 911568 - protein, 31 aa, Mycobacterium
PGMSGTPGMPGVPGVGGVGASPLLGGDAGDV

SEQ ID NO: 911569 - protein, 5 aa, Mycobacterium
PGMSS

SEQ ID NO: 911570 - protein, 4 aa, Mycobacterium
PGMT

SEQ ID NO: 911571 - protein, 12 aa, Mycobacterium
PGNAELHSTPNR

SEQ ID NO: 911572 - protein, 4 aa, Mycobacterium
PGNI

SEQ ID NO: 911573 - protein, 4 aa, Mycobacterium
PGNL

SEQ ID NO: 911574 - protein, 7 aa, Mycobacterium
PGNLPDA

SEQ ID NO: 911575 - protein, 8 aa, Mycobacterium
PGNPKGIG

SEQ ID NO: 911576 - protein, 5 aa, Mycobacterium
PGNPV

SEQ ID NO: 911577 - protein, 18 aa, Mycobacterium
PGNTEQLHDGGPSAARTA

SEQ ID NO: 911578 - protein, 11 aa, Mycobacterium
PGPAGPDGNYK

SEQ ID NO: 911579 - protein, 14 aa, Mycobacterium
PGPAPDGVGVAFSC

SEQ ID NO: 911580 - protein, 12 aa, Mycobacterium
PGPAPGEDPAAR

SEQ ID NO: 911581 - protein, 6 aa, Mycobacterium
PGPAQD

SEQ ID NO: 911582 - protein, 6 aa, Mycobacterium
PGPATA

SEQ ID NO: 911583 - protein, 8 aa, Mycobacterium
PGPATAPA

SEQ ID NO: 911584 - protein, 19 aa, Mycobacterium
PGPGLPKPDPRDATPPYAA

SEQ ID NO: 911585 - protein, 12 aa, Mycobacterium
PGPGSVQQGAQD

SEQ ID NO: 911586 - protein, 7 aa, Mycobacterium
PGPNGPQ

SEQ ID NO: 911587 - protein, 7 aa, Mycobacterium
PGPNNQQ

SEQ ID NO: 911588 - protein, 16 aa, Mycobacterium
PGPPPAPAPAPPAPTV

SEQ ID NO: 911589 - protein, 20 aa, Mycobacterium
PGPPPVPDVSPTNPDAPARY

SEQ ID NO: 911590 - protein, 6 aa, Mycobacterium
PGPPVA

SEQ ID NO: 911591 - protein, 7 aa, Mycobacterium
PGPQGSL

SEQ ID NO: 911592 - protein, 6 aa, Mycobacterium
PGPSAV

SEQ ID NO: 911593 - protein, 8 aa, Mycobacterium
PGPSDDYW

SEQ ID NO: 911594 - protein, 4 aa, Mycobacterium
PGPT

SEQ ID NO: 911595 - protein, 5 aa, Mycobacterium
PGPTV

SEQ ID NO: 911596 - protein, 5 aa, Mycobacterium
PGPVD

SEQ ID NO: 911597 - protein, 6 aa, Mycobacterium
PGPVIG

SEQ ID NO: 911598 - protein, 4 aa, Mycobacterium
PGQA

SEQ ID NO: 911599 - protein, 35 aa, Mycobacterium
PGQAPVYAGSGYSAVSGDDEVASLPPNSDEPDPEV

SEQ ID NO: 911600 - protein, 6 aa, Mycobacterium
PGQATR

SEQ ID NO: 911601 - protein, 21 aa, Mycobacterium
PGQDPTNDPTLPWPPDRRQID

SEQ ID NO: 911602 - protein, 4 aa, Mycobacterium
PGQE

SEQ ID NO: 911603 - protein, 7 aa, Mycobacterium
PGQENAD

SEQ ID NO: 911604 - protein, 11 aa, Mycobacterium
PGQETGGTPAT

SEQ ID NO: 911605 - protein, 5 aa, Mycobacterium
PGQKK

SEQ ID NO: 911606 - protein, 5 aa, Mycobacterium
PGQPV

SEQ ID NO: 911607 - protein, 6 aa, Mycobacterium
PGQRAL

SEQ ID NO: 911608 - protein, 7 aa, Mycobacterium
PGQRAMG

SEQ ID NO: 911609 - protein, 18 aa, Mycobacterium
PGQRIDPAGPLRFNPWWR

SEQ ID NO: 911610 - protein, 6 aa, Mycobacterium
PGQTSH

SEQ ID NO: 911611 - protein, 4 aa, Mycobacterium
PGQV

SEQ ID NO: 911612 - protein, 11 aa, Mycobacterium
PGRAKVDSGGV

SEQ ID NO: 911613 - protein, 4 aa, Mycobacterium
PGRE

SEQ ID NO: 911614 - protein, 13 aa, Mycobacterium
PGRGGGFSLESPE

SEQ ID NO: 911615 - protein, 8 aa, Mycobacterium
PGRGPRRY

SEQ ID NO: 911616 - protein, 9 aa, Mycobacterium
PGRISTPMQ

SEQ ID NO: 911617 - protein, 4 aa, Mycobacterium
PGRL

SEQ ID NO: 911618 - protein, 6 aa, Mycobacterium
PGRNAE

SEQ ID NO: 911619 - protein, 7 aa, Mycobacterium
PGRNAEL

SEQ ID NO: 911620 - protein, 8 aa, Mycobacterium
PGRNPRAD

SEQ ID NO: 911621 - protein, 6 aa, Mycobacterium
PGRPAR

SEQ ID NO: 911622 - protein, 6 aa, Mycobacterium
PGRQQE

SEQ ID NO: 911623 - protein, 9 aa, Mycobacterium
PGRTDSDMQ

SEQ ID NO: 911624 - protein, 13 aa, Mycobacterium
PGRTGRGIPIPPG

SEQ ID NO: 911625 - protein, 10 aa, Mycobacterium
PGRYSTDVPG

SEQ ID NO: 911626 - protein, 9 aa, Mycobacterium
PGSADPNGY

SEQ ID NO: 911627 - protein, 5 aa, Mycobacterium
PGSAG

SEQ ID NO: 911628 - protein, 5 aa, Mycobacterium
PGSDG

SEQ ID NO: 911629 - protein, 8 aa, Mycobacterium
PGSDPSVA

SEQ ID NO: 911630 - protein, 7 aa, Mycobacterium
PGSDRTS

SEQ ID NO: 911631 - protein, 7 aa, Mycobacterium
PGSIDTE

SEQ ID NO: 911632 - protein, 7 aa, Mycobacterium
PGSISSE

SEQ ID NO: 911633 - protein, 6 aa, Mycobacterium
PGSLSR

SEQ ID NO: 911634 - protein, 8 aa, Mycobacterium
PGSPAPSI

SEQ ID NO: 911635 - protein, 9 aa, Mycobacterium
PGSRQKSVS

SEQ ID NO: 911636 - protein, 7 aa, Mycobacterium
PGSSASG

SEQ ID NO: 911637 - protein, 19 aa, Mycobacterium
PGSSIGLDASSTHPSTEQT

SEQ ID NO: 911638 - protein, 10 aa, Mycobacterium
PGSSTHGARY

SEQ ID NO: 911639 - protein, 4 aa, Mycobacterium
PGTA

SEQ ID NO: 911640 - protein, 21 aa, Mycobacterium
PGTAGTANAEPPIEGAAPPCP

SEQ ID NO: 911641 - protein, 7 aa, Mycobacterium
PGTAKRT

SEQ ID NO: 911642 - protein, 5 aa, Mycobacterium
PGTAL

SEQ ID NO: 911643 - protein, 6 aa, Mycobacterium
PGTAPL

SEQ ID NO: 911644 - protein, 16 aa, Mycobacterium
PGTENIEGRQIPNDDN

SEQ ID NO: 911645 - protein, 7 aa, Mycobacterium
PGTGAHP

SEQ ID NO: 911646 - protein, 8 aa, Mycobacterium
PGTGSDDD

SEQ ID NO: 911647 - protein, 5 aa, Mycobacterium
PGTIG

SEQ ID NO: 911648 - protein, 11 aa, Mycobacterium
PGTIQPTPGLE

SEQ ID NO: 911649 - protein, 12 aa, Mycobacterium
PGTQGQGQGSYT

SEQ ID NO: 911650 - protein, 6 aa, Mycobacterium
PGTQSQ

SEQ ID NO: 911651 - protein, 11 aa, Mycobacterium
PGTQTSDSTLN

SEQ ID NO: 911652 - protein, 4 aa, Mycobacterium
PGTR

SEQ ID NO: 911653 - protein, 9 aa, Mycobacterium
PGTSLDPHG

SEQ ID NO: 911654 - protein, 14 aa, Mycobacterium
PGTTEDGYLGRSLL

SEQ ID NO: 911655 - protein, 10 aa, Mycobacterium
PGTTGPEAEE

SEQ ID NO: 911656 - protein, 5 aa, Mycobacterium
PGTTP

SEQ ID NO: 911657 - protein, 6 aa, Mycobacterium
PGTTPL

SEQ ID NO: 911658 - protein, 6 aa, Mycobacterium
PGTTRT

SEQ ID NO: 911659 - protein, 5 aa, Mycobacterium
PGTTV

SEQ ID NO: 911660 - protein, 9 aa, Mycobacterium
PGTVGQGDQ

SEQ ID NO: 911661 - protein, 11 aa, Mycobacterium
PGVAPGRPAKV

SEQ ID NO: 911662 - protein, 10 aa, Mycobacterium
PGVDDGPPAD

SEQ ID NO: 911663 - protein, 11 aa, Mycobacterium
PGVETAGPGGF

SEQ ID NO: 911664 - protein, 9 aa, Mycobacterium
PGVGGGNWT

SEQ ID NO: 911665 - protein, 17 aa, Mycobacterium
PGVGGGSWTADLGSETL

SEQ ID NO: 911666 - protein, 11 aa, Mycobacterium
PGVGSRTAPDL

SEQ ID NO: 911667 - protein, 11 aa, Mycobacterium
PGVGTRNSPDL

SEQ ID NO: 911668 - protein, 4 aa, Mycobacterium
PGVN

SEQ ID NO: 911669 - protein, 11 aa, Mycobacterium
PGVNPDEPARV

SEQ ID NO: 911670 - protein, 6 aa, Mycobacterium
PGVPNA

SEQ ID NO: 911671 - protein, 11 aa, Mycobacterium
PGVQGGGPGSF

SEQ ID NO: 911672 - protein, 7 aa, Mycobacterium
PGVRGSA

SEQ ID NO: 911673 - protein, 76 aa, Mycobacterium
PGVRPESPMDSIGAPDPAGGVVPGASMPGAAPGGLEDPVPGTHQPPPETDSESVQPKANGTIGPGSLNSGPDPAAS

SEQ ID NO: 911674 - protein, 5 aa, Mycobacterium
PGVSD

SEQ ID NO: 911675 - protein, 9 aa, Mycobacterium
PGVSGDENL

SEQ ID NO: 911676 - protein, 10 aa, Mycobacterium
PGVTDTPQLQ

SEQ ID NO: 911677 - protein, 13 aa, Mycobacterium
PGWADAGADTPEW

SEQ ID NO: 911678 - protein, 12 aa, Mycobacterium
PGWEGEKPEGVD

SEQ ID NO: 911679 - protein, 15 aa, Mycobacterium
PGWEPAGPQTPEGAY

SEQ ID NO: 911680 - protein, 5 aa, Mycobacterium
PGWGG

SEQ ID NO: 911681 - protein, 25 aa, Mycobacterium
PGWGGGHGGGWGHGSWGGHGGFGGH

SEQ ID NO: 911682 - protein, 9 aa, Mycobacterium
PGWGPDARG

SEQ ID NO: 911683 - protein, 12 aa, Mycobacterium
PGWQGEKPEGVD

SEQ ID NO: 911684 - protein, 9 aa, Mycobacterium
PGWSGRSQE

SEQ ID NO: 911685 - protein, 10 aa, Mycobacterium
PGWYGDNRER

SEQ ID NO: 911686 - protein, 7 aa, Mycobacterium
PGYAPAG

SEQ ID NO: 911687 - protein, 7 aa, Mycobacterium
PGYGEDK

SEQ ID NO: 911688 - protein, 6 aa, Mycobacterium
PGYTPH

SEQ ID NO: 911689 - protein, 11 aa, Mycobacterium
PGYTPSGRDNP

SEQ ID NO: 911690 - protein, 5 aa, Mycobacterium
PGYTV

SEQ ID NO: 911691 - protein, 7 aa, Mycobacterium
PHAAATD

SEQ ID NO: 911692 - protein, 5 aa, Mycobacterium
PHAQA

SEQ ID NO: 911693 - protein, 7 aa, Mycobacterium
PHAVDPQ

SEQ ID NO: 911694 - protein, 5 aa, Mycobacterium
PHDDG

SEQ ID NO: 911695 - protein, 4 aa, Mycobacterium
PHDP

SEQ ID NO: 911696 - protein, 4 aa, Mycobacterium
PHEV

SEQ ID NO: 911697 - protein, 9 aa, Mycobacterium
PHGPDGPRR

SEQ ID NO: 911698 - protein, 16 aa, Mycobacterium
PHIGGNAYSEAEPHTG

SEQ ID NO: 911699 - protein, 17 aa, Mycobacterium
PHIGGNAYSEAEPQTGI

SEQ ID NO: 911700 - protein, 16 aa, Mycobacterium
PHIGGNAYSEPEPQTG

SEQ ID NO: 911701 - protein, 4 aa, Mycobacterium
PHPG

SEQ ID NO: 911702 - protein, 6 aa, Mycobacterium
PHPGGP

SEQ ID NO: 911703 - protein, 14 aa, Mycobacterium
PHPGPQPEPRPGVH

SEQ ID NO: 911704 - protein, 5 aa, Mycobacterium
PHPGT

SEQ ID NO: 911705 - protein, 13 aa, Mycobacterium
PHPISKPRKSVTG

SEQ ID NO: 911706 - protein, 13 aa, Mycobacterium
PHPISRPRKSLTG

SEQ ID NO: 911707 - protein, 26 aa, Mycobacterium
PHPISRPRTSPTGTVITPSPPRTGMP

SEQ ID NO: 911708 - protein, 7 aa, Mycobacterium
PHPYQQS

SEQ ID NO: 911709 - protein, 9 aa, Mycobacterium
PHQADGADL

SEQ ID NO: 911710 - protein, 14 aa, Mycobacterium
PHQTPSPTTPQAPH

SEQ ID NO: 911711 - protein, 6 aa, Mycobacterium
PHRPGS

SEQ ID NO: 911712 - protein, 4 aa, Mycobacterium
PHRT

SEQ ID NO: 911713 - protein, 7 aa, Mycobacterium
PHSATGV

SEQ ID NO: 911714 - protein, 14 aa, Mycobacterium
PHSRGLGSSAAAAV

SEQ ID NO: 911715 - protein, 13 aa, Mycobacterium
PHSRGLGSSASAV

SEQ ID NO: 911716 - protein, 5 aa, Mycobacterium
PHTMP

SEQ ID NO: 911717 - protein, 7 aa, Mycobacterium
PHTPDED

SEQ ID NO: 911718 - protein, 8 aa, Mycobacterium
PIAPGATG

SEQ ID NO: 911719 - protein, 12 aa, Mycobacterium
PICNPTAPENWQ

SEQ ID NO: 911720 - protein, 14 aa, Mycobacterium
PIDPSPDYDASDEI

SEQ ID NO: 911721 - protein, 4 aa, Mycobacterium
PIGA

SEQ ID NO: 911722 - protein, 7 aa, Mycobacterium
PIGRERK

SEQ ID NO: 911723 - protein, 8 aa, Mycobacterium
PIGTHGYP

SEQ ID NO: 911724 - protein, 8 aa, Mycobacterium
PIKPGVPA

SEQ ID NO: 911725 - protein, 19 aa, Mycobacterium
PINAAKGGEGGKPSCGSLP

SEQ ID NO: 911726 - protein, 4 aa, Mycobacterium
PING

SEQ ID NO: 911727 - protein, 7 aa, Mycobacterium
PINGATS

SEQ ID NO: 911728 - protein, 9 aa, Mycobacterium
PINTPEGSL

SEQ ID NO: 911729 - protein, 4 aa, Mycobacterium
PIPA

SEQ ID NO: 911730 - protein, 8 aa, Mycobacterium
PIPDGPAQ

SEQ ID NO: 911731 - protein, 12 aa, Mycobacterium
PIPDSQTPTGSR

SEQ ID NO: 911732 - protein, 8 aa, Mycobacterium
PIPGGKSA

SEQ ID NO: 911733 - protein, 11 aa, Mycobacterium
PIPGGRPRPGD

SEQ ID NO: 911734 - protein, 5 aa, Mycobacterium
PIPGI

SEQ ID NO: 911735 - protein, 21 aa, Mycobacterium
PIPGLTAPAPAAPAAPAAALP

SEQ ID NO: 911736 - protein, 6 aa, Mycobacterium
PIPIPA

SEQ ID NO: 911737 - protein, 22 aa, Mycobacterium
PIPPALSATDGDCPTSDGPAEL

SEQ ID NO: 911738 - protein, 43 aa, Mycobacterium
PIPPGPPPADAPPPGDPAPGPPPDSAVPIPGATPAEAAPTDGG

SEQ ID NO: 911739 - protein, 7 aa, Mycobacterium
PIPQTDE

SEQ ID NO: 911740 - protein, 8 aa, Mycobacterium
PIPRNAPG

SEQ ID NO: 911741 - protein, 9 aa, Mycobacterium
PIPRNAPGC

SEQ ID NO: 911742 - protein, 5 aa, Mycobacterium
PIPSD

SEQ ID NO: 911743 - protein, 7 aa, Mycobacterium
PIPSFPP

SEQ ID NO: 911744 - protein, 5 aa, Mycobacterium
PIPSR

SEQ ID NO: 911745 - protein, 21 aa, Mycobacterium
PIPSTGGGPIIGGGDEAAQSR

SEQ ID NO: 911746 - protein, 10 aa, Mycobacterium
PIPTPDSPGG

SEQ ID NO: 911747 - protein, 9 aa, Mycobacterium
PIPTPESPS

SEQ ID NO: 911748 - protein, 83 aa, Mycobacterium
PIPVPDSSSGSSSSSSSSGSSSSSGSSDSSGSSDSSSGSSQSEDQTVHGPQAPAPAPTEQPPVNPAPPPPAAAPADQLPPPGP

SEQ ID NO: 911749 - protein, 11 aa, Mycobacterium
PIRPNAESLSG

SEQ ID NO: 911750 - protein, 5 aa, Mycobacterium
PISDN

SEQ ID NO: 911751 - protein, 5 aa, Mycobacterium
PISEK

SEQ ID NO: 911752 - protein, 5 aa, Mycobacterium
PISNG

SEQ ID NO: 911753 - protein, 8 aa, Mycobacterium
PISPSTPA

SEQ ID NO: 911754 - protein, 10 aa, Mycobacterium
PISTDFPESR

SEQ ID NO: 911755 - protein, 6 aa, Mycobacterium
PISTDS

SEQ ID NO: 911756 - protein, 5 aa, Mycobacterium
PITGG

SEQ ID NO: 911757 - protein, 10 aa, Mycobacterium
PITGPPPPIG

SEQ ID NO: 911758 - protein, 11 aa, Mycobacterium
PITSATERARY

SEQ ID NO: 911759 - protein, 5 aa, Mycobacterium
PITTN

SEQ ID NO: 911760 - protein, 4 aa, Mycobacterium
PIVG

SEQ ID NO: 911761 - protein, 5 aa, Mycobacterium
PIVGN

SEQ ID NO: 911762 - protein, 10 aa, Mycobacterium
PKAAADPTVT

SEQ ID NO: 911763 - protein, 8 aa, Mycobacterium
PKALAGRG

SEQ ID NO: 911764 - protein, 7 aa, Mycobacterium
PKAPTVS

SEQ ID NO: 911765 - protein, 10 aa, Mycobacterium
PKATWSNGRP

SEQ ID NO: 911766 - protein, 16 aa, Mycobacterium
PKCERSGAIREKSPHN

SEQ ID NO: 911767 - protein, 13 aa, Mycobacterium
PKDAPNAVRGARN

SEQ ID NO: 911768 - protein, 9 aa, Mycobacterium
PKDDKDDAP

SEQ ID NO: 911769 - protein, 14 aa, Mycobacterium
PKDIGGGAANTDAD

SEQ ID NO: 911770 - protein, 15 aa, Mycobacterium
PKDPATTHLKDGDTI

SEQ ID NO: 911771 - protein, 4 aa, Mycobacterium
PKDT

SEQ ID NO: 911772 - protein, 9 aa, Mycobacterium
PKEGSTGWS

SEQ ID NO: 911773 - protein, 4 aa, Mycobacterium
PKEI

SEQ ID NO: 911774 - protein, 16 aa, Mycobacterium
PKFPNETMDPARSGGD

SEQ ID NO: 911775 - protein, 8 aa, Mycobacterium
PKGATGNM

SEQ ID NO: 911776 - protein, 8 aa, Mycobacterium
PKGEGGAF

SEQ ID NO: 911777 - protein, 9 aa, Mycobacterium
PKGEPPQAG

SEQ ID NO: 911778 - protein, 4 aa, Mycobacterium
PKGI

SEQ ID NO: 911779 - protein, 4 aa, Mycobacterium
PKGQ

SEQ ID NO: 911780 - protein, 8 aa, Mycobacterium
PKGREDYD

SEQ ID NO: 911781 - protein, 10 aa, Mycobacterium
PKGSGKVREF

SEQ ID NO: 911782 - protein, 9 aa, Mycobacterium
PKGSGTVRS

SEQ ID NO: 911783 - protein, 9 aa, Mycobacterium
PKGTTGNTG

SEQ ID NO: 911784 - protein, 12 aa, Mycobacterium
PKHATDGDDDEV

SEQ ID NO: 911785 - protein, 11 aa, Mycobacterium
PKHEAPQGRLR

SEQ ID NO: 911786 - protein, 9 aa, Mycobacterium
PKHGGRWDA

SEQ ID NO: 911787 - protein, 7 aa, Mycobacterium
PKIQAGV

SEQ ID NO: 911788 - protein, 4 aa, Mycobacterium
PKLR

SEQ ID NO: 911789 - protein, 4 aa, Mycobacterium
PKNH

SEQ ID NO: 911790 - protein, 6 aa, Mycobacterium
PKNPDN

SEQ ID NO: 911791 - protein, 16 aa, Mycobacterium
PKNPDNWNFALEEPPE

SEQ ID NO: 911792 - protein, 7 aa, Mycobacterium
PKNPPRL

SEQ ID NO: 911793 - protein, 4 aa, Mycobacterium
PKNT

SEQ ID NO: 911794 - protein, 11 aa, Mycobacterium
PKPAAKGVGTE

SEQ ID NO: 911795 - protein, 9 aa, Mycobacterium
PKPANARAA

SEQ ID NO: 911796 - protein, 13 aa, Mycobacterium
PKPAPPPKPISED

SEQ ID NO: 911797 - protein, 19 aa, Mycobacterium
PKPGQRVDGGSPVLDPWWQ

SEQ ID NO: 911798 - protein, 13 aa, Mycobacterium
PKPGSNQSPRLGS

SEQ ID NO: 911799 - protein, 9 aa, Mycobacterium
PKPIPEPTK

SEQ ID NO: 911800 - protein, 5 aa, Mycobacterium
PKPPE

SEQ ID NO: 911801 - protein, 24 aa, Mycobacterium
PKPPGEPAQPAGPAEITPAEAPQA

SEQ ID NO: 911802 - protein, 20 aa, Mycobacterium
PKQSISNPPSTPSQLPPNEV

SEQ ID NO: 911803 - protein, 10 aa, Mycobacterium
PKQYSAADGT

SEQ ID NO: 911804 - protein, 8 aa, Mycobacterium
PKRADEQR

SEQ ID NO: 911805 - protein, 5 aa, Mycobacterium
PKSAT

SEQ ID NO: 911806 - protein, 5 aa, Mycobacterium
PKSFP

SEQ ID NO: 911807 - protein, 10 aa, Mycobacterium
PKSSDKPDAA

SEQ ID NO: 911808 - protein, 8 aa, Mycobacterium
PKTAPHGL

SEQ ID NO: 911809 - protein, 7 aa, Mycobacterium
PKTDPLP

SEQ ID NO: 911810 - protein, 9 aa, Mycobacterium
PKTEGARGS

SEQ ID NO: 911811 - protein, 14 aa, Mycobacterium
PKTGATTSGQGITH

SEQ ID NO: 911812 - protein, 6 aa, Mycobacterium
PKTGEV

SEQ ID NO: 911813 - protein, 10 aa, Mycobacterium
PKTSTSGTAL

SEQ ID NO: 911814 - protein, 6 aa, Mycobacterium
PKVPAG

SEQ ID NO: 911815 - protein, 7 aa, Mycobacterium
PKVPGLG

SEQ ID NO: 911816 - protein, 4 aa, Mycobacterium
PKVR

SEQ ID NO: 911817 - protein, 10 aa, Mycobacterium
PKVTTGTGAD

SEQ ID NO: 911818 - protein, 11 aa, Mycobacterium
PKWSTETPGDV

SEQ ID NO: 911819 - protein, 10 aa, Mycobacterium
PKYHNPDGTL

SEQ ID NO: 911820 - protein, 13 aa, Mycobacterium
PLAAAAPDCSSVG

SEQ ID NO: 911821 - protein, 8 aa, Mycobacterium
PLADYSQA

SEQ ID NO: 911822 - protein, 4 aa, Mycobacterium
PLAG

SEQ ID NO: 911823 - protein, 8 aa, Mycobacterium
PLAGASAQ

SEQ ID NO: 911824 - protein, 7 aa, Mycobacterium
PLAGGGL

SEQ ID NO: 911825 - protein, 15 aa, Mycobacterium
PLAHSDPGTTGGDEA

SEQ ID NO: 911826 - protein, 6 aa, Mycobacterium
PLANAN

SEQ ID NO: 911827 - protein, 4 aa, Mycobacterium
PLAP

SEQ ID NO: 911828 - protein, 13 aa, Mycobacterium
PLAPGNERIEDPT

SEQ ID NO: 911829 - protein, 5 aa, Mycobacterium
PLAPK

SEQ ID NO: 911830 - protein, 7 aa, Mycobacterium
PLAPPNP

SEQ ID NO: 911831 - protein, 33 aa, Mycobacterium
PLAPPSPPPPAAPVAPTAPPPAGADQPRPDERR

SEQ ID NO: 911832 - protein, 9 aa, Mycobacterium
PLASSPQDI

SEQ ID NO: 911833 - protein, 9 aa, Mycobacterium
PLASTTTDL

SEQ ID NO: 911834 - protein, 16 aa, Mycobacterium
PLATELDDRKAEINND

SEQ ID NO: 911835 - protein, 4 aa, Mycobacterium
PLDD

SEQ ID NO: 911836 - protein, 6 aa, Mycobacterium
PLDESR

SEQ ID NO: 911837 - protein, 40 aa, Mycobacterium
PLDPGTPPPAGLAPGPQPPAPAAPVVPPPAAPVAAPVAPA

SEQ ID NO: 911838 - protein, 11 aa, Mycobacterium
PLEDSVSAGPV

SEQ ID NO: 911839 - protein, 8 aa, Mycobacterium
PLEPGQQT

SEQ ID NO: 911840 - protein, 12 aa, Mycobacterium
PLESTGLGSCDD

SEQ ID NO: 911841 - protein, 4 aa, Mycobacterium
PLGE

SEQ ID NO: 911842 - protein, 5 aa, Mycobacterium
PLGEP

SEQ ID NO: 911843 - protein, 14 aa, Mycobacterium
PLGGSGEINRGKGI

SEQ ID NO: 911844 - protein, 6 aa, Mycobacterium
PLGNTG

SEQ ID NO: 911845 - protein, 14 aa, Mycobacterium
PLGPATRVQQPDGR

SEQ ID NO: 911846 - protein, 10 aa, Mycobacterium
PLGPDPAGAV

SEQ ID NO: 911847 - protein, 9 aa, Mycobacterium
PLGPDPKAA

SEQ ID NO: 911848 - protein, 15 aa, Mycobacterium
PLGPVASNTEGANMD

SEQ ID NO: 911849 - protein, 11 aa, Mycobacterium
PLGQPADASPR

SEQ ID NO: 911850 - protein, 10 aa, Mycobacterium
PLGQPSDASA

SEQ ID NO: 911851 - protein, 14 aa, Mycobacterium
PLGQSGELDRSKGI

SEQ ID NO: 911852 - protein, 5 aa, Mycobacterium
PLGQV

SEQ ID NO: 911853 - protein, 11 aa, Mycobacterium
PLGTATPNPKP

SEQ ID NO: 911854 - protein, 9 aa, Mycobacterium
PLGTDPAKA

SEQ ID NO: 911855 - protein, 11 aa, Mycobacterium
PLGTPTPNPKP

SEQ ID NO: 911856 - protein, 14 aa, Mycobacterium
PLKVSTSDANGDPV

SEQ ID NO: 911857 - protein, 19 aa, Mycobacterium
PLNAGAGKESTLDGTFGPR

SEQ ID NO: 911858 - protein, 9 aa, Mycobacterium
PLNGDDAPF

SEQ ID NO: 911859 - protein, 11 aa, Mycobacterium
PLNPPRVGPDG

SEQ ID NO: 911860 - protein, 9 aa, Mycobacterium
PLNTAESRA

SEQ ID NO: 911861 - protein, 4 aa, Mycobacterium
PLPA

SEQ ID NO: 911862 - protein, 12 aa, Mycobacterium
PLPAAPAPDLAG

SEQ ID NO: 911863 - protein, 13 aa, Mycobacterium
PLPAPGGGSGGYT

SEQ ID NO: 911864 - protein, 30 aa, Mycobacterium
PLPAPPPGGPPPGPPAVSPPGLASTPTPDT

SEQ ID NO: 911865 - protein, 7 aa, Mycobacterium
PLPAQAA

SEQ ID NO: 911866 - protein, 9 aa, Mycobacterium
PLPAVPGSY

SEQ ID NO: 911867 - protein, 4 aa, Mycobacterium
PLPD

SEQ ID NO: 911868 - protein, 16 aa, Mycobacterium
PLPDATPPPYASTTIK

SEQ ID NO: 911869 - protein, 6 aa, Mycobacterium
PLPDGV

SEQ ID NO: 911870 - protein, 9 aa, Mycobacterium
PLPDPEPGC

SEQ ID NO: 911871 - protein, 5 aa, Mycobacterium
PLPED

SEQ ID NO: 911872 - protein, 7 aa, Mycobacterium
PLPEGSG

SEQ ID NO: 911873 - protein, 15 aa, Mycobacterium
PLPETQPAVDTYATA

SEQ ID NO: 911874 - protein, 12 aa, Mycobacterium
PLPGAEGRGGDA

SEQ ID NO: 911875 - protein, 12 aa, Mycobacterium
PLPGAVGRGAGA

SEQ ID NO: 911876 - protein, 12 aa, Mycobacterium
PLPGAVGRGPGA

SEQ ID NO: 911877 - protein, 14 aa, Mycobacterium
PLPGAVGRGPGANT

SEQ ID NO: 911878 - protein, 6 aa, Mycobacterium
PLPGDA

SEQ ID NO: 911879 - protein, 19 aa, Mycobacterium
PLPGEAPPPPPPPPPGSNV

SEQ ID NO: 911880 - protein, 5 aa, Mycobacterium
PLPGG

SEQ ID NO: 911881 - protein, 8 aa, Mycobacterium
PLPGGGTL

SEQ ID NO: 911882 - protein, 12 aa, Mycobacterium
PLPGGPGTESGS

SEQ ID NO: 911883 - protein, 13 aa, Mycobacterium
PLPGGPGTGSERT

SEQ ID NO: 911884 - protein, 21 aa, Mycobacterium
PLPGPAEAVPTAPAAPPEPPR

SEQ ID NO: 911885 - protein, 22 aa, Mycobacterium
PLPGRRRPASRAVRSTRLIDSG

SEQ ID NO: 911886 - protein, 12 aa, Mycobacterium
PLPGTAGHGDGA

SEQ ID NO: 911887 - protein, 12 aa, Mycobacterium
PLPGTAGRGPGA

SEQ ID NO: 911888 - protein, 12 aa, Mycobacterium
PLPGTEGNGPGS

SEQ ID NO: 911889 - protein, 13 aa, Mycobacterium
PLPGTVGTGSDAA

SEQ ID NO: 911890 - protein, 22 aa, Mycobacterium
PLPKAQADRVHPPAAPPDAQSS

SEQ ID NO: 911891 - protein, 16 aa, Mycobacterium
PLPKPGAQRAPTPGVH

SEQ ID NO: 911892 - protein, 5 aa, Mycobacterium
PLPNT

SEQ ID NO: 911893 - protein, 8 aa, Mycobacterium
PLPPGTDQ

SEQ ID NO: 911894 - protein, 7 aa, Mycobacterium
PLPPNAP

SEQ ID NO: 911895 - protein, 13 aa, Mycobacterium
PLPPNARRIEDPE

SEQ ID NO: 911896 - protein, 14 aa, Mycobacterium
PLPPNARRVEDPDM

SEQ ID NO: 911897 - protein, 49 aa, Mycobacterium
PLPPPPPGAVPGPGNYGPRPGPAPAEAPMPDANLGQTPPPAEAPSTGAD

SEQ ID NO: 911898 - protein, 29 aa, Mycobacterium
PLPPPPSTPAPPPPAPSASEMLLPTDGPQ

SEQ ID NO: 911899 - protein, 7 aa, Mycobacterium
PLPPTVG

SEQ ID NO: 911900 - protein, 6 aa, Mycobacterium
PLPPVN

SEQ ID NO: 911901 - protein, 4 aa, Mycobacterium
PLPQ

SEQ ID NO: 911902 - protein, 6 aa, Mycobacterium
PLPQGT

SEQ ID NO: 911903 - protein, 7 aa, Mycobacterium
PLPQPVP

SEQ ID NO: 911904 - protein, 6 aa, Mycobacterium
PLPTDL

SEQ ID NO: 911905 - protein, 12 aa, Mycobacterium
PLPTINPAYGAK

SEQ ID NO: 911906 - protein, 12 aa, Mycobacterium
PLPTSPGYAGNT

SEQ ID NO: 911907 - protein, 19 aa, Mycobacterium
PLPTYNTNTVTGAASAGAQ

SEQ ID NO: 911908 - protein, 6 aa, Mycobacterium
PLPVAE

SEQ ID NO: 911909 - protein, 8 aa, Mycobacterium
PLQGNGVG

SEQ ID NO: 911910 - protein, 7 aa, Mycobacterium
PLQPGAD

SEQ ID NO: 911911 - protein, 7 aa, Mycobacterium
PLQPGDD

SEQ ID NO: 911912 - protein, 30 aa, Mycobacterium
PLQPVNPAHSDSSANQGGPARRTGVERDGP

SEQ ID NO: 911913 - protein, 14 aa, Mycobacterium
PLRGGGVGIRGDNA

SEQ ID NO: 911914 - protein, 5 aa, Mycobacterium
PLRGQ

SEQ ID NO: 911915 - protein, 6 aa, Mycobacterium
PLRPGQ

SEQ ID NO: 911916 - protein, 7 aa, Mycobacterium
PLRPGTA

SEQ ID NO: 911917 - protein, 11 aa, Mycobacterium
PLRPPGSADFA

SEQ ID NO: 911918 - protein, 35 aa, Mycobacterium
PLSGPTPREVPAPAGLDAPLDAPGINGQPAPLAPP

SEQ ID NO: 911919 - protein, 6 aa, Mycobacterium
PLSGYR

SEQ ID NO: 911920 - protein, 18 aa, Mycobacterium
PLSPADEALSEATRESLE

SEQ ID NO: 911921 - protein, 7 aa, Mycobacterium
PLSPDQA

SEQ ID NO: 911922 - protein, 8 aa, Mycobacterium
PLSPGQKI

SEQ ID NO: 911923 - protein, 6 aa, Mycobacterium
PLSTDQ

SEQ ID NO: 911924 - protein, 17 aa, Mycobacterium
PLTAGSGVAPIGRPLPG

SEQ ID NO: 911925 - protein, 4 aa, Mycobacterium
PLTG

SEQ ID NO: 911926 - protein, 6 aa, Mycobacterium
PLTGDR

SEQ ID NO: 911927 - protein, 4 aa, Mycobacterium
PLTP

SEQ ID NO: 911928 - protein, 6 aa, Mycobacterium
PLTPQA

SEQ ID NO: 911929 - protein, 29 aa, Mycobacterium
PLTSTTNPGLAATADSAALAADSTGGTVQ

SEQ ID NO: 911930 - protein, 11 aa, Mycobacterium
PLTVPRTPQGR

SEQ ID NO: 911931 - protein, 4 aa, Mycobacterium
PLYG

SEQ ID NO: 911932 - protein, 12 aa, Mycobacterium
PMAGTAHSGWAA

SEQ ID NO: 911933 - protein, 11 aa, Mycobacterium
PMAGTAHSGWT

SEQ ID NO: 911934 - protein, 20 aa, Mycobacterium
PMASSGGGPIIGGGSNAGIA

SEQ ID NO: 911935 - protein, 4 aa, Mycobacterium
PMDD

SEQ ID NO: 911936 - protein, 16 aa, Mycobacterium
PMDKTGATEARRSRAV

SEQ ID NO: 911937 - protein, 7 aa, Mycobacterium
PMDPTEA

SEQ ID NO: 911938 - protein, 8 aa, Mycobacterium
PMEPGQQT

SEQ ID NO: 911939 - protein, 32 aa, Mycobacterium
PMESTGLGSCDRATAKMPDVRSPLSAPGDRLT

SEQ ID NO: 911940 - protein, 5 aa, Mycobacterium
PMGDP

SEQ ID NO: 911941 - protein, 20 aa, Mycobacterium
PMGDRDAASDLSRSQPTASV

SEQ ID NO: 911942 - protein, 6 aa, Mycobacterium
PMNPNG

SEQ ID NO: 911943 - protein, 14 aa, Mycobacterium
PMPADTGAPPPDAV

SEQ ID NO: 911944 - protein, 13 aa, Mycobacterium
PMPASREAAEAKG

SEQ ID NO: 911945 - protein, 6 aa, Mycobacterium
PMPGGA

SEQ ID NO: 911946 - protein, 13 aa, Mycobacterium
PMPGGPGSGPGSY

SEQ ID NO: 911947 - protein, 13 aa, Mycobacterium
PMPGTAGHGGGAY

SEQ ID NO: 911948 - protein, 14 aa, Mycobacterium
PMPPQLPAQPPPPA

SEQ ID NO: 911949 - protein, 5 aa, Mycobacterium
PMQPA

SEQ ID NO: 911950 - protein, 4 aa, Mycobacterium
PMSG

SEQ ID NO: 911951 - protein, 20 aa, Mycobacterium
PMSSGPQQAMSPVPPAPAPA

SEQ ID NO: 911952 - protein, 14 aa, Mycobacterium
PMSSPARVSAPLRT

SEQ ID NO: 911953 - protein, 4 aa, Mycobacterium
PMTA

SEQ ID NO: 911954 - protein, 5 aa, Mycobacterium
PMTAA

SEQ ID NO: 911955 - protein, 10 aa, Mycobacterium
PMTASGDAGA

SEQ ID NO: 911956 - protein, 7 aa, Mycobacterium
PMTGTAH

SEQ ID NO: 911957 - protein, 12 aa, Mycobacterium
PMTGTAHSGWGA

SEQ ID NO: 911958 - protein, 4 aa, Mycobacterium
PMTP

SEQ ID NO: 911959 - protein, 19 aa, Mycobacterium
PMTSTGSGPIIGGGSTSLG

SEQ ID NO: 911960 - protein, 4 aa, Mycobacterium
PNAD

SEQ ID NO: 911961 - protein, 15 aa, Mycobacterium
PNAPAGGFSPGGHNG

SEQ ID NO: 911962 - protein, 9 aa, Mycobacterium
PNAPVGNQD

SEQ ID NO: 911963 - protein, 12 aa, Mycobacterium
PNASELERKDAY

SEQ ID NO: 911964 - protein, 7 aa, Mycobacterium
PNCTPGI

SEQ ID NO: 911965 - protein, 19 aa, Mycobacterium
PNDGTPPSVYHDESGDLVG

SEQ ID NO: 911966 - protein, 5 aa, Mycobacterium
PNGAS

SEQ ID NO: 911967 - protein, 4 aa, Mycobacterium
PNGD

SEQ ID NO: 911968 - protein, 8 aa, Mycobacterium
PNGEQGGP

SEQ ID NO: 911969 - protein, 8 aa, Mycobacterium
PNGGSVTG

SEQ ID NO: 911970 - protein, 4 aa, Mycobacterium
PNGH

SEQ ID NO: 911971 - protein, 7 aa, Mycobacterium
PNGMGEQ

SEQ ID NO: 911972 - protein, 6 aa, Mycobacterium
PNGPVG

SEQ ID NO: 911973 - protein, 8 aa, Mycobacterium
PNGQISND

SEQ ID NO: 911974 - protein, 7 aa, Mycobacterium
PNGQVTN

SEQ ID NO: 911975 - protein, 5 aa, Mycobacterium
PNGQY

SEQ ID NO: 911976 - protein, 10 aa, Mycobacterium
PNGRAYQDGE

SEQ ID NO: 911977 - protein, 8 aa, Mycobacterium
PNGSERVA

SEQ ID NO: 911978 - protein, 6 aa, Mycobacterium
PNGSQS

SEQ ID NO: 911979 - protein, 13 aa, Mycobacterium
PNGVPRNKFSGSP

SEQ ID NO: 911980 - protein, 13 aa, Mycobacterium
PNHTDLGGRNNAE

SEQ ID NO: 911981 - protein, 13 aa, Mycobacterium
PNKGESAEEFTPQ

SEQ ID NO: 911982 - protein, 4 aa, Mycobacterium
PNLA

SEQ ID NO: 911983 - protein, 20 aa, Mycobacterium
PNLAPGAGGGSPQPPETPPV

SEQ ID NO: 911984 - protein, 5 aa, Mycobacterium
PNLDS

SEQ ID NO: 911985 - protein, 4 aa, Mycobacterium
PNNG

SEQ ID NO: 911986 - protein, 19 aa, Mycobacterium
PNNSWDAHTSYERTGLPAE

SEQ ID NO: 911987 - protein, 7 aa, Mycobacterium
PNPAAAA

SEQ ID NO: 911988 - protein, 9 aa, Mycobacterium
PNPAQRAAD

SEQ ID NO: 911989 - protein, 13 aa, Mycobacterium
PNPASADPGDQPW

SEQ ID NO: 911990 - protein, 6 aa, Mycobacterium
PNPDSI

SEQ ID NO: 911991 - protein, 4 aa, Mycobacterium
PNPE

SEQ ID NO: 911992 - protein, 9 aa, Mycobacterium
PNPGSAEGI

SEQ ID NO: 911993 - protein, 7 aa, Mycobacterium
PNPLTQT

SEQ ID NO: 911994 - protein, 15 aa, Mycobacterium
PNPPAGGFSPGGHNG

SEQ ID NO: 911995 - protein, 13 aa, Mycobacterium
PNPPMPAPPPPPA

SEQ ID NO: 911996 - protein, 6 aa, Mycobacterium
PNPPYP

SEQ ID NO: 911997 - protein, 5 aa, Mycobacterium
PNPVS

SEQ ID NO: 911998 - protein, 6 aa, Mycobacterium
PNPVTP

SEQ ID NO: 911999 - protein, 4 aa, Mycobacterium
PNQG

SEQ ID NO: 912000 - protein, 7 aa, Mycobacterium
PNQPGAY

SEQ ID NO: 912001 - protein, 9 aa, Mycobacterium
PNRPPSEHV

SEQ ID NO: 912002 - protein, 5 aa, Mycobacterium
PNRQR

SEQ ID NO: 912003 - protein, 10 aa, Mycobacterium
PNRSVAEGSA

SEQ ID NO: 912004 - protein, 5 aa, Mycobacterium
PNSGT

SEQ ID NO: 912005 - protein, 16 aa, Mycobacterium
PNSKGTRAAQSNPDPL

SEQ ID NO: 912006 - protein, 4 aa, Mycobacterium
PNSN

SEQ ID NO: 912007 - protein, 17 aa, Mycobacterium
PNSPEPAFSTAPNQLPQ

SEQ ID NO: 912008 - protein, 4 aa, Mycobacterium
PNSR

SEQ ID NO: 912009 - protein, 7 aa, Mycobacterium
PNSSTGV

SEQ ID NO: 912010 - protein, 13 aa, Mycobacterium
PNTGNAIRTAAAT

SEQ ID NO: 912011 - protein, 14 aa, Mycobacterium
PNTIGQQGNTNVTN

SEQ ID NO: 912012 - protein, 15 aa, Mycobacterium
PNTLDPYANPGRGEL

SEQ ID NO: 912013 - protein, 17 aa, Mycobacterium
PNTTSITPGNVNTSTPY

SEQ ID NO: 912014 - protein, 6 aa, Mycobacterium
PNVGDG

SEQ ID NO: 912015 - protein, 22 aa, Mycobacterium
PNVPPAPDAFASGAPDDAPAPE

SEQ ID NO: 912016 - protein, 7 aa, Mycobacterium
PNVQRQS

SEQ ID NO: 912017 - protein, 10 aa, Mycobacterium
PNYDTGQRNR

SEQ ID NO: 912018 - protein, 4 aa, Mycobacterium
PNYS

SEQ ID NO: 912019 - protein, 11 aa, Mycobacterium
PPAAGETDAPL

SEQ ID NO: 912020 - protein, 6 aa, Mycobacterium
PPAAGR

SEQ ID NO: 912021 - protein, 10 aa, Mycobacterium
PPAASAQACP

SEQ ID NO: 912022 - protein, 18 aa, Mycobacterium
PPAAVAPTPPAVTPAVTG

SEQ ID NO: 912023 - protein, 6 aa, Mycobacterium
PPADGD

SEQ ID NO: 912024 - protein, 6 aa, Mycobacterium
PPADLN

SEQ ID NO: 912025 - protein, 11 aa, Mycobacterium
PPADPSPSPVH

SEQ ID NO: 912026 - protein, 23 aa, Mycobacterium
PPAEEETGDEQEDPAGSGAAAEV

SEQ ID NO: 912027 - protein, 5 aa, Mycobacterium
PPAEL

SEQ ID NO: 912028 - protein, 11 aa, Mycobacterium
PPAEPSSAPRD

SEQ ID NO: 912029 - protein, 11 aa, Mycobacterium
PPAEPSTQALR

SEQ ID NO: 912030 - protein, 7 aa, Mycobacterium
PPAGADT

SEQ ID NO: 912031 - protein, 9 aa, Mycobacterium
PPAGAGTEA

SEQ ID NO: 912032 - protein, 38 aa, Mycobacterium
PPAGAHEKCSAPKPGEQVCSEPGDAELHSTPTAHIPAP

SEQ ID NO: 912033 - protein, 12 aa, Mycobacterium
PPAGAPSDGPIL

SEQ ID NO: 912034 - protein, 12 aa, Mycobacterium
PPANAAPTATVR

SEQ ID NO: 912035 - protein, 13 aa, Mycobacterium
PPAPAAGPAPTTV

SEQ ID NO: 912036 - protein, 5 aa, Mycobacterium
PPAPI

SEQ ID NO: 912037 - protein, 10 aa, Mycobacterium
PPAPNNEATW

SEQ ID NO: 912038 - protein, 10 aa, Mycobacterium
PPAPNSDPIG

SEQ ID NO: 912039 - protein, 17 aa, Mycobacterium
PPAPSDDRPSGPARMVV

SEQ ID NO: 912040 - protein, 11 aa, Mycobacterium
PPAPVEPGTPL

SEQ ID NO: 912041 - protein, 9 aa, Mycobacterium
PPAPVPSPV

SEQ ID NO: 912042 - protein, 5 aa, Mycobacterium
PPAQF

SEQ ID NO: 912043 - protein, 10 aa, Mycobacterium
PPAQPVTQDL

SEQ ID NO: 912044 - protein, 8 aa, Mycobacterium
PPARDLTV

SEQ ID NO: 912045 - protein, 5 aa, Mycobacterium
PPASA

SEQ ID NO: 912046 - protein, 9 aa, Mycobacterium
PPASAEPSW

SEQ ID NO: 912047 - protein, 16 aa, Mycobacterium
PPASRGHPGPLSGPDL

SEQ ID NO: 912048 - protein, 22 aa, Mycobacterium
PPASRGRPGPLSGPDLRDPART

SEQ ID NO: 912049 - protein, 7 aa, Mycobacterium
PPAVAEP

SEQ ID NO: 912050 - protein, 8 aa, Mycobacterium
PPCGETTP

SEQ ID NO: 912051 - protein, 4 aa, Mycobacterium
PPDA

SEQ ID NO: 912052 - protein, 11 aa, Mycobacterium
PPDADDAAQVA

SEQ ID NO: 912053 - protein, 17 aa, Mycobacterium
PPDAPPPPPEGPPPPPN

SEQ ID NO: 912054 - protein, 9 aa, Mycobacterium
PPDHPKDGG

SEQ ID NO: 912055 - protein, 13 aa, Mycobacterium
PPDLESAYHEFMA

SEQ ID NO: 912056 - protein, 12 aa, Mycobacterium
PPDLETYAKGDQ

SEQ ID NO: 912057 - protein, 12 aa, Mycobacterium
PPDNPSSQPLRA

SEQ ID NO: 912058 - protein, 27 aa, Mycobacterium
PPDPATATEHGGPAAAPGPAPAPGGAG

SEQ ID NO: 912059 - protein, 11 aa, Mycobacterium
PPDPIEDTDRF

SEQ ID NO: 912060 - protein, 10 aa, Mycobacterium
PPDPSPQRLS

SEQ ID NO: 912061 - protein, 9 aa, Mycobacterium
PPDQPGACG

SEQ ID NO: 912062 - protein, 23 aa, Mycobacterium
PPEAPPDLGPLPNAATPAGQPPR

SEQ ID NO: 912063 - protein, 11 aa, Mycobacterium
PPEAVPPPAPM

SEQ ID NO: 912064 - protein, 8 aa, Mycobacterium
PPEFGEPY

SEQ ID NO: 912065 - protein, 11 aa, Mycobacterium
PPEGAPLQPEL

SEQ ID NO: 912066 - protein, 11 aa, Mycobacterium
PPEHGGPAPAQ

SEQ ID NO: 912067 - protein, 10 aa, Mycobacterium
PPEKKAQFSA

SEQ ID NO: 912068 - protein, 8 aa, Mycobacterium
PPEPLPAG

SEQ ID NO: 912069 - protein, 28 aa, Mycobacterium
PPEPPEGAAPAAPGTPPVPPAPPVPAPP

SEQ ID NO: 912070 - protein, 5 aa, Mycobacterium
PPEPT

SEQ ID NO: 912071 - protein, 6 aa, Mycobacterium
PPEPWA

SEQ ID NO: 912072 - protein, 5 aa, Mycobacterium
PPERT

SEQ ID NO: 912073 - protein, 4 aa, Mycobacterium
PPES

SEQ ID NO: 912074 - protein, 5 aa, Mycobacterium
PPFPY

SEQ ID NO: 912075 - protein, 8 aa, Mycobacterium
PPFRPPTF

SEQ ID NO: 912076 - protein, 5 aa, Mycobacterium
PPGAE

SEQ ID NO: 912077 - protein, 39 aa, Mycobacterium
PPGAGSSADGQTPAGGTSLPNSGGQAAYSGPCPPPGTGT

SEQ ID NO: 912078 - protein, 6 aa, Mycobacterium
PPGAIA

SEQ ID NO: 912079 - protein, 24 aa, Mycobacterium
PPGAPAAPPVAPNAPLLPAEGTPP

SEQ ID NO: 912080 - protein, 11 aa, Mycobacterium
PPGFTPGVGGS

SEQ ID NO: 912081 - protein, 6 aa, Mycobacterium
PPGGTA

SEQ ID NO: 912082 - protein, 5 aa, Mycobacterium
PPGIT

SEQ ID NO: 912083 - protein, 13 aa, Mycobacterium
PPGKPEGTLQPGQ

SEQ ID NO: 912084 - protein, 27 aa, Mycobacterium
PPGKSRDEVDKANTADFKESEDSAEYA

SEQ ID NO: 912085 - protein, 27 aa, Mycobacterium
PPGKSREEVDKANSADFKQSEDSAEYA

SEQ ID NO: 912086 - protein, 26 aa, Mycobacterium
PPGKSREEVDNANSADFKNSEESAEY

SEQ ID NO: 912087 - protein, 6 aa, Mycobacterium
PPGNPN

SEQ ID NO: 912088 - protein, 5 aa, Mycobacterium
PPGPE

SEQ ID NO: 912089 - protein, 7 aa, Mycobacterium
PPGPPTG

SEQ ID NO: 912090 - protein, 10 aa, Mycobacterium
PPGPRGALAS

SEQ ID NO: 912091 - protein, 4 aa, Mycobacterium
PPGQ

SEQ ID NO: 912092 - protein, 6 aa, Mycobacterium
PPGQAR

SEQ ID NO: 912093 - protein, 6 aa, Mycobacterium
PPGQSK

SEQ ID NO: 912094 - protein, 15 aa, Mycobacterium
PPGRRHDRTSSSEQS

SEQ ID NO: 912095 - protein, 4 aa, Mycobacterium
PPGS

SEQ ID NO: 912096 - protein, 6 aa, Mycobacterium
PPGSPV

SEQ ID NO: 912097 - protein, 7 aa, Mycobacterium
PPGTGTV

SEQ ID NO: 912098 - protein, 7 aa, Mycobacterium
PPGTPWN

SEQ ID NO: 912099 - protein, 6 aa, Mycobacterium
PPGTTP

SEQ ID NO: 912100 - protein, 16 aa, Mycobacterium
PPGVAPAEPAGTSPPF

SEQ ID NO: 912101 - protein, 5 aa, Mycobacterium
PPGYE

SEQ ID NO: 912102 - protein, 15 aa, Mycobacterium
PPHSTHERPPAQDTQ

SEQ ID NO: 912103 - protein, 12 aa, Mycobacterium
PPILPPNSTVTV

SEQ ID NO: 912104 - protein, 19 aa, Mycobacterium
PPKGASVVTGPETHEPDRH

SEQ ID NO: 912105 - protein, 9 aa, Mycobacterium
PPKGLSQEE

SEQ ID NO: 912106 - protein, 20 aa, Mycobacterium
PPKTPSPTSLHPNAKVTASE

SEQ ID NO: 912107 - protein, 32 aa, Mycobacterium
PPLGESPSGRLQPGSTLPLNESSTYPTTEQTL

SEQ ID NO: 912108 - protein, 5 aa, Mycobacterium
PPLGN

SEQ ID NO: 912109 - protein, 7 aa, Mycobacterium
PPLPAEH

SEQ ID NO: 912110 - protein, 7 aa, Mycobacterium
PPLPEGV

SEQ ID NO: 912111 - protein, 8 aa, Mycobacterium
PPLPGRHR

SEQ ID NO: 912112 - protein, 6 aa, Mycobacterium
PPLPTP

SEQ ID NO: 912113 - protein, 4 aa, Mycobacterium
PPLR

SEQ ID NO: 912114 - protein, 5 aa, Mycobacterium
PPLRG

SEQ ID NO: 912115 - protein, 6 aa, Mycobacterium
PPLSDL

SEQ ID NO: 912116 - protein, 13 aa, Mycobacterium
PPLTPEAQKTSPQ

SEQ ID NO: 912117 - protein, 11 aa, Mycobacterium
PPMAYDGEPAL

SEQ ID NO: 912118 - protein, 8 aa, Mycobacterium
PPMKEPPP

SEQ ID NO: 912119 - protein, 6 aa, Mycobacterium
PPMPED

SEQ ID NO: 912120 - protein, 10 aa, Mycobacterium
PPMQPGDPRV

SEQ ID NO: 912121 - protein, 12 aa, Mycobacterium
PPMTSTGSGPMI

SEQ ID NO: 912122 - protein, 11 aa, Mycobacterium
PPNASPPNLDH

SEQ ID NO: 912123 - protein, 5 aa, Mycobacterium
PPNGT

SEQ ID NO: 912124 - protein, 7 aa, Mycobacterium
PPNGTHG

SEQ ID NO: 912125 - protein, 10 aa, Mycobacterium
PPNPAPPNLD

SEQ ID NO: 912126 - protein, 13 aa, Mycobacterium
PPNPSPPKLNQSR

SEQ ID NO: 912127 - protein, 11 aa, Mycobacterium
PPNPSRPKLDP

SEQ ID NO: 912128 - protein, 11 aa, Mycobacterium
PPNSSRPNLSH

SEQ ID NO: 912129 - protein, 5 aa, Mycobacterium
PPNVD

SEQ ID NO: 912130 - protein, 18 aa, Mycobacterium
PPPAAHSSSETQAAKATA

SEQ ID NO: 912131 - protein, 29 aa, Mycobacterium
PPPAAYAPLPEDYNAAPPPPPPPPPPPNV

SEQ ID NO: 912132 - protein, 7 aa, Mycobacterium
PPPAEKQ

SEQ ID NO: 912133 - protein, 45 aa, Mycobacterium
PPPAPAPAPGEPAPQPGAPEPVPAPAPAPAAGVAPTVAPAPRTQP

SEQ ID NO: 912134 - protein, 10 aa, Mycobacterium
PPPATAGKAQ

SEQ ID NO: 912135 - protein, 5 aa, Mycobacterium
PPPCR

SEQ ID NO: 912136 - protein, 5 aa, Mycobacterium
PPPCT

SEQ ID NO: 912137 - protein, 17 aa, Mycobacterium
PPPEYTRYDDPQPPGTR

SEQ ID NO: 912138 - protein, 11 aa, Mycobacterium
PPPNQFPAATT

SEQ ID NO: 912139 - protein, 75 aa, Mycobacterium
PPPPAPAAPPPPDPLAPLGAPPVGGPPAAPAPAPAGPAPAPAGPAPAPGAPVPAGPAPTPTPSGPAPGEPVLTPV

SEQ ID NO: 912140 - protein, 59 aa, Mycobacterium
PPPPGEGGPPGPPGPPGRPGPPGPPGAPGPGGPPGGFGGPGGLGGPGGPMGTVSEDDPL

SEQ ID NO: 912141 - protein, 11 aa, Mycobacterium
PPPPPDAEGNP

SEQ ID NO: 912142 - protein, 41 aa, Mycobacterium
PPPPPPPAPDAPPPAEVPPVPAPVPTTPPPGAPPTGDVPPL

SEQ ID NO: 912143 - protein, 28 aa, Mycobacterium
PPPPPPPAPLPPGAPLPPPPAPPAPPAP

SEQ ID NO: 912144 - protein, 27 aa, Mycobacterium
PPPPPPPAPVAGPPAEPLPPGPPPPPG

SEQ ID NO: 912145 - protein, 43 aa, Mycobacterium
PPPPPPPRRPRAAVPPPSPTGRRIRRPRTNPRCPRSRRARPTG

SEQ ID NO: 912146 - protein, 8 aa, Mycobacterium
PPPPPSAR

SEQ ID NO: 912147 - protein, 6 aa, Mycobacterium
PPPPVD

SEQ ID NO: 912148 - protein, 5 aa, Mycobacterium
PPPQL

SEQ ID NO: 912149 - protein, 10 aa, Mycobacterium
PPPRPPTVKP

SEQ ID NO: 912150 - protein, 10 aa, Mycobacterium
PPPVESQYDT

SEQ ID NO: 912151 - protein, 23 aa, Mycobacterium
PPPVNESPSAAGDSATTAEDTPA

SEQ ID NO: 912152 - protein, 54 aa, Mycobacterium
PPPVPQRPATRSGSGSGASSGSGAGGAVAAEPAGAETEAVPAGEAADSTTPVTD

SEQ ID NO: 912153 - protein, 7 aa, Mycobacterium
PPPVQSQ

SEQ ID NO: 912154 - protein, 5 aa, Mycobacterium
PPQAL

SEQ ID NO: 912155 - protein, 13 aa, Mycobacterium
PPQAPADIGPLPT

SEQ ID NO: 912156 - protein, 25 aa, Mycobacterium
PPQAPAGTHWTPPTGVTMPGQAPPI

SEQ ID NO: 912157 - protein, 14 aa, Mycobacterium
PPQAPAQTQWTPPS

SEQ ID NO: 912158 - protein, 25 aa, Mycobacterium
PPQAPARTQWTPPTGVTMPGQAPPI

SEQ ID NO: 912159 - protein, 4 aa, Mycobacterium
PPQD

SEQ ID NO: 912160 - protein, 12 aa, Mycobacterium
PPQEAGAPNRIG

SEQ ID NO: 912161 - protein, 16 aa, Mycobacterium
PPQERGTPGPLSGPDL

SEQ ID NO: 912162 - protein, 4 aa, Mycobacterium
PPQG

SEQ ID NO: 912163 - protein, 5 aa, Mycobacterium
PPQMP

SEQ ID NO: 912164 - protein, 4 aa, Mycobacterium
PPQS

SEQ ID NO: 912165 - protein, 10 aa, Mycobacterium
PPQSRGRPGL

SEQ ID NO: 912166 - protein, 14 aa, Mycobacterium
PPQSRGRPGPIRGP

SEQ ID NO: 912167 - protein, 8 aa, Mycobacterium
PPQSVTMD

SEQ ID NO: 912168 - protein, 14 aa, Mycobacterium
PPQTPSPTSLRPDA

SEQ ID NO: 912169 - protein, 28 aa, Mycobacterium
PPRHGGRQRDRPRVAPDAPPWPRRAGHL

SEQ ID NO: 912170 - protein, 8 aa, Mycobacterium
PPRPAVPD

SEQ ID NO: 912171 - protein, 11 aa, Mycobacterium
PPRPVDAATDP

SEQ ID NO: 912172 - protein, 13 aa, Mycobacterium
PPRRDVADPDPEG

SEQ ID NO: 912173 - protein, 13 aa, Mycobacterium
PPRSDDDYDAATP

SEQ ID NO: 912174 - protein, 5 aa, Mycobacterium
PPRSL

SEQ ID NO: 912175 - protein, 5 aa, Mycobacterium
PPRWR

SEQ ID NO: 912176 - protein, 22 aa, Mycobacterium
PPRYPTPETVPTDPASPYAAGK

SEQ ID NO: 912177 - protein, 6 aa, Mycobacterium
PPSAAA

SEQ ID NO: 912178 - protein, 9 aa, Mycobacterium
PPSAAPPGN

SEQ ID NO: 912179 - protein, 8 aa, Mycobacterium
PPSASAWA

SEQ ID NO: 912180 - protein, 6 aa, Mycobacterium
PPSDDA

SEQ ID NO: 912181 - protein, 7 aa, Mycobacterium
PPSDDTV

SEQ ID NO: 912182 - protein, 8 aa, Mycobacterium
PPSDQTTV

SEQ ID NO: 912183 - protein, 8 aa, Mycobacterium
PPSGAKTV

SEQ ID NO: 912184 - protein, 67 aa, Mycobacterium
PPSPPPPPPQTANPQPPPTSLTSTSLPAPPPPGATSTPTPPPPPPGPGGNGPVLGPGGDGSNGGPDV

SEQ ID NO: 912185 - protein, 7 aa, Mycobacterium
PPSPSTA

SEQ ID NO: 912186 - protein, 13 aa, Mycobacterium
PPSPTPPAEGSLR

SEQ ID NO: 912187 - protein, 17 aa, Mycobacterium
PPSQRAADTPTLQDGDT

SEQ ID NO: 912188 - protein, 7 aa, Mycobacterium
PPSTPAH

SEQ ID NO: 912189 - protein, 18 aa, Mycobacterium
PPSWAAGGVPSVNATPTQ

SEQ ID NO: 912190 - protein, 8 aa, Mycobacterium
PPTAEPGL

SEQ ID NO: 912191 - protein, 11 aa, Mycobacterium
PPTAPPGTPGE

SEQ ID NO: 912192 - protein, 8 aa, Mycobacterium
PPTDEQMA

SEQ ID NO: 912193 - protein, 6 aa, Mycobacterium
PPTDIY

SEQ ID NO: 912194 - protein, 19 aa, Mycobacterium
PPTDPRYVEGGPGSQVPSV

SEQ ID NO: 912195 - protein, 13 aa, Mycobacterium
PPTDVAPRGKLTQ

SEQ ID NO: 912196 - protein, 12 aa, Mycobacterium
PPTDVPPEGNLR

SEQ ID NO: 912197 - protein, 12 aa, Mycobacterium
PPTDVRPAGKLR

SEQ ID NO: 912198 - protein, 7 aa, Mycobacterium
PPTHTIG

SEQ ID NO: 912199 - protein, 4 aa, Mycobacterium
PPTL

SEQ ID NO: 912200 - protein, 13 aa, Mycobacterium
PPTLESAYQEFMA

SEQ ID NO: 912201 - protein, 23 aa, Mycobacterium
PPTPDPEPWEAPPPPEEGAPLPP

SEQ ID NO: 912202 - protein, 11 aa, Mycobacterium
PPTPPDGTPGE

SEQ ID NO: 912203 - protein, 11 aa, Mycobacterium
PPTPPPGTPGE

SEQ ID NO: 912204 - protein, 8 aa, Mycobacterium
PPTPQTAV

SEQ ID NO: 912205 - protein, 11 aa, Mycobacterium
PPTPVDPNAPL

SEQ ID NO: 912206 - protein, 40 aa, Mycobacterium
PPTPYGDPAAAPAPPAAGSPPVPASAPPPIWPPVPVPAPV

SEQ ID NO: 912207 - protein, 12 aa, Mycobacterium
PPTRAEGGLNRD

SEQ ID NO: 912208 - protein, 8 aa, Mycobacterium
PPTSEPHE

SEQ ID NO: 912209 - protein, 8 aa, Mycobacterium
PPTSKPHA

SEQ ID NO: 912210 - protein, 8 aa, Mycobacterium
PPTSKPHE

SEQ ID NO: 912211 - protein, 9 aa, Mycobacterium
PPTSKPHPI

SEQ ID NO: 912212 - protein, 14 aa, Mycobacterium
PPTSTPHTPSTPGL

SEQ ID NO: 912213 - protein, 13 aa, Mycobacterium
PPVAQAGPTRARR

SEQ ID NO: 912214 - protein, 18 aa, Mycobacterium
PPVDSAPEGRLAPGATIP

SEQ ID NO: 912215 - protein, 5 aa, Mycobacterium
PPVGK

SEQ ID NO: 912216 - protein, 12 aa, Mycobacterium
PPVLPPNSTVTV

SEQ ID NO: 912217 - protein, 6 aa, Mycobacterium
PPVPAD

SEQ ID NO: 912218 - protein, 19 aa, Mycobacterium
PPVPARPATPADTDCDPRA

SEQ ID NO: 912219 - protein, 5 aa, Mycobacterium
PPVPD

SEQ ID NO: 912220 - protein, 8 aa, Mycobacterium
PPVPGDPY

SEQ ID NO: 912221 - protein, 6 aa, Mycobacterium
PPVTAQ

SEQ ID NO: 912222 - protein, 6 aa, Mycobacterium
PPWDPG

SEQ ID NO: 912223 - protein, 6 aa, Mycobacterium
PPYDVD

SEQ ID NO: 912224 - protein, 10 aa, Mycobacterium
PPYEGGPSLG

SEQ ID NO: 912225 - protein, 13 aa, Mycobacterium
PPYGVDGADGPVM

SEQ ID NO: 912226 - protein, 12 aa, Mycobacterium
PPYPPGSWAASD

SEQ ID NO: 912227 - protein, 4 aa, Mycobacterium
PPYY

SEQ ID NO: 912228 - protein, 17 aa, Mycobacterium
PQAAAAADCSPQGVSAT

SEQ ID NO: 912229 - protein, 7 aa, Mycobacterium
PQAAADG

SEQ ID NO: 912230 - protein, 8 aa, Mycobacterium
PQAAPTAL

SEQ ID NO: 912231 - protein, 15 aa, Mycobacterium
PQADGTLRGTQTETV

SEQ ID NO: 912232 - protein, 8 aa, Mycobacterium
PQAGDHGA

SEQ ID NO: 912233 - protein, 15 aa, Mycobacterium
PQAGTLTNHRSPEHD

SEQ ID NO: 912234 - protein, 46 aa, Mycobacterium
PQAIPPQAIPPQQAPPAAAPPAQAPPPAVGPPLPAEAPATPDPAAG

SEQ ID NO: 912235 - protein, 15 aa, Mycobacterium
PQALPTANGRRGNGR

SEQ ID NO: 912236 - protein, 19 aa, Mycobacterium
PQANPDQPWPGRLPEPSPT

SEQ ID NO: 912237 - protein, 28 aa, Mycobacterium
PQAPATAPATVPAATGTAPAVTPAANGV

SEQ ID NO: 912238 - protein, 8 aa, Mycobacterium
PQAPVPAD

SEQ ID NO: 912239 - protein, 14 aa, Mycobacterium
PQASGASTQPQLSR

SEQ ID NO: 912240 - protein, 15 aa, Mycobacterium
PQASGASTQPQLSRE

SEQ ID NO: 912241 - protein, 16 aa, Mycobacterium
PQAYTRTAGLLSRINL

SEQ ID NO: 912242 - protein, 6 aa, Mycobacterium
PQCTPE

SEQ ID NO: 912243 - protein, 30 aa, Mycobacterium
PQDCAKSATENTVPEGVKGNMAATTAEGDG

SEQ ID NO: 912244 - protein, 5 aa, Mycobacterium
PQDGS

SEQ ID NO: 912245 - protein, 7 aa, Mycobacterium
PQDTAPQ

SEQ ID NO: 912246 - protein, 7 aa, Mycobacterium
PQEADAL

SEQ ID NO: 912247 - protein, 5 aa, Mycobacterium
PQEAE

SEQ ID NO: 912248 - protein, 15 aa, Mycobacterium
PQEAEALQAAKAAPL

SEQ ID NO: 912249 - protein, 22 aa, Mycobacterium
PQELPPAAPDDQPVQLERFTPI

SEQ ID NO: 912250 - protein, 4 aa, Mycobacterium
PQEY

SEQ ID NO: 912251 - protein, 11 aa, Mycobacterium
PQFRPATSKWT

SEQ ID NO: 912252 - protein, 14 aa, Mycobacterium
PQFSNPGPNGTAAI

SEQ ID NO: 912253 - protein, 6 aa, Mycobacterium
PQGATH

SEQ ID NO: 912254 - protein, 18 aa, Mycobacterium
PQGNSAQQRYSSWPASYD

SEQ ID NO: 912255 - protein, 22 aa, Mycobacterium
PQGPELGRQQASIPHDTVAAGR

SEQ ID NO: 912256 - protein, 17 aa, Mycobacterium
PQGPKVTPGDGGMAAGM

SEQ ID NO: 912257 - protein, 9 aa, Mycobacterium
PQGPTRTEL

SEQ ID NO: 912258 - protein, 5 aa, Mycobacterium
PQGRF

SEQ ID NO: 912259 - protein, 11 aa, Mycobacterium
PQGRGGDSCTQ

SEQ ID NO: 912260 - protein, 12 aa, Mycobacterium
PQGYQAAGETFT

SEQ ID NO: 912261 - protein, 5 aa, Mycobacterium
PQHEY

SEQ ID NO: 912262 - protein, 7 aa, Mycobacterium
PQHTTSR

SEQ ID NO: 912263 - protein, 6 aa, Mycobacterium
PQIDGT

SEQ ID NO: 912264 - protein, 9 aa, Mycobacterium
PQIDHDGPA

SEQ ID NO: 912265 - protein, 12 aa, Mycobacterium
PQIGATGPVPGT

SEQ ID NO: 912266 - protein, 6 aa, Mycobacterium
PQIGSR

SEQ ID NO: 912267 - protein, 15 aa, Mycobacterium
PQIPLPNSTATLENF

SEQ ID NO: 912268 - protein, 16 aa, Mycobacterium
PQKGGSWRSTGCSSPL

SEQ ID NO: 912269 - protein, 7 aa, Mycobacterium
PQKLPEG

SEQ ID NO: 912270 - protein, 16 aa, Mycobacterium
PQKPSDSSLRPGATVT

SEQ ID NO: 912271 - protein, 10 aa, Mycobacterium
PQLGGRKPAG

SEQ ID NO: 912272 - protein, 7 aa, Mycobacterium
PQLPGGL

SEQ ID NO: 912273 - protein, 8 aa, Mycobacterium
PQLRKAGG

SEQ ID NO: 912274 - protein, 9 aa, Mycobacterium
PQLRKTGGH

SEQ ID NO: 912275 - protein, 6 aa, Mycobacterium
PQLSGR

SEQ ID NO: 912276 - protein, 10 aa, Mycobacterium
PQLSNKDASF

SEQ ID NO: 912277 - protein, 9 aa, Mycobacterium
PQLTQPNAA

SEQ ID NO: 912278 - protein, 9 aa, Mycobacterium
PQMPAPPPP

SEQ ID NO: 912279 - protein, 5 aa, Mycobacterium
PQNPE

SEQ ID NO: 912280 - protein, 7 aa, Mycobacterium
PQNVEEV

SEQ ID NO: 912281 - protein, 5 aa, Mycobacterium
PQPAR

SEQ ID NO: 912282 - protein, 10 aa, Mycobacterium
PQPDGSTRRE

SEQ ID NO: 912283 - protein, 4 aa, Mycobacterium
PQPG

SEQ ID NO: 912284 - protein, 6 aa, Mycobacterium
PQPGLG

SEQ ID NO: 912285 - protein, 4 aa, Mycobacterium
PQPI

SEQ ID NO: 912286 - protein, 5 aa, Mycobacterium
PQPLR

SEQ ID NO: 912287 - protein, 28 aa, Mycobacterium
PQPPFDSGSLAKADRATVDRATEYLDAR

SEQ ID NO: 912288 - protein, 5 aa, Mycobacterium
PQPQL

SEQ ID NO: 912289 - protein, 24 aa, Mycobacterium
PQPRTFAQTPGVDIPTSGPTAPQA

SEQ ID NO: 912290 - protein, 4 aa, Mycobacterium
PQQA

SEQ ID NO: 912291 - protein, 6 aa, Mycobacterium
PQQANR

SEQ ID NO: 912292 - protein, 6 aa, Mycobacterium
PQQARK

SEQ ID NO: 912293 - protein, 7 aa, Mycobacterium
PQQGQTF

SEQ ID NO: 912294 - protein, 11 aa, Mycobacterium
PQQQAATYSAP

SEQ ID NO: 912295 - protein, 13 aa, Mycobacterium
PQQRPSGDEETAY

SEQ ID NO: 912296 - protein, 7 aa, Mycobacterium
PQQRRKQ

SEQ ID NO: 912297 - protein, 10 aa, Mycobacterium
PQQRSSTAET

SEQ ID NO: 912298 - protein, 13 aa, Mycobacterium
PQQSAKKKPGWAQ

SEQ ID NO: 912299 - protein, 9 aa, Mycobacterium
PQRATADAC

SEQ ID NO: 912300 - protein, 8 aa, Mycobacterium
PQRDQSQV

SEQ ID NO: 912301 - protein, 10 aa, Mycobacterium
PQRKGPPTRT

SEQ ID NO: 912302 - protein, 7 aa, Mycobacterium
PQRPNGG

SEQ ID NO: 912303 - protein, 4 aa, Mycobacterium
PQRQ

SEQ ID NO: 912304 - protein, 22 aa, Mycobacterium
PQRQQRRASRGRHWGAPSPAQW

SEQ ID NO: 912305 - protein, 5 aa, Mycobacterium
PQRSK

SEQ ID NO: 912306 - protein, 6 aa, Mycobacterium
PQRTDI

SEQ ID NO: 912307 - protein, 7 aa, Mycobacterium
PQRTFTP

SEQ ID NO: 912308 - protein, 7 aa, Mycobacterium
PQRTPPV

SEQ ID NO: 912309 - protein, 17 aa, Mycobacterium
PQSAPTSAGWNTPASAA

SEQ ID NO: 912310 - protein, 11 aa, Mycobacterium
PQSGDGPALRN

SEQ ID NO: 912311 - protein, 7 aa, Mycobacterium
PQSKSEP

SEQ ID NO: 912312 - protein, 9 aa, Mycobacterium
PQSSGLGGG

SEQ ID NO: 912313 - protein, 11 aa, Mycobacterium
PQTATATTAGL

SEQ ID NO: 912314 - protein, 7 aa, Mycobacterium
PQTFTDR

SEQ ID NO: 912315 - protein, 9 aa, Mycobacterium
PQTPEASAD

SEQ ID NO: 912316 - protein, 7 aa, Mycobacterium
PQTSTAA

SEQ ID NO: 912317 - protein, 4 aa, Mycobacterium
PQVE

SEQ ID NO: 912318 - protein, 10 aa, Mycobacterium
PQVPGRRTAG

SEQ ID NO: 912319 - protein, 14 aa, Mycobacterium
PQVPQAPPIPPVPG

SEQ ID NO: 912320 - protein, 4 aa, Mycobacterium
PQVS

SEQ ID NO: 912321 - protein, 13 aa, Mycobacterium
PQVTSAPPTEPAM

SEQ ID NO: 912322 - protein, 4 aa, Mycobacterium
PQWP

SEQ ID NO: 912323 - protein, 21 aa, Mycobacterium
PQYNNPGPSGTADITGYRATN

SEQ ID NO: 912324 - protein, 6 aa, Mycobacterium
PRAAPR

SEQ ID NO: 912325 - protein, 7 aa, Mycobacterium
PRADWDP

SEQ ID NO: 912326 - protein, 8 aa, Mycobacterium
PRAGGAAI

SEQ ID NO: 912327 - protein, 8 aa, Mycobacterium
PRAPGEQR

SEQ ID NO: 912328 - protein, 8 aa, Mycobacterium
PRARAADD

SEQ ID NO: 912329 - protein, 12 aa, Mycobacterium
PRASDAVKELRQ

SEQ ID NO: 912330 - protein, 4 aa, Mycobacterium
PRAT

SEQ ID NO: 912331 - protein, 8 aa, Mycobacterium
PRAVKPDD

SEQ ID NO: 912332 - protein, 7 aa, Mycobacterium
PRDGRGP

SEQ ID NO: 912333 - protein, 4 aa, Mycobacterium
PRDH

SEQ ID NO: 912334 - protein, 14 aa, Mycobacterium
PRDHDLGGGAGGGM

SEQ ID NO: 912335 - protein, 26 aa, Mycobacterium
PRDPNGVPAITTGTNGSAGPLGFPTS

SEQ ID NO: 912336 - protein, 5 aa, Mycobacterium
PRDQR

SEQ ID NO: 912337 - protein, 15 aa, Mycobacterium
PRDSNIRQSSDLSGK

SEQ ID NO: 912338 - protein, 8 aa, Mycobacterium
PRDSPITK

SEQ ID NO: 912339 - protein, 15 aa, Mycobacterium
PRDSSVPIPGHGRDK

SEQ ID NO: 912340 - protein, 10 aa, Mycobacterium
PRDTDTPERS

SEQ ID NO: 912341 - protein, 4 aa, Mycobacterium
PRDV

SEQ ID NO: 912342 - protein, 10 aa, Mycobacterium
PRDVPGASQV

SEQ ID NO: 912343 - protein, 4 aa, Mycobacterium
PRER

SEQ ID NO: 912344 - protein, 13 aa, Mycobacterium
PRETPSPATPLQG

SEQ ID NO: 912345 - protein, 4 aa, Mycobacterium
PREW

SEQ ID NO: 912346 - protein, 34 aa, Mycobacterium
PRFATNTGARPQGAATTTPPPSGPPPIAAPKNDL

SEQ ID NO: 912347 - protein, 4 aa, Mycobacterium
PRFG

SEQ ID NO: 912348 - protein, 5 aa, Mycobacterium
PRGAG

SEQ ID NO: 912349 - protein, 7 aa, Mycobacterium
PRGEFAS

SEQ ID NO: 912350 - protein, 7 aa, Mycobacterium
PRGEWRS

SEQ ID NO: 912351 - protein, 9 aa, Mycobacterium
PRGEWRSEG

SEQ ID NO: 912352 - protein, 8 aa, Mycobacterium
PRGPGEQR

SEQ ID NO: 912353 - protein, 15 aa, Mycobacterium
PRGPLVPSGATGYRI

SEQ ID NO: 912354 - protein, 7 aa, Mycobacterium
PRGPRGE

SEQ ID NO: 912355 - protein, 6 aa, Mycobacterium
PRGRTL

SEQ ID NO: 912356 - protein, 5 aa, Mycobacterium
PRGSE

SEQ ID NO: 912357 - protein, 5 aa, Mycobacterium
PRGTT

SEQ ID NO: 912358 - protein, 9 aa, Mycobacterium
PRGTTEGQS

SEQ ID NO: 912359 - protein, 10 aa, Mycobacterium
PRGVASSSPA

SEQ ID NO: 912360 - protein, 8 aa, Mycobacterium
PRGVGASR

SEQ ID NO: 912361 - protein, 11 aa, Mycobacterium
PRGVGGSTPTL

SEQ ID NO: 912362 - protein, 10 aa, Mycobacterium
PRGVGHSTPE

SEQ ID NO: 912363 - protein, 10 aa, Mycobacterium
PRGVGHSTPQ

SEQ ID NO: 912364 - protein, 9 aa, Mycobacterium
PRGVGSSRP

SEQ ID NO: 912365 - protein, 11 aa, Mycobacterium
PRGYAQGSGKI

SEQ ID NO: 912366 - protein, 5 aa, Mycobacterium
PRHDR

SEQ ID NO: 912367 - protein, 19 aa, Mycobacterium
PRHPEEVTNPISTGAGQYR

SEQ ID NO: 912368 - protein, 19 aa, Mycobacterium
PRIAAPGGAGFPAGSDALK

SEQ ID NO: 912369 - protein, 7 aa, Mycobacterium
PRIDSTR

SEQ ID NO: 912370 - protein, 16 aa, Mycobacterium
PRIDTYPSTAPPTPAA

SEQ ID NO: 912371 - protein, 4 aa, Mycobacterium
PRIP

SEQ ID NO: 912372 - protein, 19 aa, Mycobacterium
PRIPAPGGSGFAAGNDALQ

SEQ ID NO: 912373 - protein, 7 aa, Mycobacterium
PRKGAAR

SEQ ID NO: 912374 - protein, 8 aa, Mycobacterium
PRKKAARR

SEQ ID NO: 912375 - protein, 9 aa, Mycobacterium
PRKKAARRT

SEQ ID NO: 912376 - protein, 5 aa, Mycobacterium
PRKPR

SEQ ID NO: 912377 - protein, 8 aa, Mycobacterium
PRKQGARS

SEQ ID NO: 912378 - protein, 8 aa, Mycobacterium
PRKSGARR

SEQ ID NO: 912379 - protein, 4 aa, Mycobacterium
PRLD

SEQ ID NO: 912380 - protein, 6 aa, Mycobacterium
PRLGEN

SEQ ID NO: 912381 - protein, 13 aa, Mycobacterium
PRLGTQRGPVPGV

SEQ ID NO: 912382 - protein, 8 aa, Mycobacterium
PRLPDGRQ

SEQ ID NO: 912383 - protein, 5 aa, Mycobacterium
PRLTN

SEQ ID NO: 912384 - protein, 11 aa, Mycobacterium
PRMGNKGASVA

SEQ ID NO: 912385 - protein, 4 aa, Mycobacterium
PRNA

SEQ ID NO: 912386 - protein, 7 aa, Mycobacterium
PRNPAGK

SEQ ID NO: 912387 - protein, 11 aa, Mycobacterium
PRNSDTAERFN

SEQ ID NO: 912388 - protein, 10 aa, Mycobacterium
PRPADRASDT

SEQ ID NO: 912389 - protein, 17 aa, Mycobacterium
PRPASAPCGPGDPGAAF

SEQ ID NO: 912390 - protein, 5 aa, Mycobacterium
PRPAV

SEQ ID NO: 912391 - protein, 7 aa, Mycobacterium
PRPDPLP

SEQ ID NO: 912392 - protein, 7 aa, Mycobacterium
PRPGPID

SEQ ID NO: 912393 - protein, 6 aa, Mycobacterium
PRPGTP

SEQ ID NO: 912394 - protein, 9 aa, Mycobacterium
PRPGTRGRA

SEQ ID NO: 912395 - protein, 4 aa, Mycobacterium
PRPL

SEQ ID NO: 912396 - protein, 9 aa, Mycobacterium
PRPRSCEGA

SEQ ID NO: 912397 - protein, 16 aa, Mycobacterium
PRPTPAEMTEQEPNRA

SEQ ID NO: 912398 - protein, 9 aa, Mycobacterium
PRPVAPGSD

SEQ ID NO: 912399 - protein, 5 aa, Mycobacterium
PRPWP

SEQ ID NO: 912400 - protein, 5 aa, Mycobacterium
PRQAE

SEQ ID NO: 912401 - protein, 5 aa, Mycobacterium
PRQDT

SEQ ID NO: 912402 - protein, 10 aa, Mycobacterium
PRQPQPVPPI

SEQ ID NO: 912403 - protein, 14 aa, Mycobacterium
PRQPYQEKPPSDWD

SEQ ID NO: 912404 - protein, 14 aa, Mycobacterium
PRRDPRRQALSGSH

SEQ ID NO: 912405 - protein, 11 aa, Mycobacterium
PRRGAPQARHG

SEQ ID NO: 912406 - protein, 8 aa, Mycobacterium
PRRNAELD

SEQ ID NO: 912407 - protein, 6 aa, Mycobacterium
PRRRAD

SEQ ID NO: 912408 - protein, 9 aa, Mycobacterium
PRRRKPSAV

SEQ ID NO: 912409 - protein, 5 aa, Mycobacterium
PRRRP

SEQ ID NO: 912410 - protein, 15 aa, Mycobacterium
PRRRQRASASAAQLS

SEQ ID NO: 912411 - protein, 5 aa, Mycobacterium
PRRST

SEQ ID NO: 912412 - protein, 10 aa, Mycobacterium
PRRTDSLDPD

SEQ ID NO: 912413 - protein, 27 aa, Mycobacterium
PRRVEGPDPVPAYGSSVNGAPCTPACS

SEQ ID NO: 912414 - protein, 5 aa, Mycobacterium
PRRYQ

SEQ ID NO: 912415 - protein, 9 aa, Mycobacterium
PRSADEIDP

SEQ ID NO: 912416 - protein, 8 aa, Mycobacterium
PRSGDQNA

SEQ ID NO: 912417 - protein, 15 aa, Mycobacterium
PRSGDWRAKTDDDAA

SEQ ID NO: 912418 - protein, 17 aa, Mycobacterium
PRSKRDDVQYGGGAAFG

SEQ ID NO: 912419 - protein, 8 aa, Mycobacterium
PRSPDEQR

SEQ ID NO: 912420 - protein, 8 aa, Mycobacterium
PRSPDQQR

SEQ ID NO: 912421 - protein, 18 aa, Mycobacterium
PRSRATGYNGGRPECDTA

SEQ ID NO: 912422 - protein, 10 aa, Mycobacterium
PRSSDTPERS

SEQ ID NO: 912423 - protein, 21 aa, Mycobacterium
PRSTYARTPVAQTPADPDADL

SEQ ID NO: 912424 - protein, 7 aa, Mycobacterium
PRTAAAA

SEQ ID NO: 912425 - protein, 6 aa, Mycobacterium
PRTANG

SEQ ID NO: 912426 - protein, 7 aa, Mycobacterium
PRTDTVR

SEQ ID NO: 912427 - protein, 7 aa, Mycobacterium
PRTGGAS

SEQ ID NO: 912428 - protein, 9 aa, Mycobacterium
PRTGNQNAQ

SEQ ID NO: 912429 - protein, 6 aa, Mycobacterium
PRTPPF

SEQ ID NO: 912430 - protein, 11 aa, Mycobacterium
PRTTKGEGREL

SEQ ID NO: 912431 - protein, 16 aa, Mycobacterium
PRTVPSSSCLSSSSSR

SEQ ID NO: 912432 - protein, 14 aa, Mycobacterium
PRVNAKGGPEGRPG

SEQ ID NO: 912433 - protein, 4 aa, Mycobacterium
PRVP

SEQ ID NO: 912434 - protein, 9 aa, Mycobacterium
PRVQATGAT

SEQ ID NO: 912435 - protein, 4 aa, Mycobacterium
PRVT

SEQ ID NO: 912436 - protein, 4 aa, Mycobacterium
PRWG

SEQ ID NO: 912437 - protein, 8 aa, Mycobacterium
PRWGTPEE

SEQ ID NO: 912438 - protein, 4 aa, Mycobacterium
PRYG

SEQ ID NO: 912439 - protein, 9 aa, Mycobacterium
PRYNADDRT

SEQ ID NO: 912440 - protein, 15 aa, Mycobacterium
PRYPPVSGRPPLPLG

SEQ ID NO: 912441 - protein, 15 aa, Mycobacterium
PSAAATPLRTGGPSC

SEQ ID NO: 912442 - protein, 8 aa, Mycobacterium
PSAAAVSA

SEQ ID NO: 912443 - protein, 14 aa, Mycobacterium
PSAADAGTCWPSTP

SEQ ID NO: 912444 - protein, 6 aa, Mycobacterium
PSAAQA

SEQ ID NO: 912445 - protein, 17 aa, Mycobacterium
PSACHSADSVAGDRPNA

SEQ ID NO: 912446 - protein, 7 aa, Mycobacterium
PSADATT

SEQ ID NO: 912447 - protein, 8 aa, Mycobacterium
PSADKARS

SEQ ID NO: 912448 - protein, 9 aa, Mycobacterium
PSAGAPGDA

SEQ ID NO: 912449 - protein, 4 aa, Mycobacterium
PSAI

SEQ ID NO: 912450 - protein, 7 aa, Mycobacterium
PSAKQHR

SEQ ID NO: 912451 - protein, 18 aa, Mycobacterium
PSALAEPTGPGLPEPAPA

SEQ ID NO: 912452 - protein, 15 aa, Mycobacterium
PSALAGPEDGESAAD

SEQ ID NO: 912453 - protein, 10 aa, Mycobacterium
PSALNKQPYT

SEQ ID NO: 912454 - protein, 6 aa, Mycobacterium
PSANPY

SEQ ID NO: 912455 - protein, 25 aa, Mycobacterium
PSARAGRAQGRREAREIAEFLEELA

SEQ ID NO: 912456 - protein, 28 aa, Mycobacterium
PSASADPEVPAPPVPVEPAAPPAPPNPF

SEQ ID NO: 912457 - protein, 22 aa, Mycobacterium
PSATADPSVPGDPTGQIYTPPG

SEQ ID NO: 912458 - protein, 8 aa, Mycobacterium
PSATALSD

SEQ ID NO: 912459 - protein, 16 aa, Mycobacterium
PSATGSASQPQLSPPA

SEQ ID NO: 912460 - protein, 9 aa, Mycobacterium
PSATPDQID

SEQ ID NO: 912461 - protein, 8 aa, Mycobacterium
PSATTLNG

SEQ ID NO: 912462 - protein, 13 aa, Mycobacterium
PSAVAEKYKGPIT

SEQ ID NO: 912463 - protein, 7 aa, Mycobacterium
PSAWGSA

SEQ ID NO: 912464 - protein, 12 aa, Mycobacterium
PSCGRPAQPITA

SEQ ID NO: 912465 - protein, 4 aa, Mycobacterium
PSDA

SEQ ID NO: 912466 - protein, 15 aa, Mycobacterium
PSDADLDAPGSQRSL

SEQ ID NO: 912467 - protein, 5 aa, Mycobacterium
PSDAV

SEQ ID NO: 912468 - protein, 20 aa, Mycobacterium
PSDCEGKTSVNGDGARTEPF

SEQ ID NO: 912469 - protein, 10 aa, Mycobacterium
PSDDEDATYY

SEQ ID NO: 912470 - protein, 5 aa, Mycobacterium
PSDDI

SEQ ID NO: 912471 - protein, 13 aa, Mycobacterium
PSDDSPGCTPSDY

SEQ ID NO: 912472 - protein, 12 aa, Mycobacterium
PSDEEDSPEAKY

SEQ ID NO: 912473 - protein, 9 aa, Mycobacterium
PSDEGIPIT

SEQ ID NO: 912474 - protein, 5 aa, Mycobacterium
PSDES

SEQ ID NO: 912475 - protein, 4 aa, Mycobacterium
PSDQ

SEQ ID NO: 912476 - protein, 8 aa, Mycobacterium
PSDQNTVQ

SEQ ID NO: 912477 - protein, 7 aa, Mycobacterium
PSEADAL

SEQ ID NO: 912478 - protein, 6 aa, Mycobacterium
PSEEAG

SEQ ID NO: 912479 - protein, 10 aa, Mycobacterium
PSEFDKDTRD

SEQ ID NO: 912480 - protein, 7 aa, Mycobacterium
PSEGGSF

SEQ ID NO: 912481 - protein, 4 aa, Mycobacterium
PSEV

SEQ ID NO: 912482 - protein, 8 aa, Mycobacterium
PSFPYEGR

SEQ ID NO: 912483 - protein, 7 aa, Mycobacterium
PSGAAQA

SEQ ID NO: 912484 - protein, 10 aa, Mycobacterium
PSGADPRSYY

SEQ ID NO: 912485 - protein, 11 aa, Mycobacterium
PSGAEAGPDGL

SEQ ID NO: 912486 - protein, 20 aa, Mycobacterium
PSGAEDGPEGLSNVPAQGGT

SEQ ID NO: 912487 - protein, 7 aa, Mycobacterium
PSGAPAV

SEQ ID NO: 912488 - protein, 8 aa, Mycobacterium
PSGDATSL

SEQ ID NO: 912489 - protein, 6 aa, Mycobacterium
PSGDVT

SEQ ID NO: 912490 - protein, 10 aa, Mycobacterium
PSGEASDLEP

SEQ ID NO: 912491 - protein, 18 aa, Mycobacterium
PSGELREAPHAEWSVRVV

SEQ ID NO: 912492 - protein, 7 aa, Mycobacterium
PSGELVG

SEQ ID NO: 912493 - protein, 4 aa, Mycobacterium
PSGG

SEQ ID NO: 912494 - protein, 12 aa, Mycobacterium
PSGGRVNATTDL

SEQ ID NO: 912495 - protein, 5 aa, Mycobacterium
PSGGV

SEQ ID NO: 912496 - protein, 13 aa, Mycobacterium
PSGGVRGGDARLT

SEQ ID NO: 912497 - protein, 7 aa, Mycobacterium
PSGINGL

SEQ ID NO: 912498 - protein, 4 aa, Mycobacterium
PSGL

SEQ ID NO: 912499 - protein, 11 aa, Mycobacterium
PSGLSADDGLP

SEQ ID NO: 912500 - protein, 11 aa, Mycobacterium
PSGNEAGANEQ

SEQ ID NO: 912501 - protein, 10 aa, Mycobacterium
PSGPAGRVSV

SEQ ID NO: 912502 - protein, 10 aa, Mycobacterium
PSGPQRPEIS

SEQ ID NO: 912503 - protein, 7 aa, Mycobacterium
PSGQISY

SEQ ID NO: 912504 - protein, 5 aa, Mycobacterium
PSGQL

SEQ ID NO: 912505 - protein, 11 aa, Mycobacterium
PSGRPLVSDPG

SEQ ID NO: 912506 - protein, 6 aa, Mycobacterium
PSGRRR

SEQ ID NO: 912507 - protein, 4 aa, Mycobacterium
PSGS

SEQ ID NO: 912508 - protein, 12 aa, Mycobacterium
PSGSAPAEPSEL

SEQ ID NO: 912509 - protein, 5 aa, Mycobacterium
PSGSC

SEQ ID NO: 912510 - protein, 11 aa, Mycobacterium
PSGSKPNPPQD

SEQ ID NO: 912511 - protein, 22 aa, Mycobacterium
PSGTAAADEGLDPNAAPGPDAV

SEQ ID NO: 912512 - protein, 8 aa, Mycobacterium
PSGTAGSV

SEQ ID NO: 912513 - protein, 16 aa, Mycobacterium
PSGTTLASPSASDLES

SEQ ID NO: 912514 - protein, 12 aa, Mycobacterium
PSIAGTDTSGRS

SEQ ID NO: 912515 - protein, 45 aa, Mycobacterium
PSINNGMNPAPADRLPPGGTPPPVSDPLQRPGSGTVQCNGQQPNP

SEQ ID NO: 912516 - protein, 10 aa, Mycobacterium
PSIPGDSGGP

SEQ ID NO: 912517 - protein, 18 aa, Mycobacterium
PSITGTAIPSASAADCPD

SEQ ID NO: 912518 - protein, 13 aa, Mycobacterium
PSLGGPPAPPQLP

SEQ ID NO: 912519 - protein, 8 aa, Mycobacterium
PSLGPAAD

SEQ ID NO: 912520 - protein, 20 aa, Mycobacterium
PSLPEGWRANSGGRDSVDGV

SEQ ID NO: 912521 - protein, 5 aa, Mycobacterium
PSLPN

SEQ ID NO: 912522 - protein, 6 aa, Mycobacterium
PSLPNL

SEQ ID NO: 912523 - protein, 5 aa, Mycobacterium
PSLPT

SEQ ID NO: 912524 - protein, 15 aa, Mycobacterium
PSLSYTPAADFDGTD

SEQ ID NO: 912525 - protein, 5 aa, Mycobacterium
PSLTP

SEQ ID NO: 912526 - protein, 5 aa, Mycobacterium
PSMGR

SEQ ID NO: 912527 - protein, 10 aa, Mycobacterium
PSMSGQSLAA

SEQ ID NO: 912528 - protein, 7 aa, Mycobacterium
PSNDPSV

SEQ ID NO: 912529 - protein, 17 aa, Mycobacterium
PSNLDAEESWTAPGDVA

SEQ ID NO: 912530 - protein, 10 aa, Mycobacterium
PSNRDGMPGQ

SEQ ID NO: 912531 - protein, 9 aa, Mycobacterium
PSNTASDYY

SEQ ID NO: 912532 - protein, 10 aa, Mycobacterium
PSNYPDGKSL

SEQ ID NO: 912533 - protein, 10 aa, Mycobacterium
PSNYPDQKAL

SEQ ID NO: 912534 - protein, 15 aa, Mycobacterium
PSPADSPSPWGAGTA

SEQ ID NO: 912535 - protein, 13 aa, Mycobacterium
PSPAEASEIPAPY

SEQ ID NO: 912536 - protein, 18 aa, Mycobacterium
PSPAEDKDTLAVTEETAQ

SEQ ID NO: 912537 - protein, 6 aa, Mycobacterium
PSPAMG

SEQ ID NO: 912538 - protein, 5 aa, Mycobacterium
PSPCT

SEQ ID NO: 912539 - protein, 5 aa, Mycobacterium
PSPEG

SEQ ID NO: 912540 - protein, 9 aa, Mycobacterium
PSPGSVNRH

SEQ ID NO: 912541 - protein, 4 aa, Mycobacterium
PSPL

SEQ ID NO: 912542 - protein, 9 aa, Mycobacterium
PSPLSSGAA

SEQ ID NO: 912543 - protein, 14 aa, Mycobacterium
PSPPAGGFSPGGHN

SEQ ID NO: 912544 - protein, 21 aa, Mycobacterium
PSPPPGLAEPGDERRARADAD

SEQ ID NO: 912545 - protein, 20 aa, Mycobacterium
PSPQEKTTVPEPTKKVGGEV

SEQ ID NO: 912546 - protein, 7 aa, Mycobacterium
PSPTEPG

SEQ ID NO: 912547 - protein, 33 aa, Mycobacterium
PSPTEPGQWAPAPPPGPVPPGPAPAVAPPAPGV

SEQ ID NO: 912548 - protein, 6 aa, Mycobacterium
PSPYSG

SEQ ID NO: 912549 - protein, 4 aa, Mycobacterium
PSQA

SEQ ID NO: 912550 - protein, 6 aa, Mycobacterium
PSQALP

SEQ ID NO: 912551 - protein, 6 aa, Mycobacterium
PSQALT

SEQ ID NO: 912552 - protein, 7 aa, Mycobacterium
PSQAMGP

SEQ ID NO: 912553 - protein, 8 aa, Mycobacterium
PSQAPGDE

SEQ ID NO: 912554 - protein, 18 aa, Mycobacterium
PSQGYDSRGTTYDPNSSV

SEQ ID NO: 912555 - protein, 12 aa, Mycobacterium
PSRAPFDGNVSQ

SEQ ID NO: 912556 - protein, 5 aa, Mycobacterium
PSRNG

SEQ ID NO: 912557 - protein, 7 aa, Mycobacterium
PSRPGGG

SEQ ID NO: 912558 - protein, 16 aa, Mycobacterium
PSRPSFRTSSQERSRG

SEQ ID NO: 912559 - protein, 18 aa, Mycobacterium
PSRQMDAGYASGYGNSKW

SEQ ID NO: 912560 - protein, 4 aa, Mycobacterium
PSRR

SEQ ID NO: 912561 - protein, 7 aa, Mycobacterium
PSSAGPG

SEQ ID NO: 912562 - protein, 15 aa, Mycobacterium
PSSEVTAGTATADIR

SEQ ID NO: 912563 - protein, 9 aa, Mycobacterium
PSSFNNQTY

SEQ ID NO: 912564 - protein, 9 aa, Mycobacterium
PSSGPPAAA

SEQ ID NO: 912565 - protein, 7 aa, Mycobacterium
PSSGPYK

SEQ ID NO: 912566 - protein, 14 aa, Mycobacterium
PSSGYARADPQACV

SEQ ID NO: 912567 - protein, 7 aa, Mycobacterium
PSSPVSL

SEQ ID NO: 912568 - protein, 10 aa, Mycobacterium
PSSRADYVDP

SEQ ID NO: 912569 - protein, 7 aa, Mycobacterium
PSSSQLS

SEQ ID NO: 912570 - protein, 9 aa, Mycobacterium
PSSSQVSAA

SEQ ID NO: 912571 - protein, 9 aa, Mycobacterium
PSSTTTNGA

SEQ ID NO: 912572 - protein, 4 aa, Mycobacterium
PSSV

SEQ ID NO: 912573 - protein, 9 aa, Mycobacterium
PSTGHDPSH

SEQ ID NO: 912574 - protein, 4 aa, Mycobacterium
PSTI

SEQ ID NO: 912575 - protein, 6 aa, Mycobacterium
PSTLPT

SEQ ID NO: 912576 - protein, 5 aa, Mycobacterium
PSTLQ

SEQ ID NO: 912577 - protein, 10 aa, Mycobacterium
PSTPRDGKGL

SEQ ID NO: 912578 - protein, 28 aa, Mycobacterium
PSTSPGSVTSTGSGIGHREPGISGSPAF

SEQ ID NO: 912579 - protein, 17 aa, Mycobacterium
PSTSTIGTDYTNQYRPV

SEQ ID NO: 912580 - protein, 7 aa, Mycobacterium
PSTTPTS

SEQ ID NO: 912581 - protein, 4 aa, Mycobacterium
PSTV

SEQ ID NO: 912582 - protein, 9 aa, Mycobacterium
PSTVAPDTA

SEQ ID NO: 912583 - protein, 9 aa, Mycobacterium
PSTVAPPDR

SEQ ID NO: 912584 - protein, 6 aa, Mycobacterium
PSVAAG

SEQ ID NO: 912585 - protein, 14 aa, Mycobacterium
PSVDGKPRETRAQD

SEQ ID NO: 912586 - protein, 5 aa, Mycobacterium
PSVED

SEQ ID NO: 912587 - protein, 8 aa, Mycobacterium
PSVHGRGD

SEQ ID NO: 912588 - protein, 25 aa, Mycobacterium
PSVPGTPGARPATPDPNPASTPGVI

SEQ ID NO: 912589 - protein, 10 aa, Mycobacterium
PSVPPVARPK

SEQ ID NO: 912590 - protein, 4 aa, Mycobacterium
PSVT

SEQ ID NO: 912591 - protein, 7 aa, Mycobacterium
PSVTEDS

SEQ ID NO: 912592 - protein, 15 aa, Mycobacterium
PSWAAPSSGSASALS

SEQ ID NO: 912593 - protein, 6 aa, Mycobacterium
PSWSLD

SEQ ID NO: 912594 - protein, 5 aa, Mycobacterium
PSYPT

SEQ ID NO: 912595 - protein, 5 aa, Mycobacterium
PSYQQ

SEQ ID NO: 912596 - protein, 6 aa, Mycobacterium
PSYRAA

SEQ ID NO: 912597 - protein, 6 aa, Mycobacterium
PSYTYP

SEQ ID NO: 912598 - protein, 8 aa, Mycobacterium
PTAAANPA

SEQ ID NO: 912599 - protein, 10 aa, Mycobacterium
PTAADQASAL

SEQ ID NO: 912600 - protein, 35 aa, Mycobacterium
PTAAGHTPARAGAPAAVAPQTPARAASPAAPAQAP

SEQ ID NO: 912601 - protein, 14 aa, Mycobacterium
PTAAPAARPSAEQI

SEQ ID NO: 912602 - protein, 9 aa, Mycobacterium
PTAAPTPDV

SEQ ID NO: 912603 - protein, 4 aa, Mycobacterium
PTAD

SEQ ID NO: 912604 - protein, 8 aa, Mycobacterium
PTADETLA

SEQ ID NO: 912605 - protein, 12 aa, Mycobacterium
PTADGEPGNDDL

SEQ ID NO: 912606 - protein, 6 aa, Mycobacterium
PTADSD

SEQ ID NO: 912607 - protein, 5 aa, Mycobacterium
PTAEH

SEQ ID NO: 912608 - protein, 19 aa, Mycobacterium
PTAEHKFSADGPAWEPGQL

SEQ ID NO: 912609 - protein, 19 aa, Mycobacterium
PTAERRFSAGGSAWEPAQL

SEQ ID NO: 912610 - protein, 21 aa, Mycobacterium
PTAETEDSTGGTTESGISSNR

SEQ ID NO: 912611 - protein, 18 aa, Mycobacterium
PTAGAKNGDTHITGQGVE

SEQ ID NO: 912612 - protein, 10 aa, Mycobacterium
PTAGAQTSTW

SEQ ID NO: 912613 - protein, 26 aa, Mycobacterium
PTAGTATVNSDGTVSYASDGSEITTD

SEQ ID NO: 912614 - protein, 35 aa, Mycobacterium
PTAGTTNVAARQSEPNTKFEPQAITETKATDPDTT

SEQ ID NO: 912615 - protein, 4 aa, Mycobacterium
PTAL

SEQ ID NO: 912616 - protein, 8 aa, Mycobacterium
PTAPGRQY

SEQ ID NO: 912617 - protein, 10 aa, Mycobacterium
PTAPPGTAGE

SEQ ID NO: 912618 - protein, 15 aa, Mycobacterium
PTAPPVAFGDGKAAR

SEQ ID NO: 912619 - protein, 10 aa, Mycobacterium
PTAQASPLDG

SEQ ID NO: 912620 - protein, 25 aa, Mycobacterium
PTAQGSQATGVAPGCAGQALWTRWK

SEQ ID NO: 912621 - protein, 18 aa, Mycobacterium
PTAQSDPAPEPQGRSPFG

SEQ ID NO: 912622 - protein, 7 aa, Mycobacterium
PTAREQN

SEQ ID NO: 912623 - protein, 8 aa, Mycobacterium
PTARQANT

SEQ ID NO: 912624 - protein, 9 aa, Mycobacterium
PTASAAPTL

SEQ ID NO: 912625 - protein, 39 aa, Mycobacterium
PTASAGPIAPTPNPPIPGSANAPSRGSMANQPGNDGNTG

SEQ ID NO: 912626 - protein, 10 aa, Mycobacterium
PTASQLGSEW

SEQ ID NO: 912627 - protein, 4 aa, Mycobacterium
PTAT

SEQ ID NO: 912628 - protein, 13 aa, Mycobacterium
PTATVSGDSISAD

SEQ ID NO: 912629 - protein, 12 aa, Mycobacterium
PTAYDGDSPAEV

SEQ ID NO: 912630 - protein, 5 aa, Mycobacterium
PTDAA

SEQ ID NO: 912631 - protein, 21 aa, Mycobacterium
PTDAARQQAASPDASDEDRQD

SEQ ID NO: 912632 - protein, 17 aa, Mycobacterium
PTDADLDTPGSTRSTAY

SEQ ID NO: 912633 - protein, 8 aa, Mycobacterium
PTDARRRL

SEQ ID NO: 912634 - protein, 11 aa, Mycobacterium
PTDDEARDFAS

SEQ ID NO: 912635 - protein, 11 aa, Mycobacterium
PTDKAFKTSGC

SEQ ID NO: 912636 - protein, 34 aa, Mycobacterium
PTDKAFKTSGCQPWQSTPDADVPAELPGPAAGGQ

SEQ ID NO: 912637 - protein, 10 aa, Mycobacterium
PTDKAFRTSG

SEQ ID NO: 912638 - protein, 18 aa, Mycobacterium
PTDKNDPNSGMGTNPEDL

SEQ ID NO: 912639 - protein, 12 aa, Mycobacterium
PTDLTDESAVSG

SEQ ID NO: 912640 - protein, 4 aa, Mycobacterium
PTDP

SEQ ID NO: 912641 - protein, 6 aa, Mycobacterium
PTDPGV

SEQ ID NO: 912642 - protein, 5 aa, Mycobacterium
PTDQL

SEQ ID NO: 912643 - protein, 15 aa, Mycobacterium
PTDTGITNAATGATR

SEQ ID NO: 912644 - protein, 18 aa, Mycobacterium
PTDTGITNAPAGSTHAGR

SEQ ID NO: 912645 - protein, 22 aa, Mycobacterium
PTDTPPPSSPPPPPPRPYEPPP

SEQ ID NO: 912646 - protein, 10 aa, Mycobacterium
PTEDPERGRL

SEQ ID NO: 912647 - protein, 7 aa, Mycobacterium
PTEEGAL

SEQ ID NO: 912648 - protein, 7 aa, Mycobacterium
PTEKPAD

SEQ ID NO: 912649 - protein, 5 aa, Mycobacterium
PTEPT

SEQ ID NO: 912650 - protein, 23 aa, Mycobacterium
PTEPVTPASAVETEDEPDSPASS

SEQ ID NO: 912651 - protein, 9 aa, Mycobacterium
PTFDTTGTL

SEQ ID NO: 912652 - protein, 9 aa, Mycobacterium
PTFSRGGDM

SEQ ID NO: 912653 - protein, 6 aa, Mycobacterium
PTGAGN

SEQ ID NO: 912654 - protein, 11 aa, Mycobacterium
PTGAGSNNIHS

SEQ ID NO: 912655 - protein, 11 aa, Mycobacterium
PTGDRIRTTTN

SEQ ID NO: 912656 - protein, 4 aa, Mycobacterium
PTGF

SEQ ID NO: 912657 - protein, 9 aa, Mycobacterium
PTGKTVVPD

SEQ ID NO: 912658 - protein, 10 aa, Mycobacterium
PTGKTVVPDP

SEQ ID NO: 912659 - protein, 4 aa, Mycobacterium
PTGP

SEQ ID NO: 912660 - protein, 9 aa, Mycobacterium
PTGPPPDNQ

SEQ ID NO: 912661 - protein, 19 aa, Mycobacterium
PTGPVDGAPDGLSPKIGAT

SEQ ID NO: 912662 - protein, 6 aa, Mycobacterium
PTGRLR

SEQ ID NO: 912663 - protein, 12 aa, Mycobacterium
PTGTAAAGADPQ

SEQ ID NO: 912664 - protein, 12 aa, Mycobacterium
PTGTAAAGADSQ

SEQ ID NO: 912665 - protein, 7 aa, Mycobacterium
PTGTTAL

SEQ ID NO: 912666 - protein, 7 aa, Mycobacterium
PTGVPDT

SEQ ID NO: 912667 - protein, 13 aa, Mycobacterium
PTHHASLDRYETS

SEQ ID NO: 912668 - protein, 4 aa, Mycobacterium
PTIG

SEQ ID NO: 912669 - protein, 7 aa, Mycobacterium
PTIPGKG

SEQ ID NO: 912670 - protein, 9 aa, Mycobacterium
PTIPQSGGD

SEQ ID NO: 912671 - protein, 13 aa, Mycobacterium
PTIPTGSDLAAPA

SEQ ID NO: 912672 - protein, 77 aa, Mycobacterium
PTIPTPQSAAAEATAASASPVNSNHDAEKTTKTAVGQITDAGTNSAASSNRATAQTQTATTSDTSPNTQAKQRTNLG

SEQ ID NO: 912673 - protein, 4 aa, Mycobacterium
PTKA

SEQ ID NO: 912674 - protein, 7 aa, Mycobacterium
PTKIEQE

SEQ ID NO: 912675 - protein, 31 aa, Mycobacterium
PTKPTKPTKPTEPTEPTEPTEPTRPTPTTTV

SEQ ID NO: 912676 - protein, 8 aa, Mycobacterium
PTKSSERW

SEQ ID NO: 912677 - protein, 6 aa, Mycobacterium
PTKVPN

SEQ ID NO: 912678 - protein, 10 aa, Mycobacterium
PTLDPGDWEP

SEQ ID NO: 912679 - protein, 4 aa, Mycobacterium
PTLN

SEQ ID NO: 912680 - protein, 11 aa, Mycobacterium
PTLNSAEEHPA

SEQ ID NO: 912681 - protein, 4 aa, Mycobacterium
PTLP

SEQ ID NO: 912682 - protein, 8 aa, Mycobacterium
PTLPGAGL

SEQ ID NO: 912683 - protein, 10 aa, Mycobacterium
PTLPGRGLSP

SEQ ID NO: 912684 - protein, 9 aa, Mycobacterium
PTLPGTEGL

SEQ ID NO: 912685 - protein, 5 aa, Mycobacterium
PTLSA

SEQ ID NO: 912686 - protein, 9 aa, Mycobacterium
PTLSPTDNI

SEQ ID NO: 912687 - protein, 4 aa, Mycobacterium
PTLT

SEQ ID NO: 912688 - protein, 7 aa, Mycobacterium
PTNDPTR

SEQ ID NO: 912689 - protein, 17 aa, Mycobacterium
PTNISGATIPDGAQATG

SEQ ID NO: 912690 - protein, 11 aa, Mycobacterium
PTNPNDSGGLA

SEQ ID NO: 912691 - protein, 9 aa, Mycobacterium
PTNPNDTGL

SEQ ID NO: 912692 - protein, 10 aa, Mycobacterium
PTNPNDTGLS

SEQ ID NO: 912693 - protein, 17 aa, Mycobacterium
PTNSSETGLSVKTSSVD

SEQ ID NO: 912694 - protein, 5 aa, Mycobacterium
PTPAG

SEQ ID NO: 912695 - protein, 6 aa, Mycobacterium
PTPATS

SEQ ID NO: 912696 - protein, 7 aa, Mycobacterium
PTPDNNY

SEQ ID NO: 912697 - protein, 18 aa, Mycobacterium
PTPGARRASGHAGTQPLA

SEQ ID NO: 912698 - protein, 5 aa, Mycobacterium
PTPGL

SEQ ID NO: 912699 - protein, 9 aa, Mycobacterium
PTPKKDGVN

SEQ ID NO: 912700 - protein, 6 aa, Mycobacterium
PTPKPR

SEQ ID NO: 912701 - protein, 5 aa, Mycobacterium
PTPLR

SEQ ID NO: 912702 - protein, 4 aa, Mycobacterium
PTPN

SEQ ID NO: 912703 - protein, 15 aa, Mycobacterium
PTPPAGGFSPGGHDG

SEQ ID NO: 912704 - protein, 5 aa, Mycobacterium
PTPPI

SEQ ID NO: 912705 - protein, 5 aa, Mycobacterium
PTPQG

SEQ ID NO: 912706 - protein, 12 aa, Mycobacterium
PTPQPTTLTDPN

SEQ ID NO: 912707 - protein, 19 aa, Mycobacterium
PTPSGRLAAGRSSDPALAD

SEQ ID NO: 912708 - protein, 8 aa, Mycobacterium
PTPTDEGV

SEQ ID NO: 912709 - protein, 8 aa, Mycobacterium
PTPTGFTN

SEQ ID NO: 912710 - protein, 8 aa, Mycobacterium
PTPTGITN

SEQ ID NO: 912711 - protein, 12 aa, Mycobacterium
PTPTQTWGTDPS

SEQ ID NO: 912712 - protein, 29 aa, Mycobacterium
PTPVPGSPMPKSPKPPAPLSVPRRLRSRH

SEQ ID NO: 912713 - protein, 4 aa, Mycobacterium
PTQE

SEQ ID NO: 912714 - protein, 7 aa, Mycobacterium
PTQGAIT

SEQ ID NO: 912715 - protein, 4 aa, Mycobacterium
PTQT

SEQ ID NO: 912716 - protein, 5 aa, Mycobacterium
PTQVN

SEQ ID NO: 912717 - protein, 9 aa, Mycobacterium
PTRAKLADG

SEQ ID NO: 912718 - protein, 11 aa, Mycobacterium
PTRGLPSQQPD

SEQ ID NO: 912719 - protein, 16 aa, Mycobacterium
PTRPPTDPEALAPAKA

SEQ ID NO: 912720 - protein, 5 aa, Mycobacterium
PTRRA

SEQ ID NO: 912721 - protein, 4 aa, Mycobacterium
PTRW

SEQ ID NO: 912722 - protein, 7 aa, Mycobacterium
PTSAADV

SEQ ID NO: 912723 - protein, 8 aa, Mycobacterium
PTSGNHDW

SEQ ID NO: 912724 - protein, 7 aa, Mycobacterium
PTSGTVS

SEQ ID NO: 912725 - protein, 13 aa, Mycobacterium
PTSMGKDSTPTAN

SEQ ID NO: 912726 - protein, 5 aa, Mycobacterium
PTSNR

SEQ ID NO: 912727 - protein, 4 aa, Mycobacterium
PTSP

SEQ ID NO: 912728 - protein, 9 aa, Mycobacterium
PTSQGARGS

SEQ ID NO: 912729 - protein, 13 aa, Mycobacterium
PTSSPHIQPSSAP

SEQ ID NO: 912730 - protein, 8 aa, Mycobacterium
PTSWTTSP

SEQ ID NO: 912731 - protein, 11 aa, Mycobacterium
PTTAPEGTPGE

SEQ ID NO: 912732 - protein, 11 aa, Mycobacterium
PTTAPPGTPGE

SEQ ID NO: 912733 - protein, 8 aa, Mycobacterium
PTTDLTNE

SEQ ID NO: 912734 - protein, 9 aa, Mycobacterium
PTTEGARGS

SEQ ID NO: 912735 - protein, 10 aa, Mycobacterium
PTTGAQPVTG

SEQ ID NO: 912736 - protein, 6 aa, Mycobacterium
PTTGSQ

SEQ ID NO: 912737 - protein, 4 aa, Mycobacterium
PTTH

SEQ ID NO: 912738 - protein, 13 aa, Mycobacterium
PTTMEGAAQSASH

SEQ ID NO: 912739 - protein, 7 aa, Mycobacterium
PTTPHGK

SEQ ID NO: 912740 - protein, 10 aa, Mycobacterium
PTTPLPTPEA

SEQ ID NO: 912741 - protein, 33 aa, Mycobacterium
PTTPPPSPALASKPSLPAPSAAPAAGGPALNGT

SEQ ID NO: 912742 - protein, 11 aa, Mycobacterium
PTTQGKKFDPA

SEQ ID NO: 912743 - protein, 4 aa, Mycobacterium
PTTR

SEQ ID NO: 912744 - protein, 17 aa, Mycobacterium
PTTSGEATTSVTGGRGI

SEQ ID NO: 912745 - protein, 11 aa, Mycobacterium
PTTTASAQPCP

SEQ ID NO: 912746 - protein, 5 aa, Mycobacterium
PTTTF

SEQ ID NO: 912747 - protein, 7 aa, Mycobacterium
PTTVPDA

SEQ ID NO: 912748 - protein, 5 aa, Mycobacterium
PTTVT

SEQ ID NO: 912749 - protein, 8 aa, Mycobacterium
PTVAQSGR

SEQ ID NO: 912750 - protein, 5 aa, Mycobacterium
PTVDP

SEQ ID NO: 912751 - protein, 29 aa, Mycobacterium
PTVMPGAPTPPVLESPDGQPPKAEEAPAG

SEQ ID NO: 912752 - protein, 5 aa, Mycobacterium
PTVPP

SEQ ID NO: 912753 - protein, 8 aa, Mycobacterium
PTVQQPNS

SEQ ID NO: 912754 - protein, 16 aa, Mycobacterium
PTVQQPNSLAYDDASD

SEQ ID NO: 912755 - protein, 4 aa, Mycobacterium
PTVT

SEQ ID NO: 912756 - protein, 39 aa, Mycobacterium
PTVTASAAAPAPAPAPASMTSTAAGPGPAPPPAPAAPGI

SEQ ID NO: 912757 - protein, 5 aa, Mycobacterium
PTWAG

SEQ ID NO: 912758 - protein, 4 aa, Mycobacterium
PTWK

SEQ ID NO: 912759 - protein, 12 aa, Mycobacterium
PTWSRTYSPAPE

SEQ ID NO: 912760 - protein, 4 aa, Mycobacterium
PTYI

SEQ ID NO: 912761 - protein, 4 aa, Mycobacterium
PTYP

SEQ ID NO: 912762 - protein, 5 aa, Mycobacterium
PTYTT

SEQ ID NO: 912763 - protein, 13 aa, Mycobacterium
PVAASGDARNQNT

SEQ ID NO: 912764 - protein, 11 aa, Mycobacterium
PVADGAGNTVG

SEQ ID NO: 912765 - protein, 10 aa, Mycobacterium
PVAGDPNLGR

SEQ ID NO: 912766 - protein, 11 aa, Mycobacterium
PVAGDRPEPKP

SEQ ID NO: 912767 - protein, 5 aa, Mycobacterium
PVAGT

SEQ ID NO: 912768 - protein, 14 aa, Mycobacterium
PVAGTGSAAPRLDA

SEQ ID NO: 912769 - protein, 13 aa, Mycobacterium
PVAPGTPRGQRTP

SEQ ID NO: 912770 - protein, 14 aa, Mycobacterium
PVAPGTPRGQRTPE

SEQ ID NO: 912771 - protein, 8 aa, Mycobacterium
PVAPTDPL

SEQ ID NO: 912772 - protein, 6 aa, Mycobacterium
PVAQEN

SEQ ID NO: 912773 - protein, 6 aa, Mycobacterium
PVASPG

SEQ ID NO: 912774 - protein, 18 aa, Mycobacterium
PVATPPVTAPTEPPPPVA

SEQ ID NO: 912775 - protein, 4 aa, Mycobacterium
PVDA

SEQ ID NO: 912776 - protein, 8 aa, Mycobacterium
PVDDAPVA

SEQ ID NO: 912777 - protein, 8 aa, Mycobacterium
PVDDTRSD

SEQ ID NO: 912778 - protein, 5 aa, Mycobacterium
PVDGQ

SEQ ID NO: 912779 - protein, 13 aa, Mycobacterium
PVDPNTAPGMLPP

SEQ ID NO: 912780 - protein, 12 aa, Mycobacterium
PVDPSKGRCAFV

SEQ ID NO: 912781 - protein, 12 aa, Mycobacterium
PVDTSHPHGSEA

SEQ ID NO: 912782 - protein, 5 aa, Mycobacterium
PVEDL

SEQ ID NO: 912783 - protein, 31 aa, Mycobacterium
PVEGGSQGTPIEGGSEGTPLPAGDGAPELPA

SEQ ID NO: 912784 - protein, 21 aa, Mycobacterium
PVEPRRPELAEQPPGVIVVVT

SEQ ID NO: 912785 - protein, 8 aa, Mycobacterium
PVEQTAPA

SEQ ID NO: 912786 - protein, 9 aa, Mycobacterium
PVERTDPSF

SEQ ID NO: 912787 - protein, 19 aa, Mycobacterium
PVESGDPAAEHKGIPAATE

SEQ ID NO: 912788 - protein, 13 aa, Mycobacterium
PVGAPGEAEVPED

SEQ ID NO: 912789 - protein, 11 aa, Mycobacterium
PVGDQFGEAAE

SEQ ID NO: 912790 - protein, 14 aa, Mycobacterium
PVGDQFGEAGEGVK

SEQ ID NO: 912791 - protein, 14 aa, Mycobacterium
PVGDQFGEAGEGVR

SEQ ID NO: 912792 - protein, 5 aa, Mycobacterium
PVGEM

SEQ ID NO: 912793 - protein, 7 aa, Mycobacterium
PVGEPAV

SEQ ID NO: 912794 - protein, 18 aa, Mycobacterium
PVGNGPYQLADGPDGPAW

SEQ ID NO: 912795 - protein, 13 aa, Mycobacterium
PVGNQFGEAGEGV

SEQ ID NO: 912796 - protein, 4 aa, Mycobacterium
PVGP

SEQ ID NO: 912797 - protein, 65 aa, Mycobacterium
PVGPAVQPAAAAGSSATSGAAPVGAGAMGQGAQAGGSSRPGLAAPATLTQERNDADEDDWDDEDD

SEQ ID NO: 912798 - protein, 5 aa, Mycobacterium
PVGPR

SEQ ID NO: 912799 - protein, 5 aa, Mycobacterium
PVGRS

SEQ ID NO: 912800 - protein, 13 aa, Mycobacterium
PVGSGAELRTATP

SEQ ID NO: 912801 - protein, 12 aa, Mycobacterium
PVGSSPAAVTGV

SEQ ID NO: 912802 - protein, 5 aa, Mycobacterium
PVGTA

SEQ ID NO: 912803 - protein, 26 aa, Mycobacterium
PVGTAGADPLIGDNPPGPGPAAAAEP

SEQ ID NO: 912804 - protein, 11 aa, Mycobacterium
PVNEEAGKPVG

SEQ ID NO: 912805 - protein, 7 aa, Mycobacterium
PVNPSGG

SEQ ID NO: 912806 - protein, 10 aa, Mycobacterium
PVNSPNQGAA

SEQ ID NO: 912807 - protein, 4 aa, Mycobacterium
PVPA

SEQ ID NO: 912808 - protein, 12 aa, Mycobacterium
PVPAAAPAPAAA

SEQ ID NO: 912809 - protein, 29 aa, Mycobacterium
PVPATHSPQPAPTGPSTRTVATPDGRTAQ

SEQ ID NO: 912810 - protein, 12 aa, Mycobacterium
PVPDAGSAAAEI

SEQ ID NO: 912811 - protein, 17 aa, Mycobacterium
PVPDAPYGLAGSTDPKG

SEQ ID NO: 912812 - protein, 13 aa, Mycobacterium
PVPDASSPTGSRW

SEQ ID NO: 912813 - protein, 8 aa, Mycobacterium
PVPDGPRI

SEQ ID NO: 912814 - protein, 12 aa, Mycobacterium
PVPDPATPTGSR

SEQ ID NO: 912815 - protein, 12 aa, Mycobacterium
PVPDPNSPTGSR

SEQ ID NO: 912816 - protein, 8 aa, Mycobacterium
PVPDPNVP

SEQ ID NO: 912817 - protein, 7 aa, Mycobacterium
PVPDPSA

SEQ ID NO: 912818 - protein, 12 aa, Mycobacterium
PVPDSATTTGSR

SEQ ID NO: 912819 - protein, 12 aa, Mycobacterium
PVPDTAAPTGSR

SEQ ID NO: 912820 - protein, 8 aa, Mycobacterium
PVPFRGER

SEQ ID NO: 912821 - protein, 5 aa, Mycobacterium
PVPGA

SEQ ID NO: 912822 - protein, 13 aa, Mycobacterium
PVPGAAPVPQEPP

SEQ ID NO: 912823 - protein, 8 aa, Mycobacterium
PVPGAAQK

SEQ ID NO: 912824 - protein, 11 aa, Mycobacterium
PVPGEAVTSPL

SEQ ID NO: 912825 - protein, 6 aa, Mycobacterium
PVPGNA

SEQ ID NO: 912826 - protein, 19 aa, Mycobacterium
PVPGPVPTSPANNDFKPGF

SEQ ID NO: 912827 - protein, 7 aa, Mycobacterium
PVPGYGN

SEQ ID NO: 912828 - protein, 5 aa, Mycobacterium
PVPIP

SEQ ID NO: 912829 - protein, 11 aa, Mycobacterium
PVPPAPGQDPA

SEQ ID NO: 912830 - protein, 7 aa, Mycobacterium
PVPPEVG

SEQ ID NO: 912831 - protein, 11 aa, Mycobacterium
PVPPGGPARYN

SEQ ID NO: 912832 - protein, 15 aa, Mycobacterium
PVPPQPTAQISTAPA

SEQ ID NO: 912833 - protein, 12 aa, Mycobacterium
PVPQAPYGLAGS

SEQ ID NO: 912834 - protein, 9 aa, Mycobacterium
PVPTPDSPT

SEQ ID NO: 912835 - protein, 5 aa, Mycobacterium
PVPTT

SEQ ID NO: 912836 - protein, 9 aa, Mycobacterium
PVQADDPPY

SEQ ID NO: 912837 - protein, 8 aa, Mycobacterium
PVQAGGPP

SEQ ID NO: 912838 - protein, 15 aa, Mycobacterium
PVQASPGDCTVSEEA

SEQ ID NO: 912839 - protein, 5 aa, Mycobacterium
PVQGG

SEQ ID NO: 912840 - protein, 8 aa, Mycobacterium
PVQPGGPP

SEQ ID NO: 912841 - protein, 5 aa, Mycobacterium
PVQPY

SEQ ID NO: 912842 - protein, 15 aa, Mycobacterium
PVRGRPAQPSPLGPQ

SEQ ID NO: 912843 - protein, 16 aa, Mycobacterium
PVRKPGMTPFLTRIIE

SEQ ID NO: 912844 - protein, 5 aa, Mycobacterium
PVRPA

SEQ ID NO: 912845 - protein, 11 aa, Mycobacterium
PVRPAPELPDT

SEQ ID NO: 912846 - protein, 5 aa, Mycobacterium
PVRPE

SEQ ID NO: 912847 - protein, 5 aa, Mycobacterium
PVRQW

SEQ ID NO: 912848 - protein, 7 aa, Mycobacterium
PVRSSGM

SEQ ID NO: 912849 - protein, 16 aa, Mycobacterium
PVRSSGMTPYVTRLIE

SEQ ID NO: 912850 - protein, 15 aa, Mycobacterium
PVRTNGMSPYLVRII

SEQ ID NO: 912851 - protein, 8 aa, Mycobacterium
PVSEESAV

SEQ ID NO: 912852 - protein, 12 aa, Mycobacterium
PVSGGEPAAKAG

SEQ ID NO: 912853 - protein, 8 aa, Mycobacterium
PVSGTQLD

SEQ ID NO: 912854 - protein, 14 aa, Mycobacterium
PVSGTQLDPCPSPH

SEQ ID NO: 912855 - protein, 10 aa, Mycobacterium
PVSGTSEGRQ

SEQ ID NO: 912856 - protein, 7 aa, Mycobacterium
PVSNANG

SEQ ID NO: 912857 - protein, 13 aa, Mycobacterium
PVSPTLVTGTFRL

SEQ ID NO: 912858 - protein, 4 aa, Mycobacterium
PVTA

SEQ ID NO: 912859 - protein, 4 aa, Mycobacterium
PVTG

SEQ ID NO: 912860 - protein, 27 aa, Mycobacterium
PVTPSTAPSLSGTPTTTTSAPETSTPG

SEQ ID NO: 912861 - protein, 11 aa, Mycobacterium
PVTPTTSARDM

SEQ ID NO: 912862 - protein, 7 aa, Mycobacterium
PVTTTTG

SEQ ID NO: 912863 - protein, 5 aa, Mycobacterium
PVTVE

SEQ ID NO: 912864 - protein, 10 aa, Mycobacterium
PVTVSAGDGV

SEQ ID NO: 912865 - protein, 10 aa, Mycobacterium
PVTVTAENGV

SEQ ID NO: 912866 - protein, 10 aa, Mycobacterium
PWDEGSSGAH

SEQ ID NO: 912867 - protein, 4 aa, Mycobacterium
PWHT

SEQ ID NO: 912868 - protein, 4 aa, Mycobacterium
PWLG

SEQ ID NO: 912869 - protein, 18 aa, Mycobacterium
PWNPQTSPGGSSGGAGAA

SEQ ID NO: 912870 - protein, 11 aa, Mycobacterium
PWPPRGDPVEK

SEQ ID NO: 912871 - protein, 11 aa, Mycobacterium
PWPSGCASDDD

SEQ ID NO: 912872 - protein, 5 aa, Mycobacterium
PWPTA

SEQ ID NO: 912873 - protein, 6 aa, Mycobacterium
PWPTAD

SEQ ID NO: 912874 - protein, 7 aa, Mycobacterium
PWPTADV

SEQ ID NO: 912875 - protein, 6 aa, Mycobacterium
PWPTAE

SEQ ID NO: 912876 - protein, 7 aa, Mycobacterium
PWQDNQG

SEQ ID NO: 912877 - protein, 5 aa, Mycobacterium
PWRSA

SEQ ID NO: 912878 - protein, 11 aa, Mycobacterium
PWSGAPHDAPA

SEQ ID NO: 912879 - protein, 7 aa, Mycobacterium
PWSNETR

SEQ ID NO: 912880 - protein, 8 aa, Mycobacterium
PWSNPRLN

SEQ ID NO: 912881 - protein, 8 aa, Mycobacterium
PWSSDDDK

SEQ ID NO: 912882 - protein, 9 aa, Mycobacterium
PWSSPRMNP

SEQ ID NO: 912883 - protein, 13 aa, Mycobacterium
PWSTGAQGNSNVS

SEQ ID NO: 912884 - protein, 9 aa, Mycobacterium
PWSTPLKNP

SEQ ID NO: 912885 - protein, 4 aa, Mycobacterium
PWTA

SEQ ID NO: 912886 - protein, 78 aa, Mycobacterium
PWTPPTPPTPSAAPPADPNQPAPPPADPNQPPPPPADPNQPPAPPAPTAPAAPAAEPAAPGQPAPPTPPAAPPAPGVP

SEQ ID NO: 912887 - protein, 16 aa, Mycobacterium
PYADAYQPKHTDAPNA

SEQ ID NO: 912888 - protein, 20 aa, Mycobacterium
PYANGTYAETSGPDGQASAK

SEQ ID NO: 912889 - protein, 5 aa, Mycobacterium
PYDAE

SEQ ID NO: 912890 - protein, 10 aa, Mycobacterium
PYDPAAAKRE

SEQ ID NO: 912891 - protein, 21 aa, Mycobacterium
PYGAEAAPAPVPPAAPTPGGG

SEQ ID NO: 912892 - protein, 9 aa, Mycobacterium
PYGGGPGYS

SEQ ID NO: 912893 - protein, 5 aa, Mycobacterium
PYGIP

SEQ ID NO: 912894 - protein, 6 aa, Mycobacterium
PYGRST

SEQ ID NO: 912895 - protein, 6 aa, Mycobacterium
PYHPQT

SEQ ID NO: 912896 - protein, 4 aa, Mycobacterium
PYLA

SEQ ID NO: 912897 - protein, 14 aa, Mycobacterium
PYPRTGQGGDPKLT

SEQ ID NO: 912898 - protein, 4 aa, Mycobacterium
PYPS

SEQ ID NO: 912899 - protein, 5 aa, Mycobacterium
PYPSI

SEQ ID NO: 912900 - protein, 4 aa, Mycobacterium
PYPT

SEQ ID NO: 912901 - protein, 6 aa, Mycobacterium
PYQPGR

SEQ ID NO: 912902 - protein, 5 aa, Mycobacterium
PYRTP

SEQ ID NO: 912903 - protein, 9 aa, Mycobacterium
PYSNEGQQL

SEQ ID NO: 912904 - protein, 5 aa, Mycobacterium
PYTGS

SEQ ID NO: 912905 - protein, 6 aa, Mycobacterium
PYTKPP

SEQ ID NO: 912906 - protein, 9 aa, Mycobacterium
PYTNPDDAL

SEQ ID NO: 912907 - protein, 4 aa, Mycobacterium
PYVP

SEQ ID NO: 912908 - protein, 7 aa, Mycobacterium
PYVPPPA

SEQ ID NO: 912909 - protein, 9 aa, Mycobacterium
QAAAAGDRL

SEQ ID NO: 912910 - protein, 10 aa, Mycobacterium
QAAAAGDRLS

SEQ ID NO: 912911 - protein, 25 aa, Mycobacterium
QAAADAYDAEAAQLNARGSQAQANL

SEQ ID NO: 912912 - protein, 10 aa, Mycobacterium
QAAADPNLGR

SEQ ID NO: 912913 - protein, 13 aa, Mycobacterium
QAAAGAGAFDPDR

SEQ ID NO: 912914 - protein, 13 aa, Mycobacterium
QAAAGTDPGSTLS

SEQ ID NO: 912915 - protein, 8 aa, Mycobacterium
QAAANNPM

SEQ ID NO: 912916 - protein, 10 aa, Mycobacterium
QAADEAAAGE

SEQ ID NO: 912917 - protein, 13 aa, Mycobacterium
QAADTLNGNGDSF

SEQ ID NO: 912918 - protein, 5 aa, Mycobacterium
QAAGL

SEQ ID NO: 912919 - protein, 19 aa, Mycobacterium
QAAHQRERTGDTPVRSDID

SEQ ID NO: 912920 - protein, 7 aa, Mycobacterium
QAAKPTG

SEQ ID NO: 912921 - protein, 24 aa, Mycobacterium
QAAKRENLAAPVGATQRIGSTTVP

SEQ ID NO: 912922 - protein, 7 aa, Mycobacterium
QAANPGQ

SEQ ID NO: 912923 - protein, 4 aa, Mycobacterium
QAAP

SEQ ID NO: 912924 - protein, 6 aa, Mycobacterium
QAAPAL

SEQ ID NO: 912925 - protein, 6 aa, Mycobacterium
QAAPNA

SEQ ID NO: 912926 - protein, 118 aa, Mycobacterium
QAAPQAVPRPAAPATETVAAPAPSTTPTPTPTPSSTPTPTPSSTPTPTPTPSSTPTPTPTPTPTPTPTPTPTPTPTPTPTPTSTPAPTSTPPPVTSQPVPVETPTATQEPAPAETPVT

SEQ ID NO: 912927 - protein, 8 aa, Mycobacterium
QAAPTADQ

SEQ ID NO: 912928 - protein, 5 aa, Mycobacterium
QAAQA

SEQ ID NO: 912929 - protein, 11 aa, Mycobacterium
QAAQDGGALSG

SEQ ID NO: 912930 - protein, 9 aa, Mycobacterium
QAAQGPEID

SEQ ID NO: 912931 - protein, 6 aa, Mycobacterium
QAAQHD

SEQ ID NO: 912932 - protein, 9 aa, Mycobacterium
QAASAETTD

SEQ ID NO: 912933 - protein, 7 aa, Mycobacterium
QAATAHP

SEQ ID NO: 912934 - protein, 7 aa, Mycobacterium
QADAADL

SEQ ID NO: 912935 - protein, 10 aa, Mycobacterium
QADAEQARAR

SEQ ID NO: 912936 - protein, 11 aa, Mycobacterium
QADEFNRAGAD

SEQ ID NO: 912937 - protein, 9 aa, Mycobacterium
QADGRGPAL

SEQ ID NO: 912938 - protein, 10 aa, Mycobacterium
QADGTAANLN

SEQ ID NO: 912939 - protein, 5 aa, Mycobacterium
QADIG

SEQ ID NO: 912940 - protein, 8 aa, Mycobacterium
QADKADGI

SEQ ID NO: 912941 - protein, 14 aa, Mycobacterium
QADLPTAEKRSLDY

SEQ ID NO: 912942 - protein, 8 aa, Mycobacterium
QADPAADA

SEQ ID NO: 912943 - protein, 5 aa, Mycobacterium
QADRA

SEQ ID NO: 912944 - protein, 8 aa, Mycobacterium
QADSGRSD

SEQ ID NO: 912945 - protein, 11 aa, Mycobacterium
QAEAAPGKSTL

SEQ ID NO: 912946 - protein, 5 aa, Mycobacterium
QAEAG

SEQ ID NO: 912947 - protein, 9 aa, Mycobacterium
QAEATERIA

SEQ ID NO: 912948 - protein, 7 aa, Mycobacterium
QAEGKSV

SEQ ID NO: 912949 - protein, 10 aa, Mycobacterium
QAEGTDNAHE

SEQ ID NO: 912950 - protein, 11 aa, Mycobacterium
QAEGTDNAHEA

SEQ ID NO: 912951 - protein, 12 aa, Mycobacterium
QAEGTDNSHEAD

SEQ ID NO: 912952 - protein, 17 aa, Mycobacterium
QAELAGPLAGTGREKEQ

SEQ ID NO: 912953 - protein, 5 aa, Mycobacterium
QAELD

SEQ ID NO: 912954 - protein, 7 aa, Mycobacterium
QAEPHEV

SEQ ID NO: 912955 - protein, 10 aa, Mycobacterium
QAEQQTLQGN

SEQ ID NO: 912956 - protein, 6 aa, Mycobacterium
QAEQVG

SEQ ID NO: 912957 - protein, 9 aa, Mycobacterium
QAESAGADH

SEQ ID NO: 912958 - protein, 5 aa, Mycobacterium
QAEVE

SEQ ID NO: 912959 - protein, 13 aa, Mycobacterium
QAEVPRNAIPPLA

SEQ ID NO: 912960 - protein, 15 aa, Mycobacterium
QAGAASAAGNARTGL

SEQ ID NO: 912961 - protein, 6 aa, Mycobacterium
QAGAGY

SEQ ID NO: 912962 - protein, 5 aa, Mycobacterium
QAGAP

SEQ ID NO: 912963 - protein, 20 aa, Mycobacterium
QAGAPFDPNFQSPRDTVDNI

SEQ ID NO: 912964 - protein, 6 aa, Mycobacterium
QAGAPK

SEQ ID NO: 912965 - protein, 11 aa, Mycobacterium
QAGATENDQLT

SEQ ID NO: 912966 - protein, 9 aa, Mycobacterium
QAGDSAKDA

SEQ ID NO: 912967 - protein, 7 aa, Mycobacterium
QAGESGV

SEQ ID NO: 912968 - protein, 9 aa, Mycobacterium
QAGESSKGA

SEQ ID NO: 912969 - protein, 7 aa, Mycobacterium
QAGGAGL

SEQ ID NO: 912970 - protein, 9 aa, Mycobacterium
QAGGAVTGT

SEQ ID NO: 912971 - protein, 12 aa, Mycobacterium
QAGGDDAARRTI

SEQ ID NO: 912972 - protein, 6 aa, Mycobacterium
QAGGDL

SEQ ID NO: 912973 - protein, 23 aa, Mycobacterium
QAGGGWTDGAQSLGTSPEKDVGF

SEQ ID NO: 912974 - protein, 9 aa, Mycobacterium
QAGGRARAP

SEQ ID NO: 912975 - protein, 10 aa, Mycobacterium
QAGGSVPGTV

SEQ ID NO: 912976 - protein, 8 aa, Mycobacterium
QAGHKDYD

SEQ ID NO: 912977 - protein, 4 aa, Mycobacterium
QAGI

SEQ ID NO: 912978 - protein, 12 aa, Mycobacterium
QAGNLSAEDRHT

SEQ ID NO: 912979 - protein, 8 aa, Mycobacterium
QAGPVDSY

SEQ ID NO: 912980 - protein, 4 aa, Mycobacterium
QAGQ

SEQ ID NO: 912981 - protein, 6 aa, Mycobacterium
QAGRVT

SEQ ID NO: 912982 - protein, 9 aa, Mycobacterium
QAGSEPMDD

SEQ ID NO: 912983 - protein, 9 aa, Mycobacterium
QAGTGTGKS

SEQ ID NO: 912984 - protein, 5 aa, Mycobacterium
QAGTP

SEQ ID NO: 912985 - protein, 10 aa, Mycobacterium
QAGVSAPDFS

SEQ ID NO: 912986 - protein, 9 aa, Mycobacterium
QAHQTAGQL

SEQ ID NO: 912987 - protein, 6 aa, Mycobacterium
QAHRAT

SEQ ID NO: 912988 - protein, 10 aa, Mycobacterium
QAIEPDPDPT

SEQ ID NO: 912989 - protein, 6 aa, Mycobacterium
QAIPRD

SEQ ID NO: 912990 - protein, 5 aa, Mycobacterium
QAKAI

SEQ ID NO: 912991 - protein, 20 aa, Mycobacterium
QAKEEAPASEDGGSAAPAEI

SEQ ID NO: 912992 - protein, 41 aa, Mycobacterium
QAKESATSGDTASGEKSNQITVEASDTECKLSGTEAVTGPS

SEQ ID NO: 912993 - protein, 8 aa, Mycobacterium
QAKIGQTS

SEQ ID NO: 912994 - protein, 29 aa, Mycobacterium
QAKPGVGDPDPARNGAPIPGMASDPSRPA

SEQ ID NO: 912995 - protein, 12 aa, Mycobacterium
QAKQGASYGHTK

SEQ ID NO: 912996 - protein, 22 aa, Mycobacterium
QALAAAKDVDDAIAAGSVPSGL

SEQ ID NO: 912997 - protein, 8 aa, Mycobacterium
QALGGTGN

SEQ ID NO: 912998 - protein, 9 aa, Mycobacterium
QALGRQADG

SEQ ID NO: 912999 - protein, 7 aa, Mycobacterium
QALPGEI

SEQ ID NO: 913000 - protein, 7 aa, Mycobacterium
QALPPGR

SEQ ID NO: 913001 - protein, 6 aa, Mycobacterium
QALPPT

SEQ ID NO: 913002 - protein, 27 aa, Mycobacterium
QALPQQAPTQAPAQQAPAQQAPLQQAP

SEQ ID NO: 913003 - protein, 8 aa, Mycobacterium
QALRGANY

SEQ ID NO: 913004 - protein, 6 aa, Mycobacterium
QALRGS

SEQ ID NO: 913005 - protein, 4 aa, Mycobacterium
QALT

SEQ ID NO: 913006 - protein, 10 aa, Mycobacterium
QALTDSTDDI

SEQ ID NO: 913007 - protein, 54 aa, Mycobacterium
QALTPEQRTALADPGPIPARVPDAPGPAPEGLPPGAPPEGAPTPGEAPAPGGVS

SEQ ID NO: 913008 - protein, 9 aa, Mycobacterium
QAMGSPSAL

SEQ ID NO: 913009 - protein, 4 aa, Mycobacterium
QAMT

SEQ ID NO: 913010 - protein, 10 aa, Mycobacterium
QANAPTEWTE

SEQ ID NO: 913011 - protein, 4 aa, Mycobacterium
QAND

SEQ ID NO: 913012 - protein, 6 aa, Mycobacterium
QANGIE

SEQ ID NO: 913013 - protein, 11 aa, Mycobacterium
QANPAPPVGPA

SEQ ID NO: 913014 - protein, 7 aa, Mycobacterium
QANQGEG

SEQ ID NO: 913015 - protein, 9 aa, Mycobacterium
QANTRTGPY

SEQ ID NO: 913016 - protein, 6 aa, Mycobacterium
QANYGA

SEQ ID NO: 913017 - protein, 22 aa, Mycobacterium
QAPAAEQPAVENAPAEQPQQPW

SEQ ID NO: 913018 - protein, 14 aa, Mycobacterium
QAPAPKTGDTENRI

SEQ ID NO: 913019 - protein, 14 aa, Mycobacterium
QAPDAAPGPGTYDK

SEQ ID NO: 913020 - protein, 6 aa, Mycobacterium
QAPDHV

SEQ ID NO: 913021 - protein, 9 aa, Mycobacterium
QAPEGPYET

SEQ ID NO: 913022 - protein, 31 aa, Mycobacterium
QAPGAPASQTAVSTSSPAPASTSSAPTRPPN

SEQ ID NO: 913023 - protein, 5 aa, Mycobacterium
QAPGI

SEQ ID NO: 913024 - protein, 48 aa, Mycobacterium
QAPGPAPGSPPGYGPAPGPPPAPAPAGPDAGLSSPAPGAPLPAEQGAG

SEQ ID NO: 913025 - protein, 19 aa, Mycobacterium
QAPHQVSASVSRNGQDAAS

SEQ ID NO: 913026 - protein, 14 aa, Mycobacterium
QAPLQQTPLPQTPL

SEQ ID NO: 913027 - protein, 8 aa, Mycobacterium
QAPNPRRA

SEQ ID NO: 913028 - protein, 47 aa, Mycobacterium
QAPPAPAPGPPPAAPTPGPAPGPAPGPAPAPAPAPVLGPAPGPAPES

SEQ ID NO: 913029 - protein, 8 aa, Mycobacterium
QAPPGRAP

SEQ ID NO: 913030 - protein, 10 aa, Mycobacterium
QAPPPHDPGT

SEQ ID NO: 913031 - protein, 10 aa, Mycobacterium
QAPPPHQPGT

SEQ ID NO: 913032 - protein, 7 aa, Mycobacterium
QAPPRGT

SEQ ID NO: 913033 - protein, 10 aa, Mycobacterium
QAPPTPAPVH

SEQ ID NO: 913034 - protein, 6 aa, Mycobacterium
QAPSNI

SEQ ID NO: 913035 - protein, 13 aa, Mycobacterium
QAPSQRNPEGNMG

SEQ ID NO: 913036 - protein, 16 aa, Mycobacterium
QAPTPSAPLAAGTTIP

SEQ ID NO: 913037 - protein, 4 aa, Mycobacterium
QAPY

SEQ ID NO: 913038 - protein, 11 aa, Mycobacterium
QAQDPRSNIAR

SEQ ID NO: 913039 - protein, 8 aa, Mycobacterium
QAQGQAKA

SEQ ID NO: 913040 - protein, 10 aa, Mycobacterium
QAQGQAKAIE

SEQ ID NO: 913041 - protein, 9 aa, Mycobacterium
QAQGSNRQF

SEQ ID NO: 913042 - protein, 8 aa, Mycobacterium
QAQGSNRT

SEQ ID NO: 913043 - protein, 5 aa, Mycobacterium
QAQGY

SEQ ID NO: 913044 - protein, 9 aa, Mycobacterium
QAQNPRTNL

SEQ ID NO: 913045 - protein, 13 aa, Mycobacterium
QAQQTFNAQQGEL

SEQ ID NO: 913046 - protein, 15 aa, Mycobacterium
QARDEPTPQDAGGNR

SEQ ID NO: 913047 - protein, 22 aa, Mycobacterium
QARHDSALASAAAGAIGNPPQI

SEQ ID NO: 913048 - protein, 8 aa, Mycobacterium
QARPDARV

SEQ ID NO: 913049 - protein, 6 aa, Mycobacterium
QARPEC

SEQ ID NO: 913050 - protein, 8 aa, Mycobacterium
QARPNEVT

SEQ ID NO: 913051 - protein, 8 aa, Mycobacterium
QARQDEAM

SEQ ID NO: 913052 - protein, 6 aa, Mycobacterium
QARQRL

SEQ ID NO: 913053 - protein, 11 aa, Mycobacterium
QARTQAQSSHA

SEQ ID NO: 913054 - protein, 11 aa, Mycobacterium
QARTRSAANIP

SEQ ID NO: 913055 - protein, 14 aa, Mycobacterium
QARTRSAANTPATM

SEQ ID NO: 913056 - protein, 7 aa, Mycobacterium
QASAQQR

SEQ ID NO: 913057 - protein, 5 aa, Mycobacterium
QASDA

SEQ ID NO: 913058 - protein, 13 aa, Mycobacterium
QASDDATARDTIT

SEQ ID NO: 913059 - protein, 12 aa, Mycobacterium
QASDDATARETI

SEQ ID NO: 913060 - protein, 12 aa, Mycobacterium
QASDEATARETI

SEQ ID NO: 913061 - protein, 6 aa, Mycobacterium
QASDMA

SEQ ID NO: 913062 - protein, 4 aa, Mycobacterium
QASG

SEQ ID NO: 913063 - protein, 9 aa, Mycobacterium
QASPGLPTR

SEQ ID NO: 913064 - protein, 16 aa, Mycobacterium
QASPIDPKASRPFADP

SEQ ID NO: 913065 - protein, 36 aa, Mycobacterium
QASQARGTWRATSASAGYSSAARRAGDRAGRRARLG

SEQ ID NO: 913066 - protein, 11 aa, Mycobacterium
QASQRSTPAAD

SEQ ID NO: 913067 - protein, 9 aa, Mycobacterium
QASRTERAG

SEQ ID NO: 913068 - protein, 11 aa, Mycobacterium
QASSVNSTAPF

SEQ ID NO: 913069 - protein, 14 aa, Mycobacterium
QASYGGGLPPTPLP

SEQ ID NO: 913070 - protein, 8 aa, Mycobacterium
QATAGPGN

SEQ ID NO: 913071 - protein, 6 aa, Mycobacterium
QATATG

SEQ ID NO: 913072 - protein, 10 aa, Mycobacterium
QATDKTKTVK

SEQ ID NO: 913073 - protein, 11 aa, Mycobacterium
QATGVTNGAGF

SEQ ID NO: 913074 - protein, 14 aa, Mycobacterium
QATNPGVSYTTKNN

SEQ ID NO: 913075 - protein, 8 aa, Mycobacterium
QATPGSIG

SEQ ID NO: 913076 - protein, 13 aa, Mycobacterium
QATPVNSSSRYGT

SEQ ID NO: 913077 - protein, 20 aa, Mycobacterium
QATRTTARKTKQAAEKARLA

SEQ ID NO: 913078 - protein, 5 aa, Mycobacterium
QATTI

SEQ ID NO: 913079 - protein, 5 aa, Mycobacterium
QATTT

SEQ ID NO: 913080 - protein, 4 aa, Mycobacterium
QATV

SEQ ID NO: 913081 - protein, 11 aa, Mycobacterium
QAVGADSDVES

SEQ ID NO: 913082 - protein, 9 aa, Mycobacterium
QAVGAGTAV

SEQ ID NO: 913083 - protein, 11 aa, Mycobacterium
QAVKDANAAIS

SEQ ID NO: 913084 - protein, 12 aa, Mycobacterium
QAVKPAARNLLS

SEQ ID NO: 913085 - protein, 6 aa, Mycobacterium
QAVNSV

SEQ ID NO: 913086 - protein, 6 aa, Mycobacterium
QAVPEG

SEQ ID NO: 913087 - protein, 13 aa, Mycobacterium
QAVQTTGSAPGPR

SEQ ID NO: 913088 - protein, 10 aa, Mycobacterium
QAVSADPSLA

SEQ ID NO: 913089 - protein, 6 aa, Mycobacterium
QAVTPM

SEQ ID NO: 913090 - protein, 10 aa, Mycobacterium
QAYADPAADA

SEQ ID NO: 913091 - protein, 4 aa, Mycobacterium
QAYD

SEQ ID NO: 913092 - protein, 4 aa, Mycobacterium
QAYS

SEQ ID NO: 913093 - protein, 14 aa, Mycobacterium
QAYTTDVATLSCCA

SEQ ID NO: 913094 - protein, 8 aa, Mycobacterium
QCGDSGGP

SEQ ID NO: 913095 - protein, 6 aa, Mycobacterium
QCGPLD

SEQ ID NO: 913096 - protein, 4 aa, Mycobacterium
QCPS

SEQ ID NO: 913097 - protein, 4 aa, Mycobacterium
QCPT

SEQ ID NO: 913098 - protein, 14 aa, Mycobacterium
QCQEAAAAAAAAAA

SEQ ID NO: 913099 - protein, 11 aa, Mycobacterium
QCTPAKPVRFD

SEQ ID NO: 913100 - protein, 10 aa, Mycobacterium
QDADAPEPDR

SEQ ID NO: 913101 - protein, 8 aa, Mycobacterium
QDAGAPVS

SEQ ID NO: 913102 - protein, 11 aa, Mycobacterium
QDAGSETAGPI

SEQ ID NO: 913103 - protein, 6 aa, Mycobacterium
QDASSR

SEQ ID NO: 913104 - protein, 4 aa, Mycobacterium
QDDF

SEQ ID NO: 913105 - protein, 12 aa, Mycobacterium
QDDLGQRLAPAG

SEQ ID NO: 913106 - protein, 10 aa, Mycobacterium
QDDNAQNDAV

SEQ ID NO: 913107 - protein, 7 aa, Mycobacterium
QDEATEV

SEQ ID NO: 913108 - protein, 9 aa, Mycobacterium
QDEKTQDDA

SEQ ID NO: 913109 - protein, 6 aa, Mycobacterium
QDENEA

SEQ ID NO: 913110 - protein, 7 aa, Mycobacterium
QDENESA

SEQ ID NO: 913111 - protein, 4 aa, Mycobacterium
QDEP

SEQ ID NO: 913112 - protein, 14 aa, Mycobacterium
QDERVSTTLTDLGL

SEQ ID NO: 913113 - protein, 7 aa, Mycobacterium
QDGALSN

SEQ ID NO: 913114 - protein, 6 aa, Mycobacterium
QDGFPG

SEQ ID NO: 913115 - protein, 17 aa, Mycobacterium
QDGGSAAGEFDIAVLNI

SEQ ID NO: 913116 - protein, 4 aa, Mycobacterium
QDGN

SEQ ID NO: 913117 - protein, 8 aa, Mycobacterium
QDGRKSPD

SEQ ID NO: 913118 - protein, 8 aa, Mycobacterium
QDGRTMTA

SEQ ID NO: 913119 - protein, 25 aa, Mycobacterium
QDGSEVPASNTQSAADPAGDGKAQC

SEQ ID NO: 913120 - protein, 15 aa, Mycobacterium
QDGVYGPDRAGTFGG

SEQ ID NO: 913121 - protein, 7 aa, Mycobacterium
QDHDAAR

SEQ ID NO: 913122 - protein, 5 aa, Mycobacterium
QDHRN

SEQ ID NO: 913123 - protein, 6 aa, Mycobacterium
QDISGK

SEQ ID NO: 913124 - protein, 16 aa, Mycobacterium
QDKADRAGIGNSRYNL

SEQ ID NO: 913125 - protein, 9 aa, Mycobacterium
QDKRDASAA

SEQ ID NO: 913126 - protein, 10 aa, Mycobacterium
QDKRSDQALA

SEQ ID NO: 913127 - protein, 8 aa, Mycobacterium
QDKSLSRG

SEQ ID NO: 913128 - protein, 10 aa, Mycobacterium
QDMSKSDKVT

SEQ ID NO: 913129 - protein, 21 aa, Mycobacterium
QDNADGVSFDAPEGKVTIDGE

SEQ ID NO: 913130 - protein, 11 aa, Mycobacterium
QDNADGVTFDA

SEQ ID NO: 913131 - protein, 20 aa, Mycobacterium
QDNNATAQAASDGGAMIESM

SEQ ID NO: 913132 - protein, 15 aa, Mycobacterium
QDNPSCAGDTEPRSR

SEQ ID NO: 913133 - protein, 18 aa, Mycobacterium
QDPAGGSRTVPVTLGKAD

SEQ ID NO: 913134 - protein, 5 aa, Mycobacterium
QDPAP

SEQ ID NO: 913135 - protein, 9 aa, Mycobacterium
QDPARRRRQ

SEQ ID NO: 913136 - protein, 4 aa, Mycobacterium
QDPD

SEQ ID NO: 913137 - protein, 18 aa, Mycobacterium
QDPDGSTRTVQVTLGKAE

SEQ ID NO: 913138 - protein, 5 aa, Mycobacterium
QDPGA

SEQ ID NO: 913139 - protein, 32 aa, Mycobacterium
QDPGGGGCDANGNCGSGGQFEGPGGGPGGQGC

SEQ ID NO: 913140 - protein, 9 aa, Mycobacterium
QDPGGQPFA

SEQ ID NO: 913141 - protein, 7 aa, Mycobacterium
QDPGTIG

SEQ ID NO: 913142 - protein, 8 aa, Mycobacterium
QDPGTNRQ

SEQ ID NO: 913143 - protein, 4 aa, Mycobacterium
QDPM

SEQ ID NO: 913144 - protein, 8 aa, Mycobacterium
QDPPEGAL

SEQ ID NO: 913145 - protein, 7 aa, Mycobacterium
QDPPPRR

SEQ ID NO: 913146 - protein, 6 aa, Mycobacterium
QDPRAD

SEQ ID NO: 913147 - protein, 8 aa, Mycobacterium
QDPRLAGS

SEQ ID NO: 913148 - protein, 7 aa, Mycobacterium
QDPSLPA

SEQ ID NO: 913149 - protein, 6 aa, Mycobacterium
QDQGEE

SEQ ID NO: 913150 - protein, 4 aa, Mycobacterium
QDQH

SEQ ID NO: 913151 - protein, 10 aa, Mycobacterium
QDQPKDQIRE

SEQ ID NO: 913152 - protein, 4 aa, Mycobacterium
QDQR

SEQ ID NO: 913153 - protein, 14 aa, Mycobacterium
QDQRVESTLTDLGL

SEQ ID NO: 913154 - protein, 5 aa, Mycobacterium
QDQVP

SEQ ID NO: 913155 - protein, 10 aa, Mycobacterium
QDRAERYGDQ

SEQ ID NO: 913156 - protein, 5 aa, Mycobacterium
QDRGE

SEQ ID NO: 913157 - protein, 5 aa, Mycobacterium
QDRGG

SEQ ID NO: 913158 - protein, 11 aa, Mycobacterium
QDRPNKGRRVR

SEQ ID NO: 913159 - protein, 8 aa, Mycobacterium
QDRSTPER

SEQ ID NO: 913160 - protein, 11 aa, Mycobacterium
QDRTYKPPPDA

SEQ ID NO: 913161 - protein, 5 aa, Mycobacterium
QDRVQ

SEQ ID NO: 913162 - protein, 11 aa, Mycobacterium
QDSAQNVRGVR

SEQ ID NO: 913163 - protein, 5 aa, Mycobacterium
QDSAT

SEQ ID NO: 913164 - protein, 8 aa, Mycobacterium
QDSGAPVT

SEQ ID NO: 913165 - protein, 9 aa, Mycobacterium
QDSGGRHPV

SEQ ID NO: 913166 - protein, 5 aa, Mycobacterium
QDSPK

SEQ ID NO: 913167 - protein, 10 aa, Mycobacterium
QDSSKATKGL

SEQ ID NO: 913168 - protein, 18 aa, Mycobacterium
QDSVDSTTDSEADGEVET

SEQ ID NO: 913169 - protein, 17 aa, Mycobacterium
QDSVNGKAGDLNKDAND

SEQ ID NO: 913170 - protein, 7 aa, Mycobacterium
QDTEGEA

SEQ ID NO: 913171 - protein, 6 aa, Mycobacterium
QDTVRQ

SEQ ID NO: 913172 - protein, 7 aa, Mycobacterium
QDVGCES

SEQ ID NO: 913173 - protein, 6 aa, Mycobacterium
QDVPGA

SEQ ID NO: 913174 - protein, 6 aa, Mycobacterium
QDVRAG

SEQ ID NO: 913175 - protein, 6 aa, Mycobacterium
QDVRPG

SEQ ID NO: 913176 - protein, 24 aa, Mycobacterium
QDVTGTAVRATGAGPDATGGDQNA

SEQ ID NO: 913177 - protein, 4 aa, Mycobacterium
QDWH

SEQ ID NO: 913178 - protein, 8 aa, Mycobacterium
QDYPDQQA

SEQ ID NO: 913179 - protein, 6 aa, Mycobacterium
QEAADQ

SEQ ID NO: 913180 - protein, 12 aa, Mycobacterium
QEAATRSDAGHR

SEQ ID NO: 913181 - protein, 12 aa, Mycobacterium
QEAFSPANLPTT

SEQ ID NO: 913182 - protein, 12 aa, Mycobacterium
QEAGMQTRLDYV

SEQ ID NO: 913183 - protein, 7 aa, Mycobacterium
QEAGTYT

SEQ ID NO: 913184 - protein, 8 aa, Mycobacterium
QEAPDPAA

SEQ ID NO: 913185 - protein, 9 aa, Mycobacterium
QEATGGTLD

SEQ ID NO: 913186 - protein, 17 aa, Mycobacterium
QEAVQSADGHSLSRPTW

SEQ ID NO: 913187 - protein, 5 aa, Mycobacterium
QEDPR

SEQ ID NO: 913188 - protein, 8 aa, Mycobacterium
QEEDGRQV

SEQ ID NO: 913189 - protein, 6 aa, Mycobacterium
QEEGAG

SEQ ID NO: 913190 - protein, 9 aa, Mycobacterium
QEEQRGTGH

SEQ ID NO: 913191 - protein, 6 aa, Mycobacterium
QEETGV

SEQ ID NO: 913192 - protein, 5 aa, Mycobacterium
QEGLG

SEQ ID NO: 913193 - protein, 11 aa, Mycobacterium
QEGNPLGPDGE

SEQ ID NO: 913194 - protein, 9 aa, Mycobacterium
QEGRPAKKV

SEQ ID NO: 913195 - protein, 19 aa, Mycobacterium
QEGYQDNSSPYDPEQAKRE

SEQ ID NO: 913196 - protein, 20 aa, Mycobacterium
QEGYQDNSTPYDPEQAKRDL

SEQ ID NO: 913197 - protein, 9 aa, Mycobacterium
QEKAIAASG

SEQ ID NO: 913198 - protein, 13 aa, Mycobacterium
QEKEIAESGSPYS

SEQ ID NO: 913199 - protein, 16 aa, Mycobacterium
QEKLGESGEADEVRTR

SEQ ID NO: 913200 - protein, 12 aa, Mycobacterium
QELAKARAEQVA

SEQ ID NO: 913201 - protein, 5 aa, Mycobacterium
QELPD

SEQ ID NO: 913202 - protein, 5 aa, Mycobacterium
QELRP

SEQ ID NO: 913203 - protein, 12 aa, Mycobacterium
QENEDVITDESA

SEQ ID NO: 913204 - protein, 8 aa, Mycobacterium
QENESGDV

SEQ ID NO: 913205 - protein, 8 aa, Mycobacterium
QENGPERL

SEQ ID NO: 913206 - protein, 12 aa, Mycobacterium
QEPAAGSTPPGP

SEQ ID NO: 913207 - protein, 6 aa, Mycobacterium
QEPAPG

SEQ ID NO: 913208 - protein, 12 aa, Mycobacterium
QEPASGQPARIP

SEQ ID NO: 913209 - protein, 23 aa, Mycobacterium
QEPDGSPVDYTGTPFAEAAANGV

SEQ ID NO: 913210 - protein, 7 aa, Mycobacterium
QEPGSGY

SEQ ID NO: 913211 - protein, 8 aa, Mycobacterium
QEPGTAEE

SEQ ID NO: 913212 - protein, 9 aa, Mycobacterium
QEPPTLEPC

SEQ ID NO: 913213 - protein, 7 aa, Mycobacterium
QEPTGAP

SEQ ID NO: 913214 - protein, 5 aa, Mycobacterium
QEQCS

SEQ ID NO: 913215 - protein, 8 aa, Mycobacterium
QEQPTYAP

SEQ ID NO: 913216 - protein, 5 aa, Mycobacterium
QEQQA

SEQ ID NO: 913217 - protein, 14 aa, Mycobacterium
QERAEALRRYNSLR

SEQ ID NO: 913218 - protein, 12 aa, Mycobacterium
QESASKTKTQQS

SEQ ID NO: 913219 - protein, 10 aa, Mycobacterium
QESGLTNVRG

SEQ ID NO: 913220 - protein, 5 aa, Mycobacterium
QESGR

SEQ ID NO: 913221 - protein, 4 aa, Mycobacterium
QESK

SEQ ID NO: 913222 - protein, 17 aa, Mycobacterium
QESPPPETWPPPAVEQG

SEQ ID NO: 913223 - protein, 8 aa, Mycobacterium
QETKDDFA

SEQ ID NO: 913224 - protein, 11 aa, Mycobacterium
QEVDPSPDGVE

SEQ ID NO: 913225 - protein, 6 aa, Mycobacterium
QEVSGS

SEQ ID NO: 913226 - protein, 11 aa, Mycobacterium
QEYFAGETKEY

SEQ ID NO: 913227 - protein, 11 aa, Mycobacterium
QFEDDARAGRL

SEQ ID NO: 913228 - protein, 7 aa, Mycobacterium
QFERSDE

SEQ ID NO: 913229 - protein, 13 aa, Mycobacterium
QFGTDTSDIPTAQ

SEQ ID NO: 913230 - protein, 10 aa, Mycobacterium
QFPAPDQLSG

SEQ ID NO: 913231 - protein, 9 aa, Mycobacterium
QFPENPSAS

SEQ ID NO: 913232 - protein, 6 aa, Mycobacterium
QFPPAE

SEQ ID NO: 913233 - protein, 7 aa, Mycobacterium
QFPPGTQ

SEQ ID NO: 913234 - protein, 7 aa, Mycobacterium
QFPRDKA

SEQ ID NO: 913235 - protein, 16 aa, Mycobacterium
QFPRDKACGDGLTPRA

SEQ ID NO: 913236 - protein, 17 aa, Mycobacterium
QFPRPAVRPGYSALGGR

SEQ ID NO: 913237 - protein, 12 aa, Mycobacterium
QFPSAGSGERAS

SEQ ID NO: 913238 - protein, 5 aa, Mycobacterium
QFRSS

SEQ ID NO: 913239 - protein, 9 aa, Mycobacterium
QFSGPGAQL

SEQ ID NO: 913240 - protein, 4 aa, Mycobacterium
QFTP

SEQ ID NO: 913241 - protein, 6 aa, Mycobacterium
QGAAET

SEQ ID NO: 913242 - protein, 12 aa, Mycobacterium
QGADIQDRVNNR

SEQ ID NO: 913243 - protein, 10 aa, Mycobacterium
QGAGKYPTIP

SEQ ID NO: 913244 - protein, 6 aa, Mycobacterium
QGAGTC

SEQ ID NO: 913245 - protein, 4 aa, Mycobacterium
QGAK

SEQ ID NO: 913246 - protein, 5 aa, Mycobacterium
QGAPM

SEQ ID NO: 913247 - protein, 6 aa, Mycobacterium
QGAPRA

SEQ ID NO: 913248 - protein, 5 aa, Mycobacterium
QGASA

SEQ ID NO: 913249 - protein, 7 aa, Mycobacterium
QGASQAL

SEQ ID NO: 913250 - protein, 9 aa, Mycobacterium
QGASTSKEI

SEQ ID NO: 913251 - protein, 4 aa, Mycobacterium
QGAT

SEQ ID NO: 913252 - protein, 8 aa, Mycobacterium
QGAVPSTR

SEQ ID NO: 913253 - protein, 8 aa, Mycobacterium
QGAVSSVP

SEQ ID NO: 913254 - protein, 9 aa, Mycobacterium
QGCGGPPCK

SEQ ID NO: 913255 - protein, 5 aa, Mycobacterium
QGDGD

SEQ ID NO: 913256 - protein, 8 aa, Mycobacterium
QGDGGDAG

SEQ ID NO: 913257 - protein, 7 aa, Mycobacterium
QGDGQDI

SEQ ID NO: 913258 - protein, 7 aa, Mycobacterium
QGDGSSI

SEQ ID NO: 913259 - protein, 9 aa, Mycobacterium
QGDKTDELT

SEQ ID NO: 913260 - protein, 5 aa, Mycobacterium
QGDQR

SEQ ID NO: 913261 - protein, 8 aa, Mycobacterium
QGDRDTHD

SEQ ID NO: 913262 - protein, 6 aa, Mycobacterium
QGDRNF

SEQ ID NO: 913263 - protein, 10 aa, Mycobacterium
QGDRTRTPRA

SEQ ID NO: 913264 - protein, 4 aa, Mycobacterium
QGDS

SEQ ID NO: 913265 - protein, 7 aa, Mycobacterium
QGDSDTI

SEQ ID NO: 913266 - protein, 7 aa, Mycobacterium
QGDSNQI

SEQ ID NO: 913267 - protein, 6 aa, Mycobacterium
QGDTSA

SEQ ID NO: 913268 - protein, 6 aa, Mycobacterium
QGEAPV

SEQ ID NO: 913269 - protein, 8 aa, Mycobacterium
QGEEPGAV

SEQ ID NO: 913270 - protein, 5 aa, Mycobacterium
QGEPE

SEQ ID NO: 913271 - protein, 14 aa, Mycobacterium
QGEPEQAERDAHDA

SEQ ID NO: 913272 - protein, 8 aa, Mycobacterium
QGEPNADA

SEQ ID NO: 913273 - protein, 7 aa, Mycobacterium
QGERPTL

SEQ ID NO: 913274 - protein, 6 aa, Mycobacterium
QGETND

SEQ ID NO: 913275 - protein, 19 aa, Mycobacterium
QGFATGDVTTSEIQDATSA

SEQ ID NO: 913276 - protein, 62 aa, Mycobacterium
QGFEAGYGDGYADGLAAGQDGGFDGGADAGGDWGGDTAGDWGGMDTGGGWGDFGGDFGDFGG

SEQ ID NO: 913277 - protein, 24 aa, Mycobacterium
QGGAGGIGGAASTGMAGAGGSGGS

SEQ ID NO: 913278 - protein, 10 aa, Mycobacterium
QGGAIDPEAT

SEQ ID NO: 913279 - protein, 9 aa, Mycobacterium
QGGCQGLED

SEQ ID NO: 913280 - protein, 7 aa, Mycobacterium
QGGCQSL

SEQ ID NO: 913281 - protein, 8 aa, Mycobacterium
QGGDEPCC

SEQ ID NO: 913282 - protein, 8 aa, Mycobacterium
QGGEPLPD

SEQ ID NO: 913283 - protein, 5 aa, Mycobacterium
QGGGA

SEQ ID NO: 913284 - protein, 11 aa, Mycobacterium
QGGGAAASAAE

SEQ ID NO: 913285 - protein, 16 aa, Mycobacterium
QGGGATASAAELASAY

SEQ ID NO: 913286 - protein, 7 aa, Mycobacterium
QGGGGSM

SEQ ID NO: 913287 - protein, 7 aa, Mycobacterium
QGGGPKA

SEQ ID NO: 913288 - protein, 6 aa, Mycobacterium
QGGGPR

SEQ ID NO: 913289 - protein, 9 aa, Mycobacterium
QGGNGSTAI

SEQ ID NO: 913290 - protein, 6 aa, Mycobacterium
QGGNIN

SEQ ID NO: 913291 - protein, 8 aa, Mycobacterium
QGGPAVGE

SEQ ID NO: 913292 - protein, 9 aa, Mycobacterium
QGGPGGSTQ

SEQ ID NO: 913293 - protein, 9 aa, Mycobacterium
QGGQGAGTV

SEQ ID NO: 913294 - protein, 7 aa, Mycobacterium
QGGQLTE

SEQ ID NO: 913295 - protein, 5 aa, Mycobacterium
QGGRE

SEQ ID NO: 913296 - protein, 10 aa, Mycobacterium
QGGSADDIAP

SEQ ID NO: 913297 - protein, 5 aa, Mycobacterium
QGGTA

SEQ ID NO: 913298 - protein, 5 aa, Mycobacterium
QGGTI

SEQ ID NO: 913299 - protein, 5 aa, Mycobacterium
QGGTR

SEQ ID NO: 913300 - protein, 11 aa, Mycobacterium
QGHDPARPDAA

SEQ ID NO: 913301 - protein, 23 aa, Mycobacterium
QGHEAVPASPSTGVNTVTGEGVA

SEQ ID NO: 913302 - protein, 10 aa, Mycobacterium
QGHMPSPDKE

SEQ ID NO: 913303 - protein, 4 aa, Mycobacterium
QGHP

SEQ ID NO: 913304 - protein, 6 aa, Mycobacterium
QGHPNA

SEQ ID NO: 913305 - protein, 5 aa, Mycobacterium
QGHTQ

SEQ ID NO: 913306 - protein, 8 aa, Mycobacterium
QGIPAQAS

SEQ ID NO: 913307 - protein, 11 aa, Mycobacterium
QGITDENMRDT

SEQ ID NO: 913308 - protein, 9 aa, Mycobacterium
QGKEEFDTE

SEQ ID NO: 913309 - protein, 4 aa, Mycobacterium
QGKG

SEQ ID NO: 913310 - protein, 4 aa, Mycobacterium
QGKP

SEQ ID NO: 913311 - protein, 23 aa, Mycobacterium
QGKPQTDIGITGSPALTSSEERQ

SEQ ID NO: 913312 - protein, 13 aa, Mycobacterium
QGKPVEHVNPPQT

SEQ ID NO: 913313 - protein, 15 aa, Mycobacterium
QGKQSDHALSSEDFG

SEQ ID NO: 913314 - protein, 8 aa, Mycobacterium
QGKSVVTA

SEQ ID NO: 913315 - protein, 13 aa, Mycobacterium
QGKTVDDPTLDAE

SEQ ID NO: 913316 - protein, 4 aa, Mycobacterium
QGKV

SEQ ID NO: 913317 - protein, 13 aa, Mycobacterium
QGLDTDSAKTSAP

SEQ ID NO: 913318 - protein, 6 aa, Mycobacterium
QGLDTS

SEQ ID NO: 913319 - protein, 20 aa, Mycobacterium
QGLGGTTSTSATFETHSPEN

SEQ ID NO: 913320 - protein, 11 aa, Mycobacterium
QGLGTPGGHPY

SEQ ID NO: 913321 - protein, 8 aa, Mycobacterium
QGLHGPKR

SEQ ID NO: 913322 - protein, 9 aa, Mycobacterium
QGLNPRSDI

SEQ ID NO: 913323 - protein, 11 aa, Mycobacterium
QGLRDSRIAPT

SEQ ID NO: 913324 - protein, 4 aa, Mycobacterium
QGLS

SEQ ID NO: 913325 - protein, 8 aa, Mycobacterium
QGLSNDEI

SEQ ID NO: 913326 - protein, 6 aa, Mycobacterium
QGLTGA

SEQ ID NO: 913327 - protein, 15 aa, Mycobacterium
QGMTCPDGSYAPTQE

SEQ ID NO: 913328 - protein, 13 aa, Mycobacterium
QGNGAGSGPPFGA

SEQ ID NO: 913329 - protein, 7 aa, Mycobacterium
QGNGGTI

SEQ ID NO: 913330 - protein, 7 aa, Mycobacterium
QGNGSSI

SEQ ID NO: 913331 - protein, 9 aa, Mycobacterium
QGNNEPTVE

SEQ ID NO: 913332 - protein, 17 aa, Mycobacterium
QGNPAQRRYPAWPGSYD

SEQ ID NO: 913333 - protein, 7 aa, Mycobacterium
QGNPHDG

SEQ ID NO: 913334 - protein, 8 aa, Mycobacterium
QGNPKGIK

SEQ ID NO: 913335 - protein, 7 aa, Mycobacterium
QGNSDSI

SEQ ID NO: 913336 - protein, 7 aa, Mycobacterium
QGNSNSI

SEQ ID NO: 913337 - protein, 7 aa, Mycobacterium
QGNSQSG

SEQ ID NO: 913338 - protein, 34 aa, Mycobacterium
QGPAGQSYPAGAGPWGPPPAWAPPAPPPPSWAPG

SEQ ID NO: 913339 - protein, 6 aa, Mycobacterium
QGPASA

SEQ ID NO: 913340 - protein, 9 aa, Mycobacterium
QGPAYSEGL

SEQ ID NO: 913341 - protein, 13 aa, Mycobacterium
QGPDIQDRVNNRS

SEQ ID NO: 913342 - protein, 13 aa, Mycobacterium
QGPGETVDDMRPS

SEQ ID NO: 913343 - protein, 4 aa, Mycobacterium
QGPK

SEQ ID NO: 913344 - protein, 11 aa, Mycobacterium
QGPLAQPKARR

SEQ ID NO: 913345 - protein, 6 aa, Mycobacterium
QGPNAR

SEQ ID NO: 913346 - protein, 9 aa, Mycobacterium
QGPPRTDGP

SEQ ID NO: 913347 - protein, 10 aa, Mycobacterium
QGPRPAPKWD

SEQ ID NO: 913348 - protein, 5 aa, Mycobacterium
QGPSA

SEQ ID NO: 913349 - protein, 10 aa, Mycobacterium
QGPSSTSQVT

SEQ ID NO: 913350 - protein, 5 aa, Mycobacterium
QGQGS

SEQ ID NO: 913351 - protein, 7 aa, Mycobacterium
QGQKGLA

SEQ ID NO: 913352 - protein, 28 aa, Mycobacterium
QGQPASEEAFTDTGAATSRPAPEIRHDT

SEQ ID NO: 913353 - protein, 21 aa, Mycobacterium
QGQSAADVASTVADTGGMPLG

SEQ ID NO: 913354 - protein, 8 aa, Mycobacterium
QGQVSTTS

SEQ ID NO: 913355 - protein, 6 aa, Mycobacterium
QGQYGD

SEQ ID NO: 913356 - protein, 4 aa, Mycobacterium
QGRG

SEQ ID NO: 913357 - protein, 5 aa, Mycobacterium
QGRPV

SEQ ID NO: 913358 - protein, 5 aa, Mycobacterium
QGRTL

SEQ ID NO: 913359 - protein, 9 aa, Mycobacterium
QGRTTGNSC

SEQ ID NO: 913360 - protein, 10 aa, Mycobacterium
QGRTTGRAYA

SEQ ID NO: 913361 - protein, 10 aa, Mycobacterium
QGSAGPQSFG

SEQ ID NO: 913362 - protein, 5 aa, Mycobacterium
QGSEV

SEQ ID NO: 913363 - protein, 20 aa, Mycobacterium
QGSGATTQAAGDGGMMVGSM

SEQ ID NO: 913364 - protein, 23 aa, Mycobacterium
QGSGPGAGPAPEYDAPAALQADA

SEQ ID NO: 913365 - protein, 11 aa, Mycobacterium
QGSPRRDRPYQ

SEQ ID NO: 913366 - protein, 4 aa, Mycobacterium
QGSR

SEQ ID NO: 913367 - protein, 6 aa, Mycobacterium
QGSRQF

SEQ ID NO: 913368 - protein, 4 aa, Mycobacterium
QGSS

SEQ ID NO: 913369 - protein, 5 aa, Mycobacterium
QGSSN

SEQ ID NO: 913370 - protein, 5 aa, Mycobacterium
QGSSP

SEQ ID NO: 913371 - protein, 49 aa, Mycobacterium
QGSTGSGGAGGTGGDGGSPGTVGSGKAGGTGTGDGNSTNGGPGANGLGG

SEQ ID NO: 913372 - protein, 21 aa, Mycobacterium
QGSTRRRGEQLEDAKAEARRL

SEQ ID NO: 913373 - protein, 4 aa, Mycobacterium
QGTG

SEQ ID NO: 913374 - protein, 8 aa, Mycobacterium
QGTKPRCC

SEQ ID NO: 913375 - protein, 7 aa, Mycobacterium
QGTSHQK

SEQ ID NO: 913376 - protein, 10 aa, Mycobacterium
QGTSSNGAAI

SEQ ID NO: 913377 - protein, 15 aa, Mycobacterium
QGTSSQKSASDARYS

SEQ ID NO: 913378 - protein, 4 aa, Mycobacterium
QGTT

SEQ ID NO: 913379 - protein, 10 aa, Mycobacterium
QGVGSVRSVR

SEQ ID NO: 913380 - protein, 10 aa, Mycobacterium
QGVSGSGAGG

SEQ ID NO: 913381 - protein, 9 aa, Mycobacterium
QGWQTSSHT

SEQ ID NO: 913382 - protein, 6 aa, Mycobacterium
QGYDAR

SEQ ID NO: 913383 - protein, 14 aa, Mycobacterium
QGYQSTDRTTQAQA

SEQ ID NO: 913384 - protein, 5 aa, Mycobacterium
QHAPR

SEQ ID NO: 913385 - protein, 8 aa, Mycobacterium
QHDETAAL

SEQ ID NO: 913386 - protein, 9 aa, Mycobacterium
QHDSDPMSA

SEQ ID NO: 913387 - protein, 7 aa, Mycobacterium
QHDSSGR

SEQ ID NO: 913388 - protein, 4 aa, Mycobacterium
QHEI

SEQ ID NO: 913389 - protein, 4 aa, Mycobacterium
QHGA

SEQ ID NO: 913390 - protein, 11 aa, Mycobacterium
QHGFGSTGTNI

SEQ ID NO: 913391 - protein, 9 aa, Mycobacterium
QHPDKKMSG

SEQ ID NO: 913392 - protein, 6 aa, Mycobacterium
QHPPYP

SEQ ID NO: 913393 - protein, 44 aa, Mycobacterium
QHQPVRAATTGTADTPGTASTPVAAGTGQPAAPPPNAPITGTAA

SEQ ID NO: 913394 - protein, 9 aa, Mycobacterium
QHRAAQGKG

SEQ ID NO: 913395 - protein, 10 aa, Mycobacterium
QHRDRNGHYQ

SEQ ID NO: 913396 - protein, 13 aa, Mycobacterium
QHRPVPRTAEEYQ

SEQ ID NO: 913397 - protein, 10 aa, Mycobacterium
QHSGTPALTR

SEQ ID NO: 913398 - protein, 10 aa, Mycobacterium
QHSPAPQHRE

SEQ ID NO: 913399 - protein, 4 aa, Mycobacterium
QHTD

SEQ ID NO: 913400 - protein, 19 aa, Mycobacterium
QHTVPNQNRYRESANPYEL

SEQ ID NO: 913401 - protein, 8 aa, Mycobacterium
QIAGGAQG

SEQ ID NO: 913402 - protein, 7 aa, Mycobacterium
QIAPSGA

SEQ ID NO: 913403 - protein, 5 aa, Mycobacterium
QIAQT

SEQ ID NO: 913404 - protein, 8 aa, Mycobacterium
QIATSGAR

SEQ ID NO: 913405 - protein, 7 aa, Mycobacterium
QIEPGST

SEQ ID NO: 913406 - protein, 29 aa, Mycobacterium
QIESNTSVSPAPPGPGSTTTPVSTGPPEV

SEQ ID NO: 913407 - protein, 8 aa, Mycobacterium
QIETSGSI

SEQ ID NO: 913408 - protein, 4 aa, Mycobacterium
QIGP

SEQ ID NO: 913409 - protein, 8 aa, Mycobacterium
QIGTSGGT

SEQ ID NO: 913410 - protein, 5 aa, Mycobacterium
QINDG

SEQ ID NO: 913411 - protein, 11 aa, Mycobacterium
QINGEDADGDA

SEQ ID NO: 913412 - protein, 9 aa, Mycobacterium
QINPDPGEE

SEQ ID NO: 913413 - protein, 6 aa, Mycobacterium
QIPAAA

SEQ ID NO: 913414 - protein, 5 aa, Mycobacterium
QIPEP

SEQ ID NO: 913415 - protein, 9 aa, Mycobacterium
QIPGAPGMA

SEQ ID NO: 913416 - protein, 6 aa, Mycobacterium
QIPGMG

SEQ ID NO: 913417 - protein, 7 aa, Mycobacterium
QIPGMGG

SEQ ID NO: 913418 - protein, 13 aa, Mycobacterium
QIPGMGGQVPGMT

SEQ ID NO: 913419 - protein, 6 aa, Mycobacterium
QIPSND

SEQ ID NO: 913420 - protein, 5 aa, Mycobacterium
QIRSA

SEQ ID NO: 913421 - protein, 21 aa, Mycobacterium
QIRSPSDPGYVPTAPPAMTTT

SEQ ID NO: 913422 - protein, 12 aa, Mycobacterium
QISAGAPGDPLA

SEQ ID NO: 913423 - protein, 12 aa, Mycobacterium
QISDTRTWDFWW

SEQ ID NO: 913424 - protein, 9 aa, Mycobacterium
QISGPDPEN

SEQ ID NO: 913425 - protein, 9 aa, Mycobacterium
QISPAGNAA

SEQ ID NO: 913426 - protein, 6 aa, Mycobacterium
QISPRD

SEQ ID NO: 913427 - protein, 9 aa, Mycobacterium
QISQGAPAD

SEQ ID NO: 913428 - protein, 7 aa, Mycobacterium
QISQKDD

SEQ ID NO: 913429 - protein, 8 aa, Mycobacterium
QISSGTSL

SEQ ID NO: 913430 - protein, 5 aa, Mycobacterium
QITAG

SEQ ID NO: 913431 - protein, 10 aa, Mycobacterium
QIVSSGEVRG

SEQ ID NO: 913432 - protein, 7 aa, Mycobacterium
QKAAADN

SEQ ID NO: 913433 - protein, 7 aa, Mycobacterium
QKAAPDA

SEQ ID NO: 913434 - protein, 9 aa, Mycobacterium
QKAGTSMAA

SEQ ID NO: 913435 - protein, 7 aa, Mycobacterium
QKARSTF

SEQ ID NO: 913436 - protein, 12 aa, Mycobacterium
QKGGVGKTTTAV

SEQ ID NO: 913437 - protein, 6 aa, Mycobacterium
QKGPWS

SEQ ID NO: 913438 - protein, 8 aa, Mycobacterium
QKGYQDNS

SEQ ID NO: 913439 - protein, 10 aa, Mycobacterium
QKINGQSVTS

SEQ ID NO: 913440 - protein, 7 aa, Mycobacterium
QKINSSG

SEQ ID NO: 913441 - protein, 21 aa, Mycobacterium
QKIPSPDPYGRIGNQAGSEES

SEQ ID NO: 913442 - protein, 7 aa, Mycobacterium
QKIPTTS

SEQ ID NO: 913443 - protein, 7 aa, Mycobacterium
QKKSDRI

SEQ ID NO: 913444 - protein, 8 aa, Mycobacterium
QKKSEKLK

SEQ ID NO: 913445 - protein, 15 aa, Mycobacterium
QKLKDATGKEYTPDS

SEQ ID NO: 913446 - protein, 6 aa, Mycobacterium
QKLPGS

SEQ ID NO: 913447 - protein, 7 aa, Mycobacterium
QKPDGSW

SEQ ID NO: 913448 - protein, 19 aa, Mycobacterium
QKPHAGRGRRDDHVPHDQL

SEQ ID NO: 913449 - protein, 10 aa, Mycobacterium
QKPKGAGQDR

SEQ ID NO: 913450 - protein, 4 aa, Mycobacterium
QKPV

SEQ ID NO: 913451 - protein, 35 aa, Mycobacterium
QKQAAPPANPAQTPPGNQPQTTPPANQTPTPPPVA

SEQ ID NO: 913452 - protein, 5 aa, Mycobacterium
QKQEV

SEQ ID NO: 913453 - protein, 19 aa, Mycobacterium
QKQTGQQVAPTAGLDPANY

SEQ ID NO: 913454 - protein, 10 aa, Mycobacterium
QKQVKPTGSA

SEQ ID NO: 913455 - protein, 5 aa, Mycobacterium
QKSDI

SEQ ID NO: 913456 - protein, 17 aa, Mycobacterium
QKSEEPVAAPPYPAGPV

SEQ ID NO: 913457 - protein, 9 aa, Mycobacterium
QKSGDSISL

SEQ ID NO: 913458 - protein, 7 aa, Mycobacterium
QKSGGKA

SEQ ID NO: 913459 - protein, 8 aa, Mycobacterium
QKTDQSIG

SEQ ID NO: 913460 - protein, 7 aa, Mycobacterium
QKVTSGG

SEQ ID NO: 913461 - protein, 14 aa, Mycobacterium
QKYDPGRVMFSGMN

SEQ ID NO: 913462 - protein, 14 aa, Mycobacterium
QKYDPNRVMFSGLD

SEQ ID NO: 913463 - protein, 14 aa, Mycobacterium
QKYDPSRIMFSGLN

SEQ ID NO: 913464 - protein, 9 aa, Mycobacterium
QKYSPDGPG

SEQ ID NO: 913465 - protein, 11 aa, Mycobacterium
QLADAGGSQEW

SEQ ID NO: 913466 - protein, 11 aa, Mycobacterium
QLAEETGKRLG

SEQ ID NO: 913467 - protein, 11 aa, Mycobacterium
QLAGPGPSAGP

SEQ ID NO: 913468 - protein, 7 aa, Mycobacterium
QLAGQAD

SEQ ID NO: 913469 - protein, 11 aa, Mycobacterium
QLDATGPGQAI

SEQ ID NO: 913470 - protein, 18 aa, Mycobacterium
QLDDNYDDPTVRNDSAAE

SEQ ID NO: 913471 - protein, 17 aa, Mycobacterium
QLDEREEDLAAARAANR

SEQ ID NO: 913472 - protein, 6 aa, Mycobacterium
QLEAAA

SEQ ID NO: 913473 - protein, 13 aa, Mycobacterium
QLEEAKASGDSDY

SEQ ID NO: 913474 - protein, 7 aa, Mycobacterium
QLEGGSR

SEQ ID NO: 913475 - protein, 5 aa, Mycobacterium
QLGAG

SEQ ID NO: 913476 - protein, 6 aa, Mycobacterium
QLGGAR

SEQ ID NO: 913477 - protein, 8 aa, Mycobacterium
QLGGARPA

SEQ ID NO: 913478 - protein, 6 aa, Mycobacterium
QLGGDD

SEQ ID NO: 913479 - protein, 8 aa, Mycobacterium
QLGGSRPA

SEQ ID NO: 913480 - protein, 13 aa, Mycobacterium
QLGKGDPAKKIPP

SEQ ID NO: 913481 - protein, 5 aa, Mycobacterium
QLGPS

SEQ ID NO: 913482 - protein, 5 aa, Mycobacterium
QLGPT

SEQ ID NO: 913483 - protein, 4 aa, Mycobacterium
QLGS

SEQ ID NO: 913484 - protein, 10 aa, Mycobacterium
QLGTDPNRTV

SEQ ID NO: 913485 - protein, 6 aa, Mycobacterium
QLGTIG

SEQ ID NO: 913486 - protein, 24 aa, Mycobacterium
QLGTPGEHFPPPQTRAVATAWFAG

SEQ ID NO: 913487 - protein, 11 aa, Mycobacterium
QLNAPGPSAGP

SEQ ID NO: 913488 - protein, 15 aa, Mycobacterium
QLNDTKKKAIKLCLA

SEQ ID NO: 913489 - protein, 11 aa, Mycobacterium
QLNGPGPSAGP

SEQ ID NO: 913490 - protein, 20 aa, Mycobacterium
QLPADKKTGKAWNPTPEFSD

SEQ ID NO: 913491 - protein, 6 aa, Mycobacterium
QLPAGR

SEQ ID NO: 913492 - protein, 24 aa, Mycobacterium
QLPAQQAPLPQAPLQQAPATQAPL

SEQ ID NO: 913493 - protein, 20 aa, Mycobacterium
QLPEGRRQSFAAGDSNGDAT

SEQ ID NO: 913494 - protein, 6 aa, Mycobacterium
QLPGNG

SEQ ID NO: 913495 - protein, 56 aa, Mycobacterium
QLPPQQAPAQQAPVQQAPLQQQSAQAPLQQAPVQQAPVQQVPTRQAPLQQAPLPRA

SEQ ID NO: 913496 - protein, 6 aa, Mycobacterium
QLPPVA

SEQ ID NO: 913497 - protein, 6 aa, Mycobacterium
QLPQDR

SEQ ID NO: 913498 - protein, 15 aa, Mycobacterium
QLPRGSTAELRTATP

SEQ ID NO: 913499 - protein, 13 aa, Mycobacterium
QLPTQQAPAQQAP

SEQ ID NO: 913500 - protein, 9 aa, Mycobacterium
QLPYERPPL

SEQ ID NO: 913501 - protein, 7 aa, Mycobacterium
QLRASGA

SEQ ID NO: 913502 - protein, 17 aa, Mycobacterium
QLRQDEACDPHRGSWDG

SEQ ID NO: 913503 - protein, 8 aa, Mycobacterium
QLRSSGYP

SEQ ID NO: 913504 - protein, 4 aa, Mycobacterium
QLSD

SEQ ID NO: 913505 - protein, 8 aa, Mycobacterium
QLSEGSGD

SEQ ID NO: 913506 - protein, 9 aa, Mycobacterium
QLSEGTPPH

SEQ ID NO: 913507 - protein, 8 aa, Mycobacterium
QLSGRGDV

SEQ ID NO: 913508 - protein, 8 aa, Mycobacterium
QLSPDGVT

SEQ ID NO: 913509 - protein, 7 aa, Mycobacterium
QLSPSQV

SEQ ID NO: 913510 - protein, 8 aa, Mycobacterium
QLSQGGQG

SEQ ID NO: 913511 - protein, 12 aa, Mycobacterium
QLSRPDDDSVGP

SEQ ID NO: 913512 - protein, 12 aa, Mycobacterium
QLSTATVDQGFQ

SEQ ID NO: 913513 - protein, 13 aa, Mycobacterium
QLTNTKQSSVQER

SEQ ID NO: 913514 - protein, 49 aa, Mycobacterium
QMPASGAPAAPSVPTTSSPAPPPPAPPSPTPPPGSSGHVPASGCVVGAN

SEQ ID NO: 913515 - protein, 9 aa, Mycobacterium
QMPDAKPSA

SEQ ID NO: 913516 - protein, 4 aa, Mycobacterium
QMPG

SEQ ID NO: 913517 - protein, 17 aa, Mycobacterium
QMSDDHADANVMCRVKS

SEQ ID NO: 913518 - protein, 6 aa, Mycobacterium
QMSGAD

SEQ ID NO: 913519 - protein, 5 aa, Mycobacterium
QMSGY

SEQ ID NO: 913520 - protein, 6 aa, Mycobacterium
QMTDES

SEQ ID NO: 913521 - protein, 10 aa, Mycobacterium
QMTQDGYRKA

SEQ ID NO: 913522 - protein, 6 aa, Mycobacterium
QMTSPN

SEQ ID NO: 913523 - protein, 5 aa, Mycobacterium
QNAAA

SEQ ID NO: 913524 - protein, 10 aa, Mycobacterium
QNAALAKGAS

SEQ ID NO: 913525 - protein, 6 aa, Mycobacterium
QNADRT

SEQ ID NO: 913526 - protein, 10 aa, Mycobacterium
QNAEGSADTM

SEQ ID NO: 913527 - protein, 7 aa, Mycobacterium
QNAGPEL

SEQ ID NO: 913528 - protein, 8 aa, Mycobacterium
QNAGTSYG

SEQ ID NO: 913529 - protein, 37 aa, Mycobacterium
QNALPEQFSAPAAPAAPPPPAPAPPPPPPPVEQFAPA

SEQ ID NO: 913530 - protein, 5 aa, Mycobacterium
QNAPA

SEQ ID NO: 913531 - protein, 11 aa, Mycobacterium
QNAPADAQGPI

SEQ ID NO: 913532 - protein, 7 aa, Mycobacterium
QNAPPEL

SEQ ID NO: 913533 - protein, 6 aa, Mycobacterium
QNAYGE

SEQ ID NO: 913534 - protein, 6 aa, Mycobacterium
QNCDPA

SEQ ID NO: 913535 - protein, 4 aa, Mycobacterium
QNDG

SEQ ID NO: 913536 - protein, 61 aa, Mycobacterium
QNDGAPASAEEPQSNQQGTQESTEGSAEESTDGASAEGTGPSEDTDSSTAPTTTTTEEESG

SEQ ID NO: 913537 - protein, 8 aa, Mycobacterium
QNEDGSFS

SEQ ID NO: 913538 - protein, 4 aa, Mycobacterium
QNEK

SEQ ID NO: 913539 - protein, 5 aa, Mycobacterium
QNEKN

SEQ ID NO: 913540 - protein, 6 aa, Mycobacterium
QNEKNS

SEQ ID NO: 913541 - protein, 6 aa, Mycobacterium
QNEKSA

SEQ ID NO: 913542 - protein, 7 aa, Mycobacterium
QNFSGRA

SEQ ID NO: 913543 - protein, 45 aa, Mycobacterium
QNGGAAAPAAAAAVPELPAAAAAPAAAAPAAVAPAAAAAAAAVPP

SEQ ID NO: 913544 - protein, 10 aa, Mycobacterium
QNGGADADGL

SEQ ID NO: 913545 - protein, 6 aa, Mycobacterium
QNGGAK

SEQ ID NO: 913546 - protein, 7 aa, Mycobacterium
QNGLSAS

SEQ ID NO: 913547 - protein, 8 aa, Mycobacterium
QNGSPSQL

SEQ ID NO: 913548 - protein, 12 aa, Mycobacterium
QNGTTDCATAGQ

SEQ ID NO: 913549 - protein, 8 aa, Mycobacterium
QNKPGNIG

SEQ ID NO: 913550 - protein, 6 aa, Mycobacterium
QNLKTG

SEQ ID NO: 913551 - protein, 18 aa, Mycobacterium
QNLPGYEGSGDGKASTLG

SEQ ID NO: 913552 - protein, 9 aa, Mycobacterium
QNMSNNSAV

SEQ ID NO: 913553 - protein, 6 aa, Mycobacterium
QNNELG

SEQ ID NO: 913554 - protein, 13 aa, Mycobacterium
QNPDWSRAYSGSA

SEQ ID NO: 913555 - protein, 7 aa, Mycobacterium
QNPEAAK

SEQ ID NO: 913556 - protein, 14 aa, Mycobacterium
QNPETGAVTGDPEV

SEQ ID NO: 913557 - protein, 7 aa, Mycobacterium
QNPGNAQ

SEQ ID NO: 913558 - protein, 9 aa, Mycobacterium
QNPGPEKEA

SEQ ID NO: 913559 - protein, 7 aa, Mycobacterium
QNPPALS

SEQ ID NO: 913560 - protein, 7 aa, Mycobacterium
QNPQVEK

SEQ ID NO: 913561 - protein, 14 aa, Mycobacterium
QNPQWSRAYSGGSE

SEQ ID NO: 913562 - protein, 5 aa, Mycobacterium
QNPRS

SEQ ID NO: 913563 - protein, 4 aa, Mycobacterium
QNPS

SEQ ID NO: 913564 - protein, 5 aa, Mycobacterium
QNQET

SEQ ID NO: 913565 - protein, 8 aa, Mycobacterium
QNQNVSGQ

SEQ ID NO: 913566 - protein, 7 aa, Mycobacterium
QNQTSAG

SEQ ID NO: 913567 - protein, 9 aa, Mycobacterium
QNRPGAEGF

SEQ ID NO: 913568 - protein, 8 aa, Mycobacterium
QNRPGIGD

SEQ ID NO: 913569 - protein, 6 aa, Mycobacterium
QNRSGR

SEQ ID NO: 913570 - protein, 5 aa, Mycobacterium
QNSGF

SEQ ID NO: 913571 - protein, 21 aa, Mycobacterium
QNSGGGAAAEPPGAAAEAVAP

SEQ ID NO: 913572 - protein, 7 aa, Mycobacterium
QNTDAEG

SEQ ID NO: 913573 - protein, 8 aa, Mycobacterium
QNTEGSIT

SEQ ID NO: 913574 - protein, 6 aa, Mycobacterium
QNTGHH

SEQ ID NO: 913575 - protein, 23 aa, Mycobacterium
QNTLGDGSAPAARIDAVGIGKEN

SEQ ID NO: 913576 - protein, 4 aa, Mycobacterium
QNTP

SEQ ID NO: 913577 - protein, 9 aa, Mycobacterium
QNTPAIAAT

SEQ ID NO: 913578 - protein, 7 aa, Mycobacterium
QNTQPAL

SEQ ID NO: 913579 - protein, 13 aa, Mycobacterium
QNTTAIAATESEY

SEQ ID NO: 913580 - protein, 8 aa, Mycobacterium
QNTVEKDA

SEQ ID NO: 913581 - protein, 20 aa, Mycobacterium
QNVGGADPGVPYGTDPYVPD

SEQ ID NO: 913582 - protein, 17 aa, Mycobacterium
QNYSGRTTVAKDGQIFA

SEQ ID NO: 913583 - protein, 11 aa, Mycobacterium
QPAAPGTATAD

SEQ ID NO: 913584 - protein, 8 aa, Mycobacterium
QPADATQN

SEQ ID NO: 913585 - protein, 12 aa, Mycobacterium
QPADPKDPPTIS

SEQ ID NO: 913586 - protein, 4 aa, Mycobacterium
QPAG

SEQ ID NO: 913587 - protein, 10 aa, Mycobacterium
QPAHRGTAPE

SEQ ID NO: 913588 - protein, 9 aa, Mycobacterium
QPAKGKDGV

SEQ ID NO: 913589 - protein, 7 aa, Mycobacterium
QPAPPPC

SEQ ID NO: 913590 - protein, 25 aa, Mycobacterium
QPAPPPPAAAPEKPASTTVNPARID

SEQ ID NO: 913591 - protein, 8 aa, Mycobacterium
QPAPQKPA

SEQ ID NO: 913592 - protein, 9 aa, Mycobacterium
QPAPRSGSL

SEQ ID NO: 913593 - protein, 7 aa, Mycobacterium
QPAQADG

SEQ ID NO: 913594 - protein, 6 aa, Mycobacterium
QPARGD

SEQ ID NO: 913595 - protein, 9 aa, Mycobacterium
QPATEQPRI

SEQ ID NO: 913596 - protein, 61 aa, Mycobacterium
QPCTTGSTPSTTATTATTTPTTPTTPTTTTTTTTTTTTTTTTTPTTTTSTTGAATPGAATA

SEQ ID NO: 913597 - protein, 6 aa, Mycobacterium
QPDGSR

SEQ ID NO: 913598 - protein, 8 aa, Mycobacterium
QPDNPVND

SEQ ID NO: 913599 - protein, 4 aa, Mycobacterium
QPDQ

SEQ ID NO: 913600 - protein, 7 aa, Mycobacterium
QPDTDAI

SEQ ID NO: 913601 - protein, 17 aa, Mycobacterium
QPDTHAQRISNGSEVVP

SEQ ID NO: 913602 - protein, 7 aa, Mycobacterium
QPDTNAI

SEQ ID NO: 913603 - protein, 5 aa, Mycobacterium
QPDVR

SEQ ID NO: 913604 - protein, 6 aa, Mycobacterium
QPERGK

SEQ ID NO: 913605 - protein, 7 aa, Mycobacterium
QPERGRV

SEQ ID NO: 913606 - protein, 5 aa, Mycobacterium
QPESI

SEQ ID NO: 913607 - protein, 6 aa, Mycobacterium
QPETAA

SEQ ID NO: 913608 - protein, 7 aa, Mycobacterium
QPETAAV

SEQ ID NO: 913609 - protein, 6 aa, Mycobacterium
QPETDP

SEQ ID NO: 913610 - protein, 27 aa, Mycobacterium
QPFGGNGGDGGIGGPGTIGGTGGNGGY

SEQ ID NO: 913611 - protein, 9 aa, Mycobacterium
QPGAVDPAG

SEQ ID NO: 913612 - protein, 11 aa, Mycobacterium
QPGDDGPSVSP

SEQ ID NO: 913613 - protein, 10 aa, Mycobacterium
QPGDSGAPVT

SEQ ID NO: 913614 - protein, 5 aa, Mycobacterium
QPGDV

SEQ ID NO: 913615 - protein, 5 aa, Mycobacterium
QPGEV

SEQ ID NO: 913616 - protein, 4 aa, Mycobacterium
QPGF

SEQ ID NO: 913617 - protein, 5 aa, Mycobacterium
QPGGL

SEQ ID NO: 913618 - protein, 6 aa, Mycobacterium
QPGGPH

SEQ ID NO: 913619 - protein, 4 aa, Mycobacterium
QPGI

SEQ ID NO: 913620 - protein, 9 aa, Mycobacterium
QPGNAGPAV

SEQ ID NO: 913621 - protein, 11 aa, Mycobacterium
QPGNPADPPTV

SEQ ID NO: 913622 - protein, 4 aa, Mycobacterium
QPGR

SEQ ID NO: 913623 - protein, 13 aa, Mycobacterium
QPGTVDPAGYGNI

SEQ ID NO: 913624 - protein, 7 aa, Mycobacterium
QPGTYQT

SEQ ID NO: 913625 - protein, 12 aa, Mycobacterium
QPGTYQTSCRPG

SEQ ID NO: 913626 - protein, 12 aa, Mycobacterium
QPGVFTGDGFFP

SEQ ID NO: 913627 - protein, 8 aa, Mycobacterium
QPGVNPAT

SEQ ID NO: 913628 - protein, 5 aa, Mycobacterium
QPGYA

SEQ ID NO: 913629 - protein, 5 aa, Mycobacterium
QPGYT

SEQ ID NO: 913630 - protein, 12 aa, Mycobacterium
QPHSTSADSPDT

SEQ ID NO: 913631 - protein, 7 aa, Mycobacterium
QPIDPGG

SEQ ID NO: 913632 - protein, 4 aa, Mycobacterium
QPIG

SEQ ID NO: 913633 - protein, 17 aa, Mycobacterium
QPKATAPKVDNTVRHSG

SEQ ID NO: 913634 - protein, 17 aa, Mycobacterium
QPKATAPQVDTTVRHSG

SEQ ID NO: 913635 - protein, 6 aa, Mycobacterium
QPKELP

SEQ ID NO: 913636 - protein, 7 aa, Mycobacterium
QPKPEGI

SEQ ID NO: 913637 - protein, 7 aa, Mycobacterium
QPKTTVT

SEQ ID NO: 913638 - protein, 37 aa, Mycobacterium
QPKYGANVKSPKTDNRRTPADAGLGYRPASIEQPLTT

SEQ ID NO: 913639 - protein, 4 aa, Mycobacterium
QPLP

SEQ ID NO: 913640 - protein, 4 aa, Mycobacterium
QPLT

SEQ ID NO: 913641 - protein, 14 aa, Mycobacterium
QPLTGATGPDATAA

SEQ ID NO: 913642 - protein, 9 aa, Mycobacterium
QPLTGPTGL

SEQ ID NO: 913643 - protein, 9 aa, Mycobacterium
QPNDAGFGA

SEQ ID NO: 913644 - protein, 9 aa, Mycobacterium
QPPAQDPRA

SEQ ID NO: 913645 - protein, 4 aa, Mycobacterium
QPPL

SEQ ID NO: 913646 - protein, 6 aa, Mycobacterium
QPPLSR

SEQ ID NO: 913647 - protein, 13 aa, Mycobacterium
QPPPAGGTPGNRP

SEQ ID NO: 913648 - protein, 5 aa, Mycobacterium
QPPPC

SEQ ID NO: 913649 - protein, 5 aa, Mycobacterium
QPPPG

SEQ ID NO: 913650 - protein, 12 aa, Mycobacterium
QPPVPPPDIPEE

SEQ ID NO: 913651 - protein, 12 aa, Mycobacterium
QPPVPSAGELTS

SEQ ID NO: 913652 - protein, 11 aa, Mycobacterium
QPQAPPEFTPK

SEQ ID NO: 913653 - protein, 21 aa, Mycobacterium
QPQFGTDGASNTITGYRASNT

SEQ ID NO: 913654 - protein, 6 aa, Mycobacterium
QPQGWT

SEQ ID NO: 913655 - protein, 8 aa, Mycobacterium
QPQPGPAI

SEQ ID NO: 913656 - protein, 5 aa, Mycobacterium
QPQPR

SEQ ID NO: 913657 - protein, 8 aa, Mycobacterium
QPQQGFSG

SEQ ID NO: 913658 - protein, 4 aa, Mycobacterium
QPQR

SEQ ID NO: 913659 - protein, 11 aa, Mycobacterium
QPQRASAMPAS

SEQ ID NO: 913660 - protein, 14 aa, Mycobacterium
QPQYTSPEPGAAAA

SEQ ID NO: 913661 - protein, 17 aa, Mycobacterium
QPRDDGSLTSVITVSLT

SEQ ID NO: 913662 - protein, 20 aa, Mycobacterium
QPRPTQKISPRAEYRARSGG

SEQ ID NO: 913663 - protein, 7 aa, Mycobacterium
QPRTFAQ

SEQ ID NO: 913664 - protein, 6 aa, Mycobacterium
QPRTGS

SEQ ID NO: 913665 - protein, 10 aa, Mycobacterium
QPSATAMSDK

SEQ ID NO: 913666 - protein, 5 aa, Mycobacterium
QPSGC

SEQ ID NO: 913667 - protein, 11 aa, Mycobacterium
QPSKGNGQDYT

SEQ ID NO: 913668 - protein, 13 aa, Mycobacterium
QPSKRTGARSGLS

SEQ ID NO: 913669 - protein, 9 aa, Mycobacterium
QPSPEPAPA

SEQ ID NO: 913670 - protein, 10 aa, Mycobacterium
QPSPPPAPPI

SEQ ID NO: 913671 - protein, 11 aa, Mycobacterium
QPSQGNGQGYT

SEQ ID NO: 913672 - protein, 11 aa, Mycobacterium
QPSQGNGQSYT

SEQ ID NO: 913673 - protein, 9 aa, Mycobacterium
QPSQPGGVS

SEQ ID NO: 913674 - protein, 11 aa, Mycobacterium
QPSRGNGQNYT

SEQ ID NO: 913675 - protein, 5 aa, Mycobacterium
QPSTG

SEQ ID NO: 913676 - protein, 7 aa, Mycobacterium
QPSTTFD

SEQ ID NO: 913677 - protein, 4 aa, Mycobacterium
QPTA

SEQ ID NO: 913678 - protein, 16 aa, Mycobacterium
QPTAGTATVNGDGTVT

SEQ ID NO: 913679 - protein, 11 aa, Mycobacterium
QPTAPGGTSTL

SEQ ID NO: 913680 - protein, 13 aa, Mycobacterium
QPTDATTARETIT

SEQ ID NO: 913681 - protein, 17 aa, Mycobacterium
QPTDPKTLPPDAPDDRK

SEQ ID NO: 913682 - protein, 10 aa, Mycobacterium
QPTEPGEVST

SEQ ID NO: 913683 - protein, 6 aa, Mycobacterium
QPTHRA

SEQ ID NO: 913684 - protein, 4 aa, Mycobacterium
QPTI

SEQ ID NO: 913685 - protein, 14 aa, Mycobacterium
QPTTIGQAPPTTAL

SEQ ID NO: 913686 - protein, 24 aa, Mycobacterium
QPTTVGQAPPTTALSGVGSGGGLC

SEQ ID NO: 913687 - protein, 21 aa, Mycobacterium
QPTTVGQTPPTTAMSGLGDGG

SEQ ID NO: 913688 - protein, 11 aa, Mycobacterium
QPTTVNQAPIT

SEQ ID NO: 913689 - protein, 21 aa, Mycobacterium
QPTTVNQAPTTTALSGLGPGG

SEQ ID NO: 913690 - protein, 5 aa, Mycobacterium
QPTYA

SEQ ID NO: 913691 - protein, 14 aa, Mycobacterium
QPVDGESDWLSRIP

SEQ ID NO: 913692 - protein, 19 aa, Mycobacterium
QPVSQPVAEPAEGSPYGGY

SEQ ID NO: 913693 - protein, 26 aa, Mycobacterium
QPVTPTKAPTNPKASPATVNRRMGPT

SEQ ID NO: 913694 - protein, 19 aa, Mycobacterium
QPWTRPDPEPLDTKTYHDA

SEQ ID NO: 913695 - protein, 8 aa, Mycobacterium
QPYAPAAA

SEQ ID NO: 913696 - protein, 4 aa, Mycobacterium
QPYG

SEQ ID NO: 913697 - protein, 4 aa, Mycobacterium
QPYS

SEQ ID NO: 913698 - protein, 11 aa, Mycobacterium
QQAAESKHAGD

SEQ ID NO: 913699 - protein, 9 aa, Mycobacterium
QQAAPTADQ

SEQ ID NO: 913700 - protein, 5 aa, Mycobacterium
QQAKR

SEQ ID NO: 913701 - protein, 5 aa, Mycobacterium
QQALS

SEQ ID NO: 913702 - protein, 63 aa, Mycobacterium
QQAPAAPAPGQPAPAAPGAQDIPAAPAGEVPAAPVTPAPAAPVDGSTTPTVPAGSDAPLTAGG

SEQ ID NO: 913703 - protein, 18 aa, Mycobacterium
QQAPAQPAPAQPAPTGTP

SEQ ID NO: 913704 - protein, 12 aa, Mycobacterium
QQAQRAANRALE

SEQ ID NO: 913705 - protein, 5 aa, Mycobacterium
QQAQT

SEQ ID NO: 913706 - protein, 9 aa, Mycobacterium
QQARGGTDF

SEQ ID NO: 913707 - protein, 13 aa, Mycobacterium
QQATDEAAAGGAA

SEQ ID NO: 913708 - protein, 13 aa, Mycobacterium
QQATEEAAASGAA

SEQ ID NO: 913709 - protein, 18 aa, Mycobacterium
QQAVQSREALTSAQRDAD

SEQ ID NO: 913710 - protein, 24 aa, Mycobacterium
QQDEESGAGAIPEIDGQRSLGEQL

SEQ ID NO: 913711 - protein, 14 aa, Mycobacterium
QQDSGFSDHDTGRA

SEQ ID NO: 913712 - protein, 7 aa, Mycobacterium
QQDSGRF

SEQ ID NO: 913713 - protein, 9 aa, Mycobacterium
QQESRDVNA

SEQ ID NO: 913714 - protein, 13 aa, Mycobacterium
QQGEDTPEAPTGI

SEQ ID NO: 913715 - protein, 11 aa, Mycobacterium
QQGGDPRSQIE

SEQ ID NO: 913716 - protein, 4 aa, Mycobacterium
QQGP

SEQ ID NO: 913717 - protein, 9 aa, Mycobacterium
QQGQTPQLT

SEQ ID NO: 913718 - protein, 5 aa, Mycobacterium
QQGRE

SEQ ID NO: 913719 - protein, 16 aa, Mycobacterium
QQHATVGSVQPVFGNG

SEQ ID NO: 913720 - protein, 8 aa, Mycobacterium
QQHGEGEA

SEQ ID NO: 913721 - protein, 9 aa, Mycobacterium
QQHGEGEPI

SEQ ID NO: 913722 - protein, 10 aa, Mycobacterium
QQISAKNQAL

SEQ ID NO: 913723 - protein, 12 aa, Mycobacterium
QQLPFNDPGKEC

SEQ ID NO: 913724 - protein, 18 aa, Mycobacterium
QQLPTQQAPLQPAGAGLT

SEQ ID NO: 913725 - protein, 18 aa, Mycobacterium
QQLPTQQAPTQQAPLQQA

SEQ ID NO: 913726 - protein, 9 aa, Mycobacterium
QQLSARTTL

SEQ ID NO: 913727 - protein, 5 aa, Mycobacterium
QQMPP

SEQ ID NO: 913728 - protein, 9 aa, Mycobacterium
QQNPEAAQG

SEQ ID NO: 913729 - protein, 17 aa, Mycobacterium
QQNTLRRSRTELTDAPE

SEQ ID NO: 913730 - protein, 7 aa, Mycobacterium
QQNTYAG

SEQ ID NO: 913731 - protein, 6 aa, Mycobacterium
QQPGES

SEQ ID NO: 913732 - protein, 10 aa, Mycobacterium
QQPKLADPQV

SEQ ID NO: 913733 - protein, 6 aa, Mycobacterium
QQPNSN

SEQ ID NO: 913734 - protein, 7 aa, Mycobacterium
QQPPYAP

SEQ ID NO: 913735 - protein, 15 aa, Mycobacterium
QQPQVGASALESGQV

SEQ ID NO: 913736 - protein, 13 aa, Mycobacterium
QQPSRKVGPGDEC

SEQ ID NO: 913737 - protein, 12 aa, Mycobacterium
QQQGAEIGRRIE

SEQ ID NO: 913738 - protein, 19 aa, Mycobacterium
QQQLDERDEDLAAARATNR

SEQ ID NO: 913739 - protein, 7 aa, Mycobacterium
QQQRVPS

SEQ ID NO: 913740 - protein, 18 aa, Mycobacterium
QQRAPQQSPSLTSDDTNR

SEQ ID NO: 913741 - protein, 5 aa, Mycobacterium
QQRDD

SEQ ID NO: 913742 - protein, 4 aa, Mycobacterium
QQRF

SEQ ID NO: 913743 - protein, 9 aa, Mycobacterium
QQSDNAAAN

SEQ ID NO: 913744 - protein, 6 aa, Mycobacterium
QQSERV

SEQ ID NO: 913745 - protein, 5 aa, Mycobacterium
QQSGR

SEQ ID NO: 913746 - protein, 13 aa, Mycobacterium
QQSPFLPAAPGTT

SEQ ID NO: 913747 - protein, 10 aa, Mycobacterium
QQSTPDPQDI

SEQ ID NO: 913748 - protein, 5 aa, Mycobacterium
QQTAR

SEQ ID NO: 913749 - protein, 5 aa, Mycobacterium
QQTGC

SEQ ID NO: 913750 - protein, 6 aa, Mycobacterium
QQTVRQ

SEQ ID NO: 913751 - protein, 5 aa, Mycobacterium
QQTYD

SEQ ID NO: 913752 - protein, 13 aa, Mycobacterium
QQVGRRPDAVTCP

SEQ ID NO: 913753 - protein, 13 aa, Mycobacterium
QQVGRRPDSVTCP

SEQ ID NO: 913754 - protein, 11 aa, Mycobacterium
QQVPTGPGSVA

SEQ ID NO: 913755 - protein, 13 aa, Mycobacterium
QRAADGLADDPEA

SEQ ID NO: 913756 - protein, 5 aa, Mycobacterium
QRAAY

SEQ ID NO: 913757 - protein, 6 aa, Mycobacterium
QRADPY

SEQ ID NO: 913758 - protein, 18 aa, Mycobacterium
QRADRVTAPGLAPHAQRA

SEQ ID NO: 913759 - protein, 7 aa, Mycobacterium
QRAEADQ

SEQ ID NO: 913760 - protein, 10 aa, Mycobacterium
QRAGDIGARH

SEQ ID NO: 913761 - protein, 8 aa, Mycobacterium
QRAPREGH

SEQ ID NO: 913762 - protein, 12 aa, Mycobacterium
QRAQAAANAAAQ

SEQ ID NO: 913763 - protein, 8 aa, Mycobacterium
QRAREDYN

SEQ ID NO: 913764 - protein, 5 aa, Mycobacterium
QRARG

SEQ ID NO: 913765 - protein, 19 aa, Mycobacterium
QRASGPTSARSNVPPNEVS

SEQ ID NO: 913766 - protein, 13 aa, Mycobacterium
QRATEEAAAKGAT

SEQ ID NO: 913767 - protein, 15 aa, Mycobacterium
QRATPPHGIGMQYDC

SEQ ID NO: 913768 - protein, 6 aa, Mycobacterium
QRCNRE

SEQ ID NO: 913769 - protein, 7 aa, Mycobacterium
QRCPDRP

SEQ ID NO: 913770 - protein, 5 aa, Mycobacterium
QRCPQ

SEQ ID NO: 913771 - protein, 8 aa, Mycobacterium
QRDGQVDE

SEQ ID NO: 913772 - protein, 4 aa, Mycobacterium
QRDP

SEQ ID NO: 913773 - protein, 18 aa, Mycobacterium
QRDPDAQTPAGGVSSSLN

SEQ ID NO: 913774 - protein, 18 aa, Mycobacterium
QRDPDPQSPAGGVSSSVN

SEQ ID NO: 913775 - protein, 5 aa, Mycobacterium
QRDTV

SEQ ID NO: 913776 - protein, 6 aa, Mycobacterium
QRDTYP

SEQ ID NO: 913777 - protein, 6 aa, Mycobacterium
QREAAL

SEQ ID NO: 913778 - protein, 18 aa, Mycobacterium
QREDAYSYAQSATGVPSA

SEQ ID NO: 913779 - protein, 23 aa, Mycobacterium
QREDAYTYAQSEKGLASARAEYD

SEQ ID NO: 913780 - protein, 8 aa, Mycobacterium
QREDPDYG

SEQ ID NO: 913781 - protein, 4 aa, Mycobacterium
QREL

SEQ ID NO: 913782 - protein, 9 aa, Mycobacterium
QRERPGDSV

SEQ ID NO: 913783 - protein, 11 aa, Mycobacterium
QRETKGTEGEL

SEQ ID NO: 913784 - protein, 7 aa, Mycobacterium
QRETTDV

SEQ ID NO: 913785 - protein, 8 aa, Mycobacterium
QRFTPEEY

SEQ ID NO: 913786 - protein, 5 aa, Mycobacterium
QRGGP

SEQ ID NO: 913787 - protein, 7 aa, Mycobacterium
QRGGPPI

SEQ ID NO: 913788 - protein, 4 aa, Mycobacterium
QRGI

SEQ ID NO: 913789 - protein, 11 aa, Mycobacterium
QRGQEATRAEL

SEQ ID NO: 913790 - protein, 8 aa, Mycobacterium
QRGSFDRA

SEQ ID NO: 913791 - protein, 8 aa, Mycobacterium
QRHPEQPY

SEQ ID NO: 913792 - protein, 12 aa, Mycobacterium
QRHSERERPLFV

SEQ ID NO: 913793 - protein, 6 aa, Mycobacterium
QRIERT

SEQ ID NO: 913794 - protein, 4 aa, Mycobacterium
QRIR

SEQ ID NO: 913795 - protein, 10 aa, Mycobacterium
QRKLGDDTAG

SEQ ID NO: 913796 - protein, 15 aa, Mycobacterium
QRLDDSVDDSKNRQH

SEQ ID NO: 913797 - protein, 24 aa, Mycobacterium
QRLQPGSTIPLSRSSTYPSTEQTL

SEQ ID NO: 913798 - protein, 7 aa, Mycobacterium
QRLQSGN

SEQ ID NO: 913799 - protein, 28 aa, Mycobacterium
QRLQTADPVAASKFRSGGAIDDPDREQQ

SEQ ID NO: 913800 - protein, 25 aa, Mycobacterium
QRLSEARDEARREATKDRRRPPGTA

SEQ ID NO: 913801 - protein, 6 aa, Mycobacterium
QRMPNS

SEQ ID NO: 913802 - protein, 5 aa, Mycobacterium
QRNAH

SEQ ID NO: 913803 - protein, 6 aa, Mycobacterium
QRNDTL

SEQ ID NO: 913804 - protein, 5 aa, Mycobacterium
QRNSR

SEQ ID NO: 913805 - protein, 11 aa, Mycobacterium
QRPAPAPPQSA

SEQ ID NO: 913806 - protein, 18 aa, Mycobacterium
QRPAPPGMPAPTPGMEPE

SEQ ID NO: 913807 - protein, 6 aa, Mycobacterium
QRPDGS

SEQ ID NO: 913808 - protein, 12 aa, Mycobacterium
QRPPDELYETGR

SEQ ID NO: 913809 - protein, 8 aa, Mycobacterium
QRPPVDGP

SEQ ID NO: 913810 - protein, 7 aa, Mycobacterium
QRPQITT

SEQ ID NO: 913811 - protein, 13 aa, Mycobacterium
QRPSNSRVAAGAH

SEQ ID NO: 913812 - protein, 5 aa, Mycobacterium
QRPYP

SEQ ID NO: 913813 - protein, 5 aa, Mycobacterium
QRRAA

SEQ ID NO: 913814 - protein, 7 aa, Mycobacterium
QRRAGPD

SEQ ID NO: 913815 - protein, 4 aa, Mycobacterium
QRRE

SEQ ID NO: 913816 - protein, 7 aa, Mycobacterium
QRRHYND

SEQ ID NO: 913817 - protein, 7 aa, Mycobacterium
QRRQDDV

SEQ ID NO: 913818 - protein, 9 aa, Mycobacterium
QRRQDEAMR

SEQ ID NO: 913819 - protein, 22 aa, Mycobacterium
QRRTDTSPTPSAGTAQAAGSAR

SEQ ID NO: 913820 - protein, 8 aa, Mycobacterium
QRSDNAAA

SEQ ID NO: 913821 - protein, 7 aa, Mycobacterium
QRSDPRN

SEQ ID NO: 913822 - protein, 8 aa, Mycobacterium
QRSESHGA

SEQ ID NO: 913823 - protein, 4 aa, Mycobacterium
QRSP

SEQ ID NO: 913824 - protein, 5 aa, Mycobacterium
QRSQQ

SEQ ID NO: 913825 - protein, 17 aa, Mycobacterium
QRTAATAAFDTPATQAA

SEQ ID NO: 913826 - protein, 8 aa, Mycobacterium
QRTDSYAP

SEQ ID NO: 913827 - protein, 10 aa, Mycobacterium
QRTDTGAGSG

SEQ ID NO: 913828 - protein, 8 aa, Mycobacterium
QRTPTGDR

SEQ ID NO: 913829 - protein, 10 aa, Mycobacterium
QRTQPPQRAL

SEQ ID NO: 913830 - protein, 7 aa, Mycobacterium
QRVGENG

SEQ ID NO: 913831 - protein, 4 aa, Mycobacterium
QRVS

SEQ ID NO: 913832 - protein, 14 aa, Mycobacterium
QRWPGEAAGRAYDA

SEQ ID NO: 913833 - protein, 8 aa, Mycobacterium
QSAARRGV

SEQ ID NO: 913834 - protein, 12 aa, Mycobacterium
QSAASVSAGPDH

SEQ ID NO: 913835 - protein, 13 aa, Mycobacterium
QSAATAYNDAAGE

SEQ ID NO: 913836 - protein, 9 aa, Mycobacterium
QSADATKAV

SEQ ID NO: 913837 - protein, 11 aa, Mycobacterium
QSADATKKVQS

SEQ ID NO: 913838 - protein, 12 aa, Mycobacterium
QSAEQATGIAPR

SEQ ID NO: 913839 - protein, 12 aa, Mycobacterium
QSAGAGTATADV

SEQ ID NO: 913840 - protein, 6 aa, Mycobacterium
QSAGAT

SEQ ID NO: 913841 - protein, 10 aa, Mycobacterium
QSAGNASGLI

SEQ ID NO: 913842 - protein, 16 aa, Mycobacterium
QSAKNAGSTAKIGTFD

SEQ ID NO: 913843 - protein, 9 aa, Mycobacterium
QSAKTVPRS

SEQ ID NO: 913844 - protein, 6 aa, Mycobacterium
QSALAQ

SEQ ID NO: 913845 - protein, 9 aa, Mycobacterium
QSANPRSNL

SEQ ID NO: 913846 - protein, 16 aa, Mycobacterium
QSAPYGTPTLLARADV

SEQ ID NO: 913847 - protein, 9 aa, Mycobacterium
QSAQGTLTG

SEQ ID NO: 913848 - protein, 5 aa, Mycobacterium
QSAQV

SEQ ID NO: 913849 - protein, 7 aa, Mycobacterium
QSARLGE

SEQ ID NO: 913850 - protein, 11 aa, Mycobacterium
QSASNSWDDAG

SEQ ID NO: 913851 - protein, 25 aa, Mycobacterium
QSATQMPSGGGAPPVATPGSPQVGM

SEQ ID NO: 913852 - protein, 13 aa, Mycobacterium
QSATTGVTCSTRP

SEQ ID NO: 913853 - protein, 28 aa, Mycobacterium
QSCTGGSVSTSQATTPATTTSTATSGTQ

SEQ ID NO: 913854 - protein, 8 aa, Mycobacterium
QSDADESA

SEQ ID NO: 913855 - protein, 10 aa, Mycobacterium
QSDAPPLPAD

SEQ ID NO: 913856 - protein, 5 aa, Mycobacterium
QSDGI

SEQ ID NO: 913857 - protein, 29 aa, Mycobacterium
QSEANAAGTIDTDVPGPGLTPEGKGQAEQ

SEQ ID NO: 913858 - protein, 15 aa, Mycobacterium
QSEASPPIVFSNLTI

SEQ ID NO: 913859 - protein, 4 aa, Mycobacterium
QSEH

SEQ ID NO: 913860 - protein, 7 aa, Mycobacterium
QSEHARM

SEQ ID NO: 913861 - protein, 8 aa, Mycobacterium
QSEHARME

SEQ ID NO: 913862 - protein, 4 aa, Mycobacterium
QSEI

SEQ ID NO: 913863 - protein, 16 aa, Mycobacterium
QSEPANPEDCNGGPDD

SEQ ID NO: 913864 - protein, 11 aa, Mycobacterium
QSEPGSSDDRQ

SEQ ID NO: 913865 - protein, 6 aa, Mycobacterium
QSEPIG

SEQ ID NO: 913866 - protein, 25 aa, Mycobacterium
QSEQRFAGSGNPDSTTAAVDATTSG

SEQ ID NO: 913867 - protein, 12 aa, Mycobacterium
QSEQTAGPGTFG

SEQ ID NO: 913868 - protein, 6 aa, Mycobacterium
QSGADS

SEQ ID NO: 913869 - protein, 11 aa, Mycobacterium
QSGALSSPSKL

SEQ ID NO: 913870 - protein, 9 aa, Mycobacterium
QSGDPRSNL

SEQ ID NO: 913871 - protein, 24 aa, Mycobacterium
QSGEPAKALGPPADGTYAYNEAGV

SEQ ID NO: 913872 - protein, 6 aa, Mycobacterium
QSGESL

SEQ ID NO: 913873 - protein, 7 aa, Mycobacterium
QSGGAPA

SEQ ID NO: 913874 - protein, 9 aa, Mycobacterium
QSGGDNSPA

SEQ ID NO: 913875 - protein, 9 aa, Mycobacterium
QSGGNNSPA

SEQ ID NO: 913876 - protein, 9 aa, Mycobacterium
QSGGPGAPA

SEQ ID NO: 913877 - protein, 8 aa, Mycobacterium
QSGGPGSH

SEQ ID NO: 913878 - protein, 9 aa, Mycobacterium
QSGGPNAPG

SEQ ID NO: 913879 - protein, 9 aa, Mycobacterium
QSGGPNSPA

SEQ ID NO: 913880 - protein, 4 aa, Mycobacterium
QSGH

SEQ ID NO: 913881 - protein, 5 aa, Mycobacterium
QSGIR

SEQ ID NO: 913882 - protein, 4 aa, Mycobacterium
QSGK

SEQ ID NO: 913883 - protein, 4 aa, Mycobacterium
QSGM

SEQ ID NO: 913884 - protein, 15 aa, Mycobacterium
QSGMPSQAATFVVSQ

SEQ ID NO: 913885 - protein, 9 aa, Mycobacterium
QSGNAGPAV

SEQ ID NO: 913886 - protein, 10 aa, Mycobacterium
QSGPAAEASL

SEQ ID NO: 913887 - protein, 26 aa, Mycobacterium
QSGPAPAEPAPAPEPAPAPAAAPEIP

SEQ ID NO: 913888 - protein, 5 aa, Mycobacterium
QSGQV

SEQ ID NO: 913889 - protein, 5 aa, Mycobacterium
QSGRF

SEQ ID NO: 913890 - protein, 8 aa, Mycobacterium
QSGRYPEF

SEQ ID NO: 913891 - protein, 7 aa, Mycobacterium
QSGTGDT

SEQ ID NO: 913892 - protein, 6 aa, Mycobacterium
QSGTGE

SEQ ID NO: 913893 - protein, 5 aa, Mycobacterium
QSGTH

SEQ ID NO: 913894 - protein, 4 aa, Mycobacterium
QSGV

SEQ ID NO: 913895 - protein, 12 aa, Mycobacterium
QSHNGDSGGPVY

SEQ ID NO: 913896 - protein, 12 aa, Mycobacterium
QSHPEGALEGQG

SEQ ID NO: 913897 - protein, 9 aa, Mycobacterium
QSHQAQQQR

SEQ ID NO: 913898 - protein, 6 aa, Mycobacterium
QSITGT

SEQ ID NO: 913899 - protein, 6 aa, Mycobacterium
QSITKA

SEQ ID NO: 913900 - protein, 4 aa, Mycobacterium
QSLA

SEQ ID NO: 913901 - protein, 5 aa, Mycobacterium
QSLDT

SEQ ID NO: 913902 - protein, 8 aa, Mycobacterium
QSLEATKA

SEQ ID NO: 913903 - protein, 4 aa, Mycobacterium
QSLS

SEQ ID NO: 913904 - protein, 9 aa, Mycobacterium
QSLSAQATS

SEQ ID NO: 913905 - protein, 19 aa, Mycobacterium
QSMPGQESTPVRGVPSGLC

SEQ ID NO: 913906 - protein, 8 aa, Mycobacterium
QSNADEDK

SEQ ID NO: 913907 - protein, 18 aa, Mycobacterium
QSNGGSGSPHHASREEQI

SEQ ID NO: 913908 - protein, 12 aa, Mycobacterium
QSNGKLEKAGEV

SEQ ID NO: 913909 - protein, 10 aa, Mycobacterium
QSNPGSTDRQ

SEQ ID NO: 913910 - protein, 23 aa, Mycobacterium
QSNPSRSGATPPRANVGHSPTVR

SEQ ID NO: 913911 - protein, 15 aa, Mycobacterium
QSPAAGETLGGAAER

SEQ ID NO: 913912 - protein, 7 aa, Mycobacterium
QSPAETT

SEQ ID NO: 913913 - protein, 4 aa, Mycobacterium
QSPD

SEQ ID NO: 913914 - protein, 6 aa, Mycobacterium
QSPDLS

SEQ ID NO: 913915 - protein, 11 aa, Mycobacterium
QSPDPNGPGSG

SEQ ID NO: 913916 - protein, 11 aa, Mycobacterium
QSPDSGGPGSG

SEQ ID NO: 913917 - protein, 6 aa, Mycobacterium
QSPDVA

SEQ ID NO: 913918 - protein, 7 aa, Mycobacterium
QSPEISG

SEQ ID NO: 913919 - protein, 13 aa, Mycobacterium
QSPGAEHLGDPSY

SEQ ID NO: 913920 - protein, 16 aa, Mycobacterium
QSPGPWRRNATPDQVS

SEQ ID NO: 913921 - protein, 7 aa, Mycobacterium
QSPHGDL

SEQ ID NO: 913922 - protein, 9 aa, Mycobacterium
QSPNPQTYQ

SEQ ID NO: 913923 - protein, 6 aa, Mycobacterium
QSPPQF

SEQ ID NO: 913924 - protein, 4 aa, Mycobacterium
QSPQ

SEQ ID NO: 913925 - protein, 12 aa, Mycobacterium
QSPQIAGNETID

SEQ ID NO: 913926 - protein, 9 aa, Mycobacterium
QSPRAEATV

SEQ ID NO: 913927 - protein, 28 aa, Mycobacterium
QSPSAGTVIPDDTPSTLTVARPGACASS

SEQ ID NO: 913928 - protein, 7 aa, Mycobacterium
QSPSGDV

SEQ ID NO: 913929 - protein, 8 aa, Mycobacterium
QSPTTPDR

SEQ ID NO: 913930 - protein, 8 aa, Mycobacterium
QSPVPSPL

SEQ ID NO: 913931 - protein, 5 aa, Mycobacterium
QSPWR

SEQ ID NO: 913932 - protein, 7 aa, Mycobacterium
QSQAERF

SEQ ID NO: 913933 - protein, 7 aa, Mycobacterium
QSQDPPV

SEQ ID NO: 913934 - protein, 5 aa, Mycobacterium
QSQGY

SEQ ID NO: 913935 - protein, 8 aa, Mycobacterium
QSQPITSG

SEQ ID NO: 913936 - protein, 15 aa, Mycobacterium
QSQSSVNRLSAERDA

SEQ ID NO: 913937 - protein, 10 aa, Mycobacterium
QSQTKEISGN

SEQ ID NO: 913938 - protein, 7 aa, Mycobacterium
QSRESSV

SEQ ID NO: 913939 - protein, 11 aa, Mycobacterium
QSRKETQQEYQ

SEQ ID NO: 913940 - protein, 9 aa, Mycobacterium
QSRPGGEDA

SEQ ID NO: 913941 - protein, 9 aa, Mycobacterium
QSRSGPPQV

SEQ ID NO: 913942 - protein, 11 aa, Mycobacterium
QSSAAARGLTA

SEQ ID NO: 913943 - protein, 5 aa, Mycobacterium
QSSAN

SEQ ID NO: 913944 - protein, 5 aa, Mycobacterium
QSSGD

SEQ ID NO: 913945 - protein, 12 aa, Mycobacterium
QSSGGRDQPYQL

SEQ ID NO: 913946 - protein, 11 aa, Mycobacterium
QSSGSRDQPYQ

SEQ ID NO: 913947 - protein, 6 aa, Mycobacterium
QSSNGN

SEQ ID NO: 913948 - protein, 10 aa, Mycobacterium
QSSSDSMSQL

SEQ ID NO: 913949 - protein, 7 aa, Mycobacterium
QSSSEQM

SEQ ID NO: 913950 - protein, 5 aa, Mycobacterium
QSSTD

SEQ ID NO: 913951 - protein, 46 aa, Mycobacterium
QSSTEQEPSPPSTTTTTTTTTTTPAPTTTPAPPAPTEKGLSPTGGN

SEQ ID NO: 913952 - protein, 14 aa, Mycobacterium
QSSVNRLDAQRDAL

SEQ ID NO: 913953 - protein, 7 aa, Mycobacterium
QSTAGSV

SEQ ID NO: 913954 - protein, 7 aa, Mycobacterium
QSTGDEL

SEQ ID NO: 913955 - protein, 11 aa, Mycobacterium
QSTPSASHPGS

SEQ ID NO: 913956 - protein, 9 aa, Mycobacterium
QSTPSTVHP

SEQ ID NO: 913957 - protein, 18 aa, Mycobacterium
QSTQADEFNTEPFPQKGV

SEQ ID NO: 913958 - protein, 7 aa, Mycobacterium
QSTTRIS

SEQ ID NO: 913959 - protein, 18 aa, Mycobacterium
QSTTTRDQPSPKRATSSV

SEQ ID NO: 913960 - protein, 4 aa, Mycobacterium
QSTV

SEQ ID NO: 913961 - protein, 5 aa, Mycobacterium
QSTWR

SEQ ID NO: 913962 - protein, 4 aa, Mycobacterium
QSVA

SEQ ID NO: 913963 - protein, 8 aa, Mycobacterium
QSVEGGKQ

SEQ ID NO: 913964 - protein, 7 aa, Mycobacterium
QSWHGPA

SEQ ID NO: 913965 - protein, 20 aa, Mycobacterium
QSYGASGDQSRGVEGGKPAD

SEQ ID NO: 913966 - protein, 10 aa, Mycobacterium
QSYGRDPETM

SEQ ID NO: 913967 - protein, 4 aa, Mycobacterium
QSYR

SEQ ID NO: 913968 - protein, 5 aa, Mycobacterium
QTAAT

SEQ ID NO: 913969 - protein, 12 aa, Mycobacterium
QTAAVRSAGGVP

SEQ ID NO: 913970 - protein, 9 aa, Mycobacterium
QTADGSQFT

SEQ ID NO: 913971 - protein, 8 aa, Mycobacterium
QTADPRSN

SEQ ID NO: 913972 - protein, 8 aa, Mycobacterium
QTAEDYSI

SEQ ID NO: 913973 - protein, 16 aa, Mycobacterium
QTAEGAAQLAQLAGRP

SEQ ID NO: 913974 - protein, 14 aa, Mycobacterium
QTAFEDASARAEGY

SEQ ID NO: 913975 - protein, 12 aa, Mycobacterium
QTAGNQVRSAKG

SEQ ID NO: 913976 - protein, 4 aa, Mycobacterium
QTAN

SEQ ID NO: 913977 - protein, 8 aa, Mycobacterium
QTANNCPD

SEQ ID NO: 913978 - protein, 12 aa, Mycobacterium
QTAPDVGNQTRS

SEQ ID NO: 913979 - protein, 7 aa, Mycobacterium
QTAPETK

SEQ ID NO: 913980 - protein, 4 aa, Mycobacterium
QTAQ

SEQ ID NO: 913981 - protein, 8 aa, Mycobacterium
QTAQAAGT

SEQ ID NO: 913982 - protein, 4 aa, Mycobacterium
QTAS

SEQ ID NO: 913983 - protein, 13 aa, Mycobacterium
QTAVQGDATPISP

SEQ ID NO: 913984 - protein, 17 aa, Mycobacterium
QTDAEKRAAVETTPARK

SEQ ID NO: 913985 - protein, 30 aa, Mycobacterium
QTDFGGSDSPLSADKGEYEKAKARCGGSDA

SEQ ID NO: 913986 - protein, 6 aa, Mycobacterium
QTDGTE

SEQ ID NO: 913987 - protein, 21 aa, Mycobacterium
QTDIGGSDSPLSKDKGEYDKA

SEQ ID NO: 913988 - protein, 10 aa, Mycobacterium
QTDNSGFGAR

SEQ ID NO: 913989 - protein, 7 aa, Mycobacterium
QTDPALK

SEQ ID NO: 913990 - protein, 13 aa, Mycobacterium
QTDRANATSLQDT

SEQ ID NO: 913991 - protein, 23 aa, Mycobacterium
QTDSRPYQPDPNRTHSPGSTDGL

SEQ ID NO: 913992 - protein, 6 aa, Mycobacterium
QTEAGV

SEQ ID NO: 913993 - protein, 7 aa, Mycobacterium
QTEARAP

SEQ ID NO: 913994 - protein, 4 aa, Mycobacterium
QTEG

SEQ ID NO: 913995 - protein, 6 aa, Mycobacterium
QTEPSF

SEQ ID NO: 913996 - protein, 7 aa, Mycobacterium
QTESGDY

SEQ ID NO: 913997 - protein, 6 aa, Mycobacterium
QTETGD

SEQ ID NO: 913998 - protein, 22 aa, Mycobacterium
QTFEGRPDPSAPSTQAASFTTT

SEQ ID NO: 913999 - protein, 15 aa, Mycobacterium
QTGGMAGSNPADDEA

SEQ ID NO: 914000 - protein, 4 aa, Mycobacterium
QTGL

SEQ ID NO: 914001 - protein, 9 aa, Mycobacterium
QTGLSSSLA

SEQ ID NO: 914002 - protein, 8 aa, Mycobacterium
QTGPFRPA

SEQ ID NO: 914003 - protein, 4 aa, Mycobacterium
QTGQ

SEQ ID NO: 914004 - protein, 14 aa, Mycobacterium
QTGRDANGDRADGT

SEQ ID NO: 914005 - protein, 4 aa, Mycobacterium
QTGS

SEQ ID NO: 914006 - protein, 10 aa, Mycobacterium
QTGSASRASL

SEQ ID NO: 914007 - protein, 10 aa, Mycobacterium
QTIGPSGACG

SEQ ID NO: 914008 - protein, 17 aa, Mycobacterium
QTISGTGTLAPNAGRVP

SEQ ID NO: 914009 - protein, 7 aa, Mycobacterium
QTITSGE

SEQ ID NO: 914010 - protein, 8 aa, Mycobacterium
QTKLAAKR

SEQ ID NO: 914011 - protein, 9 aa, Mycobacterium
QTKTGATTD

SEQ ID NO: 914012 - protein, 9 aa, Mycobacterium
QTKTGSDAN

SEQ ID NO: 914013 - protein, 9 aa, Mycobacterium
QTKTGSTSD

SEQ ID NO: 914014 - protein, 9 aa, Mycobacterium
QTKTGSTTD

SEQ ID NO: 914015 - protein, 9 aa, Mycobacterium
QTKTGTPDE

SEQ ID NO: 914016 - protein, 9 aa, Mycobacterium
QTKTGTPTE

SEQ ID NO: 914017 - protein, 8 aa, Mycobacterium
QTKTPDEV

SEQ ID NO: 914018 - protein, 10 aa, Mycobacterium
QTLAGQNKNL

SEQ ID NO: 914019 - protein, 13 aa, Mycobacterium
QTLQPTQPGGVAP

SEQ ID NO: 914020 - protein, 4 aa, Mycobacterium
QTLS

SEQ ID NO: 914021 - protein, 10 aa, Mycobacterium
QTLSDQSDNI

SEQ ID NO: 914022 - protein, 6 aa, Mycobacterium
QTMTSG

SEQ ID NO: 914023 - protein, 14 aa, Mycobacterium
QTNANLGPEPVATQ

SEQ ID NO: 914024 - protein, 17 aa, Mycobacterium
QTNGKLEQAGETFDSAP

SEQ ID NO: 914025 - protein, 8 aa, Mycobacterium
QTNGSTQI

SEQ ID NO: 914026 - protein, 5 aa, Mycobacterium
QTNPM

SEQ ID NO: 914027 - protein, 20 aa, Mycobacterium
QTNSRPYEPDPKRTHMPASE

SEQ ID NO: 914028 - protein, 8 aa, Mycobacterium
QTNYSAAK

SEQ ID NO: 914029 - protein, 9 aa, Mycobacterium
QTPAETADL

SEQ ID NO: 914030 - protein, 12 aa, Mycobacterium
QTPATGQPQAVG

SEQ ID NO: 914031 - protein, 14 aa, Mycobacterium
QTPDELRQHGKPRL

SEQ ID NO: 914032 - protein, 5 aa, Mycobacterium
QTPEF

SEQ ID NO: 914033 - protein, 20 aa, Mycobacterium
QTPEPDPWEPPPPEAPPLPP

SEQ ID NO: 914034 - protein, 6 aa, Mycobacterium
QTPFTA

SEQ ID NO: 914035 - protein, 5 aa, Mycobacterium
QTPGM

SEQ ID NO: 914036 - protein, 5 aa, Mycobacterium
QTPNA

SEQ ID NO: 914037 - protein, 6 aa, Mycobacterium
QTPNAR

SEQ ID NO: 914038 - protein, 9 aa, Mycobacterium
QTPPSVTPD

SEQ ID NO: 914039 - protein, 10 aa, Mycobacterium
QTPQTQGELP

SEQ ID NO: 914040 - protein, 5 aa, Mycobacterium
QTPSA

SEQ ID NO: 914041 - protein, 6 aa, Mycobacterium
QTPTPP

SEQ ID NO: 914042 - protein, 14 aa, Mycobacterium
QTPVASAAPPVAAK

SEQ ID NO: 914043 - protein, 5 aa, Mycobacterium
QTQAT

SEQ ID NO: 914044 - protein, 7 aa, Mycobacterium
QTQQETV

SEQ ID NO: 914045 - protein, 14 aa, Mycobacterium
QTRKPPSISPPLTG

SEQ ID NO: 914046 - protein, 5 aa, Mycobacterium
QTRRR

SEQ ID NO: 914047 - protein, 9 aa, Mycobacterium
QTRTGSTSN

SEQ ID NO: 914048 - protein, 13 aa, Mycobacterium
QTSDDATARDTIT

SEQ ID NO: 914049 - protein, 4 aa, Mycobacterium
QTSL

SEQ ID NO: 914050 - protein, 8 aa, Mycobacterium
QTSPAAQG

SEQ ID NO: 914051 - protein, 7 aa, Mycobacterium
QTSSMRA

SEQ ID NO: 914052 - protein, 11 aa, Mycobacterium
QTSTGPVRGTV

SEQ ID NO: 914053 - protein, 5 aa, Mycobacterium
QTSTL

SEQ ID NO: 914054 - protein, 6 aa, Mycobacterium
QTSTLT

SEQ ID NO: 914055 - protein, 9 aa, Mycobacterium
QTSWNNSPL

SEQ ID NO: 914056 - protein, 14 aa, Mycobacterium
QTTDPDNPAYQRDA

SEQ ID NO: 914057 - protein, 11 aa, Mycobacterium
QTTEFSAPDNA

SEQ ID NO: 914058 - protein, 11 aa, Mycobacterium
QTTEPDDPQYL

SEQ ID NO: 914059 - protein, 31 aa, Mycobacterium
QTTEPGPPLPSQGAPGQPGEPGLPGLPGLPG

SEQ ID NO: 914060 - protein, 6 aa, Mycobacterium
QTTGNV

SEQ ID NO: 914061 - protein, 6 aa, Mycobacterium
QTTKEE

SEQ ID NO: 914062 - protein, 8 aa, Mycobacterium
QTTPSAVH

SEQ ID NO: 914063 - protein, 29 aa, Mycobacterium
QTTSGEKIASRRDPWDPDSAEADNSGRET

SEQ ID NO: 914064 - protein, 7 aa, Mycobacterium
QTTSGTG

SEQ ID NO: 914065 - protein, 8 aa, Mycobacterium
QTTTGSTA

SEQ ID NO: 914066 - protein, 26 aa, Mycobacterium
QTVEGTAAKSGTGNVPRNDNSERKYP

SEQ ID NO: 914067 - protein, 9 aa, Mycobacterium
QTVNGDPKI

SEQ ID NO: 914068 - protein, 4 aa, Mycobacterium
QTVP

SEQ ID NO: 914069 - protein, 11 aa, Mycobacterium
QTVSEGVHDEQ

SEQ ID NO: 914070 - protein, 9 aa, Mycobacterium
QTVTDQRRD

SEQ ID NO: 914071 - protein, 4 aa, Mycobacterium
QTYG

SEQ ID NO: 914072 - protein, 6 aa, Mycobacterium
QTYGED

SEQ ID NO: 914073 - protein, 8 aa, Mycobacterium
QTYPPGST

SEQ ID NO: 914074 - protein, 5 aa, Mycobacterium
QTYYG

SEQ ID NO: 914075 - protein, 6 aa, Mycobacterium
QVAGGN

SEQ ID NO: 914076 - protein, 6 aa, Mycobacterium
QVAQDS

SEQ ID NO: 914077 - protein, 11 aa, Mycobacterium
QVAQQKGAIPG

SEQ ID NO: 914078 - protein, 5 aa, Mycobacterium
QVASP

SEQ ID NO: 914079 - protein, 11 aa, Mycobacterium
QVDGEGAPQTV

SEQ ID NO: 914080 - protein, 6 aa, Mycobacterium
QVDPAE

SEQ ID NO: 914081 - protein, 12 aa, Mycobacterium
QVDPSKGRCAFA

SEQ ID NO: 914082 - protein, 16 aa, Mycobacterium
QVGDASAELAPTAGIG

SEQ ID NO: 914083 - protein, 4 aa, Mycobacterium
QVGG

SEQ ID NO: 914084 - protein, 7 aa, Mycobacterium
QVGGQTV

SEQ ID NO: 914085 - protein, 14 aa, Mycobacterium
QVGGTGGPGGTGGL

SEQ ID NO: 914086 - protein, 6 aa, Mycobacterium
QVGNPA

SEQ ID NO: 914087 - protein, 17 aa, Mycobacterium
QVNKDKGDQAPGSWMPP

SEQ ID NO: 914088 - protein, 8 aa, Mycobacterium
QVNSGDAI

SEQ ID NO: 914089 - protein, 5 aa, Mycobacterium
QVPAD

SEQ ID NO: 914090 - protein, 6 aa, Mycobacterium
QVPAEP

SEQ ID NO: 914091 - protein, 18 aa, Mycobacterium
QVPPTQETTPARGTPSGP

SEQ ID NO: 914092 - protein, 41 aa, Mycobacterium
QVPTQQVPTQQAPLQQAPAQQLPTQQAPLQAPTRQAPTQQV

SEQ ID NO: 914093 - protein, 9 aa, Mycobacterium
QVQGVPDTL

SEQ ID NO: 914094 - protein, 5 aa, Mycobacterium
QVRPG

SEQ ID NO: 914095 - protein, 11 aa, Mycobacterium
QVRPSRPETAP

SEQ ID NO: 914096 - protein, 7 aa, Mycobacterium
QVRSGDA

SEQ ID NO: 914097 - protein, 21 aa, Mycobacterium
QVRSPSDPGYVPTAPPALSTS

SEQ ID NO: 914098 - protein, 5 aa, Mycobacterium
QVRTQ

SEQ ID NO: 914099 - protein, 7 aa, Mycobacterium
QVSAPVP

SEQ ID NO: 914100 - protein, 5 aa, Mycobacterium
QVSAS

SEQ ID NO: 914101 - protein, 4 aa, Mycobacterium
QVSP

SEQ ID NO: 914102 - protein, 6 aa, Mycobacterium
QVSRAA

SEQ ID NO: 914103 - protein, 10 aa, Mycobacterium
QVSSGVAAAT

SEQ ID NO: 914104 - protein, 11 aa, Mycobacterium
QVTNDGGDTTC

SEQ ID NO: 914105 - protein, 9 aa, Mycobacterium
QVTPTNATL

SEQ ID NO: 914106 - protein, 11 aa, Mycobacterium
QVTQASNRGVR

SEQ ID NO: 914107 - protein, 17 aa, Mycobacterium
QWDGDDALETGAADTSS

SEQ ID NO: 914108 - protein, 5 aa, Mycobacterium
QWDPT

SEQ ID NO: 914109 - protein, 8 aa, Mycobacterium
QWGPATAR

SEQ ID NO: 914110 - protein, 11 aa, Mycobacterium
QWGQSTVPALP

SEQ ID NO: 914111 - protein, 6 aa, Mycobacterium
QWPAGT

SEQ ID NO: 914112 - protein, 6 aa, Mycobacterium
QWPSTG

SEQ ID NO: 914113 - protein, 13 aa, Mycobacterium
QWQTDPKTLPASN

SEQ ID NO: 914114 - protein, 6 aa, Mycobacterium
QYDGMS

SEQ ID NO: 914115 - protein, 10 aa, Mycobacterium
QYDPASDFPR

SEQ ID NO: 914116 - protein, 5 aa, Mycobacterium
QYDPT

SEQ ID NO: 914117 - protein, 5 aa, Mycobacterium
QYEHG

SEQ ID NO: 914118 - protein, 13 aa, Mycobacterium
QYEHGHDTAPAVA

SEQ ID NO: 914119 - protein, 13 aa, Mycobacterium
QYEHGRDTAPTVG

SEQ ID NO: 914120 - protein, 8 aa, Mycobacterium
QYERDQRP

SEQ ID NO: 914121 - protein, 18 aa, Mycobacterium
QYGDAANSSYTTTAGSSK

SEQ ID NO: 914122 - protein, 9 aa, Mycobacterium
QYGKQDTAD

SEQ ID NO: 914123 - protein, 5 aa, Mycobacterium
QYGPG

SEQ ID NO: 914124 - protein, 14 aa, Mycobacterium
QYNSGRKVPSAQMK

SEQ ID NO: 914125 - protein, 9 aa, Mycobacterium
QYPPQTQNN

SEQ ID NO: 914126 - protein, 7 aa, Mycobacterium
QYPQRYP

SEQ ID NO: 914127 - protein, 8 aa, Mycobacterium
QYPSAPDT

SEQ ID NO: 914128 - protein, 10 aa, Mycobacterium
QYQNSRSTGF

SEQ ID NO: 914129 - protein, 6 aa, Mycobacterium
QYRDDR

SEQ ID NO: 914130 - protein, 19 aa, Mycobacterium
QYRGDGQRSKRDHGSNEHS

SEQ ID NO: 914131 - protein, 5 aa, Mycobacterium
QYRGQ

SEQ ID NO: 914132 - protein, 5 aa, Mycobacterium
QYRSG

SEQ ID NO: 914133 - protein, 8 aa, Mycobacterium
QYSPTSTW

SEQ ID NO: 914134 - protein, 9 aa, Mycobacterium
RAAAADPVN

SEQ ID NO: 914135 - protein, 11 aa, Mycobacterium
RAAADAAAGWD

SEQ ID NO: 914136 - protein, 18 aa, Mycobacterium
RAAADGQTVTTAEEPKDV

SEQ ID NO: 914137 - protein, 7 aa, Mycobacterium
RAAADRT

SEQ ID NO: 914138 - protein, 5 aa, Mycobacterium
RAAAG

SEQ ID NO: 914139 - protein, 17 aa, Mycobacterium
RAAAPADTRRTCSAGRR

SEQ ID NO: 914140 - protein, 7 aa, Mycobacterium
RAADAEL

SEQ ID NO: 914141 - protein, 7 aa, Mycobacterium
RAADGRD

SEQ ID NO: 914142 - protein, 7 aa, Mycobacterium
RAADSGM

SEQ ID NO: 914143 - protein, 5 aa, Mycobacterium
RAADT

SEQ ID NO: 914144 - protein, 8 aa, Mycobacterium
RAAEQSGV

SEQ ID NO: 914145 - protein, 17 aa, Mycobacterium
RAAESFTDAYGGTPVTD

SEQ ID NO: 914146 - protein, 8 aa, Mycobacterium
RAAGDTHH

SEQ ID NO: 914147 - protein, 10 aa, Mycobacterium
RAAGKGIVTP

SEQ ID NO: 914148 - protein, 6 aa, Mycobacterium
RAAGQP

SEQ ID NO: 914149 - protein, 8 aa, Mycobacterium
RAAGQPSW

SEQ ID NO: 914150 - protein, 6 aa, Mycobacterium
RAAGQT

SEQ ID NO: 914151 - protein, 8 aa, Mycobacterium
RAAGRTAG

SEQ ID NO: 914152 - protein, 4 aa, Mycobacterium
RAAH

SEQ ID NO: 914153 - protein, 5 aa, Mycobacterium
RAAHA

SEQ ID NO: 914154 - protein, 17 aa, Mycobacterium
RAAHRAGPRNQTSFPHG

SEQ ID NO: 914155 - protein, 13 aa, Mycobacterium
RAAHSSYKSNGMA

SEQ ID NO: 914156 - protein, 7 aa, Mycobacterium
RAAKAEP

SEQ ID NO: 914157 - protein, 8 aa, Mycobacterium
RAAKAQPL

SEQ ID NO: 914158 - protein, 16 aa, Mycobacterium
RAAKKLPGTSLTPDGP

SEQ ID NO: 914159 - protein, 17 aa, Mycobacterium
RAAKQGRRWLEKPARSE

SEQ ID NO: 914160 - protein, 24 aa, Mycobacterium
RAALTSATGGNSVAERSAAEQRLD

SEQ ID NO: 914161 - protein, 8 aa, Mycobacterium
RAANPGAP

SEQ ID NO: 914162 - protein, 13 aa, Mycobacterium
RAAPDDAQSRSPA

SEQ ID NO: 914163 - protein, 9 aa, Mycobacterium
RAAPETGFN

SEQ ID NO: 914164 - protein, 11 aa, Mycobacterium
RAAPPHQPGTY

SEQ ID NO: 914165 - protein, 5 aa, Mycobacterium
RAAQA

SEQ ID NO: 914166 - protein, 7 aa, Mycobacterium
RAAQAAA

SEQ ID NO: 914167 - protein, 6 aa, Mycobacterium
RAAQAG

SEQ ID NO: 914168 - protein, 13 aa, Mycobacterium
RAAQDAGRDPDAL

SEQ ID NO: 914169 - protein, 42 aa, Mycobacterium
RAAQTSADEAEQRSRDAAEAARVAAEQAKNVRASLQAKQSQL

SEQ ID NO: 914170 - protein, 4 aa, Mycobacterium
RAAR

SEQ ID NO: 914171 - protein, 6 aa, Mycobacterium
RAARDA

SEQ ID NO: 914172 - protein, 7 aa, Mycobacterium
RAARPSH

SEQ ID NO: 914173 - protein, 10 aa, Mycobacterium
RAARTTELAD

SEQ ID NO: 914174 - protein, 9 aa, Mycobacterium
RAASARVEA

SEQ ID NO: 914175 - protein, 9 aa, Mycobacterium
RAASGWSAQ

SEQ ID NO: 914176 - protein, 8 aa, Mycobacterium
RAASPDAP

SEQ ID NO: 914177 - protein, 25 aa, Mycobacterium
RAASPGQPAGPTGPTGSAGAANTVG

SEQ ID NO: 914178 - protein, 21 aa, Mycobacterium
RAASRLSEAVSSTLPGSDDTL

SEQ ID NO: 914179 - protein, 29 aa, Mycobacterium
RAATADPGALSAAPHQDPAAAYEPGSCGD

SEQ ID NO: 914180 - protein, 19 aa, Mycobacterium
RAATGSRRLDVGSGDATTI

SEQ ID NO: 914181 - protein, 6 aa, Mycobacterium
RAATQL

SEQ ID NO: 914182 - protein, 12 aa, Mycobacterium
RAATTDDLGAQQ

SEQ ID NO: 914183 - protein, 42 aa, Mycobacterium
RAATTSTADTPDTTSTPITAGTSQPAAPPPNTPITSTPTITT

SEQ ID NO: 914184 - protein, 6 aa, Mycobacterium
RAATVS

SEQ ID NO: 914185 - protein, 52 aa, Mycobacterium
RACPGQSVTYTPNGSGAGISEFTGNQTDFGSSDSPLNKDEYASAERRCGSPA

SEQ ID NO: 914186 - protein, 10 aa, Mycobacterium
RADAADGLGY

SEQ ID NO: 914187 - protein, 71 aa, Mycobacterium
RADADADADADADADAEKSTSSTGKHRKPETAASDTAASDTAASETASSESDSGTADSGDSDSGGGSGADS

SEQ ID NO: 914188 - protein, 6 aa, Mycobacterium
RADAGM

SEQ ID NO: 914189 - protein, 8 aa, Mycobacterium
RADALTSA

SEQ ID NO: 914190 - protein, 8 aa, Mycobacterium
RADAPTAG

SEQ ID NO: 914191 - protein, 6 aa, Mycobacterium
RADAVT

SEQ ID NO: 914192 - protein, 7 aa, Mycobacterium
RADAVTR

SEQ ID NO: 914193 - protein, 11 aa, Mycobacterium
RADDPRPPEAA

SEQ ID NO: 914194 - protein, 6 aa, Mycobacterium
RADEQV

SEQ ID NO: 914195 - protein, 14 aa, Mycobacterium
RADGSGKLVTTTDA

SEQ ID NO: 914196 - protein, 10 aa, Mycobacterium
RADGYDPASL

SEQ ID NO: 914197 - protein, 9 aa, Mycobacterium
RADLATREE

SEQ ID NO: 914198 - protein, 4 aa, Mycobacterium
RADP

SEQ ID NO: 914199 - protein, 8 aa, Mycobacterium
RADPDPNR

SEQ ID NO: 914200 - protein, 14 aa, Mycobacterium
RADPPLASNTKNNE

SEQ ID NO: 914201 - protein, 7 aa, Mycobacterium
RADQPDQ

SEQ ID NO: 914202 - protein, 15 aa, Mycobacterium
RADQSAPQAAPETVP

SEQ ID NO: 914203 - protein, 5 aa, Mycobacterium
RADRL

SEQ ID NO: 914204 - protein, 15 aa, Mycobacterium
RADSAVAKKGNDFAT

SEQ ID NO: 914205 - protein, 9 aa, Mycobacterium
RADSLTSSR

SEQ ID NO: 914206 - protein, 10 aa, Mycobacterium
RADSPEEQQA

SEQ ID NO: 914207 - protein, 37 aa, Mycobacterium
RADTQQQPPPPTVTDTGGPPAPPPASKTPAGLAPGPA

SEQ ID NO: 914208 - protein, 5 aa, Mycobacterium
RADYE

SEQ ID NO: 914209 - protein, 10 aa, Mycobacterium
RADYSEPARA

SEQ ID NO: 914210 - protein, 9 aa, Mycobacterium
RAEAAPTLR

SEQ ID NO: 914211 - protein, 14 aa, Mycobacterium
RAEERSRHSAEKEL

SEQ ID NO: 914212 - protein, 9 aa, Mycobacterium
RAEGEPAPA

SEQ ID NO: 914213 - protein, 5 aa, Mycobacterium
RAEKA

SEQ ID NO: 914214 - protein, 8 aa, Mycobacterium
RAENPDAP

SEQ ID NO: 914215 - protein, 9 aa, Mycobacterium
RAEPGASWA

SEQ ID NO: 914216 - protein, 7 aa, Mycobacterium
RAEPSSA

SEQ ID NO: 914217 - protein, 11 aa, Mycobacterium
RAEQRSEPGAR

SEQ ID NO: 914218 - protein, 6 aa, Mycobacterium
RAESGP

SEQ ID NO: 914219 - protein, 14 aa, Mycobacterium
RAETGDTLSDKSEP

SEQ ID NO: 914220 - protein, 7 aa, Mycobacterium
RAETVRT

SEQ ID NO: 914221 - protein, 9 aa, Mycobacterium
RAEVPAEQT

SEQ ID NO: 914222 - protein, 12 aa, Mycobacterium
RAEVRESSVGRS

SEQ ID NO: 914223 - protein, 9 aa, Mycobacterium
RAEYDKGPI

SEQ ID NO: 914224 - protein, 4 aa, Mycobacterium
RAFA

SEQ ID NO: 914225 - protein, 6 aa, Mycobacterium
RAFDGS

SEQ ID NO: 914226 - protein, 14 aa, Mycobacterium
RAFEDAKDRAGQYA

SEQ ID NO: 914227 - protein, 16 aa, Mycobacterium
RAGAAPAGVALGDPTQ

SEQ ID NO: 914228 - protein, 8 aa, Mycobacterium
RAGAASAD

SEQ ID NO: 914229 - protein, 9 aa, Mycobacterium
RAGADPQAV

SEQ ID NO: 914230 - protein, 10 aa, Mycobacterium
RAGAPDYEGR

SEQ ID NO: 914231 - protein, 6 aa, Mycobacterium
RAGAPS

SEQ ID NO: 914232 - protein, 7 aa, Mycobacterium
RAGDEDL

SEQ ID NO: 914233 - protein, 4 aa, Mycobacterium
RAGE

SEQ ID NO: 914234 - protein, 8 aa, Mycobacterium
RAGEGATT

SEQ ID NO: 914235 - protein, 8 aa, Mycobacterium
RAGEPSEV

SEQ ID NO: 914236 - protein, 7 aa, Mycobacterium
RAGESVS

SEQ ID NO: 914237 - protein, 9 aa, Mycobacterium
RAGGAALAQ

SEQ ID NO: 914238 - protein, 11 aa, Mycobacterium
RAGGLPRPENA

SEQ ID NO: 914239 - protein, 19 aa, Mycobacterium
RAGGMDRPVEGAHTGGFNR

SEQ ID NO: 914240 - protein, 6 aa, Mycobacterium
RAGGPV

SEQ ID NO: 914241 - protein, 5 aa, Mycobacterium
RAGGR

SEQ ID NO: 914242 - protein, 7 aa, Mycobacterium
RAGGRNA

SEQ ID NO: 914243 - protein, 8 aa, Mycobacterium
RAGGTPEV

SEQ ID NO: 914244 - protein, 4 aa, Mycobacterium
RAGK

SEQ ID NO: 914245 - protein, 19 aa, Mycobacterium
RAGKPARDTSFDGRSDYDA

SEQ ID NO: 914246 - protein, 12 aa, Mycobacterium
RAGKTNSGKGAA

SEQ ID NO: 914247 - protein, 9 aa, Mycobacterium
RAGLPSEIG

SEQ ID NO: 914248 - protein, 4 aa, Mycobacterium
RAGQ

SEQ ID NO: 914249 - protein, 8 aa, Mycobacterium
RAGQSVAA

SEQ ID NO: 914250 - protein, 5 aa, Mycobacterium
RAGRD

SEQ ID NO: 914251 - protein, 8 aa, Mycobacterium
RAGRDGAQ

SEQ ID NO: 914252 - protein, 5 aa, Mycobacterium
RAGRP

SEQ ID NO: 914253 - protein, 4 aa, Mycobacterium
RAGS

SEQ ID NO: 914254 - protein, 7 aa, Mycobacterium
RAGSAPR

SEQ ID NO: 914255 - protein, 10 aa, Mycobacterium
RAGSESLATP

SEQ ID NO: 914256 - protein, 8 aa, Mycobacterium
RAGSPDLP

SEQ ID NO: 914257 - protein, 8 aa, Mycobacterium
RAGSSVNP

SEQ ID NO: 914258 - protein, 17 aa, Mycobacterium
RAGTAAAEHATVAGPTR

SEQ ID NO: 914259 - protein, 6 aa, Mycobacterium
RAGVSK

SEQ ID NO: 914260 - protein, 7 aa, Mycobacterium
RAGVSTM

SEQ ID NO: 914261 - protein, 5 aa, Mycobacterium
RAGYL

SEQ ID NO: 914262 - protein, 7 aa, Mycobacterium
RAHGDRP

SEQ ID NO: 914263 - protein, 6 aa, Mycobacterium
RAISSA

SEQ ID NO: 914264 - protein, 4 aa, Mycobacterium
RAIT

SEQ ID NO: 914265 - protein, 5 aa, Mycobacterium
RAITS

SEQ ID NO: 914266 - protein, 9 aa, Mycobacterium
RAKAETASS

SEQ ID NO: 914267 - protein, 9 aa, Mycobacterium
RAKAETAST

SEQ ID NO: 914268 - protein, 9 aa, Mycobacterium
RAKAGTGEA

SEQ ID NO: 914269 - protein, 14 aa, Mycobacterium
RAKDGLADFPDDHA

SEQ ID NO: 914270 - protein, 7 aa, Mycobacterium
RAKDLRS

SEQ ID NO: 914271 - protein, 13 aa, Mycobacterium
RAKGSGAPIGQAD

SEQ ID NO: 914272 - protein, 13 aa, Mycobacterium
RAKRQARGQDTSF

SEQ ID NO: 914273 - protein, 4 aa, Mycobacterium
RALA

SEQ ID NO: 914274 - protein, 7 aa, Mycobacterium
RALAAEG

SEQ ID NO: 914275 - protein, 22 aa, Mycobacterium
RALPPQPPAPPSRPAAALGADG

SEQ ID NO: 914276 - protein, 12 aa, Mycobacterium
RALPSPWGQPDG

SEQ ID NO: 914277 - protein, 14 aa, Mycobacterium
RAMREKGNSGHPSM

SEQ ID NO: 914278 - protein, 8 aa, Mycobacterium
RANASHTK

SEQ ID NO: 914279 - protein, 9 aa, Mycobacterium
RANDTGLGP

SEQ ID NO: 914280 - protein, 4 aa, Mycobacterium
RANE

SEQ ID NO: 914281 - protein, 5 aa, Mycobacterium
RANGA

SEQ ID NO: 914282 - protein, 17 aa, Mycobacterium
RANGGAGSAAGASREEQ

SEQ ID NO: 914283 - protein, 18 aa, Mycobacterium
RANGGSGSPHLASREEQI

SEQ ID NO: 914284 - protein, 7 aa, Mycobacterium
RANGTPL

SEQ ID NO: 914285 - protein, 7 aa, Mycobacterium
RANGYDG

SEQ ID NO: 914286 - protein, 7 aa, Mycobacterium
RANLETG

SEQ ID NO: 914287 - protein, 8 aa, Mycobacterium
RANPAGDY

SEQ ID NO: 914288 - protein, 10 aa, Mycobacterium
RANPNPFGEA

SEQ ID NO: 914289 - protein, 7 aa, Mycobacterium
RANRTAL

SEQ ID NO: 914290 - protein, 8 aa, Mycobacterium
RANSTVQN

SEQ ID NO: 914291 - protein, 8 aa, Mycobacterium
RANTANAL

SEQ ID NO: 914292 - protein, 12 aa, Mycobacterium
RANTDGRDARRR

SEQ ID NO: 914293 - protein, 25 aa, Mycobacterium
RAPAAEAGRVQGRREAARVADFLSG

SEQ ID NO: 914294 - protein, 11 aa, Mycobacterium
RAPAGTPQARN

SEQ ID NO: 914295 - protein, 5 aa, Mycobacterium
RAPAP

SEQ ID NO: 914296 - protein, 34 aa, Mycobacterium
RAPAPTPQPQLRPPRPQAPTPPPPQDVPPPQQLE

SEQ ID NO: 914297 - protein, 9 aa, Mycobacterium
RAPATPDEA

SEQ ID NO: 914298 - protein, 9 aa, Mycobacterium
RAPDGSVQP

SEQ ID NO: 914299 - protein, 9 aa, Mycobacterium
RAPDGTEVA

SEQ ID NO: 914300 - protein, 10 aa, Mycobacterium
RAPDPADSRA

SEQ ID NO: 914301 - protein, 7 aa, Mycobacterium
RAPDPEH

SEQ ID NO: 914302 - protein, 11 aa, Mycobacterium
RAPDPSAGATL

SEQ ID NO: 914303 - protein, 5 aa, Mycobacterium
RAPEF

SEQ ID NO: 914304 - protein, 10 aa, Mycobacterium
RAPETARSER

SEQ ID NO: 914305 - protein, 17 aa, Mycobacterium
RAPEVGIPAENPRLTQP

SEQ ID NO: 914306 - protein, 4 aa, Mycobacterium
RAPL

SEQ ID NO: 914307 - protein, 5 aa, Mycobacterium
RAPLP

SEQ ID NO: 914308 - protein, 4 aa, Mycobacterium
RAPR

SEQ ID NO: 914309 - protein, 8 aa, Mycobacterium
RAPSARAD

SEQ ID NO: 914310 - protein, 7 aa, Mycobacterium
RAPSNPD

SEQ ID NO: 914311 - protein, 8 aa, Mycobacterium
RAPSNSDE

SEQ ID NO: 914312 - protein, 6 aa, Mycobacterium
RAPSPS

SEQ ID NO: 914313 - protein, 13 aa, Mycobacterium
RAQAAAAAAGAPV

SEQ ID NO: 914314 - protein, 7 aa, Mycobacterium
RAQAADE

SEQ ID NO: 914315 - protein, 9 aa, Mycobacterium
RAQARTDYE

SEQ ID NO: 914316 - protein, 10 aa, Mycobacterium
RAQDDANGWD

SEQ ID NO: 914317 - protein, 4 aa, Mycobacterium
RAQE

SEQ ID NO: 914318 - protein, 5 aa, Mycobacterium
RAQEL

SEQ ID NO: 914319 - protein, 8 aa, Mycobacterium
RAQNGGLP

SEQ ID NO: 914320 - protein, 11 aa, Mycobacterium
RAQPGMGGATG

SEQ ID NO: 914321 - protein, 9 aa, Mycobacterium
RAQQTDGSW

SEQ ID NO: 914322 - protein, 6 aa, Mycobacterium
RAQVES

SEQ ID NO: 914323 - protein, 16 aa, Mycobacterium
RARAFDDAKNRAQQYA

SEQ ID NO: 914324 - protein, 5 aa, Mycobacterium
RARAR

SEQ ID NO: 914325 - protein, 8 aa, Mycobacterium
RARARAGA

SEQ ID NO: 914326 - protein, 10 aa, Mycobacterium
RARDDNSGWD

SEQ ID NO: 914327 - protein, 9 aa, Mycobacterium
RARDGLPDG

SEQ ID NO: 914328 - protein, 9 aa, Mycobacterium
RARDRGKPV

SEQ ID NO: 914329 - protein, 15 aa, Mycobacterium
RARETPAPVEQFGQD

SEQ ID NO: 914330 - protein, 13 aa, Mycobacterium
RAREVGAKHDATH

SEQ ID NO: 914331 - protein, 7 aa, Mycobacterium
RARGDRV

SEQ ID NO: 914332 - protein, 9 aa, Mycobacterium
RARGSEVRY

SEQ ID NO: 914333 - protein, 11 aa, Mycobacterium
RARPGRPGGPV

SEQ ID NO: 914334 - protein, 7 aa, Mycobacterium
RARPPEL

SEQ ID NO: 914335 - protein, 14 aa, Mycobacterium
RARPWPNQAEATLD

SEQ ID NO: 914336 - protein, 4 aa, Mycobacterium
RARQ

SEQ ID NO: 914337 - protein, 8 aa, Mycobacterium
RARQDRPD

SEQ ID NO: 914338 - protein, 10 aa, Mycobacterium
RARQSDGSWG

SEQ ID NO: 914339 - protein, 7 aa, Mycobacterium
RARRANG

SEQ ID NO: 914340 - protein, 5 aa, Mycobacterium
RARRD

SEQ ID NO: 914341 - protein, 5 aa, Mycobacterium
RARRG

SEQ ID NO: 914342 - protein, 7 aa, Mycobacterium
RARRRGK

SEQ ID NO: 914343 - protein, 88 aa, Mycobacterium
RARSTGVTDHRTGRPRYPGAAGTPVPAPTEQQRGATASAAITANTTSTARTTEAEHQPAATTKTAITANTTSTARAAAAKHQPAVAPA

SEQ ID NO: 914344 - protein, 7 aa, Mycobacterium
RARTDGI

SEQ ID NO: 914345 - protein, 34 aa, Mycobacterium
RARTEQVNKESAARLAKQKADKAAAEAKASQDAA

SEQ ID NO: 914346 - protein, 33 aa, Mycobacterium
RARTEQVNKQSQARAIQEKADQAAADAQQQQDD

SEQ ID NO: 914347 - protein, 35 aa, Mycobacterium
RARTEQVNRESAARLAKEKADQAARDAESSQDNAV

SEQ ID NO: 914348 - protein, 34 aa, Mycobacterium
RARTEQVNRESAARLAKQKADKAAADAKGSQDAA

SEQ ID NO: 914349 - protein, 7 aa, Mycobacterium
RARTSTV

SEQ ID NO: 914350 - protein, 6 aa, Mycobacterium
RARTSY

SEQ ID NO: 914351 - protein, 37 aa, Mycobacterium
RASAGYSSAARRAGDRAGRQARLGQSPELPGARTALD

SEQ ID NO: 914352 - protein, 14 aa, Mycobacterium
RASASEAATPPRRQ

SEQ ID NO: 914353 - protein, 6 aa, Mycobacterium
RASDHG

SEQ ID NO: 914354 - protein, 9 aa, Mycobacterium
RASDPERNT

SEQ ID NO: 914355 - protein, 12 aa, Mycobacterium
RASDVVANGSAQ

SEQ ID NO: 914356 - protein, 11 aa, Mycobacterium
RASEVVANGSA

SEQ ID NO: 914357 - protein, 18 aa, Mycobacterium
RASGAAAAQVGGVDNRPI

SEQ ID NO: 914358 - protein, 9 aa, Mycobacterium
RASGPDSGR

SEQ ID NO: 914359 - protein, 29 aa, Mycobacterium
RASGTVSDKFGTPIGTQGSFRDNTPDGMT

SEQ ID NO: 914360 - protein, 13 aa, Mycobacterium
RASQGQRSPDGEL

SEQ ID NO: 914361 - protein, 9 aa, Mycobacterium
RASRTTGWE

SEQ ID NO: 914362 - protein, 8 aa, Mycobacterium
RASTARHA

SEQ ID NO: 914363 - protein, 9 aa, Mycobacterium
RASTPEAVG

SEQ ID NO: 914364 - protein, 12 aa, Mycobacterium
RATADPAAAGLD

SEQ ID NO: 914365 - protein, 10 aa, Mycobacterium
RATAGGPDSM

SEQ ID NO: 914366 - protein, 37 aa, Mycobacterium
RATAGYSSAARRAGDRAGRRARLGSSPELPGARTPLG

SEQ ID NO: 914367 - protein, 6 aa, Mycobacterium
RATALR

SEQ ID NO: 914368 - protein, 6 aa, Mycobacterium
RATEEA

SEQ ID NO: 914369 - protein, 8 aa, Mycobacterium
RATEGTQI

SEQ ID NO: 914370 - protein, 4 aa, Mycobacterium
RATF

SEQ ID NO: 914371 - protein, 9 aa, Mycobacterium
RATGNVSAR

SEQ ID NO: 914372 - protein, 6 aa, Mycobacterium
RATGRR

SEQ ID NO: 914373 - protein, 14 aa, Mycobacterium
RATGVPADLPQDAL

SEQ ID NO: 914374 - protein, 8 aa, Mycobacterium
RATGYTGP

SEQ ID NO: 914375 - protein, 7 aa, Mycobacterium
RATPGAI

SEQ ID NO: 914376 - protein, 7 aa, Mycobacterium
RATPGLD

SEQ ID NO: 914377 - protein, 8 aa, Mycobacterium
RATPGRAG

SEQ ID NO: 914378 - protein, 5 aa, Mycobacterium
RATPL

SEQ ID NO: 914379 - protein, 12 aa, Mycobacterium
RATPTGQDPRTD

SEQ ID NO: 914380 - protein, 4 aa, Mycobacterium
RATQ

SEQ ID NO: 914381 - protein, 9 aa, Mycobacterium
RATTGARTE

SEQ ID NO: 914382 - protein, 5 aa, Mycobacterium
RATTH

SEQ ID NO: 914383 - protein, 7 aa, Mycobacterium
RATTRSS

SEQ ID NO: 914384 - protein, 6 aa, Mycobacterium
RATVSR

SEQ ID NO: 914385 - protein, 6 aa, Mycobacterium
RAVKPD

SEQ ID NO: 914386 - protein, 5 aa, Mycobacterium
RAVQG

SEQ ID NO: 914387 - protein, 4 aa, Mycobacterium
RAVS

SEQ ID NO: 914388 - protein, 11 aa, Mycobacterium
RAVSGSPTPNI

SEQ ID NO: 914389 - protein, 14 aa, Mycobacterium
RAVTGTPRADPAPV

SEQ ID NO: 914390 - protein, 24 aa, Mycobacterium
RAWGPRGSSGRCRCPRRGKGRCRR

SEQ ID NO: 914391 - protein, 9 aa, Mycobacterium
RCATTPENN

SEQ ID NO: 914392 - protein, 7 aa, Mycobacterium
RCDQPVK

SEQ ID NO: 914393 - protein, 10 aa, Mycobacterium
RCGSPQYDNG

SEQ ID NO: 914394 - protein, 9 aa, Mycobacterium
RCGSPQYDR

SEQ ID NO: 914395 - protein, 6 aa, Mycobacterium
RCNGDP

SEQ ID NO: 914396 - protein, 7 aa, Mycobacterium
RCSPSDI

SEQ ID NO: 914397 - protein, 8 aa, Mycobacterium
RCSPSDVV

SEQ ID NO: 914398 - protein, 7 aa, Mycobacterium
RCSPSRV

SEQ ID NO: 914399 - protein, 6 aa, Mycobacterium
RCTAEA

SEQ ID NO: 914400 - protein, 16 aa, Mycobacterium
RCTAEATNAFDQARSR

SEQ ID NO: 914401 - protein, 11 aa, Mycobacterium
RCTREANEAFE

SEQ ID NO: 914402 - protein, 21 aa, Mycobacterium
RDADAAAARAAELGAPHTSGH

SEQ ID NO: 914403 - protein, 18 aa, Mycobacterium
RDADDCPDARPSPPTSYC

SEQ ID NO: 914404 - protein, 8 aa, Mycobacterium
RDADSGAT

SEQ ID NO: 914405 - protein, 9 aa, Mycobacterium
RDAGGDSCA

SEQ ID NO: 914406 - protein, 12 aa, Mycobacterium
RDAGGTDKVVWK

SEQ ID NO: 914407 - protein, 5 aa, Mycobacterium
RDAGN

SEQ ID NO: 914408 - protein, 9 aa, Mycobacterium
RDAGTSSRA

SEQ ID NO: 914409 - protein, 9 aa, Mycobacterium
RDAGTVPGY

SEQ ID NO: 914410 - protein, 8 aa, Mycobacterium
RDAGTVTR

SEQ ID NO: 914411 - protein, 4 aa, Mycobacterium
RDAL

SEQ ID NO: 914412 - protein, 17 aa, Mycobacterium
RDALGTTSDKLASVTQA

SEQ ID NO: 914413 - protein, 5 aa, Mycobacterium
RDALS

SEQ ID NO: 914414 - protein, 13 aa, Mycobacterium
RDANGRVTVRVRL

SEQ ID NO: 914415 - protein, 9 aa, Mycobacterium
RDAPAPDPL

SEQ ID NO: 914416 - protein, 17 aa, Mycobacterium
RDAQPRQAQTRDGGNRC

SEQ ID NO: 914417 - protein, 4 aa, Mycobacterium
RDAS

SEQ ID NO: 914418 - protein, 8 aa, Mycobacterium
RDASEDHT

SEQ ID NO: 914419 - protein, 7 aa, Mycobacterium
RDASSHI

SEQ ID NO: 914420 - protein, 18 aa, Mycobacterium
RDASSHVEATAKNCPNTR

SEQ ID NO: 914421 - protein, 9 aa, Mycobacterium
RDATAYSSA

SEQ ID NO: 914422 - protein, 6 aa, Mycobacterium
RDATVE

SEQ ID NO: 914423 - protein, 8 aa, Mycobacterium
RDDAPAEL

SEQ ID NO: 914424 - protein, 9 aa, Mycobacterium
RDDDGHGAG

SEQ ID NO: 914425 - protein, 8 aa, Mycobacterium
RDDDPAGL

SEQ ID NO: 914426 - protein, 5 aa, Mycobacterium
RDDDS

SEQ ID NO: 914427 - protein, 13 aa, Mycobacterium
RDDHPSQTVGGAP

SEQ ID NO: 914428 - protein, 9 aa, Mycobacterium
RDDKTEMQQ

SEQ ID NO: 914429 - protein, 7 aa, Mycobacterium
RDDMTQE

SEQ ID NO: 914430 - protein, 10 aa, Mycobacterium
RDDPQNPMTN

SEQ ID NO: 914431 - protein, 10 aa, Mycobacterium
RDDPSSPLTN

SEQ ID NO: 914432 - protein, 8 aa, Mycobacterium
RDDPTGAL

SEQ ID NO: 914433 - protein, 6 aa, Mycobacterium
RDDQRS

SEQ ID NO: 914434 - protein, 12 aa, Mycobacterium
RDDRRRVTMMSM

SEQ ID NO: 914435 - protein, 37 aa, Mycobacterium
RDDSATTPTPGTARNAPDREHRDADTAAALAGPRQRA

SEQ ID NO: 914436 - protein, 13 aa, Mycobacterium
RDDVLGPDTAGTF

SEQ ID NO: 914437 - protein, 4 aa, Mycobacterium
RDDW

SEQ ID NO: 914438 - protein, 9 aa, Mycobacterium
RDEAEAMQA

SEQ ID NO: 914439 - protein, 7 aa, Mycobacterium
RDEAKQM

SEQ ID NO: 914440 - protein, 6 aa, Mycobacterium
RDEANH

SEQ ID NO: 914441 - protein, 5 aa, Mycobacterium
RDEDG

SEQ ID NO: 914442 - protein, 7 aa, Mycobacterium
RDEDTGA

SEQ ID NO: 914443 - protein, 4 aa, Mycobacterium
RDEG

SEQ ID NO: 914444 - protein, 6 aa, Mycobacterium
RDEGSD

SEQ ID NO: 914445 - protein, 6 aa, Mycobacterium
RDEGTD

SEQ ID NO: 914446 - protein, 11 aa, Mycobacterium
RDEHDDATPDV

SEQ ID NO: 914447 - protein, 7 aa, Mycobacterium
RDEKRDL

SEQ ID NO: 914448 - protein, 7 aa, Mycobacterium
RDENADR

SEQ ID NO: 914449 - protein, 8 aa, Mycobacterium
RDEPLEGG

SEQ ID NO: 914450 - protein, 9 aa, Mycobacterium
RDEQRRDRI

SEQ ID NO: 914451 - protein, 19 aa, Mycobacterium
RDEQSDDHPDADVECRVKS

SEQ ID NO: 914452 - protein, 19 aa, Mycobacterium
RDEQSDDHQDADVQCRVKS

SEQ ID NO: 914453 - protein, 7 aa, Mycobacterium
RDERPAE

SEQ ID NO: 914454 - protein, 21 aa, Mycobacterium
RDETTALRSGDTIDVLPPFSG

SEQ ID NO: 914455 - protein, 4 aa, Mycobacterium
RDEV

SEQ ID NO: 914456 - protein, 17 aa, Mycobacterium
RDFGYDTTATAAKSGDD

SEQ ID NO: 914457 - protein, 6 aa, Mycobacterium
RDGAEA

SEQ ID NO: 914458 - protein, 6 aa, Mycobacterium
RDGARI

SEQ ID NO: 914459 - protein, 10 aa, Mycobacterium
RDGATTPLGD

SEQ ID NO: 914460 - protein, 6 aa, Mycobacterium
RDGDDV

SEQ ID NO: 914461 - protein, 8 aa, Mycobacterium
RDGDPAEL

SEQ ID NO: 914462 - protein, 13 aa, Mycobacterium
RDGEGEQTKIPEP

SEQ ID NO: 914463 - protein, 23 aa, Mycobacterium
RDGERAPLRTGDARSESVGNPAG

SEQ ID NO: 914464 - protein, 7 aa, Mycobacterium
RDGETVG

SEQ ID NO: 914465 - protein, 8 aa, Mycobacterium
RDGEWTTN

SEQ ID NO: 914466 - protein, 12 aa, Mycobacterium
RDGFEGTDTSSC

SEQ ID NO: 914467 - protein, 10 aa, Mycobacterium
RDGGAGDDEV

SEQ ID NO: 914468 - protein, 7 aa, Mycobacterium
RDGGAWT

SEQ ID NO: 914469 - protein, 9 aa, Mycobacterium
RDGGDSVDA

SEQ ID NO: 914470 - protein, 9 aa, Mycobacterium
RDGGGTPFD

SEQ ID NO: 914471 - protein, 9 aa, Mycobacterium
RDGGGTPSF

SEQ ID NO: 914472 - protein, 7 aa, Mycobacterium
RDGGGVP

SEQ ID NO: 914473 - protein, 8 aa, Mycobacterium
RDGGRAHA

SEQ ID NO: 914474 - protein, 9 aa, Mycobacterium
RDGRDGSGL

SEQ ID NO: 914475 - protein, 6 aa, Mycobacterium
RDGSAE

SEQ ID NO: 914476 - protein, 10 aa, Mycobacterium
RDGSASGTAA

SEQ ID NO: 914477 - protein, 4 aa, Mycobacterium
RDGT

SEQ ID NO: 914478 - protein, 7 aa, Mycobacterium
RDGTDGK

SEQ ID NO: 914479 - protein, 9 aa, Mycobacterium
RDGTPLTEP

SEQ ID NO: 914480 - protein, 4 aa, Mycobacterium
RDHD

SEQ ID NO: 914481 - protein, 7 aa, Mycobacterium
RDHGPNV

SEQ ID NO: 914482 - protein, 13 aa, Mycobacterium
RDIAEDTKQPVER

SEQ ID NO: 914483 - protein, 14 aa, Mycobacterium
RDIAGDAERGPGSA

SEQ ID NO: 914484 - protein, 8 aa, Mycobacterium
RDINDENF

SEQ ID NO: 914485 - protein, 9 aa, Mycobacterium
RDKLAPPRY

SEQ ID NO: 914486 - protein, 13 aa, Mycobacterium
RDKTCGDGLTPRA

SEQ ID NO: 914487 - protein, 7 aa, Mycobacterium
RDLNSNG

SEQ ID NO: 914488 - protein, 10 aa, Mycobacterium
RDLRQPPPQL

SEQ ID NO: 914489 - protein, 7 aa, Mycobacterium
RDLSSNG

SEQ ID NO: 914490 - protein, 19 aa, Mycobacterium
RDNEASSQASLADAIGADR

SEQ ID NO: 914491 - protein, 7 aa, Mycobacterium
RDNGSGH

SEQ ID NO: 914492 - protein, 7 aa, Mycobacterium
RDNISAS

SEQ ID NO: 914493 - protein, 7 aa, Mycobacterium
RDNLTAS

SEQ ID NO: 914494 - protein, 8 aa, Mycobacterium
RDNNRDAA

SEQ ID NO: 914495 - protein, 8 aa, Mycobacterium
RDNPDSPL

SEQ ID NO: 914496 - protein, 10 aa, Mycobacterium
RDNPDSPLTN

SEQ ID NO: 914497 - protein, 38 aa, Mycobacterium
RDNSATPGTPATDRAAANREHRDADTPAALAGPRQRAG

SEQ ID NO: 914498 - protein, 7 aa, Mycobacterium
RDNSRDA

SEQ ID NO: 914499 - protein, 4 aa, Mycobacterium
RDNT

SEQ ID NO: 914500 - protein, 11 aa, Mycobacterium
RDNTPSGTTVA

SEQ ID NO: 914501 - protein, 13 aa, Mycobacterium
RDNTPSGTTVSTS

SEQ ID NO: 914502 - protein, 6 aa, Mycobacterium
RDNTRG

SEQ ID NO: 914503 - protein, 9 aa, Mycobacterium
RDPAAARQL

SEQ ID NO: 914504 - protein, 26 aa, Mycobacterium
RDPADGDDAAGPPPMLSEPEGCTDGL

SEQ ID NO: 914505 - protein, 16 aa, Mycobacterium
RDPAPPVTDEQRNTAL

SEQ ID NO: 914506 - protein, 9 aa, Mycobacterium
RDPATASLT

SEQ ID NO: 914507 - protein, 16 aa, Mycobacterium
RDPDAQTPAGGVSSSL

SEQ ID NO: 914508 - protein, 11 aa, Mycobacterium
RDPDDPDAPGI

SEQ ID NO: 914509 - protein, 5 aa, Mycobacterium
RDPDE

SEQ ID NO: 914510 - protein, 8 aa, Mycobacterium
RDPDGGYT

SEQ ID NO: 914511 - protein, 17 aa, Mycobacterium
RDPEKAARIQEEDDAMD

SEQ ID NO: 914512 - protein, 4 aa, Mycobacterium
RDPG

SEQ ID NO: 914513 - protein, 14 aa, Mycobacterium
RDPHPGGRMGRADV

SEQ ID NO: 914514 - protein, 20 aa, Mycobacterium
RDPIGNGPYKLDNGADGPAW

SEQ ID NO: 914515 - protein, 16 aa, Mycobacterium
RDPKFTPAREALDNPN

SEQ ID NO: 914516 - protein, 18 aa, Mycobacterium
RDPQQTVADTFAAMRAES

SEQ ID NO: 914517 - protein, 7 aa, Mycobacterium
RDPQTGD

SEQ ID NO: 914518 - protein, 5 aa, Mycobacterium
RDPQV

SEQ ID NO: 914519 - protein, 7 aa, Mycobacterium
RDPRETL

SEQ ID NO: 914520 - protein, 17 aa, Mycobacterium
RDPRETLADTFEALRAV

SEQ ID NO: 914521 - protein, 7 aa, Mycobacterium
RDPRSNM

SEQ ID NO: 914522 - protein, 15 aa, Mycobacterium
RDPRTTLADTVAALT

SEQ ID NO: 914523 - protein, 12 aa, Mycobacterium
RDPRVASEISTS

SEQ ID NO: 914524 - protein, 7 aa, Mycobacterium
RDPSRNA

SEQ ID NO: 914525 - protein, 4 aa, Mycobacterium
RDQA

SEQ ID NO: 914526 - protein, 9 aa, Mycobacterium
RDQCAQNPD

SEQ ID NO: 914527 - protein, 8 aa, Mycobacterium
RDQDRDGL

SEQ ID NO: 914528 - protein, 5 aa, Mycobacterium
RDQMS

SEQ ID NO: 914529 - protein, 4 aa, Mycobacterium
RDQS

SEQ ID NO: 914530 - protein, 9 aa, Mycobacterium
RDRARVPAD

SEQ ID NO: 914531 - protein, 16 aa, Mycobacterium
RDRDAAPGELGPTYSD

SEQ ID NO: 914532 - protein, 8 aa, Mycobacterium
RDRDATRT

SEQ ID NO: 914533 - protein, 8 aa, Mycobacterium
RDRDGDWH

SEQ ID NO: 914534 - protein, 6 aa, Mycobacterium
RDRGAK

SEQ ID NO: 914535 - protein, 7 aa, Mycobacterium
RDRGATR

SEQ ID NO: 914536 - protein, 8 aa, Mycobacterium
RDRISGTT

SEQ ID NO: 914537 - protein, 9 aa, Mycobacterium
RDRKTGIRG

SEQ ID NO: 914538 - protein, 8 aa, Mycobacterium
RDRLNSGN

SEQ ID NO: 914539 - protein, 4 aa, Mycobacterium
RDRP

SEQ ID NO: 914540 - protein, 7 aa, Mycobacterium
RDRPGLG

SEQ ID NO: 914541 - protein, 10 aa, Mycobacterium
RDRTAAENSI

SEQ ID NO: 914542 - protein, 14 aa, Mycobacterium
RDRVGGRSYTGSVG

SEQ ID NO: 914543 - protein, 16 aa, Mycobacterium
RDRYDTVAGPASPAAN

SEQ ID NO: 914544 - protein, 10 aa, Mycobacterium
RDSAAARRLT

SEQ ID NO: 914545 - protein, 8 aa, Mycobacterium
RDSDSYRV

SEQ ID NO: 914546 - protein, 9 aa, Mycobacterium
RDSLAGHGS

SEQ ID NO: 914547 - protein, 13 aa, Mycobacterium
RDSNISQASDLSG

SEQ ID NO: 914548 - protein, 8 aa, Mycobacterium
RDSPPPVL

SEQ ID NO: 914549 - protein, 6 aa, Mycobacterium
RDSPQF

SEQ ID NO: 914550 - protein, 11 aa, Mycobacterium
RDSPSTRGTVQ

SEQ ID NO: 914551 - protein, 13 aa, Mycobacterium
RDSRGDLGQKATN

SEQ ID NO: 914552 - protein, 9 aa, Mycobacterium
RDSRIGPTE

SEQ ID NO: 914553 - protein, 9 aa, Mycobacterium
RDSRITPTE

SEQ ID NO: 914554 - protein, 9 aa, Mycobacterium
RDSRSTETV

SEQ ID NO: 914555 - protein, 9 aa, Mycobacterium
RDSSGLSVD

SEQ ID NO: 914556 - protein, 8 aa, Mycobacterium
RDSSPPWY

SEQ ID NO: 914557 - protein, 4 aa, Mycobacterium
RDST

SEQ ID NO: 914558 - protein, 7 aa, Mycobacterium
RDSVGLS

SEQ ID NO: 914559 - protein, 8 aa, Mycobacterium
RDTAQQRP

SEQ ID NO: 914560 - protein, 6 aa, Mycobacterium
RDTDLS

SEQ ID NO: 914561 - protein, 6 aa, Mycobacterium
RDTEIP

SEQ ID NO: 914562 - protein, 5 aa, Mycobacterium
RDTGG

SEQ ID NO: 914563 - protein, 15 aa, Mycobacterium
RDTIGATSDKLTSVS

SEQ ID NO: 914564 - protein, 13 aa, Mycobacterium
RDTLARDAGVPVA

SEQ ID NO: 914565 - protein, 11 aa, Mycobacterium
RDTNTGFGNSG

SEQ ID NO: 914566 - protein, 6 aa, Mycobacterium
RDTPGV

SEQ ID NO: 914567 - protein, 11 aa, Mycobacterium
RDTPNSQGTVG

SEQ ID NO: 914568 - protein, 17 aa, Mycobacterium
RDTTGAACSATAAAGSG

SEQ ID NO: 914569 - protein, 10 aa, Mycobacterium
RDTTGSTKNY

SEQ ID NO: 914570 - protein, 9 aa, Mycobacterium
RDTTYPGAS

SEQ ID NO: 914571 - protein, 16 aa, Mycobacterium
RDVGAGAAGDAAAAGA

SEQ ID NO: 914572 - protein, 18 aa, Mycobacterium
RDVPDGYTVSGTSTDAGI

SEQ ID NO: 914573 - protein, 8 aa, Mycobacterium
RDWPSGTT

SEQ ID NO: 914574 - protein, 16 aa, Mycobacterium
RDWRGEGGRLPAPAPN

SEQ ID NO: 914575 - protein, 6 aa, Mycobacterium
RDYGDE

SEQ ID NO: 914576 - protein, 6 aa, Mycobacterium
RDYPAD

SEQ ID NO: 914577 - protein, 7 aa, Mycobacterium
RDYPTDK

SEQ ID NO: 914578 - protein, 4 aa, Mycobacterium
REAA

SEQ ID NO: 914579 - protein, 6 aa, Mycobacterium
REAAGQ

SEQ ID NO: 914580 - protein, 10 aa, Mycobacterium
REAEAERERR

SEQ ID NO: 914581 - protein, 12 aa, Mycobacterium
REAGAAQNRPRV

SEQ ID NO: 914582 - protein, 14 aa, Mycobacterium
REAGAQPPSGEAPD

SEQ ID NO: 914583 - protein, 15 aa, Mycobacterium
REAGEQLRREPGAPA

SEQ ID NO: 914584 - protein, 12 aa, Mycobacterium
REAHEEAGLPAE

SEQ ID NO: 914585 - protein, 13 aa, Mycobacterium
REALGTSSDRLAS

SEQ ID NO: 914586 - protein, 8 aa, Mycobacterium
REAPDAAS

SEQ ID NO: 914587 - protein, 15 aa, Mycobacterium
REAQDAAAAGNPHPA

SEQ ID NO: 914588 - protein, 14 aa, Mycobacterium
REATPREAESGPGD

SEQ ID NO: 914589 - protein, 6 aa, Mycobacterium
REAVDG

SEQ ID NO: 914590 - protein, 5 aa, Mycobacterium
REAVT

SEQ ID NO: 914591 - protein, 7 aa, Mycobacterium
REAYGEP

SEQ ID NO: 914592 - protein, 5 aa, Mycobacterium
REDEA

SEQ ID NO: 914593 - protein, 5 aa, Mycobacterium
REDGN

SEQ ID NO: 914594 - protein, 11 aa, Mycobacterium
REDKRSQQRQI

SEQ ID NO: 914595 - protein, 4 aa, Mycobacterium
REDL

SEQ ID NO: 914596 - protein, 11 aa, Mycobacterium
REDPDGDSEPI

SEQ ID NO: 914597 - protein, 5 aa, Mycobacterium
REDPR

SEQ ID NO: 914598 - protein, 9 aa, Mycobacterium
REDRPGDQR

SEQ ID NO: 914599 - protein, 11 aa, Mycobacterium
REDRQNNYHGE

SEQ ID NO: 914600 - protein, 5 aa, Mycobacterium
REDRS

SEQ ID NO: 914601 - protein, 9 aa, Mycobacterium
REEAKSDVN

SEQ ID NO: 914602 - protein, 7 aa, Mycobacterium
REEAPSV

SEQ ID NO: 914603 - protein, 23 aa, Mycobacterium
REEERGRAGYTTEGTTGLPAGGD

SEQ ID NO: 914604 - protein, 19 aa, Mycobacterium
REEKSAAGVNPQTFCLVKS

SEQ ID NO: 914605 - protein, 19 aa, Mycobacterium
REEKSANGIDAQTYCLVKS

SEQ ID NO: 914606 - protein, 7 aa, Mycobacterium
REEMKDP

SEQ ID NO: 914607 - protein, 6 aa, Mycobacterium
REEPDP

SEQ ID NO: 914608 - protein, 9 aa, Mycobacterium
REFGSTTRQ

SEQ ID NO: 914609 - protein, 22 aa, Mycobacterium
REGANGALAAAEVSKAKPDGSV

SEQ ID NO: 914610 - protein, 5 aa, Mycobacterium
REGDD

SEQ ID NO: 914611 - protein, 7 aa, Mycobacterium
REGGHSR

SEQ ID NO: 914612 - protein, 4 aa, Mycobacterium
REGM

SEQ ID NO: 914613 - protein, 6 aa, Mycobacterium
REGNEF

SEQ ID NO: 914614 - protein, 6 aa, Mycobacterium
REGQSL

SEQ ID NO: 914615 - protein, 8 aa, Mycobacterium
REGQVDEV

SEQ ID NO: 914616 - protein, 10 aa, Mycobacterium
REGSATGTSA

SEQ ID NO: 914617 - protein, 14 aa, Mycobacterium
REGTFTDEEGESTA

SEQ ID NO: 914618 - protein, 7 aa, Mycobacterium
REGTRGV

SEQ ID NO: 914619 - protein, 8 aa, Mycobacterium
REHGPGGV

SEQ ID NO: 914620 - protein, 10 aa, Mycobacterium
REHSTATAAS

SEQ ID NO: 914621 - protein, 9 aa, Mycobacterium
REIDNGANV

SEQ ID NO: 914622 - protein, 9 aa, Mycobacterium
REKGTVTRV

SEQ ID NO: 914623 - protein, 17 aa, Mycobacterium
REKSQAISHPPTTRPIP

SEQ ID NO: 914624 - protein, 15 aa, Mycobacterium
RELADRDRPSAGRGR

SEQ ID NO: 914625 - protein, 9 aa, Mycobacterium
RELAEETGL

SEQ ID NO: 914626 - protein, 5 aa, Mycobacterium
RELGP

SEQ ID NO: 914627 - protein, 7 aa, Mycobacterium
RELPPGY

SEQ ID NO: 914628 - protein, 7 aa, Mycobacterium
RELPTGE

SEQ ID NO: 914629 - protein, 9 aa, Mycobacterium
RELQSPWST

SEQ ID NO: 914630 - protein, 6 aa, Mycobacterium
RELRDG

SEQ ID NO: 914631 - protein, 8 aa, Mycobacterium
REPAAPEA

SEQ ID NO: 914632 - protein, 11 aa, Mycobacterium
REPAQVGGPEK

SEQ ID NO: 914633 - protein, 5 aa, Mycobacterium
REPDD

SEQ ID NO: 914634 - protein, 7 aa, Mycobacterium
REPGRTY

SEQ ID NO: 914635 - protein, 6 aa, Mycobacterium
REPGRY

SEQ ID NO: 914636 - protein, 6 aa, Mycobacterium
REPGSF

SEQ ID NO: 914637 - protein, 8 aa, Mycobacterium
REPPASAP

SEQ ID NO: 914638 - protein, 8 aa, Mycobacterium
REPPPADE

SEQ ID NO: 914639 - protein, 13 aa, Mycobacterium
REPPSGKFTEAVG

SEQ ID NO: 914640 - protein, 10 aa, Mycobacterium
REPYDKPPLS

SEQ ID NO: 914641 - protein, 5 aa, Mycobacterium
REQAA

SEQ ID NO: 914642 - protein, 4 aa, Mycobacterium
REQE

SEQ ID NO: 914643 - protein, 5 aa, Mycobacterium
REQEA

SEQ ID NO: 914644 - protein, 10 aa, Mycobacterium
REQKDKGQIR

SEQ ID NO: 914645 - protein, 6 aa, Mycobacterium
REQLPD

SEQ ID NO: 914646 - protein, 5 aa, Mycobacterium
REQVA

SEQ ID NO: 914647 - protein, 16 aa, Mycobacterium
RERAFNDAKSRAEQYA

SEQ ID NO: 914648 - protein, 6 aa, Mycobacterium
RERENA

SEQ ID NO: 914649 - protein, 7 aa, Mycobacterium
REREPHV

SEQ ID NO: 914650 - protein, 9 aa, Mycobacterium
RERGADGDR

SEQ ID NO: 914651 - protein, 5 aa, Mycobacterium
RERLN

SEQ ID NO: 914652 - protein, 6 aa, Mycobacterium
RERPDV

SEQ ID NO: 914653 - protein, 9 aa, Mycobacterium
RERRPDRAI

SEQ ID NO: 914654 - protein, 9 aa, Mycobacterium
RERSASDER

SEQ ID NO: 914655 - protein, 6 aa, Mycobacterium
RESDGT

SEQ ID NO: 914656 - protein, 9 aa, Mycobacterium
RESDYNANA

SEQ ID NO: 914657 - protein, 9 aa, Mycobacterium
RESSSPSPL

SEQ ID NO: 914658 - protein, 14 aa, Mycobacterium
RESSSTKPRKFERR

SEQ ID NO: 914659 - protein, 8 aa, Mycobacterium
RESTPPAE

SEQ ID NO: 914660 - protein, 12 aa, Mycobacterium
RESYAEGDDDEL

SEQ ID NO: 914661 - protein, 10 aa, Mycobacterium
RETARGSAAD

SEQ ID NO: 914662 - protein, 12 aa, Mycobacterium
RETDPGPRPDAA

SEQ ID NO: 914663 - protein, 24 aa, Mycobacterium
RETGPSTDRAHQDTSDLGLSETGP

SEQ ID NO: 914664 - protein, 7 aa, Mycobacterium
RETIKDP

SEQ ID NO: 914665 - protein, 7 aa, Mycobacterium
RETIQDP

SEQ ID NO: 914666 - protein, 24 aa, Mycobacterium
RETLGETSDKLASVSTALNDSLDD

SEQ ID NO: 914667 - protein, 14 aa, Mycobacterium
RETTGTIPAGTRSA

SEQ ID NO: 914668 - protein, 16 aa, Mycobacterium
REVESYNAHTSCLVKS

SEQ ID NO: 914669 - protein, 7 aa, Mycobacterium
REVGTGV

SEQ ID NO: 914670 - protein, 5 aa, Mycobacterium
REWPS

SEQ ID NO: 914671 - protein, 5 aa, Mycobacterium
REYGD

SEQ ID NO: 914672 - protein, 6 aa, Mycobacterium
REYPDD

SEQ ID NO: 914673 - protein, 7 aa, Mycobacterium
REYPSDQ

SEQ ID NO: 914674 - protein, 11 aa, Mycobacterium
RFAADDAAGPR

SEQ ID NO: 914675 - protein, 10 aa, Mycobacterium
RFANDGSASV

SEQ ID NO: 914676 - protein, 33 aa, Mycobacterium
RFATYSGAKPQGAATTTPPPSGPPPIAAPKNDL

SEQ ID NO: 914677 - protein, 9 aa, Mycobacterium
RFDESEPGR

SEQ ID NO: 914678 - protein, 7 aa, Mycobacterium
RFDGYTS

SEQ ID NO: 914679 - protein, 7 aa, Mycobacterium
RFEGKSS

SEQ ID NO: 914680 - protein, 11 aa, Mycobacterium
RFEPSAVGRTA

SEQ ID NO: 914681 - protein, 12 aa, Mycobacterium
RFEPSLDGRTEL

SEQ ID NO: 914682 - protein, 13 aa, Mycobacterium
RFESNGAGAEISS

SEQ ID NO: 914683 - protein, 9 aa, Mycobacterium
RFNDGTRAA

SEQ ID NO: 914684 - protein, 9 aa, Mycobacterium
RFPPGTLPQ

SEQ ID NO: 914685 - protein, 7 aa, Mycobacterium
RFQGQGN

SEQ ID NO: 914686 - protein, 6 aa, Mycobacterium
RFTARG

SEQ ID NO: 914687 - protein, 10 aa, Mycobacterium
RFTDNAESRA

SEQ ID NO: 914688 - protein, 6 aa, Mycobacterium
RFTSHN

SEQ ID NO: 914689 - protein, 6 aa, Mycobacterium
RGAADQ

SEQ ID NO: 914690 - protein, 28 aa, Mycobacterium
RGAAPASPAVPADAVTASGSGLDPNIST

SEQ ID NO: 914691 - protein, 8 aa, Mycobacterium
RGADGPGE

SEQ ID NO: 914692 - protein, 4 aa, Mycobacterium
RGAE

SEQ ID NO: 914693 - protein, 11 aa, Mycobacterium
RGAEGADPASV

SEQ ID NO: 914694 - protein, 10 aa, Mycobacterium
RGAEIGAGAR

SEQ ID NO: 914695 - protein, 8 aa, Mycobacterium
RGAEPVAQ

SEQ ID NO: 914696 - protein, 4 aa, Mycobacterium
RGAG

SEQ ID NO: 914697 - protein, 5 aa, Mycobacterium
RGAGG

SEQ ID NO: 914698 - protein, 11 aa, Mycobacterium
RGAGSVRSVRG

SEQ ID NO: 914699 - protein, 16 aa, Mycobacterium
RGAGTTDPKPAAPAVH

SEQ ID NO: 914700 - protein, 17 aa, Mycobacterium
RGANTDVPSLYRWWQNN

SEQ ID NO: 914701 - protein, 8 aa, Mycobacterium
RGAPDEAA

SEQ ID NO: 914702 - protein, 8 aa, Mycobacterium
RGAPRGLR

SEQ ID NO: 914703 - protein, 24 aa, Mycobacterium
RGAQDAVTAPVRTPPKPPPPSVPT

SEQ ID NO: 914704 - protein, 11 aa, Mycobacterium
RGARQQETEKR

SEQ ID NO: 914705 - protein, 7 aa, Mycobacterium
RGATAVP

SEQ ID NO: 914706 - protein, 5 aa, Mycobacterium
RGATD

SEQ ID NO: 914707 - protein, 7 aa, Mycobacterium
RGATPTL

SEQ ID NO: 914708 - protein, 13 aa, Mycobacterium
RGATTQDSATDAT

SEQ ID NO: 914709 - protein, 7 aa, Mycobacterium
RGCGQVS

SEQ ID NO: 914710 - protein, 12 aa, Mycobacterium
RGCTKPGCDAPA

SEQ ID NO: 914711 - protein, 9 aa, Mycobacterium
RGDAEAALS

SEQ ID NO: 914712 - protein, 13 aa, Mycobacterium
RGDASVGGGNPPP

SEQ ID NO: 914713 - protein, 10 aa, Mycobacterium
RGDDPNADGF

SEQ ID NO: 914714 - protein, 5 aa, Mycobacterium
RGDER

SEQ ID NO: 914715 - protein, 10 aa, Mycobacterium
RGDGEGSDRI

SEQ ID NO: 914716 - protein, 5 aa, Mycobacterium
RGDGF

SEQ ID NO: 914717 - protein, 9 aa, Mycobacterium
RGDGPMGRT

SEQ ID NO: 914718 - protein, 5 aa, Mycobacterium
RGDGR

SEQ ID NO: 914719 - protein, 8 aa, Mycobacterium
RGDGYQPG

SEQ ID NO: 914720 - protein, 15 aa, Mycobacterium
RGDLKSADHKRDDAK

SEQ ID NO: 914721 - protein, 7 aa, Mycobacterium
RGDPGTP

SEQ ID NO: 914722 - protein, 17 aa, Mycobacterium
RGDPLPGVSTGESTSVD

SEQ ID NO: 914723 - protein, 4 aa, Mycobacterium
RGDQ

SEQ ID NO: 914724 - protein, 5 aa, Mycobacterium
RGDRA

SEQ ID NO: 914725 - protein, 10 aa, Mycobacterium
RGDRAAEAMP

SEQ ID NO: 914726 - protein, 9 aa, Mycobacterium
RGDRSVVSP

SEQ ID NO: 914727 - protein, 6 aa, Mycobacterium
RGDTAA

SEQ ID NO: 914728 - protein, 5 aa, Mycobacterium
RGEAE

SEQ ID NO: 914729 - protein, 5 aa, Mycobacterium
RGEGA

SEQ ID NO: 914730 - protein, 13 aa, Mycobacterium
RGEGEGADRVLPP

SEQ ID NO: 914731 - protein, 5 aa, Mycobacterium
RGEHT

SEQ ID NO: 914732 - protein, 24 aa, Mycobacterium
RGELQASDELRQAAETLSKNPASL

SEQ ID NO: 914733 - protein, 7 aa, Mycobacterium
RGELRGS

SEQ ID NO: 914734 - protein, 5 aa, Mycobacterium
RGEPA

SEQ ID NO: 914735 - protein, 16 aa, Mycobacterium
RGEPARGPSGREPEAE

SEQ ID NO: 914736 - protein, 5 aa, Mycobacterium
RGEPF

SEQ ID NO: 914737 - protein, 7 aa, Mycobacterium
RGEPPPR

SEQ ID NO: 914738 - protein, 6 aa, Mycobacterium
RGEQAA

SEQ ID NO: 914739 - protein, 8 aa, Mycobacterium
RGESRYDA

SEQ ID NO: 914740 - protein, 6 aa, Mycobacterium
RGEYKS

SEQ ID NO: 914741 - protein, 10 aa, Mycobacterium
RGFPSPREHP

SEQ ID NO: 914742 - protein, 4 aa, Mycobacterium
RGGA

SEQ ID NO: 914743 - protein, 5 aa, Mycobacterium
RGGAA

SEQ ID NO: 914744 - protein, 5 aa, Mycobacterium
RGGAF

SEQ ID NO: 914745 - protein, 8 aa, Mycobacterium
RGGCAPDI

SEQ ID NO: 914746 - protein, 11 aa, Mycobacterium
RGGDHTARLGQ

SEQ ID NO: 914747 - protein, 8 aa, Mycobacterium
RGGDPSAP

SEQ ID NO: 914748 - protein, 8 aa, Mycobacterium
RGGDRGRQ

SEQ ID NO: 914749 - protein, 4 aa, Mycobacterium
RGGE

SEQ ID NO: 914750 - protein, 15 aa, Mycobacterium
RGGFDRNGKATLAAG

SEQ ID NO: 914751 - protein, 4 aa, Mycobacterium
RGGG

SEQ ID NO: 914752 - protein, 5 aa, Mycobacterium
RGGGA

SEQ ID NO: 914753 - protein, 9 aa, Mycobacterium
RGGGGRATG

SEQ ID NO: 914754 - protein, 6 aa, Mycobacterium
RGGGGS

SEQ ID NO: 914755 - protein, 8 aa, Mycobacterium
RGGGSASI

SEQ ID NO: 914756 - protein, 6 aa, Mycobacterium
RGGIPT

SEQ ID NO: 914757 - protein, 5 aa, Mycobacterium
RGGIT

SEQ ID NO: 914758 - protein, 9 aa, Mycobacterium
RGGLPPEQA

SEQ ID NO: 914759 - protein, 9 aa, Mycobacterium
RGGPGTAIG

SEQ ID NO: 914760 - protein, 15 aa, Mycobacterium
RGGPVSSYKTSYPTD

SEQ ID NO: 914761 - protein, 6 aa, Mycobacterium
RGGTAG

SEQ ID NO: 914762 - protein, 6 aa, Mycobacterium
RGGTQL

SEQ ID NO: 914763 - protein, 21 aa, Mycobacterium
RGGWTDGRQRLGTSPEKDVGF

SEQ ID NO: 914764 - protein, 5 aa, Mycobacterium
RGGYV

SEQ ID NO: 914765 - protein, 8 aa, Mycobacterium
RGHAPSQD

SEQ ID NO: 914766 - protein, 4 aa, Mycobacterium
RGHD

SEQ ID NO: 914767 - protein, 14 aa, Mycobacterium
RGHGATVGQSITDA

SEQ ID NO: 914768 - protein, 7 aa, Mycobacterium
RGHGDDL

SEQ ID NO: 914769 - protein, 5 aa, Mycobacterium
RGHGK

SEQ ID NO: 914770 - protein, 14 aa, Mycobacterium
RGHGRSDEAAPESY

SEQ ID NO: 914771 - protein, 15 aa, Mycobacterium
RGHGRSGEAPPDTYT

SEQ ID NO: 914772 - protein, 14 aa, Mycobacterium
RGHGRSGLPAPASC

SEQ ID NO: 914773 - protein, 19 aa, Mycobacterium
RGHGRSTLGAEGIGSEPMA

SEQ ID NO: 914774 - protein, 7 aa, Mycobacterium
RGHPGRE

SEQ ID NO: 914775 - protein, 5 aa, Mycobacterium
RGHPR

SEQ ID NO: 914776 - protein, 7 aa, Mycobacterium
RGIGRSD

SEQ ID NO: 914777 - protein, 16 aa, Mycobacterium
RGKESVTLNTKSPAGL

SEQ ID NO: 914778 - protein, 9 aa, Mycobacterium
RGKPAPAQL

SEQ ID NO: 914779 - protein, 7 aa, Mycobacterium
RGKPEDL

SEQ ID NO: 914780 - protein, 6 aa, Mycobacterium
RGKPGG

SEQ ID NO: 914781 - protein, 7 aa, Mycobacterium
RGKPTLP

SEQ ID NO: 914782 - protein, 8 aa, Mycobacterium
RGKSLRSK

SEQ ID NO: 914783 - protein, 11 aa, Mycobacterium
RGLAAGDTHPQ

SEQ ID NO: 914784 - protein, 11 aa, Mycobacterium
RGLADDPKPLN

SEQ ID NO: 914785 - protein, 6 aa, Mycobacterium
RGLGGD

SEQ ID NO: 914786 - protein, 4 aa, Mycobacterium
RGLS

SEQ ID NO: 914787 - protein, 12 aa, Mycobacterium
RGLSGSSRRFGE

SEQ ID NO: 914788 - protein, 4 aa, Mycobacterium
RGLT

SEQ ID NO: 914789 - protein, 6 aa, Mycobacterium
RGLTGA

SEQ ID NO: 914790 - protein, 7 aa, Mycobacterium
RGNENFQ

SEQ ID NO: 914791 - protein, 10 aa, Mycobacterium
RGNGIAGQTE

SEQ ID NO: 914792 - protein, 10 aa, Mycobacterium
RGNGTGSGAV

SEQ ID NO: 914793 - protein, 36 aa, Mycobacterium
RGNKETLNQPLPGTAPPPGTRIPGLGDDSQGPPPEQ

SEQ ID NO: 914794 - protein, 8 aa, Mycobacterium
RGNKTGAA

SEQ ID NO: 914795 - protein, 11 aa, Mycobacterium
RGNPASGGEQL

SEQ ID NO: 914796 - protein, 8 aa, Mycobacterium
RGNQTGAA

SEQ ID NO: 914797 - protein, 9 aa, Mycobacterium
RGNVTSRRV

SEQ ID NO: 914798 - protein, 31 aa, Mycobacterium
RGPAIRGTVQDNANDRTYQNTVTGHVYYINV

SEQ ID NO: 914799 - protein, 5 aa, Mycobacterium
RGPAQ

SEQ ID NO: 914800 - protein, 16 aa, Mycobacterium
RGPDEPGTWADPDADG

SEQ ID NO: 914801 - protein, 19 aa, Mycobacterium
RGPDEPGTWPDPDAENPHP

SEQ ID NO: 914802 - protein, 11 aa, Mycobacterium
RGPDGSTDKVL

SEQ ID NO: 914803 - protein, 5 aa, Mycobacterium
RGPDL

SEQ ID NO: 914804 - protein, 8 aa, Mycobacterium
RGPDSTEL

SEQ ID NO: 914805 - protein, 5 aa, Mycobacterium
RGPDY

SEQ ID NO: 914806 - protein, 21 aa, Mycobacterium
RGPGGMPTRASSTFTTVTPTY

SEQ ID NO: 914807 - protein, 6 aa, Mycobacterium
RGPKGV

SEQ ID NO: 914808 - protein, 9 aa, Mycobacterium
RGPKSGESV

SEQ ID NO: 914809 - protein, 8 aa, Mycobacterium
RGPKVGES

SEQ ID NO: 914810 - protein, 4 aa, Mycobacterium
RGPL

SEQ ID NO: 914811 - protein, 11 aa, Mycobacterium
RGPLGAPDARR

SEQ ID NO: 914812 - protein, 12 aa, Mycobacterium
RGPLGLPTSAEI

SEQ ID NO: 914813 - protein, 9 aa, Mycobacterium
RGPRGALAS

SEQ ID NO: 914814 - protein, 8 aa, Mycobacterium
RGPRGDEY

SEQ ID NO: 914815 - protein, 18 aa, Mycobacterium
RGPSGVIGTNKKDAQDTV

SEQ ID NO: 914816 - protein, 13 aa, Mycobacterium
RGPSSAADVVDTS

SEQ ID NO: 914817 - protein, 6 aa, Mycobacterium
RGPYEL

SEQ ID NO: 914818 - protein, 4 aa, Mycobacterium
RGQA

SEQ ID NO: 914819 - protein, 7 aa, Mycobacterium
RGQAGVA

SEQ ID NO: 914820 - protein, 14 aa, Mycobacterium
RGQDAIEGDRVPGA

SEQ ID NO: 914821 - protein, 9 aa, Mycobacterium
RGQDAQPGD

SEQ ID NO: 914822 - protein, 7 aa, Mycobacterium
RGQDPFG

SEQ ID NO: 914823 - protein, 8 aa, Mycobacterium
RGQGTSDG

SEQ ID NO: 914824 - protein, 7 aa, Mycobacterium
RGQPGTR

SEQ ID NO: 914825 - protein, 15 aa, Mycobacterium
RGQPGYSSKLDRDGH

SEQ ID NO: 914826 - protein, 11 aa, Mycobacterium
RGQPRADARDQ

SEQ ID NO: 914827 - protein, 9 aa, Mycobacterium
RGQPRDDIR

SEQ ID NO: 914828 - protein, 9 aa, Mycobacterium
RGQSPVVEG

SEQ ID NO: 914829 - protein, 7 aa, Mycobacterium
RGQTGTR

SEQ ID NO: 914830 - protein, 8 aa, Mycobacterium
RGQTPAKP

SEQ ID NO: 914831 - protein, 8 aa, Mycobacterium
RGRAQLPD

SEQ ID NO: 914832 - protein, 6 aa, Mycobacterium
RGRARD

SEQ ID NO: 914833 - protein, 9 aa, Mycobacterium
RGRDEPVGL

SEQ ID NO: 914834 - protein, 5 aa, Mycobacterium
RGRDR

SEQ ID NO: 914835 - protein, 8 aa, Mycobacterium
RGRGAARS

SEQ ID NO: 914836 - protein, 8 aa, Mycobacterium
RGRGIPRE

SEQ ID NO: 914837 - protein, 9 aa, Mycobacterium
RGRKEPVGL

SEQ ID NO: 914838 - protein, 4 aa, Mycobacterium
RGRP

SEQ ID NO: 914839 - protein, 10 aa, Mycobacterium
RGRPHEEASA

SEQ ID NO: 914840 - protein, 4 aa, Mycobacterium
RGRQ

SEQ ID NO: 914841 - protein, 6 aa, Mycobacterium
RGRRYP

SEQ ID NO: 914842 - protein, 10 aa, Mycobacterium
RGRSGGGDQV

SEQ ID NO: 914843 - protein, 5 aa, Mycobacterium
RGRSH

SEQ ID NO: 914844 - protein, 11 aa, Mycobacterium
RGRSQPPGLGN

SEQ ID NO: 914845 - protein, 19 aa, Mycobacterium
RGSAEADTALQRGEEPTAA

SEQ ID NO: 914846 - protein, 6 aa, Mycobacterium
RGSAGG

SEQ ID NO: 914847 - protein, 9 aa, Mycobacterium
RGSANSKAL

SEQ ID NO: 914848 - protein, 10 aa, Mycobacterium
RGSDYQRSEF

SEQ ID NO: 914849 - protein, 20 aa, Mycobacterium
RGSGSYGCSGPLPAAPGGAN

SEQ ID NO: 914850 - protein, 11 aa, Mycobacterium
RGSIVTTDDGV

SEQ ID NO: 914851 - protein, 4 aa, Mycobacterium
RGTA

SEQ ID NO: 914852 - protein, 5 aa, Mycobacterium
RGTAA

SEQ ID NO: 914853 - protein, 5 aa, Mycobacterium
RGTAG

SEQ ID NO: 914854 - protein, 16 aa, Mycobacterium
RGTANEPAAADSAAGV

SEQ ID NO: 914855 - protein, 5 aa, Mycobacterium
RGTAR

SEQ ID NO: 914856 - protein, 6 aa, Mycobacterium
RGTDAG

SEQ ID NO: 914857 - protein, 7 aa, Mycobacterium
RGTDPGD

SEQ ID NO: 914858 - protein, 4 aa, Mycobacterium
RGTE

SEQ ID NO: 914859 - protein, 5 aa, Mycobacterium
RGTGA

SEQ ID NO: 914860 - protein, 14 aa, Mycobacterium
RGTGADLKEAQSAI

SEQ ID NO: 914861 - protein, 7 aa, Mycobacterium
RGTPVPR

SEQ ID NO: 914862 - protein, 8 aa, Mycobacterium
RGTSSCDD

SEQ ID NO: 914863 - protein, 8 aa, Mycobacterium
RGTTPDGV

SEQ ID NO: 914864 - protein, 6 aa, Mycobacterium
RGTVPK

SEQ ID NO: 914865 - protein, 4 aa, Mycobacterium
RGTW

SEQ ID NO: 914866 - protein, 8 aa, Mycobacterium
RGVANSNP

SEQ ID NO: 914867 - protein, 24 aa, Mycobacterium
RGVAQTTTTPPPPLPGKPFPKQCP

SEQ ID NO: 914868 - protein, 7 aa, Mycobacterium
RGVASSR

SEQ ID NO: 914869 - protein, 8 aa, Mycobacterium
RGVEPTGN

SEQ ID NO: 914870 - protein, 5 aa, Mycobacterium
RGVGA

SEQ ID NO: 914871 - protein, 9 aa, Mycobacterium
RGVGHSTPA

SEQ ID NO: 914872 - protein, 13 aa, Mycobacterium
RGVGSPWSHQSAA

SEQ ID NO: 914873 - protein, 34 aa, Mycobacterium
RGVGSSTPAIECNSDKDVDRLRAQNDTDYSPEGV

SEQ ID NO: 914874 - protein, 10 aa, Mycobacterium
RGVGTPKGQV

SEQ ID NO: 914875 - protein, 6 aa, Mycobacterium
RGVHTR

SEQ ID NO: 914876 - protein, 17 aa, Mycobacterium
RGVKQLSASADEENSGW

SEQ ID NO: 914877 - protein, 9 aa, Mycobacterium
RGVQQNDTA

SEQ ID NO: 914878 - protein, 8 aa, Mycobacterium
RGVRSTRN

SEQ ID NO: 914879 - protein, 6 aa, Mycobacterium
RGVSDP

SEQ ID NO: 914880 - protein, 14 aa, Mycobacterium
RGVSGYPGDGSNAW

SEQ ID NO: 914881 - protein, 8 aa, Mycobacterium
RGVSRTGN

SEQ ID NO: 914882 - protein, 9 aa, Mycobacterium
RGVSRTGNA

SEQ ID NO: 914883 - protein, 11 aa, Mycobacterium
RGYGGGATALS

SEQ ID NO: 914884 - protein, 5 aa, Mycobacterium
RGYGY

SEQ ID NO: 914885 - protein, 18 aa, Mycobacterium
RGYPDGTNTHEKESHDER

SEQ ID NO: 914886 - protein, 7 aa, Mycobacterium
RHARPEF

SEQ ID NO: 914887 - protein, 26 aa, Mycobacterium
RHDESASRVGPTARRAGAPPRRPPRR

SEQ ID NO: 914888 - protein, 4 aa, Mycobacterium
RHGE

SEQ ID NO: 914889 - protein, 35 aa, Mycobacterium
RHGGAGQRARAAGSLPPDRFPRRSQPGRDGDPAHR

SEQ ID NO: 914890 - protein, 4 aa, Mycobacterium
RHGR

SEQ ID NO: 914891 - protein, 6 aa, Mycobacterium
RHGRRR

SEQ ID NO: 914892 - protein, 4 aa, Mycobacterium
RHLR

SEQ ID NO: 914893 - protein, 5 aa, Mycobacterium
RHNPD

SEQ ID NO: 914894 - protein, 11 aa, Mycobacterium
RHPANGAPIDP

SEQ ID NO: 914895 - protein, 9 aa, Mycobacterium
RHPDKPYEL

SEQ ID NO: 914896 - protein, 6 aa, Mycobacterium
RHPEQY

SEQ ID NO: 914897 - protein, 4 aa, Mycobacterium
RHPG

SEQ ID NO: 914898 - protein, 10 aa, Mycobacterium
RHPGAAVPTE

SEQ ID NO: 914899 - protein, 11 aa, Mycobacterium
RHPGPALAGRS

SEQ ID NO: 914900 - protein, 22 aa, Mycobacterium
RHPPPGDLSAPGPCRAAGTSDL

SEQ ID NO: 914901 - protein, 6 aa, Mycobacterium
RHPPQA

SEQ ID NO: 914902 - protein, 8 aa, Mycobacterium
RHPSPQRL

SEQ ID NO: 914903 - protein, 7 aa, Mycobacterium
RHRAQAA

SEQ ID NO: 914904 - protein, 9 aa, Mycobacterium
RHRNEDTKT

SEQ ID NO: 914905 - protein, 15 aa, Mycobacterium
RHTAEARFRDGNGLG

SEQ ID NO: 914906 - protein, 6 aa, Mycobacterium
RHTKRG

SEQ ID NO: 914907 - protein, 6 aa, Mycobacterium
RHTQGK

SEQ ID NO: 914908 - protein, 5 aa, Mycobacterium
RHTRA

SEQ ID NO: 914909 - protein, 12 aa, Mycobacterium
RHTRPEEDQGDI

SEQ ID NO: 914910 - protein, 18 aa, Mycobacterium
RIAAPGGAGFAAGNDALQ

SEQ ID NO: 914911 - protein, 12 aa, Mycobacterium
RIAAPGGAGFPA

SEQ ID NO: 914912 - protein, 6 aa, Mycobacterium
RIAPAG

SEQ ID NO: 914913 - protein, 6 aa, Mycobacterium
RIASPD

SEQ ID NO: 914914 - protein, 5 aa, Mycobacterium
RIDGL

SEQ ID NO: 914915 - protein, 22 aa, Mycobacterium
RIDGTRARGFRPSWSGGPGMGT

SEQ ID NO: 914916 - protein, 4 aa, Mycobacterium
RIEG

SEQ ID NO: 914917 - protein, 5 aa, Mycobacterium
RIGAA

SEQ ID NO: 914918 - protein, 6 aa, Mycobacterium
RIGEDG

SEQ ID NO: 914919 - protein, 10 aa, Mycobacterium
RIGGEGDIPH

SEQ ID NO: 914920 - protein, 10 aa, Mycobacterium
RIGPATARAA

SEQ ID NO: 914921 - protein, 8 aa, Mycobacterium
RIGPPGAV

SEQ ID NO: 914922 - protein, 4 aa, Mycobacterium
RIGR

SEQ ID NO: 914923 - protein, 10 aa, Mycobacterium
RINDGGATRT

SEQ ID NO: 914924 - protein, 8 aa, Mycobacterium
RINDGGAV

SEQ ID NO: 914925 - protein, 9 aa, Mycobacterium
RINGDGALD

SEQ ID NO: 914926 - protein, 17 aa, Mycobacterium
RIPAGAGAGASREPLAV

SEQ ID NO: 914927 - protein, 15 aa, Mycobacterium
RIPAPGGAGFAAGND

SEQ ID NO: 914928 - protein, 10 aa, Mycobacterium
RIQPDKLDRD

SEQ ID NO: 914929 - protein, 7 aa, Mycobacterium
RIQPGDA

SEQ ID NO: 914930 - protein, 22 aa, Mycobacterium
RIQPSTVNSRRSRTPALDAGRE

SEQ ID NO: 914931 - protein, 22 aa, Mycobacterium
RIQPTTVNSRRSRTPALDAGRE

SEQ ID NO: 914932 - protein, 13 aa, Mycobacterium
RISETDTPKPPPT

SEQ ID NO: 914933 - protein, 13 aa, Mycobacterium
RISETDTPSPPPT

SEQ ID NO: 914934 - protein, 12 aa, Mycobacterium
RISGGEPTAPVG

SEQ ID NO: 914935 - protein, 15 aa, Mycobacterium
RISGSQLKAARPEAR

SEQ ID NO: 914936 - protein, 8 aa, Mycobacterium
RISNSTDV

SEQ ID NO: 914937 - protein, 12 aa, Mycobacterium
RISPDATAFPHR

SEQ ID NO: 914938 - protein, 5 aa, Mycobacterium
RISQE

SEQ ID NO: 914939 - protein, 21 aa, Mycobacterium
RITAGGSITLTSGTAADKPDL

SEQ ID NO: 914940 - protein, 11 aa, Mycobacterium
RKAAAAAGEPD

SEQ ID NO: 914941 - protein, 11 aa, Mycobacterium
RKAAAAAGKPD

SEQ ID NO: 914942 - protein, 9 aa, Mycobacterium
RKAAAQTGV

SEQ ID NO: 914943 - protein, 7 aa, Mycobacterium
RKAAEGY

SEQ ID NO: 914944 - protein, 8 aa, Mycobacterium
RKADGEHY

SEQ ID NO: 914945 - protein, 5 aa, Mycobacterium
RKADR

SEQ ID NO: 914946 - protein, 10 aa, Mycobacterium
RKALTGHGAD

SEQ ID NO: 914947 - protein, 8 aa, Mycobacterium
RKDEPNSL

SEQ ID NO: 914948 - protein, 4 aa, Mycobacterium
RKDG

SEQ ID NO: 914949 - protein, 10 aa, Mycobacterium
RKDGSGTLVT

SEQ ID NO: 914950 - protein, 8 aa, Mycobacterium
RKDIRTTE

SEQ ID NO: 914951 - protein, 5 aa, Mycobacterium
RKDKL

SEQ ID NO: 914952 - protein, 6 aa, Mycobacterium
RKDPAD

SEQ ID NO: 914953 - protein, 8 aa, Mycobacterium
RKDPSQPV

SEQ ID NO: 914954 - protein, 7 aa, Mycobacterium
RKDRVQK

SEQ ID NO: 914955 - protein, 6 aa, Mycobacterium
RKDYDS

SEQ ID NO: 914956 - protein, 4 aa, Mycobacterium
RKEG

SEQ ID NO: 914957 - protein, 7 aa, Mycobacterium
RKEGRER

SEQ ID NO: 914958 - protein, 4 aa, Mycobacterium
RKGS

SEQ ID NO: 914959 - protein, 12 aa, Mycobacterium
RKIENTDNGEID

SEQ ID NO: 914960 - protein, 6 aa, Mycobacterium
RKLPDG

SEQ ID NO: 914961 - protein, 9 aa, Mycobacterium
RKNAPNGTV

SEQ ID NO: 914962 - protein, 7 aa, Mycobacterium
RKNEPAG

SEQ ID NO: 914963 - protein, 8 aa, Mycobacterium
RKNEPAGV

SEQ ID NO: 914964 - protein, 10 aa, Mycobacterium
RKNGIDPAGL

SEQ ID NO: 914965 - protein, 8 aa, Mycobacterium
RKPELGQA

SEQ ID NO: 914966 - protein, 4 aa, Mycobacterium
RKPI

SEQ ID NO: 914967 - protein, 9 aa, Mycobacterium
RKPLGANPI

SEQ ID NO: 914968 - protein, 6 aa, Mycobacterium
RKPPGV

SEQ ID NO: 914969 - protein, 18 aa, Mycobacterium
RKPVEGPLASPPELGPYN

SEQ ID NO: 914970 - protein, 8 aa, Mycobacterium
RKQDISNG

SEQ ID NO: 914971 - protein, 7 aa, Mycobacterium
RKQNGDM

SEQ ID NO: 914972 - protein, 6 aa, Mycobacterium
RKRAQA

SEQ ID NO: 914973 - protein, 33 aa, Mycobacterium
RKRGYTTDQVRDRKSGDPAATTIKYGPGAQADA

SEQ ID NO: 914974 - protein, 9 aa, Mycobacterium
RKSAEDASR

SEQ ID NO: 914975 - protein, 25 aa, Mycobacterium
RKSKVTADKRDSWDGPNLPGASASL

SEQ ID NO: 914976 - protein, 9 aa, Mycobacterium
RKSLTLDPQ

SEQ ID NO: 914977 - protein, 6 aa, Mycobacterium
RKSPLH

SEQ ID NO: 914978 - protein, 11 aa, Mycobacterium
RKSTDGVPGYP

SEQ ID NO: 914979 - protein, 7 aa, Mycobacterium
RKTSPQS

SEQ ID NO: 914980 - protein, 7 aa, Mycobacterium
RKTSSVE

SEQ ID NO: 914981 - protein, 14 aa, Mycobacterium
RKVEQTAATCPSTK

SEQ ID NO: 914982 - protein, 6 aa, Mycobacterium
RKVGGV

SEQ ID NO: 914983 - protein, 8 aa, Mycobacterium
RKVLPGPD

SEQ ID NO: 914984 - protein, 17 aa, Mycobacterium
RKYDAAASGISVTPERE

SEQ ID NO: 914985 - protein, 12 aa, Mycobacterium
RKYRTDTARSTR

SEQ ID NO: 914986 - protein, 11 aa, Mycobacterium
RLAAQNPAQLS

SEQ ID NO: 914987 - protein, 15 aa, Mycobacterium
RLADPASPLAEVRVG

SEQ ID NO: 914988 - protein, 4 aa, Mycobacterium
RLAG

SEQ ID NO: 914989 - protein, 11 aa, Mycobacterium
RLAGDTDKTIA

SEQ ID NO: 914990 - protein, 20 aa, Mycobacterium
RLAPGGEGPKPGPPELPPAV

SEQ ID NO: 914991 - protein, 20 aa, Mycobacterium
RLAPGGEGPKPTAPEIPPAV

SEQ ID NO: 914992 - protein, 13 aa, Mycobacterium
RLAPNGDVSPPIR

SEQ ID NO: 914993 - protein, 6 aa, Mycobacterium
RLASRG

SEQ ID NO: 914994 - protein, 10 aa, Mycobacterium
RLATRTSTVP

SEQ ID NO: 914995 - protein, 5 aa, Mycobacterium
RLDGQ

SEQ ID NO: 914996 - protein, 4 aa, Mycobacterium
RLDT

SEQ ID NO: 914997 - protein, 12 aa, Mycobacterium
RLEGRPAGDMPD

SEQ ID NO: 914998 - protein, 10 aa, Mycobacterium
RLEKRSTTIL

SEQ ID NO: 914999 - protein, 7 aa, Mycobacterium
RLGERDG

SEQ ID NO: 915000 - protein, 26 aa, Mycobacterium
RLGERVPPPTVVDPTPAATHEAGNGC

SEQ ID NO: 915001 - protein, 6 aa, Mycobacterium
RLGGAR

SEQ ID NO: 915002 - protein, 8 aa, Mycobacterium
RLGGPRTA

SEQ ID NO: 915003 - protein, 12 aa, Mycobacterium
RLGPGPGRARAT

SEQ ID NO: 915004 - protein, 6 aa, Mycobacterium
RLGSGR

SEQ ID NO: 915005 - protein, 6 aa, Mycobacterium
RLGYEQ

SEQ ID NO: 915006 - protein, 14 aa, Mycobacterium
RLHQPQRASAMPAS

SEQ ID NO: 915007 - protein, 8 aa, Mycobacterium
RLNGSRNP

SEQ ID NO: 915008 - protein, 38 aa, Mycobacterium
RLNPATEDAIAGADGTAEGGKFTKGDPGAARDALGGAP

SEQ ID NO: 915009 - protein, 16 aa, Mycobacterium
RLPDDGPVMTLMWRRP

SEQ ID NO: 915010 - protein, 6 aa, Mycobacterium
RLPGDA

SEQ ID NO: 915011 - protein, 8 aa, Mycobacterium
RLPGNIDE

SEQ ID NO: 915012 - protein, 5 aa, Mycobacterium
RLPNQ

SEQ ID NO: 915013 - protein, 5 aa, Mycobacterium
RLPQN

SEQ ID NO: 915014 - protein, 10 aa, Mycobacterium
RLPTGASEAV

SEQ ID NO: 915015 - protein, 10 aa, Mycobacterium
RLRPDSVGLP

SEQ ID NO: 915016 - protein, 5 aa, Mycobacterium
RLRTG

SEQ ID NO: 915017 - protein, 5 aa, Mycobacterium
RLSAP

SEQ ID NO: 915018 - protein, 14 aa, Mycobacterium
RLSATTNPADAVAN

SEQ ID NO: 915019 - protein, 6 aa, Mycobacterium
RLSDGD

SEQ ID NO: 915020 - protein, 19 aa, Mycobacterium
RLSERGSELASAAEKGRHQ

SEQ ID NO: 915021 - protein, 7 aa, Mycobacterium
RLSETGD

SEQ ID NO: 915022 - protein, 12 aa, Mycobacterium
RLSGRIDERRPF

SEQ ID NO: 915023 - protein, 11 aa, Mycobacterium
RLSHPAATTVE

SEQ ID NO: 915024 - protein, 38 aa, Mycobacterium
RLSPALDDPVTASVGAAEAGPFGKADPGAARDALGGAP

SEQ ID NO: 915025 - protein, 10 aa, Mycobacterium
RLSPASEDAF

SEQ ID NO: 915026 - protein, 8 aa, Mycobacterium
RLSPRGSE

SEQ ID NO: 915027 - protein, 9 aa, Mycobacterium
RLSQAADQY

SEQ ID NO: 915028 - protein, 18 aa, Mycobacterium
RLSQPEQKAVAGPVEPDR

SEQ ID NO: 915029 - protein, 8 aa, Mycobacterium
RLSSRSRR

SEQ ID NO: 915030 - protein, 7 aa, Mycobacterium
RLSSSTL

SEQ ID NO: 915031 - protein, 13 aa, Mycobacterium
RLSTEEAVGYAQR

SEQ ID NO: 915032 - protein, 10 aa, Mycobacterium
RLTDGQGRTV

SEQ ID NO: 915033 - protein, 7 aa, Mycobacterium
RLTEPGG

SEQ ID NO: 915034 - protein, 5 aa, Mycobacterium
RLTND

SEQ ID NO: 915035 - protein, 4 aa, Mycobacterium
RLTP

SEQ ID NO: 915036 - protein, 10 aa, Mycobacterium
RLTRGKSDIP

SEQ ID NO: 915037 - protein, 5 aa, Mycobacterium
RLTSD

SEQ ID NO: 915038 - protein, 4 aa, Mycobacterium
RMDG

SEQ ID NO: 915039 - protein, 6 aa, Mycobacterium
RMEEET

SEQ ID NO: 915040 - protein, 8 aa, Mycobacterium
RMEQDSKD

SEQ ID NO: 915041 - protein, 11 aa, Mycobacterium
RMESTDVEGRI

SEQ ID NO: 915042 - protein, 9 aa, Mycobacterium
RMPDEGEPH

SEQ ID NO: 915043 - protein, 14 aa, Mycobacterium
RMPPRGLTEAASQY

SEQ ID NO: 915044 - protein, 12 aa, Mycobacterium
RMPTASAAPVDD

SEQ ID NO: 915045 - protein, 7 aa, Mycobacterium
RNAADDG

SEQ ID NO: 915046 - protein, 40 aa, Mycobacterium
RNADPGKASGAELRRPNGEAIYQDDDAQSVDAELAEGPDK

SEQ ID NO: 915047 - protein, 13 aa, Mycobacterium
RNAEQKMATAAPA

SEQ ID NO: 915048 - protein, 8 aa, Mycobacterium
RNAERAER

SEQ ID NO: 915049 - protein, 16 aa, Mycobacterium
RNAPGVATATPPPKFP

SEQ ID NO: 915050 - protein, 7 aa, Mycobacterium
RNAPPIT

SEQ ID NO: 915051 - protein, 6 aa, Mycobacterium
RNAQRS

SEQ ID NO: 915052 - protein, 13 aa, Mycobacterium
RNARGADRQGTSM

SEQ ID NO: 915053 - protein, 4 aa, Mycobacterium
RNAT

SEQ ID NO: 915054 - protein, 17 aa, Mycobacterium
RNATIPAGGEQDPCFAN

SEQ ID NO: 915055 - protein, 12 aa, Mycobacterium
RNATPVTTRVQL

SEQ ID NO: 915056 - protein, 5 aa, Mycobacterium
RNCPN

SEQ ID NO: 915057 - protein, 11 aa, Mycobacterium
RNDAGGSIESH

SEQ ID NO: 915058 - protein, 10 aa, Mycobacterium
RNDAGRDGVR

SEQ ID NO: 915059 - protein, 8 aa, Mycobacterium
RNDEGVDP

SEQ ID NO: 915060 - protein, 8 aa, Mycobacterium
RNDEPIDP

SEQ ID NO: 915061 - protein, 5 aa, Mycobacterium
RNDFE

SEQ ID NO: 915062 - protein, 6 aa, Mycobacterium
RNDFRG

SEQ ID NO: 915063 - protein, 9 aa, Mycobacterium
RNDGSAKLV

SEQ ID NO: 915064 - protein, 11 aa, Mycobacterium
RNDKPGDSRPY

SEQ ID NO: 915065 - protein, 6 aa, Mycobacterium
RNDPIR

SEQ ID NO: 915066 - protein, 21 aa, Mycobacterium
RNDPPRTPALTAASAPEPVAA

SEQ ID NO: 915067 - protein, 7 aa, Mycobacterium
RNDPTVQ

SEQ ID NO: 915068 - protein, 6 aa, Mycobacterium
RNDQGI

SEQ ID NO: 915069 - protein, 7 aa, Mycobacterium
RNEDGTN

SEQ ID NO: 915070 - protein, 6 aa, Mycobacterium
RNEKRD

SEQ ID NO: 915071 - protein, 7 aa, Mycobacterium
RNEKRDL

SEQ ID NO: 915072 - protein, 16 aa, Mycobacterium
RNERTRAVLAALRQLD

SEQ ID NO: 915073 - protein, 4 aa, Mycobacterium
RNET

SEQ ID NO: 915074 - protein, 4 aa, Mycobacterium
RNFQ

SEQ ID NO: 915075 - protein, 5 aa, Mycobacterium
RNGDR

SEQ ID NO: 915076 - protein, 13 aa, Mycobacterium
RNGDVESNRVDPD

SEQ ID NO: 915077 - protein, 21 aa, Mycobacterium
RNGETPEQVASHSNYPNATPA

SEQ ID NO: 915078 - protein, 6 aa, Mycobacterium
RNGGDF

SEQ ID NO: 915079 - protein, 8 aa, Mycobacterium
RNGKEVGV

SEQ ID NO: 915080 - protein, 6 aa, Mycobacterium
RNGNEV

SEQ ID NO: 915081 - protein, 8 aa, Mycobacterium
RNGVSDHS

SEQ ID NO: 915082 - protein, 8 aa, Mycobacterium
RNKLTENG

SEQ ID NO: 915083 - protein, 5 aa, Mycobacterium
RNLAD

SEQ ID NO: 915084 - protein, 7 aa, Mycobacterium
RNLRTED

SEQ ID NO: 915085 - protein, 29 aa, Mycobacterium
RNNFQGTHSRCAGDGQSGAMLRRRLGWRR

SEQ ID NO: 915086 - protein, 6 aa, Mycobacterium
RNNHAD

SEQ ID NO: 915087 - protein, 4 aa, Mycobacterium
RNNL

SEQ ID NO: 915088 - protein, 8 aa, Mycobacterium
RNPDLGTR

SEQ ID NO: 915089 - protein, 8 aa, Mycobacterium
RNPDPFPR

SEQ ID NO: 915090 - protein, 13 aa, Mycobacterium
RNPEHNFSASSLM

SEQ ID NO: 915091 - protein, 4 aa, Mycobacterium
RNPH

SEQ ID NO: 915092 - protein, 20 aa, Mycobacterium
RNPIGNGPYRLDSGGEEPAW

SEQ ID NO: 915093 - protein, 9 aa, Mycobacterium
RNPPSTKTL

SEQ ID NO: 915094 - protein, 6 aa, Mycobacterium
RNPQQV

SEQ ID NO: 915095 - protein, 7 aa, Mycobacterium
RNPQTQT

SEQ ID NO: 915096 - protein, 7 aa, Mycobacterium
RNPQWKG

SEQ ID NO: 915097 - protein, 7 aa, Mycobacterium
RNPRERT

SEQ ID NO: 915098 - protein, 16 aa, Mycobacterium
RNPRNGDPHVTGSVTP

SEQ ID NO: 915099 - protein, 6 aa, Mycobacterium
RNPTRW

SEQ ID NO: 915100 - protein, 7 aa, Mycobacterium
RNQASVD

SEQ ID NO: 915101 - protein, 5 aa, Mycobacterium
RNRAE

SEQ ID NO: 915102 - protein, 5 aa, Mycobacterium
RNRGE

SEQ ID NO: 915103 - protein, 7 aa, Mycobacterium
RNRYSGR

SEQ ID NO: 915104 - protein, 9 aa, Mycobacterium
RNSGGPPLT

SEQ ID NO: 915105 - protein, 8 aa, Mycobacterium
RNSKGADM

SEQ ID NO: 915106 - protein, 6 aa, Mycobacterium
RNSSTG

SEQ ID NO: 915107 - protein, 6 aa, Mycobacterium
RNSYMT

SEQ ID NO: 915108 - protein, 9 aa, Mycobacterium
RNTADEDAV

SEQ ID NO: 915109 - protein, 23 aa, Mycobacterium
RNTDPAKTSGAELRRPSGEPIYQ

SEQ ID NO: 915110 - protein, 9 aa, Mycobacterium
RNTEDAPAS

SEQ ID NO: 915111 - protein, 12 aa, Mycobacterium
RNTGELVTNGND

SEQ ID NO: 915112 - protein, 9 aa, Mycobacterium
RNTKGQIRS

SEQ ID NO: 915113 - protein, 18 aa, Mycobacterium
RNTLRRQRTELTDQPEGS

SEQ ID NO: 915114 - protein, 9 aa, Mycobacterium
RNTTGDQSI

SEQ ID NO: 915115 - protein, 9 aa, Mycobacterium
RNVSTTGNG

SEQ ID NO: 915116 - protein, 14 aa, Mycobacterium
RNVTKSDSGACGVN

SEQ ID NO: 915117 - protein, 4 aa, Mycobacterium
RPAA

SEQ ID NO: 915118 - protein, 6 aa, Mycobacterium
RPAAFP

SEQ ID NO: 915119 - protein, 7 aa, Mycobacterium
RPAAPGC

SEQ ID NO: 915120 - protein, 13 aa, Mycobacterium
RPADPADVPPGFG

SEQ ID NO: 915121 - protein, 11 aa, Mycobacterium
RPADPAEIPEG

SEQ ID NO: 915122 - protein, 13 aa, Mycobacterium
RPADSQPGNPAAF

SEQ ID NO: 915123 - protein, 14 aa, Mycobacterium
RPAGEAQGGQPVTA

SEQ ID NO: 915124 - protein, 7 aa, Mycobacterium
RPAHTEA

SEQ ID NO: 915125 - protein, 17 aa, Mycobacterium
RPALETDRAAARPAGRV

SEQ ID NO: 915126 - protein, 46 aa, Mycobacterium
RPALPNPPEPGSPNNLQDQQAAAVAPAPPAPAVGPAADAAVSPTTS

SEQ ID NO: 915127 - protein, 6 aa, Mycobacterium
RPAPLP

SEQ ID NO: 915128 - protein, 21 aa, Mycobacterium
RPAPSPGGIEPTQGEPISSER

SEQ ID NO: 915129 - protein, 8 aa, Mycobacterium
RPATDPER

SEQ ID NO: 915130 - protein, 6 aa, Mycobacterium
RPATKE

SEQ ID NO: 915131 - protein, 6 aa, Mycobacterium
RPATQP

SEQ ID NO: 915132 - protein, 7 aa, Mycobacterium
RPDAAAL

SEQ ID NO: 915133 - protein, 10 aa, Mycobacterium
RPDAQPGGGA

SEQ ID NO: 915134 - protein, 4 aa, Mycobacterium
RPDD

SEQ ID NO: 915135 - protein, 8 aa, Mycobacterium
RPDDPQFA

SEQ ID NO: 915136 - protein, 10 aa, Mycobacterium
RPDEQAAQHA

SEQ ID NO: 915137 - protein, 6 aa, Mycobacterium
RPDGTK

SEQ ID NO: 915138 - protein, 4 aa, Mycobacterium
RPDL

SEQ ID NO: 915139 - protein, 7 aa, Mycobacterium
RPDLETV

SEQ ID NO: 915140 - protein, 20 aa, Mycobacterium
RPDLTGAIGDAGRFAPSEEQ

SEQ ID NO: 915141 - protein, 14 aa, Mycobacterium
RPDNDEPLYRGPKV

SEQ ID NO: 915142 - protein, 15 aa, Mycobacterium
RPDNEDPLYRGPKVP

SEQ ID NO: 915143 - protein, 9 aa, Mycobacterium
RPDPADDRA

SEQ ID NO: 915144 - protein, 9 aa, Mycobacterium
RPDPGGDEV

SEQ ID NO: 915145 - protein, 5 aa, Mycobacterium
RPDSA

SEQ ID NO: 915146 - protein, 5 aa, Mycobacterium
RPDSL

SEQ ID NO: 915147 - protein, 5 aa, Mycobacterium
RPDYR

SEQ ID NO: 915148 - protein, 20 aa, Mycobacterium
RPEAAGSNESGRPIVEQAGR

SEQ ID NO: 915149 - protein, 10 aa, Mycobacterium
RPEATAEAFD

SEQ ID NO: 915150 - protein, 15 aa, Mycobacterium
RPEDRRAHALPDEQF

SEQ ID NO: 915151 - protein, 5 aa, Mycobacterium
RPEKV

SEQ ID NO: 915152 - protein, 20 aa, Mycobacterium
RPELPGGQPGGGRSLSAGPF

SEQ ID NO: 915153 - protein, 28 aa, Mycobacterium
RPENAAPTAPAPKNKDDKNKPDLGYRPA

SEQ ID NO: 915154 - protein, 4 aa, Mycobacterium
RPEP

SEQ ID NO: 915155 - protein, 5 aa, Mycobacterium
RPERD

SEQ ID NO: 915156 - protein, 14 aa, Mycobacterium
RPETELDAPGDPTM

SEQ ID NO: 915157 - protein, 6 aa, Mycobacterium
RPFDKD

SEQ ID NO: 915158 - protein, 4 aa, Mycobacterium
RPFE

SEQ ID NO: 915159 - protein, 8 aa, Mycobacterium
RPFGEQSA

SEQ ID NO: 915160 - protein, 12 aa, Mycobacterium
RPFGEQSAGPAR

SEQ ID NO: 915161 - protein, 20 aa, Mycobacterium
RPFPPPDQIPDITGGLGAAG

SEQ ID NO: 915162 - protein, 12 aa, Mycobacterium
RPFSNKEEAEAA

SEQ ID NO: 915163 - protein, 4 aa, Mycobacterium
RPGA

SEQ ID NO: 915164 - protein, 10 aa, Mycobacterium
RPGAMPPPAN

SEQ ID NO: 915165 - protein, 6 aa, Mycobacterium
RPGAPV

SEQ ID NO: 915166 - protein, 7 aa, Mycobacterium
RPGAQYT

SEQ ID NO: 915167 - protein, 12 aa, Mycobacterium
RPGATSDPRGLS

SEQ ID NO: 915168 - protein, 33 aa, Mycobacterium
RPGATYTATGRGCASKGNPPQKYCQEVGPFTAT

SEQ ID NO: 915169 - protein, 11 aa, Mycobacterium
RPGAVAGAQVP

SEQ ID NO: 915170 - protein, 17 aa, Mycobacterium
RPGESDGACNGHPSAGT

SEQ ID NO: 915171 - protein, 17 aa, Mycobacterium
RPGESDGACRGAPSAGT

SEQ ID NO: 915172 - protein, 18 aa, Mycobacterium
RPGESDGSCDRGDPRAGT

SEQ ID NO: 915173 - protein, 8 aa, Mycobacterium
RPGGPGTA

SEQ ID NO: 915174 - protein, 7 aa, Mycobacterium
RPGGQAQ

SEQ ID NO: 915175 - protein, 8 aa, Mycobacterium
RPGGQSQF

SEQ ID NO: 915176 - protein, 4 aa, Mycobacterium
RPGI

SEQ ID NO: 915177 - protein, 7 aa, Mycobacterium
RPGITPE

SEQ ID NO: 915178 - protein, 12 aa, Mycobacterium
RPGKATASPSVA

SEQ ID NO: 915179 - protein, 8 aa, Mycobacterium
RPGKRAPT

SEQ ID NO: 915180 - protein, 9 aa, Mycobacterium
RPGNPKNIR

SEQ ID NO: 915181 - protein, 8 aa, Mycobacterium
RPGNYSEQ

SEQ ID NO: 915182 - protein, 4 aa, Mycobacterium
RPGP

SEQ ID NO: 915183 - protein, 9 aa, Mycobacterium
RPGPAENAY

SEQ ID NO: 915184 - protein, 11 aa, Mycobacterium
RPGPFGVGGPD

SEQ ID NO: 915185 - protein, 16 aa, Mycobacterium
RPGPLESRSTELEDKY

SEQ ID NO: 915186 - protein, 7 aa, Mycobacterium
RPGPYAR

SEQ ID NO: 915187 - protein, 14 aa, Mycobacterium
RPGPYARSHEAGRS

SEQ ID NO: 915188 - protein, 15 aa, Mycobacterium
RPGPYARSHESGRSV

SEQ ID NO: 915189 - protein, 20 aa, Mycobacterium
RPGQTFSRTDSSVPGGRDTV

SEQ ID NO: 915190 - protein, 14 aa, Mycobacterium
RPGQYARSHESGRS

SEQ ID NO: 915191 - protein, 5 aa, Mycobacterium
RPGSA

SEQ ID NO: 915192 - protein, 6 aa, Mycobacterium
RPGTTT

SEQ ID NO: 915193 - protein, 10 aa, Mycobacterium
RPGTTTIGTS

SEQ ID NO: 915194 - protein, 11 aa, Mycobacterium
RPGTYRSQGGN

SEQ ID NO: 915195 - protein, 5 aa, Mycobacterium
RPGVR

SEQ ID NO: 915196 - protein, 13 aa, Mycobacterium
RPGVTAEQVDAAA

SEQ ID NO: 915197 - protein, 12 aa, Mycobacterium
RPHSPVTEPRVG

SEQ ID NO: 915198 - protein, 9 aa, Mycobacterium
RPHSQPGTR

SEQ ID NO: 915199 - protein, 8 aa, Mycobacterium
RPKDGGFS

SEQ ID NO: 915200 - protein, 5 aa, Mycobacterium
RPKEG

SEQ ID NO: 915201 - protein, 30 aa, Mycobacterium
RPKNKPAVGRLTDGSKITEANTGRYPTTEE

SEQ ID NO: 915202 - protein, 6 aa, Mycobacterium
RPKPAN

SEQ ID NO: 915203 - protein, 8 aa, Mycobacterium
RPKPSAPA

SEQ ID NO: 915204 - protein, 15 aa, Mycobacterium
RPKTAAPPGSRQDPL

SEQ ID NO: 915205 - protein, 14 aa, Mycobacterium
RPKTPARPGQRQDP

SEQ ID NO: 915206 - protein, 6 aa, Mycobacterium
RPLAER

SEQ ID NO: 915207 - protein, 6 aa, Mycobacterium
RPLAGP

SEQ ID NO: 915208 - protein, 4 aa, Mycobacterium
RPLD

SEQ ID NO: 915209 - protein, 10 aa, Mycobacterium
RPLEQGEGDS

SEQ ID NO: 915210 - protein, 9 aa, Mycobacterium
RPLGGQAQS

SEQ ID NO: 915211 - protein, 9 aa, Mycobacterium
RPLPGGLNG

SEQ ID NO: 915212 - protein, 5 aa, Mycobacterium
RPLSA

SEQ ID NO: 915213 - protein, 5 aa, Mycobacterium
RPLSP

SEQ ID NO: 915214 - protein, 63 aa, Mycobacterium
RPLTTPDVPGGAAPNRPVAPPPAPGDPALAPAPAPLGAPAPAPAPEPAPVGAPAPVGAPVPPP

SEQ ID NO: 915215 - protein, 4 aa, Mycobacterium
RPMA

SEQ ID NO: 915216 - protein, 41 aa, Mycobacterium
RPMPSTPAFPPPAGPPPANGAPPPPVEVPPPVAPPPPPPPV

SEQ ID NO: 915217 - protein, 5 aa, Mycobacterium
RPMTD

SEQ ID NO: 915218 - protein, 8 aa, Mycobacterium
RPNPGIGF

SEQ ID NO: 915219 - protein, 15 aa, Mycobacterium
RPNPGYRGNRRPHNK

SEQ ID NO: 915220 - protein, 5 aa, Mycobacterium
RPNPN

SEQ ID NO: 915221 - protein, 8 aa, Mycobacterium
RPNSDQFD

SEQ ID NO: 915222 - protein, 5 aa, Mycobacterium
RPNTG

SEQ ID NO: 915223 - protein, 5 aa, Mycobacterium
RPNTT

SEQ ID NO: 915224 - protein, 4 aa, Mycobacterium
RPNY

SEQ ID NO: 915225 - protein, 17 aa, Mycobacterium
RPPAATPPAAPRGFPSD

SEQ ID NO: 915226 - protein, 19 aa, Mycobacterium
RPPALKSDGMSERDDCIPE

SEQ ID NO: 915227 - protein, 6 aa, Mycobacterium
RPPAQQ

SEQ ID NO: 915228 - protein, 15 aa, Mycobacterium
RPPATGQAGLLEPHR

SEQ ID NO: 915229 - protein, 5 aa, Mycobacterium
RPPAV

SEQ ID NO: 915230 - protein, 6 aa, Mycobacterium
RPPDAA

SEQ ID NO: 915231 - protein, 8 aa, Mycobacterium
RPPDGRPV

SEQ ID NO: 915232 - protein, 10 aa, Mycobacterium
RPPDPPAESA

SEQ ID NO: 915233 - protein, 8 aa, Mycobacterium
RPPEPKQI

SEQ ID NO: 915234 - protein, 8 aa, Mycobacterium
RPPGKESL

SEQ ID NO: 915235 - protein, 9 aa, Mycobacterium
RPPGQTAPL

SEQ ID NO: 915236 - protein, 9 aa, Mycobacterium
RPPGQTQPL

SEQ ID NO: 915237 - protein, 8 aa, Mycobacterium
RPPGRTEP

SEQ ID NO: 915238 - protein, 5 aa, Mycobacterium
RPPGV

SEQ ID NO: 915239 - protein, 8 aa, Mycobacterium
RPPGVTGP

SEQ ID NO: 915240 - protein, 8 aa, Mycobacterium
RPPLKRPG

SEQ ID NO: 915241 - protein, 6 aa, Mycobacterium
RPPPAI

SEQ ID NO: 915242 - protein, 6 aa, Mycobacterium
RPPPAV

SEQ ID NO: 915243 - protein, 25 aa, Mycobacterium
RPPPPPSAPPPPPPGDAPPPPPPPN

SEQ ID NO: 915244 - protein, 16 aa, Mycobacterium
RPPPSTHEQPSAQDTR

SEQ ID NO: 915245 - protein, 5 aa, Mycobacterium
RPPPV

SEQ ID NO: 915246 - protein, 9 aa, Mycobacterium
RPPRPGVDA

SEQ ID NO: 915247 - protein, 8 aa, Mycobacterium
RPPRSQAV

SEQ ID NO: 915248 - protein, 4 aa, Mycobacterium
RPPT

SEQ ID NO: 915249 - protein, 8 aa, Mycobacterium
RPPVTRTE

SEQ ID NO: 915250 - protein, 5 aa, Mycobacterium
RPPWG

SEQ ID NO: 915251 - protein, 4 aa, Mycobacterium
RPPY

SEQ ID NO: 915252 - protein, 20 aa, Mycobacterium
RPPYGKHNAATDSVTRGLGY

SEQ ID NO: 915253 - protein, 18 aa, Mycobacterium
RPQAQAHSDDGDIGRRTS

SEQ ID NO: 915254 - protein, 7 aa, Mycobacterium
RPQGRSS

SEQ ID NO: 915255 - protein, 7 aa, Mycobacterium
RPQPGLD

SEQ ID NO: 915256 - protein, 6 aa, Mycobacterium
RPQTYP

SEQ ID NO: 915257 - protein, 5 aa, Mycobacterium
RPRDD

SEQ ID NO: 915258 - protein, 5 aa, Mycobacterium
RPRDR

SEQ ID NO: 915259 - protein, 7 aa, Mycobacterium
RPREDTV

SEQ ID NO: 915260 - protein, 7 aa, Mycobacterium
RPRGSTI

SEQ ID NO: 915261 - protein, 7 aa, Mycobacterium
RPRGTSW

SEQ ID NO: 915262 - protein, 40 aa, Mycobacterium
RPRSPASGRSTTLSTTTGPGASTGWSSTVASTSTRCRVDR

SEQ ID NO: 915263 - protein, 4 aa, Mycobacterium
RPRT

SEQ ID NO: 915264 - protein, 6 aa, Mycobacterium
RPSARL

SEQ ID NO: 915265 - protein, 7 aa, Mycobacterium
RPSATTD

SEQ ID NO: 915266 - protein, 9 aa, Mycobacterium
RPSGQDIDP

SEQ ID NO: 915267 - protein, 6 aa, Mycobacterium
RPSPRL

SEQ ID NO: 915268 - protein, 4 aa, Mycobacterium
RPSR

SEQ ID NO: 915269 - protein, 6 aa, Mycobacterium
RPSVNA

SEQ ID NO: 915270 - protein, 14 aa, Mycobacterium
RPTAVQGDTTPISP

SEQ ID NO: 915271 - protein, 5 aa, Mycobacterium
RPTMA

SEQ ID NO: 915272 - protein, 5 aa, Mycobacterium
RPTPG

SEQ ID NO: 915273 - protein, 5 aa, Mycobacterium
RPTPN

SEQ ID NO: 915274 - protein, 7 aa, Mycobacterium
RPTPRGY

SEQ ID NO: 915275 - protein, 5 aa, Mycobacterium
RPTQA

SEQ ID NO: 915276 - protein, 9 aa, Mycobacterium
RPTQPPSIS

SEQ ID NO: 915277 - protein, 9 aa, Mycobacterium
RPTRSPEVT

SEQ ID NO: 915278 - protein, 30 aa, Mycobacterium
RPTSQAPSAGERSEQTSLPGQRSSPPGNQA

SEQ ID NO: 915279 - protein, 7 aa, Mycobacterium
RPTSVDE

SEQ ID NO: 915280 - protein, 14 aa, Mycobacterium
RPVATDGGHWTSED

SEQ ID NO: 915281 - protein, 8 aa, Mycobacterium
RPVEGSPH

SEQ ID NO: 915282 - protein, 6 aa, Mycobacterium
RPVGDA

SEQ ID NO: 915283 - protein, 13 aa, Mycobacterium
RPVPDPTSPTGSR

SEQ ID NO: 915284 - protein, 14 aa, Mycobacterium
RPVSTTGEAGNQNT

SEQ ID NO: 915285 - protein, 35 aa, Mycobacterium
RPWSADEQRQIQEQYPERRRASAYASAGTPHGSYH

SEQ ID NO: 915286 - protein, 7 aa, Mycobacterium
RPWSDPE

SEQ ID NO: 915287 - protein, 10 aa, Mycobacterium
RPWSEGPKFA

SEQ ID NO: 915288 - protein, 34 aa, Mycobacterium
RPWTPEEQRQIREQYPERRRASAYAAAGTPHGTY

SEQ ID NO: 915289 - protein, 7 aa, Mycobacterium
RQAAADP

SEQ ID NO: 915290 - protein, 5 aa, Mycobacterium
RQAAS

SEQ ID NO: 915291 - protein, 11 aa, Mycobacterium
RQADAVSTDDS

SEQ ID NO: 915292 - protein, 6 aa, Mycobacterium
RQADPG

SEQ ID NO: 915293 - protein, 7 aa, Mycobacterium
RQAKAGV

SEQ ID NO: 915294 - protein, 17 aa, Mycobacterium
RQANDGKCGKPKPPGQG

SEQ ID NO: 915295 - protein, 20 aa, Mycobacterium
RQASAAAAAPTAAVQPAGGD

SEQ ID NO: 915296 - protein, 7 aa, Mycobacterium
RQASENS

SEQ ID NO: 915297 - protein, 8 aa, Mycobacterium
RQASPGHA

SEQ ID NO: 915298 - protein, 18 aa, Mycobacterium
RQATAEPATDILRRLASD

SEQ ID NO: 915299 - protein, 8 aa, Mycobacterium
RQATVDKM

SEQ ID NO: 915300 - protein, 8 aa, Mycobacterium
RQDAGAYD

SEQ ID NO: 915301 - protein, 9 aa, Mycobacterium
RQDDAIDPK

SEQ ID NO: 915302 - protein, 7 aa, Mycobacterium
RQDPRLT

SEQ ID NO: 915303 - protein, 4 aa, Mycobacterium
RQDQ

SEQ ID NO: 915304 - protein, 12 aa, Mycobacterium
RQDRTGADPTPS

SEQ ID NO: 915305 - protein, 11 aa, Mycobacterium
RQEGEVDETGA

SEQ ID NO: 915306 - protein, 19 aa, Mycobacterium
RQENLDAAENAEQTVGSTQ

SEQ ID NO: 915307 - protein, 5 aa, Mycobacterium
RQGAT

SEQ ID NO: 915308 - protein, 7 aa, Mycobacterium
RQGELDV

SEQ ID NO: 915309 - protein, 9 aa, Mycobacterium
RQGEQAPGV

SEQ ID NO: 915310 - protein, 6 aa, Mycobacterium
RQGFQG

SEQ ID NO: 915311 - protein, 8 aa, Mycobacterium
RQGGPGTV

SEQ ID NO: 915312 - protein, 6 aa, Mycobacterium
RQGGPI

SEQ ID NO: 915313 - protein, 7 aa, Mycobacterium
RQGLGGD

SEQ ID NO: 915314 - protein, 7 aa, Mycobacterium
RQGNEYL

SEQ ID NO: 915315 - protein, 7 aa, Mycobacterium
RQGQKAT

SEQ ID NO: 915316 - protein, 5 aa, Mycobacterium
RQGSG

SEQ ID NO: 915317 - protein, 10 aa, Mycobacterium
RQLDDTTDMK

SEQ ID NO: 915318 - protein, 16 aa, Mycobacterium
RQLDDTTDMKTNKVNP

SEQ ID NO: 915319 - protein, 10 aa, Mycobacterium
RQLSSPAISG

SEQ ID NO: 915320 - protein, 7 aa, Mycobacterium
RQNDSTA

SEQ ID NO: 915321 - protein, 5 aa, Mycobacterium
RQNER

SEQ ID NO: 915322 - protein, 4 aa, Mycobacterium
RQNG

SEQ ID NO: 915323 - protein, 10 aa, Mycobacterium
RQPAAPGKHI

SEQ ID NO: 915324 - protein, 9 aa, Mycobacterium
RQPALSEAP

SEQ ID NO: 915325 - protein, 5 aa, Mycobacterium
RQPDG

SEQ ID NO: 915326 - protein, 7 aa, Mycobacterium
RQPDGTL

SEQ ID NO: 915327 - protein, 48 aa, Mycobacterium
RQPEPTASGNTPAATSTATAPTGTAAVSPAPAAPPATPTTPAPRPFAD

SEQ ID NO: 915328 - protein, 4 aa, Mycobacterium
RQPG

SEQ ID NO: 915329 - protein, 8 aa, Mycobacterium
RQPGARPV

SEQ ID NO: 915330 - protein, 58 aa, Mycobacterium
RQPGRSGTDATAGSQVTDPRKPTVDDPDTPATAPPEEPDSSPLPVHSPTAPDVPSETR

SEQ ID NO: 915331 - protein, 12 aa, Mycobacterium
RQPKPRQYAQPV

SEQ ID NO: 915332 - protein, 17 aa, Mycobacterium
RQPPGPASEATERVARG

SEQ ID NO: 915333 - protein, 6 aa, Mycobacterium
RQPRGD

SEQ ID NO: 915334 - protein, 6 aa, Mycobacterium
RQPRGP

SEQ ID NO: 915335 - protein, 8 aa, Mycobacterium
RQPSAPVT

SEQ ID NO: 915336 - protein, 10 aa, Mycobacterium
RQPTGEIGTT

SEQ ID NO: 915337 - protein, 16 aa, Mycobacterium
RQPTSGSVTVNAGGTV

SEQ ID NO: 915338 - protein, 6 aa, Mycobacterium
RQPTTD

SEQ ID NO: 915339 - protein, 13 aa, Mycobacterium
RQQAAGPGAVPDR

SEQ ID NO: 915340 - protein, 8 aa, Mycobacterium
RQQASTEW

SEQ ID NO: 915341 - protein, 8 aa, Mycobacterium
RQQDKDEN

SEQ ID NO: 915342 - protein, 25 aa, Mycobacterium
RQQQADKPSDDVAKAEGAKVDARRA

SEQ ID NO: 915343 - protein, 4 aa, Mycobacterium
RQQT

SEQ ID NO: 915344 - protein, 6 aa, Mycobacterium
RQQTGG

SEQ ID NO: 915345 - protein, 5 aa, Mycobacterium
RQQTN

SEQ ID NO: 915346 - protein, 10 aa, Mycobacterium
RQREETRQGG

SEQ ID NO: 915347 - protein, 10 aa, Mycobacterium
RQRRQDDAID

SEQ ID NO: 915348 - protein, 12 aa, Mycobacterium
RQRRQDDAIDPR

SEQ ID NO: 915349 - protein, 14 aa, Mycobacterium
RQRTGVGLTICDAS

SEQ ID NO: 915350 - protein, 23 aa, Mycobacterium
RQRYRTSGVPSAADLRSALKPLL

SEQ ID NO: 915351 - protein, 8 aa, Mycobacterium
RQSAEDAN

SEQ ID NO: 915352 - protein, 16 aa, Mycobacterium
RQSASSRGRTLTAPRS

SEQ ID NO: 915353 - protein, 12 aa, Mycobacterium
RQSCDACDDGTL

SEQ ID NO: 915354 - protein, 6 aa, Mycobacterium
RQSDAT

SEQ ID NO: 915355 - protein, 9 aa, Mycobacterium
RQSETRPEI

SEQ ID NO: 915356 - protein, 7 aa, Mycobacterium
RQSLTGP

SEQ ID NO: 915357 - protein, 9 aa, Mycobacterium
RQSRPVGAG

SEQ ID NO: 915358 - protein, 10 aa, Mycobacterium
RQVKPTGSAA

SEQ ID NO: 915359 - protein, 25 aa, Mycobacterium
RQVPTGRGGTKDCQAGGTSTEDGLS

SEQ ID NO: 915360 - protein, 16 aa, Mycobacterium
RQVTGGSATVVQAAGA

SEQ ID NO: 915361 - protein, 4 aa, Mycobacterium
RRAD

SEQ ID NO: 915362 - protein, 5 aa, Mycobacterium
RRADE

SEQ ID NO: 915363 - protein, 7 aa, Mycobacterium
RRADGRW

SEQ ID NO: 915364 - protein, 5 aa, Mycobacterium
RRAER

SEQ ID NO: 915365 - protein, 4 aa, Mycobacterium
RRAG

SEQ ID NO: 915366 - protein, 11 aa, Mycobacterium
RRAGEDVAAGT

SEQ ID NO: 915367 - protein, 7 aa, Mycobacterium
RRAGQSL

SEQ ID NO: 915368 - protein, 10 aa, Mycobacterium
RRAGRPEDIA

SEQ ID NO: 915369 - protein, 8 aa, Mycobacterium
RRAPRGDE

SEQ ID NO: 915370 - protein, 15 aa, Mycobacterium
RRARAGVADPNRPTG

SEQ ID NO: 915371 - protein, 8 aa, Mycobacterium
RRARGETV

SEQ ID NO: 915372 - protein, 8 aa, Mycobacterium
RRARGGVT

SEQ ID NO: 915373 - protein, 9 aa, Mycobacterium
RRARPPQLV

SEQ ID NO: 915374 - protein, 11 aa, Mycobacterium
RRATAGNQSSM

SEQ ID NO: 915375 - protein, 5 aa, Mycobacterium
RRATG

SEQ ID NO: 915376 - protein, 17 aa, Mycobacterium
RRDAPSAKNPAPQPSAF

SEQ ID NO: 915377 - protein, 6 aa, Mycobacterium
RRDATM

SEQ ID NO: 915378 - protein, 17 aa, Mycobacterium
RRDDWSDPGVQQAGATV

SEQ ID NO: 915379 - protein, 18 aa, Mycobacterium
RRDDYDWAPEGSKHSGKA

SEQ ID NO: 915380 - protein, 7 aa, Mycobacterium
RRDEHGY

SEQ ID NO: 915381 - protein, 17 aa, Mycobacterium
RRDGGHPINDSAEVQRV

SEQ ID NO: 915382 - protein, 16 aa, Mycobacterium
RRDGRSSQSNSQDPSP

SEQ ID NO: 915383 - protein, 4 aa, Mycobacterium
RRDP

SEQ ID NO: 915384 - protein, 18 aa, Mycobacterium
RRDRTSRVQRNARQSGRV

SEQ ID NO: 915385 - protein, 29 aa, Mycobacterium
RRDSGAPLDGNNEFDTPNYAADADGKTIP

SEQ ID NO: 915386 - protein, 10 aa, Mycobacterium
RREATGSTVR

SEQ ID NO: 915387 - protein, 4 aa, Mycobacterium
RREE

SEQ ID NO: 915388 - protein, 4 aa, Mycobacterium
RREN

SEQ ID NO: 915389 - protein, 22 aa, Mycobacterium
RRESSANSDSNTTQRRPRRPRR

SEQ ID NO: 915390 - protein, 4 aa, Mycobacterium
RRFG

SEQ ID NO: 915391 - protein, 4 aa, Mycobacterium
RRFR

SEQ ID NO: 915392 - protein, 10 aa, Mycobacterium
RRGARTNDYH

SEQ ID NO: 915393 - protein, 11 aa, Mycobacterium
RRGASIPGEDV

SEQ ID NO: 915394 - protein, 5 aa, Mycobacterium
RRGDD

SEQ ID NO: 915395 - protein, 5 aa, Mycobacterium
RRGDE

SEQ ID NO: 915396 - protein, 5 aa, Mycobacterium
RRGDI

SEQ ID NO: 915397 - protein, 18 aa, Mycobacterium
RRGDVGRAAAEALLTAAG

SEQ ID NO: 915398 - protein, 7 aa, Mycobacterium
RRGGDGL

SEQ ID NO: 915399 - protein, 6 aa, Mycobacterium
RRGGKP

SEQ ID NO: 915400 - protein, 11 aa, Mycobacterium
RRGGPGAAIGL

SEQ ID NO: 915401 - protein, 7 aa, Mycobacterium
RRGGTIT

SEQ ID NO: 915402 - protein, 5 aa, Mycobacterium
RRGIP

SEQ ID NO: 915403 - protein, 6 aa, Mycobacterium
RRGNEF

SEQ ID NO: 915404 - protein, 7 aa, Mycobacterium
RRGSART

SEQ ID NO: 915405 - protein, 6 aa, Mycobacterium
RRGSGT

SEQ ID NO: 915406 - protein, 5 aa, Mycobacterium
RRGSL

SEQ ID NO: 915407 - protein, 10 aa, Mycobacterium
RRGSSIYSSN

SEQ ID NO: 915408 - protein, 4 aa, Mycobacterium
RRGT

SEQ ID NO: 915409 - protein, 9 aa, Mycobacterium
RRGVPQGRH

SEQ ID NO: 915410 - protein, 6 aa, Mycobacterium
RRGVRG

SEQ ID NO: 915411 - protein, 8 aa, Mycobacterium
RRHPSGRR

SEQ ID NO: 915412 - protein, 4 aa, Mycobacterium
RRHS

SEQ ID NO: 915413 - protein, 7 aa, Mycobacterium
RRHSGDG

SEQ ID NO: 915414 - protein, 4 aa, Mycobacterium
RRHT

SEQ ID NO: 915415 - protein, 8 aa, Mycobacterium
RRIDGDAL

SEQ ID NO: 915416 - protein, 6 aa, Mycobacterium
RRIGEG

SEQ ID NO: 915417 - protein, 4 aa, Mycobacterium
RRKI

SEQ ID NO: 915418 - protein, 9 aa, Mycobacterium
RRKSGNYTV

SEQ ID NO: 915419 - protein, 9 aa, Mycobacterium
RRLGETAAE

SEQ ID NO: 915420 - protein, 10 aa, Mycobacterium
RRLGETADEL

SEQ ID NO: 915421 - protein, 4 aa, Mycobacterium
RRLT

SEQ ID NO: 915422 - protein, 14 aa, Mycobacterium
RRLTEANDSPAGEA

SEQ ID NO: 915423 - protein, 12 aa, Mycobacterium
RRLTEANDTPVA

SEQ ID NO: 915424 - protein, 4 aa, Mycobacterium
RRNA

SEQ ID NO: 915425 - protein, 7 aa, Mycobacterium
RRNAELD

SEQ ID NO: 915426 - protein, 8 aa, Mycobacterium
RRNAELDE

SEQ ID NO: 915427 - protein, 15 aa, Mycobacterium
RRNASGELRANPARF

SEQ ID NO: 915428 - protein, 8 aa, Mycobacterium
RRNGDKLS

SEQ ID NO: 915429 - protein, 23 aa, Mycobacterium
RRNPDRRAGAKRPGDGYGRPGAP

SEQ ID NO: 915430 - protein, 5 aa, Mycobacterium
RRNSP

SEQ ID NO: 915431 - protein, 10 aa, Mycobacterium
RRNTPTLVSE

SEQ ID NO: 915432 - protein, 130 aa, Mycobacterium
RRPADGGFDRRPADGGFDRRPADGGFDRRPADGGAHRFPSQPTPQPGPQFTPQPSDEPRRRRRRRLDEEQAPAPQAERQPTPPAPPQTPPPAAPPQAPPRQAEPERAPEPQPAPQPAPQPAPQPAPEPVS

SEQ ID NO: 915433 - protein, 22 aa, Mycobacterium
RRPARPSGSPRPARSERVIEGE

SEQ ID NO: 915434 - protein, 6 aa, Mycobacterium
RRPDGS

SEQ ID NO: 915435 - protein, 8 aa, Mycobacterium
RRPEPTLP

SEQ ID NO: 915436 - protein, 5 aa, Mycobacterium
RRPGT

SEQ ID NO: 915437 - protein, 4 aa, Mycobacterium
RRPH

SEQ ID NO: 915438 - protein, 4 aa, Mycobacterium
RRPP

SEQ ID NO: 915439 - protein, 6 aa, Mycobacterium
RRQHPD

SEQ ID NO: 915440 - protein, 9 aa, Mycobacterium
RRQSESDMQ

SEQ ID NO: 915441 - protein, 8 aa, Mycobacterium
RRQVPDPA

SEQ ID NO: 915442 - protein, 5 aa, Mycobacterium
RRRAP

SEQ ID NO: 915443 - protein, 33 aa, Mycobacterium
RRRAPEPAENPEPTPPAEPAPEPVPEQSAPVPP

SEQ ID NO: 915444 - protein, 8 aa, Mycobacterium
RRRARGGV

SEQ ID NO: 915445 - protein, 17 aa, Mycobacterium
RRRDETEFVPEYLTATR

SEQ ID NO: 915446 - protein, 9 aa, Mycobacterium
RRRDGSELT

SEQ ID NO: 915447 - protein, 9 aa, Mycobacterium
RRRDPDDER

SEQ ID NO: 915448 - protein, 13 aa, Mycobacterium
RRRELDDTRVDAA

SEQ ID NO: 915449 - protein, 14 aa, Mycobacterium
RRRGVSEVEPSRDA

SEQ ID NO: 915450 - protein, 6 aa, Mycobacterium
RRRHPQ

SEQ ID NO: 915451 - protein, 7 aa, Mycobacterium
RRRRATG

SEQ ID NO: 915452 - protein, 36 aa, Mycobacterium
RRRRSPRPPRRTRRRRRRTRPRGRRRPPRDYDAPFK

SEQ ID NO: 915453 - protein, 9 aa, Mycobacterium
RRRRSRTRA

SEQ ID NO: 915454 - protein, 10 aa, Mycobacterium
RRRSGTQFDP

SEQ ID NO: 915455 - protein, 7 aa, Mycobacterium
RRSAADR

SEQ ID NO: 915456 - protein, 21 aa, Mycobacterium
RRSDNGAPLSGEKESDEPDLT

SEQ ID NO: 915457 - protein, 7 aa, Mycobacterium
RRSDPAS

SEQ ID NO: 915458 - protein, 4 aa, Mycobacterium
RRSE

SEQ ID NO: 915459 - protein, 8 aa, Mycobacterium
RRSEESRR

SEQ ID NO: 915460 - protein, 4 aa, Mycobacterium
RRSG

SEQ ID NO: 915461 - protein, 6 aa, Mycobacterium
RRSGPV

SEQ ID NO: 915462 - protein, 6 aa, Mycobacterium
RRSPHS

SEQ ID NO: 915463 - protein, 9 aa, Mycobacterium
RRSPRGDEY

SEQ ID NO: 915464 - protein, 10 aa, Mycobacterium
RRSTAGGENA

SEQ ID NO: 915465 - protein, 11 aa, Mycobacterium
RRSTDAAEAAL

SEQ ID NO: 915466 - protein, 15 aa, Mycobacterium
RRSTDPGSANVNSSA

SEQ ID NO: 915467 - protein, 16 aa, Mycobacterium
RRSTPIGPAELNDTPL

SEQ ID NO: 915468 - protein, 10 aa, Mycobacterium
RRTAAGGETA

SEQ ID NO: 915469 - protein, 7 aa, Mycobacterium
RRTAPGS

SEQ ID NO: 915470 - protein, 8 aa, Mycobacterium
RRTASAGQ

SEQ ID NO: 915471 - protein, 7 aa, Mycobacterium
RRTEVGR

SEQ ID NO: 915472 - protein, 6 aa, Mycobacterium
RRTGAQ

SEQ ID NO: 915473 - protein, 12 aa, Mycobacterium
RRTGLSPQDRKS

SEQ ID NO: 915474 - protein, 4 aa, Mycobacterium
RRTH

SEQ ID NO: 915475 - protein, 9 aa, Mycobacterium
RRTIEGDSL

SEQ ID NO: 915476 - protein, 6 aa, Mycobacterium
RRTKNN

SEQ ID NO: 915477 - protein, 9 aa, Mycobacterium
RRTNPATGF

SEQ ID NO: 915478 - protein, 6 aa, Mycobacterium
RRTPGI

SEQ ID NO: 915479 - protein, 4 aa, Mycobacterium
RRTR

SEQ ID NO: 915480 - protein, 5 aa, Mycobacterium
RRTRT

SEQ ID NO: 915481 - protein, 8 aa, Mycobacterium
RRTSEKLK

SEQ ID NO: 915482 - protein, 8 aa, Mycobacterium
RRTSPQSA

SEQ ID NO: 915483 - protein, 6 aa, Mycobacterium
RRTSSV

SEQ ID NO: 915484 - protein, 30 aa, Mycobacterium
RRTTGGPGTTVTGGPAQRSVPANAARAMTA

SEQ ID NO: 915485 - protein, 5 aa, Mycobacterium
RRVGS

SEQ ID NO: 915486 - protein, 12 aa, Mycobacterium
RRVRTADGQTYE

SEQ ID NO: 915487 - protein, 6 aa, Mycobacterium
RRVTGI

SEQ ID NO: 915488 - protein, 11 aa, Mycobacterium
RSAAEEGTLPQ

SEQ ID NO: 915489 - protein, 9 aa, Mycobacterium
RSAASGTAL

SEQ ID NO: 915490 - protein, 6 aa, Mycobacterium
RSADAD

SEQ ID NO: 915491 - protein, 15 aa, Mycobacterium
RSADAPDADGPANVR

SEQ ID NO: 915492 - protein, 10 aa, Mycobacterium
RSADNPLAAG

SEQ ID NO: 915493 - protein, 7 aa, Mycobacterium
RSADPEA

SEQ ID NO: 915494 - protein, 6 aa, Mycobacterium
RSADRV

SEQ ID NO: 915495 - protein, 4 aa, Mycobacterium
RSAE

SEQ ID NO: 915496 - protein, 6 aa, Mycobacterium
RSAFNA

SEQ ID NO: 915497 - protein, 12 aa, Mycobacterium
RSAGKPVHPDES

SEQ ID NO: 915498 - protein, 15 aa, Mycobacterium
RSAGPIQPPLGHTIG

SEQ ID NO: 915499 - protein, 5 aa, Mycobacterium
RSALT

SEQ ID NO: 915500 - protein, 6 aa, Mycobacterium
RSANAD

SEQ ID NO: 915501 - protein, 8 aa, Mycobacterium
RSAPDRIY

SEQ ID NO: 915502 - protein, 6 aa, Mycobacterium
RSAPES

SEQ ID NO: 915503 - protein, 5 aa, Mycobacterium
RSAPG

SEQ ID NO: 915504 - protein, 10 aa, Mycobacterium
RSAPQGSTVN

SEQ ID NO: 915505 - protein, 7 aa, Mycobacterium
RSAQTSS

SEQ ID NO: 915506 - protein, 14 aa, Mycobacterium
RSARIPGSLDGDEF

SEQ ID NO: 915507 - protein, 12 aa, Mycobacterium
RSASDDPDAPSL

SEQ ID NO: 915508 - protein, 14 aa, Mycobacterium
RSASGTVLDAGPGA

SEQ ID NO: 915509 - protein, 11 aa, Mycobacterium
RSASQARGTWR

SEQ ID NO: 915510 - protein, 9 aa, Mycobacterium
RSASRSERT

SEQ ID NO: 915511 - protein, 8 aa, Mycobacterium
RSATTATG

SEQ ID NO: 915512 - protein, 7 aa, Mycobacterium
RSDAADV

SEQ ID NO: 915513 - protein, 16 aa, Mycobacterium
RSDADQGSGGINGRQA

SEQ ID NO: 915514 - protein, 16 aa, Mycobacterium
RSDADQGTGGINGRQA

SEQ ID NO: 915515 - protein, 11 aa, Mycobacterium
RSDASAEALTR

SEQ ID NO: 915516 - protein, 10 aa, Mycobacterium
RSDEHDTAAA

SEQ ID NO: 915517 - protein, 5 aa, Mycobacterium
RSDEI

SEQ ID NO: 915518 - protein, 17 aa, Mycobacterium
RSDERQGAGGLSPQQAG

SEQ ID NO: 915519 - protein, 13 aa, Mycobacterium
RSDGAQSAYGTPE

SEQ ID NO: 915520 - protein, 17 aa, Mycobacterium
RSDGSAKLVTTSNSFTA

SEQ ID NO: 915521 - protein, 9 aa, Mycobacterium
RSDGSGSTF

SEQ ID NO: 915522 - protein, 9 aa, Mycobacterium
RSDGSGTLV

SEQ ID NO: 915523 - protein, 10 aa, Mycobacterium
RSDKTPRDAA

SEQ ID NO: 915524 - protein, 7 aa, Mycobacterium
RSDPGRV

SEQ ID NO: 915525 - protein, 19 aa, Mycobacterium
RSDPQATNPQFPATRHAYR

SEQ ID NO: 915526 - protein, 7 aa, Mycobacterium
RSDSTSL

SEQ ID NO: 915527 - protein, 8 aa, Mycobacterium
RSDTADRL

SEQ ID NO: 915528 - protein, 6 aa, Mycobacterium
RSDTEL

SEQ ID NO: 915529 - protein, 25 aa, Mycobacterium
RSDTTGSSCTDGKCSTEQPGPYGGN

SEQ ID NO: 915530 - protein, 4 aa, Mycobacterium
RSDV

SEQ ID NO: 915531 - protein, 7 aa, Mycobacterium
RSDVSPI

SEQ ID NO: 915532 - protein, 5 aa, Mycobacterium
RSEAR

SEQ ID NO: 915533 - protein, 8 aa, Mycobacterium
RSEDGKLS

SEQ ID NO: 915534 - protein, 7 aa, Mycobacterium
RSEDGYR

SEQ ID NO: 915535 - protein, 12 aa, Mycobacterium
RSEDTASATDEH

SEQ ID NO: 915536 - protein, 7 aa, Mycobacterium
RSEGRLG

SEQ ID NO: 915537 - protein, 8 aa, Mycobacterium
RSEGSTLE

SEQ ID NO: 915538 - protein, 6 aa, Mycobacterium
RSEGSV

SEQ ID NO: 915539 - protein, 5 aa, Mycobacterium
RSESD

SEQ ID NO: 915540 - protein, 7 aa, Mycobacterium
RSESHTR

SEQ ID NO: 915541 - protein, 6 aa, Mycobacterium
RSETGL

SEQ ID NO: 915542 - protein, 12 aa, Mycobacterium
RSFDPLPGEQRR

SEQ ID NO: 915543 - protein, 4 aa, Mycobacterium
RSFG

SEQ ID NO: 915544 - protein, 13 aa, Mycobacterium
RSFGADPQTVTDY

SEQ ID NO: 915545 - protein, 12 aa, Mycobacterium
RSFGADPTTVTD

SEQ ID NO: 915546 - protein, 12 aa, Mycobacterium
RSFGGDPNTVTA

SEQ ID NO: 915547 - protein, 12 aa, Mycobacterium
RSFGSNPETVTE

SEQ ID NO: 915548 - protein, 7 aa, Mycobacterium
RSGDEGV

SEQ ID NO: 915549 - protein, 11 aa, Mycobacterium
RSGDGAPLKNG

SEQ ID NO: 915550 - protein, 7 aa, Mycobacterium
RSGEDDL

SEQ ID NO: 915551 - protein, 8 aa, Mycobacterium
RSGETTRP

SEQ ID NO: 915552 - protein, 4 aa, Mycobacterium
RSGF

SEQ ID NO: 915553 - protein, 6 aa, Mycobacterium
RSGGNA

SEQ ID NO: 915554 - protein, 19 aa, Mycobacterium
RSGHGTGSGEEGPLSPEKV

SEQ ID NO: 915555 - protein, 6 aa, Mycobacterium
RSGHVP

SEQ ID NO: 915556 - protein, 4 aa, Mycobacterium
RSGI

SEQ ID NO: 915557 - protein, 12 aa, Mycobacterium
RSGLPDHAGDKL

SEQ ID NO: 915558 - protein, 15 aa, Mycobacterium
RSGLPDHAGDPLEDL

SEQ ID NO: 915559 - protein, 16 aa, Mycobacterium
RSGLRAADEAHRELAR

SEQ ID NO: 915560 - protein, 5 aa, Mycobacterium
RSGNS

SEQ ID NO: 915561 - protein, 7 aa, Mycobacterium
RSGPAPA

SEQ ID NO: 915562 - protein, 10 aa, Mycobacterium
RSGPQRPEIS

SEQ ID NO: 915563 - protein, 7 aa, Mycobacterium
RSGPRTG

SEQ ID NO: 915564 - protein, 5 aa, Mycobacterium
RSGQP

SEQ ID NO: 915565 - protein, 11 aa, Mycobacterium
RSGRDDSGGYP

SEQ ID NO: 915566 - protein, 9 aa, Mycobacterium
RSGRLETGE

SEQ ID NO: 915567 - protein, 6 aa, Mycobacterium
RSGRRT

SEQ ID NO: 915568 - protein, 30 aa, Mycobacterium
RSGRVRQTGPGSAVGAETDAVAQAEAERNL

SEQ ID NO: 915569 - protein, 8 aa, Mycobacterium
RSGSALAA

SEQ ID NO: 915570 - protein, 7 aa, Mycobacterium
RSGSTNV

SEQ ID NO: 915571 - protein, 4 aa, Mycobacterium
RSGT

SEQ ID NO: 915572 - protein, 5 aa, Mycobacterium
RSGTT

SEQ ID NO: 915573 - protein, 4 aa, Mycobacterium
RSGV

SEQ ID NO: 915574 - protein, 6 aa, Mycobacterium
RSGVGD

SEQ ID NO: 915575 - protein, 21 aa, Mycobacterium
RSHDQEQRPPVAARMIAARAA

SEQ ID NO: 915576 - protein, 5 aa, Mycobacterium
RSHHG

SEQ ID NO: 915577 - protein, 4 aa, Mycobacterium
RSHP

SEQ ID NO: 915578 - protein, 22 aa, Mycobacterium
RSHRAPATATGQLSAAPGVTSD

SEQ ID NO: 915579 - protein, 25 aa, Mycobacterium
RSIGGNAVKAGGNVPRNNNSQQQYP

SEQ ID NO: 915580 - protein, 4 aa, Mycobacterium
RSIP

SEQ ID NO: 915581 - protein, 4 aa, Mycobacterium
RSIR

SEQ ID NO: 915582 - protein, 26 aa, Mycobacterium
RSISGNAIKAGGGGVPRNNNSEQQYP

SEQ ID NO: 915583 - protein, 4 aa, Mycobacterium
RSKG

SEQ ID NO: 915584 - protein, 12 aa, Mycobacterium
RSKGPAAARNTG

SEQ ID NO: 915585 - protein, 18 aa, Mycobacterium
RSLGGGTDGNHNVSSDLD

SEQ ID NO: 915586 - protein, 8 aa, Mycobacterium
RSLPDDSG

SEQ ID NO: 915587 - protein, 11 aa, Mycobacterium
RSLRGSGTSVA

SEQ ID NO: 915588 - protein, 11 aa, Mycobacterium
RSMTRADRSIA

SEQ ID NO: 915589 - protein, 12 aa, Mycobacterium
RSNDPKLEGEDG

SEQ ID NO: 915590 - protein, 8 aa, Mycobacterium
RSNGGHNG

SEQ ID NO: 915591 - protein, 9 aa, Mycobacterium
RSNPAGDYT

SEQ ID NO: 915592 - protein, 7 aa, Mycobacterium
RSNRSDR

SEQ ID NO: 915593 - protein, 9 aa, Mycobacterium
RSPAESSSD

SEQ ID NO: 915594 - protein, 8 aa, Mycobacterium
RSPAGEVL

SEQ ID NO: 915595 - protein, 12 aa, Mycobacterium
RSPAPRKSGGHA

SEQ ID NO: 915596 - protein, 7 aa, Mycobacterium
RSPAPVA

SEQ ID NO: 915597 - protein, 5 aa, Mycobacterium
RSPAQ

SEQ ID NO: 915598 - protein, 8 aa, Mycobacterium
RSPARDFT

SEQ ID NO: 915599 - protein, 10 aa, Mycobacterium
RSPATSSGRE

SEQ ID NO: 915600 - protein, 6 aa, Mycobacterium
RSPDDF

SEQ ID NO: 915601 - protein, 14 aa, Mycobacterium
RSPDEVYLHMSLFN

SEQ ID NO: 915602 - protein, 13 aa, Mycobacterium
RSPDIQDRVNEGA

SEQ ID NO: 915603 - protein, 11 aa, Mycobacterium
RSPDRSARLGQ

SEQ ID NO: 915604 - protein, 8 aa, Mycobacterium
RSPDSSIR

SEQ ID NO: 915605 - protein, 8 aa, Mycobacterium
RSPEGDVL

SEQ ID NO: 915606 - protein, 8 aa, Mycobacterium
RSPEGKVL

SEQ ID NO: 915607 - protein, 13 aa, Mycobacterium
RSPEGYLGQELLA

SEQ ID NO: 915608 - protein, 24 aa, Mycobacterium
RSPEHPSAQRVSPATPIDATGVTT

SEQ ID NO: 915609 - protein, 5 aa, Mycobacterium
RSPER

SEQ ID NO: 915610 - protein, 9 aa, Mycobacterium
RSPGPPNQG

SEQ ID NO: 915611 - protein, 5 aa, Mycobacterium
RSPIR

SEQ ID NO: 915612 - protein, 13 aa, Mycobacterium
RSPKSAPKDKGLG

SEQ ID NO: 915613 - protein, 8 aa, Mycobacterium
RSPLATAA

SEQ ID NO: 915614 - protein, 15 aa, Mycobacterium
RSPLGAESAANLSER

SEQ ID NO: 915615 - protein, 6 aa, Mycobacterium
RSPSGT

SEQ ID NO: 915616 - protein, 28 aa, Mycobacterium
RSQASRPKTRVIGPDDDPEFLRKLGQGG

SEQ ID NO: 915617 - protein, 7 aa, Mycobacterium
RSQELAD

SEQ ID NO: 915618 - protein, 10 aa, Mycobacterium
RSQGERADDR

SEQ ID NO: 915619 - protein, 10 aa, Mycobacterium
RSQGFSSSAP

SEQ ID NO: 915620 - protein, 8 aa, Mycobacterium
RSQGNEDA

SEQ ID NO: 915621 - protein, 9 aa, Mycobacterium
RSQGNEESA

SEQ ID NO: 915622 - protein, 8 aa, Mycobacterium
RSQGSSVE

SEQ ID NO: 915623 - protein, 23 aa, Mycobacterium
RSQLTNPSRTKAARTDATSRSSK

SEQ ID NO: 915624 - protein, 9 aa, Mycobacterium
RSQQRARRL

SEQ ID NO: 915625 - protein, 7 aa, Mycobacterium
RSQSAVG

SEQ ID NO: 915626 - protein, 4 aa, Mycobacterium
RSQV

SEQ ID NO: 915627 - protein, 9 aa, Mycobacterium
RSRAPGTEI

SEQ ID NO: 915628 - protein, 12 aa, Mycobacterium
RSRDGRPAPLGE

SEQ ID NO: 915629 - protein, 15 aa, Mycobacterium
RSREGKNPANYANGQ

SEQ ID NO: 915630 - protein, 10 aa, Mycobacterium
RSRGGTEMAE

SEQ ID NO: 915631 - protein, 25 aa, Mycobacterium
RSRGHQVTGYSRRGSDSTRAGTLTD

SEQ ID NO: 915632 - protein, 9 aa, Mycobacterium
RSRKGPAPV

SEQ ID NO: 915633 - protein, 9 aa, Mycobacterium
RSRPGEPLY

SEQ ID NO: 915634 - protein, 9 aa, Mycobacterium
RSRPIAPEE

SEQ ID NO: 915635 - protein, 6 aa, Mycobacterium
RSRRST

SEQ ID NO: 915636 - protein, 8 aa, Mycobacterium
RSRSEPGM

SEQ ID NO: 915637 - protein, 6 aa, Mycobacterium
RSRSPE

SEQ ID NO: 915638 - protein, 9 aa, Mycobacterium
RSRTPSPEV

SEQ ID NO: 915639 - protein, 11 aa, Mycobacterium
RSRVKGPSQWG

SEQ ID NO: 915640 - protein, 14 aa, Mycobacterium
RSRVQEPSGIQMRG

SEQ ID NO: 915641 - protein, 15 aa, Mycobacterium
RSSAQTCNPGDPGVA

SEQ ID NO: 915642 - protein, 6 aa, Mycobacterium
RSSETL

SEQ ID NO: 915643 - protein, 5 aa, Mycobacterium
RSSGE

SEQ ID NO: 915644 - protein, 8 aa, Mycobacterium
RSSGPRTH

SEQ ID NO: 915645 - protein, 5 aa, Mycobacterium
RSSGR

SEQ ID NO: 915646 - protein, 8 aa, Mycobacterium
RSSGRLRE

SEQ ID NO: 915647 - protein, 10 aa, Mycobacterium
RSSNAGSCPA

SEQ ID NO: 915648 - protein, 10 aa, Mycobacterium
RSSNPNVKIP

SEQ ID NO: 915649 - protein, 10 aa, Mycobacterium
RSSRGSQLTQ

SEQ ID NO: 915650 - protein, 5 aa, Mycobacterium
RSSTA

SEQ ID NO: 915651 - protein, 15 aa, Mycobacterium
RSSVAGYSDSPTAEA

SEQ ID NO: 915652 - protein, 10 aa, Mycobacterium
RSSVITTDDG

SEQ ID NO: 915653 - protein, 10 aa, Mycobacterium
RSTAEDPEER

SEQ ID NO: 915654 - protein, 7 aa, Mycobacterium
RSTAELD

SEQ ID NO: 915655 - protein, 10 aa, Mycobacterium
RSTAEPMSTT

SEQ ID NO: 915656 - protein, 13 aa, Mycobacterium
RSTDFADGAQLAS

SEQ ID NO: 915657 - protein, 7 aa, Mycobacterium
RSTDRVS

SEQ ID NO: 915658 - protein, 5 aa, Mycobacterium
RSTGE

SEQ ID NO: 915659 - protein, 7 aa, Mycobacterium
RSTGGCA

SEQ ID NO: 915660 - protein, 10 aa, Mycobacterium
RSTGVQNAPD

SEQ ID NO: 915661 - protein, 13 aa, Mycobacterium
RSTPTGTDGYPQR

SEQ ID NO: 915662 - protein, 10 aa, Mycobacterium
RSTPTGVDGY

SEQ ID NO: 915663 - protein, 4 aa, Mycobacterium
RSTT

SEQ ID NO: 915664 - protein, 8 aa, Mycobacterium
RSTTGAKR

SEQ ID NO: 915665 - protein, 15 aa, Mycobacterium
RSTVEANARGGDSRD

SEQ ID NO: 915666 - protein, 10 aa, Mycobacterium
RSVAARGGNG

SEQ ID NO: 915667 - protein, 11 aa, Mycobacterium
RSVADAPPGGV

SEQ ID NO: 915668 - protein, 23 aa, Mycobacterium
RSVAGPDLAGGAASGASAAECEE

SEQ ID NO: 915669 - protein, 16 aa, Mycobacterium
RSVDSTQPPPQGRTIG

SEQ ID NO: 915670 - protein, 4 aa, Mycobacterium
RSVG

SEQ ID NO: 915671 - protein, 24 aa, Mycobacterium
RSVGGTAVKAGGPTRNNNSQQQYP

SEQ ID NO: 915672 - protein, 10 aa, Mycobacterium
RSVKPTGSAA

SEQ ID NO: 915673 - protein, 4 aa, Mycobacterium
RSVL

SEQ ID NO: 915674 - protein, 6 aa, Mycobacterium
RSVQNP

SEQ ID NO: 915675 - protein, 7 aa, Mycobacterium
RSVSDTS

SEQ ID NO: 915676 - protein, 7 aa, Mycobacterium
RSVSPDQ

SEQ ID NO: 915677 - protein, 10 aa, Mycobacterium
RSVTEEAEAV

SEQ ID NO: 915678 - protein, 21 aa, Mycobacterium
RSWPDPADLPTPPDVPVRPDN

SEQ ID NO: 915679 - protein, 6 aa, Mycobacterium
RSYPVD

SEQ ID NO: 915680 - protein, 4 aa, Mycobacterium
RSYQ

SEQ ID NO: 915681 - protein, 12 aa, Mycobacterium
RSYRDARTTDAA

SEQ ID NO: 915682 - protein, 9 aa, Mycobacterium
RSYRGPEAV

SEQ ID NO: 915683 - protein, 14 aa, Mycobacterium
RTAAEKAREHDQRA

SEQ ID NO: 915684 - protein, 25 aa, Mycobacterium
RTAAQSDGESPGHVPGGRGTTDLEQ

SEQ ID NO: 915685 - protein, 5 aa, Mycobacterium
RTADA

SEQ ID NO: 915686 - protein, 7 aa, Mycobacterium
RTADGTL

SEQ ID NO: 915687 - protein, 8 aa, Mycobacterium
RTADPEIP

SEQ ID NO: 915688 - protein, 13 aa, Mycobacterium
RTAEGGSAPGGEH

SEQ ID NO: 915689 - protein, 8 aa, Mycobacterium
RTAGDGNA

SEQ ID NO: 915690 - protein, 4 aa, Mycobacterium
RTAM

SEQ ID NO: 915691 - protein, 4 aa, Mycobacterium
RTAN

SEQ ID NO: 915692 - protein, 5 aa, Mycobacterium
RTANT

SEQ ID NO: 915693 - protein, 5 aa, Mycobacterium
RTAPA

SEQ ID NO: 915694 - protein, 5 aa, Mycobacterium
RTAPP

SEQ ID NO: 915695 - protein, 8 aa, Mycobacterium
RTAPPPIP

SEQ ID NO: 915696 - protein, 12 aa, Mycobacterium
RTAPTPQGPWSP

SEQ ID NO: 915697 - protein, 7 aa, Mycobacterium
RTASEAA

SEQ ID NO: 915698 - protein, 6 aa, Mycobacterium
RTATAA

SEQ ID NO: 915699 - protein, 5 aa, Mycobacterium
RTATP

SEQ ID NO: 915700 - protein, 14 aa, Mycobacterium
RTATSTSPAPSRLD

SEQ ID NO: 915701 - protein, 7 aa, Mycobacterium
RTDAGTY

SEQ ID NO: 915702 - protein, 9 aa, Mycobacterium
RTDAPSAGI

SEQ ID NO: 915703 - protein, 5 aa, Mycobacterium
RTDEL

SEQ ID NO: 915704 - protein, 7 aa, Mycobacterium
RTDELSV

SEQ ID NO: 915705 - protein, 5 aa, Mycobacterium
RTDGT

SEQ ID NO: 915706 - protein, 6 aa, Mycobacterium
RTDGTA

SEQ ID NO: 915707 - protein, 18 aa, Mycobacterium
RTDHRPPALSGGEKQRVA

SEQ ID NO: 915708 - protein, 4 aa, Mycobacterium
RTDI

SEQ ID NO: 915709 - protein, 7 aa, Mycobacterium
RTDPEHP

SEQ ID NO: 915710 - protein, 7 aa, Mycobacterium
RTDPQHP

SEQ ID NO: 915711 - protein, 4 aa, Mycobacterium
RTDQ

SEQ ID NO: 915712 - protein, 7 aa, Mycobacterium
RTEADVA

SEQ ID NO: 915713 - protein, 11 aa, Mycobacterium
RTEANLSSDPS

SEQ ID NO: 915714 - protein, 13 aa, Mycobacterium
RTEAPPSPFGGPD

SEQ ID NO: 915715 - protein, 15 aa, Mycobacterium
RTEAYPGNRSLADAY

SEQ ID NO: 915716 - protein, 6 aa, Mycobacterium
RTEDQY

SEQ ID NO: 915717 - protein, 4 aa, Mycobacterium
RTEE

SEQ ID NO: 915718 - protein, 5 aa, Mycobacterium
RTEEE

SEQ ID NO: 915719 - protein, 9 aa, Mycobacterium
RTEEPGSGV

SEQ ID NO: 915720 - protein, 12 aa, Mycobacterium
RTEGDPDERSGA

SEQ ID NO: 915721 - protein, 7 aa, Mycobacterium
RTEHPGA

SEQ ID NO: 915722 - protein, 5 aa, Mycobacterium
RTELG

SEQ ID NO: 915723 - protein, 18 aa, Mycobacterium
RTEMRDQSQFQTGDDPVA

SEQ ID NO: 915724 - protein, 10 aa, Mycobacterium
RTENATSNAQ

SEQ ID NO: 915725 - protein, 7 aa, Mycobacterium
RTENPMA

SEQ ID NO: 915726 - protein, 7 aa, Mycobacterium
RTEPGDR

SEQ ID NO: 915727 - protein, 8 aa, Mycobacterium
RTESLGDE

SEQ ID NO: 915728 - protein, 7 aa, Mycobacterium
RTETDGW

SEQ ID NO: 915729 - protein, 7 aa, Mycobacterium
RTETPEL

SEQ ID NO: 915730 - protein, 4 aa, Mycobacterium
RTGA

SEQ ID NO: 915731 - protein, 8 aa, Mycobacterium
RTGAAGAS

SEQ ID NO: 915732 - protein, 6 aa, Mycobacterium
RTGAVQ

SEQ ID NO: 915733 - protein, 5 aa, Mycobacterium
RTGDI

SEQ ID NO: 915734 - protein, 8 aa, Mycobacterium
RTGELDAR

SEQ ID NO: 915735 - protein, 9 aa, Mycobacterium
RTGGGQFAA

SEQ ID NO: 915736 - protein, 9 aa, Mycobacterium
RTGGPGYGG

SEQ ID NO: 915737 - protein, 5 aa, Mycobacterium
RTGGS

SEQ ID NO: 915738 - protein, 7 aa, Mycobacterium
RTGKPGE

SEQ ID NO: 915739 - protein, 11 aa, Mycobacterium
RTGKYTSAADE

SEQ ID NO: 915740 - protein, 7 aa, Mycobacterium
RTGNKPL

SEQ ID NO: 915741 - protein, 8 aa, Mycobacterium
RTGPGPFE

SEQ ID NO: 915742 - protein, 5 aa, Mycobacterium
RTGPT

SEQ ID NO: 915743 - protein, 4 aa, Mycobacterium
RTGQ

SEQ ID NO: 915744 - protein, 11 aa, Mycobacterium
RTGQEHDPGTR

SEQ ID NO: 915745 - protein, 10 aa, Mycobacterium
RTGQGGEPRM

SEQ ID NO: 915746 - protein, 7 aa, Mycobacterium
RTGQPGV

SEQ ID NO: 915747 - protein, 10 aa, Mycobacterium
RTGRPGTAIG

SEQ ID NO: 915748 - protein, 6 aa, Mycobacterium
RTGSLA

SEQ ID NO: 915749 - protein, 8 aa, Mycobacterium
RTGSPYSL

SEQ ID NO: 915750 - protein, 5 aa, Mycobacterium
RTHPS

SEQ ID NO: 915751 - protein, 7 aa, Mycobacterium
RTIGGRD

SEQ ID NO: 915752 - protein, 8 aa, Mycobacterium
RTIPNDDN

SEQ ID NO: 915753 - protein, 4 aa, Mycobacterium
RTIQ

SEQ ID NO: 915754 - protein, 9 aa, Mycobacterium
RTKAEADAA

SEQ ID NO: 915755 - protein, 11 aa, Mycobacterium
RTKDQAGEMSE

SEQ ID NO: 915756 - protein, 13 aa, Mycobacterium
RTKGTVPDDLPEG

SEQ ID NO: 915757 - protein, 13 aa, Mycobacterium
RTKGTVPDTLPDG

SEQ ID NO: 915758 - protein, 11 aa, Mycobacterium
RTKTGSRLTSS

SEQ ID NO: 915759 - protein, 6 aa, Mycobacterium
RTKTPV

SEQ ID NO: 915760 - protein, 7 aa, Mycobacterium
RTLATGE

SEQ ID NO: 915761 - protein, 23 aa, Mycobacterium
RTLDDSEKALADSQTAIDATQQR

SEQ ID NO: 915762 - protein, 5 aa, Mycobacterium
RTNGA

SEQ ID NO: 915763 - protein, 10 aa, Mycobacterium
RTNKTPHDAG

SEQ ID NO: 915764 - protein, 8 aa, Mycobacterium
RTPASSEE

SEQ ID NO: 915765 - protein, 9 aa, Mycobacterium
RTPDGQPDS

SEQ ID NO: 915766 - protein, 5 aa, Mycobacterium
RTPDS

SEQ ID NO: 915767 - protein, 6 aa, Mycobacterium
RTPERV

SEQ ID NO: 915768 - protein, 12 aa, Mycobacterium
RTPGAKTRGTRR

SEQ ID NO: 915769 - protein, 7 aa, Mycobacterium
RTPGDCE

SEQ ID NO: 915770 - protein, 9 aa, Mycobacterium
RTPGGSPGM

SEQ ID NO: 915771 - protein, 4 aa, Mycobacterium
RTPH

SEQ ID NO: 915772 - protein, 6 aa, Mycobacterium
RTPIDP

SEQ ID NO: 915773 - protein, 7 aa, Mycobacterium
RTPKTLS

SEQ ID NO: 915774 - protein, 7 aa, Mycobacterium
RTPPAGA

SEQ ID NO: 915775 - protein, 9 aa, Mycobacterium
RTPPAGAAR

SEQ ID NO: 915776 - protein, 17 aa, Mycobacterium
RTPPAGAIRELLSHIRS

SEQ ID NO: 915777 - protein, 8 aa, Mycobacterium
RTPPGIRA

SEQ ID NO: 915778 - protein, 10 aa, Mycobacterium
RTPPPPPDAK

SEQ ID NO: 915779 - protein, 7 aa, Mycobacterium
RTPTADR

SEQ ID NO: 915780 - protein, 4 aa, Mycobacterium
RTQA

SEQ ID NO: 915781 - protein, 7 aa, Mycobacterium
RTQAERR

SEQ ID NO: 915782 - protein, 20 aa, Mycobacterium
RTQGPGAWPKCGGGGIGGGA

SEQ ID NO: 915783 - protein, 13 aa, Mycobacterium
RTQPAMSSRAYRT

SEQ ID NO: 915784 - protein, 9 aa, Mycobacterium
RTQRPDGSW

SEQ ID NO: 915785 - protein, 5 aa, Mycobacterium
RTQRS

SEQ ID NO: 915786 - protein, 6 aa, Mycobacterium
RTRAAL

SEQ ID NO: 915787 - protein, 7 aa, Mycobacterium
RTRDPAL

SEQ ID NO: 915788 - protein, 9 aa, Mycobacterium
RTRDQTGVT

SEQ ID NO: 915789 - protein, 4 aa, Mycobacterium
RTRH

SEQ ID NO: 915790 - protein, 4 aa, Mycobacterium
RTRL

SEQ ID NO: 915791 - protein, 6 aa, Mycobacterium
RTRRAG

SEQ ID NO: 915792 - protein, 5 aa, Mycobacterium
RTRSA

SEQ ID NO: 915793 - protein, 10 aa, Mycobacterium
RTRTPGSINT

SEQ ID NO: 915794 - protein, 5 aa, Mycobacterium
RTSDV

SEQ ID NO: 915795 - protein, 4 aa, Mycobacterium
RTSF

SEQ ID NO: 915796 - protein, 30 aa, Mycobacterium
RTSGDPAAGAPSNQGPNSEKLKADIDARRA

SEQ ID NO: 915797 - protein, 9 aa, Mycobacterium
RTSGEDSGA

SEQ ID NO: 915798 - protein, 14 aa, Mycobacterium
RTSGMTPFVVRYIE

SEQ ID NO: 915799 - protein, 22 aa, Mycobacterium
RTSLSDEPKPPPQKQPKLPPPN

SEQ ID NO: 915800 - protein, 16 aa, Mycobacterium
RTSLSGGPKPEPPKAV

SEQ ID NO: 915801 - protein, 17 aa, Mycobacterium
RTSNSPRSSTAASTSLT

SEQ ID NO: 915802 - protein, 4 aa, Mycobacterium
RTSP

SEQ ID NO: 915803 - protein, 8 aa, Mycobacterium
RTSPADFS

SEQ ID NO: 915804 - protein, 6 aa, Mycobacterium
RTSPAL

SEQ ID NO: 915805 - protein, 13 aa, Mycobacterium
RTSRAAPAPPIGT

SEQ ID NO: 915806 - protein, 6 aa, Mycobacterium
RTSRPG

SEQ ID NO: 915807 - protein, 6 aa, Mycobacterium
RTSRQA

SEQ ID NO: 915808 - protein, 7 aa, Mycobacterium
RTSSFSN

SEQ ID NO: 915809 - protein, 8 aa, Mycobacterium
RTSSPYSL

SEQ ID NO: 915810 - protein, 6 aa, Mycobacterium
RTSTDD

SEQ ID NO: 915811 - protein, 4 aa, Mycobacterium
RTSV

SEQ ID NO: 915812 - protein, 6 aa, Mycobacterium
RTTAPI

SEQ ID NO: 915813 - protein, 7 aa, Mycobacterium
RTTDHSP

SEQ ID NO: 915814 - protein, 4 aa, Mycobacterium
RTTE

SEQ ID NO: 915815 - protein, 13 aa, Mycobacterium
RTTEECKPPPPLP

SEQ ID NO: 915816 - protein, 4 aa, Mycobacterium
RTTG

SEQ ID NO: 915817 - protein, 12 aa, Mycobacterium
RTTGGVPAPGGL

SEQ ID NO: 915818 - protein, 11 aa, Mycobacterium
RTTNSLGGTST

SEQ ID NO: 915819 - protein, 4 aa, Mycobacterium
RTTV

SEQ ID NO: 915820 - protein, 7 aa, Mycobacterium
RTTVDSP

SEQ ID NO: 915821 - protein, 7 aa, Mycobacterium
RTVDPRG

SEQ ID NO: 915822 - protein, 4 aa, Mycobacterium
RTVE

SEQ ID NO: 915823 - protein, 5 aa, Mycobacterium
RTVEA

SEQ ID NO: 915824 - protein, 13 aa, Mycobacterium
RTVEGDGQPNAEA

SEQ ID NO: 915825 - protein, 9 aa, Mycobacterium
RTVESTRRF

SEQ ID NO: 915826 - protein, 15 aa, Mycobacterium
RTVEVTPDAQRRYND

SEQ ID NO: 915827 - protein, 7 aa, Mycobacterium
RTVGGAR

SEQ ID NO: 915828 - protein, 8 aa, Mycobacterium
RTVGGEMR

SEQ ID NO: 915829 - protein, 29 aa, Mycobacterium
RTVSNGTTGVAAAAADGVATTATIIVVPA

SEQ ID NO: 915830 - protein, 4 aa, Mycobacterium
RTWT

SEQ ID NO: 915831 - protein, 8 aa, Mycobacterium
RVAGGSEA

SEQ ID NO: 915832 - protein, 8 aa, Mycobacterium
RVAPDGSV

SEQ ID NO: 915833 - protein, 17 aa, Mycobacterium
RVAPPASDTNDNGDFSR

SEQ ID NO: 915834 - protein, 9 aa, Mycobacterium
RVDEASRIA

SEQ ID NO: 915835 - protein, 14 aa, Mycobacterium
RVDGSRVDVGRGYG

SEQ ID NO: 915836 - protein, 5 aa, Mycobacterium
RVDPG

SEQ ID NO: 915837 - protein, 8 aa, Mycobacterium
RVDPPESC

SEQ ID NO: 915838 - protein, 8 aa, Mycobacterium
RVEATPAA

SEQ ID NO: 915839 - protein, 7 aa, Mycobacterium
RVEGSRN

SEQ ID NO: 915840 - protein, 7 aa, Mycobacterium
RVEPDGI

SEQ ID NO: 915841 - protein, 16 aa, Mycobacterium
RVETDEQTRKAGYARA

SEQ ID NO: 915842 - protein, 12 aa, Mycobacterium
RVETDTAERKDV

SEQ ID NO: 915843 - protein, 10 aa, Mycobacterium
RVGDDGRRAE

SEQ ID NO: 915844 - protein, 9 aa, Mycobacterium
RVGGLSGEI

SEQ ID NO: 915845 - protein, 7 aa, Mycobacterium
RVGGSNG

SEQ ID NO: 915846 - protein, 6 aa, Mycobacterium
RVGGTW

SEQ ID NO: 915847 - protein, 10 aa, Mycobacterium
RVGNTKPTGP

SEQ ID NO: 915848 - protein, 5 aa, Mycobacterium
RVGPA

SEQ ID NO: 915849 - protein, 23 aa, Mycobacterium
RVGPAVGTSGSSSAGGSGSRHSS

SEQ ID NO: 915850 - protein, 12 aa, Mycobacterium
RVGPDGSTTVNT

SEQ ID NO: 915851 - protein, 6 aa, Mycobacterium
RVGPSD

SEQ ID NO: 915852 - protein, 5 aa, Mycobacterium
RVGQS

SEQ ID NO: 915853 - protein, 5 aa, Mycobacterium
RVNPD

SEQ ID NO: 915854 - protein, 6 aa, Mycobacterium
RVNQQT

SEQ ID NO: 915855 - protein, 13 aa, Mycobacterium
RVNSRGGPGGAPG

SEQ ID NO: 915856 - protein, 4 aa, Mycobacterium
RVPA

SEQ ID NO: 915857 - protein, 11 aa, Mycobacterium
RVPAPGSRRDH

SEQ ID NO: 915858 - protein, 4 aa, Mycobacterium
RVPD

SEQ ID NO: 915859 - protein, 10 aa, Mycobacterium
RVPEGSAGIE

SEQ ID NO: 915860 - protein, 4 aa, Mycobacterium
RVPG

SEQ ID NO: 915861 - protein, 16 aa, Mycobacterium
RVPGGPVRPGYGPGRD

SEQ ID NO: 915862 - protein, 6 aa, Mycobacterium
RVPGQP

SEQ ID NO: 915863 - protein, 5 aa, Mycobacterium
RVQEG

SEQ ID NO: 915864 - protein, 13 aa, Mycobacterium
RVQGGRGPRASRY

SEQ ID NO: 915865 - protein, 13 aa, Mycobacterium
RVQGGRGPRESKY

SEQ ID NO: 915866 - protein, 22 aa, Mycobacterium
RVQPTTVNSRRSLTPALDAGRE

SEQ ID NO: 915867 - protein, 4 aa, Mycobacterium
RVQT

SEQ ID NO: 915868 - protein, 6 aa, Mycobacterium
RVSDGN

SEQ ID NO: 915869 - protein, 11 aa, Mycobacterium
RVSGADPGAAT

SEQ ID NO: 915870 - protein, 9 aa, Mycobacterium
RVSPSKEDV

SEQ ID NO: 915871 - protein, 5 aa, Mycobacterium
RVSQQ

SEQ ID NO: 915872 - protein, 4 aa, Mycobacterium
RVST

SEQ ID NO: 915873 - protein, 11 aa, Mycobacterium
RVTDEDPHRDE

SEQ ID NO: 915874 - protein, 5 aa, Mycobacterium
RVTGN

SEQ ID NO: 915875 - protein, 6 aa, Mycobacterium
RVTKGD

SEQ ID NO: 915876 - protein, 33 aa, Mycobacterium
RVTPHNAAGLARSASDAADEQRALAGGGVYGGL

SEQ ID NO: 915877 - protein, 6 aa, Mycobacterium
RVTQPT

SEQ ID NO: 915878 - protein, 6 aa, Mycobacterium
RWGRPE

SEQ ID NO: 915879 - protein, 6 aa, Mycobacterium
RWGTDG

SEQ ID NO: 915880 - protein, 6 aa, Mycobacterium
RWGTSA

SEQ ID NO: 915881 - protein, 4 aa, Mycobacterium
RWSA

SEQ ID NO: 915882 - protein, 7 aa, Mycobacterium
RWSPTGK

SEQ ID NO: 915883 - protein, 8 aa, Mycobacterium
RYAPPPAV

SEQ ID NO: 915884 - protein, 24 aa, Mycobacterium
RYAPPPEDYAPLPDDPPPPPPAPN

SEQ ID NO: 915885 - protein, 22 aa, Mycobacterium
RYDGTSVKSTPVDVSDNEPGIV

SEQ ID NO: 915886 - protein, 13 aa, Mycobacterium
RYDPGQLMYSGIV

SEQ ID NO: 915887 - protein, 6 aa, Mycobacterium
RYDRDA

SEQ ID NO: 915888 - protein, 4 aa, Mycobacterium
RYEG

SEQ ID NO: 915889 - protein, 6 aa, Mycobacterium
RYEPQY

SEQ ID NO: 915890 - protein, 11 aa, Mycobacterium
RYETSEMSDRH

SEQ ID NO: 915891 - protein, 4 aa, Mycobacterium
RYGG

SEQ ID NO: 915892 - protein, 11 aa, Mycobacterium
RYGNRSAGNAL

SEQ ID NO: 915893 - protein, 13 aa, Mycobacterium
RYGPQSPQALTAA

SEQ ID NO: 915894 - protein, 4 aa, Mycobacterium
RYGR

SEQ ID NO: 915895 - protein, 5 aa, Mycobacterium
RYKNK

SEQ ID NO: 915896 - protein, 14 aa, Mycobacterium
RYKSPAARASYGET

SEQ ID NO: 915897 - protein, 7 aa, Mycobacterium
RYPDASH

SEQ ID NO: 915898 - protein, 5 aa, Mycobacterium
RYPDG

SEQ ID NO: 915899 - protein, 8 aa, Mycobacterium
RYPGAARR

SEQ ID NO: 915900 - protein, 11 aa, Mycobacterium
RYPLTGRGDVN

SEQ ID NO: 915901 - protein, 16 aa, Mycobacterium
RYPQTGRDIAGTSGEL

SEQ ID NO: 915902 - protein, 16 aa, Mycobacterium
RYPQTGRDISGTSGEL

SEQ ID NO: 915903 - protein, 5 aa, Mycobacterium
RYPTN

SEQ ID NO: 915904 - protein, 7 aa, Mycobacterium
RYTPEGD

SEQ ID NO: 915905 - protein, 6 aa, Mycobacterium
SAAAAY

SEQ ID NO: 915906 - protein, 11 aa, Mycobacterium
SAAAELPPTTP

SEQ ID NO: 915907 - protein, 15 aa, Mycobacterium
SAAAGGAALSASDRA

SEQ ID NO: 915908 - protein, 7 aa, Mycobacterium
SAAAGSY

SEQ ID NO: 915909 - protein, 7 aa, Mycobacterium
SAAAGTE

SEQ ID NO: 915910 - protein, 12 aa, Mycobacterium
SAAAPRANAASL

SEQ ID NO: 915911 - protein, 8 aa, Mycobacterium
SAAAQALA

SEQ ID NO: 915912 - protein, 9 aa, Mycobacterium
SAAASASAA

SEQ ID NO: 915913 - protein, 11 aa, Mycobacterium
SAAAWAARSGR

SEQ ID NO: 915914 - protein, 5 aa, Mycobacterium
SAADG

SEQ ID NO: 915915 - protein, 9 aa, Mycobacterium
SAADGQQGW

SEQ ID NO: 915916 - protein, 6 aa, Mycobacterium
SAADGR

SEQ ID NO: 915917 - protein, 6 aa, Mycobacterium
SAADPA

SEQ ID NO: 915918 - protein, 9 aa, Mycobacterium
SAADVPSEQ

SEQ ID NO: 915919 - protein, 8 aa, Mycobacterium
SAADYAKA

SEQ ID NO: 915920 - protein, 14 aa, Mycobacterium
SAAEESGAATMGGT

SEQ ID NO: 915921 - protein, 11 aa, Mycobacterium
SAAEGVARSPL

SEQ ID NO: 915922 - protein, 12 aa, Mycobacterium
SAAEGVARSPVG

SEQ ID NO: 915923 - protein, 11 aa, Mycobacterium
SAAEGVDRSPL

SEQ ID NO: 915924 - protein, 7 aa, Mycobacterium
SAAEIGA

SEQ ID NO: 915925 - protein, 12 aa, Mycobacterium
SAAETTHNPTVN

SEQ ID NO: 915926 - protein, 4 aa, Mycobacterium
SAAG

SEQ ID NO: 915927 - protein, 8 aa, Mycobacterium
SAAGASYQ

SEQ ID NO: 915928 - protein, 8 aa, Mycobacterium
SAAGEGSE

SEQ ID NO: 915929 - protein, 6 aa, Mycobacterium
SAAGEQ

SEQ ID NO: 915930 - protein, 9 aa, Mycobacterium
SAAGGPGSA

SEQ ID NO: 915931 - protein, 15 aa, Mycobacterium
SAAGQPVAHAADGRD

SEQ ID NO: 915932 - protein, 9 aa, Mycobacterium
SAAGRTPTL

SEQ ID NO: 915933 - protein, 7 aa, Mycobacterium
SAAGSRF

SEQ ID NO: 915934 - protein, 8 aa, Mycobacterium
SAAGTAAF

SEQ ID NO: 915935 - protein, 110 aa, Mycobacterium
SAAGTANADDSAVGNSRRAAASADAAGGPSRGPATNSPDRDEPATAPAARTRAQAKPSSSRVSEARARKSDRLDDISDDAAEEWTPDADADADVPVTSAANSPEPPARST

SEQ ID NO: 915936 - protein, 8 aa, Mycobacterium
SAAGTGKS

SEQ ID NO: 915937 - protein, 13 aa, Mycobacterium
SAAGVSGPTTQAL

SEQ ID NO: 915938 - protein, 12 aa, Mycobacterium
SAAGYTYSASIT

SEQ ID NO: 915939 - protein, 10 aa, Mycobacterium
SAALAEPARA

SEQ ID NO: 915940 - protein, 4 aa, Mycobacterium
SAAM

SEQ ID NO: 915941 - protein, 8 aa, Mycobacterium
SAAMGSSR

SEQ ID NO: 915942 - protein, 6 aa, Mycobacterium
SAANDF

SEQ ID NO: 915943 - protein, 6 aa, Mycobacterium
SAANGA

SEQ ID NO: 915944 - protein, 10 aa, Mycobacterium
SAANPEGAQA

SEQ ID NO: 915945 - protein, 6 aa, Mycobacterium
SAANPR

SEQ ID NO: 915946 - protein, 7 aa, Mycobacterium
SAANTFD

SEQ ID NO: 915947 - protein, 10 aa, Mycobacterium
SAAPAGTDTW

SEQ ID NO: 915948 - protein, 20 aa, Mycobacterium
SAAPAPAQPDPQPEVEAQAP

SEQ ID NO: 915949 - protein, 23 aa, Mycobacterium
SAAPATETEQAETAPVADEAAPV

SEQ ID NO: 915950 - protein, 6 aa, Mycobacterium
SAAPDE

SEQ ID NO: 915951 - protein, 5 aa, Mycobacterium
SAAPG

SEQ ID NO: 915952 - protein, 7 aa, Mycobacterium
SAAPGAL

SEQ ID NO: 915953 - protein, 10 aa, Mycobacterium
SAAPPGQDTW

SEQ ID NO: 915954 - protein, 8 aa, Mycobacterium
SAAPPGVD

SEQ ID NO: 915955 - protein, 10 aa, Mycobacterium
SAAPRAWAGD

SEQ ID NO: 915956 - protein, 10 aa, Mycobacterium
SAAPSNPVDV

SEQ ID NO: 915957 - protein, 24 aa, Mycobacterium
SAAPTIATPSISPTMSGGSGMPGI

SEQ ID NO: 915958 - protein, 8 aa, Mycobacterium
SAAPTPNW

SEQ ID NO: 915959 - protein, 8 aa, Mycobacterium
SAAPVDGP

SEQ ID NO: 915960 - protein, 9 aa, Mycobacterium
SAAPVDGPA

SEQ ID NO: 915961 - protein, 10 aa, Mycobacterium
SAAQSTSVTN

SEQ ID NO: 915962 - protein, 10 aa, Mycobacterium
SAAQTTPRRA

SEQ ID NO: 915963 - protein, 16 aa, Mycobacterium
SAARGSAAVPTPHAAP

SEQ ID NO: 915964 - protein, 9 aa, Mycobacterium
SAARLTPAG

SEQ ID NO: 915965 - protein, 11 aa, Mycobacterium
SAARNLPRTDA

SEQ ID NO: 915966 - protein, 18 aa, Mycobacterium
SAARPDGGGLADFPDDHA

SEQ ID NO: 915967 - protein, 11 aa, Mycobacterium
SAARSPKARAG

SEQ ID NO: 915968 - protein, 7 aa, Mycobacterium
SAASEFD

SEQ ID NO: 915969 - protein, 12 aa, Mycobacterium
SAASPTALPDAS

SEQ ID NO: 915970 - protein, 7 aa, Mycobacterium
SAATADA

SEQ ID NO: 915971 - protein, 8 aa, Mycobacterium
SAATGREI

SEQ ID NO: 915972 - protein, 14 aa, Mycobacterium
SAAVDAGQTLIAPV

SEQ ID NO: 915973 - protein, 6 aa, Mycobacterium
SAAYAA

SEQ ID NO: 915974 - protein, 4 aa, Mycobacterium
SADA

SEQ ID NO: 915975 - protein, 7 aa, Mycobacterium
SADADRT

SEQ ID NO: 915976 - protein, 8 aa, Mycobacterium
SADASGVD

SEQ ID NO: 915977 - protein, 8 aa, Mycobacterium
SADDADAA

SEQ ID NO: 915978 - protein, 7 aa, Mycobacterium
SADDLDG

SEQ ID NO: 915979 - protein, 9 aa, Mycobacterium
SADDPDTVR

SEQ ID NO: 915980 - protein, 9 aa, Mycobacterium
SADDPETVR

SEQ ID NO: 915981 - protein, 9 aa, Mycobacterium
SADDSDTVR

SEQ ID NO: 915982 - protein, 22 aa, Mycobacterium
SADDSENDTLTTTVTSADPTVP

SEQ ID NO: 915983 - protein, 9 aa, Mycobacterium
SADDSETVR

SEQ ID NO: 915984 - protein, 5 aa, Mycobacterium
SADEI

SEQ ID NO: 915985 - protein, 13 aa, Mycobacterium
SADEIAAAVGNDK

SEQ ID NO: 915986 - protein, 4 aa, Mycobacterium
SADF

SEQ ID NO: 915987 - protein, 6 aa, Mycobacterium
SADFTE

SEQ ID NO: 915988 - protein, 4 aa, Mycobacterium
SADG

SEQ ID NO: 915989 - protein, 8 aa, Mycobacterium
SADGEHFA

SEQ ID NO: 915990 - protein, 6 aa, Mycobacterium
SADGNA

SEQ ID NO: 915991 - protein, 17 aa, Mycobacterium
SADGQMSYNDSRAEGTR

SEQ ID NO: 915992 - protein, 9 aa, Mycobacterium
SADGTTRTL

SEQ ID NO: 915993 - protein, 6 aa, Mycobacterium
SADGVP

SEQ ID NO: 915994 - protein, 18 aa, Mycobacterium
SADGYPNGQPSAGIRPGD

SEQ ID NO: 915995 - protein, 16 aa, Mycobacterium
SADGYPQGQPGAGILP

SEQ ID NO: 915996 - protein, 6 aa, Mycobacterium
SADHPE

SEQ ID NO: 915997 - protein, 5 aa, Mycobacterium
SADNH

SEQ ID NO: 915998 - protein, 9 aa, Mycobacterium
SADPADDAL

SEQ ID NO: 915999 - protein, 6 aa, Mycobacterium
SADPAE

SEQ ID NO: 916000 - protein, 7 aa, Mycobacterium
SADPAER

SEQ ID NO: 916001 - protein, 7 aa, Mycobacterium
SADPATS

SEQ ID NO: 916002 - protein, 7 aa, Mycobacterium
SADPAVP

SEQ ID NO: 916003 - protein, 6 aa, Mycobacterium
SADPGC

SEQ ID NO: 916004 - protein, 10 aa, Mycobacterium
SADPGTRPMD

SEQ ID NO: 916005 - protein, 6 aa, Mycobacterium
SADPQN

SEQ ID NO: 916006 - protein, 7 aa, Mycobacterium
SADPQTS

SEQ ID NO: 916007 - protein, 5 aa, Mycobacterium
SADPS

SEQ ID NO: 916008 - protein, 6 aa, Mycobacterium
SADPSC

SEQ ID NO: 916009 - protein, 10 aa, Mycobacterium
SADRGRLTPG

SEQ ID NO: 916010 - protein, 4 aa, Mycobacterium
SADS

SEQ ID NO: 916011 - protein, 10 aa, Mycobacterium
SADSAGPAEA

SEQ ID NO: 916012 - protein, 10 aa, Mycobacterium
SADTAATAAS

SEQ ID NO: 916013 - protein, 8 aa, Mycobacterium
SADTADEV

SEQ ID NO: 916014 - protein, 10 aa, Mycobacterium
SADVPEGSAA

SEQ ID NO: 916015 - protein, 5 aa, Mycobacterium
SAEAA

SEQ ID NO: 916016 - protein, 10 aa, Mycobacterium
SAEATDVDAT

SEQ ID NO: 916017 - protein, 10 aa, Mycobacterium
SAEATNPKAA

SEQ ID NO: 916018 - protein, 23 aa, Mycobacterium
SAEDAAAGDAQAPGTASAIPDNT

SEQ ID NO: 916019 - protein, 7 aa, Mycobacterium
SAEEPEV

SEQ ID NO: 916020 - protein, 7 aa, Mycobacterium
SAEGIDG

SEQ ID NO: 916021 - protein, 8 aa, Mycobacterium
SAEGRQKY

SEQ ID NO: 916022 - protein, 12 aa, Mycobacterium
SAEIPSANGAEA

SEQ ID NO: 916023 - protein, 21 aa, Mycobacterium
SAELPPPSPAPYGPAVAPGQL

SEQ ID NO: 916024 - protein, 4 aa, Mycobacterium
SAEP

SEQ ID NO: 916025 - protein, 26 aa, Mycobacterium
SAEPAGPDGAPVANRLEPGKRPRSTM

SEQ ID NO: 916026 - protein, 8 aa, Mycobacterium
SAEPPLPR

SEQ ID NO: 916027 - protein, 7 aa, Mycobacterium
SAESPNV

SEQ ID NO: 916028 - protein, 11 aa, Mycobacterium
SAESVGKTIAG

SEQ ID NO: 916029 - protein, 4 aa, Mycobacterium
SAEV

SEQ ID NO: 916030 - protein, 13 aa, Mycobacterium
SAFANRPSGLPGL

SEQ ID NO: 916031 - protein, 13 aa, Mycobacterium
SAFATRPAGLPGL

SEQ ID NO: 916032 - protein, 7 aa, Mycobacterium
SAFPTTE

SEQ ID NO: 916033 - protein, 11 aa, Mycobacterium
SAFQNRPSGLR

SEQ ID NO: 916034 - protein, 13 aa, Mycobacterium
SAFRSDAQITSSR

SEQ ID NO: 916035 - protein, 11 aa, Mycobacterium
SAFSSALGQRD

SEQ ID NO: 916036 - protein, 13 aa, Mycobacterium
SAGAANASPDAGD

SEQ ID NO: 916037 - protein, 11 aa, Mycobacterium
SAGAEGPPPGA

SEQ ID NO: 916038 - protein, 11 aa, Mycobacterium
SAGAYPSTERT

SEQ ID NO: 916039 - protein, 9 aa, Mycobacterium
SAGDAPTTT

SEQ ID NO: 916040 - protein, 9 aa, Mycobacterium
SAGDGTAVT

SEQ ID NO: 916041 - protein, 8 aa, Mycobacterium
SAGDVTGA

SEQ ID NO: 916042 - protein, 10 aa, Mycobacterium
SAGEGKPSTL

SEQ ID NO: 916043 - protein, 19 aa, Mycobacterium
SAGEQPRRPVPPAGPGSSE

SEQ ID NO: 916044 - protein, 6 aa, Mycobacterium
SAGFAD

SEQ ID NO: 916045 - protein, 4 aa, Mycobacterium
SAGG

SEQ ID NO: 916046 - protein, 27 aa, Mycobacterium
SAGGAADAGGAARTAGENIGMPARRSA

SEQ ID NO: 916047 - protein, 10 aa, Mycobacterium
SAGGGANDLS

SEQ ID NO: 916048 - protein, 18 aa, Mycobacterium
SAGGGDRTAIVALAEGPP

SEQ ID NO: 916049 - protein, 19 aa, Mycobacterium
SAGGGLAAGAAAAMTGTGA

SEQ ID NO: 916050 - protein, 6 aa, Mycobacterium
SAGGHT

SEQ ID NO: 916051 - protein, 8 aa, Mycobacterium
SAGGLTKP

SEQ ID NO: 916052 - protein, 10 aa, Mycobacterium
SAGGQGTPAE

SEQ ID NO: 916053 - protein, 25 aa, Mycobacterium
SAGGQVLSDDGQRVTLTDTPEHRAA

SEQ ID NO: 916054 - protein, 25 aa, Mycobacterium
SAGGSVLAGDGKTVTLTDTPAHRQA

SEQ ID NO: 916055 - protein, 19 aa, Mycobacterium
SAGKTAQDTAFDGRSDYDG

SEQ ID NO: 916056 - protein, 19 aa, Mycobacterium
SAGKTAQDTSFDGRSDYDG

SEQ ID NO: 916057 - protein, 6 aa, Mycobacterium
SAGKYA

SEQ ID NO: 916058 - protein, 9 aa, Mycobacterium
SAGLDPKNY

SEQ ID NO: 916059 - protein, 6 aa, Mycobacterium
SAGLGT

SEQ ID NO: 916060 - protein, 8 aa, Mycobacterium
SAGNEYLG

SEQ ID NO: 916061 - protein, 8 aa, Mycobacterium
SAGPAPVA

SEQ ID NO: 916062 - protein, 12 aa, Mycobacterium
SAGPARAGAEEL

SEQ ID NO: 916063 - protein, 9 aa, Mycobacterium
SAGPDAVGI

SEQ ID NO: 916064 - protein, 19 aa, Mycobacterium
SAGPDAVPITKDSVEKTIA

SEQ ID NO: 916065 - protein, 7 aa, Mycobacterium
SAGPDPV

SEQ ID NO: 916066 - protein, 8 aa, Mycobacterium
SAGPDPVA

SEQ ID NO: 916067 - protein, 8 aa, Mycobacterium
SAGPDPVT

SEQ ID NO: 916068 - protein, 8 aa, Mycobacterium
SAGPEPVE

SEQ ID NO: 916069 - protein, 8 aa, Mycobacterium
SAGPEPVT

SEQ ID NO: 916070 - protein, 8 aa, Mycobacterium
SAGPQRNI

SEQ ID NO: 916071 - protein, 7 aa, Mycobacterium
SAGPTTR

SEQ ID NO: 916072 - protein, 8 aa, Mycobacterium
SAGPVDDG

SEQ ID NO: 916073 - protein, 8 aa, Mycobacterium
SAGQSGQR

SEQ ID NO: 916074 - protein, 9 aa, Mycobacterium
SAGRHPGAL

SEQ ID NO: 916075 - protein, 7 aa, Mycobacterium
SAGSGPD

SEQ ID NO: 916076 - protein, 11 aa, Mycobacterium
SAGSMPAGLDG

SEQ ID NO: 916077 - protein, 9 aa, Mycobacterium
SAGSQRKEQ

SEQ ID NO: 916078 - protein, 6 aa, Mycobacterium
SAGSTV

SEQ ID NO: 916079 - protein, 6 aa, Mycobacterium
SAGSVN

SEQ ID NO: 916080 - protein, 6 aa, Mycobacterium
SAGSYG

SEQ ID NO: 916081 - protein, 11 aa, Mycobacterium
SAGSYPTTEQT

SEQ ID NO: 916082 - protein, 11 aa, Mycobacterium
SAGTGLREGSA

SEQ ID NO: 916083 - protein, 7 aa, Mycobacterium
SAGTGTL

SEQ ID NO: 916084 - protein, 13 aa, Mycobacterium
SAGVGWADPAADA

SEQ ID NO: 916085 - protein, 12 aa, Mycobacterium
SAGYGNAAKPLP

SEQ ID NO: 916086 - protein, 5 aa, Mycobacterium
SAGYS

SEQ ID NO: 916087 - protein, 11 aa, Mycobacterium
SAHAAPQPAGR

SEQ ID NO: 916088 - protein, 23 aa, Mycobacterium
SAHGGPDAFGPTADLTRTEQVQF

SEQ ID NO: 916089 - protein, 16 aa, Mycobacterium
SAHGGVRPVEQGEGDS

SEQ ID NO: 916090 - protein, 13 aa, Mycobacterium
SAHPSFPEGEPNK

SEQ ID NO: 916091 - protein, 10 aa, Mycobacterium
SAIASGAAQM

SEQ ID NO: 916092 - protein, 5 aa, Mycobacterium
SAIPD

SEQ ID NO: 916093 - protein, 7 aa, Mycobacterium
SAKAAKV

SEQ ID NO: 916094 - protein, 10 aa, Mycobacterium
SAKESGDAND

SEQ ID NO: 916095 - protein, 19 aa, Mycobacterium
SAKPDPAAGPGVDDAQRDT

SEQ ID NO: 916096 - protein, 8 aa, Mycobacterium
SAKSPTTP

SEQ ID NO: 916097 - protein, 5 aa, Mycobacterium
SALAG

SEQ ID NO: 916098 - protein, 21 aa, Mycobacterium
SALAGRAQGRREASAVAAFLG

SEQ ID NO: 916099 - protein, 11 aa, Mycobacterium
SALAPRAAVPP

SEQ ID NO: 916100 - protein, 4 aa, Mycobacterium
SALD

SEQ ID NO: 916101 - protein, 5 aa, Mycobacterium
SALDA

SEQ ID NO: 916102 - protein, 8 aa, Mycobacterium
SALGGREA

SEQ ID NO: 916103 - protein, 228 aa, Mycobacterium
SALPGQGGEGGNGGNGGAGGGTGGTGGTGGGGFHGPGGAAGDGGTGGIGATGGDGSNGGAGGAGGTGGLYGNGGNGGTGGTGGNGGTGATGGTGGDGGIGGSSEAGTAAVGGDGGDGGTGGTGGNGGNGGDGGAAGAGGTYGQSGTNGTGGDAGTGGSGGEGGTGGNGGAGGETSSTQSPDGLSGATGAMGASGQDGIAGTTPGTGTGGPPAGGPDGNGGDGGPGVPG

SEQ ID NO: 916104 - protein, 6 aa, Mycobacterium
SALPNE

SEQ ID NO: 916105 - protein, 4 aa, Mycobacterium
SAME

SEQ ID NO: 916106 - protein, 10 aa, Mycobacterium
SAMSTLAGRG

SEQ ID NO: 916107 - protein, 7 aa, Mycobacterium
SANATLR

SEQ ID NO: 916108 - protein, 7 aa, Mycobacterium
SANDTKL

SEQ ID NO: 916109 - protein, 7 aa, Mycobacterium
SANERAT

SEQ ID NO: 916110 - protein, 4 aa, Mycobacterium
SANG

SEQ ID NO: 916111 - protein, 20 aa, Mycobacterium
SANGNGAAASTHPDHDEDER

SEQ ID NO: 916112 - protein, 7 aa, Mycobacterium
SANGTRG

SEQ ID NO: 916113 - protein, 7 aa, Mycobacterium
SANGYRT

SEQ ID NO: 916114 - protein, 8 aa, Mycobacterium
SANIPGDP

SEQ ID NO: 916115 - protein, 9 aa, Mycobacterium
SANKNLTAV

SEQ ID NO: 916116 - protein, 6 aa, Mycobacterium
SANPEN

SEQ ID NO: 916117 - protein, 13 aa, Mycobacterium
SANPLGGGPLSGN

SEQ ID NO: 916118 - protein, 4 aa, Mycobacterium
SANR

SEQ ID NO: 916119 - protein, 4 aa, Mycobacterium
SAPA

SEQ ID NO: 916120 - protein, 5 aa, Mycobacterium
SAPAA

SEQ ID NO: 916121 - protein, 7 aa, Mycobacterium
SAPAGAR

SEQ ID NO: 916122 - protein, 9 aa, Mycobacterium
SAPATEAPL

SEQ ID NO: 916123 - protein, 7 aa, Mycobacterium
SAPDATT

SEQ ID NO: 916124 - protein, 17 aa, Mycobacterium
SAPDEVSSTDTGTGGTL

SEQ ID NO: 916125 - protein, 20 aa, Mycobacterium
SAPDQTGADCDNPGVNCTDV

SEQ ID NO: 916126 - protein, 5 aa, Mycobacterium
SAPEP

SEQ ID NO: 916127 - protein, 4 aa, Mycobacterium
SAPF

SEQ ID NO: 916128 - protein, 7 aa, Mycobacterium
SAPFDAQ

SEQ ID NO: 916129 - protein, 4 aa, Mycobacterium
SAPG

SEQ ID NO: 916130 - protein, 9 aa, Mycobacterium
SAPGAELPP

SEQ ID NO: 916131 - protein, 25 aa, Mycobacterium
SAPGALRTGSRGCCSKEDASDASRV

SEQ ID NO: 916132 - protein, 9 aa, Mycobacterium
SAPGASGPH

SEQ ID NO: 916133 - protein, 10 aa, Mycobacterium
SAPGASGRNG

SEQ ID NO: 916134 - protein, 17 aa, Mycobacterium
SAPGAVSTGTFKAGPDT

SEQ ID NO: 916135 - protein, 7 aa, Mycobacterium
SAPGMEK

SEQ ID NO: 916136 - protein, 9 aa, Mycobacterium
SAPGNELST

SEQ ID NO: 916137 - protein, 5 aa, Mycobacterium
SAPGP

SEQ ID NO: 916138 - protein, 32 aa, Mycobacterium
SAPGQDTNPAGLAAQSAAVSQAAGNAPASAQS

SEQ ID NO: 916139 - protein, 7 aa, Mycobacterium
SAPGQTG

SEQ ID NO: 916140 - protein, 4 aa, Mycobacterium
SAPK

SEQ ID NO: 916141 - protein, 14 aa, Mycobacterium
SAPKPPPPAAAPDL

SEQ ID NO: 916142 - protein, 5 aa, Mycobacterium
SAPLD

SEQ ID NO: 916143 - protein, 5 aa, Mycobacterium
SAPLP

SEQ ID NO: 916144 - protein, 4 aa, Mycobacterium
SAPM

SEQ ID NO: 916145 - protein, 12 aa, Mycobacterium
SAPMGAADAAGR

SEQ ID NO: 916146 - protein, 6 aa, Mycobacterium
SAPNCP

SEQ ID NO: 916147 - protein, 9 aa, Mycobacterium
SAPNPEGAQ

SEQ ID NO: 916148 - protein, 8 aa, Mycobacterium
SAPPAGAG

SEQ ID NO: 916149 - protein, 7 aa, Mycobacterium
SAPPAHA

SEQ ID NO: 916150 - protein, 23 aa, Mycobacterium
SAPPAVQGSETTSSTTPPPPKKE

SEQ ID NO: 916151 - protein, 13 aa, Mycobacterium
SAPPTWPPRPPAA

SEQ ID NO: 916152 - protein, 6 aa, Mycobacterium
SAPQAA

SEQ ID NO: 916153 - protein, 17 aa, Mycobacterium
SAPQASASCNLTPKDDQ

SEQ ID NO: 916154 - protein, 16 aa, Mycobacterium
SAPQASASCSMSPADD

SEQ ID NO: 916155 - protein, 30 aa, Mycobacterium
SAPSAFSAASESATPAPTSKPNSRPSPQRR

SEQ ID NO: 916156 - protein, 48 aa, Mycobacterium
SAPTPPPAPDAQPTVPLTPPAPAAPVAAASGDPAAVPPAAPAADAGVP

SEQ ID NO: 916157 - protein, 93 aa, Mycobacterium
SAPTPQAPAQQLPTQQGPAQQAPTQQAPLQQAPVQQSPFTQAPQQQLPTQQAPLQQVPTQQAPLQQVPTQQAPLQQVPTQQAPAQQVPTQRAP

SEQ ID NO: 916158 - protein, 9 aa, Mycobacterium
SAPTPTRRG

SEQ ID NO: 916159 - protein, 6 aa, Mycobacterium
SAPTSA

SEQ ID NO: 916160 - protein, 4 aa, Mycobacterium
SAPV

SEQ ID NO: 916161 - protein, 7 aa, Mycobacterium
SAQAEES

SEQ ID NO: 916162 - protein, 6 aa, Mycobacterium
SAQANA

SEQ ID NO: 916163 - protein, 15 aa, Mycobacterium
SAQGALDAAAPEYAA

SEQ ID NO: 916164 - protein, 5 aa, Mycobacterium
SAQGD

SEQ ID NO: 916165 - protein, 7 aa, Mycobacterium
SAQLGAS

SEQ ID NO: 916166 - protein, 4 aa, Mycobacterium
SAQP

SEQ ID NO: 916167 - protein, 16 aa, Mycobacterium
SAQPEPEQPAPPGPSL

SEQ ID NO: 916168 - protein, 26 aa, Mycobacterium
SAQPEPTPAPDAEGPKTTIDASGSYA

SEQ ID NO: 916169 - protein, 7 aa, Mycobacterium
SAQPGPI

SEQ ID NO: 916170 - protein, 15 aa, Mycobacterium
SAQPQSVKTDDTGTK

SEQ ID NO: 916171 - protein, 7 aa, Mycobacterium
SAQQGLR

SEQ ID NO: 916172 - protein, 5 aa, Mycobacterium
SAQQN

SEQ ID NO: 916173 - protein, 8 aa, Mycobacterium
SAQTIERT

SEQ ID NO: 916174 - protein, 5 aa, Mycobacterium
SARAA

SEQ ID NO: 916175 - protein, 11 aa, Mycobacterium
SARAATNPTPR

SEQ ID NO: 916176 - protein, 8 aa, Mycobacterium
SARADAAT

SEQ ID NO: 916177 - protein, 9 aa, Mycobacterium
SARAETAQQ

SEQ ID NO: 916178 - protein, 8 aa, Mycobacterium
SARAGSFG

SEQ ID NO: 916179 - protein, 11 aa, Mycobacterium
SARDTADNVNR

SEQ ID NO: 916180 - protein, 11 aa, Mycobacterium
SARDTGEREEL

SEQ ID NO: 916181 - protein, 4 aa, Mycobacterium
SARG

SEQ ID NO: 916182 - protein, 9 aa, Mycobacterium
SARGNTEAR

SEQ ID NO: 916183 - protein, 16 aa, Mycobacterium
SARGTEPSPHEETTNY

SEQ ID NO: 916184 - protein, 4 aa, Mycobacterium
SARH

SEQ ID NO: 916185 - protein, 4 aa, Mycobacterium
SARI

SEQ ID NO: 916186 - protein, 6 aa, Mycobacterium
SARKRG

SEQ ID NO: 916187 - protein, 29 aa, Mycobacterium
SARKTGSGGGPPGADAPTHRTNSAKRGLQ

SEQ ID NO: 916188 - protein, 5 aa, Mycobacterium
SARNQ

SEQ ID NO: 916189 - protein, 8 aa, Mycobacterium
SARPNELT

SEQ ID NO: 916190 - protein, 6 aa, Mycobacterium
SARQRN

SEQ ID NO: 916191 - protein, 7 aa, Mycobacterium
SARSEAG

SEQ ID NO: 916192 - protein, 7 aa, Mycobacterium
SARTRGV

SEQ ID NO: 916193 - protein, 14 aa, Mycobacterium
SARVTNPDPEGTYQ

SEQ ID NO: 916194 - protein, 13 aa, Mycobacterium
SARVTSPEPEATY

SEQ ID NO: 916195 - protein, 11 aa, Mycobacterium
SARYDDPSASW

SEQ ID NO: 916196 - protein, 10 aa, Mycobacterium
SASAADVGEA

SEQ ID NO: 916197 - protein, 16 aa, Mycobacterium
SASARRTASEPDQAAV

SEQ ID NO: 916198 - protein, 19 aa, Mycobacterium
SASASAPARAFLQQIVELG

SEQ ID NO: 916199 - protein, 8 aa, Mycobacterium
SASDPHSR

SEQ ID NO: 916200 - protein, 11 aa, Mycobacterium
SASEHEGAKRD

SEQ ID NO: 916201 - protein, 17 aa, Mycobacterium
SASFDADAAQTREATEL

SEQ ID NO: 916202 - protein, 11 aa, Mycobacterium
SASGDYSSRAA

SEQ ID NO: 916203 - protein, 6 aa, Mycobacterium
SASGLY

SEQ ID NO: 916204 - protein, 8 aa, Mycobacterium
SASGTYDT

SEQ ID NO: 916205 - protein, 12 aa, Mycobacterium
SASGVSLSSGEH

SEQ ID NO: 916206 - protein, 23 aa, Mycobacterium
SASHPKNASPAATTTSATAAPTR

SEQ ID NO: 916207 - protein, 10 aa, Mycobacterium
SASKARGTYQ

SEQ ID NO: 916208 - protein, 10 aa, Mycobacterium
SASLSGDLSA

SEQ ID NO: 916209 - protein, 11 aa, Mycobacterium
SASMAAAAAPY

SEQ ID NO: 916210 - protein, 6 aa, Mycobacterium
SASMGR

SEQ ID NO: 916211 - protein, 7 aa, Mycobacterium
SASMRSA

SEQ ID NO: 916212 - protein, 9 aa, Mycobacterium
SASNAWDDA

SEQ ID NO: 916213 - protein, 30 aa, Mycobacterium
SASNGGWGKRAGKHFNGGVGEGAKGNAGAA

SEQ ID NO: 916214 - protein, 5 aa, Mycobacterium
SASQA

SEQ ID NO: 916215 - protein, 13 aa, Mycobacterium
SASREGAGDVNTS

SEQ ID NO: 916216 - protein, 7 aa, Mycobacterium
SASRGDL

SEQ ID NO: 916217 - protein, 14 aa, Mycobacterium
SASRPGSGIPGGPY

SEQ ID NO: 916218 - protein, 6 aa, Mycobacterium
SASRYR

SEQ ID NO: 916219 - protein, 7 aa, Mycobacterium
SASSANV

SEQ ID NO: 916220 - protein, 8 aa, Mycobacterium
SASSQRSM

SEQ ID NO: 916221 - protein, 15 aa, Mycobacterium
SASTGLASGSTTTLQ

SEQ ID NO: 916222 - protein, 7 aa, Mycobacterium
SASTTAT

SEQ ID NO: 916223 - protein, 7 aa, Mycobacterium
SASVRDE

SEQ ID NO: 916224 - protein, 10 aa, Mycobacterium
SASYRATTST

SEQ ID NO: 916225 - protein, 9 aa, Mycobacterium
SATAGATQS

SEQ ID NO: 916226 - protein, 5 aa, Mycobacterium
SATAL

SEQ ID NO: 916227 - protein, 8 aa, Mycobacterium
SATAMNGA

SEQ ID NO: 916228 - protein, 13 aa, Mycobacterium
SATDEPEARETPL

SEQ ID NO: 916229 - protein, 8 aa, Mycobacterium
SATDESAD

SEQ ID NO: 916230 - protein, 11 aa, Mycobacterium
SATDPDDTPAM

SEQ ID NO: 916231 - protein, 5 aa, Mycobacterium
SATDT

SEQ ID NO: 916232 - protein, 9 aa, Mycobacterium
SATEEANAL

SEQ ID NO: 916233 - protein, 6 aa, Mycobacterium
SATEGL

SEQ ID NO: 916234 - protein, 7 aa, Mycobacterium
SATERAR

SEQ ID NO: 916235 - protein, 8 aa, Mycobacterium
SATEREID

SEQ ID NO: 916236 - protein, 7 aa, Mycobacterium
SATFSDK

SEQ ID NO: 916237 - protein, 9 aa, Mycobacterium
SATGEMTGD

SEQ ID NO: 916238 - protein, 11 aa, Mycobacterium
SATGGAGVPRT

SEQ ID NO: 916239 - protein, 6 aa, Mycobacterium
SATGNR

SEQ ID NO: 916240 - protein, 6 aa, Mycobacterium
SATGPT

SEQ ID NO: 916241 - protein, 5 aa, Mycobacterium
SATGS

SEQ ID NO: 916242 - protein, 8 aa, Mycobacterium
SATGSNIA

SEQ ID NO: 916243 - protein, 4 aa, Mycobacterium
SATI

SEQ ID NO: 916244 - protein, 16 aa, Mycobacterium
SATIPHTDGRITGSRN

SEQ ID NO: 916245 - protein, 8 aa, Mycobacterium
SATKRAGE

SEQ ID NO: 916246 - protein, 8 aa, Mycobacterium
SATNPSDV

SEQ ID NO: 916247 - protein, 6 aa, Mycobacterium
SATPDI

SEQ ID NO: 916248 - protein, 14 aa, Mycobacterium
SATPEGDAATPFAA

SEQ ID NO: 916249 - protein, 6 aa, Mycobacterium
SATQDH

SEQ ID NO: 916250 - protein, 9 aa, Mycobacterium
SATQSAKDL

SEQ ID NO: 916251 - protein, 15 aa, Mycobacterium
SATQVRAALQRLSAA

SEQ ID NO: 916252 - protein, 9 aa, Mycobacterium
SATSAQVTA

SEQ ID NO: 916253 - protein, 6 aa, Mycobacterium
SATSDM

SEQ ID NO: 916254 - protein, 28 aa, Mycobacterium
SATSETSSSSASPSPTDTEPPPPPPPVS

SEQ ID NO: 916255 - protein, 29 aa, Mycobacterium
SATSETSSSSPSPSATEPQAPPPPPPPLS

SEQ ID NO: 916256 - protein, 7 aa, Mycobacterium
SATSRIS

SEQ ID NO: 916257 - protein, 8 aa, Mycobacterium
SATSVSAP

SEQ ID NO: 916258 - protein, 14 aa, Mycobacterium
SATTDGESAEPVPD

SEQ ID NO: 916259 - protein, 5 aa, Mycobacterium
SATTS

SEQ ID NO: 916260 - protein, 7 aa, Mycobacterium
SATTSLP

SEQ ID NO: 916261 - protein, 5 aa, Mycobacterium
SATTT

SEQ ID NO: 916262 - protein, 8 aa, Mycobacterium
SATVGSSL

SEQ ID NO: 916263 - protein, 11 aa, Mycobacterium
SAVAGEPGWST

SEQ ID NO: 916264 - protein, 15 aa, Mycobacterium
SAVAGRASVTHPDGQ

SEQ ID NO: 916265 - protein, 5 aa, Mycobacterium
SAVAP

SEQ ID NO: 916266 - protein, 10 aa, Mycobacterium
SAVAQSPDGV

SEQ ID NO: 916267 - protein, 9 aa, Mycobacterium
SAVGEAAPV

SEQ ID NO: 916268 - protein, 9 aa, Mycobacterium
SAVKNDPCK

SEQ ID NO: 916269 - protein, 13 aa, Mycobacterium
SAVKSGGPAPAAA

SEQ ID NO: 916270 - protein, 4 aa, Mycobacterium
SAVP

SEQ ID NO: 916271 - protein, 30 aa, Mycobacterium
SAVPAAANALPAAAPVAPAVPPAPRPPTIV

SEQ ID NO: 916272 - protein, 17 aa, Mycobacterium
SAVPGDPRDTSTPAALA

SEQ ID NO: 916273 - protein, 7 aa, Mycobacterium
SAVPTAR

SEQ ID NO: 916274 - protein, 4 aa, Mycobacterium
SAVS

SEQ ID NO: 916275 - protein, 10 aa, Mycobacterium
SAWDPTEGYR

SEQ ID NO: 916276 - protein, 4 aa, Mycobacterium
SAWG

SEQ ID NO: 916277 - protein, 8 aa, Mycobacterium
SAYEPAGF

SEQ ID NO: 916278 - protein, 7 aa, Mycobacterium
SAYPGTG

SEQ ID NO: 916279 - protein, 25 aa, Mycobacterium
SAYTGAGDIAPPPGWSDPPQPPGAF

SEQ ID NO: 916280 - protein, 41 aa, Mycobacterium
SAYTGAGDIPPPPGWGAPPGPRGIYQPDPDAPATPSPALYP

SEQ ID NO: 916281 - protein, 14 aa, Mycobacterium
SCAGSRQTEGDDEW

SEQ ID NO: 916282 - protein, 19 aa, Mycobacterium
SCDGPLPGLPDNAPVGSDG

SEQ ID NO: 916283 - protein, 12 aa, Mycobacterium
SCGKSGSVADGA

SEQ ID NO: 916284 - protein, 12 aa, Mycobacterium
SCGKTGSVAAGA

SEQ ID NO: 916285 - protein, 7 aa, Mycobacterium
SCGPAGI

SEQ ID NO: 916286 - protein, 10 aa, Mycobacterium
SCGSGSAGEI

SEQ ID NO: 916287 - protein, 45 aa, Mycobacterium
SCKRPPGDHASAPPAAAPPRSSAPVQRLGQPQPKAVAAPVDPDKR

SEQ ID NO: 916288 - protein, 6 aa, Mycobacterium
SCPFGG

SEQ ID NO: 916289 - protein, 4 aa, Mycobacterium
SCPN

SEQ ID NO: 916290 - protein, 5 aa, Mycobacterium
SCPPG

SEQ ID NO: 916291 - protein, 8 aa, Mycobacterium
SCPTPDEF

SEQ ID NO: 916292 - protein, 19 aa, Mycobacterium
SCSKEPGSQKLSADEAKSI

SEQ ID NO: 916293 - protein, 13 aa, Mycobacterium
SCSPTKAADPTVV

SEQ ID NO: 916294 - protein, 18 aa, Mycobacterium
SCSTAQDCSGQVTSDQGW

SEQ ID NO: 916295 - protein, 11 aa, Mycobacterium
SCTTASPSAVA

SEQ ID NO: 916296 - protein, 12 aa, Mycobacterium
SCTTSQDCTGTV

SEQ ID NO: 916297 - protein, 4 aa, Mycobacterium
SCVA

SEQ ID NO: 916298 - protein, 5 aa, Mycobacterium
SDAAD

SEQ ID NO: 916299 - protein, 6 aa, Mycobacterium
SDAADE

SEQ ID NO: 916300 - protein, 7 aa, Mycobacterium
SDAADRA

SEQ ID NO: 916301 - protein, 6 aa, Mycobacterium
SDAAPT

SEQ ID NO: 916302 - protein, 8 aa, Mycobacterium
SDAARPGF

SEQ ID NO: 916303 - protein, 4 aa, Mycobacterium
SDAD

SEQ ID NO: 916304 - protein, 11 aa, Mycobacterium
SDADGTSVPAG

SEQ ID NO: 916305 - protein, 19 aa, Mycobacterium
SDADNDRLRADPTVEYTPE

SEQ ID NO: 916306 - protein, 20 aa, Mycobacterium
SDADNDRLRTEPNVDYSPAG

SEQ ID NO: 916307 - protein, 6 aa, Mycobacterium
SDAEAR

SEQ ID NO: 916308 - protein, 6 aa, Mycobacterium
SDAGKS

SEQ ID NO: 916309 - protein, 9 aa, Mycobacterium
SDAGTSSRA

SEQ ID NO: 916310 - protein, 20 aa, Mycobacterium
SDAGTVGDVANPALQATATG

SEQ ID NO: 916311 - protein, 10 aa, Mycobacterium
SDAIDDTKAA

SEQ ID NO: 916312 - protein, 27 aa, Mycobacterium
SDAKAEGRETIDGQSTIKVSGNVSADA

SEQ ID NO: 916313 - protein, 7 aa, Mycobacterium
SDAKAQA

SEQ ID NO: 916314 - protein, 9 aa, Mycobacterium
SDAKATGQL

SEQ ID NO: 916315 - protein, 5 aa, Mycobacterium
SDALR

SEQ ID NO: 916316 - protein, 12 aa, Mycobacterium
SDANNSKGTIGA

SEQ ID NO: 916317 - protein, 9 aa, Mycobacterium
SDANPRRVR

SEQ ID NO: 916318 - protein, 8 aa, Mycobacterium
SDAPDNTV

SEQ ID NO: 916319 - protein, 14 aa, Mycobacterium
SDAQRIGNHKPTGP

SEQ ID NO: 916320 - protein, 9 aa, Mycobacterium
SDAQVDADS

SEQ ID NO: 916321 - protein, 10 aa, Mycobacterium
SDASAPRALT

SEQ ID NO: 916322 - protein, 11 aa, Mycobacterium
SDASSTLKGEG

SEQ ID NO: 916323 - protein, 8 aa, Mycobacterium
SDASYSTA

SEQ ID NO: 916324 - protein, 16 aa, Mycobacterium
SDATADGRESINGTEA

SEQ ID NO: 916325 - protein, 8 aa, Mycobacterium
SDATNPQF

SEQ ID NO: 916326 - protein, 9 aa, Mycobacterium
SDATPASTA

SEQ ID NO: 916327 - protein, 18 aa, Mycobacterium
SDATPGAGSRVARNADEI

SEQ ID NO: 916328 - protein, 18 aa, Mycobacterium
SDATVTLSARSPALANTP

SEQ ID NO: 916329 - protein, 9 aa, Mycobacterium
SDAVGAQET

SEQ ID NO: 916330 - protein, 11 aa, Mycobacterium
SDAVGGGPLAS

SEQ ID NO: 916331 - protein, 13 aa, Mycobacterium
SDAVPVNTPSDQC

SEQ ID NO: 916332 - protein, 8 aa, Mycobacterium
SDAVTAHA

SEQ ID NO: 916333 - protein, 12 aa, Mycobacterium
SDCNPGGGEESF

SEQ ID NO: 916334 - protein, 29 aa, Mycobacterium
SDDAPVSGRAGRTRAAVPTSTTDTTGSAI

SEQ ID NO: 916335 - protein, 9 aa, Mycobacterium
SDDDAVRRR

SEQ ID NO: 916336 - protein, 6 aa, Mycobacterium
SDDDPY

SEQ ID NO: 916337 - protein, 8 aa, Mycobacterium
SDDDRGRG

SEQ ID NO: 916338 - protein, 11 aa, Mycobacterium
SDDGPRLPADE

SEQ ID NO: 916339 - protein, 15 aa, Mycobacterium
SDDGPSKGKLQQNDA

SEQ ID NO: 916340 - protein, 10 aa, Mycobacterium
SDDGQSQRQL

SEQ ID NO: 916341 - protein, 7 aa, Mycobacterium
SDDGTVS

SEQ ID NO: 916342 - protein, 10 aa, Mycobacterium
SDDHTPTRTY

SEQ ID NO: 916343 - protein, 20 aa, Mycobacterium
SDDNPPVSNLGPGPDDAGGW

SEQ ID NO: 916344 - protein, 15 aa, Mycobacterium
SDDPAGRAEPDATAD

SEQ ID NO: 916345 - protein, 24 aa, Mycobacterium
SDDPAGVTEAAAQRDALAGPLESA

SEQ ID NO: 916346 - protein, 24 aa, Mycobacterium
SDDPEGRAETDATVDTLPGPLASA

SEQ ID NO: 916347 - protein, 9 aa, Mycobacterium
SDDPPGALG

SEQ ID NO: 916348 - protein, 8 aa, Mycobacterium
SDEDDDAV

SEQ ID NO: 916349 - protein, 8 aa, Mycobacterium
SDEKPPMV

SEQ ID NO: 916350 - protein, 9 aa, Mycobacterium
SDEPLPKGT

SEQ ID NO: 916351 - protein, 9 aa, Mycobacterium
SDERPPTVD

SEQ ID NO: 916352 - protein, 5 aa, Mycobacterium
SDESA

SEQ ID NO: 916353 - protein, 10 aa, Mycobacterium
SDESKPNGQI

SEQ ID NO: 916354 - protein, 9 aa, Mycobacterium
SDEYSDPDC

SEQ ID NO: 916355 - protein, 5 aa, Mycobacterium
SDFGA

SEQ ID NO: 916356 - protein, 19 aa, Mycobacterium
SDFPQYAPNPNTAAPFGRN

SEQ ID NO: 916357 - protein, 4 aa, Mycobacterium
SDGA

SEQ ID NO: 916358 - protein, 9 aa, Mycobacterium
SDGAPDNPS

SEQ ID NO: 916359 - protein, 14 aa, Mycobacterium
SDGDVIASGPTPGF

SEQ ID NO: 916360 - protein, 8 aa, Mycobacterium
SDGEPATE

SEQ ID NO: 916361 - protein, 6 aa, Mycobacterium
SDGEVE

SEQ ID NO: 916362 - protein, 13 aa, Mycobacterium
SDGEVKDERTSSA

SEQ ID NO: 916363 - protein, 6 aa, Mycobacterium
SDGGAA

SEQ ID NO: 916364 - protein, 37 aa, Mycobacterium
SDGGGTGAENADEAPQAPTVSYEPADGSSDVAPKGAV

SEQ ID NO: 916365 - protein, 6 aa, Mycobacterium
SDGGKA

SEQ ID NO: 916366 - protein, 8 aa, Mycobacterium
SDGIKQSI

SEQ ID NO: 916367 - protein, 7 aa, Mycobacterium
SDGKTAL

SEQ ID NO: 916368 - protein, 7 aa, Mycobacterium
SDGLDGR

SEQ ID NO: 916369 - protein, 8 aa, Mycobacterium
SDGNGKLV

SEQ ID NO: 916370 - protein, 8 aa, Mycobacterium
SDGNPLAG

SEQ ID NO: 916371 - protein, 9 aa, Mycobacterium
SDGNPPQVK

SEQ ID NO: 916372 - protein, 4 aa, Mycobacterium
SDGP

SEQ ID NO: 916373 - protein, 8 aa, Mycobacterium
SDGPDGPF

SEQ ID NO: 916374 - protein, 15 aa, Mycobacterium
SDGPVYDDSGNRVGT

SEQ ID NO: 916375 - protein, 6 aa, Mycobacterium
SDGRTA

SEQ ID NO: 916376 - protein, 6 aa, Mycobacterium
SDGSTI

SEQ ID NO: 916377 - protein, 8 aa, Mycobacterium
SDGSTRAN

SEQ ID NO: 916378 - protein, 5 aa, Mycobacterium
SDGSY

SEQ ID NO: 916379 - protein, 5 aa, Mycobacterium
SDGTP

SEQ ID NO: 916380 - protein, 8 aa, Mycobacterium
SDGTPFTA

SEQ ID NO: 916381 - protein, 10 aa, Mycobacterium
SDGTSTAQAT

SEQ ID NO: 916382 - protein, 15 aa, Mycobacterium
SDGTSVAAGQNTSEQ

SEQ ID NO: 916383 - protein, 9 aa, Mycobacterium
SDGTSVTPV

SEQ ID NO: 916384 - protein, 6 aa, Mycobacterium
SDGTTL

SEQ ID NO: 916385 - protein, 4 aa, Mycobacterium
SDGV

SEQ ID NO: 916386 - protein, 12 aa, Mycobacterium
SDGVTVATGERI

SEQ ID NO: 916387 - protein, 8 aa, Mycobacterium
SDHVDDDA

SEQ ID NO: 916388 - protein, 10 aa, Mycobacterium
SDIEKDGTTV

SEQ ID NO: 916389 - protein, 7 aa, Mycobacterium
SDIGATG

SEQ ID NO: 916390 - protein, 11 aa, Mycobacterium
SDIGNGRGPVD

SEQ ID NO: 916391 - protein, 13 aa, Mycobacterium
SDIPDEAAGTVSR

SEQ ID NO: 916392 - protein, 8 aa, Mycobacterium
SDKAVGAG

SEQ ID NO: 916393 - protein, 16 aa, Mycobacterium
SDKKFAEAYGSAGGAN

SEQ ID NO: 916394 - protein, 10 aa, Mycobacterium
SDKNPSNVKA

SEQ ID NO: 916395 - protein, 8 aa, Mycobacterium
SDKTPSNV

SEQ ID NO: 916396 - protein, 14 aa, Mycobacterium
SDLAKGGPVHSQAE

SEQ ID NO: 916397 - protein, 11 aa, Mycobacterium
SDLARRGSPDA

SEQ ID NO: 916398 - protein, 9 aa, Mycobacterium
SDLDQAKAR

SEQ ID NO: 916399 - protein, 10 aa, Mycobacterium
SDLGPRGRKE

SEQ ID NO: 916400 - protein, 20 aa, Mycobacterium
SDLNTRGGLASHAEKMGPAY

SEQ ID NO: 916401 - protein, 6 aa, Mycobacterium
SDLPSS

SEQ ID NO: 916402 - protein, 8 aa, Mycobacterium
SDLPSSAQ

SEQ ID NO: 916403 - protein, 9 aa, Mycobacterium
SDLSRGQYT

SEQ ID NO: 916404 - protein, 14 aa, Mycobacterium
SDLVEGGIGGTEAR

SEQ ID NO: 916405 - protein, 24 aa, Mycobacterium
SDNATAAGSCPTAVPQSGGTPDWT

SEQ ID NO: 916406 - protein, 9 aa, Mycobacterium
SDNEAELAP

SEQ ID NO: 916407 - protein, 17 aa, Mycobacterium
SDNEPIADGLAPEKGAT

SEQ ID NO: 916408 - protein, 7 aa, Mycobacterium
SDNPHAP

SEQ ID NO: 916409 - protein, 6 aa, Mycobacterium
SDNSDT

SEQ ID NO: 916410 - protein, 8 aa, Mycobacterium
SDPAANAN

SEQ ID NO: 916411 - protein, 13 aa, Mycobacterium
SDPAARESDGPAV

SEQ ID NO: 916412 - protein, 8 aa, Mycobacterium
SDPAEIEA

SEQ ID NO: 916413 - protein, 19 aa, Mycobacterium
SDPAGGGSRTLPVTLGKAD

SEQ ID NO: 916414 - protein, 14 aa, Mycobacterium
SDPAGRPDGRRPIG

SEQ ID NO: 916415 - protein, 12 aa, Mycobacterium
SDPAREDPDVPA

SEQ ID NO: 916416 - protein, 7 aa, Mycobacterium
SDPATFP

SEQ ID NO: 916417 - protein, 10 aa, Mycobacterium
SDPATQTTEA

SEQ ID NO: 916418 - protein, 5 aa, Mycobacterium
SDPAV

SEQ ID NO: 916419 - protein, 9 aa, Mycobacterium
SDPAVQTTE

SEQ ID NO: 916420 - protein, 8 aa, Mycobacterium
SDPDNEVH

SEQ ID NO: 916421 - protein, 7 aa, Mycobacterium
SDPDQLA

SEQ ID NO: 916422 - protein, 8 aa, Mycobacterium
SDPDVAPG

SEQ ID NO: 916423 - protein, 7 aa, Mycobacterium
SDPGGNY

SEQ ID NO: 916424 - protein, 9 aa, Mycobacterium
SDPKRGRAV

SEQ ID NO: 916425 - protein, 15 aa, Mycobacterium
SDPLNGTTNIAGPDK

SEQ ID NO: 916426 - protein, 5 aa, Mycobacterium
SDPRE

SEQ ID NO: 916427 - protein, 15 aa, Mycobacterium
SDPRSPGLSAGKPIK

SEQ ID NO: 916428 - protein, 6 aa, Mycobacterium
SDPRVD

SEQ ID NO: 916429 - protein, 5 aa, Mycobacterium
SDPSD

SEQ ID NO: 916430 - protein, 5 aa, Mycobacterium
SDPTD

SEQ ID NO: 916431 - protein, 5 aa, Mycobacterium
SDPTN

SEQ ID NO: 916432 - protein, 4 aa, Mycobacterium
SDPV

SEQ ID NO: 916433 - protein, 4 aa, Mycobacterium
SDQF

SEQ ID NO: 916434 - protein, 8 aa, Mycobacterium
SDQIPTEV

SEQ ID NO: 916435 - protein, 21 aa, Mycobacterium
SDQPQGQPPPAPAPTPSPSAF

SEQ ID NO: 916436 - protein, 4 aa, Mycobacterium
SDRA

SEQ ID NO: 916437 - protein, 11 aa, Mycobacterium
SDRAGEPSETV

SEQ ID NO: 916438 - protein, 10 aa, Mycobacterium
SDRASQPAMR

SEQ ID NO: 916439 - protein, 17 aa, Mycobacterium
SDRGTVDGASDGDGVQR

SEQ ID NO: 916440 - protein, 5 aa, Mycobacterium
SDRKA

SEQ ID NO: 916441 - protein, 8 aa, Mycobacterium
SDRKATRD

SEQ ID NO: 916442 - protein, 5 aa, Mycobacterium
SDRPA

SEQ ID NO: 916443 - protein, 6 aa, Mycobacterium
SDSAGV

SEQ ID NO: 916444 - protein, 6 aa, Mycobacterium
SDSAHA

SEQ ID NO: 916445 - protein, 12 aa, Mycobacterium
SDSALDNPTPCT

SEQ ID NO: 916446 - protein, 20 aa, Mycobacterium
SDSEPQGPSVPTSEEPQQNV

SEQ ID NO: 916447 - protein, 6 aa, Mycobacterium
SDSGRA

SEQ ID NO: 916448 - protein, 8 aa, Mycobacterium
SDSKAAEI

SEQ ID NO: 916449 - protein, 7 aa, Mycobacterium
SDSPDEV

SEQ ID NO: 916450 - protein, 5 aa, Mycobacterium
SDSQF

SEQ ID NO: 916451 - protein, 19 aa, Mycobacterium
SDSQQNGGGEGGSPPQMEP

SEQ ID NO: 916452 - protein, 27 aa, Mycobacterium
SDSRQDLTAEQQQNLATGGDIGTGRTD

SEQ ID NO: 916453 - protein, 10 aa, Mycobacterium
SDSSGTTDNF

SEQ ID NO: 916454 - protein, 11 aa, Mycobacterium
SDSYSGADFPA

SEQ ID NO: 916455 - protein, 4 aa, Mycobacterium
SDTA

SEQ ID NO: 916456 - protein, 11 aa, Mycobacterium
SDTAATAQERR

SEQ ID NO: 916457 - protein, 6 aa, Mycobacterium
SDTDTG

SEQ ID NO: 916458 - protein, 7 aa, Mycobacterium
SDTEAAE

SEQ ID NO: 916459 - protein, 6 aa, Mycobacterium
SDTGIE

SEQ ID NO: 916460 - protein, 6 aa, Mycobacterium
SDTGSG

SEQ ID NO: 916461 - protein, 12 aa, Mycobacterium
SDTGYSIETSAT

SEQ ID NO: 916462 - protein, 10 aa, Mycobacterium
SDTIGKRDEQ

SEQ ID NO: 916463 - protein, 8 aa, Mycobacterium
SDTKIPAD

SEQ ID NO: 916464 - protein, 9 aa, Mycobacterium
SDTNPEGLD

SEQ ID NO: 916465 - protein, 9 aa, Mycobacterium
SDTPEGGWS

SEQ ID NO: 916466 - protein, 8 aa, Mycobacterium
SDTQAAEA

SEQ ID NO: 916467 - protein, 20 aa, Mycobacterium
SDTTDTGDRDDLKPGVPDRS

SEQ ID NO: 916468 - protein, 17 aa, Mycobacterium
SDVAATDPGVADGAGAG

SEQ ID NO: 916469 - protein, 10 aa, Mycobacterium
SDVKSSFGPD

SEQ ID NO: 916470 - protein, 10 aa, Mycobacterium
SDVNGQTVPA

SEQ ID NO: 916471 - protein, 10 aa, Mycobacterium
SDVPEGAPPR

SEQ ID NO: 916472 - protein, 5 aa, Mycobacterium
SDVPL

SEQ ID NO: 916473 - protein, 7 aa, Mycobacterium
SDVPPST

SEQ ID NO: 916474 - protein, 9 aa, Mycobacterium
SDVTPNDEF

SEQ ID NO: 916475 - protein, 4 aa, Mycobacterium
SDWD

SEQ ID NO: 916476 - protein, 7 aa, Mycobacterium
SDYADRG

SEQ ID NO: 916477 - protein, 9 aa, Mycobacterium
SEAAQGNYA

SEQ ID NO: 916478 - protein, 13 aa, Mycobacterium
SEAARRQLEETDD

SEQ ID NO: 916479 - protein, 9 aa, Mycobacterium
SEADGPVPT

SEQ ID NO: 916480 - protein, 10 aa, Mycobacterium
SEADRERADA

SEQ ID NO: 916481 - protein, 5 aa, Mycobacterium
SEAGV

SEQ ID NO: 916482 - protein, 10 aa, Mycobacterium
SEAKSAVAQT

SEQ ID NO: 916483 - protein, 10 aa, Mycobacterium
SEALDPTKMP

SEQ ID NO: 916484 - protein, 19 aa, Mycobacterium
SEALGEQTWRESGLGARTD

SEQ ID NO: 916485 - protein, 13 aa, Mycobacterium
SEAMPDPSKEPPA

SEQ ID NO: 916486 - protein, 18 aa, Mycobacterium
SEAPSAVAASPRLPTTDR

SEQ ID NO: 916487 - protein, 8 aa, Mycobacterium
SEARKAEL

SEQ ID NO: 916488 - protein, 7 aa, Mycobacterium
SEARLGD

SEQ ID NO: 916489 - protein, 5 aa, Mycobacterium
SEASA

SEQ ID NO: 916490 - protein, 16 aa, Mycobacterium
SEATAATIGEDAITYD

SEQ ID NO: 916491 - protein, 6 aa, Mycobacterium
SEAYPD

SEQ ID NO: 916492 - protein, 4 aa, Mycobacterium
SEDE

SEQ ID NO: 916493 - protein, 23 aa, Mycobacterium
SEDPAGLAEADATENTLPGPLET

SEQ ID NO: 916494 - protein, 13 aa, Mycobacterium
SEDPAGLAETDAT

SEQ ID NO: 916495 - protein, 22 aa, Mycobacterium
SEDPAGLTEADATSDTLPGPIR

SEQ ID NO: 916496 - protein, 6 aa, Mycobacterium
SEDPEA

SEQ ID NO: 916497 - protein, 7 aa, Mycobacterium
SEDQPGL

SEQ ID NO: 916498 - protein, 16 aa, Mycobacterium
SEDTPGCTADDYDGLP

SEQ ID NO: 916499 - protein, 9 aa, Mycobacterium
SEEERREAL

SEQ ID NO: 916500 - protein, 7 aa, Mycobacterium
SEEPSVT

SEQ ID NO: 916501 - protein, 6 aa, Mycobacterium
SEESAV

SEQ ID NO: 916502 - protein, 13 aa, Mycobacterium
SEESGSTPPRPMP

SEQ ID NO: 916503 - protein, 4 aa, Mycobacterium
SEFP

SEQ ID NO: 916504 - protein, 7 aa, Mycobacterium
SEGERNN

SEQ ID NO: 916505 - protein, 5 aa, Mycobacterium
SEGGS

SEQ ID NO: 916506 - protein, 7 aa, Mycobacterium
SEGHDYD

SEQ ID NO: 916507 - protein, 10 aa, Mycobacterium
SEGKGWRQPE

SEQ ID NO: 916508 - protein, 8 aa, Mycobacterium
SEGKPTLT

SEQ ID NO: 916509 - protein, 34 aa, Mycobacterium
SEGMGAKVGSADVKVDGKTYTITGEASGADVKNP

SEQ ID NO: 916510 - protein, 7 aa, Mycobacterium
SEGPSRK

SEQ ID NO: 916511 - protein, 4 aa, Mycobacterium
SEGR

SEQ ID NO: 916512 - protein, 9 aa, Mycobacterium
SEGSPHYRD

SEQ ID NO: 916513 - protein, 20 aa, Mycobacterium
SEGTPGASAKATKDGKKYHI

SEQ ID NO: 916514 - protein, 5 aa, Mycobacterium
SEGWR

SEQ ID NO: 916515 - protein, 5 aa, Mycobacterium
SEGYT

SEQ ID NO: 916516 - protein, 4 aa, Mycobacterium
SEHG

SEQ ID NO: 916517 - protein, 4 aa, Mycobacterium
SEHL

SEQ ID NO: 916518 - protein, 5 aa, Mycobacterium
SEHSH

SEQ ID NO: 916519 - protein, 18 aa, Mycobacterium
SEHTATGEHAGVWCQVLS

SEQ ID NO: 916520 - protein, 13 aa, Mycobacterium
SEIERRRGDLPTG

SEQ ID NO: 916521 - protein, 5 aa, Mycobacterium
SEIGA

SEQ ID NO: 916522 - protein, 10 aa, Mycobacterium
SEIGAGQPAA

SEQ ID NO: 916523 - protein, 9 aa, Mycobacterium
SEIGSEHGP

SEQ ID NO: 916524 - protein, 13 aa, Mycobacterium
SEIHTADAQNLEE

SEQ ID NO: 916525 - protein, 7 aa, Mycobacterium
SEIRSNA

SEQ ID NO: 916526 - protein, 8 aa, Mycobacterium
SEKGGDLR

SEQ ID NO: 916527 - protein, 8 aa, Mycobacterium
SEKQTPNV

SEQ ID NO: 916528 - protein, 7 aa, Mycobacterium
SELDPGI

SEQ ID NO: 916529 - protein, 15 aa, Mycobacterium
SELVPPGSPLQPGQI

SEQ ID NO: 916530 - protein, 5 aa, Mycobacterium
SEMTE

SEQ ID NO: 916531 - protein, 8 aa, Mycobacterium
SENAKYGV

SEQ ID NO: 916532 - protein, 10 aa, Mycobacterium
SENAPPGTVS

SEQ ID NO: 916533 - protein, 8 aa, Mycobacterium
SENHGPAP

SEQ ID NO: 916534 - protein, 6 aa, Mycobacterium
SENQDE

SEQ ID NO: 916535 - protein, 4 aa, Mycobacterium
SEPA

SEQ ID NO: 916536 - protein, 6 aa, Mycobacterium
SEPAVQ

SEQ ID NO: 916537 - protein, 4 aa, Mycobacterium
SEPD

SEQ ID NO: 916538 - protein, 7 aa, Mycobacterium
SEPDPDC

SEQ ID NO: 916539 - protein, 7 aa, Mycobacterium
SEPDQLA

SEQ ID NO: 916540 - protein, 5 aa, Mycobacterium
SEPGL

SEQ ID NO: 916541 - protein, 12 aa, Mycobacterium
SEPRPTCNFAYW

SEQ ID NO: 916542 - protein, 11 aa, Mycobacterium
SEPVEDNDSFD

SEQ ID NO: 916543 - protein, 22 aa, Mycobacterium
SEPVPPPDNTADDPPPDNGRER

SEQ ID NO: 916544 - protein, 4 aa, Mycobacterium
SEQE

SEQ ID NO: 916545 - protein, 8 aa, Mycobacterium
SEQEKTHY

SEQ ID NO: 916546 - protein, 5 aa, Mycobacterium
SEQLV

SEQ ID NO: 916547 - protein, 11 aa, Mycobacterium
SEQTAPEAYGD

SEQ ID NO: 916548 - protein, 11 aa, Mycobacterium
SEQTTPAAIGA

SEQ ID NO: 916549 - protein, 8 aa, Mycobacterium
SERGYDAQ

SEQ ID NO: 916550 - protein, 8 aa, Mycobacterium
SERKATRD

SEQ ID NO: 916551 - protein, 9 aa, Mycobacterium
SERPHTEGH

SEQ ID NO: 916552 - protein, 11 aa, Mycobacterium
SERSAPAAEVS

SEQ ID NO: 916553 - protein, 4 aa, Mycobacterium
SERV

SEQ ID NO: 916554 - protein, 7 aa, Mycobacterium
SESDAQQ

SEQ ID NO: 916555 - protein, 10 aa, Mycobacterium
SESDDAEARV

SEQ ID NO: 916556 - protein, 7 aa, Mycobacterium
SESGAEL

SEQ ID NO: 916557 - protein, 8 aa, Mycobacterium
SESGGLLP

SEQ ID NO: 916558 - protein, 7 aa, Mycobacterium
SESGVAG

SEQ ID NO: 916559 - protein, 27 aa, Mycobacterium
SESPPGDVPSDFGSGARIADAGTDEAA

SEQ ID NO: 916560 - protein, 9 aa, Mycobacterium
SESRPGANF

SEQ ID NO: 916561 - protein, 13 aa, Mycobacterium
SESSETTRNQTSA

SEQ ID NO: 916562 - protein, 11 aa, Mycobacterium
SESSGTARTAN

SEQ ID NO: 916563 - protein, 7 aa, Mycobacterium
SESTGGS

SEQ ID NO: 916564 - protein, 6 aa, Mycobacterium
SETAGV

SEQ ID NO: 916565 - protein, 35 aa, Mycobacterium
SETASPPAATPTTSTSAQKKAAGTAPAPAPITGPL

SEQ ID NO: 916566 - protein, 12 aa, Mycobacterium
SETLAEATDREL

SEQ ID NO: 916567 - protein, 11 aa, Mycobacterium
SETPPSAVPPG

SEQ ID NO: 916568 - protein, 15 aa, Mycobacterium
SETRRITRTEENGDI

SEQ ID NO: 916569 - protein, 9 aa, Mycobacterium
SETSGATPI

SEQ ID NO: 916570 - protein, 8 aa, Mycobacterium
SETSGLTP

SEQ ID NO: 916571 - protein, 7 aa, Mycobacterium
SETTALN

SEQ ID NO: 916572 - protein, 9 aa, Mycobacterium
SETTTSSAV

SEQ ID NO: 916573 - protein, 12 aa, Mycobacterium
SETVRDGKPAAK

SEQ ID NO: 916574 - protein, 33 aa, Mycobacterium
SETVSAPPLTPTAPTSASKTTTRAGPAPITGPL

SEQ ID NO: 916575 - protein, 6 aa, Mycobacterium
SETYKP

SEQ ID NO: 916576 - protein, 4 aa, Mycobacterium
SEVA

SEQ ID NO: 916577 - protein, 7 aa, Mycobacterium
SEVAADG

SEQ ID NO: 916578 - protein, 10 aa, Mycobacterium
SEVATGHQGI

SEQ ID NO: 916579 - protein, 6 aa, Mycobacterium
SEVNGN

SEQ ID NO: 916580 - protein, 11 aa, Mycobacterium
SEVTADGGDTS

SEQ ID NO: 916581 - protein, 10 aa, Mycobacterium
SEVTGSEPRL

SEQ ID NO: 916582 - protein, 9 aa, Mycobacterium
SEVVANGSA

SEQ ID NO: 916583 - protein, 7 aa, Mycobacterium
SEWAQGA

SEQ ID NO: 916584 - protein, 11 aa, Mycobacterium
SEYADSGSTGV

SEQ ID NO: 916585 - protein, 12 aa, Mycobacterium
SFADPTVRNYSA

SEQ ID NO: 916586 - protein, 10 aa, Mycobacterium
SFAGRDQSLG

SEQ ID NO: 916587 - protein, 8 aa, Mycobacterium
SFAPSGRA

SEQ ID NO: 916588 - protein, 7 aa, Mycobacterium
SFARGAA

SEQ ID NO: 916589 - protein, 16 aa, Mycobacterium
SFASPCTGTVGPAPHT

SEQ ID NO: 916590 - protein, 5 aa, Mycobacterium
SFDSD

SEQ ID NO: 916591 - protein, 5 aa, Mycobacterium
SFGAA

SEQ ID NO: 916592 - protein, 19 aa, Mycobacterium
SFGASGDQSRAVVDGKPAD

SEQ ID NO: 916593 - protein, 11 aa, Mycobacterium
SFGDEQVSPSV

SEQ ID NO: 916594 - protein, 6 aa, Mycobacterium
SFGEGN

SEQ ID NO: 916595 - protein, 8 aa, Mycobacterium
SFGRDPET

SEQ ID NO: 916596 - protein, 17 aa, Mycobacterium
SFGSNSSTSATGGVNLG

SEQ ID NO: 916597 - protein, 6 aa, Mycobacterium
SFGTTA

SEQ ID NO: 916598 - protein, 10 aa, Mycobacterium
SFKKSSENVR

SEQ ID NO: 916599 - protein, 11 aa, Mycobacterium
SFPASAAPSGW

SEQ ID NO: 916600 - protein, 7 aa, Mycobacterium
SFPDDLD

SEQ ID NO: 916601 - protein, 16 aa, Mycobacterium
SFPETSAIADPHARGY

SEQ ID NO: 916602 - protein, 6 aa, Mycobacterium
SFPGPT

SEQ ID NO: 916603 - protein, 6 aa, Mycobacterium
SFPNDL

SEQ ID NO: 916604 - protein, 17 aa, Mycobacterium
SFPRDKACGDGLTPRAV

SEQ ID NO: 916605 - protein, 5 aa, Mycobacterium
SFRDA

SEQ ID NO: 916606 - protein, 14 aa, Mycobacterium
SFRDGTRVAASAPD

SEQ ID NO: 916607 - protein, 14 aa, Mycobacterium
SFRDGTRVAATAPD

SEQ ID NO: 916608 - protein, 14 aa, Mycobacterium
SFRDGTRVAGTAPD

SEQ ID NO: 916609 - protein, 16 aa, Mycobacterium
SFSPPSNCLLNGQYPC

SEQ ID NO: 916610 - protein, 26 aa, Mycobacterium
SFTTDPNDVPPENVKTIPGNADHGPI

SEQ ID NO: 916611 - protein, 18 aa, Mycobacterium
SFTTTSEAALKDGGTYGV

SEQ ID NO: 916612 - protein, 10 aa, Mycobacterium
SGAAAETADL

SEQ ID NO: 916613 - protein, 21 aa, Mycobacterium
SGAAAGVTSIASSGMSTSPAI

SEQ ID NO: 916614 - protein, 9 aa, Mycobacterium
SGAAGTAGM

SEQ ID NO: 916615 - protein, 6 aa, Mycobacterium
SGAAMP

SEQ ID NO: 916616 - protein, 13 aa, Mycobacterium
SGAATQESPTDAT

SEQ ID NO: 916617 - protein, 5 aa, Mycobacterium
SGADI

SEQ ID NO: 916618 - protein, 6 aa, Mycobacterium
SGADKN

SEQ ID NO: 916619 - protein, 8 aa, Mycobacterium
SGADPEAK

SEQ ID NO: 916620 - protein, 6 aa, Mycobacterium
SGADVN

SEQ ID NO: 916621 - protein, 8 aa, Mycobacterium
SGAEGGVA

SEQ ID NO: 916622 - protein, 14 aa, Mycobacterium
SGAESRDADPDNPV

SEQ ID NO: 916623 - protein, 20 aa, Mycobacterium
SGAETDPHSYEASPSDAAAI

SEQ ID NO: 916624 - protein, 5 aa, Mycobacterium
SGAGA

SEQ ID NO: 916625 - protein, 6 aa, Mycobacterium
SGAGAY

SEQ ID NO: 916626 - protein, 7 aa, Mycobacterium
SGAGDMS

SEQ ID NO: 916627 - protein, 8 aa, Mycobacterium
SGAGGAMT

SEQ ID NO: 916628 - protein, 6 aa, Mycobacterium
SGAGPA

SEQ ID NO: 916629 - protein, 7 aa, Mycobacterium
SGAGPSV

SEQ ID NO: 916630 - protein, 13 aa, Mycobacterium
SGAGSAVAAAGDA

SEQ ID NO: 916631 - protein, 7 aa, Mycobacterium
SGAGVQA

SEQ ID NO: 916632 - protein, 10 aa, Mycobacterium
SGAHRPTPTI

SEQ ID NO: 916633 - protein, 4 aa, Mycobacterium
SGAI

SEQ ID NO: 916634 - protein, 6 aa, Mycobacterium
SGAITR

SEQ ID NO: 916635 - protein, 8 aa, Mycobacterium
SGAKASDW

SEQ ID NO: 916636 - protein, 22 aa, Mycobacterium
SGAKMAESTKAVDVERDSAGRI

SEQ ID NO: 916637 - protein, 11 aa, Mycobacterium
SGAKSDAGDAK

SEQ ID NO: 916638 - protein, 6 aa, Mycobacterium
SGALPR

SEQ ID NO: 916639 - protein, 6 aa, Mycobacterium
SGAPAL

SEQ ID NO: 916640 - protein, 11 aa, Mycobacterium
SGAPAPADPGA

SEQ ID NO: 916641 - protein, 16 aa, Mycobacterium
SGAPDLAAMHAIRLVD

SEQ ID NO: 916642 - protein, 7 aa, Mycobacterium
SGAPEER

SEQ ID NO: 916643 - protein, 14 aa, Mycobacterium
SGAPFNGASLQGKP

SEQ ID NO: 916644 - protein, 14 aa, Mycobacterium
SGAPFSGASLQGKP

SEQ ID NO: 916645 - protein, 8 aa, Mycobacterium
SGAPHPAA

SEQ ID NO: 916646 - protein, 8 aa, Mycobacterium
SGAPRGSA

SEQ ID NO: 916647 - protein, 17 aa, Mycobacterium
SGAPSVPAANMPPGSVE

SEQ ID NO: 916648 - protein, 6 aa, Mycobacterium
SGAPTH

SEQ ID NO: 916649 - protein, 15 aa, Mycobacterium
SGAPVSAPRTGGPVQ

SEQ ID NO: 916650 - protein, 5 aa, Mycobacterium
SGAPY

SEQ ID NO: 916651 - protein, 8 aa, Mycobacterium
SGAQGADV

SEQ ID NO: 916652 - protein, 5 aa, Mycobacterium
SGARD

SEQ ID NO: 916653 - protein, 6 aa, Mycobacterium
SGASAV

SEQ ID NO: 916654 - protein, 9 aa, Mycobacterium
SGASLGESA

SEQ ID NO: 916655 - protein, 15 aa, Mycobacterium
SGASTEPGSSNTKER

SEQ ID NO: 916656 - protein, 32 aa, Mycobacterium
SGATASSTTSTTATTATTSTTSTTPVKLPEGA

SEQ ID NO: 916657 - protein, 5 aa, Mycobacterium
SGATE

SEQ ID NO: 916658 - protein, 11 aa, Mycobacterium
SGATPAEQAAY

SEQ ID NO: 916659 - protein, 25 aa, Mycobacterium
SGAVTKTATLENAPNELSGAVGHEH

SEQ ID NO: 916660 - protein, 13 aa, Mycobacterium
SGCDGNPPALPTG

SEQ ID NO: 916661 - protein, 17 aa, Mycobacterium
SGCDSHNASPPGANPRQ

SEQ ID NO: 916662 - protein, 15 aa, Mycobacterium
SGCPQAFTGNPAAAE

SEQ ID NO: 916663 - protein, 47 aa, Mycobacterium
SGCSGGNKSGTSASSSASSSGTSASASTGGAAGTKVTIDGKDQNVSG

SEQ ID NO: 916664 - protein, 14 aa, Mycobacterium
SGCSSGDDAVAQGG

SEQ ID NO: 916665 - protein, 29 aa, Mycobacterium
SGCSSNKSSSGGSGTSSAVNTSAGAASGT

SEQ ID NO: 916666 - protein, 33 aa, Mycobacterium
SGCSSNKSTSSGGSSSSAATSTSTGGGGGASGT

SEQ ID NO: 916667 - protein, 4 aa, Mycobacterium
SGCV

SEQ ID NO: 916668 - protein, 11 aa, Mycobacterium
SGDAPPAPGDV

SEQ ID NO: 916669 - protein, 6 aa, Mycobacterium
SGDAVD

SEQ ID NO: 916670 - protein, 10 aa, Mycobacterium
SGDDQRRTLA

SEQ ID NO: 916671 - protein, 8 aa, Mycobacterium
SGDECDIN

SEQ ID NO: 916672 - protein, 11 aa, Mycobacterium
SGDGAADATNR

SEQ ID NO: 916673 - protein, 7 aa, Mycobacterium
SGDGERA

SEQ ID NO: 916674 - protein, 18 aa, Mycobacterium
SGDGNMGGVADGGGSTVS

SEQ ID NO: 916675 - protein, 9 aa, Mycobacterium
SGDGPSAPV

SEQ ID NO: 916676 - protein, 9 aa, Mycobacterium
SGDGSLQAR

SEQ ID NO: 916677 - protein, 7 aa, Mycobacterium
SGDGVPE

SEQ ID NO: 916678 - protein, 4 aa, Mycobacterium
SGDH

SEQ ID NO: 916679 - protein, 7 aa, Mycobacterium
SGDHPRY

SEQ ID NO: 916680 - protein, 6 aa, Mycobacterium
SGDHQL

SEQ ID NO: 916681 - protein, 15 aa, Mycobacterium
SGDIEGAKAQYPTSR

SEQ ID NO: 916682 - protein, 15 aa, Mycobacterium
SGDLPEDRAGNCEDE

SEQ ID NO: 916683 - protein, 14 aa, Mycobacterium
SGDLTTNPTAAKGN

SEQ ID NO: 916684 - protein, 5 aa, Mycobacterium
SGDNN

SEQ ID NO: 916685 - protein, 4 aa, Mycobacterium
SGDP

SEQ ID NO: 916686 - protein, 11 aa, Mycobacterium
SGDPLTTDQDG

SEQ ID NO: 916687 - protein, 10 aa, Mycobacterium
SGDQFNTGRR

SEQ ID NO: 916688 - protein, 9 aa, Mycobacterium
SGDQPDSPQ

SEQ ID NO: 916689 - protein, 18 aa, Mycobacterium
SGDQYNAGRHISPDQARR

SEQ ID NO: 916690 - protein, 18 aa, Mycobacterium
SGDQYNTGRKVPVNQAKR

SEQ ID NO: 916691 - protein, 19 aa, Mycobacterium
SGDRFEKTTGTLAPRAAVP

SEQ ID NO: 916692 - protein, 5 aa, Mycobacterium
SGDTP

SEQ ID NO: 916693 - protein, 8 aa, Mycobacterium
SGDTRLPA

SEQ ID NO: 916694 - protein, 9 aa, Mycobacterium
SGDTTKSDN

SEQ ID NO: 916695 - protein, 4 aa, Mycobacterium
SGDV

SEQ ID NO: 916696 - protein, 4 aa, Mycobacterium
SGEA

SEQ ID NO: 916697 - protein, 10 aa, Mycobacterium
SGEAPNLEPP

SEQ ID NO: 916698 - protein, 9 aa, Mycobacterium
SGEDPAVDR

SEQ ID NO: 916699 - protein, 15 aa, Mycobacterium
SGEDTAFTAGRQGIG

SEQ ID NO: 916700 - protein, 14 aa, Mycobacterium
SGEETRKRKAHNGF

SEQ ID NO: 916701 - protein, 7 aa, Mycobacterium
SGEGADE

SEQ ID NO: 916702 - protein, 13 aa, Mycobacterium
SGEIKAGEPRTDG

SEQ ID NO: 916703 - protein, 4 aa, Mycobacterium
SGEK

SEQ ID NO: 916704 - protein, 12 aa, Mycobacterium
SGELPSTDTYCP

SEQ ID NO: 916705 - protein, 4 aa, Mycobacterium
SGEN

SEQ ID NO: 916706 - protein, 11 aa, Mycobacterium
SGEQVAPSKLS

SEQ ID NO: 916707 - protein, 13 aa, Mycobacterium
SGESATGGQIAQR

SEQ ID NO: 916708 - protein, 6 aa, Mycobacterium
SGETCG

SEQ ID NO: 916709 - protein, 15 aa, Mycobacterium
SGEVTSRAVDGQDDV

SEQ ID NO: 916710 - protein, 6 aa, Mycobacterium
SGFAPS

SEQ ID NO: 916711 - protein, 6 aa, Mycobacterium
SGFGRG

SEQ ID NO: 916712 - protein, 7 aa, Mycobacterium
SGFPRTD

SEQ ID NO: 916713 - protein, 6 aa, Mycobacterium
SGFRNG

SEQ ID NO: 916714 - protein, 51 aa, Mycobacterium
SGFTDDTADSRSQTSKTTGSETHAKQAADTEPDTAIARGNDLSDRPAIPPE

SEQ ID NO: 916715 - protein, 15 aa, Mycobacterium
SGFVSPPTARASASS

SEQ ID NO: 916716 - protein, 5 aa, Mycobacterium
SGGAA

SEQ ID NO: 916717 - protein, 30 aa, Mycobacterium
SGGAGGDGGAATGTGGAGGNGGAGGAASGL

SEQ ID NO: 916718 - protein, 11 aa, Mycobacterium
SGGAGGNGGAA

SEQ ID NO: 916719 - protein, 7 aa, Mycobacterium
SGGAGLT

SEQ ID NO: 916720 - protein, 8 aa, Mycobacterium
SGGAPQTI

SEQ ID NO: 916721 - protein, 41 aa, Mycobacterium
SGGDDDTDAAGTTTSTSAAPDTPDTAGAQAPTTTAKPACEG

SEQ ID NO: 916722 - protein, 6 aa, Mycobacterium
SGGDPI

SEQ ID NO: 916723 - protein, 8 aa, Mycobacterium
SGGDPIDA

SEQ ID NO: 916724 - protein, 11 aa, Mycobacterium
SGGETNCATAG

SEQ ID NO: 916725 - protein, 29 aa, Mycobacterium
SGGGDDAPTEPTAAPPTTTVSSRDTDAET

SEQ ID NO: 916726 - protein, 20 aa, Mycobacterium
SGGGDGETRPAGGAATAEAA

SEQ ID NO: 916727 - protein, 8 aa, Mycobacterium
SGGGGGNT

SEQ ID NO: 916728 - protein, 11 aa, Mycobacterium
SGGGGWTPSDI

SEQ ID NO: 916729 - protein, 15 aa, Mycobacterium
SGGGQVLSEDGRRVT

SEQ ID NO: 916730 - protein, 7 aa, Mycobacterium
SGGGYEY

SEQ ID NO: 916731 - protein, 9 aa, Mycobacterium
SGGIRDDEA

SEQ ID NO: 916732 - protein, 6 aa, Mycobacterium
SGGIRS

SEQ ID NO: 916733 - protein, 4 aa, Mycobacterium
SGGL

SEQ ID NO: 916734 - protein, 7 aa, Mycobacterium
SGGLLPN

SEQ ID NO: 916735 - protein, 7 aa, Mycobacterium
SGGLNPA

SEQ ID NO: 916736 - protein, 8 aa, Mycobacterium
SGGLPADQ

SEQ ID NO: 916737 - protein, 10 aa, Mycobacterium
SGGNAWRSDP

SEQ ID NO: 916738 - protein, 11 aa, Mycobacterium
SGGNGGSGGNA

SEQ ID NO: 916739 - protein, 14 aa, Mycobacterium
SGGNYGWPSSEGVC

SEQ ID NO: 916740 - protein, 6 aa, Mycobacterium
SGGPFP

SEQ ID NO: 916741 - protein, 4 aa, Mycobacterium
SGGR

SEQ ID NO: 916742 - protein, 8 aa, Mycobacterium
SGGRAGVD

SEQ ID NO: 916743 - protein, 57 aa, Mycobacterium
SGGRGGSGGVGQKGGNGGSAGLWGNGGNGGLGGEGVQGGPGHPGQAGGNGGNGGNAG

SEQ ID NO: 916744 - protein, 9 aa, Mycobacterium
SGGRGPAER

SEQ ID NO: 916745 - protein, 4 aa, Mycobacterium
SGGS

SEQ ID NO: 916746 - protein, 49 aa, Mycobacterium
SGGSGGSGGVGQNGGNGGDAGLFGSGGAGGAGGIDGGGGAGTGGTGGRG

SEQ ID NO: 916747 - protein, 17 aa, Mycobacterium
SGGSQPVRPYGAQGARF

SEQ ID NO: 916748 - protein, 10 aa, Mycobacterium
SGGSVDEAQQ

SEQ ID NO: 916749 - protein, 12 aa, Mycobacterium
SGGTNTGFGNGG

SEQ ID NO: 916750 - protein, 5 aa, Mycobacterium
SGGVE

SEQ ID NO: 916751 - protein, 8 aa, Mycobacterium
SGGVEEAI

SEQ ID NO: 916752 - protein, 7 aa, Mycobacterium
SGGVREP

SEQ ID NO: 916753 - protein, 7 aa, Mycobacterium
SGGVSSL

SEQ ID NO: 916754 - protein, 9 aa, Mycobacterium
SGGVTDYSS

SEQ ID NO: 916755 - protein, 9 aa, Mycobacterium
SGGYGGPPF

SEQ ID NO: 916756 - protein, 6 aa, Mycobacterium
SGHEGA

SEQ ID NO: 916757 - protein, 4 aa, Mycobacterium
SGHG

SEQ ID NO: 916758 - protein, 8 aa, Mycobacterium
SGHNGVPA

SEQ ID NO: 916759 - protein, 8 aa, Mycobacterium
SGHPEEPY

SEQ ID NO: 916760 - protein, 10 aa, Mycobacterium
SGHPLTRGST

SEQ ID NO: 916761 - protein, 6 aa, Mycobacterium
SGHPQA

SEQ ID NO: 916762 - protein, 4 aa, Mycobacterium
SGIG

SEQ ID NO: 916763 - protein, 13 aa, Mycobacterium
SGIGGDLSHQGPW

SEQ ID NO: 916764 - protein, 5 aa, Mycobacterium
SGIGR

SEQ ID NO: 916765 - protein, 5 aa, Mycobacterium
SGIGW

SEQ ID NO: 916766 - protein, 5 aa, Mycobacterium
SGING

SEQ ID NO: 916767 - protein, 4 aa, Mycobacterium
SGIP

SEQ ID NO: 916768 - protein, 26 aa, Mycobacterium
SGIQAGGGAAKAIAKGAESVGPATLR

SEQ ID NO: 916769 - protein, 10 aa, Mycobacterium
SGISDTLPAD

SEQ ID NO: 916770 - protein, 9 aa, Mycobacterium
SGISTAEVT

SEQ ID NO: 916771 - protein, 4 aa, Mycobacterium
SGKA

SEQ ID NO: 916772 - protein, 10 aa, Mycobacterium
SGKAATPRAS

SEQ ID NO: 916773 - protein, 7 aa, Mycobacterium
SGKARAH

SEQ ID NO: 916774 - protein, 14 aa, Mycobacterium
SGKGVDTLRTRMLL

SEQ ID NO: 916775 - protein, 12 aa, Mycobacterium
SGKLPGTDTYCP

SEQ ID NO: 916776 - protein, 16 aa, Mycobacterium
SGKPTKVFGDGGNTRD

SEQ ID NO: 916777 - protein, 15 aa, Mycobacterium
SGKPTKVFGDGTNTR

SEQ ID NO: 916778 - protein, 4 aa, Mycobacterium
SGKT

SEQ ID NO: 916779 - protein, 10 aa, Mycobacterium
SGKTATARAS

SEQ ID NO: 916780 - protein, 11 aa, Mycobacterium
SGKTGTTEAHR

SEQ ID NO: 916781 - protein, 13 aa, Mycobacterium
SGKTGTTEANRSS

SEQ ID NO: 916782 - protein, 13 aa, Mycobacterium
SGKVDAEDADGDE

SEQ ID NO: 916783 - protein, 7 aa, Mycobacterium
SGLAAPD

SEQ ID NO: 916784 - protein, 13 aa, Mycobacterium
SGLASGSWQGPAA

SEQ ID NO: 916785 - protein, 12 aa, Mycobacterium
SGLAVQKGNPHD

SEQ ID NO: 916786 - protein, 10 aa, Mycobacterium
SGLDTDQLSE

SEQ ID NO: 916787 - protein, 12 aa, Mycobacterium
SGLGRSLDGYGT

SEQ ID NO: 916788 - protein, 11 aa, Mycobacterium
SGLGTADHESV

SEQ ID NO: 916789 - protein, 4 aa, Mycobacterium
SGLN

SEQ ID NO: 916790 - protein, 11 aa, Mycobacterium
SGLNTGQLSES

SEQ ID NO: 916791 - protein, 4 aa, Mycobacterium
SGLP

SEQ ID NO: 916792 - protein, 17 aa, Mycobacterium
SGLPASAPSYPVIAARV

SEQ ID NO: 916793 - protein, 10 aa, Mycobacterium
SGLPDHAGDA

SEQ ID NO: 916794 - protein, 8 aa, Mycobacterium
SGLPNKTD

SEQ ID NO: 916795 - protein, 7 aa, Mycobacterium
SGLPTGE

SEQ ID NO: 916796 - protein, 10 aa, Mycobacterium
SGLQNGKPTI

SEQ ID NO: 916797 - protein, 8 aa, Mycobacterium
SGLRAGED

SEQ ID NO: 916798 - protein, 6 aa, Mycobacterium
SGLRTA

SEQ ID NO: 916799 - protein, 14 aa, Mycobacterium
SGLSAATASADVEE

SEQ ID NO: 916800 - protein, 5 aa, Mycobacterium
SGLSK

SEQ ID NO: 916801 - protein, 11 aa, Mycobacterium
SGLSPEGVPTG

SEQ ID NO: 916802 - protein, 6 aa, Mycobacterium
SGLSVD

SEQ ID NO: 916803 - protein, 6 aa, Mycobacterium
SGLTNG

SEQ ID NO: 916804 - protein, 27 aa, Mycobacterium
SGMPPDSQIPPQAPVTQVPEAPPAHPA

SEQ ID NO: 916805 - protein, 6 aa, Mycobacterium
SGMTGG

SEQ ID NO: 916806 - protein, 5 aa, Mycobacterium
SGMTN

SEQ ID NO: 916807 - protein, 7 aa, Mycobacterium
SGMTPTA

SEQ ID NO: 916808 - protein, 7 aa, Mycobacterium
SGMTPTS

SEQ ID NO: 916809 - protein, 5 aa, Mycobacterium
SGNDN

SEQ ID NO: 916810 - protein, 6 aa, Mycobacterium
SGNGVD

SEQ ID NO: 916811 - protein, 24 aa, Mycobacterium
SGNIGDASLGSGNAGNANLGSGNQ

SEQ ID NO: 916812 - protein, 35 aa, Mycobacterium
SGNIGNTNLGSGNFGNTNLGSGNFGNSNLGSGNGN

SEQ ID NO: 916813 - protein, 9 aa, Mycobacterium
SGNKGDTNF

SEQ ID NO: 916814 - protein, 9 aa, Mycobacterium
SGNPRRGNY

SEQ ID NO: 916815 - protein, 8 aa, Mycobacterium
SGNPTRWG

SEQ ID NO: 916816 - protein, 6 aa, Mycobacterium
SGNPVH

SEQ ID NO: 916817 - protein, 5 aa, Mycobacterium
SGNTD

SEQ ID NO: 916818 - protein, 8 aa, Mycobacterium
SGNTGNIN

SEQ ID NO: 916819 - protein, 14 aa, Mycobacterium
SGNTTTGAKAVGIG

SEQ ID NO: 916820 - protein, 14 aa, Mycobacterium
SGNTVNVSGESQSA

SEQ ID NO: 916821 - protein, 5 aa, Mycobacterium
SGPDE

SEQ ID NO: 916822 - protein, 7 aa, Mycobacterium
SGPDEAA

SEQ ID NO: 916823 - protein, 6 aa, Mycobacterium
SGPGAL

SEQ ID NO: 916824 - protein, 7 aa, Mycobacterium
SGPGPLQ

SEQ ID NO: 916825 - protein, 13 aa, Mycobacterium
SGPKSAALAGRHG

SEQ ID NO: 916826 - protein, 12 aa, Mycobacterium
SGPKSATLAGQY

SEQ ID NO: 916827 - protein, 15 aa, Mycobacterium
SGPLNTGLANSGGIN

SEQ ID NO: 916828 - protein, 7 aa, Mycobacterium
SGPLSAK

SEQ ID NO: 916829 - protein, 5 aa, Mycobacterium
SGPMT

SEQ ID NO: 916830 - protein, 5 aa, Mycobacterium
SGPNP

SEQ ID NO: 916831 - protein, 20 aa, Mycobacterium
SGPNTISGATIPQGASSTGK

SEQ ID NO: 916832 - protein, 5 aa, Mycobacterium
SGPQL

SEQ ID NO: 916833 - protein, 10 aa, Mycobacterium
SGPRAQAADD

SEQ ID NO: 916834 - protein, 8 aa, Mycobacterium
SGPRPEMT

SEQ ID NO: 916835 - protein, 6 aa, Mycobacterium
SGPSGF

SEQ ID NO: 916836 - protein, 5 aa, Mycobacterium
SGPTV

SEQ ID NO: 916837 - protein, 5 aa, Mycobacterium
SGPVL

SEQ ID NO: 916838 - protein, 7 aa, Mycobacterium
SGPVNAQ

SEQ ID NO: 916839 - protein, 6 aa, Mycobacterium
SGPVTP

SEQ ID NO: 916840 - protein, 4 aa, Mycobacterium
SGPW

SEQ ID NO: 916841 - protein, 6 aa, Mycobacterium
SGPYGC

SEQ ID NO: 916842 - protein, 4 aa, Mycobacterium
SGQA

SEQ ID NO: 916843 - protein, 5 aa, Mycobacterium
SGQAN

SEQ ID NO: 916844 - protein, 13 aa, Mycobacterium
SGQAVTASAASNP

SEQ ID NO: 916845 - protein, 14 aa, Mycobacterium
SGQAVTASAASNPD

SEQ ID NO: 916846 - protein, 20 aa, Mycobacterium
SGQCGSGESGVTDHDGNPVG

SEQ ID NO: 916847 - protein, 12 aa, Mycobacterium
SGQDRDISTSPW

SEQ ID NO: 916848 - protein, 6 aa, Mycobacterium
SGQDTV

SEQ ID NO: 916849 - protein, 6 aa, Mycobacterium
SGQELV

SEQ ID NO: 916850 - protein, 13 aa, Mycobacterium
SGQEQNPDLTSRN

SEQ ID NO: 916851 - protein, 5 aa, Mycobacterium
SGQGG

SEQ ID NO: 916852 - protein, 7 aa, Mycobacterium
SGQGTSL

SEQ ID NO: 916853 - protein, 10 aa, Mycobacterium
SGQIASAPDF

SEQ ID NO: 916854 - protein, 10 aa, Mycobacterium
SGQIQGKPTF

SEQ ID NO: 916855 - protein, 7 aa, Mycobacterium
SGQPGLY

SEQ ID NO: 916856 - protein, 9 aa, Mycobacterium
SGQPHGGKT

SEQ ID NO: 916857 - protein, 5 aa, Mycobacterium
SGQPL

SEQ ID NO: 916858 - protein, 4 aa, Mycobacterium
SGQQ

SEQ ID NO: 916859 - protein, 21 aa, Mycobacterium
SGQQQSASSGPSGQPQPGGTL

SEQ ID NO: 916860 - protein, 16 aa, Mycobacterium
SGQREPGEDVTAPVTA

SEQ ID NO: 916861 - protein, 15 aa, Mycobacterium
SGQSALGDEDEERER

SEQ ID NO: 916862 - protein, 5 aa, Mycobacterium
SGQSL

SEQ ID NO: 916863 - protein, 9 aa, Mycobacterium
SGQTAKGGT

SEQ ID NO: 916864 - protein, 12 aa, Mycobacterium
SGQVGQTSDPIG

SEQ ID NO: 916865 - protein, 10 aa, Mycobacterium
SGRDAVAQGG

SEQ ID NO: 916866 - protein, 7 aa, Mycobacterium
SGRFGPP

SEQ ID NO: 916867 - protein, 17 aa, Mycobacterium
SGRFPGFDSASRAGYRD

SEQ ID NO: 916868 - protein, 20 aa, Mycobacterium
SGRFQGGSGPDTTASDADAL

SEQ ID NO: 916869 - protein, 11 aa, Mycobacterium
SGRGAMDPGYD

SEQ ID NO: 916870 - protein, 9 aa, Mycobacterium
SGRGSGAAT

SEQ ID NO: 916871 - protein, 13 aa, Mycobacterium
SGRGTGPTEGPAI

SEQ ID NO: 916872 - protein, 4 aa, Mycobacterium
SGRI

SEQ ID NO: 916873 - protein, 6 aa, Mycobacterium
SGRLRG

SEQ ID NO: 916874 - protein, 38 aa, Mycobacterium
SGRPAPPAASAPSSSTSAVNPATPMTTRTGASPTTTAP

SEQ ID NO: 916875 - protein, 7 aa, Mycobacterium
SGRPEDR

SEQ ID NO: 916876 - protein, 9 aa, Mycobacterium
SGRPPGGKT

SEQ ID NO: 916877 - protein, 4 aa, Mycobacterium
SGRQ

SEQ ID NO: 916878 - protein, 6 aa, Mycobacterium
SGRRGR

SEQ ID NO: 916879 - protein, 5 aa, Mycobacterium
SGRRV

SEQ ID NO: 916880 - protein, 19 aa, Mycobacterium
SGRSGTVPGFGAAPQPIVG

SEQ ID NO: 916881 - protein, 16 aa, Mycobacterium
SGRSTKVFGDGGNTRD

SEQ ID NO: 916882 - protein, 6 aa, Mycobacterium
SGRTSD

SEQ ID NO: 916883 - protein, 4 aa, Mycobacterium
SGSA

SEQ ID NO: 916884 - protein, 14 aa, Mycobacterium
SGSAEGSPLKDRNG

SEQ ID NO: 916885 - protein, 9 aa, Mycobacterium
SGSAPTNKC

SEQ ID NO: 916886 - protein, 10 aa, Mycobacterium
SGSAREAEKD

SEQ ID NO: 916887 - protein, 7 aa, Mycobacterium
SGSDTSF

SEQ ID NO: 916888 - protein, 4 aa, Mycobacterium
SGSE

SEQ ID NO: 916889 - protein, 5 aa, Mycobacterium
SGSEN

SEQ ID NO: 916890 - protein, 28 aa, Mycobacterium
SGSETPPETASEAHSEPAEGGGTKPTTE

SEQ ID NO: 916891 - protein, 16 aa, Mycobacterium
SGSGAGVQVIADAGGP

SEQ ID NO: 916892 - protein, 8 aa, Mycobacterium
SGSGALSS

SEQ ID NO: 916893 - protein, 8 aa, Mycobacterium
SGSGASEL

SEQ ID NO: 916894 - protein, 6 aa, Mycobacterium
SGSGNI

SEQ ID NO: 916895 - protein, 17 aa, Mycobacterium
SGSGNVGIANSGLSNYG

SEQ ID NO: 916896 - protein, 18 aa, Mycobacterium
SGSIREIDPGPDRDPAAD

SEQ ID NO: 916897 - protein, 14 aa, Mycobacterium
SGSLRGDGAGGGPI

SEQ ID NO: 916898 - protein, 8 aa, Mycobacterium
SGSLTDRD

SEQ ID NO: 916899 - protein, 4 aa, Mycobacterium
SGSM

SEQ ID NO: 916900 - protein, 5 aa, Mycobacterium
SGSMG

SEQ ID NO: 916901 - protein, 7 aa, Mycobacterium
SGSPGQQ

SEQ ID NO: 916902 - protein, 9 aa, Mycobacterium
SGSPPQLPK

SEQ ID NO: 916903 - protein, 16 aa, Mycobacterium
SGSPSLPGGGDRPVEL

SEQ ID NO: 916904 - protein, 17 aa, Mycobacterium
SGSQYNAGRKIPSSQMR

SEQ ID NO: 916905 - protein, 18 aa, Mycobacterium
SGSQYNAGRKVPSSQMQR

SEQ ID NO: 916906 - protein, 17 aa, Mycobacterium
SGSQYNAGRKVPSSQMR

SEQ ID NO: 916907 - protein, 6 aa, Mycobacterium
SGSRES

SEQ ID NO: 916908 - protein, 21 aa, Mycobacterium
SGSRGGDGGDGGNGGEGRGGF

SEQ ID NO: 916909 - protein, 13 aa, Mycobacterium
SGSSLAGNSRATI

SEQ ID NO: 916910 - protein, 10 aa, Mycobacterium
SGSTGAPKGA

SEQ ID NO: 916911 - protein, 6 aa, Mycobacterium
SGSTGG

SEQ ID NO: 916912 - protein, 15 aa, Mycobacterium
SGSTPAQKIKDEYQG

SEQ ID NO: 916913 - protein, 11 aa, Mycobacterium
SGSTTDAPKSL

SEQ ID NO: 916914 - protein, 12 aa, Mycobacterium
SGSVPTATTVPG

SEQ ID NO: 916915 - protein, 14 aa, Mycobacterium
SGSVSGTKQDGTPF

SEQ ID NO: 916916 - protein, 10 aa, Mycobacterium
SGTAPDGSKA

SEQ ID NO: 916917 - protein, 30 aa, Mycobacterium
SGTASADPLPPAPAPVPAVPAQAPQNLGPE

SEQ ID NO: 916918 - protein, 28 aa, Mycobacterium
SGTASADPLYPQPPSPAPAPAQAAVPPV

SEQ ID NO: 916919 - protein, 6 aa, Mycobacterium
SGTASD

SEQ ID NO: 916920 - protein, 33 aa, Mycobacterium
SGTDDASKQALADASERYTAAASQIDQATTVKQ

SEQ ID NO: 916921 - protein, 41 aa, Mycobacterium
SGTDDASRQALADASERYTAASSAIEQARTPSQAALAKESA

SEQ ID NO: 916922 - protein, 7 aa, Mycobacterium
SGTDRGV

SEQ ID NO: 916923 - protein, 9 aa, Mycobacterium
SGTEEERSR

SEQ ID NO: 916924 - protein, 11 aa, Mycobacterium
SGTEEPGDRDR

SEQ ID NO: 916925 - protein, 31 aa, Mycobacterium
SGTGDEHHNPAADAPSLTQQPLDDLGGGETI

SEQ ID NO: 916926 - protein, 32 aa, Mycobacterium
SGTGKDGPIGPAPAGGPVAGQPVQPGPSGAGA

SEQ ID NO: 916927 - protein, 5 aa, Mycobacterium
SGTGN

SEQ ID NO: 916928 - protein, 9 aa, Mycobacterium
SGTGTTDSA

SEQ ID NO: 916929 - protein, 5 aa, Mycobacterium
SGTGV

SEQ ID NO: 916930 - protein, 6 aa, Mycobacterium
SGTITA

SEQ ID NO: 916931 - protein, 8 aa, Mycobacterium
SGTLNPSE

SEQ ID NO: 916932 - protein, 5 aa, Mycobacterium
SGTLS

SEQ ID NO: 916933 - protein, 11 aa, Mycobacterium
SGTNGFDSGSP

SEQ ID NO: 916934 - protein, 39 aa, Mycobacterium
SGTNGTNNPNGGPPNVNPGPGIGVSGGGGQEIFNQNIPL

SEQ ID NO: 916935 - protein, 18 aa, Mycobacterium
SGTPYIPGGDSPSGTDCS

SEQ ID NO: 916936 - protein, 8 aa, Mycobacterium
SGTSVENA

SEQ ID NO: 916937 - protein, 13 aa, Mycobacterium
SGTTADPKGIRHT

SEQ ID NO: 916938 - protein, 8 aa, Mycobacterium
SGTTGHPK

SEQ ID NO: 916939 - protein, 9 aa, Mycobacterium
SGTTGRPKG

SEQ ID NO: 916940 - protein, 10 aa, Mycobacterium
SGTTGRPKGV

SEQ ID NO: 916941 - protein, 22 aa, Mycobacterium
SGTTGSPKGAKRSAGSGGSGDL

SEQ ID NO: 916942 - protein, 17 aa, Mycobacterium
SGTTQPTDWATGQPKLD

SEQ ID NO: 916943 - protein, 26 aa, Mycobacterium
SGTTTAYPLPRPGDGPAPKPVTLPAG

SEQ ID NO: 916944 - protein, 4 aa, Mycobacterium
SGTV

SEQ ID NO: 916945 - protein, 15 aa, Mycobacterium
SGTVPTQDHGPHQQY

SEQ ID NO: 916946 - protein, 11 aa, Mycobacterium
SGVAATEGAYQ

SEQ ID NO: 916947 - protein, 16 aa, Mycobacterium
SGVARTENVTLAEGPP

SEQ ID NO: 916948 - protein, 9 aa, Mycobacterium
SGVASAEPV

SEQ ID NO: 916949 - protein, 7 aa, Mycobacterium
SGVATPE

SEQ ID NO: 916950 - protein, 10 aa, Mycobacterium
SGVDPGPEEL

SEQ ID NO: 916951 - protein, 10 aa, Mycobacterium
SGVETQDKNV

SEQ ID NO: 916952 - protein, 13 aa, Mycobacterium
SGVGGHSGGMPGM

SEQ ID NO: 916953 - protein, 19 aa, Mycobacterium
SGVNNVGAGNGGSSNVGLG

SEQ ID NO: 916954 - protein, 6 aa, Mycobacterium
SGVPYK

SEQ ID NO: 916955 - protein, 14 aa, Mycobacterium
SGVRASGGGFGVGT

SEQ ID NO: 916956 - protein, 7 aa, Mycobacterium
SGVSAAT

SEQ ID NO: 916957 - protein, 5 aa, Mycobacterium
SGVSP

SEQ ID NO: 916958 - protein, 7 aa, Mycobacterium
SGVSPST

SEQ ID NO: 916959 - protein, 13 aa, Mycobacterium
SGVSPYLVEQQPL

SEQ ID NO: 916960 - protein, 4 aa, Mycobacterium
SGVT

SEQ ID NO: 916961 - protein, 5 aa, Mycobacterium
SGVTR

SEQ ID NO: 916962 - protein, 8 aa, Mycobacterium
SGWSDDGM

SEQ ID NO: 916963 - protein, 10 aa, Mycobacterium
SGYEARRDGA

SEQ ID NO: 916964 - protein, 12 aa, Mycobacterium
SGYSSKGAKVVL

SEQ ID NO: 916965 - protein, 7 aa, Mycobacterium
SGYTAGE

SEQ ID NO: 916966 - protein, 5 aa, Mycobacterium
SGYYS

SEQ ID NO: 916967 - protein, 12 aa, Mycobacterium
SHAKPKDDEPCP

SEQ ID NO: 916968 - protein, 10 aa, Mycobacterium
SHAKQGNGEI

SEQ ID NO: 916969 - protein, 8 aa, Mycobacterium
SHAPHEQA

SEQ ID NO: 916970 - protein, 10 aa, Mycobacterium
SHAPVNARTA

SEQ ID NO: 916971 - protein, 9 aa, Mycobacterium
SHDEQRETD

SEQ ID NO: 916972 - protein, 10 aa, Mycobacterium
SHDGQITKQS

SEQ ID NO: 916973 - protein, 7 aa, Mycobacterium
SHDPEVQ

SEQ ID NO: 916974 - protein, 9 aa, Mycobacterium
SHEGGLPAG

SEQ ID NO: 916975 - protein, 8 aa, Mycobacterium
SHENGGPG

SEQ ID NO: 916976 - protein, 5 aa, Mycobacterium
SHEPP

SEQ ID NO: 916977 - protein, 4 aa, Mycobacterium
SHEW

SEQ ID NO: 916978 - protein, 5 aa, Mycobacterium
SHGAD

SEQ ID NO: 916979 - protein, 12 aa, Mycobacterium
SHGAWGRGAGRQ

SEQ ID NO: 916980 - protein, 12 aa, Mycobacterium
SHHGGSPSSHAA

SEQ ID NO: 916981 - protein, 21 aa, Mycobacterium
SHKVGGTLSTSEEQVGSEDGW

SEQ ID NO: 916982 - protein, 4 aa, Mycobacterium
SHLA

SEQ ID NO: 916983 - protein, 15 aa, Mycobacterium
SHNATLQPLRDNATY

SEQ ID NO: 916984 - protein, 9 aa, Mycobacterium
SHNDPATAA

SEQ ID NO: 916985 - protein, 16 aa, Mycobacterium
SHNQNAPAESRNVATS

SEQ ID NO: 916986 - protein, 6 aa, Mycobacterium
SHPDVA

SEQ ID NO: 916987 - protein, 6 aa, Mycobacterium
SHPGDP

SEQ ID NO: 916988 - protein, 6 aa, Mycobacterium
SHPGGQ

SEQ ID NO: 916989 - protein, 6 aa, Mycobacterium
SHPRAE

SEQ ID NO: 916990 - protein, 6 aa, Mycobacterium
SHPSQI

SEQ ID NO: 916991 - protein, 11 aa, Mycobacterium
SHPTDELESRL

SEQ ID NO: 916992 - protein, 7 aa, Mycobacterium
SHPTPEV

SEQ ID NO: 916993 - protein, 6 aa, Mycobacterium
SHRRMS

SEQ ID NO: 916994 - protein, 7 aa, Mycobacterium
SHRSPEV

SEQ ID NO: 916995 - protein, 9 aa, Mycobacterium
SHSADGPQR

SEQ ID NO: 916996 - protein, 16 aa, Mycobacterium
SHSAQRSAAQAPTQRT

SEQ ID NO: 916997 - protein, 16 aa, Mycobacterium
SHSATRSAAQSPTQRT

SEQ ID NO: 916998 - protein, 6 aa, Mycobacterium
SHSEFT

SEQ ID NO: 916999 - protein, 7 aa, Mycobacterium
SHSGVAG

SEQ ID NO: 917000 - protein, 13 aa, Mycobacterium
SHTAAAPGANPRQ

SEQ ID NO: 917001 - protein, 4 aa, Mycobacterium
SHTG

SEQ ID NO: 917002 - protein, 7 aa, Mycobacterium
SHTGTEL

SEQ ID NO: 917003 - protein, 6 aa, Mycobacterium
SHTGYQ

SEQ ID NO: 917004 - protein, 5 aa, Mycobacterium
SHTHG

SEQ ID NO: 917005 - protein, 39 aa, Mycobacterium
SHTTGNHSEPTPSSTQTSVGPSGSKTPGASAAPAAGAAV

SEQ ID NO: 917006 - protein, 12 aa, Mycobacterium
SHVEATADTCPD

SEQ ID NO: 917007 - protein, 12 aa, Mycobacterium
SHYPTRAAAEAT

SEQ ID NO: 917008 - protein, 12 aa, Mycobacterium
SIAGTDKTGRSV

SEQ ID NO: 917009 - protein, 12 aa, Mycobacterium
SIAGTDSSGRSV

SEQ ID NO: 917010 - protein, 11 aa, Mycobacterium
SIAGTDTSGHS

SEQ ID NO: 917011 - protein, 12 aa, Mycobacterium
SIAGTDTSGRSV

SEQ ID NO: 917012 - protein, 13 aa, Mycobacterium
SIAKQAEAERERR

SEQ ID NO: 917013 - protein, 13 aa, Mycobacterium
SIAPGGSATGGLR

SEQ ID NO: 917014 - protein, 9 aa, Mycobacterium
SIDGRNGVP

SEQ ID NO: 917015 - protein, 6 aa, Mycobacterium
SIDRTA

SEQ ID NO: 917016 - protein, 9 aa, Mycobacterium
SIDSNNVDA

SEQ ID NO: 917017 - protein, 6 aa, Mycobacterium
SIEPNQ

SEQ ID NO: 917018 - protein, 8 aa, Mycobacterium
SIEPQPES

SEQ ID NO: 917019 - protein, 9 aa, Mycobacterium
SIESRPDGK

SEQ ID NO: 917020 - protein, 13 aa, Mycobacterium
SIGDGGPRPPTPF

SEQ ID NO: 917021 - protein, 5 aa, Mycobacterium
SIGQK

SEQ ID NO: 917022 - protein, 4 aa, Mycobacterium
SIGT

SEQ ID NO: 917023 - protein, 31 aa, Mycobacterium
SIKDETLTACGDSGQSPTTWRQGSAGATAGQ

SEQ ID NO: 917024 - protein, 8 aa, Mycobacterium
SINAGGGH

SEQ ID NO: 917025 - protein, 9 aa, Mycobacterium
SINPPTPDQ

SEQ ID NO: 917026 - protein, 6 aa, Mycobacterium
SIPGGK

SEQ ID NO: 917027 - protein, 12 aa, Mycobacterium
SIPGGPGSGAGS

SEQ ID NO: 917028 - protein, 12 aa, Mycobacterium
SIPGGPGTGDGS

SEQ ID NO: 917029 - protein, 13 aa, Mycobacterium
SIPPADQTGLTES

SEQ ID NO: 917030 - protein, 24 aa, Mycobacterium
SIPPNTFTRRSTKVNPDGQDGASA

SEQ ID NO: 917031 - protein, 21 aa, Mycobacterium
SIPPSTTPVGPANTIPGDGTY

SEQ ID NO: 917032 - protein, 9 aa, Mycobacterium
SIQGTDSRS

SEQ ID NO: 917033 - protein, 7 aa, Mycobacterium
SIQPVGA

SEQ ID NO: 917034 - protein, 7 aa, Mycobacterium
SIQSLTD

SEQ ID NO: 917035 - protein, 4 aa, Mycobacterium
SIRP

SEQ ID NO: 917036 - protein, 10 aa, Mycobacterium
SIRPASPDAI

SEQ ID NO: 917037 - protein, 5 aa, Mycobacterium
SIRQP

SEQ ID NO: 917038 - protein, 25 aa, Mycobacterium
SISGTAVKAGAGGVPRNDNSERQYP

SEQ ID NO: 917039 - protein, 7 aa, Mycobacterium
SISPSTL

SEQ ID NO: 917040 - protein, 7 aa, Mycobacterium
SISSPGV

SEQ ID NO: 917041 - protein, 7 aa, Mycobacterium
SITQGTD

SEQ ID NO: 917042 - protein, 11 aa, Mycobacterium
SITRPPGSTSV

SEQ ID NO: 917043 - protein, 12 aa, Mycobacterium
SITSAKDLEGKK

SEQ ID NO: 917044 - protein, 5 aa, Mycobacterium
SITSH

SEQ ID NO: 917045 - protein, 6 aa, Mycobacterium
SITTAD

SEQ ID NO: 917046 - protein, 6 aa, Mycobacterium
SIYDAD

SEQ ID NO: 917047 - protein, 18 aa, Mycobacterium
SIYDKDGNPTLDTEQAAR

SEQ ID NO: 917048 - protein, 4 aa, Mycobacterium
SKAA

SEQ ID NO: 917049 - protein, 7 aa, Mycobacterium
SKAPENY

SEQ ID NO: 917050 - protein, 6 aa, Mycobacterium
SKDAGR

SEQ ID NO: 917051 - protein, 18 aa, Mycobacterium
SKDALGGGTASGSAGAAG

SEQ ID NO: 917052 - protein, 18 aa, Mycobacterium
SKDAVGGGTAAGSASAAG

SEQ ID NO: 917053 - protein, 9 aa, Mycobacterium
SKDGKDRFG

SEQ ID NO: 917054 - protein, 14 aa, Mycobacterium
SKDGPRGVLCSLRI

SEQ ID NO: 917055 - protein, 9 aa, Mycobacterium
SKDGTASTL

SEQ ID NO: 917056 - protein, 9 aa, Mycobacterium
SKDKAMSRA

SEQ ID NO: 917057 - protein, 7 aa, Mycobacterium
SKDNGQN

SEQ ID NO: 917058 - protein, 5 aa, Mycobacterium
SKDNL

SEQ ID NO: 917059 - protein, 7 aa, Mycobacterium
SKDPHAD

SEQ ID NO: 917060 - protein, 14 aa, Mycobacterium
SKDPYGSYAPASTI

SEQ ID NO: 917061 - protein, 52 aa, Mycobacterium
SKDVDTEVVTKDDETTATDTDTDTDTEARAGDDIEKKKSPRETRRERRHEHR

SEQ ID NO: 917062 - protein, 10 aa, Mycobacterium
SKDVIKSGGE

SEQ ID NO: 917063 - protein, 16 aa, Mycobacterium
SKEGVAAKTKDQLTSA

SEQ ID NO: 917064 - protein, 10 aa, Mycobacterium
SKGDAEAALS

SEQ ID NO: 917065 - protein, 22 aa, Mycobacterium
SKGGPPSSSAPSLTIASPSSPV

SEQ ID NO: 917066 - protein, 17 aa, Mycobacterium
SKGGWYDQPDGASDWQM

SEQ ID NO: 917067 - protein, 6 aa, Mycobacterium
SKGKIH

SEQ ID NO: 917068 - protein, 9 aa, Mycobacterium
SKGLSDSLG

SEQ ID NO: 917069 - protein, 12 aa, Mycobacterium
SKGSALSLLSSV

SEQ ID NO: 917070 - protein, 9 aa, Mycobacterium
SKGTAYDAQ

SEQ ID NO: 917071 - protein, 7 aa, Mycobacterium
SKGVPGV

SEQ ID NO: 917072 - protein, 7 aa, Mycobacterium
SKHAPDA

SEQ ID NO: 917073 - protein, 25 aa, Mycobacterium
SKHPASESSTVSSLPPATSSQVAAP

SEQ ID NO: 917074 - protein, 8 aa, Mycobacterium
SKISGEED

SEQ ID NO: 917075 - protein, 8 aa, Mycobacterium
SKLAQSGT

SEQ ID NO: 917076 - protein, 13 aa, Mycobacterium
SKLDGGYIDTWAC

SEQ ID NO: 917077 - protein, 13 aa, Mycobacterium
SKLGGGYIDTWAC

SEQ ID NO: 917078 - protein, 8 aa, Mycobacterium
SKLSKTGT

SEQ ID NO: 917079 - protein, 15 aa, Mycobacterium
SKMPPRGLTQAASRY

SEQ ID NO: 917080 - protein, 13 aa, Mycobacterium
SKMSTDKVQTNLD

SEQ ID NO: 917081 - protein, 9 aa, Mycobacterium
SKNAIDKTN

SEQ ID NO: 917082 - protein, 9 aa, Mycobacterium
SKNAPQSSC

SEQ ID NO: 917083 - protein, 12 aa, Mycobacterium
SKNDTTATPYES

SEQ ID NO: 917084 - protein, 8 aa, Mycobacterium
SKNPTRWG

SEQ ID NO: 917085 - protein, 11 aa, Mycobacterium
SKPAPVPESTV

SEQ ID NO: 917086 - protein, 4 aa, Mycobacterium
SKPD

SEQ ID NO: 917087 - protein, 7 aa, Mycobacterium
SKPGFRV

SEQ ID NO: 917088 - protein, 7 aa, Mycobacterium
SKPITNG

SEQ ID NO: 917089 - protein, 9 aa, Mycobacterium
SKPLPEGMR

SEQ ID NO: 917090 - protein, 6 aa, Mycobacterium
SKPLSA

SEQ ID NO: 917091 - protein, 6 aa, Mycobacterium
SKPLSD

SEQ ID NO: 917092 - protein, 5 aa, Mycobacterium
SKPVL

SEQ ID NO: 917093 - protein, 15 aa, Mycobacterium
SKPVLDAQSGAPDAV

SEQ ID NO: 917094 - protein, 8 aa, Mycobacterium
SKQEAEGV

SEQ ID NO: 917095 - protein, 5 aa, Mycobacterium
SKRGD

SEQ ID NO: 917096 - protein, 5 aa, Mycobacterium
SKRTS

SEQ ID NO: 917097 - protein, 17 aa, Mycobacterium
SKSLKGDGKGGGPVADL

SEQ ID NO: 917098 - protein, 10 aa, Mycobacterium
SKSNDPRFDT

SEQ ID NO: 917099 - protein, 5 aa, Mycobacterium
SKSVG

SEQ ID NO: 917100 - protein, 6 aa, Mycobacterium
SKSVGA

SEQ ID NO: 917101 - protein, 17 aa, Mycobacterium
SKTGTAEHGTDPRHTPP

SEQ ID NO: 917102 - protein, 7 aa, Mycobacterium
SKTINTV

SEQ ID NO: 917103 - protein, 18 aa, Mycobacterium
SKTPTTSTTTPTAKPVPL

SEQ ID NO: 917104 - protein, 9 aa, Mycobacterium
SKTQANPLA

SEQ ID NO: 917105 - protein, 5 aa, Mycobacterium
SKTYG

SEQ ID NO: 917106 - protein, 4 aa, Mycobacterium
SKVA

SEQ ID NO: 917107 - protein, 6 aa, Mycobacterium
SKVEEA

SEQ ID NO: 917108 - protein, 9 aa, Mycobacterium
SKVGGRSMG

SEQ ID NO: 917109 - protein, 6 aa, Mycobacterium
SKVGTV

SEQ ID NO: 917110 - protein, 8 aa, Mycobacterium
SKVPPVTS

SEQ ID NO: 917111 - protein, 5 aa, Mycobacterium
SKVSR

SEQ ID NO: 917112 - protein, 10 aa, Mycobacterium
SKVTSKGSYV

SEQ ID NO: 917113 - protein, 5 aa, Mycobacterium
SKYGL

SEQ ID NO: 917114 - protein, 12 aa, Mycobacterium
SKYGTRATELGR

SEQ ID NO: 917115 - protein, 7 aa, Mycobacterium
SKYRGEF

SEQ ID NO: 917116 - protein, 8 aa, Mycobacterium
SKYRGEFE

SEQ ID NO: 917117 - protein, 49 aa, Mycobacterium
SLAAPSSPAPSSPAPAAAPTGAATGAGAPAPGGSGSSWDVDPATGNRET

SEQ ID NO: 917118 - protein, 6 aa, Mycobacterium
SLADRG

SEQ ID NO: 917119 - protein, 13 aa, Mycobacterium
SLAESASTQYPIP

SEQ ID NO: 917120 - protein, 4 aa, Mycobacterium
SLAG

SEQ ID NO: 917121 - protein, 7 aa, Mycobacterium
SLAGDTV

SEQ ID NO: 917122 - protein, 5 aa, Mycobacterium
SLAGG

SEQ ID NO: 917123 - protein, 5 aa, Mycobacterium
SLANE

SEQ ID NO: 917124 - protein, 8 aa, Mycobacterium
SLANTASG

SEQ ID NO: 917125 - protein, 6 aa, Mycobacterium
SLAPGA

SEQ ID NO: 917126 - protein, 14 aa, Mycobacterium
SLAPQVASAKAKGI

SEQ ID NO: 917127 - protein, 14 aa, Mycobacterium
SLASGDPGSVSANR

SEQ ID NO: 917128 - protein, 7 aa, Mycobacterium
SLATAAG

SEQ ID NO: 917129 - protein, 12 aa, Mycobacterium
SLDEADQHGLGE

SEQ ID NO: 917130 - protein, 9 aa, Mycobacterium
SLDNERSVA

SEQ ID NO: 917131 - protein, 5 aa, Mycobacterium
SLDPD

SEQ ID NO: 917132 - protein, 6 aa, Mycobacterium
SLDPHG

SEQ ID NO: 917133 - protein, 5 aa, Mycobacterium
SLDQD

SEQ ID NO: 917134 - protein, 9 aa, Mycobacterium
SLDQGGPCA

SEQ ID NO: 917135 - protein, 8 aa, Mycobacterium
SLDRQTGD

SEQ ID NO: 917136 - protein, 18 aa, Mycobacterium
SLDSPGCGSRRYQWANAA

SEQ ID NO: 917137 - protein, 12 aa, Mycobacterium
SLEAQRAPDGEI

SEQ ID NO: 917138 - protein, 9 aa, Mycobacterium
SLEDKPVDA

SEQ ID NO: 917139 - protein, 12 aa, Mycobacterium
SLENSTASGTDT

SEQ ID NO: 917140 - protein, 5 aa, Mycobacterium
SLGDP

SEQ ID NO: 917141 - protein, 7 aa, Mycobacterium
SLGEAPD

SEQ ID NO: 917142 - protein, 10 aa, Mycobacterium
SLGHGADDGA

SEQ ID NO: 917143 - protein, 10 aa, Mycobacterium
SLGHGGDDGA

SEQ ID NO: 917144 - protein, 7 aa, Mycobacterium
SLGNERK

SEQ ID NO: 917145 - protein, 10 aa, Mycobacterium
SLGNERKVAE

SEQ ID NO: 917146 - protein, 9 aa, Mycobacterium
SLGNPARSW

SEQ ID NO: 917147 - protein, 11 aa, Mycobacterium
SLGNSGNSDAP

SEQ ID NO: 917148 - protein, 14 aa, Mycobacterium
SLGPRGNDTFDHAK

SEQ ID NO: 917149 - protein, 4 aa, Mycobacterium
SLGS

SEQ ID NO: 917150 - protein, 8 aa, Mycobacterium
SLGSSSDL

SEQ ID NO: 917151 - protein, 10 aa, Mycobacterium
SLGSSSDLRV

SEQ ID NO: 917152 - protein, 5 aa, Mycobacterium
SLGTS

SEQ ID NO: 917153 - protein, 25 aa, Mycobacterium
SLGYGPGTSSLGGSGLGSSTGGGGI

SEQ ID NO: 917154 - protein, 8 aa, Mycobacterium
SLLDTKAA

SEQ ID NO: 917155 - protein, 14 aa, Mycobacterium
SLNNAQAVPDPDGK

SEQ ID NO: 917156 - protein, 9 aa, Mycobacterium
SLNNRNESL

SEQ ID NO: 917157 - protein, 9 aa, Mycobacterium
SLPADAVET

SEQ ID NO: 917158 - protein, 7 aa, Mycobacterium
SLPAGIA

SEQ ID NO: 917159 - protein, 34 aa, Mycobacterium
SLPANARDEARTDVTRDSDPERSPTWPRRPYEPA

SEQ ID NO: 917160 - protein, 4 aa, Mycobacterium
SLPD

SEQ ID NO: 917161 - protein, 6 aa, Mycobacterium
SLPDGR

SEQ ID NO: 917162 - protein, 5 aa, Mycobacterium
SLPEE

SEQ ID NO: 917163 - protein, 9 aa, Mycobacterium
SLPGAKPTD

SEQ ID NO: 917164 - protein, 12 aa, Mycobacterium
SLPGFDPNIAGN

SEQ ID NO: 917165 - protein, 7 aa, Mycobacterium
SLPGRNH

SEQ ID NO: 917166 - protein, 10 aa, Mycobacterium
SLPGVDSTTH

SEQ ID NO: 917167 - protein, 6 aa, Mycobacterium
SLPLDP

SEQ ID NO: 917168 - protein, 7 aa, Mycobacterium
SLPPQYA

SEQ ID NO: 917169 - protein, 21 aa, Mycobacterium
SLPPTEPRYVDGGPNSEVPSV

SEQ ID NO: 917170 - protein, 8 aa, Mycobacterium
SLPPVPAH

SEQ ID NO: 917171 - protein, 14 aa, Mycobacterium
SLPQIPSANIPGDP

SEQ ID NO: 917172 - protein, 6 aa, Mycobacterium
SLPQKA

SEQ ID NO: 917173 - protein, 21 aa, Mycobacterium
SLPQSPESASATVSSDESGWT

SEQ ID NO: 917174 - protein, 5 aa, Mycobacterium
SLPQT

SEQ ID NO: 917175 - protein, 4 aa, Mycobacterium
SLPR

SEQ ID NO: 917176 - protein, 6 aa, Mycobacterium
SLPRGD

SEQ ID NO: 917177 - protein, 8 aa, Mycobacterium
SLPRRAAA

SEQ ID NO: 917178 - protein, 7 aa, Mycobacterium
SLPSATA

SEQ ID NO: 917179 - protein, 35 aa, Mycobacterium
SLPSNARDQARADVTRDSDLGRSPSWPPPDPNEPA

SEQ ID NO: 917180 - protein, 50 aa, Mycobacterium
SLPTTSEAPPTSGRPACREPAPGQQECSKPGNAEIHSTPDPEHEATPPLT

SEQ ID NO: 917181 - protein, 13 aa, Mycobacterium
SLQATAQATQTTF

SEQ ID NO: 917182 - protein, 13 aa, Mycobacterium
SLQATAQATQTTL

SEQ ID NO: 917183 - protein, 13 aa, Mycobacterium
SLQATAQATQTTM

SEQ ID NO: 917184 - protein, 13 aa, Mycobacterium
SLQGDGRGGGPVA

SEQ ID NO: 917185 - protein, 8 aa, Mycobacterium
SLQGDTGS

SEQ ID NO: 917186 - protein, 11 aa, Mycobacterium
SLQPGATAMSD

SEQ ID NO: 917187 - protein, 15 aa, Mycobacterium
SLRASATALAGSGGT

SEQ ID NO: 917188 - protein, 10 aa, Mycobacterium
SLRDSRIAPT

SEQ ID NO: 917189 - protein, 11 aa, Mycobacterium
SLRPAPASASL

SEQ ID NO: 917190 - protein, 6 aa, Mycobacterium
SLRPPQ

SEQ ID NO: 917191 - protein, 8 aa, Mycobacterium
SLRRGGGE

SEQ ID NO: 917192 - protein, 6 aa, Mycobacterium
SLRSGE

SEQ ID NO: 917193 - protein, 5 aa, Mycobacterium
SLRSN

SEQ ID NO: 917194 - protein, 7 aa, Mycobacterium
SLRSPEA

SEQ ID NO: 917195 - protein, 8 aa, Mycobacterium
SLRTSDPD

SEQ ID NO: 917196 - protein, 26 aa, Mycobacterium
SLSGAATPLPDPGDADGFVSTPAPGR

SEQ ID NO: 917197 - protein, 5 aa, Mycobacterium
SLSGG

SEQ ID NO: 917198 - protein, 5 aa, Mycobacterium
SLSKG

SEQ ID NO: 917199 - protein, 7 aa, Mycobacterium
SLSNERK

SEQ ID NO: 917200 - protein, 9 aa, Mycobacterium
SLSNERKVA

SEQ ID NO: 917201 - protein, 14 aa, Mycobacterium
SLSPDQDPEPVDTE

SEQ ID NO: 917202 - protein, 8 aa, Mycobacterium
SLSPTERL

SEQ ID NO: 917203 - protein, 7 aa, Mycobacterium
SLSQEPY

SEQ ID NO: 917204 - protein, 7 aa, Mycobacterium
SLSQSSG

SEQ ID NO: 917205 - protein, 21 aa, Mycobacterium
SLSSTAAAPPVGRTRRSAVPR

SEQ ID NO: 917206 - protein, 6 aa, Mycobacterium
SLSYQG

SEQ ID NO: 917207 - protein, 7 aa, Mycobacterium
SLTPQTP

SEQ ID NO: 917208 - protein, 4 aa, Mycobacterium
SLTR

SEQ ID NO: 917209 - protein, 7 aa, Mycobacterium
SLTRPSW

SEQ ID NO: 917210 - protein, 8 aa, Mycobacterium
SMAGKQGR

SEQ ID NO: 917211 - protein, 9 aa, Mycobacterium
SMDGPEGEL

SEQ ID NO: 917212 - protein, 12 aa, Mycobacterium
SMGKPKHPTPVG

SEQ ID NO: 917213 - protein, 12 aa, Mycobacterium
SMGKPSRPTPMG

SEQ ID NO: 917214 - protein, 12 aa, Mycobacterium
SMGKPSRPTPVG

SEQ ID NO: 917215 - protein, 6 aa, Mycobacterium
SMGSDE

SEQ ID NO: 917216 - protein, 9 aa, Mycobacterium
SMKGAAQKL

SEQ ID NO: 917217 - protein, 5 aa, Mycobacterium
SMPEP

SEQ ID NO: 917218 - protein, 4 aa, Mycobacterium
SMPQ

SEQ ID NO: 917219 - protein, 15 aa, Mycobacterium
SMQPAADLPPRPLRG

SEQ ID NO: 917220 - protein, 5 aa, Mycobacterium
SMQPD

SEQ ID NO: 917221 - protein, 20 aa, Mycobacterium
SMRAAQAANVSAVPAATDST

SEQ ID NO: 917222 - protein, 5 aa, Mycobacterium
SMRQR

SEQ ID NO: 917223 - protein, 13 aa, Mycobacterium
SMSADTNKSDPKI

SEQ ID NO: 917224 - protein, 5 aa, Mycobacterium
SMSGG

SEQ ID NO: 917225 - protein, 14 aa, Mycobacterium
SMTSQHGDSGAPVY

SEQ ID NO: 917226 - protein, 10 aa, Mycobacterium
SNAADWEEGV

SEQ ID NO: 917227 - protein, 5 aa, Mycobacterium
SNAEE

SEQ ID NO: 917228 - protein, 4 aa, Mycobacterium
SNAK

SEQ ID NO: 917229 - protein, 16 aa, Mycobacterium
SNAKAEGRDTINGQNT

SEQ ID NO: 917230 - protein, 8 aa, Mycobacterium
SNATLENY

SEQ ID NO: 917231 - protein, 19 aa, Mycobacterium
SNAVYGARNPHKATGPVTA

SEQ ID NO: 917232 - protein, 7 aa, Mycobacterium
SNDAAGR

SEQ ID NO: 917233 - protein, 5 aa, Mycobacterium
SNDEI

SEQ ID NO: 917234 - protein, 7 aa, Mycobacterium
SNDGLRS

SEQ ID NO: 917235 - protein, 27 aa, Mycobacterium
SNDKPAGAAQVSSGSNAEVKVDGKDLA

SEQ ID NO: 917236 - protein, 7 aa, Mycobacterium
SNDPAKL

SEQ ID NO: 917237 - protein, 10 aa, Mycobacterium
SNDPEAPNQA

SEQ ID NO: 917238 - protein, 8 aa, Mycobacterium
SNDPTSVA

SEQ ID NO: 917239 - protein, 10 aa, Mycobacterium
SNDPVDKGAA

SEQ ID NO: 917240 - protein, 12 aa, Mycobacterium
SNDTGASVESRA

SEQ ID NO: 917241 - protein, 6 aa, Mycobacterium
SNDTGV

SEQ ID NO: 917242 - protein, 36 aa, Mycobacterium
SNDTTTTSPAKPAVTPAGPAPNAAPPPAPPPAAKDH

SEQ ID NO: 917243 - protein, 6 aa, Mycobacterium
SNDVPA

SEQ ID NO: 917244 - protein, 8 aa, Mycobacterium
SNEATTSC

SEQ ID NO: 917245 - protein, 14 aa, Mycobacterium
SNFVPGQGYEYSNT

SEQ ID NO: 917246 - protein, 7 aa, Mycobacterium
SNGAGAY

SEQ ID NO: 917247 - protein, 5 aa, Mycobacterium
SNGDM

SEQ ID NO: 917248 - protein, 15 aa, Mycobacterium
SNGKSVDGSAPPQVG

SEQ ID NO: 917249 - protein, 4 aa, Mycobacterium
SNGL

SEQ ID NO: 917250 - protein, 10 aa, Mycobacterium
SNGNGQVVGT

SEQ ID NO: 917251 - protein, 7 aa, Mycobacterium
SNGNPPL

SEQ ID NO: 917252 - protein, 8 aa, Mycobacterium
SNGPDDTL

SEQ ID NO: 917253 - protein, 11 aa, Mycobacterium
SNGPGAAEETR

SEQ ID NO: 917254 - protein, 5 aa, Mycobacterium
SNGQI

SEQ ID NO: 917255 - protein, 13 aa, Mycobacterium
SNGSGATIGTPQI

SEQ ID NO: 917256 - protein, 9 aa, Mycobacterium
SNGSLGGRT

SEQ ID NO: 917257 - protein, 7 aa, Mycobacterium
SNGTRED

SEQ ID NO: 917258 - protein, 9 aa, Mycobacterium
SNIDPKSAL

SEQ ID NO: 917259 - protein, 12 aa, Mycobacterium
SNIKPEGPLARD

SEQ ID NO: 917260 - protein, 17 aa, Mycobacterium
SNIQPGKPITSMDTSPV

SEQ ID NO: 917261 - protein, 20 aa, Mycobacterium
SNIQSAPNNFYAGDGKTPIG

SEQ ID NO: 917262 - protein, 20 aa, Mycobacterium
SNKAGLTSRSALADAIRDLV

SEQ ID NO: 917263 - protein, 7 aa, Mycobacterium
SNKDFQE

SEQ ID NO: 917264 - protein, 4 aa, Mycobacterium
SNKQ

SEQ ID NO: 917265 - protein, 19 aa, Mycobacterium
SNLDSSVQTLQDGTAGQLS

SEQ ID NO: 917266 - protein, 6 aa, Mycobacterium
SNLPNG

SEQ ID NO: 917267 - protein, 6 aa, Mycobacterium
SNNACP

SEQ ID NO: 917268 - protein, 5 aa, Mycobacterium
SNNGE

SEQ ID NO: 917269 - protein, 8 aa, Mycobacterium
SNNSGVAA

SEQ ID NO: 917270 - protein, 10 aa, Mycobacterium
SNNTSSASAL

SEQ ID NO: 917271 - protein, 7 aa, Mycobacterium
SNNYGPY

SEQ ID NO: 917272 - protein, 10 aa, Mycobacterium
SNPAAPRSLA

SEQ ID NO: 917273 - protein, 55 aa, Mycobacterium
SNPADAACTGSPYLPPPPPIVQPPAAAAPPPIAAPPIAAPPIAPPPIAPPPIAAP

SEQ ID NO: 917274 - protein, 9 aa, Mycobacterium
SNPALGGQY

SEQ ID NO: 917275 - protein, 6 aa, Mycobacterium
SNPDGA

SEQ ID NO: 917276 - protein, 6 aa, Mycobacterium
SNPGGE

SEQ ID NO: 917277 - protein, 6 aa, Mycobacterium
SNPKLS

SEQ ID NO: 917278 - protein, 28 aa, Mycobacterium
SNPLHTAPPTIQPAQPAVSPPVSQAPAG

SEQ ID NO: 917279 - protein, 9 aa, Mycobacterium
SNPNGADDP

SEQ ID NO: 917280 - protein, 6 aa, Mycobacterium
SNPQEY

SEQ ID NO: 917281 - protein, 16 aa, Mycobacterium
SNPSADGRETVEGTQT

SEQ ID NO: 917282 - protein, 13 aa, Mycobacterium
SNQDRTGADPTPS

SEQ ID NO: 917283 - protein, 13 aa, Mycobacterium
SNQDRTGANPTPS

SEQ ID NO: 917284 - protein, 14 aa, Mycobacterium
SNQDRTGANPTPST

SEQ ID NO: 917285 - protein, 6 aa, Mycobacterium
SNQNLY

SEQ ID NO: 917286 - protein, 6 aa, Mycobacterium
SNQVHE

SEQ ID NO: 917287 - protein, 20 aa, Mycobacterium
SNRDGRGSVRAGDDRILQFR

SEQ ID NO: 917288 - protein, 5 aa, Mycobacterium
SNRDI

SEQ ID NO: 917289 - protein, 7 aa, Mycobacterium
SNREFQR

SEQ ID NO: 917290 - protein, 8 aa, Mycobacterium
SNRPADVQ

SEQ ID NO: 917291 - protein, 4 aa, Mycobacterium
SNRR

SEQ ID NO: 917292 - protein, 6 aa, Mycobacterium
SNRSID

SEQ ID NO: 917293 - protein, 10 aa, Mycobacterium
SNRTVAHRAD

SEQ ID NO: 917294 - protein, 9 aa, Mycobacterium
SNSDPLGAQ

SEQ ID NO: 917295 - protein, 6 aa, Mycobacterium
SNSNEQ

SEQ ID NO: 917296 - protein, 8 aa, Mycobacterium
SNSPSFAD

SEQ ID NO: 917297 - protein, 13 aa, Mycobacterium
SNSPTGGGQTIFD

SEQ ID NO: 917298 - protein, 14 aa, Mycobacterium
SNSSGKAVAGTFNQ

SEQ ID NO: 917299 - protein, 7 aa, Mycobacterium
SNSSGVG

SEQ ID NO: 917300 - protein, 15 aa, Mycobacterium
SNTDVNALYQWWRGN

SEQ ID NO: 917301 - protein, 7 aa, Mycobacterium
SNTTTNG

SEQ ID NO: 917302 - protein, 4 aa, Mycobacterium
SNTV

SEQ ID NO: 917303 - protein, 11 aa, Mycobacterium
SNVGCSPSQPV

SEQ ID NO: 917304 - protein, 11 aa, Mycobacterium
SNYGRANHPAW

SEQ ID NO: 917305 - protein, 13 aa, Mycobacterium
SNYSNGNTRDRQG

SEQ ID NO: 917306 - protein, 6 aa, Mycobacterium
SNYTTP

SEQ ID NO: 917307 - protein, 7 aa, Mycobacterium
SNYTTPY

SEQ ID NO: 917308 - protein, 9 aa, Mycobacterium
SPAAAERAA

SEQ ID NO: 917309 - protein, 9 aa, Mycobacterium
SPAAAQRAA

SEQ ID NO: 917310 - protein, 7 aa, Mycobacterium
SPAAFSP

SEQ ID NO: 917311 - protein, 11 aa, Mycobacterium
SPAAGELQGPL

SEQ ID NO: 917312 - protein, 6 aa, Mycobacterium
SPAAGY

SEQ ID NO: 917313 - protein, 10 aa, Mycobacterium
SPAAQADPCS

SEQ ID NO: 917314 - protein, 5 aa, Mycobacterium
SPAAS

SEQ ID NO: 917315 - protein, 17 aa, Mycobacterium
SPAASSPPPAAPAPNAT

SEQ ID NO: 917316 - protein, 19 aa, Mycobacterium
SPAATAATRGTVVPAGGVE

SEQ ID NO: 917317 - protein, 7 aa, Mycobacterium
SPADEVP

SEQ ID NO: 917318 - protein, 7 aa, Mycobacterium
SPAEQTT

SEQ ID NO: 917319 - protein, 9 aa, Mycobacterium
SPAFADGAP

SEQ ID NO: 917320 - protein, 4 aa, Mycobacterium
SPAG

SEQ ID NO: 917321 - protein, 10 aa, Mycobacterium
SPAGIRTSDG

SEQ ID NO: 917322 - protein, 11 aa, Mycobacterium
SPAGIRTSDGI

SEQ ID NO: 917323 - protein, 12 aa, Mycobacterium
SPAGVPGLRGSE

SEQ ID NO: 917324 - protein, 18 aa, Mycobacterium
SPAKGSGKKYRYVRFTPP

SEQ ID NO: 917325 - protein, 6 aa, Mycobacterium
SPAPAD

SEQ ID NO: 917326 - protein, 8 aa, Mycobacterium
SPAPDDVK

SEQ ID NO: 917327 - protein, 29 aa, Mycobacterium
SPAPLPPGVTVDPPDCAKYSGGSAVPAEL

SEQ ID NO: 917328 - protein, 23 aa, Mycobacterium
SPAPVTAPTHTSPSAHPTTVNPA

SEQ ID NO: 917329 - protein, 8 aa, Mycobacterium
SPAQADAA

SEQ ID NO: 917330 - protein, 16 aa, Mycobacterium
SPAQPGATSYDNRGDT

SEQ ID NO: 917331 - protein, 19 aa, Mycobacterium
SPAQPGHNDGQLKAANDAA

SEQ ID NO: 917332 - protein, 6 aa, Mycobacterium
SPARAH

SEQ ID NO: 917333 - protein, 15 aa, Mycobacterium
SPARRGSPAAAPDLG

SEQ ID NO: 917334 - protein, 23 aa, Mycobacterium
SPASQRPARRAGRRRAAAKNPDR

SEQ ID NO: 917335 - protein, 12 aa, Mycobacterium
SPATADDTGPLT

SEQ ID NO: 917336 - protein, 19 aa, Mycobacterium
SPATTGKPCAGDLRERKAT

SEQ ID NO: 917337 - protein, 4 aa, Mycobacterium
SPAV

SEQ ID NO: 917338 - protein, 6 aa, Mycobacterium
SPAYAD

SEQ ID NO: 917339 - protein, 5 aa, Mycobacterium
SPAYE

SEQ ID NO: 917340 - protein, 27 aa, Mycobacterium
SPCDPPPGFGYTREGTYKGFPGSSVER

SEQ ID NO: 917341 - protein, 9 aa, Mycobacterium
SPDADTAGM

SEQ ID NO: 917342 - protein, 42 aa, Mycobacterium
SPDAEAAEDPETPEEAADTERALTETTQIDPLPEAPPETSTV

SEQ ID NO: 917343 - protein, 7 aa, Mycobacterium
SPDFEGR

SEQ ID NO: 917344 - protein, 8 aa, Mycobacterium
SPDFTPTD

SEQ ID NO: 917345 - protein, 4 aa, Mycobacterium
SPDG

SEQ ID NO: 917346 - protein, 8 aa, Mycobacterium
SPDGDDYT

SEQ ID NO: 917347 - protein, 29 aa, Mycobacterium
SPDGNTTIYENPGNALSVTADPAGLATAG

SEQ ID NO: 917348 - protein, 5 aa, Mycobacterium
SPDLN

SEQ ID NO: 917349 - protein, 6 aa, Mycobacterium
SPDNAS

SEQ ID NO: 917350 - protein, 7 aa, Mycobacterium
SPDQIGN

SEQ ID NO: 917351 - protein, 7 aa, Mycobacterium
SPDQRQE

SEQ ID NO: 917352 - protein, 4 aa, Mycobacterium
SPDR

SEQ ID NO: 917353 - protein, 18 aa, Mycobacterium
SPDRHSSGGGATTTTPNV

SEQ ID NO: 917354 - protein, 15 aa, Mycobacterium
SPDRSIDNQALSDQR

SEQ ID NO: 917355 - protein, 30 aa, Mycobacterium
SPDRSMGTAEPGNFGPPTAPVPPTPEHGTS

SEQ ID NO: 917356 - protein, 20 aa, Mycobacterium
SPDTTDNYAGYDYQNPRSTG

SEQ ID NO: 917357 - protein, 21 aa, Mycobacterium
SPDTTDTYAGYDHDNERSTGF

SEQ ID NO: 917358 - protein, 10 aa, Mycobacterium
SPDTTNTYAG

SEQ ID NO: 917359 - protein, 13 aa, Mycobacterium
SPEAAELGEVDRS

SEQ ID NO: 917360 - protein, 11 aa, Mycobacterium
SPEATTSAPTA

SEQ ID NO: 917361 - protein, 7 aa, Mycobacterium
SPEDEQA

SEQ ID NO: 917362 - protein, 10 aa, Mycobacterium
SPEFDTGSAL

SEQ ID NO: 917363 - protein, 8 aa, Mycobacterium
SPEFPEPY

SEQ ID NO: 917364 - protein, 7 aa, Mycobacterium
SPEGEGW

SEQ ID NO: 917365 - protein, 9 aa, Mycobacterium
SPEHRSGRR

SEQ ID NO: 917366 - protein, 4 aa, Mycobacterium
SPEN

SEQ ID NO: 917367 - protein, 18 aa, Mycobacterium
SPENLPPGTSATPTQQGR

SEQ ID NO: 917368 - protein, 23 aa, Mycobacterium
SPENLPPGTTETPDQIPGQGPNM

SEQ ID NO: 917369 - protein, 14 aa, Mycobacterium
SPEPLNPIGDPERT

SEQ ID NO: 917370 - protein, 9 aa, Mycobacterium
SPEPPAQYC

SEQ ID NO: 917371 - protein, 5 aa, Mycobacterium
SPEQA

SEQ ID NO: 917372 - protein, 5 aa, Mycobacterium
SPFDH

SEQ ID NO: 917373 - protein, 4 aa, Mycobacterium
SPFQ

SEQ ID NO: 917374 - protein, 5 aa, Mycobacterium
SPFQH

SEQ ID NO: 917375 - protein, 6 aa, Mycobacterium
SPGALG

SEQ ID NO: 917376 - protein, 8 aa, Mycobacterium
SPGAPGAS

SEQ ID NO: 917377 - protein, 11 aa, Mycobacterium
SPGASQSPKAD

SEQ ID NO: 917378 - protein, 4 aa, Mycobacterium
SPGC

SEQ ID NO: 917379 - protein, 20 aa, Mycobacterium
SPGCGRPRPVATTPAPTAGV

SEQ ID NO: 917380 - protein, 8 aa, Mycobacterium
SPGDDGPG

SEQ ID NO: 917381 - protein, 26 aa, Mycobacterium
SPGEATCAQNGGSYPGRTGSRGHEIQ

SEQ ID NO: 917382 - protein, 7 aa, Mycobacterium
SPGEVTD

SEQ ID NO: 917383 - protein, 33 aa, Mycobacterium
SPGGKTDISYDPPSSRGRPGPLAGPDLADPAHT

SEQ ID NO: 917384 - protein, 17 aa, Mycobacterium
SPGKPAVTVGGRSHAVD

SEQ ID NO: 917385 - protein, 12 aa, Mycobacterium
SPGKRPGGRSGL

SEQ ID NO: 917386 - protein, 41 aa, Mycobacterium
SPGLAANPRYATDSGAGPQGAPETSDQPAGPPAVEAPKNEL

SEQ ID NO: 917387 - protein, 19 aa, Mycobacterium
SPGNTGQLHDGGPSAARTA

SEQ ID NO: 917388 - protein, 5 aa, Mycobacterium
SPGNV

SEQ ID NO: 917389 - protein, 5 aa, Mycobacterium
SPGRI

SEQ ID NO: 917390 - protein, 8 aa, Mycobacterium
SPGSIDTE

SEQ ID NO: 917391 - protein, 6 aa, Mycobacterium
SPGSTP

SEQ ID NO: 917392 - protein, 9 aa, Mycobacterium
SPGSVDTEM

SEQ ID NO: 917393 - protein, 8 aa, Mycobacterium
SPGTPRGL

SEQ ID NO: 917394 - protein, 7 aa, Mycobacterium
SPGVDTV

SEQ ID NO: 917395 - protein, 4 aa, Mycobacterium
SPHQ

SEQ ID NO: 917396 - protein, 5 aa, Mycobacterium
SPIDI

SEQ ID NO: 917397 - protein, 12 aa, Mycobacterium
SPIDTGDAARPT

SEQ ID NO: 917398 - protein, 5 aa, Mycobacterium
SPIGN

SEQ ID NO: 917399 - protein, 17 aa, Mycobacterium
SPIGRERATEERTRPSV

SEQ ID NO: 917400 - protein, 17 aa, Mycobacterium
SPIGREREGEERTREEV

SEQ ID NO: 917401 - protein, 15 aa, Mycobacterium
SPIGRERKTEELSRA

SEQ ID NO: 917402 - protein, 4 aa, Mycobacterium
SPIP

SEQ ID NO: 917403 - protein, 5 aa, Mycobacterium
SPIQE

SEQ ID NO: 917404 - protein, 7 aa, Mycobacterium
SPIQEPP

SEQ ID NO: 917405 - protein, 5 aa, Mycobacterium
SPIRS

SEQ ID NO: 917406 - protein, 7 aa, Mycobacterium
SPKATER

SEQ ID NO: 917407 - protein, 15 aa, Mycobacterium
SPKCGNGNDPLDKAG

SEQ ID NO: 917408 - protein, 8 aa, Mycobacterium
SPKDAEGI

SEQ ID NO: 917409 - protein, 7 aa, Mycobacterium
SPKNPDN

SEQ ID NO: 917410 - protein, 10 aa, Mycobacterium
SPKNPPQLSY

SEQ ID NO: 917411 - protein, 9 aa, Mycobacterium
SPKNPPTLS

SEQ ID NO: 917412 - protein, 8 aa, Mycobacterium
SPKPKRQQ

SEQ ID NO: 917413 - protein, 4 aa, Mycobacterium
SPLA

SEQ ID NO: 917414 - protein, 6 aa, Mycobacterium
SPLGQR

SEQ ID NO: 917415 - protein, 11 aa, Mycobacterium
SPLGQRKPLPT

SEQ ID NO: 917416 - protein, 24 aa, Mycobacterium
SPLGSAHAQPPAVPSEPLPAGDAG

SEQ ID NO: 917417 - protein, 10 aa, Mycobacterium
SPLGSPGPTM

SEQ ID NO: 917418 - protein, 13 aa, Mycobacterium
SPLGTAGDDGNGI

SEQ ID NO: 917419 - protein, 5 aa, Mycobacterium
SPLHG

SEQ ID NO: 917420 - protein, 5 aa, Mycobacterium
SPLNP

SEQ ID NO: 917421 - protein, 4 aa, Mycobacterium
SPLP

SEQ ID NO: 917422 - protein, 13 aa, Mycobacterium
SPLPAESRGGAVD

SEQ ID NO: 917423 - protein, 8 aa, Mycobacterium
SPLPAEYA

SEQ ID NO: 917424 - protein, 9 aa, Mycobacterium
SPLPPGADQ

SEQ ID NO: 917425 - protein, 7 aa, Mycobacterium
SPLPPGV

SEQ ID NO: 917426 - protein, 15 aa, Mycobacterium
SPLPTSPCATRPAPL

SEQ ID NO: 917427 - protein, 6 aa, Mycobacterium
SPLRAA

SEQ ID NO: 917428 - protein, 15 aa, Mycobacterium
SPLSGPELDKKIGQL

SEQ ID NO: 917429 - protein, 5 aa, Mycobacterium
SPLTE

SEQ ID NO: 917430 - protein, 9 aa, Mycobacterium
SPLTGPGAS

SEQ ID NO: 917431 - protein, 17 aa, Mycobacterium
SPMAEAQQTAAPLAGEL

SEQ ID NO: 917432 - protein, 44 aa, Mycobacterium
SPMQSTDPSGAQASTAAGAAAAGTTAQTTASQPTTTATDTAQGL

SEQ ID NO: 917433 - protein, 15 aa, Mycobacterium
SPMSTGQAALLEPHL

SEQ ID NO: 917434 - protein, 4 aa, Mycobacterium
SPMT

SEQ ID NO: 917435 - protein, 4 aa, Mycobacterium
SPNA

SEQ ID NO: 917436 - protein, 14 aa, Mycobacterium
SPNAAADATDTDTT

SEQ ID NO: 917437 - protein, 22 aa, Mycobacterium
SPNAGYFTDDGDQSGLPGTGVR

SEQ ID NO: 917438 - protein, 8 aa, Mycobacterium
SPNGIRTA

SEQ ID NO: 917439 - protein, 12 aa, Mycobacterium
SPNGIRTADGIE

SEQ ID NO: 917440 - protein, 6 aa, Mycobacterium
SPNPVY

SEQ ID NO: 917441 - protein, 8 aa, Mycobacterium
SPNRYGNH

SEQ ID NO: 917442 - protein, 7 aa, Mycobacterium
SPNSGMR

SEQ ID NO: 917443 - protein, 9 aa, Mycobacterium
SPPGRQLEG

SEQ ID NO: 917444 - protein, 13 aa, Mycobacterium
SPPLNAAQAGPSV

SEQ ID NO: 917445 - protein, 13 aa, Mycobacterium
SPPLNAAQSGPSV

SEQ ID NO: 917446 - protein, 4 aa, Mycobacterium
SPPP

SEQ ID NO: 917447 - protein, 13 aa, Mycobacterium
SPPPAPPTSYGDW

SEQ ID NO: 917448 - protein, 13 aa, Mycobacterium
SPPQGQFGGRPHP

SEQ ID NO: 917449 - protein, 6 aa, Mycobacterium
SPPRVH

SEQ ID NO: 917450 - protein, 9 aa, Mycobacterium
SPPTGRDPL

SEQ ID NO: 917451 - protein, 14 aa, Mycobacterium
SPPVAAETSDRALA

SEQ ID NO: 917452 - protein, 5 aa, Mycobacterium
SPQAA

SEQ ID NO: 917453 - protein, 11 aa, Mycobacterium
SPQEATDAAAA

SEQ ID NO: 917454 - protein, 9 aa, Mycobacterium
SPQEDPPIR

SEQ ID NO: 917455 - protein, 7 aa, Mycobacterium
SPQLHTS

SEQ ID NO: 917456 - protein, 9 aa, Mycobacterium
SPQQDPPVR

SEQ ID NO: 917457 - protein, 20 aa, Mycobacterium
SPQSVSTSTALENSKPTLTI

SEQ ID NO: 917458 - protein, 18 aa, Mycobacterium
SPQTVSTPATTPKARTGF

SEQ ID NO: 917459 - protein, 8 aa, Mycobacterium
SPRASEPW

SEQ ID NO: 917460 - protein, 19 aa, Mycobacterium
SPRDAERAATRIADAMEAG

SEQ ID NO: 917461 - protein, 8 aa, Mycobacterium
SPRDRIAE

SEQ ID NO: 917462 - protein, 14 aa, Mycobacterium
SPRDRIPNSSSAYP

SEQ ID NO: 917463 - protein, 6 aa, Mycobacterium
SPREWT

SEQ ID NO: 917464 - protein, 5 aa, Mycobacterium
SPRFG

SEQ ID NO: 917465 - protein, 17 aa, Mycobacterium
SPRGRITRTYREARTVE

SEQ ID NO: 917466 - protein, 8 aa, Mycobacterium
SPRKADRD

SEQ ID NO: 917467 - protein, 13 aa, Mycobacterium
SPRKGSRTGRSGL

SEQ ID NO: 917468 - protein, 13 aa, Mycobacterium
SPRLDDSKPFKPK

SEQ ID NO: 917469 - protein, 22 aa, Mycobacterium
SPRPRRGRRDDGRAVRGGSGGV

SEQ ID NO: 917470 - protein, 11 aa, Mycobacterium
SPRSEASAALA

SEQ ID NO: 917471 - protein, 17 aa, Mycobacterium
SPRTRRSSRFASPPGLL

SEQ ID NO: 917472 - protein, 8 aa, Mycobacterium
SPRVNRRN

SEQ ID NO: 917473 - protein, 8 aa, Mycobacterium
SPRVTLPG

SEQ ID NO: 917474 - protein, 10 aa, Mycobacterium
SPSATADPCS

SEQ ID NO: 917475 - protein, 8 aa, Mycobacterium
SPSDIDTF

SEQ ID NO: 917476 - protein, 6 aa, Mycobacterium
SPSFAD

SEQ ID NO: 917477 - protein, 5 aa, Mycobacterium
SPSGR

SEQ ID NO: 917478 - protein, 4 aa, Mycobacterium
SPSI

SEQ ID NO: 917479 - protein, 15 aa, Mycobacterium
SPSLTEYEAQEQSAT

SEQ ID NO: 917480 - protein, 6 aa, Mycobacterium
SPSMGR

SEQ ID NO: 917481 - protein, 4 aa, Mycobacterium
SPSN

SEQ ID NO: 917482 - protein, 7 aa, Mycobacterium
SPSNPDK

SEQ ID NO: 917483 - protein, 4 aa, Mycobacterium
SPSP

SEQ ID NO: 917484 - protein, 9 aa, Mycobacterium
SPSPAADAD

SEQ ID NO: 917485 - protein, 5 aa, Mycobacterium
SPSPF

SEQ ID NO: 917486 - protein, 10 aa, Mycobacterium
SPSTEGTGST

SEQ ID NO: 917487 - protein, 6 aa, Mycobacterium
SPSYDP

SEQ ID NO: 917488 - protein, 14 aa, Mycobacterium
SPTAKGGTVTIGND

SEQ ID NO: 917489 - protein, 10 aa, Mycobacterium
SPTAYDGEPT

SEQ ID NO: 917490 - protein, 9 aa, Mycobacterium
SPTDPPTLS

SEQ ID NO: 917491 - protein, 16 aa, Mycobacterium
SPTECTGTVTSDQGWS

SEQ ID NO: 917492 - protein, 13 aa, Mycobacterium
SPTGLATDKTTAP

SEQ ID NO: 917493 - protein, 7 aa, Mycobacterium
SPTGVTT

SEQ ID NO: 917494 - protein, 4 aa, Mycobacterium
SPTN

SEQ ID NO: 917495 - protein, 6 aa, Mycobacterium
SPTPFA

SEQ ID NO: 917496 - protein, 12 aa, Mycobacterium
SPTSAAASNTAT

SEQ ID NO: 917497 - protein, 15 aa, Mycobacterium
SPVASAPSATAEPCP

SEQ ID NO: 917498 - protein, 16 aa, Mycobacterium
SPVEDAPKHSAADDAD

SEQ ID NO: 917499 - protein, 16 aa, Mycobacterium
SPVEDAPKHSADDDAD

SEQ ID NO: 917500 - protein, 18 aa, Mycobacterium
SPVEDLPKHAGDGDDAEV

SEQ ID NO: 917501 - protein, 7 aa, Mycobacterium
SPVGGGG

SEQ ID NO: 917502 - protein, 4 aa, Mycobacterium
SPVP

SEQ ID NO: 917503 - protein, 17 aa, Mycobacterium
SPVRTSGMTPYVTRLIE

SEQ ID NO: 917504 - protein, 4 aa, Mycobacterium
SPVS

SEQ ID NO: 917505 - protein, 7 aa, Mycobacterium
SPVTGQS

SEQ ID NO: 917506 - protein, 6 aa, Mycobacterium
SPVYGS

SEQ ID NO: 917507 - protein, 10 aa, Mycobacterium
SPWSGPLADG

SEQ ID NO: 917508 - protein, 4 aa, Mycobacterium
SPYG

SEQ ID NO: 917509 - protein, 4 aa, Mycobacterium
SPYP

SEQ ID NO: 917510 - protein, 8 aa, Mycobacterium
SQAAADND

SEQ ID NO: 917511 - protein, 13 aa, Mycobacterium
SQAAAPASPPSIA

SEQ ID NO: 917512 - protein, 4 aa, Mycobacterium
SQAD

SEQ ID NO: 917513 - protein, 7 aa, Mycobacterium
SQADSGG

SEQ ID NO: 917514 - protein, 5 aa, Mycobacterium
SQADV

SEQ ID NO: 917515 - protein, 6 aa, Mycobacterium
SQADVE

SEQ ID NO: 917516 - protein, 8 aa, Mycobacterium
SQAERFTG

SEQ ID NO: 917517 - protein, 10 aa, Mycobacterium
SQAGKPHGEM

SEQ ID NO: 917518 - protein, 12 aa, Mycobacterium
SQAKGKAQLVTD

SEQ ID NO: 917519 - protein, 19 aa, Mycobacterium
SQALARGGQPVSTDQMQPG

SEQ ID NO: 917520 - protein, 25 aa, Mycobacterium
SQAPAPASTGTPTAHQTPTSTSTPR

SEQ ID NO: 917521 - protein, 10 aa, Mycobacterium
SQAPEAQRAM

SEQ ID NO: 917522 - protein, 5 aa, Mycobacterium
SQARR

SEQ ID NO: 917523 - protein, 4 aa, Mycobacterium
SQAS

SEQ ID NO: 917524 - protein, 8 aa, Mycobacterium
SQAVGPMG

SEQ ID NO: 917525 - protein, 8 aa, Mycobacterium
SQAVSGDK

SEQ ID NO: 917526 - protein, 7 aa, Mycobacterium
SQDAATN

SEQ ID NO: 917527 - protein, 12 aa, Mycobacterium
SQDDTSAAGGIS

SEQ ID NO: 917528 - protein, 9 aa, Mycobacterium
SQDGPASET

SEQ ID NO: 917529 - protein, 12 aa, Mycobacterium
SQDKPALSGSAQ

SEQ ID NO: 917530 - protein, 10 aa, Mycobacterium
SQDPEKENAA

SEQ ID NO: 917531 - protein, 14 aa, Mycobacterium
SQDPVYAGTGYTGI

SEQ ID NO: 917532 - protein, 11 aa, Mycobacterium
SQDRTHSPGGN

SEQ ID NO: 917533 - protein, 7 aa, Mycobacterium
SQDSSGL

SEQ ID NO: 917534 - protein, 6 aa, Mycobacterium
SQENGV

SEQ ID NO: 917535 - protein, 8 aa, Mycobacterium
SQEPGSGY

SEQ ID NO: 917536 - protein, 7 aa, Mycobacterium
SQERAQK

SEQ ID NO: 917537 - protein, 14 aa, Mycobacterium
SQETSPTRGIPSGP

SEQ ID NO: 917538 - protein, 13 aa, Mycobacterium
SQGAKPGLGGHLP

SEQ ID NO: 917539 - protein, 6 aa, Mycobacterium
SQGGQA

SEQ ID NO: 917540 - protein, 11 aa, Mycobacterium
SQGGSADDIAP

SEQ ID NO: 917541 - protein, 6 aa, Mycobacterium
SQGIST

SEQ ID NO: 917542 - protein, 14 aa, Mycobacterium
SQGKTTLSAQDRQA

SEQ ID NO: 917543 - protein, 6 aa, Mycobacterium
SQGSVD

SEQ ID NO: 917544 - protein, 5 aa, Mycobacterium
SQGTT

SEQ ID NO: 917545 - protein, 7 aa, Mycobacterium
SQGVPPD

SEQ ID NO: 917546 - protein, 5 aa, Mycobacterium
SQGWD

SEQ ID NO: 917547 - protein, 16 aa, Mycobacterium
SQHANDKMQAQPRGGS

SEQ ID NO: 917548 - protein, 6 aa, Mycobacterium
SQIGSR

SEQ ID NO: 917549 - protein, 9 aa, Mycobacterium
SQKKSDRLK

SEQ ID NO: 917550 - protein, 7 aa, Mycobacterium
SQKNSGL

SEQ ID NO: 917551 - protein, 6 aa, Mycobacterium
SQLGGR

SEQ ID NO: 917552 - protein, 7 aa, Mycobacterium
SQLGGRS

SEQ ID NO: 917553 - protein, 13 aa, Mycobacterium
SQLGPQEGSVQGP

SEQ ID NO: 917554 - protein, 6 aa, Mycobacterium
SQLPPE

SEQ ID NO: 917555 - protein, 9 aa, Mycobacterium
SQMPGGPYA

SEQ ID NO: 917556 - protein, 9 aa, Mycobacterium
SQMTDAREL

SEQ ID NO: 917557 - protein, 7 aa, Mycobacterium
SQNAPGV

SEQ ID NO: 917558 - protein, 14 aa, Mycobacterium
SQNGGSGVSCSTRP

SEQ ID NO: 917559 - protein, 14 aa, Mycobacterium
SQNGGSGVTCSTRP

SEQ ID NO: 917560 - protein, 4 aa, Mycobacterium
SQPE

SEQ ID NO: 917561 - protein, 10 aa, Mycobacterium
SQPGSPAEES

SEQ ID NO: 917562 - protein, 9 aa, Mycobacterium
SQPGTGSTF

SEQ ID NO: 917563 - protein, 4 aa, Mycobacterium
SQPL

SEQ ID NO: 917564 - protein, 4 aa, Mycobacterium
SQPM

SEQ ID NO: 917565 - protein, 11 aa, Mycobacterium
SQQLKTADRAG

SEQ ID NO: 917566 - protein, 8 aa, Mycobacterium
SQQPDSAF

SEQ ID NO: 917567 - protein, 6 aa, Mycobacterium
SQRDEL

SEQ ID NO: 917568 - protein, 7 aa, Mycobacterium
SQRDGLT

SEQ ID NO: 917569 - protein, 7 aa, Mycobacterium
SQRGAHA

SEQ ID NO: 917570 - protein, 9 aa, Mycobacterium
SQRGLTDAP

SEQ ID NO: 917571 - protein, 5 aa, Mycobacterium
SQRLA

SEQ ID NO: 917572 - protein, 16 aa, Mycobacterium
SQRSDPQVGQPGTPAM

SEQ ID NO: 917573 - protein, 18 aa, Mycobacterium
SQRTEPPLGQPGTPPLPV

SEQ ID NO: 917574 - protein, 4 aa, Mycobacterium
SQRW

SEQ ID NO: 917575 - protein, 7 aa, Mycobacterium
SQSAYNA

SEQ ID NO: 917576 - protein, 9 aa, Mycobacterium
SQSGAARDH

SEQ ID NO: 917577 - protein, 9 aa, Mycobacterium
SQSGAAREH

SEQ ID NO: 917578 - protein, 8 aa, Mycobacterium
SQSGSVAA

SEQ ID NO: 917579 - protein, 19 aa, Mycobacterium
SQSKSGTDLTKTGCEVDPS

SEQ ID NO: 917580 - protein, 6 aa, Mycobacterium
SQSNEQ

SEQ ID NO: 917581 - protein, 18 aa, Mycobacterium
SQSYERGPLGLPTSAEIQ

SEQ ID NO: 917582 - protein, 13 aa, Mycobacterium
SQTAGRLGDSRTD

SEQ ID NO: 917583 - protein, 7 aa, Mycobacterium
SQTDADT

SEQ ID NO: 917584 - protein, 6 aa, Mycobacterium
SQTFGE

SEQ ID NO: 917585 - protein, 13 aa, Mycobacterium
SQTGDFTRSGGKQ

SEQ ID NO: 917586 - protein, 5 aa, Mycobacterium
SQTGG

SEQ ID NO: 917587 - protein, 5 aa, Mycobacterium
SQTIS

SEQ ID NO: 917588 - protein, 13 aa, Mycobacterium
SQTLPTNDPGKEC

SEQ ID NO: 917589 - protein, 5 aa, Mycobacterium
SQTNR

SEQ ID NO: 917590 - protein, 6 aa, Mycobacterium
SQTPAG

SEQ ID NO: 917591 - protein, 9 aa, Mycobacterium
SQTSYPGNG

SEQ ID NO: 917592 - protein, 7 aa, Mycobacterium
SQTYDSC

SEQ ID NO: 917593 - protein, 7 aa, Mycobacterium
SQVGGRS

SEQ ID NO: 917594 - protein, 6 aa, Mycobacterium
SQVHRP

SEQ ID NO: 917595 - protein, 10 aa, Mycobacterium
SQVQEAGDGW

SEQ ID NO: 917596 - protein, 6 aa, Mycobacterium
SQVSNN

SEQ ID NO: 917597 - protein, 4 aa, Mycobacterium
SRAD

SEQ ID NO: 917598 - protein, 4 aa, Mycobacterium
SRAE

SEQ ID NO: 917599 - protein, 12 aa, Mycobacterium
SRAESKGPEPEG

SEQ ID NO: 917600 - protein, 13 aa, Mycobacterium
SRAESKGPEPEGL

SEQ ID NO: 917601 - protein, 6 aa, Mycobacterium
SRAGDN

SEQ ID NO: 917602 - protein, 5 aa, Mycobacterium
SRAPD

SEQ ID NO: 917603 - protein, 7 aa, Mycobacterium
SRAQPTS

SEQ ID NO: 917604 - protein, 21 aa, Mycobacterium
SRATAFNTQGISADARANRAA

SEQ ID NO: 917605 - protein, 20 aa, Mycobacterium
SRDANGTRYECSGPADDVAD

SEQ ID NO: 917606 - protein, 9 aa, Mycobacterium
SRDATAEQI

SEQ ID NO: 917607 - protein, 9 aa, Mycobacterium
SRDDAKKMS

SEQ ID NO: 917608 - protein, 10 aa, Mycobacterium
SRDDATATYA

SEQ ID NO: 917609 - protein, 6 aa, Mycobacterium
SRDDTA

SEQ ID NO: 917610 - protein, 9 aa, Mycobacterium
SRDDVTAEL

SEQ ID NO: 917611 - protein, 6 aa, Mycobacterium
SRDFGG

SEQ ID NO: 917612 - protein, 13 aa, Mycobacterium
SRDGDRPATPGPH

SEQ ID NO: 917613 - protein, 15 aa, Mycobacterium
SRDGGAFELNAALHA

SEQ ID NO: 917614 - protein, 11 aa, Mycobacterium
SRDGKPADLQP

SEQ ID NO: 917615 - protein, 10 aa, Mycobacterium
SRDSEDPIPG

SEQ ID NO: 917616 - protein, 15 aa, Mycobacterium
SRDSGITNAQDLSGR

SEQ ID NO: 917617 - protein, 4 aa, Mycobacterium
SREA

SEQ ID NO: 917618 - protein, 6 aa, Mycobacterium
SREAAR

SEQ ID NO: 917619 - protein, 10 aa, Mycobacterium
SREAERTTEA

SEQ ID NO: 917620 - protein, 12 aa, Mycobacterium
SREAGSGTREAL

SEQ ID NO: 917621 - protein, 8 aa, Mycobacterium
SREAPRKS

SEQ ID NO: 917622 - protein, 4 aa, Mycobacterium
SREL

SEQ ID NO: 917623 - protein, 15 aa, Mycobacterium
SRENFGTDKAFGQPE

SEQ ID NO: 917624 - protein, 21 aa, Mycobacterium
SRENQKATAIEGGLPAVDSSL

SEQ ID NO: 917625 - protein, 4 aa, Mycobacterium
SREP

SEQ ID NO: 917626 - protein, 7 aa, Mycobacterium
SREPDSI

SEQ ID NO: 917627 - protein, 8 aa, Mycobacterium
SREPLGLP

SEQ ID NO: 917628 - protein, 8 aa, Mycobacterium
SREPLGVP

SEQ ID NO: 917629 - protein, 7 aa, Mycobacterium
SREPVDP

SEQ ID NO: 917630 - protein, 12 aa, Mycobacterium
SRERAQPAWLAF

SEQ ID NO: 917631 - protein, 26 aa, Mycobacterium
SRESRETPNDPAASSSSSQQSAEPTV

SEQ ID NO: 917632 - protein, 5 aa, Mycobacterium
SRETW

SEQ ID NO: 917633 - protein, 7 aa, Mycobacterium
SRFPGPI

SEQ ID NO: 917634 - protein, 5 aa, Mycobacterium
SRGAA

SEQ ID NO: 917635 - protein, 9 aa, Mycobacterium
SRGAAPVDR

SEQ ID NO: 917636 - protein, 12 aa, Mycobacterium
SRGAEAKATKQM

SEQ ID NO: 917637 - protein, 30 aa, Mycobacterium
SRGDNQPQLPPPTVTDTGSPPASQTPTGRG

SEQ ID NO: 917638 - protein, 4 aa, Mycobacterium
SRGG

SEQ ID NO: 917639 - protein, 5 aa, Mycobacterium
SRGGT

SEQ ID NO: 917640 - protein, 16 aa, Mycobacterium
SRGPDDEGATPIRERA

SEQ ID NO: 917641 - protein, 5 aa, Mycobacterium
SRGPH

SEQ ID NO: 917642 - protein, 6 aa, Mycobacterium
SRGPHA

SEQ ID NO: 917643 - protein, 4 aa, Mycobacterium
SRGQ

SEQ ID NO: 917644 - protein, 4 aa, Mycobacterium
SRGR

SEQ ID NO: 917645 - protein, 5 aa, Mycobacterium
SRGRN

SEQ ID NO: 917646 - protein, 7 aa, Mycobacterium
SRGRPAK

SEQ ID NO: 917647 - protein, 8 aa, Mycobacterium
SRGRYPGR

SEQ ID NO: 917648 - protein, 9 aa, Mycobacterium
SRGSSAPHG

SEQ ID NO: 917649 - protein, 38 aa, Mycobacterium
SRGTRLPSSMSGARGPRMSGGVEGAGAAGGVKVSGGFG

SEQ ID NO: 917650 - protein, 4 aa, Mycobacterium
SRGV

SEQ ID NO: 917651 - protein, 9 aa, Mycobacterium
SRHEDEPDE

SEQ ID NO: 917652 - protein, 6 aa, Mycobacterium
SRHEPY

SEQ ID NO: 917653 - protein, 10 aa, Mycobacterium
SRHRDTEPGD

SEQ ID NO: 917654 - protein, 6 aa, Mycobacterium
SRIGDS

SEQ ID NO: 917655 - protein, 5 aa, Mycobacterium
SRKDA

SEQ ID NO: 917656 - protein, 15 aa, Mycobacterium
SRKGFTSSGPGSGCG

SEQ ID NO: 917657 - protein, 21 aa, Mycobacterium
SRKLAGEQGLDGVSAPAEAMT

SEQ ID NO: 917658 - protein, 14 aa, Mycobacterium
SRKSDQRPLQLVEN

SEQ ID NO: 917659 - protein, 7 aa, Mycobacterium
SRKYGAR

SEQ ID NO: 917660 - protein, 8 aa, Mycobacterium
SRLGAEES

SEQ ID NO: 917661 - protein, 8 aa, Mycobacterium
SRLGAERS

SEQ ID NO: 917662 - protein, 8 aa, Mycobacterium
SRLKAGQK

SEQ ID NO: 917663 - protein, 9 aa, Mycobacterium
SRLNNEQSA

SEQ ID NO: 917664 - protein, 6 aa, Mycobacterium
SRLPAG

SEQ ID NO: 917665 - protein, 25 aa, Mycobacterium
SRLPGDGPYPDRSGGVLPGYGGAKA

SEQ ID NO: 917666 - protein, 5 aa, Mycobacterium
SRLPQ

SEQ ID NO: 917667 - protein, 6 aa, Mycobacterium
SRLPTG

SEQ ID NO: 917668 - protein, 11 aa, Mycobacterium
SRLTSADVTTV

SEQ ID NO: 917669 - protein, 13 aa, Mycobacterium
SRLTTENVSTVPT

SEQ ID NO: 917670 - protein, 15 aa, Mycobacterium
SRMPPRGLTQAASRY

SEQ ID NO: 917671 - protein, 5 aa, Mycobacterium
SRNDA

SEQ ID NO: 917672 - protein, 10 aa, Mycobacterium
SRNDKDADPV

SEQ ID NO: 917673 - protein, 10 aa, Mycobacterium
SRNGAGPTSD

SEQ ID NO: 917674 - protein, 10 aa, Mycobacterium
SRNGAGPVEG

SEQ ID NO: 917675 - protein, 13 aa, Mycobacterium
SRNGAPNWSRGDD

SEQ ID NO: 917676 - protein, 7 aa, Mycobacterium
SRNGDAV

SEQ ID NO: 917677 - protein, 10 aa, Mycobacterium
SRNGVGPVDS

SEQ ID NO: 917678 - protein, 10 aa, Mycobacterium
SRNPPSTKTL

SEQ ID NO: 917679 - protein, 9 aa, Mycobacterium
SRNSDGSLT

SEQ ID NO: 917680 - protein, 10 aa, Mycobacterium
SRPAAPGFAT

SEQ ID NO: 917681 - protein, 6 aa, Mycobacterium
SRPADA

SEQ ID NO: 917682 - protein, 13 aa, Mycobacterium
SRPARTKDPRGLS

SEQ ID NO: 917683 - protein, 8 aa, Mycobacterium
SRPDIDGI

SEQ ID NO: 917684 - protein, 8 aa, Mycobacterium
SRPDRAGI

SEQ ID NO: 917685 - protein, 7 aa, Mycobacterium
SRPDTES

SEQ ID NO: 917686 - protein, 8 aa, Mycobacterium
SRPDTGEL

SEQ ID NO: 917687 - protein, 20 aa, Mycobacterium
SRPEPLPPTDPPPPAPPAPY

SEQ ID NO: 917688 - protein, 15 aa, Mycobacterium
SRPGSSFGAKPITRR

SEQ ID NO: 917689 - protein, 10 aa, Mycobacterium
SRPGSVTDGT

SEQ ID NO: 917690 - protein, 19 aa, Mycobacterium
SRPGTGAETGGFKGDPAFH

SEQ ID NO: 917691 - protein, 5 aa, Mycobacterium
SRPHR

SEQ ID NO: 917692 - protein, 5 aa, Mycobacterium
SRPIA

SEQ ID NO: 917693 - protein, 24 aa, Mycobacterium
SRPSAAGAGYDPTSSGGSNLGPES

SEQ ID NO: 917694 - protein, 8 aa, Mycobacterium
SRPSTHAR

SEQ ID NO: 917695 - protein, 11 aa, Mycobacterium
SRQAQADTISA

SEQ ID NO: 917696 - protein, 4 aa, Mycobacterium
SRQG

SEQ ID NO: 917697 - protein, 6 aa, Mycobacterium
SRQGAS

SEQ ID NO: 917698 - protein, 4 aa, Mycobacterium
SRQI

SEQ ID NO: 917699 - protein, 5 aa, Mycobacterium
SRQMN

SEQ ID NO: 917700 - protein, 4 aa, Mycobacterium
SRQQ

SEQ ID NO: 917701 - protein, 11 aa, Mycobacterium
SRQRGQISAGG

SEQ ID NO: 917702 - protein, 12 aa, Mycobacterium
SRQRGQISASGQ

SEQ ID NO: 917703 - protein, 11 aa, Mycobacterium
SRRAGARAQAG

SEQ ID NO: 917704 - protein, 5 aa, Mycobacterium
SRRAL

SEQ ID NO: 917705 - protein, 7 aa, Mycobacterium
SRRAPHR

SEQ ID NO: 917706 - protein, 8 aa, Mycobacterium
SRRGGDGL

SEQ ID NO: 917707 - protein, 8 aa, Mycobacterium
SRRGGTGL

SEQ ID NO: 917708 - protein, 9 aa, Mycobacterium
SRRKRGDNV

SEQ ID NO: 917709 - protein, 7 aa, Mycobacterium
SRRLGST

SEQ ID NO: 917710 - protein, 6 aa, Mycobacterium
SRRNPD

SEQ ID NO: 917711 - protein, 6 aa, Mycobacterium
SRRPLQ

SEQ ID NO: 917712 - protein, 6 aa, Mycobacterium
SRRPVQ

SEQ ID NO: 917713 - protein, 8 aa, Mycobacterium
SRRRNGDN

SEQ ID NO: 917714 - protein, 8 aa, Mycobacterium
SRRRRGDK

SEQ ID NO: 917715 - protein, 8 aa, Mycobacterium
SRRRRGDN

SEQ ID NO: 917716 - protein, 8 aa, Mycobacterium
SRRRRGEN

SEQ ID NO: 917717 - protein, 5 aa, Mycobacterium
SRRSE

SEQ ID NO: 917718 - protein, 13 aa, Mycobacterium
SRRSPGTASSAPA

SEQ ID NO: 917719 - protein, 5 aa, Mycobacterium
SRSAD

SEQ ID NO: 917720 - protein, 8 aa, Mycobacterium
SRSDAESA

SEQ ID NO: 917721 - protein, 14 aa, Mycobacterium
SRSDVASRFGADGV

SEQ ID NO: 917722 - protein, 9 aa, Mycobacterium
SRSEQISTG

SEQ ID NO: 917723 - protein, 23 aa, Mycobacterium
SRSGKLREGPGGTDDVQAPPGIE

SEQ ID NO: 917724 - protein, 6 aa, Mycobacterium
SRSGRR

SEQ ID NO: 917725 - protein, 29 aa, Mycobacterium
SRSGSFTYTPTKEAQHAAAAPDGRRTDSV

SEQ ID NO: 917726 - protein, 6 aa, Mycobacterium
SRSKAV

SEQ ID NO: 917727 - protein, 11 aa, Mycobacterium
SRSKPGSEPIT

SEQ ID NO: 917728 - protein, 11 aa, Mycobacterium
SRSKVAAENAD

SEQ ID NO: 917729 - protein, 4 aa, Mycobacterium
SRSL

SEQ ID NO: 917730 - protein, 13 aa, Mycobacterium
SRSTTYPSTEQTL

SEQ ID NO: 917731 - protein, 8 aa, Mycobacterium
SRTATPPF

SEQ ID NO: 917732 - protein, 13 aa, Mycobacterium
SRTDAHGNPLSAE

SEQ ID NO: 917733 - protein, 13 aa, Mycobacterium
SRTDAHGNPLSQE

SEQ ID NO: 917734 - protein, 15 aa, Mycobacterium
SRTDAHGNPLSQEEL

SEQ ID NO: 917735 - protein, 13 aa, Mycobacterium
SRTDAHGNPLTPE

SEQ ID NO: 917736 - protein, 8 aa, Mycobacterium
SRTGARYS

SEQ ID NO: 917737 - protein, 38 aa, Mycobacterium
SRTGFPTTITGSPPEGRERASDRRPPLTGAVARGRGPC

SEQ ID NO: 917738 - protein, 5 aa, Mycobacterium
SRTGP

SEQ ID NO: 917739 - protein, 10 aa, Mycobacterium
SRTGSPYSLT

SEQ ID NO: 917740 - protein, 6 aa, Mycobacterium
SRTGVH

SEQ ID NO: 917741 - protein, 13 aa, Mycobacterium
SRTLKAPSTAVRV

SEQ ID NO: 917742 - protein, 4 aa, Mycobacterium
SRTM

SEQ ID NO: 917743 - protein, 12 aa, Mycobacterium
SRTPHGYPNRVP

SEQ ID NO: 917744 - protein, 16 aa, Mycobacterium
SRTPRASAETARWSPE

SEQ ID NO: 917745 - protein, 6 aa, Mycobacterium
SRTPVR

SEQ ID NO: 917746 - protein, 7 aa, Mycobacterium
SRTQPRG

SEQ ID NO: 917747 - protein, 6 aa, Mycobacterium
SRTTAR

SEQ ID NO: 917748 - protein, 10 aa, Mycobacterium
SRTTGNGGGT

SEQ ID NO: 917749 - protein, 9 aa, Mycobacterium
SRTTPGTPT

SEQ ID NO: 917750 - protein, 16 aa, Mycobacterium
SRTTVSNAYNRPDQLS

SEQ ID NO: 917751 - protein, 6 aa, Mycobacterium
SRTYGL

SEQ ID NO: 917752 - protein, 22 aa, Mycobacterium
SRYRTAASPTGTAGTTSTADAT

SEQ ID NO: 917753 - protein, 18 aa, Mycobacterium
SRYVDGGNYVTSSGVSAG

SEQ ID NO: 917754 - protein, 15 aa, Mycobacterium
SSADFPDRDAASAMD

SEQ ID NO: 917755 - protein, 6 aa, Mycobacterium
SSADLR

SEQ ID NO: 917756 - protein, 13 aa, Mycobacterium
SSADPLGAEVRNP

SEQ ID NO: 917757 - protein, 7 aa, Mycobacterium
SSADPQN

SEQ ID NO: 917758 - protein, 9 aa, Mycobacterium
SSAEGQQSW

SEQ ID NO: 917759 - protein, 23 aa, Mycobacterium
SSAETTESESTTTTTPKVQPTPV

SEQ ID NO: 917760 - protein, 8 aa, Mycobacterium
SSAGGLPP

SEQ ID NO: 917761 - protein, 11 aa, Mycobacterium
SSAGRSATGVL

SEQ ID NO: 917762 - protein, 11 aa, Mycobacterium
SSAGRTQYGHS

SEQ ID NO: 917763 - protein, 8 aa, Mycobacterium
SSAGSLAQ

SEQ ID NO: 917764 - protein, 12 aa, Mycobacterium
SSAGSYPSTEQT

SEQ ID NO: 917765 - protein, 42 aa, Mycobacterium
SSAGTADPTNTAGETHLTGRAGVTGAAAPTGPTPSTNPTEQR

SEQ ID NO: 917766 - protein, 94 aa, Mycobacterium
SSAGTAYADTADSSSSSESSTAGSSASSSKPSAFSRPDSSPGTGGSATADDTTDDPDSDTDTSRGKSSIRDSADPADAEAGDAAADDDAVTDDA

SEQ ID NO: 917767 - protein, 7 aa, Mycobacterium
SSAGTSV

SEQ ID NO: 917768 - protein, 21 aa, Mycobacterium
SSAHFDNTGQPRFSSGQAQRV

SEQ ID NO: 917769 - protein, 6 aa, Mycobacterium
SSAKNV

SEQ ID NO: 917770 - protein, 6 aa, Mycobacterium
SSALAT

SEQ ID NO: 917771 - protein, 13 aa, Mycobacterium
SSALNQSSQRQQA

SEQ ID NO: 917772 - protein, 17 aa, Mycobacterium
SSANEAPFLRSSIALHP

SEQ ID NO: 917773 - protein, 4 aa, Mycobacterium
SSAP

SEQ ID NO: 917774 - protein, 6 aa, Mycobacterium
SSAPAY

SEQ ID NO: 917775 - protein, 25 aa, Mycobacterium
SSAPGTLRTGSRGCCSKEDASDARR

SEQ ID NO: 917776 - protein, 11 aa, Mycobacterium
SSAPSHASPEV

SEQ ID NO: 917777 - protein, 10 aa, Mycobacterium
SSAQKEASVA

SEQ ID NO: 917778 - protein, 10 aa, Mycobacterium
SSARSGSLDD

SEQ ID NO: 917779 - protein, 8 aa, Mycobacterium
SSASDLAA

SEQ ID NO: 917780 - protein, 9 aa, Mycobacterium
SSATPEAKV

SEQ ID NO: 917781 - protein, 26 aa, Mycobacterium
SSATTHSTPDSPAGTTSGSQPTSTAA

SEQ ID NO: 917782 - protein, 4 aa, Mycobacterium
SSAV

SEQ ID NO: 917783 - protein, 7 aa, Mycobacterium
SSAYPTI

SEQ ID NO: 917784 - protein, 5 aa, Mycobacterium
SSCAG

SEQ ID NO: 917785 - protein, 12 aa, Mycobacterium
SSDAADADGPVN

SEQ ID NO: 917786 - protein, 7 aa, Mycobacterium
SSDDDAA

SEQ ID NO: 917787 - protein, 7 aa, Mycobacterium
SSDDSAA

SEQ ID NO: 917788 - protein, 9 aa, Mycobacterium
SSDDSAAQT

SEQ ID NO: 917789 - protein, 11 aa, Mycobacterium
SSDGGAQTREQ

SEQ ID NO: 917790 - protein, 6 aa, Mycobacterium
SSDGRR

SEQ ID NO: 917791 - protein, 8 aa, Mycobacterium
SSDGTKDV

SEQ ID NO: 917792 - protein, 22 aa, Mycobacterium
SSDNKGDDAKSEHSGHSGMSGM

SEQ ID NO: 917793 - protein, 4 aa, Mycobacterium
SSDR

SEQ ID NO: 917794 - protein, 7 aa, Mycobacterium
SSDRDLA

SEQ ID NO: 917795 - protein, 11 aa, Mycobacterium
SSDRGQVTKDQ

SEQ ID NO: 917796 - protein, 5 aa, Mycobacterium
SSDRL

SEQ ID NO: 917797 - protein, 7 aa, Mycobacterium
SSDRRTS

SEQ ID NO: 917798 - protein, 11 aa, Mycobacterium
SSDRTTPPSHS

SEQ ID NO: 917799 - protein, 9 aa, Mycobacterium
SSDSDAADT

SEQ ID NO: 917800 - protein, 7 aa, Mycobacterium
SSDTGSV

SEQ ID NO: 917801 - protein, 47 aa, Mycobacterium
SSDTTTESSGDTVHRSADGDIVTNGGARRIDGDQTDTERSAINGGKA

SEQ ID NO: 917802 - protein, 5 aa, Mycobacterium
SSDYR

SEQ ID NO: 917803 - protein, 5 aa, Mycobacterium
SSEGA

SEQ ID NO: 917804 - protein, 14 aa, Mycobacterium
SSEGNTYLGREGAA

SEQ ID NO: 917805 - protein, 7 aa, Mycobacterium
SSEGTDM

SEQ ID NO: 917806 - protein, 14 aa, Mycobacterium
SSELATQLTQGATA

SEQ ID NO: 917807 - protein, 8 aa, Mycobacterium
SSEPGDTY

SEQ ID NO: 917808 - protein, 6 aa, Mycobacterium
SSERQL

SEQ ID NO: 917809 - protein, 29 aa, Mycobacterium
SSERRATFAPPRQRASQSRTFPERTESEA

SEQ ID NO: 917810 - protein, 6 aa, Mycobacterium
SSETAG

SEQ ID NO: 917811 - protein, 12 aa, Mycobacterium
SSETDDAENRVR

SEQ ID NO: 917812 - protein, 6 aa, Mycobacterium
SSFGPE

SEQ ID NO: 917813 - protein, 4 aa, Mycobacterium
SSFN

SEQ ID NO: 917814 - protein, 18 aa, Mycobacterium
SSGAAAPGAFDGAEDYAA

SEQ ID NO: 917815 - protein, 5 aa, Mycobacterium
SSGAI

SEQ ID NO: 917816 - protein, 6 aa, Mycobacterium
SSGAIS

SEQ ID NO: 917817 - protein, 5 aa, Mycobacterium
SSGEL

SEQ ID NO: 917818 - protein, 34 aa, Mycobacterium
SSGEQSVPAAGGNSELGATADINPQDPATLRQGG

SEQ ID NO: 917819 - protein, 32 aa, Mycobacterium
SSGGHTAGPASSTAPSVAHGGGAQVKVGGADL

SEQ ID NO: 917820 - protein, 35 aa, Mycobacterium
SSGGHTASPASSVSTGGGGTQVQVGGTDLPGLNPA

SEQ ID NO: 917821 - protein, 9 aa, Mycobacterium
SSGGPTDNG

SEQ ID NO: 917822 - protein, 7 aa, Mycobacterium
SSGGRVS

SEQ ID NO: 917823 - protein, 15 aa, Mycobacterium
SSGHNTGLGNSGFTN

SEQ ID NO: 917824 - protein, 8 aa, Mycobacterium
SSGHRSTQ

SEQ ID NO: 917825 - protein, 16 aa, Mycobacterium
SSGIGAATAKALAAEG

SEQ ID NO: 917826 - protein, 15 aa, Mycobacterium
SSGKKDSGGPLPDAT

SEQ ID NO: 917827 - protein, 13 aa, Mycobacterium
SSGKLPNTDTYCP

SEQ ID NO: 917828 - protein, 4 aa, Mycobacterium
SSGL

SEQ ID NO: 917829 - protein, 15 aa, Mycobacterium
SSGLAAPAQAAPTNL

SEQ ID NO: 917830 - protein, 5 aa, Mycobacterium
SSGLI

SEQ ID NO: 917831 - protein, 8 aa, Mycobacterium
SSGLRPED

SEQ ID NO: 917832 - protein, 7 aa, Mycobacterium
SSGLSVD

SEQ ID NO: 917833 - protein, 7 aa, Mycobacterium
SSGMPGL

SEQ ID NO: 917834 - protein, 5 aa, Mycobacterium
SSGMT

SEQ ID NO: 917835 - protein, 8 aa, Mycobacterium
SSGNGVDA

SEQ ID NO: 917836 - protein, 17 aa, Mycobacterium
SSGPDIRPALGDPTEVA

SEQ ID NO: 917837 - protein, 9 aa, Mycobacterium
SSGPGPGSL

SEQ ID NO: 917838 - protein, 4 aa, Mycobacterium
SSGR

SEQ ID NO: 917839 - protein, 30 aa, Mycobacterium
SSGRAEAAGHQHPAGIGTTEIDTITFGGPD

SEQ ID NO: 917840 - protein, 18 aa, Mycobacterium
SSGRASSDVNGETAPAGF

SEQ ID NO: 917841 - protein, 8 aa, Mycobacterium
SSGSAAAP

SEQ ID NO: 917842 - protein, 8 aa, Mycobacterium
SSGSFTTD

SEQ ID NO: 917843 - protein, 53 aa, Mycobacterium
SSGTEAPSTSTGPATPTSSSEAVTTPGAPAAPGMSPDGVTTAVEAPAESTEDD

SEQ ID NO: 917844 - protein, 6 aa, Mycobacterium
SSGVGA

SEQ ID NO: 917845 - protein, 7 aa, Mycobacterium
SSGVQAP

SEQ ID NO: 917846 - protein, 16 aa, Mycobacterium
SSHARSDGRTNQRKHR

SEQ ID NO: 917847 - protein, 13 aa, Mycobacterium
SSHAVSRSEVAGQ

SEQ ID NO: 917848 - protein, 14 aa, Mycobacterium
SSHEPKPGRPGGGA

SEQ ID NO: 917849 - protein, 4 aa, Mycobacterium
SSHI

SEQ ID NO: 917850 - protein, 17 aa, Mycobacterium
SSHQGRADQNFADAGGN

SEQ ID NO: 917851 - protein, 7 aa, Mycobacterium
SSHRPAL

SEQ ID NO: 917852 - protein, 14 aa, Mycobacterium
SSHVPARTDESEID

SEQ ID NO: 917853 - protein, 4 aa, Mycobacterium
SSIE

SEQ ID NO: 917854 - protein, 4 aa, Mycobacterium
SSIG

SEQ ID NO: 917855 - protein, 6 aa, Mycobacterium
SSIGQK

SEQ ID NO: 917856 - protein, 4 aa, Mycobacterium
SSIP

SEQ ID NO: 917857 - protein, 4 aa, Mycobacterium
SSIQ

SEQ ID NO: 917858 - protein, 4 aa, Mycobacterium
SSIT

SEQ ID NO: 917859 - protein, 21 aa, Mycobacterium
SSKASGNRAAASLADAKADAR

SEQ ID NO: 917860 - protein, 11 aa, Mycobacterium
SSKAYPSTEQA

SEQ ID NO: 917861 - protein, 10 aa, Mycobacterium
SSKRGGGSDK

SEQ ID NO: 917862 - protein, 12 aa, Mycobacterium
SSKTGTTEAHRS

SEQ ID NO: 917863 - protein, 6 aa, Mycobacterium
SSLAGG

SEQ ID NO: 917864 - protein, 8 aa, Mycobacterium
SSLDPDAH

SEQ ID NO: 917865 - protein, 15 aa, Mycobacterium
SSLGAANAAAVTPTT

SEQ ID NO: 917866 - protein, 4 aa, Mycobacterium
SSLP

SEQ ID NO: 917867 - protein, 8 aa, Mycobacterium
SSLPGDDR

SEQ ID NO: 917868 - protein, 6 aa, Mycobacterium
SSLPGF

SEQ ID NO: 917869 - protein, 6 aa, Mycobacterium
SSLPVQ

SEQ ID NO: 917870 - protein, 7 aa, Mycobacterium
SSLRANN

SEQ ID NO: 917871 - protein, 5 aa, Mycobacterium
SSLRD

SEQ ID NO: 917872 - protein, 10 aa, Mycobacterium
SSLSGRGTSL

SEQ ID NO: 917873 - protein, 7 aa, Mycobacterium
SSLTAQS

SEQ ID NO: 917874 - protein, 8 aa, Mycobacterium
SSLTAQSD

SEQ ID NO: 917875 - protein, 6 aa, Mycobacterium
SSLTRQ

SEQ ID NO: 917876 - protein, 6 aa, Mycobacterium
SSLTST

SEQ ID NO: 917877 - protein, 26 aa, Mycobacterium
SSMDAQNAAAAAPTTSIAPAAADEVS

SEQ ID NO: 917878 - protein, 14 aa, Mycobacterium
SSMPASGQTLIAPV

SEQ ID NO: 917879 - protein, 6 aa, Mycobacterium
SSMPST

SEQ ID NO: 917880 - protein, 15 aa, Mycobacterium
SSMSAQNAAAAAPTT

SEQ ID NO: 917881 - protein, 12 aa, Mycobacterium
SSMSPSAASSPT

SEQ ID NO: 917882 - protein, 5 aa, Mycobacterium
SSMSS

SEQ ID NO: 917883 - protein, 7 aa, Mycobacterium
SSNADAV

SEQ ID NO: 917884 - protein, 7 aa, Mycobacterium
SSNADEI

SEQ ID NO: 917885 - protein, 6 aa, Mycobacterium
SSNGEW

SEQ ID NO: 917886 - protein, 8 aa, Mycobacterium
SSNGNHSY

SEQ ID NO: 917887 - protein, 8 aa, Mycobacterium
SSNGTLRP

SEQ ID NO: 917888 - protein, 20 aa, Mycobacterium
SSNKSGTSPSGSSSPAGAAG

SEQ ID NO: 917889 - protein, 5 aa, Mycobacterium
SSNMP

SEQ ID NO: 917890 - protein, 8 aa, Mycobacterium
SSNPPVPG

SEQ ID NO: 917891 - protein, 7 aa, Mycobacterium
SSNQDTL

SEQ ID NO: 917892 - protein, 4 aa, Mycobacterium
SSNT

SEQ ID NO: 917893 - protein, 5 aa, Mycobacterium
SSNTV

SEQ ID NO: 917894 - protein, 7 aa, Mycobacterium
SSPAARS

SEQ ID NO: 917895 - protein, 7 aa, Mycobacterium
SSPAVQN

SEQ ID NO: 917896 - protein, 6 aa, Mycobacterium
SSPEHS

SEQ ID NO: 917897 - protein, 6 aa, Mycobacterium
SSPFTE

SEQ ID NO: 917898 - protein, 9 aa, Mycobacterium
SSPGLGDDR

SEQ ID NO: 917899 - protein, 8 aa, Mycobacterium
SSPKDKRV

SEQ ID NO: 917900 - protein, 14 aa, Mycobacterium
SSPLSSDADPVPIG

SEQ ID NO: 917901 - protein, 6 aa, Mycobacterium
SSPMYN

SEQ ID NO: 917902 - protein, 13 aa, Mycobacterium
SSPPLGDVQAGPA

SEQ ID NO: 917903 - protein, 14 aa, Mycobacterium
SSPPLNAAQAGPSV

SEQ ID NO: 917904 - protein, 14 aa, Mycobacterium
SSPPLNDAQAGPAV

SEQ ID NO: 917905 - protein, 11 aa, Mycobacterium
SSPQAADREGH

SEQ ID NO: 917906 - protein, 9 aa, Mycobacterium
SSPQAAVQE

SEQ ID NO: 917907 - protein, 50 aa, Mycobacterium
SSPQHASSQSGTTPPVKSAPPASSGETTTPAPSGESLSAQLKTPDGRSVA

SEQ ID NO: 917908 - protein, 16 aa, Mycobacterium
SSPQHASTTPGTTPSI

SEQ ID NO: 917909 - protein, 5 aa, Mycobacterium
SSPRA

SEQ ID NO: 917910 - protein, 7 aa, Mycobacterium
SSPSVDA

SEQ ID NO: 917911 - protein, 18 aa, Mycobacterium
SSPTAVADTTSTSEGLPT

SEQ ID NO: 917912 - protein, 23 aa, Mycobacterium
SSPVDGLDHPDSPLSDDQSKAQV

SEQ ID NO: 917913 - protein, 9 aa, Mycobacterium
SSQAGGRSV

SEQ ID NO: 917914 - protein, 7 aa, Mycobacterium
SSQPDRL

SEQ ID NO: 917915 - protein, 34 aa, Mycobacterium
SSQTAPTAPETSGAAAPPTSAAPVAPPAPATAQP

SEQ ID NO: 917916 - protein, 23 aa, Mycobacterium
SSQVPPSRLREEHKATTREEHVR

SEQ ID NO: 917917 - protein, 10 aa, Mycobacterium
SSRATAFATQ

SEQ ID NO: 917918 - protein, 21 aa, Mycobacterium
SSRATGRRTAESLADAKADAR

SEQ ID NO: 917919 - protein, 10 aa, Mycobacterium
SSRFEAENPD

SEQ ID NO: 917920 - protein, 7 aa, Mycobacterium
SSRGPEY

SEQ ID NO: 917921 - protein, 8 aa, Mycobacterium
SSRGRTRY

SEQ ID NO: 917922 - protein, 12 aa, Mycobacterium
SSRPAAASVPDA

SEQ ID NO: 917923 - protein, 8 aa, Mycobacterium
SSRPSRTV

SEQ ID NO: 917924 - protein, 22 aa, Mycobacterium
SSRPSSDGDGDGGSPDAQVTTV

SEQ ID NO: 917925 - protein, 6 aa, Mycobacterium
SSRQEI

SEQ ID NO: 917926 - protein, 5 aa, Mycobacterium
SSRQF

SEQ ID NO: 917927 - protein, 6 aa, Mycobacterium
SSRQKV

SEQ ID NO: 917928 - protein, 6 aa, Mycobacterium
SSRRNR

SEQ ID NO: 917929 - protein, 8 aa, Mycobacterium
SSRTADEK

SEQ ID NO: 917930 - protein, 9 aa, Mycobacterium
SSSAPDTDF

SEQ ID NO: 917931 - protein, 10 aa, Mycobacterium
SSSAQGGQAR

SEQ ID NO: 917932 - protein, 11 aa, Mycobacterium
SSSESLGDPEW

SEQ ID NO: 917933 - protein, 9 aa, Mycobacterium
SSSGLERAE

SEQ ID NO: 917934 - protein, 9 aa, Mycobacterium
SSSNPGFTV

SEQ ID NO: 917935 - protein, 9 aa, Mycobacterium
SSSPDPADR

SEQ ID NO: 917936 - protein, 6 aa, Mycobacterium
SSSPIY

SEQ ID NO: 917937 - protein, 6 aa, Mycobacterium
SSSPYP

SEQ ID NO: 917938 - protein, 6 aa, Mycobacterium
SSSRDE

SEQ ID NO: 917939 - protein, 10 aa, Mycobacterium
SSSSATSSSR

SEQ ID NO: 917940 - protein, 6 aa, Mycobacterium
SSSSGL

SEQ ID NO: 917941 - protein, 10 aa, Mycobacterium
SSSSTHSGTP

SEQ ID NO: 917942 - protein, 6 aa, Mycobacterium
SSSTGA

SEQ ID NO: 917943 - protein, 9 aa, Mycobacterium
SSSTHSGTP

SEQ ID NO: 917944 - protein, 20 aa, Mycobacterium
SSSTQTGGGASTAPARTNPL

SEQ ID NO: 917945 - protein, 32 aa, Mycobacterium
SSSVNNNADPSDTAAPATNVEVDDGGCTENHD

SEQ ID NO: 917946 - protein, 7 aa, Mycobacterium
SSTAGAA

SEQ ID NO: 917947 - protein, 7 aa, Mycobacterium
SSTAGID

SEQ ID NO: 917948 - protein, 40 aa, Mycobacterium
SSTANPPAGSSTTTTKSSPTTSAGAAPTTGSSGASTTASL

SEQ ID NO: 917949 - protein, 8 aa, Mycobacterium
SSTAVPGG

SEQ ID NO: 917950 - protein, 12 aa, Mycobacterium
SSTGASAPLGSH

SEQ ID NO: 917951 - protein, 22 aa, Mycobacterium
SSTGGAPRESGEGGGGGTVDTP

SEQ ID NO: 917952 - protein, 9 aa, Mycobacterium
SSTGLERAE

SEQ ID NO: 917953 - protein, 10 aa, Mycobacterium
SSTGLERAED

SEQ ID NO: 917954 - protein, 7 aa, Mycobacterium
SSTGMMT

SEQ ID NO: 917955 - protein, 7 aa, Mycobacterium
SSTGSSV

SEQ ID NO: 917956 - protein, 5 aa, Mycobacterium
SSTGT

SEQ ID NO: 917957 - protein, 18 aa, Mycobacterium
SSTNPAAAPYGAQGARLG

SEQ ID NO: 917958 - protein, 7 aa, Mycobacterium
SSTNYNG

SEQ ID NO: 917959 - protein, 9 aa, Mycobacterium
SSTPPPGAR

SEQ ID NO: 917960 - protein, 9 aa, Mycobacterium
SSTQSAVRQ

SEQ ID NO: 917961 - protein, 9 aa, Mycobacterium
SSTTGQVSR

SEQ ID NO: 917962 - protein, 8 aa, Mycobacterium
SSTTKAAD

SEQ ID NO: 917963 - protein, 10 aa, Mycobacterium
SSTTPLAGAG

SEQ ID NO: 917964 - protein, 7 aa, Mycobacterium
SSTTTNG

SEQ ID NO: 917965 - protein, 7 aa, Mycobacterium
SSVDNDG

SEQ ID NO: 917966 - protein, 21 aa, Mycobacterium
SSVEPDGETTAPSSAVPSVGH

SEQ ID NO: 917967 - protein, 4 aa, Mycobacterium
SSVG

SEQ ID NO: 917968 - protein, 13 aa, Mycobacterium
SSVNDPKLTGGDR

SEQ ID NO: 917969 - protein, 5 aa, Mycobacterium
SSVPA

SEQ ID NO: 917970 - protein, 7 aa, Mycobacterium
SSVPPGT

SEQ ID NO: 917971 - protein, 20 aa, Mycobacterium
SSVPQKPSATTEPSPLPAQT

SEQ ID NO: 917972 - protein, 8 aa, Mycobacterium
SSVTGSAQ

SEQ ID NO: 917973 - protein, 7 aa, Mycobacterium
SSYDRSP

SEQ ID NO: 917974 - protein, 4 aa, Mycobacterium
SSYI

SEQ ID NO: 917975 - protein, 9 aa, Mycobacterium
SSYPQLNSS

SEQ ID NO: 917976 - protein, 4 aa, Mycobacterium
STAA

SEQ ID NO: 917977 - protein, 15 aa, Mycobacterium
STAAAGVASAAPDYG

SEQ ID NO: 917978 - protein, 22 aa, Mycobacterium
STACPGKSINYNPTGSGKGRDN

SEQ ID NO: 917979 - protein, 10 aa, Mycobacterium
STADDTTKTV

SEQ ID NO: 917980 - protein, 11 aa, Mycobacterium
STAELRSATPL

SEQ ID NO: 917981 - protein, 29 aa, Mycobacterium
STAGAVATNPNVPPPSPILTAGSDKPECI

SEQ ID NO: 917982 - protein, 7 aa, Mycobacterium
STAGDVG

SEQ ID NO: 917983 - protein, 20 aa, Mycobacterium
STAGEDRPAATPPTSDAVTG

SEQ ID NO: 917984 - protein, 7 aa, Mycobacterium
STAGGAL

SEQ ID NO: 917985 - protein, 6 aa, Mycobacterium
STAGGI

SEQ ID NO: 917986 - protein, 8 aa, Mycobacterium
STAGNSIS

SEQ ID NO: 917987 - protein, 5 aa, Mycobacterium
STAGP

SEQ ID NO: 917988 - protein, 7 aa, Mycobacterium
STAGYSG

SEQ ID NO: 917989 - protein, 6 aa, Mycobacterium
STAHAS

SEQ ID NO: 917990 - protein, 4 aa, Mycobacterium
STAK

SEQ ID NO: 917991 - protein, 16 aa, Mycobacterium
STAKAWGGSDVSADLS

SEQ ID NO: 917992 - protein, 10 aa, Mycobacterium
STANPALPAD

SEQ ID NO: 917993 - protein, 4 aa, Mycobacterium
STAP

SEQ ID NO: 917994 - protein, 15 aa, Mycobacterium
STAPAAHADNKRLND

SEQ ID NO: 917995 - protein, 5 aa, Mycobacterium
STAPM

SEQ ID NO: 917996 - protein, 6 aa, Mycobacterium
STAPPI

SEQ ID NO: 917997 - protein, 6 aa, Mycobacterium
STAPVS

SEQ ID NO: 917998 - protein, 9 aa, Mycobacterium
STAQPMETT

SEQ ID NO: 917999 - protein, 7 aa, Mycobacterium
STARQYR

SEQ ID NO: 918000 - protein, 13 aa, Mycobacterium
STARSDLRKGLRG

SEQ ID NO: 918001 - protein, 7 aa, Mycobacterium
STASRRT

SEQ ID NO: 918002 - protein, 7 aa, Mycobacterium
STATASS

SEQ ID NO: 918003 - protein, 6 aa, Mycobacterium
STATDV

SEQ ID NO: 918004 - protein, 12 aa, Mycobacterium
STDDEARRREAE

SEQ ID NO: 918005 - protein, 10 aa, Mycobacterium
STDDRDTLRP

SEQ ID NO: 918006 - protein, 8 aa, Mycobacterium
STDFSSSD

SEQ ID NO: 918007 - protein, 18 aa, Mycobacterium
STDGGDRTANITLAEGPP

SEQ ID NO: 918008 - protein, 8 aa, Mycobacterium
STDGLTGT

SEQ ID NO: 918009 - protein, 16 aa, Mycobacterium
STDGNSFLGRSGSAIP

SEQ ID NO: 918010 - protein, 5 aa, Mycobacterium
STDGR

SEQ ID NO: 918011 - protein, 34 aa, Mycobacterium
STDGSSTSAGTSSSSVPQSTTPAKPVRTPATDEA

SEQ ID NO: 918012 - protein, 4 aa, Mycobacterium
STDL

SEQ ID NO: 918013 - protein, 13 aa, Mycobacterium
STDLTARAREGKL

SEQ ID NO: 918014 - protein, 29 aa, Mycobacterium
STDNNGKPVAATGTYIEPDNPWPGDGPRP

SEQ ID NO: 918015 - protein, 8 aa, Mycobacterium
STDPAEAD

SEQ ID NO: 918016 - protein, 9 aa, Mycobacterium
STDPANPME

SEQ ID NO: 918017 - protein, 8 aa, Mycobacterium
STDPSRAD

SEQ ID NO: 918018 - protein, 11 aa, Mycobacterium
STDQLPYQPKG

SEQ ID NO: 918019 - protein, 30 aa, Mycobacterium
STDSSSQQADTSTSSPSETAAAVTPAEARA

SEQ ID NO: 918020 - protein, 14 aa, Mycobacterium
STDTGRTVAAQAGK

SEQ ID NO: 918021 - protein, 5 aa, Mycobacterium
STDVD

SEQ ID NO: 918022 - protein, 6 aa, Mycobacterium
STDVPG

SEQ ID NO: 918023 - protein, 7 aa, Mycobacterium
STDWNPS

SEQ ID NO: 918024 - protein, 4 aa, Mycobacterium
STEG

SEQ ID NO: 918025 - protein, 13 aa, Mycobacterium
STEKMYGDRRVTL

SEQ ID NO: 918026 - protein, 10 aa, Mycobacterium
STENTRTPVT

SEQ ID NO: 918027 - protein, 6 aa, Mycobacterium
STEPLT

SEQ ID NO: 918028 - protein, 9 aa, Mycobacterium
STFSTSDPA

SEQ ID NO: 918029 - protein, 6 aa, Mycobacterium
STGADV

SEQ ID NO: 918030 - protein, 8 aa, Mycobacterium
STGAGRGG

SEQ ID NO: 918031 - protein, 8 aa, Mycobacterium
STGAGSGR

SEQ ID NO: 918032 - protein, 15 aa, Mycobacterium
STGAPETGEVPINQD

SEQ ID NO: 918033 - protein, 11 aa, Mycobacterium
STGAVTGEPDV

SEQ ID NO: 918034 - protein, 4 aa, Mycobacterium
STGD

SEQ ID NO: 918035 - protein, 7 aa, Mycobacterium
STGDAEQ

SEQ ID NO: 918036 - protein, 7 aa, Mycobacterium
STGDATA

SEQ ID NO: 918037 - protein, 11 aa, Mycobacterium
STGDDAVARGG

SEQ ID NO: 918038 - protein, 8 aa, Mycobacterium
STGDEPTL

SEQ ID NO: 918039 - protein, 6 aa, Mycobacterium
STGDGL

SEQ ID NO: 918040 - protein, 15 aa, Mycobacterium
STGDSVSTYGEPWNM

SEQ ID NO: 918041 - protein, 13 aa, Mycobacterium
STGDVVNVNSGAV

SEQ ID NO: 918042 - protein, 4 aa, Mycobacterium
STGE

SEQ ID NO: 918043 - protein, 6 aa, Mycobacterium
STGEGL

SEQ ID NO: 918044 - protein, 15 aa, Mycobacterium
STGERVDLGDEASGN

SEQ ID NO: 918045 - protein, 4 aa, Mycobacterium
STGG

SEQ ID NO: 918046 - protein, 16 aa, Mycobacterium
STGGAAGSGSTGSSAM

SEQ ID NO: 918047 - protein, 17 aa, Mycobacterium
STGGASGSGSTGSSSMD

SEQ ID NO: 918048 - protein, 8 aa, Mycobacterium
STGGSNAK

SEQ ID NO: 918049 - protein, 5 aa, Mycobacterium
STGGY

SEQ ID NO: 918050 - protein, 7 aa, Mycobacterium
STGHQQP

SEQ ID NO: 918051 - protein, 28 aa, Mycobacterium
STGHSGHEDHGHEGHDHEGHDHADEGNP

SEQ ID NO: 918052 - protein, 9 aa, Mycobacterium
STGKASHAS

SEQ ID NO: 918053 - protein, 15 aa, Mycobacterium
STGLERAEDPLLNGS

SEQ ID NO: 918054 - protein, 13 aa, Mycobacterium
STGLPSVSAGAAQ

SEQ ID NO: 918055 - protein, 33 aa, Mycobacterium
STGNPGKVFSPGQTITKGTVPSEIGPALDTANR

SEQ ID NO: 918056 - protein, 10 aa, Mycobacterium
STGPGTGDTS

SEQ ID NO: 918057 - protein, 10 aa, Mycobacterium
STGQPPADAD

SEQ ID NO: 918058 - protein, 9 aa, Mycobacterium
STGQPPARA

SEQ ID NO: 918059 - protein, 7 aa, Mycobacterium
STGRPTY

SEQ ID NO: 918060 - protein, 10 aa, Mycobacterium
STGSIDTAGE

SEQ ID NO: 918061 - protein, 7 aa, Mycobacterium
STGTDKL

SEQ ID NO: 918062 - protein, 5 aa, Mycobacterium
STGTI

SEQ ID NO: 918063 - protein, 10 aa, Mycobacterium
STGTLQDYGP

SEQ ID NO: 918064 - protein, 10 aa, Mycobacterium
STGTSHAGLD

SEQ ID NO: 918065 - protein, 12 aa, Mycobacterium
STGVGQAPASIH

SEQ ID NO: 918066 - protein, 12 aa, Mycobacterium
STGVPAPVVAAA

SEQ ID NO: 918067 - protein, 16 aa, Mycobacterium
STHAGQPGANALTPEQ

SEQ ID NO: 918068 - protein, 4 aa, Mycobacterium
STHL

SEQ ID NO: 918069 - protein, 6 aa, Mycobacterium
STIEGG

SEQ ID NO: 918070 - protein, 7 aa, Mycobacterium
STIGPIA

SEQ ID NO: 918071 - protein, 19 aa, Mycobacterium
STIPAPDPARHGPLPGPGG

SEQ ID NO: 918072 - protein, 4 aa, Mycobacterium
STIT

SEQ ID NO: 918073 - protein, 8 aa, Mycobacterium
STKPGQTV

SEQ ID NO: 918074 - protein, 9 aa, Mycobacterium
STKRCPDAV

SEQ ID NO: 918075 - protein, 10 aa, Mycobacterium
STLPEERSRE

SEQ ID NO: 918076 - protein, 8 aa, Mycobacterium
STLPQNSP

SEQ ID NO: 918077 - protein, 5 aa, Mycobacterium
STLPS

SEQ ID NO: 918078 - protein, 8 aa, Mycobacterium
STLPTPAL

SEQ ID NO: 918079 - protein, 6 aa, Mycobacterium
STLSDH

SEQ ID NO: 918080 - protein, 12 aa, Mycobacterium
STLSERERDELD

SEQ ID NO: 918081 - protein, 8 aa, Mycobacterium
STMPPSDG

SEQ ID NO: 918082 - protein, 8 aa, Mycobacterium
STMTDSKG

SEQ ID NO: 918083 - protein, 5 aa, Mycobacterium
STNAQ

SEQ ID NO: 918084 - protein, 9 aa, Mycobacterium
STNAQGSSS

SEQ ID NO: 918085 - protein, 6 aa, Mycobacterium
STNAQL

SEQ ID NO: 918086 - protein, 9 aa, Mycobacterium
STNEQISAA

SEQ ID NO: 918087 - protein, 9 aa, Mycobacterium
STNGSTVQG

SEQ ID NO: 918088 - protein, 5 aa, Mycobacterium
STNLA

SEQ ID NO: 918089 - protein, 6 aa, Mycobacterium
STNLAG

SEQ ID NO: 918090 - protein, 11 aa, Mycobacterium
STNLGSAFSST

SEQ ID NO: 918091 - protein, 9 aa, Mycobacterium
STNPEAEND

SEQ ID NO: 918092 - protein, 10 aa, Mycobacterium
STNRGSENLE

SEQ ID NO: 918093 - protein, 7 aa, Mycobacterium
STNRQPL

SEQ ID NO: 918094 - protein, 8 aa, Mycobacterium
STNSNSGF

SEQ ID NO: 918095 - protein, 8 aa, Mycobacterium
STNSYSAE

SEQ ID NO: 918096 - protein, 14 aa, Mycobacterium
STNYGSAIPPRGTE

SEQ ID NO: 918097 - protein, 6 aa, Mycobacterium
STNYTT

SEQ ID NO: 918098 - protein, 9 aa, Mycobacterium
STPAHGSTG

SEQ ID NO: 918099 - protein, 20 aa, Mycobacterium
STPALSPDTADEDGPAMGSD

SEQ ID NO: 918100 - protein, 8 aa, Mycobacterium
STPAPGTA

SEQ ID NO: 918101 - protein, 8 aa, Mycobacterium
STPDANKD

SEQ ID NO: 918102 - protein, 5 aa, Mycobacterium
STPDH

SEQ ID NO: 918103 - protein, 12 aa, Mycobacterium
STPEGAPATPNA

SEQ ID NO: 918104 - protein, 13 aa, Mycobacterium
STPEGKTAVGISQ

SEQ ID NO: 918105 - protein, 5 aa, Mycobacterium
STPEK

SEQ ID NO: 918106 - protein, 8 aa, Mycobacterium
STPEPPDY

SEQ ID NO: 918107 - protein, 10 aa, Mycobacterium
STPERITPAD

SEQ ID NO: 918108 - protein, 10 aa, Mycobacterium
STPGFRAAPA

SEQ ID NO: 918109 - protein, 11 aa, Mycobacterium
STPGNGEPNSY

SEQ ID NO: 918110 - protein, 6 aa, Mycobacterium
STPGVG

SEQ ID NO: 918111 - protein, 7 aa, Mycobacterium
STPIPGL

SEQ ID NO: 918112 - protein, 8 aa, Mycobacterium
STPNMPEY

SEQ ID NO: 918113 - protein, 4 aa, Mycobacterium
STPP

SEQ ID NO: 918114 - protein, 30 aa, Mycobacterium
STPPAETKTVTKTVAPPPPPGPKTSIEANG

SEQ ID NO: 918115 - protein, 18 aa, Mycobacterium
STPPAGSYTNEDENNGKI

SEQ ID NO: 918116 - protein, 7 aa, Mycobacterium
STPPPWN

SEQ ID NO: 918117 - protein, 4 aa, Mycobacterium
STPQ

SEQ ID NO: 918118 - protein, 15 aa, Mycobacterium
STPQYASSVPGTTPA

SEQ ID NO: 918119 - protein, 4 aa, Mycobacterium
STPR

SEQ ID NO: 918120 - protein, 9 aa, Mycobacterium
STPRAEKTG

SEQ ID NO: 918121 - protein, 5 aa, Mycobacterium
STPSM

SEQ ID NO: 918122 - protein, 6 aa, Mycobacterium
STPTDN

SEQ ID NO: 918123 - protein, 9 aa, Mycobacterium
STQIAGGAQ

SEQ ID NO: 918124 - protein, 47 aa, Mycobacterium
STQVPSTGETTPVSSAPAGPPPSTGPGTTTATPTSAPPPSRPADPNA

SEQ ID NO: 918125 - protein, 45 aa, Mycobacterium
STQVPTSAGPSTTAPASGGPTTTGPNPSATTPTSAPPSRPADPNA

SEQ ID NO: 918126 - protein, 7 aa, Mycobacterium
STQYPGG

SEQ ID NO: 918127 - protein, 4 aa, Mycobacterium
STRA

SEQ ID NO: 918128 - protein, 4 aa, Mycobacterium
STRD

SEQ ID NO: 918129 - protein, 18 aa, Mycobacterium
STRFRSGDTFHNGQQAAL

SEQ ID NO: 918130 - protein, 16 aa, Mycobacterium
STRGFNDPSPAYQQKG

SEQ ID NO: 918131 - protein, 6 aa, Mycobacterium
STRGSF

SEQ ID NO: 918132 - protein, 6 aa, Mycobacterium
STRPTV

SEQ ID NO: 918133 - protein, 5 aa, Mycobacterium
STRQF

SEQ ID NO: 918134 - protein, 9 aa, Mycobacterium
STSAQVTAD

SEQ ID NO: 918135 - protein, 7 aa, Mycobacterium
STSASLT

SEQ ID NO: 918136 - protein, 14 aa, Mycobacterium
STSATSSAWSRHGQ

SEQ ID NO: 918137 - protein, 21 aa, Mycobacterium
STSEPLNPSSPGDVPIGAPVP

SEQ ID NO: 918138 - protein, 4 aa, Mycobacterium
STSF

SEQ ID NO: 918139 - protein, 5 aa, Mycobacterium
STSGD

SEQ ID NO: 918140 - protein, 29 aa, Mycobacterium
STSGGYAKGGEPDGAENWYPSNNTPVNKA

SEQ ID NO: 918141 - protein, 11 aa, Mycobacterium
STSGLNPYVNP

SEQ ID NO: 918142 - protein, 6 aa, Mycobacterium
STSKTN

SEQ ID NO: 918143 - protein, 5 aa, Mycobacterium
STSLP

SEQ ID NO: 918144 - protein, 14 aa, Mycobacterium
STSLRGDGRGGGPV

SEQ ID NO: 918145 - protein, 7 aa, Mycobacterium
STSNAEE

SEQ ID NO: 918146 - protein, 5 aa, Mycobacterium
STSNG

SEQ ID NO: 918147 - protein, 9 aa, Mycobacterium
STSNGVTIA

SEQ ID NO: 918148 - protein, 7 aa, Mycobacterium
STSPIAG

SEQ ID NO: 918149 - protein, 8 aa, Mycobacterium
STSRHKAE

SEQ ID NO: 918150 - protein, 10 aa, Mycobacterium
STSRPGSNFG

SEQ ID NO: 918151 - protein, 19 aa, Mycobacterium
STSRPGSSFGAKPITRPYA

SEQ ID NO: 918152 - protein, 6 aa, Mycobacterium
STSSDG

SEQ ID NO: 918153 - protein, 6 aa, Mycobacterium
STSSVD

SEQ ID NO: 918154 - protein, 7 aa, Mycobacterium
STSSVTS

SEQ ID NO: 918155 - protein, 15 aa, Mycobacterium
STSTLNPYTNPDGAL

SEQ ID NO: 918156 - protein, 16 aa, Mycobacterium
STSTLNPYTNPDGALA

SEQ ID NO: 918157 - protein, 6 aa, Mycobacterium
STSVPK

SEQ ID NO: 918158 - protein, 7 aa, Mycobacterium
STTAASV

SEQ ID NO: 918159 - protein, 38 aa, Mycobacterium
STTAGATPAGATGTAGPTRSAGPTGTAQPTGTAGSAGV

SEQ ID NO: 918160 - protein, 9 aa, Mycobacterium
STTAPLSST

SEQ ID NO: 918161 - protein, 12 aa, Mycobacterium
STTARTPAQDYD

SEQ ID NO: 918162 - protein, 8 aa, Mycobacterium
STTDPLDY

SEQ ID NO: 918163 - protein, 10 aa, Mycobacterium
STTETKPTEH

SEQ ID NO: 918164 - protein, 25 aa, Mycobacterium
STTGSLAISDGKPVTEEDPHNWDQG

SEQ ID NO: 918165 - protein, 7 aa, Mycobacterium
STTGYGD

SEQ ID NO: 918166 - protein, 12 aa, Mycobacterium
STTHGGRGAPNA

SEQ ID NO: 918167 - protein, 8 aa, Mycobacterium
STTKRPAD

SEQ ID NO: 918168 - protein, 10 aa, Mycobacterium
STTPQQITRA

SEQ ID NO: 918169 - protein, 8 aa, Mycobacterium
STTRHKAE

SEQ ID NO: 918170 - protein, 7 aa, Mycobacterium
STTRHRA

SEQ ID NO: 918171 - protein, 6 aa, Mycobacterium
STTSNA

SEQ ID NO: 918172 - protein, 4 aa, Mycobacterium
STTV

SEQ ID NO: 918173 - protein, 21 aa, Mycobacterium
STTVGQDSCAPLDPNGPTVAL

SEQ ID NO: 918174 - protein, 12 aa, Mycobacterium
STTYTDKVPGGR

SEQ ID NO: 918175 - protein, 12 aa, Mycobacterium
STVAATTRLPPV

SEQ ID NO: 918176 - protein, 6 aa, Mycobacterium
STVDDK

SEQ ID NO: 918177 - protein, 9 aa, Mycobacterium
STVGPMSDD

SEQ ID NO: 918178 - protein, 11 aa, Mycobacterium
STVPDGARADV

SEQ ID NO: 918179 - protein, 19 aa, Mycobacterium
STVSPSAYPLRRRHDERQP

SEQ ID NO: 918180 - protein, 11 aa, Mycobacterium
STVSSDGTVTP

SEQ ID NO: 918181 - protein, 6 aa, Mycobacterium
STVTAR

SEQ ID NO: 918182 - protein, 10 aa, Mycobacterium
STWPPAGAEA

SEQ ID NO: 918183 - protein, 5 aa, Mycobacterium
STYDP

SEQ ID NO: 918184 - protein, 6 aa, Mycobacterium
STYGVP

SEQ ID NO: 918185 - protein, 16 aa, Mycobacterium
STYGVPVNSPNGYRTE

SEQ ID NO: 918186 - protein, 4 aa, Mycobacterium
STYK

SEQ ID NO: 918187 - protein, 6 aa, Mycobacterium
STYTGV

SEQ ID NO: 918188 - protein, 10 aa, Mycobacterium
SVADSAPLAP

SEQ ID NO: 918189 - protein, 17 aa, Mycobacterium
SVAPAAVQPAAAASAEL

SEQ ID NO: 918190 - protein, 10 aa, Mycobacterium
SVAPPEGPAE

SEQ ID NO: 918191 - protein, 8 aa, Mycobacterium
SVASADSM

SEQ ID NO: 918192 - protein, 6 aa, Mycobacterium
SVATDS

SEQ ID NO: 918193 - protein, 4 aa, Mycobacterium
SVDD

SEQ ID NO: 918194 - protein, 20 aa, Mycobacterium
SVDGESPKATGTYDKDTKKF

SEQ ID NO: 918195 - protein, 6 aa, Mycobacterium
SVDGKD

SEQ ID NO: 918196 - protein, 4 aa, Mycobacterium
SVDN

SEQ ID NO: 918197 - protein, 4 aa, Mycobacterium
SVDR

SEQ ID NO: 918198 - protein, 13 aa, Mycobacterium
SVDSSGRTEYSHS

SEQ ID NO: 918199 - protein, 10 aa, Mycobacterium
SVDTDEKPPR

SEQ ID NO: 918200 - protein, 10 aa, Mycobacterium
SVEGAAGSAP

SEQ ID NO: 918201 - protein, 22 aa, Mycobacterium
SVEGAQAAAADGFDASTELTET

SEQ ID NO: 918202 - protein, 20 aa, Mycobacterium
SVEGAQGAVADGFDATTDLT

SEQ ID NO: 918203 - protein, 6 aa, Mycobacterium
SVEGGD

SEQ ID NO: 918204 - protein, 7 aa, Mycobacterium
SVEGGKT

SEQ ID NO: 918205 - protein, 6 aa, Mycobacterium
SVEGKD

SEQ ID NO: 918206 - protein, 15 aa, Mycobacterium
SVEGNQGIDPDEAAQ

SEQ ID NO: 918207 - protein, 7 aa, Mycobacterium
SVEKCPS

SEQ ID NO: 918208 - protein, 26 aa, Mycobacterium
SVEKQSPVTDVGAGRDAQNYPTTVPV

SEQ ID NO: 918209 - protein, 11 aa, Mycobacterium
SVEPEPEPERK

SEQ ID NO: 918210 - protein, 13 aa, Mycobacterium
SVEPVDPPPGFGY

SEQ ID NO: 918211 - protein, 7 aa, Mycobacterium
SVETCPN

SEQ ID NO: 918212 - protein, 7 aa, Mycobacterium
SVETGKR

SEQ ID NO: 918213 - protein, 4 aa, Mycobacterium
SVGA

SEQ ID NO: 918214 - protein, 6 aa, Mycobacterium
SVGAES

SEQ ID NO: 918215 - protein, 5 aa, Mycobacterium
SVGDD

SEQ ID NO: 918216 - protein, 8 aa, Mycobacterium
SVGDGTVR

SEQ ID NO: 918217 - protein, 7 aa, Mycobacterium
SVGDLDK

SEQ ID NO: 918218 - protein, 9 aa, Mycobacterium
SVGGPDKTD

SEQ ID NO: 918219 - protein, 17 aa, Mycobacterium
SVGGQNPHQPDTGSGQA

SEQ ID NO: 918220 - protein, 9 aa, Mycobacterium
SVGKDYETF

SEQ ID NO: 918221 - protein, 8 aa, Mycobacterium
SVGPKLTG

SEQ ID NO: 918222 - protein, 6 aa, Mycobacterium
SVGPTI

SEQ ID NO: 918223 - protein, 9 aa, Mycobacterium
SVGSQGYAN

SEQ ID NO: 918224 - protein, 10 aa, Mycobacterium
SVGSQGYSNV

SEQ ID NO: 918225 - protein, 5 aa, Mycobacterium
SVGSV

SEQ ID NO: 918226 - protein, 4 aa, Mycobacterium
SVHQ

SEQ ID NO: 918227 - protein, 70 aa, Mycobacterium
SVKARKAQSSGKSSDSDDSDDSDDSDDSDDSDEKDDKPAKKVPAKKSAAKKAPAKKAAKKAPAKKAAAKK

SEQ ID NO: 918228 - protein, 59 aa, Mycobacterium
SVKARKGGKSDSKDDSDSESDSKESKSDSKPAKKAPAKKAAAKKSTAKKAPAKKAAAKK

SEQ ID NO: 918229 - protein, 11 aa, Mycobacterium
SVKKGDKDFSA

SEQ ID NO: 918230 - protein, 4 aa, Mycobacterium
SVND

SEQ ID NO: 918231 - protein, 7 aa, Mycobacterium
SVNPADG

SEQ ID NO: 918232 - protein, 6 aa, Mycobacterium
SVNQPN

SEQ ID NO: 918233 - protein, 10 aa, Mycobacterium
SVPAPSAAPT

SEQ ID NO: 918234 - protein, 12 aa, Mycobacterium
SVPAQPDGPTNL

SEQ ID NO: 918235 - protein, 4 aa, Mycobacterium
SVPE

SEQ ID NO: 918236 - protein, 15 aa, Mycobacterium
SVPEGPGINDNGSGV

SEQ ID NO: 918237 - protein, 17 aa, Mycobacterium
SVPEGPGINDNGTGTAA

SEQ ID NO: 918238 - protein, 13 aa, Mycobacterium
SVPGGDSAQPLRS

SEQ ID NO: 918239 - protein, 8 aa, Mycobacterium
SVPGGPGR

SEQ ID NO: 918240 - protein, 6 aa, Mycobacterium
SVPGRS

SEQ ID NO: 918241 - protein, 11 aa, Mycobacterium
SVPGSGGIRGP

SEQ ID NO: 918242 - protein, 12 aa, Mycobacterium
SVPKSEPPEGGW

SEQ ID NO: 918243 - protein, 6 aa, Mycobacterium
SVPPDL

SEQ ID NO: 918244 - protein, 8 aa, Mycobacterium
SVPPDQAT

SEQ ID NO: 918245 - protein, 7 aa, Mycobacterium
SVPPLPG

SEQ ID NO: 918246 - protein, 6 aa, Mycobacterium
SVPPLT

SEQ ID NO: 918247 - protein, 17 aa, Mycobacterium
SVPQGGGAPIIANTSPR

SEQ ID NO: 918248 - protein, 15 aa, Mycobacterium
SVPQGPGINDNGSGV

SEQ ID NO: 918249 - protein, 5 aa, Mycobacterium
SVPQL

SEQ ID NO: 918250 - protein, 8 aa, Mycobacterium
SVPSRSAT

SEQ ID NO: 918251 - protein, 4 aa, Mycobacterium
SVPT

SEQ ID NO: 918252 - protein, 6 aa, Mycobacterium
SVPTAG

SEQ ID NO: 918253 - protein, 17 aa, Mycobacterium
SVPTRPQTRVTGPDDDP

SEQ ID NO: 918254 - protein, 8 aa, Mycobacterium
SVPVPPAW

SEQ ID NO: 918255 - protein, 10 aa, Mycobacterium
SVRGYQAGGV

SEQ ID NO: 918256 - protein, 8 aa, Mycobacterium
SVRTEAQA

SEQ ID NO: 918257 - protein, 6 aa, Mycobacterium
SVSAPL

SEQ ID NO: 918258 - protein, 15 aa, Mycobacterium
SVSATDTLTGAQENL

SEQ ID NO: 918259 - protein, 7 aa, Mycobacterium
SVSCPRS

SEQ ID NO: 918260 - protein, 5 aa, Mycobacterium
SVSDQ

SEQ ID NO: 918261 - protein, 6 aa, Mycobacterium
SVSEDG

SEQ ID NO: 918262 - protein, 15 aa, Mycobacterium
SVSEGPGINDNGSGV

SEQ ID NO: 918263 - protein, 6 aa, Mycobacterium
SVSGDT

SEQ ID NO: 918264 - protein, 18 aa, Mycobacterium
SVSGSTPAQRIKDEYPGV

SEQ ID NO: 918265 - protein, 8 aa, Mycobacterium
SVSGTRTD

SEQ ID NO: 918266 - protein, 35 aa, Mycobacterium
SVSNGMGAKVGSADVAVDGKTYTITGQAQGADLKN

SEQ ID NO: 918267 - protein, 5 aa, Mycobacterium
SVSPL

SEQ ID NO: 918268 - protein, 11 aa, Mycobacterium
SVSSENAGFTV

SEQ ID NO: 918269 - protein, 9 aa, Mycobacterium
SVSSGKAAS

SEQ ID NO: 918270 - protein, 6 aa, Mycobacterium
SVSVGT

SEQ ID NO: 918271 - protein, 5 aa, Mycobacterium
SVTAD

SEQ ID NO: 918272 - protein, 8 aa, Mycobacterium
SVTAGKAQ

SEQ ID NO: 918273 - protein, 12 aa, Mycobacterium
SVTAPQGTIRDR

SEQ ID NO: 918274 - protein, 8 aa, Mycobacterium
SVTATSQN

SEQ ID NO: 918275 - protein, 7 aa, Mycobacterium
SVTDPQL

SEQ ID NO: 918276 - protein, 6 aa, Mycobacterium
SVTIPG

SEQ ID NO: 918277 - protein, 9 aa, Mycobacterium
SVTKGVDDR

SEQ ID NO: 918278 - protein, 8 aa, Mycobacterium
SVTPAPGW

SEQ ID NO: 918279 - protein, 26 aa, Mycobacterium
SVTQESPVSNVQPARDVRNNPTTVPT

SEQ ID NO: 918280 - protein, 13 aa, Mycobacterium
SVTSATIAGEAPA

SEQ ID NO: 918281 - protein, 6 aa, Mycobacterium
SVTSDG

SEQ ID NO: 918282 - protein, 9 aa, Mycobacterium
SVTSSPSDL

SEQ ID NO: 918283 - protein, 5 aa, Mycobacterium
SVTTE

SEQ ID NO: 918284 - protein, 9 aa, Mycobacterium
SWAAGSRQV

SEQ ID NO: 918285 - protein, 17 aa, Mycobacterium
SWADGRGASVPDREGVD

SEQ ID NO: 918286 - protein, 7 aa, Mycobacterium
SWDPDAL

SEQ ID NO: 918287 - protein, 19 aa, Mycobacterium
SWDPPPRPADCPDVTGYGQ

SEQ ID NO: 918288 - protein, 8 aa, Mycobacterium
SWETGQPM

SEQ ID NO: 918289 - protein, 9 aa, Mycobacterium
SWGATGPDA

SEQ ID NO: 918290 - protein, 20 aa, Mycobacterium
SWGDGNGTVAAGSGGAGGNI

SEQ ID NO: 918291 - protein, 9 aa, Mycobacterium
SWGRDPETM

SEQ ID NO: 918292 - protein, 6 aa, Mycobacterium
SWLGPS

SEQ ID NO: 918293 - protein, 11 aa, Mycobacterium
SWNENQPNNQW

SEQ ID NO: 918294 - protein, 5 aa, Mycobacterium
SWPGA

SEQ ID NO: 918295 - protein, 6 aa, Mycobacterium
SWPGAS

SEQ ID NO: 918296 - protein, 12 aa, Mycobacterium
SWPGTSAKEAAE

SEQ ID NO: 918297 - protein, 12 aa, Mycobacterium
SWPPSDDRGPCA

SEQ ID NO: 918298 - protein, 6 aa, Mycobacterium
SWTAPA

SEQ ID NO: 918299 - protein, 11 aa, Mycobacterium
SWTGPGSGQLK

SEQ ID NO: 918300 - protein, 8 aa, Mycobacterium
SWTSPKSL

SEQ ID NO: 918301 - protein, 13 aa, Mycobacterium
SYAATEAINAAAS

SEQ ID NO: 918302 - protein, 8 aa, Mycobacterium
SYAGATQV

SEQ ID NO: 918303 - protein, 7 aa, Mycobacterium
SYANDQA

SEQ ID NO: 918304 - protein, 10 aa, Mycobacterium
SYATSDEPRV

SEQ ID NO: 918305 - protein, 14 aa, Mycobacterium
SYATSDRRGASSQS

SEQ ID NO: 918306 - protein, 7 aa, Mycobacterium
SYERGAP

SEQ ID NO: 918307 - protein, 10 aa, Mycobacterium
SYGADDGEYT

SEQ ID NO: 918308 - protein, 9 aa, Mycobacterium
SYGDEKISP

SEQ ID NO: 918309 - protein, 6 aa, Mycobacterium
SYGGGI

SEQ ID NO: 918310 - protein, 7 aa, Mycobacterium
SYGGHRV

SEQ ID NO: 918311 - protein, 15 aa, Mycobacterium
SYGKPYTPAAGHVDP

SEQ ID NO: 918312 - protein, 11 aa, Mycobacterium
SYGPATGGSLP

SEQ ID NO: 918313 - protein, 5 aa, Mycobacterium
SYITG

SEQ ID NO: 918314 - protein, 17 aa, Mycobacterium
SYNGATQAQLNKGTLPR

SEQ ID NO: 918315 - protein, 7 aa, Mycobacterium
SYPATIA

SEQ ID NO: 918316 - protein, 9 aa, Mycobacterium
SYPGECTGT

SEQ ID NO: 918317 - protein, 14 aa, Mycobacterium
SYPGGDPVANPDRY

SEQ ID NO: 918318 - protein, 13 aa, Mycobacterium
SYPGGFEHSPDLG

SEQ ID NO: 918319 - protein, 5 aa, Mycobacterium
SYPSA

SEQ ID NO: 918320 - protein, 8 aa, Mycobacterium
SYQPVRPT

SEQ ID NO: 918321 - protein, 7 aa, Mycobacterium
SYQRGAP

SEQ ID NO: 918322 - protein, 7 aa, Mycobacterium
SYQTSDD

SEQ ID NO: 918323 - protein, 4 aa, Mycobacterium
SYRG

SEQ ID NO: 918324 - protein, 12 aa, Mycobacterium
SYRRSNPGAGLD

SEQ ID NO: 918325 - protein, 6 aa, Mycobacterium
SYSATK

SEQ ID NO: 918326 - protein, 6 aa, Mycobacterium
SYSPDE

SEQ ID NO: 918327 - protein, 5 aa, Mycobacterium
SYSVD

SEQ ID NO: 918328 - protein, 17 aa, Mycobacterium
SYTAGTDEGGLGSTSWT

SEQ ID NO: 918329 - protein, 6 aa, Mycobacterium
SYTPDN

SEQ ID NO: 918330 - protein, 8 aa, Mycobacterium
SYTPDQIA

SEQ ID NO: 918331 - protein, 17 aa, Mycobacterium
SYTTGAAEGGQGAKGWP

SEQ ID NO: 918332 - protein, 19 aa, Mycobacterium
SYTTGTDEGGLGARSWPSR

SEQ ID NO: 918333 - protein, 17 aa, Mycobacterium
SYTTGTGEGGVGPRSWP

SEQ ID NO: 918334 - protein, 5 aa, Mycobacterium
SYTYP

SEQ ID NO: 918335 - protein, 4 aa, Mycobacterium
TAAA

SEQ ID NO: 918336 - protein, 14 aa, Mycobacterium
TAAAAAAHTAPTPL

SEQ ID NO: 918337 - protein, 9 aa, Mycobacterium
TAAAAAPPR

SEQ ID NO: 918338 - protein, 9 aa, Mycobacterium
TAAAADYGV

SEQ ID NO: 918339 - protein, 9 aa, Mycobacterium
TAAAALAEE

SEQ ID NO: 918340 - protein, 10 aa, Mycobacterium
TAAAAPTTGV

SEQ ID NO: 918341 - protein, 7 aa, Mycobacterium
TAAAATV

SEQ ID NO: 918342 - protein, 10 aa, Mycobacterium
TAAAELAPSG

SEQ ID NO: 918343 - protein, 16 aa, Mycobacterium
TAAAGSSGTAKAAPYE

SEQ ID NO: 918344 - protein, 22 aa, Mycobacterium
TAAAQNDGSDQNDGSDAQQTVR

SEQ ID NO: 918345 - protein, 5 aa, Mycobacterium
TAAAR

SEQ ID NO: 918346 - protein, 5 aa, Mycobacterium
TAADA

SEQ ID NO: 918347 - protein, 8 aa, Mycobacterium
TAADAGWQ

SEQ ID NO: 918348 - protein, 7 aa, Mycobacterium
TAADPKP

SEQ ID NO: 918349 - protein, 13 aa, Mycobacterium
TAAENLPAARRRA

SEQ ID NO: 918350 - protein, 10 aa, Mycobacterium
TAAGAAASGH

SEQ ID NO: 918351 - protein, 18 aa, Mycobacterium
TAAGDNTNIGIGDPTAGL

SEQ ID NO: 918352 - protein, 7 aa, Mycobacterium
TAAGDTV

SEQ ID NO: 918353 - protein, 6 aa, Mycobacterium
TAAGEI

SEQ ID NO: 918354 - protein, 7 aa, Mycobacterium
TAAGEQC

SEQ ID NO: 918355 - protein, 19 aa, Mycobacterium
TAAGGNNGASATASGLGGN

SEQ ID NO: 918356 - protein, 7 aa, Mycobacterium
TAAGGRN

SEQ ID NO: 918357 - protein, 21 aa, Mycobacterium
TAAGGTAIANGDSVATEEGGA

SEQ ID NO: 918358 - protein, 5 aa, Mycobacterium
TAAGQ

SEQ ID NO: 918359 - protein, 6 aa, Mycobacterium
TAAGRE

SEQ ID NO: 918360 - protein, 7 aa, Mycobacterium
TAAGTDY

SEQ ID NO: 918361 - protein, 11 aa, Mycobacterium
TAAKAGVASPF

SEQ ID NO: 918362 - protein, 11 aa, Mycobacterium
TAAKTLAASAQ

SEQ ID NO: 918363 - protein, 9 aa, Mycobacterium
TAANPVTTT

SEQ ID NO: 918364 - protein, 8 aa, Mycobacterium
TAANVGQS

SEQ ID NO: 918365 - protein, 7 aa, Mycobacterium
TAAPANS

SEQ ID NO: 918366 - protein, 13 aa, Mycobacterium
TAAPAVADPDTAF

SEQ ID NO: 918367 - protein, 30 aa, Mycobacterium
TAAPAVGDAGGGAVSPGATVGAGPAVTAAT

SEQ ID NO: 918368 - protein, 31 aa, Mycobacterium
TAAPESWTKGSSGSWEGGAGESAEKSSGVAE

SEQ ID NO: 918369 - protein, 9 aa, Mycobacterium
TAAPGEPAG

SEQ ID NO: 918370 - protein, 6 aa, Mycobacterium
TAAPGS

SEQ ID NO: 918371 - protein, 8 aa, Mycobacterium
TAAPLVSD

SEQ ID NO: 918372 - protein, 8 aa, Mycobacterium
TAAPNHHG

SEQ ID NO: 918373 - protein, 13 aa, Mycobacterium
TAAPTQAAVGHRS

SEQ ID NO: 918374 - protein, 42 aa, Mycobacterium
TAAPVGTDTQASTTSPTPLTTLPPPSTLSAPPAPSAPPAPPL

SEQ ID NO: 918375 - protein, 7 aa, Mycobacterium
TAARDGG

SEQ ID NO: 918376 - protein, 16 aa, Mycobacterium
TAAREEKLARRRRRTA

SEQ ID NO: 918377 - protein, 6 aa, Mycobacterium
TAAREY

SEQ ID NO: 918378 - protein, 8 aa, Mycobacterium
TAARQSCG

SEQ ID NO: 918379 - protein, 8 aa, Mycobacterium
TAASAGAS

SEQ ID NO: 918380 - protein, 7 aa, Mycobacterium
TAASDNF

SEQ ID NO: 918381 - protein, 15 aa, Mycobacterium
TAASDNFQMSGGGTG

SEQ ID NO: 918382 - protein, 21 aa, Mycobacterium
TAASEEAAASSSAREAERQAS

SEQ ID NO: 918383 - protein, 6 aa, Mycobacterium
TAASTD

SEQ ID NO: 918384 - protein, 86 aa, Mycobacterium
TAASTTSPRPAATGSGTSASTPARTAPVTTAPASNTPATELVPESPAVAPTGAAPAAAPGAGAAATDIPGSTVPPLAEDAADEALA

SEQ ID NO: 918385 - protein, 62 aa, Mycobacterium
TAATANADDGLDPNAVGADTTGFDPNLPAAPGAFEPPAPQDAPPAPELADADPDLPPPAPDA

SEQ ID NO: 918386 - protein, 15 aa, Mycobacterium
TAATDNYKMSGGGQG

SEQ ID NO: 918387 - protein, 14 aa, Mycobacterium
TAATDSYKMSGGQG

SEQ ID NO: 918388 - protein, 16 aa, Mycobacterium
TAATGADLRDEKAQDE

SEQ ID NO: 918389 - protein, 12 aa, Mycobacterium
TAATGRAVTGGG

SEQ ID NO: 918390 - protein, 8 aa, Mycobacterium
TAATRTGV

SEQ ID NO: 918391 - protein, 7 aa, Mycobacterium
TAATSWP

SEQ ID NO: 918392 - protein, 10 aa, Mycobacterium
TACGGGPTAT

SEQ ID NO: 918393 - protein, 8 aa, Mycobacterium
TACSGGRA

SEQ ID NO: 918394 - protein, 10 aa, Mycobacterium
TADAGPVRGR

SEQ ID NO: 918395 - protein, 8 aa, Mycobacterium
TADASVPE

SEQ ID NO: 918396 - protein, 7 aa, Mycobacterium
TADATDD

SEQ ID NO: 918397 - protein, 8 aa, Mycobacterium
TADDATHQ

SEQ ID NO: 918398 - protein, 10 aa, Mycobacterium
TADDATKTMT

SEQ ID NO: 918399 - protein, 10 aa, Mycobacterium
TADDGADDPL

SEQ ID NO: 918400 - protein, 5 aa, Mycobacterium
TADDH

SEQ ID NO: 918401 - protein, 6 aa, Mycobacterium
TADDNT

SEQ ID NO: 918402 - protein, 25 aa, Mycobacterium
TADDRVPYGGGPGKAFSRNGTARVD

SEQ ID NO: 918403 - protein, 32 aa, Mycobacterium
TADDRVPYNGGPGVARSFDGSARVDGPSAAAV

SEQ ID NO: 918404 - protein, 15 aa, Mycobacterium
TADDSPDGATPDEGM

SEQ ID NO: 918405 - protein, 21 aa, Mycobacterium
TADEQGVDFTTQRAKALKGTA

SEQ ID NO: 918406 - protein, 7 aa, Mycobacterium
TADESAA

SEQ ID NO: 918407 - protein, 32 aa, Mycobacterium
TADESVPYAGGPGKALTANGTPRVDGPSVPSV

SEQ ID NO: 918408 - protein, 4 aa, Mycobacterium
TADG

SEQ ID NO: 918409 - protein, 7 aa, Mycobacterium
TADGDCN

SEQ ID NO: 918410 - protein, 8 aa, Mycobacterium
TADGRQTA

SEQ ID NO: 918411 - protein, 8 aa, Mycobacterium
TADGSEKW

SEQ ID NO: 918412 - protein, 7 aa, Mycobacterium
TADGTEC

SEQ ID NO: 918413 - protein, 9 aa, Mycobacterium
TADGTPETI

SEQ ID NO: 918414 - protein, 5 aa, Mycobacterium
TADGV

SEQ ID NO: 918415 - protein, 8 aa, Mycobacterium
TADGWGSS

SEQ ID NO: 918416 - protein, 6 aa, Mycobacterium
TADITS

SEQ ID NO: 918417 - protein, 9 aa, Mycobacterium
TADNLSGRQ

SEQ ID NO: 918418 - protein, 7 aa, Mycobacterium
TADPANR

SEQ ID NO: 918419 - protein, 13 aa, Mycobacterium
TADPGARSMDYQQ

SEQ ID NO: 918420 - protein, 61 aa, Mycobacterium
TADPGIAAAAAPGSKPQATRATGTTGIPASPLRSSPAGTESKRSAPTQDQQDGAEQTAAED

SEQ ID NO: 918421 - protein, 9 aa, Mycobacterium
TADPSAPLS

SEQ ID NO: 918422 - protein, 15 aa, Mycobacterium
TADPSMQPMESEGRY

SEQ ID NO: 918423 - protein, 10 aa, Mycobacterium
TADPSNRAAP

SEQ ID NO: 918424 - protein, 8 aa, Mycobacterium
TADPSNRH

SEQ ID NO: 918425 - protein, 10 aa, Mycobacterium
TADPSNRHRA

SEQ ID NO: 918426 - protein, 5 aa, Mycobacterium
TADPV

SEQ ID NO: 918427 - protein, 8 aa, Mycobacterium
TADRPAPV

SEQ ID NO: 918428 - protein, 5 aa, Mycobacterium
TADRQ

SEQ ID NO: 918429 - protein, 8 aa, Mycobacterium
TADRRGQL

SEQ ID NO: 918430 - protein, 9 aa, Mycobacterium
TADSAARQR

SEQ ID NO: 918431 - protein, 9 aa, Mycobacterium
TADSANMDK

SEQ ID NO: 918432 - protein, 7 aa, Mycobacterium
TADSEST

SEQ ID NO: 918433 - protein, 10 aa, Mycobacterium
TAEAAADIAQ

SEQ ID NO: 918434 - protein, 24 aa, Mycobacterium
TAEAGRAPGARCAGSGTGRAAGST

SEQ ID NO: 918435 - protein, 8 aa, Mycobacterium
TAEARSGA

SEQ ID NO: 918436 - protein, 8 aa, Mycobacterium
TAEARTGA

SEQ ID NO: 918437 - protein, 7 aa, Mycobacterium
TAEEAPD

SEQ ID NO: 918438 - protein, 6 aa, Mycobacterium
TAEELA

SEQ ID NO: 918439 - protein, 8 aa, Mycobacterium
TAEESTIS

SEQ ID NO: 918440 - protein, 8 aa, Mycobacterium
TAEETSRL

SEQ ID NO: 918441 - protein, 6 aa, Mycobacterium
TAEGGA

SEQ ID NO: 918442 - protein, 7 aa, Mycobacterium
TAEGGAM

SEQ ID NO: 918443 - protein, 7 aa, Mycobacterium
TAEGGGL

SEQ ID NO: 918444 - protein, 7 aa, Mycobacterium
TAEGGGV

SEQ ID NO: 918445 - protein, 10 aa, Mycobacterium
TAEHAETPEF

SEQ ID NO: 918446 - protein, 5 aa, Mycobacterium
TAEIP

SEQ ID NO: 918447 - protein, 11 aa, Mycobacterium
TAELPSGPGVG

SEQ ID NO: 918448 - protein, 7 aa, Mycobacterium
TAELTSA

SEQ ID NO: 918449 - protein, 9 aa, Mycobacterium
TAENPGSGV

SEQ ID NO: 918450 - protein, 8 aa, Mycobacterium
TAEPARAG

SEQ ID NO: 918451 - protein, 7 aa, Mycobacterium
TAEPHDC

SEQ ID NO: 918452 - protein, 15 aa, Mycobacterium
TAEQHSAGQPPHNTR

SEQ ID NO: 918453 - protein, 8 aa, Mycobacterium
TAERGGQV

SEQ ID NO: 918454 - protein, 5 aa, Mycobacterium
TAERH

SEQ ID NO: 918455 - protein, 5 aa, Mycobacterium
TAERR

SEQ ID NO: 918456 - protein, 9 aa, Mycobacterium
TAESGPGAL

SEQ ID NO: 918457 - protein, 7 aa, Mycobacterium
TAESPQR

SEQ ID NO: 918458 - protein, 9 aa, Mycobacterium
TAFGGLGPS

SEQ ID NO: 918459 - protein, 9 aa, Mycobacterium
TAFSGREQD

SEQ ID NO: 918460 - protein, 11 aa, Mycobacterium
TAGAAHKSDVG

SEQ ID NO: 918461 - protein, 17 aa, Mycobacterium
TAGADTTLGQQGRLTNG

SEQ ID NO: 918462 - protein, 10 aa, Mycobacterium
TAGAEGAGTT

SEQ ID NO: 918463 - protein, 8 aa, Mycobacterium
TAGAEYQA

SEQ ID NO: 918464 - protein, 6 aa, Mycobacterium
TAGAGA

SEQ ID NO: 918465 - protein, 13 aa, Mycobacterium
TAGAGTTGNTTAK

SEQ ID NO: 918466 - protein, 15 aa, Mycobacterium
TAGASGESASTARAV

SEQ ID NO: 918467 - protein, 19 aa, Mycobacterium
TAGATSRTSTVLVVVLGYD

SEQ ID NO: 918468 - protein, 7 aa, Mycobacterium
TAGDATR

SEQ ID NO: 918469 - protein, 6 aa, Mycobacterium
TAGEPM

SEQ ID NO: 918470 - protein, 9 aa, Mycobacterium
TAGESARRS

SEQ ID NO: 918471 - protein, 8 aa, Mycobacterium
TAGGASTD

SEQ ID NO: 918472 - protein, 8 aa, Mycobacterium
TAGGAVAG

SEQ ID NO: 918473 - protein, 7 aa, Mycobacterium
TAGGDTQ

SEQ ID NO: 918474 - protein, 5 aa, Mycobacterium
TAGGN

SEQ ID NO: 918475 - protein, 8 aa, Mycobacterium
TAGGRQAA

SEQ ID NO: 918476 - protein, 9 aa, Mycobacterium
TAGGSVSGR

SEQ ID NO: 918477 - protein, 9 aa, Mycobacterium
TAGGTREPL

SEQ ID NO: 918478 - protein, 14 aa, Mycobacterium
TAGKQDSKIKEAPH

SEQ ID NO: 918479 - protein, 6 aa, Mycobacterium
TAGKVS

SEQ ID NO: 918480 - protein, 16 aa, Mycobacterium
TAGLATATAAGGRHGL

SEQ ID NO: 918481 - protein, 6 aa, Mycobacterium
TAGLGA

SEQ ID NO: 918482 - protein, 15 aa, Mycobacterium
TAGLGAATARALAAE

SEQ ID NO: 918483 - protein, 7 aa, Mycobacterium
TAGLTSN

SEQ ID NO: 918484 - protein, 4 aa, Mycobacterium
TAGN

SEQ ID NO: 918485 - protein, 11 aa, Mycobacterium
TAGPAEAVPNT

SEQ ID NO: 918486 - protein, 4 aa, Mycobacterium
TAGQ

SEQ ID NO: 918487 - protein, 15 aa, Mycobacterium
TAGQAMADSTDDYPI

SEQ ID NO: 918488 - protein, 5 aa, Mycobacterium
TAGRR

SEQ ID NO: 918489 - protein, 7 aa, Mycobacterium
TAGRSRF

SEQ ID NO: 918490 - protein, 12 aa, Mycobacterium
TAGSAAASTDDT

SEQ ID NO: 918491 - protein, 6 aa, Mycobacterium
TAGSAG

SEQ ID NO: 918492 - protein, 12 aa, Mycobacterium
TAGSNNYSPYDS

SEQ ID NO: 918493 - protein, 9 aa, Mycobacterium
TAGSPDATL

SEQ ID NO: 918494 - protein, 8 aa, Mycobacterium
TAGSQSCP

SEQ ID NO: 918495 - protein, 14 aa, Mycobacterium
TAGSTAQLRTATPL

SEQ ID NO: 918496 - protein, 19 aa, Mycobacterium
TAGSTAYATAEAANAGPLQ

SEQ ID NO: 918497 - protein, 8 aa, Mycobacterium
TAGTAAAS

SEQ ID NO: 918498 - protein, 7 aa, Mycobacterium
TAGTPQD

SEQ ID NO: 918499 - protein, 22 aa, Mycobacterium
TAGTSAPPSVPTTTKAPAPPPL

SEQ ID NO: 918500 - protein, 11 aa, Mycobacterium
TAGVGSAAPEA

SEQ ID NO: 918501 - protein, 7 aa, Mycobacterium
TAGVSKQ

SEQ ID NO: 918502 - protein, 6 aa, Mycobacterium
TAHADA

SEQ ID NO: 918503 - protein, 9 aa, Mycobacterium
TAHAEPEGH

SEQ ID NO: 918504 - protein, 12 aa, Mycobacterium
TAHDEDTPGINP

SEQ ID NO: 918505 - protein, 9 aa, Mycobacterium
TAHGGYDPD

SEQ ID NO: 918506 - protein, 5 aa, Mycobacterium
TAHPP

SEQ ID NO: 918507 - protein, 7 aa, Mycobacterium
TAHSQEG

SEQ ID NO: 918508 - protein, 14 aa, Mycobacterium
TAIAPASAQPAQCT

SEQ ID NO: 918509 - protein, 12 aa, Mycobacterium
TAIEPNPRQPRQ

SEQ ID NO: 918510 - protein, 19 aa, Mycobacterium
TAIGDGNTNVAAQAGGVGG

SEQ ID NO: 918511 - protein, 9 aa, Mycobacterium
TAIGTQPWR

SEQ ID NO: 918512 - protein, 7 aa, Mycobacterium
TAIPGLP

SEQ ID NO: 918513 - protein, 13 aa, Mycobacterium
TAISPAAWGAPSN

SEQ ID NO: 918514 - protein, 8 aa, Mycobacterium
TAKADGID

SEQ ID NO: 918515 - protein, 7 aa, Mycobacterium
TAKAGDH

SEQ ID NO: 918516 - protein, 14 aa, Mycobacterium
TAKAWGGSDVSADL

SEQ ID NO: 918517 - protein, 21 aa, Mycobacterium
TAKEELSSSMATTLSDGLTGE

SEQ ID NO: 918518 - protein, 10 aa, Mycobacterium
TAKELTEKTV

SEQ ID NO: 918519 - protein, 7 aa, Mycobacterium
TAKGDCN

SEQ ID NO: 918520 - protein, 9 aa, Mycobacterium
TAKGQQRAT

SEQ ID NO: 918521 - protein, 15 aa, Mycobacterium
TAKGRPGSGFVPVGA

SEQ ID NO: 918522 - protein, 9 aa, Mycobacterium
TAKNGPLDQ

SEQ ID NO: 918523 - protein, 8 aa, Mycobacterium
TAKNGPLE

SEQ ID NO: 918524 - protein, 5 aa, Mycobacterium
TAKNS

SEQ ID NO: 918525 - protein, 6 aa, Mycobacterium
TAKNSV

SEQ ID NO: 918526 - protein, 7 aa, Mycobacterium
TAKPAAE

SEQ ID NO: 918527 - protein, 7 aa, Mycobacterium
TAKPDPI

SEQ ID NO: 918528 - protein, 8 aa, Mycobacterium
TAKPSQRA

SEQ ID NO: 918529 - protein, 9 aa, Mycobacterium
TAKRPADAA

SEQ ID NO: 918530 - protein, 8 aa, Mycobacterium
TAKSLDVP

SEQ ID NO: 918531 - protein, 5 aa, Mycobacterium
TAKST

SEQ ID NO: 918532 - protein, 6 aa, Mycobacterium
TAKSVS

SEQ ID NO: 918533 - protein, 6 aa, Mycobacterium
TAKTSV

SEQ ID NO: 918534 - protein, 9 aa, Mycobacterium
TALADDAQS

SEQ ID NO: 918535 - protein, 4 aa, Mycobacterium
TALP

SEQ ID NO: 918536 - protein, 12 aa, Mycobacterium
TALPAAADTPVM

SEQ ID NO: 918537 - protein, 13 aa, Mycobacterium
TALPGRSATNQKA

SEQ ID NO: 918538 - protein, 6 aa, Mycobacterium
TALRPQ

SEQ ID NO: 918539 - protein, 6 aa, Mycobacterium
TALRPR

SEQ ID NO: 918540 - protein, 4 aa, Mycobacterium
TAMA

SEQ ID NO: 918541 - protein, 6 aa, Mycobacterium
TAMPST

SEQ ID NO: 918542 - protein, 6 aa, Mycobacterium
TANAEP

SEQ ID NO: 918543 - protein, 14 aa, Mycobacterium
TANAESSVSSFGPT

SEQ ID NO: 918544 - protein, 20 aa, Mycobacterium
TANDPDYQSELPEGSDTSVD

SEQ ID NO: 918545 - protein, 20 aa, Mycobacterium
TANDPGYQGELPEGSDTSVD

SEQ ID NO: 918546 - protein, 13 aa, Mycobacterium
TANDSRLDDTAAK

SEQ ID NO: 918547 - protein, 13 aa, Mycobacterium
TANDTDADGTIDT

SEQ ID NO: 918548 - protein, 7 aa, Mycobacterium
TANGQPV

SEQ ID NO: 918549 - protein, 10 aa, Mycobacterium
TANPAAPQLG

SEQ ID NO: 918550 - protein, 9 aa, Mycobacterium
TANPKPVTA

SEQ ID NO: 918551 - protein, 10 aa, Mycobacterium
TANQTRREST

SEQ ID NO: 918552 - protein, 4 aa, Mycobacterium
TANR

SEQ ID NO: 918553 - protein, 10 aa, Mycobacterium
TANSRHPERA

SEQ ID NO: 918554 - protein, 22 aa, Mycobacterium
TANTEPHQPVSQATHQVTHVSQ

SEQ ID NO: 918555 - protein, 5 aa, Mycobacterium
TANTV

SEQ ID NO: 918556 - protein, 9 aa, Mycobacterium
TANYPTTEQ

SEQ ID NO: 918557 - protein, 4 aa, Mycobacterium
TAPA

SEQ ID NO: 918558 - protein, 32 aa, Mycobacterium
TAPAAPAATATAVPATPVTGPGATASITLPQP

SEQ ID NO: 918559 - protein, 26 aa, Mycobacterium
TAPAASAAPDCSQERLSDTVGSTTIA

SEQ ID NO: 918560 - protein, 10 aa, Mycobacterium
TAPAASIGIS

SEQ ID NO: 918561 - protein, 5 aa, Mycobacterium
TAPAC

SEQ ID NO: 918562 - protein, 10 aa, Mycobacterium
TAPAPSAAGV

SEQ ID NO: 918563 - protein, 8 aa, Mycobacterium
TAPAPSPQ

SEQ ID NO: 918564 - protein, 16 aa, Mycobacterium
TAPARAGLAAADAGLT

SEQ ID NO: 918565 - protein, 13 aa, Mycobacterium
TAPASAHATSADD

SEQ ID NO: 918566 - protein, 6 aa, Mycobacterium
TAPATL

SEQ ID NO: 918567 - protein, 23 aa, Mycobacterium
TAPATPSTAPSLSGTPEPSAGPG

SEQ ID NO: 918568 - protein, 7 aa, Mycobacterium
TAPDDTV

SEQ ID NO: 918569 - protein, 7 aa, Mycobacterium
TAPDGAT

SEQ ID NO: 918570 - protein, 16 aa, Mycobacterium
TAPDVTPLQGPNFQQQ

SEQ ID NO: 918571 - protein, 5 aa, Mycobacterium
TAPED

SEQ ID NO: 918572 - protein, 12 aa, Mycobacterium
TAPGAGQEPKDV

SEQ ID NO: 918573 - protein, 5 aa, Mycobacterium
TAPGF

SEQ ID NO: 918574 - protein, 6 aa, Mycobacterium
TAPIAP

SEQ ID NO: 918575 - protein, 9 aa, Mycobacterium
TAPIGPRPW

SEQ ID NO: 918576 - protein, 9 aa, Mycobacterium
TAPLPPPEA

SEQ ID NO: 918577 - protein, 4 aa, Mycobacterium
TAPN

SEQ ID NO: 918578 - protein, 9 aa, Mycobacterium
TAPNPGGGL

SEQ ID NO: 918579 - protein, 6 aa, Mycobacterium
TAPPAI

SEQ ID NO: 918580 - protein, 6 aa, Mycobacterium
TAPPAM

SEQ ID NO: 918581 - protein, 11 aa, Mycobacterium
TAPPASASAQS

SEQ ID NO: 918582 - protein, 16 aa, Mycobacterium
TAPPPLNMRPPNDPDV

SEQ ID NO: 918583 - protein, 18 aa, Mycobacterium
TAPPPVANAKNGDTHVTG

SEQ ID NO: 918584 - protein, 12 aa, Mycobacterium
TAPRAAAAATMS

SEQ ID NO: 918585 - protein, 39 aa, Mycobacterium
TAPRAAADPDTENAAATAAVAPDEGLVPSSDPVTYTTPE

SEQ ID NO: 918586 - protein, 13 aa, Mycobacterium
TAPRASAAPGQWP

SEQ ID NO: 918587 - protein, 5 aa, Mycobacterium
TAPRG

SEQ ID NO: 918588 - protein, 11 aa, Mycobacterium
TAPSDGAGTTH

SEQ ID NO: 918589 - protein, 11 aa, Mycobacterium
TAPSSKTLGPM

SEQ ID NO: 918590 - protein, 24 aa, Mycobacterium
TAPSTLRTGSRGCCSKEDASDARR

SEQ ID NO: 918591 - protein, 9 aa, Mycobacterium
TAPTASATY

SEQ ID NO: 918592 - protein, 9 aa, Mycobacterium
TAPTATSVS

SEQ ID NO: 918593 - protein, 5 aa, Mycobacterium
TAPTV

SEQ ID NO: 918594 - protein, 20 aa, Mycobacterium
TAPVAGEPADTIDGANRGRE

SEQ ID NO: 918595 - protein, 9 aa, Mycobacterium
TAPVGTGPY

SEQ ID NO: 918596 - protein, 12 aa, Mycobacterium
TAPVPAAPAPVV

SEQ ID NO: 918597 - protein, 4 aa, Mycobacterium
TAQA

SEQ ID NO: 918598 - protein, 7 aa, Mycobacterium
TAQAANF

SEQ ID NO: 918599 - protein, 9 aa, Mycobacterium
TAQAAPPKV

SEQ ID NO: 918600 - protein, 8 aa, Mycobacterium
TAQADNAN

SEQ ID NO: 918601 - protein, 9 aa, Mycobacterium
TAQAEKELP

SEQ ID NO: 918602 - protein, 8 aa, Mycobacterium
TAQAEQQL

SEQ ID NO: 918603 - protein, 5 aa, Mycobacterium
TAQAK

SEQ ID NO: 918604 - protein, 9 aa, Mycobacterium
TAQATQATM

SEQ ID NO: 918605 - protein, 8 aa, Mycobacterium
TAQERGGI

SEQ ID NO: 918606 - protein, 8 aa, Mycobacterium
TAQFPGKT

SEQ ID NO: 918607 - protein, 9 aa, Mycobacterium
TAQGDTDSI

SEQ ID NO: 918608 - protein, 6 aa, Mycobacterium
TAQGEC

SEQ ID NO: 918609 - protein, 18 aa, Mycobacterium
TAQGVNPASIPQGQQKTG

SEQ ID NO: 918610 - protein, 4 aa, Mycobacterium
TAQL

SEQ ID NO: 918611 - protein, 5 aa, Mycobacterium
TAQNS

SEQ ID NO: 918612 - protein, 7 aa, Mycobacterium
TAQPENR

SEQ ID NO: 918613 - protein, 8 aa, Mycobacterium
TAQQQAAQ

SEQ ID NO: 918614 - protein, 4 aa, Mycobacterium
TAQR

SEQ ID NO: 918615 - protein, 13 aa, Mycobacterium
TAQRRAEDRQRAE

SEQ ID NO: 918616 - protein, 8 aa, Mycobacterium
TAQRSGGG

SEQ ID NO: 918617 - protein, 8 aa, Mycobacterium
TAQSGDAC

SEQ ID NO: 918618 - protein, 18 aa, Mycobacterium
TAQSGKASCLTDSKHTGS

SEQ ID NO: 918619 - protein, 6 aa, Mycobacterium
TAQTEY

SEQ ID NO: 918620 - protein, 6 aa, Mycobacterium
TAQTPA

SEQ ID NO: 918621 - protein, 8 aa, Mycobacterium
TAQTPTRA

SEQ ID NO: 918622 - protein, 9 aa, Mycobacterium
TARDADRDT

SEQ ID NO: 918623 - protein, 11 aa, Mycobacterium
TARDDAAAAQL

SEQ ID NO: 918624 - protein, 26 aa, Mycobacterium
TARDEAAAAEHELEASQQAVKDANAA

SEQ ID NO: 918625 - protein, 10 aa, Mycobacterium
TARDEATAAE

SEQ ID NO: 918626 - protein, 16 aa, Mycobacterium
TARDKQFDYGLQRLLT

SEQ ID NO: 918627 - protein, 29 aa, Mycobacterium
TAREQAAKAEQASEKSAADAKSAAEQAAA

SEQ ID NO: 918628 - protein, 8 aa, Mycobacterium
TARGAGVT

SEQ ID NO: 918629 - protein, 9 aa, Mycobacterium
TARGEQDPE

SEQ ID NO: 918630 - protein, 6 aa, Mycobacterium
TARGGR

SEQ ID NO: 918631 - protein, 11 aa, Mycobacterium
TARGGSPGARR

SEQ ID NO: 918632 - protein, 9 aa, Mycobacterium
TARGTAATA

SEQ ID NO: 918633 - protein, 4 aa, Mycobacterium
TARH

SEQ ID NO: 918634 - protein, 9 aa, Mycobacterium
TARKKPPFG

SEQ ID NO: 918635 - protein, 6 aa, Mycobacterium
TARPAT

SEQ ID NO: 918636 - protein, 8 aa, Mycobacterium
TARPNEVT

SEQ ID NO: 918637 - protein, 36 aa, Mycobacterium
TARPWSYSTNNDHAQPNGGGVAPTQGNTLGTERPDA

SEQ ID NO: 918638 - protein, 4 aa, Mycobacterium
TARR

SEQ ID NO: 918639 - protein, 25 aa, Mycobacterium
TARREGISTTATVSGAGVESLTSQR

SEQ ID NO: 918640 - protein, 5 aa, Mycobacterium
TARRS

SEQ ID NO: 918641 - protein, 8 aa, Mycobacterium
TARSEDPW

SEQ ID NO: 918642 - protein, 8 aa, Mycobacterium
TARSPSQI

SEQ ID NO: 918643 - protein, 9 aa, Mycobacterium
TASADGPVQ

SEQ ID NO: 918644 - protein, 9 aa, Mycobacterium
TASADPADD

SEQ ID NO: 918645 - protein, 28 aa, Mycobacterium
TASADPVPPPPGPPVPPNAPKKPAETWQ

SEQ ID NO: 918646 - protein, 15 aa, Mycobacterium
TASAEPDNGNPADVD

SEQ ID NO: 918647 - protein, 9 aa, Mycobacterium
TASANDNPD

SEQ ID NO: 918648 - protein, 11 aa, Mycobacterium
TASAQPTPAPA

SEQ ID NO: 918649 - protein, 6 aa, Mycobacterium
TASARV

SEQ ID NO: 918650 - protein, 5 aa, Mycobacterium
TASAV

SEQ ID NO: 918651 - protein, 5 aa, Mycobacterium
TASDQ

SEQ ID NO: 918652 - protein, 15 aa, Mycobacterium
TASEHPDYRPADGAA

SEQ ID NO: 918653 - protein, 14 aa, Mycobacterium
TASEHSYSAAQQGD

SEQ ID NO: 918654 - protein, 11 aa, Mycobacterium
TASEKEGDARD

SEQ ID NO: 918655 - protein, 9 aa, Mycobacterium
TASENTDAA

SEQ ID NO: 918656 - protein, 5 aa, Mycobacterium
TASEQ

SEQ ID NO: 918657 - protein, 10 aa, Mycobacterium
TASGATPDNL

SEQ ID NO: 918658 - protein, 5 aa, Mycobacterium
TASGR

SEQ ID NO: 918659 - protein, 9 aa, Mycobacterium
TASGSRMRP

SEQ ID NO: 918660 - protein, 6 aa, Mycobacterium
TASGVA

SEQ ID NO: 918661 - protein, 6 aa, Mycobacterium
TASLAA

SEQ ID NO: 918662 - protein, 8 aa, Mycobacterium
TASNPGPI

SEQ ID NO: 918663 - protein, 28 aa, Mycobacterium
TASNPPSAGQQPHPPVSATSAPADAAPV

SEQ ID NO: 918664 - protein, 31 aa, Mycobacterium
TASPASAGCQGGWTPWGGGTTCDGPIAQDGT

SEQ ID NO: 918665 - protein, 10 aa, Mycobacterium
TASPDSPSVV

SEQ ID NO: 918666 - protein, 10 aa, Mycobacterium
TASPDTAEAQ

SEQ ID NO: 918667 - protein, 23 aa, Mycobacterium
TASPGQPAGPAGAAGSSGAANAV

SEQ ID NO: 918668 - protein, 10 aa, Mycobacterium
TASPPALPLD

SEQ ID NO: 918669 - protein, 16 aa, Mycobacterium
TASPTALAGPTGTPNA

SEQ ID NO: 918670 - protein, 9 aa, Mycobacterium
TASPTQAAV

SEQ ID NO: 918671 - protein, 19 aa, Mycobacterium
TASQAFQAAGQAKAAAAAY

SEQ ID NO: 918672 - protein, 10 aa, Mycobacterium
TASQGKPTLT

SEQ ID NO: 918673 - protein, 9 aa, Mycobacterium
TASREGIYD

SEQ ID NO: 918674 - protein, 6 aa, Mycobacterium
TASRVR

SEQ ID NO: 918675 - protein, 9 aa, Mycobacterium
TASSAARAL

SEQ ID NO: 918676 - protein, 8 aa, Mycobacterium
TASSPQNL

SEQ ID NO: 918677 - protein, 4 aa, Mycobacterium
TAST

SEQ ID NO: 918678 - protein, 9 aa, Mycobacterium
TASTATQVS

SEQ ID NO: 918679 - protein, 11 aa, Mycobacterium
TASTGPEPGTP

SEQ ID NO: 918680 - protein, 7 aa, Mycobacterium
TASTVDE

SEQ ID NO: 918681 - protein, 4 aa, Mycobacterium
TASV

SEQ ID NO: 918682 - protein, 5 aa, Mycobacterium
TATAA

SEQ ID NO: 918683 - protein, 79 aa, Mycobacterium
TATAAADPGSESASAGATNAGPSAGEDGGSTAPDAATDADAATDADETDDAAADADETADDDEAADDAAAEEPDAEPVA

SEQ ID NO: 918684 - protein, 13 aa, Mycobacterium
TATAAPWPQGTHT

SEQ ID NO: 918685 - protein, 13 aa, Mycobacterium
TATAATGGTATQN

SEQ ID NO: 918686 - protein, 7 aa, Mycobacterium
TATAATV

SEQ ID NO: 918687 - protein, 23 aa, Mycobacterium
TATADESPIGGPPTPGAPGDQTA

SEQ ID NO: 918688 - protein, 15 aa, Mycobacterium
TATAEPVPPRPPNCT

SEQ ID NO: 918689 - protein, 11 aa, Mycobacterium
TATAGKAGAQC

SEQ ID NO: 918690 - protein, 28 aa, Mycobacterium
TATANADPTGTASDVNTLAGSVSKGYGL

SEQ ID NO: 918691 - protein, 6 aa, Mycobacterium
TATARS

SEQ ID NO: 918692 - protein, 11 aa, Mycobacterium
TATASAGSTDD

SEQ ID NO: 918693 - protein, 6 aa, Mycobacterium
TATATL

SEQ ID NO: 918694 - protein, 28 aa, Mycobacterium
TATATRGQTSANASNLELGTSRGWPTEA

SEQ ID NO: 918695 - protein, 8 aa, Mycobacterium
TATDEAIQ

SEQ ID NO: 918696 - protein, 9 aa, Mycobacterium
TATDEAVSG

SEQ ID NO: 918697 - protein, 8 aa, Mycobacterium
TATDGPLQ

SEQ ID NO: 918698 - protein, 9 aa, Mycobacterium
TATDPEDAV

SEQ ID NO: 918699 - protein, 8 aa, Mycobacterium
TATDTAVE

SEQ ID NO: 918700 - protein, 4 aa, Mycobacterium
TATE

SEQ ID NO: 918701 - protein, 6 aa, Mycobacterium
TATGAD

SEQ ID NO: 918702 - protein, 8 aa, Mycobacterium
TATGAGNQ

SEQ ID NO: 918703 - protein, 8 aa, Mycobacterium
TATGDITA

SEQ ID NO: 918704 - protein, 18 aa, Mycobacterium
TATGPERVGGQDAQPVGD

SEQ ID NO: 918705 - protein, 7 aa, Mycobacterium
TATGPRL

SEQ ID NO: 918706 - protein, 9 aa, Mycobacterium
TATGQPHGL

SEQ ID NO: 918707 - protein, 7 aa, Mycobacterium
TATGQSH

SEQ ID NO: 918708 - protein, 10 aa, Mycobacterium
TATGSSAEPL

SEQ ID NO: 918709 - protein, 8 aa, Mycobacterium
TATHPTTG

SEQ ID NO: 918710 - protein, 6 aa, Mycobacterium
TATIPN

SEQ ID NO: 918711 - protein, 17 aa, Mycobacterium
TATIPNSGGRVDGSRNE

SEQ ID NO: 918712 - protein, 8 aa, Mycobacterium
TATLGESQ

SEQ ID NO: 918713 - protein, 15 aa, Mycobacterium
TATPAAGAVPSDPGV

SEQ ID NO: 918714 - protein, 10 aa, Mycobacterium
TATPAHPSVT

SEQ ID NO: 918715 - protein, 7 aa, Mycobacterium
TATPEAF

SEQ ID NO: 918716 - protein, 10 aa, Mycobacterium
TATPEAFNTG

SEQ ID NO: 918717 - protein, 22 aa, Mycobacterium
TATPEDLRAAPDTAGKAADGTE

SEQ ID NO: 918718 - protein, 5 aa, Mycobacterium
TATPL

SEQ ID NO: 918719 - protein, 10 aa, Mycobacterium
TATPPPPVGT

SEQ ID NO: 918720 - protein, 14 aa, Mycobacterium
TATQAAGPGEVEAG

SEQ ID NO: 918721 - protein, 6 aa, Mycobacterium
TATQNL

SEQ ID NO: 918722 - protein, 5 aa, Mycobacterium
TATQS

SEQ ID NO: 918723 - protein, 16 aa, Mycobacterium
TATRALPGVDGDTVAA

SEQ ID NO: 918724 - protein, 11 aa, Mycobacterium
TATRAMTASTQ

SEQ ID NO: 918725 - protein, 30 aa, Mycobacterium
TATRPASGTVTIESDGTFTYTPGATYTGQD

SEQ ID NO: 918726 - protein, 4 aa, Mycobacterium
TATS

SEQ ID NO: 918727 - protein, 13 aa, Mycobacterium
TATSDGQVYGFAP

SEQ ID NO: 918728 - protein, 13 aa, Mycobacterium
TATSDGQVYSFAP

SEQ ID NO: 918729 - protein, 13 aa, Mycobacterium
TATSHADTPKTEA

SEQ ID NO: 918730 - protein, 8 aa, Mycobacterium
TATSPHSL

SEQ ID NO: 918731 - protein, 5 aa, Mycobacterium
TATSR

SEQ ID NO: 918732 - protein, 14 aa, Mycobacterium
TATTASAAPAGPGC

SEQ ID NO: 918733 - protein, 19 aa, Mycobacterium
TATTLEQAGAQATASAAAY

SEQ ID NO: 918734 - protein, 25 aa, Mycobacterium
TATTNCTDTISPGDSAYNDAHAAED

SEQ ID NO: 918735 - protein, 6 aa, Mycobacterium
TATVAQ

SEQ ID NO: 918736 - protein, 8 aa, Mycobacterium
TATVDGVE

SEQ ID NO: 918737 - protein, 7 aa, Mycobacterium
TATWPGA

SEQ ID NO: 918738 - protein, 20 aa, Mycobacterium
TATYAGDPADTIDGSNRGRQ

SEQ ID NO: 918739 - protein, 4 aa, Mycobacterium
TAVA

SEQ ID NO: 918740 - protein, 8 aa, Mycobacterium
TAVDPADR

SEQ ID NO: 918741 - protein, 7 aa, Mycobacterium
TAVGDSN

SEQ ID NO: 918742 - protein, 10 aa, Mycobacterium
TAVGPDPAGL

SEQ ID NO: 918743 - protein, 9 aa, Mycobacterium
TAVPPATTI

SEQ ID NO: 918744 - protein, 44 aa, Mycobacterium
TAVPTTPGAPPPDPPPSETPGSTPPPRTTATPTPPSPAPESGEL

SEQ ID NO: 918745 - protein, 5 aa, Mycobacterium
TAVRP

SEQ ID NO: 918746 - protein, 9 aa, Mycobacterium
TAVSSRFPG

SEQ ID NO: 918747 - protein, 9 aa, Mycobacterium
TAYAAAKSG

SEQ ID NO: 918748 - protein, 10 aa, Mycobacterium
TAYGTGPENY

SEQ ID NO: 918749 - protein, 7 aa, Mycobacterium
TCAGEPA

SEQ ID NO: 918750 - protein, 6 aa, Mycobacterium
TCEPGD

SEQ ID NO: 918751 - protein, 8 aa, Mycobacterium
TCTDSSTG

SEQ ID NO: 918752 - protein, 12 aa, Mycobacterium
TCTPGPLGTEPL

SEQ ID NO: 918753 - protein, 5 aa, Mycobacterium
TDAAG

SEQ ID NO: 918754 - protein, 13 aa, Mycobacterium
TDAAGNKPESVTC

SEQ ID NO: 918755 - protein, 5 aa, Mycobacterium
TDAAS

SEQ ID NO: 918756 - protein, 7 aa, Mycobacterium
TDADATD

SEQ ID NO: 918757 - protein, 11 aa, Mycobacterium
TDADGNNSLTP

SEQ ID NO: 918758 - protein, 7 aa, Mycobacterium
TDADGRV

SEQ ID NO: 918759 - protein, 15 aa, Mycobacterium
TDADLAKNPDLSAAD

SEQ ID NO: 918760 - protein, 5 aa, Mycobacterium
TDADR

SEQ ID NO: 918761 - protein, 8 aa, Mycobacterium
TDADTGAE

SEQ ID NO: 918762 - protein, 8 aa, Mycobacterium
TDAEHARR

SEQ ID NO: 918763 - protein, 16 aa, Mycobacterium
TDAEKRAAIETTPARK

SEQ ID NO: 918764 - protein, 14 aa, Mycobacterium
TDAELAKGPDFSAA

SEQ ID NO: 918765 - protein, 16 aa, Mycobacterium
TDAERKAAIETTPARK

SEQ ID NO: 918766 - protein, 6 aa, Mycobacterium
TDAGQL

SEQ ID NO: 918767 - protein, 4 aa, Mycobacterium
TDAH

SEQ ID NO: 918768 - protein, 8 aa, Mycobacterium
TDAKGKPM

SEQ ID NO: 918769 - protein, 17 aa, Mycobacterium
TDANGRVSAKDTGEREE

SEQ ID NO: 918770 - protein, 17 aa, Mycobacterium
TDANGRVSANDTGEREE

SEQ ID NO: 918771 - protein, 6 aa, Mycobacterium
TDANHP

SEQ ID NO: 918772 - protein, 9 aa, Mycobacterium
TDANQGERL

SEQ ID NO: 918773 - protein, 7 aa, Mycobacterium
TDAPASL

SEQ ID NO: 918774 - protein, 8 aa, Mycobacterium
TDAPDDTV

SEQ ID NO: 918775 - protein, 9 aa, Mycobacterium
TDAPQEQKQ

SEQ ID NO: 918776 - protein, 5 aa, Mycobacterium
TDAPS

SEQ ID NO: 918777 - protein, 9 aa, Mycobacterium
TDAQATAAG

SEQ ID NO: 918778 - protein, 7 aa, Mycobacterium
TDASHPV

SEQ ID NO: 918779 - protein, 8 aa, Mycobacterium
TDATDGVI

SEQ ID NO: 918780 - protein, 12 aa, Mycobacterium
TDATEAEADAVT

SEQ ID NO: 918781 - protein, 10 aa, Mycobacterium
TDCATDDATA

SEQ ID NO: 918782 - protein, 10 aa, Mycobacterium
TDDDDDPDFT

SEQ ID NO: 918783 - protein, 12 aa, Mycobacterium
TDDDGTYAVDGP

SEQ ID NO: 918784 - protein, 6 aa, Mycobacterium
TDDDQD

SEQ ID NO: 918785 - protein, 4 aa, Mycobacterium
TDDG

SEQ ID NO: 918786 - protein, 6 aa, Mycobacterium
TDDLSG

SEQ ID NO: 918787 - protein, 8 aa, Mycobacterium
TDDPVHPA

SEQ ID NO: 918788 - protein, 8 aa, Mycobacterium
TDDQGQVD

SEQ ID NO: 918789 - protein, 9 aa, Mycobacterium
TDDQGTTDT

SEQ ID NO: 918790 - protein, 9 aa, Mycobacterium
TDEAVQGNV

SEQ ID NO: 918791 - protein, 5 aa, Mycobacterium
TDEDW

SEQ ID NO: 918792 - protein, 5 aa, Mycobacterium
TDEEF

SEQ ID NO: 918793 - protein, 13 aa, Mycobacterium
TDEGGHSSQPGSF

SEQ ID NO: 918794 - protein, 5 aa, Mycobacterium
TDEGT

SEQ ID NO: 918795 - protein, 5 aa, Mycobacterium
TDEGV

SEQ ID NO: 918796 - protein, 6 aa, Mycobacterium
TDEPEP

SEQ ID NO: 918797 - protein, 6 aa, Mycobacterium
TDEPVR

SEQ ID NO: 918798 - protein, 5 aa, Mycobacterium
TDEQG

SEQ ID NO: 918799 - protein, 8 aa, Mycobacterium
TDEQRADR

SEQ ID NO: 918800 - protein, 17 aa, Mycobacterium
TDEQTQEFNTIYAEVTG

SEQ ID NO: 918801 - protein, 14 aa, Mycobacterium
TDESADLGYDPRRA

SEQ ID NO: 918802 - protein, 5 aa, Mycobacterium
TDETY

SEQ ID NO: 918803 - protein, 27 aa, Mycobacterium
TDFAGSDTPMNPAKNEPQKASERCGSE

SEQ ID NO: 918804 - protein, 4 aa, Mycobacterium
TDFE

SEQ ID NO: 918805 - protein, 24 aa, Mycobacterium
TDFGGSDSPLNSDEHTQAEQRCGS

SEQ ID NO: 918806 - protein, 4 aa, Mycobacterium
TDGA

SEQ ID NO: 918807 - protein, 6 aa, Mycobacterium
TDGAAV

SEQ ID NO: 918808 - protein, 6 aa, Mycobacterium
TDGAGA

SEQ ID NO: 918809 - protein, 10 aa, Mycobacterium
TDGASSSNIA

SEQ ID NO: 918810 - protein, 7 aa, Mycobacterium
TDGATPY

SEQ ID NO: 918811 - protein, 7 aa, Mycobacterium
TDGDAVA

SEQ ID NO: 918812 - protein, 9 aa, Mycobacterium
TDGDGVSGP

SEQ ID NO: 918813 - protein, 7 aa, Mycobacterium
TDGEQEF

SEQ ID NO: 918814 - protein, 7 aa, Mycobacterium
TDGGDDE

SEQ ID NO: 918815 - protein, 9 aa, Mycobacterium
TDGGGYPTG

SEQ ID NO: 918816 - protein, 19 aa, Mycobacterium
TDGGGYPTGRETYYIASMK

SEQ ID NO: 918817 - protein, 8 aa, Mycobacterium
TDGPDEVA

SEQ ID NO: 918818 - protein, 10 aa, Mycobacterium
TDGPNTNGSQ

SEQ ID NO: 918819 - protein, 5 aa, Mycobacterium
TDGRI

SEQ ID NO: 918820 - protein, 5 aa, Mycobacterium
TDGRT

SEQ ID NO: 918821 - protein, 8 aa, Mycobacterium
TDGSDKYG

SEQ ID NO: 918822 - protein, 6 aa, Mycobacterium
TDGSWK

SEQ ID NO: 918823 - protein, 5 aa, Mycobacterium
TDGTH

SEQ ID NO: 918824 - protein, 13 aa, Mycobacterium
TDGTPYHTPRPRP

SEQ ID NO: 918825 - protein, 13 aa, Mycobacterium
TDGTTPNIGPKRS

SEQ ID NO: 918826 - protein, 17 aa, Mycobacterium
TDGTVPTDNPVLDGERT

SEQ ID NO: 918827 - protein, 7 aa, Mycobacterium
TDHDGDV

SEQ ID NO: 918828 - protein, 39 aa, Mycobacterium
TDHPNPVGPAIAGAAQRHTGTAAQTDSQTDTATPPNDSA

SEQ ID NO: 918829 - protein, 8 aa, Mycobacterium
TDIASPHD

SEQ ID NO: 918830 - protein, 7 aa, Mycobacterium
TDIDAGP

SEQ ID NO: 918831 - protein, 6 aa, Mycobacterium
TDIPVT

SEQ ID NO: 918832 - protein, 10 aa, Mycobacterium
TDISADKASS

SEQ ID NO: 918833 - protein, 14 aa, Mycobacterium
TDKGSVTVTRGADG

SEQ ID NO: 918834 - protein, 8 aa, Mycobacterium
TDKGVPGA

SEQ ID NO: 918835 - protein, 8 aa, Mycobacterium
TDKPHPRG

SEQ ID NO: 918836 - protein, 8 aa, Mycobacterium
TDKQWTDS

SEQ ID NO: 918837 - protein, 8 aa, Mycobacterium
TDKSGRHV

SEQ ID NO: 918838 - protein, 27 aa, Mycobacterium
TDLAGSDSPMDPAKGEPDKAAARCGSE

SEQ ID NO: 918839 - protein, 27 aa, Mycobacterium
TDLAGSDVPLDPSTGQNDRAAQRCGSQ

SEQ ID NO: 918840 - protein, 28 aa, Mycobacterium
TDLAGSDVPLDPSTGQPDRAAARCGSPA

SEQ ID NO: 918841 - protein, 21 aa, Mycobacterium
TDLASVGSSISAANAAAAAPT

SEQ ID NO: 918842 - protein, 9 aa, Mycobacterium
TDLGGGETI

SEQ ID NO: 918843 - protein, 4 aa, Mycobacterium
TDLS

SEQ ID NO: 918844 - protein, 13 aa, Mycobacterium
TDLTGRGRAQLSD

SEQ ID NO: 918845 - protein, 7 aa, Mycobacterium
TDLTSKQ

SEQ ID NO: 918846 - protein, 12 aa, Mycobacterium
TDMGAAAENRPV

SEQ ID NO: 918847 - protein, 9 aa, Mycobacterium
TDNAPIGAD

SEQ ID NO: 918848 - protein, 8 aa, Mycobacterium
TDNAYGPA

SEQ ID NO: 918849 - protein, 6 aa, Mycobacterium
TDNPGQ

SEQ ID NO: 918850 - protein, 4 aa, Mycobacterium
TDNR

SEQ ID NO: 918851 - protein, 24 aa, Mycobacterium
TDNSPEIVGQENTNGDQTKAQTAM

SEQ ID NO: 918852 - protein, 6 aa, Mycobacterium
TDPADV

SEQ ID NO: 918853 - protein, 9 aa, Mycobacterium
TDPAFADDP

SEQ ID NO: 918854 - protein, 6 aa, Mycobacterium
TDPATR

SEQ ID NO: 918855 - protein, 7 aa, Mycobacterium
TDPATSV

SEQ ID NO: 918856 - protein, 9 aa, Mycobacterium
TDPDLPPEA

SEQ ID NO: 918857 - protein, 7 aa, Mycobacterium
TDPDQVD

SEQ ID NO: 918858 - protein, 8 aa, Mycobacterium
TDPDRVPG

SEQ ID NO: 918859 - protein, 7 aa, Mycobacterium
TDPGSDI

SEQ ID NO: 918860 - protein, 11 aa, Mycobacterium
TDPGSPNPALD

SEQ ID NO: 918861 - protein, 7 aa, Mycobacterium
TDPGTNI

SEQ ID NO: 918862 - protein, 7 aa, Mycobacterium
TDPGVNY

SEQ ID NO: 918863 - protein, 4 aa, Mycobacterium
TDPH

SEQ ID NO: 918864 - protein, 4 aa, Mycobacterium
TDPQ

SEQ ID NO: 918865 - protein, 8 aa, Mycobacterium
TDPQPNSV

SEQ ID NO: 918866 - protein, 4 aa, Mycobacterium
TDPR

SEQ ID NO: 918867 - protein, 7 aa, Mycobacterium
TDPRDDL

SEQ ID NO: 918868 - protein, 5 aa, Mycobacterium
TDPRF

SEQ ID NO: 918869 - protein, 6 aa, Mycobacterium
TDPRLE

SEQ ID NO: 918870 - protein, 8 aa, Mycobacterium
TDPRQTPQ

SEQ ID NO: 918871 - protein, 7 aa, Mycobacterium
TDPSGAD

SEQ ID NO: 918872 - protein, 7 aa, Mycobacterium
TDPSGAT

SEQ ID NO: 918873 - protein, 7 aa, Mycobacterium
TDPSGTM

SEQ ID NO: 918874 - protein, 6 aa, Mycobacterium
TDPSSP

SEQ ID NO: 918875 - protein, 4 aa, Mycobacterium
TDPT

SEQ ID NO: 918876 - protein, 16 aa, Mycobacterium
TDPTPSVGTGRTSLGF

SEQ ID NO: 918877 - protein, 5 aa, Mycobacterium
TDPVD

SEQ ID NO: 918878 - protein, 18 aa, Mycobacterium
TDPVDRRTEQPRLGPGES

SEQ ID NO: 918879 - protein, 17 aa, Mycobacterium
TDPVPDEHTGPTVTQAS

SEQ ID NO: 918880 - protein, 9 aa, Mycobacterium
TDQAADDVL

SEQ ID NO: 918881 - protein, 15 aa, Mycobacterium
TDQEARGFTRSEADR

SEQ ID NO: 918882 - protein, 7 aa, Mycobacterium
TDQGGQI

SEQ ID NO: 918883 - protein, 10 aa, Mycobacterium
TDQPAVDPDE

SEQ ID NO: 918884 - protein, 8 aa, Mycobacterium
TDQRQTQD

SEQ ID NO: 918885 - protein, 12 aa, Mycobacterium
TDRARGHGRRRG

SEQ ID NO: 918886 - protein, 11 aa, Mycobacterium
TDRDSGDEHKV

SEQ ID NO: 918887 - protein, 4 aa, Mycobacterium
TDRG

SEQ ID NO: 918888 - protein, 7 aa, Mycobacterium
TDRGEAT

SEQ ID NO: 918889 - protein, 8 aa, Mycobacterium
TDRGTENF

SEQ ID NO: 918890 - protein, 6 aa, Mycobacterium
TDRLGE

SEQ ID NO: 918891 - protein, 4 aa, Mycobacterium
TDRP

SEQ ID NO: 918892 - protein, 10 aa, Mycobacterium
TDRPAGGRGT

SEQ ID NO: 918893 - protein, 7 aa, Mycobacterium
TDRPDCG

SEQ ID NO: 918894 - protein, 5 aa, Mycobacterium
TDRPE

SEQ ID NO: 918895 - protein, 8 aa, Mycobacterium
TDRRRQTR

SEQ ID NO: 918896 - protein, 5 aa, Mycobacterium
TDRSA

SEQ ID NO: 918897 - protein, 13 aa, Mycobacterium
TDRSDESSIPERL

SEQ ID NO: 918898 - protein, 18 aa, Mycobacterium
TDRSENRYGIATRGSKSW

SEQ ID NO: 918899 - protein, 21 aa, Mycobacterium
TDRSRSASADWPAGAGVRSEG

SEQ ID NO: 918900 - protein, 18 aa, Mycobacterium
TDRTEPKPDARASGRSIG

SEQ ID NO: 918901 - protein, 24 aa, Mycobacterium
TDRVGAAQSANAALAKDLGKGLEP

SEQ ID NO: 918902 - protein, 23 aa, Mycobacterium
TDSATSPAKPEQSSTPEGGTATM

SEQ ID NO: 918903 - protein, 10 aa, Mycobacterium
TDSDGNGARV

SEQ ID NO: 918904 - protein, 5 aa, Mycobacterium
TDSDV

SEQ ID NO: 918905 - protein, 9 aa, Mycobacterium
TDSEGHQRV

SEQ ID NO: 918906 - protein, 5 aa, Mycobacterium
TDSGA

SEQ ID NO: 918907 - protein, 8 aa, Mycobacterium
TDSGERLD

SEQ ID NO: 918908 - protein, 6 aa, Mycobacterium
TDSGIT

SEQ ID NO: 918909 - protein, 6 aa, Mycobacterium
TDSGRA

SEQ ID NO: 918910 - protein, 9 aa, Mycobacterium
TDSHGDHGH

SEQ ID NO: 918911 - protein, 4 aa, Mycobacterium
TDSM

SEQ ID NO: 918912 - protein, 6 aa, Mycobacterium
TDSPAM

SEQ ID NO: 918913 - protein, 10 aa, Mycobacterium
TDSSGTTDNV

SEQ ID NO: 918914 - protein, 10 aa, Mycobacterium
TDSVDRSSHA

SEQ ID NO: 918915 - protein, 9 aa, Mycobacterium
TDSVQAGAE

SEQ ID NO: 918916 - protein, 5 aa, Mycobacterium
TDTAA

SEQ ID NO: 918917 - protein, 9 aa, Mycobacterium
TDTAGNPVP

SEQ ID NO: 918918 - protein, 14 aa, Mycobacterium
TDTAPTAATRGSRL

SEQ ID NO: 918919 - protein, 15 aa, Mycobacterium
TDTFTEEQLTGPDGS

SEQ ID NO: 918920 - protein, 4 aa, Mycobacterium
TDTG

SEQ ID NO: 918921 - protein, 16 aa, Mycobacterium
TDTKADTATGTAPRRA

SEQ ID NO: 918922 - protein, 6 aa, Mycobacterium
TDTLEE

SEQ ID NO: 918923 - protein, 8 aa, Mycobacterium
TDTPAHRA

SEQ ID NO: 918924 - protein, 9 aa, Mycobacterium
TDTPAHRAA

SEQ ID NO: 918925 - protein, 8 aa, Mycobacterium
TDTRGNPI

SEQ ID NO: 918926 - protein, 9 aa, Mycobacterium
TDTRGNPIA

SEQ ID NO: 918927 - protein, 5 aa, Mycobacterium
TDTRY

SEQ ID NO: 918928 - protein, 15 aa, Mycobacterium
TDTTEFGPSGSGGVF

SEQ ID NO: 918929 - protein, 9 aa, Mycobacterium
TDVDDAAET

SEQ ID NO: 918930 - protein, 11 aa, Mycobacterium
TDVNTSSQTDL

SEQ ID NO: 918931 - protein, 6 aa, Mycobacterium
TDVPRD

SEQ ID NO: 918932 - protein, 33 aa, Mycobacterium
TDVSSGLQIGGTGGLAGSVGYSGGPSVGGSGGL

SEQ ID NO: 918933 - protein, 5 aa, Mycobacterium
TDVVD

SEQ ID NO: 918934 - protein, 8 aa, Mycobacterium
TDYIQPGT

SEQ ID NO: 918935 - protein, 8 aa, Mycobacterium
TDYPDQQA

SEQ ID NO: 918936 - protein, 14 aa, Mycobacterium
TEAARRQLEETDDT

SEQ ID NO: 918937 - protein, 5 aa, Mycobacterium
TEAAY

SEQ ID NO: 918938 - protein, 8 aa, Mycobacterium
TEADVDRT

SEQ ID NO: 918939 - protein, 9 aa, Mycobacterium
TEAGETAIG

SEQ ID NO: 918940 - protein, 8 aa, Mycobacterium
TEAGFGEA

SEQ ID NO: 918941 - protein, 7 aa, Mycobacterium
TEAGGTA

SEQ ID NO: 918942 - protein, 5 aa, Mycobacterium
TEAGI

SEQ ID NO: 918943 - protein, 12 aa, Mycobacterium
TEAKGEFPANGT

SEQ ID NO: 918944 - protein, 10 aa, Mycobacterium
TEALGTGGAI

SEQ ID NO: 918945 - protein, 17 aa, Mycobacterium
TEALTSSDGSLADGQAF

SEQ ID NO: 918946 - protein, 5 aa, Mycobacterium
TEARY

SEQ ID NO: 918947 - protein, 11 aa, Mycobacterium
TEATTRAWDGT

SEQ ID NO: 918948 - protein, 6 aa, Mycobacterium
TECIDP

SEQ ID NO: 918949 - protein, 17 aa, Mycobacterium
TEDCPGDHDRVSTTYAG

SEQ ID NO: 918950 - protein, 5 aa, Mycobacterium
TEDGP

SEQ ID NO: 918951 - protein, 25 aa, Mycobacterium
TEDLPDELSQDSVTPGESVGTPLPA

SEQ ID NO: 918952 - protein, 4 aa, Mycobacterium
TEDM

SEQ ID NO: 918953 - protein, 8 aa, Mycobacterium
TEDPAQPM

SEQ ID NO: 918954 - protein, 11 aa, Mycobacterium
TEDQAPNAKGV

SEQ ID NO: 918955 - protein, 9 aa, Mycobacterium
TEEGPRTGE

SEQ ID NO: 918956 - protein, 8 aa, Mycobacterium
TEEPKAEV

SEQ ID NO: 918957 - protein, 5 aa, Mycobacterium
TEEQV

SEQ ID NO: 918958 - protein, 6 aa, Mycobacterium
TEETRD

SEQ ID NO: 918959 - protein, 22 aa, Mycobacterium
TEETTSGETADDEAEPVEETRD

SEQ ID NO: 918960 - protein, 7 aa, Mycobacterium
TEFPGGS

SEQ ID NO: 918961 - protein, 18 aa, Mycobacterium
TEGDSPTVKSAGLGSLNG

SEQ ID NO: 918962 - protein, 11 aa, Mycobacterium
TEGKEGMDTYA

SEQ ID NO: 918963 - protein, 11 aa, Mycobacterium
TEGLPQNASNI

SEQ ID NO: 918964 - protein, 21 aa, Mycobacterium
TEGNHSATGPTTSPPPSAPES

SEQ ID NO: 918965 - protein, 5 aa, Mycobacterium
TEGNV

SEQ ID NO: 918966 - protein, 9 aa, Mycobacterium
TEGPVDPVA

SEQ ID NO: 918967 - protein, 6 aa, Mycobacterium
TEGQEH

SEQ ID NO: 918968 - protein, 5 aa, Mycobacterium
TEGRH

SEQ ID NO: 918969 - protein, 9 aa, Mycobacterium
TEGRTANPA

SEQ ID NO: 918970 - protein, 5 aa, Mycobacterium
TEGSS

SEQ ID NO: 918971 - protein, 5 aa, Mycobacterium
TEGVS

SEQ ID NO: 918972 - protein, 4 aa, Mycobacterium
TEHD

SEQ ID NO: 918973 - protein, 16 aa, Mycobacterium
TEHEGREYNPDDYMRP

SEQ ID NO: 918974 - protein, 5 aa, Mycobacterium
TEIAT

SEQ ID NO: 918975 - protein, 4 aa, Mycobacterium
TEID

SEQ ID NO: 918976 - protein, 4 aa, Mycobacterium
TEIG

SEQ ID NO: 918977 - protein, 5 aa, Mycobacterium
TEIGP

SEQ ID NO: 918978 - protein, 39 aa, Mycobacterium
TEISRAAGKITTSSTSETTGPSPSPAEPAGPPPPPPPVS

SEQ ID NO: 918979 - protein, 14 aa, Mycobacterium
TEKEGSPGADRVNA

SEQ ID NO: 918980 - protein, 6 aa, Mycobacterium
TELGSA

SEQ ID NO: 918981 - protein, 5 aa, Mycobacterium
TELGT

SEQ ID NO: 918982 - protein, 28 aa, Mycobacterium
TELNDAAAGNKSVADALRDAQAAVERIQ

SEQ ID NO: 918983 - protein, 34 aa, Mycobacterium
TELPTSEEAPPPGGPTDDGSATIEIPTPELPTTT

SEQ ID NO: 918984 - protein, 18 aa, Mycobacterium
TENDTLSASQLQEGGDGW

SEQ ID NO: 918985 - protein, 7 aa, Mycobacterium
TENKPVG

SEQ ID NO: 918986 - protein, 6 aa, Mycobacterium
TENREA

SEQ ID NO: 918987 - protein, 17 aa, Mycobacterium
TEPANDRHADAKRSGEV

SEQ ID NO: 918988 - protein, 5 aa, Mycobacterium
TEPAS

SEQ ID NO: 918989 - protein, 10 aa, Mycobacterium
TEPDAGTLPA

SEQ ID NO: 918990 - protein, 9 aa, Mycobacterium
TEPDEWQSP

SEQ ID NO: 918991 - protein, 9 aa, Mycobacterium
TEPDSASLP

SEQ ID NO: 918992 - protein, 17 aa, Mycobacterium
TEPEAAAEKRVAVETVS

SEQ ID NO: 918993 - protein, 5 aa, Mycobacterium
TEPGR

SEQ ID NO: 918994 - protein, 10 aa, Mycobacterium
TEPGVKPKPG

SEQ ID NO: 918995 - protein, 12 aa, Mycobacterium
TEPKPTEGSPLN

SEQ ID NO: 918996 - protein, 13 aa, Mycobacterium
TEPLSTNTEITGP

SEQ ID NO: 918997 - protein, 8 aa, Mycobacterium
TEPPTPGR

SEQ ID NO: 918998 - protein, 4 aa, Mycobacterium
TEPS

SEQ ID NO: 918999 - protein, 9 aa, Mycobacterium
TEPSPARAT

SEQ ID NO: 919000 - protein, 17 aa, Mycobacterium
TEQAPLAPTPQKIEDPE

SEQ ID NO: 919001 - protein, 5 aa, Mycobacterium
TEQPH

SEQ ID NO: 919002 - protein, 6 aa, Mycobacterium
TEQPLY

SEQ ID NO: 919003 - protein, 8 aa, Mycobacterium
TEQPMSNS

SEQ ID NO: 919004 - protein, 11 aa, Mycobacterium
TEQQAGGHAIR

SEQ ID NO: 919005 - protein, 9 aa, Mycobacterium
TERAGSDRI

SEQ ID NO: 919006 - protein, 5 aa, Mycobacterium
TERGA

SEQ ID NO: 919007 - protein, 11 aa, Mycobacterium
TERQSGTPSSY

SEQ ID NO: 919008 - protein, 11 aa, Mycobacterium
TERTEDGFGQG

SEQ ID NO: 919009 - protein, 12 aa, Mycobacterium
TESDGDTNPAPG

SEQ ID NO: 919010 - protein, 8 aa, Mycobacterium
TESERGIG

SEQ ID NO: 919011 - protein, 11 aa, Mycobacterium
TESGASTTHQA

SEQ ID NO: 919012 - protein, 11 aa, Mycobacterium
TESGSRTWDDA

SEQ ID NO: 919013 - protein, 9 aa, Mycobacterium
TESPEDQQA

SEQ ID NO: 919014 - protein, 7 aa, Mycobacterium
TESQQAS

SEQ ID NO: 919015 - protein, 19 aa, Mycobacterium
TESTPYNPSSPYSATKAGA

SEQ ID NO: 919016 - protein, 8 aa, Mycobacterium
TESVGKTI

SEQ ID NO: 919017 - protein, 11 aa, Mycobacterium
TESVPDATGVR

SEQ ID NO: 919018 - protein, 4 aa, Mycobacterium
TETA

SEQ ID NO: 919019 - protein, 7 aa, Mycobacterium
TETADSW

SEQ ID NO: 919020 - protein, 5 aa, Mycobacterium
TETGE

SEQ ID NO: 919021 - protein, 9 aa, Mycobacterium
TETISGKPE

SEQ ID NO: 919022 - protein, 11 aa, Mycobacterium
TETNSRGGTTT

SEQ ID NO: 919023 - protein, 20 aa, Mycobacterium
TETPATETPATECVPTAELA

SEQ ID NO: 919024 - protein, 7 aa, Mycobacterium
TETPRGA

SEQ ID NO: 919025 - protein, 6 aa, Mycobacterium
TETRWD

SEQ ID NO: 919026 - protein, 14 aa, Mycobacterium
TETTIRRSESTRAD

SEQ ID NO: 919027 - protein, 5 aa, Mycobacterium
TETTT

SEQ ID NO: 919028 - protein, 6 aa, Mycobacterium
TETTTL

SEQ ID NO: 919029 - protein, 4 aa, Mycobacterium
TETV

SEQ ID NO: 919030 - protein, 8 aa, Mycobacterium
TETVSESV

SEQ ID NO: 919031 - protein, 4 aa, Mycobacterium
TEVD

SEQ ID NO: 919032 - protein, 5 aa, Mycobacterium
TEVDK

SEQ ID NO: 919033 - protein, 12 aa, Mycobacterium
TEVDNGQSEEAV

SEQ ID NO: 919034 - protein, 7 aa, Mycobacterium
TEVEAGT

SEQ ID NO: 919035 - protein, 9 aa, Mycobacterium
TEVKNDIAD

SEQ ID NO: 919036 - protein, 18 aa, Mycobacterium
TEVPGTGLTADGKGQAQQ

SEQ ID NO: 919037 - protein, 5 aa, Mycobacterium
TEVTG

SEQ ID NO: 919038 - protein, 6 aa, Mycobacterium
TEYGGR

SEQ ID NO: 919039 - protein, 6 aa, Mycobacterium
TEYPEE

SEQ ID NO: 919040 - protein, 7 aa, Mycobacterium
TFAGDDQ

SEQ ID NO: 919041 - protein, 10 aa, Mycobacterium
TFATDGDGEA

SEQ ID NO: 919042 - protein, 14 aa, Mycobacterium
TFATDNKAAGVAQG

SEQ ID NO: 919043 - protein, 8 aa, Mycobacterium
TFGGPGMT

SEQ ID NO: 919044 - protein, 10 aa, Mycobacterium
TFGPGPTVDG

SEQ ID NO: 919045 - protein, 4 aa, Mycobacterium
TFGQ

SEQ ID NO: 919046 - protein, 9 aa, Mycobacterium
TFGQNTPAI

SEQ ID NO: 919047 - protein, 4 aa, Mycobacterium
TFKP

SEQ ID NO: 919048 - protein, 9 aa, Mycobacterium
TFNDTDEAI

SEQ ID NO: 919049 - protein, 27 aa, Mycobacterium
TFPDPAPLARDDRAADGLWRASAAMVG

SEQ ID NO: 919050 - protein, 6 aa, Mycobacterium
TFPGPT

SEQ ID NO: 919051 - protein, 18 aa, Mycobacterium
TFPGSEYGPDAAPPSAAR

SEQ ID NO: 919052 - protein, 4 aa, Mycobacterium
TFPS

SEQ ID NO: 919053 - protein, 6 aa, Mycobacterium
TFSDTA

SEQ ID NO: 919054 - protein, 7 aa, Mycobacterium
TFSEEGN

SEQ ID NO: 919055 - protein, 4 aa, Mycobacterium
TGAA

SEQ ID NO: 919056 - protein, 13 aa, Mycobacterium
TGAAAKDTKRTIN

SEQ ID NO: 919057 - protein, 19 aa, Mycobacterium
TGAAGEAHGDGSGTAGAST

SEQ ID NO: 919058 - protein, 8 aa, Mycobacterium
TGAAPGEH

SEQ ID NO: 919059 - protein, 9 aa, Mycobacterium
TGAAPGLSQ

SEQ ID NO: 919060 - protein, 8 aa, Mycobacterium
TGADALRS

SEQ ID NO: 919061 - protein, 16 aa, Mycobacterium
TGADAPSPFGGGSAAE

SEQ ID NO: 919062 - protein, 17 aa, Mycobacterium
TGADAVDGNGQKIKGAL

SEQ ID NO: 919063 - protein, 15 aa, Mycobacterium
TGADGAPGRNGGDGG

SEQ ID NO: 919064 - protein, 7 aa, Mycobacterium
TGADGYA

SEQ ID NO: 919065 - protein, 7 aa, Mycobacterium
TGADPGR

SEQ ID NO: 919066 - protein, 15 aa, Mycobacterium
TGADTADQAVPDDRR

SEQ ID NO: 919067 - protein, 9 aa, Mycobacterium
TGAEAASEA

SEQ ID NO: 919068 - protein, 9 aa, Mycobacterium
TGAEVRGST

SEQ ID NO: 919069 - protein, 11 aa, Mycobacterium
TGAGAAPDPTF

SEQ ID NO: 919070 - protein, 14 aa, Mycobacterium
TGAGATGAAAPPLL

SEQ ID NO: 919071 - protein, 6 aa, Mycobacterium
TGAGDD

SEQ ID NO: 919072 - protein, 8 aa, Mycobacterium
TGAGDVPV

SEQ ID NO: 919073 - protein, 9 aa, Mycobacterium
TGAGGSDAK

SEQ ID NO: 919074 - protein, 8 aa, Mycobacterium
TGAGGTAN

SEQ ID NO: 919075 - protein, 10 aa, Mycobacterium
TGAGGTDEYR

SEQ ID NO: 919076 - protein, 9 aa, Mycobacterium
TGAGSADEF

SEQ ID NO: 919077 - protein, 14 aa, Mycobacterium
TGAGSAPDPGFQPA

SEQ ID NO: 919078 - protein, 8 aa, Mycobacterium
TGAGSGIG

SEQ ID NO: 919079 - protein, 9 aa, Mycobacterium
TGAGSGIGQ

SEQ ID NO: 919080 - protein, 14 aa, Mycobacterium
TGAGSNDVGYSSRE

SEQ ID NO: 919081 - protein, 6 aa, Mycobacterium
TGAGSR

SEQ ID NO: 919082 - protein, 5 aa, Mycobacterium
TGAGV

SEQ ID NO: 919083 - protein, 15 aa, Mycobacterium
TGAHGDALGPSAPGY

SEQ ID NO: 919084 - protein, 4 aa, Mycobacterium
TGAI

SEQ ID NO: 919085 - protein, 17 aa, Mycobacterium
TGAKCPGSQAAAQTPDG

SEQ ID NO: 919086 - protein, 13 aa, Mycobacterium
TGAKSEKTETIDG

SEQ ID NO: 919087 - protein, 12 aa, Mycobacterium
TGALGAARAADC

SEQ ID NO: 919088 - protein, 14 aa, Mycobacterium
TGANPWKYGNRGPI

SEQ ID NO: 919089 - protein, 7 aa, Mycobacterium
TGAPDDY

SEQ ID NO: 919090 - protein, 12 aa, Mycobacterium
TGAPIGDTFTRW

SEQ ID NO: 919091 - protein, 6 aa, Mycobacterium
TGAPKL

SEQ ID NO: 919092 - protein, 16 aa, Mycobacterium
TGARAAGRDPGSLGKR

SEQ ID NO: 919093 - protein, 7 aa, Mycobacterium
TGARGQV

SEQ ID NO: 919094 - protein, 11 aa, Mycobacterium
TGASAAELKDR

SEQ ID NO: 919095 - protein, 9 aa, Mycobacterium
TGASAGLGA

SEQ ID NO: 919096 - protein, 5 aa, Mycobacterium
TGASG

SEQ ID NO: 919097 - protein, 9 aa, Mycobacterium
TGASQNIGE

SEQ ID NO: 919098 - protein, 8 aa, Mycobacterium
TGASRGLG

SEQ ID NO: 919099 - protein, 8 aa, Mycobacterium
TGASSGEI

SEQ ID NO: 919100 - protein, 8 aa, Mycobacterium
TGATHSQS

SEQ ID NO: 919101 - protein, 5 aa, Mycobacterium
TGATS

SEQ ID NO: 919102 - protein, 7 aa, Mycobacterium
TGATSAE

SEQ ID NO: 919103 - protein, 7 aa, Mycobacterium
TGATTAA

SEQ ID NO: 919104 - protein, 4 aa, Mycobacterium
TGAV

SEQ ID NO: 919105 - protein, 10 aa, Mycobacterium
TGAVDTTGGW

SEQ ID NO: 919106 - protein, 7 aa, Mycobacterium
TGAVTGT

SEQ ID NO: 919107 - protein, 8 aa, Mycobacterium
TGCGSGDS

SEQ ID NO: 919108 - protein, 17 aa, Mycobacterium
TGCRDAKPSPPASYCPA

SEQ ID NO: 919109 - protein, 33 aa, Mycobacterium
TGCSGPTVVTTEDAAQTTATSAAPTPTTGRPSN

SEQ ID NO: 919110 - protein, 14 aa, Mycobacterium
TGCSHRGRSPATKT

SEQ ID NO: 919111 - protein, 15 aa, Mycobacterium
TGCTTGDDAVSQGGT

SEQ ID NO: 919112 - protein, 19 aa, Mycobacterium
TGDAGDPAMAADPNSPAGK

SEQ ID NO: 919113 - protein, 17 aa, Mycobacterium
TGDAGNPAQATDPGSMA

SEQ ID NO: 919114 - protein, 6 aa, Mycobacterium
TGDAPR

SEQ ID NO: 919115 - protein, 8 aa, Mycobacterium
TGDAQLPA

SEQ ID NO: 919116 - protein, 10 aa, Mycobacterium
TGDATRHNID

SEQ ID NO: 919117 - protein, 17 aa, Mycobacterium
TGDDDKPGAAVTEAGPF

SEQ ID NO: 919118 - protein, 5 aa, Mycobacterium
TGDDG

SEQ ID NO: 919119 - protein, 7 aa, Mycobacterium
TGDDPLR

SEQ ID NO: 919120 - protein, 8 aa, Mycobacterium
TGDDQRGI

SEQ ID NO: 919121 - protein, 9 aa, Mycobacterium
TGDDRARAW

SEQ ID NO: 919122 - protein, 13 aa, Mycobacterium
TGDGAGARQAAEE

SEQ ID NO: 919123 - protein, 8 aa, Mycobacterium
TGDGANDA

SEQ ID NO: 919124 - protein, 9 aa, Mycobacterium
TGDGFGGGP

SEQ ID NO: 919125 - protein, 14 aa, Mycobacterium
TGDGPKGALCAVRH

SEQ ID NO: 919126 - protein, 4 aa, Mycobacterium
TGDH

SEQ ID NO: 919127 - protein, 12 aa, Mycobacterium
TGDHQAAKGAGN

SEQ ID NO: 919128 - protein, 6 aa, Mycobacterium
TGDLEK

SEQ ID NO: 919129 - protein, 19 aa, Mycobacterium
TGDLPTRSSVGDDQAVRDQ

SEQ ID NO: 919130 - protein, 21 aa, Mycobacterium
TGDLTTKPAVAAKGTAKTGGL

SEQ ID NO: 919131 - protein, 14 aa, Mycobacterium
TGDLTTNPTAAKGN

SEQ ID NO: 919132 - protein, 9 aa, Mycobacterium
TGDPAAATN

SEQ ID NO: 919133 - protein, 24 aa, Mycobacterium
TGDPAAEDQPEWPAYSASESSGRQ

SEQ ID NO: 919134 - protein, 8 aa, Mycobacterium
TGDPFDAQ

SEQ ID NO: 919135 - protein, 9 aa, Mycobacterium
TGDPGFPGI

SEQ ID NO: 919136 - protein, 5 aa, Mycobacterium
TGDPL

SEQ ID NO: 919137 - protein, 15 aa, Mycobacterium
TGDPNGGCGVASDAA

SEQ ID NO: 919138 - protein, 6 aa, Mycobacterium
TGDQAG

SEQ ID NO: 919139 - protein, 6 aa, Mycobacterium
TGDSEV

SEQ ID NO: 919140 - protein, 14 aa, Mycobacterium
TGDSTDLDATRNGF

SEQ ID NO: 919141 - protein, 9 aa, Mycobacterium
TGDTATADV

SEQ ID NO: 919142 - protein, 8 aa, Mycobacterium
TGDTATGS

SEQ ID NO: 919143 - protein, 20 aa, Mycobacterium
TGDTGAAAQLADDPEGARAA

SEQ ID NO: 919144 - protein, 4 aa, Mycobacterium
TGEA

SEQ ID NO: 919145 - protein, 9 aa, Mycobacterium
TGEAGSLNA

SEQ ID NO: 919146 - protein, 9 aa, Mycobacterium
TGEASPSGL

SEQ ID NO: 919147 - protein, 4 aa, Mycobacterium
TGED

SEQ ID NO: 919148 - protein, 14 aa, Mycobacterium
TGEDRGPKPEGAAG

SEQ ID NO: 919149 - protein, 4 aa, Mycobacterium
TGEG

SEQ ID NO: 919150 - protein, 5 aa, Mycobacterium
TGEGE

SEQ ID NO: 919151 - protein, 14 aa, Mycobacterium
TGEGPSESSLAPQF

SEQ ID NO: 919152 - protein, 6 aa, Mycobacterium
TGEGRA

SEQ ID NO: 919153 - protein, 14 aa, Mycobacterium
TGEGRGPKPDGQPG

SEQ ID NO: 919154 - protein, 9 aa, Mycobacterium
TGEKVTAES

SEQ ID NO: 919155 - protein, 7 aa, Mycobacterium
TGEPPAI

SEQ ID NO: 919156 - protein, 16 aa, Mycobacterium
TGEPPMPGQAPPIAND

SEQ ID NO: 919157 - protein, 11 aa, Mycobacterium
TGEQVAPGNLP

SEQ ID NO: 919158 - protein, 6 aa, Mycobacterium
TGERIP

SEQ ID NO: 919159 - protein, 19 aa, Mycobacterium
TGERLNEQAATNAFGTYTE

SEQ ID NO: 919160 - protein, 20 aa, Mycobacterium
TGERLNEQATTNAYGDYAER

SEQ ID NO: 919161 - protein, 7 aa, Mycobacterium
TGESRGA

SEQ ID NO: 919162 - protein, 9 aa, Mycobacterium
TGESSTGGI

SEQ ID NO: 919163 - protein, 4 aa, Mycobacterium
TGET

SEQ ID NO: 919164 - protein, 5 aa, Mycobacterium
TGETC

SEQ ID NO: 919165 - protein, 9 aa, Mycobacterium
TGETCGTVE

SEQ ID NO: 919166 - protein, 5 aa, Mycobacterium
TGEYD

SEQ ID NO: 919167 - protein, 6 aa, Mycobacterium
TGFETG

SEQ ID NO: 919168 - protein, 4 aa, Mycobacterium
TGFG

SEQ ID NO: 919169 - protein, 35 aa, Mycobacterium
TGFGNGGYHNTGFANGGSFNAGSFNSGNHNTGGFN

SEQ ID NO: 919170 - protein, 16 aa, Mycobacterium
TGFGPFDDAGHDGSQW

SEQ ID NO: 919171 - protein, 5 aa, Mycobacterium
TGFPN

SEQ ID NO: 919172 - protein, 8 aa, Mycobacterium
TGFQTGSS

SEQ ID NO: 919173 - protein, 16 aa, Mycobacterium
TGGAAGSGSSGSSAVD

SEQ ID NO: 919174 - protein, 6 aa, Mycobacterium
TGGAQG

SEQ ID NO: 919175 - protein, 4 aa, Mycobacterium
TGGC

SEQ ID NO: 919176 - protein, 8 aa, Mycobacterium
TGGDAARI

SEQ ID NO: 919177 - protein, 11 aa, Mycobacterium
TGGDFANPSGR

SEQ ID NO: 919178 - protein, 5 aa, Mycobacterium
TGGDK

SEQ ID NO: 919179 - protein, 6 aa, Mycobacterium
TGGDNR

SEQ ID NO: 919180 - protein, 43 aa, Mycobacterium
TGGDSTVSKTPTNTIASPSSTPPSPGQPSAPVKPKLPSTKDDC

SEQ ID NO: 919181 - protein, 20 aa, Mycobacterium
TGGDTDPHSYAASPSDAAAI

SEQ ID NO: 919182 - protein, 15 aa, Mycobacterium
TGGFPTASAFSKPGL

SEQ ID NO: 919183 - protein, 15 aa, Mycobacterium
TGGGAARPPIPGSEN

SEQ ID NO: 919184 - protein, 9 aa, Mycobacterium
TGGGNYASY

SEQ ID NO: 919185 - protein, 6 aa, Mycobacterium
TGGGRR

SEQ ID NO: 919186 - protein, 6 aa, Mycobacterium
TGGIRS

SEQ ID NO: 919187 - protein, 16 aa, Mycobacterium
TGGKINIGSGSSGGRQ

SEQ ID NO: 919188 - protein, 4 aa, Mycobacterium
TGGL

SEQ ID NO: 919189 - protein, 8 aa, Mycobacterium
TGGLPADK

SEQ ID NO: 919190 - protein, 6 aa, Mycobacterium
TGGLPL

SEQ ID NO: 919191 - protein, 10 aa, Mycobacterium
TGGNDSTSYY

SEQ ID NO: 919192 - protein, 11 aa, Mycobacterium
TGGNGQPQTAY

SEQ ID NO: 919193 - protein, 5 aa, Mycobacterium
TGGPG

SEQ ID NO: 919194 - protein, 10 aa, Mycobacterium
TGGPSHSQGL

SEQ ID NO: 919195 - protein, 4 aa, Mycobacterium
TGGR

SEQ ID NO: 919196 - protein, 6 aa, Mycobacterium
TGGSAI

SEQ ID NO: 919197 - protein, 15 aa, Mycobacterium
TGGSATASAFSRPGL

SEQ ID NO: 919198 - protein, 15 aa, Mycobacterium
TGGSVTAGAFSRPGL

SEQ ID NO: 919199 - protein, 6 aa, Mycobacterium
TGGTGS

SEQ ID NO: 919200 - protein, 20 aa, Mycobacterium
TGGTGTALANPDAGQQPDIP

SEQ ID NO: 919201 - protein, 31 aa, Mycobacterium
TGGTIATSTGADGVRRPSRSGAELTAAAGAD

SEQ ID NO: 919202 - protein, 5 aa, Mycobacterium
TGGTL

SEQ ID NO: 919203 - protein, 4 aa, Mycobacterium
TGHA

SEQ ID NO: 919204 - protein, 22 aa, Mycobacterium
TGHGAGSARAPIPPPHAPTVKP

SEQ ID NO: 919205 - protein, 11 aa, Mycobacterium
TGHPQGGGSEA

SEQ ID NO: 919206 - protein, 6 aa, Mycobacterium
TGHRTR

SEQ ID NO: 919207 - protein, 19 aa, Mycobacterium
TGIDAGARKVTSSSGQTYR

SEQ ID NO: 919208 - protein, 17 aa, Mycobacterium
TGIDTKVRESADPVTEL

SEQ ID NO: 919209 - protein, 4 aa, Mycobacterium
TGIP

SEQ ID NO: 919210 - protein, 4 aa, Mycobacterium
TGIT

SEQ ID NO: 919211 - protein, 6 aa, Mycobacterium
TGITSD

SEQ ID NO: 919212 - protein, 8 aa, Mycobacterium
TGKASHAS

SEQ ID NO: 919213 - protein, 9 aa, Mycobacterium
TGKASHASL

SEQ ID NO: 919214 - protein, 9 aa, Mycobacterium
TGKEPSERA

SEQ ID NO: 919215 - protein, 10 aa, Mycobacterium
TGKKPDGEPL

SEQ ID NO: 919216 - protein, 13 aa, Mycobacterium
TGKPTPERYAEAK

SEQ ID NO: 919217 - protein, 23 aa, Mycobacterium
TGKSGSATLKTRPDLNPEGPTTL

SEQ ID NO: 919218 - protein, 23 aa, Mycobacterium
TGKSGSVTLKPRPDMNPNGPTTL

SEQ ID NO: 919219 - protein, 23 aa, Mycobacterium
TGKSGSVTLKPRSDINPEGPTTL

SEQ ID NO: 919220 - protein, 9 aa, Mycobacterium
TGKYDGTYT

SEQ ID NO: 919221 - protein, 6 aa, Mycobacterium
TGLAPD

SEQ ID NO: 919222 - protein, 13 aa, Mycobacterium
TGLDEHESPGEAT

SEQ ID NO: 919223 - protein, 10 aa, Mycobacterium
TGLGGAASKQ

SEQ ID NO: 919224 - protein, 7 aa, Mycobacterium
TGLGSSE

SEQ ID NO: 919225 - protein, 7 aa, Mycobacterium
TGLGSTE

SEQ ID NO: 919226 - protein, 6 aa, Mycobacterium
TGLNRN

SEQ ID NO: 919227 - protein, 4 aa, Mycobacterium
TGLP

SEQ ID NO: 919228 - protein, 8 aa, Mycobacterium
TGLPANDP

SEQ ID NO: 919229 - protein, 21 aa, Mycobacterium
TGLPGDTPEAPPPPPPPARIP

SEQ ID NO: 919230 - protein, 5 aa, Mycobacterium
TGLPS

SEQ ID NO: 919231 - protein, 8 aa, Mycobacterium
TGLRDGDD

SEQ ID NO: 919232 - protein, 9 aa, Mycobacterium
TGLSPKVSA

SEQ ID NO: 919233 - protein, 8 aa, Mycobacterium
TGLYGNSK

SEQ ID NO: 919234 - protein, 6 aa, Mycobacterium
TGLYNG

SEQ ID NO: 919235 - protein, 13 aa, Mycobacterium
TGMGPPPGKELGG

SEQ ID NO: 919236 - protein, 9 aa, Mycobacterium
TGMPAAGDL

SEQ ID NO: 919237 - protein, 9 aa, Mycobacterium
TGNAGGGVG

SEQ ID NO: 919238 - protein, 6 aa, Mycobacterium
TGNAPL

SEQ ID NO: 919239 - protein, 5 aa, Mycobacterium
TGNDH

SEQ ID NO: 919240 - protein, 12 aa, Mycobacterium
TGNDPPTDPGGM

SEQ ID NO: 919241 - protein, 13 aa, Mycobacterium
TGNFRGKDDTETV

SEQ ID NO: 919242 - protein, 5 aa, Mycobacterium
TGNGH

SEQ ID NO: 919243 - protein, 7 aa, Mycobacterium
TGNGYHG

SEQ ID NO: 919244 - protein, 19 aa, Mycobacterium
TGNLAQQNDSLDKAITNTR

SEQ ID NO: 919245 - protein, 6 aa, Mycobacterium
TGNLTG

SEQ ID NO: 919246 - protein, 7 aa, Mycobacterium
TGNPAGD

SEQ ID NO: 919247 - protein, 12 aa, Mycobacterium
TGNPNVEGQPEW

SEQ ID NO: 919248 - protein, 14 aa, Mycobacterium
TGNSGGLGTQQTGV

SEQ ID NO: 919249 - protein, 6 aa, Mycobacterium
TGNVDP

SEQ ID NO: 919250 - protein, 16 aa, Mycobacterium
TGPADEEFGPDAAGTF

SEQ ID NO: 919251 - protein, 7 aa, Mycobacterium
TGPAGQA

SEQ ID NO: 919252 - protein, 9 aa, Mycobacterium
TGPALDDPG

SEQ ID NO: 919253 - protein, 9 aa, Mycobacterium
TGPAPTTVT

SEQ ID NO: 919254 - protein, 41 aa, Mycobacterium
TGPDGKVDEAGSLGEASRTCGADKGDEQSPQYGIGPGGTGW

SEQ ID NO: 919255 - protein, 10 aa, Mycobacterium
TGPDSPNKTL

SEQ ID NO: 919256 - protein, 7 aa, Mycobacterium
TGPEPTT

SEQ ID NO: 919257 - protein, 11 aa, Mycobacterium
TGPETHEEGRH

SEQ ID NO: 919258 - protein, 9 aa, Mycobacterium
TGPETPERY

SEQ ID NO: 919259 - protein, 10 aa, Mycobacterium
TGPGGTALAS

SEQ ID NO: 919260 - protein, 12 aa, Mycobacterium
TGPGGTAVGSEK

SEQ ID NO: 919261 - protein, 9 aa, Mycobacterium
TGPGQPERS

SEQ ID NO: 919262 - protein, 10 aa, Mycobacterium
TGPGQPQRSM

SEQ ID NO: 919263 - protein, 6 aa, Mycobacterium
TGPGQV

SEQ ID NO: 919264 - protein, 5 aa, Mycobacterium
TGPGS

SEQ ID NO: 919265 - protein, 5 aa, Mycobacterium
TGPGY

SEQ ID NO: 919266 - protein, 9 aa, Mycobacterium
TGPHNYTDD

SEQ ID NO: 919267 - protein, 10 aa, Mycobacterium
TGPKPSVADA

SEQ ID NO: 919268 - protein, 10 aa, Mycobacterium
TGPLASASDY

SEQ ID NO: 919269 - protein, 4 aa, Mycobacterium
TGPN

SEQ ID NO: 919270 - protein, 5 aa, Mycobacterium
TGPNR

SEQ ID NO: 919271 - protein, 10 aa, Mycobacterium
TGPNSDSYSR

SEQ ID NO: 919272 - protein, 9 aa, Mycobacterium
TGPPGATAN

SEQ ID NO: 919273 - protein, 7 aa, Mycobacterium
TGPPGSL

SEQ ID NO: 919274 - protein, 8 aa, Mycobacterium
TGPPPDHK

SEQ ID NO: 919275 - protein, 8 aa, Mycobacterium
TGPPPDNQ

SEQ ID NO: 919276 - protein, 7 aa, Mycobacterium
TGPPPNG

SEQ ID NO: 919277 - protein, 9 aa, Mycobacterium
TGPPPSPIE

SEQ ID NO: 919278 - protein, 10 aa, Mycobacterium
TGPPRPGAQR

SEQ ID NO: 919279 - protein, 9 aa, Mycobacterium
TGPRPEMDK

SEQ ID NO: 919280 - protein, 9 aa, Mycobacterium
TGPRPGGFG

SEQ ID NO: 919281 - protein, 19 aa, Mycobacterium
TGPRPGGFGELNDRTNQIC

SEQ ID NO: 919282 - protein, 20 aa, Mycobacterium
TGPTMAPGWDPADVDNGDIA

SEQ ID NO: 919283 - protein, 20 aa, Mycobacterium
TGPTMAPGWDPADVGNGDIA

SEQ ID NO: 919284 - protein, 6 aa, Mycobacterium
TGPVDT

SEQ ID NO: 919285 - protein, 15 aa, Mycobacterium
TGPVPQAAAYSRDGL

SEQ ID NO: 919286 - protein, 9 aa, Mycobacterium
TGQADQARQ

SEQ ID NO: 919287 - protein, 10 aa, Mycobacterium
TGQAHRNGAA

SEQ ID NO: 919288 - protein, 13 aa, Mycobacterium
TGQARTGALRGRD

SEQ ID NO: 919289 - protein, 6 aa, Mycobacterium
TGQEQQ

SEQ ID NO: 919290 - protein, 7 aa, Mycobacterium
TGQGPTV

SEQ ID NO: 919291 - protein, 5 aa, Mycobacterium
TGQIR

SEQ ID NO: 919292 - protein, 4 aa, Mycobacterium
TGQL

SEQ ID NO: 919293 - protein, 13 aa, Mycobacterium
TGQLVSNGNEQSI

SEQ ID NO: 919294 - protein, 5 aa, Mycobacterium
TGQPF

SEQ ID NO: 919295 - protein, 23 aa, Mycobacterium
TGQPGDSGNGGNGGTGAGGGPGG

SEQ ID NO: 919296 - protein, 7 aa, Mycobacterium
TGQPQDA

SEQ ID NO: 919297 - protein, 6 aa, Mycobacterium
TGQPRA

SEQ ID NO: 919298 - protein, 11 aa, Mycobacterium
TGQPVAPESVP

SEQ ID NO: 919299 - protein, 5 aa, Mycobacterium
TGQQI

SEQ ID NO: 919300 - protein, 6 aa, Mycobacterium
TGQTKY

SEQ ID NO: 919301 - protein, 5 aa, Mycobacterium
TGRAM

SEQ ID NO: 919302 - protein, 10 aa, Mycobacterium
TGRAQTFSGT

SEQ ID NO: 919303 - protein, 5 aa, Mycobacterium
TGRAT

SEQ ID NO: 919304 - protein, 5 aa, Mycobacterium
TGRDR

SEQ ID NO: 919305 - protein, 9 aa, Mycobacterium
TGREADDLT

SEQ ID NO: 919306 - protein, 8 aa, Mycobacterium
TGREEDVA

SEQ ID NO: 919307 - protein, 7 aa, Mycobacterium
TGRGART

SEQ ID NO: 919308 - protein, 16 aa, Mycobacterium
TGRGSNGVESKQVSSF

SEQ ID NO: 919309 - protein, 7 aa, Mycobacterium
TGRGTRL

SEQ ID NO: 919310 - protein, 15 aa, Mycobacterium
TGRPGELGGGGDVPG

SEQ ID NO: 919311 - protein, 8 aa, Mycobacterium
TGRPGRNL

SEQ ID NO: 919312 - protein, 7 aa, Mycobacterium
TGRPSTD

SEQ ID NO: 919313 - protein, 12 aa, Mycobacterium
TGRRAASAYEAE

SEQ ID NO: 919314 - protein, 7 aa, Mycobacterium
TGRRGIR

SEQ ID NO: 919315 - protein, 13 aa, Mycobacterium
TGRRPPTPAEEAD

SEQ ID NO: 919316 - protein, 12 aa, Mycobacterium
TGRRSRRRARRC

SEQ ID NO: 919317 - protein, 11 aa, Mycobacterium
TGRSGTKAFAD

SEQ ID NO: 919318 - protein, 10 aa, Mycobacterium
TGRSGTSAFR

SEQ ID NO: 919319 - protein, 10 aa, Mycobacterium
TGRTPGNIDD

SEQ ID NO: 919320 - protein, 7 aa, Mycobacterium
TGRTPPL

SEQ ID NO: 919321 - protein, 14 aa, Mycobacterium
TGRTPRRWPSNMKS

SEQ ID NO: 919322 - protein, 23 aa, Mycobacterium
TGRVPNADNAAQRVENGIGQGTV

SEQ ID NO: 919323 - protein, 17 aa, Mycobacterium
TGSAGSYAGAEAANVSP

SEQ ID NO: 919324 - protein, 9 aa, Mycobacterium
TGSALPSAP

SEQ ID NO: 919325 - protein, 15 aa, Mycobacterium
TGSASRRLPIPGADA

SEQ ID NO: 919326 - protein, 17 aa, Mycobacterium
TGSASRRLPIPGADASG

SEQ ID NO: 919327 - protein, 18 aa, Mycobacterium
TGSASRRPPIPGADSPGV

SEQ ID NO: 919328 - protein, 25 aa, Mycobacterium
TGSERHRRAGGSGSFPAGAGGDLHP

SEQ ID NO: 919329 - protein, 4 aa, Mycobacterium
TGSG

SEQ ID NO: 919330 - protein, 11 aa, Mycobacterium
TGSGRRDQPYQ

SEQ ID NO: 919331 - protein, 26 aa, Mycobacterium
TGSHGAGARPPVPPPRPPTVKPGVTP

SEQ ID NO: 919332 - protein, 11 aa, Mycobacterium
TGSLGAAGREL

SEQ ID NO: 919333 - protein, 9 aa, Mycobacterium
TGSLGGAAR

SEQ ID NO: 919334 - protein, 8 aa, Mycobacterium
TGSLGRAA

SEQ ID NO: 919335 - protein, 6 aa, Mycobacterium
TGSLTG

SEQ ID NO: 919336 - protein, 9 aa, Mycobacterium
TGSLTGTNA

SEQ ID NO: 919337 - protein, 6 aa, Mycobacterium
TGSLTN

SEQ ID NO: 919338 - protein, 4 aa, Mycobacterium
TGSP

SEQ ID NO: 919339 - protein, 23 aa, Mycobacterium
TGSPAPAGTNEHREGASESEGLA

SEQ ID NO: 919340 - protein, 23 aa, Mycobacterium
TGSPAPSEGNGHQEGVPGAQGLT

SEQ ID NO: 919341 - protein, 11 aa, Mycobacterium
TGSPPAPPKSL

SEQ ID NO: 919342 - protein, 11 aa, Mycobacterium
TGSPPPSPKTL

SEQ ID NO: 919343 - protein, 30 aa, Mycobacterium
TGSPSPAAPSGEDHGGGHGAGAAGAGETLT

SEQ ID NO: 919344 - protein, 21 aa, Mycobacterium
TGSPSPSGAKAAEAGPAEVPT

SEQ ID NO: 919345 - protein, 19 aa, Mycobacterium
TGSQHAGTSGFAGTTASKA

SEQ ID NO: 919346 - protein, 17 aa, Mycobacterium
TGSSSRRPPIPGSDAES

SEQ ID NO: 919347 - protein, 28 aa, Mycobacterium
TGSTAPATAGEHGGHGGGEQPVPAGEKL

SEQ ID NO: 919348 - protein, 8 aa, Mycobacterium
TGSTTELG

SEQ ID NO: 919349 - protein, 14 aa, Mycobacterium
TGSVPELEAATTAT

SEQ ID NO: 919350 - protein, 19 aa, Mycobacterium
TGSVTGSGSTTLSGGTLEA

SEQ ID NO: 919351 - protein, 4 aa, Mycobacterium
TGTA

SEQ ID NO: 919352 - protein, 12 aa, Mycobacterium
TGTADGSKVVDD

SEQ ID NO: 919353 - protein, 9 aa, Mycobacterium
TGTAHAGLD

SEQ ID NO: 919354 - protein, 6 aa, Mycobacterium
TGTAPQ

SEQ ID NO: 919355 - protein, 25 aa, Mycobacterium
TGTARSAATTGSAGATGTPADTEEA

SEQ ID NO: 919356 - protein, 9 aa, Mycobacterium
TGTASGKSL

SEQ ID NO: 919357 - protein, 4 aa, Mycobacterium
TGTD

SEQ ID NO: 919358 - protein, 17 aa, Mycobacterium
TGTGGNAGAANDPNSLA

SEQ ID NO: 919359 - protein, 6 aa, Mycobacterium
TGTGHL

SEQ ID NO: 919360 - protein, 7 aa, Mycobacterium
TGTGSSA

SEQ ID NO: 919361 - protein, 6 aa, Mycobacterium
TGTGWQ

SEQ ID NO: 919362 - protein, 7 aa, Mycobacterium
TGTISVD

SEQ ID NO: 919363 - protein, 14 aa, Mycobacterium
TGTITADGKVGPIG

SEQ ID NO: 919364 - protein, 14 aa, Mycobacterium
TGTITADGKVGQIG

SEQ ID NO: 919365 - protein, 6 aa, Mycobacterium
TGTKIT

SEQ ID NO: 919366 - protein, 11 aa, Mycobacterium
TGTNGKSTTTR

SEQ ID NO: 919367 - protein, 8 aa, Mycobacterium
TGTPDEVA

SEQ ID NO: 919368 - protein, 7 aa, Mycobacterium
TGTPEDY

SEQ ID NO: 919369 - protein, 8 aa, Mycobacterium
TGTPRQVG

SEQ ID NO: 919370 - protein, 15 aa, Mycobacterium
TGTPSDLDSGTPGQN

SEQ ID NO: 919371 - protein, 15 aa, Mycobacterium
TGTPSELDAGVSGGN

SEQ ID NO: 919372 - protein, 5 aa, Mycobacterium
TGTPT

SEQ ID NO: 919373 - protein, 8 aa, Mycobacterium
TGTQHGTV

SEQ ID NO: 919374 - protein, 7 aa, Mycobacterium
TGTQIGR

SEQ ID NO: 919375 - protein, 4 aa, Mycobacterium
TGTR

SEQ ID NO: 919376 - protein, 8 aa, Mycobacterium
TGTREVSN

SEQ ID NO: 919377 - protein, 10 aa, Mycobacterium
TGTSGKTTTT

SEQ ID NO: 919378 - protein, 11 aa, Mycobacterium
TGTSGKTTTTY

SEQ ID NO: 919379 - protein, 19 aa, Mycobacterium
TGTTGGAVPAKTAGPALAA

SEQ ID NO: 919380 - protein, 20 aa, Mycobacterium
TGTTGSVAVTGSTDTTAPRI

SEQ ID NO: 919381 - protein, 8 aa, Mycobacterium
TGTTVVPD

SEQ ID NO: 919382 - protein, 4 aa, Mycobacterium
TGTV

SEQ ID NO: 919383 - protein, 9 aa, Mycobacterium
TGTVPEPGN

SEQ ID NO: 919384 - protein, 24 aa, Mycobacterium
TGTYSDPPKTALEEDTATRSDYTL

SEQ ID NO: 919385 - protein, 11 aa, Mycobacterium
TGVASAEPDIT

SEQ ID NO: 919386 - protein, 9 aa, Mycobacterium
TGVETSDRQ

SEQ ID NO: 919387 - protein, 5 aa, Mycobacterium
TGVGN

SEQ ID NO: 919388 - protein, 9 aa, Mycobacterium
TGVGNNSGL

SEQ ID NO: 919389 - protein, 4 aa, Mycobacterium
TGVK

SEQ ID NO: 919390 - protein, 9 aa, Mycobacterium
TGVKNPDYA

SEQ ID NO: 919391 - protein, 10 aa, Mycobacterium
TGVKNPEYSD

SEQ ID NO: 919392 - protein, 6 aa, Mycobacterium
TGVPAA

SEQ ID NO: 919393 - protein, 24 aa, Mycobacterium
TGVPASQLQQTATQLAEASGPMQQ

SEQ ID NO: 919394 - protein, 6 aa, Mycobacterium
TGVPDT

SEQ ID NO: 919395 - protein, 10 aa, Mycobacterium
TGVRDDGAKV

SEQ ID NO: 919396 - protein, 10 aa, Mycobacterium
TGVRRDEHGY

SEQ ID NO: 919397 - protein, 5 aa, Mycobacterium
TGVRT

SEQ ID NO: 919398 - protein, 7 aa, Mycobacterium
TGVSNGY

SEQ ID NO: 919399 - protein, 4 aa, Mycobacterium
TGWG

SEQ ID NO: 919400 - protein, 5 aa, Mycobacterium
TGYAP

SEQ ID NO: 919401 - protein, 8 aa, Mycobacterium
TGYDRTYE

SEQ ID NO: 919402 - protein, 5 aa, Mycobacterium
TGYPL

SEQ ID NO: 919403 - protein, 4 aa, Mycobacterium
TGYR

SEQ ID NO: 919404 - protein, 4 aa, Mycobacterium
TGYV

SEQ ID NO: 919405 - protein, 10 aa, Mycobacterium
THADERDTQQ

SEQ ID NO: 919406 - protein, 5 aa, Mycobacterium
THAEH

SEQ ID NO: 919407 - protein, 5 aa, Mycobacterium
THAPD

SEQ ID NO: 919408 - protein, 5 aa, Mycobacterium
THDGM

SEQ ID NO: 919409 - protein, 17 aa, Mycobacterium
THDPAPAEQSPTAAPGF

SEQ ID NO: 919410 - protein, 10 aa, Mycobacterium
THDPATPYEA

SEQ ID NO: 919411 - protein, 10 aa, Mycobacterium
THDPATPYQA

SEQ ID NO: 919412 - protein, 9 aa, Mycobacterium
THDPSRPPR

SEQ ID NO: 919413 - protein, 8 aa, Mycobacterium
THDSSGRV

SEQ ID NO: 919414 - protein, 9 aa, Mycobacterium
THEPQPPTR

SEQ ID NO: 919415 - protein, 8 aa, Mycobacterium
THGGLSPL

SEQ ID NO: 919416 - protein, 15 aa, Mycobacterium
THGNVAKYTPKCRGI

SEQ ID NO: 919417 - protein, 12 aa, Mycobacterium
THGPYGGRDGGC

SEQ ID NO: 919418 - protein, 14 aa, Mycobacterium
THGQGRANQAVTGT

SEQ ID NO: 919419 - protein, 10 aa, Mycobacterium
THGQGRANQV

SEQ ID NO: 919420 - protein, 5 aa, Mycobacterium
THGRT

SEQ ID NO: 919421 - protein, 8 aa, Mycobacterium
THGTPATI

SEQ ID NO: 919422 - protein, 5 aa, Mycobacterium
THGVP

SEQ ID NO: 919423 - protein, 5 aa, Mycobacterium
THNAT

SEQ ID NO: 919424 - protein, 13 aa, Mycobacterium
THNDNSLADPSPF

SEQ ID NO: 919425 - protein, 6 aa, Mycobacterium
THNPGF

SEQ ID NO: 919426 - protein, 9 aa, Mycobacterium
THPAGAPQR

SEQ ID NO: 919427 - protein, 8 aa, Mycobacterium
THPDAPGE

SEQ ID NO: 919428 - protein, 38 aa, Mycobacterium
THPDPKVSAALKDSSYRLKTTTAEQIASRADPWDPGSV

SEQ ID NO: 919429 - protein, 12 aa, Mycobacterium
THPENYPTTLGD

SEQ ID NO: 919430 - protein, 6 aa, Mycobacterium
THPEVN

SEQ ID NO: 919431 - protein, 6 aa, Mycobacterium
THPGAN

SEQ ID NO: 919432 - protein, 11 aa, Mycobacterium
THPNYPDRHEP

SEQ ID NO: 919433 - protein, 13 aa, Mycobacterium
THPNYPDRHEPGH

SEQ ID NO: 919434 - protein, 6 aa, Mycobacterium
THPTTG

SEQ ID NO: 919435 - protein, 9 aa, Mycobacterium
THQAPGLGD

SEQ ID NO: 919436 - protein, 6 aa, Mycobacterium
THSPEN

SEQ ID NO: 919437 - protein, 6 aa, Mycobacterium
THSPQN

SEQ ID NO: 919438 - protein, 8 aa, Mycobacterium
THSTVSSQ

SEQ ID NO: 919439 - protein, 9 aa, Mycobacterium
THTDSEAWR

SEQ ID NO: 919440 - protein, 12 aa, Mycobacterium
THTTNANGHSVI

SEQ ID NO: 919441 - protein, 12 aa, Mycobacterium
TIARDGEVTPPI

SEQ ID NO: 919442 - protein, 7 aa, Mycobacterium
TIDGEGR

SEQ ID NO: 919443 - protein, 9 aa, Mycobacterium
TIDNDTKQM

SEQ ID NO: 919444 - protein, 20 aa, Mycobacterium
TIDPGNAADYRASAATFGRR

SEQ ID NO: 919445 - protein, 13 aa, Mycobacterium
TIGGEPDAARTDY

SEQ ID NO: 919446 - protein, 4 aa, Mycobacterium
TIGP

SEQ ID NO: 919447 - protein, 6 aa, Mycobacterium
TIGPDG

SEQ ID NO: 919448 - protein, 14 aa, Mycobacterium
TIGPGQKGLSDNGY

SEQ ID NO: 919449 - protein, 6 aa, Mycobacterium
TIGSPD

SEQ ID NO: 919450 - protein, 11 aa, Mycobacterium
TIGVGSGTNQE

SEQ ID NO: 919451 - protein, 8 aa, Mycobacterium
TINAGNQH

SEQ ID NO: 919452 - protein, 10 aa, Mycobacterium
TINAQQKDLD

SEQ ID NO: 919453 - protein, 11 aa, Mycobacterium
TINSRGAKDTT

SEQ ID NO: 919454 - protein, 4 aa, Mycobacterium
TIPA

SEQ ID NO: 919455 - protein, 11 aa, Mycobacterium
TIPADKASYGS

SEQ ID NO: 919456 - protein, 13 aa, Mycobacterium
TIPGEPTDTTRTD

SEQ ID NO: 919457 - protein, 7 aa, Mycobacterium
TIPGGKQ

SEQ ID NO: 919458 - protein, 21 aa, Mycobacterium
TIPGSKRPASYQGGSQTQISG

SEQ ID NO: 919459 - protein, 17 aa, Mycobacterium
TIPGTEVAEQGAPGMPG

SEQ ID NO: 919460 - protein, 6 aa, Mycobacterium
TIPPEA

SEQ ID NO: 919461 - protein, 7 aa, Mycobacterium
TIPPQGS

SEQ ID NO: 919462 - protein, 10 aa, Mycobacterium
TIPQQIPETQ

SEQ ID NO: 919463 - protein, 7 aa, Mycobacterium
TIPTSDR

SEQ ID NO: 919464 - protein, 7 aa, Mycobacterium
TISGAGP

SEQ ID NO: 919465 - protein, 6 aa, Mycobacterium
TISRQQ

SEQ ID NO: 919466 - protein, 17 aa, Mycobacterium
TISTATGADGVHRPAYG

SEQ ID NO: 919467 - protein, 22 aa, Mycobacterium
TISTSSDADGVKRPTRSGADLT

SEQ ID NO: 919468 - protein, 8 aa, Mycobacterium
TITSRGPH

SEQ ID NO: 919469 - protein, 6 aa, Mycobacterium
TKAGIP

SEQ ID NO: 919470 - protein, 14 aa, Mycobacterium
TKAQETFKAQQTEL

SEQ ID NO: 919471 - protein, 5 aa, Mycobacterium
TKATV

SEQ ID NO: 919472 - protein, 10 aa, Mycobacterium
TKDEPTAQDI

SEQ ID NO: 919473 - protein, 8 aa, Mycobacterium
TKDGQTYA

SEQ ID NO: 919474 - protein, 10 aa, Mycobacterium
TKDGTLTGPN

SEQ ID NO: 919475 - protein, 9 aa, Mycobacterium
TKDQAGEMS

SEQ ID NO: 919476 - protein, 4 aa, Mycobacterium
TKDS

SEQ ID NO: 919477 - protein, 34 aa, Mycobacterium
TKEDKSYTVTGTGQATTPGQSGTRPVTFGVHVTC

SEQ ID NO: 919478 - protein, 8 aa, Mycobacterium
TKEDNAVA

SEQ ID NO: 919479 - protein, 6 aa, Mycobacterium
TKEEQI

SEQ ID NO: 919480 - protein, 8 aa, Mycobacterium
TKEGNKYF

SEQ ID NO: 919481 - protein, 16 aa, Mycobacterium
TKEGVAARTGDQLTSA

SEQ ID NO: 919482 - protein, 7 aa, Mycobacterium
TKEKHGI

SEQ ID NO: 919483 - protein, 9 aa, Mycobacterium
TKESAEATA

SEQ ID NO: 919484 - protein, 12 aa, Mycobacterium
TKETIETGAQPA

SEQ ID NO: 919485 - protein, 6 aa, Mycobacterium
TKFTTS

SEQ ID NO: 919486 - protein, 14 aa, Mycobacterium
TKGGGYPSGGEVYL

SEQ ID NO: 919487 - protein, 8 aa, Mycobacterium
TKGQWTEP

SEQ ID NO: 919488 - protein, 11 aa, Mycobacterium
TKISGEEETFS

SEQ ID NO: 919489 - protein, 5 aa, Mycobacterium
TKITS

SEQ ID NO: 919490 - protein, 10 aa, Mycobacterium
TKKDYDAATP

SEQ ID NO: 919491 - protein, 4 aa, Mycobacterium
TKKP

SEQ ID NO: 919492 - protein, 8 aa, Mycobacterium
TKLADQVA

SEQ ID NO: 919493 - protein, 15 aa, Mycobacterium
TKLPKNATAKIGQTS

SEQ ID NO: 919494 - protein, 10 aa, Mycobacterium
TKNATAPAHR

SEQ ID NO: 919495 - protein, 10 aa, Mycobacterium
TKNDDPAGAC

SEQ ID NO: 919496 - protein, 6 aa, Mycobacterium
TKNSEV

SEQ ID NO: 919497 - protein, 19 aa, Mycobacterium
TKNSGGDMTQPKLDAAATA

SEQ ID NO: 919498 - protein, 20 aa, Mycobacterium
TKNTSGAATSPRVNPDSPRI

SEQ ID NO: 919499 - protein, 19 aa, Mycobacterium
TKPADTKNPNSGQGTSQAD

SEQ ID NO: 919500 - protein, 5 aa, Mycobacterium
TKPAL

SEQ ID NO: 919501 - protein, 18 aa, Mycobacterium
TKPDLTPVTDADRAVETD

SEQ ID NO: 919502 - protein, 18 aa, Mycobacterium
TKPDLTPVTDADRAVETE

SEQ ID NO: 919503 - protein, 4 aa, Mycobacterium
TKPG

SEQ ID NO: 919504 - protein, 6 aa, Mycobacterium
TKPGLR

SEQ ID NO: 919505 - protein, 7 aa, Mycobacterium
TKPGVDP

SEQ ID NO: 919506 - protein, 6 aa, Mycobacterium
TKPGVR

SEQ ID NO: 919507 - protein, 21 aa, Mycobacterium
TKPTEIPQTTTAPTVSDQEQI

SEQ ID NO: 919508 - protein, 14 aa, Mycobacterium
TKPTQSEPRPMRAG

SEQ ID NO: 919509 - protein, 16 aa, Mycobacterium
TKPTRPPANPAALTPA

SEQ ID NO: 919510 - protein, 5 aa, Mycobacterium
TKRGD

SEQ ID NO: 919511 - protein, 5 aa, Mycobacterium
TKRRG

SEQ ID NO: 919512 - protein, 4 aa, Mycobacterium
TKSA

SEQ ID NO: 919513 - protein, 9 aa, Mycobacterium
TKSDAAETI

SEQ ID NO: 919514 - protein, 10 aa, Mycobacterium
TKSDYDSATP

SEQ ID NO: 919515 - protein, 21 aa, Mycobacterium
TKSEAGRRVDEAADLGERQAL

SEQ ID NO: 919516 - protein, 9 aa, Mycobacterium
TKSEKLTAG

SEQ ID NO: 919517 - protein, 10 aa, Mycobacterium
TKSSPGPRVG

SEQ ID NO: 919518 - protein, 7 aa, Mycobacterium
TKSTAAD

SEQ ID NO: 919519 - protein, 5 aa, Mycobacterium
TKTEP

SEQ ID NO: 919520 - protein, 7 aa, Mycobacterium
TKTIDEL

SEQ ID NO: 919521 - protein, 6 aa, Mycobacterium
TKTNPQ

SEQ ID NO: 919522 - protein, 8 aa, Mycobacterium
TKTPEFEG

SEQ ID NO: 919523 - protein, 5 aa, Mycobacterium
TKTPV

SEQ ID NO: 919524 - protein, 11 aa, Mycobacterium
TKVATPDGKTI

SEQ ID NO: 919525 - protein, 4 aa, Mycobacterium
TKVE

SEQ ID NO: 919526 - protein, 9 aa, Mycobacterium
TKVTPAEEA

SEQ ID NO: 919527 - protein, 5 aa, Mycobacterium
TLAEL

SEQ ID NO: 919528 - protein, 23 aa, Mycobacterium
TLAGATSATPISAISTSGREIPA

SEQ ID NO: 919529 - protein, 5 aa, Mycobacterium
TLAGK

SEQ ID NO: 919530 - protein, 10 aa, Mycobacterium
TLAGPARRGE

SEQ ID NO: 919531 - protein, 8 aa, Mycobacterium
TLAGSDRP

SEQ ID NO: 919532 - protein, 13 aa, Mycobacterium
TLAPNGDVSPPIR

SEQ ID NO: 919533 - protein, 8 aa, Mycobacterium
TLAREGES

SEQ ID NO: 919534 - protein, 13 aa, Mycobacterium
TLASGGKWCPPNP

SEQ ID NO: 919535 - protein, 12 aa, Mycobacterium
TLASGGTWCPPN

SEQ ID NO: 919536 - protein, 13 aa, Mycobacterium
TLASGGTWCPPNP

SEQ ID NO: 919537 - protein, 9 aa, Mycobacterium
TLASPEKID

SEQ ID NO: 919538 - protein, 9 aa, Mycobacterium
TLASTGTAY

SEQ ID NO: 919539 - protein, 13 aa, Mycobacterium
TLAWPGDTADEQA

SEQ ID NO: 919540 - protein, 12 aa, Mycobacterium
TLDAHGAAPSAV

SEQ ID NO: 919541 - protein, 9 aa, Mycobacterium
TLDDQSDDI

SEQ ID NO: 919542 - protein, 8 aa, Mycobacterium
TLDNEGNT

SEQ ID NO: 919543 - protein, 19 aa, Mycobacterium
TLDSGAPLTGHRETDEPDF

SEQ ID NO: 919544 - protein, 8 aa, Mycobacterium
TLDTEQRD

SEQ ID NO: 919545 - protein, 7 aa, Mycobacterium
TLEPNSP

SEQ ID NO: 919546 - protein, 9 aa, Mycobacterium
TLEPQNSRD

SEQ ID NO: 919547 - protein, 7 aa, Mycobacterium
TLESNSP

SEQ ID NO: 919548 - protein, 4 aa, Mycobacterium
TLET

SEQ ID NO: 919549 - protein, 14 aa, Mycobacterium
TLGADSPDAQSGSI

SEQ ID NO: 919550 - protein, 14 aa, Mycobacterium
TLGGESPDAQSGSI

SEQ ID NO: 919551 - protein, 16 aa, Mycobacterium
TLGGGGDGIAATTTAQ

SEQ ID NO: 919552 - protein, 9 aa, Mycobacterium
TLGGSGAVN

SEQ ID NO: 919553 - protein, 7 aa, Mycobacterium
TLGNGGW

SEQ ID NO: 919554 - protein, 7 aa, Mycobacterium
TLGPPAV

SEQ ID NO: 919555 - protein, 6 aa, Mycobacterium
TLGPVA

SEQ ID NO: 919556 - protein, 8 aa, Mycobacterium
TLHDPYTN

SEQ ID NO: 919557 - protein, 4 aa, Mycobacterium
TLHS

SEQ ID NO: 919558 - protein, 15 aa, Mycobacterium
TLKGAARSLDGVGPG

SEQ ID NO: 919559 - protein, 10 aa, Mycobacterium
TLKPSNQTKV

SEQ ID NO: 919560 - protein, 9 aa, Mycobacterium
TLKSSKPPL

SEQ ID NO: 919561 - protein, 9 aa, Mycobacterium
TLKSSKPPV

SEQ ID NO: 919562 - protein, 10 aa, Mycobacterium
TLNTPEAKRA

SEQ ID NO: 919563 - protein, 5 aa, Mycobacterium
TLPAD

SEQ ID NO: 919564 - protein, 9 aa, Mycobacterium
TLPAPGLNP

SEQ ID NO: 919565 - protein, 6 aa, Mycobacterium
TLPDGR

SEQ ID NO: 919566 - protein, 25 aa, Mycobacterium
TLPDGTSVASGEGGGVRIGGGGAYQ

SEQ ID NO: 919567 - protein, 8 aa, Mycobacterium
TLPGPLKT

SEQ ID NO: 919568 - protein, 8 aa, Mycobacterium
TLPGPVPS

SEQ ID NO: 919569 - protein, 9 aa, Mycobacterium
TLPGRGLSP

SEQ ID NO: 919570 - protein, 36 aa, Mycobacterium
TLPGTEEPVASGYPGYPGMPGGGASRSVGAGVPPRY

SEQ ID NO: 919571 - protein, 7 aa, Mycobacterium
TLPPDAV

SEQ ID NO: 919572 - protein, 8 aa, Mycobacterium
TLPPDAVE

SEQ ID NO: 919573 - protein, 6 aa, Mycobacterium
TLPPGV

SEQ ID NO: 919574 - protein, 12 aa, Mycobacterium
TLPPLPRGTTAT

SEQ ID NO: 919575 - protein, 7 aa, Mycobacterium
TLPPPGL

SEQ ID NO: 919576 - protein, 18 aa, Mycobacterium
TLPPRTGGAAAAMAGAPH

SEQ ID NO: 919577 - protein, 6 aa, Mycobacterium
TLPRRP

SEQ ID NO: 919578 - protein, 9 aa, Mycobacterium
TLPSDAGSF

SEQ ID NO: 919579 - protein, 10 aa, Mycobacterium
TLPTDPESEL

SEQ ID NO: 919580 - protein, 15 aa, Mycobacterium
TLPTTARAHASAPSF

SEQ ID NO: 919581 - protein, 5 aa, Mycobacterium
TLPTV

SEQ ID NO: 919582 - protein, 4 aa, Mycobacterium
TLPV

SEQ ID NO: 919583 - protein, 8 aa, Mycobacterium
TLQDDGAA

SEQ ID NO: 919584 - protein, 16 aa, Mycobacterium
TLQGPGENQGANREEY

SEQ ID NO: 919585 - protein, 6 aa, Mycobacterium
TLQGTL

SEQ ID NO: 919586 - protein, 13 aa, Mycobacterium
TLQPETPGGTSAL

SEQ ID NO: 919587 - protein, 8 aa, Mycobacterium
TLQPNSRV

SEQ ID NO: 919588 - protein, 13 aa, Mycobacterium
TLQPTEPGGVSPL

SEQ ID NO: 919589 - protein, 10 aa, Mycobacterium
TLRDNSKTQL

SEQ ID NO: 919590 - protein, 12 aa, Mycobacterium
TLREQAPFSSYG

SEQ ID NO: 919591 - protein, 5 aa, Mycobacterium
TLRRP

SEQ ID NO: 919592 - protein, 6 aa, Mycobacterium
TLSAQG

SEQ ID NO: 919593 - protein, 13 aa, Mycobacterium
TLSATAAAQRQGL

SEQ ID NO: 919594 - protein, 9 aa, Mycobacterium
TLSDNDVSS

SEQ ID NO: 919595 - protein, 7 aa, Mycobacterium
TLSGAGP

SEQ ID NO: 919596 - protein, 8 aa, Mycobacterium
TLSGAGPS

SEQ ID NO: 919597 - protein, 14 aa, Mycobacterium
TLSGLGAEPTAQRR

SEQ ID NO: 919598 - protein, 13 aa, Mycobacterium
TLSPVQERDPANQ

SEQ ID NO: 919599 - protein, 8 aa, Mycobacterium
TLSSPTTV

SEQ ID NO: 919600 - protein, 9 aa, Mycobacterium
TLTDEADAR

SEQ ID NO: 919601 - protein, 5 aa, Mycobacterium
TLTDR

SEQ ID NO: 919602 - protein, 11 aa, Mycobacterium
TLTEDPPRRTE

SEQ ID NO: 919603 - protein, 6 aa, Mycobacterium
TLTGAQ

SEQ ID NO: 919604 - protein, 19 aa, Mycobacterium
TLTPAGRAAVADARRAIDA

SEQ ID NO: 919605 - protein, 23 aa, Mycobacterium
TLTSASASAASDSGHTSVPIDPA

SEQ ID NO: 919606 - protein, 8 aa, Mycobacterium
TLTSRDQI

SEQ ID NO: 919607 - protein, 9 aa, Mycobacterium
TLTSRDQIN

SEQ ID NO: 919608 - protein, 11 aa, Mycobacterium
TLTSRDSINGQ

SEQ ID NO: 919609 - protein, 9 aa, Mycobacterium
TLTTGEPHG

SEQ ID NO: 919610 - protein, 21 aa, Mycobacterium
TLTTYNTNTVAGAASSGPQAF

SEQ ID NO: 919611 - protein, 9 aa, Mycobacterium
TMAKRGRGS

SEQ ID NO: 919612 - protein, 8 aa, Mycobacterium
TMEKPNSG

SEQ ID NO: 919613 - protein, 11 aa, Mycobacterium
TMNPESAALST

SEQ ID NO: 919614 - protein, 5 aa, Mycobacterium
TMPEK

SEQ ID NO: 919615 - protein, 14 aa, Mycobacterium
TMPTPDDPDTAHTQ

SEQ ID NO: 919616 - protein, 5 aa, Mycobacterium
TMQTQ

SEQ ID NO: 919617 - protein, 13 aa, Mycobacterium
TMSGNAATTASGF

SEQ ID NO: 919618 - protein, 10 aa, Mycobacterium
TMTSPKQRPY

SEQ ID NO: 919619 - protein, 12 aa, Mycobacterium
TNAARPDPRVDR

SEQ ID NO: 919620 - protein, 8 aa, Mycobacterium
TNAEQTSR

SEQ ID NO: 919621 - protein, 8 aa, Mycobacterium
TNAPNGAV

SEQ ID NO: 919622 - protein, 4 aa, Mycobacterium
TNAQ

SEQ ID NO: 919623 - protein, 8 aa, Mycobacterium
TNASNERT

SEQ ID NO: 919624 - protein, 14 aa, Mycobacterium
TNASTEEQTGVPTG

SEQ ID NO: 919625 - protein, 7 aa, Mycobacterium
TNAVTGS

SEQ ID NO: 919626 - protein, 4 aa, Mycobacterium
TNDA

SEQ ID NO: 919627 - protein, 6 aa, Mycobacterium
TNDAGK

SEQ ID NO: 919628 - protein, 6 aa, Mycobacterium
TNDEVQ

SEQ ID NO: 919629 - protein, 10 aa, Mycobacterium
TNDKGSPGAK

SEQ ID NO: 919630 - protein, 9 aa, Mycobacterium
TNDPDEVAS

SEQ ID NO: 919631 - protein, 6 aa, Mycobacterium
TNEAGE

SEQ ID NO: 919632 - protein, 7 aa, Mycobacterium
TNEGGDT

SEQ ID NO: 919633 - protein, 6 aa, Mycobacterium
TNEGLR

SEQ ID NO: 919634 - protein, 5 aa, Mycobacterium
TNETF

SEQ ID NO: 919635 - protein, 4 aa, Mycobacterium
TNGA

SEQ ID NO: 919636 - protein, 7 aa, Mycobacterium
TNGALTS

SEQ ID NO: 919637 - protein, 20 aa, Mycobacterium
TNGANTGTTFSEGAAKTAIQ

SEQ ID NO: 919638 - protein, 8 aa, Mycobacterium
TNGDDPGA

SEQ ID NO: 919639 - protein, 23 aa, Mycobacterium
TNGETPTAFSPPTTSTKAKPKPI

SEQ ID NO: 919640 - protein, 7 aa, Mycobacterium
TNGGDRD

SEQ ID NO: 919641 - protein, 9 aa, Mycobacterium
TNGGGYPTG

SEQ ID NO: 919642 - protein, 17 aa, Mycobacterium
TNGNCDPVAGTNTRESL

SEQ ID NO: 919643 - protein, 13 aa, Mycobacterium
TNGSSARASDATA

SEQ ID NO: 919644 - protein, 4 aa, Mycobacterium
TNGT

SEQ ID NO: 919645 - protein, 5 aa, Mycobacterium
TNGTH

SEQ ID NO: 919646 - protein, 20 aa, Mycobacterium
TNGTNTGGTFTEASAKTAIQ

SEQ ID NO: 919647 - protein, 8 aa, Mycobacterium
TNGYPGTV

SEQ ID NO: 919648 - protein, 6 aa, Mycobacterium
TNHRTV

SEQ ID NO: 919649 - protein, 20 aa, Mycobacterium
TNIASSARGIPDGVDRETVR

SEQ ID NO: 919650 - protein, 10 aa, Mycobacterium
TNIPTPLTDS

SEQ ID NO: 919651 - protein, 13 aa, Mycobacterium
TNIQGGKEPAVTY

SEQ ID NO: 919652 - protein, 5 aa, Mycobacterium
TNKEF

SEQ ID NO: 919653 - protein, 4 aa, Mycobacterium
TNKV

SEQ ID NO: 919654 - protein, 13 aa, Mycobacterium
TNLEDSVADPGLR

SEQ ID NO: 919655 - protein, 8 aa, Mycobacterium
TNLGPGHV

SEQ ID NO: 919656 - protein, 7 aa, Mycobacterium
TNLTSKQ

SEQ ID NO: 919657 - protein, 6 aa, Mycobacterium
TNLTTK

SEQ ID NO: 919658 - protein, 11 aa, Mycobacterium
TNNAASPAHQA

SEQ ID NO: 919659 - protein, 10 aa, Mycobacterium
TNNENPAGAC

SEQ ID NO: 919660 - protein, 12 aa, Mycobacterium
TNNERANAVRQG

SEQ ID NO: 919661 - protein, 4 aa, Mycobacterium
TNNF

SEQ ID NO: 919662 - protein, 7 aa, Mycobacterium
TNNGSKV

SEQ ID NO: 919663 - protein, 6 aa, Mycobacterium
TNNPQV

SEQ ID NO: 919664 - protein, 20 aa, Mycobacterium
TNNREGLQCPDGSWAPTTED

SEQ ID NO: 919665 - protein, 9 aa, Mycobacterium
TNNRPVDIQ

SEQ ID NO: 919666 - protein, 6 aa, Mycobacterium
TNNTLA

SEQ ID NO: 919667 - protein, 10 aa, Mycobacterium
TNNVDKSVGS

SEQ ID NO: 919668 - protein, 6 aa, Mycobacterium
TNPDAG

SEQ ID NO: 919669 - protein, 8 aa, Mycobacterium
TNPEDDTQ

SEQ ID NO: 919670 - protein, 10 aa, Mycobacterium
TNPGASDPAA

SEQ ID NO: 919671 - protein, 9 aa, Mycobacterium
TNPGIPPRG

SEQ ID NO: 919672 - protein, 5 aa, Mycobacterium
TNPID

SEQ ID NO: 919673 - protein, 17 aa, Mycobacterium
TNPIDDDENELSTTGGG

SEQ ID NO: 919674 - protein, 7 aa, Mycobacterium
TNPPVEG

SEQ ID NO: 919675 - protein, 13 aa, Mycobacterium
TNPQFTSTRHVNR

SEQ ID NO: 919676 - protein, 4 aa, Mycobacterium
TNPS

SEQ ID NO: 919677 - protein, 6 aa, Mycobacterium
TNPSGK

SEQ ID NO: 919678 - protein, 6 aa, Mycobacterium
TNPSKT

SEQ ID NO: 919679 - protein, 4 aa, Mycobacterium
TNPT

SEQ ID NO: 919680 - protein, 9 aa, Mycobacterium
TNPVPQGEA

SEQ ID NO: 919681 - protein, 9 aa, Mycobacterium
TNQNDTGLT

SEQ ID NO: 919682 - protein, 10 aa, Mycobacterium
TNQNDTGLTV

SEQ ID NO: 919683 - protein, 26 aa, Mycobacterium
TNRDEEPHTVAASDGSFHSPGMGTGA

SEQ ID NO: 919684 - protein, 5 aa, Mycobacterium
TNRDH

SEQ ID NO: 919685 - protein, 7 aa, Mycobacterium
TNREGGV

SEQ ID NO: 919686 - protein, 8 aa, Mycobacterium
TNRGAENL

SEQ ID NO: 919687 - protein, 5 aa, Mycobacterium
TNRHP

SEQ ID NO: 919688 - protein, 7 aa, Mycobacterium
TNRRAAQ

SEQ ID NO: 919689 - protein, 5 aa, Mycobacterium
TNRRD

SEQ ID NO: 919690 - protein, 8 aa, Mycobacterium
TNRRNPGA

SEQ ID NO: 919691 - protein, 8 aa, Mycobacterium
TNRTPPGF

SEQ ID NO: 919692 - protein, 8 aa, Mycobacterium
TNSAPPSW

SEQ ID NO: 919693 - protein, 5 aa, Mycobacterium
TNSEH

SEQ ID NO: 919694 - protein, 8 aa, Mycobacterium
TNSGDGTV

SEQ ID NO: 919695 - protein, 10 aa, Mycobacterium
TNSPQTCASA

SEQ ID NO: 919696 - protein, 5 aa, Mycobacterium
TNSSM

SEQ ID NO: 919697 - protein, 9 aa, Mycobacterium
TNTAGDAVP

SEQ ID NO: 919698 - protein, 5 aa, Mycobacterium
TNTAQ

SEQ ID NO: 919699 - protein, 6 aa, Mycobacterium
TNTAQD

SEQ ID NO: 919700 - protein, 8 aa, Mycobacterium
TNTDKGGW

SEQ ID NO: 919701 - protein, 8 aa, Mycobacterium
TNTIGTDS

SEQ ID NO: 919702 - protein, 4 aa, Mycobacterium
TNTL

SEQ ID NO: 919703 - protein, 6 aa, Mycobacterium
TNTQEG

SEQ ID NO: 919704 - protein, 15 aa, Mycobacterium
TNTTASQGSCTEAAQ

SEQ ID NO: 919705 - protein, 5 aa, Mycobacterium
TNTTV

SEQ ID NO: 919706 - protein, 13 aa, Mycobacterium
TNVTGANGEPSEQ

SEQ ID NO: 919707 - protein, 5 aa, Mycobacterium
TNYSD

SEQ ID NO: 919708 - protein, 8 aa, Mycobacterium
TPAAAAAL

SEQ ID NO: 919709 - protein, 11 aa, Mycobacterium
TPAAAEPETCP

SEQ ID NO: 919710 - protein, 11 aa, Mycobacterium
TPAAGFSGTET

SEQ ID NO: 919711 - protein, 11 aa, Mycobacterium
TPAASAQQPCP

SEQ ID NO: 919712 - protein, 6 aa, Mycobacterium
TPADGL

SEQ ID NO: 919713 - protein, 19 aa, Mycobacterium
TPAEGDVERTDLAEGTTTT

SEQ ID NO: 919714 - protein, 7 aa, Mycobacterium
TPAGAGF

SEQ ID NO: 919715 - protein, 11 aa, Mycobacterium
TPAGASPDEVI

SEQ ID NO: 919716 - protein, 14 aa, Mycobacterium
TPAGHGAPPVSAGP

SEQ ID NO: 919717 - protein, 9 aa, Mycobacterium
TPAGRKTVT

SEQ ID NO: 919718 - protein, 6 aa, Mycobacterium
TPAGRR

SEQ ID NO: 919719 - protein, 13 aa, Mycobacterium
TPAGRTASRTPTS

SEQ ID NO: 919720 - protein, 5 aa, Mycobacterium
TPAGT

SEQ ID NO: 919721 - protein, 6 aa, Mycobacterium
TPAGTR

SEQ ID NO: 919722 - protein, 11 aa, Mycobacterium
TPAGWKPVDGG

SEQ ID NO: 919723 - protein, 5 aa, Mycobacterium
TPAHS

SEQ ID NO: 919724 - protein, 9 aa, Mycobacterium
TPAKPDPLT

SEQ ID NO: 919725 - protein, 5 aa, Mycobacterium
TPALG

SEQ ID NO: 919726 - protein, 8 aa, Mycobacterium
TPAPANDD

SEQ ID NO: 919727 - protein, 12 aa, Mycobacterium
TPAPAPATAYGE

SEQ ID NO: 919728 - protein, 20 aa, Mycobacterium
TPAPDSPPWTASRYQVETVT

SEQ ID NO: 919729 - protein, 6 aa, Mycobacterium
TPAPPG

SEQ ID NO: 919730 - protein, 8 aa, Mycobacterium
TPAPPRGD

SEQ ID NO: 919731 - protein, 4 aa, Mycobacterium
TPAR

SEQ ID NO: 919732 - protein, 14 aa, Mycobacterium
TPARLPKARAGTYG

SEQ ID NO: 919733 - protein, 9 aa, Mycobacterium
TPATAGVPP

SEQ ID NO: 919734 - protein, 18 aa, Mycobacterium
TPATANQPPGTNAEADWT

SEQ ID NO: 919735 - protein, 25 aa, Mycobacterium
TPATARDPRDSAVSARSTVQHPDGQ

SEQ ID NO: 919736 - protein, 13 aa, Mycobacterium
TPATQAKAETPVP

SEQ ID NO: 919737 - protein, 12 aa, Mycobacterium
TPATSHADPAGH

SEQ ID NO: 919738 - protein, 5 aa, Mycobacterium
TPAVD

SEQ ID NO: 919739 - protein, 6 aa, Mycobacterium
TPAVGG

SEQ ID NO: 919740 - protein, 69 aa, Mycobacterium
TPAWAESPSTSESASSESKAPQKPSSRRSTPATSGDSANGGDSAGKSGSDGSTASAGGNDNDSPVEDEA

SEQ ID NO: 919741 - protein, 6 aa, Mycobacterium
TPDAAA

SEQ ID NO: 919742 - protein, 9 aa, Mycobacterium
TPDADGTGR

SEQ ID NO: 919743 - protein, 8 aa, Mycobacterium
TPDANKDH

SEQ ID NO: 919744 - protein, 9 aa, Mycobacterium
TPDANKDNV

SEQ ID NO: 919745 - protein, 4 aa, Mycobacterium
TPDD

SEQ ID NO: 919746 - protein, 10 aa, Mycobacterium
TPDDCGLPTP

SEQ ID NO: 919747 - protein, 11 aa, Mycobacterium
TPDDSPPTRNA

SEQ ID NO: 919748 - protein, 5 aa, Mycobacterium
TPDEA

SEQ ID NO: 919749 - protein, 19 aa, Mycobacterium
TPDEAFDQAQAKAALPNRQ

SEQ ID NO: 919750 - protein, 9 aa, Mycobacterium
TPDESHHVS

SEQ ID NO: 919751 - protein, 7 aa, Mycobacterium
TPDEYSR

SEQ ID NO: 919752 - protein, 12 aa, Mycobacterium
TPDGAPGNDDLG

SEQ ID NO: 919753 - protein, 7 aa, Mycobacterium
TPDGATI

SEQ ID NO: 919754 - protein, 5 aa, Mycobacterium
TPDGE

SEQ ID NO: 919755 - protein, 9 aa, Mycobacterium
TPDGQETAL

SEQ ID NO: 919756 - protein, 22 aa, Mycobacterium
TPDGQKVAPGPVGSSNAAKATV

SEQ ID NO: 919757 - protein, 6 aa, Mycobacterium
TPDIGF

SEQ ID NO: 919758 - protein, 9 aa, Mycobacterium
TPDKVYSGG

SEQ ID NO: 919759 - protein, 4 aa, Mycobacterium
TPDL

SEQ ID NO: 919760 - protein, 4 aa, Mycobacterium
TPDP

SEQ ID NO: 919761 - protein, 31 aa, Mycobacterium
TPDPLHPGAPGPVPPPAGSPLTPIAGPQPSY

SEQ ID NO: 919762 - protein, 16 aa, Mycobacterium
TPDPPPSATNVSRTDG

SEQ ID NO: 919763 - protein, 36 aa, Mycobacterium
TPDPRNPSAPGPVAPPVGAPLTPTAAPGPATPVPLP

SEQ ID NO: 919764 - protein, 8 aa, Mycobacterium
TPDPSIPV

SEQ ID NO: 919765 - protein, 26 aa, Mycobacterium
TPDQRAALADPGPVPPTPPAPPAANP

SEQ ID NO: 919766 - protein, 4 aa, Mycobacterium
TPDR

SEQ ID NO: 919767 - protein, 4 aa, Mycobacterium
TPDS

SEQ ID NO: 919768 - protein, 9 aa, Mycobacterium
TPDTNKDNV

SEQ ID NO: 919769 - protein, 5 aa, Mycobacterium
TPDVP

SEQ ID NO: 919770 - protein, 11 aa, Mycobacterium
TPEADRSDVDG

SEQ ID NO: 919771 - protein, 16 aa, Mycobacterium
TPEDQELTDEGHGTAL

SEQ ID NO: 919772 - protein, 11 aa, Mycobacterium
TPEDRQATQRE

SEQ ID NO: 919773 - protein, 11 aa, Mycobacterium
TPEDRRASQRE

SEQ ID NO: 919774 - protein, 8 aa, Mycobacterium
TPEDTAYT

SEQ ID NO: 919775 - protein, 5 aa, Mycobacterium
TPEGE

SEQ ID NO: 919776 - protein, 5 aa, Mycobacterium
TPEGQ

SEQ ID NO: 919777 - protein, 22 aa, Mycobacterium
TPEGQKVAPGPIDSSTAAKATV

SEQ ID NO: 919778 - protein, 6 aa, Mycobacterium
TPEIGG

SEQ ID NO: 919779 - protein, 5 aa, Mycobacterium
TPEKL

SEQ ID NO: 919780 - protein, 8 aa, Mycobacterium
TPELPAAP

SEQ ID NO: 919781 - protein, 10 aa, Mycobacterium
TPEPTENPAA

SEQ ID NO: 919782 - protein, 18 aa, Mycobacterium
TPEPVEDSIRKAAVWFAS

SEQ ID NO: 919783 - protein, 5 aa, Mycobacterium
TPEQD

SEQ ID NO: 919784 - protein, 9 aa, Mycobacterium
TPEQITAQR

SEQ ID NO: 919785 - protein, 5 aa, Mycobacterium
TPERI

SEQ ID NO: 919786 - protein, 8 aa, Mycobacterium
TPERPTGA

SEQ ID NO: 919787 - protein, 5 aa, Mycobacterium
TPERR

SEQ ID NO: 919788 - protein, 12 aa, Mycobacterium
TPESVAQRLREL

SEQ ID NO: 919789 - protein, 5 aa, Mycobacterium
TPETI

SEQ ID NO: 919790 - protein, 10 aa, Mycobacterium
TPEVRSSPEI

SEQ ID NO: 919791 - protein, 6 aa, Mycobacterium
TPEYRE

SEQ ID NO: 919792 - protein, 33 aa, Mycobacterium
TPGAGGAGGAGGAGVGTFASPGGHGGSGGDAGA

SEQ ID NO: 919793 - protein, 6 aa, Mycobacterium
TPGDAE

SEQ ID NO: 919794 - protein, 7 aa, Mycobacterium
TPGDERS

SEQ ID NO: 919795 - protein, 8 aa, Mycobacterium
TPGDNLQD

SEQ ID NO: 919796 - protein, 11 aa, Mycobacterium
TPGDPLSNYGA

SEQ ID NO: 919797 - protein, 7 aa, Mycobacterium
TPGELDG

SEQ ID NO: 919798 - protein, 10 aa, Mycobacterium
TPGGAQASRL

SEQ ID NO: 919799 - protein, 22 aa, Mycobacterium
TPGGPPTAVYSPQSGELVGPDG

SEQ ID NO: 919800 - protein, 9 aa, Mycobacterium
TPGGPRTGE

SEQ ID NO: 919801 - protein, 5 aa, Mycobacterium
TPGGW

SEQ ID NO: 919802 - protein, 5 aa, Mycobacterium
TPGIT

SEQ ID NO: 919803 - protein, 6 aa, Mycobacterium
TPGKPL

SEQ ID NO: 919804 - protein, 6 aa, Mycobacterium
TPGLGN

SEQ ID NO: 919805 - protein, 9 aa, Mycobacterium
TPGLGPAGH

SEQ ID NO: 919806 - protein, 10 aa, Mycobacterium
TPGLGPDGHS

SEQ ID NO: 919807 - protein, 9 aa, Mycobacterium
TPGLGPEGH

SEQ ID NO: 919808 - protein, 17 aa, Mycobacterium
TPGLTPLPGSTGPTVTA

SEQ ID NO: 919809 - protein, 11 aa, Mycobacterium
TPGPSQPARGL

SEQ ID NO: 919810 - protein, 25 aa, Mycobacterium
TPGQEQSARSQDTQRGAKSVEFQFS

SEQ ID NO: 919811 - protein, 8 aa, Mycobacterium
TPGQRRKQ

SEQ ID NO: 919812 - protein, 8 aa, Mycobacterium
TPGSGQVA

SEQ ID NO: 919813 - protein, 10 aa, Mycobacterium
TPGSPAAASG

SEQ ID NO: 919814 - protein, 9 aa, Mycobacterium
TPGSPNGID

SEQ ID NO: 919815 - protein, 11 aa, Mycobacterium
TPGSRYEYSNT

SEQ ID NO: 919816 - protein, 6 aa, Mycobacterium
TPGSSP

SEQ ID NO: 919817 - protein, 15 aa, Mycobacterium
TPGTATAAPGAAGPE

SEQ ID NO: 919818 - protein, 10 aa, Mycobacterium
TPGTTKAQKL

SEQ ID NO: 919819 - protein, 4 aa, Mycobacterium
TPGY

SEQ ID NO: 919820 - protein, 20 aa, Mycobacterium
TPGYTGGPTLQNNATIPRAR

SEQ ID NO: 919821 - protein, 15 aa, Mycobacterium
TPHESARNGGPVPRV

SEQ ID NO: 919822 - protein, 9 aa, Mycobacterium
TPHTQSESM

SEQ ID NO: 919823 - protein, 6 aa, Mycobacterium
TPIDDP

SEQ ID NO: 919824 - protein, 10 aa, Mycobacterium
TPIGDTASAD

SEQ ID NO: 919825 - protein, 19 aa, Mycobacterium
TPIPGPSFYSDPGDLAGRV

SEQ ID NO: 919826 - protein, 8 aa, Mycobacterium
TPIPGRPD

SEQ ID NO: 919827 - protein, 5 aa, Mycobacterium
TPIPR

SEQ ID NO: 919828 - protein, 15 aa, Mycobacterium
TPIRPGDSGGPLVNN

SEQ ID NO: 919829 - protein, 6 aa, Mycobacterium
TPISGD

SEQ ID NO: 919830 - protein, 12 aa, Mycobacterium
TPIYEGPPPSIY

SEQ ID NO: 919831 - protein, 8 aa, Mycobacterium
TPKEYSQE

SEQ ID NO: 919832 - protein, 4 aa, Mycobacterium
TPLA

SEQ ID NO: 919833 - protein, 13 aa, Mycobacterium
TPLATKPPSGPMV

SEQ ID NO: 919834 - protein, 5 aa, Mycobacterium
TPLED

SEQ ID NO: 919835 - protein, 33 aa, Mycobacterium
TPLGQQGSGRLQPGATIPLSRSSAYPSTEQTLS

SEQ ID NO: 919836 - protein, 12 aa, Mycobacterium
TPLGTATPEPRP

SEQ ID NO: 919837 - protein, 11 aa, Mycobacterium
TPLPRTGPLPE

SEQ ID NO: 919838 - protein, 11 aa, Mycobacterium
TPLQSPPGREF

SEQ ID NO: 919839 - protein, 4 aa, Mycobacterium
TPLV

SEQ ID NO: 919840 - protein, 8 aa, Mycobacterium
TPNGRQGA

SEQ ID NO: 919841 - protein, 16 aa, Mycobacterium
TPNPHDAPGGPLVERG

SEQ ID NO: 919842 - protein, 16 aa, Mycobacterium
TPNPNSAPNGPLIERS

SEQ ID NO: 919843 - protein, 14 aa, Mycobacterium
TPNPSIATKATLPE

SEQ ID NO: 919844 - protein, 13 aa, Mycobacterium
TPNSLTDAQRAAL

SEQ ID NO: 919845 - protein, 8 aa, Mycobacterium
TPPAGSFS

SEQ ID NO: 919846 - protein, 93 aa, Mycobacterium
TPPAPAATPPPSRQSPPPPQEPPPPQEPPPPQEPPPAPQEVEPPADAPQPGAGGGGSGGSGGGGGSGGGGNGEAGPVQPSPARPSPPGVIRLA

SEQ ID NO: 919847 - protein, 10 aa, Mycobacterium
TPPATPSGQL

SEQ ID NO: 919848 - protein, 4 aa, Mycobacterium
TPPD

SEQ ID NO: 919849 - protein, 14 aa, Mycobacterium
TPPDPLPPGEPGDV

SEQ ID NO: 919850 - protein, 13 aa, Mycobacterium
TPPDPLPPGRPGD

SEQ ID NO: 919851 - protein, 10 aa, Mycobacterium
TPPDQPGTGM

SEQ ID NO: 919852 - protein, 11 aa, Mycobacterium
TPPDSNPPTAR

SEQ ID NO: 919853 - protein, 8 aa, Mycobacterium
TPPEDPAA

SEQ ID NO: 919854 - protein, 6 aa, Mycobacterium
TPPEER

SEQ ID NO: 919855 - protein, 6 aa, Mycobacterium
TPPGAP

SEQ ID NO: 919856 - protein, 90 aa, Mycobacterium
TPPGATGQAPGHRGAATAPAPQAPTPAIAPAPQAPAPAIAPAPQAPAPAIAPAPQAPAQATHSAPVAAPAPQASAPHLNPASPSLPGVTT

SEQ ID NO: 919857 - protein, 19 aa, Mycobacterium
TPPGGLAGPPVRPSRSDGC

SEQ ID NO: 919858 - protein, 19 aa, Mycobacterium
TPPGGLTAQPVRPTQPAGC

SEQ ID NO: 919859 - protein, 20 aa, Mycobacterium
TPPGGLTGQPIRPAQPSGCA

SEQ ID NO: 919860 - protein, 31 aa, Mycobacterium
TPPGGLTGQPVRPRQPSGCAAGDYPAALPKG

SEQ ID NO: 919861 - protein, 6 aa, Mycobacterium
TPPLEQ

SEQ ID NO: 919862 - protein, 6 aa, Mycobacterium
TPPLSD

SEQ ID NO: 919863 - protein, 12 aa, Mycobacterium
TPPNPLPAGQAG

SEQ ID NO: 919864 - protein, 10 aa, Mycobacterium
TPPNPSRPNL

SEQ ID NO: 919865 - protein, 10 aa, Mycobacterium
TPPNPTRPNL

SEQ ID NO: 919866 - protein, 26 aa, Mycobacterium
TPPPRVRDAGGTRAMTNADPESAHVG

SEQ ID NO: 919867 - protein, 10 aa, Mycobacterium
TPPQPTAIPQ

SEQ ID NO: 919868 - protein, 5 aa, Mycobacterium
TPPQV

SEQ ID NO: 919869 - protein, 7 aa, Mycobacterium
TPPSSSV

SEQ ID NO: 919870 - protein, 12 aa, Mycobacterium
TPPTAPPGTPGE

SEQ ID NO: 919871 - protein, 8 aa, Mycobacterium
TPPTQEDS

SEQ ID NO: 919872 - protein, 7 aa, Mycobacterium
TPPTVTP

SEQ ID NO: 919873 - protein, 4 aa, Mycobacterium
TPPY

SEQ ID NO: 919874 - protein, 12 aa, Mycobacterium
TPPYESGPELPD

SEQ ID NO: 919875 - protein, 8 aa, Mycobacterium
TPPYGSPV

SEQ ID NO: 919876 - protein, 12 aa, Mycobacterium
TPPYHGGPTLED

SEQ ID NO: 919877 - protein, 6 aa, Mycobacterium
TPPYRG

SEQ ID NO: 919878 - protein, 13 aa, Mycobacterium
TPPYRGDGPTLRD

SEQ ID NO: 919879 - protein, 7 aa, Mycobacterium
TPPYRGG

SEQ ID NO: 919880 - protein, 14 aa, Mycobacterium
TPPYRGGPTLQNNA

SEQ ID NO: 919881 - protein, 11 aa, Mycobacterium
TPPYSGGPTMA

SEQ ID NO: 919882 - protein, 11 aa, Mycobacterium
TPQEATEAGDN

SEQ ID NO: 919883 - protein, 6 aa, Mycobacterium
TPQGRA

SEQ ID NO: 919884 - protein, 8 aa, Mycobacterium
TPQGVEAT

SEQ ID NO: 919885 - protein, 19 aa, Mycobacterium
TPQGVNPSTIPQGEKASGK

SEQ ID NO: 919886 - protein, 19 aa, Mycobacterium
TPQGVNPSTLAPGQKTTGK

SEQ ID NO: 919887 - protein, 19 aa, Mycobacterium
TPQGVNPSTLGQGESTTGT

SEQ ID NO: 919888 - protein, 6 aa, Mycobacterium
TPQHEE

SEQ ID NO: 919889 - protein, 12 aa, Mycobacterium
TPQIKEPHYPVQ

SEQ ID NO: 919890 - protein, 12 aa, Mycobacterium
TPQISEPQYPVE

SEQ ID NO: 919891 - protein, 10 aa, Mycobacterium
TPQPLAPQPG

SEQ ID NO: 919892 - protein, 8 aa, Mycobacterium
TPQQPGHD

SEQ ID NO: 919893 - protein, 5 aa, Mycobacterium
TPQQR

SEQ ID NO: 919894 - protein, 10 aa, Mycobacterium
TPQSDGSMRG

SEQ ID NO: 919895 - protein, 5 aa, Mycobacterium
TPQSY

SEQ ID NO: 919896 - protein, 6 aa, Mycobacterium
TPQTTQ

SEQ ID NO: 919897 - protein, 10 aa, Mycobacterium
TPQVAGESTA

SEQ ID NO: 919898 - protein, 5 aa, Mycobacterium
TPQVS

SEQ ID NO: 919899 - protein, 4 aa, Mycobacterium
TPRA

SEQ ID NO: 919900 - protein, 19 aa, Mycobacterium
TPRAEEADDAATAAAREGE

SEQ ID NO: 919901 - protein, 4 aa, Mycobacterium
TPRD

SEQ ID NO: 919902 - protein, 11 aa, Mycobacterium
TPRGDGRLSEP

SEQ ID NO: 919903 - protein, 13 aa, Mycobacterium
TPRGGSGPVAESG

SEQ ID NO: 919904 - protein, 6 aa, Mycobacterium
TPRGRQ

SEQ ID NO: 919905 - protein, 12 aa, Mycobacterium
TPRPNGPEPTAE

SEQ ID NO: 919906 - protein, 12 aa, Mycobacterium
TPRPNGPGPAAE

SEQ ID NO: 919907 - protein, 8 aa, Mycobacterium
TPRTDPGV

SEQ ID NO: 919908 - protein, 11 aa, Mycobacterium
TPRTNRSTGAV

SEQ ID NO: 919909 - protein, 6 aa, Mycobacterium
TPRYPR

SEQ ID NO: 919910 - protein, 4 aa, Mycobacterium
TPSA

SEQ ID NO: 919911 - protein, 8 aa, Mycobacterium
TPSAANGS

SEQ ID NO: 919912 - protein, 8 aa, Mycobacterium
TPSAQREQ

SEQ ID NO: 919913 - protein, 4 aa, Mycobacterium
TPSD

SEQ ID NO: 919914 - protein, 7 aa, Mycobacterium
TPSDGLA

SEQ ID NO: 919915 - protein, 10 aa, Mycobacterium
TPSDQAPTHD

SEQ ID NO: 919916 - protein, 5 aa, Mycobacterium
TPSDT

SEQ ID NO: 919917 - protein, 4 aa, Mycobacterium
TPSG

SEQ ID NO: 919918 - protein, 10 aa, Mycobacterium
TPSGATRSRL

SEQ ID NO: 919919 - protein, 5 aa, Mycobacterium
TPSGD

SEQ ID NO: 919920 - protein, 21 aa, Mycobacterium
TPSGHGDAGGGGGCDSGPGWN

SEQ ID NO: 919921 - protein, 13 aa, Mycobacterium
TPSGIRTNDGIEH

SEQ ID NO: 919922 - protein, 15 aa, Mycobacterium
TPSGPTTGAPPSYDA

SEQ ID NO: 919923 - protein, 9 aa, Mycobacterium
TPSGRGGAA

SEQ ID NO: 919924 - protein, 10 aa, Mycobacterium
TPSGRSGSGF

SEQ ID NO: 919925 - protein, 7 aa, Mycobacterium
TPSGTAT

SEQ ID NO: 919926 - protein, 4 aa, Mycobacterium
TPSI

SEQ ID NO: 919927 - protein, 4 aa, Mycobacterium
TPSN

SEQ ID NO: 919928 - protein, 20 aa, Mycobacterium
TPSPASDTDTVTVTGATAGK

SEQ ID NO: 919929 - protein, 20 aa, Mycobacterium
TPSPASDTDTVTVTGGTANS

SEQ ID NO: 919930 - protein, 11 aa, Mycobacterium
TPSPLSSGSAK

SEQ ID NO: 919931 - protein, 19 aa, Mycobacterium
TPSPVDDAGTRPEDDSDEV

SEQ ID NO: 919932 - protein, 18 aa, Mycobacterium
TPSPVDDTPPKTDDDEEV

SEQ ID NO: 919933 - protein, 19 aa, Mycobacterium
TPSRTGYPAAHGLIGARGG

SEQ ID NO: 919934 - protein, 7 aa, Mycobacterium
TPSSAGM

SEQ ID NO: 919935 - protein, 8 aa, Mycobacterium
TPSSATVR

SEQ ID NO: 919936 - protein, 9 aa, Mycobacterium
TPSSPADVQ

SEQ ID NO: 919937 - protein, 5 aa, Mycobacterium
TPSVE

SEQ ID NO: 919938 - protein, 6 aa, Mycobacterium
TPSWNG

SEQ ID NO: 919939 - protein, 7 aa, Mycobacterium
TPSYDPN

SEQ ID NO: 919940 - protein, 27 aa, Mycobacterium
TPTAPAVPATSAGTPAIPGVTTPIPGI

SEQ ID NO: 919941 - protein, 6 aa, Mycobacterium
TPTDNR

SEQ ID NO: 919942 - protein, 12 aa, Mycobacterium
TPTDTPNTPAES

SEQ ID NO: 919943 - protein, 15 aa, Mycobacterium
TPTEAPATAPPPSYA

SEQ ID NO: 919944 - protein, 7 aa, Mycobacterium
TPTEPPV

SEQ ID NO: 919945 - protein, 4 aa, Mycobacterium
TPTG

SEQ ID NO: 919946 - protein, 6 aa, Mycobacterium
TPTIDT

SEQ ID NO: 919947 - protein, 6 aa, Mycobacterium
TPTPLD

SEQ ID NO: 919948 - protein, 5 aa, Mycobacterium
TPTQS

SEQ ID NO: 919949 - protein, 29 aa, Mycobacterium
TPTRQSGSPMSTQRARKSFRPSGIWASRP

SEQ ID NO: 919950 - protein, 8 aa, Mycobacterium
TPTSAADV

SEQ ID NO: 919951 - protein, 10 aa, Mycobacterium
TPTSGTPTSI

SEQ ID NO: 919952 - protein, 6 aa, Mycobacterium
TPTTTY

SEQ ID NO: 919953 - protein, 5 aa, Mycobacterium
TPTTV

SEQ ID NO: 919954 - protein, 4 aa, Mycobacterium
TPTV

SEQ ID NO: 919955 - protein, 11 aa, Mycobacterium
TPVDQAPATVR

SEQ ID NO: 919956 - protein, 13 aa, Mycobacterium
TPVEAGAEIDSQT

SEQ ID NO: 919957 - protein, 5 aa, Mycobacterium
TPVEG

SEQ ID NO: 919958 - protein, 11 aa, Mycobacterium
TPVGPDPNPFG

SEQ ID NO: 919959 - protein, 13 aa, Mycobacterium
TPVGSDTAEDFNP

SEQ ID NO: 919960 - protein, 6 aa, Mycobacterium
TPVNGP

SEQ ID NO: 919961 - protein, 6 aa, Mycobacterium
TPVPVS

SEQ ID NO: 919962 - protein, 8 aa, Mycobacterium
TPVSGGYG

SEQ ID NO: 919963 - protein, 11 aa, Mycobacterium
TPWGKRGGRTV

SEQ ID NO: 919964 - protein, 4 aa, Mycobacterium
TPYG

SEQ ID NO: 919965 - protein, 6 aa, Mycobacterium
TPYSAP

SEQ ID NO: 919966 - protein, 12 aa, Mycobacterium
TQAAAPAPSQQE

SEQ ID NO: 919967 - protein, 6 aa, Mycobacterium
TQAARD

SEQ ID NO: 919968 - protein, 6 aa, Mycobacterium
TQAARG

SEQ ID NO: 919969 - protein, 15 aa, Mycobacterium
TQAARRQLEETTDTV

SEQ ID NO: 919970 - protein, 7 aa, Mycobacterium
TQAGVEA

SEQ ID NO: 919971 - protein, 4 aa, Mycobacterium
TQAI

SEQ ID NO: 919972 - protein, 5 aa, Mycobacterium
TQAIA

SEQ ID NO: 919973 - protein, 12 aa, Mycobacterium
TQAPETPAAPAI

SEQ ID NO: 919974 - protein, 4 aa, Mycobacterium
TQAQ

SEQ ID NO: 919975 - protein, 9 aa, Mycobacterium
TQDPPTDQI

SEQ ID NO: 919976 - protein, 5 aa, Mycobacterium
TQDTP

SEQ ID NO: 919977 - protein, 8 aa, Mycobacterium
TQEGADGW

SEQ ID NO: 919978 - protein, 14 aa, Mycobacterium
TQESSPTRGIPSGL

SEQ ID NO: 919979 - protein, 14 aa, Mycobacterium
TQETQPARGIPSGL

SEQ ID NO: 919980 - protein, 14 aa, Mycobacterium
TQETTPARGIPSGP

SEQ ID NO: 919981 - protein, 6 aa, Mycobacterium
TQGAQA

SEQ ID NO: 919982 - protein, 9 aa, Mycobacterium
TQGDGTVTA

SEQ ID NO: 919983 - protein, 15 aa, Mycobacterium
TQGGPGSENSPIGAG

SEQ ID NO: 919984 - protein, 4 aa, Mycobacterium
TQGL

SEQ ID NO: 919985 - protein, 5 aa, Mycobacterium
TQGNT

SEQ ID NO: 919986 - protein, 5 aa, Mycobacterium
TQGQA

SEQ ID NO: 919987 - protein, 5 aa, Mycobacterium
TQGRG

SEQ ID NO: 919988 - protein, 13 aa, Mycobacterium
TQGSSGDGGAGWS

SEQ ID NO: 919989 - protein, 6 aa, Mycobacterium
TQHPSA

SEQ ID NO: 919990 - protein, 7 aa, Mycobacterium
TQIPPGQ

SEQ ID NO: 919991 - protein, 17 aa, Mycobacterium
TQLGQRVGRKPDSVTCP

SEQ ID NO: 919992 - protein, 13 aa, Mycobacterium
TQLKSADGNQVAN

SEQ ID NO: 919993 - protein, 4 aa, Mycobacterium
TQLP

SEQ ID NO: 919994 - protein, 11 aa, Mycobacterium
TQLPSGPTVPA

SEQ ID NO: 919995 - protein, 5 aa, Mycobacterium
TQLRD

SEQ ID NO: 919996 - protein, 9 aa, Mycobacterium
TQLTPTGSL

SEQ ID NO: 919997 - protein, 13 aa, Mycobacterium
TQPADKAAYDADP

SEQ ID NO: 919998 - protein, 11 aa, Mycobacterium
TQPADPSDPPT

SEQ ID NO: 919999 - protein, 8 aa, Mycobacterium
TQPDPTIA

SEQ ID NO: 920000 - protein, 6 aa, Mycobacterium
TQPETM

SEQ ID NO: 920001 - protein, 12 aa, Mycobacterium
TQPGGPAETIES

SEQ ID NO: 920002 - protein, 5 aa, Mycobacterium
TQPGQ

SEQ ID NO: 920003 - protein, 7 aa, Mycobacterium
TQPGQGP

SEQ ID NO: 920004 - protein, 8 aa, Mycobacterium
TQPGTGEA

SEQ ID NO: 920005 - protein, 27 aa, Mycobacterium
TQPSAGTVTVNSDGTVTYTSTGTTTTT

SEQ ID NO: 920006 - protein, 20 aa, Mycobacterium
TQPSEGIKPVAAPSTTTAEM

SEQ ID NO: 920007 - protein, 5 aa, Mycobacterium
TQPTA

SEQ ID NO: 920008 - protein, 7 aa, Mycobacterium
TQPTNGT

SEQ ID NO: 920009 - protein, 6 aa, Mycobacterium
TQPVPS

SEQ ID NO: 920010 - protein, 4 aa, Mycobacterium
TQQG

SEQ ID NO: 920011 - protein, 7 aa, Mycobacterium
TQQPEVK

SEQ ID NO: 920012 - protein, 8 aa, Mycobacterium
TQQPSPDF

SEQ ID NO: 920013 - protein, 17 aa, Mycobacterium
TQQQATVGAVQPVFGNG

SEQ ID NO: 920014 - protein, 8 aa, Mycobacterium
TQQTAAPL

SEQ ID NO: 920015 - protein, 9 aa, Mycobacterium
TQQTAQPLA

SEQ ID NO: 920016 - protein, 6 aa, Mycobacterium
TQQTAR

SEQ ID NO: 920017 - protein, 9 aa, Mycobacterium
TQRATNQDK

SEQ ID NO: 920018 - protein, 7 aa, Mycobacterium
TQRDPAV

SEQ ID NO: 920019 - protein, 6 aa, Mycobacterium
TQRENI

SEQ ID NO: 920020 - protein, 8 aa, Mycobacterium
TQRIEDGT

SEQ ID NO: 920021 - protein, 11 aa, Mycobacterium
TQRRGATDGAA

SEQ ID NO: 920022 - protein, 5 aa, Mycobacterium
TQRVP

SEQ ID NO: 920023 - protein, 6 aa, Mycobacterium
TQSPPA

SEQ ID NO: 920024 - protein, 9 aa, Mycobacterium
TQSRQEKNH

SEQ ID NO: 920025 - protein, 7 aa, Mycobacterium
TQSRQGW

SEQ ID NO: 920026 - protein, 11 aa, Mycobacterium
TQSSCAASTQI

SEQ ID NO: 920027 - protein, 6 aa, Mycobacterium
TQSSDV

SEQ ID NO: 920028 - protein, 20 aa, Mycobacterium
TQSTSNGKPALDVAGNGRYA

SEQ ID NO: 920029 - protein, 53 aa, Mycobacterium
TQTAPGQQLPPQTPLPQAPVQQTPQTPLPQAPVQQTPLPQTPLQQAPARQAPL

SEQ ID NO: 920030 - protein, 5 aa, Mycobacterium
TQTAQ

SEQ ID NO: 920031 - protein, 6 aa, Mycobacterium
TQTDPQ

SEQ ID NO: 920032 - protein, 11 aa, Mycobacterium
TQTEGSVPEQI

SEQ ID NO: 920033 - protein, 7 aa, Mycobacterium
TQTPSAV

SEQ ID NO: 920034 - protein, 18 aa, Mycobacterium
TQTQTQPQPATSNPAAAE

SEQ ID NO: 920035 - protein, 7 aa, Mycobacterium
TQTRAAT

SEQ ID NO: 920036 - protein, 6 aa, Mycobacterium
TQTRPY

SEQ ID NO: 920037 - protein, 6 aa, Mycobacterium
TQTSQA

SEQ ID NO: 920038 - protein, 10 aa, Mycobacterium
TQVAGSPDHT

SEQ ID NO: 920039 - protein, 6 aa, Mycobacterium
TQVDNL

SEQ ID NO: 920040 - protein, 10 aa, Mycobacterium
TQVDTSRRDD

SEQ ID NO: 920041 - protein, 23 aa, Mycobacterium
TQVPPPASPAVTPTGATPTVAPD

SEQ ID NO: 920042 - protein, 10 aa, Mycobacterium
TQYASPDLPG

SEQ ID NO: 920043 - protein, 7 aa, Mycobacterium
TRAAGSG

SEQ ID NO: 920044 - protein, 10 aa, Mycobacterium
TRADGSATGL

SEQ ID NO: 920045 - protein, 15 aa, Mycobacterium
TRADSSLASAASTVD

SEQ ID NO: 920046 - protein, 5 aa, Mycobacterium
TRAGA

SEQ ID NO: 920047 - protein, 17 aa, Mycobacterium
TRAGYAASTQKVGGSGG

SEQ ID NO: 920048 - protein, 4 aa, Mycobacterium
TRAI

SEQ ID NO: 920049 - protein, 7 aa, Mycobacterium
TRANAGW

SEQ ID NO: 920050 - protein, 12 aa, Mycobacterium
TRAPAQDTDGSH

SEQ ID NO: 920051 - protein, 8 aa, Mycobacterium
TRAPRPGH

SEQ ID NO: 920052 - protein, 7 aa, Mycobacterium
TRAPTVK

SEQ ID NO: 920053 - protein, 4 aa, Mycobacterium
TRAQ

SEQ ID NO: 920054 - protein, 10 aa, Mycobacterium
TRASSSFDRY

SEQ ID NO: 920055 - protein, 14 aa, Mycobacterium
TRATRGADGNYTID

SEQ ID NO: 920056 - protein, 4 aa, Mycobacterium
TRDD

SEQ ID NO: 920057 - protein, 7 aa, Mycobacterium
TRDDAAR

SEQ ID NO: 920058 - protein, 9 aa, Mycobacterium
TRDDNPRDL

SEQ ID NO: 920059 - protein, 9 aa, Mycobacterium
TRDEPSPAM

SEQ ID NO: 920060 - protein, 8 aa, Mycobacterium
TRDGDTYT

SEQ ID NO: 920061 - protein, 6 aa, Mycobacterium
TRDGGE

SEQ ID NO: 920062 - protein, 8 aa, Mycobacterium
TRDGQPVT

SEQ ID NO: 920063 - protein, 5 aa, Mycobacterium
TRDIT

SEQ ID NO: 920064 - protein, 9 aa, Mycobacterium
TRDNPQQAA

SEQ ID NO: 920065 - protein, 9 aa, Mycobacterium
TRDPTSEQI

SEQ ID NO: 920066 - protein, 18 aa, Mycobacterium
TRDQSPANASAVSCQVTV

SEQ ID NO: 920067 - protein, 4 aa, Mycobacterium
TRDR

SEQ ID NO: 920068 - protein, 7 aa, Mycobacterium
TRDRGTI

SEQ ID NO: 920069 - protein, 15 aa, Mycobacterium
TRDRITDESAPAGQG

SEQ ID NO: 920070 - protein, 9 aa, Mycobacterium
TRDRTGEQV

SEQ ID NO: 920071 - protein, 9 aa, Mycobacterium
TRDTPNPVG

SEQ ID NO: 920072 - protein, 8 aa, Mycobacterium
TRDTPRAD

SEQ ID NO: 920073 - protein, 5 aa, Mycobacterium
TRDVD

SEQ ID NO: 920074 - protein, 10 aa, Mycobacterium
TRDVNAAPKV

SEQ ID NO: 920075 - protein, 8 aa, Mycobacterium
TRDYADGL

SEQ ID NO: 920076 - protein, 6 aa, Mycobacterium
TREADG

SEQ ID NO: 920077 - protein, 6 aa, Mycobacterium
TREAPA

SEQ ID NO: 920078 - protein, 6 aa, Mycobacterium
TREEAA

SEQ ID NO: 920079 - protein, 4 aa, Mycobacterium
TREL

SEQ ID NO: 920080 - protein, 4 aa, Mycobacterium
TREN

SEQ ID NO: 920081 - protein, 9 aa, Mycobacterium
TREPRSGIR

SEQ ID NO: 920082 - protein, 10 aa, Mycobacterium
TREQGSGTRE

SEQ ID NO: 920083 - protein, 13 aa, Mycobacterium
TRETRSGATAFTG

SEQ ID NO: 920084 - protein, 19 aa, Mycobacterium
TRFAPPGSYEQDSLPAEAD

SEQ ID NO: 920085 - protein, 20 aa, Mycobacterium
TRFSDPLTGQPDRRTAGGGC

SEQ ID NO: 920086 - protein, 4 aa, Mycobacterium
TRGA

SEQ ID NO: 920087 - protein, 6 aa, Mycobacterium
TRGAAR

SEQ ID NO: 920088 - protein, 7 aa, Mycobacterium
TRGAVTA

SEQ ID NO: 920089 - protein, 8 aa, Mycobacterium
TRGCSGQT

SEQ ID NO: 920090 - protein, 8 aa, Mycobacterium
TRGDGPVR

SEQ ID NO: 920091 - protein, 7 aa, Mycobacterium
TRGEETG

SEQ ID NO: 920092 - protein, 12 aa, Mycobacterium
TRGEGTTIQEKY

SEQ ID NO: 920093 - protein, 5 aa, Mycobacterium
TRGEL

SEQ ID NO: 920094 - protein, 6 aa, Mycobacterium
TRGGVG

SEQ ID NO: 920095 - protein, 8 aa, Mycobacterium
TRGLSDAQ

SEQ ID NO: 920096 - protein, 8 aa, Mycobacterium
TRGPAGAH

SEQ ID NO: 920097 - protein, 14 aa, Mycobacterium
TRGPGTTIQEKYAS

SEQ ID NO: 920098 - protein, 5 aa, Mycobacterium
TRGPI

SEQ ID NO: 920099 - protein, 42 aa, Mycobacterium
TRGQPEPPSVRYPGGPAPGPIPYPGAPPYGAPQYAPDGAPLY

SEQ ID NO: 920100 - protein, 7 aa, Mycobacterium
TRGRLSS

SEQ ID NO: 920101 - protein, 6 aa, Mycobacterium
TRGSTV

SEQ ID NO: 920102 - protein, 7 aa, Mycobacterium
TRGVDDR

SEQ ID NO: 920103 - protein, 5 aa, Mycobacterium
TRHDT

SEQ ID NO: 920104 - protein, 7 aa, Mycobacterium
TRHPEQL

SEQ ID NO: 920105 - protein, 6 aa, Mycobacterium
TRIAPD

SEQ ID NO: 920106 - protein, 5 aa, Mycobacterium
TRIGT

SEQ ID NO: 920107 - protein, 9 aa, Mycobacterium
TRKTGNARS

SEQ ID NO: 920108 - protein, 7 aa, Mycobacterium
TRKTLSE

SEQ ID NO: 920109 - protein, 6 aa, Mycobacterium
TRLAND

SEQ ID NO: 920110 - protein, 5 aa, Mycobacterium
TRNAG

SEQ ID NO: 920111 - protein, 5 aa, Mycobacterium
TRNGC

SEQ ID NO: 920112 - protein, 8 aa, Mycobacterium
TRNGKESL

SEQ ID NO: 920113 - protein, 14 aa, Mycobacterium
TRNLGRTNAKVTGT

SEQ ID NO: 920114 - protein, 15 aa, Mycobacterium
TRNLTEAATKTGTGH

SEQ ID NO: 920115 - protein, 6 aa, Mycobacterium
TRNNVT

SEQ ID NO: 920116 - protein, 10 aa, Mycobacterium
TRNPDRTVTV

SEQ ID NO: 920117 - protein, 9 aa, Mycobacterium
TRNQTSEQI

SEQ ID NO: 920118 - protein, 23 aa, Mycobacterium
TRPDDAPATRPAAPAAPAPTGPA

SEQ ID NO: 920119 - protein, 5 aa, Mycobacterium
TRPDG

SEQ ID NO: 920120 - protein, 9 aa, Mycobacterium
TRPDPGSGL

SEQ ID NO: 920121 - protein, 15 aa, Mycobacterium
TRPEDRYLFPGSLAQ

SEQ ID NO: 920122 - protein, 6 aa, Mycobacterium
TRPEEM

SEQ ID NO: 920123 - protein, 10 aa, Mycobacterium
TRPKNDPGYG

SEQ ID NO: 920124 - protein, 18 aa, Mycobacterium
TRPLATELDNRKAELNND

SEQ ID NO: 920125 - protein, 21 aa, Mycobacterium
TRPLATELDNRKAEVNNDIEQ

SEQ ID NO: 920126 - protein, 14 aa, Mycobacterium
TRPLGGAANRGKAY

SEQ ID NO: 920127 - protein, 7 aa, Mycobacterium
TRPPGAD

SEQ ID NO: 920128 - protein, 5 aa, Mycobacterium
TRPPL

SEQ ID NO: 920129 - protein, 16 aa, Mycobacterium
TRPRTLSSPSAGPTPL

SEQ ID NO: 920130 - protein, 5 aa, Mycobacterium
TRPYS

SEQ ID NO: 920131 - protein, 11 aa, Mycobacterium
TRQANPKLPTL

SEQ ID NO: 920132 - protein, 12 aa, Mycobacterium
TRQETPNGKPSG

SEQ ID NO: 920133 - protein, 9 aa, Mycobacterium
TRQGGPAPD

SEQ ID NO: 920134 - protein, 4 aa, Mycobacterium
TRQP

SEQ ID NO: 920135 - protein, 13 aa, Mycobacterium
TRQRDRDSTNEVS

SEQ ID NO: 920136 - protein, 5 aa, Mycobacterium
TRQSD

SEQ ID NO: 920137 - protein, 5 aa, Mycobacterium
TRQSW

SEQ ID NO: 920138 - protein, 11 aa, Mycobacterium
TRRATQQRSGM

SEQ ID NO: 920139 - protein, 11 aa, Mycobacterium
TRRRGGEVRYG

SEQ ID NO: 920140 - protein, 10 aa, Mycobacterium
TRRRGSEVRY

SEQ ID NO: 920141 - protein, 8 aa, Mycobacterium
TRRRTRPR

SEQ ID NO: 920142 - protein, 5 aa, Mycobacterium
TRRRY

SEQ ID NO: 920143 - protein, 4 aa, Mycobacterium
TRRS

SEQ ID NO: 920144 - protein, 4 aa, Mycobacterium
TRRV

SEQ ID NO: 920145 - protein, 12 aa, Mycobacterium
TRSAHDADGDSL

SEQ ID NO: 920146 - protein, 9 aa, Mycobacterium
TRSAQISEA

SEQ ID NO: 920147 - protein, 7 aa, Mycobacterium
TRSDAAL

SEQ ID NO: 920148 - protein, 13 aa, Mycobacterium
TRSDAALTGTVST

SEQ ID NO: 920149 - protein, 5 aa, Mycobacterium
TRSEP

SEQ ID NO: 920150 - protein, 20 aa, Mycobacterium
TRSGATGPTLDQLYAWWSSH

SEQ ID NO: 920151 - protein, 7 aa, Mycobacterium
TRSGNDY

SEQ ID NO: 920152 - protein, 9 aa, Mycobacterium
TRSGNGSTL

SEQ ID NO: 920153 - protein, 8 aa, Mycobacterium
TRSGWGSN

SEQ ID NO: 920154 - protein, 4 aa, Mycobacterium
TRSP

SEQ ID NO: 920155 - protein, 8 aa, Mycobacterium
TRSPGPGM

SEQ ID NO: 920156 - protein, 9 aa, Mycobacterium
TRSPPSRMS

SEQ ID NO: 920157 - protein, 10 aa, Mycobacterium
TRSRESGDFD

SEQ ID NO: 920158 - protein, 7 aa, Mycobacterium
TRSVTLT

SEQ ID NO: 920159 - protein, 13 aa, Mycobacterium
TRTADKAGHLEAS

SEQ ID NO: 920160 - protein, 8 aa, Mycobacterium
TRTGSATV

SEQ ID NO: 920161 - protein, 9 aa, Mycobacterium
TRTPATSYG

SEQ ID NO: 920162 - protein, 11 aa, Mycobacterium
TRTPDEVRSSD

SEQ ID NO: 920163 - protein, 7 aa, Mycobacterium
TRTPGRS

SEQ ID NO: 920164 - protein, 16 aa, Mycobacterium
TRTQQTATPTAQALGE

SEQ ID NO: 920165 - protein, 5 aa, Mycobacterium
TRTRL

SEQ ID NO: 920166 - protein, 10 aa, Mycobacterium
TRTSSAGGQF

SEQ ID NO: 920167 - protein, 5 aa, Mycobacterium
TRTST

SEQ ID NO: 920168 - protein, 5 aa, Mycobacterium
TRTTP

SEQ ID NO: 920169 - protein, 5 aa, Mycobacterium
TRTTR

SEQ ID NO: 920170 - protein, 5 aa, Mycobacterium
TRTTT

SEQ ID NO: 920171 - protein, 16 aa, Mycobacterium
TRTVAGQARGGEPVPG

SEQ ID NO: 920172 - protein, 4 aa, Mycobacterium
TRVG

SEQ ID NO: 920173 - protein, 5 aa, Mycobacterium
TRVRP

SEQ ID NO: 920174 - protein, 8 aa, Mycobacterium
TSAAASVE

SEQ ID NO: 920175 - protein, 17 aa, Mycobacterium
TSAACSSEGSESSDKDI

SEQ ID NO: 920176 - protein, 5 aa, Mycobacterium
TSAAM

SEQ ID NO: 920177 - protein, 46 aa, Mycobacterium
TSAAPHAAPVTTVPGGLPSMATSGRGGYGLGAPRYGVKPTVMPKPA

SEQ ID NO: 920178 - protein, 9 aa, Mycobacterium
TSADFTAEA

SEQ ID NO: 920179 - protein, 6 aa, Mycobacterium
TSADVA

SEQ ID NO: 920180 - protein, 8 aa, Mycobacterium
TSAEPNDM

SEQ ID NO: 920181 - protein, 12 aa, Mycobacterium
TSAFSSALGQRD

SEQ ID NO: 920182 - protein, 8 aa, Mycobacterium
TSAGIATT

SEQ ID NO: 920183 - protein, 9 aa, Mycobacterium
TSAGPDAVA

SEQ ID NO: 920184 - protein, 9 aa, Mycobacterium
TSAGPDAVS

SEQ ID NO: 920185 - protein, 9 aa, Mycobacterium
TSAGPDPVE

SEQ ID NO: 920186 - protein, 9 aa, Mycobacterium
TSAGPEPVA

SEQ ID NO: 920187 - protein, 10 aa, Mycobacterium
TSAGRAAASQ

SEQ ID NO: 920188 - protein, 8 aa, Mycobacterium
TSAGSAVA

SEQ ID NO: 920189 - protein, 9 aa, Mycobacterium
TSAGSTVAA

SEQ ID NO: 920190 - protein, 15 aa, Mycobacterium
TSAGTVEVRTGGAVA

SEQ ID NO: 920191 - protein, 16 aa, Mycobacterium
TSALNPYTNPDGALSR

SEQ ID NO: 920192 - protein, 12 aa, Mycobacterium
TSAMNQTNDRQQ

SEQ ID NO: 920193 - protein, 12 aa, Mycobacterium
TSANIDSPADLR

SEQ ID NO: 920194 - protein, 38 aa, Mycobacterium
TSANTATSAGGVAPAAAAGSALAQTVTSAGVGDASSVG

SEQ ID NO: 920195 - protein, 11 aa, Mycobacterium
TSAPAAAENDW

SEQ ID NO: 920196 - protein, 14 aa, Mycobacterium
TSASGFYGAPNATL

SEQ ID NO: 920197 - protein, 12 aa, Mycobacterium
TSASGTFVAEVA

SEQ ID NO: 920198 - protein, 7 aa, Mycobacterium
TSASNSE

SEQ ID NO: 920199 - protein, 9 aa, Mycobacterium
TSATQTING

SEQ ID NO: 920200 - protein, 16 aa, Mycobacterium
TSATTSTTATTAPPVP

SEQ ID NO: 920201 - protein, 9 aa, Mycobacterium
TSAVEGGPA

SEQ ID NO: 920202 - protein, 6 aa, Mycobacterium
TSAVPT

SEQ ID NO: 920203 - protein, 12 aa, Mycobacterium
TSAVRPALIALL

SEQ ID NO: 920204 - protein, 7 aa, Mycobacterium
TSAVTSG

SEQ ID NO: 920205 - protein, 24 aa, Mycobacterium
TSAYSGPTMAPGWDPADIDGGDIA

SEQ ID NO: 920206 - protein, 21 aa, Mycobacterium
TSCDPTASLRPTSDRAANDEA

SEQ ID NO: 920207 - protein, 5 aa, Mycobacterium
TSCPS

SEQ ID NO: 920208 - protein, 10 aa, Mycobacterium
TSDDDATRER

SEQ ID NO: 920209 - protein, 11 aa, Mycobacterium
TSDEGKDRVSA

SEQ ID NO: 920210 - protein, 10 aa, Mycobacterium
TSDESGEPTG

SEQ ID NO: 920211 - protein, 6 aa, Mycobacterium
TSDGSG

SEQ ID NO: 920212 - protein, 6 aa, Mycobacterium
TSDGTF

SEQ ID NO: 920213 - protein, 9 aa, Mycobacterium
TSDGYYSTY

SEQ ID NO: 920214 - protein, 10 aa, Mycobacterium
TSDKGTPGAK

SEQ ID NO: 920215 - protein, 5 aa, Mycobacterium
TSDNM

SEQ ID NO: 920216 - protein, 5 aa, Mycobacterium
TSDPF

SEQ ID NO: 920217 - protein, 6 aa, Mycobacterium
TSDPKE

SEQ ID NO: 920218 - protein, 10 aa, Mycobacterium
TSDPPSDTGW

SEQ ID NO: 920219 - protein, 8 aa, Mycobacterium
TSDPSPLN

SEQ ID NO: 920220 - protein, 10 aa, Mycobacterium
TSDQADGFQS

SEQ ID NO: 920221 - protein, 10 aa, Mycobacterium
TSDQATGFQS

SEQ ID NO: 920222 - protein, 34 aa, Mycobacterium
TSDSGGGAYFQPGDTITKATVPAEVGPALDAAEK

SEQ ID NO: 920223 - protein, 7 aa, Mycobacterium
TSDTHDP

SEQ ID NO: 920224 - protein, 5 aa, Mycobacterium
TSEAF

SEQ ID NO: 920225 - protein, 4 aa, Mycobacterium
TSEF

SEQ ID NO: 920226 - protein, 8 aa, Mycobacterium
TSEGIKES

SEQ ID NO: 920227 - protein, 20 aa, Mycobacterium
TSEPGYALAGSTDGRDADRF

SEQ ID NO: 920228 - protein, 14 aa, Mycobacterium
TSEPVPLSDPGDEC

SEQ ID NO: 920229 - protein, 6 aa, Mycobacterium
TSERER

SEQ ID NO: 920230 - protein, 4 aa, Mycobacterium
TSFE

SEQ ID NO: 920231 - protein, 21 aa, Mycobacterium
TSFGDENAPLVPAPGDPGYET

SEQ ID NO: 920232 - protein, 16 aa, Mycobacterium
TSFGNGNKVTASAFGA

SEQ ID NO: 920233 - protein, 5 aa, Mycobacterium
TSGAK

SEQ ID NO: 920234 - protein, 11 aa, Mycobacterium
TSGATGTPTEV

SEQ ID NO: 920235 - protein, 6 aa, Mycobacterium
TSGDAG

SEQ ID NO: 920236 - protein, 6 aa, Mycobacterium
TSGDDR

SEQ ID NO: 920237 - protein, 7 aa, Mycobacterium
TSGEPVD

SEQ ID NO: 920238 - protein, 5 aa, Mycobacterium
TSGGF

SEQ ID NO: 920239 - protein, 5 aa, Mycobacterium
TSGIG

SEQ ID NO: 920240 - protein, 8 aa, Mycobacterium
TSGIGRAT

SEQ ID NO: 920241 - protein, 5 aa, Mycobacterium
TSGKV

SEQ ID NO: 920242 - protein, 14 aa, Mycobacterium
TSGPAAAAGISPGD

SEQ ID NO: 920243 - protein, 7 aa, Mycobacterium
TSGPDRR

SEQ ID NO: 920244 - protein, 8 aa, Mycobacterium
TSGPLPVE

SEQ ID NO: 920245 - protein, 7 aa, Mycobacterium
TSGPPMV

SEQ ID NO: 920246 - protein, 14 aa, Mycobacterium
TSGPPQIEAATAGK

SEQ ID NO: 920247 - protein, 9 aa, Mycobacterium
TSGPPRPIE

SEQ ID NO: 920248 - protein, 5 aa, Mycobacterium
TSGQK

SEQ ID NO: 920249 - protein, 8 aa, Mycobacterium
TSGTDFSQ

SEQ ID NO: 920250 - protein, 6 aa, Mycobacterium
TSGTHS

SEQ ID NO: 920251 - protein, 9 aa, Mycobacterium
TSGTTGVPK

SEQ ID NO: 920252 - protein, 25 aa, Mycobacterium
TSGVANSGNNSSGGFNANPDQSGFF

SEQ ID NO: 920253 - protein, 8 aa, Mycobacterium
TSGVPERK

SEQ ID NO: 920254 - protein, 6 aa, Mycobacterium
TSGVPG

SEQ ID NO: 920255 - protein, 4 aa, Mycobacterium
TSGY

SEQ ID NO: 920256 - protein, 10 aa, Mycobacterium
TSHSARTRAE

SEQ ID NO: 920257 - protein, 4 aa, Mycobacterium
TSIG

SEQ ID NO: 920258 - protein, 5 aa, Mycobacterium
TSIGD

SEQ ID NO: 920259 - protein, 18 aa, Mycobacterium
TSIGDNNGVSATNSLGVG

SEQ ID NO: 920260 - protein, 7 aa, Mycobacterium
TSIPSGS

SEQ ID NO: 920261 - protein, 16 aa, Mycobacterium
TSIPTSPAFPEPHPQG

SEQ ID NO: 920262 - protein, 29 aa, Mycobacterium
TSISVSTKTATTAPAMASTANTANSSYGT

SEQ ID NO: 920263 - protein, 9 aa, Mycobacterium
TSITSPDEI

SEQ ID NO: 920264 - protein, 12 aa, Mycobacterium
TSKALKSGDRAG

SEQ ID NO: 920265 - protein, 9 aa, Mycobacterium
TSKNGPLEQ

SEQ ID NO: 920266 - protein, 7 aa, Mycobacterium
TSKSGLV

SEQ ID NO: 920267 - protein, 10 aa, Mycobacterium
TSKSTGQRAT

SEQ ID NO: 920268 - protein, 15 aa, Mycobacterium
TSLARQSISAADGFN

SEQ ID NO: 920269 - protein, 5 aa, Mycobacterium
TSLGA

SEQ ID NO: 920270 - protein, 8 aa, Mycobacterium
TSLGDGGR

SEQ ID NO: 920271 - protein, 19 aa, Mycobacterium
TSLGDGNNVSASAPGIGGN

SEQ ID NO: 920272 - protein, 4 aa, Mycobacterium
TSLP

SEQ ID NO: 920273 - protein, 9 aa, Mycobacterium
TSLRADGDY

SEQ ID NO: 920274 - protein, 21 aa, Mycobacterium
TSLSGEPKPPPQKQPKLPPPA

SEQ ID NO: 920275 - protein, 12 aa, Mycobacterium
TSLTASAQAAGY

SEQ ID NO: 920276 - protein, 8 aa, Mycobacterium
TSMATPAP

SEQ ID NO: 920277 - protein, 8 aa, Mycobacterium
TSNCGGKI

SEQ ID NO: 920278 - protein, 8 aa, Mycobacterium
TSNGEWAR

SEQ ID NO: 920279 - protein, 6 aa, Mycobacterium
TSNGRS

SEQ ID NO: 920280 - protein, 12 aa, Mycobacterium
TSNLGAAEQDPR

SEQ ID NO: 920281 - protein, 4 aa, Mycobacterium
TSNP

SEQ ID NO: 920282 - protein, 8 aa, Mycobacterium
TSNPPVPG

SEQ ID NO: 920283 - protein, 19 aa, Mycobacterium
TSNSGGQRTENVTLAEGPP

SEQ ID NO: 920284 - protein, 8 aa, Mycobacterium
TSNSPQNL

SEQ ID NO: 920285 - protein, 5 aa, Mycobacterium
TSNYD

SEQ ID NO: 920286 - protein, 21 aa, Mycobacterium
TSPADGEDCTERGPAAGECPE

SEQ ID NO: 920287 - protein, 6 aa, Mycobacterium
TSPADV

SEQ ID NO: 920288 - protein, 14 aa, Mycobacterium
TSPAGSGNSTAAAI

SEQ ID NO: 920289 - protein, 7 aa, Mycobacterium
TSPAIEQ

SEQ ID NO: 920290 - protein, 6 aa, Mycobacterium
TSPAIP

SEQ ID NO: 920291 - protein, 7 aa, Mycobacterium
TSPAIPQ

SEQ ID NO: 920292 - protein, 7 aa, Mycobacterium
TSPANES

SEQ ID NO: 920293 - protein, 12 aa, Mycobacterium
TSPAPQGPWSPP

SEQ ID NO: 920294 - protein, 12 aa, Mycobacterium
TSPAWSASPSRH

SEQ ID NO: 920295 - protein, 17 aa, Mycobacterium
TSPGAAAPGAFDGAEDY

SEQ ID NO: 920296 - protein, 20 aa, Mycobacterium
TSPGAAAPGAFDNAEDYNAN

SEQ ID NO: 920297 - protein, 21 aa, Mycobacterium
TSPHSRNRSFGERLGKGGTMQ

SEQ ID NO: 920298 - protein, 21 aa, Mycobacterium
TSPHSRNRSFGERLGRGETMQ

SEQ ID NO: 920299 - protein, 14 aa, Mycobacterium
TSPLASAENGDTHV

SEQ ID NO: 920300 - protein, 18 aa, Mycobacterium
TSPLSNHPLAGGSGASMG

SEQ ID NO: 920301 - protein, 6 aa, Mycobacterium
TSPNAD

SEQ ID NO: 920302 - protein, 7 aa, Mycobacterium
TSPNITP

SEQ ID NO: 920303 - protein, 5 aa, Mycobacterium
TSPNL

SEQ ID NO: 920304 - protein, 16 aa, Mycobacterium
TSPPAPVEQPTAAGQL

SEQ ID NO: 920305 - protein, 10 aa, Mycobacterium
TSPPLTAPPE

SEQ ID NO: 920306 - protein, 16 aa, Mycobacterium
TSPPNPGGLPPTPGIP

SEQ ID NO: 920307 - protein, 9 aa, Mycobacterium
TSPPQAPWP

SEQ ID NO: 920308 - protein, 8 aa, Mycobacterium
TSPQGPAQ

SEQ ID NO: 920309 - protein, 7 aa, Mycobacterium
TSPQNTT

SEQ ID NO: 920310 - protein, 10 aa, Mycobacterium
TSPQQSCPAE

SEQ ID NO: 920311 - protein, 5 aa, Mycobacterium
TSPRL

SEQ ID NO: 920312 - protein, 14 aa, Mycobacterium
TSPRLDESKPFKPK

SEQ ID NO: 920313 - protein, 6 aa, Mycobacterium
TSPSGN

SEQ ID NO: 920314 - protein, 7 aa, Mycobacterium
TSPSNMT

SEQ ID NO: 920315 - protein, 7 aa, Mycobacterium
TSPTATA

SEQ ID NO: 920316 - protein, 4 aa, Mycobacterium
TSQA

SEQ ID NO: 920317 - protein, 14 aa, Mycobacterium
TSQARPPAGSVTHR

SEQ ID NO: 920318 - protein, 7 aa, Mycobacterium
TSQCTGD

SEQ ID NO: 920319 - protein, 8 aa, Mycobacterium
TSQEPGAY

SEQ ID NO: 920320 - protein, 6 aa, Mycobacterium
TSQEVP

SEQ ID NO: 920321 - protein, 5 aa, Mycobacterium
TSQLR

SEQ ID NO: 920322 - protein, 11 aa, Mycobacterium
TSQLTETFAGR

SEQ ID NO: 920323 - protein, 9 aa, Mycobacterium
TSQNTATEV

SEQ ID NO: 920324 - protein, 7 aa, Mycobacterium
TSQPQWE

SEQ ID NO: 920325 - protein, 10 aa, Mycobacterium
TSQQTPADAG

SEQ ID NO: 920326 - protein, 6 aa, Mycobacterium
TSRGPH

SEQ ID NO: 920327 - protein, 7 aa, Mycobacterium
TSRIPTA

SEQ ID NO: 920328 - protein, 10 aa, Mycobacterium
TSRLGKPDDL

SEQ ID NO: 920329 - protein, 9 aa, Mycobacterium
TSRNDVRAA

SEQ ID NO: 920330 - protein, 9 aa, Mycobacterium
TSRQASQNS

SEQ ID NO: 920331 - protein, 7 aa, Mycobacterium
TSRRRDV

SEQ ID NO: 920332 - protein, 7 aa, Mycobacterium
TSRRRNR

SEQ ID NO: 920333 - protein, 14 aa, Mycobacterium
TSSADKAGRDAATF

SEQ ID NO: 920334 - protein, 22 aa, Mycobacterium
TSSAQAAAAGGGGSSASDTVDK

SEQ ID NO: 920335 - protein, 9 aa, Mycobacterium
TSSDPELTN

SEQ ID NO: 920336 - protein, 7 aa, Mycobacterium
TSSEAGL

SEQ ID NO: 920337 - protein, 23 aa, Mycobacterium
TSSEAGLVGPAGQANYGAAKAGI

SEQ ID NO: 920338 - protein, 8 aa, Mycobacterium
TSSEQAPW

SEQ ID NO: 920339 - protein, 31 aa, Mycobacterium
TSSGGSIYGTPKQIPTSETVPTDPHSPYAAG

SEQ ID NO: 920340 - protein, 32 aa, Mycobacterium
TSSGGSIYGTPPHYPTSEDAPTDPASPYAAGK

SEQ ID NO: 920341 - protein, 9 aa, Mycobacterium
TSSGNPAIY

SEQ ID NO: 920342 - protein, 9 aa, Mycobacterium
TSSGSGAGV

SEQ ID NO: 920343 - protein, 11 aa, Mycobacterium
TSSGSGPDASM

SEQ ID NO: 920344 - protein, 25 aa, Mycobacterium
TSSKPQADESSETPAAAGEAPAAAV

SEQ ID NO: 920345 - protein, 7 aa, Mycobacterium
TSSNGQL

SEQ ID NO: 920346 - protein, 5 aa, Mycobacterium
TSSPA

SEQ ID NO: 920347 - protein, 12 aa, Mycobacterium
TSSPAAAPTPDV

SEQ ID NO: 920348 - protein, 13 aa, Mycobacterium
TSSPAAAPTPDVI

SEQ ID NO: 920349 - protein, 6 aa, Mycobacterium
TSSPAH

SEQ ID NO: 920350 - protein, 11 aa, Mycobacterium
TSSPDGDDYTT

SEQ ID NO: 920351 - protein, 6 aa, Mycobacterium
TSSPGS

SEQ ID NO: 920352 - protein, 14 aa, Mycobacterium
TSSPVAADSRGLGT

SEQ ID NO: 920353 - protein, 6 aa, Mycobacterium
TSSQRW

SEQ ID NO: 920354 - protein, 4 aa, Mycobacterium
TSSR

SEQ ID NO: 920355 - protein, 5 aa, Mycobacterium
TSSRQ

SEQ ID NO: 920356 - protein, 8 aa, Mycobacterium
TSSRRGRE

SEQ ID NO: 920357 - protein, 8 aa, Mycobacterium
TSSSFEGT

SEQ ID NO: 920358 - protein, 19 aa, Mycobacterium
TSSSKDNDDIVAYYGVTKT

SEQ ID NO: 920359 - protein, 8 aa, Mycobacterium
TSSSSIGA

SEQ ID NO: 920360 - protein, 10 aa, Mycobacterium
TSSSTRYGIQ

SEQ ID NO: 920361 - protein, 8 aa, Mycobacterium
TSSTDAAD

SEQ ID NO: 920362 - protein, 8 aa, Mycobacterium
TSSVTDGA

SEQ ID NO: 920363 - protein, 6 aa, Mycobacterium
TSTADA

SEQ ID NO: 920364 - protein, 16 aa, Mycobacterium
TSTADGTRFQNNSTGH

SEQ ID NO: 920365 - protein, 9 aa, Mycobacterium
TSTANPAVP

SEQ ID NO: 920366 - protein, 9 aa, Mycobacterium
TSTARATLA

SEQ ID NO: 920367 - protein, 18 aa, Mycobacterium
TSTASAQPAVPQPTVPQP

SEQ ID NO: 920368 - protein, 9 aa, Mycobacterium
TSTDGSGQI

SEQ ID NO: 920369 - protein, 6 aa, Mycobacterium
TSTDPQ

SEQ ID NO: 920370 - protein, 6 aa, Mycobacterium
TSTDRY

SEQ ID NO: 920371 - protein, 6 aa, Mycobacterium
TSTEPQ

SEQ ID NO: 920372 - protein, 13 aa, Mycobacterium
TSTGAKSGRPRSQ

SEQ ID NO: 920373 - protein, 8 aa, Mycobacterium
TSTGKFDK

SEQ ID NO: 920374 - protein, 11 aa, Mycobacterium
TSTGSAAPLGS

SEQ ID NO: 920375 - protein, 7 aa, Mycobacterium
TSTGYVP

SEQ ID NO: 920376 - protein, 7 aa, Mycobacterium
TSTKTVP

SEQ ID NO: 920377 - protein, 4 aa, Mycobacterium
TSTL

SEQ ID NO: 920378 - protein, 6 aa, Mycobacterium
TSTLAS

SEQ ID NO: 920379 - protein, 5 aa, Mycobacterium
TSTLS

SEQ ID NO: 920380 - protein, 22 aa, Mycobacterium
TSTLSSEAVASPKNLNSTDAGG

SEQ ID NO: 920381 - protein, 7 aa, Mycobacterium
TSTPAVT

SEQ ID NO: 920382 - protein, 6 aa, Mycobacterium
TSTPFG

SEQ ID NO: 920383 - protein, 13 aa, Mycobacterium
TSTPGPPGEPDSY

SEQ ID NO: 920384 - protein, 7 aa, Mycobacterium
TSTRRLA

SEQ ID NO: 920385 - protein, 15 aa, Mycobacterium
TSTSFSTTAIAGGTN

SEQ ID NO: 920386 - protein, 6 aa, Mycobacterium
TSTSLD

SEQ ID NO: 920387 - protein, 10 aa, Mycobacterium
TSTTKVTETM

SEQ ID NO: 920388 - protein, 23 aa, Mycobacterium
TSTTSGASESESYGPSETAELTP

SEQ ID NO: 920389 - protein, 4 aa, Mycobacterium
TSTV

SEQ ID NO: 920390 - protein, 7 aa, Mycobacterium
TSVDGKD

SEQ ID NO: 920391 - protein, 11 aa, Mycobacterium
TSVEPSESGAR

SEQ ID NO: 920392 - protein, 5 aa, Mycobacterium
TSVES

SEQ ID NO: 920393 - protein, 12 aa, Mycobacterium
TSVESGTEIDSR

SEQ ID NO: 920394 - protein, 5 aa, Mycobacterium
TSVET

SEQ ID NO: 920395 - protein, 10 aa, Mycobacterium
TSVGADPAHA

SEQ ID NO: 920396 - protein, 20 aa, Mycobacterium
TSVPGPGLTPEGKGQAQQVA

SEQ ID NO: 920397 - protein, 5 aa, Mycobacterium
TSVSV

SEQ ID NO: 920398 - protein, 16 aa, Mycobacterium
TSVTEKVREPIGTGPY

SEQ ID NO: 920399 - protein, 14 aa, Mycobacterium
TSVTGTPAGSLGWG

SEQ ID NO: 920400 - protein, 12 aa, Mycobacterium
TSWSTGQPSTNA

SEQ ID NO: 920401 - protein, 20 aa, Mycobacterium
TSYGSNRQNVTEKSPPDAKL

SEQ ID NO: 920402 - protein, 8 aa, Mycobacterium
TSYGTAAA

SEQ ID NO: 920403 - protein, 6 aa, Mycobacterium
TSYTGK

SEQ ID NO: 920404 - protein, 7 aa, Mycobacterium
TSYTGPQ

SEQ ID NO: 920405 - protein, 4 aa, Mycobacterium
TTAA

SEQ ID NO: 920406 - protein, 5 aa, Mycobacterium
TTAAE

SEQ ID NO: 920407 - protein, 9 aa, Mycobacterium
TTAAPPPAR

SEQ ID NO: 920408 - protein, 16 aa, Mycobacterium
TTAASQAIADAPATDA

SEQ ID NO: 920409 - protein, 6 aa, Mycobacterium
TTAASY

SEQ ID NO: 920410 - protein, 19 aa, Mycobacterium
TTAATVAPAPAARATDSYG

SEQ ID NO: 920411 - protein, 8 aa, Mycobacterium
TTADELPG

SEQ ID NO: 920412 - protein, 11 aa, Mycobacterium
TTADTAGETIA

SEQ ID NO: 920413 - protein, 6 aa, Mycobacterium
TTAEAV

SEQ ID NO: 920414 - protein, 13 aa, Mycobacterium
TTAEEAEQARDAG

SEQ ID NO: 920415 - protein, 13 aa, Mycobacterium
TTAENLRGQGADI

SEQ ID NO: 920416 - protein, 8 aa, Mycobacterium
TTAGPGAQ

SEQ ID NO: 920417 - protein, 9 aa, Mycobacterium
TTAPSAAPN

SEQ ID NO: 920418 - protein, 55 aa, Mycobacterium
TTAPTSSLAAGAGNNGNGGGNRDHARLGTGQYTMNNSGPQMRYTPPPSGQYIGGI

SEQ ID NO: 920419 - protein, 15 aa, Mycobacterium
TTAQSQAVADAPATD

SEQ ID NO: 920420 - protein, 13 aa, Mycobacterium
TTARRRASADWTA

SEQ ID NO: 920421 - protein, 8 aa, Mycobacterium
TTASGPKP

SEQ ID NO: 920422 - protein, 15 aa, Mycobacterium
TTASVKKKDPEKTQS

SEQ ID NO: 920423 - protein, 4 aa, Mycobacterium
TTAT

SEQ ID NO: 920424 - protein, 16 aa, Mycobacterium
TTATEDAIGSAELTPQ

SEQ ID NO: 920425 - protein, 11 aa, Mycobacterium
TTATPFNTPPV

SEQ ID NO: 920426 - protein, 4 aa, Mycobacterium
TTAV

SEQ ID NO: 920427 - protein, 10 aa, Mycobacterium
TTCQQRSVET

SEQ ID NO: 920428 - protein, 6 aa, Mycobacterium
TTDAAS

SEQ ID NO: 920429 - protein, 15 aa, Mycobacterium
TTDADLARGTDFSAA

SEQ ID NO: 920430 - protein, 19 aa, Mycobacterium
TTDADSNFGRISSPEVDTK

SEQ ID NO: 920431 - protein, 12 aa, Mycobacterium
TTDAETGERVPP

SEQ ID NO: 920432 - protein, 8 aa, Mycobacterium
TTDAPTGF

SEQ ID NO: 920433 - protein, 8 aa, Mycobacterium
TTDDSEET

SEQ ID NO: 920434 - protein, 5 aa, Mycobacterium
TTDDV

SEQ ID NO: 920435 - protein, 5 aa, Mycobacterium
TTDFR

SEQ ID NO: 920436 - protein, 8 aa, Mycobacterium
TTDGSRAA

SEQ ID NO: 920437 - protein, 7 aa, Mycobacterium
TTDGTLP

SEQ ID NO: 920438 - protein, 9 aa, Mycobacterium
TTDLTNEYA

SEQ ID NO: 920439 - protein, 7 aa, Mycobacterium
TTDPGDL

SEQ ID NO: 920440 - protein, 8 aa, Mycobacterium
TTDPGSAL

SEQ ID NO: 920441 - protein, 7 aa, Mycobacterium
TTDPGSM

SEQ ID NO: 920442 - protein, 7 aa, Mycobacterium
TTDPGSV

SEQ ID NO: 920443 - protein, 6 aa, Mycobacterium
TTDPKE

SEQ ID NO: 920444 - protein, 9 aa, Mycobacterium
TTDPKPFDP

SEQ ID NO: 920445 - protein, 7 aa, Mycobacterium
TTDPKVE

SEQ ID NO: 920446 - protein, 7 aa, Mycobacterium
TTDRAAD

SEQ ID NO: 920447 - protein, 5 aa, Mycobacterium
TTDSG

SEQ ID NO: 920448 - protein, 7 aa, Mycobacterium
TTDSRED

SEQ ID NO: 920449 - protein, 8 aa, Mycobacterium
TTEAGKDS

SEQ ID NO: 920450 - protein, 9 aa, Mycobacterium
TTEDPVAGI

SEQ ID NO: 920451 - protein, 4 aa, Mycobacterium
TTEI

SEQ ID NO: 920452 - protein, 7 aa, Mycobacterium
TTEIRPT

SEQ ID NO: 920453 - protein, 8 aa, Mycobacterium
TTELRTSD

SEQ ID NO: 920454 - protein, 6 aa, Mycobacterium
TTELTR

SEQ ID NO: 920455 - protein, 5 aa, Mycobacterium
TTEPA

SEQ ID NO: 920456 - protein, 8 aa, Mycobacterium
TTEPAGKT

SEQ ID NO: 920457 - protein, 10 aa, Mycobacterium
TTEPSAAPNI

SEQ ID NO: 920458 - protein, 9 aa, Mycobacterium
TTEQAPPQR

SEQ ID NO: 920459 - protein, 6 aa, Mycobacterium
TTEQLG

SEQ ID NO: 920460 - protein, 4 aa, Mycobacterium
TTET

SEQ ID NO: 920461 - protein, 5 aa, Mycobacterium
TTEVE

SEQ ID NO: 920462 - protein, 10 aa, Mycobacterium
TTEVKAPPKR

SEQ ID NO: 920463 - protein, 9 aa, Mycobacterium
TTFSPADPA

SEQ ID NO: 920464 - protein, 6 aa, Mycobacterium
TTFTTS

SEQ ID NO: 920465 - protein, 16 aa, Mycobacterium
TTGAGSNDVGYSSGEF

SEQ ID NO: 920466 - protein, 19 aa, Mycobacterium
TTGASTAHQLQSADPEPAL

SEQ ID NO: 920467 - protein, 5 aa, Mycobacterium
TTGAT

SEQ ID NO: 920468 - protein, 10 aa, Mycobacterium
TTGATATESV

SEQ ID NO: 920469 - protein, 6 aa, Mycobacterium
TTGATV

SEQ ID NO: 920470 - protein, 4 aa, Mycobacterium
TTGD

SEQ ID NO: 920471 - protein, 7 aa, Mycobacterium
TTGDLND

SEQ ID NO: 920472 - protein, 7 aa, Mycobacterium
TTGDLTG

SEQ ID NO: 920473 - protein, 10 aa, Mycobacterium
TTGDPATPYE

SEQ ID NO: 920474 - protein, 11 aa, Mycobacterium
TTGDPATPYQA

SEQ ID NO: 920475 - protein, 11 aa, Mycobacterium
TTGDSSDAASI

SEQ ID NO: 920476 - protein, 11 aa, Mycobacterium
TTGGDFPHPSG

SEQ ID NO: 920477 - protein, 14 aa, Mycobacterium
TTGGGYPDGDEVYY

SEQ ID NO: 920478 - protein, 14 aa, Mycobacterium
TTGGGYPTGKEIYL

SEQ ID NO: 920479 - protein, 6 aa, Mycobacterium
TTGGLA

SEQ ID NO: 920480 - protein, 5 aa, Mycobacterium
TTGGM

SEQ ID NO: 920481 - protein, 18 aa, Mycobacterium
TTGGRTKATGGNAPDAIT

SEQ ID NO: 920482 - protein, 10 aa, Mycobacterium
TTGGSTSHAP

SEQ ID NO: 920483 - protein, 7 aa, Mycobacterium
TTGHSNG

SEQ ID NO: 920484 - protein, 11 aa, Mycobacterium
TTGPTGVTGGS

SEQ ID NO: 920485 - protein, 5 aa, Mycobacterium
TTGQF

SEQ ID NO: 920486 - protein, 4 aa, Mycobacterium
TTGR

SEQ ID NO: 920487 - protein, 6 aa, Mycobacterium
TTGTPT

SEQ ID NO: 920488 - protein, 42 aa, Mycobacterium
TTGTPVPGDQTGPGVARDTDAVPDASRVTPPRLADDDERPEL

SEQ ID NO: 920489 - protein, 7 aa, Mycobacterium
TTGYISP

SEQ ID NO: 920490 - protein, 10 aa, Mycobacterium
TTHDGPQHHT

SEQ ID NO: 920491 - protein, 6 aa, Mycobacterium
TTHRTD

SEQ ID NO: 920492 - protein, 4 aa, Mycobacterium
TTIP

SEQ ID NO: 920493 - protein, 5 aa, Mycobacterium
TTKDD

SEQ ID NO: 920494 - protein, 5 aa, Mycobacterium
TTKER

SEQ ID NO: 920495 - protein, 4 aa, Mycobacterium
TTKG

SEQ ID NO: 920496 - protein, 13 aa, Mycobacterium
TTKITGNSAADDI

SEQ ID NO: 920497 - protein, 6 aa, Mycobacterium
TTKPAV

SEQ ID NO: 920498 - protein, 7 aa, Mycobacterium
TTKPPVE

SEQ ID NO: 920499 - protein, 11 aa, Mycobacterium
TTKPRAPGRAG

SEQ ID NO: 920500 - protein, 33 aa, Mycobacterium
TTKSENQNRAQQLADSVRSGDGHRLMSAFGFGA

SEQ ID NO: 920501 - protein, 7 aa, Mycobacterium
TTKSRAR

SEQ ID NO: 920502 - protein, 9 aa, Mycobacterium
TTKSYPGYR

SEQ ID NO: 920503 - protein, 4 aa, Mycobacterium
TTKV

SEQ ID NO: 920504 - protein, 8 aa, Mycobacterium
TTLAGTAA

SEQ ID NO: 920505 - protein, 6 aa, Mycobacterium
TTLDTG

SEQ ID NO: 920506 - protein, 19 aa, Mycobacterium
TTLDTNAAAPVSDHNDADV

SEQ ID NO: 920507 - protein, 5 aa, Mycobacterium
TTLGR

SEQ ID NO: 920508 - protein, 10 aa, Mycobacterium
TTLGSGPALP

SEQ ID NO: 920509 - protein, 7 aa, Mycobacterium
TTLPDGA

SEQ ID NO: 920510 - protein, 8 aa, Mycobacterium
TTLPQNSP

SEQ ID NO: 920511 - protein, 5 aa, Mycobacterium
TTLPS

SEQ ID NO: 920512 - protein, 5 aa, Mycobacterium
TTLSN

SEQ ID NO: 920513 - protein, 16 aa, Mycobacterium
TTLSQRSLNGKPALDI

SEQ ID NO: 920514 - protein, 10 aa, Mycobacterium
TTNARDQSRL

SEQ ID NO: 920515 - protein, 7 aa, Mycobacterium
TTNDREW

SEQ ID NO: 920516 - protein, 7 aa, Mycobacterium
TTNENTT

SEQ ID NO: 920517 - protein, 16 aa, Mycobacterium
TTNGCAATGTQLDDAT

SEQ ID NO: 920518 - protein, 10 aa, Mycobacterium
TTNGIGSQPW

SEQ ID NO: 920519 - protein, 18 aa, Mycobacterium
TTNPAQGLSGMMVPPEGG

SEQ ID NO: 920520 - protein, 8 aa, Mycobacterium
TTNPPVEG

SEQ ID NO: 920521 - protein, 5 aa, Mycobacterium
TTNPY

SEQ ID NO: 920522 - protein, 6 aa, Mycobacterium
TTNSAT

SEQ ID NO: 920523 - protein, 25 aa, Mycobacterium
TTNTAGTALTDQPTTVATATPSDSI

SEQ ID NO: 920524 - protein, 12 aa, Mycobacterium
TTPAARATATDD

SEQ ID NO: 920525 - protein, 13 aa, Mycobacterium
TTPASAPATPLAS

SEQ ID NO: 920526 - protein, 16 aa, Mycobacterium
TTPDSVQTRPGNCGRD

SEQ ID NO: 920527 - protein, 6 aa, Mycobacterium
TTPEDV

SEQ ID NO: 920528 - protein, 8 aa, Mycobacterium
TTPEQALS

SEQ ID NO: 920529 - protein, 12 aa, Mycobacterium
TTPGAALAAAAG

SEQ ID NO: 920530 - protein, 7 aa, Mycobacterium
TTPGPEG

SEQ ID NO: 920531 - protein, 4 aa, Mycobacterium
TTPH

SEQ ID NO: 920532 - protein, 14 aa, Mycobacterium
TTPHQTGPNSTGDI

SEQ ID NO: 920533 - protein, 4 aa, Mycobacterium
TTPI

SEQ ID NO: 920534 - protein, 11 aa, Mycobacterium
TTPLKPEQAEW

SEQ ID NO: 920535 - protein, 26 aa, Mycobacterium
TTPLSTQPPSGPTVPPEHFSLPTHPV

SEQ ID NO: 920536 - protein, 10 aa, Mycobacterium
TTPQQPCTSG

SEQ ID NO: 920537 - protein, 17 aa, Mycobacterium
TTPQSHGAQAQKGPSVR

SEQ ID NO: 920538 - protein, 4 aa, Mycobacterium
TTPS

SEQ ID NO: 920539 - protein, 6 aa, Mycobacterium
TTPTET

SEQ ID NO: 920540 - protein, 22 aa, Mycobacterium
TTPTTARTEHHPTEHAQNGSNV

SEQ ID NO: 920541 - protein, 8 aa, Mycobacterium
TTQAGERF

SEQ ID NO: 920542 - protein, 15 aa, Mycobacterium
TTQARLERGISGELE

SEQ ID NO: 920543 - protein, 9 aa, Mycobacterium
TTQEGADGW

SEQ ID NO: 920544 - protein, 5 aa, Mycobacterium
TTQLE

SEQ ID NO: 920545 - protein, 9 aa, Mycobacterium
TTQNQKAAE

SEQ ID NO: 920546 - protein, 4 aa, Mycobacterium
TTQP

SEQ ID NO: 920547 - protein, 8 aa, Mycobacterium
TTQPRDGW

SEQ ID NO: 920548 - protein, 15 aa, Mycobacterium
TTQPVGGTGGNGGRA

SEQ ID NO: 920549 - protein, 18 aa, Mycobacterium
TTQTAEGAAQLARLAGRP

SEQ ID NO: 920550 - protein, 4 aa, Mycobacterium
TTRA

SEQ ID NO: 920551 - protein, 4 aa, Mycobacterium
TTRG

SEQ ID NO: 920552 - protein, 6 aa, Mycobacterium
TTRGPV

SEQ ID NO: 920553 - protein, 9 aa, Mycobacterium
TTRGSELTP

SEQ ID NO: 920554 - protein, 16 aa, Mycobacterium
TTRKLDDKVAVSRVIN

SEQ ID NO: 920555 - protein, 6 aa, Mycobacterium
TTRKRE

SEQ ID NO: 920556 - protein, 8 aa, Mycobacterium
TTRRPDTY

SEQ ID NO: 920557 - protein, 13 aa, Mycobacterium
TTRSNPDGTTGGS

SEQ ID NO: 920558 - protein, 7 aa, Mycobacterium
TTRTGTK

SEQ ID NO: 920559 - protein, 5 aa, Mycobacterium
TTSAM

SEQ ID NO: 920560 - protein, 19 aa, Mycobacterium
TTSATPTSPSAAADSAEPM

SEQ ID NO: 920561 - protein, 7 aa, Mycobacterium
TTSDPYV

SEQ ID NO: 920562 - protein, 7 aa, Mycobacterium
TTSDTGV

SEQ ID NO: 920563 - protein, 6 aa, Mycobacterium
TTSGDH

SEQ ID NO: 920564 - protein, 13 aa, Mycobacterium
TTSGRHGAYSGSH

SEQ ID NO: 920565 - protein, 10 aa, Mycobacterium
TTSHSEAANA

SEQ ID NO: 920566 - protein, 8 aa, Mycobacterium
TTSKPAPG

SEQ ID NO: 920567 - protein, 5 aa, Mycobacterium
TTSKV

SEQ ID NO: 920568 - protein, 11 aa, Mycobacterium
TTSMNQKQAEW

SEQ ID NO: 920569 - protein, 11 aa, Mycobacterium
TTSMSQKQAEW

SEQ ID NO: 920570 - protein, 6 aa, Mycobacterium
TTSPEF

SEQ ID NO: 920571 - protein, 4 aa, Mycobacterium
TTSS

SEQ ID NO: 920572 - protein, 9 aa, Mycobacterium
TTSSDAISV

SEQ ID NO: 920573 - protein, 18 aa, Mycobacterium
TTSTTTTTTTRAAKPVPL

SEQ ID NO: 920574 - protein, 7 aa, Mycobacterium
TTSTVSQ

SEQ ID NO: 920575 - protein, 10 aa, Mycobacterium
TTTADPGVPA

SEQ ID NO: 920576 - protein, 22 aa, Mycobacterium
TTTATCEAGKSLNITGANNTLT

SEQ ID NO: 920577 - protein, 25 aa, Mycobacterium
TTTDPDGDDLSGSLNTSNNGQGDPW

SEQ ID NO: 920578 - protein, 11 aa, Mycobacterium
TTTDRQAAEKD

SEQ ID NO: 920579 - protein, 7 aa, Mycobacterium
TTTEGYR

SEQ ID NO: 920580 - protein, 5 aa, Mycobacterium
TTTEK

SEQ ID NO: 920581 - protein, 11 aa, Mycobacterium
TTTGATVTASD

SEQ ID NO: 920582 - protein, 15 aa, Mycobacterium
TTTGGGYPTGDEVYL

SEQ ID NO: 920583 - protein, 23 aa, Mycobacterium
TTTHQAGQESTIAPPTKAATAVT

SEQ ID NO: 920584 - protein, 4 aa, Mycobacterium
TTTI

SEQ ID NO: 920585 - protein, 7 aa, Mycobacterium
TTTITNP

SEQ ID NO: 920586 - protein, 5 aa, Mycobacterium
TTTLG

SEQ ID NO: 920587 - protein, 30 aa, Mycobacterium
TTTLTAASSPWRQDPYRDVQGGSSTADYQK

SEQ ID NO: 920588 - protein, 4 aa, Mycobacterium
TTTN

SEQ ID NO: 920589 - protein, 9 aa, Mycobacterium
TTTNDPSYA

SEQ ID NO: 920590 - protein, 10 aa, Mycobacterium
TTTPEYAEEH

SEQ ID NO: 920591 - protein, 8 aa, Mycobacterium
TTTPGVGN

SEQ ID NO: 920592 - protein, 6 aa, Mycobacterium
TTTPPH

SEQ ID NO: 920593 - protein, 5 aa, Mycobacterium
TTTPS

SEQ ID NO: 920594 - protein, 4 aa, Mycobacterium
TTTS

SEQ ID NO: 920595 - protein, 6 aa, Mycobacterium
TTTSDL

SEQ ID NO: 920596 - protein, 11 aa, Mycobacterium
TTTSQVNTAMA

SEQ ID NO: 920597 - protein, 4 aa, Mycobacterium
TTTT

SEQ ID NO: 920598 - protein, 15 aa, Mycobacterium
TTTTTTTTPSGEPPV

SEQ ID NO: 920599 - protein, 10 aa, Mycobacterium
TTVAGTALPA

SEQ ID NO: 920600 - protein, 8 aa, Mycobacterium
TTVASQSG

SEQ ID NO: 920601 - protein, 8 aa, Mycobacterium
TTVGARGS

SEQ ID NO: 920602 - protein, 12 aa, Mycobacterium
TTVNSRGAKDTT

SEQ ID NO: 920603 - protein, 30 aa, Mycobacterium
TTVPPPSTPSTLGEEPDGGALSAPVSPFDT

SEQ ID NO: 920604 - protein, 19 aa, Mycobacterium
TTVPSGPGVPPVSDAARAA

SEQ ID NO: 920605 - protein, 13 aa, Mycobacterium
TTVSGTRHTVEGS

SEQ ID NO: 920606 - protein, 11 aa, Mycobacterium
TTVSPSKKIGG

SEQ ID NO: 920607 - protein, 12 aa, Mycobacterium
TTVTPKKKIDGG

SEQ ID NO: 920608 - protein, 8 aa, Mycobacterium
TTYANNTN

SEQ ID NO: 920609 - protein, 24 aa, Mycobacterium
TTYGDGPAKSDPSDSAGPAPGGGE

SEQ ID NO: 920610 - protein, 6 aa, Mycobacterium
TTYSGQ

SEQ ID NO: 920611 - protein, 5 aa, Mycobacterium
TVAAP

SEQ ID NO: 920612 - protein, 9 aa, Mycobacterium
TVAEDSGTT

SEQ ID NO: 920613 - protein, 9 aa, Mycobacterium
TVAEDSSPT

SEQ ID NO: 920614 - protein, 17 aa, Mycobacterium
TVAGAGSAWAGPAAPNA

SEQ ID NO: 920615 - protein, 13 aa, Mycobacterium
TVAKGPATRPLDA

SEQ ID NO: 920616 - protein, 10 aa, Mycobacterium
TVANGGGLGQ

SEQ ID NO: 920617 - protein, 6 aa, Mycobacterium
TVAPGA

SEQ ID NO: 920618 - protein, 7 aa, Mycobacterium
TVAPGAT

SEQ ID NO: 920619 - protein, 7 aa, Mycobacterium
TVAQSGT

SEQ ID NO: 920620 - protein, 11 aa, Mycobacterium
TVASELERTDA

SEQ ID NO: 920621 - protein, 13 aa, Mycobacterium
TVASQTRAVGERA

SEQ ID NO: 920622 - protein, 5 aa, Mycobacterium
TVASR

SEQ ID NO: 920623 - protein, 11 aa, Mycobacterium
TVCSSPGNVQI

SEQ ID NO: 920624 - protein, 11 aa, Mycobacterium
TVDADAAGEID

SEQ ID NO: 920625 - protein, 17 aa, Mycobacterium
TVDAKTGRRGPARTSYA

SEQ ID NO: 920626 - protein, 7 aa, Mycobacterium
TVDATGT

SEQ ID NO: 920627 - protein, 9 aa, Mycobacterium
TVDEGGTTT

SEQ ID NO: 920628 - protein, 19 aa, Mycobacterium
TVDESSEDTGASDKKTDVI

SEQ ID NO: 920629 - protein, 10 aa, Mycobacterium
TVDGRSVTPA

SEQ ID NO: 920630 - protein, 6 aa, Mycobacterium
TVDGTR

SEQ ID NO: 920631 - protein, 7 aa, Mycobacterium
TVDTGNL

SEQ ID NO: 920632 - protein, 14 aa, Mycobacterium
TVEASDALTGAEET

SEQ ID NO: 920633 - protein, 9 aa, Mycobacterium
TVEDAKGNK

SEQ ID NO: 920634 - protein, 49 aa, Mycobacterium
TVEEDTGASDHAVGNHPDAEADDAAPANGSAKSSDDDGDSDDDASERAA

SEQ ID NO: 920635 - protein, 32 aa, Mycobacterium
TVEGTASAPVEAAGWGNSQGAGVTVGGAGDVA

SEQ ID NO: 920636 - protein, 13 aa, Mycobacterium
TVEPTRSATDSFN

SEQ ID NO: 920637 - protein, 10 aa, Mycobacterium
TVESHNGTYH

SEQ ID NO: 920638 - protein, 5 aa, Mycobacterium
TVEYR

SEQ ID NO: 920639 - protein, 6 aa, Mycobacterium
TVGGGA

SEQ ID NO: 920640 - protein, 37 aa, Mycobacterium
TVGGQAQQTQTSAGASATPSGGKPAAPSAPPAAGAPI

SEQ ID NO: 920641 - protein, 8 aa, Mycobacterium
TVGNTSNL

SEQ ID NO: 920642 - protein, 7 aa, Mycobacterium
TVGPIPD

SEQ ID NO: 920643 - protein, 9 aa, Mycobacterium
TVGPKKVDA

SEQ ID NO: 920644 - protein, 9 aa, Mycobacterium
TVGPRTPAI

SEQ ID NO: 920645 - protein, 8 aa, Mycobacterium
TVGPTSTS

SEQ ID NO: 920646 - protein, 5 aa, Mycobacterium
TVGQT

SEQ ID NO: 920647 - protein, 16 aa, Mycobacterium
TVGSNQPEEAPSPGAS

SEQ ID NO: 920648 - protein, 6 aa, Mycobacterium
TVGTAT

SEQ ID NO: 920649 - protein, 5 aa, Mycobacterium
TVGTD

SEQ ID NO: 920650 - protein, 4 aa, Mycobacterium
TVHD

SEQ ID NO: 920651 - protein, 8 aa, Mycobacterium
TVHGGSGH

SEQ ID NO: 920652 - protein, 8 aa, Mycobacterium
TVIPPSTT

SEQ ID NO: 920653 - protein, 5 aa, Mycobacterium
TVIPT

SEQ ID NO: 920654 - protein, 5 aa, Mycobacterium
TVKGV

SEQ ID NO: 920655 - protein, 9 aa, Mycobacterium
TVKPQIANN

SEQ ID NO: 920656 - protein, 9 aa, Mycobacterium
TVKSSKPPM

SEQ ID NO: 920657 - protein, 12 aa, Mycobacterium
TVNADDQTLDGR

SEQ ID NO: 920658 - protein, 13 aa, Mycobacterium
TVNAQYDPTENSI

SEQ ID NO: 920659 - protein, 10 aa, Mycobacterium
TVNKTSGDAM

SEQ ID NO: 920660 - protein, 9 aa, Mycobacterium
TVNRPTPDR

SEQ ID NO: 920661 - protein, 14 aa, Mycobacterium
TVPAQPASPGSSTQ

SEQ ID NO: 920662 - protein, 17 aa, Mycobacterium
TVPDPVAGATAAAARNA

SEQ ID NO: 920663 - protein, 4 aa, Mycobacterium
TVPG

SEQ ID NO: 920664 - protein, 4 aa, Mycobacterium
TVPP

SEQ ID NO: 920665 - protein, 8 aa, Mycobacterium
TVPPAEVA

SEQ ID NO: 920666 - protein, 7 aa, Mycobacterium
TVPPPEI

SEQ ID NO: 920667 - protein, 15 aa, Mycobacterium
TVPRSARDLPEFGPD

SEQ ID NO: 920668 - protein, 23 aa, Mycobacterium
TVPTPEQTEKASKYLAENWASAV

SEQ ID NO: 920669 - protein, 6 aa, Mycobacterium
TVPVET

SEQ ID NO: 920670 - protein, 19 aa, Mycobacterium
TVPVTDGLSADEIEAQKDT

SEQ ID NO: 920671 - protein, 7 aa, Mycobacterium
TVPYEQR

SEQ ID NO: 920672 - protein, 13 aa, Mycobacterium
TVPYGGKVGDPGF

SEQ ID NO: 920673 - protein, 14 aa, Mycobacterium
TVQASDALTGAEET

SEQ ID NO: 920674 - protein, 11 aa, Mycobacterium
TVQIDDGGKVS

SEQ ID NO: 920675 - protein, 8 aa, Mycobacterium
TVQQPLGQ

SEQ ID NO: 920676 - protein, 9 aa, Mycobacterium
TVRAERGTI

SEQ ID NO: 920677 - protein, 8 aa, Mycobacterium
TVRNGGQA

SEQ ID NO: 920678 - protein, 5 aa, Mycobacterium
TVRRG

SEQ ID NO: 920679 - protein, 9 aa, Mycobacterium
TVRSTPKGT

SEQ ID NO: 920680 - protein, 10 aa, Mycobacterium
TVRTPADGVV

SEQ ID NO: 920681 - protein, 11 aa, Mycobacterium
TVSGGGGGKNV

SEQ ID NO: 920682 - protein, 10 aa, Mycobacterium
TVSGSVPPTV

SEQ ID NO: 920683 - protein, 10 aa, Mycobacterium
TVSKSDGERA

SEQ ID NO: 920684 - protein, 5 aa, Mycobacterium
TVSNR

SEQ ID NO: 920685 - protein, 18 aa, Mycobacterium
TVSPDADSVPDEIRELLD

SEQ ID NO: 920686 - protein, 10 aa, Mycobacterium
TVSPSKKIGG

SEQ ID NO: 920687 - protein, 8 aa, Mycobacterium
TVSSPTPY

SEQ ID NO: 920688 - protein, 4 aa, Mycobacterium
TVST

SEQ ID NO: 920689 - protein, 5 aa, Mycobacterium
TVTAT

SEQ ID NO: 920690 - protein, 7 aa, Mycobacterium
TVTDDDY

SEQ ID NO: 920691 - protein, 8 aa, Mycobacterium
TVTERDGQ

SEQ ID NO: 920692 - protein, 16 aa, Mycobacterium
TVTGGTAQVDPAEAPV

SEQ ID NO: 920693 - protein, 10 aa, Mycobacterium
TVTGQGDGLR

SEQ ID NO: 920694 - protein, 11 aa, Mycobacterium
TVTGSGNDLQV

SEQ ID NO: 920695 - protein, 9 aa, Mycobacterium
TVTGSTNAP

SEQ ID NO: 920696 - protein, 10 aa, Mycobacterium
TVTGSVPPTV

SEQ ID NO: 920697 - protein, 18 aa, Mycobacterium
TVTGTDPNGTATGPTTVT

SEQ ID NO: 920698 - protein, 5 aa, Mycobacterium
TVTGY

SEQ ID NO: 920699 - protein, 16 aa, Mycobacterium
TVTKEPLKSLGNTNTA

SEQ ID NO: 920700 - protein, 10 aa, Mycobacterium
TVTPDKQIDG

SEQ ID NO: 920701 - protein, 6 aa, Mycobacterium
TVTPIT

SEQ ID NO: 920702 - protein, 25 aa, Mycobacterium
TVTPSGNVDCGGRPTLKASGSTAQE

SEQ ID NO: 920703 - protein, 9 aa, Mycobacterium
TVTPVGSGY

SEQ ID NO: 920704 - protein, 7 aa, Mycobacterium
TVTTDDV

SEQ ID NO: 920705 - protein, 8 aa, Mycobacterium
TVTTDDVR

SEQ ID NO: 920706 - protein, 8 aa, Mycobacterium
TVTTGTAL

SEQ ID NO: 920707 - protein, 11 aa, Mycobacterium
TVTTNTLGGVT

SEQ ID NO: 920708 - protein, 11 aa, Mycobacterium
TVTTVSDHKDD

SEQ ID NO: 920709 - protein, 9 aa, Mycobacterium
TVYTTSEPL

SEQ ID NO: 920710 - protein, 9 aa, Mycobacterium
TWASAHPAA

SEQ ID NO: 920711 - protein, 7 aa, Mycobacterium
TWTGAGG

SEQ ID NO: 920712 - protein, 13 aa, Mycobacterium
TWVPGDPNAATPI

SEQ ID NO: 920713 - protein, 7 aa, Mycobacterium
TYAPGRA

SEQ ID NO: 920714 - protein, 23 aa, Mycobacterium
TYASVGAQPRDIKPVATRSPQFD

SEQ ID NO: 920715 - protein, 10 aa, Mycobacterium
TYDPATPYQA

SEQ ID NO: 920716 - protein, 6 aa, Mycobacterium
TYDPRR

SEQ ID NO: 920717 - protein, 8 aa, Mycobacterium
TYDPRRID

SEQ ID NO: 920718 - protein, 4 aa, Mycobacterium
TYEQ

SEQ ID NO: 920719 - protein, 7 aa, Mycobacterium
TYGAGTY

SEQ ID NO: 920720 - protein, 5 aa, Mycobacterium
TYGLP

SEQ ID NO: 920721 - protein, 7 aa, Mycobacterium
TYGNPVG

SEQ ID NO: 920722 - protein, 12 aa, Mycobacterium
TYGPGDWAPTPH

SEQ ID NO: 920723 - protein, 7 aa, Mycobacterium
TYGPSGV

SEQ ID NO: 920724 - protein, 13 aa, Mycobacterium
TYGQGGDINSPHD

SEQ ID NO: 920725 - protein, 5 aa, Mycobacterium
TYGTG

SEQ ID NO: 920726 - protein, 14 aa, Mycobacterium
TYGVPANSPDGYRT

SEQ ID NO: 920727 - protein, 15 aa, Mycobacterium
TYGVPVDDPSGEGYK

SEQ ID NO: 920728 - protein, 14 aa, Mycobacterium
TYGVPVNSPDGYRT

SEQ ID NO: 920729 - protein, 21 aa, Mycobacterium
TYKDGDPKVDNLGSDNTINKG

SEQ ID NO: 920730 - protein, 21 aa, Mycobacterium
TYKTGEPKVNNYGSNNTIQKA

SEQ ID NO: 920731 - protein, 16 aa, Mycobacterium
TYNPPSSSLAPENYDA

SEQ ID NO: 920732 - protein, 4 aa, Mycobacterium
TYPG

SEQ ID NO: 920733 - protein, 6 aa, Mycobacterium
TYPGDF

SEQ ID NO: 920734 - protein, 15 aa, Mycobacterium
TYPGSKEGIGDDTTV

SEQ ID NO: 920735 - protein, 5 aa, Mycobacterium
TYPGT

SEQ ID NO: 920736 - protein, 14 aa, Mycobacterium
TYPQYDDGETSYEL

SEQ ID NO: 920737 - protein, 5 aa, Mycobacterium
TYPTS

SEQ ID NO: 920738 - protein, 5 aa, Mycobacterium
TYPVD

SEQ ID NO: 920739 - protein, 12 aa, Mycobacterium
TYQGKGAHPSDS

SEQ ID NO: 920740 - protein, 23 aa, Mycobacterium
TYQSPSVCTGAEVDGETVTRTEP

SEQ ID NO: 920741 - protein, 20 aa, Mycobacterium
TYRDGDPKINNTGSGNSVSK

SEQ ID NO: 920742 - protein, 20 aa, Mycobacterium
TYRDGDPQVNDTGSNNTITK

SEQ ID NO: 920743 - protein, 7 aa, Mycobacterium
TYRGTTI

SEQ ID NO: 920744 - protein, 9 aa, Mycobacterium
TYRGTTVGR

SEQ ID NO: 920745 - protein, 13 aa, Mycobacterium
TYRPAAGYSGTDT

SEQ ID NO: 920746 - protein, 7 aa, Mycobacterium
TYSEDGD

SEQ ID NO: 920747 - protein, 7 aa, Mycobacterium
TYSGPDM

SEQ ID NO: 920748 - protein, 12 aa, Mycobacterium
TYSPADGSSEST

SEQ ID NO: 920749 - protein, 5 aa, Mycobacterium
TYSPE

SEQ ID NO: 920750 - protein, 4 aa, Mycobacterium
TYSQ

SEQ ID NO: 920751 - protein, 11 aa, Mycobacterium
TYTPESNFHGT

SEQ ID NO: 920752 - protein, 7 aa, Mycobacterium
TYTPGAA

SEQ ID NO: 920753 - protein, 7 aa, Mycobacterium
TYTPGAN

SEQ ID NO: 920754 - protein, 4 aa, Mycobacterium
TYTS

SEQ ID NO: 920755 - protein, 27 aa, Mycobacterium
VAAADDYAGQKYSDAESALSDAGEKGV

SEQ ID NO: 920756 - protein, 78 aa, Mycobacterium
VAAADTGAASADQSAGASTSDTRTSGKPSEKSSSRPTSETGDADAADPASEDDESSVPVDDAAPEEQAGETDGATEPI

SEQ ID NO: 920757 - protein, 9 aa, Mycobacterium
VAAAGPTSN

SEQ ID NO: 920758 - protein, 23 aa, Mycobacterium
VAAAPNPPLGAQPQLASDPAQLA

SEQ ID NO: 920759 - protein, 5 aa, Mycobacterium
VAAAT

SEQ ID NO: 920760 - protein, 6 aa, Mycobacterium
VAAATS

SEQ ID NO: 920761 - protein, 7 aa, Mycobacterium
VAADDGA

SEQ ID NO: 920762 - protein, 6 aa, Mycobacterium
VAADGD

SEQ ID NO: 920763 - protein, 18 aa, Mycobacterium
VAADNSQISITTDAPTGY

SEQ ID NO: 920764 - protein, 18 aa, Mycobacterium
VAADTSGVVAPPSPTAPC

SEQ ID NO: 920765 - protein, 10 aa, Mycobacterium
VAAEAPRSAH

SEQ ID NO: 920766 - protein, 15 aa, Mycobacterium
VAAEGRAGYGMPGDH

SEQ ID NO: 920767 - protein, 40 aa, Mycobacterium
VAAESAAAAVAGGALGAHGGSGAASACGSAGTAGAALAAG

SEQ ID NO: 920768 - protein, 36 aa, Mycobacterium
VAAESAGAAVAGGARRPNGGSGAALTGRATSTAGAA

SEQ ID NO: 920769 - protein, 4 aa, Mycobacterium
VAAG

SEQ ID NO: 920770 - protein, 7 aa, Mycobacterium
VAAGAGK

SEQ ID NO: 920771 - protein, 7 aa, Mycobacterium
VAAGDTA

SEQ ID NO: 920772 - protein, 9 aa, Mycobacterium
VAAGEPVPE

SEQ ID NO: 920773 - protein, 12 aa, Mycobacterium
VAAGGTKDLLPG

SEQ ID NO: 920774 - protein, 17 aa, Mycobacterium
VAAGQSIGTLDEGHSGC

SEQ ID NO: 920775 - protein, 8 aa, Mycobacterium
VAAGRTPV

SEQ ID NO: 920776 - protein, 10 aa, Mycobacterium
VAAKGGPQCT

SEQ ID NO: 920777 - protein, 10 aa, Mycobacterium
VAAKSGGRDY

SEQ ID NO: 920778 - protein, 7 aa, Mycobacterium
VAANTTD

SEQ ID NO: 920779 - protein, 16 aa, Mycobacterium
VAAPPGDDNPSPRDDL

SEQ ID NO: 920780 - protein, 17 aa, Mycobacterium
VAAPPPVPGAQPAPPPA

SEQ ID NO: 920781 - protein, 25 aa, Mycobacterium
VAAPTAPAAAATPAIPGVTTPIPGV

SEQ ID NO: 920782 - protein, 12 aa, Mycobacterium
VAAPTPKVPGFD

SEQ ID NO: 920783 - protein, 13 aa, Mycobacterium
VAAPTRSYTAQFT

SEQ ID NO: 920784 - protein, 8 aa, Mycobacterium
VAAPTTAL

SEQ ID NO: 920785 - protein, 6 aa, Mycobacterium
VAARGP

SEQ ID NO: 920786 - protein, 6 aa, Mycobacterium
VAARRD

SEQ ID NO: 920787 - protein, 7 aa, Mycobacterium
VAASEGA

SEQ ID NO: 920788 - protein, 27 aa, Mycobacterium
VAASGGGTSMGAAPATTGGSGMYGGTP

SEQ ID NO: 920789 - protein, 6 aa, Mycobacterium
VAASPA

SEQ ID NO: 920790 - protein, 8 aa, Mycobacterium
VAATGGPQ

SEQ ID NO: 920791 - protein, 9 aa, Mycobacterium
VAATGGPQC

SEQ ID NO: 920792 - protein, 10 aa, Mycobacterium
VAATGGPQCT

SEQ ID NO: 920793 - protein, 11 aa, Mycobacterium
VAATPTSGPTV

SEQ ID NO: 920794 - protein, 4 aa, Mycobacterium
VAAV

SEQ ID NO: 920795 - protein, 6 aa, Mycobacterium
VADART

SEQ ID NO: 920796 - protein, 11 aa, Mycobacterium
VADDAPPPDAP

SEQ ID NO: 920797 - protein, 5 aa, Mycobacterium
VADGD

SEQ ID NO: 920798 - protein, 6 aa, Mycobacterium
VADGGR

SEQ ID NO: 920799 - protein, 7 aa, Mycobacterium
VADKSAY

SEQ ID NO: 920800 - protein, 4 aa, Mycobacterium
VADP

SEQ ID NO: 920801 - protein, 9 aa, Mycobacterium
VADPADDAL

SEQ ID NO: 920802 - protein, 6 aa, Mycobacterium
VADPAT

SEQ ID NO: 920803 - protein, 10 aa, Mycobacterium
VADPNGSRIA

SEQ ID NO: 920804 - protein, 7 aa, Mycobacterium
VADPRLP

SEQ ID NO: 920805 - protein, 10 aa, Mycobacterium
VADQLDGEPG

SEQ ID NO: 920806 - protein, 11 aa, Mycobacterium
VADQPTDVGGR

SEQ ID NO: 920807 - protein, 15 aa, Mycobacterium
VADSKQHSLPQGDDT

SEQ ID NO: 920808 - protein, 24 aa, Mycobacterium
VAEAQSAAKEIGQIDPVSRHQLPE

SEQ ID NO: 920809 - protein, 7 aa, Mycobacterium
VAEDPGF

SEQ ID NO: 920810 - protein, 8 aa, Mycobacterium
VAEDSGPT

SEQ ID NO: 920811 - protein, 10 aa, Mycobacterium
VAEDSGPTTI

SEQ ID NO: 920812 - protein, 8 aa, Mycobacterium
VAEDSGTT

SEQ ID NO: 920813 - protein, 10 aa, Mycobacterium
VAEGADPGAV

SEQ ID NO: 920814 - protein, 12 aa, Mycobacterium
VAEGAEPPNDTS

SEQ ID NO: 920815 - protein, 6 aa, Mycobacterium
VAEGGT

SEQ ID NO: 920816 - protein, 10 aa, Mycobacterium
VAEGNTATIS

SEQ ID NO: 920817 - protein, 14 aa, Mycobacterium
VAEGPGINDNGSGV

SEQ ID NO: 920818 - protein, 8 aa, Mycobacterium
VAEPEDAQ

SEQ ID NO: 920819 - protein, 7 aa, Mycobacterium
VAEPGTK

SEQ ID NO: 920820 - protein, 12 aa, Mycobacterium
VAEPNTGSATDM

SEQ ID NO: 920821 - protein, 14 aa, Mycobacterium
VAEQINSTRYNPDY

SEQ ID NO: 920822 - protein, 6 aa, Mycobacterium
VAERDP

SEQ ID NO: 920823 - protein, 8 aa, Mycobacterium
VAERENPR

SEQ ID NO: 920824 - protein, 7 aa, Mycobacterium
VAERGGV

SEQ ID NO: 920825 - protein, 5 aa, Mycobacterium
VAERT

SEQ ID NO: 920826 - protein, 22 aa, Mycobacterium
VAGAAGAGVLGGRASAASTGPV

SEQ ID NO: 920827 - protein, 12 aa, Mycobacterium
VAGADPEVLQSN

SEQ ID NO: 920828 - protein, 10 aa, Mycobacterium
VAGAEPQCAD

SEQ ID NO: 920829 - protein, 18 aa, Mycobacterium
VAGAPSALAEPPPGTDAI

SEQ ID NO: 920830 - protein, 10 aa, Mycobacterium
VAGAQPEQNG

SEQ ID NO: 920831 - protein, 8 aa, Mycobacterium
VAGDSTSL

SEQ ID NO: 920832 - protein, 22 aa, Mycobacterium
VAGEPAGPAGTTVAAGAAGAVG

SEQ ID NO: 920833 - protein, 13 aa, Mycobacterium
VAGEPGEGKPTTM

SEQ ID NO: 920834 - protein, 8 aa, Mycobacterium
VAGESAGA

SEQ ID NO: 920835 - protein, 4 aa, Mycobacterium
VAGG

SEQ ID NO: 920836 - protein, 21 aa, Mycobacterium
VAGGADPQSVADGWLAEHPLG

SEQ ID NO: 920837 - protein, 6 aa, Mycobacterium
VAGGQQ

SEQ ID NO: 920838 - protein, 8 aa, Mycobacterium
VAGGTPTD

SEQ ID NO: 920839 - protein, 8 aa, Mycobacterium
VAGGTTSY

SEQ ID NO: 920840 - protein, 6 aa, Mycobacterium
VAGHGA

SEQ ID NO: 920841 - protein, 7 aa, Mycobacterium
VAGLPGD

SEQ ID NO: 920842 - protein, 37 aa, Mycobacterium
VAGLSGKKAKPAKPVKQESSTKSGGSESDGGGSGGGA

SEQ ID NO: 920843 - protein, 11 aa, Mycobacterium
VAGNASAGAQA

SEQ ID NO: 920844 - protein, 11 aa, Mycobacterium
VAGNPPPDVAS

SEQ ID NO: 920845 - protein, 13 aa, Mycobacterium
VAGNSGIDPDQAA

SEQ ID NO: 920846 - protein, 8 aa, Mycobacterium
VAGPAPTH

SEQ ID NO: 920847 - protein, 5 aa, Mycobacterium
VAGPG

SEQ ID NO: 920848 - protein, 25 aa, Mycobacterium
VAGPHRGSAVATNGPLHDRVLESLV

SEQ ID NO: 920849 - protein, 15 aa, Mycobacterium
VAGPTKDGKPARTTM

SEQ ID NO: 920850 - protein, 11 aa, Mycobacterium
VAGQPVAPDKL

SEQ ID NO: 920851 - protein, 17 aa, Mycobacterium
VAGQTNIPTLAPGQDPL

SEQ ID NO: 920852 - protein, 4 aa, Mycobacterium
VAGR

SEQ ID NO: 920853 - protein, 11 aa, Mycobacterium
VAGRNASEGYG

SEQ ID NO: 920854 - protein, 6 aa, Mycobacterium
VAGRQD

SEQ ID NO: 920855 - protein, 7 aa, Mycobacterium
VAGRQGQ

SEQ ID NO: 920856 - protein, 14 aa, Mycobacterium
VAGSALGQAVTLTL

SEQ ID NO: 920857 - protein, 14 aa, Mycobacterium
VAGSALGQTVTLTL

SEQ ID NO: 920858 - protein, 9 aa, Mycobacterium
VAGSGNNTV

SEQ ID NO: 920859 - protein, 8 aa, Mycobacterium
VAGSPEHA

SEQ ID NO: 920860 - protein, 8 aa, Mycobacterium
VAGSTNDY

SEQ ID NO: 920861 - protein, 4 aa, Mycobacterium
VAGT

SEQ ID NO: 920862 - protein, 16 aa, Mycobacterium
VAGTDEQSLPQGDDTA

SEQ ID NO: 920863 - protein, 27 aa, Mycobacterium
VAGTGGDGGAGGDGGGAGGNGGAGGNS

SEQ ID NO: 920864 - protein, 12 aa, Mycobacterium
VAGTGTATAEYN

SEQ ID NO: 920865 - protein, 10 aa, Mycobacterium
VAGTNTGESL

SEQ ID NO: 920866 - protein, 13 aa, Mycobacterium
VAGTPAAAADPCP

SEQ ID NO: 920867 - protein, 7 aa, Mycobacterium
VAKETRP

SEQ ID NO: 920868 - protein, 10 aa, Mycobacterium
VAKNGTKQDY

SEQ ID NO: 920869 - protein, 12 aa, Mycobacterium
VAKTGGLAVSTE

SEQ ID NO: 920870 - protein, 10 aa, Mycobacterium
VAKVDTERAR

SEQ ID NO: 920871 - protein, 11 aa, Mycobacterium
VALSGDGRLPA

SEQ ID NO: 920872 - protein, 9 aa, Mycobacterium
VANADESTC

SEQ ID NO: 920873 - protein, 4 aa, Mycobacterium
VANG

SEQ ID NO: 920874 - protein, 6 aa, Mycobacterium
VANGDP

SEQ ID NO: 920875 - protein, 7 aa, Mycobacterium
VANPEAP

SEQ ID NO: 920876 - protein, 11 aa, Mycobacterium
VANPGRSGISV

SEQ ID NO: 920877 - protein, 12 aa, Mycobacterium
VAPADAPDLASS

SEQ ID NO: 920878 - protein, 5 aa, Mycobacterium
VAPAG

SEQ ID NO: 920879 - protein, 14 aa, Mycobacterium
VAPAGTSAPMPGTT

SEQ ID NO: 920880 - protein, 20 aa, Mycobacterium
VAPASADPDIPPVSEAARAA

SEQ ID NO: 920881 - protein, 13 aa, Mycobacterium
VAPCNPGDPGVAT

SEQ ID NO: 920882 - protein, 7 aa, Mycobacterium
VAPDADG

SEQ ID NO: 920883 - protein, 6 aa, Mycobacterium
VAPDAP

SEQ ID NO: 920884 - protein, 7 aa, Mycobacterium
VAPDAPR

SEQ ID NO: 920885 - protein, 7 aa, Mycobacterium
VAPDASN

SEQ ID NO: 920886 - protein, 11 aa, Mycobacterium
VAPDGAAAAEA

SEQ ID NO: 920887 - protein, 7 aa, Mycobacterium
VAPDGPI

SEQ ID NO: 920888 - protein, 14 aa, Mycobacterium
VAPEPEAAEDAPPL

SEQ ID NO: 920889 - protein, 45 aa, Mycobacterium
VAPEPSVAGTQPAGQGSGPAPGPSAGTPLPAEEHGTSAVVVPSPG

SEQ ID NO: 920890 - protein, 7 aa, Mycobacterium
VAPEQGL

SEQ ID NO: 920891 - protein, 7 aa, Mycobacterium
VAPGAGR

SEQ ID NO: 920892 - protein, 8 aa, Mycobacterium
VAPGEPTT

SEQ ID NO: 920893 - protein, 11 aa, Mycobacterium
VAPGPAGGGRV

SEQ ID NO: 920894 - protein, 15 aa, Mycobacterium
VAPGPRLGKGPKGLL

SEQ ID NO: 920895 - protein, 9 aa, Mycobacterium
VAPGPTDTP

SEQ ID NO: 920896 - protein, 8 aa, Mycobacterium
VAPGRTYT

SEQ ID NO: 920897 - protein, 9 aa, Mycobacterium
VAPGTTYTT

SEQ ID NO: 920898 - protein, 12 aa, Mycobacterium
VAPLDRRRATTT

SEQ ID NO: 920899 - protein, 16 aa, Mycobacterium
VAPPAADTNDNGDFSR

SEQ ID NO: 920900 - protein, 10 aa, Mycobacterium
VAPPASAPVP

SEQ ID NO: 920901 - protein, 15 aa, Mycobacterium
VAPPASDTNDNGDFS

SEQ ID NO: 920902 - protein, 16 aa, Mycobacterium
VAPPASDTNDNGDFSR

SEQ ID NO: 920903 - protein, 16 aa, Mycobacterium
VAPPASETNDNGDFSR

SEQ ID NO: 920904 - protein, 26 aa, Mycobacterium
VAPPPAEAIPAPAEGAAATPALPPMS

SEQ ID NO: 920905 - protein, 17 aa, Mycobacterium
VAPQPGGRWRWRRRRKR

SEQ ID NO: 920906 - protein, 19 aa, Mycobacterium
VAPRGGGHSYVGASSANGT

SEQ ID NO: 920907 - protein, 5 aa, Mycobacterium
VAPRR

SEQ ID NO: 920908 - protein, 16 aa, Mycobacterium
VAPSAADTNDNNDFSR

SEQ ID NO: 920909 - protein, 6 aa, Mycobacterium
VAPSTD

SEQ ID NO: 920910 - protein, 11 aa, Mycobacterium
VAPTGDTASVT

SEQ ID NO: 920911 - protein, 7 aa, Mycobacterium
VAPTGID

SEQ ID NO: 920912 - protein, 16 aa, Mycobacterium
VAPTPGRFGNGGSAAV

SEQ ID NO: 920913 - protein, 13 aa, Mycobacterium
VAPTSVQVYAALT

SEQ ID NO: 920914 - protein, 8 aa, Mycobacterium
VAPTTEVN

SEQ ID NO: 920915 - protein, 7 aa, Mycobacterium
VAQAQPG

SEQ ID NO: 920916 - protein, 7 aa, Mycobacterium
VAQDPTV

SEQ ID NO: 920917 - protein, 5 aa, Mycobacterium
VAQES

SEQ ID NO: 920918 - protein, 4 aa, Mycobacterium
VAQP

SEQ ID NO: 920919 - protein, 4 aa, Mycobacterium
VAQS

SEQ ID NO: 920920 - protein, 10 aa, Mycobacterium
VAQSTGPASI

SEQ ID NO: 920921 - protein, 4 aa, Mycobacterium
VARA

SEQ ID NO: 920922 - protein, 10 aa, Mycobacterium
VARADPPGAH

SEQ ID NO: 920923 - protein, 10 aa, Mycobacterium
VAREDVQTNE

SEQ ID NO: 920924 - protein, 10 aa, Mycobacterium
VAREPGAGND

SEQ ID NO: 920925 - protein, 12 aa, Mycobacterium
VARGGGGQSGDP

SEQ ID NO: 920926 - protein, 5 aa, Mycobacterium
VARGQ

SEQ ID NO: 920927 - protein, 8 aa, Mycobacterium
VARGRVRD

SEQ ID NO: 920928 - protein, 6 aa, Mycobacterium
VARGSH

SEQ ID NO: 920929 - protein, 10 aa, Mycobacterium
VARIDTQRAR

SEQ ID NO: 920930 - protein, 7 aa, Mycobacterium
VARPQGE

SEQ ID NO: 920931 - protein, 7 aa, Mycobacterium
VARSPND

SEQ ID NO: 920932 - protein, 4 aa, Mycobacterium
VASA

SEQ ID NO: 920933 - protein, 44 aa, Mycobacterium
VASAKTPGNSAASPEGRAAIQQAKEEAAQQKQQAQADQAKAKGK

SEQ ID NO: 920934 - protein, 11 aa, Mycobacterium
VASANTPQDDA

SEQ ID NO: 920935 - protein, 6 aa, Mycobacterium
VASDAA

SEQ ID NO: 920936 - protein, 8 aa, Mycobacterium
VASDDGGA

SEQ ID NO: 920937 - protein, 6 aa, Mycobacterium
VASDGV

SEQ ID NO: 920938 - protein, 13 aa, Mycobacterium
VASENPAGSSSDL

SEQ ID NO: 920939 - protein, 10 aa, Mycobacterium
VASEQPGGDS

SEQ ID NO: 920940 - protein, 10 aa, Mycobacterium
VASGELPARR

SEQ ID NO: 920941 - protein, 7 aa, Mycobacterium
VASGRRR

SEQ ID NO: 920942 - protein, 18 aa, Mycobacterium
VASGSALASGSAGAALAA

SEQ ID NO: 920943 - protein, 11 aa, Mycobacterium
VASQKGDSGGP

SEQ ID NO: 920944 - protein, 8 aa, Mycobacterium
VASSADGS

SEQ ID NO: 920945 - protein, 9 aa, Mycobacterium
VASTTANSL

SEQ ID NO: 920946 - protein, 22 aa, Mycobacterium
VATAGGSGNSAVSADANGTGNI

SEQ ID NO: 920947 - protein, 15 aa, Mycobacterium
VATAGRNAADPHSSM

SEQ ID NO: 920948 - protein, 20 aa, Mycobacterium
VATAPGADPSITRTDEGTAR

SEQ ID NO: 920949 - protein, 9 aa, Mycobacterium
VATDAHTDT

SEQ ID NO: 920950 - protein, 9 aa, Mycobacterium
VATGELTPA

SEQ ID NO: 920951 - protein, 16 aa, Mycobacterium
VATGGQASAPSESVSE

SEQ ID NO: 920952 - protein, 9 aa, Mycobacterium
VATGGTALR

SEQ ID NO: 920953 - protein, 5 aa, Mycobacterium
VATGV

SEQ ID NO: 920954 - protein, 9 aa, Mycobacterium
VATGVSAAT

SEQ ID NO: 920955 - protein, 10 aa, Mycobacterium
VATGVSAATS

SEQ ID NO: 920956 - protein, 8 aa, Mycobacterium
VATKEEID

SEQ ID NO: 920957 - protein, 8 aa, Mycobacterium
VATPKGDI

SEQ ID NO: 920958 - protein, 22 aa, Mycobacterium
VATSGGDSNGVSASATGAGGNI

SEQ ID NO: 920959 - protein, 11 aa, Mycobacterium
VAVPTEPARTL

SEQ ID NO: 920960 - protein, 11 aa, Mycobacterium
VAVSSGSGLTL

SEQ ID NO: 920961 - protein, 6 aa, Mycobacterium
VAYGPS

SEQ ID NO: 920962 - protein, 32 aa, Mycobacterium
VCASGGDGGLAAHTSYPGNGMTSQAADFVAGR

SEQ ID NO: 920963 - protein, 9 aa, Mycobacterium
VCGGGNDPV

SEQ ID NO: 920964 - protein, 7 aa, Mycobacterium
VCSAGDS

SEQ ID NO: 920965 - protein, 13 aa, Mycobacterium
VCSPTGSDGASHN

SEQ ID NO: 920966 - protein, 13 aa, Mycobacterium
VDAADAPAYGGHN

SEQ ID NO: 920967 - protein, 8 aa, Mycobacterium
VDAAPGRI

SEQ ID NO: 920968 - protein, 6 aa, Mycobacterium
VDADGS

SEQ ID NO: 920969 - protein, 9 aa, Mycobacterium
VDADPRDIQ

SEQ ID NO: 920970 - protein, 5 aa, Mycobacterium
VDAGA

SEQ ID NO: 920971 - protein, 5 aa, Mycobacterium
VDAGD

SEQ ID NO: 920972 - protein, 4 aa, Mycobacterium
VDAL

SEQ ID NO: 920973 - protein, 10 aa, Mycobacterium
VDANGAQTNV

SEQ ID NO: 920974 - protein, 9 aa, Mycobacterium
VDAPGKPSL

SEQ ID NO: 920975 - protein, 32 aa, Mycobacterium
VDAPVTQAPVTAEANPAELGYRPATKEQPFGQ

SEQ ID NO: 920976 - protein, 9 aa, Mycobacterium
VDAQANRAA

SEQ ID NO: 920977 - protein, 5 aa, Mycobacterium
VDATE

SEQ ID NO: 920978 - protein, 6 aa, Mycobacterium
VDATNN

SEQ ID NO: 920979 - protein, 7 aa, Mycobacterium
VDATQDG

SEQ ID NO: 920980 - protein, 21 aa, Mycobacterium
VDDAPVTVGDTATVAEDSGPT

SEQ ID NO: 920981 - protein, 4 aa, Mycobacterium
VDDD

SEQ ID NO: 920982 - protein, 5 aa, Mycobacterium
VDDGV

SEQ ID NO: 920983 - protein, 6 aa, Mycobacterium
VDDPHL

SEQ ID NO: 920984 - protein, 9 aa, Mycobacterium
VDDPHLDRD

SEQ ID NO: 920985 - protein, 5 aa, Mycobacterium
VDDSL

SEQ ID NO: 920986 - protein, 9 aa, Mycobacterium
VDDSTKTLT

SEQ ID NO: 920987 - protein, 7 aa, Mycobacterium
VDDSVPN

SEQ ID NO: 920988 - protein, 11 aa, Mycobacterium
VDDVDTAPGRI

SEQ ID NO: 920989 - protein, 11 aa, Mycobacterium
VDDVDTSSGQI

SEQ ID NO: 920990 - protein, 18 aa, Mycobacterium
VDEASAGVLRTAAATCPS

SEQ ID NO: 920991 - protein, 9 aa, Mycobacterium
VDEDRRSRE

SEQ ID NO: 920992 - protein, 10 aa, Mycobacterium
VDEKGAQFDA

SEQ ID NO: 920993 - protein, 19 aa, Mycobacterium
VDENKTSGTLGEDSNPKIP

SEQ ID NO: 920994 - protein, 6 aa, Mycobacterium
VDEQSA

SEQ ID NO: 920995 - protein, 9 aa, Mycobacterium
VDESPSALP

SEQ ID NO: 920996 - protein, 4 aa, Mycobacterium
VDGA

SEQ ID NO: 920997 - protein, 9 aa, Mycobacterium
VDGADHSRD

SEQ ID NO: 920998 - protein, 12 aa, Mycobacterium
VDGAGHAGWAVI

SEQ ID NO: 920999 - protein, 9 aa, Mycobacterium
VDGARPRRL

SEQ ID NO: 921000 - protein, 7 aa, Mycobacterium
VDGDTPQ

SEQ ID NO: 921001 - protein, 4 aa, Mycobacterium
VDGE

SEQ ID NO: 921002 - protein, 21 aa, Mycobacterium
VDGEDGKDFGAHGDFDSRSHA

SEQ ID NO: 921003 - protein, 5 aa, Mycobacterium
VDGEF

SEQ ID NO: 921004 - protein, 12 aa, Mycobacterium
VDGEPAAASRYH

SEQ ID NO: 921005 - protein, 9 aa, Mycobacterium
VDGERAPAG

SEQ ID NO: 921006 - protein, 6 aa, Mycobacterium
VDGGDD

SEQ ID NO: 921007 - protein, 13 aa, Mycobacterium
VDGGDGDKATAAL

SEQ ID NO: 921008 - protein, 7 aa, Mycobacterium
VDGGGGY

SEQ ID NO: 921009 - protein, 8 aa, Mycobacterium
VDGGTVAG

SEQ ID NO: 921010 - protein, 10 aa, Mycobacterium
VDGHRGPGVT

SEQ ID NO: 921011 - protein, 10 aa, Mycobacterium
VDGKEKKVEG

SEQ ID NO: 921012 - protein, 5 aa, Mycobacterium
VDGLP

SEQ ID NO: 921013 - protein, 8 aa, Mycobacterium
VDGMKDGS

SEQ ID NO: 921014 - protein, 14 aa, Mycobacterium
VDGPPSPEATMSKA

SEQ ID NO: 921015 - protein, 14 aa, Mycobacterium
VDGPVPNYPAPDGV

SEQ ID NO: 921016 - protein, 8 aa, Mycobacterium
VDGQDTQQ

SEQ ID NO: 921017 - protein, 7 aa, Mycobacterium
VDGQPGS

SEQ ID NO: 921018 - protein, 11 aa, Mycobacterium
VDGRPTEHTSL

SEQ ID NO: 921019 - protein, 7 aa, Mycobacterium
VDGRTGI

SEQ ID NO: 921020 - protein, 13 aa, Mycobacterium
VDGSAEEGTPYIP

SEQ ID NO: 921021 - protein, 6 aa, Mycobacterium
VDGSGT

SEQ ID NO: 921022 - protein, 6 aa, Mycobacterium
VDGSST

SEQ ID NO: 921023 - protein, 19 aa, Mycobacterium
VDGTARPAPGLKPRPVTGQ

SEQ ID NO: 921024 - protein, 7 aa, Mycobacterium
VDGTEHR

SEQ ID NO: 921025 - protein, 8 aa, Mycobacterium
VDGTNLPP

SEQ ID NO: 921026 - protein, 4 aa, Mycobacterium
VDGV

SEQ ID NO: 921027 - protein, 7 aa, Mycobacterium
VDIGPAA

SEQ ID NO: 921028 - protein, 6 aa, Mycobacterium
VDKSNY

SEQ ID NO: 921029 - protein, 5 aa, Mycobacterium
VDNAN

SEQ ID NO: 921030 - protein, 8 aa, Mycobacterium
VDNGIPDT

SEQ ID NO: 921031 - protein, 9 aa, Mycobacterium
VDNNGRDPA

SEQ ID NO: 921032 - protein, 9 aa, Mycobacterium
VDPAAGSFE

SEQ ID NO: 921033 - protein, 9 aa, Mycobacterium
VDPADADAV

SEQ ID NO: 921034 - protein, 15 aa, Mycobacterium
VDPADGLREFAFAPL

SEQ ID NO: 921035 - protein, 34 aa, Mycobacterium
VDPADPRRGLEDCEPARPKCPISASPAYDPATGT

SEQ ID NO: 921036 - protein, 6 aa, Mycobacterium
VDPAEL

SEQ ID NO: 921037 - protein, 10 aa, Mycobacterium
VDPAPSTPVT

SEQ ID NO: 921038 - protein, 10 aa, Mycobacterium
VDPAQTTGDT

SEQ ID NO: 921039 - protein, 5 aa, Mycobacterium
VDPAR

SEQ ID NO: 921040 - protein, 7 aa, Mycobacterium
VDPATKK

SEQ ID NO: 921041 - protein, 6 aa, Mycobacterium
VDPDPR

SEQ ID NO: 921042 - protein, 4 aa, Mycobacterium
VDPE

SEQ ID NO: 921043 - protein, 7 aa, Mycobacterium
VDPEAGR

SEQ ID NO: 921044 - protein, 7 aa, Mycobacterium
VDPGEWE

SEQ ID NO: 921045 - protein, 6 aa, Mycobacterium
VDPGRI

SEQ ID NO: 921046 - protein, 9 aa, Mycobacterium
VDPHQSPDL

SEQ ID NO: 921047 - protein, 5 aa, Mycobacterium
VDPHR

SEQ ID NO: 921048 - protein, 6 aa, Mycobacterium
VDPHRG

SEQ ID NO: 921049 - protein, 4 aa, Mycobacterium
VDPM

SEQ ID NO: 921050 - protein, 10 aa, Mycobacterium
VDPNADPIEA

SEQ ID NO: 921051 - protein, 43 aa, Mycobacterium
VDPPNLKRSQAPPGIPGQQYANGADSGESGDELPWTTRPASIT

SEQ ID NO: 921052 - protein, 9 aa, Mycobacterium
VDPPPGFGY

SEQ ID NO: 921053 - protein, 7 aa, Mycobacterium
VDPPRVP

SEQ ID NO: 921054 - protein, 5 aa, Mycobacterium
VDPQA

SEQ ID NO: 921055 - protein, 8 aa, Mycobacterium
VDPQRGRL

SEQ ID NO: 921056 - protein, 7 aa, Mycobacterium
VDPRGQV

SEQ ID NO: 921057 - protein, 15 aa, Mycobacterium
VDPRTLPPDAPDDRK

SEQ ID NO: 921058 - protein, 9 aa, Mycobacterium
VDPSASAGA

SEQ ID NO: 921059 - protein, 9 aa, Mycobacterium
VDPSEAVDG

SEQ ID NO: 921060 - protein, 8 aa, Mycobacterium
VDPSGDGG

SEQ ID NO: 921061 - protein, 7 aa, Mycobacterium
VDPSNGV

SEQ ID NO: 921062 - protein, 8 aa, Mycobacterium
VDPSQPLT

SEQ ID NO: 921063 - protein, 9 aa, Mycobacterium
VDPSQPLTS

SEQ ID NO: 921064 - protein, 9 aa, Mycobacterium
VDPTDPARG

SEQ ID NO: 921065 - protein, 7 aa, Mycobacterium
VDPTLDP

SEQ ID NO: 921066 - protein, 10 aa, Mycobacterium
VDQATGLGAT

SEQ ID NO: 921067 - protein, 9 aa, Mycobacterium
VDQGSQAGD

SEQ ID NO: 921068 - protein, 8 aa, Mycobacterium
VDQPNPVE

SEQ ID NO: 921069 - protein, 18 aa, Mycobacterium
VDQPSTGVLRQAAGTCPA

SEQ ID NO: 921070 - protein, 7 aa, Mycobacterium
VDQQGPV

SEQ ID NO: 921071 - protein, 9 aa, Mycobacterium
VDQTAKATG

SEQ ID NO: 921072 - protein, 14 aa, Mycobacterium
VDQTTGTFTYNPDD

SEQ ID NO: 921073 - protein, 24 aa, Mycobacterium
VDRDGNELSRDTESTPTGGPIDNP

SEQ ID NO: 921074 - protein, 8 aa, Mycobacterium
VDRDKDQS

SEQ ID NO: 921075 - protein, 10 aa, Mycobacterium
VDRPAAQRFT

SEQ ID NO: 921076 - protein, 17 aa, Mycobacterium
VDRPAPPSLPTPTPGMD

SEQ ID NO: 921077 - protein, 11 aa, Mycobacterium
VDRPASQRFTD

SEQ ID NO: 921078 - protein, 15 aa, Mycobacterium
VDRQRTAGNEQQLTD

SEQ ID NO: 921079 - protein, 4 aa, Mycobacterium
VDRT

SEQ ID NO: 921080 - protein, 9 aa, Mycobacterium
VDRTDERPT

SEQ ID NO: 921081 - protein, 7 aa, Mycobacterium
VDRTNGA

SEQ ID NO: 921082 - protein, 9 aa, Mycobacterium
VDSAGEDPA

SEQ ID NO: 921083 - protein, 10 aa, Mycobacterium
VDSDGDDPAI

SEQ ID NO: 921084 - protein, 7 aa, Mycobacterium
VDSDRAL

SEQ ID NO: 921085 - protein, 12 aa, Mycobacterium
VDSPAGTPEPAL

SEQ ID NO: 921086 - protein, 14 aa, Mycobacterium
VDSPASVSAGPKGD

SEQ ID NO: 921087 - protein, 13 aa, Mycobacterium
VDSSGNQETGEVT

SEQ ID NO: 921088 - protein, 10 aa, Mycobacterium
VDSSGRPMIG

SEQ ID NO: 921089 - protein, 15 aa, Mycobacterium
VDSSYSSRNVLGGAN

SEQ ID NO: 921090 - protein, 10 aa, Mycobacterium
VDTNGNNPAL

SEQ ID NO: 921091 - protein, 12 aa, Mycobacterium
VDTPAARANVSD

SEQ ID NO: 921092 - protein, 7 aa, Mycobacterium
VDTQDTD

SEQ ID NO: 921093 - protein, 4 aa, Mycobacterium
VDTS

SEQ ID NO: 921094 - protein, 10 aa, Mycobacterium
VDTSDPAVRD

SEQ ID NO: 921095 - protein, 9 aa, Mycobacterium
VDTSPGNTI

SEQ ID NO: 921096 - protein, 4 aa, Mycobacterium
VDTT

SEQ ID NO: 921097 - protein, 11 aa, Mycobacterium
VDVDPAAENVS

SEQ ID NO: 921098 - protein, 4 aa, Mycobacterium
VDYN

SEQ ID NO: 921099 - protein, 8 aa, Mycobacterium
VEAPDPST

SEQ ID NO: 921100 - protein, 8 aa, Mycobacterium
VEARTDGG

SEQ ID NO: 921101 - protein, 23 aa, Mycobacterium
VEASRSEESKRQETSRAQAQADA

SEQ ID NO: 921102 - protein, 10 aa, Mycobacterium
VEAVGNGPAN

SEQ ID NO: 921103 - protein, 4 aa, Mycobacterium
VEDP

SEQ ID NO: 921104 - protein, 7 aa, Mycobacterium
VEDPDTV

SEQ ID NO: 921105 - protein, 10 aa, Mycobacterium
VEDPGAPGLQ

SEQ ID NO: 921106 - protein, 9 aa, Mycobacterium
VEDRDGDPL

SEQ ID NO: 921107 - protein, 8 aa, Mycobacterium
VEEGDDAE

SEQ ID NO: 921108 - protein, 9 aa, Mycobacterium
VEEGDDAEV

SEQ ID NO: 921109 - protein, 10 aa, Mycobacterium
VEEKQESARA

SEQ ID NO: 921110 - protein, 16 aa, Mycobacterium
VEEQPAELDEGTEDVS

SEQ ID NO: 921111 - protein, 89 aa, Mycobacterium
VEETEEADETAPVTEEAETEAGTEEAATEEDGDAEAPAADESDSDSKDSDDSGDARKSGKPAQAERSSGSSDSSDSGSSSSDSGSSGSD

SEQ ID NO: 921112 - protein, 23 aa, Mycobacterium
VEGAHGARAEGFDASTDLSATLT

SEQ ID NO: 921113 - protein, 17 aa, Mycobacterium
VEGANGAQSDGFEATTD

SEQ ID NO: 921114 - protein, 8 aa, Mycobacterium
VEGARRGV

SEQ ID NO: 921115 - protein, 5 aa, Mycobacterium
VEGDR

SEQ ID NO: 921116 - protein, 20 aa, Mycobacterium
VEGEAKTDGSPGLPNGDPES

SEQ ID NO: 921117 - protein, 15 aa, Mycobacterium
VEGEATAAHPSETSL

SEQ ID NO: 921118 - protein, 4 aa, Mycobacterium
VEGK

SEQ ID NO: 921119 - protein, 7 aa, Mycobacterium
VEGPRPV

SEQ ID NO: 921120 - protein, 12 aa, Mycobacterium
VEGQGAGEVPLD

SEQ ID NO: 921121 - protein, 9 aa, Mycobacterium
VEGRDPAQT

SEQ ID NO: 921122 - protein, 9 aa, Mycobacterium
VEGSDQNRF

SEQ ID NO: 921123 - protein, 8 aa, Mycobacterium
VEGSQTAV

SEQ ID NO: 921124 - protein, 6 aa, Mycobacterium
VEINDG

SEQ ID NO: 921125 - protein, 9 aa, Mycobacterium
VEKAGGSAK

SEQ ID NO: 921126 - protein, 5 aa, Mycobacterium
VEKGG

SEQ ID NO: 921127 - protein, 7 aa, Mycobacterium
VEKGQCT

SEQ ID NO: 921128 - protein, 11 aa, Mycobacterium
VEKGSTSGYRA

SEQ ID NO: 921129 - protein, 5 aa, Mycobacterium
VELDD

SEQ ID NO: 921130 - protein, 8 aa, Mycobacterium
VELPAAAP

SEQ ID NO: 921131 - protein, 4 aa, Mycobacterium
VELS

SEQ ID NO: 921132 - protein, 5 aa, Mycobacterium
VENPD

SEQ ID NO: 921133 - protein, 6 aa, Mycobacterium
VENPGT

SEQ ID NO: 921134 - protein, 12 aa, Mycobacterium
VENPLGPPPELR

SEQ ID NO: 921135 - protein, 9 aa, Mycobacterium
VENSAQRSA

SEQ ID NO: 921136 - protein, 19 aa, Mycobacterium
VENSTKTGDDGWKEMLAPA

SEQ ID NO: 921137 - protein, 4 aa, Mycobacterium
VENT

SEQ ID NO: 921138 - protein, 4 aa, Mycobacterium
VEPA

SEQ ID NO: 921139 - protein, 7 aa, Mycobacterium
VEPAGSR

SEQ ID NO: 921140 - protein, 7 aa, Mycobacterium
VEPAPGA

SEQ ID NO: 921141 - protein, 5 aa, Mycobacterium
VEPES

SEQ ID NO: 921142 - protein, 24 aa, Mycobacterium
VEPPPREQNDATGGTTESGISTGT

SEQ ID NO: 921143 - protein, 10 aa, Mycobacterium
VEPPRSPAQM

SEQ ID NO: 921144 - protein, 7 aa, Mycobacterium
VEPPTTW

SEQ ID NO: 921145 - protein, 7 aa, Mycobacterium
VEPRQAF

SEQ ID NO: 921146 - protein, 11 aa, Mycobacterium
VEPRRDAADAW

SEQ ID NO: 921147 - protein, 9 aa, Mycobacterium
VEPSGEMPQ

SEQ ID NO: 921148 - protein, 6 aa, Mycobacterium
VEPSGT

SEQ ID NO: 921149 - protein, 5 aa, Mycobacterium
VEPTG

SEQ ID NO: 921150 - protein, 38 aa, Mycobacterium
VEPTTGSTTGASGSSSATTTTSRSPFEPTTTPTPPDTS

SEQ ID NO: 921151 - protein, 5 aa, Mycobacterium
VEQGL

SEQ ID NO: 921152 - protein, 30 aa, Mycobacterium
VEQKSTTPTPSAPTSADDTGIDAHESSEPV

SEQ ID NO: 921153 - protein, 19 aa, Mycobacterium
VEQQYRDAPLPLGASHGSE

SEQ ID NO: 921154 - protein, 12 aa, Mycobacterium
VERAGAPPEGKP

SEQ ID NO: 921155 - protein, 7 aa, Mycobacterium
VERANTA

SEQ ID NO: 921156 - protein, 9 aa, Mycobacterium
VERDSTGRV

SEQ ID NO: 921157 - protein, 7 aa, Mycobacterium
VERESGC

SEQ ID NO: 921158 - protein, 11 aa, Mycobacterium
VERGPQPDGAE

SEQ ID NO: 921159 - protein, 17 aa, Mycobacterium
VERPAPPSLPKPTPDMD

SEQ ID NO: 921160 - protein, 5 aa, Mycobacterium
VERTG

SEQ ID NO: 921161 - protein, 6 aa, Mycobacterium
VESATG

SEQ ID NO: 921162 - protein, 5 aa, Mycobacterium
VESAV

SEQ ID NO: 921163 - protein, 14 aa, Mycobacterium
VESPDSRLNVPVRL

SEQ ID NO: 921164 - protein, 6 aa, Mycobacterium
VESRQA

SEQ ID NO: 921165 - protein, 6 aa, Mycobacterium
VESTGN

SEQ ID NO: 921166 - protein, 7 aa, Mycobacterium
VESTGPA

SEQ ID NO: 921167 - protein, 6 aa, Mycobacterium
VETADG

SEQ ID NO: 921168 - protein, 7 aa, Mycobacterium
VETADGT

SEQ ID NO: 921169 - protein, 7 aa, Mycobacterium
VETAGEA

SEQ ID NO: 921170 - protein, 12 aa, Mycobacterium
VETDGPGNGRDV

SEQ ID NO: 921171 - protein, 8 aa, Mycobacterium
VETENGPV

SEQ ID NO: 921172 - protein, 12 aa, Mycobacterium
VETEPGGGDRYG

SEQ ID NO: 921173 - protein, 5 aa, Mycobacterium
VETRT

SEQ ID NO: 921174 - protein, 5 aa, Mycobacterium
VETSR

SEQ ID NO: 921175 - protein, 9 aa, Mycobacterium
VETSTGETF

SEQ ID NO: 921176 - protein, 7 aa, Mycobacterium
VETTDSG

SEQ ID NO: 921177 - protein, 26 aa, Mycobacterium
VETTDSGVQVSPVRTENMTPYLVRII

SEQ ID NO: 921178 - protein, 8 aa, Mycobacterium
VETTDTGV

SEQ ID NO: 921179 - protein, 12 aa, Mycobacterium
VETTPTLPYPTP

SEQ ID NO: 921180 - protein, 7 aa, Mycobacterium
VETTSSG

SEQ ID NO: 921181 - protein, 13 aa, Mycobacterium
VEVTPGAQRRYND

SEQ ID NO: 921182 - protein, 4 aa, Mycobacterium
VFGG

SEQ ID NO: 921183 - protein, 6 aa, Mycobacterium
VFQDGN

SEQ ID NO: 921184 - protein, 14 aa, Mycobacterium
VFQESDSALRPNPV

SEQ ID NO: 921185 - protein, 4 aa, Mycobacterium
VGAA

SEQ ID NO: 921186 - protein, 5 aa, Mycobacterium
VGAAA

SEQ ID NO: 921187 - protein, 10 aa, Mycobacterium
VGAAGTAITG

SEQ ID NO: 921188 - protein, 9 aa, Mycobacterium
VGAAPGPLA

SEQ ID NO: 921189 - protein, 9 aa, Mycobacterium
VGAASYSQS

SEQ ID NO: 921190 - protein, 11 aa, Mycobacterium
VGAATARGAAA

SEQ ID NO: 921191 - protein, 7 aa, Mycobacterium
VGADAKN

SEQ ID NO: 921192 - protein, 10 aa, Mycobacterium
VGADSRSVPT

SEQ ID NO: 921193 - protein, 5 aa, Mycobacterium
VGAEY

SEQ ID NO: 921194 - protein, 14 aa, Mycobacterium
VGAGAAPQATPQVT

SEQ ID NO: 921195 - protein, 10 aa, Mycobacterium
VGAGDDNTVT

SEQ ID NO: 921196 - protein, 11 aa, Mycobacterium
VGAGDPAAGTF

SEQ ID NO: 921197 - protein, 10 aa, Mycobacterium
VGAGDPAAGV

SEQ ID NO: 921198 - protein, 5 aa, Mycobacterium
VGAGE

SEQ ID NO: 921199 - protein, 30 aa, Mycobacterium
VGAGGDAGSGGDGGGGGAGGDGGDGGTSFD

SEQ ID NO: 921200 - protein, 7 aa, Mycobacterium
VGAGGTA

SEQ ID NO: 921201 - protein, 12 aa, Mycobacterium
VGAGPTVTPATA

SEQ ID NO: 921202 - protein, 12 aa, Mycobacterium
VGAGQDGLADNG

SEQ ID NO: 921203 - protein, 11 aa, Mycobacterium
VGAGQNALAGT

SEQ ID NO: 921204 - protein, 5 aa, Mycobacterium
VGAHE

SEQ ID NO: 921205 - protein, 10 aa, Mycobacterium
VGAKGLSPNH

SEQ ID NO: 921206 - protein, 18 aa, Mycobacterium
VGAKPQTVTFALKRRQAG

SEQ ID NO: 921207 - protein, 12 aa, Mycobacterium
VGAQGKSDTSHG

SEQ ID NO: 921208 - protein, 11 aa, Mycobacterium
VGAQPTGTENH

SEQ ID NO: 921209 - protein, 14 aa, Mycobacterium
VGARGHPRLRDGGT

SEQ ID NO: 921210 - protein, 5 aa, Mycobacterium
VGARP

SEQ ID NO: 921211 - protein, 10 aa, Mycobacterium
VGATDTNGRP

SEQ ID NO: 921212 - protein, 10 aa, Mycobacterium
VGATEADPRA

SEQ ID NO: 921213 - protein, 5 aa, Mycobacterium
VGATS

SEQ ID NO: 921214 - protein, 11 aa, Mycobacterium
VGATSKGVSGQ

SEQ ID NO: 921215 - protein, 10 aa, Mycobacterium
VGDAKGSTAE

SEQ ID NO: 921216 - protein, 9 aa, Mycobacterium
VGDATTATV

SEQ ID NO: 921217 - protein, 4 aa, Mycobacterium
VGDD

SEQ ID NO: 921218 - protein, 9 aa, Mycobacterium
VGDDARTRA

SEQ ID NO: 921219 - protein, 4 aa, Mycobacterium
VGDG

SEQ ID NO: 921220 - protein, 7 aa, Mycobacterium
VGDGEGQ

SEQ ID NO: 921221 - protein, 7 aa, Mycobacterium
VGDGPVR

SEQ ID NO: 921222 - protein, 15 aa, Mycobacterium
VGDISRGAKTPNHAE

SEQ ID NO: 921223 - protein, 15 aa, Mycobacterium
VGDNPALRARSKDPK

SEQ ID NO: 921224 - protein, 8 aa, Mycobacterium
VGDQGSYR

SEQ ID NO: 921225 - protein, 6 aa, Mycobacterium
VGDRAA

SEQ ID NO: 921226 - protein, 16 aa, Mycobacterium
VGDRGAQIARRIARKI

SEQ ID NO: 921227 - protein, 4 aa, Mycobacterium
VGDS

SEQ ID NO: 921228 - protein, 5 aa, Mycobacterium
VGDST

SEQ ID NO: 921229 - protein, 4 aa, Mycobacterium
VGDT

SEQ ID NO: 921230 - protein, 26 aa, Mycobacterium
VGDTDSHEVLGSDEANHLPKKPAGAG

SEQ ID NO: 921231 - protein, 7 aa, Mycobacterium
VGEAPSA

SEQ ID NO: 921232 - protein, 5 aa, Mycobacterium
VGEDN

SEQ ID NO: 921233 - protein, 4 aa, Mycobacterium
VGEP

SEQ ID NO: 921234 - protein, 12 aa, Mycobacterium
VGEPARAPGVPV

SEQ ID NO: 921235 - protein, 5 aa, Mycobacterium
VGEPN

SEQ ID NO: 921236 - protein, 10 aa, Mycobacterium
VGEPVAPEKI

SEQ ID NO: 921237 - protein, 7 aa, Mycobacterium
VGEQTGD

SEQ ID NO: 921238 - protein, 7 aa, Mycobacterium
VGESNRS

SEQ ID NO: 921239 - protein, 9 aa, Mycobacterium
VGESTADEW

SEQ ID NO: 921240 - protein, 4 aa, Mycobacterium
VGGA

SEQ ID NO: 921241 - protein, 11 aa, Mycobacterium
VGGANTTPRTA

SEQ ID NO: 921242 - protein, 7 aa, Mycobacterium
VGGAPLA

SEQ ID NO: 921243 - protein, 8 aa, Mycobacterium
VGGATSVA

SEQ ID NO: 921244 - protein, 23 aa, Mycobacterium
VGGDGGAASSGTGGVGGAGGNAD

SEQ ID NO: 921245 - protein, 14 aa, Mycobacterium
VGGDGIREKDGKKL

SEQ ID NO: 921246 - protein, 9 aa, Mycobacterium
VGGDHNPIH

SEQ ID NO: 921247 - protein, 13 aa, Mycobacterium
VGGDHNPIHTSSI

SEQ ID NO: 921248 - protein, 19 aa, Mycobacterium
VGGEPIGCQGSTSVGDSGF

SEQ ID NO: 921249 - protein, 8 aa, Mycobacterium
VGGGATPA

SEQ ID NO: 921250 - protein, 12 aa, Mycobacterium
VGGGERADPRAV

SEQ ID NO: 921251 - protein, 8 aa, Mycobacterium
VGGGPEAP

SEQ ID NO: 921252 - protein, 46 aa, Mycobacterium
VGGGSRVGASYASTTGTARAAGTARSGGATRPAGGAADAAGTSVAS

SEQ ID NO: 921253 - protein, 4 aa, Mycobacterium
VGGH

SEQ ID NO: 921254 - protein, 20 aa, Mycobacterium
VGGHNGVPTMDDRTRHLLTK

SEQ ID NO: 921255 - protein, 10 aa, Mycobacterium
VGGNGLYSSN

SEQ ID NO: 921256 - protein, 24 aa, Mycobacterium
VGGPAGPLGNPTSPEAAAEGEARY

SEQ ID NO: 921257 - protein, 10 aa, Mycobacterium
VGGPRPQTTY

SEQ ID NO: 921258 - protein, 7 aa, Mycobacterium
VGGPSTW

SEQ ID NO: 921259 - protein, 15 aa, Mycobacterium
VGGRRVPGPSSNVYA

SEQ ID NO: 921260 - protein, 6 aa, Mycobacterium
VGGRSS

SEQ ID NO: 921261 - protein, 17 aa, Mycobacterium
VGGRTNAPNGASEVTGG

SEQ ID NO: 921262 - protein, 14 aa, Mycobacterium
VGGSGADTEEKSQL

SEQ ID NO: 921263 - protein, 9 aa, Mycobacterium
VGGSGAVNG

SEQ ID NO: 921264 - protein, 6 aa, Mycobacterium
VGGSNG

SEQ ID NO: 921265 - protein, 4 aa, Mycobacterium
VGGT

SEQ ID NO: 921266 - protein, 11 aa, Mycobacterium
VGGTAQAAPTS

SEQ ID NO: 921267 - protein, 7 aa, Mycobacterium
VGGTEHR

SEQ ID NO: 921268 - protein, 14 aa, Mycobacterium
VGGTGSALVGDQGP

SEQ ID NO: 921269 - protein, 7 aa, Mycobacterium
VGGTTVV

SEQ ID NO: 921270 - protein, 26 aa, Mycobacterium
VGGVGGVGGAATGAGATAAAGGAGGL

SEQ ID NO: 921271 - protein, 4 aa, Mycobacterium
VGHD

SEQ ID NO: 921272 - protein, 11 aa, Mycobacterium
VGHDGKAIPVG

SEQ ID NO: 921273 - protein, 6 aa, Mycobacterium
VGHRPA

SEQ ID NO: 921274 - protein, 7 aa, Mycobacterium
VGHSART

SEQ ID NO: 921275 - protein, 10 aa, Mycobacterium
VGIPVDAPDG

SEQ ID NO: 921276 - protein, 9 aa, Mycobacterium
VGKARAAGY

SEQ ID NO: 921277 - protein, 5 aa, Mycobacterium
VGKAT

SEQ ID NO: 921278 - protein, 62 aa, Mycobacterium
VGKDTNKVDVKTTDTGTEPVQPTDQPTDQGTVTGDVTAAAAPEVTAPADTDAVETPKANGKP

SEQ ID NO: 921279 - protein, 6 aa, Mycobacterium
VGKGKD

SEQ ID NO: 921280 - protein, 12 aa, Mycobacterium
VGLTPTAKEVTG

SEQ ID NO: 921281 - protein, 9 aa, Mycobacterium
VGNATTAPT

SEQ ID NO: 921282 - protein, 7 aa, Mycobacterium
VGNGGTW

SEQ ID NO: 921283 - protein, 10 aa, Mycobacterium
VGNKSSANCS

SEQ ID NO: 921284 - protein, 9 aa, Mycobacterium
VGNNSDGQL

SEQ ID NO: 921285 - protein, 7 aa, Mycobacterium
VGNTSDE

SEQ ID NO: 921286 - protein, 5 aa, Mycobacterium
VGPAA

SEQ ID NO: 921287 - protein, 10 aa, Mycobacterium
VGPAGTPATV

SEQ ID NO: 921288 - protein, 6 aa, Mycobacterium
VGPAVT

SEQ ID NO: 921289 - protein, 7 aa, Mycobacterium
VGPAYAS

SEQ ID NO: 921290 - protein, 4 aa, Mycobacterium
VGPD

SEQ ID NO: 921291 - protein, 6 aa, Mycobacterium
VGPDES

SEQ ID NO: 921292 - protein, 5 aa, Mycobacterium
VGPDF

SEQ ID NO: 921293 - protein, 7 aa, Mycobacterium
VGPDGTA

SEQ ID NO: 921294 - protein, 5 aa, Mycobacterium
VGPDI

SEQ ID NO: 921295 - protein, 5 aa, Mycobacterium
VGPDL

SEQ ID NO: 921296 - protein, 7 aa, Mycobacterium
VGPEDAP

SEQ ID NO: 921297 - protein, 5 aa, Mycobacterium
VGPEL

SEQ ID NO: 921298 - protein, 77 aa, Mycobacterium
VGPETPAAGAVTTPAEATTDAPAAATDTSTKQAPSATDAASASAASEAKPVADDSEEAITTPAKPSTVAKPKKVNAV

SEQ ID NO: 921299 - protein, 12 aa, Mycobacterium
VGPGAAGDFEEL

SEQ ID NO: 921300 - protein, 5 aa, Mycobacterium
VGPGC

SEQ ID NO: 921301 - protein, 18 aa, Mycobacterium
VGPHATADGPPSQNPGGI

SEQ ID NO: 921302 - protein, 24 aa, Mycobacterium
VGPHEPDTSRYGQDRRTVVEDRDG

SEQ ID NO: 921303 - protein, 6 aa, Mycobacterium
VGPKDA

SEQ ID NO: 921304 - protein, 5 aa, Mycobacterium
VGPNE

SEQ ID NO: 921305 - protein, 9 aa, Mycobacterium
VGPNNTAQA

SEQ ID NO: 921306 - protein, 6 aa, Mycobacterium
VGPNPA

SEQ ID NO: 921307 - protein, 6 aa, Mycobacterium
VGPNPS

SEQ ID NO: 921308 - protein, 10 aa, Mycobacterium
VGPPLPPGLQ

SEQ ID NO: 921309 - protein, 17 aa, Mycobacterium
VGPPPAPDGAVASGPPG

SEQ ID NO: 921310 - protein, 10 aa, Mycobacterium
VGPPPPPPWC

SEQ ID NO: 921311 - protein, 7 aa, Mycobacterium
VGPPVPG

SEQ ID NO: 921312 - protein, 6 aa, Mycobacterium
VGPRGP

SEQ ID NO: 921313 - protein, 17 aa, Mycobacterium
VGPRGRKEYRATDAGRA

SEQ ID NO: 921314 - protein, 18 aa, Mycobacterium
VGPRRQGQPAHSDIGSTG

SEQ ID NO: 921315 - protein, 5 aa, Mycobacterium
VGPRV

SEQ ID NO: 921316 - protein, 7 aa, Mycobacterium
VGPSNAP

SEQ ID NO: 921317 - protein, 5 aa, Mycobacterium
VGPTL

SEQ ID NO: 921318 - protein, 5 aa, Mycobacterium
VGPTM

SEQ ID NO: 921319 - protein, 18 aa, Mycobacterium
VGPVPSQEQANGWARDHT

SEQ ID NO: 921320 - protein, 16 aa, Mycobacterium
VGQGPAAQGFGVQGPT

SEQ ID NO: 921321 - protein, 21 aa, Mycobacterium
VGQGTSAVTATLSEGDQPAVS

SEQ ID NO: 921322 - protein, 14 aa, Mycobacterium
VGQKQDAAIKKGLG

SEQ ID NO: 921323 - protein, 6 aa, Mycobacterium
VGQQKK

SEQ ID NO: 921324 - protein, 11 aa, Mycobacterium
VGQRPDSVTCP

SEQ ID NO: 921325 - protein, 11 aa, Mycobacterium
VGQSTAAEAMS

SEQ ID NO: 921326 - protein, 5 aa, Mycobacterium
VGQTM

SEQ ID NO: 921327 - protein, 8 aa, Mycobacterium
VGQYRDDR

SEQ ID NO: 921328 - protein, 9 aa, Mycobacterium
VGRDLGPRN

SEQ ID NO: 921329 - protein, 10 aa, Mycobacterium
VGRDTPTNFT

SEQ ID NO: 921330 - protein, 8 aa, Mycobacterium
VGRGEGYG

SEQ ID NO: 921331 - protein, 11 aa, Mycobacterium
VGRGERRIRSH

SEQ ID NO: 921332 - protein, 8 aa, Mycobacterium
VGRGPAAV

SEQ ID NO: 921333 - protein, 8 aa, Mycobacterium
VGRPDDIA

SEQ ID NO: 921334 - protein, 9 aa, Mycobacterium
VGRQGRSQG

SEQ ID NO: 921335 - protein, 10 aa, Mycobacterium
VGRQSEEGSG

SEQ ID NO: 921336 - protein, 13 aa, Mycobacterium
VGRSNGCSYADSA

SEQ ID NO: 921337 - protein, 8 aa, Mycobacterium
VGRSRERG

SEQ ID NO: 921338 - protein, 13 aa, Mycobacterium
VGRTDLPGGSGRD

SEQ ID NO: 921339 - protein, 12 aa, Mycobacterium
VGSAARKAGKPP

SEQ ID NO: 921340 - protein, 7 aa, Mycobacterium
VGSAGDT

SEQ ID NO: 921341 - protein, 9 aa, Mycobacterium
VGSAGTTTY

SEQ ID NO: 921342 - protein, 5 aa, Mycobacterium
VGSAP

SEQ ID NO: 921343 - protein, 6 aa, Mycobacterium
VGSCPN

SEQ ID NO: 921344 - protein, 4 aa, Mycobacterium
VGSD

SEQ ID NO: 921345 - protein, 8 aa, Mycobacterium
VGSDTIRR

SEQ ID NO: 921346 - protein, 13 aa, Mycobacterium
VGSEGEITYSTNN

SEQ ID NO: 921347 - protein, 16 aa, Mycobacterium
VGSGGQSGNDPEKPTI

SEQ ID NO: 921348 - protein, 10 aa, Mycobacterium
VGSGGSVASA

SEQ ID NO: 921349 - protein, 10 aa, Mycobacterium
VGSGNNGSYN

SEQ ID NO: 921350 - protein, 10 aa, Mycobacterium
VGSGQPTTKY

SEQ ID NO: 921351 - protein, 20 aa, Mycobacterium
VGSGRAAGWGTGGSQDQANQ

SEQ ID NO: 921352 - protein, 11 aa, Mycobacterium
VGSGSSVGSAI

SEQ ID NO: 921353 - protein, 27 aa, Mycobacterium
VGSGTGGAGGAGGVGAGTGGAGGAGAH

SEQ ID NO: 921354 - protein, 5 aa, Mycobacterium
VGSGY

SEQ ID NO: 921355 - protein, 6 aa, Mycobacterium
VGSPGL

SEQ ID NO: 921356 - protein, 8 aa, Mycobacterium
VGSPNAPY

SEQ ID NO: 921357 - protein, 11 aa, Mycobacterium
VGSPSSASAII

SEQ ID NO: 921358 - protein, 6 aa, Mycobacterium
VGSQTA

SEQ ID NO: 921359 - protein, 6 aa, Mycobacterium
VGSRGE

SEQ ID NO: 921360 - protein, 8 aa, Mycobacterium
VGSRGEVK

SEQ ID NO: 921361 - protein, 9 aa, Mycobacterium
VGSRPTSIA

SEQ ID NO: 921362 - protein, 26 aa, Mycobacterium
VGSSATRHADEYAARADVPTVQPGTD

SEQ ID NO: 921363 - protein, 9 aa, Mycobacterium
VGSSETGAQ

SEQ ID NO: 921364 - protein, 12 aa, Mycobacterium
VGSSRADPGPFI

SEQ ID NO: 921365 - protein, 9 aa, Mycobacterium
VGSSSSDAH

SEQ ID NO: 921366 - protein, 6 aa, Mycobacterium
VGSSVP

SEQ ID NO: 921367 - protein, 8 aa, Mycobacterium
VGSSVPDE

SEQ ID NO: 921368 - protein, 13 aa, Mycobacterium
VGSTAELRSATPL

SEQ ID NO: 921369 - protein, 5 aa, Mycobacterium
VGSTV

SEQ ID NO: 921370 - protein, 11 aa, Mycobacterium
VGSVSDHGAHS

SEQ ID NO: 921371 - protein, 8 aa, Mycobacterium
VGTATIGG

SEQ ID NO: 921372 - protein, 4 aa, Mycobacterium
VGTD

SEQ ID NO: 921373 - protein, 7 aa, Mycobacterium
VGTDAGD

SEQ ID NO: 921374 - protein, 7 aa, Mycobacterium
VGTDART

SEQ ID NO: 921375 - protein, 7 aa, Mycobacterium
VGTDSAE

SEQ ID NO: 921376 - protein, 19 aa, Mycobacterium
VGTEFQGGVGEGAAKSAGV

SEQ ID NO: 921377 - protein, 10 aa, Mycobacterium
VGTGKRATSV

SEQ ID NO: 921378 - protein, 71 aa, Mycobacterium
VGTGQSVPGYGPSFPGAGPQVPGQPGYGQQTPVYGQTPPGSGPSIHGGTGTAPAPARLAPGPVTSVPQAPL

SEQ ID NO: 921379 - protein, 13 aa, Mycobacterium
VGTGRSHADDTPM

SEQ ID NO: 921380 - protein, 17 aa, Mycobacterium
VGTGRTGLGPFQDRPTE

SEQ ID NO: 921381 - protein, 6 aa, Mycobacterium
VGTHSY

SEQ ID NO: 921382 - protein, 4 aa, Mycobacterium
VGTI

SEQ ID NO: 921383 - protein, 16 aa, Mycobacterium
VGTPANRKSATGLPPT

SEQ ID NO: 921384 - protein, 7 aa, Mycobacterium
VGTPERI

SEQ ID NO: 921385 - protein, 21 aa, Mycobacterium
VGTPNGLSPAPIPQGSESTGT

SEQ ID NO: 921386 - protein, 17 aa, Mycobacterium
VGTSASRHSAEYAARAD

SEQ ID NO: 921387 - protein, 18 aa, Mycobacterium
VGTSDSDGQRDPQTQTNY

SEQ ID NO: 921388 - protein, 4 aa, Mycobacterium
VGTT

SEQ ID NO: 921389 - protein, 16 aa, Mycobacterium
VGTTELGTQTPPRPDT

SEQ ID NO: 921390 - protein, 14 aa, Mycobacterium
VGTYNKNDGAQDWQ

SEQ ID NO: 921391 - protein, 9 aa, Mycobacterium
VGVDGSDPY

SEQ ID NO: 921392 - protein, 6 aa, Mycobacterium
VGVDPT

SEQ ID NO: 921393 - protein, 9 aa, Mycobacterium
VHGDTGPIT

SEQ ID NO: 921394 - protein, 19 aa, Mycobacterium
VHGGGEPPHYLATTNANAI

SEQ ID NO: 921395 - protein, 10 aa, Mycobacterium
VHGRTGPIPV

SEQ ID NO: 921396 - protein, 5 aa, Mycobacterium
VHNNK

SEQ ID NO: 921397 - protein, 9 aa, Mycobacterium
VHPADPAAG

SEQ ID NO: 921398 - protein, 5 aa, Mycobacterium
VHPGG

SEQ ID NO: 921399 - protein, 4 aa, Mycobacterium
VHSG

SEQ ID NO: 921400 - protein, 4 aa, Mycobacterium
VHSP

SEQ ID NO: 921401 - protein, 9 aa, Mycobacterium
VHSQSAVGE

SEQ ID NO: 921402 - protein, 6 aa, Mycobacterium
VHTSNG

SEQ ID NO: 921403 - protein, 8 aa, Mycobacterium
VIDDPAPE

SEQ ID NO: 921404 - protein, 11 aa, Mycobacterium
VIGGGQPTLTG

SEQ ID NO: 921405 - protein, 11 aa, Mycobacterium
VIGGNREALST

SEQ ID NO: 921406 - protein, 11 aa, Mycobacterium
VIGSSGTPGRR

SEQ ID NO: 921407 - protein, 7 aa, Mycobacterium
VIPKERT

SEQ ID NO: 921408 - protein, 20 aa, Mycobacterium
VKAEKVSNQTNAFTSCLLKA

SEQ ID NO: 921409 - protein, 7 aa, Mycobacterium
VKAENMT

SEQ ID NO: 921410 - protein, 31 aa, Mycobacterium
VKAGPSPAGGTPPAATALGTTSPTSPRPRTE

SEQ ID NO: 921411 - protein, 17 aa, Mycobacterium
VKAPGPQTAIPGNRENT

SEQ ID NO: 921412 - protein, 53 aa, Mycobacterium
VKARSGDGKAPAKKAPAKKAPAKKAPAKKTPAKKTAAKKTTAKKAPAKKAAAK

SEQ ID NO: 921413 - protein, 32 aa, Mycobacterium
VKARSGDGKSAAKKSTAEKAPAKKARAKQAAK

SEQ ID NO: 921414 - protein, 14 aa, Mycobacterium
VKARSGEKKPPVAK

SEQ ID NO: 921415 - protein, 16 aa, Mycobacterium
VKASYAASKAGLSSLG

SEQ ID NO: 921416 - protein, 7 aa, Mycobacterium
VKDEKIR

SEQ ID NO: 921417 - protein, 20 aa, Mycobacterium
VKDERSVTRPKALTFCQVTS

SEQ ID NO: 921418 - protein, 20 aa, Mycobacterium
VKDERTSTGVNAQTFCLVKA

SEQ ID NO: 921419 - protein, 4 aa, Mycobacterium
VKDG

SEQ ID NO: 921420 - protein, 6 aa, Mycobacterium
VKDGKR

SEQ ID NO: 921421 - protein, 7 aa, Mycobacterium
VKDGTVS

SEQ ID NO: 921422 - protein, 20 aa, Mycobacterium
VKDQRSVSRPKALTFCQVTS

SEQ ID NO: 921423 - protein, 9 aa, Mycobacterium
VKEPGTSCA

SEQ ID NO: 921424 - protein, 71 aa, Mycobacterium
VKGADSADADIEETDTADQADIDSGAEKEAAQEDSDAGAQSGDDADKDGSVSSDSGASTDRSPSKPSATSD

SEQ ID NO: 921425 - protein, 8 aa, Mycobacterium
VKGHDDSA

SEQ ID NO: 921426 - protein, 5 aa, Mycobacterium
VKGND

SEQ ID NO: 921427 - protein, 8 aa, Mycobacterium
VKGPKRPD

SEQ ID NO: 921428 - protein, 8 aa, Mycobacterium
VKGPTARY

SEQ ID NO: 921429 - protein, 21 aa, Mycobacterium
VKGRSGSTRQVAYSSAKGAIE

SEQ ID NO: 921430 - protein, 9 aa, Mycobacterium
VKGSNDDVQ

SEQ ID NO: 921431 - protein, 9 aa, Mycobacterium
VKKTDEQAK

SEQ ID NO: 921432 - protein, 15 aa, Mycobacterium
VKNNTQSDSPENRVD

SEQ ID NO: 921433 - protein, 22 aa, Mycobacterium
VKPAPGNADPNNGALACGAPLP

SEQ ID NO: 921434 - protein, 8 aa, Mycobacterium
VKPEEQEM

SEQ ID NO: 921435 - protein, 14 aa, Mycobacterium
VKPGNDAPDARVRT

SEQ ID NO: 921436 - protein, 7 aa, Mycobacterium
VKPPEGR

SEQ ID NO: 921437 - protein, 15 aa, Mycobacterium
VKPSTHRTKADTAVE

SEQ ID NO: 921438 - protein, 7 aa, Mycobacterium
VKPTYGT

SEQ ID NO: 921439 - protein, 7 aa, Mycobacterium
VKQAGGK

SEQ ID NO: 921440 - protein, 6 aa, Mycobacterium
VKQEEL

SEQ ID NO: 921441 - protein, 15 aa, Mycobacterium
VKRPDRPLPGRPEDI

SEQ ID NO: 921442 - protein, 16 aa, Mycobacterium
VKSAVDGIAAPTTRGV

SEQ ID NO: 921443 - protein, 9 aa, Mycobacterium
VKSDGSDRL

SEQ ID NO: 921444 - protein, 12 aa, Mycobacterium
VKSEGGRNSQAG

SEQ ID NO: 921445 - protein, 12 aa, Mycobacterium
VKSEGGRNTQAG

SEQ ID NO: 921446 - protein, 20 aa, Mycobacterium
VKSEKVTNQTNAFTSCLLKA

SEQ ID NO: 921447 - protein, 5 aa, Mycobacterium
VKSFE

SEQ ID NO: 921448 - protein, 5 aa, Mycobacterium
VKSGE

SEQ ID NO: 921449 - protein, 10 aa, Mycobacterium
VKSGSEADIS

SEQ ID NO: 921450 - protein, 8 aa, Mycobacterium
VKSPPVDD

SEQ ID NO: 921451 - protein, 7 aa, Mycobacterium
VKSSAPD

SEQ ID NO: 921452 - protein, 9 aa, Mycobacterium
VKTDPSGVA

SEQ ID NO: 921453 - protein, 7 aa, Mycobacterium
VKTSGDS

SEQ ID NO: 921454 - protein, 5 aa, Mycobacterium
VKVKS

SEQ ID NO: 921455 - protein, 7 aa, Mycobacterium
VLDGTPY

SEQ ID NO: 921456 - protein, 12 aa, Mycobacterium
VLGGTDPAGPLT

SEQ ID NO: 921457 - protein, 7 aa, Mycobacterium
VLNGSDE

SEQ ID NO: 921458 - protein, 21 aa, Mycobacterium
VLSNDGEKTVNCQDRIVPLPP

SEQ ID NO: 921459 - protein, 9 aa, Mycobacterium
VLSPADQKL

SEQ ID NO: 921460 - protein, 13 aa, Mycobacterium
VLTGSDDVRPADP

SEQ ID NO: 921461 - protein, 8 aa, Mycobacterium
VMGGTSTS

SEQ ID NO: 921462 - protein, 21 aa, Mycobacterium
VNAADGDRRRDVTNAMTGQPL

SEQ ID NO: 921463 - protein, 14 aa, Mycobacterium
VNAEDSLTGTKDEL

SEQ ID NO: 921464 - protein, 9 aa, Mycobacterium
VNAEEPGCS

SEQ ID NO: 921465 - protein, 7 aa, Mycobacterium
VNAESAQ

SEQ ID NO: 921466 - protein, 6 aa, Mycobacterium
VNAGEH

SEQ ID NO: 921467 - protein, 10 aa, Mycobacterium
VNAPDGAELD

SEQ ID NO: 921468 - protein, 4 aa, Mycobacterium
VNDA

SEQ ID NO: 921469 - protein, 4 aa, Mycobacterium
VNDG

SEQ ID NO: 921470 - protein, 4 aa, Mycobacterium
VNDP

SEQ ID NO: 921471 - protein, 17 aa, Mycobacterium
VNDPGPSAGKLKAGDAI

SEQ ID NO: 921472 - protein, 10 aa, Mycobacterium
VNDREDSDAL

SEQ ID NO: 921473 - protein, 9 aa, Mycobacterium
VNDSEAQNF

SEQ ID NO: 921474 - protein, 17 aa, Mycobacterium
VNEATEGAVTKGLKDTT

SEQ ID NO: 921475 - protein, 28 aa, Mycobacterium
VNGAPGPDQTTMATGDAGSRVACGVISA

SEQ ID NO: 921476 - protein, 20 aa, Mycobacterium
VNGDGGNGGDGGNGGLGGAG

SEQ ID NO: 921477 - protein, 8 aa, Mycobacterium
VNGDNGNN

SEQ ID NO: 921478 - protein, 26 aa, Mycobacterium
VNGGYYGDEPSLTDLDRGDLKSTTDF

SEQ ID NO: 921479 - protein, 20 aa, Mycobacterium
VNGLNGNSAYTKNGAGNGGI

SEQ ID NO: 921480 - protein, 7 aa, Mycobacterium
VNGPAGS

SEQ ID NO: 921481 - protein, 6 aa, Mycobacterium
VNGPGG

SEQ ID NO: 921482 - protein, 8 aa, Mycobacterium
VNGRDGSI

SEQ ID NO: 921483 - protein, 10 aa, Mycobacterium
VNGSSDVYDA

SEQ ID NO: 921484 - protein, 26 aa, Mycobacterium
VNGYDPAAVTAPATQAAFGGGTDPVS

SEQ ID NO: 921485 - protein, 4 aa, Mycobacterium
VNIT

SEQ ID NO: 921486 - protein, 18 aa, Mycobacterium
VNNDTTYAKRAPVDQNAI

SEQ ID NO: 921487 - protein, 18 aa, Mycobacterium
VNPANPPAPPVDDAQRDT

SEQ ID NO: 921488 - protein, 19 aa, Mycobacterium
VNPAPGSPPLGVPAPAAAP

SEQ ID NO: 921489 - protein, 24 aa, Mycobacterium
VNPFPAEPDIKPAAAPEGTGQPVP

SEQ ID NO: 921490 - protein, 9 aa, Mycobacterium
VNPKGTTPL

SEQ ID NO: 921491 - protein, 5 aa, Mycobacterium
VNPKV

SEQ ID NO: 921492 - protein, 14 aa, Mycobacterium
VNPKVTDCNVPQPS

SEQ ID NO: 921493 - protein, 6 aa, Mycobacterium
VNPPGR

SEQ ID NO: 921494 - protein, 24 aa, Mycobacterium
VNPPPAPQSTDTPHNSPPPPPRPT

SEQ ID NO: 921495 - protein, 23 aa, Mycobacterium
VNPPPAPQSTDTPHNSVPPPPRV

SEQ ID NO: 921496 - protein, 6 aa, Mycobacterium
VNPQGT

SEQ ID NO: 921497 - protein, 10 aa, Mycobacterium
VNRPNGGYGS

SEQ ID NO: 921498 - protein, 5 aa, Mycobacterium
VNRPT

SEQ ID NO: 921499 - protein, 8 aa, Mycobacterium
VNRPTPDR

SEQ ID NO: 921500 - protein, 5 aa, Mycobacterium
VNRTV

SEQ ID NO: 921501 - protein, 7 aa, Mycobacterium
VNSAAGV

SEQ ID NO: 921502 - protein, 9 aa, Mycobacterium
VNSDAPARG

SEQ ID NO: 921503 - protein, 12 aa, Mycobacterium
VNSKGGLQIGDQ

SEQ ID NO: 921504 - protein, 9 aa, Mycobacterium
VNSPNGYRT

SEQ ID NO: 921505 - protein, 7 aa, Mycobacterium
VNSQTDA

SEQ ID NO: 921506 - protein, 9 aa, Mycobacterium
VNSSGIGNV

SEQ ID NO: 921507 - protein, 15 aa, Mycobacterium
VNSSGRTQYGHSGGF

SEQ ID NO: 921508 - protein, 6 aa, Mycobacterium
VNSTGT

SEQ ID NO: 921509 - protein, 15 aa, Mycobacterium
VNTDSDSAAQTGVAT

SEQ ID NO: 921510 - protein, 9 aa, Mycobacterium
VNTEQALRE

SEQ ID NO: 921511 - protein, 17 aa, Mycobacterium
VNTGETPPRTPAPTTTA

SEQ ID NO: 921512 - protein, 16 aa, Mycobacterium
VNTPRDGHVHEIVVRP

SEQ ID NO: 921513 - protein, 13 aa, Mycobacterium
VNTQGPQKFDPTL

SEQ ID NO: 921514 - protein, 7 aa, Mycobacterium
VNTTESG

SEQ ID NO: 921515 - protein, 9 aa, Mycobacterium
VNVNAGGTK

SEQ ID NO: 921516 - protein, 12 aa, Mycobacterium
VNVSADGESLVL

SEQ ID NO: 921517 - protein, 4 aa, Mycobacterium
VPAA

SEQ ID NO: 921518 - protein, 8 aa, Mycobacterium
VPAAADPC

SEQ ID NO: 921519 - protein, 12 aa, Mycobacterium
VPAAAEPKSLPD

SEQ ID NO: 921520 - protein, 6 aa, Mycobacterium
VPAAAG

SEQ ID NO: 921521 - protein, 14 aa, Mycobacterium
VPAAASAAAAKGAT

SEQ ID NO: 921522 - protein, 144 aa, Mycobacterium
VPAAPPAQPLDNPSPGIEQDEDPRRYTEKPKAGADAPEPVADAPTDKAGTSVTQPGVSPGADAGTGKADVGDEGLATSSPVTQPGMTPAPRPAAASPLGGGAPSMSGLGSGGGGMGSGGGIPKMPGGLGSGGMPGTGSNPLSGV

SEQ ID NO: 921523 - protein, 28 aa, Mycobacterium
VPAAPQAPEVIPPATAPGVTPETPAAPT

SEQ ID NO: 921524 - protein, 13 aa, Mycobacterium
VPAASADSSRRDM

SEQ ID NO: 921525 - protein, 7 aa, Mycobacterium
VPAATTP

SEQ ID NO: 921526 - protein, 5 aa, Mycobacterium
VPADA

SEQ ID NO: 921527 - protein, 5 aa, Mycobacterium
VPADG

SEQ ID NO: 921528 - protein, 8 aa, Mycobacterium
VPAEQGEL

SEQ ID NO: 921529 - protein, 13 aa, Mycobacterium
VPAGAGPAVPPTA

SEQ ID NO: 921530 - protein, 6 aa, Mycobacterium
VPAGDL

SEQ ID NO: 921531 - protein, 9 aa, Mycobacterium
VPAGEQSSL

SEQ ID NO: 921532 - protein, 13 aa, Mycobacterium
VPAGGEHELAPGG

SEQ ID NO: 921533 - protein, 8 aa, Mycobacterium
VPAGPAAG

SEQ ID NO: 921534 - protein, 25 aa, Mycobacterium
VPAGPPEQAPEPPPEQASEPNPEVP

SEQ ID NO: 921535 - protein, 12 aa, Mycobacterium
VPAGPTESDRAI

SEQ ID NO: 921536 - protein, 6 aa, Mycobacterium
VPAGRQ

SEQ ID NO: 921537 - protein, 5 aa, Mycobacterium
VPAGT

SEQ ID NO: 921538 - protein, 7 aa, Mycobacterium
VPAGTGS

SEQ ID NO: 921539 - protein, 6 aa, Mycobacterium
VPAGTT

SEQ ID NO: 921540 - protein, 93 aa, Mycobacterium
VPAGTTAAASTAIAAGATGNGGIRTRSSRHTVTTGAAGTARPNAPAIAAGPTSAAGTTGHGRVGTSTSSPAITADAAGPGAVVTGGGTASGMG

SEQ ID NO: 921541 - protein, 7 aa, Mycobacterium
VPANDAD

SEQ ID NO: 921542 - protein, 10 aa, Mycobacterium
VPANSTEEEY

SEQ ID NO: 921543 - protein, 7 aa, Mycobacterium
VPAPAAV

SEQ ID NO: 921544 - protein, 10 aa, Mycobacterium
VPAPGAEPGT

SEQ ID NO: 921545 - protein, 9 aa, Mycobacterium
VPAPGDPSY

SEQ ID NO: 921546 - protein, 10 aa, Mycobacterium
VPAPGGLNPA

SEQ ID NO: 921547 - protein, 6 aa, Mycobacterium
VPAPMP

SEQ ID NO: 921548 - protein, 16 aa, Mycobacterium
VPAPPGPVTEPPPGVD

SEQ ID NO: 921549 - protein, 8 aa, Mycobacterium
VPAPTDDW

SEQ ID NO: 921550 - protein, 7 aa, Mycobacterium
VPAPTDF

SEQ ID NO: 921551 - protein, 22 aa, Mycobacterium
VPAPTTTGGSGTPSETPTPGAM

SEQ ID NO: 921552 - protein, 11 aa, Mycobacterium
VPAQAPAPAPV

SEQ ID NO: 921553 - protein, 4 aa, Mycobacterium
VPAR

SEQ ID NO: 921554 - protein, 5 aa, Mycobacterium
VPARN

SEQ ID NO: 921555 - protein, 12 aa, Mycobacterium
VPASTNKPGAFT

SEQ ID NO: 921556 - protein, 11 aa, Mycobacterium
VPATDPNVNQG

SEQ ID NO: 921557 - protein, 5 aa, Mycobacterium
VPATT

SEQ ID NO: 921558 - protein, 74 aa, Mycobacterium
VPATTAPAQNGPPPPGTPGGVYGPGGWGGPGGPGGPPAPGEPYGPYGPQVGAPGTPGWPGGIAGPTAAGGHAGM

SEQ ID NO: 921559 - protein, 27 aa, Mycobacterium
VPAVPASDSVPHGQRAAGSQGTPVSTE

SEQ ID NO: 921560 - protein, 7 aa, Mycobacterium
VPDDDLG

SEQ ID NO: 921561 - protein, 4 aa, Mycobacterium
VPDG

SEQ ID NO: 921562 - protein, 8 aa, Mycobacterium
VPDPPDTI

SEQ ID NO: 921563 - protein, 46 aa, Mycobacterium
VPDPTATPDAAATAGARVTGRAQQTGRATSPRSAPVTTQTAVPTSA

SEQ ID NO: 921564 - protein, 4 aa, Mycobacterium
VPDQ

SEQ ID NO: 921565 - protein, 8 aa, Mycobacterium
VPDQDQLT

SEQ ID NO: 921566 - protein, 13 aa, Mycobacterium
VPDSRPAHSRAEA

SEQ ID NO: 921567 - protein, 17 aa, Mycobacterium
VPDSSPYSNPGNFTAPG

SEQ ID NO: 921568 - protein, 6 aa, Mycobacterium
VPDTYG

SEQ ID NO: 921569 - protein, 19 aa, Mycobacterium
VPDYGATGLQASERNDRPW

SEQ ID NO: 921570 - protein, 41 aa, Mycobacterium
VPEAKAAPAEPEARAAPEATAPKAPTHPSPARPAAKAEPAA

SEQ ID NO: 921571 - protein, 16 aa, Mycobacterium
VPEDQVTQQSLDAAGK

SEQ ID NO: 921572 - protein, 29 aa, Mycobacterium
VPEDTPEDIEDDDVEVSATAGELRGEEGT

SEQ ID NO: 921573 - protein, 5 aa, Mycobacterium
VPEEA

SEQ ID NO: 921574 - protein, 10 aa, Mycobacterium
VPEEAAPVSG

SEQ ID NO: 921575 - protein, 30 aa, Mycobacterium
VPEEAGPVTAMPGGPGMAAASKGGGYAGPR

SEQ ID NO: 921576 - protein, 22 aa, Mycobacterium
VPEGDPQLPSPPQTPAPPPPTA

SEQ ID NO: 921577 - protein, 5 aa, Mycobacterium
VPEGL

SEQ ID NO: 921578 - protein, 9 aa, Mycobacterium
VPEGPGSVQ

SEQ ID NO: 921579 - protein, 9 aa, Mycobacterium
VPEGSAGIE

SEQ ID NO: 921580 - protein, 4 aa, Mycobacterium
VPEK

SEQ ID NO: 921581 - protein, 4 aa, Mycobacterium
VPEL

SEQ ID NO: 921582 - protein, 9 aa, Mycobacterium
VPENGPGAY

SEQ ID NO: 921583 - protein, 17 aa, Mycobacterium
VPEPGPSAGKLKAGDAI

SEQ ID NO: 921584 - protein, 9 aa, Mycobacterium
VPEPHSAGQ

SEQ ID NO: 921585 - protein, 9 aa, Mycobacterium
VPEPPATWD

SEQ ID NO: 921586 - protein, 39 aa, Mycobacterium
VPEPPSIRYPGGPAPGPMPYPGAPPYGAPQYGPDGTPLY

SEQ ID NO: 921587 - protein, 5 aa, Mycobacterium
VPEPR

SEQ ID NO: 921588 - protein, 6 aa, Mycobacterium
VPEQRP

SEQ ID NO: 921589 - protein, 7 aa, Mycobacterium
VPESLRD

SEQ ID NO: 921590 - protein, 5 aa, Mycobacterium
VPESV

SEQ ID NO: 921591 - protein, 6 aa, Mycobacterium
VPETAV

SEQ ID NO: 921592 - protein, 19 aa, Mycobacterium
VPFDPNYQGPRETADNINR

SEQ ID NO: 921593 - protein, 19 aa, Mycobacterium
VPFPDEASGPRGRQGSPAR

SEQ ID NO: 921594 - protein, 10 aa, Mycobacterium
VPGAGKGVAQ

SEQ ID NO: 921595 - protein, 6 aa, Mycobacterium
VPGAGT

SEQ ID NO: 921596 - protein, 12 aa, Mycobacterium
VPGCGGGALTPE

SEQ ID NO: 921597 - protein, 13 aa, Mycobacterium
VPGDRPDGVYTTG

SEQ ID NO: 921598 - protein, 5 aa, Mycobacterium
VPGDS

SEQ ID NO: 921599 - protein, 4 aa, Mycobacterium
VPGE

SEQ ID NO: 921600 - protein, 11 aa, Mycobacterium
VPGGEDGNAFD

SEQ ID NO: 921601 - protein, 6 aa, Mycobacterium
VPGGFS

SEQ ID NO: 921602 - protein, 6 aa, Mycobacterium
VPGGRY

SEQ ID NO: 921603 - protein, 12 aa, Mycobacterium
VPGGSGGGSAAA

SEQ ID NO: 921604 - protein, 6 aa, Mycobacterium
VPGGVS

SEQ ID NO: 921605 - protein, 12 aa, Mycobacterium
VPGHGQSGGESR

SEQ ID NO: 921606 - protein, 14 aa, Mycobacterium
VPGKGGASTIQNQL

SEQ ID NO: 921607 - protein, 22 aa, Mycobacterium
VPGKRAATPRECRSDEPYQPLG

SEQ ID NO: 921608 - protein, 5 aa, Mycobacterium
VPGMP

SEQ ID NO: 921609 - protein, 24 aa, Mycobacterium
VPGNSAPGAPNASPAPGTPPSPAH

SEQ ID NO: 921610 - protein, 12 aa, Mycobacterium
VPGNTTENQGGR

SEQ ID NO: 921611 - protein, 6 aa, Mycobacterium
VPGPAP

SEQ ID NO: 921612 - protein, 13 aa, Mycobacterium
VPGPGLSEAGELQ

SEQ ID NO: 921613 - protein, 47 aa, Mycobacterium
VPGPPPGAPVPPPPGQAVPAAAPAETTTPTPAPAPPPGPAPGPAVMG

SEQ ID NO: 921614 - protein, 16 aa, Mycobacterium
VPGPVPTSPANNDFKP

SEQ ID NO: 921615 - protein, 14 aa, Mycobacterium
VPGQGGTGGAGGHA

SEQ ID NO: 921616 - protein, 4 aa, Mycobacterium
VPGR

SEQ ID NO: 921617 - protein, 15 aa, Mycobacterium
VPGRAKAGQSSGDLT

SEQ ID NO: 921618 - protein, 8 aa, Mycobacterium
VPGSDPKV

SEQ ID NO: 921619 - protein, 19 aa, Mycobacterium
VPGSVRPGDYEGGRQTQIS

SEQ ID NO: 921620 - protein, 11 aa, Mycobacterium
VPGTPSWEDMD

SEQ ID NO: 921621 - protein, 15 aa, Mycobacterium
VPGTYDELDDQDAES

SEQ ID NO: 921622 - protein, 13 aa, Mycobacterium
VPGVGTRSKPDVT

SEQ ID NO: 921623 - protein, 4 aa, Mycobacterium
VPGY

SEQ ID NO: 921624 - protein, 6 aa, Mycobacterium
VPHDGD

SEQ ID NO: 921625 - protein, 16 aa, Mycobacterium
VPIDRTNSDAAQAALE

SEQ ID NO: 921626 - protein, 6 aa, Mycobacterium
VPIPAG

SEQ ID NO: 921627 - protein, 9 aa, Mycobacterium
VPIPDGPAQ

SEQ ID NO: 921628 - protein, 7 aa, Mycobacterium
VPKPMAP

SEQ ID NO: 921629 - protein, 6 aa, Mycobacterium
VPLEQN

SEQ ID NO: 921630 - protein, 5 aa, Mycobacterium
VPLKT

SEQ ID NO: 921631 - protein, 14 aa, Mycobacterium
VPLPGSTFDGSSTL

SEQ ID NO: 921632 - protein, 13 aa, Mycobacterium
VPLPTSPGYNGNT

SEQ ID NO: 921633 - protein, 19 aa, Mycobacterium
VPLQGSDQVVPGATTPITD

SEQ ID NO: 921634 - protein, 17 aa, Mycobacterium
VPNGLNPAPINQGDQRS

SEQ ID NO: 921635 - protein, 7 aa, Mycobacterium
VPNRESA

SEQ ID NO: 921636 - protein, 11 aa, Mycobacterium
VPNRNTKQGYK

SEQ ID NO: 921637 - protein, 18 aa, Mycobacterium
VPNSGGSFSPIPGNPNLP

SEQ ID NO: 921638 - protein, 8 aa, Mycobacterium
VPPAAPAP

SEQ ID NO: 921639 - protein, 12 aa, Mycobacterium
VPPAMPDGKRAS

SEQ ID NO: 921640 - protein, 5 aa, Mycobacterium
VPPAP

SEQ ID NO: 921641 - protein, 17 aa, Mycobacterium
VPPAPVPVAPPADTLSI

SEQ ID NO: 921642 - protein, 15 aa, Mycobacterium
VPPASDALGAPGTET

SEQ ID NO: 921643 - protein, 33 aa, Mycobacterium
VPPDAPRVAPPHGNAAPDAQATASGDVTVQNAA

SEQ ID NO: 921644 - protein, 5 aa, Mycobacterium
VPPGS

SEQ ID NO: 921645 - protein, 7 aa, Mycobacterium
VPPGSRL

SEQ ID NO: 921646 - protein, 6 aa, Mycobacterium
VPPGVA

SEQ ID NO: 921647 - protein, 5 aa, Mycobacterium
VPPGW

SEQ ID NO: 921648 - protein, 47 aa, Mycobacterium
VPPHPDSPPTGDGTAPPAAGATPAEAPPPAADAPAPAQAAPTNPAEG

SEQ ID NO: 921649 - protein, 8 aa, Mycobacterium
VPPIGGDQ

SEQ ID NO: 921650 - protein, 9 aa, Mycobacterium
VPPLSDKDI

SEQ ID NO: 921651 - protein, 12 aa, Mycobacterium
VPPNPSRPNLNQ

SEQ ID NO: 921652 - protein, 12 aa, Mycobacterium
VPPPDGVGAAFS

SEQ ID NO: 921653 - protein, 12 aa, Mycobacterium
VPPPDGVGTAFS

SEQ ID NO: 921654 - protein, 14 aa, Mycobacterium
VPPPGAPDTPLPCS

SEQ ID NO: 921655 - protein, 13 aa, Mycobacterium
VPPPNPDPQPLRA

SEQ ID NO: 921656 - protein, 10 aa, Mycobacterium
VPPPSNSTAA

SEQ ID NO: 921657 - protein, 39 aa, Mycobacterium
VPPPSTSTSTSTVTVTSTPTTTSAPTTTVTTPPSLPPGT

SEQ ID NO: 921658 - protein, 15 aa, Mycobacterium
VPPQPDMPPAERPAD

SEQ ID NO: 921659 - protein, 58 aa, Mycobacterium
VPPQPTLPAATGADPDAPPPLTGPTLPAEAPVPMPDPSNRQTDPAAGLPGMMIPHGGG

SEQ ID NO: 921660 - protein, 20 aa, Mycobacterium
VPPQQNPAAAPGPPAPPEVR

SEQ ID NO: 921661 - protein, 17 aa, Mycobacterium
VPPQRAAAAAARQEAGY

SEQ ID NO: 921662 - protein, 17 aa, Mycobacterium
VPPRADGVYSRGGGPVQ

SEQ ID NO: 921663 - protein, 6 aa, Mycobacterium
VPPRAI

SEQ ID NO: 921664 - protein, 12 aa, Mycobacterium
VPPSSDALGAPG

SEQ ID NO: 921665 - protein, 13 aa, Mycobacterium
VPPYPQGTWAEAA

SEQ ID NO: 921666 - protein, 9 aa, Mycobacterium
VPQFGDAPA

SEQ ID NO: 921667 - protein, 8 aa, Mycobacterium
VPQPPGDW

SEQ ID NO: 921668 - protein, 19 aa, Mycobacterium
VPQPSAPAAPVAAEAPGAG

SEQ ID NO: 921669 - protein, 6 aa, Mycobacterium
VPQQGH

SEQ ID NO: 921670 - protein, 6 aa, Mycobacterium
VPQRDQ

SEQ ID NO: 921671 - protein, 8 aa, Mycobacterium
VPQSGMPP

SEQ ID NO: 921672 - protein, 5 aa, Mycobacterium
VPQST

SEQ ID NO: 921673 - protein, 14 aa, Mycobacterium
VPQTLGASKGRIAE

SEQ ID NO: 921674 - protein, 4 aa, Mycobacterium
VPRD

SEQ ID NO: 921675 - protein, 10 aa, Mycobacterium
VPRDYDPGYS

SEQ ID NO: 921676 - protein, 8 aa, Mycobacterium
VPRGPEDV

SEQ ID NO: 921677 - protein, 8 aa, Mycobacterium
VPRPGTPI

SEQ ID NO: 921678 - protein, 15 aa, Mycobacterium
VPRRADSAASVVSTG

SEQ ID NO: 921679 - protein, 7 aa, Mycobacterium
VPRSPAT

SEQ ID NO: 921680 - protein, 12 aa, Mycobacterium
VPRVTQPPIDAG

SEQ ID NO: 921681 - protein, 6 aa, Mycobacterium
VPSDDP

SEQ ID NO: 921682 - protein, 7 aa, Mycobacterium
VPSGDTI

SEQ ID NO: 921683 - protein, 17 aa, Mycobacterium
VPSITAPPISHAGERGI

SEQ ID NO: 921684 - protein, 56 aa, Mycobacterium
VPSLTGGTGTGMSPGLTSPGLTSPGLTSPGLTSPGLTTPGLTSPGLTTPGLTPGMP

SEQ ID NO: 921685 - protein, 7 aa, Mycobacterium
VPSPDLE

SEQ ID NO: 921686 - protein, 17 aa, Mycobacterium
VPSPDSSGNQPAPASFT

SEQ ID NO: 921687 - protein, 12 aa, Mycobacterium
VPSPSASAAPCP

SEQ ID NO: 921688 - protein, 7 aa, Mycobacterium
VPSPSMG

SEQ ID NO: 921689 - protein, 10 aa, Mycobacterium
VPTAKEQGLD

SEQ ID NO: 921690 - protein, 6 aa, Mycobacterium
VPTANA

SEQ ID NO: 921691 - protein, 11 aa, Mycobacterium
VPTASADNYPV

SEQ ID NO: 921692 - protein, 13 aa, Mycobacterium
VPTDDSPGCTAAD

SEQ ID NO: 921693 - protein, 7 aa, Mycobacterium
VPTDGED

SEQ ID NO: 921694 - protein, 5 aa, Mycobacterium
VPTDP

SEQ ID NO: 921695 - protein, 7 aa, Mycobacterium
VPTGGKH

SEQ ID NO: 921696 - protein, 12 aa, Mycobacterium
VPTGHPGTAVPA

SEQ ID NO: 921697 - protein, 5 aa, Mycobacterium
VPTGP

SEQ ID NO: 921698 - protein, 13 aa, Mycobacterium
VPTISQDTGQPPV

SEQ ID NO: 921699 - protein, 6 aa, Mycobacterium
VPTKRC

SEQ ID NO: 921700 - protein, 5 aa, Mycobacterium
VPTLP

SEQ ID NO: 921701 - protein, 10 aa, Mycobacterium
VPTPDLPTPQ

SEQ ID NO: 921702 - protein, 25 aa, Mycobacterium
VPTPESIAGLSSGEIAATAVSGASA

SEQ ID NO: 921703 - protein, 21 aa, Mycobacterium
VPTPGQRVDPAAPVKANPWWR

SEQ ID NO: 921704 - protein, 17 aa, Mycobacterium
VPTPGTTEHHHHQYNRG

SEQ ID NO: 921705 - protein, 18 aa, Mycobacterium
VPTPPPPGFGYPPRAPRN

SEQ ID NO: 921706 - protein, 6 aa, Mycobacterium
VPTPVN

SEQ ID NO: 921707 - protein, 6 aa, Mycobacterium
VPTQAQ

SEQ ID NO: 921708 - protein, 6 aa, Mycobacterium
VPTRQD

SEQ ID NO: 921709 - protein, 8 aa, Mycobacterium
VPTVAPGA

SEQ ID NO: 921710 - protein, 9 aa, Mycobacterium
VPTVAPGED

SEQ ID NO: 921711 - protein, 8 aa, Mycobacterium
VPTVQPGT

SEQ ID NO: 921712 - protein, 7 aa, Mycobacterium
VPTYGEG

SEQ ID NO: 921713 - protein, 8 aa, Mycobacterium
VPVADTPA

SEQ ID NO: 921714 - protein, 4 aa, Mycobacterium
VPVD

SEQ ID NO: 921715 - protein, 8 aa, Mycobacterium
VPVEQPTV

SEQ ID NO: 921716 - protein, 4 aa, Mycobacterium
VPVP

SEQ ID NO: 921717 - protein, 13 aa, Mycobacterium
VPVPGAPGAPTDQ

SEQ ID NO: 921718 - protein, 12 aa, Mycobacterium
VPVPPPPSAGPT

SEQ ID NO: 921719 - protein, 7 aa, Mycobacterium
VPVPRDG

SEQ ID NO: 921720 - protein, 49 aa, Mycobacterium
VPVSTGTDTEVVTGDESSDAAEEDTGTAAADTDTDTDTDAQTPSAESVI

SEQ ID NO: 921721 - protein, 4 aa, Mycobacterium
VPWP

SEQ ID NO: 921722 - protein, 4 aa, Mycobacterium
VQAA

SEQ ID NO: 921723 - protein, 10 aa, Mycobacterium
VQAGGDAARL

SEQ ID NO: 921724 - protein, 7 aa, Mycobacterium
VQAGPSV

SEQ ID NO: 921725 - protein, 8 aa, Mycobacterium
VQAPGPVT

SEQ ID NO: 921726 - protein, 6 aa, Mycobacterium
VQATNN

SEQ ID NO: 921727 - protein, 6 aa, Mycobacterium
VQDGGF

SEQ ID NO: 921728 - protein, 5 aa, Mycobacterium
VQDGK

SEQ ID NO: 921729 - protein, 7 aa, Mycobacterium
VQDGRRS

SEQ ID NO: 921730 - protein, 18 aa, Mycobacterium
VQDPDADLEHGDNSGEDC

SEQ ID NO: 921731 - protein, 11 aa, Mycobacterium
VQDPGAPGTQD

SEQ ID NO: 921732 - protein, 5 aa, Mycobacterium
VQEQG

SEQ ID NO: 921733 - protein, 10 aa, Mycobacterium
VQEVDGSDAA

SEQ ID NO: 921734 - protein, 10 aa, Mycobacterium
VQGAHTGGFN

SEQ ID NO: 921735 - protein, 8 aa, Mycobacterium
VQGGPPRR

SEQ ID NO: 921736 - protein, 7 aa, Mycobacterium
VQGIPDT

SEQ ID NO: 921737 - protein, 7 aa, Mycobacterium
VQGPRWG

SEQ ID NO: 921738 - protein, 7 aa, Mycobacterium
VQGVPGV

SEQ ID NO: 921739 - protein, 5 aa, Mycobacterium
VQGVR

SEQ ID NO: 921740 - protein, 4 aa, Mycobacterium
VQLN

SEQ ID NO: 921741 - protein, 6 aa, Mycobacterium
VQNGQV

SEQ ID NO: 921742 - protein, 13 aa, Mycobacterium
VQNPKPTRRPNAV

SEQ ID NO: 921743 - protein, 15 aa, Mycobacterium
VQNSIPGSIDGKQFN

SEQ ID NO: 921744 - protein, 12 aa, Mycobacterium
VQPEAGANTPAQ

SEQ ID NO: 921745 - protein, 10 aa, Mycobacterium
VQPGDPRRGA

SEQ ID NO: 921746 - protein, 8 aa, Mycobacterium
VQPGLGES

SEQ ID NO: 921747 - protein, 10 aa, Mycobacterium
VQPQPEAQTA

SEQ ID NO: 921748 - protein, 13 aa, Mycobacterium
VQPSGGGRRRRRS

SEQ ID NO: 921749 - protein, 12 aa, Mycobacterium
VQPSPTCGGTVR

SEQ ID NO: 921750 - protein, 7 aa, Mycobacterium
VQPYSAG

SEQ ID NO: 921751 - protein, 4 aa, Mycobacterium
VQQA

SEQ ID NO: 921752 - protein, 12 aa, Mycobacterium
VQQTGVADGTGA

SEQ ID NO: 921753 - protein, 10 aa, Mycobacterium
VQRDPAGAKR

SEQ ID NO: 921754 - protein, 7 aa, Mycobacterium
VQRPDGS

SEQ ID NO: 921755 - protein, 8 aa, Mycobacterium
VQRRHNED

SEQ ID NO: 921756 - protein, 6 aa, Mycobacterium
VQRRHP

SEQ ID NO: 921757 - protein, 5 aa, Mycobacterium
VQSAG

SEQ ID NO: 921758 - protein, 8 aa, Mycobacterium
VQSDPAIP

SEQ ID NO: 921759 - protein, 8 aa, Mycobacterium
VQSEISSD

SEQ ID NO: 921760 - protein, 12 aa, Mycobacterium
VQSHNGDSGGPV

SEQ ID NO: 921761 - protein, 14 aa, Mycobacterium
VQSPGAEHLDDRGY

SEQ ID NO: 921762 - protein, 10 aa, Mycobacterium
VQSPGAEHLG

SEQ ID NO: 921763 - protein, 13 aa, Mycobacterium
VQSPGAEHLGDPA

SEQ ID NO: 921764 - protein, 14 aa, Mycobacterium
VQSPGAERLGDPRY

SEQ ID NO: 921765 - protein, 14 aa, Mycobacterium
VQSPGAQRIDDPRY

SEQ ID NO: 921766 - protein, 5 aa, Mycobacterium
VQSPN

SEQ ID NO: 921767 - protein, 10 aa, Mycobacterium
VQSPSAEASM

SEQ ID NO: 921768 - protein, 7 aa, Mycobacterium
VQTAAQN

SEQ ID NO: 921769 - protein, 6 aa, Mycobacterium
VQTARP

SEQ ID NO: 921770 - protein, 4 aa, Mycobacterium
VQTP

SEQ ID NO: 921771 - protein, 6 aa, Mycobacterium
VQTPEF

SEQ ID NO: 921772 - protein, 13 aa, Mycobacterium
VQTPSAAQVPGSV

SEQ ID NO: 921773 - protein, 13 aa, Mycobacterium
VQTPTASRHVTGE

SEQ ID NO: 921774 - protein, 6 aa, Mycobacterium
VQVPAN

SEQ ID NO: 921775 - protein, 8 aa, Mycobacterium
VRAAGGVP

SEQ ID NO: 921776 - protein, 7 aa, Mycobacterium
VRAASGA

SEQ ID NO: 921777 - protein, 4 aa, Mycobacterium
VRAG

SEQ ID NO: 921778 - protein, 14 aa, Mycobacterium
VRAGDSGGPVVDGA

SEQ ID NO: 921779 - protein, 4 aa, Mycobacterium
VRAQ

SEQ ID NO: 921780 - protein, 10 aa, Mycobacterium
VRATRDGETL

SEQ ID NO: 921781 - protein, 6 aa, Mycobacterium
VRDDEP

SEQ ID NO: 921782 - protein, 20 aa, Mycobacterium
VRDEQVQSREQGSVACKVKS

SEQ ID NO: 921783 - protein, 7 aa, Mycobacterium
VRDGEDS

SEQ ID NO: 921784 - protein, 10 aa, Mycobacterium
VRDGKTRAVA

SEQ ID NO: 921785 - protein, 24 aa, Mycobacterium
VRDPRRAPARGPVPGGADQPAGGC

SEQ ID NO: 921786 - protein, 16 aa, Mycobacterium
VREASIKQAEGAKQSQ

SEQ ID NO: 921787 - protein, 7 aa, Mycobacterium
VREPNIS

SEQ ID NO: 921788 - protein, 5 aa, Mycobacterium
VRERA

SEQ ID NO: 921789 - protein, 11 aa, Mycobacterium
VRGDGSGTLVT

SEQ ID NO: 921790 - protein, 6 aa, Mycobacterium
VRGDRP

SEQ ID NO: 921791 - protein, 11 aa, Mycobacterium
VRGGGDTDTVA

SEQ ID NO: 921792 - protein, 8 aa, Mycobacterium
VRGGSAPD

SEQ ID NO: 921793 - protein, 10 aa, Mycobacterium
VRGSGGIRGP

SEQ ID NO: 921794 - protein, 10 aa, Mycobacterium
VRGSQDPAEV

SEQ ID NO: 921795 - protein, 11 aa, Mycobacterium
VRGSTSEAQSW

SEQ ID NO: 921796 - protein, 17 aa, Mycobacterium
VRGTATTIAATKTATSV

SEQ ID NO: 921797 - protein, 6 aa, Mycobacterium
VRGTLG

SEQ ID NO: 921798 - protein, 20 aa, Mycobacterium
VRKDSDAAAFESTAPDRAHA

SEQ ID NO: 921799 - protein, 8 aa, Mycobacterium
VRKNGRDL

SEQ ID NO: 921800 - protein, 12 aa, Mycobacterium
VRLGGADVGEVE

SEQ ID NO: 921801 - protein, 6 aa, Mycobacterium
VRNGVK

SEQ ID NO: 921802 - protein, 4 aa, Mycobacterium
VRNP

SEQ ID NO: 921803 - protein, 6 aa, Mycobacterium
VRPATP

SEQ ID NO: 921804 - protein, 9 aa, Mycobacterium
VRPDAERTY

SEQ ID NO: 921805 - protein, 5 aa, Mycobacterium
VRPDS

SEQ ID NO: 921806 - protein, 10 aa, Mycobacterium
VRPEASAQAR

SEQ ID NO: 921807 - protein, 10 aa, Mycobacterium
VRPGAEATDA

SEQ ID NO: 921808 - protein, 8 aa, Mycobacterium
VRPGSSTA

SEQ ID NO: 921809 - protein, 5 aa, Mycobacterium
VRPGT

SEQ ID NO: 921810 - protein, 10 aa, Mycobacterium
VRPPDTPYET

SEQ ID NO: 921811 - protein, 6 aa, Mycobacterium
VRPPSM

SEQ ID NO: 921812 - protein, 10 aa, Mycobacterium
VRPTTDTGNP

SEQ ID NO: 921813 - protein, 10 aa, Mycobacterium
VRQGHDPQLE

SEQ ID NO: 921814 - protein, 5 aa, Mycobacterium
VRQGR

SEQ ID NO: 921815 - protein, 23 aa, Mycobacterium
VRQPAAGDWTSTSPYLTPPAASA

SEQ ID NO: 921816 - protein, 7 aa, Mycobacterium
VRQPGGK

SEQ ID NO: 921817 - protein, 5 aa, Mycobacterium
VRQQI

SEQ ID NO: 921818 - protein, 8 aa, Mycobacterium
VRQSGDEE

SEQ ID NO: 921819 - protein, 15 aa, Mycobacterium
VRQTDSGDSLETARP

SEQ ID NO: 921820 - protein, 8 aa, Mycobacterium
VRRGDQRA

SEQ ID NO: 921821 - protein, 11 aa, Mycobacterium
VRRGDQRSETV

SEQ ID NO: 921822 - protein, 25 aa, Mycobacterium
VRRKATDALESAASQAAGAPSNDIG

SEQ ID NO: 921823 - protein, 58 aa, Mycobacterium
VRRRRGRAIPQRPRRHGHTTAPHRRGGRRRAARRTGARARRPLPGDESDRAPVIGTAK

SEQ ID NO: 921824 - protein, 16 aa, Mycobacterium
VRRSRAGVSDPNRPTG

SEQ ID NO: 921825 - protein, 4 aa, Mycobacterium
VRSA

SEQ ID NO: 921826 - protein, 6 aa, Mycobacterium
VRSDGS

SEQ ID NO: 921827 - protein, 9 aa, Mycobacterium
VRSDPRGDH

SEQ ID NO: 921828 - protein, 4 aa, Mycobacterium
VRSG

SEQ ID NO: 921829 - protein, 5 aa, Mycobacterium
VRSGA

SEQ ID NO: 921830 - protein, 16 aa, Mycobacterium
VRSPSDPGYKPTAPVA

SEQ ID NO: 921831 - protein, 5 aa, Mycobacterium
VRSQT

SEQ ID NO: 921832 - protein, 8 aa, Mycobacterium
VRSSTAET

SEQ ID NO: 921833 - protein, 4 aa, Mycobacterium
VRST

SEQ ID NO: 921834 - protein, 6 aa, Mycobacterium
VRSTQG

SEQ ID NO: 921835 - protein, 4 aa, Mycobacterium
VRSV

SEQ ID NO: 921836 - protein, 8 aa, Mycobacterium
VRTDSSSG

SEQ ID NO: 921837 - protein, 7 aa, Mycobacterium
VRTGAGA

SEQ ID NO: 921838 - protein, 14 aa, Mycobacterium
VRTGDTEPAPAALR

SEQ ID NO: 921839 - protein, 6 aa, Mycobacterium
VRTGEA

SEQ ID NO: 921840 - protein, 6 aa, Mycobacterium
VRTGSD

SEQ ID NO: 921841 - protein, 7 aa, Mycobacterium
VRTGSGA

SEQ ID NO: 921842 - protein, 20 aa, Mycobacterium
VRTHGPAVNAPGDVDPGTAH

SEQ ID NO: 921843 - protein, 15 aa, Mycobacterium
VRTSGMTPFVVRYIE

SEQ ID NO: 921844 - protein, 15 aa, Mycobacterium
VRTSGMTPYVVRYIE

SEQ ID NO: 921845 - protein, 5 aa, Mycobacterium
VRVPD

SEQ ID NO: 921846 - protein, 11 aa, Mycobacterium
VSAAAAARHET

SEQ ID NO: 921847 - protein, 10 aa, Mycobacterium
VSAAGRHEDD

SEQ ID NO: 921848 - protein, 20 aa, Mycobacterium
VSAATDGTVKATAAETGASV

SEQ ID NO: 921849 - protein, 4 aa, Mycobacterium
VSAD

SEQ ID NO: 921850 - protein, 10 aa, Mycobacterium
VSADDAGGLH

SEQ ID NO: 921851 - protein, 8 aa, Mycobacterium
VSAEGKGN

SEQ ID NO: 921852 - protein, 60 aa, Mycobacterium
VSAEPDGGGTETTVRSSAKPADGDDRAAEADDASGPERTDRKAGSDTDEAPRKPRKPQGD

SEQ ID NO: 921853 - protein, 31 aa, Mycobacterium
VSAGPASASGDVAGAAGSTIPAARASGDDLG

SEQ ID NO: 921854 - protein, 13 aa, Mycobacterium
VSAGTAQADPGTG

SEQ ID NO: 921855 - protein, 15 aa, Mycobacterium
VSAPPAGQSSAMSST

SEQ ID NO: 921856 - protein, 18 aa, Mycobacterium
VSAPPGPVAGPPPGVDQQ

SEQ ID NO: 921857 - protein, 6 aa, Mycobacterium
VSAPRA

SEQ ID NO: 921858 - protein, 7 aa, Mycobacterium
VSASEQQ

SEQ ID NO: 921859 - protein, 18 aa, Mycobacterium
VSASPNSGVNTVTGEGVA

SEQ ID NO: 921860 - protein, 30 aa, Mycobacterium
VSASPTAAAPAPAAHSTTVAPTQTGATGAG

SEQ ID NO: 921861 - protein, 15 aa, Mycobacterium
VSATAPAAPVSGDQV

SEQ ID NO: 921862 - protein, 7 aa, Mycobacterium
VSATATQ

SEQ ID NO: 921863 - protein, 15 aa, Mycobacterium
VSATDTLTGANESLG

SEQ ID NO: 921864 - protein, 28 aa, Mycobacterium
VSATGLSAAEAGGGASLGSAGVPASTFT

SEQ ID NO: 921865 - protein, 19 aa, Mycobacterium
VSDAATDIAGTNTDALNQS

SEQ ID NO: 921866 - protein, 6 aa, Mycobacterium
VSDAPM

SEQ ID NO: 921867 - protein, 8 aa, Mycobacterium
VSDASGRM

SEQ ID NO: 921868 - protein, 14 aa, Mycobacterium
VSDASRGRSGEYQS

SEQ ID NO: 921869 - protein, 8 aa, Mycobacterium
VSDEEVTT

SEQ ID NO: 921870 - protein, 11 aa, Mycobacterium
VSDERKAELGE

SEQ ID NO: 921871 - protein, 4 aa, Mycobacterium
VSDG

SEQ ID NO: 921872 - protein, 6 aa, Mycobacterium
VSDGGC

SEQ ID NO: 921873 - protein, 13 aa, Mycobacterium
VSDGSGPSAPATV

SEQ ID NO: 921874 - protein, 10 aa, Mycobacterium
VSDGVDDPDC

SEQ ID NO: 921875 - protein, 9 aa, Mycobacterium
VSDKPKADP

SEQ ID NO: 921876 - protein, 34 aa, Mycobacterium
VSDNMGAKVGSAKVAVDGKTYTITGQAQGADLKN

SEQ ID NO: 921877 - protein, 17 aa, Mycobacterium
VSDPGPSAGKLKSGDAI

SEQ ID NO: 921878 - protein, 8 aa, Mycobacterium
VSDPGTRR

SEQ ID NO: 921879 - protein, 7 aa, Mycobacterium
VSDQTVA

SEQ ID NO: 921880 - protein, 7 aa, Mycobacterium
VSDQTVT

SEQ ID NO: 921881 - protein, 8 aa, Mycobacterium
VSDQTVTE

SEQ ID NO: 921882 - protein, 11 aa, Mycobacterium
VSDTAARRWTS

SEQ ID NO: 921883 - protein, 5 aa, Mycobacterium
VSDTF

SEQ ID NO: 921884 - protein, 9 aa, Mycobacterium
VSDTYSAAA

SEQ ID NO: 921885 - protein, 44 aa, Mycobacterium
VSEAAGAAAKAIAGGTTALGSASGGLGGSGLAAGLGRAASVGSL

SEQ ID NO: 921886 - protein, 7 aa, Mycobacterium
VSEAPGY

SEQ ID NO: 921887 - protein, 8 aa, Mycobacterium
VSEDAATH

SEQ ID NO: 921888 - protein, 17 aa, Mycobacterium
VSEGTNQNLHNFDAPST

SEQ ID NO: 921889 - protein, 4 aa, Mycobacterium
VSEN

SEQ ID NO: 921890 - protein, 17 aa, Mycobacterium
VSEPGPSAGKLKAGDAI

SEQ ID NO: 921891 - protein, 16 aa, Mycobacterium
VSEPHTSTLSGPKFQQ

SEQ ID NO: 921892 - protein, 8 aa, Mycobacterium
VSESNTVT

SEQ ID NO: 921893 - protein, 18 aa, Mycobacterium
VSGAGASAALGEASAVGG

SEQ ID NO: 921894 - protein, 12 aa, Mycobacterium
VSGATKFPGTGT

SEQ ID NO: 921895 - protein, 5 aa, Mycobacterium
VSGDK

SEQ ID NO: 921896 - protein, 10 aa, Mycobacterium
VSGDNGETWT

SEQ ID NO: 921897 - protein, 7 aa, Mycobacterium
VSGDSDV

SEQ ID NO: 921898 - protein, 7 aa, Mycobacterium
VSGGANP

SEQ ID NO: 921899 - protein, 10 aa, Mycobacterium
VSGGEIGAKN

SEQ ID NO: 921900 - protein, 9 aa, Mycobacterium
VSGGPMRGQ

SEQ ID NO: 921901 - protein, 5 aa, Mycobacterium
VSGGT

SEQ ID NO: 921902 - protein, 4 aa, Mycobacterium
VSGI

SEQ ID NO: 921903 - protein, 4 aa, Mycobacterium
VSGL

SEQ ID NO: 921904 - protein, 5 aa, Mycobacterium
VSGNG

SEQ ID NO: 921905 - protein, 4 aa, Mycobacterium
VSGP

SEQ ID NO: 921906 - protein, 8 aa, Mycobacterium
VSGPGTDQ

SEQ ID NO: 921907 - protein, 6 aa, Mycobacterium
VSGPGV

SEQ ID NO: 921908 - protein, 8 aa, Mycobacterium
VSGQATTG

SEQ ID NO: 921909 - protein, 7 aa, Mycobacterium
VSGQLNP

SEQ ID NO: 921910 - protein, 16 aa, Mycobacterium
VSGQPAYAESCDEPSC

SEQ ID NO: 921911 - protein, 6 aa, Mycobacterium
VSGQTL

SEQ ID NO: 921912 - protein, 5 aa, Mycobacterium
VSGRD

SEQ ID NO: 921913 - protein, 12 aa, Mycobacterium
VSGRPAELAGSD

SEQ ID NO: 921914 - protein, 10 aa, Mycobacterium
VSGSGGIRGP

SEQ ID NO: 921915 - protein, 8 aa, Mycobacterium
VSGSGTYA

SEQ ID NO: 921916 - protein, 8 aa, Mycobacterium
VSGSQERY

SEQ ID NO: 921917 - protein, 10 aa, Mycobacterium
VSGSTPAQNV

SEQ ID NO: 921918 - protein, 8 aa, Mycobacterium
VSGSTTAY

SEQ ID NO: 921919 - protein, 13 aa, Mycobacterium
VSGTGDPAHKDPG

SEQ ID NO: 921920 - protein, 4 aa, Mycobacterium
VSGY

SEQ ID NO: 921921 - protein, 15 aa, Mycobacterium
VSHDPAVEAKGDEPF

SEQ ID NO: 921922 - protein, 7 aa, Mycobacterium
VSKDGKQ

SEQ ID NO: 921923 - protein, 14 aa, Mycobacterium
VSKGDGQDNKVDTD

SEQ ID NO: 921924 - protein, 6 aa, Mycobacterium
VSKGVR

SEQ ID NO: 921925 - protein, 8 aa, Mycobacterium
VSKSALED

SEQ ID NO: 921926 - protein, 18 aa, Mycobacterium
VSLPHSSQALARGGTPVS

SEQ ID NO: 921927 - protein, 11 aa, Mycobacterium
VSLPKSSLHPA

SEQ ID NO: 921928 - protein, 7 aa, Mycobacterium
VSNANGV

SEQ ID NO: 921929 - protein, 8 aa, Mycobacterium
VSNGGAVR

SEQ ID NO: 921930 - protein, 7 aa, Mycobacterium
VSNGNTS

SEQ ID NO: 921931 - protein, 6 aa, Mycobacterium
VSNPSW

SEQ ID NO: 921932 - protein, 4 aa, Mycobacterium
VSNS

SEQ ID NO: 921933 - protein, 16 aa, Mycobacterium
VSPAATAAADPPPPPV

SEQ ID NO: 921934 - protein, 5 aa, Mycobacterium
VSPAD

SEQ ID NO: 921935 - protein, 17 aa, Mycobacterium
VSPATHTTRRRDEHQPL

SEQ ID NO: 921936 - protein, 7 aa, Mycobacterium
VSPDGTQ

SEQ ID NO: 921937 - protein, 14 aa, Mycobacterium
VSPDMPSAPPLGGA

SEQ ID NO: 921938 - protein, 9 aa, Mycobacterium
VSPDNGENW

SEQ ID NO: 921939 - protein, 17 aa, Mycobacterium
VSPDQYRKTFQRTDRSS

SEQ ID NO: 921940 - protein, 30 aa, Mycobacterium
VSPDRIPVSGNGSAPSHRLGTGAGSNPLDQ

SEQ ID NO: 921941 - protein, 6 aa, Mycobacterium
VSPDTS

SEQ ID NO: 921942 - protein, 7 aa, Mycobacterium
VSPDTSL

SEQ ID NO: 921943 - protein, 6 aa, Mycobacterium
VSPEAI

SEQ ID NO: 921944 - protein, 10 aa, Mycobacterium
VSPEDPGDNV

SEQ ID NO: 921945 - protein, 7 aa, Mycobacterium
VSPEMAG

SEQ ID NO: 921946 - protein, 29 aa, Mycobacterium
VSPEPTAINSGAARGTVVGTSPRGKTIPG

SEQ ID NO: 921947 - protein, 10 aa, Mycobacterium
VSPEQAAPGL

SEQ ID NO: 921948 - protein, 18 aa, Mycobacterium
VSPEQAAPGLRTATVPGR

SEQ ID NO: 921949 - protein, 8 aa, Mycobacterium
VSPEYTGT

SEQ ID NO: 921950 - protein, 12 aa, Mycobacterium
VSPGPTRTEGTV

SEQ ID NO: 921951 - protein, 10 aa, Mycobacterium
VSPPNNTGDG

SEQ ID NO: 921952 - protein, 22 aa, Mycobacterium
VSPPPAPQSTDTTESTPPPPMK

SEQ ID NO: 921953 - protein, 23 aa, Mycobacterium
VSPPPAPQSTDTTHNTPPPPPHP

SEQ ID NO: 921954 - protein, 24 aa, Mycobacterium
VSPPPAPQSTDTTHVTPPPPPHPT

SEQ ID NO: 921955 - protein, 25 aa, Mycobacterium
VSPPPAPQSTETTETTPPPPPKAPT

SEQ ID NO: 921956 - protein, 19 aa, Mycobacterium
VSPPPSGRVSTDPPQIPAT

SEQ ID NO: 921957 - protein, 4 aa, Mycobacterium
VSPR

SEQ ID NO: 921958 - protein, 11 aa, Mycobacterium
VSPRPDAEGEQ

SEQ ID NO: 921959 - protein, 11 aa, Mycobacterium
VSPRPDATGEQ

SEQ ID NO: 921960 - protein, 10 aa, Mycobacterium
VSPRPDDAVG

SEQ ID NO: 921961 - protein, 11 aa, Mycobacterium
VSPRPDETGEQ

SEQ ID NO: 921962 - protein, 11 aa, Mycobacterium
VSPRPDGVSGE

SEQ ID NO: 921963 - protein, 4 aa, Mycobacterium
VSPS

SEQ ID NO: 921964 - protein, 7 aa, Mycobacterium
VSPSMGP

SEQ ID NO: 921965 - protein, 6 aa, Mycobacterium
VSPSNA

SEQ ID NO: 921966 - protein, 8 aa, Mycobacterium
VSPSTGRG

SEQ ID NO: 921967 - protein, 6 aa, Mycobacterium
VSPTAT

SEQ ID NO: 921968 - protein, 5 aa, Mycobacterium
VSPVR

SEQ ID NO: 921969 - protein, 8 aa, Mycobacterium
VSQARDGL

SEQ ID NO: 921970 - protein, 12 aa, Mycobacterium
VSQQFEKTAEDP

SEQ ID NO: 921971 - protein, 7 aa, Mycobacterium
VSQRDDL

SEQ ID NO: 921972 - protein, 7 aa, Mycobacterium
VSQRDGL

SEQ ID NO: 921973 - protein, 18 aa, Mycobacterium
VSRETSTEIDTPIGAAAE

SEQ ID NO: 921974 - protein, 19 aa, Mycobacterium
VSRKGDSGGPVYTPTPDGR

SEQ ID NO: 921975 - protein, 14 aa, Mycobacterium
VSRNPIGYTAYELG

SEQ ID NO: 921976 - protein, 8 aa, Mycobacterium
VSRRGAAH

SEQ ID NO: 921977 - protein, 25 aa, Mycobacterium
VSRTSKTARSGGRPAARGRPGGSGA

SEQ ID NO: 921978 - protein, 9 aa, Mycobacterium
VSSAAATQL

SEQ ID NO: 921979 - protein, 6 aa, Mycobacterium
VSSCSN

SEQ ID NO: 921980 - protein, 8 aa, Mycobacterium
VSSDAGKS

SEQ ID NO: 921981 - protein, 4 aa, Mycobacterium
VSSG

SEQ ID NO: 921982 - protein, 10 aa, Mycobacterium
VSSGPSFTED

SEQ ID NO: 921983 - protein, 6 aa, Mycobacterium
VSSGPY

SEQ ID NO: 921984 - protein, 4 aa, Mycobacterium
VSSP

SEQ ID NO: 921985 - protein, 14 aa, Mycobacterium
VSSPETGPHSLRDN

SEQ ID NO: 921986 - protein, 6 aa, Mycobacterium
VSSPGY

SEQ ID NO: 921987 - protein, 10 aa, Mycobacterium
VSSPRANKNV

SEQ ID NO: 921988 - protein, 51 aa, Mycobacterium
VSSQTPLPAAPFPAEDAAPAEEAPAAESGSAEEGAGDGADAPAVPGAEESE

SEQ ID NO: 921989 - protein, 7 aa, Mycobacterium
VSSSGEL

SEQ ID NO: 921990 - protein, 12 aa, Mycobacterium
VSSTAGAGIDPV

SEQ ID NO: 921991 - protein, 11 aa, Mycobacterium
VSSTDPTEGYR

SEQ ID NO: 921992 - protein, 7 aa, Mycobacterium
VSSTEGA

SEQ ID NO: 921993 - protein, 17 aa, Mycobacterium
VSSTGPGKTSSSAAPVP

SEQ ID NO: 921994 - protein, 4 aa, Mycobacterium
VSSV

SEQ ID NO: 921995 - protein, 8 aa, Mycobacterium
VSSVTASA

SEQ ID NO: 921996 - protein, 9 aa, Mycobacterium
VSTATSGWG

SEQ ID NO: 921997 - protein, 6 aa, Mycobacterium
VSTDHG

SEQ ID NO: 921998 - protein, 8 aa, Mycobacterium
VSTDQPDT

SEQ ID NO: 921999 - protein, 6 aa, Mycobacterium
VSTGRA

SEQ ID NO: 922000 - protein, 5 aa, Mycobacterium
VSTGT

SEQ ID NO: 922001 - protein, 8 aa, Mycobacterium
VSTGTASK

SEQ ID NO: 922002 - protein, 6 aa, Mycobacterium
VSTKEA

SEQ ID NO: 922003 - protein, 11 aa, Mycobacterium
VSTKIRGDEVT

SEQ ID NO: 922004 - protein, 16 aa, Mycobacterium
VSTLQAGDGPVVSPTA

SEQ ID NO: 922005 - protein, 4 aa, Mycobacterium
VSTN

SEQ ID NO: 922006 - protein, 4 aa, Mycobacterium
VSTP

SEQ ID NO: 922007 - protein, 9 aa, Mycobacterium
VSTQIGASQ

SEQ ID NO: 922008 - protein, 7 aa, Mycobacterium
VSTRGDR

SEQ ID NO: 922009 - protein, 7 aa, Mycobacterium
VSTRGKG

SEQ ID NO: 922010 - protein, 20 aa, Mycobacterium
VSTTAAAPEVDHAEAQPGDP

SEQ ID NO: 922011 - protein, 13 aa, Mycobacterium
VSTTGSATNVTLT

SEQ ID NO: 922012 - protein, 10 aa, Mycobacterium
VSTTPPQPGA

SEQ ID NO: 922013 - protein, 14 aa, Mycobacterium
VSTVDDVDSESGRI

SEQ ID NO: 922014 - protein, 9 aa, Mycobacterium
VTAADQDNP

SEQ ID NO: 922015 - protein, 5 aa, Mycobacterium
VTADA

SEQ ID NO: 922016 - protein, 6 aa, Mycobacterium
VTADRP

SEQ ID NO: 922017 - protein, 16 aa, Mycobacterium
VTAEDGKPGAVGQQVH

SEQ ID NO: 922018 - protein, 10 aa, Mycobacterium
VTAEESGKAC

SEQ ID NO: 922019 - protein, 8 aa, Mycobacterium
VTAEGRGN

SEQ ID NO: 922020 - protein, 6 aa, Mycobacterium
VTAEPT

SEQ ID NO: 922021 - protein, 8 aa, Mycobacterium
VTAPESSK

SEQ ID NO: 922022 - protein, 7 aa, Mycobacterium
VTAPETA

SEQ ID NO: 922023 - protein, 7 aa, Mycobacterium
VTAPGVP

SEQ ID NO: 922024 - protein, 14 aa, Mycobacterium
VTAPHGTVRDRSAR

SEQ ID NO: 922025 - protein, 9 aa, Mycobacterium
VTAPNADTL

SEQ ID NO: 922026 - protein, 11 aa, Mycobacterium
VTAPPKASKNY

SEQ ID NO: 922027 - protein, 5 aa, Mycobacterium
VTAPT

SEQ ID NO: 922028 - protein, 24 aa, Mycobacterium
VTAPTATADVTAQGHDVTANQQRE

SEQ ID NO: 922029 - protein, 12 aa, Mycobacterium
VTAQPQPGNPAP

SEQ ID NO: 922030 - protein, 20 aa, Mycobacterium
VTAQRNAAAYDAAGHHAATL

SEQ ID NO: 922031 - protein, 4 aa, Mycobacterium
VTAR

SEQ ID NO: 922032 - protein, 19 aa, Mycobacterium
VTARDREVTNRFTKDGQVT

SEQ ID NO: 922033 - protein, 9 aa, Mycobacterium
VTARGGDGY

SEQ ID NO: 922034 - protein, 13 aa, Mycobacterium
VTARPQPGNPPPR

SEQ ID NO: 922035 - protein, 9 aa, Mycobacterium
VTARSDGGL

SEQ ID NO: 922036 - protein, 4 aa, Mycobacterium
VTAS

SEQ ID NO: 922037 - protein, 18 aa, Mycobacterium
VTATADPADTGSSSDLNT

SEQ ID NO: 922038 - protein, 20 aa, Mycobacterium
VTATDSSCQLSKTEGTTGPV

SEQ ID NO: 922039 - protein, 8 aa, Mycobacterium
VTATESGK

SEQ ID NO: 922040 - protein, 7 aa, Mycobacterium
VTATPSD

SEQ ID NO: 922041 - protein, 56 aa, Mycobacterium
VTATPTPAPATPTPGAEGTPLNSTAVPASPAPATATPAVPVPEGAAPQTGTPPVAA

SEQ ID NO: 922042 - protein, 12 aa, Mycobacterium
VTATQAPDTAAM

SEQ ID NO: 922043 - protein, 7 aa, Mycobacterium
VTATRVP

SEQ ID NO: 922044 - protein, 4 aa, Mycobacterium
VTAV

SEQ ID NO: 922045 - protein, 4 aa, Mycobacterium
VTAY

SEQ ID NO: 922046 - protein, 7 aa, Mycobacterium
VTDADQV

SEQ ID NO: 922047 - protein, 7 aa, Mycobacterium
VTDEESV

SEQ ID NO: 922048 - protein, 6 aa, Mycobacterium
VTDEGD

SEQ ID NO: 922049 - protein, 10 aa, Mycobacterium
VTDERKERMQ

SEQ ID NO: 922050 - protein, 8 aa, Mycobacterium
VTDGARGG

SEQ ID NO: 922051 - protein, 8 aa, Mycobacterium
VTDGATVA

SEQ ID NO: 922052 - protein, 4 aa, Mycobacterium
VTDK

SEQ ID NO: 922053 - protein, 10 aa, Mycobacterium
VTDKKAAEAA

SEQ ID NO: 922054 - protein, 16 aa, Mycobacterium
VTDKSRAVGSSGLALP

SEQ ID NO: 922055 - protein, 19 aa, Mycobacterium
VTDKSRAVGSSGLQLPAGA

SEQ ID NO: 922056 - protein, 17 aa, Mycobacterium
VTDNGKPRADGVTRSQY

SEQ ID NO: 922057 - protein, 9 aa, Mycobacterium
VTDNTGRER

SEQ ID NO: 922058 - protein, 4 aa, Mycobacterium
VTDP

SEQ ID NO: 922059 - protein, 6 aa, Mycobacterium
VTDPAQ

SEQ ID NO: 922060 - protein, 27 aa, Mycobacterium
VTDPGPSAGKLQDGDAIDGVNGKPVAN

SEQ ID NO: 922061 - protein, 11 aa, Mycobacterium
VTDPSGGRTPG

SEQ ID NO: 922062 - protein, 7 aa, Mycobacterium
VTDQRTQ

SEQ ID NO: 922063 - protein, 11 aa, Mycobacterium
VTDQTLDNADN

SEQ ID NO: 922064 - protein, 8 aa, Mycobacterium
VTDRPQVD

SEQ ID NO: 922065 - protein, 6 aa, Mycobacterium
VTDSDG

SEQ ID NO: 922066 - protein, 6 aa, Mycobacterium
VTDSLG

SEQ ID NO: 922067 - protein, 10 aa, Mycobacterium
VTDSVSAKSY

SEQ ID NO: 922068 - protein, 4 aa, Mycobacterium
VTDT

SEQ ID NO: 922069 - protein, 4 aa, Mycobacterium
VTDV

SEQ ID NO: 922070 - protein, 7 aa, Mycobacterium
VTEAGEA

SEQ ID NO: 922071 - protein, 10 aa, Mycobacterium
VTEARGGPMG

SEQ ID NO: 922072 - protein, 12 aa, Mycobacterium
VTEDGKPVTLDT

SEQ ID NO: 922073 - protein, 11 aa, Mycobacterium
VTEDGSPQGAR

SEQ ID NO: 922074 - protein, 8 aa, Mycobacterium
VTEERKEK

SEQ ID NO: 922075 - protein, 11 aa, Mycobacterium
VTEGEAPNVES

SEQ ID NO: 922076 - protein, 9 aa, Mycobacterium
VTEGTATAL

SEQ ID NO: 922077 - protein, 5 aa, Mycobacterium
VTEHA

SEQ ID NO: 922078 - protein, 9 aa, Mycobacterium
VTEPERQEL

SEQ ID NO: 922079 - protein, 11 aa, Mycobacterium
VTEPGAGSDVA

SEQ ID NO: 922080 - protein, 16 aa, Mycobacterium
VTEQTGTGTPGHTVCT

SEQ ID NO: 922081 - protein, 28 aa, Mycobacterium
VTESDDGTDASEDATVPESSAEPAGVPR

SEQ ID NO: 922082 - protein, 7 aa, Mycobacterium
VTETAGL

SEQ ID NO: 922083 - protein, 7 aa, Mycobacterium
VTETGNL

SEQ ID NO: 922084 - protein, 13 aa, Mycobacterium
VTETGVRDGTGRL

SEQ ID NO: 922085 - protein, 74 aa, Mycobacterium
VTETTPPAEASPPSTPADGTDAPQPETAPPATGGNKADPGTTPAPSSPGGSTGGPSTAAPDDEAATPETEAETE

SEQ ID NO: 922086 - protein, 10 aa, Mycobacterium
VTGAGDTDAF

SEQ ID NO: 922087 - protein, 7 aa, Mycobacterium
VTGAGRD

SEQ ID NO: 922088 - protein, 11 aa, Mycobacterium
VTGAGSDTFEG

SEQ ID NO: 922089 - protein, 43 aa, Mycobacterium
VTGCGSDQNRRGASPAAVSGPTGTAGCGGKNKLTAEGSTAQQN

SEQ ID NO: 922090 - protein, 17 aa, Mycobacterium
VTGDGQAMQGREPATGD

SEQ ID NO: 922091 - protein, 7 aa, Mycobacterium
VTGDGVR

SEQ ID NO: 922092 - protein, 5 aa, Mycobacterium
VTGDM

SEQ ID NO: 922093 - protein, 6 aa, Mycobacterium
VTGDMT

SEQ ID NO: 922094 - protein, 9 aa, Mycobacterium
VTGDPSLTE

SEQ ID NO: 922095 - protein, 6 aa, Mycobacterium
VTGDSV

SEQ ID NO: 922096 - protein, 6 aa, Mycobacterium
VTGDVG

SEQ ID NO: 922097 - protein, 8 aa, Mycobacterium
VTGEDGAP

SEQ ID NO: 922098 - protein, 4 aa, Mycobacterium
VTGG

SEQ ID NO: 922099 - protein, 5 aa, Mycobacterium
VTGGD

SEQ ID NO: 922100 - protein, 8 aa, Mycobacterium
VTGGDAPR

SEQ ID NO: 922101 - protein, 9 aa, Mycobacterium
VTGGSGPVT

SEQ ID NO: 922102 - protein, 32 aa, Mycobacterium
VTGGSSVEGGQTTDCASEGNVQIDSTPPEPGY

SEQ ID NO: 922103 - protein, 9 aa, Mycobacterium
VTGGTATQL

SEQ ID NO: 922104 - protein, 6 aa, Mycobacterium
VTGKDL

SEQ ID NO: 922105 - protein, 9 aa, Mycobacterium
VTGKEPSEQ

SEQ ID NO: 922106 - protein, 4 aa, Mycobacterium
VTGP

SEQ ID NO: 922107 - protein, 16 aa, Mycobacterium
VTGPDTADQPVPDDKR

SEQ ID NO: 922108 - protein, 5 aa, Mycobacterium
VTGPG

SEQ ID NO: 922109 - protein, 17 aa, Mycobacterium
VTGPGTADRDVPEEQQA

SEQ ID NO: 922110 - protein, 6 aa, Mycobacterium
VTGPGY

SEQ ID NO: 922111 - protein, 10 aa, Mycobacterium
VTGPSGAAGI

SEQ ID NO: 922112 - protein, 4 aa, Mycobacterium
VTGQ

SEQ ID NO: 922113 - protein, 7 aa, Mycobacterium
VTGQSPF

SEQ ID NO: 922114 - protein, 8 aa, Mycobacterium
VTGQSTDA

SEQ ID NO: 922115 - protein, 4 aa, Mycobacterium
VTGS

SEQ ID NO: 922116 - protein, 20 aa, Mycobacterium
VTGSDEPQPLPAPSNTATVD

SEQ ID NO: 922117 - protein, 10 aa, Mycobacterium
VTGSGSELGA

SEQ ID NO: 922118 - protein, 7 aa, Mycobacterium
VTGSPVT

SEQ ID NO: 922119 - protein, 9 aa, Mycobacterium
VTGSVPPTV

SEQ ID NO: 922120 - protein, 11 aa, Mycobacterium
VTGTGERSQFG

SEQ ID NO: 922121 - protein, 9 aa, Mycobacterium
VTGTGETDC

SEQ ID NO: 922122 - protein, 20 aa, Mycobacterium
VTGTPRSAQASVPDPDRSYG

SEQ ID NO: 922123 - protein, 5 aa, Mycobacterium
VTGTR

SEQ ID NO: 922124 - protein, 20 aa, Mycobacterium
VTGTTMQGVTGAKDGADPMS

SEQ ID NO: 922125 - protein, 9 aa, Mycobacterium
VTINSGGEK

SEQ ID NO: 922126 - protein, 4 aa, Mycobacterium
VTKD

SEQ ID NO: 922127 - protein, 9 aa, Mycobacterium
VTKPDQVTS

SEQ ID NO: 922128 - protein, 7 aa, Mycobacterium
VTKPESW

SEQ ID NO: 922129 - protein, 11 aa, Mycobacterium
VTKRGGGSALP

SEQ ID NO: 922130 - protein, 7 aa, Mycobacterium
VTKTRGF

SEQ ID NO: 922131 - protein, 6 aa, Mycobacterium
VTLPDE

SEQ ID NO: 922132 - protein, 10 aa, Mycobacterium
VTLPDGSAVG

SEQ ID NO: 922133 - protein, 12 aa, Mycobacterium
VTLTGDSTVPAD

SEQ ID NO: 922134 - protein, 6 aa, Mycobacterium
VTLTQG

SEQ ID NO: 922135 - protein, 13 aa, Mycobacterium
VTNGDTATTVEDR

SEQ ID NO: 922136 - protein, 46 aa, Mycobacterium
VTNGTATPDTKVAPAYRQSVSASVSASSATSSVRESQRQQSLTTKA

SEQ ID NO: 922137 - protein, 7 aa, Mycobacterium
VTNKPDH

SEQ ID NO: 922138 - protein, 11 aa, Mycobacterium
VTNKSDEAVEV

SEQ ID NO: 922139 - protein, 13 aa, Mycobacterium
VTNPTPEQTEAAT

SEQ ID NO: 922140 - protein, 7 aa, Mycobacterium
VTNRSQV

SEQ ID NO: 922141 - protein, 19 aa, Mycobacterium
VTNSNTPGDDGWKEMLAPA

SEQ ID NO: 922142 - protein, 17 aa, Mycobacterium
VTPAGSSNTGNNRPPRA

SEQ ID NO: 922143 - protein, 14 aa, Mycobacterium
VTPAHTVPAGQSQV

SEQ ID NO: 922144 - protein, 20 aa, Mycobacterium
VTPAPEAKPQASSDPAIKHG

SEQ ID NO: 922145 - protein, 9 aa, Mycobacterium
VTPASQGIT

SEQ ID NO: 922146 - protein, 7 aa, Mycobacterium
VTPDGRI

SEQ ID NO: 922147 - protein, 16 aa, Mycobacterium
VTPDTQVQSSTSGDSL

SEQ ID NO: 922148 - protein, 12 aa, Mycobacterium
VTPEPGPAPPDE

SEQ ID NO: 922149 - protein, 20 aa, Mycobacterium
VTPGDPVNRYSGSPISQPGF

SEQ ID NO: 922150 - protein, 10 aa, Mycobacterium
VTPGLTPEQI

SEQ ID NO: 922151 - protein, 13 aa, Mycobacterium
VTPLSTSSLAAGN

SEQ ID NO: 922152 - protein, 19 aa, Mycobacterium
VTPNADAYKPRASDAPDAL

SEQ ID NO: 922153 - protein, 5 aa, Mycobacterium
VTPPD

SEQ ID NO: 922154 - protein, 8 aa, Mycobacterium
VTPPGLRA

SEQ ID NO: 922155 - protein, 8 aa, Mycobacterium
VTPPPGSR

SEQ ID NO: 922156 - protein, 9 aa, Mycobacterium
VTPPPPAAP

SEQ ID NO: 922157 - protein, 9 aa, Mycobacterium
VTPPPQPGR

SEQ ID NO: 922158 - protein, 6 aa, Mycobacterium
VTPPQS

SEQ ID NO: 922159 - protein, 11 aa, Mycobacterium
VTPRSGQVRQQ

SEQ ID NO: 922160 - protein, 6 aa, Mycobacterium
VTPSGN

SEQ ID NO: 922161 - protein, 5 aa, Mycobacterium
VTPSN

SEQ ID NO: 922162 - protein, 19 aa, Mycobacterium
VTPTGDAYEPRNSDAPDAL

SEQ ID NO: 922163 - protein, 12 aa, Mycobacterium
VTPTPVSDALEE

SEQ ID NO: 922164 - protein, 8 aa, Mycobacterium
VTPTQRRK

SEQ ID NO: 922165 - protein, 16 aa, Mycobacterium
VTPVPPAPSEPPGPNA

SEQ ID NO: 922166 - protein, 12 aa, Mycobacterium
VTPYTGSPAPFA

SEQ ID NO: 922167 - protein, 7 aa, Mycobacterium
VTQGEAV

SEQ ID NO: 922168 - protein, 10 aa, Mycobacterium
VTQTSATDQT

SEQ ID NO: 922169 - protein, 18 aa, Mycobacterium
VTRADGGKSGIGKGYGGA

SEQ ID NO: 922170 - protein, 19 aa, Mycobacterium
VTRADGGKSGIGKGYGGAR

SEQ ID NO: 922171 - protein, 18 aa, Mycobacterium
VTRADGGKTGIGRGYGGA

SEQ ID NO: 922172 - protein, 10 aa, Mycobacterium
VTRGDESRGL

SEQ ID NO: 922173 - protein, 4 aa, Mycobacterium
VTRM

SEQ ID NO: 922174 - protein, 12 aa, Mycobacterium
VTRTAKGSGRVL

SEQ ID NO: 922175 - protein, 6 aa, Mycobacterium
VTRTPV

SEQ ID NO: 922176 - protein, 13 aa, Mycobacterium
VTRYRNADEVRQG

SEQ ID NO: 922177 - protein, 4 aa, Mycobacterium
VTSD

SEQ ID NO: 922178 - protein, 7 aa, Mycobacterium
VTSELTS

SEQ ID NO: 922179 - protein, 7 aa, Mycobacterium
VTSENPF

SEQ ID NO: 922180 - protein, 8 aa, Mycobacterium
VTSERKAV

SEQ ID NO: 922181 - protein, 28 aa, Mycobacterium
VTSGLPAKKAAAKEKKAATSEKAAEGSE

SEQ ID NO: 922182 - protein, 8 aa, Mycobacterium
VTSNPATR

SEQ ID NO: 922183 - protein, 15 aa, Mycobacterium
VTSPAGLANWVARQN

SEQ ID NO: 922184 - protein, 10 aa, Mycobacterium
VTSPGGTPGH

SEQ ID NO: 922185 - protein, 7 aa, Mycobacterium
VTSPGNA

SEQ ID NO: 922186 - protein, 9 aa, Mycobacterium
VTSPRGKRQ

SEQ ID NO: 922187 - protein, 10 aa, Mycobacterium
VTSPRGVRTV

SEQ ID NO: 922188 - protein, 10 aa, Mycobacterium
VTSPSNTPGH

SEQ ID NO: 922189 - protein, 47 aa, Mycobacterium
VTSQGSAQPAGPASTTSAASPTVGTRAPGCGRGQTLRSGNTVATGTA

SEQ ID NO: 922190 - protein, 7 aa, Mycobacterium
VTSQNPF

SEQ ID NO: 922191 - protein, 8 aa, Mycobacterium
VTSRGRPL

SEQ ID NO: 922192 - protein, 13 aa, Mycobacterium
VTSSPGASAKPTL

SEQ ID NO: 922193 - protein, 10 aa, Mycobacterium
VTSSRGGTVT

SEQ ID NO: 922194 - protein, 11 aa, Mycobacterium
VTSSTDSPAVV

SEQ ID NO: 922195 - protein, 8 aa, Mycobacterium
VTSTRDGF

SEQ ID NO: 922196 - protein, 9 aa, Mycobacterium
VTSTTPETA

SEQ ID NO: 922197 - protein, 6 aa, Mycobacterium
VTSTYD

SEQ ID NO: 922198 - protein, 7 aa, Mycobacterium
VTSVTDN

SEQ ID NO: 922199 - protein, 10 aa, Mycobacterium
VTTADGSRAA

SEQ ID NO: 922200 - protein, 20 aa, Mycobacterium
VTTDAGRATGVTLSDGATVA

SEQ ID NO: 922201 - protein, 14 aa, Mycobacterium
VTTDAPSGFEVRGD

SEQ ID NO: 922202 - protein, 7 aa, Mycobacterium
VTTDDVR

SEQ ID NO: 922203 - protein, 5 aa, Mycobacterium
VTTEG

SEQ ID NO: 922204 - protein, 13 aa, Mycobacterium
VTTESGDAAGAAL

SEQ ID NO: 922205 - protein, 4 aa, Mycobacterium
VTTG

SEQ ID NO: 922206 - protein, 21 aa, Mycobacterium
VTTGPAGPTGDIDRTPATGAA

SEQ ID NO: 922207 - protein, 7 aa, Mycobacterium
VTTGQAD

SEQ ID NO: 922208 - protein, 8 aa, Mycobacterium
VTTGQADA

SEQ ID NO: 922209 - protein, 11 aa, Mycobacterium
VTTGSSQVIGT

SEQ ID NO: 922210 - protein, 10 aa, Mycobacterium
VTTHPRDGTV

SEQ ID NO: 922211 - protein, 10 aa, Mycobacterium
VTTNPGDGTI

SEQ ID NO: 922212 - protein, 13 aa, Mycobacterium
VTTPDEAVRAREA

SEQ ID NO: 922213 - protein, 7 aa, Mycobacterium
VTTPERT

SEQ ID NO: 922214 - protein, 5 aa, Mycobacterium
VTTRT

SEQ ID NO: 922215 - protein, 10 aa, Mycobacterium
VTTSDGSRAA

SEQ ID NO: 922216 - protein, 6 aa, Mycobacterium
VTTSGY

SEQ ID NO: 922217 - protein, 7 aa, Mycobacterium
VTTSGYG

SEQ ID NO: 922218 - protein, 9 aa, Mycobacterium
VTTSPKAVG

SEQ ID NO: 922219 - protein, 6 aa, Mycobacterium
VTTTEK

SEQ ID NO: 922220 - protein, 9 aa, Mycobacterium
VTTTPPVEG

SEQ ID NO: 922221 - protein, 16 aa, Mycobacterium
VTTTTGDKPPKREQQT

SEQ ID NO: 922222 - protein, 16 aa, Mycobacterium
VTTTTTTSAAPEPARP

SEQ ID NO: 922223 - protein, 12 aa, Mycobacterium
VTTTYERPPTRA

SEQ ID NO: 922224 - protein, 20 aa, Mycobacterium
VTVEPDPAAGLRGMMVPPGG

SEQ ID NO: 922225 - protein, 5 aa, Mycobacterium
VTVGA

SEQ ID NO: 922226 - protein, 6 aa, Mycobacterium
VTVGAP

SEQ ID NO: 922227 - protein, 10 aa, Mycobacterium
VTVSSATATA

SEQ ID NO: 922228 - protein, 7 aa, Mycobacterium
VTVTTRP

SEQ ID NO: 922229 - protein, 5 aa, Mycobacterium
VTYAT

SEQ ID NO: 922230 - protein, 21 aa, Mycobacterium
VTYRDGDPSVADLGTGNSITK

SEQ ID NO: 922231 - protein, 6 aa, Mycobacterium
VTYRGS

SEQ ID NO: 922232 - protein, 14 aa, Mycobacterium
VTYTPNADFTGTDT

SEQ ID NO: 922233 - protein, 12 aa, Mycobacterium
VVAPPGAPDPAA

SEQ ID NO: 922234 - protein, 26 aa, Mycobacterium
VVDRDGNELSRDTESTPTGGRIDSPD

SEQ ID NO: 922235 - protein, 10 aa, Mycobacterium
VVDTATGRTV

SEQ ID NO: 922236 - protein, 5 aa, Mycobacterium
VVGED

SEQ ID NO: 922237 - protein, 12 aa, Mycobacterium
VVGEDGKAVPLS

SEQ ID NO: 922238 - protein, 8 aa, Mycobacterium
VVGGGRGM

SEQ ID NO: 922239 - protein, 8 aa, Mycobacterium
VVGGNREA

SEQ ID NO: 922240 - protein, 11 aa, Mycobacterium
VVGPDSPASGY

SEQ ID NO: 922241 - protein, 8 aa, Mycobacterium
VVGPGAQQ

SEQ ID NO: 922242 - protein, 11 aa, Mycobacterium
VVNGDTAQPIT

SEQ ID NO: 922243 - protein, 9 aa, Mycobacterium
VVPAASSPV

SEQ ID NO: 922244 - protein, 9 aa, Mycobacterium
VVPGRPAKV

SEQ ID NO: 922245 - protein, 4 aa, Mycobacterium
VVPP

SEQ ID NO: 922246 - protein, 22 aa, Mycobacterium
VVPPAPNAPAGPPQITKDGDPL

SEQ ID NO: 922247 - protein, 15 aa, Mycobacterium
VVPTPQPGPPADPGA

SEQ ID NO: 922248 - protein, 25 aa, Mycobacterium
VVSGDTTTARAAGSAGRDVADEIGD

SEQ ID NO: 922249 - protein, 15 aa, Mycobacterium
VVSPGKGHVDPEGER

SEQ ID NO: 922250 - protein, 10 aa, Mycobacterium
VVSPTASAVP

SEQ ID NO: 922251 - protein, 10 aa, Mycobacterium
VVTGAGSGIG

SEQ ID NO: 922252 - protein, 7 aa, Mycobacterium
VVTPGEN

SEQ ID NO: 922253 - protein, 9 aa, Mycobacterium
VVTQRTSAE

SEQ ID NO: 922254 - protein, 12 aa, Mycobacterium
VWGNDSPKTTTS

SEQ ID NO: 922255 - protein, 7 aa, Mycobacterium
VYDAPSN

SEQ ID NO: 922256 - protein, 18 aa, Mycobacterium
VYDPPDNELRTENAALGD

SEQ ID NO: 922257 - protein, 9 aa, Mycobacterium
VYGQTREAK

SEQ ID NO: 922258 - protein, 5 aa, Mycobacterium
VYKPD

SEQ ID NO: 922259 - protein, 15 aa, Mycobacterium
VYPGAGDADSIDSGG

SEQ ID NO: 922260 - protein, 15 aa, Mycobacterium
VYPGARGANSPYSGG

SEQ ID NO: 922261 - protein, 5 aa, Mycobacterium
VYPPH

SEQ ID NO: 922262 - protein, 7 aa, Mycobacterium
VYQGDAS

SEQ ID NO: 922263 - protein, 9 aa, Mycobacterium
VYSDGKPIT

SEQ ID NO: 922264 - protein, 9 aa, Mycobacterium
VYSDGKQVT

SEQ ID NO: 922265 - protein, 19 aa, Mycobacterium
VYTDGAASPQWYGTGTEDL

SEQ ID NO: 922266 - protein, 19 aa, Mycobacterium
VYTDGASSPQWYGTGTEDL

SEQ ID NO: 922267 - protein, 8 aa, Mycobacterium
WAAPDAES

SEQ ID NO: 922268 - protein, 13 aa, Mycobacterium
WAAPSAARVDDAG

SEQ ID NO: 922269 - protein, 9 aa, Mycobacterium
WAAPTSTHI

SEQ ID NO: 922270 - protein, 6 aa, Mycobacterium
WAARAG

SEQ ID NO: 922271 - protein, 7 aa, Mycobacterium
WAARAGR

SEQ ID NO: 922272 - protein, 7 aa, Mycobacterium
WAARGGR

SEQ ID NO: 922273 - protein, 7 aa, Mycobacterium
WAARSGR

SEQ ID NO: 922274 - protein, 6 aa, Mycobacterium
WAATEK

SEQ ID NO: 922275 - protein, 11 aa, Mycobacterium
WADPGQRSTIS

SEQ ID NO: 922276 - protein, 8 aa, Mycobacterium
WADPPDRP

SEQ ID NO: 922277 - protein, 11 aa, Mycobacterium
WAEQAVTSGRK

SEQ ID NO: 922278 - protein, 16 aa, Mycobacterium
WAGGPGGGWNKPPTPL

SEQ ID NO: 922279 - protein, 6 aa, Mycobacterium
WAGGSD

SEQ ID NO: 922280 - protein, 8 aa, Mycobacterium
WAPAQRGV

SEQ ID NO: 922281 - protein, 5 aa, Mycobacterium
WAPLS

SEQ ID NO: 922282 - protein, 36 aa, Mycobacterium
WAPPPPPPADPNAPVPPADPNAPPADPNAAPPRPAV

SEQ ID NO: 922283 - protein, 36 aa, Mycobacterium
WAPPPPPPPAPADPADPNAAPPPPDPNAPPARPGVG

SEQ ID NO: 922284 - protein, 32 aa, Mycobacterium
WAPPPPPPSMPPLQPSPTIEGGGWQPAPAEGQ

SEQ ID NO: 922285 - protein, 4 aa, Mycobacterium
WAQR

SEQ ID NO: 922286 - protein, 4 aa, Mycobacterium
WART

SEQ ID NO: 922287 - protein, 21 aa, Mycobacterium
WASHGGGQYAPSAELATKEQQ

SEQ ID NO: 922288 - protein, 23 aa, Mycobacterium
WATGQGADEQLPGRSAQAQRSIS

SEQ ID NO: 922289 - protein, 11 aa, Mycobacterium
WATTADPGLPA

SEQ ID NO: 922290 - protein, 22 aa, Mycobacterium
WCNPPGRALGSPPTTATAGAHA

SEQ ID NO: 922291 - protein, 4 aa, Mycobacterium
WDAR

SEQ ID NO: 922292 - protein, 18 aa, Mycobacterium
WDDNNDAPGGHNGCDTRD

SEQ ID NO: 922293 - protein, 4 aa, Mycobacterium
WDDP

SEQ ID NO: 922294 - protein, 8 aa, Mycobacterium
WDEPPGAL

SEQ ID NO: 922295 - protein, 5 aa, Mycobacterium
WDESA

SEQ ID NO: 922296 - protein, 13 aa, Mycobacterium
WDGAGASGGRAAA

SEQ ID NO: 922297 - protein, 6 aa, Mycobacterium
WDPNTN

SEQ ID NO: 922298 - protein, 28 aa, Mycobacterium
WDPQGPAGEPAAPLPSCASTTEPRPTNV

SEQ ID NO: 922299 - protein, 28 aa, Mycobacterium
WDPQGPAGEQAVPLPSRADRTEPRPTNV

SEQ ID NO: 922300 - protein, 12 aa, Mycobacterium
WDPRTQSLDPSG

SEQ ID NO: 922301 - protein, 7 aa, Mycobacterium
WDQTSED

SEQ ID NO: 922302 - protein, 18 aa, Mycobacterium
WDTNPRSFDPSSNYNPCS

SEQ ID NO: 922303 - protein, 13 aa, Mycobacterium
WEGSRAEPEQATT

SEQ ID NO: 922304 - protein, 16 aa, Mycobacterium
WEPPPAPGEPTPTFPE

SEQ ID NO: 922305 - protein, 7 aa, Mycobacterium
WEPTGPG

SEQ ID NO: 922306 - protein, 11 aa, Mycobacterium
WESSPQDDPLN

SEQ ID NO: 922307 - protein, 11 aa, Mycobacterium
WETGESAVRTE

SEQ ID NO: 922308 - protein, 6 aa, Mycobacterium
WGADES

SEQ ID NO: 922309 - protein, 11 aa, Mycobacterium
WGANESDRCPP

SEQ ID NO: 922310 - protein, 12 aa, Mycobacterium
WGATPETSGPTM

SEQ ID NO: 922311 - protein, 5 aa, Mycobacterium
WGDEN

SEQ ID NO: 922312 - protein, 6 aa, Mycobacterium
WGEENY

SEQ ID NO: 922313 - protein, 10 aa, Mycobacterium
WGGAGPGGFD

SEQ ID NO: 922314 - protein, 25 aa, Mycobacterium
WGGDGGAGGDGGGAGGNGGNGGLGL

SEQ ID NO: 922315 - protein, 20 aa, Mycobacterium
WGGGNAAGPSRGIDSGAGTV

SEQ ID NO: 922316 - protein, 60 aa, Mycobacterium
WGGNGGDGGADGGAGGNGGTGGHSSGSGGILGTAGNGGNGGNGGTGGGAGGNGGDGGSLT

SEQ ID NO: 922317 - protein, 5 aa, Mycobacterium
WGGYS

SEQ ID NO: 922318 - protein, 9 aa, Mycobacterium
WGPDSDPAW

SEQ ID NO: 922319 - protein, 11 aa, Mycobacterium
WGPDSDPAWAR

SEQ ID NO: 922320 - protein, 11 aa, Mycobacterium
WGPDSDPAWQR

SEQ ID NO: 922321 - protein, 9 aa, Mycobacterium
WGPGQEPGT

SEQ ID NO: 922322 - protein, 11 aa, Mycobacterium
WGPQGADGTGT

SEQ ID NO: 922323 - protein, 23 aa, Mycobacterium
WGPSSAPPPPPDTCTAADGPDPM

SEQ ID NO: 922324 - protein, 12 aa, Mycobacterium
WGPSSDPAWKRN

SEQ ID NO: 922325 - protein, 14 aa, Mycobacterium
WGPTEDPNSAWKRN

SEQ ID NO: 922326 - protein, 25 aa, Mycobacterium
WGPTGGPGWQRNDPTVQAGRLAGNN

SEQ ID NO: 922327 - protein, 26 aa, Mycobacterium
WGPTRNAAGAAAAAKVVSGQPNVDGT

SEQ ID NO: 922328 - protein, 7 aa, Mycobacterium
WGQPGAS

SEQ ID NO: 922329 - protein, 10 aa, Mycobacterium
WGQPQGRSAI

SEQ ID NO: 922330 - protein, 13 aa, Mycobacterium
WGRQDEAAFDAGQ

SEQ ID NO: 922331 - protein, 10 aa, Mycobacterium
WGSTGPWADR

SEQ ID NO: 922332 - protein, 20 aa, Mycobacterium
WGSTNDPNNAWKANDPTENV

SEQ ID NO: 922333 - protein, 19 aa, Mycobacterium
WGTGGAGGTGGQAGTGGRG

SEQ ID NO: 922334 - protein, 7 aa, Mycobacterium
WGTPAKP

SEQ ID NO: 922335 - protein, 11 aa, Mycobacterium
WKESPSAQRET

SEQ ID NO: 922336 - protein, 31 aa, Mycobacterium
WKGDPNATLSGQPVPQPRTPAPPAPPPAPLP

SEQ ID NO: 922337 - protein, 9 aa, Mycobacterium
WKTQETVNR

SEQ ID NO: 922338 - protein, 30 aa, Mycobacterium
WLPPGAPGSHWAPGEPAAAPTAQPAGRRRR

SEQ ID NO: 922339 - protein, 9 aa, Mycobacterium
WNDPQSGRA

SEQ ID NO: 922340 - protein, 9 aa, Mycobacterium
WNEEESSAY

SEQ ID NO: 922341 - protein, 6 aa, Mycobacterium
WNGAGG

SEQ ID NO: 922342 - protein, 7 aa, Mycobacterium
WNGAGGV

SEQ ID NO: 922343 - protein, 7 aa, Mycobacterium
WNGGAND

SEQ ID NO: 922344 - protein, 8 aa, Mycobacterium
WNGGANDN

SEQ ID NO: 922345 - protein, 4 aa, Mycobacterium
WNGT

SEQ ID NO: 922346 - protein, 8 aa, Mycobacterium
WNNGANDN

SEQ ID NO: 922347 - protein, 8 aa, Mycobacterium
WNNGGNDN

SEQ ID NO: 922348 - protein, 15 aa, Mycobacterium
WNPESGDLDPDTLGD

SEQ ID NO: 922349 - protein, 4 aa, Mycobacterium
WNPM

SEQ ID NO: 922350 - protein, 15 aa, Mycobacterium
WNPQTQSNDPAGTTI

SEQ ID NO: 922351 - protein, 14 aa, Mycobacterium
WNPRTQAPDPASTT

SEQ ID NO: 922352 - protein, 8 aa, Mycobacterium
WNPSQGGW

SEQ ID NO: 922353 - protein, 10 aa, Mycobacterium
WNQSDDDDFY

SEQ ID NO: 922354 - protein, 19 aa, Mycobacterium
WNRPAGSVTDDHFFDGRHR

SEQ ID NO: 922355 - protein, 5 aa, Mycobacterium
WPARK

SEQ ID NO: 922356 - protein, 19 aa, Mycobacterium
WPDAGYKGDPTFHGPKQAD

SEQ ID NO: 922357 - protein, 8 aa, Mycobacterium
WPDPPDPA

SEQ ID NO: 922358 - protein, 4 aa, Mycobacterium
WPDT

SEQ ID NO: 922359 - protein, 4 aa, Mycobacterium
WPGA

SEQ ID NO: 922360 - protein, 8 aa, Mycobacterium
WPGGGPRP

SEQ ID NO: 922361 - protein, 5 aa, Mycobacterium
WPGHS

SEQ ID NO: 922362 - protein, 13 aa, Mycobacterium
WPGNRGSGPEALA

SEQ ID NO: 922363 - protein, 18 aa, Mycobacterium
WPGPSFPATSSAVPRTEL

SEQ ID NO: 922364 - protein, 18 aa, Mycobacterium
WPGPSFPPTSSAVPRTEL

SEQ ID NO: 922365 - protein, 12 aa, Mycobacterium
WPGPSFPSTGSA

SEQ ID NO: 922366 - protein, 4 aa, Mycobacterium
WPGT

SEQ ID NO: 922367 - protein, 16 aa, Mycobacterium
WPHGPGPALADPERVR

SEQ ID NO: 922368 - protein, 8 aa, Mycobacterium
WPPASGRA

SEQ ID NO: 922369 - protein, 5 aa, Mycobacterium
WPPDH

SEQ ID NO: 922370 - protein, 7 aa, Mycobacterium
WPPRTEE

SEQ ID NO: 922371 - protein, 12 aa, Mycobacterium
WPPSARGEPRSH

SEQ ID NO: 922372 - protein, 40 aa, Mycobacterium
WPQPDPHQTAPGTQPAQPTAKPSAPQPTPAPQTATAGRSG

SEQ ID NO: 922373 - protein, 11 aa, Mycobacterium
WPQPDQGDGEH

SEQ ID NO: 922374 - protein, 8 aa, Mycobacterium
WPSGAGQA

SEQ ID NO: 922375 - protein, 13 aa, Mycobacterium
WQAGKYNGVGFTP

SEQ ID NO: 922376 - protein, 21 aa, Mycobacterium
WQANSGGRSGIDGGRTLPDGQ

SEQ ID NO: 922377 - protein, 6 aa, Mycobacterium
WQDNEG

SEQ ID NO: 922378 - protein, 4 aa, Mycobacterium
WQGA

SEQ ID NO: 922379 - protein, 7 aa, Mycobacterium
WQNEKSA

SEQ ID NO: 922380 - protein, 9 aa, Mycobacterium
WQPASSGSG

SEQ ID NO: 922381 - protein, 13 aa, Mycobacterium
WQSDDKEDPDAEE

SEQ ID NO: 922382 - protein, 12 aa, Mycobacterium
WQTANDSSTSYG

SEQ ID NO: 922383 - protein, 14 aa, Mycobacterium
WRAPPQAAPPLPDV

SEQ ID NO: 922384 - protein, 5 aa, Mycobacterium
WRPGS

SEQ ID NO: 922385 - protein, 4 aa, Mycobacterium
WRPP

SEQ ID NO: 922386 - protein, 12 aa, Mycobacterium
WRPPAESGPPSA

SEQ ID NO: 922387 - protein, 17 aa, Mycobacterium
WRPPSARPPPPDTLPDT

SEQ ID NO: 922388 - protein, 12 aa, Mycobacterium
WRPPYAKRNAAV

SEQ ID NO: 922389 - protein, 22 aa, Mycobacterium
WRSDGGRLETGEVTPRPGNVTV

SEQ ID NO: 922390 - protein, 4 aa, Mycobacterium
WRSK

SEQ ID NO: 922391 - protein, 4 aa, Mycobacterium
WRSP

SEQ ID NO: 922392 - protein, 14 aa, Mycobacterium
WRSPADTRTEPLPS

SEQ ID NO: 922393 - protein, 17 aa, Mycobacterium
WSANGGVGNPARAPRHE

SEQ ID NO: 922394 - protein, 11 aa, Mycobacterium
WSASADPDSAV

SEQ ID NO: 922395 - protein, 10 aa, Mycobacterium
WSATAGPGRA

SEQ ID NO: 922396 - protein, 7 aa, Mycobacterium
WSATPAE

SEQ ID NO: 922397 - protein, 7 aa, Mycobacterium
WSDFGKA

SEQ ID NO: 922398 - protein, 9 aa, Mycobacterium
WSDFGKASD

SEQ ID NO: 922399 - protein, 10 aa, Mycobacterium
WSDPGKRSTI

SEQ ID NO: 922400 - protein, 10 aa, Mycobacterium
WSGTMPGPAA

SEQ ID NO: 922401 - protein, 9 aa, Mycobacterium
WSHGDREPA

SEQ ID NO: 922402 - protein, 6 aa, Mycobacterium
WSHQGG

SEQ ID NO: 922403 - protein, 8 aa, Mycobacterium
WSPGPDDT

SEQ ID NO: 922404 - protein, 9 aa, Mycobacterium
WSPGSDDTL

SEQ ID NO: 922405 - protein, 25 aa, Mycobacterium
WSPPAPAPTSTAAECGPGPTEQAVE

SEQ ID NO: 922406 - protein, 13 aa, Mycobacterium
WSPPRATAAPATV

SEQ ID NO: 922407 - protein, 8 aa, Mycobacterium
WSRATGPA

SEQ ID NO: 922408 - protein, 8 aa, Mycobacterium
WSRTYSPA

SEQ ID NO: 922409 - protein, 6 aa, Mycobacterium
WSTPRM

SEQ ID NO: 922410 - protein, 19 aa, Mycobacterium
WSTQNVASTDPGASEGAGV

SEQ ID NO: 922411 - protein, 4 aa, Mycobacterium
WTDD

SEQ ID NO: 922412 - protein, 19 aa, Mycobacterium
WTDDNDAPGGHNGCDTRND

SEQ ID NO: 922413 - protein, 18 aa, Mycobacterium
WTDDNDAPGGRNGCDTRN

SEQ ID NO: 922414 - protein, 19 aa, Mycobacterium
WTDDNDAPLGHNGCDTRDD

SEQ ID NO: 922415 - protein, 5 aa, Mycobacterium
WTDPV
